United States Patent 7,888,497 (BIOINFORMATICALLY DETECTABLE GROUP OF NOVEL REGULATORY OLIGONUCLEOTIDES AND USES THEREOF) - sequence listing, part 28

SEQ ID NO: 1157582 - DNA, 19 bp, Homo sapiens
ttctctttaccttctaaaa

SEQ ID NO: 1157583 - DNA, 13 bp, Homo sapiens
ttctctttctctc

SEQ ID NO: 1157584 - DNA, 14 bp, Homo sapiens
ttctctttctctcc

SEQ ID NO: 1157585 - DNA, 14 bp, Homo sapiens
ttctctttctctct

SEQ ID NO: 1157586 - DNA, 17 bp, Homo sapiens
ttctctttctctcttcc

SEQ ID NO: 1157587 - DNA, 14 bp, Homo sapiens
ttctctttcttcct

SEQ ID NO: 1157588 - DNA, 21 bp, Homo sapiens
ttctctttgtctgccttccca

SEQ ID NO: 1157589 - DNA, 12 bp, Homo sapiens
ttctctttgtgc

SEQ ID NO: 1157590 - DNA, 15 bp, Homo sapiens
ttctctttgtgcagt

SEQ ID NO: 1157591 - DNA, 14 bp, Homo sapiens
ttctctttgtttct

SEQ ID NO: 1157592 - DNA, 22 bp, Homo sapiens
ttctcttttcccctttcctgtc

SEQ ID NO: 1157593 - DNA, 17 bp, Homo sapiens
ttctcttttcctcgcag

SEQ ID NO: 1157594 - DNA, 18 bp, Homo sapiens
ttctcttttgctttctgt

SEQ ID NO: 1157595 - DNA, 13 bp, Homo sapiens
ttctgaaaacact

SEQ ID NO: 1157596 - DNA, 15 bp, Homo sapiens
ttctgaaacacacga

SEQ ID NO: 1157597 - DNA, 18 bp, Homo sapiens
ttctgaaacacacgagca

SEQ ID NO: 1157598 - DNA, 23 bp, Homo sapiens
ttctgaaaggaaatacacttctt

SEQ ID NO: 1157599 - DNA, 14 bp, Homo sapiens
ttctgaaatacttt

SEQ ID NO: 1157600 - DNA, 16 bp, Homo sapiens
ttctgaaatacttttg

SEQ ID NO: 1157601 - DNA, 16 bp, Homo sapiens
ttctgaaatgttctta

SEQ ID NO: 1157602 - DNA, 20 bp, Homo sapiens
ttctgaaatttttttcctaa

SEQ ID NO: 1157603 - DNA, 21 bp, Homo sapiens
ttctgaaatttttttcctaag

SEQ ID NO: 1157604 - DNA, 17 bp, Homo sapiens
ttctgaacactttaggt

SEQ ID NO: 1157605 - DNA, 18 bp, Homo sapiens
ttctgaactcaaactgag

SEQ ID NO: 1157606 - DNA, 22 bp, Homo sapiens
ttctgaactccatacagcctct

SEQ ID NO: 1157607 - DNA, 23 bp, Homo sapiens
ttctgaacttttgtggagtttga

SEQ ID NO: 1157608 - DNA, 16 bp, Homo sapiens
ttctgaagactgagaa

SEQ ID NO: 1157609 - DNA, 19 bp, Homo sapiens
ttctgaagccatgtagcca

SEQ ID NO: 1157610 - DNA, 13 bp, Homo sapiens
ttctgaagtactt

SEQ ID NO: 1157611 - DNA, 20 bp, Homo sapiens
ttctgaagtgtgtccatcct

SEQ ID NO: 1157612 - DNA, 21 bp, Homo sapiens
ttctgaagtgtgtccatcctg

SEQ ID NO: 1157613 - DNA, 10 bp, Homo sapiens
ttctgaataa

SEQ ID NO: 1157614 - DNA, 12 bp, Homo sapiens
ttctgaataaaa

SEQ ID NO: 1157615 - DNA, 19 bp, Homo sapiens
ttctgaataaaaaagattc

SEQ ID NO: 1157616 - DNA, 19 bp, Homo sapiens
tactttgttaggattttca

SEQ ID NO: 1157617 - DNA, 17 bp, Homo sapiens
tacttttaccactattt

SEQ ID NO: 1157618 - DNA, 17 bp, Homo sapiens
tacttttcacactgtct

SEQ ID NO: 1157619 - DNA, 20 bp, Homo sapiens
tacttttcacactgtcttcc

SEQ ID NO: 1157620 - DNA, 16 bp, Homo sapiens
tacttttcattctctt

SEQ ID NO: 1157621 - DNA, 16 bp, Homo sapiens
tacttttcccctgtta

SEQ ID NO: 1157622 - DNA, 18 bp, Homo sapiens
tacttttcccctgttaaa

SEQ ID NO: 1157623 - DNA, 13 bp, Homo sapiens
tacttttctaaaa

SEQ ID NO: 1157624 - DNA, 14 bp, Homo sapiens
tacttttctaaaat

SEQ ID NO: 1157625 - DNA, 18 bp, Homo sapiens
tacttttctggttccaaa

SEQ ID NO: 1157626 - DNA, 21 bp, Homo sapiens
tacttttctggttccaaacca

SEQ ID NO: 1157627 - DNA, 22 bp, Homo sapiens
tacttttctgtttagttttaca

SEQ ID NO: 1157628 - DNA, 22 bp, Homo sapiens
tacttttgagtatggctatcta

SEQ ID NO: 1157629 - DNA, 17 bp, Homo sapiens
tacttttgagtgtgtgt

SEQ ID NO: 1157630 - DNA, 19 bp, Homo sapiens
tacttttgcaaactgtcct

SEQ ID NO: 1157631 - DNA, 17 bp, Homo sapiens
tacttttgcatgaaaat

SEQ ID NO: 1157632 - DNA, 15 bp, Homo sapiens
tacttttgccctttg

SEQ ID NO: 1157633 - DNA, 13 bp, Homo sapiens
tacttttgtaaat

SEQ ID NO: 1157634 - DNA, 20 bp, Homo sapiens
tactttttaaaaggtatttt

SEQ ID NO: 1157635 - DNA, 19 bp, Homo sapiens
tactttttagtaatttctt

SEQ ID NO: 1157636 - DNA, 16 bp, Homo sapiens
tactttttatactcca

SEQ ID NO: 1157637 - DNA, 13 bp, Homo sapiens
tactttttctaat

SEQ ID NO: 1157638 - DNA, 17 bp, Homo sapiens
tactttttcttgtattc

SEQ ID NO: 1157639 - DNA, 19 bp, Homo sapiens
tactttttgaggggttctt

SEQ ID NO: 1157640 - DNA, 21 bp, Homo sapiens
tactttttgtagagagagctg

SEQ ID NO: 1157641 - DNA, 13 bp, Homo sapiens
tacttttttaaat

SEQ ID NO: 1157642 - DNA, 20 bp, Homo sapiens
tacttttttaaatattttct

SEQ ID NO: 1157643 - DNA, 18 bp, Homo sapiens
tacttttttaacatgtgt

SEQ ID NO: 1157644 - DNA, 20 bp, Homo sapiens
tacttttttaacatgtgtta

SEQ ID NO: 1157645 - DNA, 19 bp, Homo sapiens
tacttttttacactgataa

SEQ ID NO: 1157646 - DNA, 19 bp, Homo sapiens
tacttttttatccacctcc

SEQ ID NO: 1157647 - DNA, 19 bp, Homo sapiens
tacttttttctagtttcag

SEQ ID NO: 1157648 - DNA, 14 bp, Homo sapiens
tactttttttcaca

SEQ ID NO: 1157649 - DNA, 22 bp, Homo sapiens
tactttttttctgtgacattta

SEQ ID NO: 1157650 - DNA, 18 bp, Homo sapiens
tactttttttgtagatga

SEQ ID NO: 1157651 - DNA, 15 bp, Homo sapiens
tactttttttgttat

SEQ ID NO: 1157652 - DNA, 15 bp, Homo sapiens
tagaaaaaaagaaaa

SEQ ID NO: 1157653 - DNA, 23 bp, Homo sapiens
tagaaaaaaagaaaaaaaaaaga

SEQ ID NO: 1157654 - DNA, 15 bp, Homo sapiens
tagaaaaaaattact

SEQ ID NO: 1157655 - DNA, 12 bp, Homo sapiens
tagaaaaataaa

SEQ ID NO: 1157656 - DNA, 17 bp, Homo sapiens
tagaaaaatctcattcc

SEQ ID NO: 1157657 - DNA, 18 bp, Homo sapiens
tagaaaaatgtataaaaa

SEQ ID NO: 1157658 - DNA, 20 bp, Homo sapiens
tagaaaaattcagcaaacca

SEQ ID NO: 1157659 - DNA, 15 bp, Homo sapiens
tagaaaacaggaaaa

SEQ ID NO: 1157660 - DNA, 22 bp, Homo sapiens
tagaaaacaggaaaaaaacttt

SEQ ID NO: 1157661 - DNA, 14 bp, Homo sapiens
tagaaaactccagg

SEQ ID NO: 1157662 - DNA, 15 bp, Homo sapiens
tagaaaactgaaaat

SEQ ID NO: 1157663 - DNA, 22 bp, Homo sapiens
tagaaaactgaaaatctaatat

SEQ ID NO: 1157664 - DNA, 15 bp, Homo sapiens
tagaaaactttaaag

SEQ ID NO: 1157665 - DNA, 18 bp, Homo sapiens
tagaaaagaaaacattta

SEQ ID NO: 1157666 - DNA, 21 bp, Homo sapiens
tagaaaagaaaacatttaaca

SEQ ID NO: 1157667 - DNA, 23 bp, Homo sapiens
tagaaaagaaaacatttaacata

SEQ ID NO: 1157668 - DNA, 22 bp, Homo sapiens
tagaaaagagacttctctgtaa

SEQ ID NO: 1157669 - DNA, 23 bp, Homo sapiens
tagaaaagcagtcccattcatat

SEQ ID NO: 1157670 - DNA, 17 bp, Homo sapiens
tagaaaaggcgtgcagt

SEQ ID NO: 1157671 - DNA, 16 bp, Homo sapiens
tagaaaagtatgttct

SEQ ID NO: 1157672 - DNA, 23 bp, Homo sapiens
tagaaaagttgcagatgtattga

SEQ ID NO: 1157673 - DNA, 19 bp, Homo sapiens
tagaaaagttgctcttaaa

SEQ ID NO: 1157674 - DNA, 22 bp, Homo sapiens
tagaaaatataagtaaagtgat

SEQ ID NO: 1157675 - DNA, 16 bp, Homo sapiens
tagaaaatattctcta

SEQ ID NO: 1157676 - DNA, 18 bp, Homo sapiens
tagaaaatattctctatt

SEQ ID NO: 1157677 - DNA, 12 bp, Homo sapiens
tagaaaattaaa

SEQ ID NO: 1157678 - DNA, 18 bp, Homo sapiens
tagaaaattagtgaccat

SEQ ID NO: 1157679 - DNA, 21 bp, Homo sapiens
tagaaaatttagccctttaaa

SEQ ID NO: 1157680 - DNA, 15 bp, Homo sapiens
tagaaacccaagctc

SEQ ID NO: 1157681 - DNA, 20 bp, Homo sapiens
tagaaacccaagctcctcct

SEQ ID NO: 1157682 - DNA, 15 bp, Homo sapiens
tagaaaccttaatat

SEQ ID NO: 1157683 - DNA, 17 bp, Homo sapiens
tagaaacttcatggttt

SEQ ID NO: 1157684 - DNA, 13 bp, Homo sapiens
tagaaagaaacta

SEQ ID NO: 1157685 - DNA, 15 bp, Homo sapiens
tagaaagaagccata

SEQ ID NO: 1157686 - DNA, 17 bp, Homo sapiens
tagaaagatcgtttaaa

SEQ ID NO: 1157687 - DNA, 23 bp, Homo sapiens
tagaaagctgtttatttattcac

SEQ ID NO: 1157688 - DNA, 21 bp, Homo sapiens
tagaaaggaagccttgctcat

SEQ ID NO: 1157689 - DNA, 19 bp, Homo sapiens
tagaaaggacaacagttct

SEQ ID NO: 1157690 - DNA, 21 bp, Homo sapiens
tagaaaggacaacagttctga

SEQ ID NO: 1157691 - DNA, 13 bp, Homo sapiens
tagaaaggcagcc

SEQ ID NO: 1157692 - DNA, 22 bp, Homo sapiens
tagaaaggggcagtttaaagca

SEQ ID NO: 1157693 - DNA, 23 bp, Homo sapiens
tagaaaggtcatccaaagaacat

SEQ ID NO: 1157694 - DNA, 11 bp, Homo sapiens
tagaaataagt

SEQ ID NO: 1157695 - DNA, 15 bp, Homo sapiens
tagaaataatatgca

SEQ ID NO: 1157696 - DNA, 16 bp, Homo sapiens
tagaaatagatttaaa

SEQ ID NO: 1157697 - DNA, 15 bp, Homo sapiens
tagaaatatctttct

SEQ ID NO: 1157698 - DNA, 14 bp, Homo sapiens
tagaaatattttaa

SEQ ID NO: 1157699 - DNA, 15 bp, Homo sapiens
tagaaatattttaaa

SEQ ID NO: 1157700 - DNA, 16 bp, Homo sapiens
tagaaatattttaaaa

SEQ ID NO: 1157701 - DNA, 19 bp, Homo sapiens
tagaaatattttaaaatca

SEQ ID NO: 1157702 - DNA, 14 bp, Homo sapiens
tagaaatgcatatt

SEQ ID NO: 1157703 - DNA, 21 bp, Homo sapiens
tagaaatggaaattttgctat

SEQ ID NO: 1157704 - DNA, 21 bp, Homo sapiens
tagaaatggtttcctctggat

SEQ ID NO: 1157705 - DNA, 18 bp, Homo sapiens
tagaaatgtaaactgcca

SEQ ID NO: 1157706 - DNA, 19 bp, Homo sapiens
tagaaatgtaaactgccat

SEQ ID NO: 1157707 - DNA, 14 bp, Homo sapiens
tagaaatgtatcct

SEQ ID NO: 1157708 - DNA, 21 bp, Homo sapiens
tagaaatgttagtgccccgca

SEQ ID NO: 1157709 - DNA, 12 bp, Homo sapiens
tagaaatgttta

SEQ ID NO: 1157710 - DNA, 14 bp, Homo sapiens
tagaaattttacaa

SEQ ID NO: 1157711 - DNA, 13 bp, Homo sapiens
tagaaattttgta

SEQ ID NO: 1157712 - DNA, 15 bp, Homo sapiens
tagaaattttgtaag

SEQ ID NO: 1157713 - DNA, 13 bp, Homo sapiens
tagaacaaggctg

SEQ ID NO: 1157714 - DNA, 16 bp, Homo sapiens
tagaacactaattcat

SEQ ID NO: 1157715 - DNA, 14 bp, Homo sapiens
tagaacaggagact

SEQ ID NO: 1157716 - DNA, 18 bp, Homo sapiens
tagaacagtggaaactat

SEQ ID NO: 1157717 - DNA, 17 bp, Homo sapiens
tagaacataaagcaaat

SEQ ID NO: 1157718 - DNA, 22 bp, Homo sapiens
tagaacataaagcaaatagaca

SEQ ID NO: 1157719 - DNA, 19 bp, Homo sapiens
tagaacatgcacatttata

SEQ ID NO: 1157720 - DNA, 14 bp, Homo sapiens
tagaacattcactt

SEQ ID NO: 1157721 - DNA, 17 bp, Homo sapiens
tagaacattcacttttg

SEQ ID NO: 1157722 - DNA, 21 bp, Homo sapiens
tagaaccagccgtattttaca

SEQ ID NO: 1157723 - DNA, 15 bp, Homo sapiens
tagaacctaacaccc

SEQ ID NO: 1157724 - DNA, 14 bp, Homo sapiens
tagaacctatcttt

SEQ ID NO: 1157725 - DNA, 16 bp, Homo sapiens
tagaacgtgcatcctt

SEQ ID NO: 1157726 - DNA, 18 bp, Homo sapiens
tagaacgttaaactatta

SEQ ID NO: 1157727 - DNA, 19 bp, Homo sapiens
tagaactatcatttttaca

SEQ ID NO: 1157728 - DNA, 21 bp, Homo sapiens
tagaactatctgcattatcta

SEQ ID NO: 1157729 - DNA, 18 bp, Homo sapiens
tagaactcactctgggct

SEQ ID NO: 1157730 - DNA, 20 bp, Homo sapiens
tagaactcactctgggctgt

SEQ ID NO: 1157731 - DNA, 19 bp, Homo sapiens
tagaactcagttttaacta

SEQ ID NO: 1157732 - DNA, 22 bp, Homo sapiens
tagaactcagttttaactagaa

SEQ ID NO: 1157733 - DNA, 23 bp, Homo sapiens
tagaactctccatcttattttca

SEQ ID NO: 1157734 - DNA, 16 bp, Homo sapiens
tagaacttgaccccct

SEQ ID NO: 1157735 - DNA, 13 bp, Homo sapiens
tagaacttgcctt

SEQ ID NO: 1157736 - DNA, 20 bp, Homo sapiens
tagaactttgccagtcttta

SEQ ID NO: 1157737 - DNA, 14 bp, Homo sapiens
tagaagaaaacccg

SEQ ID NO: 1157738 - DNA, 19 bp, Homo sapiens
tagaagaaccaaatacctc

SEQ ID NO: 1157739 - DNA, 17 bp, Homo sapiens
tagaagaagaggaagaa

SEQ ID NO: 1157740 - DNA, 17 bp, Homo sapiens
ttctgaataacatttgt

SEQ ID NO: 1157741 - DNA, 16 bp, Homo sapiens
ttctgaataatttctt

SEQ ID NO: 1157742 - DNA, 11 bp, Homo sapiens
ttctgaatgta

SEQ ID NO: 1157743 - DNA, 22 bp, Homo sapiens
ttctgacaaaaagtttccatat

SEQ ID NO: 1157744 - DNA, 14 bp, Homo sapiens
ttctgacagcccaa

SEQ ID NO: 1157745 - DNA, 12 bp, Homo sapiens
ttctgacatgta

SEQ ID NO: 1157746 - DNA, 20 bp, Homo sapiens
ttctgacattaacagttttc

SEQ ID NO: 1157747 - DNA, 22 bp, Homo sapiens
ttctgaccacacttcctgtcca

SEQ ID NO: 1157748 - DNA, 14 bp, Homo sapiens
ttctgaccatttca

SEQ ID NO: 1157749 - DNA, 16 bp, Homo sapiens
ttctgacccaaagcaa

SEQ ID NO: 1157750 - DNA, 16 bp, Homo sapiens
ttctgacccagggcct

SEQ ID NO: 1157751 - DNA, 23 bp, Homo sapiens
ttctgaccccacttatgctgctg

SEQ ID NO: 1157752 - DNA, 21 bp, Homo sapiens
ttctgaccctgcttcaaatat

SEQ ID NO: 1157753 - DNA, 18 bp, Homo sapiens
ttctgactcggtttctcc

SEQ ID NO: 1157754 - DNA, 13 bp, Homo sapiens
ttctgactgctga

SEQ ID NO: 1157755 - DNA, 15 bp, Homo sapiens
ttctgactgtccctg

SEQ ID NO: 1157756 - DNA, 16 bp, Homo sapiens
ttctgactgtccctgc

SEQ ID NO: 1157757 - DNA, 15 bp, Homo sapiens
ttctgacttatgaat

SEQ ID NO: 1157758 - DNA, 20 bp, Homo sapiens
ttctgacttctagctgtctg

SEQ ID NO: 1157759 - DNA, 13 bp, Homo sapiens
ttctgacttttac

SEQ ID NO: 1157760 - DNA, 19 bp, Homo sapiens
ttctgagaactgactttct

SEQ ID NO: 1157761 - DNA, 22 bp, Homo sapiens
ttctgagagttggctcaggcag

SEQ ID NO: 1157762 - DNA, 20 bp, Homo sapiens
ttctgagcaccgaatattga

SEQ ID NO: 1157763 - DNA, 19 bp, Homo sapiens
ttctgagcccggtaagagc

SEQ ID NO: 1157764 - DNA, 15 bp, Homo sapiens
ttctgagctccacct

SEQ ID NO: 1157765 - DNA, 19 bp, Homo sapiens
ttctgagcttttcatggaa

SEQ ID NO: 1157766 - DNA, 13 bp, Homo sapiens
ttctgagtattct

SEQ ID NO: 1157767 - DNA, 14 bp, Homo sapiens
ttctgagtattctc

SEQ ID NO: 1157768 - DNA, 14 bp, Homo sapiens
ttctgagttcttga

SEQ ID NO: 1157769 - DNA, 23 bp, Homo sapiens
ttctgagtttcattctcctgcct

SEQ ID NO: 1157770 - DNA, 15 bp, Homo sapiens
ttctgataggagggg

SEQ ID NO: 1157771 - DNA, 21 bp, Homo sapiens
ttctgataggagggggcggca

SEQ ID NO: 1157772 - DNA, 23 bp, Homo sapiens
ttctgatgacgcctgtctgtgtg

SEQ ID NO: 1157773 - DNA, 22 bp, Homo sapiens
ttctgatgatgtcggtcttgca

SEQ ID NO: 1157774 - DNA, 13 bp, Homo sapiens
ttctgatgtatta

SEQ ID NO: 1157775 - DNA, 13 bp, Homo sapiens
ttctgatgtttat

SEQ ID NO: 1157776 - DNA, 20 bp, Homo sapiens
ttctgattaatatatttaat

SEQ ID NO: 1157777 - DNA, 15 bp, Homo sapiens
ttctgattagaaatg

SEQ ID NO: 1157778 - DNA, 21 bp, Homo sapiens
ttctgattcgaatgacactgt

SEQ ID NO: 1157779 - DNA, 17 bp, Homo sapiens
ttctgattggtgattca

SEQ ID NO: 1157780 - DNA, 17 bp, Homo sapiens
ttctgatttcagttttt

SEQ ID NO: 1157781 - DNA, 20 bp, Homo sapiens
ttctgatttcagtttttcat

SEQ ID NO: 1157782 - DNA, 19 bp, Homo sapiens
ttctgcaaaaatatttata

SEQ ID NO: 1157783 - DNA, 22 bp, Homo sapiens
ttctgcaaaggtggcaatgctt

SEQ ID NO: 1157784 - DNA, 15 bp, Homo sapiens
ttctgcaaatagaaa

SEQ ID NO: 1157785 - DNA, 15 bp, Homo sapiens
ttctgcaactagcca

SEQ ID NO: 1157786 - DNA, 12 bp, Homo sapiens
ttctgcaagaat

SEQ ID NO: 1157787 - DNA, 16 bp, Homo sapiens
ttctgcaagaattaaa

SEQ ID NO: 1157788 - DNA, 20 bp, Homo sapiens
ttctgcaagaattaaaactg

SEQ ID NO: 1157789 - DNA, 23 bp, Homo sapiens
ttctgcaagaattaaaactgagt

SEQ ID NO: 1157790 - DNA, 22 bp, Homo sapiens
ttctgcaagcacatctgcattt

SEQ ID NO: 1157791 - DNA, 16 bp, Homo sapiens
ttctgcaagtttctgt

SEQ ID NO: 1157792 - DNA, 18 bp, Homo sapiens
ttctgcaccacacctggc

SEQ ID NO: 1157793 - DNA, 21 bp, Homo sapiens
ttctgcaccccaattgggaat

SEQ ID NO: 1157794 - DNA, 19 bp, Homo sapiens
ttctgcaccctccaccctg

SEQ ID NO: 1157795 - DNA, 22 bp, Homo sapiens
ttctgcaccctccaccctgtcc

SEQ ID NO: 1157796 - DNA, 20 bp, Homo sapiens
ttctgcagaactcctccaaa

SEQ ID NO: 1157797 - DNA, 23 bp, Homo sapiens
ttctgcagcatgacctgtgacca

SEQ ID NO: 1157798 - DNA, 22 bp, Homo sapiens
ttctgcagtaaatcttttacaa

SEQ ID NO: 1157799 - DNA, 20 bp, Homo sapiens
ttctgcagtagtctctgtgc

SEQ ID NO: 1157800 - DNA, 17 bp, Homo sapiens
ttctgcatatgttgaat

SEQ ID NO: 1157801 - DNA, 23 bp, Homo sapiens
ttctgcatatgttgaatactttt

SEQ ID NO: 1157802 - DNA, 20 bp, Homo sapiens
ttctgcattgctagataaaa

SEQ ID NO: 1157803 - DNA, 23 bp, Homo sapiens
ttctgccatcatttttgatgact

SEQ ID NO: 1157804 - DNA, 19 bp, Homo sapiens
ttctgcccaaaaatatggt

SEQ ID NO: 1157805 - DNA, 17 bp, Homo sapiens
ttctgccccccagggct

SEQ ID NO: 1157806 - DNA, 23 bp, Homo sapiens
ttctgcccctctactgttgcaca

SEQ ID NO: 1157807 - DNA, 17 bp, Homo sapiens
ttctgccctgcctgagg

SEQ ID NO: 1157808 - DNA, 16 bp, Homo sapiens
ttctgccctggctgct

SEQ ID NO: 1157809 - DNA, 19 bp, Homo sapiens
ttctgccctggctgctgcc

SEQ ID NO: 1157810 - DNA, 21 bp, Homo sapiens
ttctgccgccccctcctgaac

SEQ ID NO: 1157811 - DNA, 21 bp, Homo sapiens
ttctgcctacgttctctttaa

SEQ ID NO: 1157812 - DNA, 20 bp, Homo sapiens
ttctgcctagagtgtagcct

SEQ ID NO: 1157813 - DNA, 22 bp, Homo sapiens
ttctgcctagagtgtagcctaa

SEQ ID NO: 1157814 - DNA, 21 bp, Homo sapiens
ttctgcctgcctcctccctcc

SEQ ID NO: 1157815 - DNA, 14 bp, Homo sapiens
ttctgcctggagac

SEQ ID NO: 1157816 - DNA, 14 bp, Homo sapiens
ttctgcctgttata

SEQ ID NO: 1157817 - DNA, 16 bp, Homo sapiens
ttctgccttctcatga

SEQ ID NO: 1157818 - DNA, 15 bp, Homo sapiens
ttctgcctttccccc

SEQ ID NO: 1157819 - DNA, 14 bp, Homo sapiens
ttctgcgcctcagg

SEQ ID NO: 1157820 - DNA, 17 bp, Homo sapiens
ttctgcgggctccctcc

SEQ ID NO: 1157821 - DNA, 18 bp, Homo sapiens
ttctgcgggctccctcct

SEQ ID NO: 1157822 - DNA, 19 bp, Homo sapiens
ttctgcgtccaccaggcct

SEQ ID NO: 1157823 - DNA, 15 bp, Homo sapiens
ttctgctaaatatca

SEQ ID NO: 1157824 - DNA, 22 bp, Homo sapiens
ttctgctacttcactgtcatct

SEQ ID NO: 1157825 - DNA, 19 bp, Homo sapiens
ttctgctagagcagacagg

SEQ ID NO: 1157826 - DNA, 23 bp, Homo sapiens
ttctgctagagcagacaggcctg

SEQ ID NO: 1157827 - DNA, 19 bp, Homo sapiens
ttctgctcatcattctctg

SEQ ID NO: 1157828 - DNA, 20 bp, Homo sapiens
ttctgctccacccttggcct

SEQ ID NO: 1157829 - DNA, 13 bp, Homo sapiens
ttctgctccagcc

SEQ ID NO: 1157830 - DNA, 14 bp, Homo sapiens
ttctgctccagccc

SEQ ID NO: 1157831 - DNA, 15 bp, Homo sapiens
ttctgctcccacccc

SEQ ID NO: 1157832 - DNA, 15 bp, Homo sapiens
ttctgctcctctcca

SEQ ID NO: 1157833 - DNA, 12 bp, Homo sapiens
ttctgctcctgc

SEQ ID NO: 1157834 - DNA, 17 bp, Homo sapiens
ttctgctctggttgttt

SEQ ID NO: 1157835 - DNA, 13 bp, Homo sapiens
ttctgctgccctc

SEQ ID NO: 1157836 - DNA, 17 bp, Homo sapiens
ttctgctgcctctacac

SEQ ID NO: 1157837 - DNA, 15 bp, Homo sapiens
ttctgctggaggagg

SEQ ID NO: 1157838 - DNA, 13 bp, Homo sapiens
ttctgctggataa

SEQ ID NO: 1157839 - DNA, 14 bp, Homo sapiens
ttctgctgttcttc

SEQ ID NO: 1157840 - DNA, 16 bp, Homo sapiens
ttctgcttaggagaga

SEQ ID NO: 1157841 - DNA, 19 bp, Homo sapiens
ttctgcttcaataaatctt

SEQ ID NO: 1157842 - DNA, 17 bp, Homo sapiens
ttctgctttatcttttc

SEQ ID NO: 1157843 - DNA, 19 bp, Homo sapiens
ttctgctttatcttttcat

SEQ ID NO: 1157844 - DNA, 10 bp, Homo sapiens
ttctggaaat

SEQ ID NO: 1157845 - DNA, 19 bp, Homo sapiens
ttctggaaattttgtccat

SEQ ID NO: 1157846 - DNA, 21 bp, Homo sapiens
ttctggaaattttgtccattt

SEQ ID NO: 1157847 - DNA, 20 bp, Homo sapiens
ttctggaatttacctcccct

SEQ ID NO: 1157848 - DNA, 20 bp, Homo sapiens
ttctggaatttgttcaagtt

SEQ ID NO: 1157849 - DNA, 22 bp, Homo sapiens
ttctggaatttgttcaagtttt

SEQ ID NO: 1157850 - DNA, 20 bp, Homo sapiens
ttctggactacacccaagcc

SEQ ID NO: 1157851 - DNA, 17 bp, Homo sapiens
ttctggactatagctgt

SEQ ID NO: 1157852 - DNA, 15 bp, Homo sapiens
ttctggactctgccc

SEQ ID NO: 1157853 - DNA, 18 bp, Homo sapiens
ttctggactctgccccaa

SEQ ID NO: 1157854 - DNA, 17 bp, Homo sapiens
ttctggagatggatcct

SEQ ID NO: 1157855 - DNA, 21 bp, Homo sapiens
ttctggagcaatctgaccctt

SEQ ID NO: 1157856 - DNA, 14 bp, Homo sapiens
ttctggagctggga

SEQ ID NO: 1157857 - DNA, 14 bp, Homo sapiens
ttctggagtttctc

SEQ ID NO: 1157858 - DNA, 16 bp, Homo sapiens
ttctggatctcctgct

SEQ ID NO: 1157859 - DNA, 18 bp, Homo sapiens
ttctggatctcctgctgc

SEQ ID NO: 1157860 - DNA, 15 bp, Homo sapiens
ttctggcaagagcag

SEQ ID NO: 1157861 - DNA, 21 bp, Homo sapiens
ttctggccaaggggtgggcct

SEQ ID NO: 1157862 - DNA, 17 bp, Homo sapiens
ttctggccacatcagcc

SEQ ID NO: 1157863 - DNA, 16 bp, Homo sapiens
ttctggccaccccaga

SEQ ID NO: 1157864 - DNA, 19 bp, Homo sapiens
tagaagaagaggaagaaat

SEQ ID NO: 1157865 - DNA, 16 bp, Homo sapiens
tagaagaatattgtat

SEQ ID NO: 1157866 - DNA, 18 bp, Homo sapiens
tagaagagcacagagccc

SEQ ID NO: 1157867 - DNA, 19 bp, Homo sapiens
tagaagagcacagagccct

SEQ ID NO: 1157868 - DNA, 15 bp, Homo sapiens
tagaagatgtgtaaa

SEQ ID NO: 1157869 - DNA, 19 bp, Homo sapiens
tagaagattgttggtgaat

SEQ ID NO: 1157870 - DNA, 19 bp, Homo sapiens
tagaagcaaagatttcagt

SEQ ID NO: 1157871 - DNA, 22 bp, Homo sapiens
tagaagcactacaccttgcctt

SEQ ID NO: 1157872 - DNA, 12 bp, Homo sapiens
tagaagccaagg

SEQ ID NO: 1157873 - DNA, 16 bp, Homo sapiens
tagaagccaagggaaa

SEQ ID NO: 1157874 - DNA, 12 bp, Homo sapiens
tagaagcctgca

SEQ ID NO: 1157875 - DNA, 16 bp, Homo sapiens
tagaagctgcagtggt

SEQ ID NO: 1157876 - DNA, 23 bp, Homo sapiens
tagaagctggtaaaaatgacaat

SEQ ID NO: 1157877 - DNA, 19 bp, Homo sapiens
tagaaggaagtgtgtttgc

SEQ ID NO: 1157878 - DNA, 19 bp, Homo sapiens
tagaaggaatttgtacttc

SEQ ID NO: 1157879 - DNA, 21 bp, Homo sapiens
tagaaggcgtccatgtttatt

SEQ ID NO: 1157880 - DNA, 18 bp, Homo sapiens
tagaaggcttctctccac

SEQ ID NO: 1157881 - DNA, 22 bp, Homo sapiens
tagaagggccagtcctgcctgg

SEQ ID NO: 1157882 - DNA, 17 bp, Homo sapiens
tagaagtagaattgaca

SEQ ID NO: 1157883 - DNA, 15 bp, Homo sapiens
tagaagtaggaggaa

SEQ ID NO: 1157884 - DNA, 14 bp, Homo sapiens
tagaagtatttgtg

SEQ ID NO: 1157885 - DNA, 19 bp, Homo sapiens
tagaagtcttagatgtata

SEQ ID NO: 1157886 - DNA, 18 bp, Homo sapiens
tagaagtgagtttgtaaa

SEQ ID NO: 1157887 - DNA, 21 bp, Homo sapiens
tagaagtgagtttgtaaatat

SEQ ID NO: 1157888 - DNA, 19 bp, Homo sapiens
tagaagtggaccaggacag

SEQ ID NO: 1157889 - DNA, 20 bp, Homo sapiens
tagaagttctagtgttttca

SEQ ID NO: 1157890 - DNA, 22 bp, Homo sapiens
tagaagttctagtgttttcaat

SEQ ID NO: 1157891 - DNA, 12 bp, Homo sapiens
tagaataaacct

SEQ ID NO: 1157892 - DNA, 21 bp, Homo sapiens
tagaataaaggcagttttcta

SEQ ID NO: 1157893 - DNA, 22 bp, Homo sapiens
tagaataaaggcagttttctaa

SEQ ID NO: 1157894 - DNA, 18 bp, Homo sapiens
tagaataacctttcagaa

SEQ ID NO: 1157895 - DNA, 19 bp, Homo sapiens
tagaataagaatttgcata

SEQ ID NO: 1157896 - DNA, 21 bp, Homo sapiens
tagaataatgtgggaagaaac

SEQ ID NO: 1157897 - DNA, 22 bp, Homo sapiens
tagaataatgtgggaagaaaca

SEQ ID NO: 1157898 - DNA, 11 bp, Homo sapiens
tagaataattc

SEQ ID NO: 1157899 - DNA, 13 bp, Homo sapiens
tagaataattctt

SEQ ID NO: 1157900 - DNA, 20 bp, Homo sapiens
tagaataattcttttctgag

SEQ ID NO: 1157901 - DNA, 23 bp, Homo sapiens
tagaatacagttttgagtagagt

SEQ ID NO: 1157902 - DNA, 17 bp, Homo sapiens
tagaatacattgataca

SEQ ID NO: 1157903 - DNA, 12 bp, Homo sapiens
tagaatactttt

SEQ ID NO: 1157904 - DNA, 22 bp, Homo sapiens
tagaataggcagggggccctgc

SEQ ID NO: 1157905 - DNA, 15 bp, Homo sapiens
tagaatatttattac

SEQ ID NO: 1157906 - DNA, 21 bp, Homo sapiens
tagaatcaaacattttgaaag

SEQ ID NO: 1157907 - DNA, 14 bp, Homo sapiens
tagaatccaaactt

SEQ ID NO: 1157908 - DNA, 18 bp, Homo sapiens
tagaatctgatgccttta

SEQ ID NO: 1157909 - DNA, 13 bp, Homo sapiens
tagaatcttgttt

SEQ ID NO: 1157910 - DNA, 14 bp, Homo sapiens
tagaatcttttaaa

SEQ ID NO: 1157911 - DNA, 19 bp, Homo sapiens
tagaatgaatttatcttta

SEQ ID NO: 1157912 - DNA, 12 bp, Homo sapiens
tagaatgacagt

SEQ ID NO: 1157913 - DNA, 16 bp, Homo sapiens
tagaatgataaatgta

SEQ ID NO: 1157914 - DNA, 17 bp, Homo sapiens
tagaatgatgttttaaa

SEQ ID NO: 1157915 - DNA, 18 bp, Homo sapiens
tagaatgatgttttaaaa

SEQ ID NO: 1157916 - DNA, 11 bp, Homo sapiens
tagaatgtgat

SEQ ID NO: 1157917 - DNA, 20 bp, Homo sapiens
tagaatgtgttttctgaata

SEQ ID NO: 1157918 - DNA, 21 bp, Homo sapiens
tagaattaaaaaagcatactt

SEQ ID NO: 1157919 - DNA, 21 bp, Homo sapiens
tagaattaccattaattacat

SEQ ID NO: 1157920 - DNA, 15 bp, Homo sapiens
tagaattaccatttg

SEQ ID NO: 1157921 - DNA, 15 bp, Homo sapiens
tagaattatctaatt

SEQ ID NO: 1157922 - DNA, 16 bp, Homo sapiens
tagaattatctaattt

SEQ ID NO: 1157923 - DNA, 21 bp, Homo sapiens
tagaattatctaatttataaa

SEQ ID NO: 1157924 - DNA, 15 bp, Homo sapiens
tagaattatttaaac

SEQ ID NO: 1157925 - DNA, 19 bp, Homo sapiens
tagaattatttttcactct

SEQ ID NO: 1157926 - DNA, 17 bp, Homo sapiens
tagaattccttcgaaag

SEQ ID NO: 1157927 - DNA, 18 bp, Homo sapiens
tagaattctagtgctgct

SEQ ID NO: 1157928 - DNA, 19 bp, Homo sapiens
tagaattgagtgtttaaag

SEQ ID NO: 1157929 - DNA, 15 bp, Homo sapiens
tagaattgtatatag

SEQ ID NO: 1157930 - DNA, 20 bp, Homo sapiens
tagaatttattcaattcctc

SEQ ID NO: 1157931 - DNA, 22 bp, Homo sapiens
tagacaaacaagggagaagagt

SEQ ID NO: 1157932 - DNA, 12 bp, Homo sapiens
tagacaaagtac

SEQ ID NO: 1157933 - DNA, 14 bp, Homo sapiens
tagacaaagtacat

SEQ ID NO: 1157934 - DNA, 20 bp, Homo sapiens
tagacaacctgaaatttatt

SEQ ID NO: 1157935 - DNA, 14 bp, Homo sapiens
tagacaacctttct

SEQ ID NO: 1157936 - DNA, 16 bp, Homo sapiens
tagacaacctttctgt

SEQ ID NO: 1157937 - DNA, 20 bp, Homo sapiens
tagacaacgatgaatttctt

SEQ ID NO: 1157938 - DNA, 13 bp, Homo sapiens
tagacaactagat

SEQ ID NO: 1157939 - DNA, 14 bp, Homo sapiens
tagacaactagatt

SEQ ID NO: 1157940 - DNA, 17 bp, Homo sapiens
tagacaactagatttgt

SEQ ID NO: 1157941 - DNA, 18 bp, Homo sapiens
tagacaactagatttgtc

SEQ ID NO: 1157942 - DNA, 18 bp, Homo sapiens
tagacaattgaggtaagt

SEQ ID NO: 1157943 - DNA, 18 bp, Homo sapiens
tagacaatttattatggc

SEQ ID NO: 1157944 - DNA, 13 bp, Homo sapiens
tagacacatgaag

SEQ ID NO: 1157945 - DNA, 20 bp, Homo sapiens
tagacacatgaaggtaaata

SEQ ID NO: 1157946 - DNA, 21 bp, Homo sapiens
tagacacatgaaggtaaataa

SEQ ID NO: 1157947 - DNA, 22 bp, Homo sapiens
tagacacatgaaggtaaataaa

SEQ ID NO: 1157948 - DNA, 17 bp, Homo sapiens
tagacacccattttcac

SEQ ID NO: 1157949 - DNA, 20 bp, Homo sapiens
tagacacgagcttaatcaac

SEQ ID NO: 1157950 - DNA, 17 bp, Homo sapiens
tagacactccccacggg

SEQ ID NO: 1157951 - DNA, 11 bp, Homo sapiens
tagacactgga

SEQ ID NO: 1157952 - DNA, 12 bp, Homo sapiens
tagacactggac

SEQ ID NO: 1157953 - DNA, 18 bp, Homo sapiens
tagacagaaaccaagcca

SEQ ID NO: 1157954 - DNA, 19 bp, Homo sapiens
tagacagaaaccaagccat

SEQ ID NO: 1157955 - DNA, 15 bp, Homo sapiens
tagacagaacaccta

SEQ ID NO: 1157956 - DNA, 15 bp, Homo sapiens
tagacagaagaaaca

SEQ ID NO: 1157957 - DNA, 14 bp, Homo sapiens
tagacagcatgaga

SEQ ID NO: 1157958 - DNA, 18 bp, Homo sapiens
tagacagtattgccacct

SEQ ID NO: 1157959 - DNA, 20 bp, Homo sapiens
tagacagtattgccacctct

SEQ ID NO: 1157960 - DNA, 14 bp, Homo sapiens
tagacagtgctgcc

SEQ ID NO: 1157961 - DNA, 16 bp, Homo sapiens
tagacagtgctgccct

SEQ ID NO: 1157962 - DNA, 17 bp, Homo sapiens
tagacagtgctgccctg

SEQ ID NO: 1157963 - DNA, 20 bp, Homo sapiens
tagacagtgctgccctgcga

SEQ ID NO: 1157964 - DNA, 13 bp, Homo sapiens
tagacatcaaact

SEQ ID NO: 1157965 - DNA, 22 bp, Homo sapiens
tagacatcaaactcaatgcttt

SEQ ID NO: 1157966 - DNA, 19 bp, Homo sapiens
tagacatctacctatactt

SEQ ID NO: 1157967 - DNA, 22 bp, Homo sapiens
tagacatctacctatacttaat

SEQ ID NO: 1157968 - DNA, 20 bp, Homo sapiens
tagacatgcccaaaacttat

SEQ ID NO: 1157969 - DNA, 11 bp, Homo sapiens
tagacatgtag

SEQ ID NO: 1157970 - DNA, 13 bp, Homo sapiens
tagacatttcaaa

SEQ ID NO: 1157971 - DNA, 19 bp, Homo sapiens
tagacatttcaaaattaat

SEQ ID NO: 1157972 - DNA, 20 bp, Homo sapiens
tagacattttggggttttat

SEQ ID NO: 1157973 - DNA, 16 bp, Homo sapiens
tagacatttttgtgcc

SEQ ID NO: 1157974 - DNA, 12 bp, Homo sapiens
tagaccaaagca

SEQ ID NO: 1157975 - DNA, 16 bp, Homo sapiens
tagaccagtttgcatg

SEQ ID NO: 1157976 - DNA, 20 bp, Homo sapiens
tagaccctgggtgggctctg

SEQ ID NO: 1157977 - DNA, 22 bp, Homo sapiens
tagacctagggaggaccttatc

SEQ ID NO: 1157978 - DNA, 21 bp, Homo sapiens
tagacctataatccttgataa

SEQ ID NO: 1157979 - DNA, 21 bp, Homo sapiens
tagacctcagcctgtgctgcc

SEQ ID NO: 1157980 - DNA, 21 bp, Homo sapiens
tagacctctggttaatttata

SEQ ID NO: 1157981 - DNA, 15 bp, Homo sapiens
tagacctgagctggg

SEQ ID NO: 1157982 - DNA, 20 bp, Homo sapiens
tagaccttgagggtgggcca

SEQ ID NO: 1157983 - DNA, 17 bp, Homo sapiens
tagaccttgttacttct

SEQ ID NO: 1157984 - DNA, 14 bp, Homo sapiens
tagacggtgctcac

SEQ ID NO: 1157985 - DNA, 23 bp, Homo sapiens
tagactaaggccattattgtact

SEQ ID NO: 1157986 - DNA, 18 bp, Homo sapiens
tagactaattaaaatctg

SEQ ID NO: 1157987 - DNA, 19 bp, Homo sapiens
tagactaattaaaatctgg

SEQ ID NO: 1157988 - DNA, 17 bp, Homo sapiens
ttctggccagtgtttaa

SEQ ID NO: 1157989 - DNA, 18 bp, Homo sapiens
ttctggccagtgtttaaa

SEQ ID NO: 1157990 - DNA, 22 bp, Homo sapiens
ttctggccagtgtttaaaactt

SEQ ID NO: 1157991 - DNA, 15 bp, Homo sapiens
ttctggcctccagcc

SEQ ID NO: 1157992 - DNA, 14 bp, Homo sapiens
ttctggcctcccac

SEQ ID NO: 1157993 - DNA, 14 bp, Homo sapiens
ttctggcctctgct

SEQ ID NO: 1157994 - DNA, 17 bp, Homo sapiens
ttctggcgcccctgcct

SEQ ID NO: 1157995 - DNA, 18 bp, Homo sapiens
ttctggcgcccctgcctg

SEQ ID NO: 1157996 - DNA, 19 bp, Homo sapiens
ttctggcgcccctgcctgt

SEQ ID NO: 1157997 - DNA, 18 bp, Homo sapiens
ttctggctatgcatttga

SEQ ID NO: 1157998 - DNA, 16 bp, Homo sapiens
ttctggctcacaggaa

SEQ ID NO: 1157999 - DNA, 23 bp, Homo sapiens
ttctgggaaatggcttgaagcca

SEQ ID NO: 1158000 - DNA, 21 bp, Homo sapiens
ttctgggaagggagagttctt

SEQ ID NO: 1158001 - DNA, 22 bp, Homo sapiens
ttctgggagacacccaaagggt

SEQ ID NO: 1158002 - DNA, 16 bp, Homo sapiens
ttctgggaggaagcag

SEQ ID NO: 1158003 - DNA, 23 bp, Homo sapiens
ttctgggatatatggaggattct

SEQ ID NO: 1158004 - DNA, 17 bp, Homo sapiens
ttctgggcagagcctgt

SEQ ID NO: 1158005 - DNA, 22 bp, Homo sapiens
ttctgggctactgccactgtgt

SEQ ID NO: 1158006 - DNA, 14 bp, Homo sapiens
ttctgggctggggc

SEQ ID NO: 1158007 - DNA, 15 bp, Homo sapiens
ttctggggaaaaaaa

SEQ ID NO: 1158008 - DNA, 20 bp, Homo sapiens
ttctggggaaaaaaaagaga

SEQ ID NO: 1158009 - DNA, 22 bp, Homo sapiens
ttctggggaaaaaaaagagact

SEQ ID NO: 1158010 - DNA, 21 bp, Homo sapiens
ttctggggtcaggtgccactg

SEQ ID NO: 1158011 - DNA, 18 bp, Homo sapiens
ttctgggtagtcccctgt

SEQ ID NO: 1158012 - DNA, 17 bp, Homo sapiens
ttctgggtccctgctcc

SEQ ID NO: 1158013 - DNA, 10 bp, Homo sapiens
ttctgggtga

SEQ ID NO: 1158014 - DNA, 18 bp, Homo sapiens
ttctgggtggcctcggga

SEQ ID NO: 1158015 - DNA, 22 bp, Homo sapiens
ttctgggtgttgaccactccag

SEQ ID NO: 1158016 - DNA, 16 bp, Homo sapiens
ttctgggttttctgaa

SEQ ID NO: 1158017 - DNA, 15 bp, Homo sapiens
ttctggtactctcct

SEQ ID NO: 1158018 - DNA, 17 bp, Homo sapiens
ttctggtagatagaaat

SEQ ID NO: 1158019 - DNA, 18 bp, Homo sapiens
ttctggtagatagaaata

SEQ ID NO: 1158020 - DNA, 17 bp, Homo sapiens
ttctggtattcacagaa

SEQ ID NO: 1158021 - DNA, 19 bp, Homo sapiens
ttctggtatttcccctgtc

SEQ ID NO: 1158022 - DNA, 18 bp, Homo sapiens
ttctggtccctcttctct

SEQ ID NO: 1158023 - DNA, 21 bp, Homo sapiens
ttctggtccctcttctctcct

SEQ ID NO: 1158024 - DNA, 16 bp, Homo sapiens
ttctggtcctttttgg

SEQ ID NO: 1158025 - DNA, 13 bp, Homo sapiens
ttctggtctcgtc

SEQ ID NO: 1158026 - DNA, 22 bp, Homo sapiens
ttctggtctcgtcttccgtctc

SEQ ID NO: 1158027 - DNA, 15 bp, Homo sapiens
ttctggtgaccagac

SEQ ID NO: 1158028 - DNA, 17 bp, Homo sapiens
ttctggtgaccagactt

SEQ ID NO: 1158029 - DNA, 14 bp, Homo sapiens
ttctggtgtctgct

SEQ ID NO: 1158030 - DNA, 13 bp, Homo sapiens
ttctggtgttcct

SEQ ID NO: 1158031 - DNA, 13 bp, Homo sapiens
ttctggttccaaa

SEQ ID NO: 1158032 - DNA, 13 bp, Homo sapiens
ttctggttccatt

SEQ ID NO: 1158033 - DNA, 13 bp, Homo sapiens
ttctgtaaacaga

SEQ ID NO: 1158034 - DNA, 22 bp, Homo sapiens
ttctgtaaactctgcatccaga

SEQ ID NO: 1158035 - DNA, 11 bp, Homo sapiens
ttctgtaattc

SEQ ID NO: 1158036 - DNA, 22 bp, Homo sapiens
ttctgtaattcaggtttttcct

SEQ ID NO: 1158037 - DNA, 12 bp, Homo sapiens
ttctgtaccagt

SEQ ID NO: 1158038 - DNA, 14 bp, Homo sapiens
ttctgtaccagtta

SEQ ID NO: 1158039 - DNA, 21 bp, Homo sapiens
ttctgtaccagttaatttttc

SEQ ID NO: 1158040 - DNA, 14 bp, Homo sapiens
ttctgtagctttct

SEQ ID NO: 1158041 - DNA, 20 bp, Homo sapiens
ttctgtagtttttaattaaa

SEQ ID NO: 1158042 - DNA, 24 bp, Homo sapiens
ttctgtatacaaccctggcattat

SEQ ID NO: 1158043 - DNA, 16 bp, Homo sapiens
ttctgtatatactttt

SEQ ID NO: 1158044 - DNA, 22 bp, Homo sapiens
ttctgtatatttgtcatgacag

SEQ ID NO: 1158045 - DNA, 18 bp, Homo sapiens
ttctgtatttcactcttt

SEQ ID NO: 1158046 - DNA, 18 bp, Homo sapiens
ttctgtattttgtttttg

SEQ ID NO: 1158047 - DNA, 22 bp, Homo sapiens
ttctgtatttttttttctaaga

SEQ ID NO: 1158048 - DNA, 18 bp, Homo sapiens
ttctgtcaccaaatttgt

SEQ ID NO: 1158049 - DNA, 16 bp, Homo sapiens
ttctgtcatttacaca

SEQ ID NO: 1158050 - DNA, 17 bp, Homo sapiens
ttctgtcatttacacac

SEQ ID NO: 1158051 - DNA, 17 bp, Homo sapiens
ttctgtccatcagtgca

SEQ ID NO: 1158052 - DNA, 19 bp, Homo sapiens
ttctgtccatcagtgcatg

SEQ ID NO: 1158053 - DNA, 14 bp, Homo sapiens
ttctgtccccagcc

SEQ ID NO: 1158054 - DNA, 14 bp, Homo sapiens
ttctgtccctgtcc

SEQ ID NO: 1158055 - DNA, 21 bp, Homo sapiens
ttctgtccgagctttgaaaat

SEQ ID NO: 1158056 - DNA, 22 bp, Homo sapiens
ttctgtccttttggcactgaga

SEQ ID NO: 1158057 - DNA, 22 bp, Homo sapiens
ttctgtctaggttaaagctaaa

SEQ ID NO: 1158058 - DNA, 22 bp, Homo sapiens
ttctgtctctaaccattcaaat

SEQ ID NO: 1158059 - DNA, 19 bp, Homo sapiens
ttctgtctctgcctccctc

SEQ ID NO: 1158060 - DNA, 18 bp, Homo sapiens
ttctgtctcttttctctt

SEQ ID NO: 1158061 - DNA, 15 bp, Homo sapiens
ttctgtgaaatataa

SEQ ID NO: 1158062 - DNA, 13 bp, Homo sapiens
ttctgtgaagagg

SEQ ID NO: 1158063 - DNA, 15 bp, Homo sapiens
ttctgtgaagctaat

SEQ ID NO: 1158064 - DNA, 18 bp, Homo sapiens
ttctgtgaagctaataca

SEQ ID NO: 1158065 - DNA, 14 bp, Homo sapiens
ttctgtgacattta

SEQ ID NO: 1158066 - DNA, 17 bp, Homo sapiens
ttctgtgacatttatgt

SEQ ID NO: 1158067 - DNA, 23 bp, Homo sapiens
ttctgtgactgaagaagatgagc

SEQ ID NO: 1158068 - DNA, 19 bp, Homo sapiens
ttctgtgagacccccacac

SEQ ID NO: 1158069 - DNA, 16 bp, Homo sapiens
ttctgtgagataaatg

SEQ ID NO: 1158070 - DNA, 17 bp, Homo sapiens
ttctgtgatgagctgat

SEQ ID NO: 1158071 - DNA, 18 bp, Homo sapiens
ttctgtgatgagctgatc

SEQ ID NO: 1158072 - DNA, 13 bp, Homo sapiens
ttctgtgcccagg

SEQ ID NO: 1158073 - DNA, 16 bp, Homo sapiens
ttctgtgccctactca

SEQ ID NO: 1158074 - DNA, 12 bp, Homo sapiens
ttctgtgcctcc

SEQ ID NO: 1158075 - DNA, 15 bp, Homo sapiens
ttctgtgcctccagg

SEQ ID NO: 1158076 - DNA, 15 bp, Homo sapiens
ttctgtgcctccccc

SEQ ID NO: 1158077 - DNA, 16 bp, Homo sapiens
ttctgtgcctgaatat

SEQ ID NO: 1158078 - DNA, 20 bp, Homo sapiens
ttctgtggatacagtgccca

SEQ ID NO: 1158079 - DNA, 22 bp, Homo sapiens
ttctgtggatgccgatttctgt

SEQ ID NO: 1158080 - DNA, 19 bp, Homo sapiens
ttctgtggccgccatctgc

SEQ ID NO: 1158081 - DNA, 12 bp, Homo sapiens
ttctgtggctca

SEQ ID NO: 1158082 - DNA, 22 bp, Homo sapiens
ttctgtgggagaattcttacat

SEQ ID NO: 1158083 - DNA, 19 bp, Homo sapiens
ttctgtgggcatggccgct

SEQ ID NO: 1158084 - DNA, 17 bp, Homo sapiens
ttctgtggtcacagtga

SEQ ID NO: 1158085 - DNA, 17 bp, Homo sapiens
ttctgtggttcctctgc

SEQ ID NO: 1158086 - DNA, 18 bp, Homo sapiens
ttctgtggtttcatgtta

SEQ ID NO: 1158087 - DNA, 20 bp, Homo sapiens
ttctgtggttttcccctccc

SEQ ID NO: 1158088 - DNA, 22 bp, Homo sapiens
ttctgtggttttcccctccctg

SEQ ID NO: 1158089 - DNA, 21 bp, Homo sapiens
ttctgtgtatctctttcacat

SEQ ID NO: 1158090 - DNA, 23 bp, Homo sapiens
ttctgtgtgcaccttaccaactt

SEQ ID NO: 1158091 - DNA, 18 bp, Homo sapiens
ttctgtgtgtcagttttc

SEQ ID NO: 1158092 - DNA, 15 bp, Homo sapiens
ttctgtgttcatttt

SEQ ID NO: 1158093 - DNA, 18 bp, Homo sapiens
ttctgttaaaaaaataaa

SEQ ID NO: 1158094 - DNA, 13 bp, Homo sapiens
ttctgttaactga

SEQ ID NO: 1158095 - DNA, 14 bp, Homo sapiens
ttctgttaactgaa

SEQ ID NO: 1158096 - DNA, 13 bp, Homo sapiens
ttctgttccaaat

SEQ ID NO: 1158097 - DNA, 19 bp, Homo sapiens
ttctgttccaaattcagtt

SEQ ID NO: 1158098 - DNA, 17 bp, Homo sapiens
ttctgttccagtcacat

SEQ ID NO: 1158099 - DNA, 18 bp, Homo sapiens
ttctgttcccaaggaagc

SEQ ID NO: 1158100 - DNA, 13 bp, Homo sapiens
ttctgttccccag

SEQ ID NO: 1158101 - DNA, 15 bp, Homo sapiens
ttctgttcttacaaa

SEQ ID NO: 1158102 - DNA, 18 bp, Homo sapiens
ttctgttctttctggcta

SEQ ID NO: 1158103 - DNA, 17 bp, Homo sapiens
ttctgttgatcccactt

SEQ ID NO: 1158104 - DNA, 11 bp, Homo sapiens
ttctgttgctg

SEQ ID NO: 1158105 - DNA, 20 bp, Homo sapiens
ttctgttgtcattgctgttg

SEQ ID NO: 1158106 - DNA, 20 bp, Homo sapiens
ttctgttgttccattttatg

SEQ ID NO: 1158107 - DNA, 19 bp, Homo sapiens
ttctgtttagttttacact

SEQ ID NO: 1158108 - DNA, 18 bp, Homo sapiens
ttctgtttatggccacat

SEQ ID NO: 1158109 - DNA, 20 bp, Homo sapiens
ttctgtttattcttccagaa

SEQ ID NO: 1158110 - DNA, 11 bp, Homo sapiens
ttctgtttctt

SEQ ID NO: 1158111 - DNA, 14 bp, Homo sapiens
ttctgtttggcact

SEQ ID NO: 1158112 - DNA, 18 bp, Homo sapiens
ttctgtttggcacttgta

SEQ ID NO: 1158113 - DNA, 23 bp, Homo sapiens
tagactaattaaaatctggaaat

SEQ ID NO: 1158114 - DNA, 17 bp, Homo sapiens
tagactagtcctatgga

SEQ ID NO: 1158115 - DNA, 15 bp, Homo sapiens
tagactataaatgtt

SEQ ID NO: 1158116 - DNA, 16 bp, Homo sapiens
tagactctagtattta

SEQ ID NO: 1158117 - DNA, 17 bp, Homo sapiens
tagactctgtctacctg

SEQ ID NO: 1158118 - DNA, 21 bp, Homo sapiens
tagactcttttccttcccttt

SEQ ID NO: 1158119 - DNA, 18 bp, Homo sapiens
tagactggacagcttgtg

SEQ ID NO: 1158120 - DNA, 23 bp, Homo sapiens
tagactggagtgaggcttccagg

SEQ ID NO: 1158121 - DNA, 17 bp, Homo sapiens
tagactgtgattcagaa

SEQ ID NO: 1158122 - DNA, 16 bp, Homo sapiens
tagacttaataaaggt

SEQ ID NO: 1158123 - DNA, 17 bp, Homo sapiens
tagacttactttcctat

SEQ ID NO: 1158124 - DNA, 22 bp, Homo sapiens
tagacttcaagcatggctattt

SEQ ID NO: 1158125 - DNA, 13 bp, Homo sapiens
tagacttctctta

SEQ ID NO: 1158126 - DNA, 16 bp, Homo sapiens
tagacttctgagtaat

SEQ ID NO: 1158127 - DNA, 14 bp, Homo sapiens
tagacttctggttg

SEQ ID NO: 1158128 - DNA, 20 bp, Homo sapiens
tagacttgaaagttttccag

SEQ ID NO: 1158129 - DNA, 15 bp, Homo sapiens
tagacttggacccaa

SEQ ID NO: 1158130 - DNA, 19 bp, Homo sapiens
tagactttagaaataaatg

SEQ ID NO: 1158131 - DNA, 12 bp, Homo sapiens
tagactttctgt

SEQ ID NO: 1158132 - DNA, 13 bp, Homo sapiens
tagagaaaaggct

SEQ ID NO: 1158133 - DNA, 20 bp, Homo sapiens
tagagaaaataaatttaact

SEQ ID NO: 1158134 - DNA, 20 bp, Homo sapiens
tagagaacacgcgtatttac

SEQ ID NO: 1158135 - DNA, 21 bp, Homo sapiens
tagagaactggaggaaccaca

SEQ ID NO: 1158136 - DNA, 16 bp, Homo sapiens
tagagaactgtggccg

SEQ ID NO: 1158137 - DNA, 14 bp, Homo sapiens
tagagacagaagca

SEQ ID NO: 1158138 - DNA, 18 bp, Homo sapiens
tagagacagaagcaggct

SEQ ID NO: 1158139 - DNA, 21 bp, Homo sapiens
tagagacagaagcaggctgga

SEQ ID NO: 1158140 - DNA, 15 bp, Homo sapiens
tagagacccccaggc

SEQ ID NO: 1158141 - DNA, 14 bp, Homo sapiens
tagagagaacaggt

SEQ ID NO: 1158142 - DNA, 14 bp, Homo sapiens
tagagagagaggta

SEQ ID NO: 1158143 - DNA, 19 bp, Homo sapiens
tagagagatgagaagccag

SEQ ID NO: 1158144 - DNA, 12 bp, Homo sapiens
tagagaggcctg

SEQ ID NO: 1158145 - DNA, 19 bp, Homo sapiens
tagagagggagaagaagtc

SEQ ID NO: 1158146 - DNA, 18 bp, Homo sapiens
tagagaggtttttcttgg

SEQ ID NO: 1158147 - DNA, 20 bp, Homo sapiens
tagagatattcttatttcac

SEQ ID NO: 1158148 - DNA, 23 bp, Homo sapiens
tagagatgctgtaacttaaaata

SEQ ID NO: 1158149 - DNA, 22 bp, Homo sapiens
tagagatgtgcctgtgggaggg

SEQ ID NO: 1158150 - DNA, 23 bp, Homo sapiens
tagagatgtgcctgtgggagggg

SEQ ID NO: 1158151 - DNA, 19 bp, Homo sapiens
tagagatgtttttaaaagt

SEQ ID NO: 1158152 - DNA, 17 bp, Homo sapiens
tagagattacctcctga

SEQ ID NO: 1158153 - DNA, 20 bp, Homo sapiens
tagagatttgtctaattgca

SEQ ID NO: 1158154 - DNA, 18 bp, Homo sapiens
tagagatttttatgtgtt

SEQ ID NO: 1158155 - DNA, 21 bp, Homo sapiens
tagagcaaaatcaacatgact

SEQ ID NO: 1158156 - DNA, 20 bp, Homo sapiens
tagagcacagcttcttctgc

SEQ ID NO: 1158157 - DNA, 19 bp, Homo sapiens
tagagcagcctcgtggagc

SEQ ID NO: 1158158 - DNA, 19 bp, Homo sapiens
tagagcattgaattggaga

SEQ ID NO: 1158159 - DNA, 20 bp, Homo sapiens
tagagccaactgattttgta

SEQ ID NO: 1158160 - DNA, 23 bp, Homo sapiens
tagagccaactgattttgtatgt

SEQ ID NO: 1158161 - DNA, 15 bp, Homo sapiens
tagagccaagctgca

SEQ ID NO: 1158162 - DNA, 20 bp, Homo sapiens
tagagccaagtgtcttttaa

SEQ ID NO: 1158163 - DNA, 14 bp, Homo sapiens
tagagctagctgcc

SEQ ID NO: 1158164 - DNA, 15 bp, Homo sapiens
tagagctccagttct

SEQ ID NO: 1158165 - DNA, 18 bp, Homo sapiens
tagagctgatccagagca

SEQ ID NO: 1158166 - DNA, 20 bp, Homo sapiens
tagagctttttaatagcact

SEQ ID NO: 1158167 - DNA, 12 bp, Homo sapiens
tagaggaaaagg

SEQ ID NO: 1158168 - DNA, 20 bp, Homo sapiens
tagaggaaataagaaaaatc

SEQ ID NO: 1158169 - DNA, 23 bp, Homo sapiens
tagaggcattacttgctttcaat

SEQ ID NO: 1158170 - DNA, 13 bp, Homo sapiens
tagaggccaggga

SEQ ID NO: 1158171 - DNA, 16 bp, Homo sapiens
tagaggccagggcagc

SEQ ID NO: 1158172 - DNA, 12 bp, Homo sapiens
tagaggcctgag

SEQ ID NO: 1158173 - DNA, 15 bp, Homo sapiens
tagaggcctgaggat

SEQ ID NO: 1158174 - DNA, 17 bp, Homo sapiens
tagaggctttcaaatgt

SEQ ID NO: 1158175 - DNA, 18 bp, Homo sapiens
tagaggctttcaaatgta

SEQ ID NO: 1158176 - DNA, 17 bp, Homo sapiens
tagagggaacagggcgg

SEQ ID NO: 1158177 - DNA, 23 bp, Homo sapiens
tagagggaggagaatgagcctcg

SEQ ID NO: 1158178 - DNA, 19 bp, Homo sapiens
tagagggccttgcttctct

SEQ ID NO: 1158179 - DNA, 20 bp, Homo sapiens
tagagggccttgcttctctt

SEQ ID NO: 1158180 - DNA, 22 bp, Homo sapiens
tagaggggaaggaaatctcctc

SEQ ID NO: 1158181 - DNA, 18 bp, Homo sapiens
tagagggttgctgccttt

SEQ ID NO: 1158182 - DNA, 17 bp, Homo sapiens
tagaggtcctctggagc

SEQ ID NO: 1158183 - DNA, 16 bp, Homo sapiens
tagaggtgagaaattt

SEQ ID NO: 1158184 - DNA, 14 bp, Homo sapiens
tagaggtgggcagc

SEQ ID NO: 1158185 - DNA, 14 bp, Homo sapiens
tagaggttcaaaga

SEQ ID NO: 1158186 - DNA, 19 bp, Homo sapiens
tagaggttcaaagatattt

SEQ ID NO: 1158187 - DNA, 21 bp, Homo sapiens
tagaggttcaaagatattttg

SEQ ID NO: 1158188 - DNA, 23 bp, Homo sapiens
tagaggttctgggttttctgaaa

SEQ ID NO: 1158189 - DNA, 21 bp, Homo sapiens
tagaggttgcagcatgagact

SEQ ID NO: 1158190 - DNA, 15 bp, Homo sapiens
tagaggttttaaagt

SEQ ID NO: 1158191 - DNA, 19 bp, Homo sapiens
tagaggttttaaagtgatt

SEQ ID NO: 1158192 - DNA, 15 bp, Homo sapiens
tagaggttttgtatt

SEQ ID NO: 1158193 - DNA, 16 bp, Homo sapiens
tagaggttttgtattg

SEQ ID NO: 1158194 - DNA, 16 bp, Homo sapiens
tagaggttttgttgtt

SEQ ID NO: 1158195 - DNA, 15 bp, Homo sapiens
tagagtaatgaaatg

SEQ ID NO: 1158196 - DNA, 16 bp, Homo sapiens
tagagtaatgatgtaa

SEQ ID NO: 1158197 - DNA, 15 bp, Homo sapiens
tagagtatttccctt

SEQ ID NO: 1158198 - DNA, 17 bp, Homo sapiens
tagagtatttcccttcc

SEQ ID NO: 1158199 - DNA, 21 bp, Homo sapiens
tagagtcaatttgctgaaaac

SEQ ID NO: 1158200 - DNA, 14 bp, Homo sapiens
tagagtcagccttc

SEQ ID NO: 1158201 - DNA, 21 bp, Homo sapiens
tagagtcatctccatcagctg

SEQ ID NO: 1158202 - DNA, 13 bp, Homo sapiens
tagagtcatgtga

SEQ ID NO: 1158203 - DNA, 12 bp, Homo sapiens
tagagtcattca

SEQ ID NO: 1158204 - DNA, 16 bp, Homo sapiens
tagagtcattcatatt

SEQ ID NO: 1158205 - DNA, 20 bp, Homo sapiens
tagagtcttaaagcatttca

SEQ ID NO: 1158206 - DNA, 13 bp, Homo sapiens
tagagtgcccagc

SEQ ID NO: 1158207 - DNA, 15 bp, Homo sapiens
tagagtgcccagcag

SEQ ID NO: 1158208 - DNA, 18 bp, Homo sapiens
tagagtggttattcatta

SEQ ID NO: 1158209 - DNA, 23 bp, Homo sapiens
tagagtggttattcattattcct

SEQ ID NO: 1158210 - DNA, 21 bp, Homo sapiens
tagagtgtagcctaaagggca

SEQ ID NO: 1158211 - DNA, 22 bp, Homo sapiens
tagagtgtagcctaaagggcag

SEQ ID NO: 1158212 - DNA, 20 bp, Homo sapiens
tagagtgtagctgtaagggc

SEQ ID NO: 1158213 - DNA, 15 bp, Homo sapiens
tagagtgtctttcca

SEQ ID NO: 1158214 - DNA, 23 bp, Homo sapiens
tagagttcggtctgacagtcctt

SEQ ID NO: 1158215 - DNA, 13 bp, Homo sapiens
tagagttgctgag

SEQ ID NO: 1158216 - DNA, 13 bp, Homo sapiens
tagagtttacagt

SEQ ID NO: 1158217 - DNA, 19 bp, Homo sapiens
tagataaatatttgacttg

SEQ ID NO: 1158218 - DNA, 13 bp, Homo sapiens
tagatacaataaa

SEQ ID NO: 1158219 - DNA, 14 bp, Homo sapiens
tagatacaataaat

SEQ ID NO: 1158220 - DNA, 16 bp, Homo sapiens
tagatacaataaattg

SEQ ID NO: 1158221 - DNA, 22 bp, Homo sapiens
tagataccctacgctgtccaga

SEQ ID NO: 1158222 - DNA, 20 bp, Homo sapiens
tagatactttgctagccggc

SEQ ID NO: 1158223 - DNA, 11 bp, Homo sapiens
tagatagaaat

SEQ ID NO: 1158224 - DNA, 16 bp, Homo sapiens
tagatagaagaatttt

SEQ ID NO: 1158225 - DNA, 17 bp, Homo sapiens
tagatagccctgtcctg

SEQ ID NO: 1158226 - DNA, 19 bp, Homo sapiens
tagatagccctgtcctggt

SEQ ID NO: 1158227 - DNA, 20 bp, Homo sapiens
tagataggaagaaagaagac

SEQ ID NO: 1158228 - DNA, 16 bp, Homo sapiens
tagataggtaaatacc

SEQ ID NO: 1158229 - DNA, 23 bp, Homo sapiens
tagatataatgaacaaaattatt

SEQ ID NO: 1158230 - DNA, 19 bp, Homo sapiens
tagatatatgctctgcatg

SEQ ID NO: 1158231 - DNA, 16 bp, Homo sapiens
tagatatcctctcccc

SEQ ID NO: 1158232 - DNA, 23 bp, Homo sapiens
tagatatcgacttgtttttgcac

SEQ ID NO: 1158233 - DNA, 14 bp, Homo sapiens
tagatattaaaatt

SEQ ID NO: 1158234 - DNA, 22 bp, Homo sapiens
tagatattattttagcttcagt

SEQ ID NO: 1158235 - DNA, 13 bp, Homo sapiens
tagatattgtttt

SEQ ID NO: 1158236 - DNA, 18 bp, Homo sapiens
tagatattgttttctgta

SEQ ID NO: 1158237 - DNA, 16 bp, Homo sapiens
ttctgtttgtaaatta

SEQ ID NO: 1158238 - DNA, 22 bp, Homo sapiens
ttctgttttcgtaccttcccac

SEQ ID NO: 1158239 - DNA, 23 bp, Homo sapiens
ttctgttttcgtaccttcccact

SEQ ID NO: 1158240 - DNA, 14 bp, Homo sapiens
ttctgttttctgtt

SEQ ID NO: 1158241 - DNA, 14 bp, Homo sapiens
ttcttaaaaactgt

SEQ ID NO: 1158242 - DNA, 15 bp, Homo sapiens
ttcttaaaaactgtg

SEQ ID NO: 1158243 - DNA, 11 bp, Homo sapiens
ttcttaaaagt

SEQ ID NO: 1158244 - DNA, 14 bp, Homo sapiens
ttcttaaaagtact

SEQ ID NO: 1158245 - DNA, 15 bp, Homo sapiens
ttcttaaaagtactt

SEQ ID NO: 1158246 - DNA, 18 bp, Homo sapiens
ttcttaaaagtactttaa

SEQ ID NO: 1158247 - DNA, 21 bp, Homo sapiens
ttcttaaaatatatttcagat

SEQ ID NO: 1158248 - DNA, 13 bp, Homo sapiens
ttcttaaagagtt

SEQ ID NO: 1158249 - DNA, 19 bp, Homo sapiens
ttcttaaaggcctggaacc

SEQ ID NO: 1158250 - DNA, 18 bp, Homo sapiens
ttcttaaataagaaactt

SEQ ID NO: 1158251 - DNA, 16 bp, Homo sapiens
ttcttaaataatgctt

SEQ ID NO: 1158252 - DNA, 11 bp, Homo sapiens
ttcttaaatat

SEQ ID NO: 1158253 - DNA, 13 bp, Homo sapiens
ttcttaaatggaa

SEQ ID NO: 1158254 - DNA, 21 bp, Homo sapiens
ttcttaaatgggctactttgt

SEQ ID NO: 1158255 - DNA, 12 bp, Homo sapiens
ttcttaaattat

SEQ ID NO: 1158256 - DNA, 13 bp, Homo sapiens
ttcttaacaaccg

SEQ ID NO: 1158257 - DNA, 19 bp, Homo sapiens
ttcttaacacagccttcct

SEQ ID NO: 1158258 - DNA, 13 bp, Homo sapiens
ttcttaacctttg

SEQ ID NO: 1158259 - DNA, 17 bp, Homo sapiens
ttcttaacttcttgctt

SEQ ID NO: 1158260 - DNA, 18 bp, Homo sapiens
ttcttaattattataaaa

SEQ ID NO: 1158261 - DNA, 22 bp, Homo sapiens
ttcttaattattataaaaatat

SEQ ID NO: 1158262 - DNA, 20 bp, Homo sapiens
ttcttaattttagggacagc

SEQ ID NO: 1158263 - DNA, 11 bp, Homo sapiens
ttcttacaaaa

SEQ ID NO: 1158264 - DNA, 20 bp, Homo sapiens
ttcttacaagcttaaagctt

SEQ ID NO: 1158265 - DNA, 13 bp, Homo sapiens
ttcttacataatt

SEQ ID NO: 1158266 - DNA, 14 bp, Homo sapiens
ttcttacatgcatt

SEQ ID NO: 1158267 - DNA, 16 bp, Homo sapiens
ttcttacatgcatttg

SEQ ID NO: 1158268 - DNA, 14 bp, Homo sapiens
ttcttacatgtttt

SEQ ID NO: 1158269 - DNA, 16 bp, Homo sapiens
ttcttacccaaagcac

SEQ ID NO: 1158270 - DNA, 17 bp, Homo sapiens
ttcttacccaaagcaca

SEQ ID NO: 1158271 - DNA, 18 bp, Homo sapiens
ttcttactaaaaagtata

SEQ ID NO: 1158272 - DNA, 12 bp, Homo sapiens
ttcttactcctc

SEQ ID NO: 1158273 - DNA, 15 bp, Homo sapiens
ttcttactcctcctc

SEQ ID NO: 1158274 - DNA, 19 bp, Homo sapiens
ttcttactcctcctctttc

SEQ ID NO: 1158275 - DNA, 16 bp, Homo sapiens
ttcttagaaaattaaa

SEQ ID NO: 1158276 - DNA, 24 bp, Homo sapiens
ttcttagaaaattaaaataggcat

SEQ ID NO: 1158277 - DNA, 20 bp, Homo sapiens
ttcttagaacagtggaaact

SEQ ID NO: 1158278 - DNA, 22 bp, Homo sapiens
ttcttagagtgtagctgtaagg

SEQ ID NO: 1158279 - DNA, 23 bp, Homo sapiens
ttcttagctcttaattgttcatt

SEQ ID NO: 1158280 - DNA, 17 bp, Homo sapiens
ttcttagctttgaaact

SEQ ID NO: 1158281 - DNA, 20 bp, Homo sapiens
ttcttaggagcaagaagaaa

SEQ ID NO: 1158282 - DNA, 22 bp, Homo sapiens
ttcttaggagcaagaagaaaat

SEQ ID NO: 1158283 - DNA, 23 bp, Homo sapiens
ttcttaggagcaagaagaaaatg

SEQ ID NO: 1158284 - DNA, 13 bp, Homo sapiens
ttcttagtgactt

SEQ ID NO: 1158285 - DNA, 22 bp, Homo sapiens
ttcttagttcatatatcaagaa

SEQ ID NO: 1158286 - DNA, 14 bp, Homo sapiens
ttcttagttgctgt

SEQ ID NO: 1158287 - DNA, 15 bp, Homo sapiens
ttcttagttgctgta

SEQ ID NO: 1158288 - DNA, 23 bp, Homo sapiens
ttcttagttgctgtatgtctcgt

SEQ ID NO: 1158289 - DNA, 19 bp, Homo sapiens
ttcttataccttctgacag

SEQ ID NO: 1158290 - DNA, 16 bp, Homo sapiens
ttcttatacgcttttc

SEQ ID NO: 1158291 - DNA, 23 bp, Homo sapiens
ttcttatcacataagagagatga

SEQ ID NO: 1158292 - DNA, 21 bp, Homo sapiens
ttcttattaattcttcacctg

SEQ ID NO: 1158293 - DNA, 22 bp, Homo sapiens
ttcttattaattcttcacctgt

SEQ ID NO: 1158294 - DNA, 17 bp, Homo sapiens
ttcttattactattatt

SEQ ID NO: 1158295 - DNA, 19 bp, Homo sapiens
ttcttattctcactccacc

SEQ ID NO: 1158296 - DNA, 18 bp, Homo sapiens
ttcttatttaatcttttc

SEQ ID NO: 1158297 - DNA, 12 bp, Homo sapiens
ttcttattttag

SEQ ID NO: 1158298 - DNA, 19 bp, Homo sapiens
ttcttattttagattgcta

SEQ ID NO: 1158299 - DNA, 13 bp, Homo sapiens
ttcttcaaatctc

SEQ ID NO: 1158300 - DNA, 22 bp, Homo sapiens
ttcttcaacatcaatgttcatt

SEQ ID NO: 1158301 - DNA, 21 bp, Homo sapiens
ttcttcaacatgctccaaata

SEQ ID NO: 1158302 - DNA, 14 bp, Homo sapiens
ttcttcaactccct

SEQ ID NO: 1158303 - DNA, 12 bp, Homo sapiens
ttcttcaagagg

SEQ ID NO: 1158304 - DNA, 18 bp, Homo sapiens
ttcttcacacagacacta

SEQ ID NO: 1158305 - DNA, 18 bp, Homo sapiens
ttcttcactcaaattttg

SEQ ID NO: 1158306 - DNA, 16 bp, Homo sapiens
ttcttcagagatcaag

SEQ ID NO: 1158307 - DNA, 18 bp, Homo sapiens
ttcttcagagtttgtcat

SEQ ID NO: 1158308 - DNA, 17 bp, Homo sapiens
ttcttcagatcagtgct

SEQ ID NO: 1158309 - DNA, 18 bp, Homo sapiens
ttcttcagggccagtcct

SEQ ID NO: 1158310 - DNA, 19 bp, Homo sapiens
ttcttcaggtaacactaca

SEQ ID NO: 1158311 - DNA, 20 bp, Homo sapiens
ttcttcaggtcgtagcattt

SEQ ID NO: 1158312 - DNA, 18 bp, Homo sapiens
ttcttcagtgtctctgtt

SEQ ID NO: 1158313 - DNA, 20 bp, Homo sapiens
ttcttcatattctaaaacca

SEQ ID NO: 1158314 - DNA, 21 bp, Homo sapiens
ttcttcatccaacttccaaga

SEQ ID NO: 1158315 - DNA, 20 bp, Homo sapiens
ttcttcatctttgccatatg

SEQ ID NO: 1158316 - DNA, 17 bp, Homo sapiens
ttcttcatgcaatgaca

SEQ ID NO: 1158317 - DNA, 18 bp, Homo sapiens
ttcttcatgcaatgacat

SEQ ID NO: 1158318 - DNA, 20 bp, Homo sapiens
ttcttcattcaatacaagtg

SEQ ID NO: 1158319 - DNA, 21 bp, Homo sapiens
ttcttcattcaatacaagtgt

SEQ ID NO: 1158320 - DNA, 23 bp, Homo sapiens
ttcttccaaatgcagttcattgc

SEQ ID NO: 1158321 - DNA, 22 bp, Homo sapiens
ttcttccacctcagcctcccag

SEQ ID NO: 1158322 - DNA, 14 bp, Homo sapiens
ttcttccactgtgt

SEQ ID NO: 1158323 - DNA, 15 bp, Homo sapiens
ttcttccagaatgct

SEQ ID NO: 1158324 - DNA, 21 bp, Homo sapiens
ttcttccatcatcactgtaaa

SEQ ID NO: 1158325 - DNA, 20 bp, Homo sapiens
ttcttccccaggtccttcct

SEQ ID NO: 1158326 - DNA, 17 bp, Homo sapiens
ttcttcccgccccacct

SEQ ID NO: 1158327 - DNA, 18 bp, Homo sapiens
ttcttcccgccccacctc

SEQ ID NO: 1158328 - DNA, 13 bp, Homo sapiens
ttcttcccttttc

SEQ ID NO: 1158329 - DNA, 14 bp, Homo sapiens
ttcttcccttttcc

SEQ ID NO: 1158330 - DNA, 18 bp, Homo sapiens
ttcttcctaccaagtcaa

SEQ ID NO: 1158331 - DNA, 13 bp, Homo sapiens
ttcttcctcccct

SEQ ID NO: 1158332 - DNA, 15 bp, Homo sapiens
ttcttcctcccctca

SEQ ID NO: 1158333 - DNA, 14 bp, Homo sapiens
ttcttcctcctctg

SEQ ID NO: 1158334 - DNA, 19 bp, Homo sapiens
ttcttcctctccttcccac

SEQ ID NO: 1158335 - DNA, 20 bp, Homo sapiens
ttcttcctctcggctggaag

SEQ ID NO: 1158336 - DNA, 14 bp, Homo sapiens
ttcttcctctgcat

SEQ ID NO: 1158337 - DNA, 13 bp, Homo sapiens
ttcttcctctgct

SEQ ID NO: 1158338 - DNA, 9 bp, Homo sapiens
ttcttcctt

SEQ ID NO: 1158339 - DNA, 11 bp, Homo sapiens
ttcttccttcc

SEQ ID NO: 1158340 - DNA, 12 bp, Homo sapiens
ttcttccttcca

SEQ ID NO: 1158341 - DNA, 13 bp, Homo sapiens
ttcttccttccta

SEQ ID NO: 1158342 - DNA, 13 bp, Homo sapiens
ttcttcctttccc

SEQ ID NO: 1158343 - DNA, 19 bp, Homo sapiens
ttcttcctttccctggagc

SEQ ID NO: 1158344 - DNA, 13 bp, Homo sapiens
ttcttcctttctc

SEQ ID NO: 1158345 - DNA, 18 bp, Homo sapiens
ttcttcgctgctagagaa

SEQ ID NO: 1158346 - DNA, 23 bp, Homo sapiens
ttcttctaaagcactggtttcaa

SEQ ID NO: 1158347 - DNA, 16 bp, Homo sapiens
ttcttctaagaagaca

SEQ ID NO: 1158348 - DNA, 19 bp, Homo sapiens
ttcttctagctgagcttta

SEQ ID NO: 1158349 - DNA, 20 bp, Homo sapiens
ttcttctaggggtagctggt

SEQ ID NO: 1158350 - DNA, 20 bp, Homo sapiens
ttcttctattaatcaagaga

SEQ ID NO: 1158351 - DNA, 14 bp, Homo sapiens
ttcttctctctgtt

SEQ ID NO: 1158352 - DNA, 20 bp, Homo sapiens
ttcttctgaactcaaactga

SEQ ID NO: 1158353 - DNA, 23 bp, Homo sapiens
ttcttctgaactcaaactgagga

SEQ ID NO: 1158354 - DNA, 16 bp, Homo sapiens
ttcttctgccacttct

SEQ ID NO: 1158355 - DNA, 19 bp, Homo sapiens
ttcttctgcccctctactg

SEQ ID NO: 1158356 - DNA, 12 bp, Homo sapiens
ttcttctggctt

SEQ ID NO: 1158357 - DNA, 13 bp, Homo sapiens
ttcttctgtaata

SEQ ID NO: 1158358 - DNA, 23 bp, Homo sapiens
ttcttctgtaatatttacaatgt

SEQ ID NO: 1158359 - DNA, 15 bp, Homo sapiens
ttcttcttacacttc

SEQ ID NO: 1158360 - DNA, 15 bp, Homo sapiens
ttcttcttcagaaga

SEQ ID NO: 1158361 - DNA, 13 bp, Homo sapiens
ttcttcttccctc

SEQ ID NO: 1158362 - DNA, 16 bp, Homo sapiens
tagatcacatcttaaa

SEQ ID NO: 1158363 - DNA, 16 bp, Homo sapiens
tagatcacgagatcaa

SEQ ID NO: 1158364 - DNA, 17 bp, Homo sapiens
tagatcacgagatcaag

SEQ ID NO: 1158365 - DNA, 12 bp, Homo sapiens
tagatcaggttt

SEQ ID NO: 1158366 - DNA, 13 bp, Homo sapiens
tagatcaggtttg

SEQ ID NO: 1158367 - DNA, 17 bp, Homo sapiens
tagatcatatttaaaga

SEQ ID NO: 1158368 - DNA, 16 bp, Homo sapiens
tagatccacacacaga

SEQ ID NO: 1158369 - DNA, 21 bp, Homo sapiens
tagatcccatgtcacctcagc

SEQ ID NO: 1158370 - DNA, 17 bp, Homo sapiens
tagatcctaagatgtgt

SEQ ID NO: 1158371 - DNA, 21 bp, Homo sapiens
tagatcctaagatgtgttctt

SEQ ID NO: 1158372 - DNA, 15 bp, Homo sapiens
tagatcctgagatga

SEQ ID NO: 1158373 - DNA, 22 bp, Homo sapiens
tagatcctgcaccccagcattc

SEQ ID NO: 1158374 - DNA, 13 bp, Homo sapiens
tagatcctttaaa

SEQ ID NO: 1158375 - DNA, 14 bp, Homo sapiens
tagatcctttaaaa

SEQ ID NO: 1158376 - DNA, 22 bp, Homo sapiens
tagatcttcaatttggatattt

SEQ ID NO: 1158377 - DNA, 16 bp, Homo sapiens
tagatcttctgaaatg

SEQ ID NO: 1158378 - DNA, 20 bp, Homo sapiens
tagatgaacttgagctctgt

SEQ ID NO: 1158379 - DNA, 13 bp, Homo sapiens
tagatgaccaaaa

SEQ ID NO: 1158380 - DNA, 17 bp, Homo sapiens
tagatgagggtgactgt

SEQ ID NO: 1158381 - DNA, 14 bp, Homo sapiens
tagatgattatata

SEQ ID NO: 1158382 - DNA, 18 bp, Homo sapiens
tagatgattttttgaaag

SEQ ID NO: 1158383 - DNA, 20 bp, Homo sapiens
tagatgcacgtggggcccac

SEQ ID NO: 1158384 - DNA, 18 bp, Homo sapiens
tagatgctgaatatctgt

SEQ ID NO: 1158385 - DNA, 14 bp, Homo sapiens
tagatgctgactgt

SEQ ID NO: 1158386 - DNA, 17 bp, Homo sapiens
tagatggaaaaacttgt

SEQ ID NO: 1158387 - DNA, 16 bp, Homo sapiens
tagatggaatttggaa

SEQ ID NO: 1158388 - DNA, 14 bp, Homo sapiens
tagatggctcctct

SEQ ID NO: 1158389 - DNA, 21 bp, Homo sapiens
tagatgggagggaggctcagg

SEQ ID NO: 1158390 - DNA, 18 bp, Homo sapiens
tagatgggggaactgtga

SEQ ID NO: 1158391 - DNA, 16 bp, Homo sapiens
tagatgggtctggctg

SEQ ID NO: 1158392 - DNA, 14 bp, Homo sapiens
tagatggtgaaatt

SEQ ID NO: 1158393 - DNA, 16 bp, Homo sapiens
tagatgtaattttgtg

SEQ ID NO: 1158394 - DNA, 20 bp, Homo sapiens
tagatgtagataaactcaga

SEQ ID NO: 1158395 - DNA, 15 bp, Homo sapiens
tagatgtagcattgt

SEQ ID NO: 1158396 - DNA, 22 bp, Homo sapiens
tagatgtagcattgttccacac

SEQ ID NO: 1158397 - DNA, 12 bp, Homo sapiens
tagatgtatata

SEQ ID NO: 1158398 - DNA, 15 bp, Homo sapiens
tagatgtatttttga

SEQ ID NO: 1158399 - DNA, 21 bp, Homo sapiens
tagatgtccctttcttggcca

SEQ ID NO: 1158400 - DNA, 12 bp, Homo sapiens
tagatgtgatta

SEQ ID NO: 1158401 - DNA, 16 bp, Homo sapiens
tagatgtgattaacat

SEQ ID NO: 1158402 - DNA, 16 bp, Homo sapiens
tagatgttgtcttggc

SEQ ID NO: 1158403 - DNA, 13 bp, Homo sapiens
tagatgtttcaca

SEQ ID NO: 1158404 - DNA, 20 bp, Homo sapiens
tagattaagattttacttta

SEQ ID NO: 1158405 - DNA, 21 bp, Homo sapiens
tagattaccccctcattgttt

SEQ ID NO: 1158406 - DNA, 16 bp, Homo sapiens
tagattactgatgtga

SEQ ID NO: 1158407 - DNA, 14 bp, Homo sapiens
tagattagctctgg

SEQ ID NO: 1158408 - DNA, 16 bp, Homo sapiens
tagattagctctggac

SEQ ID NO: 1158409 - DNA, 17 bp, Homo sapiens
tagattaggtagacttt

SEQ ID NO: 1158410 - DNA, 18 bp, Homo sapiens
tagattaggtagactttg

SEQ ID NO: 1158411 - DNA, 14 bp, Homo sapiens
tagattattataaa

SEQ ID NO: 1158412 - DNA, 13 bp, Homo sapiens
tagattatttcat

SEQ ID NO: 1158413 - DNA, 14 bp, Homo sapiens
tagattatttcata

SEQ ID NO: 1158414 - DNA, 16 bp, Homo sapiens
tagattatttcatata

SEQ ID NO: 1158415 - DNA, 13 bp, Homo sapiens
tagattatttctg

SEQ ID NO: 1158416 - DNA, 20 bp, Homo sapiens
tagattcacctgtaaaactt

SEQ ID NO: 1158417 - DNA, 21 bp, Homo sapiens
tagattcacctgtaaaacttt

SEQ ID NO: 1158418 - DNA, 19 bp, Homo sapiens
tagattcaggggaagggca

SEQ ID NO: 1158419 - DNA, 13 bp, Homo sapiens
tagattgcaaagc

SEQ ID NO: 1158420 - DNA, 16 bp, Homo sapiens
tagattggttctgttt

SEQ ID NO: 1158421 - DNA, 15 bp, Homo sapiens
tagattgtcttaatg

SEQ ID NO: 1158422 - DNA, 15 bp, Homo sapiens
tagatttatttcatc

SEQ ID NO: 1158423 - DNA, 16 bp, Homo sapiens
tagatttattttacat

SEQ ID NO: 1158424 - DNA, 19 bp, Homo sapiens
tagatttcatagttcagaa

SEQ ID NO: 1158425 - DNA, 12 bp, Homo sapiens
tagatttctctt

SEQ ID NO: 1158426 - DNA, 13 bp, Homo sapiens
tagatttctcttg

SEQ ID NO: 1158427 - DNA, 17 bp, Homo sapiens
tagatttctcttgggca

SEQ ID NO: 1158428 - DNA, 13 bp, Homo sapiens
tagatttggaata

SEQ ID NO: 1158429 - DNA, 13 bp, Homo sapiens
tagatttgtcctt

SEQ ID NO: 1158430 - DNA, 15 bp, Homo sapiens
tagattttatagtgt

SEQ ID NO: 1158431 - DNA, 19 bp, Homo sapiens
tagattttatagtgtgttg

SEQ ID NO: 1158432 - DNA, 12 bp, Homo sapiens
tagattttccaa

SEQ ID NO: 1158433 - DNA, 16 bp, Homo sapiens
tagattttctctggaa

SEQ ID NO: 1158434 - DNA, 16 bp, Homo sapiens
tagatttttgattcag

SEQ ID NO: 1158435 - DNA, 18 bp, Homo sapiens
tagcaaaacaaattcaaa

SEQ ID NO: 1158436 - DNA, 17 bp, Homo sapiens
tagcaaaataaaacata

SEQ ID NO: 1158437 - DNA, 19 bp, Homo sapiens
tagcaaaataaaacatagc

SEQ ID NO: 1158438 - DNA, 16 bp, Homo sapiens
tagcaaaattcctgtg

SEQ ID NO: 1158439 - DNA, 12 bp, Homo sapiens
tagcaaaggaaa

SEQ ID NO: 1158440 - DNA, 16 bp, Homo sapiens
tagcaacaacaattgg

SEQ ID NO: 1158441 - DNA, 18 bp, Homo sapiens
tagcaacatatctctgcc

SEQ ID NO: 1158442 - DNA, 15 bp, Homo sapiens
tagcaactaatgttt

SEQ ID NO: 1158443 - DNA, 21 bp, Homo sapiens
tagcaactacagtctaaagct

SEQ ID NO: 1158444 - DNA, 12 bp, Homo sapiens
tagcaagacaca

SEQ ID NO: 1158445 - DNA, 23 bp, Homo sapiens
tagcaagacctgaaaatatgtct

SEQ ID NO: 1158446 - DNA, 21 bp, Homo sapiens
tagcaagagagcagcgcccag

SEQ ID NO: 1158447 - DNA, 22 bp, Homo sapiens
tagcaagtgaatttttctctaa

SEQ ID NO: 1158448 - DNA, 17 bp, Homo sapiens
tagcaatcacaacactg

SEQ ID NO: 1158449 - DNA, 21 bp, Homo sapiens
tagcaatccatgttagttttt

SEQ ID NO: 1158450 - DNA, 17 bp, Homo sapiens
tagcaatgtgccttgat

SEQ ID NO: 1158451 - DNA, 14 bp, Homo sapiens
tagcaattagtgat

SEQ ID NO: 1158452 - DNA, 14 bp, Homo sapiens
tagcacaatcctat

SEQ ID NO: 1158453 - DNA, 14 bp, Homo sapiens
tagcacaatttgag

SEQ ID NO: 1158454 - DNA, 23 bp, Homo sapiens
tagcacacctgaatcagctggac

SEQ ID NO: 1158455 - DNA, 16 bp, Homo sapiens
tagcacagattttgaa

SEQ ID NO: 1158456 - DNA, 22 bp, Homo sapiens
tagcacagattttgaatctgtg

SEQ ID NO: 1158457 - DNA, 22 bp, Homo sapiens
tagcacaggttagggtgtgtgc

SEQ ID NO: 1158458 - DNA, 18 bp, Homo sapiens
tagcacataaactttggg

SEQ ID NO: 1158459 - DNA, 20 bp, Homo sapiens
tagcacatgtctgtcctcag

SEQ ID NO: 1158460 - DNA, 23 bp, Homo sapiens
tagcacatgtctgtcctcagagc

SEQ ID NO: 1158461 - DNA, 13 bp, Homo sapiens
tagcacctccccc

SEQ ID NO: 1158462 - DNA, 17 bp, Homo sapiens
tagcaccttcagggctg

SEQ ID NO: 1158463 - DNA, 19 bp, Homo sapiens
tagcactcctcaagacttt

SEQ ID NO: 1158464 - DNA, 19 bp, Homo sapiens
tagcactgatagtcctttt

SEQ ID NO: 1158465 - DNA, 20 bp, Homo sapiens
tagcactgttgatgtatctg

SEQ ID NO: 1158466 - DNA, 19 bp, Homo sapiens
tagcactttgggaggctga

SEQ ID NO: 1158467 - DNA, 19 bp, Homo sapiens
tagcagaatggagaaagta

SEQ ID NO: 1158468 - DNA, 11 bp, Homo sapiens
tagcagacagg

SEQ ID NO: 1158469 - DNA, 19 bp, Homo sapiens
tagcagacaggccccgtga

SEQ ID NO: 1158470 - DNA, 15 bp, Homo sapiens
tagcagacagtgttt

SEQ ID NO: 1158471 - DNA, 21 bp, Homo sapiens
tagcagacccagcttagagtt

SEQ ID NO: 1158472 - DNA, 11 bp, Homo sapiens
tagcagagcct

SEQ ID NO: 1158473 - DNA, 12 bp, Homo sapiens
tagcagagccta

SEQ ID NO: 1158474 - DNA, 13 bp, Homo sapiens
tagcagagcctat

SEQ ID NO: 1158475 - DNA, 22 bp, Homo sapiens
tagcagaggggtaagagaggat

SEQ ID NO: 1158476 - DNA, 21 bp, Homo sapiens
tagcagatggtttccacattt

SEQ ID NO: 1158477 - DNA, 19 bp, Homo sapiens
tagcagcaccgttctgtgc

SEQ ID NO: 1158478 - DNA, 14 bp, Homo sapiens
tagcagcacctcct

SEQ ID NO: 1158479 - DNA, 20 bp, Homo sapiens
tagcagcagcctttaatgca

SEQ ID NO: 1158480 - DNA, 12 bp, Homo sapiens
tagcagcctttc

SEQ ID NO: 1158481 - DNA, 13 bp, Homo sapiens
tagcagcctttct

SEQ ID NO: 1158482 - DNA, 11 bp, Homo sapiens
tagcagctggc

SEQ ID NO: 1158483 - DNA, 15 bp, Homo sapiens
tagcaggctgttcca

SEQ ID NO: 1158484 - DNA, 17 bp, Homo sapiens
tagcaggctgttccatg

SEQ ID NO: 1158485 - DNA, 16 bp, Homo sapiens
tagcagggatgttcct

SEQ ID NO: 1158486 - DNA, 16 bp, Homo sapiens
tagcagggattctctc

SEQ ID NO: 1158487 - DNA, 18 bp, Homo sapiens
tagcaggggcaccttccg

SEQ ID NO: 1158488 - DNA, 13 bp, Homo sapiens
ttcttcttcctga

SEQ ID NO: 1158489 - DNA, 14 bp, Homo sapiens
ttcttcttcctgaa

SEQ ID NO: 1158490 - DNA, 14 bp, Homo sapiens
ttcttcttctaaga

SEQ ID NO: 1158491 - DNA, 16 bp, Homo sapiens
ttcttcttgaggggaa

SEQ ID NO: 1158492 - DNA, 12 bp, Homo sapiens
ttcttctttccc

SEQ ID NO: 1158493 - DNA, 12 bp, Homo sapiens
ttcttcttttcc

SEQ ID NO: 1158494 - DNA, 21 bp, Homo sapiens
ttcttctttttgcttcaaaaa

SEQ ID NO: 1158495 - DNA, 13 bp, Homo sapiens
ttcttgaaaaaga

SEQ ID NO: 1158496 - DNA, 23 bp, Homo sapiens
ttcttgaagctgggctgtctctc

SEQ ID NO: 1158497 - DNA, 17 bp, Homo sapiens
ttcttgaagttcatggt

SEQ ID NO: 1158498 - DNA, 17 bp, Homo sapiens
ttcttgaatataaaaaa

SEQ ID NO: 1158499 - DNA, 15 bp, Homo sapiens
ttcttgaattgttat

SEQ ID NO: 1158500 - DNA, 16 bp, Homo sapiens
ttcttgaattgttatg

SEQ ID NO: 1158501 - DNA, 20 bp, Homo sapiens
ttcttgaattgttatgaaaa

SEQ ID NO: 1158502 - DNA, 23 bp, Homo sapiens
ttcttgaggggaagctagtcttt

SEQ ID NO: 1158503 - DNA, 13 bp, Homo sapiens
ttcttgatcttaa

SEQ ID NO: 1158504 - DNA, 18 bp, Homo sapiens
ttcttgatcttaaagatc

SEQ ID NO: 1158505 - DNA, 15 bp, Homo sapiens
ttcttgatgtcatgt

SEQ ID NO: 1158506 - DNA, 16 bp, Homo sapiens
ttcttgatgttgctta

SEQ ID NO: 1158507 - DNA, 23 bp, Homo sapiens
ttcttgcataggctcttaagcag

SEQ ID NO: 1158508 - DNA, 16 bp, Homo sapiens
ttcttgcatctaatga

SEQ ID NO: 1158509 - DNA, 15 bp, Homo sapiens
ttcttgcctctgtgc

SEQ ID NO: 1158510 - DNA, 15 bp, Homo sapiens
ttcttgctgccctgc

SEQ ID NO: 1158511 - DNA, 20 bp, Homo sapiens
ttcttgctggctctgagaat

SEQ ID NO: 1158512 - DNA, 20 bp, Homo sapiens
ttcttgctgttcagtgcttt

SEQ ID NO: 1158513 - DNA, 19 bp, Homo sapiens
ttcttgcttctttctagaa

SEQ ID NO: 1158514 - DNA, 22 bp, Homo sapiens
ttcttggaccagtttgcagagt

SEQ ID NO: 1158515 - DNA, 20 bp, Homo sapiens
ttcttggagctttggaatat

SEQ ID NO: 1158516 - DNA, 14 bp, Homo sapiens
ttcttggcaaattt

SEQ ID NO: 1158517 - DNA, 19 bp, Homo sapiens
ttcttgggatagtgttctg

SEQ ID NO: 1158518 - DNA, 14 bp, Homo sapiens
ttcttgggccctcc

SEQ ID NO: 1158519 - DNA, 12 bp, Homo sapiens
ttcttggggaga

SEQ ID NO: 1158520 - DNA, 22 bp, Homo sapiens
ttcttgggggaggccaccccaa

SEQ ID NO: 1158521 - DNA, 23 bp, Homo sapiens
ttcttggggtactcttgatgtga

SEQ ID NO: 1158522 - DNA, 19 bp, Homo sapiens
ttcttggggtcccagggaa

SEQ ID NO: 1158523 - DNA, 15 bp, Homo sapiens
ttcttggtagagatt

SEQ ID NO: 1158524 - DNA, 18 bp, Homo sapiens
ttcttggtgactgtccca

SEQ ID NO: 1158525 - DNA, 14 bp, Homo sapiens
ttcttggtgctctg

SEQ ID NO: 1158526 - DNA, 17 bp, Homo sapiens
ttcttggtgctctgtgt

SEQ ID NO: 1158527 - DNA, 14 bp, Homo sapiens
ttcttggttcctgg

SEQ ID NO: 1158528 - DNA, 22 bp, Homo sapiens
ttcttggttgaggaaacaaaca

SEQ ID NO: 1158529 - DNA, 16 bp, Homo sapiens
ttcttggtttcagcca

SEQ ID NO: 1158530 - DNA, 14 bp, Homo sapiens
ttcttggtttctgg

SEQ ID NO: 1158531 - DNA, 13 bp, Homo sapiens
ttcttggtttgta

SEQ ID NO: 1158532 - DNA, 23 bp, Homo sapiens
ttcttggtttgtaaattaacttt

SEQ ID NO: 1158533 - DNA, 19 bp, Homo sapiens
ttcttggttttctctctgg

SEQ ID NO: 1158534 - DNA, 20 bp, Homo sapiens
ttcttgtaaatctttttgct

SEQ ID NO: 1158535 - DNA, 13 bp, Homo sapiens
ttcttgtaaatgt

SEQ ID NO: 1158536 - DNA, 14 bp, Homo sapiens
ttcttgtaaatgtt

SEQ ID NO: 1158537 - DNA, 16 bp, Homo sapiens
ttcttgtaaatgtttc

SEQ ID NO: 1158538 - DNA, 13 bp, Homo sapiens
ttcttgtaatttt

SEQ ID NO: 1158539 - DNA, 23 bp, Homo sapiens
ttcttgtagccatggctgggcgt

SEQ ID NO: 1158540 - DNA, 13 bp, Homo sapiens
ttcttgtagtagt

SEQ ID NO: 1158541 - DNA, 12 bp, Homo sapiens
ttcttgtatctg

SEQ ID NO: 1158542 - DNA, 22 bp, Homo sapiens
ttcttgtatctggattcaaatt

SEQ ID NO: 1158543 - DNA, 12 bp, Homo sapiens
ttcttgtattta

SEQ ID NO: 1158544 - DNA, 14 bp, Homo sapiens
ttcttgtcacaaat

SEQ ID NO: 1158545 - DNA, 18 bp, Homo sapiens
ttcttgtcgtttgtgaac

SEQ ID NO: 1158546 - DNA, 17 bp, Homo sapiens
ttcttgtctataaagca

SEQ ID NO: 1158547 - DNA, 18 bp, Homo sapiens
ttcttgtctataaagcat

SEQ ID NO: 1158548 - DNA, 21 bp, Homo sapiens
ttcttgtctataaagcattta

SEQ ID NO: 1158549 - DNA, 19 bp, Homo sapiens
ttcttgtctgattggctca

SEQ ID NO: 1158550 - DNA, 15 bp, Homo sapiens
ttcttgtctttcctc

SEQ ID NO: 1158551 - DNA, 18 bp, Homo sapiens
ttcttgtgggagacagca

SEQ ID NO: 1158552 - DNA, 20 bp, Homo sapiens
ttcttgtgtagatttgaaaa

SEQ ID NO: 1158553 - DNA, 17 bp, Homo sapiens
ttcttgtgtcctgatga

SEQ ID NO: 1158554 - DNA, 14 bp, Homo sapiens
ttcttgttggtgca

SEQ ID NO: 1158555 - DNA, 12 bp, Homo sapiens
ttcttgtttaac

SEQ ID NO: 1158556 - DNA, 14 bp, Homo sapiens
ttcttgtttccttg

SEQ ID NO: 1158557 - DNA, 13 bp, Homo sapiens
ttcttgtttctcc

SEQ ID NO: 1158558 - DNA, 17 bp, Homo sapiens
ttctttaaaagaatgac

SEQ ID NO: 1158559 - DNA, 14 bp, Homo sapiens
ttctttaaagaagt

SEQ ID NO: 1158560 - DNA, 14 bp, Homo sapiens
ttctttaatatgat

SEQ ID NO: 1158561 - DNA, 16 bp, Homo sapiens
ttctttaatatgattc

SEQ ID NO: 1158562 - DNA, 12 bp, Homo sapiens
ttctttaatgct

SEQ ID NO: 1158563 - DNA, 20 bp, Homo sapiens
ttctttacctgagaccagtt

SEQ ID NO: 1158564 - DNA, 16 bp, Homo sapiens
ttctttactaaagata

SEQ ID NO: 1158565 - DNA, 17 bp, Homo sapiens
ttctttactcgtcccct

SEQ ID NO: 1158566 - DNA, 19 bp, Homo sapiens
ttctttacttctcacttca

SEQ ID NO: 1158567 - DNA, 23 bp, Homo sapiens
ttctttagaggctttcaaatgta

SEQ ID NO: 1158568 - DNA, 20 bp, Homo sapiens
ttctttagcatttttatgca

SEQ ID NO: 1158569 - DNA, 14 bp, Homo sapiens
ttctttaggagatt

SEQ ID NO: 1158570 - DNA, 15 bp, Homo sapiens
ttctttaggagattt

SEQ ID NO: 1158571 - DNA, 22 bp, Homo sapiens
ttctttaggagattttaggtgt

SEQ ID NO: 1158572 - DNA, 20 bp, Homo sapiens
ttctttagtagcaactaaaa

SEQ ID NO: 1158573 - DNA, 15 bp, Homo sapiens
ttctttataaaatgt

SEQ ID NO: 1158574 - DNA, 14 bp, Homo sapiens
ttctttataaactt

SEQ ID NO: 1158575 - DNA, 18 bp, Homo sapiens
ttctttataattctactt

SEQ ID NO: 1158576 - DNA, 19 bp, Homo sapiens
ttctttatatctgaaccaa

SEQ ID NO: 1158577 - DNA, 17 bp, Homo sapiens
ttctttattagctttct

SEQ ID NO: 1158578 - DNA, 13 bp, Homo sapiens
ttctttattgcac

SEQ ID NO: 1158579 - DNA, 16 bp, Homo sapiens
ttctttattgcactag

SEQ ID NO: 1158580 - DNA, 19 bp, Homo sapiens
ttctttccaaaacatttct

SEQ ID NO: 1158581 - DNA, 17 bp, Homo sapiens
ttctttccattatgatt

SEQ ID NO: 1158582 - DNA, 13 bp, Homo sapiens
ttctttccccaga

SEQ ID NO: 1158583 - DNA, 21 bp, Homo sapiens
ttctttccctggacaggcagc

SEQ ID NO: 1158584 - DNA, 11 bp, Homo sapiens
ttctttcctcc

SEQ ID NO: 1158585 - DNA, 19 bp, Homo sapiens
ttctttcctccccctgcaa

SEQ ID NO: 1158586 - DNA, 13 bp, Homo sapiens
ttctttcctgccc

SEQ ID NO: 1158587 - DNA, 15 bp, Homo sapiens
ttctttcctgccctg

SEQ ID NO: 1158588 - DNA, 13 bp, Homo sapiens
ttctttctagaaa

SEQ ID NO: 1158589 - DNA, 19 bp, Homo sapiens
ttctttctagttcagctgc

SEQ ID NO: 1158590 - DNA, 12 bp, Homo sapiens
ttctttctgaga

SEQ ID NO: 1158591 - DNA, 20 bp, Homo sapiens
ttctttgaaaaaaaataaat

SEQ ID NO: 1158592 - DNA, 16 bp, Homo sapiens
ttctttgatttgtacc

SEQ ID NO: 1158593 - DNA, 16 bp, Homo sapiens
ttctttgcaaagtatt

SEQ ID NO: 1158594 - DNA, 16 bp, Homo sapiens
ttctttgcaccaaaga

SEQ ID NO: 1158595 - DNA, 14 bp, Homo sapiens
ttctttgctgcccc

SEQ ID NO: 1158596 - DNA, 20 bp, Homo sapiens
ttctttggaaagtacactct

SEQ ID NO: 1158597 - DNA, 20 bp, Homo sapiens
ttctttggagttaaaatgca

SEQ ID NO: 1158598 - DNA, 17 bp, Homo sapiens
ttctttggcctacattc

SEQ ID NO: 1158599 - DNA, 20 bp, Homo sapiens
ttctttgggggtggaaaagg

SEQ ID NO: 1158600 - DNA, 22 bp, Homo sapiens
ttctttggtggagataaagatt

SEQ ID NO: 1158601 - DNA, 22 bp, Homo sapiens
ttctttggtttcccaagagcta

SEQ ID NO: 1158602 - DNA, 16 bp, Homo sapiens
ttctttgtactaatac

SEQ ID NO: 1158603 - DNA, 21 bp, Homo sapiens
ttctttgtagaataaatggtt

SEQ ID NO: 1158604 - DNA, 15 bp, Homo sapiens
ttctttgtttcctgg

SEQ ID NO: 1158605 - DNA, 13 bp, Homo sapiens
ttctttgtttctt

SEQ ID NO: 1158606 - DNA, 21 bp, Homo sapiens
ttcttttaaaggggcagaaaa

SEQ ID NO: 1158607 - DNA, 18 bp, Homo sapiens
ttcttttaaattagaaaa

SEQ ID NO: 1158608 - DNA, 14 bp, Homo sapiens
ttcttttaagaatc

SEQ ID NO: 1158609 - DNA, 19 bp, Homo sapiens
ttcttttactcatgatctt

SEQ ID NO: 1158610 - DNA, 15 bp, Homo sapiens
ttcttttattatcag

SEQ ID NO: 1158611 - DNA, 13 bp, Homo sapiens
ttcttttccccct

SEQ ID NO: 1158612 - DNA, 15 bp, Homo sapiens
ttcttttctattttt

SEQ ID NO: 1158613 - DNA, 12 bp, Homo sapiens
ttcttttctcat

SEQ ID NO: 1158614 - DNA, 23 bp, Homo sapiens
tagcaggtggtcctgagacctga

SEQ ID NO: 1158615 - DNA, 20 bp, Homo sapiens
tagcagtaaaagataaattt

SEQ ID NO: 1158616 - DNA, 16 bp, Homo sapiens
tagcagtaaaagatga

SEQ ID NO: 1158617 - DNA, 21 bp, Homo sapiens
tagcagtaaatacttgcagtt

SEQ ID NO: 1158618 - DNA, 22 bp, Homo sapiens
tagcagtaaatacttgcagttg

SEQ ID NO: 1158619 - DNA, 23 bp, Homo sapiens
tagcagtaaatacttgcagttgt

SEQ ID NO: 1158620 - DNA, 13 bp, Homo sapiens
tagcagtggctgg

SEQ ID NO: 1158621 - DNA, 17 bp, Homo sapiens
tagcagtggctggtgcc

SEQ ID NO: 1158622 - DNA, 23 bp, Homo sapiens
tagcagtggctggtgcccatgaa

SEQ ID NO: 1158623 - DNA, 17 bp, Homo sapiens
tagcataaataaaactg

SEQ ID NO: 1158624 - DNA, 20 bp, Homo sapiens
tagcataaataaaactgaat

SEQ ID NO: 1158625 - DNA, 21 bp, Homo sapiens
tagcatacatttataatgttt

SEQ ID NO: 1158626 - DNA, 12 bp, Homo sapiens
tagcatactgtg

SEQ ID NO: 1158627 - DNA, 21 bp, Homo sapiens
tagcatactgtgtatgtttta

SEQ ID NO: 1158628 - DNA, 23 bp, Homo sapiens
tagcatactgtgtatgttttata

SEQ ID NO: 1158629 - DNA, 21 bp, Homo sapiens
tagcatcagaaggttcaccca

SEQ ID NO: 1158630 - DNA, 16 bp, Homo sapiens
tagcatcttctggagt

SEQ ID NO: 1158631 - DNA, 15 bp, Homo sapiens
tagcatgaaataaaa

SEQ ID NO: 1158632 - DNA, 18 bp, Homo sapiens
tagcatgacaagccccag

SEQ ID NO: 1158633 - DNA, 18 bp, Homo sapiens
tagcatgcttcctttctc

SEQ ID NO: 1158634 - DNA, 19 bp, Homo sapiens
tagcatgcttcctttctct

SEQ ID NO: 1158635 - DNA, 23 bp, Homo sapiens
tagcatgcttcctttctctcctg

SEQ ID NO: 1158636 - DNA, 16 bp, Homo sapiens
tagcatggggcccctg

SEQ ID NO: 1158637 - DNA, 21 bp, Homo sapiens
tagcatggggcccctggccca

SEQ ID NO: 1158638 - DNA, 22 bp, Homo sapiens
tagcatggggcccctggcccag

SEQ ID NO: 1158639 - DNA, 12 bp, Homo sapiens
tagcatgtaatg

SEQ ID NO: 1158640 - DNA, 14 bp, Homo sapiens
tagcatgtcaactt

SEQ ID NO: 1158641 - DNA, 19 bp, Homo sapiens
tagcatgtcaacttttgac

SEQ ID NO: 1158642 - DNA, 13 bp, Homo sapiens
tagcatgtgactc

SEQ ID NO: 1158643 - DNA, 20 bp, Homo sapiens
tagcatgttgagccaggcct

SEQ ID NO: 1158644 - DNA, 16 bp, Homo sapiens
tagcattaactaatct

SEQ ID NO: 1158645 - DNA, 15 bp, Homo sapiens
tagcattatgcaatt

SEQ ID NO: 1158646 - DNA, 15 bp, Homo sapiens
tagcattcctcagga

SEQ ID NO: 1158647 - DNA, 17 bp, Homo sapiens
tagcattctttggagtt

SEQ ID NO: 1158648 - DNA, 13 bp, Homo sapiens
tagcattgaacat

SEQ ID NO: 1158649 - DNA, 14 bp, Homo sapiens
tagcattgaacatt

SEQ ID NO: 1158650 - DNA, 20 bp, Homo sapiens
tagcattgtgaactgacagg

SEQ ID NO: 1158651 - DNA, 23 bp, Homo sapiens
tagcattgttccacacatttaaa

SEQ ID NO: 1158652 - DNA, 18 bp, Homo sapiens
tagcatttatttctctgg

SEQ ID NO: 1158653 - DNA, 16 bp, Homo sapiens
tagcatttgccactta

SEQ ID NO: 1158654 - DNA, 21 bp, Homo sapiens
tagcattttcctgtttactga

SEQ ID NO: 1158655 - DNA, 22 bp, Homo sapiens
tagcattttgctaaatgtgaat

SEQ ID NO: 1158656 - DNA, 19 bp, Homo sapiens
tagcatttttatgcagaca

SEQ ID NO: 1158657 - DNA, 14 bp, Homo sapiens
tagcatttttgatt

SEQ ID NO: 1158658 - DNA, 20 bp, Homo sapiens
tagccaaaaatgtctaaaag

SEQ ID NO: 1158659 - DNA, 14 bp, Homo sapiens
tagccaaagccagg

SEQ ID NO: 1158660 - DNA, 20 bp, Homo sapiens
tagccaaggtgggctgagcc

SEQ ID NO: 1158661 - DNA, 22 bp, Homo sapiens
tagccaagttatattgaatata

SEQ ID NO: 1158662 - DNA, 21 bp, Homo sapiens
tagccaatgtctcctcccctt

SEQ ID NO: 1158663 - DNA, 16 bp, Homo sapiens
tagccacatttggaat

SEQ ID NO: 1158664 - DNA, 17 bp, Homo sapiens
tagccactccctcccag

SEQ ID NO: 1158665 - DNA, 16 bp, Homo sapiens
tagccactcctgccag

SEQ ID NO: 1158666 - DNA, 24 bp, Homo sapiens
tagccagagcccttcactgccatg

SEQ ID NO: 1158667 - DNA, 17 bp, Homo sapiens
tagccagaggctctaat

SEQ ID NO: 1158668 - DNA, 19 bp, Homo sapiens
tagccagcacttgtatata

SEQ ID NO: 1158669 - DNA, 19 bp, Homo sapiens
tagccagcattcagcacac

SEQ ID NO: 1158670 - DNA, 17 bp, Homo sapiens
tagccagccaggtgcat

SEQ ID NO: 1158671 - DNA, 12 bp, Homo sapiens
tagccagtgact

SEQ ID NO: 1158672 - DNA, 19 bp, Homo sapiens
tagccagttaaggaaagaa

SEQ ID NO: 1158673 - DNA, 15 bp, Homo sapiens
tagccagttcaaagt

SEQ ID NO: 1158674 - DNA, 16 bp, Homo sapiens
tagccagttcaaagtg

SEQ ID NO: 1158675 - DNA, 19 bp, Homo sapiens
tagccagttcaaagtgtat

SEQ ID NO: 1158676 - DNA, 15 bp, Homo sapiens
tagccataaacctga

SEQ ID NO: 1158677 - DNA, 18 bp, Homo sapiens
tagccatcccttggggaa

SEQ ID NO: 1158678 - DNA, 22 bp, Homo sapiens
tagccatgatttgtcccagcct

SEQ ID NO: 1158679 - DNA, 18 bp, Homo sapiens
tagccatggctcaggcaa

SEQ ID NO: 1158680 - DNA, 19 bp, Homo sapiens
tagccatttttcaaagcaa

SEQ ID NO: 1158681 - DNA, 18 bp, Homo sapiens
tagcccaatgaaatgaat

SEQ ID NO: 1158682 - DNA, 23 bp, Homo sapiens
tagcccacacttgagaggatgaa

SEQ ID NO: 1158683 - DNA, 16 bp, Homo sapiens
tagcccactccctgcc

SEQ ID NO: 1158684 - DNA, 17 bp, Homo sapiens
tagcccagactctgagc

SEQ ID NO: 1158685 - DNA, 14 bp, Homo sapiens
tagcccaggagcaa

SEQ ID NO: 1158686 - DNA, 20 bp, Homo sapiens
tagcccataaagtctgagaa

SEQ ID NO: 1158687 - DNA, 13 bp, Homo sapiens
tagccccagactg

SEQ ID NO: 1158688 - DNA, 18 bp, Homo sapiens
tagccccagactgggccc

SEQ ID NO: 1158689 - DNA, 23 bp, Homo sapiens
tagccccagactgggcccaggca

SEQ ID NO: 1158690 - DNA, 17 bp, Homo sapiens
tagccccagtgacagct

SEQ ID NO: 1158691 - DNA, 13 bp, Homo sapiens
tagccccataatt

SEQ ID NO: 1158692 - DNA, 15 bp, Homo sapiens
tagccccctggcctc

SEQ ID NO: 1158693 - DNA, 18 bp, Homo sapiens
tagccccgctgagcttgg

SEQ ID NO: 1158694 - DNA, 23 bp, Homo sapiens
tagcccgacagttctgaactgga

SEQ ID NO: 1158695 - DNA, 20 bp, Homo sapiens
tagccctcagacatttatat

SEQ ID NO: 1158696 - DNA, 16 bp, Homo sapiens
tagccctcccactttg

SEQ ID NO: 1158697 - DNA, 17 bp, Homo sapiens
tagccctcccactttgc

SEQ ID NO: 1158698 - DNA, 19 bp, Homo sapiens
tagccctccccccagctcc

SEQ ID NO: 1158699 - DNA, 13 bp, Homo sapiens
tagccctccccct

SEQ ID NO: 1158700 - DNA, 16 bp, Homo sapiens
tagccctccccctcaa

SEQ ID NO: 1158701 - DNA, 23 bp, Homo sapiens
tagccctccccctcaacctcacc

SEQ ID NO: 1158702 - DNA, 18 bp, Homo sapiens
tagccctcctttttccaa

SEQ ID NO: 1158703 - DNA, 16 bp, Homo sapiens
tagccctgagcccggc

SEQ ID NO: 1158704 - DNA, 13 bp, Homo sapiens
tagccctgtcctg

SEQ ID NO: 1158705 - DNA, 14 bp, Homo sapiens
tagccctgtcctgg

SEQ ID NO: 1158706 - DNA, 15 bp, Homo sapiens
tagccctgtcctggt

SEQ ID NO: 1158707 - DNA, 11 bp, Homo sapiens
tagcccttcca

SEQ ID NO: 1158708 - DNA, 14 bp, Homo sapiens
tagcccttccagcc

SEQ ID NO: 1158709 - DNA, 16 bp, Homo sapiens
tagcccttccagcctg

SEQ ID NO: 1158710 - DNA, 20 bp, Homo sapiens
tagcccttccagcctgggac

SEQ ID NO: 1158711 - DNA, 21 bp, Homo sapiens
tagcccttccagcctgggaca

SEQ ID NO: 1158712 - DNA, 12 bp, Homo sapiens
tagcccttccct

SEQ ID NO: 1158713 - DNA, 15 bp, Homo sapiens
tagccctttctgtgt

SEQ ID NO: 1158714 - DNA, 16 bp, Homo sapiens
tagccgacctcagcct

SEQ ID NO: 1158715 - DNA, 15 bp, Homo sapiens
tagccgagagcctgc

SEQ ID NO: 1158716 - DNA, 17 bp, Homo sapiens
tagccgattctctgccc

SEQ ID NO: 1158717 - DNA, 21 bp, Homo sapiens
tagccgcaccctgcacctgct

SEQ ID NO: 1158718 - DNA, 15 bp, Homo sapiens
tagccgccctgagag

SEQ ID NO: 1158719 - DNA, 16 bp, Homo sapiens
tagccgtccatggcac

SEQ ID NO: 1158720 - DNA, 17 bp, Homo sapiens
tagccgtccatggcacc

SEQ ID NO: 1158721 - DNA, 20 bp, Homo sapiens
tagccgtccatggcaccagc

SEQ ID NO: 1158722 - DNA, 21 bp, Homo sapiens
tagcctaaaacgaatggtctt

SEQ ID NO: 1158723 - DNA, 15 bp, Homo sapiens
tagcctaaagggcag

SEQ ID NO: 1158724 - DNA, 20 bp, Homo sapiens
tagcctaaggctcctgtttt

SEQ ID NO: 1158725 - DNA, 11 bp, Homo sapiens
tagcctaccat

SEQ ID NO: 1158726 - DNA, 19 bp, Homo sapiens
tagcctcaatttctgaaca

SEQ ID NO: 1158727 - DNA, 14 bp, Homo sapiens
tagcctccagcttt

SEQ ID NO: 1158728 - DNA, 13 bp, Homo sapiens
tagcctccctgaa

SEQ ID NO: 1158729 - DNA, 22 bp, Homo sapiens
tagcctccgtttatgggccttg

SEQ ID NO: 1158730 - DNA, 12 bp, Homo sapiens
tagcctctccca

SEQ ID NO: 1158731 - DNA, 14 bp, Homo sapiens
tagcctctcccacc

SEQ ID NO: 1158732 - DNA, 17 bp, Homo sapiens
tagcctcttccctctga

SEQ ID NO: 1158733 - DNA, 12 bp, Homo sapiens
tagcctgcctca

SEQ ID NO: 1158734 - DNA, 15 bp, Homo sapiens
tagcctgctgtgggg

SEQ ID NO: 1158735 - DNA, 14 bp, Homo sapiens
tagcctggatggcc

SEQ ID NO: 1158736 - DNA, 17 bp, Homo sapiens
tagcctggatggcccct

SEQ ID NO: 1158737 - DNA, 11 bp, Homo sapiens
tagcctggcta

SEQ ID NO: 1158738 - DNA, 14 bp, Homo sapiens
tagcctgggccaga

SEQ ID NO: 1158739 - DNA, 14 bp, Homo sapiens
ttcttttctggaaa

SEQ ID NO: 1158740 - DNA, 20 bp, Homo sapiens
ttcttttcttcactcaaatt

SEQ ID NO: 1158741 - DNA, 15 bp, Homo sapiens
ttcttttgattttgt

SEQ ID NO: 1158742 - DNA, 14 bp, Homo sapiens
ttcttttgtatgta

SEQ ID NO: 1158743 - DNA, 20 bp, Homo sapiens
ttcttttgtatgtaaatgtg

SEQ ID NO: 1158744 - DNA, 17 bp, Homo sapiens
ttcttttgtggtgtctt

SEQ ID NO: 1158745 - DNA, 21 bp, Homo sapiens
ttctttttaaagtttgttcac

SEQ ID NO: 1158746 - DNA, 16 bp, Homo sapiens
ttctttttaagagata

SEQ ID NO: 1158747 - DNA, 20 bp, Homo sapiens
ttctttttaattattttaaa

SEQ ID NO: 1158748 - DNA, 22 bp, Homo sapiens
ttctttttacagcattgtcttt

SEQ ID NO: 1158749 - DNA, 15 bp, Homo sapiens
ttctttttattgaat

SEQ ID NO: 1158750 - DNA, 15 bp, Homo sapiens
ttctttttattttct

SEQ ID NO: 1158751 - DNA, 16 bp, Homo sapiens
ttctttttctggactc

SEQ ID NO: 1158752 - DNA, 17 bp, Homo sapiens
ttcttttttaaaatcaa

SEQ ID NO: 1158753 - DNA, 14 bp, Homo sapiens
ttcttttttaaagt

SEQ ID NO: 1158754 - DNA, 14 bp, Homo sapiens
ttcttttttaagtt

SEQ ID NO: 1158755 - DNA, 14 bp, Homo sapiens
ttctttttttgtga

SEQ ID NO: 1158756 - DNA, 18 bp, Homo sapiens
ttcttttttttcattata

SEQ ID NO: 1158757 - DNA, 17 bp, Homo sapiens
ttctttttttttaagtt

SEQ ID NO: 1158758 - DNA, 20 bp, Homo sapiens
ttctttttttttaagttctt

SEQ ID NO: 1158759 - DNA, 23 bp, Homo sapiens
ttgaaaaaaaaaatgttgagaag

SEQ ID NO: 1158760 - DNA, 13 bp, Homo sapiens
ttgaaaaaaaata

SEQ ID NO: 1158761 - DNA, 21 bp, Homo sapiens
ttgaaaaaatttaaaagtaaa

SEQ ID NO: 1158762 - DNA, 20 bp, Homo sapiens
ttgaaaaagttccatagaaa

SEQ ID NO: 1158763 - DNA, 15 bp, Homo sapiens
ttgaaaaagtttgtt

SEQ ID NO: 1158764 - DNA, 22 bp, Homo sapiens
ttgaaaaatacgttttgtgtat

SEQ ID NO: 1158765 - DNA, 14 bp, Homo sapiens
ttgaaaaatattgc

SEQ ID NO: 1158766 - DNA, 13 bp, Homo sapiens
ttgaaaacaaaaa

SEQ ID NO: 1158767 - DNA, 16 bp, Homo sapiens
ttgaaaacctgacaaa

SEQ ID NO: 1158768 - DNA, 18 bp, Homo sapiens
ttgaaaacttcagaagca

SEQ ID NO: 1158769 - DNA, 15 bp, Homo sapiens
ttgaaaagcagacat

SEQ ID NO: 1158770 - DNA, 15 bp, Homo sapiens
ttgaaaagtcaaact

SEQ ID NO: 1158771 - DNA, 14 bp, Homo sapiens
ttgaaaatatttct

SEQ ID NO: 1158772 - DNA, 17 bp, Homo sapiens
ttgaaaatatttctatg

SEQ ID NO: 1158773 - DNA, 21 bp, Homo sapiens
ttgaaaatatttctatgtaaa

SEQ ID NO: 1158774 - DNA, 17 bp, Homo sapiens
ttgaaaatgtgtttgct

SEQ ID NO: 1158775 - DNA, 23 bp, Homo sapiens
ttgaaaattatgcaaaagcagct

SEQ ID NO: 1158776 - DNA, 20 bp, Homo sapiens
ttgaaaattcaaaaagtgtt

SEQ ID NO: 1158777 - DNA, 21 bp, Homo sapiens
ttgaaaattcaaaaagtgttt

SEQ ID NO: 1158778 - DNA, 16 bp, Homo sapiens
ttgaaaattgaaaagt

SEQ ID NO: 1158779 - DNA, 23 bp, Homo sapiens
ttgaaaattgtataccaatgtgt

SEQ ID NO: 1158780 - DNA, 18 bp, Homo sapiens
ttgaaaattttacttcca

SEQ ID NO: 1158781 - DNA, 14 bp, Homo sapiens
ttgaaacagttcca

SEQ ID NO: 1158782 - DNA, 14 bp, Homo sapiens
ttgaaacctgttaa

SEQ ID NO: 1158783 - DNA, 18 bp, Homo sapiens
ttgaaacgttatgatgac

SEQ ID NO: 1158784 - DNA, 16 bp, Homo sapiens
ttgaaactaaaataaa

SEQ ID NO: 1158785 - DNA, 20 bp, Homo sapiens
ttgaaactaaaataaattaa

SEQ ID NO: 1158786 - DNA, 19 bp, Homo sapiens
ttgaaactctctgttcaga

SEQ ID NO: 1158787 - DNA, 16 bp, Homo sapiens
ttgaaactgcatttgt

SEQ ID NO: 1158788 - DNA, 20 bp, Homo sapiens
ttgaaactgtaaatatgttt

SEQ ID NO: 1158789 - DNA, 13 bp, Homo sapiens
ttgaaagaagttt

SEQ ID NO: 1158790 - DNA, 14 bp, Homo sapiens
ttgaaagaatagaa

SEQ ID NO: 1158791 - DNA, 20 bp, Homo sapiens
ttgaaagattttattgtata

SEQ ID NO: 1158792 - DNA, 22 bp, Homo sapiens
ttgaaagattttattgtataaa

SEQ ID NO: 1158793 - DNA, 16 bp, Homo sapiens
ttgaaagcatccatgt

SEQ ID NO: 1158794 - DNA, 18 bp, Homo sapiens
ttgaaagctgaaaagcat

SEQ ID NO: 1158795 - DNA, 22 bp, Homo sapiens
ttgaaaggcaggaagggaagcg

SEQ ID NO: 1158796 - DNA, 21 bp, Homo sapiens
ttgaaaggggacacctgtaca

SEQ ID NO: 1158797 - DNA, 21 bp, Homo sapiens
ttgaaaggttttttttcagtt

SEQ ID NO: 1158798 - DNA, 22 bp, Homo sapiens
ttgaaagtaaaaacctgcttgg

SEQ ID NO: 1158799 - DNA, 16 bp, Homo sapiens
ttgaaagtagagctag

SEQ ID NO: 1158800 - DNA, 20 bp, Homo sapiens
ttgaaagtattcagaaatta

SEQ ID NO: 1158801 - DNA, 19 bp, Homo sapiens
ttgaaagtttaacaaatga

SEQ ID NO: 1158802 - DNA, 21 bp, Homo sapiens
ttgaaagttttccagtattga

SEQ ID NO: 1158803 - DNA, 14 bp, Homo sapiens
ttgaaataaagcta

SEQ ID NO: 1158804 - DNA, 21 bp, Homo sapiens
ttgaaataactggaacaaatt

SEQ ID NO: 1158805 - DNA, 16 bp, Homo sapiens
ttgaaataagaattca

SEQ ID NO: 1158806 - DNA, 14 bp, Homo sapiens
ttgaaatatataat

SEQ ID NO: 1158807 - DNA, 14 bp, Homo sapiens
ttgaaatatcatgt

SEQ ID NO: 1158808 - DNA, 15 bp, Homo sapiens
ttgaaatattaaaat

SEQ ID NO: 1158809 - DNA, 19 bp, Homo sapiens
ttgaaatcagcatgacaaa

SEQ ID NO: 1158810 - DNA, 13 bp, Homo sapiens
ttgaaatctttta

SEQ ID NO: 1158811 - DNA, 21 bp, Homo sapiens
ttgaaatgaaagtataactga

SEQ ID NO: 1158812 - DNA, 18 bp, Homo sapiens
ttgaaatgaggtctgttt

SEQ ID NO: 1158813 - DNA, 20 bp, Homo sapiens
ttgaaatgaggtctgtttaa

SEQ ID NO: 1158814 - DNA, 13 bp, Homo sapiens
ttgaaatgagtaa

SEQ ID NO: 1158815 - DNA, 18 bp, Homo sapiens
ttgaaatgtggttttcct

SEQ ID NO: 1158816 - DNA, 19 bp, Homo sapiens
ttgaaatgtggttttcctg

SEQ ID NO: 1158817 - DNA, 16 bp, Homo sapiens
ttgaaattactgtgta

SEQ ID NO: 1158818 - DNA, 21 bp, Homo sapiens
ttgaaattatgtatgtttaca

SEQ ID NO: 1158819 - DNA, 23 bp, Homo sapiens
ttgaaattatgtatgtttacata

SEQ ID NO: 1158820 - DNA, 17 bp, Homo sapiens
ttgaaattatgtgacat

SEQ ID NO: 1158821 - DNA, 20 bp, Homo sapiens
ttgaaattatgtgacatttt

SEQ ID NO: 1158822 - DNA, 21 bp, Homo sapiens
ttgaaattctatttataatac

SEQ ID NO: 1158823 - DNA, 19 bp, Homo sapiens
ttgaaattgtttaagtgtt

SEQ ID NO: 1158824 - DNA, 20 bp, Homo sapiens
ttgaacaagttgtttcattg

SEQ ID NO: 1158825 - DNA, 18 bp, Homo sapiens
ttgaacacaaactgtaaa

SEQ ID NO: 1158826 - DNA, 16 bp, Homo sapiens
ttgaacagctatcacg

SEQ ID NO: 1158827 - DNA, 21 bp, Homo sapiens
ttgaacatgtgccttttctga

SEQ ID NO: 1158828 - DNA, 14 bp, Homo sapiens
ttgaaccccctccc

SEQ ID NO: 1158829 - DNA, 20 bp, Homo sapiens
ttgaacctggatccagcact

SEQ ID NO: 1158830 - DNA, 12 bp, Homo sapiens
ttgaacctggga

SEQ ID NO: 1158831 - DNA, 20 bp, Homo sapiens
ttgaacctttttttttgaaa

SEQ ID NO: 1158832 - DNA, 21 bp, Homo sapiens
ttgaacgactgtatattgcta

SEQ ID NO: 1158833 - DNA, 19 bp, Homo sapiens
ttgaactatgactggagta

SEQ ID NO: 1158834 - DNA, 21 bp, Homo sapiens
ttgaactgaaacttttctaaa

SEQ ID NO: 1158835 - DNA, 23 bp, Homo sapiens
ttgaactgtattctagtggctgt

SEQ ID NO: 1158836 - DNA, 18 bp, Homo sapiens
ttgaactgttagatgctg

SEQ ID NO: 1158837 - DNA, 14 bp, Homo sapiens
ttgaacttagatgt

SEQ ID NO: 1158838 - DNA, 16 bp, Homo sapiens
ttgaacttgctctttt

SEQ ID NO: 1158839 - DNA, 17 bp, Homo sapiens
ttgaactttgacctctg

SEQ ID NO: 1158840 - DNA, 18 bp, Homo sapiens
ttgaactttgacctctgc

SEQ ID NO: 1158841 - DNA, 20 bp, Homo sapiens
ttgaacttttcattccctgt

SEQ ID NO: 1158842 - DNA, 22 bp, Homo sapiens
ttgaacttttcattccctgtag

SEQ ID NO: 1158843 - DNA, 15 bp, Homo sapiens
ttgaactttttttaa

SEQ ID NO: 1158844 - DNA, 16 bp, Homo sapiens
ttgaagaaaatgactt

SEQ ID NO: 1158845 - DNA, 18 bp, Homo sapiens
ttgaagaactgcactttt

SEQ ID NO: 1158846 - DNA, 20 bp, Homo sapiens
ttgaagaactgcaggccctg

SEQ ID NO: 1158847 - DNA, 20 bp, Homo sapiens
ttgaagaagaaccagcccag

SEQ ID NO: 1158848 - DNA, 23 bp, Homo sapiens
ttgaagaagaaccagcccagcct

SEQ ID NO: 1158849 - DNA, 17 bp, Homo sapiens
ttgaagaatctgcccct

SEQ ID NO: 1158850 - DNA, 18 bp, Homo sapiens
ttgaagaatctgcccctg

SEQ ID NO: 1158851 - DNA, 23 bp, Homo sapiens
ttgaagaatgttaagacttgaca

SEQ ID NO: 1158852 - DNA, 16 bp, Homo sapiens
ttgaagacacagcctc

SEQ ID NO: 1158853 - DNA, 22 bp, Homo sapiens
ttgaagacagagcaaagcgccc

SEQ ID NO: 1158854 - DNA, 15 bp, Homo sapiens
ttgaagacttcctct

SEQ ID NO: 1158855 - DNA, 22 bp, Homo sapiens
ttgaagcaataactccaagcag

SEQ ID NO: 1158856 - DNA, 11 bp, Homo sapiens
ttgaagcactt

SEQ ID NO: 1158857 - DNA, 23 bp, Homo sapiens
ttgaagcacttaagtcttcctta

SEQ ID NO: 1158858 - DNA, 14 bp, Homo sapiens
ttgaagccaaagaa

SEQ ID NO: 1158859 - DNA, 14 bp, Homo sapiens
ttgaagccatgtct

SEQ ID NO: 1158860 - DNA, 19 bp, Homo sapiens
ttgaagccgactctggccc

SEQ ID NO: 1158861 - DNA, 18 bp, Homo sapiens
ttgaagctgggctgtctc

SEQ ID NO: 1158862 - DNA, 14 bp, Homo sapiens
tagcctggggtggg

SEQ ID NO: 1158863 - DNA, 20 bp, Homo sapiens
tagccttaaatttttgtcat

SEQ ID NO: 1158864 - DNA, 17 bp, Homo sapiens
tagccttatcctctgat

SEQ ID NO: 1158865 - DNA, 18 bp, Homo sapiens
tagccttatcctctgatc

SEQ ID NO: 1158866 - DNA, 13 bp, Homo sapiens
tagccttcctcca

SEQ ID NO: 1158867 - DNA, 18 bp, Homo sapiens
tagccttcctccacatcc

SEQ ID NO: 1158868 - DNA, 15 bp, Homo sapiens
tagccttgtgccctg

SEQ ID NO: 1158869 - DNA, 17 bp, Homo sapiens
tagccttgtgccctgcc

SEQ ID NO: 1158870 - DNA, 18 bp, Homo sapiens
tagcctttacctgtgaag

SEQ ID NO: 1158871 - DNA, 22 bp, Homo sapiens
tagcctttacctgtgaagtgtt

SEQ ID NO: 1158872 - DNA, 13 bp, Homo sapiens
tagcctttcttgt

SEQ ID NO: 1158873 - DNA, 23 bp, Homo sapiens
tagcgaacgtatttctccagacc

SEQ ID NO: 1158874 - DNA, 17 bp, Homo sapiens
tagcgatctctcctggc

SEQ ID NO: 1158875 - DNA, 20 bp, Homo sapiens
tagcgatctctcctggccta

SEQ ID NO: 1158876 - DNA, 15 bp, Homo sapiens
tagcgctctcttcca

SEQ ID NO: 1158877 - DNA, 12 bp, Homo sapiens
tagcggctcctc

SEQ ID NO: 1158878 - DNA, 17 bp, Homo sapiens
tagcgtcaagacatttg

SEQ ID NO: 1158879 - DNA, 20 bp, Homo sapiens
tagcgtcaagacatttgctg

SEQ ID NO: 1158880 - DNA, 14 bp, Homo sapiens
tagcgtcctgagga

SEQ ID NO: 1158881 - DNA, 14 bp, Homo sapiens
tagcgtgtgtagat

SEQ ID NO: 1158882 - DNA, 22 bp, Homo sapiens
tagcgttctggactctgcccca

SEQ ID NO: 1158883 - DNA, 15 bp, Homo sapiens
tagcgttcttgtaat

SEQ ID NO: 1158884 - DNA, 17 bp, Homo sapiens
tagcgttcttgtaattt

SEQ ID NO: 1158885 - DNA, 18 bp, Homo sapiens
tagcgttttttaaatgta

SEQ ID NO: 1158886 - DNA, 19 bp, Homo sapiens
tagctaaacggattccaaa

SEQ ID NO: 1158887 - DNA, 22 bp, Homo sapiens
tagctaagtacacaataagcaa

SEQ ID NO: 1158888 - DNA, 20 bp, Homo sapiens
tagctaataaaaagcttttg

SEQ ID NO: 1158889 - DNA, 22 bp, Homo sapiens
tagctacaatttgtttttgcat

SEQ ID NO: 1158890 - DNA, 13 bp, Homo sapiens
tagctacactgag

SEQ ID NO: 1158891 - DNA, 15 bp, Homo sapiens
tagctacaggaagca

SEQ ID NO: 1158892 - DNA, 14 bp, Homo sapiens
tagctacatagcag

SEQ ID NO: 1158893 - DNA, 23 bp, Homo sapiens
tagctacctacatgctgaaaaat

SEQ ID NO: 1158894 - DNA, 19 bp, Homo sapiens
tagctacctttttatattt

SEQ ID NO: 1158895 - DNA, 19 bp, Homo sapiens
tagctagaagtgggccagg

SEQ ID NO: 1158896 - DNA, 15 bp, Homo sapiens
tagctaggtgacata

SEQ ID NO: 1158897 - DNA, 17 bp, Homo sapiens
tagctagtttgcttttt

SEQ ID NO: 1158898 - DNA, 17 bp, Homo sapiens
tagctatatccatgtac

SEQ ID NO: 1158899 - DNA, 18 bp, Homo sapiens
tagctatatccatgtact

SEQ ID NO: 1158900 - DNA, 19 bp, Homo sapiens
tagctatatccatgtactg

SEQ ID NO: 1158901 - DNA, 22 bp, Homo sapiens
tagctatatccatgtactgtag

SEQ ID NO: 1158902 - DNA, 21 bp, Homo sapiens
tagctatgctgtatctgtgct

SEQ ID NO: 1158903 - DNA, 21 bp, Homo sapiens
tagctattagcggctcctcgc

SEQ ID NO: 1158904 - DNA, 21 bp, Homo sapiens
tagctatttgtttacatgcag

SEQ ID NO: 1158905 - DNA, 15 bp, Homo sapiens
tagctattttccttg

SEQ ID NO: 1158906 - DNA, 20 bp, Homo sapiens
tagctcaagtttaaaagcca

SEQ ID NO: 1158907 - DNA, 21 bp, Homo sapiens
tagctcaagtttaaaagccat

SEQ ID NO: 1158908 - DNA, 21 bp, Homo sapiens
tagctcactgaatcttcacga

SEQ ID NO: 1158909 - DNA, 22 bp, Homo sapiens
tagctcaggacctgggacctcc

SEQ ID NO: 1158910 - DNA, 15 bp, Homo sapiens
tagctcaggtgcctt

SEQ ID NO: 1158911 - DNA, 11 bp, Homo sapiens
tagctcagttt

SEQ ID NO: 1158912 - DNA, 21 bp, Homo sapiens
tagctccctgtggggcaggag

SEQ ID NO: 1158913 - DNA, 21 bp, Homo sapiens
tagctcctgccacatggagcc

SEQ ID NO: 1158914 - DNA, 16 bp, Homo sapiens
tagctcctgtggcccc

SEQ ID NO: 1158915 - DNA, 14 bp, Homo sapiens
tagctccttggagc

SEQ ID NO: 1158916 - DNA, 19 bp, Homo sapiens
tagctccttggagcaggca

SEQ ID NO: 1158917 - DNA, 17 bp, Homo sapiens
tagctctattttaaagt

SEQ ID NO: 1158918 - DNA, 14 bp, Homo sapiens
tagctctcccagtg

SEQ ID NO: 1158919 - DNA, 14 bp, Homo sapiens
tagctctccttccc

SEQ ID NO: 1158920 - DNA, 13 bp, Homo sapiens
tagctctctaggc

SEQ ID NO: 1158921 - DNA, 21 bp, Homo sapiens
tagctctggaggtgctgctct

SEQ ID NO: 1158922 - DNA, 13 bp, Homo sapiens
tagctctttcctt

SEQ ID NO: 1158923 - DNA, 12 bp, Homo sapiens
tagctctttctc

SEQ ID NO: 1158924 - DNA, 23 bp, Homo sapiens
tagctcttttttgtttgtttctt

SEQ ID NO: 1158925 - DNA, 14 bp, Homo sapiens
tagctgaaaactaa

SEQ ID NO: 1158926 - DNA, 22 bp, Homo sapiens
tagctgaaaactaatgtactgt

SEQ ID NO: 1158927 - DNA, 17 bp, Homo sapiens
tagctgaaaagggcact

SEQ ID NO: 1158928 - DNA, 23 bp, Homo sapiens
tagctgaaaagggcactcccaac

SEQ ID NO: 1158929 - DNA, 21 bp, Homo sapiens
tagctgacccagccccttgag

SEQ ID NO: 1158930 - DNA, 11 bp, Homo sapiens
tagctgaggga

SEQ ID NO: 1158931 - DNA, 13 bp, Homo sapiens
tagctgaggggac

SEQ ID NO: 1158932 - DNA, 11 bp, Homo sapiens
tagctgcagaa

SEQ ID NO: 1158933 - DNA, 12 bp, Homo sapiens
tagctgccactt

SEQ ID NO: 1158934 - DNA, 16 bp, Homo sapiens
tagctgccagtgctgg

SEQ ID NO: 1158935 - DNA, 22 bp, Homo sapiens
tagctgctctgagcatcaagaa

SEQ ID NO: 1158936 - DNA, 23 bp, Homo sapiens
tagctggagatctgaacccagct

SEQ ID NO: 1158937 - DNA, 11 bp, Homo sapiens
tagctggcagg

SEQ ID NO: 1158938 - DNA, 16 bp, Homo sapiens
tagctgggaaagcata

SEQ ID NO: 1158939 - DNA, 15 bp, Homo sapiens
tagctgggattacag

SEQ ID NO: 1158940 - DNA, 15 bp, Homo sapiens
tagctgggcctgtgc

SEQ ID NO: 1158941 - DNA, 17 bp, Homo sapiens
tagctgggcctgtgcac

SEQ ID NO: 1158942 - DNA, 21 bp, Homo sapiens
tagctgggcctgtgcactggg

SEQ ID NO: 1158943 - DNA, 12 bp, Homo sapiens
tagctggggctt

SEQ ID NO: 1158944 - DNA, 20 bp, Homo sapiens
tagctgggggtgggccaggc

SEQ ID NO: 1158945 - DNA, 21 bp, Homo sapiens
tagctggtgtcagcccctctt

SEQ ID NO: 1158946 - DNA, 23 bp, Homo sapiens
tagctgtaagggcagtgcccatg

SEQ ID NO: 1158947 - DNA, 12 bp, Homo sapiens
tagctgtacaaa

SEQ ID NO: 1158948 - DNA, 21 bp, Homo sapiens
tagctgtagttttccctgcac

SEQ ID NO: 1158949 - DNA, 17 bp, Homo sapiens
tagctgtctagagtagc

SEQ ID NO: 1158950 - DNA, 14 bp, Homo sapiens
tagctgtctgtgaa

SEQ ID NO: 1158951 - DNA, 10 bp, Homo sapiens
tagctgtggg

SEQ ID NO: 1158952 - DNA, 14 bp, Homo sapiens
tagctgtgggggtg

SEQ ID NO: 1158953 - DNA, 14 bp, Homo sapiens
tagctgtggtgagg

SEQ ID NO: 1158954 - DNA, 14 bp, Homo sapiens
tagctgtgtgaaat

SEQ ID NO: 1158955 - DNA, 13 bp, Homo sapiens
tagctgttgagct

SEQ ID NO: 1158956 - DNA, 17 bp, Homo sapiens
tagctgttgagctgttt

SEQ ID NO: 1158957 - DNA, 18 bp, Homo sapiens
tagctgtttcaaatgtgc

SEQ ID NO: 1158958 - DNA, 14 bp, Homo sapiens
tagcttacactgag

SEQ ID NO: 1158959 - DNA, 15 bp, Homo sapiens
tagcttacactgagg

SEQ ID NO: 1158960 - DNA, 16 bp, Homo sapiens
tagcttaccagaagct

SEQ ID NO: 1158961 - DNA, 14 bp, Homo sapiens
tagcttactgatga

SEQ ID NO: 1158962 - DNA, 15 bp, Homo sapiens
tagcttagacctcag

SEQ ID NO: 1158963 - DNA, 19 bp, Homo sapiens
tagcttagacctcagcctg

SEQ ID NO: 1158964 - DNA, 23 bp, Homo sapiens
tagcttagacctcagcctgtgct

SEQ ID NO: 1158965 - DNA, 19 bp, Homo sapiens
tagcttatctacttccaaa

SEQ ID NO: 1158966 - DNA, 22 bp, Homo sapiens
tagcttatctacttccaaacta

SEQ ID NO: 1158967 - DNA, 17 bp, Homo sapiens
tagcttatctttctttc

SEQ ID NO: 1158968 - DNA, 18 bp, Homo sapiens
tagcttatctttctttcc

SEQ ID NO: 1158969 - DNA, 16 bp, Homo sapiens
tagcttcagttgttct

SEQ ID NO: 1158970 - DNA, 16 bp, Homo sapiens
tagcttccaataaagc

SEQ ID NO: 1158971 - DNA, 13 bp, Homo sapiens
tagcttcctccag

SEQ ID NO: 1158972 - DNA, 16 bp, Homo sapiens
tagcttcctccagagg

SEQ ID NO: 1158973 - DNA, 20 bp, Homo sapiens
tagcttctcttctttctgaa

SEQ ID NO: 1158974 - DNA, 13 bp, Homo sapiens
tagcttctgcttt

SEQ ID NO: 1158975 - DNA, 16 bp, Homo sapiens
tagcttgcaccttgtc

SEQ ID NO: 1158976 - DNA, 17 bp, Homo sapiens
tagcttgtttctgtcaa

SEQ ID NO: 1158977 - DNA, 19 bp, Homo sapiens
tagctttaaaaccacagct

SEQ ID NO: 1158978 - DNA, 15 bp, Homo sapiens
tagctttaccctcag

SEQ ID NO: 1158979 - DNA, 16 bp, Homo sapiens
tagctttactgtttct

SEQ ID NO: 1158980 - DNA, 17 bp, Homo sapiens
tagctttagaccctggg

SEQ ID NO: 1158981 - DNA, 18 bp, Homo sapiens
tagctttatatatggaca

SEQ ID NO: 1158982 - DNA, 19 bp, Homo sapiens
tagctttatatatggacat

SEQ ID NO: 1158983 - DNA, 15 bp, Homo sapiens
tagctttattcttca

SEQ ID NO: 1158984 - DNA, 18 bp, Homo sapiens
tagctttattttttaagt

SEQ ID NO: 1158985 - DNA, 19 bp, Homo sapiens
tagctttcccaaataaact

SEQ ID NO: 1158986 - DNA, 18 bp, Homo sapiens
tagctttgtgtttacttt

SEQ ID NO: 1158987 - DNA, 19 bp, Homo sapiens
ttgaagctgggctgtctct

SEQ ID NO: 1158988 - DNA, 13 bp, Homo sapiens
ttgaaggaaacag

SEQ ID NO: 1158989 - DNA, 22 bp, Homo sapiens
ttgaaggaaatgagtggccagc

SEQ ID NO: 1158990 - DNA, 19 bp, Homo sapiens
ttgaaggacctaaattcgt

SEQ ID NO: 1158991 - DNA, 21 bp, Homo sapiens
ttgaaggactaatagaaaagt

SEQ ID NO: 1158992 - DNA, 12 bp, Homo sapiens
ttgaaggattgc

SEQ ID NO: 1158993 - DNA, 12 bp, Homo sapiens
ttgaaggcaaaa

SEQ ID NO: 1158994 - DNA, 15 bp, Homo sapiens
ttgaaggcaaaattg

SEQ ID NO: 1158995 - DNA, 16 bp, Homo sapiens
ttgaaggcagtctgaa

SEQ ID NO: 1158996 - DNA, 11 bp, Homo sapiens
ttgaaggctta

SEQ ID NO: 1158997 - DNA, 20 bp, Homo sapiens
ttgaagggaggggctgtgtt

SEQ ID NO: 1158998 - DNA, 16 bp, Homo sapiens
ttgaagggcaagaaat

SEQ ID NO: 1158999 - DNA, 19 bp, Homo sapiens
ttgaagggtaaagaagttt

SEQ ID NO: 1159000 - DNA, 22 bp, Homo sapiens
ttgaaggtgataagggaaaaga

SEQ ID NO: 1159001 - DNA, 18 bp, Homo sapiens
ttgaaggtttcagatgag

SEQ ID NO: 1159002 - DNA, 15 bp, Homo sapiens
ttgaagtaaactttt

SEQ ID NO: 1159003 - DNA, 16 bp, Homo sapiens
ttgaagtaaacttttt

SEQ ID NO: 1159004 - DNA, 18 bp, Homo sapiens
ttgaagtaatcccgccac

SEQ ID NO: 1159005 - DNA, 23 bp, Homo sapiens
ttgaagtaggtggcttgagctag

SEQ ID NO: 1159006 - DNA, 17 bp, Homo sapiens
ttgaagtatattcttat

SEQ ID NO: 1159007 - DNA, 12 bp, Homo sapiens
ttgaagtcagcc

SEQ ID NO: 1159008 - DNA, 19 bp, Homo sapiens
ttgaagtctataaaaaata

SEQ ID NO: 1159009 - DNA, 19 bp, Homo sapiens
ttgaagtgtaggcagacac

SEQ ID NO: 1159010 - DNA, 13 bp, Homo sapiens
ttgaagtgtcttc

SEQ ID NO: 1159011 - DNA, 19 bp, Homo sapiens
ttgaagttagctttaactt

SEQ ID NO: 1159012 - DNA, 22 bp, Homo sapiens
ttgaagttagtggaaatctgaa

SEQ ID NO: 1159013 - DNA, 19 bp, Homo sapiens
ttgaagttgggtgtttcca

SEQ ID NO: 1159014 - DNA, 19 bp, Homo sapiens
ttgaagttgttactaacta

SEQ ID NO: 1159015 - DNA, 13 bp, Homo sapiens
ttgaataaaaagt

SEQ ID NO: 1159016 - DNA, 16 bp, Homo sapiens
ttgaataaaaatgcac

SEQ ID NO: 1159017 - DNA, 14 bp, Homo sapiens
ttgaataaaagtgc

SEQ ID NO: 1159018 - DNA, 12 bp, Homo sapiens
ttgaataaacta

SEQ ID NO: 1159019 - DNA, 16 bp, Homo sapiens
ttgaataaatgagaaa

SEQ ID NO: 1159020 - DNA, 22 bp, Homo sapiens
ttgaataaattttcaaatcctt

SEQ ID NO: 1159021 - DNA, 15 bp, Homo sapiens
ttgaataatgacaga

SEQ ID NO: 1159022 - DNA, 18 bp, Homo sapiens
ttgaatactctgccctct

SEQ ID NO: 1159023 - DNA, 13 bp, Homo sapiens
ttgaatataaaaa

SEQ ID NO: 1159024 - DNA, 18 bp, Homo sapiens
ttgaatattttttgaagg

SEQ ID NO: 1159025 - DNA, 15 bp, Homo sapiens
ttgaatcacatgaat

SEQ ID NO: 1159026 - DNA, 18 bp, Homo sapiens
ttgaatcagtttccaatt

SEQ ID NO: 1159027 - DNA, 21 bp, Homo sapiens
ttgaatcagtttccaattatt

SEQ ID NO: 1159028 - DNA, 19 bp, Homo sapiens
ttgaatccatgcttgggtg

SEQ ID NO: 1159029 - DNA, 22 bp, Homo sapiens
ttgaatgaaaaatttaagcatt

SEQ ID NO: 1159030 - DNA, 21 bp, Homo sapiens
ttgaatgatttttctttacaa

SEQ ID NO: 1159031 - DNA, 15 bp, Homo sapiens
ttgaatgcaaaccat

SEQ ID NO: 1159032 - DNA, 23 bp, Homo sapiens
ttgaatgctgccagtgtggagtg

SEQ ID NO: 1159033 - DNA, 16 bp, Homo sapiens
ttgaatgcttcctgac

SEQ ID NO: 1159034 - DNA, 16 bp, Homo sapiens
ttgaatggctatgttt

SEQ ID NO: 1159035 - DNA, 20 bp, Homo sapiens
ttgaatggctatgtttttaa

SEQ ID NO: 1159036 - DNA, 16 bp, Homo sapiens
ttgaatggtgttgtat

SEQ ID NO: 1159037 - DNA, 16 bp, Homo sapiens
ttgaatgtaaaacagg

SEQ ID NO: 1159038 - DNA, 12 bp, Homo sapiens
ttgaatgtcaca

SEQ ID NO: 1159039 - DNA, 19 bp, Homo sapiens
ttgaatgtcacaaattgat

SEQ ID NO: 1159040 - DNA, 23 bp, Homo sapiens
ttgaatgtcacaaattgatcaag

SEQ ID NO: 1159041 - DNA, 19 bp, Homo sapiens
ttgaatgtgagtgtgtatg

SEQ ID NO: 1159042 - DNA, 21 bp, Homo sapiens
ttgaatgtggcttgagaaata

SEQ ID NO: 1159043 - DNA, 13 bp, Homo sapiens
ttgaatgtgtcag

SEQ ID NO: 1159044 - DNA, 16 bp, Homo sapiens
ttgaatgttaagaatt

SEQ ID NO: 1159045 - DNA, 22 bp, Homo sapiens
ttgaattaaattaggaataaat

SEQ ID NO: 1159046 - DNA, 23 bp, Homo sapiens
ttgaattaatatccctacatgta

SEQ ID NO: 1159047 - DNA, 20 bp, Homo sapiens
ttgaattatcagcaaagaaa

SEQ ID NO: 1159048 - DNA, 18 bp, Homo sapiens
ttgaattatcttggttga

SEQ ID NO: 1159049 - DNA, 15 bp, Homo sapiens
ttgaattctggaaac

SEQ ID NO: 1159050 - DNA, 20 bp, Homo sapiens
ttgaattgaggggattaata

SEQ ID NO: 1159051 - DNA, 18 bp, Homo sapiens
ttgaattgtaactgttct

SEQ ID NO: 1159052 - DNA, 15 bp, Homo sapiens
ttgaatttaaataaa

SEQ ID NO: 1159053 - DNA, 17 bp, Homo sapiens
ttgaatttaaataaagt

SEQ ID NO: 1159054 - DNA, 23 bp, Homo sapiens
ttgaatttgcacggtttgtgaga

SEQ ID NO: 1159055 - DNA, 19 bp, Homo sapiens
ttgaatttgtattaaaaag

SEQ ID NO: 1159056 - DNA, 16 bp, Homo sapiens
ttgaattttaaatcta

SEQ ID NO: 1159057 - DNA, 22 bp, Homo sapiens
ttgaattttgttctctgggaga

SEQ ID NO: 1159058 - DNA, 16 bp, Homo sapiens
ttgaatttttcctatg

SEQ ID NO: 1159059 - DNA, 17 bp, Homo sapiens
ttgaattttttgaaatg

SEQ ID NO: 1159060 - DNA, 20 bp, Homo sapiens
ttgaattttttgaaatgggc

SEQ ID NO: 1159061 - DNA, 15 bp, Homo sapiens
ttgacaaaagtaaat

SEQ ID NO: 1159062 - DNA, 12 bp, Homo sapiens
ttgacaaaattt

SEQ ID NO: 1159063 - DNA, 17 bp, Homo sapiens
ttgacaaaattttctca

SEQ ID NO: 1159064 - DNA, 15 bp, Homo sapiens
ttgacaacagactga

SEQ ID NO: 1159065 - DNA, 14 bp, Homo sapiens
ttgacaacctagaa

SEQ ID NO: 1159066 - DNA, 14 bp, Homo sapiens
ttgacaagctgact

SEQ ID NO: 1159067 - DNA, 14 bp, Homo sapiens
ttgacaaggaaaat

SEQ ID NO: 1159068 - DNA, 13 bp, Homo sapiens
ttgacaataaaat

SEQ ID NO: 1159069 - DNA, 19 bp, Homo sapiens
ttgacaataaaatattatt

SEQ ID NO: 1159070 - DNA, 16 bp, Homo sapiens
ttgacaatcaaagaaa

SEQ ID NO: 1159071 - DNA, 15 bp, Homo sapiens
ttgacaattcctaga

SEQ ID NO: 1159072 - DNA, 14 bp, Homo sapiens
ttgacacaagtgga

SEQ ID NO: 1159073 - DNA, 19 bp, Homo sapiens
ttgacacaggtctttccta

SEQ ID NO: 1159074 - DNA, 11 bp, Homo sapiens
ttgacacatag

SEQ ID NO: 1159075 - DNA, 19 bp, Homo sapiens
ttgacacatatgaacacag

SEQ ID NO: 1159076 - DNA, 12 bp, Homo sapiens
ttgacacctgct

SEQ ID NO: 1159077 - DNA, 14 bp, Homo sapiens
ttgacaccttagag

SEQ ID NO: 1159078 - DNA, 17 bp, Homo sapiens
ttgacactaagaaaata

SEQ ID NO: 1159079 - DNA, 11 bp, Homo sapiens
ttgacactgaa

SEQ ID NO: 1159080 - DNA, 21 bp, Homo sapiens
ttgacactgaaagttttgtaa

SEQ ID NO: 1159081 - DNA, 15 bp, Homo sapiens
ttgacactgaaataa

SEQ ID NO: 1159082 - DNA, 16 bp, Homo sapiens
ttgacactgctctaac

SEQ ID NO: 1159083 - DNA, 16 bp, Homo sapiens
ttgacactgttttcct

SEQ ID NO: 1159084 - DNA, 16 bp, Homo sapiens
ttgacagcaaaatgtt

SEQ ID NO: 1159085 - DNA, 18 bp, Homo sapiens
ttgacaggtacttggagg

SEQ ID NO: 1159086 - DNA, 14 bp, Homo sapiens
ttgacagtatattt

SEQ ID NO: 1159087 - DNA, 15 bp, Homo sapiens
ttgacagtatatttg

SEQ ID NO: 1159088 - DNA, 14 bp, Homo sapiens
ttgacagtgttttt

SEQ ID NO: 1159089 - DNA, 17 bp, Homo sapiens
ttgacagttctgaagaa

SEQ ID NO: 1159090 - DNA, 15 bp, Homo sapiens
ttgacataaagttga

SEQ ID NO: 1159091 - DNA, 20 bp, Homo sapiens
ttgacatacctaccagtatt

SEQ ID NO: 1159092 - DNA, 16 bp, Homo sapiens
ttgacatatttaatgt

SEQ ID NO: 1159093 - DNA, 20 bp, Homo sapiens
ttgacatgaccctctgtccc

SEQ ID NO: 1159094 - DNA, 15 bp, Homo sapiens
ttgacatgggtgggg

SEQ ID NO: 1159095 - DNA, 16 bp, Homo sapiens
ttgacattctgaatgc

SEQ ID NO: 1159096 - DNA, 23 bp, Homo sapiens
ttgacattgaaatctaggaaaat

SEQ ID NO: 1159097 - DNA, 17 bp, Homo sapiens
ttgacatttacaggagg

SEQ ID NO: 1159098 - DNA, 15 bp, Homo sapiens
ttgacatttgtagtt

SEQ ID NO: 1159099 - DNA, 23 bp, Homo sapiens
ttgacattttctttttaaatttt

SEQ ID NO: 1159100 - DNA, 17 bp, Homo sapiens
ttgaccaagaactgcat

SEQ ID NO: 1159101 - DNA, 18 bp, Homo sapiens
ttgaccactccagagaag

SEQ ID NO: 1159102 - DNA, 18 bp, Homo sapiens
ttgaccagataaatagaa

SEQ ID NO: 1159103 - DNA, 15 bp, Homo sapiens
ttgaccagatctttc

SEQ ID NO: 1159104 - DNA, 19 bp, Homo sapiens
ttgaccccagtttcttctt

SEQ ID NO: 1159105 - DNA, 16 bp, Homo sapiens
ttgacccttgctgtga

SEQ ID NO: 1159106 - DNA, 18 bp, Homo sapiens
ttgacccttttttgaacc

SEQ ID NO: 1159107 - DNA, 20 bp, Homo sapiens
ttgaccgcgactaatttcaa

SEQ ID NO: 1159108 - DNA, 22 bp, Homo sapiens
ttgaccgtactctcacatgtgg

SEQ ID NO: 1159109 - DNA, 21 bp, Homo sapiens
ttgaccgttttcatcctggcc

SEQ ID NO: 1159110 - DNA, 22 bp, Homo sapiens
ttgaccgtttttatattacttt

SEQ ID NO: 1159111 - DNA, 14 bp, Homo sapiens
ttgacctctgcagc

SEQ ID NO: 1159112 - DNA, 18 bp, Homo sapiens
tagcttttaaaaaatatt

SEQ ID NO: 1159113 - DNA, 19 bp, Homo sapiens
tagcttttaaaaaatattt

SEQ ID NO: 1159114 - DNA, 14 bp, Homo sapiens
tagcttttccttcc

SEQ ID NO: 1159115 - DNA, 11 bp, Homo sapiens
tagcttttcta

SEQ ID NO: 1159116 - DNA, 22 bp, Homo sapiens
taggaaaaaattgaaagaactt

SEQ ID NO: 1159117 - DNA, 21 bp, Homo sapiens
taggaaaatcactttgtctaa

SEQ ID NO: 1159118 - DNA, 12 bp, Homo sapiens
taggaaaatgag

SEQ ID NO: 1159119 - DNA, 22 bp, Homo sapiens
taggaaaccccccaatgtctgt

SEQ ID NO: 1159120 - DNA, 16 bp, Homo sapiens
taggaaataaaacctt

SEQ ID NO: 1159121 - DNA, 20 bp, Homo sapiens
taggaaataaaacctttcaa

SEQ ID NO: 1159122 - DNA, 16 bp, Homo sapiens
taggaacatatgaaaa

SEQ ID NO: 1159123 - DNA, 14 bp, Homo sapiens
taggaacttcagag

SEQ ID NO: 1159124 - DNA, 12 bp, Homo sapiens
taggaagaaaga

SEQ ID NO: 1159125 - DNA, 16 bp, Homo sapiens
taggaagaaagatttg

SEQ ID NO: 1159126 - DNA, 14 bp, Homo sapiens
taggaagacataaa

SEQ ID NO: 1159127 - DNA, 17 bp, Homo sapiens
taggaagacataaaact

SEQ ID NO: 1159128 - DNA, 22 bp, Homo sapiens
taggaagacataaaactttaaa

SEQ ID NO: 1159129 - DNA, 21 bp, Homo sapiens
taggaagagcccgcagggcca

SEQ ID NO: 1159130 - DNA, 12 bp, Homo sapiens
taggaaggaaac

SEQ ID NO: 1159131 - DNA, 18 bp, Homo sapiens
taggaagggaccaaggca

SEQ ID NO: 1159132 - DNA, 17 bp, Homo sapiens
taggaagggatctgaga

SEQ ID NO: 1159133 - DNA, 18 bp, Homo sapiens
taggaagtggcagttctt

SEQ ID NO: 1159134 - DNA, 14 bp, Homo sapiens
taggaagtggctgg

SEQ ID NO: 1159135 - DNA, 17 bp, Homo sapiens
taggaagtgtaacagct

SEQ ID NO: 1159136 - DNA, 21 bp, Homo sapiens
taggaagtgtaacagctgagg

SEQ ID NO: 1159137 - DNA, 16 bp, Homo sapiens
taggaatagaggaaga

SEQ ID NO: 1159138 - DNA, 18 bp, Homo sapiens
taggaatagaggaagaaa

SEQ ID NO: 1159139 - DNA, 20 bp, Homo sapiens
taggaatcccagaggtggga

SEQ ID NO: 1159140 - DNA, 21 bp, Homo sapiens
taggaatcccagaggtgggat

SEQ ID NO: 1159141 - DNA, 22 bp, Homo sapiens
taggaatcctttgagaatgtga

SEQ ID NO: 1159142 - DNA, 16 bp, Homo sapiens
taggaatctcttcact

SEQ ID NO: 1159143 - DNA, 17 bp, Homo sapiens
taggaatctgccttcca

SEQ ID NO: 1159144 - DNA, 14 bp, Homo sapiens
taggaattcaattt

SEQ ID NO: 1159145 - DNA, 20 bp, Homo sapiens
taggaattcaatttggcaaa

SEQ ID NO: 1159146 - DNA, 17 bp, Homo sapiens
taggaattctttgcatt

SEQ ID NO: 1159147 - DNA, 19 bp, Homo sapiens
taggaattctttgcattcc

SEQ ID NO: 1159148 - DNA, 19 bp, Homo sapiens
taggaattcttttggggaa

SEQ ID NO: 1159149 - DNA, 19 bp, Homo sapiens
taggacacagttcctggga

SEQ ID NO: 1159150 - DNA, 20 bp, Homo sapiens
taggacataaattagaggtc

SEQ ID NO: 1159151 - DNA, 14 bp, Homo sapiens
taggacatcttaaa

SEQ ID NO: 1159152 - DNA, 14 bp, Homo sapiens
taggaccaagaaag

SEQ ID NO: 1159153 - DNA, 22 bp, Homo sapiens
taggaccaagcatcttgggggg

SEQ ID NO: 1159154 - DNA, 18 bp, Homo sapiens
taggacgccaacttctcc

SEQ ID NO: 1159155 - DNA, 14 bp, Homo sapiens
taggactaccgcag

SEQ ID NO: 1159156 - DNA, 20 bp, Homo sapiens
taggactccatttctttctt

SEQ ID NO: 1159157 - DNA, 13 bp, Homo sapiens
taggactgaggag

SEQ ID NO: 1159158 - DNA, 22 bp, Homo sapiens
taggagacagatcactcctgga

SEQ ID NO: 1159159 - DNA, 23 bp, Homo sapiens
taggagacagatcactcctggag

SEQ ID NO: 1159160 - DNA, 14 bp, Homo sapiens
taggagaccaaggc

SEQ ID NO: 1159161 - DNA, 21 bp, Homo sapiens
taggagaccaaggcgggagca

SEQ ID NO: 1159162 - DNA, 12 bp, Homo sapiens
taggagactgcg

SEQ ID NO: 1159163 - DNA, 14 bp, Homo sapiens
taggagagaccgag

SEQ ID NO: 1159164 - DNA, 14 bp, Homo sapiens
taggagagcactgc

SEQ ID NO: 1159165 - DNA, 16 bp, Homo sapiens
taggagagccaacctc

SEQ ID NO: 1159166 - DNA, 13 bp, Homo sapiens
taggagaggagaa

SEQ ID NO: 1159167 - DNA, 17 bp, Homo sapiens
taggagaggagaaccag

SEQ ID NO: 1159168 - DNA, 15 bp, Homo sapiens
taggagcccttctct

SEQ ID NO: 1159169 - DNA, 23 bp, Homo sapiens
taggagctcccctgtttgcatga

SEQ ID NO: 1159170 - DNA, 22 bp, Homo sapiens
taggaggaaaacacagcctccc

SEQ ID NO: 1159171 - DNA, 22 bp, Homo sapiens
taggaggaaacagttctcactg

SEQ ID NO: 1159172 - DNA, 20 bp, Homo sapiens
taggaggaccagagctactg

SEQ ID NO: 1159173 - DNA, 20 bp, Homo sapiens
taggaggctgcatgctctgg

SEQ ID NO: 1159174 - DNA, 16 bp, Homo sapiens
taggagggaaaccttt

SEQ ID NO: 1159175 - DNA, 14 bp, Homo sapiens
taggagggagactg

SEQ ID NO: 1159176 - DNA, 19 bp, Homo sapiens
taggagggagactgtggta

SEQ ID NO: 1159177 - DNA, 16 bp, Homo sapiens
taggagggagttatct

SEQ ID NO: 1159178 - DNA, 21 bp, Homo sapiens
taggagggagttatctaaaag

SEQ ID NO: 1159179 - DNA, 23 bp, Homo sapiens
taggagggggcggcagggctggg

SEQ ID NO: 1159180 - DNA, 17 bp, Homo sapiens
taggagtgagtgtatgt

SEQ ID NO: 1159181 - DNA, 18 bp, Homo sapiens
taggagtgtgtgacattc

SEQ ID NO: 1159182 - DNA, 20 bp, Homo sapiens
taggagtgtgtgacattcca

SEQ ID NO: 1159183 - DNA, 17 bp, Homo sapiens
taggagtgtgtgatttt

SEQ ID NO: 1159184 - DNA, 17 bp, Homo sapiens
taggagttcgagaccag

SEQ ID NO: 1159185 - DNA, 21 bp, Homo sapiens
taggagttcgagaccagcctg

SEQ ID NO: 1159186 - DNA, 13 bp, Homo sapiens
taggagttctctg

SEQ ID NO: 1159187 - DNA, 20 bp, Homo sapiens
taggagttctctgatgcaga

SEQ ID NO: 1159188 - DNA, 21 bp, Homo sapiens
taggagttctctgatgcagaa

SEQ ID NO: 1159189 - DNA, 21 bp, Homo sapiens
taggagttttgttccagagga

SEQ ID NO: 1159190 - DNA, 20 bp, Homo sapiens
taggataaaaagccagggct

SEQ ID NO: 1159191 - DNA, 22 bp, Homo sapiens
taggataaaaagccagggctgg

SEQ ID NO: 1159192 - DNA, 15 bp, Homo sapiens
taggatacaatgtat

SEQ ID NO: 1159193 - DNA, 18 bp, Homo sapiens
taggatagacactggaca

SEQ ID NO: 1159194 - DNA, 13 bp, Homo sapiens
taggatagcattt

SEQ ID NO: 1159195 - DNA, 19 bp, Homo sapiens
taggatagctaactgtaaa

SEQ ID NO: 1159196 - DNA, 19 bp, Homo sapiens
taggatatgtatattttaa

SEQ ID NO: 1159197 - DNA, 20 bp, Homo sapiens
taggatattgatttaaaatt

SEQ ID NO: 1159198 - DNA, 19 bp, Homo sapiens
taggatcagccctcatttt

SEQ ID NO: 1159199 - DNA, 20 bp, Homo sapiens
taggatcatttgttggaatg

SEQ ID NO: 1159200 - DNA, 13 bp, Homo sapiens
taggatcctggag

SEQ ID NO: 1159201 - DNA, 17 bp, Homo sapiens
taggatcctggaggctg

SEQ ID NO: 1159202 - DNA, 18 bp, Homo sapiens
taggatctgcaaacaatg

SEQ ID NO: 1159203 - DNA, 16 bp, Homo sapiens
taggatgactgctgtg

SEQ ID NO: 1159204 - DNA, 20 bp, Homo sapiens
taggatgcggctttctctgc

SEQ ID NO: 1159205 - DNA, 17 bp, Homo sapiens
taggatggggctcccag

SEQ ID NO: 1159206 - DNA, 18 bp, Homo sapiens
taggatggggctcccagc

SEQ ID NO: 1159207 - DNA, 21 bp, Homo sapiens
taggatgttgcttctgaatca

SEQ ID NO: 1159208 - DNA, 13 bp, Homo sapiens
taggattaaacac

SEQ ID NO: 1159209 - DNA, 18 bp, Homo sapiens
taggattccccctgccct

SEQ ID NO: 1159210 - DNA, 21 bp, Homo sapiens
taggattcccctcaatgcagt

SEQ ID NO: 1159211 - DNA, 14 bp, Homo sapiens
taggattgctgggg

SEQ ID NO: 1159212 - DNA, 12 bp, Homo sapiens
taggattgctgt

SEQ ID NO: 1159213 - DNA, 19 bp, Homo sapiens
taggattgcttcaattaaa

SEQ ID NO: 1159214 - DNA, 22 bp, Homo sapiens
taggatttaacagtcatttaaa

SEQ ID NO: 1159215 - DNA, 17 bp, Homo sapiens
taggatttatttaaaat

SEQ ID NO: 1159216 - DNA, 21 bp, Homo sapiens
taggatttatttaaaatagca

SEQ ID NO: 1159217 - DNA, 23 bp, Homo sapiens
taggattttaacttaactgaaat

SEQ ID NO: 1159218 - DNA, 13 bp, Homo sapiens
taggcaaagcaat

SEQ ID NO: 1159219 - DNA, 18 bp, Homo sapiens
taggcaaagtacaaaatt

SEQ ID NO: 1159220 - DNA, 20 bp, Homo sapiens
taggcaaagtacaaaattgc

SEQ ID NO: 1159221 - DNA, 19 bp, Homo sapiens
taggcaaggctatgtgatt

SEQ ID NO: 1159222 - DNA, 16 bp, Homo sapiens
taggcacgaagcaatt

SEQ ID NO: 1159223 - DNA, 14 bp, Homo sapiens
taggcactgaggga

SEQ ID NO: 1159224 - DNA, 16 bp, Homo sapiens
taggcactttaaaaca

SEQ ID NO: 1159225 - DNA, 21 bp, Homo sapiens
taggcacttttattttcattg

SEQ ID NO: 1159226 - DNA, 13 bp, Homo sapiens
taggcagaatgga

SEQ ID NO: 1159227 - DNA, 22 bp, Homo sapiens
taggcagacacagggacttgaa

SEQ ID NO: 1159228 - DNA, 12 bp, Homo sapiens
taggcagagcct

SEQ ID NO: 1159229 - DNA, 20 bp, Homo sapiens
taggcagattgaaaaggaca

SEQ ID NO: 1159230 - DNA, 19 bp, Homo sapiens
taggcagcctctctgctat

SEQ ID NO: 1159231 - DNA, 12 bp, Homo sapiens
taggcagcttct

SEQ ID NO: 1159232 - DNA, 22 bp, Homo sapiens
taggcaggaagcccaattgctg

SEQ ID NO: 1159233 - DNA, 14 bp, Homo sapiens
taggcagggggccc

SEQ ID NO: 1159234 - DNA, 16 bp, Homo sapiens
taggcagggggccctg

SEQ ID NO: 1159235 - DNA, 21 bp, Homo sapiens
taggcagggggccctgcccca

SEQ ID NO: 1159236 - DNA, 17 bp, Homo sapiens
taggcataaattaaaat

SEQ ID NO: 1159237 - DNA, 18 bp, Homo sapiens
taggcatacactgtagtt

SEQ ID NO: 1159238 - DNA, 16 bp, Homo sapiens
taggcatgtcccaccc

SEQ ID NO: 1159239 - DNA, 17 bp, Homo sapiens
taggcattatttaatgt

SEQ ID NO: 1159240 - DNA, 17 bp, Homo sapiens
taggcattgcaggacct

SEQ ID NO: 1159241 - DNA, 17 bp, Homo sapiens
taggcatttcctgctga

SEQ ID NO: 1159242 - DNA, 16 bp, Homo sapiens
taggcatttgctgaat

SEQ ID NO: 1159243 - DNA, 18 bp, Homo sapiens
taggcattttaagtaaaa

SEQ ID NO: 1159244 - DNA, 19 bp, Homo sapiens
taggccaccccctatcctc

SEQ ID NO: 1159245 - DNA, 15 bp, Homo sapiens
taggccactcctcca

SEQ ID NO: 1159246 - DNA, 23 bp, Homo sapiens
taggccagagccatgccaggctg

SEQ ID NO: 1159247 - DNA, 14 bp, Homo sapiens
taggccatctgtaa

SEQ ID NO: 1159248 - DNA, 14 bp, Homo sapiens
taggccatgaaaaa

SEQ ID NO: 1159249 - DNA, 23 bp, Homo sapiens
taggcccaaggtcccctccacat

SEQ ID NO: 1159250 - DNA, 12 bp, Homo sapiens
taggcccaggat

SEQ ID NO: 1159251 - DNA, 20 bp, Homo sapiens
taggcccattgtcctccttt

SEQ ID NO: 1159252 - DNA, 14 bp, Homo sapiens
taggcccccacttg

SEQ ID NO: 1159253 - DNA, 19 bp, Homo sapiens
taggcccccacttgcctct

SEQ ID NO: 1159254 - DNA, 22 bp, Homo sapiens
taggcctataaaattaaatgcc

SEQ ID NO: 1159255 - DNA, 23 bp, Homo sapiens
taggcctataaaattaaatgcct

SEQ ID NO: 1159256 - DNA, 18 bp, Homo sapiens
taggcctcagccagagaa

SEQ ID NO: 1159257 - DNA, 19 bp, Homo sapiens
taggcctcatttctttgtc

SEQ ID NO: 1159258 - DNA, 14 bp, Homo sapiens
taggcctctctgcc

SEQ ID NO: 1159259 - DNA, 16 bp, Homo sapiens
taggcctctctgcctg

SEQ ID NO: 1159260 - DNA, 19 bp, Homo sapiens
taggcctgggtgctggctg

SEQ ID NO: 1159261 - DNA, 20 bp, Homo sapiens
taggcctgggtgctggctgc

SEQ ID NO: 1159262 - DNA, 21 bp, Homo sapiens
taggccttcctctctccagat

SEQ ID NO: 1159263 - DNA, 15 bp, Homo sapiens
taggcgaccaccgcc

SEQ ID NO: 1159264 - DNA, 18 bp, Homo sapiens
taggcgagtgccaggact

SEQ ID NO: 1159265 - DNA, 17 bp, Homo sapiens
taggcggcgatttttgt

SEQ ID NO: 1159266 - DNA, 14 bp, Homo sapiens
taggcgggatgggc

SEQ ID NO: 1159267 - DNA, 13 bp, Homo sapiens
taggctaaatgtt

SEQ ID NO: 1159268 - DNA, 15 bp, Homo sapiens
taggctacaattttc

SEQ ID NO: 1159269 - DNA, 16 bp, Homo sapiens
taggctattaaaaaag

SEQ ID NO: 1159270 - DNA, 20 bp, Homo sapiens
taggctcttaagcagcatgg

SEQ ID NO: 1159271 - DNA, 15 bp, Homo sapiens
taggctgcaaaatta

SEQ ID NO: 1159272 - DNA, 21 bp, Homo sapiens
taggctggcaagataaacact

SEQ ID NO: 1159273 - DNA, 19 bp, Homo sapiens
taggctggtggcccaggac

SEQ ID NO: 1159274 - DNA, 16 bp, Homo sapiens
taggctggtggccttg

SEQ ID NO: 1159275 - DNA, 21 bp, Homo sapiens
taggctgtaactactttataa

SEQ ID NO: 1159276 - DNA, 17 bp, Homo sapiens
taggctgtctgtgccat

SEQ ID NO: 1159277 - DNA, 18 bp, Homo sapiens
taggctgtctgtgccatg

SEQ ID NO: 1159278 - DNA, 19 bp, Homo sapiens
taggctgtggggtctggct

SEQ ID NO: 1159279 - DNA, 20 bp, Homo sapiens
taggctgtggggtctggctg

SEQ ID NO: 1159280 - DNA, 17 bp, Homo sapiens
taggctgtggggtgggc

SEQ ID NO: 1159281 - DNA, 14 bp, Homo sapiens
taggctgttccctt

SEQ ID NO: 1159282 - DNA, 21 bp, Homo sapiens
taggctgttccctttgcctta

SEQ ID NO: 1159283 - DNA, 19 bp, Homo sapiens
tagggaaaaaccagcgtgt

SEQ ID NO: 1159284 - DNA, 21 bp, Homo sapiens
tagggaaaaaccagcgtgtga

SEQ ID NO: 1159285 - DNA, 18 bp, Homo sapiens
tagggaaaggttttgtat

SEQ ID NO: 1159286 - DNA, 16 bp, Homo sapiens
tagggaaataataggg

SEQ ID NO: 1159287 - DNA, 13 bp, Homo sapiens
tagggaaatgaaa

SEQ ID NO: 1159288 - DNA, 13 bp, Homo sapiens
tagggaacaattt

SEQ ID NO: 1159289 - DNA, 20 bp, Homo sapiens
tagggaagttgtctccttcc

SEQ ID NO: 1159290 - DNA, 16 bp, Homo sapiens
tagggaatctggatta

SEQ ID NO: 1159291 - DNA, 19 bp, Homo sapiens
tagggacaggaccccagct

SEQ ID NO: 1159292 - DNA, 18 bp, Homo sapiens
tagggacctcagaggttt

SEQ ID NO: 1159293 - DNA, 14 bp, Homo sapiens
tagggactatcagg

SEQ ID NO: 1159294 - DNA, 16 bp, Homo sapiens
tagggagaaatgttgt

SEQ ID NO: 1159295 - DNA, 13 bp, Homo sapiens
tagggagagggaa

SEQ ID NO: 1159296 - DNA, 20 bp, Homo sapiens
tagggagatgagttgcagtt

SEQ ID NO: 1159297 - DNA, 16 bp, Homo sapiens
tagggagcagatgact

SEQ ID NO: 1159298 - DNA, 17 bp, Homo sapiens
tagggagccatttgaga

SEQ ID NO: 1159299 - DNA, 22 bp, Homo sapiens
tagggaggaccttatctgtgcg

SEQ ID NO: 1159300 - DNA, 18 bp, Homo sapiens
tagggagtggttcctgtg

SEQ ID NO: 1159301 - DNA, 16 bp, Homo sapiens
tagggattcaggctgc

SEQ ID NO: 1159302 - DNA, 16 bp, Homo sapiens
tagggcactgggctgt

SEQ ID NO: 1159303 - DNA, 13 bp, Homo sapiens
tagggcagcttgc

SEQ ID NO: 1159304 - DNA, 14 bp, Homo sapiens
tagggccctggagg

SEQ ID NO: 1159305 - DNA, 16 bp, Homo sapiens
tagggccttttctgtg

SEQ ID NO: 1159306 - DNA, 17 bp, Homo sapiens
tagggctaaatgtttaa

SEQ ID NO: 1159307 - DNA, 20 bp, Homo sapiens
tagggctaaatgtttaaaga

SEQ ID NO: 1159308 - DNA, 21 bp, Homo sapiens
tagggctgctgcttctgctcc

SEQ ID NO: 1159309 - DNA, 23 bp, Homo sapiens
tagggctgctgcttctgctccag

SEQ ID NO: 1159310 - DNA, 12 bp, Homo sapiens
tagggctgggga

SEQ ID NO: 1159311 - DNA, 14 bp, Homo sapiens
tagggctgtaaaat

SEQ ID NO: 1159312 - DNA, 19 bp, Homo sapiens
tagggctgttgctagggag

SEQ ID NO: 1159313 - DNA, 12 bp, Homo sapiens
taggggaagggg

SEQ ID NO: 1159314 - DNA, 21 bp, Homo sapiens
taggggaggggggagggggaa

SEQ ID NO: 1159315 - DNA, 18 bp, Homo sapiens
taggggatggtccaggat

SEQ ID NO: 1159316 - DNA, 14 bp, Homo sapiens
taggggccacctcc

SEQ ID NO: 1159317 - DNA, 17 bp, Homo sapiens
taggggccacctcctcc

SEQ ID NO: 1159318 - DNA, 19 bp, Homo sapiens
taggggccacctcctcccc

SEQ ID NO: 1159319 - DNA, 20 bp, Homo sapiens
taggggccacctcctccccc

SEQ ID NO: 1159320 - DNA, 22 bp, Homo sapiens
taggggcttataataaaggact

SEQ ID NO: 1159321 - DNA, 22 bp, Homo sapiens
tagggggaaatgacctttttac

SEQ ID NO: 1159322 - DNA, 18 bp, Homo sapiens
tagggggacggggctgac

SEQ ID NO: 1159323 - DNA, 19 bp, Homo sapiens
tagggggccttgcggaagc

SEQ ID NO: 1159324 - DNA, 23 bp, Homo sapiens
tagggggccttgcggaagccata

SEQ ID NO: 1159325 - DNA, 15 bp, Homo sapiens
tagggggctttctgg

SEQ ID NO: 1159326 - DNA, 15 bp, Homo sapiens
tagggggtgtcagaa

SEQ ID NO: 1159327 - DNA, 22 bp, Homo sapiens
tagggtaaatcagtaagaggtg

SEQ ID NO: 1159328 - DNA, 17 bp, Homo sapiens
tagggtaagaagtttgt

SEQ ID NO: 1159329 - DNA, 23 bp, Homo sapiens
tagggtaagaagtttgtgtcttt

SEQ ID NO: 1159330 - DNA, 15 bp, Homo sapiens
tagggtaaggtgcct

SEQ ID NO: 1159331 - DNA, 18 bp, Homo sapiens
tagggtaaggtgccttct

SEQ ID NO: 1159332 - DNA, 13 bp, Homo sapiens
tagggtagaatga

SEQ ID NO: 1159333 - DNA, 18 bp, Homo sapiens
tagggtcagccattttta

SEQ ID NO: 1159334 - DNA, 15 bp, Homo sapiens
tagggtctcttcagg

SEQ ID NO: 1159335 - DNA, 22 bp, Homo sapiens
tagggtctgcagcctgctgggg

SEQ ID NO: 1159336 - DNA, 24 bp, Homo sapiens
tagggtctgcagcctgctggggct

SEQ ID NO: 1159337 - DNA, 23 bp, Homo sapiens
tagggtgctctgaggtcaataaa

SEQ ID NO: 1159338 - DNA, 12 bp, Homo sapiens
tagggtggccct

SEQ ID NO: 1159339 - DNA, 19 bp, Homo sapiens
tagggtgggtaagaaagcc

SEQ ID NO: 1159340 - DNA, 14 bp, Homo sapiens
tagggttaaatggt

SEQ ID NO: 1159341 - DNA, 15 bp, Homo sapiens
tagggttataataat

SEQ ID NO: 1159342 - DNA, 13 bp, Homo sapiens
tagggttatattt

SEQ ID NO: 1159343 - DNA, 17 bp, Homo sapiens
tagggttatatttggga

SEQ ID NO: 1159344 - DNA, 15 bp, Homo sapiens
tagggttctgcctct

SEQ ID NO: 1159345 - DNA, 21 bp, Homo sapiens
tagggttttttttaatgtgaa

SEQ ID NO: 1159346 - DNA, 19 bp, Homo sapiens
taggtaaatgtatttaatt

SEQ ID NO: 1159347 - DNA, 13 bp, Homo sapiens
taggtaacacatt

SEQ ID NO: 1159348 - DNA, 14 bp, Homo sapiens
taggtagaaactat

SEQ ID NO: 1159349 - DNA, 16 bp, Homo sapiens
taggtagactttgctt

SEQ ID NO: 1159350 - DNA, 16 bp, Homo sapiens
taggtagtttggatat

SEQ ID NO: 1159351 - DNA, 18 bp, Homo sapiens
taggtattgtctactctg

SEQ ID NO: 1159352 - DNA, 19 bp, Homo sapiens
taggtattgtctactctga

SEQ ID NO: 1159353 - DNA, 21 bp, Homo sapiens
taggtatttaagactgataat

SEQ ID NO: 1159354 - DNA, 11 bp, Homo sapiens
taggtattttg

SEQ ID NO: 1159355 - DNA, 19 bp, Homo sapiens
taggtcaagtaataaaaag

SEQ ID NO: 1159356 - DNA, 15 bp, Homo sapiens
taggtcactcctggg

SEQ ID NO: 1159357 - DNA, 14 bp, Homo sapiens
taggtcagtgaggc

SEQ ID NO: 1159358 - DNA, 15 bp, Homo sapiens
taggtcatgtctgta

SEQ ID NO: 1159359 - DNA, 15 bp, Homo sapiens
taggtcattgcacct

SEQ ID NO: 1159360 - DNA, 20 bp, Homo sapiens
taggtcattgcacctatctc

SEQ ID NO: 1159361 - DNA, 16 bp, Homo sapiens
ttgacctctgtgacca

SEQ ID NO: 1159362 - DNA, 19 bp, Homo sapiens
ttgacctgcattgtaaata

SEQ ID NO: 1159363 - DNA, 18 bp, Homo sapiens
ttgacctgtcctctttgt

SEQ ID NO: 1159364 - DNA, 20 bp, Homo sapiens
ttgaccttcatttcatgtat

SEQ ID NO: 1159365 - DNA, 15 bp, Homo sapiens
ttgacggatgattgg

SEQ ID NO: 1159366 - DNA, 23 bp, Homo sapiens
ttgacgtcactttttggccatgt

SEQ ID NO: 1159367 - DNA, 17 bp, Homo sapiens
ttgacgttgttgtcatt

SEQ ID NO: 1159368 - DNA, 23 bp, Homo sapiens
ttgacgttgttgtcattgtccag

SEQ ID NO: 1159369 - DNA, 14 bp, Homo sapiens
ttgactaattttac

SEQ ID NO: 1159370 - DNA, 23 bp, Homo sapiens
ttgactcaggatttaaaaactgg

SEQ ID NO: 1159371 - DNA, 16 bp, Homo sapiens
ttgactcatggcagct

SEQ ID NO: 1159372 - DNA, 16 bp, Homo sapiens
ttgactcccaagtttc

SEQ ID NO: 1159373 - DNA, 17 bp, Homo sapiens
ttgactcctttccaata

SEQ ID NO: 1159374 - DNA, 17 bp, Homo sapiens
ttgactctcacactgaa

SEQ ID NO: 1159375 - DNA, 19 bp, Homo sapiens
ttgactctggcaaagcttt

SEQ ID NO: 1159376 - DNA, 21 bp, Homo sapiens
ttgactctttcaaagaaatcc

SEQ ID NO: 1159377 - DNA, 18 bp, Homo sapiens
ttgactgcagttgaacag

SEQ ID NO: 1159378 - DNA, 23 bp, Homo sapiens
ttgactgggtttctctgtatagt

SEQ ID NO: 1159379 - DNA, 15 bp, Homo sapiens
ttgactgtacagaga

SEQ ID NO: 1159380 - DNA, 14 bp, Homo sapiens
ttgactgtcagcaa

SEQ ID NO: 1159381 - DNA, 19 bp, Homo sapiens
ttgactgtctagccactcc

SEQ ID NO: 1159382 - DNA, 17 bp, Homo sapiens
ttgacttagatattaaa

SEQ ID NO: 1159383 - DNA, 18 bp, Homo sapiens
ttgacttattaggacttt

SEQ ID NO: 1159384 - DNA, 15 bp, Homo sapiens
ttgacttattttctc

SEQ ID NO: 1159385 - DNA, 14 bp, Homo sapiens
ttgacttcttggtt

SEQ ID NO: 1159386 - DNA, 17 bp, Homo sapiens
ttgactttatctcctgc

SEQ ID NO: 1159387 - DNA, 15 bp, Homo sapiens
ttgactttcaggtac

SEQ ID NO: 1159388 - DNA, 15 bp, Homo sapiens
ttgactttctgattg

SEQ ID NO: 1159389 - DNA, 22 bp, Homo sapiens
ttgagaaaaatagagcaaaatc

SEQ ID NO: 1159390 - DNA, 16 bp, Homo sapiens
ttgagaaaatataata

SEQ ID NO: 1159391 - DNA, 19 bp, Homo sapiens
ttgagaaagagcacttaag

SEQ ID NO: 1159392 - DNA, 15 bp, Homo sapiens
ttgagaaatgaataa

SEQ ID NO: 1159393 - DNA, 17 bp, Homo sapiens
ttgagaaccagtctcct

SEQ ID NO: 1159394 - DNA, 13 bp, Homo sapiens
ttgagaactgaca

SEQ ID NO: 1159395 - DNA, 20 bp, Homo sapiens
ttgagaactgcttctaagat

SEQ ID NO: 1159396 - DNA, 18 bp, Homo sapiens
ttgagaagcacaactgaa

SEQ ID NO: 1159397 - DNA, 23 bp, Homo sapiens
ttgagaagccttcagctccaggg

SEQ ID NO: 1159398 - DNA, 19 bp, Homo sapiens
ttgagaaggaaaattttag

SEQ ID NO: 1159399 - DNA, 19 bp, Homo sapiens
ttgagaataagaatttgag

SEQ ID NO: 1159400 - DNA, 17 bp, Homo sapiens
ttgagaatcaggttgca

SEQ ID NO: 1159401 - DNA, 23 bp, Homo sapiens
ttgagaatcccaaatttgattga

SEQ ID NO: 1159402 - DNA, 14 bp, Homo sapiens
ttgagacaatgttt

SEQ ID NO: 1159403 - DNA, 13 bp, Homo sapiens
ttgagaccagcct

SEQ ID NO: 1159404 - DNA, 15 bp, Homo sapiens
ttgagaccagcctgg

SEQ ID NO: 1159405 - DNA, 18 bp, Homo sapiens
ttgagacctacaggctga

SEQ ID NO: 1159406 - DNA, 17 bp, Homo sapiens
ttgagactcaaaaaaac

SEQ ID NO: 1159407 - DNA, 15 bp, Homo sapiens
ttgagactgaaattt

SEQ ID NO: 1159408 - DNA, 13 bp, Homo sapiens
ttgagacttaaaa

SEQ ID NO: 1159409 - DNA, 23 bp, Homo sapiens
ttgagagaaatatgaagaactga

SEQ ID NO: 1159410 - DNA, 13 bp, Homo sapiens
ttgagagaagcca

SEQ ID NO: 1159411 - DNA, 12 bp, Homo sapiens
ttgagagccagt

SEQ ID NO: 1159412 - DNA, 16 bp, Homo sapiens
ttgagagcttggcctt

SEQ ID NO: 1159413 - DNA, 14 bp, Homo sapiens
ttgagagctttctg

SEQ ID NO: 1159414 - DNA, 16 bp, Homo sapiens
ttgagagttcacagaa

SEQ ID NO: 1159415 - DNA, 15 bp, Homo sapiens
ttgagatactatttt

SEQ ID NO: 1159416 - DNA, 19 bp, Homo sapiens
ttgagatactattttcatt

SEQ ID NO: 1159417 - DNA, 15 bp, Homo sapiens
ttgagatcagcctgg

SEQ ID NO: 1159418 - DNA, 16 bp, Homo sapiens
ttgagatcagcctggg

SEQ ID NO: 1159419 - DNA, 15 bp, Homo sapiens
ttgagatctgtataa

SEQ ID NO: 1159420 - DNA, 12 bp, Homo sapiens
ttgagatgagtt

SEQ ID NO: 1159421 - DNA, 17 bp, Homo sapiens
ttgagatggtgaggctg

SEQ ID NO: 1159422 - DNA, 13 bp, Homo sapiens
ttgagatgtatga

SEQ ID NO: 1159423 - DNA, 17 bp, Homo sapiens
ttgagatttttaagaac

SEQ ID NO: 1159424 - DNA, 18 bp, Homo sapiens
ttgagatttttaagaact

SEQ ID NO: 1159425 - DNA, 19 bp, Homo sapiens
ttgagatttttttttctct

SEQ ID NO: 1159426 - DNA, 18 bp, Homo sapiens
ttgagcagggatcctggt

SEQ ID NO: 1159427 - DNA, 21 bp, Homo sapiens
ttgagcagtggcctacaaatc

SEQ ID NO: 1159428 - DNA, 13 bp, Homo sapiens
ttgagcatatttt

SEQ ID NO: 1159429 - DNA, 19 bp, Homo sapiens
ttgagcatattttcttact

SEQ ID NO: 1159430 - DNA, 16 bp, Homo sapiens
ttgagcatcaatcttg

SEQ ID NO: 1159431 - DNA, 17 bp, Homo sapiens
ttgagcatcaatcttgt

SEQ ID NO: 1159432 - DNA, 21 bp, Homo sapiens
ttgagcatgacagcctgcagc

SEQ ID NO: 1159433 - DNA, 12 bp, Homo sapiens
ttgagccacagt

SEQ ID NO: 1159434 - DNA, 20 bp, Homo sapiens
ttgagccactccttccttca

SEQ ID NO: 1159435 - DNA, 15 bp, Homo sapiens
ttgagccaggtggat

SEQ ID NO: 1159436 - DNA, 14 bp, Homo sapiens
ttgagccccaagtc

SEQ ID NO: 1159437 - DNA, 18 bp, Homo sapiens
ttgagccccaagtcctga

SEQ ID NO: 1159438 - DNA, 23 bp, Homo sapiens
ttgagccccaagtcctgaagagg

SEQ ID NO: 1159439 - DNA, 13 bp, Homo sapiens
ttgagccctggct

SEQ ID NO: 1159440 - DNA, 18 bp, Homo sapiens
ttgagcctggctgtccaa

SEQ ID NO: 1159441 - DNA, 16 bp, Homo sapiens
ttgagccttgaacttt

SEQ ID NO: 1159442 - DNA, 22 bp, Homo sapiens
ttgagcctttattggtaaattc

SEQ ID NO: 1159443 - DNA, 19 bp, Homo sapiens
ttgagctactggattctta

SEQ ID NO: 1159444 - DNA, 22 bp, Homo sapiens
ttgagctgaaatgctgcatttt

SEQ ID NO: 1159445 - DNA, 14 bp, Homo sapiens
ttgagctgagatgg

SEQ ID NO: 1159446 - DNA, 11 bp, Homo sapiens
ttgagctgcct

SEQ ID NO: 1159447 - DNA, 13 bp, Homo sapiens
ttgagctgccttc

SEQ ID NO: 1159448 - DNA, 14 bp, Homo sapiens
ttgagctgccttcc

SEQ ID NO: 1159449 - DNA, 19 bp, Homo sapiens
ttgagctgccttccctagc

SEQ ID NO: 1159450 - DNA, 21 bp, Homo sapiens
ttgagctgttgcctcagtccc

SEQ ID NO: 1159451 - DNA, 18 bp, Homo sapiens
ttgagctgttttccctga

SEQ ID NO: 1159452 - DNA, 18 bp, Homo sapiens
ttgaggaagcccaggctc

SEQ ID NO: 1159453 - DNA, 17 bp, Homo sapiens
ttgaggaagctctccct

SEQ ID NO: 1159454 - DNA, 17 bp, Homo sapiens
ttgaggaagttttgtct

SEQ ID NO: 1159455 - DNA, 19 bp, Homo sapiens
ttgaggaagttttgtctaa

SEQ ID NO: 1159456 - DNA, 13 bp, Homo sapiens
ttgaggacttctt

SEQ ID NO: 1159457 - DNA, 15 bp, Homo sapiens
ttgaggacttcttgc

SEQ ID NO: 1159458 - DNA, 12 bp, Homo sapiens
ttgaggagcccc

SEQ ID NO: 1159459 - DNA, 21 bp, Homo sapiens
ttgaggatatattttcacttt

SEQ ID NO: 1159460 - DNA, 15 bp, Homo sapiens
ttgaggattgtggaa

SEQ ID NO: 1159461 - DNA, 17 bp, Homo sapiens
ttgaggattgtggaaaa

SEQ ID NO: 1159462 - DNA, 18 bp, Homo sapiens
ttgaggcaaattaactgt

SEQ ID NO: 1159463 - DNA, 19 bp, Homo sapiens
ttgaggcaaattaactgta

SEQ ID NO: 1159464 - DNA, 13 bp, Homo sapiens
ttgaggcaagtgt

SEQ ID NO: 1159465 - DNA, 19 bp, Homo sapiens
ttgagggaaggttcttcat

SEQ ID NO: 1159466 - DNA, 11 bp, Homo sapiens
ttgagggaggg

SEQ ID NO: 1159467 - DNA, 13 bp, Homo sapiens
ttgagggatgctg

SEQ ID NO: 1159468 - DNA, 16 bp, Homo sapiens
ttgagggcaagccacc

SEQ ID NO: 1159469 - DNA, 21 bp, Homo sapiens
ttgagggccagtgatgatgtt

SEQ ID NO: 1159470 - DNA, 14 bp, Homo sapiens
ttgagggctgcagt

SEQ ID NO: 1159471 - DNA, 22 bp, Homo sapiens
ttgaggggattaatatgaaaac

SEQ ID NO: 1159472 - DNA, 13 bp, Homo sapiens
ttgaggggccagg

SEQ ID NO: 1159473 - DNA, 15 bp, Homo sapiens
ttgaggggctcctgg

SEQ ID NO: 1159474 - DNA, 16 bp, Homo sapiens
ttgaggggctcctgga

SEQ ID NO: 1159475 - DNA, 13 bp, Homo sapiens
ttgagggtaggag

SEQ ID NO: 1159476 - DNA, 21 bp, Homo sapiens
ttgaggtaccagttgtattta

SEQ ID NO: 1159477 - DNA, 17 bp, Homo sapiens
ttgaggtctgctcggcc

SEQ ID NO: 1159478 - DNA, 16 bp, Homo sapiens
ttgaggtctgttcttt

SEQ ID NO: 1159479 - DNA, 23 bp, Homo sapiens
ttgaggtcttttgacatgtggaa

SEQ ID NO: 1159480 - DNA, 19 bp, Homo sapiens
ttgaggtgggtgggcctga

SEQ ID NO: 1159481 - DNA, 21 bp, Homo sapiens
ttgaggtgggtgggcctgact

SEQ ID NO: 1159482 - DNA, 19 bp, Homo sapiens
ttgaggtttgaaaagctga

SEQ ID NO: 1159483 - DNA, 22 bp, Homo sapiens
ttgaggtttttaaatatatatt

SEQ ID NO: 1159484 - DNA, 13 bp, Homo sapiens
ttgagtaaaaagg

SEQ ID NO: 1159485 - DNA, 16 bp, Homo sapiens
ttgagtaatggtgtag

SEQ ID NO: 1159486 - DNA, 15 bp, Homo sapiens
taggtccaagggcca

SEQ ID NO: 1159487 - DNA, 21 bp, Homo sapiens
taggtccagatccgctccagc

SEQ ID NO: 1159488 - DNA, 16 bp, Homo sapiens
taggtctcatctcttc

SEQ ID NO: 1159489 - DNA, 12 bp, Homo sapiens
taggtctccagt

SEQ ID NO: 1159490 - DNA, 20 bp, Homo sapiens
taggtctcctcagggtgggg

SEQ ID NO: 1159491 - DNA, 19 bp, Homo sapiens
taggtctcttctcccagaa

SEQ ID NO: 1159492 - DNA, 18 bp, Homo sapiens
taggtctgaaatttttct

SEQ ID NO: 1159493 - DNA, 12 bp, Homo sapiens
taggtctggttg

SEQ ID NO: 1159494 - DNA, 21 bp, Homo sapiens
taggtgaagggatgggggaag

SEQ ID NO: 1159495 - DNA, 22 bp, Homo sapiens
taggtgaagggatgggggaaga

SEQ ID NO: 1159496 - DNA, 18 bp, Homo sapiens
taggtggccgctcctccc

SEQ ID NO: 1159497 - DNA, 19 bp, Homo sapiens
taggtgggccagcccctcc

SEQ ID NO: 1159498 - DNA, 20 bp, Homo sapiens
taggtgggccagcccctccc

SEQ ID NO: 1159499 - DNA, 17 bp, Homo sapiens
taggtgggtaggagccc

SEQ ID NO: 1159500 - DNA, 22 bp, Homo sapiens
taggtgggtaggagcccttctc

SEQ ID NO: 1159501 - DNA, 23 bp, Homo sapiens
taggtgggtaggagcccttctct

SEQ ID NO: 1159502 - DNA, 19 bp, Homo sapiens
taggtgtaaatgagaagac

SEQ ID NO: 1159503 - DNA, 18 bp, Homo sapiens
taggtgtctctgggcctg

SEQ ID NO: 1159504 - DNA, 21 bp, Homo sapiens
taggtgtctgccttcacaaat

SEQ ID NO: 1159505 - DNA, 22 bp, Homo sapiens
taggtgtctgccttcacaaatg

SEQ ID NO: 1159506 - DNA, 23 bp, Homo sapiens
taggtgtgactgaatttcttttg

SEQ ID NO: 1159507 - DNA, 22 bp, Homo sapiens
taggtgtgatttcctaatatga

SEQ ID NO: 1159508 - DNA, 22 bp, Homo sapiens
taggtgttaggcatgtcccacc

SEQ ID NO: 1159509 - DNA, 17 bp, Homo sapiens
taggtgttcaggccagt

SEQ ID NO: 1159510 - DNA, 22 bp, Homo sapiens
taggtgttgattttctgttgta

SEQ ID NO: 1159511 - DNA, 13 bp, Homo sapiens
taggttaaagcta

SEQ ID NO: 1159512 - DNA, 15 bp, Homo sapiens
taggttaaaggccag

SEQ ID NO: 1159513 - DNA, 12 bp, Homo sapiens
taggttatacaa

SEQ ID NO: 1159514 - DNA, 15 bp, Homo sapiens
taggttatacaataa

SEQ ID NO: 1159515 - DNA, 21 bp, Homo sapiens
taggttatacaataacccagt

SEQ ID NO: 1159516 - DNA, 18 bp, Homo sapiens
taggttatctttttaaaa

SEQ ID NO: 1159517 - DNA, 15 bp, Homo sapiens
taggttatttaaaat

SEQ ID NO: 1159518 - DNA, 15 bp, Homo sapiens
taggttcagccaagg

SEQ ID NO: 1159519 - DNA, 15 bp, Homo sapiens
taggttccccagaga

SEQ ID NO: 1159520 - DNA, 23 bp, Homo sapiens
taggttccccagagagcaggcag

SEQ ID NO: 1159521 - DNA, 17 bp, Homo sapiens
taggttccctgttcttc

SEQ ID NO: 1159522 - DNA, 12 bp, Homo sapiens
taggttctaaaa

SEQ ID NO: 1159523 - DNA, 12 bp, Homo sapiens
taggttcttctt

SEQ ID NO: 1159524 - DNA, 20 bp, Homo sapiens
taggttgccaataatacact

SEQ ID NO: 1159525 - DNA, 12 bp, Homo sapiens
taggtttctctc

SEQ ID NO: 1159526 - DNA, 21 bp, Homo sapiens
taggtttgtcccagtcagaaa

SEQ ID NO: 1159527 - DNA, 21 bp, Homo sapiens
taggtttttccttatttgctt

SEQ ID NO: 1159528 - DNA, 15 bp, Homo sapiens
taggtttttgtttgt

SEQ ID NO: 1159529 - DNA, 15 bp, Homo sapiens
taggtttttttgtat

SEQ ID NO: 1159530 - DNA, 18 bp, Homo sapiens
tagtaaaaccttgttcta

SEQ ID NO: 1159531 - DNA, 23 bp, Homo sapiens
tagtaaaagtggtctctgctggg

SEQ ID NO: 1159532 - DNA, 13 bp, Homo sapiens
tagtaaatatgtg

SEQ ID NO: 1159533 - DNA, 18 bp, Homo sapiens
tagtaaatatgtgaagaa

SEQ ID NO: 1159534 - DNA, 22 bp, Homo sapiens
tagtaaatcacgctttttgaaa

SEQ ID NO: 1159535 - DNA, 16 bp, Homo sapiens
tagtaaatcagaaagt

SEQ ID NO: 1159536 - DNA, 20 bp, Homo sapiens
tagtaagaattctggtgttt

SEQ ID NO: 1159537 - DNA, 23 bp, Homo sapiens
tagtaagaattctggtgtttaca

SEQ ID NO: 1159538 - DNA, 20 bp, Homo sapiens
tagtaagtttttcttcatga

SEQ ID NO: 1159539 - DNA, 17 bp, Homo sapiens
tagtaatagtccaatat

SEQ ID NO: 1159540 - DNA, 20 bp, Homo sapiens
tagtaatagtccaatatttg

SEQ ID NO: 1159541 - DNA, 14 bp, Homo sapiens
tagtaattgacatg

SEQ ID NO: 1159542 - DNA, 13 bp, Homo sapiens
tagtaatttccta

SEQ ID NO: 1159543 - DNA, 16 bp, Homo sapiens
tagtaccatttataca

SEQ ID NO: 1159544 - DNA, 22 bp, Homo sapiens
tagtactagagatattttgtaa

SEQ ID NO: 1159545 - DNA, 17 bp, Homo sapiens
tagtactcctgcaaaat

SEQ ID NO: 1159546 - DNA, 20 bp, Homo sapiens
tagtactcctgcaaaatttt

SEQ ID NO: 1159547 - DNA, 17 bp, Homo sapiens
tagtactctctgctcta

SEQ ID NO: 1159548 - DNA, 16 bp, Homo sapiens
tagtactgtattggct

SEQ ID NO: 1159549 - DNA, 22 bp, Homo sapiens
tagtacttgaaatctaggatta

SEQ ID NO: 1159550 - DNA, 22 bp, Homo sapiens
tagtagaaagacatctgcctgt

SEQ ID NO: 1159551 - DNA, 19 bp, Homo sapiens
tagtagaaattttacaata

SEQ ID NO: 1159552 - DNA, 16 bp, Homo sapiens
tagtagaactggatcc

SEQ ID NO: 1159553 - DNA, 14 bp, Homo sapiens
tagtagattaaaaa

SEQ ID NO: 1159554 - DNA, 19 bp, Homo sapiens
tagtagcaatgtgccttga

SEQ ID NO: 1159555 - DNA, 20 bp, Homo sapiens
tagtagcagtgattgtctta

SEQ ID NO: 1159556 - DNA, 11 bp, Homo sapiens
tagtagcattt

SEQ ID NO: 1159557 - DNA, 19 bp, Homo sapiens
tagtagcgttttttaaatg

SEQ ID NO: 1159558 - DNA, 17 bp, Homo sapiens
tagtaggggttgaagaa

SEQ ID NO: 1159559 - DNA, 21 bp, Homo sapiens
tagtaggggttgaagaaaaca

SEQ ID NO: 1159560 - DNA, 19 bp, Homo sapiens
tagtagttcctgctacaac

SEQ ID NO: 1159561 - DNA, 14 bp, Homo sapiens
tagtagtttttaca

SEQ ID NO: 1159562 - DNA, 16 bp, Homo sapiens
tagtagtttttacaaa

SEQ ID NO: 1159563 - DNA, 19 bp, Homo sapiens
tagtatagaagtctggaaa

SEQ ID NO: 1159564 - DNA, 21 bp, Homo sapiens
tagtatagaagtctggaaaaa

SEQ ID NO: 1159565 - DNA, 14 bp, Homo sapiens
tagtatctaacatg

SEQ ID NO: 1159566 - DNA, 19 bp, Homo sapiens
tagtatctagcaatcacaa

SEQ ID NO: 1159567 - DNA, 17 bp, Homo sapiens
tagtatgaggcatttgt

SEQ ID NO: 1159568 - DNA, 19 bp, Homo sapiens
tagtatgttcaactctcat

SEQ ID NO: 1159569 - DNA, 16 bp, Homo sapiens
tagtattaaaagttgc

SEQ ID NO: 1159570 - DNA, 19 bp, Homo sapiens
tagtattgctgaactctta

SEQ ID NO: 1159571 - DNA, 21 bp, Homo sapiens
tagtattgttgtccttttcat

SEQ ID NO: 1159572 - DNA, 20 bp, Homo sapiens
tagtatttaactacatctgc

SEQ ID NO: 1159573 - DNA, 14 bp, Homo sapiens
tagtatttctcagg

SEQ ID NO: 1159574 - DNA, 9 bp, Homo sapiens
tagtatttt

SEQ ID NO: 1159575 - DNA, 19 bp, Homo sapiens
tagtcaaaaacaaagctga

SEQ ID NO: 1159576 - DNA, 15 bp, Homo sapiens
tagtcaagattgtgt

SEQ ID NO: 1159577 - DNA, 15 bp, Homo sapiens
tagtcaagctcctcc

SEQ ID NO: 1159578 - DNA, 15 bp, Homo sapiens
tagtcaataaaatga

SEQ ID NO: 1159579 - DNA, 18 bp, Homo sapiens
tagtcaccgacagcggcc

SEQ ID NO: 1159580 - DNA, 23 bp, Homo sapiens
tagtcactgcctgcagaggtctg

SEQ ID NO: 1159581 - DNA, 15 bp, Homo sapiens
tagtcactgctgcta

SEQ ID NO: 1159582 - DNA, 22 bp, Homo sapiens
tagtcagaagcaggttcttgat

SEQ ID NO: 1159583 - DNA, 19 bp, Homo sapiens
tagtcagactgacactact

SEQ ID NO: 1159584 - DNA, 13 bp, Homo sapiens
tagtcagctgcct

SEQ ID NO: 1159585 - DNA, 23 bp, Homo sapiens
tagtcagggcacagctgccctgc

SEQ ID NO: 1159586 - DNA, 15 bp, Homo sapiens
tagtcatgtttatct

SEQ ID NO: 1159587 - DNA, 18 bp, Homo sapiens
tagtcattccaaatatga

SEQ ID NO: 1159588 - DNA, 16 bp, Homo sapiens
tagtccaatatttggc

SEQ ID NO: 1159589 - DNA, 18 bp, Homo sapiens
tagtccaatttttactca

SEQ ID NO: 1159590 - DNA, 21 bp, Homo sapiens
tagtcccagctactcagaagc

SEQ ID NO: 1159591 - DNA, 22 bp, Homo sapiens
tagtccccccagctctaagcag

SEQ ID NO: 1159592 - DNA, 14 bp, Homo sapiens
tagtcccttcccct

SEQ ID NO: 1159593 - DNA, 22 bp, Homo sapiens
tagtcccttcccctccctggct

SEQ ID NO: 1159594 - DNA, 23 bp, Homo sapiens
tagtccgtgctgacagctgctcc

SEQ ID NO: 1159595 - DNA, 16 bp, Homo sapiens
tagtcctatggaaaaa

SEQ ID NO: 1159596 - DNA, 14 bp, Homo sapiens
tagtcctattctat

SEQ ID NO: 1159597 - DNA, 16 bp, Homo sapiens
tagtcctggcagctgg

SEQ ID NO: 1159598 - DNA, 14 bp, Homo sapiens
tagtctattagcca

SEQ ID NO: 1159599 - DNA, 19 bp, Homo sapiens
tagtctcactgcttgaact

SEQ ID NO: 1159600 - DNA, 15 bp, Homo sapiens
tagtctcagtgaaga

SEQ ID NO: 1159601 - DNA, 18 bp, Homo sapiens
tagtctcagtgaagacta

SEQ ID NO: 1159602 - DNA, 18 bp, Homo sapiens
tagtctcctttgcactga

SEQ ID NO: 1159603 - DNA, 18 bp, Homo sapiens
tagtctctttaaaaggaa

SEQ ID NO: 1159604 - DNA, 19 bp, Homo sapiens
tagtctgagcttctttagc

SEQ ID NO: 1159605 - DNA, 18 bp, Homo sapiens
tagtctgtcagggccttg

SEQ ID NO: 1159606 - DNA, 13 bp, Homo sapiens
tagtctgtgtaac

SEQ ID NO: 1159607 - DNA, 13 bp, Homo sapiens
tagtcttacctaa

SEQ ID NO: 1159608 - DNA, 16 bp, Homo sapiens
tagtcttatgtaaagt

SEQ ID NO: 1159609 - DNA, 22 bp, Homo sapiens
tagtcttccacaaaaaatactt

SEQ ID NO: 1159610 - DNA, 21 bp, Homo sapiens
ttgagtaatggtgtagaacac

SEQ ID NO: 1159611 - DNA, 18 bp, Homo sapiens
ttgagtaggtaccttgta

SEQ ID NO: 1159612 - DNA, 14 bp, Homo sapiens
ttgagtatcacttt

SEQ ID NO: 1159613 - DNA, 13 bp, Homo sapiens
ttgagtctcaagg

SEQ ID NO: 1159614 - DNA, 11 bp, Homo sapiens
ttgagtctctt

SEQ ID NO: 1159615 - DNA, 17 bp, Homo sapiens
ttgagtctcttttttat

SEQ ID NO: 1159616 - DNA, 14 bp, Homo sapiens
ttgagtctgtgcca

SEQ ID NO: 1159617 - DNA, 16 bp, Homo sapiens
ttgagtgcactaaaca

SEQ ID NO: 1159618 - DNA, 15 bp, Homo sapiens
ttgagtgcactgact

SEQ ID NO: 1159619 - DNA, 19 bp, Homo sapiens
ttgagtggatgatgtttcg

SEQ ID NO: 1159620 - DNA, 15 bp, Homo sapiens
ttgagtgggccctgc

SEQ ID NO: 1159621 - DNA, 20 bp, Homo sapiens
ttgagtgtatacatgtgtgg

SEQ ID NO: 1159622 - DNA, 13 bp, Homo sapiens
ttgagtgtatata

SEQ ID NO: 1159623 - DNA, 16 bp, Homo sapiens
ttgagtgtatatatat

SEQ ID NO: 1159624 - DNA, 13 bp, Homo sapiens
ttgagttcctcct

SEQ ID NO: 1159625 - DNA, 23 bp, Homo sapiens
ttgagttcttcctgtaatcttgt

SEQ ID NO: 1159626 - DNA, 17 bp, Homo sapiens
ttgagttggctgtgttc

SEQ ID NO: 1159627 - DNA, 18 bp, Homo sapiens
ttgagtttataattcagg

SEQ ID NO: 1159628 - DNA, 17 bp, Homo sapiens
ttgagtttattctgatt

SEQ ID NO: 1159629 - DNA, 23 bp, Homo sapiens
ttgagtttgtcgctcatgtgtgc

SEQ ID NO: 1159630 - DNA, 17 bp, Homo sapiens
ttgagtttttcctccca

SEQ ID NO: 1159631 - DNA, 14 bp, Homo sapiens
ttgataaaatgtaa

SEQ ID NO: 1159632 - DNA, 14 bp, Homo sapiens
ttgataaagatttt

SEQ ID NO: 1159633 - DNA, 17 bp, Homo sapiens
ttgataaagatttttta

SEQ ID NO: 1159634 - DNA, 20 bp, Homo sapiens
ttgataaagattttttaata

SEQ ID NO: 1159635 - DNA, 22 bp, Homo sapiens
ttgataaagattttttaataat

SEQ ID NO: 1159636 - DNA, 20 bp, Homo sapiens
ttgataaatatatatgatca

SEQ ID NO: 1159637 - DNA, 21 bp, Homo sapiens
ttgataaattccactggactt

SEQ ID NO: 1159638 - DNA, 18 bp, Homo sapiens
ttgataaccttgaaaaaa

SEQ ID NO: 1159639 - DNA, 18 bp, Homo sapiens
ttgataatattagtgatt

SEQ ID NO: 1159640 - DNA, 13 bp, Homo sapiens
ttgataatcttca

SEQ ID NO: 1159641 - DNA, 14 bp, Homo sapiens
ttgataatcttcag

SEQ ID NO: 1159642 - DNA, 22 bp, Homo sapiens
ttgataatcttcaggtgaacac

SEQ ID NO: 1159643 - DNA, 23 bp, Homo sapiens
ttgataatttcagggaaattaat

SEQ ID NO: 1159644 - DNA, 13 bp, Homo sapiens
ttgatacccccct

SEQ ID NO: 1159645 - DNA, 17 bp, Homo sapiens
ttgatactacagtttgt

SEQ ID NO: 1159646 - DNA, 17 bp, Homo sapiens
ttgatagttctataaga

SEQ ID NO: 1159647 - DNA, 20 bp, Homo sapiens
ttgatatctcaatctgcagc

SEQ ID NO: 1159648 - DNA, 22 bp, Homo sapiens
ttgatatctcaatctgcagcca

SEQ ID NO: 1159649 - DNA, 15 bp, Homo sapiens
ttgatatgactgttt

SEQ ID NO: 1159650 - DNA, 15 bp, Homo sapiens
ttgatattgtttgct

SEQ ID NO: 1159651 - DNA, 18 bp, Homo sapiens
ttgatattgtttgctgtt

SEQ ID NO: 1159652 - DNA, 22 bp, Homo sapiens
ttgatattttcaacgcagccct

SEQ ID NO: 1159653 - DNA, 17 bp, Homo sapiens
ttgatcaaattcatttt

SEQ ID NO: 1159654 - DNA, 12 bp, Homo sapiens
ttgatcagaatc

SEQ ID NO: 1159655 - DNA, 17 bp, Homo sapiens
ttgatcagatgctgaat

SEQ ID NO: 1159656 - DNA, 20 bp, Homo sapiens
ttgatcagccccaccctggc

SEQ ID NO: 1159657 - DNA, 20 bp, Homo sapiens
ttgatcatccctttctccca

SEQ ID NO: 1159658 - DNA, 20 bp, Homo sapiens
ttgatccagaagagcccata

SEQ ID NO: 1159659 - DNA, 20 bp, Homo sapiens
ttgatcccacttcactgtga

SEQ ID NO: 1159660 - DNA, 21 bp, Homo sapiens
ttgatccctgttacccagaga

SEQ ID NO: 1159661 - DNA, 12 bp, Homo sapiens
ttgatccttgga

SEQ ID NO: 1159662 - DNA, 20 bp, Homo sapiens
ttgatcctttgatcccagaa

SEQ ID NO: 1159663 - DNA, 19 bp, Homo sapiens
ttgatcgcctttcccaggt

SEQ ID NO: 1159664 - DNA, 14 bp, Homo sapiens
ttgatctctaatga

SEQ ID NO: 1159665 - DNA, 17 bp, Homo sapiens
ttgatctcttagaagcc

SEQ ID NO: 1159666 - DNA, 13 bp, Homo sapiens
ttgatctgctctg

SEQ ID NO: 1159667 - DNA, 14 bp, Homo sapiens
ttgatctgctctgt

SEQ ID NO: 1159668 - DNA, 14 bp, Homo sapiens
ttgatctggacaga

SEQ ID NO: 1159669 - DNA, 21 bp, Homo sapiens
ttgatctgtgatttcttctcc

SEQ ID NO: 1159670 - DNA, 22 bp, Homo sapiens
ttgatctgttgcaagcccctct

SEQ ID NO: 1159671 - DNA, 19 bp, Homo sapiens
ttgatctttgtttaaatgc

SEQ ID NO: 1159672 - DNA, 20 bp, Homo sapiens
ttgatctttgtttaaatgcc

SEQ ID NO: 1159673 - DNA, 19 bp, Homo sapiens
ttgatctttttatattctt

SEQ ID NO: 1159674 - DNA, 20 bp, Homo sapiens
ttgatgaaacgtcatgtgtt

SEQ ID NO: 1159675 - DNA, 18 bp, Homo sapiens
ttgatgaaattcttgaag

SEQ ID NO: 1159676 - DNA, 18 bp, Homo sapiens
ttgatgaagcaaggaaga

SEQ ID NO: 1159677 - DNA, 19 bp, Homo sapiens
ttgatgaattcttcctctc

SEQ ID NO: 1159678 - DNA, 19 bp, Homo sapiens
ttgatgactcgaaactgac

SEQ ID NO: 1159679 - DNA, 18 bp, Homo sapiens
ttgatgataacacttaaa

SEQ ID NO: 1159680 - DNA, 21 bp, Homo sapiens
ttgatgatgtctacagaaaat

SEQ ID NO: 1159681 - DNA, 18 bp, Homo sapiens
ttgatgcagataaaatat

SEQ ID NO: 1159682 - DNA, 21 bp, Homo sapiens
ttgatgcagataaaatatttt

SEQ ID NO: 1159683 - DNA, 18 bp, Homo sapiens
ttgatgccagagggccag

SEQ ID NO: 1159684 - DNA, 20 bp, Homo sapiens
ttgatgccagagggccagca

SEQ ID NO: 1159685 - DNA, 16 bp, Homo sapiens
ttgatgctatttatgc

SEQ ID NO: 1159686 - DNA, 14 bp, Homo sapiens
ttgatggaaaataa

SEQ ID NO: 1159687 - DNA, 15 bp, Homo sapiens
ttgatggaaaataaa

SEQ ID NO: 1159688 - DNA, 19 bp, Homo sapiens
ttgatggagggtggaaata

SEQ ID NO: 1159689 - DNA, 15 bp, Homo sapiens
ttgatggtatttctt

SEQ ID NO: 1159690 - DNA, 19 bp, Homo sapiens
ttgatggtatttctttctc

SEQ ID NO: 1159691 - DNA, 17 bp, Homo sapiens
ttgatggtggactaagc

SEQ ID NO: 1159692 - DNA, 17 bp, Homo sapiens
ttgatgtacatgtgtag

SEQ ID NO: 1159693 - DNA, 13 bp, Homo sapiens
ttgatgtatctga

SEQ ID NO: 1159694 - DNA, 12 bp, Homo sapiens
ttgatgtatgtg

SEQ ID NO: 1159695 - DNA, 15 bp, Homo sapiens
ttgatgtatgtgtga

SEQ ID NO: 1159696 - DNA, 20 bp, Homo sapiens
ttgatgtatgtgtgaaacaa

SEQ ID NO: 1159697 - DNA, 21 bp, Homo sapiens
ttgatgtcatgtacttcctgt

SEQ ID NO: 1159698 - DNA, 22 bp, Homo sapiens
ttgatgtgaagataatttgcat

SEQ ID NO: 1159699 - DNA, 21 bp, Homo sapiens
ttgatgtgactttttttggta

SEQ ID NO: 1159700 - DNA, 13 bp, Homo sapiens
ttgatgttaacaa

SEQ ID NO: 1159701 - DNA, 23 bp, Homo sapiens
ttgatgttaacaagaggggaaaa

SEQ ID NO: 1159702 - DNA, 13 bp, Homo sapiens
ttgatgtttagaa

SEQ ID NO: 1159703 - DNA, 15 bp, Homo sapiens
ttgatgtttagaaaa

SEQ ID NO: 1159704 - DNA, 15 bp, Homo sapiens
ttgatgtttgtggcc

SEQ ID NO: 1159705 - DNA, 18 bp, Homo sapiens
ttgatgtttgtggcctca

SEQ ID NO: 1159706 - DNA, 19 bp, Homo sapiens
ttgatgtttgtggcctcag

SEQ ID NO: 1159707 - DNA, 20 bp, Homo sapiens
ttgatgtttgtggcctcaga

SEQ ID NO: 1159708 - DNA, 21 bp, Homo sapiens
ttgatgttttacgtgcaaaca

SEQ ID NO: 1159709 - DNA, 16 bp, Homo sapiens
ttgatgtttttaaagg

SEQ ID NO: 1159710 - DNA, 16 bp, Homo sapiens
ttgattaaaatctctt

SEQ ID NO: 1159711 - DNA, 17 bp, Homo sapiens
ttgattaaaatctcttg

SEQ ID NO: 1159712 - DNA, 21 bp, Homo sapiens
ttgattaaaatctcttgatta

SEQ ID NO: 1159713 - DNA, 16 bp, Homo sapiens
ttgattaatgtttctt

SEQ ID NO: 1159714 - DNA, 11 bp, Homo sapiens
ttgattacata

SEQ ID NO: 1159715 - DNA, 20 bp, Homo sapiens
ttgattacataatcaaagct

SEQ ID NO: 1159716 - DNA, 21 bp, Homo sapiens
ttgattagaaaataaactcat

SEQ ID NO: 1159717 - DNA, 17 bp, Homo sapiens
ttgattagtataatatt

SEQ ID NO: 1159718 - DNA, 21 bp, Homo sapiens
ttgattagtataatatttctt

SEQ ID NO: 1159719 - DNA, 14 bp, Homo sapiens
ttgattatcttcag

SEQ ID NO: 1159720 - DNA, 19 bp, Homo sapiens
ttgattatcttcagcccag

SEQ ID NO: 1159721 - DNA, 16 bp, Homo sapiens
ttgattattagccagg

SEQ ID NO: 1159722 - DNA, 20 bp, Homo sapiens
ttgattattctgattccact

SEQ ID NO: 1159723 - DNA, 16 bp, Homo sapiens
ttgattatttgcatgt

SEQ ID NO: 1159724 - DNA, 20 bp, Homo sapiens
ttgattcacctcctaaaaca

SEQ ID NO: 1159725 - DNA, 14 bp, Homo sapiens
ttgattcagcaaaa

SEQ ID NO: 1159726 - DNA, 22 bp, Homo sapiens
ttgattcagctcattatgaaaa

SEQ ID NO: 1159727 - DNA, 16 bp, Homo sapiens
ttgattcagctctgca

SEQ ID NO: 1159728 - DNA, 15 bp, Homo sapiens
ttgattcattttcct

SEQ ID NO: 1159729 - DNA, 18 bp, Homo sapiens
ttgattcctcgcgacatc

SEQ ID NO: 1159730 - DNA, 13 bp, Homo sapiens
ttgattcctggtt

SEQ ID NO: 1159731 - DNA, 12 bp, Homo sapiens
ttgattcttcct

SEQ ID NO: 1159732 - DNA, 15 bp, Homo sapiens
ttgattgagaaagat

SEQ ID NO: 1159733 - DNA, 13 bp, Homo sapiens
ttgattgaggagc

SEQ ID NO: 1159734 - DNA, 19 bp, Homo sapiens
ttgattgaggagctgcact

SEQ ID NO: 1159735 - DNA, 12 bp, Homo sapiens
tagtcttctcat

SEQ ID NO: 1159736 - DNA, 19 bp, Homo sapiens
tagtcttctcatagcatta

SEQ ID NO: 1159737 - DNA, 11 bp, Homo sapiens
tagtcttggaa

SEQ ID NO: 1159738 - DNA, 22 bp, Homo sapiens
tagtcttgtcccaattaaaata

SEQ ID NO: 1159739 - DNA, 15 bp, Homo sapiens
tagtctttggagaaa

SEQ ID NO: 1159740 - DNA, 15 bp, Homo sapiens
tagtcttttgcatgt

SEQ ID NO: 1159741 - DNA, 21 bp, Homo sapiens
tagtcttttgcttttggcaaa

SEQ ID NO: 1159742 - DNA, 19 bp, Homo sapiens
tagtcttttgtaatatcaa

SEQ ID NO: 1159743 - DNA, 17 bp, Homo sapiens
tagtgaaacataataat

SEQ ID NO: 1159744 - DNA, 17 bp, Homo sapiens
tagtgacacacactgtc

SEQ ID NO: 1159745 - DNA, 16 bp, Homo sapiens
tagtgaccattattca

SEQ ID NO: 1159746 - DNA, 14 bp, Homo sapiens
tagtgacttcctgg

SEQ ID NO: 1159747 - DNA, 16 bp, Homo sapiens
tagtgacttgtgtccc

SEQ ID NO: 1159748 - DNA, 15 bp, Homo sapiens
tagtgagacccctgt

SEQ ID NO: 1159749 - DNA, 23 bp, Homo sapiens
tagtgagccactcagtctcttcc

SEQ ID NO: 1159750 - DNA, 15 bp, Homo sapiens
tagtgagcctgggcc

SEQ ID NO: 1159751 - DNA, 13 bp, Homo sapiens
tagtgatgcagtt

SEQ ID NO: 1159752 - DNA, 15 bp, Homo sapiens
tagtgattaaatata

SEQ ID NO: 1159753 - DNA, 18 bp, Homo sapiens
tagtgcaaaactgtgtca

SEQ ID NO: 1159754 - DNA, 15 bp, Homo sapiens
tagtgcaagctgaag

SEQ ID NO: 1159755 - DNA, 17 bp, Homo sapiens
tagtgcagctgatttta

SEQ ID NO: 1159756 - DNA, 18 bp, Homo sapiens
tagtgcatttcaaggaat

SEQ ID NO: 1159757 - DNA, 19 bp, Homo sapiens
tagtgcatttttaaacttg

SEQ ID NO: 1159758 - DNA, 15 bp, Homo sapiens
tagtgccccacctcc

SEQ ID NO: 1159759 - DNA, 17 bp, Homo sapiens
tagtgccccagactgag

SEQ ID NO: 1159760 - DNA, 21 bp, Homo sapiens
tagtgccccagactgagctct

SEQ ID NO: 1159761 - DNA, 14 bp, Homo sapiens
tagtgcccgcctag

SEQ ID NO: 1159762 - DNA, 23 bp, Homo sapiens
tagtgccctccacagccgcagcc

SEQ ID NO: 1159763 - DNA, 14 bp, Homo sapiens
tagtgcctaaaatt

SEQ ID NO: 1159764 - DNA, 23 bp, Homo sapiens
tagtgcctaaaattgtatgaaaa

SEQ ID NO: 1159765 - DNA, 20 bp, Homo sapiens
tagtgcctaaagtgctgcag

SEQ ID NO: 1159766 - DNA, 18 bp, Homo sapiens
tagtgccttgcccacagg

SEQ ID NO: 1159767 - DNA, 19 bp, Homo sapiens
tagtgcggacaagttttaa

SEQ ID NO: 1159768 - DNA, 21 bp, Homo sapiens
tagtgctggtcagagagacct

SEQ ID NO: 1159769 - DNA, 16 bp, Homo sapiens
tagtgctgtaatattg

SEQ ID NO: 1159770 - DNA, 23 bp, Homo sapiens
tagtgctgtagagttcactgttg

SEQ ID NO: 1159771 - DNA, 13 bp, Homo sapiens
tagtgctgtgaaa

SEQ ID NO: 1159772 - DNA, 21 bp, Homo sapiens
tagtgcttaaaaatcattgat

SEQ ID NO: 1159773 - DNA, 15 bp, Homo sapiens
tagtgcttcagagtt

SEQ ID NO: 1159774 - DNA, 17 bp, Homo sapiens
tagtggaagagcagcct

SEQ ID NO: 1159775 - DNA, 23 bp, Homo sapiens
tagtggaagagcagcctgatggc

SEQ ID NO: 1159776 - DNA, 15 bp, Homo sapiens
tagtggacatggtca

SEQ ID NO: 1159777 - DNA, 23 bp, Homo sapiens
tagtggattactgccattcactt

SEQ ID NO: 1159778 - DNA, 14 bp, Homo sapiens
tagtgggccagggc

SEQ ID NO: 1159779 - DNA, 14 bp, Homo sapiens
tagtggggcctggg

SEQ ID NO: 1159780 - DNA, 16 bp, Homo sapiens
tagtggggcctgggag

SEQ ID NO: 1159781 - DNA, 21 bp, Homo sapiens
tagtggggtctccctctcctg

SEQ ID NO: 1159782 - DNA, 23 bp, Homo sapiens
tagtggggtctccctctcctgcc

SEQ ID NO: 1159783 - DNA, 13 bp, Homo sapiens
tagtgtaaaataa

SEQ ID NO: 1159784 - DNA, 23 bp, Homo sapiens
tagtgtaacttgcttaaatttct

SEQ ID NO: 1159785 - DNA, 17 bp, Homo sapiens
tagtgtataccacctgt

SEQ ID NO: 1159786 - DNA, 18 bp, Homo sapiens
tagtgtataccacctgta

SEQ ID NO: 1159787 - DNA, 22 bp, Homo sapiens
tagtgtataccacctgtacata

SEQ ID NO: 1159788 - DNA, 18 bp, Homo sapiens
tagtgtattaatcataga

SEQ ID NO: 1159789 - DNA, 16 bp, Homo sapiens
tagtgtccataaataa

SEQ ID NO: 1159790 - DNA, 20 bp, Homo sapiens
tagtgtccccatgggctccc

SEQ ID NO: 1159791 - DNA, 22 bp, Homo sapiens
tagtgtccccatgggctcccac

SEQ ID NO: 1159792 - DNA, 20 bp, Homo sapiens
tagtgtccccccttgaagca

SEQ ID NO: 1159793 - DNA, 18 bp, Homo sapiens
tagtgtctggatcagtaa

SEQ ID NO: 1159794 - DNA, 19 bp, Homo sapiens
tagtgtctggatcagtaaa

SEQ ID NO: 1159795 - DNA, 17 bp, Homo sapiens
tagtgtgaaatatatta

SEQ ID NO: 1159796 - DNA, 20 bp, Homo sapiens
tagtgtgacagtttccaaat

SEQ ID NO: 1159797 - DNA, 17 bp, Homo sapiens
tagtgtgagtggcagcc

SEQ ID NO: 1159798 - DNA, 21 bp, Homo sapiens
tagtgtgagtggcagccatgc

SEQ ID NO: 1159799 - DNA, 18 bp, Homo sapiens
tagtgtgtgcttacagta

SEQ ID NO: 1159800 - DNA, 23 bp, Homo sapiens
tagtgtgtgtgcagagtccattt

SEQ ID NO: 1159801 - DNA, 14 bp, Homo sapiens
tagtgtgtgtgcat

SEQ ID NO: 1159802 - DNA, 17 bp, Homo sapiens
tagtgtgtgtgcatgtg

SEQ ID NO: 1159803 - DNA, 19 bp, Homo sapiens
tagtgttcaaaacaaaatg

SEQ ID NO: 1159804 - DNA, 14 bp, Homo sapiens
tagtgttcacaaac

SEQ ID NO: 1159805 - DNA, 15 bp, Homo sapiens
tagtgttctgtttgt

SEQ ID NO: 1159806 - DNA, 22 bp, Homo sapiens
tagtgtttctagctaaataaat

SEQ ID NO: 1159807 - DNA, 23 bp, Homo sapiens
tagtgttttcaattttaaacata

SEQ ID NO: 1159808 - DNA, 14 bp, Homo sapiens
tagttaaaacacat

SEQ ID NO: 1159809 - DNA, 13 bp, Homo sapiens
tagttaaagaaag

SEQ ID NO: 1159810 - DNA, 18 bp, Homo sapiens
tagttaaagaaaggaaaa

SEQ ID NO: 1159811 - DNA, 20 bp, Homo sapiens
tagttaacacactaccgaat

SEQ ID NO: 1159812 - DNA, 14 bp, Homo sapiens
tagttaagacatga

SEQ ID NO: 1159813 - DNA, 21 bp, Homo sapiens
tagttaagacatgatttcctt

SEQ ID NO: 1159814 - DNA, 13 bp, Homo sapiens
tagttaagggctt

SEQ ID NO: 1159815 - DNA, 18 bp, Homo sapiens
tagttaccgagacatgaa

SEQ ID NO: 1159816 - DNA, 16 bp, Homo sapiens
tagttaggaaataaaa

SEQ ID NO: 1159817 - DNA, 19 bp, Homo sapiens
tagttaggatattgattta

SEQ ID NO: 1159818 - DNA, 15 bp, Homo sapiens
tagttagtagcatgt

SEQ ID NO: 1159819 - DNA, 14 bp, Homo sapiens
tagttagtttggaa

SEQ ID NO: 1159820 - DNA, 23 bp, Homo sapiens
tagttagtttggaaatggtactt

SEQ ID NO: 1159821 - DNA, 22 bp, Homo sapiens
tagttatagtgtttaactggca

SEQ ID NO: 1159822 - DNA, 21 bp, Homo sapiens
tagttcaatacagtgaaggtc

SEQ ID NO: 1159823 - DNA, 15 bp, Homo sapiens
tagttcacagacata

SEQ ID NO: 1159824 - DNA, 22 bp, Homo sapiens
tagttcactccatttggtcctt

SEQ ID NO: 1159825 - DNA, 14 bp, Homo sapiens
tagttcatatatac

SEQ ID NO: 1159826 - DNA, 18 bp, Homo sapiens
tagttcatccaatcctca

SEQ ID NO: 1159827 - DNA, 20 bp, Homo sapiens
tagttcatccaatcctcact

SEQ ID NO: 1159828 - DNA, 16 bp, Homo sapiens
tagttccagtttctcc

SEQ ID NO: 1159829 - DNA, 18 bp, Homo sapiens
tagttccagtttctcctt

SEQ ID NO: 1159830 - DNA, 16 bp, Homo sapiens
tagttcctattttcta

SEQ ID NO: 1159831 - DNA, 15 bp, Homo sapiens
tagttccttgcctta

SEQ ID NO: 1159832 - DNA, 20 bp, Homo sapiens
tagttctatccttttgcctg

SEQ ID NO: 1159833 - DNA, 22 bp, Homo sapiens
tagttctatccttttgcctgca

SEQ ID NO: 1159834 - DNA, 17 bp, Homo sapiens
tagttctctagggtctg

SEQ ID NO: 1159835 - DNA, 14 bp, Homo sapiens
tagttctgccaggc

SEQ ID NO: 1159836 - DNA, 16 bp, Homo sapiens
tagttctgctgccctc

SEQ ID NO: 1159837 - DNA, 16 bp, Homo sapiens
tagttctgtgtacttt

SEQ ID NO: 1159838 - DNA, 14 bp, Homo sapiens
tagttcttgaattg

SEQ ID NO: 1159839 - DNA, 16 bp, Homo sapiens
tagttctttcctcccc

SEQ ID NO: 1159840 - DNA, 22 bp, Homo sapiens
tagttctttcctccccctgcaa

SEQ ID NO: 1159841 - DNA, 12 bp, Homo sapiens
tagttgaaatga

SEQ ID NO: 1159842 - DNA, 18 bp, Homo sapiens
tagttgacaacctagaat

SEQ ID NO: 1159843 - DNA, 20 bp, Homo sapiens
tagttgacaacctagaatgt

SEQ ID NO: 1159844 - DNA, 17 bp, Homo sapiens
tagttgacaattctgca

SEQ ID NO: 1159845 - DNA, 17 bp, Homo sapiens
tagttgagccccaagtc

SEQ ID NO: 1159846 - DNA, 23 bp, Homo sapiens
tagttgcagactcagtttgtcag

SEQ ID NO: 1159847 - DNA, 19 bp, Homo sapiens
tagttgcatagcagtatat

SEQ ID NO: 1159848 - DNA, 20 bp, Homo sapiens
tagttgcatagcagtatatg

SEQ ID NO: 1159849 - DNA, 19 bp, Homo sapiens
tagttgccaacagttgtat

SEQ ID NO: 1159850 - DNA, 17 bp, Homo sapiens
tagttgccttaaaataa

SEQ ID NO: 1159851 - DNA, 11 bp, Homo sapiens
tagttggaatg

SEQ ID NO: 1159852 - DNA, 18 bp, Homo sapiens
tagttggcagaaatacag

SEQ ID NO: 1159853 - DNA, 19 bp, Homo sapiens
tagttggctagtactttga

SEQ ID NO: 1159854 - DNA, 20 bp, Homo sapiens
tagttggctagtactttgat

SEQ ID NO: 1159855 - DNA, 22 bp, Homo sapiens
tagttggctttcataaatcatg

SEQ ID NO: 1159856 - DNA, 20 bp, Homo sapiens
tagttgggtagaaaaattat

SEQ ID NO: 1159857 - DNA, 14 bp, Homo sapiens
tagttgtattcttc

SEQ ID NO: 1159858 - DNA, 13 bp, Homo sapiens
tagttgtgctttt

SEQ ID NO: 1159859 - DNA, 13 bp, Homo sapiens
ttgattgctttgc

SEQ ID NO: 1159860 - DNA, 19 bp, Homo sapiens
ttgattgctttgctgcaca

SEQ ID NO: 1159861 - DNA, 15 bp, Homo sapiens
ttgattgtcagctac

SEQ ID NO: 1159862 - DNA, 13 bp, Homo sapiens
ttgattgtttaag

SEQ ID NO: 1159863 - DNA, 12 bp, Homo sapiens
ttgatttatgca

SEQ ID NO: 1159864 - DNA, 14 bp, Homo sapiens
ttgatttgaagaac

SEQ ID NO: 1159865 - DNA, 11 bp, Homo sapiens
ttgatttgcat

SEQ ID NO: 1159866 - DNA, 16 bp, Homo sapiens
ttgatttgcatggatt

SEQ ID NO: 1159867 - DNA, 13 bp, Homo sapiens
ttgatttgcattg

SEQ ID NO: 1159868 - DNA, 19 bp, Homo sapiens
ttgatttgcattgaacaca

SEQ ID NO: 1159869 - DNA, 18 bp, Homo sapiens
ttgatttgtaccattcct

SEQ ID NO: 1159870 - DNA, 16 bp, Homo sapiens
ttgatttgttcttaca

SEQ ID NO: 1159871 - DNA, 14 bp, Homo sapiens
ttgattttaataca

SEQ ID NO: 1159872 - DNA, 15 bp, Homo sapiens
ttgattttaatacat

SEQ ID NO: 1159873 - DNA, 13 bp, Homo sapiens
ttgattttacaat

SEQ ID NO: 1159874 - DNA, 15 bp, Homo sapiens
ttgattttgaacttt

SEQ ID NO: 1159875 - DNA, 16 bp, Homo sapiens
ttgattttggaaagat

SEQ ID NO: 1159876 - DNA, 18 bp, Homo sapiens
ttgatttttaccgtttct

SEQ ID NO: 1159877 - DNA, 22 bp, Homo sapiens
ttgcaaaacggatgagttatta

SEQ ID NO: 1159878 - DNA, 16 bp, Homo sapiens
ttgcaaaataagtttt

SEQ ID NO: 1159879 - DNA, 14 bp, Homo sapiens
ttgcaaaatacatg

SEQ ID NO: 1159880 - DNA, 19 bp, Homo sapiens
ttgcaaaatagcatttgtt

SEQ ID NO: 1159881 - DNA, 16 bp, Homo sapiens
ttgcaaaatttccagt

SEQ ID NO: 1159882 - DNA, 22 bp, Homo sapiens
ttgcaaaatttccagtaccttt

SEQ ID NO: 1159883 - DNA, 20 bp, Homo sapiens
ttgcaaactatgcatctgag

SEQ ID NO: 1159884 - DNA, 19 bp, Homo sapiens
ttgcaaagaaagaaaaaaa

SEQ ID NO: 1159885 - DNA, 15 bp, Homo sapiens
ttgcaaagaccacct

SEQ ID NO: 1159886 - DNA, 17 bp, Homo sapiens
ttgcaaagaccacctcc

SEQ ID NO: 1159887 - DNA, 17 bp, Homo sapiens
ttgcaaagcgacagatt

SEQ ID NO: 1159888 - DNA, 20 bp, Homo sapiens
ttgcaaagtattgtaaatta

SEQ ID NO: 1159889 - DNA, 13 bp, Homo sapiens
ttgcaaagtgtat

SEQ ID NO: 1159890 - DNA, 12 bp, Homo sapiens
ttgcaaatcttg

SEQ ID NO: 1159891 - DNA, 17 bp, Homo sapiens
ttgcaaatcttgaaatt

SEQ ID NO: 1159892 - DNA, 18 bp, Homo sapiens
ttgcaaattatttattac

SEQ ID NO: 1159893 - DNA, 15 bp, Homo sapiens
ttgcaacacacagac

SEQ ID NO: 1159894 - DNA, 23 bp, Homo sapiens
ttgcaacaggggaggaaaaaaga

SEQ ID NO: 1159895 - DNA, 15 bp, Homo sapiens
ttgcaacagtgccat

SEQ ID NO: 1159896 - DNA, 13 bp, Homo sapiens
ttgcaaccaggaa

SEQ ID NO: 1159897 - DNA, 15 bp, Homo sapiens
ttgcaaccaggcagc

SEQ ID NO: 1159898 - DNA, 18 bp, Homo sapiens
ttgcaacctcaccttcct

SEQ ID NO: 1159899 - DNA, 18 bp, Homo sapiens
ttgcaactaaggacaaat

SEQ ID NO: 1159900 - DNA, 22 bp, Homo sapiens
ttgcaacttcatgtcaacttct

SEQ ID NO: 1159901 - DNA, 12 bp, Homo sapiens
ttgcaagccata

SEQ ID NO: 1159902 - DNA, 22 bp, Homo sapiens
ttgcaaggatttttccatgtgt

SEQ ID NO: 1159903 - DNA, 16 bp, Homo sapiens
ttgcaaggcagtctct

SEQ ID NO: 1159904 - DNA, 13 bp, Homo sapiens
ttgcaagggaaaa

SEQ ID NO: 1159905 - DNA, 22 bp, Homo sapiens
ttgcaagggaaaagtctcttgt

SEQ ID NO: 1159906 - DNA, 17 bp, Homo sapiens
ttgcaataacagctgca

SEQ ID NO: 1159907 - DNA, 20 bp, Homo sapiens
ttgcaataacagctgcaatt

SEQ ID NO: 1159908 - DNA, 13 bp, Homo sapiens
ttgcaataacttc

SEQ ID NO: 1159909 - DNA, 18 bp, Homo sapiens
ttgcaataacttctatat

SEQ ID NO: 1159910 - DNA, 19 bp, Homo sapiens
ttgcaatctaatctgaact

SEQ ID NO: 1159911 - DNA, 23 bp, Homo sapiens
ttgcaatgcttttatatggccca

SEQ ID NO: 1159912 - DNA, 16 bp, Homo sapiens
ttgcacacagatgtga

SEQ ID NO: 1159913 - DNA, 22 bp, Homo sapiens
ttgcacacagatgtgaaatgaa

SEQ ID NO: 1159914 - DNA, 21 bp, Homo sapiens
ttgcacagagcacacttattt

SEQ ID NO: 1159915 - DNA, 22 bp, Homo sapiens
ttgcacagccaacgagacacat

SEQ ID NO: 1159916 - DNA, 12 bp, Homo sapiens
ttgcacatgtga

SEQ ID NO: 1159917 - DNA, 13 bp, Homo sapiens
ttgcacattgttc

SEQ ID NO: 1159918 - DNA, 16 bp, Homo sapiens
ttgcacatttttttct

SEQ ID NO: 1159919 - DNA, 20 bp, Homo sapiens
ttgcaccaaattatcttgat

SEQ ID NO: 1159920 - DNA, 14 bp, Homo sapiens
ttgcaccactgcac

SEQ ID NO: 1159921 - DNA, 16 bp, Homo sapiens
ttgcaccactgcactc

SEQ ID NO: 1159922 - DNA, 18 bp, Homo sapiens
ttgcaccactgcactcca

SEQ ID NO: 1159923 - DNA, 23 bp, Homo sapiens
ttgcaccactgcactccagcttg

SEQ ID NO: 1159924 - DNA, 16 bp, Homo sapiens
ttgcaccatctgcttg

SEQ ID NO: 1159925 - DNA, 14 bp, Homo sapiens
ttgcaccattttca

SEQ ID NO: 1159926 - DNA, 13 bp, Homo sapiens
ttgcacccctcac

SEQ ID NO: 1159927 - DNA, 24 bp, Homo sapiens
ttgcacccctcactctggcctcag

SEQ ID NO: 1159928 - DNA, 12 bp, Homo sapiens
ttgcacccctcc

SEQ ID NO: 1159929 - DNA, 16 bp, Homo sapiens
ttgcacccgcctctcc

SEQ ID NO: 1159930 - DNA, 16 bp, Homo sapiens
ttgcaccgcctgccct

SEQ ID NO: 1159931 - DNA, 19 bp, Homo sapiens
ttgcaccgcctgccctccc

SEQ ID NO: 1159932 - DNA, 16 bp, Homo sapiens
ttgcacctatctcagc

SEQ ID NO: 1159933 - DNA, 20 bp, Homo sapiens
ttgcacctatctcagccata

SEQ ID NO: 1159934 - DNA, 21 bp, Homo sapiens
ttgcacctatctcagccatag

SEQ ID NO: 1159935 - DNA, 21 bp, Homo sapiens
ttgcacctcagcctcccaagt

SEQ ID NO: 1159936 - DNA, 14 bp, Homo sapiens
ttgcacctgagacc

SEQ ID NO: 1159937 - DNA, 13 bp, Homo sapiens
ttgcacctgtccc

SEQ ID NO: 1159938 - DNA, 16 bp, Homo sapiens
ttgcacctgtccccac

SEQ ID NO: 1159939 - DNA, 21 bp, Homo sapiens
ttgcaccttttcatgtacagc

SEQ ID NO: 1159940 - DNA, 21 bp, Homo sapiens
ttgcacgacgccctctcccca

SEQ ID NO: 1159941 - DNA, 17 bp, Homo sapiens
ttgcacgcccatgtgtg

SEQ ID NO: 1159942 - DNA, 14 bp, Homo sapiens
ttgcacgcctcccc

SEQ ID NO: 1159943 - DNA, 12 bp, Homo sapiens
ttgcacggctgc

SEQ ID NO: 1159944 - DNA, 22 bp, Homo sapiens
ttgcactaggaattctttgcat

SEQ ID NO: 1159945 - DNA, 14 bp, Homo sapiens
ttgcactgaacagg

SEQ ID NO: 1159946 - DNA, 23 bp, Homo sapiens
ttgcactgaatatataaacactc

SEQ ID NO: 1159947 - DNA, 13 bp, Homo sapiens
ttgcactttagac

SEQ ID NO: 1159948 - DNA, 19 bp, Homo sapiens
ttgcactttataaacactg

SEQ ID NO: 1159949 - DNA, 17 bp, Homo sapiens
ttgcagaaaattctgtg

SEQ ID NO: 1159950 - DNA, 22 bp, Homo sapiens
ttgcagaaacattttgtggtca

SEQ ID NO: 1159951 - DNA, 11 bp, Homo sapiens
ttgcagaactg

SEQ ID NO: 1159952 - DNA, 20 bp, Homo sapiens
ttgcagaagagggtgtgttt

SEQ ID NO: 1159953 - DNA, 19 bp, Homo sapiens
ttgcagaaggaaatgatgg

SEQ ID NO: 1159954 - DNA, 20 bp, Homo sapiens
ttgcagactagaattctagt

SEQ ID NO: 1159955 - DNA, 20 bp, Homo sapiens
ttgcagagatttcctccatg

SEQ ID NO: 1159956 - DNA, 16 bp, Homo sapiens
ttgcagaggagcccag

SEQ ID NO: 1159957 - DNA, 18 bp, Homo sapiens
ttgcagatatctgcatgt

SEQ ID NO: 1159958 - DNA, 12 bp, Homo sapiens
ttgcagattcta

SEQ ID NO: 1159959 - DNA, 16 bp, Homo sapiens
ttgcagattttcttaa

SEQ ID NO: 1159960 - DNA, 13 bp, Homo sapiens
ttgcagcagagga

SEQ ID NO: 1159961 - DNA, 17 bp, Homo sapiens
ttgcagcagaggagctg

SEQ ID NO: 1159962 - DNA, 11 bp, Homo sapiens
ttgcagcaggg

SEQ ID NO: 1159963 - DNA, 17 bp, Homo sapiens
ttgcagcagggctgggc

SEQ ID NO: 1159964 - DNA, 12 bp, Homo sapiens
ttgcagcagtga

SEQ ID NO: 1159965 - DNA, 23 bp, Homo sapiens
ttgcagcagtgagtctcttcaga

SEQ ID NO: 1159966 - DNA, 16 bp, Homo sapiens
ttgcagcatgagactt

SEQ ID NO: 1159967 - DNA, 15 bp, Homo sapiens
ttgcagcccttgtga

SEQ ID NO: 1159968 - DNA, 18 bp, Homo sapiens
ttgcagccggcacagggt

SEQ ID NO: 1159969 - DNA, 20 bp, Homo sapiens
ttgcagccggcacagggtct

SEQ ID NO: 1159970 - DNA, 15 bp, Homo sapiens
ttgcagcctgctcta

SEQ ID NO: 1159971 - DNA, 14 bp, Homo sapiens
ttgcagcttcaact

SEQ ID NO: 1159972 - DNA, 14 bp, Homo sapiens
ttgcagctttatgt

SEQ ID NO: 1159973 - DNA, 15 bp, Homo sapiens
ttgcaggattccctt

SEQ ID NO: 1159974 - DNA, 22 bp, Homo sapiens
ttgcaggattcccttctgggct

SEQ ID NO: 1159975 - DNA, 12 bp, Homo sapiens
ttgcagggtact

SEQ ID NO: 1159976 - DNA, 17 bp, Homo sapiens
ttgcagggtcctcttct

SEQ ID NO: 1159977 - DNA, 23 bp, Homo sapiens
ttgcagggtcctcttctgggcct

SEQ ID NO: 1159978 - DNA, 20 bp, Homo sapiens
ttgcagtagagtcatctcca

SEQ ID NO: 1159979 - DNA, 23 bp, Homo sapiens
ttgcagtgagcagggtggggtct

SEQ ID NO: 1159980 - DNA, 20 bp, Homo sapiens
ttgcagtgtggtgagatcat

SEQ ID NO: 1159981 - DNA, 13 bp, Homo sapiens
ttgcagttcacct

SEQ ID NO: 1159982 - DNA, 16 bp, Homo sapiens
ttgcagttcagcacca

SEQ ID NO: 1159983 - DNA, 13 bp, Homo sapiens
ttgcagtttatca

SEQ ID NO: 1159984 - DNA, 13 bp, Homo sapiens
ttgcagttttgta

SEQ ID NO: 1159985 - DNA, 12 bp, Homo sapiens
tagttgtgtctg

SEQ ID NO: 1159986 - DNA, 15 bp, Homo sapiens
tagttgtgtttcaac

SEQ ID NO: 1159987 - DNA, 23 bp, Homo sapiens
tagtttaccacttgcctttttct

SEQ ID NO: 1159988 - DNA, 22 bp, Homo sapiens
tagtttacctgaataaatggta

SEQ ID NO: 1159989 - DNA, 16 bp, Homo sapiens
tagtttaggaaaatga

SEQ ID NO: 1159990 - DNA, 12 bp, Homo sapiens
tagtttatctta

SEQ ID NO: 1159991 - DNA, 18 bp, Homo sapiens
tagtttattggaagtgtt

SEQ ID NO: 1159992 - DNA, 17 bp, Homo sapiens
tagtttcaaatctgtaa

SEQ ID NO: 1159993 - DNA, 16 bp, Homo sapiens
tagtttcaccactcct

SEQ ID NO: 1159994 - DNA, 18 bp, Homo sapiens
tagtttcaccactcctct

SEQ ID NO: 1159995 - DNA, 19 bp, Homo sapiens
tagtttcaccactcctctc

SEQ ID NO: 1159996 - DNA, 18 bp, Homo sapiens
tagtttcagatatatatc

SEQ ID NO: 1159997 - DNA, 20 bp, Homo sapiens
tagtttcatataaagtatca

SEQ ID NO: 1159998 - DNA, 16 bp, Homo sapiens
tagtttctagaggcct

SEQ ID NO: 1159999 - DNA, 16 bp, Homo sapiens
tagtttctttctgtct

SEQ ID NO: 1160000 - DNA, 22 bp, Homo sapiens
tagtttgaacagatatgttttt

SEQ ID NO: 1160001 - DNA, 17 bp, Homo sapiens
tagtttgatcagacagc

SEQ ID NO: 1160002 - DNA, 23 bp, Homo sapiens
tagtttgattaaattcttgcaaa

SEQ ID NO: 1160003 - DNA, 21 bp, Homo sapiens
tagtttgattattcagtgtca

SEQ ID NO: 1160004 - DNA, 19 bp, Homo sapiens
tagtttgcctgcagtttct

SEQ ID NO: 1160005 - DNA, 11 bp, Homo sapiens
tagtttggata

SEQ ID NO: 1160006 - DNA, 15 bp, Homo sapiens
tagtttggatatttt

SEQ ID NO: 1160007 - DNA, 21 bp, Homo sapiens
tagtttggatatttttgtact

SEQ ID NO: 1160008 - DNA, 22 bp, Homo sapiens
tagtttggatatttttgtactt

SEQ ID NO: 1160009 - DNA, 17 bp, Homo sapiens
tagtttgtacatgcatt

SEQ ID NO: 1160010 - DNA, 23 bp, Homo sapiens
tagtttgtgggttaaacaaaatg

SEQ ID NO: 1160011 - DNA, 14 bp, Homo sapiens
tagttttactttta

SEQ ID NO: 1160012 - DNA, 22 bp, Homo sapiens
tagttttagtgatttttttcat

SEQ ID NO: 1160013 - DNA, 17 bp, Homo sapiens
tagttttagttgcagaa

SEQ ID NO: 1160014 - DNA, 22 bp, Homo sapiens
tagttttcatccataactgaac

SEQ ID NO: 1160015 - DNA, 19 bp, Homo sapiens
tagttttgtaaaaactgaa

SEQ ID NO: 1160016 - DNA, 15 bp, Homo sapiens
tagttttgtaactta

SEQ ID NO: 1160017 - DNA, 14 bp, Homo sapiens
tagttttgtttaat

SEQ ID NO: 1160018 - DNA, 16 bp, Homo sapiens
tagtttttaattaaaa

SEQ ID NO: 1160019 - DNA, 20 bp, Homo sapiens
tagtttttgcagggttttat

SEQ ID NO: 1160020 - DNA, 17 bp, Homo sapiens
tagtttttgtaatttat

SEQ ID NO: 1160021 - DNA, 18 bp, Homo sapiens
tagttttttttgtaaact

SEQ ID NO: 1160022 - DNA, 21 bp, Homo sapiens
tagttttttttgtaaactgta

SEQ ID NO: 1160023 - DNA, 17 bp, Homo sapiens
tataaaaaatggttcag

SEQ ID NO: 1160024 - DNA, 13 bp, Homo sapiens
tataaaaaatgta

SEQ ID NO: 1160025 - DNA, 14 bp, Homo sapiens
tataaaaaatgtaa

SEQ ID NO: 1160026 - DNA, 11 bp, Homo sapiens
tataaaaacaa

SEQ ID NO: 1160027 - DNA, 12 bp, Homo sapiens
tataaaaacaga

SEQ ID NO: 1160028 - DNA, 20 bp, Homo sapiens
tataaaaaccccaaactgtt

SEQ ID NO: 1160029 - DNA, 19 bp, Homo sapiens
tataaaaagaaaagataaa

SEQ ID NO: 1160030 - DNA, 14 bp, Homo sapiens
tataaaaagataat

SEQ ID NO: 1160031 - DNA, 21 bp, Homo sapiens
tataaaaaggaaattagtctt

SEQ ID NO: 1160032 - DNA, 14 bp, Homo sapiens
tataaaaatggctt

SEQ ID NO: 1160033 - DNA, 22 bp, Homo sapiens
tataaaactgcgttaaaggctc

SEQ ID NO: 1160034 - DNA, 14 bp, Homo sapiens
tataaaagaaacac

SEQ ID NO: 1160035 - DNA, 18 bp, Homo sapiens
tataaaagctatggtgag

SEQ ID NO: 1160036 - DNA, 19 bp, Homo sapiens
tataaaaggatgttacaag

SEQ ID NO: 1160037 - DNA, 20 bp, Homo sapiens
tataaaaggcaaatgtgtac

SEQ ID NO: 1160038 - DNA, 17 bp, Homo sapiens
tataaaataaacttctt

SEQ ID NO: 1160039 - DNA, 14 bp, Homo sapiens
tataaaataaatat

SEQ ID NO: 1160040 - DNA, 17 bp, Homo sapiens
tataaaataaatatata

SEQ ID NO: 1160041 - DNA, 21 bp, Homo sapiens
tataaaataaatatatataaa

SEQ ID NO: 1160042 - DNA, 19 bp, Homo sapiens
tataaaatagacaaataga

SEQ ID NO: 1160043 - DNA, 21 bp, Homo sapiens
tataaaatatgaagacataaa

SEQ ID NO: 1160044 - DNA, 18 bp, Homo sapiens
tataaaattaaatgcctt

SEQ ID NO: 1160045 - DNA, 19 bp, Homo sapiens
tataaacactccacagtgt

SEQ ID NO: 1160046 - DNA, 20 bp, Homo sapiens
tataaacagacaatatgtga

SEQ ID NO: 1160047 - DNA, 15 bp, Homo sapiens
tataaacatattttt

SEQ ID NO: 1160048 - DNA, 18 bp, Homo sapiens
tataaacatatttttata

SEQ ID NO: 1160049 - DNA, 20 bp, Homo sapiens
tataaacatatttttatact

SEQ ID NO: 1160050 - DNA, 17 bp, Homo sapiens
tataaacatcacacaca

SEQ ID NO: 1160051 - DNA, 18 bp, Homo sapiens
tataaacatcacacacac

SEQ ID NO: 1160052 - DNA, 21 bp, Homo sapiens
tataaactaattttgtacgta

SEQ ID NO: 1160053 - DNA, 17 bp, Homo sapiens
tataaactaggtaaaat

SEQ ID NO: 1160054 - DNA, 16 bp, Homo sapiens
tataaactataaactt

SEQ ID NO: 1160055 - DNA, 11 bp, Homo sapiens
tataaactgag

SEQ ID NO: 1160056 - DNA, 17 bp, Homo sapiens
tataaactgctgtcaat

SEQ ID NO: 1160057 - DNA, 23 bp, Homo sapiens
tataaacttagtgcggacaagtt

SEQ ID NO: 1160058 - DNA, 13 bp, Homo sapiens
tataaacttcaga

SEQ ID NO: 1160059 - DNA, 16 bp, Homo sapiens
tataaactttaccttt

SEQ ID NO: 1160060 - DNA, 22 bp, Homo sapiens
tataaagaacaaggtagttttt

SEQ ID NO: 1160061 - DNA, 23 bp, Homo sapiens
tataaagaaggttggtgaatttc

SEQ ID NO: 1160062 - DNA, 22 bp, Homo sapiens
tataaagacaagtatgaatatt

SEQ ID NO: 1160063 - DNA, 17 bp, Homo sapiens
tataaagattgtactta

SEQ ID NO: 1160064 - DNA, 24 bp, Homo sapiens
tataaagattgtacttagccagtt

SEQ ID NO: 1160065 - DNA, 17 bp, Homo sapiens
tataaagcaaattactc

SEQ ID NO: 1160066 - DNA, 19 bp, Homo sapiens
tataaagcattactctttt

SEQ ID NO: 1160067 - DNA, 21 bp, Homo sapiens
tataaagcctgtattctcaaa

SEQ ID NO: 1160068 - DNA, 20 bp, Homo sapiens
tataaagtatatattaggat

SEQ ID NO: 1160069 - DNA, 21 bp, Homo sapiens
tataaataaaatcatgtagtt

SEQ ID NO: 1160070 - DNA, 13 bp, Homo sapiens
tataaataataaa

SEQ ID NO: 1160071 - DNA, 19 bp, Homo sapiens
tataaataataaagaactc

SEQ ID NO: 1160072 - DNA, 23 bp, Homo sapiens
tataaatacgtattacaaacaag

SEQ ID NO: 1160073 - DNA, 16 bp, Homo sapiens
tataaatagctgaaaa

SEQ ID NO: 1160074 - DNA, 18 bp, Homo sapiens
tataaatagctgaaaact

SEQ ID NO: 1160075 - DNA, 15 bp, Homo sapiens
tataaatatcattgt

SEQ ID NO: 1160076 - DNA, 23 bp, Homo sapiens
tataaatcaacaccttaatatgc

SEQ ID NO: 1160077 - DNA, 17 bp, Homo sapiens
tataaatgacaaagtgt

SEQ ID NO: 1160078 - DNA, 14 bp, Homo sapiens
tataaatgctattt

SEQ ID NO: 1160079 - DNA, 16 bp, Homo sapiens
tataaatggtgttttt

SEQ ID NO: 1160080 - DNA, 18 bp, Homo sapiens
tataaatgtaaaaatgaa

SEQ ID NO: 1160081 - DNA, 20 bp, Homo sapiens
tataaatgtacatttccaaa

SEQ ID NO: 1160082 - DNA, 23 bp, Homo sapiens
tataaatgtacatttccaaatga

SEQ ID NO: 1160083 - DNA, 13 bp, Homo sapiens
tataaatgtgtgt

SEQ ID NO: 1160084 - DNA, 16 bp, Homo sapiens
tataaatgtgtgtatg

SEQ ID NO: 1160085 - DNA, 15 bp, Homo sapiens
tataaatgtgtttat

SEQ ID NO: 1160086 - DNA, 13 bp, Homo sapiens
tataaattaaata

SEQ ID NO: 1160087 - DNA, 19 bp, Homo sapiens
tataaattaaatatatgta

SEQ ID NO: 1160088 - DNA, 23 bp, Homo sapiens
tataaattaaatatatgtatgta

SEQ ID NO: 1160089 - DNA, 21 bp, Homo sapiens
tataaattactatctgttgaa

SEQ ID NO: 1160090 - DNA, 22 bp, Homo sapiens
tataaattactatctgttgaaa

SEQ ID NO: 1160091 - DNA, 16 bp, Homo sapiens
tataaattattcagaa

SEQ ID NO: 1160092 - DNA, 22 bp, Homo sapiens
tataaattattcagaactattt

SEQ ID NO: 1160093 - DNA, 13 bp, Homo sapiens
tataaattcactt

SEQ ID NO: 1160094 - DNA, 20 bp, Homo sapiens
tataaattcctctttgcttt

SEQ ID NO: 1160095 - DNA, 21 bp, Homo sapiens
tataaattcctctttgctttg

SEQ ID NO: 1160096 - DNA, 19 bp, Homo sapiens
tataaattgtacattttgt

SEQ ID NO: 1160097 - DNA, 23 bp, Homo sapiens
tataaattgtctttaaaaactgt

SEQ ID NO: 1160098 - DNA, 16 bp, Homo sapiens
tataaatttaagaaaa

SEQ ID NO: 1160099 - DNA, 15 bp, Homo sapiens
tataaatttaagcaa

SEQ ID NO: 1160100 - DNA, 16 bp, Homo sapiens
tataaatttatttact

SEQ ID NO: 1160101 - DNA, 22 bp, Homo sapiens
tataaatttatttactgctagt

SEQ ID NO: 1160102 - DNA, 15 bp, Homo sapiens
tataaatttttacct

SEQ ID NO: 1160103 - DNA, 17 bp, Homo sapiens
tataaattttttttgtt

SEQ ID NO: 1160104 - DNA, 14 bp, Homo sapiens
tataacagatcctt

SEQ ID NO: 1160105 - DNA, 22 bp, Homo sapiens
tataacagtgtctttctagcca

SEQ ID NO: 1160106 - DNA, 16 bp, Homo sapiens
tataacagtgtttaaa

SEQ ID NO: 1160107 - DNA, 17 bp, Homo sapiens
tataacagttatatttt

SEQ ID NO: 1160108 - DNA, 16 bp, Homo sapiens
ttgcagttttgtaagc

SEQ ID NO: 1160109 - DNA, 13 bp, Homo sapiens
ttgcataagagct

SEQ ID NO: 1160110 - DNA, 23 bp, Homo sapiens
ttgcatattgaaaagcacagagg

SEQ ID NO: 1160111 - DNA, 21 bp, Homo sapiens
ttgcatccattgttgtgtctg

SEQ ID NO: 1160112 - DNA, 15 bp, Homo sapiens
ttgcatcctgctggg

SEQ ID NO: 1160113 - DNA, 20 bp, Homo sapiens
ttgcatctaatgaaaaacaa

SEQ ID NO: 1160114 - DNA, 17 bp, Homo sapiens
ttgcatctcaaaattat

SEQ ID NO: 1160115 - DNA, 19 bp, Homo sapiens
ttgcatctgggtagctgta

SEQ ID NO: 1160116 - DNA, 20 bp, Homo sapiens
ttgcatctgggtagctgtaa

SEQ ID NO: 1160117 - DNA, 23 bp, Homo sapiens
ttgcatctgtataagtaagaaaa

SEQ ID NO: 1160118 - DNA, 18 bp, Homo sapiens
ttgcatgaccacatagaa

SEQ ID NO: 1160119 - DNA, 18 bp, Homo sapiens
ttgcatgctgataatcat

SEQ ID NO: 1160120 - DNA, 23 bp, Homo sapiens
ttgcatggaaatcagccaagttt

SEQ ID NO: 1160121 - DNA, 16 bp, Homo sapiens
ttgcatggcagggcct

SEQ ID NO: 1160122 - DNA, 16 bp, Homo sapiens
ttgcatgttatgttta

SEQ ID NO: 1160123 - DNA, 17 bp, Homo sapiens
ttgcatgttatgtttaa

SEQ ID NO: 1160124 - DNA, 20 bp, Homo sapiens
ttgcattaaattcacaaact

SEQ ID NO: 1160125 - DNA, 11 bp, Homo sapiens
ttgcattcaaa

SEQ ID NO: 1160126 - DNA, 12 bp, Homo sapiens
ttgcattcaaat

SEQ ID NO: 1160127 - DNA, 20 bp, Homo sapiens
ttgcattccttacttgcact

SEQ ID NO: 1160128 - DNA, 21 bp, Homo sapiens
ttgcattccttacttgcactg

SEQ ID NO: 1160129 - DNA, 23 bp, Homo sapiens
ttgcattgaacacaaactgtaaa

SEQ ID NO: 1160130 - DNA, 14 bp, Homo sapiens
ttgcattgaatata

SEQ ID NO: 1160131 - DNA, 21 bp, Homo sapiens
ttgcattgaccgcgactaatt

SEQ ID NO: 1160132 - DNA, 22 bp, Homo sapiens
ttgcatttaaaacagacactgg

SEQ ID NO: 1160133 - DNA, 19 bp, Homo sapiens
ttgcatttatgatgcagtt

SEQ ID NO: 1160134 - DNA, 15 bp, Homo sapiens
ttgcatttggtcaag

SEQ ID NO: 1160135 - DNA, 18 bp, Homo sapiens
ttgcatttttgttttgaa

SEQ ID NO: 1160136 - DNA, 21 bp, Homo sapiens
ttgcatttttgttttgaaagt

SEQ ID NO: 1160137 - DNA, 20 bp, Homo sapiens
ttgccaaaatgttggctgcg

SEQ ID NO: 1160138 - DNA, 16 bp, Homo sapiens
ttgccaaatatgtcct

SEQ ID NO: 1160139 - DNA, 21 bp, Homo sapiens
ttgccaagaaaatgaagggat

SEQ ID NO: 1160140 - DNA, 22 bp, Homo sapiens
ttgccaagaaaatgaagggatt

SEQ ID NO: 1160141 - DNA, 22 bp, Homo sapiens
ttgccaagctccaagccccatc

SEQ ID NO: 1160142 - DNA, 16 bp, Homo sapiens
ttgccaagttgctgtc

SEQ ID NO: 1160143 - DNA, 21 bp, Homo sapiens
ttgccaatgaggtctgaaatg

SEQ ID NO: 1160144 - DNA, 20 bp, Homo sapiens
ttgccacaagtccagctggg

SEQ ID NO: 1160145 - DNA, 20 bp, Homo sapiens
ttgccacaccaatcagagag

SEQ ID NO: 1160146 - DNA, 18 bp, Homo sapiens
ttgccacagcttttgcaa

SEQ ID NO: 1160147 - DNA, 20 bp, Homo sapiens
ttgccacagtagaactgtct

SEQ ID NO: 1160148 - DNA, 17 bp, Homo sapiens
ttgccaccacctctgtg

SEQ ID NO: 1160149 - DNA, 18 bp, Homo sapiens
ttgccaccacctctgtgg

SEQ ID NO: 1160150 - DNA, 18 bp, Homo sapiens
ttgccaccactagagctg

SEQ ID NO: 1160151 - DNA, 19 bp, Homo sapiens
ttgccacccccagttccta

SEQ ID NO: 1160152 - DNA, 19 bp, Homo sapiens
ttgccacctctggccaaat

SEQ ID NO: 1160153 - DNA, 15 bp, Homo sapiens
ttgccacctgttaaa

SEQ ID NO: 1160154 - DNA, 21 bp, Homo sapiens
ttgccactaattttagtattc

SEQ ID NO: 1160155 - DNA, 14 bp, Homo sapiens
ttgccactgcctct

SEQ ID NO: 1160156 - DNA, 17 bp, Homo sapiens
ttgccactttggcttct

SEQ ID NO: 1160157 - DNA, 22 bp, Homo sapiens
ttgccactttggcttctcctgt

SEQ ID NO: 1160158 - DNA, 15 bp, Homo sapiens
ttgccagagaaacta

SEQ ID NO: 1160159 - DNA, 19 bp, Homo sapiens
ttgccagagcaggagcccc

SEQ ID NO: 1160160 - DNA, 21 bp, Homo sapiens
ttgccagagcaggagcccctg

SEQ ID NO: 1160161 - DNA, 13 bp, Homo sapiens
ttgccagcaaata

SEQ ID NO: 1160162 - DNA, 17 bp, Homo sapiens
ttgccagcaaataaata

SEQ ID NO: 1160163 - DNA, 12 bp, Homo sapiens
ttgccagcacag

SEQ ID NO: 1160164 - DNA, 13 bp, Homo sapiens
ttgccagcacagg

SEQ ID NO: 1160165 - DNA, 14 bp, Homo sapiens
ttgccagcacaggg

SEQ ID NO: 1160166 - DNA, 17 bp, Homo sapiens
ttgccagcacaggggcc

SEQ ID NO: 1160167 - DNA, 16 bp, Homo sapiens
ttgccagcctccttgc

SEQ ID NO: 1160168 - DNA, 19 bp, Homo sapiens
ttgccagctgctgctggat

SEQ ID NO: 1160169 - DNA, 12 bp, Homo sapiens
ttgccagctttt

SEQ ID NO: 1160170 - DNA, 22 bp, Homo sapiens
ttgccaggaaaggagagtactt

SEQ ID NO: 1160171 - DNA, 21 bp, Homo sapiens
ttgccaggagatggccccaac

SEQ ID NO: 1160172 - DNA, 13 bp, Homo sapiens
ttgccagtcagca

SEQ ID NO: 1160173 - DNA, 15 bp, Homo sapiens
ttgccagtcagcaac

SEQ ID NO: 1160174 - DNA, 22 bp, Homo sapiens
ttgccatcactggtccaggtct

SEQ ID NO: 1160175 - DNA, 17 bp, Homo sapiens
ttgccatccattctgga

SEQ ID NO: 1160176 - DNA, 21 bp, Homo sapiens
ttgccatcctaaaagccaccc

SEQ ID NO: 1160177 - DNA, 14 bp, Homo sapiens
ttgccatcctgatg

SEQ ID NO: 1160178 - DNA, 21 bp, Homo sapiens
ttgccatgacatttcatctgg

SEQ ID NO: 1160179 - DNA, 23 bp, Homo sapiens
ttgccatgacatttcatctgggt

SEQ ID NO: 1160180 - DNA, 14 bp, Homo sapiens
ttgccatgcaggaa

SEQ ID NO: 1160181 - DNA, 20 bp, Homo sapiens
ttgccatggagatctgaagg

SEQ ID NO: 1160182 - DNA, 21 bp, Homo sapiens
ttgccatggagatctgaaggg

SEQ ID NO: 1160183 - DNA, 18 bp, Homo sapiens
ttgccatgggcctgctgc

SEQ ID NO: 1160184 - DNA, 16 bp, Homo sapiens
ttgccatgtagacccc

SEQ ID NO: 1160185 - DNA, 19 bp, Homo sapiens
ttgccatttttattagaaa

SEQ ID NO: 1160186 - DNA, 14 bp, Homo sapiens
ttgcccacccctca

SEQ ID NO: 1160187 - DNA, 15 bp, Homo sapiens
ttgcccacccctcac

SEQ ID NO: 1160188 - DNA, 16 bp, Homo sapiens
ttgcccagagatgcct

SEQ ID NO: 1160189 - DNA, 20 bp, Homo sapiens
ttgcccagtacatttaaatt

SEQ ID NO: 1160190 - DNA, 13 bp, Homo sapiens
ttgcccagtcctg

SEQ ID NO: 1160191 - DNA, 17 bp, Homo sapiens
ttgcccatcagccattt

SEQ ID NO: 1160192 - DNA, 17 bp, Homo sapiens
ttgcccatttatattca

SEQ ID NO: 1160193 - DNA, 14 bp, Homo sapiens
ttgccccaagtcct

SEQ ID NO: 1160194 - DNA, 11 bp, Homo sapiens
ttgccccactc

SEQ ID NO: 1160195 - DNA, 13 bp, Homo sapiens
ttgccccactcct

SEQ ID NO: 1160196 - DNA, 16 bp, Homo sapiens
ttgccccactcctctc

SEQ ID NO: 1160197 - DNA, 15 bp, Homo sapiens
ttgccccaggccagg

SEQ ID NO: 1160198 - DNA, 14 bp, Homo sapiens
ttgccccatcactg

SEQ ID NO: 1160199 - DNA, 15 bp, Homo sapiens
ttgcccccatccctc

SEQ ID NO: 1160200 - DNA, 13 bp, Homo sapiens
ttgcccccatggg

SEQ ID NO: 1160201 - DNA, 23 bp, Homo sapiens
ttgcccccatggggtccttggag

SEQ ID NO: 1160202 - DNA, 16 bp, Homo sapiens
ttgccccccaccccag

SEQ ID NO: 1160203 - DNA, 19 bp, Homo sapiens
ttgcccccgacggctgtga

SEQ ID NO: 1160204 - DNA, 23 bp, Homo sapiens
ttgccccggccccggccccagcc

SEQ ID NO: 1160205 - DNA, 20 bp, Homo sapiens
ttgcccgaaactaagccagg

SEQ ID NO: 1160206 - DNA, 15 bp, Homo sapiens
ttgcccgccagcctc

SEQ ID NO: 1160207 - DNA, 17 bp, Homo sapiens
ttgcccgcgctcaggag

SEQ ID NO: 1160208 - DNA, 21 bp, Homo sapiens
ttgcccgctcccacagcttcc

SEQ ID NO: 1160209 - DNA, 22 bp, Homo sapiens
ttgcccgctcccacagcttcct

SEQ ID NO: 1160210 - DNA, 17 bp, Homo sapiens
ttgcccgtcgtgtgctg

SEQ ID NO: 1160211 - DNA, 17 bp, Homo sapiens
ttgccctccgcctggga

SEQ ID NO: 1160212 - DNA, 18 bp, Homo sapiens
ttgccctgacctcccagc

SEQ ID NO: 1160213 - DNA, 16 bp, Homo sapiens
ttgcccttcacagtgt

SEQ ID NO: 1160214 - DNA, 11 bp, Homo sapiens
ttgcccttccc

SEQ ID NO: 1160215 - DNA, 13 bp, Homo sapiens
ttgcccttccctg

SEQ ID NO: 1160216 - DNA, 19 bp, Homo sapiens
ttgcccttccctgtccctc

SEQ ID NO: 1160217 - DNA, 17 bp, Homo sapiens
ttgcccttgccctgacc

SEQ ID NO: 1160218 - DNA, 18 bp, Homo sapiens
ttgcccttgccctgacct

SEQ ID NO: 1160219 - DNA, 22 bp, Homo sapiens
ttgccctttagggctgttgcta

SEQ ID NO: 1160220 - DNA, 14 bp, Homo sapiens
ttgccgagagaggc

SEQ ID NO: 1160221 - DNA, 21 bp, Homo sapiens
ttgccgtctcatcttctctca

SEQ ID NO: 1160222 - DNA, 22 bp, Homo sapiens
ttgcctaaatcccaagaaatgg

SEQ ID NO: 1160223 - DNA, 22 bp, Homo sapiens
ttgcctaaatttaatgctgcct

SEQ ID NO: 1160224 - DNA, 22 bp, Homo sapiens
ttgcctagaaatatctttctct

SEQ ID NO: 1160225 - DNA, 23 bp, Homo sapiens
ttgcctagaaatatctttctctt

SEQ ID NO: 1160226 - DNA, 19 bp, Homo sapiens
ttgcctataatacttgcaa

SEQ ID NO: 1160227 - DNA, 14 bp, Homo sapiens
ttgcctatctttaa

SEQ ID NO: 1160228 - DNA, 20 bp, Homo sapiens
ttgcctcagtagatactaaa

SEQ ID NO: 1160229 - DNA, 12 bp, Homo sapiens
ttgcctcccagg

SEQ ID NO: 1160230 - DNA, 19 bp, Homo sapiens
ttgcctcccaggcaagcag

SEQ ID NO: 1160231 - DNA, 20 bp, Homo sapiens
ttgcctccccatttcccatc

SEQ ID NO: 1160232 - DNA, 22 bp, Homo sapiens
tataacagttttgagtaattca

SEQ ID NO: 1160233 - DNA, 16 bp, Homo sapiens
tataaccagacacata

SEQ ID NO: 1160234 - DNA, 13 bp, Homo sapiens
tataaccattaca

SEQ ID NO: 1160235 - DNA, 16 bp, Homo sapiens
tataaccattacatgt

SEQ ID NO: 1160236 - DNA, 15 bp, Homo sapiens
tataaccccagcctg

SEQ ID NO: 1160237 - DNA, 16 bp, Homo sapiens
tataaccccagcctga

SEQ ID NO: 1160238 - DNA, 23 bp, Homo sapiens
tataacctgatgccataaataca

SEQ ID NO: 1160239 - DNA, 14 bp, Homo sapiens
tataacctggcaaa

SEQ ID NO: 1160240 - DNA, 20 bp, Homo sapiens
tataacctggcaaaatcttg

SEQ ID NO: 1160241 - DNA, 23 bp, Homo sapiens
tataaccttcatttttaagactg

SEQ ID NO: 1160242 - DNA, 20 bp, Homo sapiens
tataacggtttaattctgtc

SEQ ID NO: 1160243 - DNA, 14 bp, Homo sapiens
tataacgtgttcaa

SEQ ID NO: 1160244 - DNA, 19 bp, Homo sapiens
tataacgtgttcaatattt

SEQ ID NO: 1160245 - DNA, 21 bp, Homo sapiens
tataactagacatctgctgtt

SEQ ID NO: 1160246 - DNA, 17 bp, Homo sapiens
tataactcatcataaaa

SEQ ID NO: 1160247 - DNA, 18 bp, Homo sapiens
tataactcatcataaaat

SEQ ID NO: 1160248 - DNA, 23 bp, Homo sapiens
tataactctgcactactcctctg

SEQ ID NO: 1160249 - DNA, 13 bp, Homo sapiens
tataactgtttta

SEQ ID NO: 1160250 - DNA, 14 bp, Homo sapiens
tataactgttttag

SEQ ID NO: 1160251 - DNA, 20 bp, Homo sapiens
tataactgttttagaaattg

SEQ ID NO: 1160252 - DNA, 22 bp, Homo sapiens
tataactgttttagaaattggt

SEQ ID NO: 1160253 - DNA, 14 bp, Homo sapiens
tataacttaatgaa

SEQ ID NO: 1160254 - DNA, 16 bp, Homo sapiens
tataacttaatgaaaa

SEQ ID NO: 1160255 - DNA, 15 bp, Homo sapiens
tataacttcttaaaa

SEQ ID NO: 1160256 - DNA, 13 bp, Homo sapiens
tataacttgaaaa

SEQ ID NO: 1160257 - DNA, 16 bp, Homo sapiens
tataactttagaaata

SEQ ID NO: 1160258 - DNA, 15 bp, Homo sapiens
tataacttttgatga

SEQ ID NO: 1160259 - DNA, 15 bp, Homo sapiens
tataagaaaaacttt

SEQ ID NO: 1160260 - DNA, 13 bp, Homo sapiens
tataagaaaagta

SEQ ID NO: 1160261 - DNA, 22 bp, Homo sapiens
tataagaaaagtaatgaagaat

SEQ ID NO: 1160262 - DNA, 14 bp, Homo sapiens
tataagaagcaatc

SEQ ID NO: 1160263 - DNA, 20 bp, Homo sapiens
tataagaagcaatctttgaa

SEQ ID NO: 1160264 - DNA, 22 bp, Homo sapiens
tataagaagcaatctttgaaat

SEQ ID NO: 1160265 - DNA, 19 bp, Homo sapiens
tataagaataaaatgttga

SEQ ID NO: 1160266 - DNA, 12 bp, Homo sapiens
tataagaatttt

SEQ ID NO: 1160267 - DNA, 17 bp, Homo sapiens
tataagacactttgcca

SEQ ID NO: 1160268 - DNA, 17 bp, Homo sapiens
tataagaccactacagt

SEQ ID NO: 1160269 - DNA, 14 bp, Homo sapiens
tataagatttttga

SEQ ID NO: 1160270 - DNA, 22 bp, Homo sapiens
tataagcagattgctttaattt

SEQ ID NO: 1160271 - DNA, 15 bp, Homo sapiens
tataagccctgcata

SEQ ID NO: 1160272 - DNA, 13 bp, Homo sapiens
tataagcttaaat

SEQ ID NO: 1160273 - DNA, 22 bp, Homo sapiens
tataaggaaagcaataaatgaa

SEQ ID NO: 1160274 - DNA, 14 bp, Homo sapiens
tataaggaagattt

SEQ ID NO: 1160275 - DNA, 13 bp, Homo sapiens
tataagggagagc

SEQ ID NO: 1160276 - DNA, 14 bp, Homo sapiens
tataaggtaatgta

SEQ ID NO: 1160277 - DNA, 15 bp, Homo sapiens
tataaggtaatgtag

SEQ ID NO: 1160278 - DNA, 15 bp, Homo sapiens
tataaggtgcctcag

SEQ ID NO: 1160279 - DNA, 14 bp, Homo sapiens
tataagtaagaaaa

SEQ ID NO: 1160280 - DNA, 16 bp, Homo sapiens
tataagtagcaggcca

SEQ ID NO: 1160281 - DNA, 20 bp, Homo sapiens
tataagtagttggtttgtat

SEQ ID NO: 1160282 - DNA, 15 bp, Homo sapiens
tataagtcaagcaca

SEQ ID NO: 1160283 - DNA, 18 bp, Homo sapiens
tataagtcattgtatgtt

SEQ ID NO: 1160284 - DNA, 14 bp, Homo sapiens
tataagtgaagtga

SEQ ID NO: 1160285 - DNA, 18 bp, Homo sapiens
tataagtgtacatatgtg

SEQ ID NO: 1160286 - DNA, 15 bp, Homo sapiens
tataagttgtaccaa

SEQ ID NO: 1160287 - DNA, 21 bp, Homo sapiens
tataagttgtaccaaaacatc

SEQ ID NO: 1160288 - DNA, 16 bp, Homo sapiens
tataagtttgaaggaa

SEQ ID NO: 1160289 - DNA, 14 bp, Homo sapiens
tataataaaaatat

SEQ ID NO: 1160290 - DNA, 18 bp, Homo sapiens
tataataaaaatatattt

SEQ ID NO: 1160291 - DNA, 12 bp, Homo sapiens
tataataaaaga

SEQ ID NO: 1160292 - DNA, 22 bp, Homo sapiens
tataataaaaggaaaagcaaat

SEQ ID NO: 1160293 - DNA, 16 bp, Homo sapiens
tataataaatgtacat

SEQ ID NO: 1160294 - DNA, 12 bp, Homo sapiens
tataataacttt

SEQ ID NO: 1160295 - DNA, 22 bp, Homo sapiens
tataataactttattgcatata

SEQ ID NO: 1160296 - DNA, 15 bp, Homo sapiens
tataataagttttga

SEQ ID NO: 1160297 - DNA, 21 bp, Homo sapiens
tataataagttttgatataat

SEQ ID NO: 1160298 - DNA, 20 bp, Homo sapiens
tataatacagaatcttgttt

SEQ ID NO: 1160299 - DNA, 17 bp, Homo sapiens
tataatactctgttgta

SEQ ID NO: 1160300 - DNA, 15 bp, Homo sapiens
tataatactgtattt

SEQ ID NO: 1160301 - DNA, 17 bp, Homo sapiens
tataatacttgcaacta

SEQ ID NO: 1160302 - DNA, 19 bp, Homo sapiens
tataatactttgtatacaa

SEQ ID NO: 1160303 - DNA, 14 bp, Homo sapiens
tataatagattttt

SEQ ID NO: 1160304 - DNA, 22 bp, Homo sapiens
tataatatatttgtgtatttaa

SEQ ID NO: 1160305 - DNA, 14 bp, Homo sapiens
tataatatggaacc

SEQ ID NO: 1160306 - DNA, 13 bp, Homo sapiens
tataatattcagc

SEQ ID NO: 1160307 - DNA, 23 bp, Homo sapiens
tataatattcagccagcttaaac

SEQ ID NO: 1160308 - DNA, 16 bp, Homo sapiens
tataatattgaaaatt

SEQ ID NO: 1160309 - DNA, 15 bp, Homo sapiens
tataatattttatct

SEQ ID NO: 1160310 - DNA, 15 bp, Homo sapiens
tataatcatgctcat

SEQ ID NO: 1160311 - DNA, 23 bp, Homo sapiens
tataatcatgctcatgtatattt

SEQ ID NO: 1160312 - DNA, 18 bp, Homo sapiens
tataatcccagcactttg

SEQ ID NO: 1160313 - DNA, 22 bp, Homo sapiens
tataatccttaaatcttaatgt

SEQ ID NO: 1160314 - DNA, 22 bp, Homo sapiens
tataatccttgataatatattg

SEQ ID NO: 1160315 - DNA, 21 bp, Homo sapiens
tataatctcaaaggagaaaaa

SEQ ID NO: 1160316 - DNA, 18 bp, Homo sapiens
tataatctcctctgctca

SEQ ID NO: 1160317 - DNA, 20 bp, Homo sapiens
tataatctgtcaaaacactg

SEQ ID NO: 1160318 - DNA, 21 bp, Homo sapiens
tataatctgtcaaaacactgt

SEQ ID NO: 1160319 - DNA, 22 bp, Homo sapiens
tataatctgtcaaaacactgtg

SEQ ID NO: 1160320 - DNA, 16 bp, Homo sapiens
tataatcttatacaac

SEQ ID NO: 1160321 - DNA, 19 bp, Homo sapiens
tataatcttggcttcttaa

SEQ ID NO: 1160322 - DNA, 22 bp, Homo sapiens
tataatcttggcttcttaaaaa

SEQ ID NO: 1160323 - DNA, 13 bp, Homo sapiens
tataatctttcta

SEQ ID NO: 1160324 - DNA, 17 bp, Homo sapiens
tataatgaacaaaatta

SEQ ID NO: 1160325 - DNA, 15 bp, Homo sapiens
tataatgaataaatc

SEQ ID NO: 1160326 - DNA, 15 bp, Homo sapiens
tataatgattcataa

SEQ ID NO: 1160327 - DNA, 20 bp, Homo sapiens
tataatggaaacatttacaa

SEQ ID NO: 1160328 - DNA, 20 bp, Homo sapiens
tataatggacagattaatat

SEQ ID NO: 1160329 - DNA, 14 bp, Homo sapiens
tataatgtaagctc

SEQ ID NO: 1160330 - DNA, 21 bp, Homo sapiens
tataatgtatttgaaaattac

SEQ ID NO: 1160331 - DNA, 22 bp, Homo sapiens
tataatgtatttgaaaattaca

SEQ ID NO: 1160332 - DNA, 20 bp, Homo sapiens
tataatgtcattaaacatga

SEQ ID NO: 1160333 - DNA, 18 bp, Homo sapiens
tataatgttgttatttaa

SEQ ID NO: 1160334 - DNA, 16 bp, Homo sapiens
tataatgtttaaatca

SEQ ID NO: 1160335 - DNA, 17 bp, Homo sapiens
tataatgtttaaatcat

SEQ ID NO: 1160336 - DNA, 17 bp, Homo sapiens
tataatgtttattaaat

SEQ ID NO: 1160337 - DNA, 15 bp, Homo sapiens
tataatgtttgctat

SEQ ID NO: 1160338 - DNA, 17 bp, Homo sapiens
tataatgtttttaatat

SEQ ID NO: 1160339 - DNA, 21 bp, Homo sapiens
tataattaacttaactgaaga

SEQ ID NO: 1160340 - DNA, 22 bp, Homo sapiens
tataattcctatatcctgtgac

SEQ ID NO: 1160341 - DNA, 12 bp, Homo sapiens
tataattctgga

SEQ ID NO: 1160342 - DNA, 16 bp, Homo sapiens
tataattctgtaaatg

SEQ ID NO: 1160343 - DNA, 17 bp, Homo sapiens
tataattggatttccta

SEQ ID NO: 1160344 - DNA, 18 bp, Homo sapiens
tataattggatttcctaa

SEQ ID NO: 1160345 - DNA, 20 bp, Homo sapiens
tataattgggtcatagaaat

SEQ ID NO: 1160346 - DNA, 16 bp, Homo sapiens
tataattgttgatatt

SEQ ID NO: 1160347 - DNA, 15 bp, Homo sapiens
tataatttaacttca

SEQ ID NO: 1160348 - DNA, 18 bp, Homo sapiens
tataatttacctaagatt

SEQ ID NO: 1160349 - DNA, 20 bp, Homo sapiens
tataatttacctaagattac

SEQ ID NO: 1160350 - DNA, 18 bp, Homo sapiens
tataatttactttgtaga

SEQ ID NO: 1160351 - DNA, 20 bp, Homo sapiens
tataatttactttgtagact

SEQ ID NO: 1160352 - DNA, 19 bp, Homo sapiens
tataatttatttccactaa

SEQ ID NO: 1160353 - DNA, 14 bp, Homo sapiens
tataatttcaagga

SEQ ID NO: 1160354 - DNA, 22 bp, Homo sapiens
tataatttccatttacttaaga

SEQ ID NO: 1160355 - DNA, 15 bp, Homo sapiens
tataatttcctcact

SEQ ID NO: 1160356 - DNA, 14 bp, Homo sapiens
tataatttgaggtg

SEQ ID NO: 1160357 - DNA, 19 bp, Homo sapiens
ttgcctcctgttctgccca

SEQ ID NO: 1160358 - DNA, 13 bp, Homo sapiens
ttgcctctgccca

SEQ ID NO: 1160359 - DNA, 14 bp, Homo sapiens
ttgcctctgtcctc

SEQ ID NO: 1160360 - DNA, 16 bp, Homo sapiens
ttgcctctgtcctccc

SEQ ID NO: 1160361 - DNA, 17 bp, Homo sapiens
ttgcctctgtcctccca

SEQ ID NO: 1160362 - DNA, 14 bp, Homo sapiens
ttgcctctgtgctg

SEQ ID NO: 1160363 - DNA, 22 bp, Homo sapiens
ttgcctgaacatccttccttcc

SEQ ID NO: 1160364 - DNA, 19 bp, Homo sapiens
ttgcctgcagagagaagcc

SEQ ID NO: 1160365 - DNA, 20 bp, Homo sapiens
ttgcctgcagtttcttgtgt

SEQ ID NO: 1160366 - DNA, 18 bp, Homo sapiens
ttgcctgcctcctaggct

SEQ ID NO: 1160367 - DNA, 13 bp, Homo sapiens
ttgcctgctgtat

SEQ ID NO: 1160368 - DNA, 15 bp, Homo sapiens
ttgcctggctgtgga

SEQ ID NO: 1160369 - DNA, 22 bp, Homo sapiens
ttgcctggctgtggaggcctga

SEQ ID NO: 1160370 - DNA, 23 bp, Homo sapiens
ttgcctggtcaccctggggctgc

SEQ ID NO: 1160371 - DNA, 14 bp, Homo sapiens
ttgcctgtaacaag

SEQ ID NO: 1160372 - DNA, 15 bp, Homo sapiens
ttgcctgttaaatat

SEQ ID NO: 1160373 - DNA, 16 bp, Homo sapiens
ttgccttatttctcat

SEQ ID NO: 1160374 - DNA, 15 bp, Homo sapiens
ttgccttatttgtct

SEQ ID NO: 1160375 - DNA, 20 bp, Homo sapiens
ttgccttatttgtctgtaaa

SEQ ID NO: 1160376 - DNA, 23 bp, Homo sapiens
ttgccttcctttctccaggacca

SEQ ID NO: 1160377 - DNA, 19 bp, Homo sapiens
ttgccttctctgcccacag

SEQ ID NO: 1160378 - DNA, 21 bp, Homo sapiens
ttgccttctggagctgggaga

SEQ ID NO: 1160379 - DNA, 19 bp, Homo sapiens
ttgccttctggtttcttcc

SEQ ID NO: 1160380 - DNA, 15 bp, Homo sapiens
ttgccttgcagaact

SEQ ID NO: 1160381 - DNA, 18 bp, Homo sapiens
ttgcctttaggggtgtgt

SEQ ID NO: 1160382 - DNA, 14 bp, Homo sapiens
ttgcctttgaggtt

SEQ ID NO: 1160383 - DNA, 19 bp, Homo sapiens
ttgcgaatccaagctccct

SEQ ID NO: 1160384 - DNA, 17 bp, Homo sapiens
ttgcgaatggttccatt

SEQ ID NO: 1160385 - DNA, 18 bp, Homo sapiens
ttgcgacggagagaaaaa

SEQ ID NO: 1160386 - DNA, 19 bp, Homo sapiens
ttgcgacggagagaaaaaa

SEQ ID NO: 1160387 - DNA, 22 bp, Homo sapiens
ttgcgacggagagaaaaaagaa

SEQ ID NO: 1160388 - DNA, 19 bp, Homo sapiens
ttgcgcctcagccctcagt

SEQ ID NO: 1160389 - DNA, 23 bp, Homo sapiens
ttgcgcctttgtattataaaagc

SEQ ID NO: 1160390 - DNA, 20 bp, Homo sapiens
ttgcgctctcaagaccagag

SEQ ID NO: 1160391 - DNA, 13 bp, Homo sapiens
ttgcggaagccat

SEQ ID NO: 1160392 - DNA, 16 bp, Homo sapiens
ttgcggcaaaaggaaa

SEQ ID NO: 1160393 - DNA, 17 bp, Homo sapiens
ttgcggcaaaaggaaag

SEQ ID NO: 1160394 - DNA, 14 bp, Homo sapiens
ttgcggttcaggaa

SEQ ID NO: 1160395 - DNA, 18 bp, Homo sapiens
ttgcgtgcccggggcagc

SEQ ID NO: 1160396 - DNA, 15 bp, Homo sapiens
ttgctaaaaaataaa

SEQ ID NO: 1160397 - DNA, 16 bp, Homo sapiens
ttgctaaaagaagaga

SEQ ID NO: 1160398 - DNA, 18 bp, Homo sapiens
ttgctaaaatattttaga

SEQ ID NO: 1160399 - DNA, 23 bp, Homo sapiens
ttgctaaagcactttgcacttaa

SEQ ID NO: 1160400 - DNA, 18 bp, Homo sapiens
ttgctaatcaaagccagg

SEQ ID NO: 1160401 - DNA, 22 bp, Homo sapiens
ttgctaatcaaagccagggtct

SEQ ID NO: 1160402 - DNA, 20 bp, Homo sapiens
ttgctaattaactgaaacat

SEQ ID NO: 1160403 - DNA, 21 bp, Homo sapiens
ttgctacaaatttatgcattt

SEQ ID NO: 1160404 - DNA, 21 bp, Homo sapiens
ttgctacaccccttttccagt

SEQ ID NO: 1160405 - DNA, 13 bp, Homo sapiens
ttgctacataatt

SEQ ID NO: 1160406 - DNA, 15 bp, Homo sapiens
ttgctaccagtattt

SEQ ID NO: 1160407 - DNA, 16 bp, Homo sapiens
ttgctaccagtattta

SEQ ID NO: 1160408 - DNA, 13 bp, Homo sapiens
ttgctacgtgcct

SEQ ID NO: 1160409 - DNA, 15 bp, Homo sapiens
ttgctacgtgcctcc

SEQ ID NO: 1160410 - DNA, 18 bp, Homo sapiens
ttgctacgtgcctcccga

SEQ ID NO: 1160411 - DNA, 23 bp, Homo sapiens
ttgctagataaaagctgaagtta

SEQ ID NO: 1160412 - DNA, 20 bp, Homo sapiens
ttgctaggacgcaataaatt

SEQ ID NO: 1160413 - DNA, 22 bp, Homo sapiens
ttgctaggagctcccctgtttg

SEQ ID NO: 1160414 - DNA, 18 bp, Homo sapiens
ttgctatcaacaataaaa

SEQ ID NO: 1160415 - DNA, 22 bp, Homo sapiens
ttgctatcaacaataaaatttt

SEQ ID NO: 1160416 - DNA, 21 bp, Homo sapiens
ttgctatcgccctcctttccc

SEQ ID NO: 1160417 - DNA, 21 bp, Homo sapiens
ttgctatctaatggggaaatg

SEQ ID NO: 1160418 - DNA, 22 bp, Homo sapiens
ttgctatggcaggataagaaag

SEQ ID NO: 1160419 - DNA, 18 bp, Homo sapiens
ttgctatgttactatttt

SEQ ID NO: 1160420 - DNA, 19 bp, Homo sapiens
ttgctatgttactattttc

SEQ ID NO: 1160421 - DNA, 21 bp, Homo sapiens
ttgctatgttactattttcta

SEQ ID NO: 1160422 - DNA, 16 bp, Homo sapiens
ttgctatgttgcccaa

SEQ ID NO: 1160423 - DNA, 14 bp, Homo sapiens
ttgctattagagca

SEQ ID NO: 1160424 - DNA, 19 bp, Homo sapiens
ttgctattgtaaatatgtt

SEQ ID NO: 1160425 - DNA, 14 bp, Homo sapiens
ttgctattgtaagg

SEQ ID NO: 1160426 - DNA, 21 bp, Homo sapiens
ttgctattgtaaggtctttgt

SEQ ID NO: 1160427 - DNA, 12 bp, Homo sapiens
ttgctatttcaa

SEQ ID NO: 1160428 - DNA, 17 bp, Homo sapiens
ttgctatttcaataaca

SEQ ID NO: 1160429 - DNA, 19 bp, Homo sapiens
ttgctattttatttgtatt

SEQ ID NO: 1160430 - DNA, 20 bp, Homo sapiens
ttgctattttatttgtattc

SEQ ID NO: 1160431 - DNA, 17 bp, Homo sapiens
ttgctcaaaaaatgagc

SEQ ID NO: 1160432 - DNA, 19 bp, Homo sapiens
ttgctcaaatctattcaga

SEQ ID NO: 1160433 - DNA, 21 bp, Homo sapiens
ttgctcaagttcattgatgac

SEQ ID NO: 1160434 - DNA, 20 bp, Homo sapiens
ttgctcactcactcactcca

SEQ ID NO: 1160435 - DNA, 22 bp, Homo sapiens
ttgctcactcactcactccaag

SEQ ID NO: 1160436 - DNA, 17 bp, Homo sapiens
ttgctcagagaaggaaa

SEQ ID NO: 1160437 - DNA, 23 bp, Homo sapiens
ttgctcagagaaggaaaagactg

SEQ ID NO: 1160438 - DNA, 19 bp, Homo sapiens
ttgctcagatagatctgtg

SEQ ID NO: 1160439 - DNA, 13 bp, Homo sapiens
ttgctcagtctcc

SEQ ID NO: 1160440 - DNA, 17 bp, Homo sapiens
ttgctcagtgcctcctg

SEQ ID NO: 1160441 - DNA, 15 bp, Homo sapiens
ttgctcagtgtccag

SEQ ID NO: 1160442 - DNA, 16 bp, Homo sapiens
ttgctcagtgtccagc

SEQ ID NO: 1160443 - DNA, 20 bp, Homo sapiens
ttgctcagtgtccagcttcc

SEQ ID NO: 1160444 - DNA, 16 bp, Homo sapiens
ttgctcatgccctgcc

SEQ ID NO: 1160445 - DNA, 23 bp, Homo sapiens
ttgctcatgtaatgtggtcacca

SEQ ID NO: 1160446 - DNA, 20 bp, Homo sapiens
ttgctccagattctgatgca

SEQ ID NO: 1160447 - DNA, 11 bp, Homo sapiens
ttgctccaggg

SEQ ID NO: 1160448 - DNA, 14 bp, Homo sapiens
ttgctcccaaccca

SEQ ID NO: 1160449 - DNA, 21 bp, Homo sapiens
ttgctcccctgatagaagatt

SEQ ID NO: 1160450 - DNA, 21 bp, Homo sapiens
ttgctcccggggactcaagag

SEQ ID NO: 1160451 - DNA, 16 bp, Homo sapiens
ttgctccgcctggcct

SEQ ID NO: 1160452 - DNA, 14 bp, Homo sapiens
ttgctcctgccaac

SEQ ID NO: 1160453 - DNA, 20 bp, Homo sapiens
ttgctcgcccagacaccatg

SEQ ID NO: 1160454 - DNA, 21 bp, Homo sapiens
ttgctcgcccagacaccatgt

SEQ ID NO: 1160455 - DNA, 16 bp, Homo sapiens
ttgctctccctcttct

SEQ ID NO: 1160456 - DNA, 23 bp, Homo sapiens
ttgctctccctcttctcaagtgc

SEQ ID NO: 1160457 - DNA, 20 bp, Homo sapiens
ttgctctctctccctgcctt

SEQ ID NO: 1160458 - DNA, 12 bp, Homo sapiens
ttgctctgcacc

SEQ ID NO: 1160459 - DNA, 11 bp, Homo sapiens
ttgctctgccc

SEQ ID NO: 1160460 - DNA, 16 bp, Homo sapiens
ttgctctggagcagcc

SEQ ID NO: 1160461 - DNA, 19 bp, Homo sapiens
ttgctctggaggaagttct

SEQ ID NO: 1160462 - DNA, 16 bp, Homo sapiens
ttgctctgtcccccag

SEQ ID NO: 1160463 - DNA, 19 bp, Homo sapiens
ttgctcttgtcccacgtgt

SEQ ID NO: 1160464 - DNA, 20 bp, Homo sapiens
ttgctctttgacaactaaaa

SEQ ID NO: 1160465 - DNA, 18 bp, Homo sapiens
ttgctcttttaagcagtc

SEQ ID NO: 1160466 - DNA, 17 bp, Homo sapiens
ttgctgaaaatggtatt

SEQ ID NO: 1160467 - DNA, 14 bp, Homo sapiens
ttgctgaaactgtg

SEQ ID NO: 1160468 - DNA, 16 bp, Homo sapiens
ttgctgaaattttata

SEQ ID NO: 1160469 - DNA, 19 bp, Homo sapiens
ttgctgaaattttatatgc

SEQ ID NO: 1160470 - DNA, 12 bp, Homo sapiens
ttgctgaagatg

SEQ ID NO: 1160471 - DNA, 19 bp, Homo sapiens
ttgctgaagatgccttgag

SEQ ID NO: 1160472 - DNA, 23 bp, Homo sapiens
ttgctgaaggctaaattcacagc

SEQ ID NO: 1160473 - DNA, 17 bp, Homo sapiens
ttgctgaatcccatcag

SEQ ID NO: 1160474 - DNA, 19 bp, Homo sapiens
ttgctgaattcctttacaa

SEQ ID NO: 1160475 - DNA, 20 bp, Homo sapiens
ttgctgaccagctggagtga

SEQ ID NO: 1160476 - DNA, 22 bp, Homo sapiens
ttgctgactactactctgccaa

SEQ ID NO: 1160477 - DNA, 15 bp, Homo sapiens
ttgctgagaagcaaa

SEQ ID NO: 1160478 - DNA, 19 bp, Homo sapiens
ttgctgagtttcccttcct

SEQ ID NO: 1160479 - DNA, 14 bp, Homo sapiens
ttgctgatgctcct

SEQ ID NO: 1160480 - DNA, 21 bp, Homo sapiens
tataatttgaggtgaaattca

SEQ ID NO: 1160481 - DNA, 13 bp, Homo sapiens
tataattttatgg

SEQ ID NO: 1160482 - DNA, 13 bp, Homo sapiens
tataattttgcct

SEQ ID NO: 1160483 - DNA, 15 bp, Homo sapiens
tatacaaaactttat

SEQ ID NO: 1160484 - DNA, 13 bp, Homo sapiens
tatacaaattaga

SEQ ID NO: 1160485 - DNA, 17 bp, Homo sapiens
tatacaaattagaaaat

SEQ ID NO: 1160486 - DNA, 18 bp, Homo sapiens
tatacaaattagaaaatg

SEQ ID NO: 1160487 - DNA, 20 bp, Homo sapiens
tatacaaattttcagaaggt

SEQ ID NO: 1160488 - DNA, 23 bp, Homo sapiens
tatacaaattttcagaaggttat

SEQ ID NO: 1160489 - DNA, 21 bp, Homo sapiens
tatacaacagcaaaccctgat

SEQ ID NO: 1160490 - DNA, 21 bp, Homo sapiens
tatacaaccctggcattatgt

SEQ ID NO: 1160491 - DNA, 22 bp, Homo sapiens
tatacaaccctggcattatgtc

SEQ ID NO: 1160492 - DNA, 18 bp, Homo sapiens
tatacaaccttcatttaa

SEQ ID NO: 1160493 - DNA, 20 bp, Homo sapiens
tatacaactgtaaagcaaat

SEQ ID NO: 1160494 - DNA, 13 bp, Homo sapiens
tatacaaggcaag

SEQ ID NO: 1160495 - DNA, 19 bp, Homo sapiens
tatacaaggcaagcatttt

SEQ ID NO: 1160496 - DNA, 16 bp, Homo sapiens
tatacaagtactggta

SEQ ID NO: 1160497 - DNA, 23 bp, Homo sapiens
tatacaagtactggtaagattgt

SEQ ID NO: 1160498 - DNA, 15 bp, Homo sapiens
tatacaataacataa

SEQ ID NO: 1160499 - DNA, 16 bp, Homo sapiens
tatacaataacccagt

SEQ ID NO: 1160500 - DNA, 17 bp, Homo sapiens
tatacaataacccagtt

SEQ ID NO: 1160501 - DNA, 21 bp, Homo sapiens
tatacaataacccagttactt

SEQ ID NO: 1160502 - DNA, 22 bp, Homo sapiens
tatacaataacccagttacttt

SEQ ID NO: 1160503 - DNA, 16 bp, Homo sapiens
tatacacaactttgca

SEQ ID NO: 1160504 - DNA, 18 bp, Homo sapiens
tatacacaactttgcaaa

SEQ ID NO: 1160505 - DNA, 12 bp, Homo sapiens
tatacacacata

SEQ ID NO: 1160506 - DNA, 16 bp, Homo sapiens
tatacacacatataca

SEQ ID NO: 1160507 - DNA, 14 bp, Homo sapiens
tatacacatacata

SEQ ID NO: 1160508 - DNA, 19 bp, Homo sapiens
tatacacccagttctgaat

SEQ ID NO: 1160509 - DNA, 21 bp, Homo sapiens
tatacacgaatagacatcaaa

SEQ ID NO: 1160510 - DNA, 21 bp, Homo sapiens
tatacacttacactttatgca

SEQ ID NO: 1160511 - DNA, 22 bp, Homo sapiens
tatacacttacactttatgcac

SEQ ID NO: 1160512 - DNA, 17 bp, Homo sapiens
tatacagattttctaga

SEQ ID NO: 1160513 - DNA, 18 bp, Homo sapiens
tatacaggcataaaatag

SEQ ID NO: 1160514 - DNA, 19 bp, Homo sapiens
tatacagtaactttatgtg

SEQ ID NO: 1160515 - DNA, 17 bp, Homo sapiens
tatacagtgcagagcct

SEQ ID NO: 1160516 - DNA, 16 bp, Homo sapiens
tatacagttataaaat

SEQ ID NO: 1160517 - DNA, 19 bp, Homo sapiens
tatacagttataaaattaa

SEQ ID NO: 1160518 - DNA, 22 bp, Homo sapiens
tatacagttataaaattaaaag

SEQ ID NO: 1160519 - DNA, 16 bp, Homo sapiens
tatacagtttgacttt

SEQ ID NO: 1160520 - DNA, 13 bp, Homo sapiens
tatacataaacaa

SEQ ID NO: 1160521 - DNA, 14 bp, Homo sapiens
tatacatacatgta

SEQ ID NO: 1160522 - DNA, 18 bp, Homo sapiens
tatacatacatgtatctg

SEQ ID NO: 1160523 - DNA, 12 bp, Homo sapiens
tatacatatata

SEQ ID NO: 1160524 - DNA, 18 bp, Homo sapiens
tatacatatctttattaa

SEQ ID NO: 1160525 - DNA, 21 bp, Homo sapiens
tatacatatctttattaatca

SEQ ID NO: 1160526 - DNA, 21 bp, Homo sapiens
tatacatatgagaatatacct

SEQ ID NO: 1160527 - DNA, 23 bp, Homo sapiens
tatacatcagtatagtgttttat

SEQ ID NO: 1160528 - DNA, 22 bp, Homo sapiens
tatacatgaagaatagaaacaa

SEQ ID NO: 1160529 - DNA, 22 bp, Homo sapiens
tatacatggaatcgaagtgttt

SEQ ID NO: 1160530 - DNA, 11 bp, Homo sapiens
tatacatgttg

SEQ ID NO: 1160531 - DNA, 17 bp, Homo sapiens
tatacatgtttttctat

SEQ ID NO: 1160532 - DNA, 22 bp, Homo sapiens
tatacattagttttaatctctt

SEQ ID NO: 1160533 - DNA, 16 bp, Homo sapiens
tatacattctttatct

SEQ ID NO: 1160534 - DNA, 18 bp, Homo sapiens
tatacattgtgtgaaaaa

SEQ ID NO: 1160535 - DNA, 13 bp, Homo sapiens
tatacattttgtt

SEQ ID NO: 1160536 - DNA, 22 bp, Homo sapiens
tatacattttttaggacatctt

SEQ ID NO: 1160537 - DNA, 14 bp, Homo sapiens
tataccaatgtgtt

SEQ ID NO: 1160538 - DNA, 13 bp, Homo sapiens
tataccacctgta

SEQ ID NO: 1160539 - DNA, 14 bp, Homo sapiens
tataccacctgtac

SEQ ID NO: 1160540 - DNA, 20 bp, Homo sapiens
tataccagatgaacatttca

SEQ ID NO: 1160541 - DNA, 19 bp, Homo sapiens
tataccagtataattgagt

SEQ ID NO: 1160542 - DNA, 23 bp, Homo sapiens
tataccccaaattgtgtatatat

SEQ ID NO: 1160543 - DNA, 24 bp, Homo sapiens
tatacccccaggaaactagctttt

SEQ ID NO: 1160544 - DNA, 20 bp, Homo sapiens
tatacccgggaccaaactca

SEQ ID NO: 1160545 - DNA, 20 bp, Homo sapiens
tatacctgattttttttcct

SEQ ID NO: 1160546 - DNA, 13 bp, Homo sapiens
tatacctgccttt

SEQ ID NO: 1160547 - DNA, 19 bp, Homo sapiens
tatacctggcaattcacaa

SEQ ID NO: 1160548 - DNA, 20 bp, Homo sapiens
tatacctggcttttacttta

SEQ ID NO: 1160549 - DNA, 16 bp, Homo sapiens
tatacctggcttttta

SEQ ID NO: 1160550 - DNA, 13 bp, Homo sapiens
tatacctggttta

SEQ ID NO: 1160551 - DNA, 16 bp, Homo sapiens
tatacctggtttactt

SEQ ID NO: 1160552 - DNA, 17 bp, Homo sapiens
tatacctggtttacttc

SEQ ID NO: 1160553 - DNA, 19 bp, Homo sapiens
tatacgaaaagccagcttg

SEQ ID NO: 1160554 - DNA, 16 bp, Homo sapiens
tatacgaaataattgt

SEQ ID NO: 1160555 - DNA, 20 bp, Homo sapiens
tatacgtataaatatcagta

SEQ ID NO: 1160556 - DNA, 15 bp, Homo sapiens
tatactaagaaaaga

SEQ ID NO: 1160557 - DNA, 21 bp, Homo sapiens
tatactactttgttaggattt

SEQ ID NO: 1160558 - DNA, 18 bp, Homo sapiens
tatactctagatgaagtt

SEQ ID NO: 1160559 - DNA, 19 bp, Homo sapiens
tatactctttctgtatata

SEQ ID NO: 1160560 - DNA, 14 bp, Homo sapiens
tatactgaaagatc

SEQ ID NO: 1160561 - DNA, 23 bp, Homo sapiens
tatactgaaagatctctgtcaca

SEQ ID NO: 1160562 - DNA, 20 bp, Homo sapiens
tatactgaaggaaaaacaca

SEQ ID NO: 1160563 - DNA, 19 bp, Homo sapiens
tatactgcacagtggcaca

SEQ ID NO: 1160564 - DNA, 14 bp, Homo sapiens
tatactgcagcttt

SEQ ID NO: 1160565 - DNA, 17 bp, Homo sapiens
tatactgcatacttttt

SEQ ID NO: 1160566 - DNA, 14 bp, Homo sapiens
tatactgggtttca

SEQ ID NO: 1160567 - DNA, 15 bp, Homo sapiens
tatactgtaaaagtt

SEQ ID NO: 1160568 - DNA, 15 bp, Homo sapiens
tatactgtaatttag

SEQ ID NO: 1160569 - DNA, 22 bp, Homo sapiens
tatactgtaatttagttattga

SEQ ID NO: 1160570 - DNA, 22 bp, Homo sapiens
tatactgtacaataaaaacatt

SEQ ID NO: 1160571 - DNA, 16 bp, Homo sapiens
tatactgtacttaata

SEQ ID NO: 1160572 - DNA, 21 bp, Homo sapiens
tatactgtatttctaagaagt

SEQ ID NO: 1160573 - DNA, 18 bp, Homo sapiens
tatactgtgtgcttgttt

SEQ ID NO: 1160574 - DNA, 14 bp, Homo sapiens
tatactgtgtgtga

SEQ ID NO: 1160575 - DNA, 22 bp, Homo sapiens
tatacttaaaatgacaaagcca

SEQ ID NO: 1160576 - DNA, 23 bp, Homo sapiens
tatacttaaaatgacaaagccat

SEQ ID NO: 1160577 - DNA, 12 bp, Homo sapiens
tatacttaagaa

SEQ ID NO: 1160578 - DNA, 12 bp, Homo sapiens
tatacttcaaaa

SEQ ID NO: 1160579 - DNA, 19 bp, Homo sapiens
tatactttagtagacattt

SEQ ID NO: 1160580 - DNA, 18 bp, Homo sapiens
tatactttatataaggca

SEQ ID NO: 1160581 - DNA, 22 bp, Homo sapiens
tatacttttcccctgttaaaca

SEQ ID NO: 1160582 - DNA, 23 bp, Homo sapiens
tatacttttcccctgttaaacag

SEQ ID NO: 1160583 - DNA, 20 bp, Homo sapiens
tatactttttttgttataga

SEQ ID NO: 1160584 - DNA, 22 bp, Homo sapiens
tatactttttttgttatagatt

SEQ ID NO: 1160585 - DNA, 16 bp, Homo sapiens
tatagaaaaaaacatt

SEQ ID NO: 1160586 - DNA, 22 bp, Homo sapiens
tatagaaaaataaaaatctctt

SEQ ID NO: 1160587 - DNA, 11 bp, Homo sapiens
tatagaaaaca

SEQ ID NO: 1160588 - DNA, 12 bp, Homo sapiens
tatagaaaatct

SEQ ID NO: 1160589 - DNA, 17 bp, Homo sapiens
tatagaaaatcttagta

SEQ ID NO: 1160590 - DNA, 19 bp, Homo sapiens
tatagaaacaatactgttc

SEQ ID NO: 1160591 - DNA, 13 bp, Homo sapiens
tatagaaagctat

SEQ ID NO: 1160592 - DNA, 24 bp, Homo sapiens
tatagaaagctatataagacaaga

SEQ ID NO: 1160593 - DNA, 11 bp, Homo sapiens
tatagaaatgc

SEQ ID NO: 1160594 - DNA, 18 bp, Homo sapiens
tatagaaggaatttgtac

SEQ ID NO: 1160595 - DNA, 12 bp, Homo sapiens
tatagaataaac

SEQ ID NO: 1160596 - DNA, 17 bp, Homo sapiens
tatagaatagcctgagg

SEQ ID NO: 1160597 - DNA, 20 bp, Homo sapiens
tatagaataggcactttaaa

SEQ ID NO: 1160598 - DNA, 21 bp, Homo sapiens
tatagaatatttattacctct

SEQ ID NO: 1160599 - DNA, 13 bp, Homo sapiens
tatagacgctctt

SEQ ID NO: 1160600 - DNA, 20 bp, Homo sapiens
tatagacggtgctcactccc

SEQ ID NO: 1160601 - DNA, 22 bp, Homo sapiens
tatagagacaggacagaatgtg

SEQ ID NO: 1160602 - DNA, 18 bp, Homo sapiens
tatagagagggggctctc

SEQ ID NO: 1160603 - DNA, 23 bp, Homo sapiens
tatagagagggggctctccaaag

SEQ ID NO: 1160604 - DNA, 20 bp, Homo sapiens
ttgctgatggctgctagatt

SEQ ID NO: 1160605 - DNA, 15 bp, Homo sapiens
ttgctgatggcttga

SEQ ID NO: 1160606 - DNA, 20 bp, Homo sapiens
ttgctgatggcttgacatgt

SEQ ID NO: 1160607 - DNA, 16 bp, Homo sapiens
ttgctgatgtttataa

SEQ ID NO: 1160608 - DNA, 17 bp, Homo sapiens
ttgctgattatttatga

SEQ ID NO: 1160609 - DNA, 22 bp, Homo sapiens
ttgctgatttctagtgtatact

SEQ ID NO: 1160610 - DNA, 13 bp, Homo sapiens
ttgctgcaaagag

SEQ ID NO: 1160611 - DNA, 20 bp, Homo sapiens
ttgctgcaagcacagccctt

SEQ ID NO: 1160612 - DNA, 19 bp, Homo sapiens
ttgctgcactcttgcacat

SEQ ID NO: 1160613 - DNA, 21 bp, Homo sapiens
ttgctgcagagaaacttaagc

SEQ ID NO: 1160614 - DNA, 19 bp, Homo sapiens
ttgctgcaggccctccctc

SEQ ID NO: 1160615 - DNA, 20 bp, Homo sapiens
ttgctgcaggccctccctct

SEQ ID NO: 1160616 - DNA, 21 bp, Homo sapiens
ttgctgcaggccctccctcta

SEQ ID NO: 1160617 - DNA, 19 bp, Homo sapiens
ttgctgcagtcatctactt

SEQ ID NO: 1160618 - DNA, 23 bp, Homo sapiens
ttgctgcattgatccaggagata

SEQ ID NO: 1160619 - DNA, 15 bp, Homo sapiens
ttgctgccaaaacca

SEQ ID NO: 1160620 - DNA, 19 bp, Homo sapiens
ttgctgccccatcagtgct

SEQ ID NO: 1160621 - DNA, 20 bp, Homo sapiens
ttgctgccccatcagtgctc

SEQ ID NO: 1160622 - DNA, 21 bp, Homo sapiens
ttgctgcctgaagaacagtaa

SEQ ID NO: 1160623 - DNA, 16 bp, Homo sapiens
ttgctgcctttcaagc

SEQ ID NO: 1160624 - DNA, 21 bp, Homo sapiens
ttgctgctaccgccctgggct

SEQ ID NO: 1160625 - DNA, 14 bp, Homo sapiens
ttgctgctgctacc

SEQ ID NO: 1160626 - DNA, 16 bp, Homo sapiens
ttgctgctgctaccag

SEQ ID NO: 1160627 - DNA, 21 bp, Homo sapiens
ttgctgctgctctcaggcgct

SEQ ID NO: 1160628 - DNA, 19 bp, Homo sapiens
ttgctggaagaaactaaaa

SEQ ID NO: 1160629 - DNA, 21 bp, Homo sapiens
ttgctggacggggactgggga

SEQ ID NO: 1160630 - DNA, 21 bp, Homo sapiens
ttgctggaggggctgtcctcc

SEQ ID NO: 1160631 - DNA, 17 bp, Homo sapiens
ttgctggatcaggaagc

SEQ ID NO: 1160632 - DNA, 17 bp, Homo sapiens
ttgctggccccagccct

SEQ ID NO: 1160633 - DNA, 15 bp, Homo sapiens
ttgctggctctgaga

SEQ ID NO: 1160634 - DNA, 16 bp, Homo sapiens
ttgctggctctgagaa

SEQ ID NO: 1160635 - DNA, 19 bp, Homo sapiens
ttgctggctctgagaatca

SEQ ID NO: 1160636 - DNA, 13 bp, Homo sapiens
ttgctgggccagg

SEQ ID NO: 1160637 - DNA, 14 bp, Homo sapiens
ttgctgggccaggg

SEQ ID NO: 1160638 - DNA, 18 bp, Homo sapiens
ttgctggggtccagggct

SEQ ID NO: 1160639 - DNA, 23 bp, Homo sapiens
ttgctggtagagacccccaggcc

SEQ ID NO: 1160640 - DNA, 19 bp, Homo sapiens
ttgctggtgcaaagataga

SEQ ID NO: 1160641 - DNA, 22 bp, Homo sapiens
ttgctggttcagccttcgtgtg

SEQ ID NO: 1160642 - DNA, 22 bp, Homo sapiens
ttgctggttgtaaatactttgt

SEQ ID NO: 1160643 - DNA, 22 bp, Homo sapiens
ttgctggtttgaaagattatga

SEQ ID NO: 1160644 - DNA, 13 bp, Homo sapiens
ttgctgtaaaatt

SEQ ID NO: 1160645 - DNA, 15 bp, Homo sapiens
ttgctgtaaaatttg

SEQ ID NO: 1160646 - DNA, 16 bp, Homo sapiens
ttgctgtaaaatttgt

SEQ ID NO: 1160647 - DNA, 21 bp, Homo sapiens
ttgctgtaccacatctgctct

SEQ ID NO: 1160648 - DNA, 21 bp, Homo sapiens
ttgctgtcataagaatgaata

SEQ ID NO: 1160649 - DNA, 17 bp, Homo sapiens
ttgctgtccaggcagct

SEQ ID NO: 1160650 - DNA, 11 bp, Homo sapiens
ttgctgtccta

SEQ ID NO: 1160651 - DNA, 23 bp, Homo sapiens
ttgctgtctacagtagctgctac

SEQ ID NO: 1160652 - DNA, 16 bp, Homo sapiens
ttgctgtctctgctcg

SEQ ID NO: 1160653 - DNA, 16 bp, Homo sapiens
ttgctgtctggtgagg

SEQ ID NO: 1160654 - DNA, 15 bp, Homo sapiens
ttgctgtgaggctgt

SEQ ID NO: 1160655 - DNA, 19 bp, Homo sapiens
ttgctgtgaggctgtcctg

SEQ ID NO: 1160656 - DNA, 11 bp, Homo sapiens
ttgctgtggac

SEQ ID NO: 1160657 - DNA, 11 bp, Homo sapiens
ttgctgtgtga

SEQ ID NO: 1160658 - DNA, 20 bp, Homo sapiens
ttgctgttgatttctttcca

SEQ ID NO: 1160659 - DNA, 20 bp, Homo sapiens
ttgctgtttagcttcctcca

SEQ ID NO: 1160660 - DNA, 18 bp, Homo sapiens
ttgctgttttaaacatta

SEQ ID NO: 1160661 - DNA, 19 bp, Homo sapiens
ttgctgttttcctcccttc

SEQ ID NO: 1160662 - DNA, 22 bp, Homo sapiens
ttgctgttttcctcccttctgc

SEQ ID NO: 1160663 - DNA, 23 bp, Homo sapiens
ttgcttaaaatatgtgaagtttt

SEQ ID NO: 1160664 - DNA, 12 bp, Homo sapiens
ttgcttaaacaa

SEQ ID NO: 1160665 - DNA, 13 bp, Homo sapiens
ttgcttaacatta

SEQ ID NO: 1160666 - DNA, 20 bp, Homo sapiens
ttgcttaacattagatgtca

SEQ ID NO: 1160667 - DNA, 22 bp, Homo sapiens
ttgcttaatttccttctgttaa

SEQ ID NO: 1160668 - DNA, 14 bp, Homo sapiens
ttgcttacctctca

SEQ ID NO: 1160669 - DNA, 12 bp, Homo sapiens
ttgcttactaag

SEQ ID NO: 1160670 - DNA, 21 bp, Homo sapiens
ttgcttagagtgcccagcaga

SEQ ID NO: 1160671 - DNA, 21 bp, Homo sapiens
ttgcttagtatggttctcaga

SEQ ID NO: 1160672 - DNA, 19 bp, Homo sapiens
ttgcttataaactgggaag

SEQ ID NO: 1160673 - DNA, 22 bp, Homo sapiens
ttgcttattgttccaagacatt

SEQ ID NO: 1160674 - DNA, 23 bp, Homo sapiens
ttgcttattgttccaagacattg

SEQ ID NO: 1160675 - DNA, 24 bp, Homo sapiens
ttgcttcactttgccttctggtta

SEQ ID NO: 1160676 - DNA, 17 bp, Homo sapiens
ttgcttcataaatgaag

SEQ ID NO: 1160677 - DNA, 21 bp, Homo sapiens
ttgcttcctcttcttcttttc

SEQ ID NO: 1160678 - DNA, 21 bp, Homo sapiens
ttgcttctaggagtcaactgg

SEQ ID NO: 1160679 - DNA, 11 bp, Homo sapiens
ttgcttctccc

SEQ ID NO: 1160680 - DNA, 17 bp, Homo sapiens
ttgcttctcccatttcc

SEQ ID NO: 1160681 - DNA, 15 bp, Homo sapiens
ttgcttcttactgat

SEQ ID NO: 1160682 - DNA, 22 bp, Homo sapiens
ttgcttcttctcctatgtgtaa

SEQ ID NO: 1160683 - DNA, 12 bp, Homo sapiens
ttgcttctttct

SEQ ID NO: 1160684 - DNA, 20 bp, Homo sapiens
ttgcttgaaattactgtgta

SEQ ID NO: 1160685 - DNA, 21 bp, Homo sapiens
ttgcttgaaattactgtgtaa

SEQ ID NO: 1160686 - DNA, 13 bp, Homo sapiens
ttgcttgatccag

SEQ ID NO: 1160687 - DNA, 22 bp, Homo sapiens
ttgcttgccgagcctaatgaaa

SEQ ID NO: 1160688 - DNA, 18 bp, Homo sapiens
ttgcttgtattgtaaatg

SEQ ID NO: 1160689 - DNA, 23 bp, Homo sapiens
ttgctttaaagtacctgtagtga

SEQ ID NO: 1160690 - DNA, 16 bp, Homo sapiens
ttgctttaattaatta

SEQ ID NO: 1160691 - DNA, 19 bp, Homo sapiens
ttgctttagtatgctggct

SEQ ID NO: 1160692 - DNA, 16 bp, Homo sapiens
ttgctttcctgggcct

SEQ ID NO: 1160693 - DNA, 16 bp, Homo sapiens
ttgctttctattatca

SEQ ID NO: 1160694 - DNA, 13 bp, Homo sapiens
ttgctttctgaaa

SEQ ID NO: 1160695 - DNA, 14 bp, Homo sapiens
ttgctttctgaaat

SEQ ID NO: 1160696 - DNA, 18 bp, Homo sapiens
ttgctttctttagaattt

SEQ ID NO: 1160697 - DNA, 14 bp, Homo sapiens
ttgctttgaaaata

SEQ ID NO: 1160698 - DNA, 15 bp, Homo sapiens
ttgctttgaaaatat

SEQ ID NO: 1160699 - DNA, 22 bp, Homo sapiens
ttgctttgaagcagttgtgtca

SEQ ID NO: 1160700 - DNA, 11 bp, Homo sapiens
ttgctttgagc

SEQ ID NO: 1160701 - DNA, 14 bp, Homo sapiens
ttgctttgccagag

SEQ ID NO: 1160702 - DNA, 16 bp, Homo sapiens
ttgctttgccagagca

SEQ ID NO: 1160703 - DNA, 16 bp, Homo sapiens
ttgctttgcccaagat

SEQ ID NO: 1160704 - DNA, 14 bp, Homo sapiens
ttgctttgctgcac

SEQ ID NO: 1160705 - DNA, 23 bp, Homo sapiens
ttgctttgggctttgcaggctct

SEQ ID NO: 1160706 - DNA, 13 bp, Homo sapiens
ttgcttttagaaa

SEQ ID NO: 1160707 - DNA, 14 bp, Homo sapiens
ttgcttttagaaaa

SEQ ID NO: 1160708 - DNA, 15 bp, Homo sapiens
ttgcttttccctctt

SEQ ID NO: 1160709 - DNA, 19 bp, Homo sapiens
ttgcttttgcctctgccca

SEQ ID NO: 1160710 - DNA, 22 bp, Homo sapiens
ttgcttttgtttttttcctcat

SEQ ID NO: 1160711 - DNA, 19 bp, Homo sapiens
ttgctttttcacagtcact

SEQ ID NO: 1160712 - DNA, 15 bp, Homo sapiens
ttgctttttcaccag

SEQ ID NO: 1160713 - DNA, 22 bp, Homo sapiens
ttgctttttctaatgtggttat

SEQ ID NO: 1160714 - DNA, 15 bp, Homo sapiens
ttggaaaaaactctg

SEQ ID NO: 1160715 - DNA, 15 bp, Homo sapiens
ttggaaaaaatttgt

SEQ ID NO: 1160716 - DNA, 21 bp, Homo sapiens
ttggaaaaatccagaaagaaa

SEQ ID NO: 1160717 - DNA, 22 bp, Homo sapiens
ttggaaaagaatacagaaagat

SEQ ID NO: 1160718 - DNA, 17 bp, Homo sapiens
ttggaaaataaattatt

SEQ ID NO: 1160719 - DNA, 21 bp, Homo sapiens
ttggaaaatgtgtctctgctt

SEQ ID NO: 1160720 - DNA, 17 bp, Homo sapiens
ttggaaacctgccctgc

SEQ ID NO: 1160721 - DNA, 20 bp, Homo sapiens
ttggaaacctgccctgcctg

SEQ ID NO: 1160722 - DNA, 21 bp, Homo sapiens
ttggaaacctgccctgcctga

SEQ ID NO: 1160723 - DNA, 22 bp, Homo sapiens
ttggaaagcatcacctcaggcc

SEQ ID NO: 1160724 - DNA, 21 bp, Homo sapiens
ttggaaagccattgaccaccc

SEQ ID NO: 1160725 - DNA, 15 bp, Homo sapiens
ttggaaataaaaatg

SEQ ID NO: 1160726 - DNA, 16 bp, Homo sapiens
ttggaaataaaccatt

SEQ ID NO: 1160727 - DNA, 21 bp, Homo sapiens
tatagatataatgaacaaaat

SEQ ID NO: 1160728 - DNA, 14 bp, Homo sapiens
tatagatcctgagc

SEQ ID NO: 1160729 - DNA, 22 bp, Homo sapiens
tatagatgcaagatatttatat

SEQ ID NO: 1160730 - DNA, 14 bp, Homo sapiens
tatagattgtctta

SEQ ID NO: 1160731 - DNA, 17 bp, Homo sapiens
tatagcaactaatgttt

SEQ ID NO: 1160732 - DNA, 13 bp, Homo sapiens
tatagcaatccat

SEQ ID NO: 1160733 - DNA, 20 bp, Homo sapiens
tatagcagagtccttattct

SEQ ID NO: 1160734 - DNA, 17 bp, Homo sapiens
tatagcattgaacattt

SEQ ID NO: 1160735 - DNA, 18 bp, Homo sapiens
tatagccaaaaatagcta

SEQ ID NO: 1160736 - DNA, 22 bp, Homo sapiens
tatagccaaaaatagctaaata

SEQ ID NO: 1160737 - DNA, 14 bp, Homo sapiens
tatagctaagtaca

SEQ ID NO: 1160738 - DNA, 22 bp, Homo sapiens
tatagctacaggaagcacccca

SEQ ID NO: 1160739 - DNA, 19 bp, Homo sapiens
tatagctaggtgacatata

SEQ ID NO: 1160740 - DNA, 11 bp, Homo sapiens
tatagctatta

SEQ ID NO: 1160741 - DNA, 14 bp, Homo sapiens
tatagctattactg

SEQ ID NO: 1160742 - DNA, 22 bp, Homo sapiens
tatagctattactgtctggttt

SEQ ID NO: 1160743 - DNA, 21 bp, Homo sapiens
tatagctgagactacaagtgt

SEQ ID NO: 1160744 - DNA, 18 bp, Homo sapiens
tataggatagacactgga

SEQ ID NO: 1160745 - DNA, 21 bp, Homo sapiens
tataggatttatttaaaatag

SEQ ID NO: 1160746 - DNA, 22 bp, Homo sapiens
tataggcacattaccattcata

SEQ ID NO: 1160747 - DNA, 16 bp, Homo sapiens
tataggcatgagccac

SEQ ID NO: 1160748 - DNA, 14 bp, Homo sapiens
tataggccagggca

SEQ ID NO: 1160749 - DNA, 15 bp, Homo sapiens
tataggccagggcat

SEQ ID NO: 1160750 - DNA, 19 bp, Homo sapiens
tataggccagggcatgtgt

SEQ ID NO: 1160751 - DNA, 14 bp, Homo sapiens
tataggccatctgt

SEQ ID NO: 1160752 - DNA, 15 bp, Homo sapiens
tataggccatctgta

SEQ ID NO: 1160753 - DNA, 13 bp, Homo sapiens
tataggcgttttt

SEQ ID NO: 1160754 - DNA, 14 bp, Homo sapiens
tataggctggagaa

SEQ ID NO: 1160755 - DNA, 23 bp, Homo sapiens
tataggtaacgtgattgattcag

SEQ ID NO: 1160756 - DNA, 20 bp, Homo sapiens
tataggtgatgtttgctctt

SEQ ID NO: 1160757 - DNA, 14 bp, Homo sapiens
tatagtaaatgtgt

SEQ ID NO: 1160758 - DNA, 14 bp, Homo sapiens
tatagtacatgata

SEQ ID NO: 1160759 - DNA, 17 bp, Homo sapiens
tatagtatatttatact

SEQ ID NO: 1160760 - DNA, 21 bp, Homo sapiens
tatagtatgtgacttttctga

SEQ ID NO: 1160761 - DNA, 15 bp, Homo sapiens
tatagtctacagttg

SEQ ID NO: 1160762 - DNA, 13 bp, Homo sapiens
tatagtctattca

SEQ ID NO: 1160763 - DNA, 16 bp, Homo sapiens
tatagtctcttgtttg

SEQ ID NO: 1160764 - DNA, 21 bp, Homo sapiens
tatagtgcaatagtgcaacat

SEQ ID NO: 1160765 - DNA, 17 bp, Homo sapiens
tatagtgggtacatcaa

SEQ ID NO: 1160766 - DNA, 13 bp, Homo sapiens
tatagtgtaaaat

SEQ ID NO: 1160767 - DNA, 18 bp, Homo sapiens
tatagtgtaaaataagaa

SEQ ID NO: 1160768 - DNA, 13 bp, Homo sapiens
tatagtgtaataa

SEQ ID NO: 1160769 - DNA, 18 bp, Homo sapiens
tatagtgtaataatgtta

SEQ ID NO: 1160770 - DNA, 23 bp, Homo sapiens
tatagtgtataccacctgtacat

SEQ ID NO: 1160771 - DNA, 15 bp, Homo sapiens
tatagtgtccaggct

SEQ ID NO: 1160772 - DNA, 16 bp, Homo sapiens
tatagtgtgttgtgct

SEQ ID NO: 1160773 - DNA, 18 bp, Homo sapiens
tatagttaacacactacc

SEQ ID NO: 1160774 - DNA, 17 bp, Homo sapiens
tatagttactgtcctgt

SEQ ID NO: 1160775 - DNA, 20 bp, Homo sapiens
tatagttactgtgtaattag

SEQ ID NO: 1160776 - DNA, 17 bp, Homo sapiens
tatagttatgcatacat

SEQ ID NO: 1160777 - DNA, 14 bp, Homo sapiens
tatagttctgtgta

SEQ ID NO: 1160778 - DNA, 19 bp, Homo sapiens
tatagtttattgacaataa

SEQ ID NO: 1160779 - DNA, 22 bp, Homo sapiens
tatagttttacttttaaactgt

SEQ ID NO: 1160780 - DNA, 12 bp, Homo sapiens
tatataaaaaga

SEQ ID NO: 1160781 - DNA, 19 bp, Homo sapiens
tatataaaaagaaaagata

SEQ ID NO: 1160782 - DNA, 23 bp, Homo sapiens
tatataaaaagaaaagataaaga

SEQ ID NO: 1160783 - DNA, 15 bp, Homo sapiens
tatataaaaatggct

SEQ ID NO: 1160784 - DNA, 19 bp, Homo sapiens
tatataaaactaaggcttt

SEQ ID NO: 1160785 - DNA, 22 bp, Homo sapiens
tatataaaactaaggcttttat

SEQ ID NO: 1160786 - DNA, 16 bp, Homo sapiens
tatataaaataaatat

SEQ ID NO: 1160787 - DNA, 17 bp, Homo sapiens
tatataaaataaatata

SEQ ID NO: 1160788 - DNA, 14 bp, Homo sapiens
tatataaaatgtat

SEQ ID NO: 1160789 - DNA, 21 bp, Homo sapiens
tatataaacactccacagtgt

SEQ ID NO: 1160790 - DNA, 11 bp, Homo sapiens
tatataaacat

SEQ ID NO: 1160791 - DNA, 15 bp, Homo sapiens
tatataaacctaaaa

SEQ ID NO: 1160792 - DNA, 17 bp, Homo sapiens
tatataaacctaaaaaa

SEQ ID NO: 1160793 - DNA, 12 bp, Homo sapiens
tatataaatata

SEQ ID NO: 1160794 - DNA, 23 bp, Homo sapiens
tatataaattttttttgtttcat

SEQ ID NO: 1160795 - DNA, 18 bp, Homo sapiens
tatataacagatacattt

SEQ ID NO: 1160796 - DNA, 23 bp, Homo sapiens
tatataagtgtacatatgtgctg

SEQ ID NO: 1160797 - DNA, 18 bp, Homo sapiens
tatataagttgctgtgtg

SEQ ID NO: 1160798 - DNA, 14 bp, Homo sapiens
tatataataaagta

SEQ ID NO: 1160799 - DNA, 19 bp, Homo sapiens
tatataatatctaaagtta

SEQ ID NO: 1160800 - DNA, 14 bp, Homo sapiens
tatataatatgtca

SEQ ID NO: 1160801 - DNA, 16 bp, Homo sapiens
tatataatcatcaagt

SEQ ID NO: 1160802 - DNA, 16 bp, Homo sapiens
tatataatcatgctca

SEQ ID NO: 1160803 - DNA, 20 bp, Homo sapiens
tatataatggtgatgtcata

SEQ ID NO: 1160804 - DNA, 18 bp, Homo sapiens
tatataatttactttgta

SEQ ID NO: 1160805 - DNA, 22 bp, Homo sapiens
tatataatttttttatgttttg

SEQ ID NO: 1160806 - DNA, 18 bp, Homo sapiens
tatatacaaaaagaaaat

SEQ ID NO: 1160807 - DNA, 16 bp, Homo sapiens
tatatacaataacata

SEQ ID NO: 1160808 - DNA, 13 bp, Homo sapiens
tatatacacacaa

SEQ ID NO: 1160809 - DNA, 12 bp, Homo sapiens
tatatacacata

SEQ ID NO: 1160810 - DNA, 17 bp, Homo sapiens
tatatacagtaacttta

SEQ ID NO: 1160811 - DNA, 22 bp, Homo sapiens
tatatacagtaactttatgtgt

SEQ ID NO: 1160812 - DNA, 23 bp, Homo sapiens
tatatacagtaactttatgtgta

SEQ ID NO: 1160813 - DNA, 15 bp, Homo sapiens
tatatacattgctta

SEQ ID NO: 1160814 - DNA, 22 bp, Homo sapiens
tatatacctggcttttacttta

SEQ ID NO: 1160815 - DNA, 19 bp, Homo sapiens
tatatactgggttcttgtt

SEQ ID NO: 1160816 - DNA, 13 bp, Homo sapiens
tatatagagatgt

SEQ ID NO: 1160817 - DNA, 22 bp, Homo sapiens
tatatagagattgtacatttat

SEQ ID NO: 1160818 - DNA, 18 bp, Homo sapiens
tatatagcaaaatgattc

SEQ ID NO: 1160819 - DNA, 14 bp, Homo sapiens
tatataggctattt

SEQ ID NO: 1160820 - DNA, 21 bp, Homo sapiens
tatatagtatatttatactct

SEQ ID NO: 1160821 - DNA, 16 bp, Homo sapiens
tatatagtctacagtt

SEQ ID NO: 1160822 - DNA, 12 bp, Homo sapiens
tatatataaacc

SEQ ID NO: 1160823 - DNA, 14 bp, Homo sapiens
tatatataaagata

SEQ ID NO: 1160824 - DNA, 22 bp, Homo sapiens
tatatatacacatacatacaca

SEQ ID NO: 1160825 - DNA, 12 bp, Homo sapiens
tatatatagaat

SEQ ID NO: 1160826 - DNA, 13 bp, Homo sapiens
tatatatatatgt

SEQ ID NO: 1160827 - DNA, 20 bp, Homo sapiens
tatatatctatctatttgag

SEQ ID NO: 1160828 - DNA, 20 bp, Homo sapiens
tatatatctattattcaaaa

SEQ ID NO: 1160829 - DNA, 16 bp, Homo sapiens
tatatatcttataact

SEQ ID NO: 1160830 - DNA, 15 bp, Homo sapiens
tatatatgtatatgt

SEQ ID NO: 1160831 - DNA, 23 bp, Homo sapiens
tatatatgtgtatgcacagtaaa

SEQ ID NO: 1160832 - DNA, 18 bp, Homo sapiens
tatatatgtgtgtttaaa

SEQ ID NO: 1160833 - DNA, 22 bp, Homo sapiens
tatatatgtgtgtttaaataaa

SEQ ID NO: 1160834 - DNA, 14 bp, Homo sapiens
tatatattctatta

SEQ ID NO: 1160835 - DNA, 14 bp, Homo sapiens
tatatatttaaagg

SEQ ID NO: 1160836 - DNA, 17 bp, Homo sapiens
tatatatttacaaggag

SEQ ID NO: 1160837 - DNA, 13 bp, Homo sapiens
tatatatttgtaa

SEQ ID NO: 1160838 - DNA, 23 bp, Homo sapiens
tatatattttaagccttcatttg

SEQ ID NO: 1160839 - DNA, 15 bp, Homo sapiens
tatatattttatatg

SEQ ID NO: 1160840 - DNA, 15 bp, Homo sapiens
tatatatttttcaaa

SEQ ID NO: 1160841 - DNA, 17 bp, Homo sapiens
tatatatttttcaaata

SEQ ID NO: 1160842 - DNA, 20 bp, Homo sapiens
tatatatttttctgagattt

SEQ ID NO: 1160843 - DNA, 20 bp, Homo sapiens
tatatatttttggttgtcaa

SEQ ID NO: 1160844 - DNA, 22 bp, Homo sapiens
tatatcaacagatagttgtgtt

SEQ ID NO: 1160845 - DNA, 13 bp, Homo sapiens
tatatcagaaaag

SEQ ID NO: 1160846 - DNA, 14 bp, Homo sapiens
tatatcagaatctg

SEQ ID NO: 1160847 - DNA, 16 bp, Homo sapiens
tatatcagaatctgtg

SEQ ID NO: 1160848 - DNA, 19 bp, Homo sapiens
tatatcagaatctgtgtga

SEQ ID NO: 1160849 - DNA, 15 bp, Homo sapiens
tatatcagcctgagt

SEQ ID NO: 1160850 - DNA, 23 bp, Homo sapiens
tatatcagcctgagtctcctgtg

SEQ ID NO: 1160851 - DNA, 17 bp, Homo sapiens
tatatcagcttttctga

SEQ ID NO: 1160852 - DNA, 18 bp, Homo sapiens
ttggaaatagaaagaagc

SEQ ID NO: 1160853 - DNA, 22 bp, Homo sapiens
ttggaaatagaaagaagccata

SEQ ID NO: 1160854 - DNA, 13 bp, Homo sapiens
ttggaaatgtgtt

SEQ ID NO: 1160855 - DNA, 16 bp, Homo sapiens
ttggaaatgtgttttt

SEQ ID NO: 1160856 - DNA, 14 bp, Homo sapiens
ttggaacagaatgt

SEQ ID NO: 1160857 - DNA, 22 bp, Homo sapiens
ttggaacatttctttcttgctg

SEQ ID NO: 1160858 - DNA, 14 bp, Homo sapiens
ttggaaccagactc

SEQ ID NO: 1160859 - DNA, 21 bp, Homo sapiens
ttggaactgcgataactgaga

SEQ ID NO: 1160860 - DNA, 16 bp, Homo sapiens
ttggaagagaggcacc

SEQ ID NO: 1160861 - DNA, 13 bp, Homo sapiens
ttggaagagcccg

SEQ ID NO: 1160862 - DNA, 15 bp, Homo sapiens
ttggaagattcagct

SEQ ID NO: 1160863 - DNA, 18 bp, Homo sapiens
ttggaagctgtttggaaa

SEQ ID NO: 1160864 - DNA, 18 bp, Homo sapiens
ttggaaggatctgctgag

SEQ ID NO: 1160865 - DNA, 20 bp, Homo sapiens
ttggaaggatctgctgaggc

SEQ ID NO: 1160866 - DNA, 20 bp, Homo sapiens
ttggaagtgaaaactttgta

SEQ ID NO: 1160867 - DNA, 13 bp, Homo sapiens
ttggaagtttcat

SEQ ID NO: 1160868 - DNA, 15 bp, Homo sapiens
ttggaagttttaatc

SEQ ID NO: 1160869 - DNA, 22 bp, Homo sapiens
ttggaatattttatcctgtatt

SEQ ID NO: 1160870 - DNA, 14 bp, Homo sapiens
ttggaatcaaggta

SEQ ID NO: 1160871 - DNA, 21 bp, Homo sapiens
ttggaatcttcacctcagagt

SEQ ID NO: 1160872 - DNA, 13 bp, Homo sapiens
ttggaatttacca

SEQ ID NO: 1160873 - DNA, 17 bp, Homo sapiens
ttggaatttctggcctc

SEQ ID NO: 1160874 - DNA, 19 bp, Homo sapiens
ttggaatttgtaacctcag

SEQ ID NO: 1160875 - DNA, 21 bp, Homo sapiens
ttggaatttgtaacctcagct

SEQ ID NO: 1160876 - DNA, 20 bp, Homo sapiens
ttggacaaacctagaatttt

SEQ ID NO: 1160877 - DNA, 14 bp, Homo sapiens
ttggacaaatcaca

SEQ ID NO: 1160878 - DNA, 23 bp, Homo sapiens
ttggacaatcatgaaatatgcat

SEQ ID NO: 1160879 - DNA, 16 bp, Homo sapiens
ttggacagatttcagt

SEQ ID NO: 1160880 - DNA, 17 bp, Homo sapiens
ttggacagatttcagta

SEQ ID NO: 1160881 - DNA, 14 bp, Homo sapiens
ttggacagcaaaac

SEQ ID NO: 1160882 - DNA, 15 bp, Homo sapiens
ttggacagccccctt

SEQ ID NO: 1160883 - DNA, 18 bp, Homo sapiens
ttggacaggagatcagca

SEQ ID NO: 1160884 - DNA, 12 bp, Homo sapiens
ttggacagtggc

SEQ ID NO: 1160885 - DNA, 14 bp, Homo sapiens
ttggacagtggcct

SEQ ID NO: 1160886 - DNA, 14 bp, Homo sapiens
ttggacatcctcct

SEQ ID NO: 1160887 - DNA, 16 bp, Homo sapiens
ttggacatctctctgg

SEQ ID NO: 1160888 - DNA, 22 bp, Homo sapiens
ttggacatctctctggcttctg

SEQ ID NO: 1160889 - DNA, 16 bp, Homo sapiens
ttggacccagggcctg

SEQ ID NO: 1160890 - DNA, 19 bp, Homo sapiens
ttggacccagggcctgact

SEQ ID NO: 1160891 - DNA, 13 bp, Homo sapiens
ttggaccccagct

SEQ ID NO: 1160892 - DNA, 19 bp, Homo sapiens
ttggaccccagctgggagg

SEQ ID NO: 1160893 - DNA, 20 bp, Homo sapiens
ttggaccccagctgggaggc

SEQ ID NO: 1160894 - DNA, 16 bp, Homo sapiens
ttggacccgctctgga

SEQ ID NO: 1160895 - DNA, 22 bp, Homo sapiens
ttggaccctggtgacctcctgt

SEQ ID NO: 1160896 - DNA, 17 bp, Homo sapiens
ttggacccttggaaaac

SEQ ID NO: 1160897 - DNA, 23 bp, Homo sapiens
ttggacctaaatggcctcatgtg

SEQ ID NO: 1160898 - DNA, 15 bp, Homo sapiens
ttggacctccagggg

SEQ ID NO: 1160899 - DNA, 23 bp, Homo sapiens
ttggacctccaggggctcctggg

SEQ ID NO: 1160900 - DNA, 15 bp, Homo sapiens
ttggacctctgctct

SEQ ID NO: 1160901 - DNA, 17 bp, Homo sapiens
ttggacctctgctctga

SEQ ID NO: 1160902 - DNA, 21 bp, Homo sapiens
ttggacctctgctctgaggct

SEQ ID NO: 1160903 - DNA, 13 bp, Homo sapiens
ttggacggcctga

SEQ ID NO: 1160904 - DNA, 20 bp, Homo sapiens
ttggacggtttctagcctct

SEQ ID NO: 1160905 - DNA, 14 bp, Homo sapiens
ttggactccatctc

SEQ ID NO: 1160906 - DNA, 18 bp, Homo sapiens
ttggactgttagtgttaa

SEQ ID NO: 1160907 - DNA, 14 bp, Homo sapiens
ttggactgttttca

SEQ ID NO: 1160908 - DNA, 20 bp, Homo sapiens
ttggacttcctggggccccg

SEQ ID NO: 1160909 - DNA, 16 bp, Homo sapiens
ttggagaagatttatg

SEQ ID NO: 1160910 - DNA, 20 bp, Homo sapiens
ttggagaagcccgtgtgaga

SEQ ID NO: 1160911 - DNA, 21 bp, Homo sapiens
ttggagaatactttgcttcat

SEQ ID NO: 1160912 - DNA, 13 bp, Homo sapiens
ttggagaatttag

SEQ ID NO: 1160913 - DNA, 13 bp, Homo sapiens
ttggagactctgt

SEQ ID NO: 1160914 - DNA, 20 bp, Homo sapiens
ttggagactctgtggggcct

SEQ ID NO: 1160915 - DNA, 14 bp, Homo sapiens
ttggagagaatcat

SEQ ID NO: 1160916 - DNA, 12 bp, Homo sapiens
ttggagagcaaa

SEQ ID NO: 1160917 - DNA, 22 bp, Homo sapiens
ttggagagcagcaggtgctgtg

SEQ ID NO: 1160918 - DNA, 14 bp, Homo sapiens
ttggagagcagctg

SEQ ID NO: 1160919 - DNA, 13 bp, Homo sapiens
ttggagagccctg

SEQ ID NO: 1160920 - DNA, 15 bp, Homo sapiens
ttggagagccctgga

SEQ ID NO: 1160921 - DNA, 17 bp, Homo sapiens
ttggagagggggccgga

SEQ ID NO: 1160922 - DNA, 13 bp, Homo sapiens
ttggagagtaaaa

SEQ ID NO: 1160923 - DNA, 22 bp, Homo sapiens
ttggagatgctgagggtgtttc

SEQ ID NO: 1160924 - DNA, 15 bp, Homo sapiens
ttggagatttttcat

SEQ ID NO: 1160925 - DNA, 21 bp, Homo sapiens
ttggagcaaagaaggagctga

SEQ ID NO: 1160926 - DNA, 14 bp, Homo sapiens
ttggagcaagcttg

SEQ ID NO: 1160927 - DNA, 21 bp, Homo sapiens
ttggagcacaaaattcaaagc

SEQ ID NO: 1160928 - DNA, 23 bp, Homo sapiens
ttggagcacatgttactgcttca

SEQ ID NO: 1160929 - DNA, 23 bp, Homo sapiens
ttggagcaggcaaaaaagggaca

SEQ ID NO: 1160930 - DNA, 17 bp, Homo sapiens
ttggagcattaactaaa

SEQ ID NO: 1160931 - DNA, 24 bp, Homo sapiens
ttggagcattaactaaatgctcat

SEQ ID NO: 1160932 - DNA, 12 bp, Homo sapiens
ttggagccactc

SEQ ID NO: 1160933 - DNA, 14 bp, Homo sapiens
ttggagcctgcagg

SEQ ID NO: 1160934 - DNA, 17 bp, Homo sapiens
ttggagctttttcaaaa

SEQ ID NO: 1160935 - DNA, 21 bp, Homo sapiens
ttggagcttttttctttaaga

SEQ ID NO: 1160936 - DNA, 22 bp, Homo sapiens
ttggaggaagtatgagtgctga

SEQ ID NO: 1160937 - DNA, 14 bp, Homo sapiens
ttggaggaagttgg

SEQ ID NO: 1160938 - DNA, 11 bp, Homo sapiens
ttggaggctga

SEQ ID NO: 1160939 - DNA, 21 bp, Homo sapiens
ttggagggagaggtggcagga

SEQ ID NO: 1160940 - DNA, 12 bp, Homo sapiens
ttggagggatgg

SEQ ID NO: 1160941 - DNA, 18 bp, Homo sapiens
ttggaggtgcttaagcag

SEQ ID NO: 1160942 - DNA, 12 bp, Homo sapiens
ttggagtaattg

SEQ ID NO: 1160943 - DNA, 17 bp, Homo sapiens
ttggataaatcatttca

SEQ ID NO: 1160944 - DNA, 21 bp, Homo sapiens
ttggataagtttctattctgt

SEQ ID NO: 1160945 - DNA, 18 bp, Homo sapiens
ttggataccagctcaggg

SEQ ID NO: 1160946 - DNA, 19 bp, Homo sapiens
ttggatacttggatttagt

SEQ ID NO: 1160947 - DNA, 13 bp, Homo sapiens
ttggatccaagga

SEQ ID NO: 1160948 - DNA, 19 bp, Homo sapiens
ttggatcttcaatggcttt

SEQ ID NO: 1160949 - DNA, 17 bp, Homo sapiens
ttggatcttgaatgtgg

SEQ ID NO: 1160950 - DNA, 19 bp, Homo sapiens
ttggatgcgagcttggcct

SEQ ID NO: 1160951 - DNA, 21 bp, Homo sapiens
ttggatgggagtgagacagaa

SEQ ID NO: 1160952 - DNA, 14 bp, Homo sapiens
ttggatgggagtgg

SEQ ID NO: 1160953 - DNA, 18 bp, Homo sapiens
ttggatgggagtgggcac

SEQ ID NO: 1160954 - DNA, 21 bp, Homo sapiens
ttggatgggagtgggcacctc

SEQ ID NO: 1160955 - DNA, 23 bp, Homo sapiens
ttggatggggctggcatgttttc

SEQ ID NO: 1160956 - DNA, 16 bp, Homo sapiens
ttggatgttgtaaata

SEQ ID NO: 1160957 - DNA, 23 bp, Homo sapiens
ttggattaaatacatatggatgt

SEQ ID NO: 1160958 - DNA, 22 bp, Homo sapiens
ttggattcctaaatattttcaa

SEQ ID NO: 1160959 - DNA, 15 bp, Homo sapiens
ttggattcttatgta

SEQ ID NO: 1160960 - DNA, 20 bp, Homo sapiens
ttggattctttccatttgca

SEQ ID NO: 1160961 - DNA, 14 bp, Homo sapiens
ttggattggggtcc

SEQ ID NO: 1160962 - DNA, 21 bp, Homo sapiens
ttggatttaaaagcctgctca

SEQ ID NO: 1160963 - DNA, 19 bp, Homo sapiens
ttggatttgctcattgctg

SEQ ID NO: 1160964 - DNA, 13 bp, Homo sapiens
ttggatttgctgt

SEQ ID NO: 1160965 - DNA, 18 bp, Homo sapiens
ttggatttgctgtgacta

SEQ ID NO: 1160966 - DNA, 20 bp, Homo sapiens
ttggattttgcaaggtgcat

SEQ ID NO: 1160967 - DNA, 13 bp, Homo sapiens
ttggcaaaatggg

SEQ ID NO: 1160968 - DNA, 22 bp, Homo sapiens
ttggcaaaatggggtttgggcc

SEQ ID NO: 1160969 - DNA, 17 bp, Homo sapiens
ttggcaagatgtttctt

SEQ ID NO: 1160970 - DNA, 16 bp, Homo sapiens
ttggcaagtcacgttg

SEQ ID NO: 1160971 - DNA, 18 bp, Homo sapiens
ttggcaatacatttgatt

SEQ ID NO: 1160972 - DNA, 23 bp, Homo sapiens
ttggcacagaaacacaatatttt

SEQ ID NO: 1160973 - DNA, 14 bp, Homo sapiens
ttggcaccaccagg

SEQ ID NO: 1160974 - DNA, 20 bp, Homo sapiens
ttggcacccccatgctgcct

SEQ ID NO: 1160975 - DNA, 23 bp, Homo sapiens
ttggcactcacagacctggagcc

SEQ ID NO: 1160976 - DNA, 21 bp, Homo sapiens
tatatcagcttttctgatggt

SEQ ID NO: 1160977 - DNA, 17 bp, Homo sapiens
tatatcaggtgtataaa

SEQ ID NO: 1160978 - DNA, 23 bp, Homo sapiens
tatatcaggtgtataaatgtaca

SEQ ID NO: 1160979 - DNA, 14 bp, Homo sapiens
tatatcagtagtgt

SEQ ID NO: 1160980 - DNA, 18 bp, Homo sapiens
tatatcagtagtgtacat

SEQ ID NO: 1160981 - DNA, 14 bp, Homo sapiens
tatatcataactat

SEQ ID NO: 1160982 - DNA, 20 bp, Homo sapiens
tatatcatacagttttcatt

SEQ ID NO: 1160983 - DNA, 18 bp, Homo sapiens
tatatcattctacagaat

SEQ ID NO: 1160984 - DNA, 20 bp, Homo sapiens
tatatcattctacagaataa

SEQ ID NO: 1160985 - DNA, 21 bp, Homo sapiens
tatatcattctacagaataat

SEQ ID NO: 1160986 - DNA, 18 bp, Homo sapiens
tatatccagttcctgctc

SEQ ID NO: 1160987 - DNA, 14 bp, Homo sapiens
tatatcccagaaat

SEQ ID NO: 1160988 - DNA, 20 bp, Homo sapiens
tatatccttaatattttata

SEQ ID NO: 1160989 - DNA, 21 bp, Homo sapiens
tatatctaccccagactagat

SEQ ID NO: 1160990 - DNA, 15 bp, Homo sapiens
tatatctattatgta

SEQ ID NO: 1160991 - DNA, 23 bp, Homo sapiens
tatatctgaagagtatccttcct

SEQ ID NO: 1160992 - DNA, 14 bp, Homo sapiens
tatatcttaagcag

SEQ ID NO: 1160993 - DNA, 16 bp, Homo sapiens
tatatcttgtttacaa

SEQ ID NO: 1160994 - DNA, 14 bp, Homo sapiens
tatatcttttggtt

SEQ ID NO: 1160995 - DNA, 12 bp, Homo sapiens
tatatgaagttg

SEQ ID NO: 1160996 - DNA, 22 bp, Homo sapiens
tatatgaatttaaatataattc

SEQ ID NO: 1160997 - DNA, 15 bp, Homo sapiens
tatatgaccagaagc

SEQ ID NO: 1160998 - DNA, 20 bp, Homo sapiens
tatatgagagaatcacacaa

SEQ ID NO: 1160999 - DNA, 19 bp, Homo sapiens
tatatgaggacttgtgtct

SEQ ID NO: 1161000 - DNA, 14 bp, Homo sapiens
tatatgatcattga

SEQ ID NO: 1161001 - DNA, 17 bp, Homo sapiens
tatatgatctaatacaa

SEQ ID NO: 1161002 - DNA, 23 bp, Homo sapiens
tatatgatctaatacaaagatga

SEQ ID NO: 1161003 - DNA, 13 bp, Homo sapiens
tatatgatggggg

SEQ ID NO: 1161004 - DNA, 19 bp, Homo sapiens
tatatgatgtggacatatg

SEQ ID NO: 1161005 - DNA, 22 bp, Homo sapiens
tatatgatgtggacatatgtat

SEQ ID NO: 1161006 - DNA, 23 bp, Homo sapiens
tatatgatgtggacatatgtata

SEQ ID NO: 1161007 - DNA, 17 bp, Homo sapiens
tatatgcacaaaactac

SEQ ID NO: 1161008 - DNA, 21 bp, Homo sapiens
tatatgcacaaaactactttt

SEQ ID NO: 1161009 - DNA, 10 bp, Homo sapiens
tatatgcacc

SEQ ID NO: 1161010 - DNA, 18 bp, Homo sapiens
tatatgccaagctaattt

SEQ ID NO: 1161011 - DNA, 12 bp, Homo sapiens
tatatgctgtat

SEQ ID NO: 1161012 - DNA, 14 bp, Homo sapiens
tatatgctgtattt

SEQ ID NO: 1161013 - DNA, 16 bp, Homo sapiens
tatatgcttactgata

SEQ ID NO: 1161014 - DNA, 21 bp, Homo sapiens
tatatgcttactgatatattt

SEQ ID NO: 1161015 - DNA, 21 bp, Homo sapiens
tatatgcttcacatagcatgt

SEQ ID NO: 1161016 - DNA, 17 bp, Homo sapiens
tatatggaaattctgct

SEQ ID NO: 1161017 - DNA, 15 bp, Homo sapiens
tatatggacatggca

SEQ ID NO: 1161018 - DNA, 19 bp, Homo sapiens
tatatggcagagttgtaaa

SEQ ID NO: 1161019 - DNA, 23 bp, Homo sapiens
tatatggcagagttgtaaatata

SEQ ID NO: 1161020 - DNA, 20 bp, Homo sapiens
tatatggcatatttatattg

SEQ ID NO: 1161021 - DNA, 16 bp, Homo sapiens
tatatggcccagcctt

SEQ ID NO: 1161022 - DNA, 20 bp, Homo sapiens
tatatgggtatatattcatc

SEQ ID NO: 1161023 - DNA, 17 bp, Homo sapiens
tatatggttctccaaga

SEQ ID NO: 1161024 - DNA, 14 bp, Homo sapiens
tatatgtaaatgtg

SEQ ID NO: 1161025 - DNA, 13 bp, Homo sapiens
tatatgtacttgt

SEQ ID NO: 1161026 - DNA, 19 bp, Homo sapiens
tatatgtagtgcattttta

SEQ ID NO: 1161027 - DNA, 13 bp, Homo sapiens
tatatgtatatat

SEQ ID NO: 1161028 - DNA, 21 bp, Homo sapiens
tatatgtatatatatatagta

SEQ ID NO: 1161029 - DNA, 21 bp, Homo sapiens
tatatgtatatttttttaatt

SEQ ID NO: 1161030 - DNA, 22 bp, Homo sapiens
tatatgtatctacaatacatat

SEQ ID NO: 1161031 - DNA, 14 bp, Homo sapiens
tatatgtattccct

SEQ ID NO: 1161032 - DNA, 19 bp, Homo sapiens
tatatgtattcccttgtat

SEQ ID NO: 1161033 - DNA, 12 bp, Homo sapiens
tatatgtattta

SEQ ID NO: 1161034 - DNA, 23 bp, Homo sapiens
tatatgtatttaagatgtacatt

SEQ ID NO: 1161035 - DNA, 12 bp, Homo sapiens
tatatgtcaaag

SEQ ID NO: 1161036 - DNA, 12 bp, Homo sapiens
tatatgtctgat

SEQ ID NO: 1161037 - DNA, 19 bp, Homo sapiens
tatatgtctgataatgatt

SEQ ID NO: 1161038 - DNA, 23 bp, Homo sapiens
tatatgtgaaaaaaatgagactt

SEQ ID NO: 1161039 - DNA, 18 bp, Homo sapiens
tatatgtgaaaggatatg

SEQ ID NO: 1161040 - DNA, 22 bp, Homo sapiens
tatatgtgaatcctcttcttta

SEQ ID NO: 1161041 - DNA, 22 bp, Homo sapiens
tatatgtggactaaatatctgt

SEQ ID NO: 1161042 - DNA, 19 bp, Homo sapiens
tatatgtgtatacatacat

SEQ ID NO: 1161043 - DNA, 14 bp, Homo sapiens
tatatgttcactgt

SEQ ID NO: 1161044 - DNA, 14 bp, Homo sapiens
tatatgtttacaca

SEQ ID NO: 1161045 - DNA, 18 bp, Homo sapiens
tatatgtttacacaatta

SEQ ID NO: 1161046 - DNA, 19 bp, Homo sapiens
tatatgtttttgaaggcag

SEQ ID NO: 1161047 - DNA, 20 bp, Homo sapiens
tatattaaaaatataaaact

SEQ ID NO: 1161048 - DNA, 18 bp, Homo sapiens
tatattaaaatagcatac

SEQ ID NO: 1161049 - DNA, 23 bp, Homo sapiens
tatattaaaatagcatactgtgt

SEQ ID NO: 1161050 - DNA, 14 bp, Homo sapiens
tatattaacatcat

SEQ ID NO: 1161051 - DNA, 14 bp, Homo sapiens
tatattaagcagaa

SEQ ID NO: 1161052 - DNA, 15 bp, Homo sapiens
tatattaatagtaat

SEQ ID NO: 1161053 - DNA, 22 bp, Homo sapiens
tatattaatagtaatttgtaaa

SEQ ID NO: 1161054 - DNA, 23 bp, Homo sapiens
tatattaatagtaatttgtaaag

SEQ ID NO: 1161055 - DNA, 17 bp, Homo sapiens
tatattaatgtacttgt

SEQ ID NO: 1161056 - DNA, 11 bp, Homo sapiens
tatattacaag

SEQ ID NO: 1161057 - DNA, 18 bp, Homo sapiens
tatattacttttgtaaat

SEQ ID NO: 1161058 - DNA, 20 bp, Homo sapiens
tatattacttttgtaaatat

SEQ ID NO: 1161059 - DNA, 17 bp, Homo sapiens
tatattagctgaaacaa

SEQ ID NO: 1161060 - DNA, 18 bp, Homo sapiens
tatattataattggaagt

SEQ ID NO: 1161061 - DNA, 22 bp, Homo sapiens
tatattatcatgcaaatgctgt

SEQ ID NO: 1161062 - DNA, 12 bp, Homo sapiens
tatattattata

SEQ ID NO: 1161063 - DNA, 19 bp, Homo sapiens
tatattcaaattatgtata

SEQ ID NO: 1161064 - DNA, 14 bp, Homo sapiens
tatattcacagttt

SEQ ID NO: 1161065 - DNA, 22 bp, Homo sapiens
tatattcactggttttacacag

SEQ ID NO: 1161066 - DNA, 18 bp, Homo sapiens
tatattcatcagaatgtt

SEQ ID NO: 1161067 - DNA, 22 bp, Homo sapiens
tatattccaggtttaagtagat

SEQ ID NO: 1161068 - DNA, 15 bp, Homo sapiens
tatattccatgtata

SEQ ID NO: 1161069 - DNA, 13 bp, Homo sapiens
tatattctggaaa

SEQ ID NO: 1161070 - DNA, 22 bp, Homo sapiens
tatattctggaaaaaaaatata

SEQ ID NO: 1161071 - DNA, 18 bp, Homo sapiens
tatattgaaatttattta

SEQ ID NO: 1161072 - DNA, 22 bp, Homo sapiens
tatattgaataaaaaatagaca

SEQ ID NO: 1161073 - DNA, 15 bp, Homo sapiens
tatattgtaagaaat

SEQ ID NO: 1161074 - DNA, 19 bp, Homo sapiens
tatattgtaagaaatactg

SEQ ID NO: 1161075 - DNA, 13 bp, Homo sapiens
tatattgtacaaa

SEQ ID NO: 1161076 - DNA, 14 bp, Homo sapiens
tatattgtatattc

SEQ ID NO: 1161077 - DNA, 17 bp, Homo sapiens
tatattgtatattctgg

SEQ ID NO: 1161078 - DNA, 19 bp, Homo sapiens
tatattgtcagatattttt

SEQ ID NO: 1161079 - DNA, 19 bp, Homo sapiens
tatattgtggaataaatcc

SEQ ID NO: 1161080 - DNA, 19 bp, Homo sapiens
tatattgtgtttgtgtatt

SEQ ID NO: 1161081 - DNA, 13 bp, Homo sapiens
tatattgttttct

SEQ ID NO: 1161082 - DNA, 19 bp, Homo sapiens
tatatttaaaaaattaaaa

SEQ ID NO: 1161083 - DNA, 14 bp, Homo sapiens
tatatttaaaaata

SEQ ID NO: 1161084 - DNA, 15 bp, Homo sapiens
tatatttaaaaataa

SEQ ID NO: 1161085 - DNA, 20 bp, Homo sapiens
tatatttaagcaacatcttt

SEQ ID NO: 1161086 - DNA, 15 bp, Homo sapiens
tatatttaattttga

SEQ ID NO: 1161087 - DNA, 22 bp, Homo sapiens
tatatttagttacgtataatgc

SEQ ID NO: 1161088 - DNA, 18 bp, Homo sapiens
tatatttagttatagttt

SEQ ID NO: 1161089 - DNA, 12 bp, Homo sapiens
tatatttataac

SEQ ID NO: 1161090 - DNA, 21 bp, Homo sapiens
tatatttataactcatcataa

SEQ ID NO: 1161091 - DNA, 13 bp, Homo sapiens
tatatttatactc

SEQ ID NO: 1161092 - DNA, 14 bp, Homo sapiens
tatatttatactct

SEQ ID NO: 1161093 - DNA, 12 bp, Homo sapiens
tatatttattca

SEQ ID NO: 1161094 - DNA, 17 bp, Homo sapiens
tatatttattcataatg

SEQ ID NO: 1161095 - DNA, 22 bp, Homo sapiens
tatatttcacttttgttctgct

SEQ ID NO: 1161096 - DNA, 19 bp, Homo sapiens
tatatttcagatgtaatgt

SEQ ID NO: 1161097 - DNA, 12 bp, Homo sapiens
tatatttcagtg

SEQ ID NO: 1161098 - DNA, 11 bp, Homo sapiens
tatatttcctt

SEQ ID NO: 1161099 - DNA, 13 bp, Homo sapiens
tatatttccttta

SEQ ID NO: 1161100 - DNA, 22 bp, Homo sapiens
ttggcacttataggtaacgtga

SEQ ID NO: 1161101 - DNA, 20 bp, Homo sapiens
ttggcacttgccattccaaa

SEQ ID NO: 1161102 - DNA, 13 bp, Homo sapiens
ttggcacttgtat

SEQ ID NO: 1161103 - DNA, 17 bp, Homo sapiens
ttggcacttgtatttaa

SEQ ID NO: 1161104 - DNA, 19 bp, Homo sapiens
ttggcacttgtatttaatt

SEQ ID NO: 1161105 - DNA, 14 bp, Homo sapiens
ttggcagagaaggc

SEQ ID NO: 1161106 - DNA, 17 bp, Homo sapiens
ttggcagagaaggcctc

SEQ ID NO: 1161107 - DNA, 18 bp, Homo sapiens
ttggcagagaaggcctct

SEQ ID NO: 1161108 - DNA, 23 bp, Homo sapiens
ttggcagcttaacattgacttct

SEQ ID NO: 1161109 - DNA, 15 bp, Homo sapiens
ttggcagctttttct

SEQ ID NO: 1161110 - DNA, 19 bp, Homo sapiens
ttggcagctttttctgtgg

SEQ ID NO: 1161111 - DNA, 21 bp, Homo sapiens
ttggcaggcccactccccagc

SEQ ID NO: 1161112 - DNA, 13 bp, Homo sapiens
ttggcaggctggc

SEQ ID NO: 1161113 - DNA, 16 bp, Homo sapiens
ttggcataatttgtct

SEQ ID NO: 1161114 - DNA, 17 bp, Homo sapiens
ttggcataatttgtctt

SEQ ID NO: 1161115 - DNA, 17 bp, Homo sapiens
ttggcatctctgtccca

SEQ ID NO: 1161116 - DNA, 20 bp, Homo sapiens
ttggcatggaaatttaaagc

SEQ ID NO: 1161117 - DNA, 12 bp, Homo sapiens
ttggcatggtga

SEQ ID NO: 1161118 - DNA, 14 bp, Homo sapiens
ttggcatttctata

SEQ ID NO: 1161119 - DNA, 16 bp, Homo sapiens
ttggccaaacatcaga

SEQ ID NO: 1161120 - DNA, 15 bp, Homo sapiens
ttggccaaagtgtta

SEQ ID NO: 1161121 - DNA, 15 bp, Homo sapiens
ttggccaagcagaaa

SEQ ID NO: 1161122 - DNA, 22 bp, Homo sapiens
ttggccaatgcacctaaagaaa

SEQ ID NO: 1161123 - DNA, 23 bp, Homo sapiens
ttggccaatgcacctaaagaaaa

SEQ ID NO: 1161124 - DNA, 21 bp, Homo sapiens
ttggccactccgagaggtggg

SEQ ID NO: 1161125 - DNA, 22 bp, Homo sapiens
ttggccactccgagaggtgggc

SEQ ID NO: 1161126 - DNA, 22 bp, Homo sapiens
ttggccactgggtctcactcct

SEQ ID NO: 1161127 - DNA, 22 bp, Homo sapiens
ttggccaggaggttcccccgac

SEQ ID NO: 1161128 - DNA, 21 bp, Homo sapiens
ttggccagggaggcgcaggga

SEQ ID NO: 1161129 - DNA, 20 bp, Homo sapiens
ttggccatgatgtccttgga

SEQ ID NO: 1161130 - DNA, 13 bp, Homo sapiens
ttggcccaatgcc

SEQ ID NO: 1161131 - DNA, 15 bp, Homo sapiens
ttggcccaggagctc

SEQ ID NO: 1161132 - DNA, 16 bp, Homo sapiens
ttggcccaggagctct

SEQ ID NO: 1161133 - DNA, 14 bp, Homo sapiens
ttggccccagagga

SEQ ID NO: 1161134 - DNA, 13 bp, Homo sapiens
ttggcccctccct

SEQ ID NO: 1161135 - DNA, 21 bp, Homo sapiens
ttggccctcttgcgggcctgg

SEQ ID NO: 1161136 - DNA, 13 bp, Homo sapiens
ttggccctggagc

SEQ ID NO: 1161137 - DNA, 15 bp, Homo sapiens
ttggccctggagcca

SEQ ID NO: 1161138 - DNA, 16 bp, Homo sapiens
ttggccctggagccag

SEQ ID NO: 1161139 - DNA, 22 bp, Homo sapiens
ttggccctggagccagggcaga

SEQ ID NO: 1161140 - DNA, 15 bp, Homo sapiens
ttggcccttccagtg

SEQ ID NO: 1161141 - DNA, 15 bp, Homo sapiens
ttggcccttgtcttt

SEQ ID NO: 1161142 - DNA, 23 bp, Homo sapiens
ttggccgtggccatcagggtggg

SEQ ID NO: 1161143 - DNA, 15 bp, Homo sapiens
ttggcctacattctt

SEQ ID NO: 1161144 - DNA, 22 bp, Homo sapiens
ttggcctccagctgttcttagt

SEQ ID NO: 1161145 - DNA, 17 bp, Homo sapiens
ttggcctccatttctgt

SEQ ID NO: 1161146 - DNA, 19 bp, Homo sapiens
ttggcctccggcctcccct

SEQ ID NO: 1161147 - DNA, 16 bp, Homo sapiens
ttggcctctccttgga

SEQ ID NO: 1161148 - DNA, 20 bp, Homo sapiens
ttggcctcttgtcccttggc

SEQ ID NO: 1161149 - DNA, 19 bp, Homo sapiens
ttggcctgatcagaccacg

SEQ ID NO: 1161150 - DNA, 13 bp, Homo sapiens
ttggcctgctgtg

SEQ ID NO: 1161151 - DNA, 12 bp, Homo sapiens
ttggcctgtcac

SEQ ID NO: 1161152 - DNA, 23 bp, Homo sapiens
ttggcctgtccacctgtgctgct

SEQ ID NO: 1161153 - DNA, 13 bp, Homo sapiens
ttggcctgtgagc

SEQ ID NO: 1161154 - DNA, 19 bp, Homo sapiens
ttggcctgtttgatgtatg

SEQ ID NO: 1161155 - DNA, 22 bp, Homo sapiens
ttggccttcagaaccatccata

SEQ ID NO: 1161156 - DNA, 13 bp, Homo sapiens
ttggcctttcctt

SEQ ID NO: 1161157 - DNA, 21 bp, Homo sapiens
ttggccttttgtacaaagatt

SEQ ID NO: 1161158 - DNA, 23 bp, Homo sapiens
ttggcgatgaggtaattctccct

SEQ ID NO: 1161159 - DNA, 14 bp, Homo sapiens
ttggcgctggagag

SEQ ID NO: 1161160 - DNA, 21 bp, Homo sapiens
ttggctagaggttcaaagata

SEQ ID NO: 1161161 - DNA, 22 bp, Homo sapiens
ttggctagaggttcaaagatat

SEQ ID NO: 1161162 - DNA, 17 bp, Homo sapiens
ttggctatttaaaactt

SEQ ID NO: 1161163 - DNA, 22 bp, Homo sapiens
ttggctcccattcactcttcca

SEQ ID NO: 1161164 - DNA, 22 bp, Homo sapiens
ttggctcgaatctctgtgcctt

SEQ ID NO: 1161165 - DNA, 13 bp, Homo sapiens
ttggctctactcc

SEQ ID NO: 1161166 - DNA, 19 bp, Homo sapiens
ttggctgaaattctcctgg

SEQ ID NO: 1161167 - DNA, 20 bp, Homo sapiens
ttggctgaaattctcctgga

SEQ ID NO: 1161168 - DNA, 16 bp, Homo sapiens
ttggctgaattaaaat

SEQ ID NO: 1161169 - DNA, 14 bp, Homo sapiens
ttggctgacccctc

SEQ ID NO: 1161170 - DNA, 21 bp, Homo sapiens
ttggctgacccctctggtgtg

SEQ ID NO: 1161171 - DNA, 12 bp, Homo sapiens
ttggctgagacc

SEQ ID NO: 1161172 - DNA, 18 bp, Homo sapiens
ttggctgagacctgggat

SEQ ID NO: 1161173 - DNA, 20 bp, Homo sapiens
ttggctgagtactggaataa

SEQ ID NO: 1161174 - DNA, 15 bp, Homo sapiens
ttggctgcagccatc

SEQ ID NO: 1161175 - DNA, 20 bp, Homo sapiens
ttggctgcgtactccactgg

SEQ ID NO: 1161176 - DNA, 13 bp, Homo sapiens
ttggctgggccca

SEQ ID NO: 1161177 - DNA, 19 bp, Homo sapiens
ttggctggggaggaccagg

SEQ ID NO: 1161178 - DNA, 21 bp, Homo sapiens
ttggctggtagcagcaggctc

SEQ ID NO: 1161179 - DNA, 18 bp, Homo sapiens
ttggctgtccttcccctt

SEQ ID NO: 1161180 - DNA, 19 bp, Homo sapiens
ttggctgtgacctcttcaa

SEQ ID NO: 1161181 - DNA, 17 bp, Homo sapiens
ttggctgtgtctaaact

SEQ ID NO: 1161182 - DNA, 20 bp, Homo sapiens
ttggctgtgtctaaactgca

SEQ ID NO: 1161183 - DNA, 14 bp, Homo sapiens
ttggctgttccaga

SEQ ID NO: 1161184 - DNA, 15 bp, Homo sapiens
ttggcttaaagtgaa

SEQ ID NO: 1161185 - DNA, 21 bp, Homo sapiens
ttggcttaaagtgaaggaaat

SEQ ID NO: 1161186 - DNA, 17 bp, Homo sapiens
ttggcttaatttaatgt

SEQ ID NO: 1161187 - DNA, 16 bp, Homo sapiens
ttggcttacctgacct

SEQ ID NO: 1161188 - DNA, 17 bp, Homo sapiens
ttggcttcctttcttgg

SEQ ID NO: 1161189 - DNA, 19 bp, Homo sapiens
ttggcttctcctgtgaccc

SEQ ID NO: 1161190 - DNA, 21 bp, Homo sapiens
ttggcttcttaaaaactgtgt

SEQ ID NO: 1161191 - DNA, 23 bp, Homo sapiens
ttggcttcttaaaaactgtgtat

SEQ ID NO: 1161192 - DNA, 15 bp, Homo sapiens
ttggcttgctgttta

SEQ ID NO: 1161193 - DNA, 12 bp, Homo sapiens
ttggctttctcc

SEQ ID NO: 1161194 - DNA, 18 bp, Homo sapiens
ttggctttctccctcacc

SEQ ID NO: 1161195 - DNA, 22 bp, Homo sapiens
ttggctttgggttgcaggacct

SEQ ID NO: 1161196 - DNA, 15 bp, Homo sapiens
ttggctttgtgcttg

SEQ ID NO: 1161197 - DNA, 12 bp, Homo sapiens
ttgggaaagaga

SEQ ID NO: 1161198 - DNA, 18 bp, Homo sapiens
ttgggaactgaactcact

SEQ ID NO: 1161199 - DNA, 18 bp, Homo sapiens
ttgggaagacgttttctt

SEQ ID NO: 1161200 - DNA, 22 bp, Homo sapiens
ttgggaaggaaatatatttgta

SEQ ID NO: 1161201 - DNA, 18 bp, Homo sapiens
ttgggaaggggtcctgca

SEQ ID NO: 1161202 - DNA, 19 bp, Homo sapiens
ttgggaatatccatgtact

SEQ ID NO: 1161203 - DNA, 13 bp, Homo sapiens
ttgggaatgcaat

SEQ ID NO: 1161204 - DNA, 11 bp, Homo sapiens
ttgggaatgtt

SEQ ID NO: 1161205 - DNA, 13 bp, Homo sapiens
ttgggacagccag

SEQ ID NO: 1161206 - DNA, 21 bp, Homo sapiens
ttgggacccaaaacacaggaa

SEQ ID NO: 1161207 - DNA, 19 bp, Homo sapiens
ttgggactcaggtctgtaa

SEQ ID NO: 1161208 - DNA, 22 bp, Homo sapiens
ttgggactgctaaataaaattt

SEQ ID NO: 1161209 - DNA, 17 bp, Homo sapiens
ttgggagacatgtgaca

SEQ ID NO: 1161210 - DNA, 21 bp, Homo sapiens
ttgggagcaaaataaggaaga

SEQ ID NO: 1161211 - DNA, 19 bp, Homo sapiens
ttgggagcctgaggcagga

SEQ ID NO: 1161212 - DNA, 14 bp, Homo sapiens
ttgggagctgctgg

SEQ ID NO: 1161213 - DNA, 18 bp, Homo sapiens
ttgggagctgctgggcta

SEQ ID NO: 1161214 - DNA, 17 bp, Homo sapiens
ttgggagcttgggaatg

SEQ ID NO: 1161215 - DNA, 16 bp, Homo sapiens
ttgggaggccaaggca

SEQ ID NO: 1161216 - DNA, 19 bp, Homo sapiens
ttgggaggtgcgtgttcag

SEQ ID NO: 1161217 - DNA, 22 bp, Homo sapiens
ttgggaggttttattctgactt

SEQ ID NO: 1161218 - DNA, 18 bp, Homo sapiens
ttgggagtatgttgtcat

SEQ ID NO: 1161219 - DNA, 13 bp, Homo sapiens
ttgggagttttta

SEQ ID NO: 1161220 - DNA, 16 bp, Homo sapiens
ttgggatcaataggaa

SEQ ID NO: 1161221 - DNA, 14 bp, Homo sapiens
ttgggatccttcag

SEQ ID NO: 1161222 - DNA, 17 bp, Homo sapiens
ttgggatctgtcttggc

SEQ ID NO: 1161223 - DNA, 14 bp, Homo sapiens
ttgggattgggggc

SEQ ID NO: 1161224 - DNA, 16 bp, Homo sapiens
tatatttcctttatgt

SEQ ID NO: 1161225 - DNA, 17 bp, Homo sapiens
tatatttcctttatgtg

SEQ ID NO: 1161226 - DNA, 20 bp, Homo sapiens
tatatttcctttatgtgaat

SEQ ID NO: 1161227 - DNA, 22 bp, Homo sapiens
tatatttcctttatgtgaattt

SEQ ID NO: 1161228 - DNA, 16 bp, Homo sapiens
tatatttctacagaga

SEQ ID NO: 1161229 - DNA, 18 bp, Homo sapiens
tatatttcttcttctaag

SEQ ID NO: 1161230 - DNA, 14 bp, Homo sapiens
tatatttctttgtt

SEQ ID NO: 1161231 - DNA, 18 bp, Homo sapiens
tatatttgcattatgtat

SEQ ID NO: 1161232 - DNA, 13 bp, Homo sapiens
tatatttgctgca

SEQ ID NO: 1161233 - DNA, 14 bp, Homo sapiens
tatatttgctgcaa

SEQ ID NO: 1161234 - DNA, 12 bp, Homo sapiens
tatatttgtaaa

SEQ ID NO: 1161235 - DNA, 22 bp, Homo sapiens
tatatttgtaaactacaaagta

SEQ ID NO: 1161236 - DNA, 12 bp, Homo sapiens
tatatttgtaca

SEQ ID NO: 1161237 - DNA, 14 bp, Homo sapiens
tatatttgtacaaa

SEQ ID NO: 1161238 - DNA, 13 bp, Homo sapiens
tatatttgtagga

SEQ ID NO: 1161239 - DNA, 17 bp, Homo sapiens
tatatttgtaggagaaa

SEQ ID NO: 1161240 - DNA, 14 bp, Homo sapiens
tatatttgtcatga

SEQ ID NO: 1161241 - DNA, 13 bp, Homo sapiens
tatatttgtcttc

SEQ ID NO: 1161242 - DNA, 14 bp, Homo sapiens
tatatttgtcttcc

SEQ ID NO: 1161243 - DNA, 17 bp, Homo sapiens
tatatttgtgctatagt

SEQ ID NO: 1161244 - DNA, 22 bp, Homo sapiens
tatatttgtgctatagtatttg

SEQ ID NO: 1161245 - DNA, 13 bp, Homo sapiens
tatatttgtgtat

SEQ ID NO: 1161246 - DNA, 20 bp, Homo sapiens
tatatttgtgtatttaacag

SEQ ID NO: 1161247 - DNA, 21 bp, Homo sapiens
tatattttaagccttcatttg

SEQ ID NO: 1161248 - DNA, 22 bp, Homo sapiens
tatattttaagccttcatttgc

SEQ ID NO: 1161249 - DNA, 13 bp, Homo sapiens
tatattttaatag

SEQ ID NO: 1161250 - DNA, 23 bp, Homo sapiens
tatattttacacgtatctcttgg

SEQ ID NO: 1161251 - DNA, 13 bp, Homo sapiens
tatattttatata

SEQ ID NO: 1161252 - DNA, 15 bp, Homo sapiens
tatattttatatgtt

SEQ ID NO: 1161253 - DNA, 13 bp, Homo sapiens
tatattttatgaa

SEQ ID NO: 1161254 - DNA, 16 bp, Homo sapiens
tatattttatgaacat

SEQ ID NO: 1161255 - DNA, 14 bp, Homo sapiens
tatattttcctata

SEQ ID NO: 1161256 - DNA, 12 bp, Homo sapiens
tatattttcctc

SEQ ID NO: 1161257 - DNA, 14 bp, Homo sapiens
tatattttctattt

SEQ ID NO: 1161258 - DNA, 17 bp, Homo sapiens
tatattttgattttaca

SEQ ID NO: 1161259 - DNA, 20 bp, Homo sapiens
tatattttgattttacatgc

SEQ ID NO: 1161260 - DNA, 17 bp, Homo sapiens
tatattttgtttacaaa

SEQ ID NO: 1161261 - DNA, 16 bp, Homo sapiens
tatatttttaaagaat

SEQ ID NO: 1161262 - DNA, 13 bp, Homo sapiens
tatatttttcaaa

SEQ ID NO: 1161263 - DNA, 16 bp, Homo sapiens
tatatttttctgagat

SEQ ID NO: 1161264 - DNA, 19 bp, Homo sapiens
tatatttttctgagatttt

SEQ ID NO: 1161265 - DNA, 19 bp, Homo sapiens
tatatttttggttgtcaat

SEQ ID NO: 1161266 - DNA, 20 bp, Homo sapiens
tatatttttgtacatattgt

SEQ ID NO: 1161267 - DNA, 21 bp, Homo sapiens
tatatttttgtacatattgtt

SEQ ID NO: 1161268 - DNA, 19 bp, Homo sapiens
tatatttttgtctgcagct

SEQ ID NO: 1161269 - DNA, 18 bp, Homo sapiens
tatatttttgtgttttct

SEQ ID NO: 1161270 - DNA, 18 bp, Homo sapiens
tatattttttaaaataag

SEQ ID NO: 1161271 - DNA, 19 bp, Homo sapiens
tatattttttaaaataagt

SEQ ID NO: 1161272 - DNA, 16 bp, Homo sapiens
tatatttttttaactt

SEQ ID NO: 1161273 - DNA, 21 bp, Homo sapiens
tatcaaaaaaagactcagcca

SEQ ID NO: 1161274 - DNA, 15 bp, Homo sapiens
tatcaaaaaaccttt

SEQ ID NO: 1161275 - DNA, 18 bp, Homo sapiens
tatcaaaaaacctttaca

SEQ ID NO: 1161276 - DNA, 23 bp, Homo sapiens
tatcaaaaagtattatcattgct

SEQ ID NO: 1161277 - DNA, 22 bp, Homo sapiens
tatcaaaatgtagcttttgggg

SEQ ID NO: 1161278 - DNA, 20 bp, Homo sapiens
tatcaaacagaattttaaag

SEQ ID NO: 1161279 - DNA, 17 bp, Homo sapiens
tatcaaaccctagcctt

SEQ ID NO: 1161280 - DNA, 19 bp, Homo sapiens
tatcaaaccctagccttgc

SEQ ID NO: 1161281 - DNA, 22 bp, Homo sapiens
tatcaaaccctagccttgcttg

SEQ ID NO: 1161282 - DNA, 12 bp, Homo sapiens
tatcaaagtcat

SEQ ID NO: 1161283 - DNA, 23 bp, Homo sapiens
tatcaaatacatttaaaacatta

SEQ ID NO: 1161284 - DNA, 22 bp, Homo sapiens
tatcaaatctgtatatgttgta

SEQ ID NO: 1161285 - DNA, 13 bp, Homo sapiens
tatcaaatgaaac

SEQ ID NO: 1161286 - DNA, 19 bp, Homo sapiens
tatcaaatgccttcatgaa

SEQ ID NO: 1161287 - DNA, 23 bp, Homo sapiens
tatcaaatgccttcatgaatctt

SEQ ID NO: 1161288 - DNA, 13 bp, Homo sapiens
tatcaaatgcttg

SEQ ID NO: 1161289 - DNA, 17 bp, Homo sapiens
tatcaaattatcttcac

SEQ ID NO: 1161290 - DNA, 18 bp, Homo sapiens
tatcaaccccagacactg

SEQ ID NO: 1161291 - DNA, 18 bp, Homo sapiens
tatcaacttcgctagaaa

SEQ ID NO: 1161292 - DNA, 12 bp, Homo sapiens
tatcaagaaagt

SEQ ID NO: 1161293 - DNA, 22 bp, Homo sapiens
tatcaaggaagaaatggttcag

SEQ ID NO: 1161294 - DNA, 21 bp, Homo sapiens
tatcaagtattataccttttt

SEQ ID NO: 1161295 - DNA, 18 bp, Homo sapiens
tatcaagtggcatgtgct

SEQ ID NO: 1161296 - DNA, 16 bp, Homo sapiens
tatcaatgtgtctttc

SEQ ID NO: 1161297 - DNA, 22 bp, Homo sapiens
tatcaatgtgtctttctaagaa

SEQ ID NO: 1161298 - DNA, 16 bp, Homo sapiens
tatcaatttttcccag

SEQ ID NO: 1161299 - DNA, 21 bp, Homo sapiens
tatcaatttttcccagtattt

SEQ ID NO: 1161300 - DNA, 21 bp, Homo sapiens
tatcacatgtgaaaagcttaa

SEQ ID NO: 1161301 - DNA, 23 bp, Homo sapiens
tatcaccgtgggctccctgactg

SEQ ID NO: 1161302 - DNA, 16 bp, Homo sapiens
tatcacctcattctga

SEQ ID NO: 1161303 - DNA, 17 bp, Homo sapiens
tatcacctcattctgaa

SEQ ID NO: 1161304 - DNA, 19 bp, Homo sapiens
tatcacctcattctgaacc

SEQ ID NO: 1161305 - DNA, 13 bp, Homo sapiens
tatcacctcccct

SEQ ID NO: 1161306 - DNA, 18 bp, Homo sapiens
tatcacctcgagaagtaa

SEQ ID NO: 1161307 - DNA, 16 bp, Homo sapiens
tatcacgatttgcagg

SEQ ID NO: 1161308 - DNA, 15 bp, Homo sapiens
tatcacgttgaacca

SEQ ID NO: 1161309 - DNA, 13 bp, Homo sapiens
tatcactcaagcc

SEQ ID NO: 1161310 - DNA, 19 bp, Homo sapiens
tatcactcattaattaacc

SEQ ID NO: 1161311 - DNA, 18 bp, Homo sapiens
tatcactgacacaaaaag

SEQ ID NO: 1161312 - DNA, 16 bp, Homo sapiens
tatcacttaaacttgc

SEQ ID NO: 1161313 - DNA, 15 bp, Homo sapiens
tatcacttttctggg

SEQ ID NO: 1161314 - DNA, 15 bp, Homo sapiens
tatcagaagagaggg

SEQ ID NO: 1161315 - DNA, 16 bp, Homo sapiens
tatcagaagagagggg

SEQ ID NO: 1161316 - DNA, 18 bp, Homo sapiens
tatcagaagtatatctgt

SEQ ID NO: 1161317 - DNA, 14 bp, Homo sapiens
tatcagaatctgtg

SEQ ID NO: 1161318 - DNA, 16 bp, Homo sapiens
tatcagaatctgtgtg

SEQ ID NO: 1161319 - DNA, 20 bp, Homo sapiens
tatcagaatttgtgttgaag

SEQ ID NO: 1161320 - DNA, 15 bp, Homo sapiens
tatcagacaagcact

SEQ ID NO: 1161321 - DNA, 17 bp, Homo sapiens
tatcagacaagcactat

SEQ ID NO: 1161322 - DNA, 14 bp, Homo sapiens
tatcagcaaagaaa

SEQ ID NO: 1161323 - DNA, 14 bp, Homo sapiens
tatcagcattgttt

SEQ ID NO: 1161324 - DNA, 20 bp, Homo sapiens
tatcaggacccagaggaagg

SEQ ID NO: 1161325 - DNA, 21 bp, Homo sapiens
tatcaggacccagaggaaggg

SEQ ID NO: 1161326 - DNA, 13 bp, Homo sapiens
tatcaggggaaaa

SEQ ID NO: 1161327 - DNA, 19 bp, Homo sapiens
tatcagggtataaattata

SEQ ID NO: 1161328 - DNA, 14 bp, Homo sapiens
tatcaggtaataaa

SEQ ID NO: 1161329 - DNA, 17 bp, Homo sapiens
tatcaggtgtataaatg

SEQ ID NO: 1161330 - DNA, 18 bp, Homo sapiens
tatcaggtgtataaatgt

SEQ ID NO: 1161331 - DNA, 20 bp, Homo sapiens
tatcagtagtgtacattacc

SEQ ID NO: 1161332 - DNA, 21 bp, Homo sapiens
tatcagtatcacgatttgcag

SEQ ID NO: 1161333 - DNA, 15 bp, Homo sapiens
tatcagtgacagagt

SEQ ID NO: 1161334 - DNA, 17 bp, Homo sapiens
tatcagtgacagagttc

SEQ ID NO: 1161335 - DNA, 22 bp, Homo sapiens
tatcagtgacagagttcactat

SEQ ID NO: 1161336 - DNA, 20 bp, Homo sapiens
tatcagttaaaatcacattt

SEQ ID NO: 1161337 - DNA, 15 bp, Homo sapiens
tatcagttactcagc

SEQ ID NO: 1161338 - DNA, 14 bp, Homo sapiens
tatcagttatatga

SEQ ID NO: 1161339 - DNA, 15 bp, Homo sapiens
tatcagttatatgat

SEQ ID NO: 1161340 - DNA, 15 bp, Homo sapiens
tatcagttatccttt

SEQ ID NO: 1161341 - DNA, 23 bp, Homo sapiens
tatcagttatcctttgtgagcct

SEQ ID NO: 1161342 - DNA, 17 bp, Homo sapiens
tatcagtttcatgaaat

SEQ ID NO: 1161343 - DNA, 20 bp, Homo sapiens
tatcagtttgtcctgtagag

SEQ ID NO: 1161344 - DNA, 13 bp, Homo sapiens
tatcataattacc

SEQ ID NO: 1161345 - DNA, 18 bp, Homo sapiens
tatcataccctttattct

SEQ ID NO: 1161346 - DNA, 20 bp, Homo sapiens
tatcataccctttattctca

SEQ ID NO: 1161347 - DNA, 23 bp, Homo sapiens
tatcatagaaatgtaacttttgt

SEQ ID NO: 1161348 - DNA, 16 bp, Homo sapiens
tatcatatccttgccc

SEQ ID NO: 1161349 - DNA, 13 bp, Homo sapiens
ttgggatttgctg

SEQ ID NO: 1161350 - DNA, 12 bp, Homo sapiens
ttgggcagagct

SEQ ID NO: 1161351 - DNA, 14 bp, Homo sapiens
ttgggcagccagga

SEQ ID NO: 1161352 - DNA, 17 bp, Homo sapiens
ttgggcattagtgtccc

SEQ ID NO: 1161353 - DNA, 19 bp, Homo sapiens
ttgggcattagtgtccccc

SEQ ID NO: 1161354 - DNA, 17 bp, Homo sapiens
ttgggccaaggtgtttc

SEQ ID NO: 1161355 - DNA, 22 bp, Homo sapiens
ttgggccacgctcttgaggaag

SEQ ID NO: 1161356 - DNA, 13 bp, Homo sapiens
ttgggccattacc

SEQ ID NO: 1161357 - DNA, 16 bp, Homo sapiens
ttgggccattacccca

SEQ ID NO: 1161358 - DNA, 17 bp, Homo sapiens
ttgggccgaaagagaga

SEQ ID NO: 1161359 - DNA, 24 bp, Homo sapiens
ttgggccggtgctgggggcacagc

SEQ ID NO: 1161360 - DNA, 23 bp, Homo sapiens
ttgggcctccatgccccagctct

SEQ ID NO: 1161361 - DNA, 22 bp, Homo sapiens
ttgggcctccttcccatgcctg

SEQ ID NO: 1161362 - DNA, 20 bp, Homo sapiens
ttgggcctctcctgccctct

SEQ ID NO: 1161363 - DNA, 15 bp, Homo sapiens
ttgggcctgttcctt

SEQ ID NO: 1161364 - DNA, 20 bp, Homo sapiens
ttgggcgccgtgctgggcag

SEQ ID NO: 1161365 - DNA, 21 bp, Homo sapiens
ttgggcgccgtgctgggcagc

SEQ ID NO: 1161366 - DNA, 18 bp, Homo sapiens
ttgggcggctgagagccc

SEQ ID NO: 1161367 - DNA, 16 bp, Homo sapiens
ttgggcgtctccccca

SEQ ID NO: 1161368 - DNA, 22 bp, Homo sapiens
ttgggcgtctcccccagagtgc

SEQ ID NO: 1161369 - DNA, 24 bp, Homo sapiens
ttgggctactggcagctcctctcc

SEQ ID NO: 1161370 - DNA, 20 bp, Homo sapiens
ttgggctcagggttggccat

SEQ ID NO: 1161371 - DNA, 21 bp, Homo sapiens
ttgggctcagggttggccatt

SEQ ID NO: 1161372 - DNA, 18 bp, Homo sapiens
ttgggctccacgggcagg

SEQ ID NO: 1161373 - DNA, 17 bp, Homo sapiens
ttgggctcctggctgcc

SEQ ID NO: 1161374 - DNA, 20 bp, Homo sapiens
ttgggctcctggctgccagg

SEQ ID NO: 1161375 - DNA, 17 bp, Homo sapiens
ttgggctgaatgtatgt

SEQ ID NO: 1161376 - DNA, 22 bp, Homo sapiens
ttgggctgacacctaccatgct

SEQ ID NO: 1161377 - DNA, 15 bp, Homo sapiens
ttgggctgacccagc

SEQ ID NO: 1161378 - DNA, 16 bp, Homo sapiens
ttgggctgagtgcagc

SEQ ID NO: 1161379 - DNA, 19 bp, Homo sapiens
ttgggctgagtgcagccaa

SEQ ID NO: 1161380 - DNA, 22 bp, Homo sapiens
ttgggctgagtgcagccaaagg

SEQ ID NO: 1161381 - DNA, 17 bp, Homo sapiens
ttggggacagggggtgg

SEQ ID NO: 1161382 - DNA, 17 bp, Homo sapiens
ttggggatgtttgcccc

SEQ ID NO: 1161383 - DNA, 17 bp, Homo sapiens
ttggggcactgggcgtc

SEQ ID NO: 1161384 - DNA, 21 bp, Homo sapiens
ttggggccaccaaagctgccc

SEQ ID NO: 1161385 - DNA, 23 bp, Homo sapiens
ttggggccaccaaagctgcccac

SEQ ID NO: 1161386 - DNA, 20 bp, Homo sapiens
ttggggccagcgcttctggt

SEQ ID NO: 1161387 - DNA, 21 bp, Homo sapiens
ttggggccatggtggagggca

SEQ ID NO: 1161388 - DNA, 15 bp, Homo sapiens
ttggggccctcttgc

SEQ ID NO: 1161389 - DNA, 19 bp, Homo sapiens
ttggggccctcttgccagc

SEQ ID NO: 1161390 - DNA, 24 bp, Homo sapiens
ttggggccctcttgccagcctcct

SEQ ID NO: 1161391 - DNA, 13 bp, Homo sapiens
ttggggccctgcc

SEQ ID NO: 1161392 - DNA, 11 bp, Homo sapiens
ttggggcctgg

SEQ ID NO: 1161393 - DNA, 16 bp, Homo sapiens
ttggggcctggcttgc

SEQ ID NO: 1161394 - DNA, 21 bp, Homo sapiens
ttggggcctggcttgctccag

SEQ ID NO: 1161395 - DNA, 20 bp, Homo sapiens
ttgggggaaaaaaaaaaaag

SEQ ID NO: 1161396 - DNA, 17 bp, Homo sapiens
ttgggggaaaaaaaaga

SEQ ID NO: 1161397 - DNA, 18 bp, Homo sapiens
ttgggggaaaaaaaagaa

SEQ ID NO: 1161398 - DNA, 19 bp, Homo sapiens
ttgggggaaaaaaaagaaa

SEQ ID NO: 1161399 - DNA, 13 bp, Homo sapiens
ttgggggaatgca

SEQ ID NO: 1161400 - DNA, 19 bp, Homo sapiens
ttgggggctcatttttgct

SEQ ID NO: 1161401 - DNA, 16 bp, Homo sapiens
ttgggggctgtgggga

SEQ ID NO: 1161402 - DNA, 21 bp, Homo sapiens
ttggggggccaaagaaggcag

SEQ ID NO: 1161403 - DNA, 13 bp, Homo sapiens
ttggggggccggg

SEQ ID NO: 1161404 - DNA, 19 bp, Homo sapiens
ttgggggggcgtgagaccc

SEQ ID NO: 1161405 - DNA, 23 bp, Homo sapiens
ttggggggggcccgcctggcaga

SEQ ID NO: 1161406 - DNA, 22 bp, Homo sapiens
ttgggggtcaggcagccagtga

SEQ ID NO: 1161407 - DNA, 19 bp, Homo sapiens
ttgggggtcagtgctgcct

SEQ ID NO: 1161408 - DNA, 17 bp, Homo sapiens
ttgggggttcaggcccg

SEQ ID NO: 1161409 - DNA, 20 bp, Homo sapiens
ttgggggttttcaatgtgaa

SEQ ID NO: 1161410 - DNA, 16 bp, Homo sapiens
ttggggtacaattgta

SEQ ID NO: 1161411 - DNA, 21 bp, Homo sapiens
ttggggtactcttgatgtgaa

SEQ ID NO: 1161412 - DNA, 19 bp, Homo sapiens
ttggggtataggtctcatc

SEQ ID NO: 1161413 - DNA, 23 bp, Homo sapiens
ttggggtcaagaaacagccagca

SEQ ID NO: 1161414 - DNA, 15 bp, Homo sapiens
ttggggtcagccagg

SEQ ID NO: 1161415 - DNA, 21 bp, Homo sapiens
ttggggtcatgaagggctgga

SEQ ID NO: 1161416 - DNA, 20 bp, Homo sapiens
ttggggtccctccaccccac

SEQ ID NO: 1161417 - DNA, 15 bp, Homo sapiens
ttggggtctgacccc

SEQ ID NO: 1161418 - DNA, 17 bp, Homo sapiens
ttggggtctggcagcct

SEQ ID NO: 1161419 - DNA, 14 bp, Homo sapiens
ttggggtgggggcc

SEQ ID NO: 1161420 - DNA, 18 bp, Homo sapiens
ttggggtgggggccaggc

SEQ ID NO: 1161421 - DNA, 20 bp, Homo sapiens
ttggggttttttttttctga

SEQ ID NO: 1161422 - DNA, 23 bp, Homo sapiens
ttggggttttttttttctgaata

SEQ ID NO: 1161423 - DNA, 18 bp, Homo sapiens
ttgggtagggcagacatg

SEQ ID NO: 1161424 - DNA, 21 bp, Homo sapiens
ttgggtcaaggacagggctga

SEQ ID NO: 1161425 - DNA, 15 bp, Homo sapiens
ttgggtcctgggcag

SEQ ID NO: 1161426 - DNA, 22 bp, Homo sapiens
ttgggtctcactctctggggaa

SEQ ID NO: 1161427 - DNA, 13 bp, Homo sapiens
ttgggtgaagagc

SEQ ID NO: 1161428 - DNA, 15 bp, Homo sapiens
ttgggtgaagagctt

SEQ ID NO: 1161429 - DNA, 21 bp, Homo sapiens
ttgggtgaatatggtggaaaa

SEQ ID NO: 1161430 - DNA, 22 bp, Homo sapiens
ttgggtgggattttttcccttt

SEQ ID NO: 1161431 - DNA, 18 bp, Homo sapiens
ttgggtgggggctgtggc

SEQ ID NO: 1161432 - DNA, 20 bp, Homo sapiens
ttgggtgtaacaggtctcct

SEQ ID NO: 1161433 - DNA, 19 bp, Homo sapiens
ttgggtgtagatttctgac

SEQ ID NO: 1161434 - DNA, 17 bp, Homo sapiens
ttgggtgtattctctgt

SEQ ID NO: 1161435 - DNA, 18 bp, Homo sapiens
ttgggttactatttcttg

SEQ ID NO: 1161436 - DNA, 20 bp, Homo sapiens
ttgggttccaaccaggcagt

SEQ ID NO: 1161437 - DNA, 17 bp, Homo sapiens
ttgggtttggccaggga

SEQ ID NO: 1161438 - DNA, 19 bp, Homo sapiens
ttgggtttggccagggagg

SEQ ID NO: 1161439 - DNA, 20 bp, Homo sapiens
ttgggtttggccagggaggc

SEQ ID NO: 1161440 - DNA, 12 bp, Homo sapiens
ttgggtttttat

SEQ ID NO: 1161441 - DNA, 17 bp, Homo sapiens
ttgggtttttgctgttt

SEQ ID NO: 1161442 - DNA, 17 bp, Homo sapiens
ttggtaaaaacagcagc

SEQ ID NO: 1161443 - DNA, 21 bp, Homo sapiens
ttggtaaaaacagcagctcat

SEQ ID NO: 1161444 - DNA, 18 bp, Homo sapiens
ttggtaaaaatgctgctc

SEQ ID NO: 1161445 - DNA, 11 bp, Homo sapiens
ttggtaaattt

SEQ ID NO: 1161446 - DNA, 19 bp, Homo sapiens
ttggtaacacaaattttca

SEQ ID NO: 1161447 - DNA, 15 bp, Homo sapiens
ttggtaacttttgtg

SEQ ID NO: 1161448 - DNA, 18 bp, Homo sapiens
ttggtaagatgactctga

SEQ ID NO: 1161449 - DNA, 22 bp, Homo sapiens
ttggtaatgatgttgataattt

SEQ ID NO: 1161450 - DNA, 15 bp, Homo sapiens
ttggtaattattttg

SEQ ID NO: 1161451 - DNA, 22 bp, Homo sapiens
ttggtaattttttttgtttttt

SEQ ID NO: 1161452 - DNA, 13 bp, Homo sapiens
ttggtacaaaaat

SEQ ID NO: 1161453 - DNA, 15 bp, Homo sapiens
ttggtacaaaaataa

SEQ ID NO: 1161454 - DNA, 18 bp, Homo sapiens
ttggtacccccaaacccc

SEQ ID NO: 1161455 - DNA, 14 bp, Homo sapiens
ttggtacctttcta

SEQ ID NO: 1161456 - DNA, 22 bp, Homo sapiens
ttggtagatcttcaatttggat

SEQ ID NO: 1161457 - DNA, 16 bp, Homo sapiens
ttggtagcagcctggg

SEQ ID NO: 1161458 - DNA, 21 bp, Homo sapiens
ttggtagttctgtgcctcccc

SEQ ID NO: 1161459 - DNA, 20 bp, Homo sapiens
ttggtataatgtttaaatca

SEQ ID NO: 1161460 - DNA, 14 bp, Homo sapiens
ttggtataggaatg

SEQ ID NO: 1161461 - DNA, 17 bp, Homo sapiens
ttggtatcaagaaagtc

SEQ ID NO: 1161462 - DNA, 15 bp, Homo sapiens
ttggtatgtgccagg

SEQ ID NO: 1161463 - DNA, 21 bp, Homo sapiens
ttggtattatataattcaagg

SEQ ID NO: 1161464 - DNA, 15 bp, Homo sapiens
ttggtatttatgtaa

SEQ ID NO: 1161465 - DNA, 22 bp, Homo sapiens
ttggtcaaactttttccagcaa

SEQ ID NO: 1161466 - DNA, 14 bp, Homo sapiens
ttggtcactccagt

SEQ ID NO: 1161467 - DNA, 15 bp, Homo sapiens
ttggtcactccagta

SEQ ID NO: 1161468 - DNA, 13 bp, Homo sapiens
ttggtcagaggag

SEQ ID NO: 1161469 - DNA, 14 bp, Homo sapiens
ttggtcaggctggt

SEQ ID NO: 1161470 - DNA, 19 bp, Homo sapiens
ttggtcatgtgggtcttcc

SEQ ID NO: 1161471 - DNA, 13 bp, Homo sapiens
ttggtccaaaaaa

SEQ ID NO: 1161472 - DNA, 14 bp, Homo sapiens
tatcatattattat

SEQ ID NO: 1161473 - DNA, 23 bp, Homo sapiens
tatcatctccatcatatgcctga

SEQ ID NO: 1161474 - DNA, 17 bp, Homo sapiens
tatcatgaaacacttct

SEQ ID NO: 1161475 - DNA, 20 bp, Homo sapiens
tatcatgaaacacttctcat

SEQ ID NO: 1161476 - DNA, 23 bp, Homo sapiens
tatcatgaaacacttctcatcat

SEQ ID NO: 1161477 - DNA, 16 bp, Homo sapiens
tatcatgaagccttgc

SEQ ID NO: 1161478 - DNA, 15 bp, Homo sapiens
tatcatgaattttaa

SEQ ID NO: 1161479 - DNA, 18 bp, Homo sapiens
tatcatgaattttaaagt

SEQ ID NO: 1161480 - DNA, 13 bp, Homo sapiens
tatcatgacatgt

SEQ ID NO: 1161481 - DNA, 16 bp, Homo sapiens
tatcatgagtgaataa

SEQ ID NO: 1161482 - DNA, 13 bp, Homo sapiens
tatcatgcaaaat

SEQ ID NO: 1161483 - DNA, 12 bp, Homo sapiens
tatcatgcattc

SEQ ID NO: 1161484 - DNA, 15 bp, Homo sapiens
tatcatggagtgacg

SEQ ID NO: 1161485 - DNA, 19 bp, Homo sapiens
tatcatggtatttgaccat

SEQ ID NO: 1161486 - DNA, 12 bp, Homo sapiens
tatcatgtacct

SEQ ID NO: 1161487 - DNA, 15 bp, Homo sapiens
tatcatgttaaatta

SEQ ID NO: 1161488 - DNA, 16 bp, Homo sapiens
tatcattaaaaattac

SEQ ID NO: 1161489 - DNA, 22 bp, Homo sapiens
tatcattaaaatatatgttctg

SEQ ID NO: 1161490 - DNA, 19 bp, Homo sapiens
tatcattccaattctaaat

SEQ ID NO: 1161491 - DNA, 14 bp, Homo sapiens
tatcattctacaga

SEQ ID NO: 1161492 - DNA, 14 bp, Homo sapiens
tatcatttactctt

SEQ ID NO: 1161493 - DNA, 16 bp, Homo sapiens
tatcatttcactgtct

SEQ ID NO: 1161494 - DNA, 15 bp, Homo sapiens
tatcatttcttaacc

SEQ ID NO: 1161495 - DNA, 15 bp, Homo sapiens
tatcatttgtgaaga

SEQ ID NO: 1161496 - DNA, 18 bp, Homo sapiens
tatcatttttgtataaaa

SEQ ID NO: 1161497 - DNA, 20 bp, Homo sapiens
tatcatttttgtataaaaag

SEQ ID NO: 1161498 - DNA, 21 bp, Homo sapiens
tatcatttttgtataaaaagg

SEQ ID NO: 1161499 - DNA, 19 bp, Homo sapiens
tatccaaaaatagccctgc

SEQ ID NO: 1161500 - DNA, 18 bp, Homo sapiens
tatccaaagactgtactg

SEQ ID NO: 1161501 - DNA, 20 bp, Homo sapiens
tatccaaatctgaagattgc

SEQ ID NO: 1161502 - DNA, 16 bp, Homo sapiens
tatccaaatcttgaat

SEQ ID NO: 1161503 - DNA, 12 bp, Homo sapiens
tatccaaggaaa

SEQ ID NO: 1161504 - DNA, 17 bp, Homo sapiens
tatccaaggaaacattt

SEQ ID NO: 1161505 - DNA, 19 bp, Homo sapiens
tatccaagtaccaatgctg

SEQ ID NO: 1161506 - DNA, 14 bp, Homo sapiens
tatccaagtgttat

SEQ ID NO: 1161507 - DNA, 17 bp, Homo sapiens
tatccaattttgatctt

SEQ ID NO: 1161508 - DNA, 19 bp, Homo sapiens
tatccaattttgatctttt

SEQ ID NO: 1161509 - DNA, 20 bp, Homo sapiens
tatccacaatagtcagaaaa

SEQ ID NO: 1161510 - DNA, 19 bp, Homo sapiens
tatccacagtactcacttt

SEQ ID NO: 1161511 - DNA, 13 bp, Homo sapiens
tatccaccacctc

SEQ ID NO: 1161512 - DNA, 13 bp, Homo sapiens
tatccacccagca

SEQ ID NO: 1161513 - DNA, 19 bp, Homo sapiens
tatccacccagcccattct

SEQ ID NO: 1161514 - DNA, 15 bp, Homo sapiens
tatccagagctgttt

SEQ ID NO: 1161515 - DNA, 18 bp, Homo sapiens
tatccaggtaatccaaga

SEQ ID NO: 1161516 - DNA, 21 bp, Homo sapiens
tatccaggtaatccaagatat

SEQ ID NO: 1161517 - DNA, 19 bp, Homo sapiens
tatccaggttccctcccag

SEQ ID NO: 1161518 - DNA, 22 bp, Homo sapiens
tatccagttcctgctctctgct

SEQ ID NO: 1161519 - DNA, 14 bp, Homo sapiens
tatccatattttat

SEQ ID NO: 1161520 - DNA, 13 bp, Homo sapiens
tatccatgtaata

SEQ ID NO: 1161521 - DNA, 13 bp, Homo sapiens
tatccatgtactg

SEQ ID NO: 1161522 - DNA, 14 bp, Homo sapiens
tatccatgtactgt

SEQ ID NO: 1161523 - DNA, 16 bp, Homo sapiens
tatccatgtactgtag

SEQ ID NO: 1161524 - DNA, 18 bp, Homo sapiens
tatccatgtactgtagtt

SEQ ID NO: 1161525 - DNA, 20 bp, Homo sapiens
tatccatgtacttgtttgca

SEQ ID NO: 1161526 - DNA, 16 bp, Homo sapiens
tatccattacgtgcat

SEQ ID NO: 1161527 - DNA, 17 bp, Homo sapiens
tatccattacgtgcatt

SEQ ID NO: 1161528 - DNA, 18 bp, Homo sapiens
tatccattacgtgcattt

SEQ ID NO: 1161529 - DNA, 19 bp, Homo sapiens
tatccattacgtgcattta

SEQ ID NO: 1161530 - DNA, 15 bp, Homo sapiens
tatccatttctcatg

SEQ ID NO: 1161531 - DNA, 14 bp, Homo sapiens
tatccatttctttt

SEQ ID NO: 1161532 - DNA, 15 bp, Homo sapiens
tatccatttctttta

SEQ ID NO: 1161533 - DNA, 19 bp, Homo sapiens
tatcccaaacttcggaaac

SEQ ID NO: 1161534 - DNA, 22 bp, Homo sapiens
tatcccaatcaaagaattacag

SEQ ID NO: 1161535 - DNA, 23 bp, Homo sapiens
tatcccacccaacagctcagaga

SEQ ID NO: 1161536 - DNA, 14 bp, Homo sapiens
tatcccagaaatta

SEQ ID NO: 1161537 - DNA, 14 bp, Homo sapiens
tatcccagagaaca

SEQ ID NO: 1161538 - DNA, 13 bp, Homo sapiens
tatccccaagctg

SEQ ID NO: 1161539 - DNA, 13 bp, Homo sapiens
tatccccatctcc

SEQ ID NO: 1161540 - DNA, 22 bp, Homo sapiens
tatccccatctccctgcctggc

SEQ ID NO: 1161541 - DNA, 14 bp, Homo sapiens
tatcccccccagcc

SEQ ID NO: 1161542 - DNA, 21 bp, Homo sapiens
tatccccctacaaccccagcc

SEQ ID NO: 1161543 - DNA, 15 bp, Homo sapiens
tatcccccttaaaga

SEQ ID NO: 1161544 - DNA, 17 bp, Homo sapiens
tatcccgagtctgggac

SEQ ID NO: 1161545 - DNA, 19 bp, Homo sapiens
tatcccgagtctgggacac

SEQ ID NO: 1161546 - DNA, 15 bp, Homo sapiens
tatccctcttgtaag

SEQ ID NO: 1161547 - DNA, 19 bp, Homo sapiens
tatccctgcggcctccaca

SEQ ID NO: 1161548 - DNA, 12 bp, Homo sapiens
tatccctttcct

SEQ ID NO: 1161549 - DNA, 14 bp, Homo sapiens
tatccgctgccagc

SEQ ID NO: 1161550 - DNA, 13 bp, Homo sapiens
tatcctaaacttt

SEQ ID NO: 1161551 - DNA, 23 bp, Homo sapiens
tatcctaaactttagacttccca

SEQ ID NO: 1161552 - DNA, 15 bp, Homo sapiens
tatcctacaacaaga

SEQ ID NO: 1161553 - DNA, 17 bp, Homo sapiens
tatcctacttccccttc

SEQ ID NO: 1161554 - DNA, 13 bp, Homo sapiens
tatcctcactgcc

SEQ ID NO: 1161555 - DNA, 15 bp, Homo sapiens
tatcctccaccgtct

SEQ ID NO: 1161556 - DNA, 12 bp, Homo sapiens
tatcctccctgc

SEQ ID NO: 1161557 - DNA, 15 bp, Homo sapiens
tatcctccctgccca

SEQ ID NO: 1161558 - DNA, 19 bp, Homo sapiens
tatcctctccccctcctcc

SEQ ID NO: 1161559 - DNA, 20 bp, Homo sapiens
tatcctctccccctcctcca

SEQ ID NO: 1161560 - DNA, 12 bp, Homo sapiens
tatcctctctct

SEQ ID NO: 1161561 - DNA, 18 bp, Homo sapiens
tatcctgccaaaatcatt

SEQ ID NO: 1161562 - DNA, 15 bp, Homo sapiens
tatcctgcccagtgt

SEQ ID NO: 1161563 - DNA, 15 bp, Homo sapiens
tatcctgcctcagcc

SEQ ID NO: 1161564 - DNA, 16 bp, Homo sapiens
tatcctgcctcagccc

SEQ ID NO: 1161565 - DNA, 18 bp, Homo sapiens
tatcctgctagcaggccc

SEQ ID NO: 1161566 - DNA, 21 bp, Homo sapiens
tatcctggaacaatattttat

SEQ ID NO: 1161567 - DNA, 18 bp, Homo sapiens
tatcctggccttgtactt

SEQ ID NO: 1161568 - DNA, 10 bp, Homo sapiens
tatcctgggg

SEQ ID NO: 1161569 - DNA, 22 bp, Homo sapiens
tatcctgggggacccaatgtag

SEQ ID NO: 1161570 - DNA, 14 bp, Homo sapiens
tatcctggtctttt

SEQ ID NO: 1161571 - DNA, 14 bp, Homo sapiens
tatcctgtattctt

SEQ ID NO: 1161572 - DNA, 13 bp, Homo sapiens
tatcctgtgactg

SEQ ID NO: 1161573 - DNA, 23 bp, Homo sapiens
tatcctgtgactgtctcacttaa

SEQ ID NO: 1161574 - DNA, 23 bp, Homo sapiens
tatccttaggaaaatgcttctgt

SEQ ID NO: 1161575 - DNA, 14 bp, Homo sapiens
tatccttccttcag

SEQ ID NO: 1161576 - DNA, 14 bp, Homo sapiens
tatccttctacttg

SEQ ID NO: 1161577 - DNA, 18 bp, Homo sapiens
tatccttggagagcagct

SEQ ID NO: 1161578 - DNA, 19 bp, Homo sapiens
tatccttggagagcagctg

SEQ ID NO: 1161579 - DNA, 20 bp, Homo sapiens
tatccttggagagcagctgg

SEQ ID NO: 1161580 - DNA, 19 bp, Homo sapiens
tatccttgggccataatta

SEQ ID NO: 1161581 - DNA, 16 bp, Homo sapiens
tatcctttcattaggc

SEQ ID NO: 1161582 - DNA, 24 bp, Homo sapiens
tatcctttcattaggcaaagtaca

SEQ ID NO: 1161583 - DNA, 22 bp, Homo sapiens
tatcgaatatagttctgtgtag

SEQ ID NO: 1161584 - DNA, 22 bp, Homo sapiens
tatcgagtttgcaatgtcacaa

SEQ ID NO: 1161585 - DNA, 14 bp, Homo sapiens
tatcgatataaatt

SEQ ID NO: 1161586 - DNA, 16 bp, Homo sapiens
tatcgatctcttattt

SEQ ID NO: 1161587 - DNA, 14 bp, Homo sapiens
tatcgccctccttt

SEQ ID NO: 1161588 - DNA, 16 bp, Homo sapiens
tatcgccctcctttcc

SEQ ID NO: 1161589 - DNA, 20 bp, Homo sapiens
tatcgccctcctttccctta

SEQ ID NO: 1161590 - DNA, 20 bp, Homo sapiens
tatcgctgacttcatggaat

SEQ ID NO: 1161591 - DNA, 14 bp, Homo sapiens
tatcgggagcagtg

SEQ ID NO: 1161592 - DNA, 16 bp, Homo sapiens
tatcgtcactgcttaa

SEQ ID NO: 1161593 - DNA, 19 bp, Homo sapiens
tatcgtcactgcttaactt

SEQ ID NO: 1161594 - DNA, 18 bp, Homo sapiens
tatcgttatcactgtgca

SEQ ID NO: 1161595 - DNA, 18 bp, Homo sapiens
tatcgttttcttaaagtg

SEQ ID NO: 1161596 - DNA, 19 bp, Homo sapiens
tatctaaagttatatttca

SEQ ID NO: 1161597 - DNA, 15 bp, Homo sapiens
tatctaaagtttgtt

SEQ ID NO: 1161598 - DNA, 14 bp, Homo sapiens
ttggtccaaaaaaa

SEQ ID NO: 1161599 - DNA, 22 bp, Homo sapiens
ttggtccaaaaaaaggaaaaat

SEQ ID NO: 1161600 - DNA, 16 bp, Homo sapiens
ttggtcccctccctcg

SEQ ID NO: 1161601 - DNA, 15 bp, Homo sapiens
ttggtccctggtccc

SEQ ID NO: 1161602 - DNA, 14 bp, Homo sapiens
ttggtcctttctcc

SEQ ID NO: 1161603 - DNA, 21 bp, Homo sapiens
ttggtctcccatatgcagaaa

SEQ ID NO: 1161604 - DNA, 16 bp, Homo sapiens
ttggtctctatctcct

SEQ ID NO: 1161605 - DNA, 17 bp, Homo sapiens
ttggtctggactgacag

SEQ ID NO: 1161606 - DNA, 17 bp, Homo sapiens
ttggtgaaataataaaa

SEQ ID NO: 1161607 - DNA, 21 bp, Homo sapiens
ttggtgaaataataaaatgca

SEQ ID NO: 1161608 - DNA, 15 bp, Homo sapiens
ttggtgaacagtttt

SEQ ID NO: 1161609 - DNA, 15 bp, Homo sapiens
ttggtgaattttcaa

SEQ ID NO: 1161610 - DNA, 11 bp, Homo sapiens
ttggtgactca

SEQ ID NO: 1161611 - DNA, 15 bp, Homo sapiens
ttggtgactgtccca

SEQ ID NO: 1161612 - DNA, 22 bp, Homo sapiens
ttggtgcacagattgctgaaac

SEQ ID NO: 1161613 - DNA, 15 bp, Homo sapiens
ttggtgcacagtgat

SEQ ID NO: 1161614 - DNA, 20 bp, Homo sapiens
ttggtgccgatgttgaactt

SEQ ID NO: 1161615 - DNA, 18 bp, Homo sapiens
ttggtgccttttgtgtga

SEQ ID NO: 1161616 - DNA, 22 bp, Homo sapiens
ttggtgcttacacatctcagac

SEQ ID NO: 1161617 - DNA, 19 bp, Homo sapiens
ttggtggagcagccagagc

SEQ ID NO: 1161618 - DNA, 21 bp, Homo sapiens
ttggtggcagattttacaaaa

SEQ ID NO: 1161619 - DNA, 18 bp, Homo sapiens
ttggtggctcacgcctgt

SEQ ID NO: 1161620 - DNA, 17 bp, Homo sapiens
ttggtggcttttccttg

SEQ ID NO: 1161621 - DNA, 13 bp, Homo sapiens
ttggtgggctggc

SEQ ID NO: 1161622 - DNA, 17 bp, Homo sapiens
ttggtgggctggcccag

SEQ ID NO: 1161623 - DNA, 15 bp, Homo sapiens
ttggtggggtggcac

SEQ ID NO: 1161624 - DNA, 21 bp, Homo sapiens
ttggtggggtggcacctgttt

SEQ ID NO: 1161625 - DNA, 22 bp, Homo sapiens
ttggtggggtggcacctgtttc

SEQ ID NO: 1161626 - DNA, 18 bp, Homo sapiens
ttggtggtttcagaaatg

SEQ ID NO: 1161627 - DNA, 15 bp, Homo sapiens
ttggtgtatattata

SEQ ID NO: 1161628 - DNA, 12 bp, Homo sapiens
ttggtgtgaaga

SEQ ID NO: 1161629 - DNA, 17 bp, Homo sapiens
ttggtgttcctggaagc

SEQ ID NO: 1161630 - DNA, 22 bp, Homo sapiens
ttggtgttcgtttccatcatgt

SEQ ID NO: 1161631 - DNA, 15 bp, Homo sapiens
ttggttaaaactgta

SEQ ID NO: 1161632 - DNA, 21 bp, Homo sapiens
ttggttcaataaagcactgag

SEQ ID NO: 1161633 - DNA, 20 bp, Homo sapiens
ttggttcagacacctgttca

SEQ ID NO: 1161634 - DNA, 14 bp, Homo sapiens
ttggttcccttgtg

SEQ ID NO: 1161635 - DNA, 23 bp, Homo sapiens
ttggttcttcctttccctggagc

SEQ ID NO: 1161636 - DNA, 22 bp, Homo sapiens
ttggttcttggtagagattcat

SEQ ID NO: 1161637 - DNA, 13 bp, Homo sapiens
ttggttggaagct

SEQ ID NO: 1161638 - DNA, 17 bp, Homo sapiens
ttggttggctggttgtt

SEQ ID NO: 1161639 - DNA, 13 bp, Homo sapiens
ttggttggtgtga

SEQ ID NO: 1161640 - DNA, 17 bp, Homo sapiens
ttggttggtgtgaagaa

SEQ ID NO: 1161641 - DNA, 12 bp, Homo sapiens
ttggttgtcaat

SEQ ID NO: 1161642 - DNA, 17 bp, Homo sapiens
ttggtttaaagaaagtg

SEQ ID NO: 1161643 - DNA, 15 bp, Homo sapiens
ttggtttattttcac

SEQ ID NO: 1161644 - DNA, 16 bp, Homo sapiens
ttggtttcctatttcc

SEQ ID NO: 1161645 - DNA, 13 bp, Homo sapiens
ttggtttctggat

SEQ ID NO: 1161646 - DNA, 12 bp, Homo sapiens
ttggtttgtatg

SEQ ID NO: 1161647 - DNA, 14 bp, Homo sapiens
ttggtttgtatgag

SEQ ID NO: 1161648 - DNA, 17 bp, Homo sapiens
ttggtttgtatgagatg

SEQ ID NO: 1161649 - DNA, 21 bp, Homo sapiens
ttggtttgtggcgtctccctc

SEQ ID NO: 1161650 - DNA, 13 bp, Homo sapiens
ttggttttaaaag

SEQ ID NO: 1161651 - DNA, 14 bp, Homo sapiens
ttggttttaaaagc

SEQ ID NO: 1161652 - DNA, 23 bp, Homo sapiens
ttggttttaaacctttaatgaga

SEQ ID NO: 1161653 - DNA, 22 bp, Homo sapiens
ttggtttttactgctctgagaa

SEQ ID NO: 1161654 - DNA, 16 bp, Homo sapiens
ttggtttttttgtaca

SEQ ID NO: 1161655 - DNA, 23 bp, Homo sapiens
ttggtttttttgtacaatatgaa

SEQ ID NO: 1161656 - DNA, 19 bp, Homo sapiens
ttgtaaaaacagcattgct

SEQ ID NO: 1161657 - DNA, 12 bp, Homo sapiens
ttgtaaaaatga

SEQ ID NO: 1161658 - DNA, 21 bp, Homo sapiens
ttgtaaaaatgaaagtgactt

SEQ ID NO: 1161659 - DNA, 16 bp, Homo sapiens
ttgtaaaaatgagtca

SEQ ID NO: 1161660 - DNA, 23 bp, Homo sapiens
ttgtaaaaatgagtcatttgttt

SEQ ID NO: 1161661 - DNA, 13 bp, Homo sapiens
ttgtaaaacaggt

SEQ ID NO: 1161662 - DNA, 15 bp, Homo sapiens
ttgtaaaacaggtag

SEQ ID NO: 1161663 - DNA, 21 bp, Homo sapiens
ttgtaaaagaacagtaaacat

SEQ ID NO: 1161664 - DNA, 20 bp, Homo sapiens
ttgtaaaagcattttgtaat

SEQ ID NO: 1161665 - DNA, 13 bp, Homo sapiens
ttgtaaaatatag

SEQ ID NO: 1161666 - DNA, 14 bp, Homo sapiens
ttgtaaaatatagc

SEQ ID NO: 1161667 - DNA, 18 bp, Homo sapiens
ttgtaaaatatagctgta

SEQ ID NO: 1161668 - DNA, 22 bp, Homo sapiens
ttgtaaaatgcttttcactttc

SEQ ID NO: 1161669 - DNA, 18 bp, Homo sapiens
ttgtaaaatgtattatgt

SEQ ID NO: 1161670 - DNA, 18 bp, Homo sapiens
ttgtaaaattgttcctga

SEQ ID NO: 1161671 - DNA, 15 bp, Homo sapiens
ttgtaaacaaactct

SEQ ID NO: 1161672 - DNA, 14 bp, Homo sapiens
ttgtaaacatgtgt

SEQ ID NO: 1161673 - DNA, 12 bp, Homo sapiens
ttgtaaacattt

SEQ ID NO: 1161674 - DNA, 12 bp, Homo sapiens
ttgtaaaccatt

SEQ ID NO: 1161675 - DNA, 13 bp, Homo sapiens
ttgtaaaccattg

SEQ ID NO: 1161676 - DNA, 16 bp, Homo sapiens
ttgtaaaccattgtaa

SEQ ID NO: 1161677 - DNA, 13 bp, Homo sapiens
ttgtaaacttctg

SEQ ID NO: 1161678 - DNA, 20 bp, Homo sapiens
ttgtaaactttttcaatggt

SEQ ID NO: 1161679 - DNA, 21 bp, Homo sapiens
ttgtaaagacagagtgaattt

SEQ ID NO: 1161680 - DNA, 13 bp, Homo sapiens
ttgtaaagtatgt

SEQ ID NO: 1161681 - DNA, 16 bp, Homo sapiens
ttgtaaataagagatt

SEQ ID NO: 1161682 - DNA, 16 bp, Homo sapiens
ttgtaaataattttct

SEQ ID NO: 1161683 - DNA, 12 bp, Homo sapiens
ttgtaaatacac

SEQ ID NO: 1161684 - DNA, 17 bp, Homo sapiens
ttgtaaatactgcttga

SEQ ID NO: 1161685 - DNA, 12 bp, Homo sapiens
ttgtaaatatat

SEQ ID NO: 1161686 - DNA, 21 bp, Homo sapiens
ttgtaaatatataaatatata

SEQ ID NO: 1161687 - DNA, 11 bp, Homo sapiens
ttgtaaatatt

SEQ ID NO: 1161688 - DNA, 12 bp, Homo sapiens
ttgtaaatcttt

SEQ ID NO: 1161689 - DNA, 14 bp, Homo sapiens
ttgtaaatgctcgt

SEQ ID NO: 1161690 - DNA, 18 bp, Homo sapiens
ttgtaaatgctcgtgtga

SEQ ID NO: 1161691 - DNA, 15 bp, Homo sapiens
ttgtaaattaacttt

SEQ ID NO: 1161692 - DNA, 23 bp, Homo sapiens
ttgtaaattaacttttataaact

SEQ ID NO: 1161693 - DNA, 20 bp, Homo sapiens
ttgtaaattatatttgtgct

SEQ ID NO: 1161694 - DNA, 21 bp, Homo sapiens
ttgtaaattattgatgatttt

SEQ ID NO: 1161695 - DNA, 16 bp, Homo sapiens
ttgtaaattatttgct

SEQ ID NO: 1161696 - DNA, 12 bp, Homo sapiens
ttgtaaattggc

SEQ ID NO: 1161697 - DNA, 14 bp, Homo sapiens
ttgtaaattggcat

SEQ ID NO: 1161698 - DNA, 17 bp, Homo sapiens
ttgtaacaagaaaacat

SEQ ID NO: 1161699 - DNA, 19 bp, Homo sapiens
ttgtaacattgtaaagtat

SEQ ID NO: 1161700 - DNA, 14 bp, Homo sapiens
ttgtaacctcagct

SEQ ID NO: 1161701 - DNA, 15 bp, Homo sapiens
ttgtaacctcagctc

SEQ ID NO: 1161702 - DNA, 12 bp, Homo sapiens
ttgtaactacaa

SEQ ID NO: 1161703 - DNA, 22 bp, Homo sapiens
ttgtaactacaaagctttgcta

SEQ ID NO: 1161704 - DNA, 14 bp, Homo sapiens
ttgtaactccacca

SEQ ID NO: 1161705 - DNA, 14 bp, Homo sapiens
ttgtaacttagctt

SEQ ID NO: 1161706 - DNA, 14 bp, Homo sapiens
ttgtaagaaatact

SEQ ID NO: 1161707 - DNA, 19 bp, Homo sapiens
ttgtaagaaggcaatatta

SEQ ID NO: 1161708 - DNA, 20 bp, Homo sapiens
ttgtaagaaggcaatattaa

SEQ ID NO: 1161709 - DNA, 20 bp, Homo sapiens
ttgtaagagtggaaccaaca

SEQ ID NO: 1161710 - DNA, 21 bp, Homo sapiens
ttgtaaggtctttgtaaaatc

SEQ ID NO: 1161711 - DNA, 21 bp, Homo sapiens
ttgtaagtaacaatatgtaat

SEQ ID NO: 1161712 - DNA, 21 bp, Homo sapiens
ttgtaagtaataatttgtaaa

SEQ ID NO: 1161713 - DNA, 16 bp, Homo sapiens
ttgtaagtttgaattt

SEQ ID NO: 1161714 - DNA, 20 bp, Homo sapiens
ttgtaataagcaatcaaggt

SEQ ID NO: 1161715 - DNA, 15 bp, Homo sapiens
ttgtaataataaaga

SEQ ID NO: 1161716 - DNA, 21 bp, Homo sapiens
ttgtaatagatgtttgataga

SEQ ID NO: 1161717 - DNA, 11 bp, Homo sapiens
ttgtaatagtc

SEQ ID NO: 1161718 - DNA, 13 bp, Homo sapiens
ttgtaatatctaa

SEQ ID NO: 1161719 - DNA, 17 bp, Homo sapiens
ttgtaatattctgtttt

SEQ ID NO: 1161720 - DNA, 18 bp, Homo sapiens
ttgtaatgaattcctaga

SEQ ID NO: 1161721 - DNA, 16 bp, Homo sapiens
ttgtaatgctgcactt

SEQ ID NO: 1161722 - DNA, 22 bp, Homo sapiens
ttgtaatggattcttttcatca

SEQ ID NO: 1161723 - DNA, 21 bp, Homo sapiens
ttgtaatggatttttgacttt

SEQ ID NO: 1161724 - DNA, 15 bp, Homo sapiens
tatctaaatgttgaa

SEQ ID NO: 1161725 - DNA, 19 bp, Homo sapiens
tatctaagaataataaaat

SEQ ID NO: 1161726 - DNA, 19 bp, Homo sapiens
tatctaagttaatttaaag

SEQ ID NO: 1161727 - DNA, 22 bp, Homo sapiens
tatctaagttaatttaaagttg

SEQ ID NO: 1161728 - DNA, 21 bp, Homo sapiens
tatctaatatatatgaataaa

SEQ ID NO: 1161729 - DNA, 14 bp, Homo sapiens
tatctaatatgaag

SEQ ID NO: 1161730 - DNA, 18 bp, Homo sapiens
tatctaattatttccact

SEQ ID NO: 1161731 - DNA, 15 bp, Homo sapiens
tatctacaatacata

SEQ ID NO: 1161732 - DNA, 17 bp, Homo sapiens
tatctacagtaatgaaa

SEQ ID NO: 1161733 - DNA, 22 bp, Homo sapiens
tatctaccccagactagatgta

SEQ ID NO: 1161734 - DNA, 21 bp, Homo sapiens
tatctacctggaaacagcttt

SEQ ID NO: 1161735 - DNA, 14 bp, Homo sapiens
tatctacctgttct

SEQ ID NO: 1161736 - DNA, 15 bp, Homo sapiens
tatctactaccagaa

SEQ ID NO: 1161737 - DNA, 20 bp, Homo sapiens
tatctactaccagaagggct

SEQ ID NO: 1161738 - DNA, 22 bp, Homo sapiens
tatctacttccaaactaatttt

SEQ ID NO: 1161739 - DNA, 21 bp, Homo sapiens
tatctagaaagaaaagaccct

SEQ ID NO: 1161740 - DNA, 20 bp, Homo sapiens
tatctagaactatcattttt

SEQ ID NO: 1161741 - DNA, 19 bp, Homo sapiens
tatctagatactgtatcat

SEQ ID NO: 1161742 - DNA, 21 bp, Homo sapiens
tatctagcatttatttctctg

SEQ ID NO: 1161743 - DNA, 20 bp, Homo sapiens
tatctagtgcagctgatttt

SEQ ID NO: 1161744 - DNA, 23 bp, Homo sapiens
tatctagtgcagctgattttaac

SEQ ID NO: 1161745 - DNA, 19 bp, Homo sapiens
tatctataatttacctaag

SEQ ID NO: 1161746 - DNA, 13 bp, Homo sapiens
tatctatatatgt

SEQ ID NO: 1161747 - DNA, 15 bp, Homo sapiens
tatctatatatgtat

SEQ ID NO: 1161748 - DNA, 15 bp, Homo sapiens
tatctatatatgtgt

SEQ ID NO: 1161749 - DNA, 22 bp, Homo sapiens
tatctatatatgtgtatgtacg

SEQ ID NO: 1161750 - DNA, 14 bp, Homo sapiens
tatctatatttttg

SEQ ID NO: 1161751 - DNA, 16 bp, Homo sapiens
tatctatctatttgag

SEQ ID NO: 1161752 - DNA, 23 bp, Homo sapiens
tatctatcttccaaatgcaattt

SEQ ID NO: 1161753 - DNA, 23 bp, Homo sapiens
tatctatgcaaagcactctctgc

SEQ ID NO: 1161754 - DNA, 14 bp, Homo sapiens
tatctatggaaatg

SEQ ID NO: 1161755 - DNA, 14 bp, Homo sapiens
tatctattaaagtg

SEQ ID NO: 1161756 - DNA, 16 bp, Homo sapiens
tatctattaaagtgac

SEQ ID NO: 1161757 - DNA, 12 bp, Homo sapiens
tatctattaata

SEQ ID NO: 1161758 - DNA, 13 bp, Homo sapiens
tatctattaatat

SEQ ID NO: 1161759 - DNA, 12 bp, Homo sapiens
tatctcagaaag

SEQ ID NO: 1161760 - DNA, 12 bp, Homo sapiens
tatctcagccat

SEQ ID NO: 1161761 - DNA, 14 bp, Homo sapiens
tatctcagccatcc

SEQ ID NO: 1161762 - DNA, 19 bp, Homo sapiens
tatctcaggaagtccagcc

SEQ ID NO: 1161763 - DNA, 16 bp, Homo sapiens
tatctcatactgtctg

SEQ ID NO: 1161764 - DNA, 22 bp, Homo sapiens
tatctcatagggatgctgtgag

SEQ ID NO: 1161765 - DNA, 16 bp, Homo sapiens
tatctcatcctttcct

SEQ ID NO: 1161766 - DNA, 15 bp, Homo sapiens
tatctccaagaccag

SEQ ID NO: 1161767 - DNA, 15 bp, Homo sapiens
tatctccatggccct

SEQ ID NO: 1161768 - DNA, 19 bp, Homo sapiens
tatctccatggccctgtcc

SEQ ID NO: 1161769 - DNA, 20 bp, Homo sapiens
tatctcctaactttggacct

SEQ ID NO: 1161770 - DNA, 11 bp, Homo sapiens
tatctcctgac

SEQ ID NO: 1161771 - DNA, 13 bp, Homo sapiens
tatctcctgacag

SEQ ID NO: 1161772 - DNA, 20 bp, Homo sapiens
tatctctactgaatgtcatt

SEQ ID NO: 1161773 - DNA, 18 bp, Homo sapiens
tatctctatttaatattt

SEQ ID NO: 1161774 - DNA, 20 bp, Homo sapiens
tatctctatttaatatttat

SEQ ID NO: 1161775 - DNA, 16 bp, Homo sapiens
tatctctgaagcatgt

SEQ ID NO: 1161776 - DNA, 17 bp, Homo sapiens
tatctctgaagcatgtt

SEQ ID NO: 1161777 - DNA, 18 bp, Homo sapiens
tatctctgaagcatgttt

SEQ ID NO: 1161778 - DNA, 18 bp, Homo sapiens
tatctctgagttctgtgt

SEQ ID NO: 1161779 - DNA, 19 bp, Homo sapiens
tatctctggcaccacacta

SEQ ID NO: 1161780 - DNA, 17 bp, Homo sapiens
tatctctgtgtgcacaa

SEQ ID NO: 1161781 - DNA, 18 bp, Homo sapiens
tatctctgtgtgcacaaa

SEQ ID NO: 1161782 - DNA, 23 bp, Homo sapiens
tatctctgtgtgcacaaatattt

SEQ ID NO: 1161783 - DNA, 18 bp, Homo sapiens
tatctctttgatctactt

SEQ ID NO: 1161784 - DNA, 23 bp, Homo sapiens
tatctcttttgaatccatgcttg

SEQ ID NO: 1161785 - DNA, 15 bp, Homo sapiens
tatctgaaggacccc

SEQ ID NO: 1161786 - DNA, 19 bp, Homo sapiens
tatctgaaggaccccaggt

SEQ ID NO: 1161787 - DNA, 20 bp, Homo sapiens
tatctgaaggaccccaggta

SEQ ID NO: 1161788 - DNA, 22 bp, Homo sapiens
tatctgaaggaccccaggtaag

SEQ ID NO: 1161789 - DNA, 20 bp, Homo sapiens
tatctgaatagtgtcaccaa

SEQ ID NO: 1161790 - DNA, 19 bp, Homo sapiens
tatctgaatttttaaacaa

SEQ ID NO: 1161791 - DNA, 23 bp, Homo sapiens
tatctgagcaataacttctatgt

SEQ ID NO: 1161792 - DNA, 15 bp, Homo sapiens
tatctgataaaattg

SEQ ID NO: 1161793 - DNA, 14 bp, Homo sapiens
tatctgatctgtga

SEQ ID NO: 1161794 - DNA, 17 bp, Homo sapiens
tatctgattcctttaaa

SEQ ID NO: 1161795 - DNA, 14 bp, Homo sapiens
tatctgcagaacat

SEQ ID NO: 1161796 - DNA, 16 bp, Homo sapiens
tatctgcagaatgggc

SEQ ID NO: 1161797 - DNA, 10 bp, Homo sapiens
tatctgcagc

SEQ ID NO: 1161798 - DNA, 11 bp, Homo sapiens
tatctgcctgg

SEQ ID NO: 1161799 - DNA, 12 bp, Homo sapiens
tatctgcctggc

SEQ ID NO: 1161800 - DNA, 18 bp, Homo sapiens
tatctgcctggcctggct

SEQ ID NO: 1161801 - DNA, 20 bp, Homo sapiens
tatctgcttcagtggagaat

SEQ ID NO: 1161802 - DNA, 19 bp, Homo sapiens
tatctggattcaaatttat

SEQ ID NO: 1161803 - DNA, 23 bp, Homo sapiens
tatctgggaagctatttttttca

SEQ ID NO: 1161804 - DNA, 16 bp, Homo sapiens
tatctgggattattct

SEQ ID NO: 1161805 - DNA, 17 bp, Homo sapiens
tatctgggattattctt

SEQ ID NO: 1161806 - DNA, 18 bp, Homo sapiens
tatctgggattattcttt

SEQ ID NO: 1161807 - DNA, 22 bp, Homo sapiens
tatctgggattattctttgaaa

SEQ ID NO: 1161808 - DNA, 18 bp, Homo sapiens
tatctgggctgtgggcaa

SEQ ID NO: 1161809 - DNA, 19 bp, Homo sapiens
tatctgggtgcatgatctt

SEQ ID NO: 1161810 - DNA, 16 bp, Homo sapiens
tatctgggttaagtgt

SEQ ID NO: 1161811 - DNA, 17 bp, Homo sapiens
tatctggtatatgtcat

SEQ ID NO: 1161812 - DNA, 15 bp, Homo sapiens
tatctggtgcctcct

SEQ ID NO: 1161813 - DNA, 23 bp, Homo sapiens
tatctgtaacccttgaatttcta

SEQ ID NO: 1161814 - DNA, 21 bp, Homo sapiens
tatctgtagacggctcagtat

SEQ ID NO: 1161815 - DNA, 16 bp, Homo sapiens
tatctgtatctctctc

SEQ ID NO: 1161816 - DNA, 15 bp, Homo sapiens
tatctgtcagctgca

SEQ ID NO: 1161817 - DNA, 16 bp, Homo sapiens
tatctgtcatatagta

SEQ ID NO: 1161818 - DNA, 18 bp, Homo sapiens
tatctgtgcgtgaaacac

SEQ ID NO: 1161819 - DNA, 20 bp, Homo sapiens
tatctgtgcgtgaaacacac

SEQ ID NO: 1161820 - DNA, 17 bp, Homo sapiens
tatctgtgtttttgaaa

SEQ ID NO: 1161821 - DNA, 20 bp, Homo sapiens
tatctgtgtttttgaaatat

SEQ ID NO: 1161822 - DNA, 15 bp, Homo sapiens
tatctgtttgtatat

SEQ ID NO: 1161823 - DNA, 18 bp, Homo sapiens
tatctgtttgtatatttg

SEQ ID NO: 1161824 - DNA, 15 bp, Homo sapiens
tatcttaaagaaaca

SEQ ID NO: 1161825 - DNA, 13 bp, Homo sapiens
tatcttaagcagg

SEQ ID NO: 1161826 - DNA, 16 bp, Homo sapiens
tatcttacgaaaaaat

SEQ ID NO: 1161827 - DNA, 18 bp, Homo sapiens
tatcttagagtttacagt

SEQ ID NO: 1161828 - DNA, 14 bp, Homo sapiens
tatcttataactgt

SEQ ID NO: 1161829 - DNA, 14 bp, Homo sapiens
tatcttcatgtaaa

SEQ ID NO: 1161830 - DNA, 20 bp, Homo sapiens
tatcttcccatttaacattg

SEQ ID NO: 1161831 - DNA, 16 bp, Homo sapiens
tatcttcctttcttgt

SEQ ID NO: 1161832 - DNA, 18 bp, Homo sapiens
tatcttcctttcttgtct

SEQ ID NO: 1161833 - DNA, 20 bp, Homo sapiens
tatcttcgttagtaatctgt

SEQ ID NO: 1161834 - DNA, 15 bp, Homo sapiens
tatcttgatacattc

SEQ ID NO: 1161835 - DNA, 23 bp, Homo sapiens
tatcttgatgtttagaaaagtat

SEQ ID NO: 1161836 - DNA, 19 bp, Homo sapiens
tatcttggggcaagactgc

SEQ ID NO: 1161837 - DNA, 22 bp, Homo sapiens
tatcttggggcaagactgcaaa

SEQ ID NO: 1161838 - DNA, 19 bp, Homo sapiens
tatcttgggtgtattctct

SEQ ID NO: 1161839 - DNA, 21 bp, Homo sapiens
tatcttgggtgtattctctgt

SEQ ID NO: 1161840 - DNA, 22 bp, Homo sapiens
tatcttgggtgtattctctgta

SEQ ID NO: 1161841 - DNA, 14 bp, Homo sapiens
tatcttgtgcttct

SEQ ID NO: 1161842 - DNA, 21 bp, Homo sapiens
tatcttgttattaatgtttct

SEQ ID NO: 1161843 - DNA, 16 bp, Homo sapiens
tatcttgtttacaata

SEQ ID NO: 1161844 - DNA, 14 bp, Homo sapiens
tatcttgtttttcc

SEQ ID NO: 1161845 - DNA, 21 bp, Homo sapiens
tatctttaaagccgtgctctt

SEQ ID NO: 1161846 - DNA, 16 bp, Homo sapiens
tatctttaacaattgt

SEQ ID NO: 1161847 - DNA, 20 bp, Homo sapiens
tatctttaacaattgtctta

SEQ ID NO: 1161848 - DNA, 17 bp, Homo sapiens
ttgtaattgcttacatt

SEQ ID NO: 1161849 - DNA, 12 bp, Homo sapiens
ttgtaattgtgt

SEQ ID NO: 1161850 - DNA, 16 bp, Homo sapiens
ttgtaatttaaaataa

SEQ ID NO: 1161851 - DNA, 21 bp, Homo sapiens
ttgtaatttaaacaggcccag

SEQ ID NO: 1161852 - DNA, 16 bp, Homo sapiens
ttgtaatttgaattgg

SEQ ID NO: 1161853 - DNA, 12 bp, Homo sapiens
ttgtacaatggt

SEQ ID NO: 1161854 - DNA, 15 bp, Homo sapiens
ttgtacaatggttta

SEQ ID NO: 1161855 - DNA, 21 bp, Homo sapiens
ttgtacagactgttttactgt

SEQ ID NO: 1161856 - DNA, 16 bp, Homo sapiens
ttgtacagctgtttaa

SEQ ID NO: 1161857 - DNA, 14 bp, Homo sapiens
ttgtacaggactgt

SEQ ID NO: 1161858 - DNA, 17 bp, Homo sapiens
ttgtacaggactgtaaa

SEQ ID NO: 1161859 - DNA, 18 bp, Homo sapiens
ttgtacagtgtctgtgcc

SEQ ID NO: 1161860 - DNA, 16 bp, Homo sapiens
ttgtacagtttttatt

SEQ ID NO: 1161861 - DNA, 20 bp, Homo sapiens
ttgtacatgtaacattaaag

SEQ ID NO: 1161862 - DNA, 12 bp, Homo sapiens
ttgtacattttt

SEQ ID NO: 1161863 - DNA, 14 bp, Homo sapiens
ttgtaccaaaacat

SEQ ID NO: 1161864 - DNA, 15 bp, Homo sapiens
ttgtaccaaaatttt

SEQ ID NO: 1161865 - DNA, 18 bp, Homo sapiens
ttgtaccaaaattttaaa

SEQ ID NO: 1161866 - DNA, 16 bp, Homo sapiens
ttgtacctatttctga

SEQ ID NO: 1161867 - DNA, 11 bp, Homo sapiens
ttgtacctctc

SEQ ID NO: 1161868 - DNA, 21 bp, Homo sapiens
ttgtacctgtaggactctcat

SEQ ID NO: 1161869 - DNA, 11 bp, Homo sapiens
ttgtactatgt

SEQ ID NO: 1161870 - DNA, 14 bp, Homo sapiens
ttgtactccagcct

SEQ ID NO: 1161871 - DNA, 22 bp, Homo sapiens
ttgtactgaatttttttgtaat

SEQ ID NO: 1161872 - DNA, 17 bp, Homo sapiens
ttgtactgttgctttaa

SEQ ID NO: 1161873 - DNA, 23 bp, Homo sapiens
ttgtacttagccagttcaaagtg

SEQ ID NO: 1161874 - DNA, 14 bp, Homo sapiens
ttgtacttctgtgt

SEQ ID NO: 1161875 - DNA, 19 bp, Homo sapiens
ttgtacttgtgtttgctta

SEQ ID NO: 1161876 - DNA, 15 bp, Homo sapiens
ttgtactttatcatg

SEQ ID NO: 1161877 - DNA, 19 bp, Homo sapiens
ttgtactttatcatgaatg

SEQ ID NO: 1161878 - DNA, 22 bp, Homo sapiens
ttgtacttttctggttccaaac

SEQ ID NO: 1161879 - DNA, 17 bp, Homo sapiens
ttgtagaactcactctg

SEQ ID NO: 1161880 - DNA, 20 bp, Homo sapiens
ttgtagaactcactctgggc

SEQ ID NO: 1161881 - DNA, 13 bp, Homo sapiens
ttgtagaacttta

SEQ ID NO: 1161882 - DNA, 20 bp, Homo sapiens
ttgtagaagatggactctga

SEQ ID NO: 1161883 - DNA, 20 bp, Homo sapiens
ttgtagagagagctgtatta

SEQ ID NO: 1161884 - DNA, 20 bp, Homo sapiens
ttgtagagttgtactgcttt

SEQ ID NO: 1161885 - DNA, 19 bp, Homo sapiens
ttgtagatgaacttgagct

SEQ ID NO: 1161886 - DNA, 23 bp, Homo sapiens
ttgtagcacaatcctattactct

SEQ ID NO: 1161887 - DNA, 14 bp, Homo sapiens
ttgtagcataactg

SEQ ID NO: 1161888 - DNA, 22 bp, Homo sapiens
ttgtagcataactgtagctcaa

SEQ ID NO: 1161889 - DNA, 22 bp, Homo sapiens
ttgtagcatttaaaatggaaaa

SEQ ID NO: 1161890 - DNA, 14 bp, Homo sapiens
ttgtagcattttcc

SEQ ID NO: 1161891 - DNA, 15 bp, Homo sapiens
ttgtagcattttcct

SEQ ID NO: 1161892 - DNA, 15 bp, Homo sapiens
ttgtagccatggctg

SEQ ID NO: 1161893 - DNA, 21 bp, Homo sapiens
ttgtagctaaaaataaaacat

SEQ ID NO: 1161894 - DNA, 15 bp, Homo sapiens
ttgtaggctgtgggg

SEQ ID NO: 1161895 - DNA, 16 bp, Homo sapiens
ttgtagtaaaagtggt

SEQ ID NO: 1161896 - DNA, 15 bp, Homo sapiens
ttgtagtaagagctt

SEQ ID NO: 1161897 - DNA, 17 bp, Homo sapiens
ttgtagtgcaaaatggt

SEQ ID NO: 1161898 - DNA, 19 bp, Homo sapiens
ttgtagtgccactgttgtt

SEQ ID NO: 1161899 - DNA, 19 bp, Homo sapiens
ttgtagttacctactgagt

SEQ ID NO: 1161900 - DNA, 19 bp, Homo sapiens
ttgtataaaaaggaaatta

SEQ ID NO: 1161901 - DNA, 21 bp, Homo sapiens
ttgtataaaaaggaaattagt

SEQ ID NO: 1161902 - DNA, 12 bp, Homo sapiens
ttgtataaaata

SEQ ID NO: 1161903 - DNA, 19 bp, Homo sapiens
ttgtataaaatccaaaatg

SEQ ID NO: 1161904 - DNA, 12 bp, Homo sapiens
ttgtataaataa

SEQ ID NO: 1161905 - DNA, 16 bp, Homo sapiens
ttgtataagtcaagca

SEQ ID NO: 1161906 - DNA, 11 bp, Homo sapiens
ttgtataattg

SEQ ID NO: 1161907 - DNA, 20 bp, Homo sapiens
ttgtataattggatttccta

SEQ ID NO: 1161908 - DNA, 20 bp, Homo sapiens
ttgtatagcatgaaataaaa

SEQ ID NO: 1161909 - DNA, 19 bp, Homo sapiens
ttgtataggccatctgtaa

SEQ ID NO: 1161910 - DNA, 21 bp, Homo sapiens
ttgtataggccatctgtaaat

SEQ ID NO: 1161911 - DNA, 14 bp, Homo sapiens
ttgtatagtaaagt

SEQ ID NO: 1161912 - DNA, 15 bp, Homo sapiens
ttgtatagtaaagtg

SEQ ID NO: 1161913 - DNA, 14 bp, Homo sapiens
ttgtatagtgtaaa

SEQ ID NO: 1161914 - DNA, 14 bp, Homo sapiens
ttgtatagttgctt

SEQ ID NO: 1161915 - DNA, 22 bp, Homo sapiens
ttgtatatagagattgtacatt

SEQ ID NO: 1161916 - DNA, 13 bp, Homo sapiens
ttgtatatatctg

SEQ ID NO: 1161917 - DNA, 19 bp, Homo sapiens
ttgtatatatctgcttcag

SEQ ID NO: 1161918 - DNA, 21 bp, Homo sapiens
ttgtatatatgtgtgtttaaa

SEQ ID NO: 1161919 - DNA, 21 bp, Homo sapiens
ttgtatatattattataatct

SEQ ID NO: 1161920 - DNA, 14 bp, Homo sapiens
ttgtatattacaat

SEQ ID NO: 1161921 - DNA, 20 bp, Homo sapiens
ttgtatattatggaagattt

SEQ ID NO: 1161922 - DNA, 15 bp, Homo sapiens
ttgtatattctggaa

SEQ ID NO: 1161923 - DNA, 20 bp, Homo sapiens
ttgtatattgtggatgtgtt

SEQ ID NO: 1161924 - DNA, 21 bp, Homo sapiens
ttgtatattgtggatgtgttc

SEQ ID NO: 1161925 - DNA, 13 bp, Homo sapiens
ttgtatatttgta

SEQ ID NO: 1161926 - DNA, 14 bp, Homo sapiens
ttgtatatttgtac

SEQ ID NO: 1161927 - DNA, 16 bp, Homo sapiens
ttgtatatttgtacaa

SEQ ID NO: 1161928 - DNA, 17 bp, Homo sapiens
ttgtatatttgtacaaa

SEQ ID NO: 1161929 - DNA, 19 bp, Homo sapiens
ttgtatcaaatgttacagt

SEQ ID NO: 1161930 - DNA, 19 bp, Homo sapiens
ttgtatcatttgaacaact

SEQ ID NO: 1161931 - DNA, 20 bp, Homo sapiens
ttgtatctacagtaatgaaa

SEQ ID NO: 1161932 - DNA, 21 bp, Homo sapiens
ttgtatctagtgcagctgatt

SEQ ID NO: 1161933 - DNA, 16 bp, Homo sapiens
ttgtatctcatactgt

SEQ ID NO: 1161934 - DNA, 20 bp, Homo sapiens
ttgtatctcatactgtctgg

SEQ ID NO: 1161935 - DNA, 13 bp, Homo sapiens
ttgtatctctttt

SEQ ID NO: 1161936 - DNA, 15 bp, Homo sapiens
ttgtatctgtctttc

SEQ ID NO: 1161937 - DNA, 22 bp, Homo sapiens
ttgtatgacttctgctgaagga

SEQ ID NO: 1161938 - DNA, 22 bp, Homo sapiens
ttgtatgagatggttaaaaagg

SEQ ID NO: 1161939 - DNA, 19 bp, Homo sapiens
ttgtatgaggtcctcaggt

SEQ ID NO: 1161940 - DNA, 20 bp, Homo sapiens
ttgtatgaggtcctcaggtc

SEQ ID NO: 1161941 - DNA, 23 bp, Homo sapiens
ttgtatgaggtcctcaggtcagc

SEQ ID NO: 1161942 - DNA, 15 bp, Homo sapiens
ttgtatgcaaatgag

SEQ ID NO: 1161943 - DNA, 13 bp, Homo sapiens
ttgtatgcaggga

SEQ ID NO: 1161944 - DNA, 15 bp, Homo sapiens
ttgtatgcagggagc

SEQ ID NO: 1161945 - DNA, 20 bp, Homo sapiens
ttgtatgcctttaaatctgt

SEQ ID NO: 1161946 - DNA, 13 bp, Homo sapiens
ttgtatgtaaata

SEQ ID NO: 1161947 - DNA, 18 bp, Homo sapiens
ttgtatgtaaatgtgcat

SEQ ID NO: 1161948 - DNA, 15 bp, Homo sapiens
ttgtatgtggaagta

SEQ ID NO: 1161949 - DNA, 17 bp, Homo sapiens
ttgtatgttatgaacat

SEQ ID NO: 1161950 - DNA, 17 bp, Homo sapiens
ttgtattaaaaatagat

SEQ ID NO: 1161951 - DNA, 15 bp, Homo sapiens
ttgtattaaactctt

SEQ ID NO: 1161952 - DNA, 14 bp, Homo sapiens
ttgtattaacaaaa

SEQ ID NO: 1161953 - DNA, 12 bp, Homo sapiens
ttgtattaataa

SEQ ID NO: 1161954 - DNA, 17 bp, Homo sapiens
ttgtattaataaagcat

SEQ ID NO: 1161955 - DNA, 21 bp, Homo sapiens
ttgtattaataaagcattctt

SEQ ID NO: 1161956 - DNA, 16 bp, Homo sapiens
ttgtattacatctaat

SEQ ID NO: 1161957 - DNA, 18 bp, Homo sapiens
ttgtattactgcttccca

SEQ ID NO: 1161958 - DNA, 13 bp, Homo sapiens
ttgtattatttgg

SEQ ID NO: 1161959 - DNA, 14 bp, Homo sapiens
ttgtattatttgga

SEQ ID NO: 1161960 - DNA, 12 bp, Homo sapiens
ttgtattcagat

SEQ ID NO: 1161961 - DNA, 13 bp, Homo sapiens
ttgtattccctta

SEQ ID NO: 1161962 - DNA, 15 bp, Homo sapiens
ttgtattctctcctg

SEQ ID NO: 1161963 - DNA, 19 bp, Homo sapiens
ttgtattctctcctgtacc

SEQ ID NO: 1161964 - DNA, 15 bp, Homo sapiens
ttgtattctctgagc

SEQ ID NO: 1161965 - DNA, 22 bp, Homo sapiens
ttgtattctctgagctgtgcag

SEQ ID NO: 1161966 - DNA, 18 bp, Homo sapiens
ttgtattcttctgtattt

SEQ ID NO: 1161967 - DNA, 22 bp, Homo sapiens
ttgtattcttttccaagctcct

SEQ ID NO: 1161968 - DNA, 20 bp, Homo sapiens
ttgtattgttagatgtttgt

SEQ ID NO: 1161969 - DNA, 15 bp, Homo sapiens
ttgtattgtttcaat

SEQ ID NO: 1161970 - DNA, 13 bp, Homo sapiens
ttgtatttaacag

SEQ ID NO: 1161971 - DNA, 17 bp, Homo sapiens
ttgtatttaacagaaat

SEQ ID NO: 1161972 - DNA, 22 bp, Homo sapiens
ttgtatttatggattaaaaact

SEQ ID NO: 1161973 - DNA, 21 bp, Homo sapiens
tatctttaacaattgtcttaa

SEQ ID NO: 1161974 - DNA, 15 bp, Homo sapiens
tatctttaagaaaaa

SEQ ID NO: 1161975 - DNA, 16 bp, Homo sapiens
tatctttatacagatt

SEQ ID NO: 1161976 - DNA, 14 bp, Homo sapiens
tatctttatgctgt

SEQ ID NO: 1161977 - DNA, 15 bp, Homo sapiens
tatctttatgctgta

SEQ ID NO: 1161978 - DNA, 15 bp, Homo sapiens
tatctttattaaaac

SEQ ID NO: 1161979 - DNA, 12 bp, Homo sapiens
tatctttcctcc

SEQ ID NO: 1161980 - DNA, 13 bp, Homo sapiens
tatctttctttcc

SEQ ID NO: 1161981 - DNA, 18 bp, Homo sapiens
tatctttgtgtaatctaa

SEQ ID NO: 1161982 - DNA, 12 bp, Homo sapiens
tatcttttcata

SEQ ID NO: 1161983 - DNA, 22 bp, Homo sapiens
tatcttttgtttccttttttcc

SEQ ID NO: 1161984 - DNA, 17 bp, Homo sapiens
tatctttttaaaaactc

SEQ ID NO: 1161985 - DNA, 19 bp, Homo sapiens
tatctttttaaaaactctt

SEQ ID NO: 1161986 - DNA, 15 bp, Homo sapiens
tatcttttttcaaaa

SEQ ID NO: 1161987 - DNA, 17 bp, Homo sapiens
tatgaaaaatgtaaata

SEQ ID NO: 1161988 - DNA, 16 bp, Homo sapiens
tatgaaaaccaaattt

SEQ ID NO: 1161989 - DNA, 18 bp, Homo sapiens
tatgaaaaccaaatttta

SEQ ID NO: 1161990 - DNA, 17 bp, Homo sapiens
tatgaaaatatagacat

SEQ ID NO: 1161991 - DNA, 22 bp, Homo sapiens
tatgaaaatcctatatctgttt

SEQ ID NO: 1161992 - DNA, 15 bp, Homo sapiens
tatgaaaatgagccc

SEQ ID NO: 1161993 - DNA, 14 bp, Homo sapiens
tatgaaacatatca

SEQ ID NO: 1161994 - DNA, 20 bp, Homo sapiens
tatgaaagatggctgtgcct

SEQ ID NO: 1161995 - DNA, 16 bp, Homo sapiens
tatgaaattccagcaa

SEQ ID NO: 1161996 - DNA, 23 bp, Homo sapiens
tatgaacagaaactacatttcta

SEQ ID NO: 1161997 - DNA, 19 bp, Homo sapiens
tatgaacatattgttgaaa

SEQ ID NO: 1161998 - DNA, 18 bp, Homo sapiens
tatgaacctattttcatt

SEQ ID NO: 1161999 - DNA, 20 bp, Homo sapiens
tatgaacctattttcatttg

SEQ ID NO: 1162000 - DNA, 22 bp, Homo sapiens
tatgaacctattttcatttgta

SEQ ID NO: 1162001 - DNA, 21 bp, Homo sapiens
tatgaactacaggtgtttgac

SEQ ID NO: 1162002 - DNA, 14 bp, Homo sapiens
tatgaagacataaa

SEQ ID NO: 1162003 - DNA, 15 bp, Homo sapiens
tatgaagcagattta

SEQ ID NO: 1162004 - DNA, 12 bp, Homo sapiens
tatgaagccttt

SEQ ID NO: 1162005 - DNA, 17 bp, Homo sapiens
tatgaaggaatcattcc

SEQ ID NO: 1162006 - DNA, 15 bp, Homo sapiens
tatgaaggaatttga

SEQ ID NO: 1162007 - DNA, 14 bp, Homo sapiens
tatgaagttgctgt

SEQ ID NO: 1162008 - DNA, 17 bp, Homo sapiens
tatgaagttgctgttta

SEQ ID NO: 1162009 - DNA, 16 bp, Homo sapiens
tatgaagttggcacat

SEQ ID NO: 1162010 - DNA, 20 bp, Homo sapiens
tatgaagttggcacatttca

SEQ ID NO: 1162011 - DNA, 16 bp, Homo sapiens
tatgaataaaaggctg

SEQ ID NO: 1162012 - DNA, 12 bp, Homo sapiens
tatgaataaagt

SEQ ID NO: 1162013 - DNA, 12 bp, Homo sapiens
tatgaatacagg

SEQ ID NO: 1162014 - DNA, 20 bp, Homo sapiens
tatgaatctatgccaaagat

SEQ ID NO: 1162015 - DNA, 16 bp, Homo sapiens
tatgaatgatatcttt

SEQ ID NO: 1162016 - DNA, 21 bp, Homo sapiens
tatgaatgcccccagctggcc

SEQ ID NO: 1162017 - DNA, 15 bp, Homo sapiens
tatgaatgtcacatt

SEQ ID NO: 1162018 - DNA, 13 bp, Homo sapiens
tatgaatgtgatt

SEQ ID NO: 1162019 - DNA, 21 bp, Homo sapiens
tatgaattcaagaaaggaaat

SEQ ID NO: 1162020 - DNA, 18 bp, Homo sapiens
tatgaattgaattatctt

SEQ ID NO: 1162021 - DNA, 17 bp, Homo sapiens
tatgaattgtctaaagt

SEQ ID NO: 1162022 - DNA, 23 bp, Homo sapiens
tatgaatttaaatataattctgt

SEQ ID NO: 1162023 - DNA, 17 bp, Homo sapiens
tatgacaaattcaagag

SEQ ID NO: 1162024 - DNA, 19 bp, Homo sapiens
tatgacaatttctggcaga

SEQ ID NO: 1162025 - DNA, 15 bp, Homo sapiens
tatgaccagaagcct

SEQ ID NO: 1162026 - DNA, 15 bp, Homo sapiens
tatgacccacactgc

SEQ ID NO: 1162027 - DNA, 22 bp, Homo sapiens
tatgacctaagtcaggtaatat

SEQ ID NO: 1162028 - DNA, 16 bp, Homo sapiens
tatgacggaagaacat

SEQ ID NO: 1162029 - DNA, 16 bp, Homo sapiens
tatgactaaagagaga

SEQ ID NO: 1162030 - DNA, 17 bp, Homo sapiens
tatgactaaagagagaa

SEQ ID NO: 1162031 - DNA, 18 bp, Homo sapiens
tatgactaaagagagaat

SEQ ID NO: 1162032 - DNA, 20 bp, Homo sapiens
tatgactaaattttctttta

SEQ ID NO: 1162033 - DNA, 21 bp, Homo sapiens
tatgactaaattttcttttaa

SEQ ID NO: 1162034 - DNA, 21 bp, Homo sapiens
tatgactaatttggggaaaat

SEQ ID NO: 1162035 - DNA, 17 bp, Homo sapiens
tatgactatgtaaacta

SEQ ID NO: 1162036 - DNA, 18 bp, Homo sapiens
tatgactatgtaaactac

SEQ ID NO: 1162037 - DNA, 20 bp, Homo sapiens
tatgactttgtctaataaag

SEQ ID NO: 1162038 - DNA, 13 bp, Homo sapiens
tatgactttttat

SEQ ID NO: 1162039 - DNA, 22 bp, Homo sapiens
tatgactttttataaaatggct

SEQ ID NO: 1162040 - DNA, 18 bp, Homo sapiens
tatgacttttttaaacta

SEQ ID NO: 1162041 - DNA, 20 bp, Homo sapiens
tatgagaaaaatattcaagt

SEQ ID NO: 1162042 - DNA, 23 bp, Homo sapiens
tatgagaaaagaggcgtctgtat

SEQ ID NO: 1162043 - DNA, 16 bp, Homo sapiens
tatgagaatatacctt

SEQ ID NO: 1162044 - DNA, 19 bp, Homo sapiens
tatgagaatataccttatt

SEQ ID NO: 1162045 - DNA, 20 bp, Homo sapiens
tatgagacaggaaaaaccaa

SEQ ID NO: 1162046 - DNA, 23 bp, Homo sapiens
tatgagacaggaaaaaccaacag

SEQ ID NO: 1162047 - DNA, 14 bp, Homo sapiens
tatgagagaatcac

SEQ ID NO: 1162048 - DNA, 18 bp, Homo sapiens
tatgagagtttggaatta

SEQ ID NO: 1162049 - DNA, 16 bp, Homo sapiens
tatgagatactttgca

SEQ ID NO: 1162050 - DNA, 19 bp, Homo sapiens
tatgagatctaatgtgaaa

SEQ ID NO: 1162051 - DNA, 16 bp, Homo sapiens
tatgagatggccatgc

SEQ ID NO: 1162052 - DNA, 18 bp, Homo sapiens
tatgagatggccatgctc

SEQ ID NO: 1162053 - DNA, 19 bp, Homo sapiens
tatgagatggccatgctca

SEQ ID NO: 1162054 - DNA, 13 bp, Homo sapiens
tatgagatttact

SEQ ID NO: 1162055 - DNA, 16 bp, Homo sapiens
tatgagatttactgct

SEQ ID NO: 1162056 - DNA, 18 bp, Homo sapiens
tatgagcatcctgagccc

SEQ ID NO: 1162057 - DNA, 20 bp, Homo sapiens
tatgagcatcctgagccccg

SEQ ID NO: 1162058 - DNA, 17 bp, Homo sapiens
tatgagccagacaaatg

SEQ ID NO: 1162059 - DNA, 19 bp, Homo sapiens
tatgagccagacaaatgga

SEQ ID NO: 1162060 - DNA, 21 bp, Homo sapiens
tatgagccgtgaactgtgcat

SEQ ID NO: 1162061 - DNA, 13 bp, Homo sapiens
tatgagctgaggg

SEQ ID NO: 1162062 - DNA, 16 bp, Homo sapiens
tatgagctgagggggg

SEQ ID NO: 1162063 - DNA, 15 bp, Homo sapiens
tatgagcttcaatat

SEQ ID NO: 1162064 - DNA, 22 bp, Homo sapiens
tatgaggaaagcgtttctgtgt

SEQ ID NO: 1162065 - DNA, 13 bp, Homo sapiens
tatgaggcatttg

SEQ ID NO: 1162066 - DNA, 14 bp, Homo sapiens
tatgaggtcctcag

SEQ ID NO: 1162067 - DNA, 20 bp, Homo sapiens
tatgaggtcctcaggtcagc

SEQ ID NO: 1162068 - DNA, 15 bp, Homo sapiens
tatgagtcaatgtgc

SEQ ID NO: 1162069 - DNA, 23 bp, Homo sapiens
tatgagtgcgcagatctgtgcct

SEQ ID NO: 1162070 - DNA, 16 bp, Homo sapiens
tatgataaagttgtaa

SEQ ID NO: 1162071 - DNA, 21 bp, Homo sapiens
tatgatagatgacaaattggg

SEQ ID NO: 1162072 - DNA, 21 bp, Homo sapiens
tatgatattccccatttcctg

SEQ ID NO: 1162073 - DNA, 19 bp, Homo sapiens
tatgatattctttaaacaa

SEQ ID NO: 1162074 - DNA, 15 bp, Homo sapiens
tatgatattttctgt

SEQ ID NO: 1162075 - DNA, 17 bp, Homo sapiens
tatgatcacagtgactt

SEQ ID NO: 1162076 - DNA, 19 bp, Homo sapiens
tatgatcagtactgacttt

SEQ ID NO: 1162077 - DNA, 13 bp, Homo sapiens
tatgatcagtgtt

SEQ ID NO: 1162078 - DNA, 15 bp, Homo sapiens
tatgatccagagcag

SEQ ID NO: 1162079 - DNA, 18 bp, Homo sapiens
tatgatccagagcagagt

SEQ ID NO: 1162080 - DNA, 15 bp, Homo sapiens
tatgatcccagcact

SEQ ID NO: 1162081 - DNA, 18 bp, Homo sapiens
tatgatctaatacaaaga

SEQ ID NO: 1162082 - DNA, 23 bp, Homo sapiens
tatgatgcatacagttttctagc

SEQ ID NO: 1162083 - DNA, 12 bp, Homo sapiens
tatgatgctaag

SEQ ID NO: 1162084 - DNA, 16 bp, Homo sapiens
tatgatgctaagctga

SEQ ID NO: 1162085 - DNA, 14 bp, Homo sapiens
tatgatgggcttct

SEQ ID NO: 1162086 - DNA, 16 bp, Homo sapiens
tatgatgggcttctgt

SEQ ID NO: 1162087 - DNA, 15 bp, Homo sapiens
tatgatgggggaaaa

SEQ ID NO: 1162088 - DNA, 13 bp, Homo sapiens
tatgatgtatatt

SEQ ID NO: 1162089 - DNA, 18 bp, Homo sapiens
tatgatgtggacatatgt

SEQ ID NO: 1162090 - DNA, 21 bp, Homo sapiens
tatgatgtggacatatgtata

SEQ ID NO: 1162091 - DNA, 15 bp, Homo sapiens
tatgatgtgttgtga

SEQ ID NO: 1162092 - DNA, 18 bp, Homo sapiens
tatgatgttaaaaaaata

SEQ ID NO: 1162093 - DNA, 22 bp, Homo sapiens
tatgattactggcctttttcat

SEQ ID NO: 1162094 - DNA, 12 bp, Homo sapiens
tatgattattaa

SEQ ID NO: 1162095 - DNA, 18 bp, Homo sapiens
tatgattccaatctctgt

SEQ ID NO: 1162096 - DNA, 15 bp, Homo sapiens
tatgattctattata

SEQ ID NO: 1162097 - DNA, 19 bp, Homo sapiens
tatgattctgcttttacca

SEQ ID NO: 1162098 - DNA, 15 bp, Homo sapiens
ttgtatttctcttgt

SEQ ID NO: 1162099 - DNA, 20 bp, Homo sapiens
ttgtattttttatttacatt

SEQ ID NO: 1162100 - DNA, 22 bp, Homo sapiens
ttgtatttttttgcaagtgaag

SEQ ID NO: 1162101 - DNA, 14 bp, Homo sapiens
ttgtcaaaattgtt

SEQ ID NO: 1162102 - DNA, 22 bp, Homo sapiens
ttgtcaacactatataaataag

SEQ ID NO: 1162103 - DNA, 14 bp, Homo sapiens
ttgtcaacattgtg

SEQ ID NO: 1162104 - DNA, 22 bp, Homo sapiens
ttgtcaagaatagcattgtaaa

SEQ ID NO: 1162105 - DNA, 20 bp, Homo sapiens
ttgtcaagtctctgctggcc

SEQ ID NO: 1162106 - DNA, 17 bp, Homo sapiens
ttgtcaataaggagcat

SEQ ID NO: 1162107 - DNA, 22 bp, Homo sapiens
ttgtcaataaggagcatcagcc

SEQ ID NO: 1162108 - DNA, 16 bp, Homo sapiens
ttgtcaatactgagcc

SEQ ID NO: 1162109 - DNA, 23 bp, Homo sapiens
ttgtcaccagttaaaagcatttt

SEQ ID NO: 1162110 - DNA, 13 bp, Homo sapiens
ttgtcacttgcca

SEQ ID NO: 1162111 - DNA, 14 bp, Homo sapiens
ttgtcacttgccac

SEQ ID NO: 1162112 - DNA, 15 bp, Homo sapiens
ttgtcacttgccaca

SEQ ID NO: 1162113 - DNA, 20 bp, Homo sapiens
ttgtcacttgccacatggtg

SEQ ID NO: 1162114 - DNA, 15 bp, Homo sapiens
ttgtcacttttcctt

SEQ ID NO: 1162115 - DNA, 17 bp, Homo sapiens
ttgtcacttttttataa

SEQ ID NO: 1162116 - DNA, 23 bp, Homo sapiens
ttgtcagaatggaatccatctgt

SEQ ID NO: 1162117 - DNA, 15 bp, Homo sapiens
ttgtcagagctggga

SEQ ID NO: 1162118 - DNA, 12 bp, Homo sapiens
ttgtcagcaggc

SEQ ID NO: 1162119 - DNA, 21 bp, Homo sapiens
ttgtcagcaggcaggctgggg

SEQ ID NO: 1162120 - DNA, 12 bp, Homo sapiens
ttgtcagctact

SEQ ID NO: 1162121 - DNA, 15 bp, Homo sapiens
ttgtcagtatctgta

SEQ ID NO: 1162122 - DNA, 14 bp, Homo sapiens
ttgtcataaaatgc

SEQ ID NO: 1162123 - DNA, 19 bp, Homo sapiens
ttgtcataacatttaaaga

SEQ ID NO: 1162124 - DNA, 22 bp, Homo sapiens
ttgtcataacatttaaagagat

SEQ ID NO: 1162125 - DNA, 17 bp, Homo sapiens
ttgtcatcgttccccac

SEQ ID NO: 1162126 - DNA, 19 bp, Homo sapiens
ttgtcatctttcttctatt

SEQ ID NO: 1162127 - DNA, 21 bp, Homo sapiens
ttgtcatggggatcaattttc

SEQ ID NO: 1162128 - DNA, 21 bp, Homo sapiens
ttgtcattcaagcctgtgaat

SEQ ID NO: 1162129 - DNA, 18 bp, Homo sapiens
ttgtcattgagcctggca

SEQ ID NO: 1162130 - DNA, 14 bp, Homo sapiens
ttgtcattgctgtt

SEQ ID NO: 1162131 - DNA, 15 bp, Homo sapiens
ttgtcattgctgttg

SEQ ID NO: 1162132 - DNA, 22 bp, Homo sapiens
ttgtcattgtaaacaaactctt

SEQ ID NO: 1162133 - DNA, 17 bp, Homo sapiens
ttgtcattgtccagctg

SEQ ID NO: 1162134 - DNA, 20 bp, Homo sapiens
ttgtcattgtccagctggga

SEQ ID NO: 1162135 - DNA, 13 bp, Homo sapiens
ttgtcattttatg

SEQ ID NO: 1162136 - DNA, 17 bp, Homo sapiens
ttgtccaagttcacagt

SEQ ID NO: 1162137 - DNA, 21 bp, Homo sapiens
ttgtccaggagaaacctcaca

SEQ ID NO: 1162138 - DNA, 19 bp, Homo sapiens
ttgtcccaattaaaatact

SEQ ID NO: 1162139 - DNA, 17 bp, Homo sapiens
ttgtcccagcctggggc

SEQ ID NO: 1162140 - DNA, 18 bp, Homo sapiens
ttgtcccagcctggggct

SEQ ID NO: 1162141 - DNA, 23 bp, Homo sapiens
ttgtcccagcctggggctccctc

SEQ ID NO: 1162142 - DNA, 15 bp, Homo sapiens
ttgtccccagggccc

SEQ ID NO: 1162143 - DNA, 14 bp, Homo sapiens
ttgtcccccaactt

SEQ ID NO: 1162144 - DNA, 16 bp, Homo sapiens
ttgtcccccaacttga

SEQ ID NO: 1162145 - DNA, 17 bp, Homo sapiens
ttgtccccgctggctca

SEQ ID NO: 1162146 - DNA, 14 bp, Homo sapiens
ttgtcccctcttga

SEQ ID NO: 1162147 - DNA, 19 bp, Homo sapiens
ttgtcccggatttttgtta

SEQ ID NO: 1162148 - DNA, 16 bp, Homo sapiens
ttgtccctgtgttgtc

SEQ ID NO: 1162149 - DNA, 23 bp, Homo sapiens
ttgtccctgtgttgtcccatctg

SEQ ID NO: 1162150 - DNA, 17 bp, Homo sapiens
ttgtcctacgtccaagg

SEQ ID NO: 1162151 - DNA, 15 bp, Homo sapiens
ttgtcctatgtcaat

SEQ ID NO: 1162152 - DNA, 16 bp, Homo sapiens
ttgtcctcccaggctc

SEQ ID NO: 1162153 - DNA, 13 bp, Homo sapiens
ttgtcctcccctt

SEQ ID NO: 1162154 - DNA, 15 bp, Homo sapiens
ttgtcctccccttgg

SEQ ID NO: 1162155 - DNA, 19 bp, Homo sapiens
ttgtcctccttttcacttt

SEQ ID NO: 1162156 - DNA, 17 bp, Homo sapiens
ttgtcctgcagtgctca

SEQ ID NO: 1162157 - DNA, 14 bp, Homo sapiens
ttgtcctgccagct

SEQ ID NO: 1162158 - DNA, 16 bp, Homo sapiens
ttgtcctgccagctgc

SEQ ID NO: 1162159 - DNA, 20 bp, Homo sapiens
ttgtcctgcctgcaatattt

SEQ ID NO: 1162160 - DNA, 11 bp, Homo sapiens
ttgtcctgtgt

SEQ ID NO: 1162161 - DNA, 21 bp, Homo sapiens
ttgtcctttttcactttgaaa

SEQ ID NO: 1162162 - DNA, 19 bp, Homo sapiens
ttgtcgcgcgtctcccatc

SEQ ID NO: 1162163 - DNA, 14 bp, Homo sapiens
ttgtcgctcatgtg

SEQ ID NO: 1162164 - DNA, 14 bp, Homo sapiens
ttgtcgtttttagc

SEQ ID NO: 1162165 - DNA, 22 bp, Homo sapiens
ttgtctaaagttactactgatt

SEQ ID NO: 1162166 - DNA, 21 bp, Homo sapiens
ttgtctatgaagttgctgttt

SEQ ID NO: 1162167 - DNA, 19 bp, Homo sapiens
ttgtctattctgagccttg

SEQ ID NO: 1162168 - DNA, 12 bp, Homo sapiens
ttgtctatttta

SEQ ID NO: 1162169 - DNA, 12 bp, Homo sapiens
ttgtctcagaag

SEQ ID NO: 1162170 - DNA, 16 bp, Homo sapiens
ttgtctcctactctgt

SEQ ID NO: 1162171 - DNA, 12 bp, Homo sapiens
ttgtctccttcc

SEQ ID NO: 1162172 - DNA, 14 bp, Homo sapiens
ttgtctcctttctg

SEQ ID NO: 1162173 - DNA, 18 bp, Homo sapiens
ttgtctcgtgtacagctc

SEQ ID NO: 1162174 - DNA, 19 bp, Homo sapiens
ttgtctctatgccagctca

SEQ ID NO: 1162175 - DNA, 23 bp, Homo sapiens
ttgtctctgttggtccactgtgt

SEQ ID NO: 1162176 - DNA, 17 bp, Homo sapiens
ttgtctgaagtcactgc

SEQ ID NO: 1162177 - DNA, 14 bp, Homo sapiens
ttgtctgcagctgt

SEQ ID NO: 1162178 - DNA, 12 bp, Homo sapiens
ttgtctgggtgc

SEQ ID NO: 1162179 - DNA, 17 bp, Homo sapiens
ttgtctggttaaaaaat

SEQ ID NO: 1162180 - DNA, 18 bp, Homo sapiens
ttgtctggttaaaaaata

SEQ ID NO: 1162181 - DNA, 15 bp, Homo sapiens
ttgtctgtaaaaaat

SEQ ID NO: 1162182 - DNA, 13 bp, Homo sapiens
ttgtctgtaaatc

SEQ ID NO: 1162183 - DNA, 13 bp, Homo sapiens
ttgtctgtacata

SEQ ID NO: 1162184 - DNA, 16 bp, Homo sapiens
ttgtctgtacatactg

SEQ ID NO: 1162185 - DNA, 22 bp, Homo sapiens
ttgtctgtacatactggcctct

SEQ ID NO: 1162186 - DNA, 17 bp, Homo sapiens
ttgtctgtctccctccc

SEQ ID NO: 1162187 - DNA, 17 bp, Homo sapiens
ttgtctgtttgtttcaa

SEQ ID NO: 1162188 - DNA, 18 bp, Homo sapiens
ttgtcttaaaaaatgtga

SEQ ID NO: 1162189 - DNA, 15 bp, Homo sapiens
ttgtcttaaaaagtg

SEQ ID NO: 1162190 - DNA, 13 bp, Homo sapiens
ttgtcttaaaaat

SEQ ID NO: 1162191 - DNA, 15 bp, Homo sapiens
ttgtcttatctggcc

SEQ ID NO: 1162192 - DNA, 21 bp, Homo sapiens
ttgtcttatgtgaaaaattaa

SEQ ID NO: 1162193 - DNA, 14 bp, Homo sapiens
ttgtcttattctta

SEQ ID NO: 1162194 - DNA, 15 bp, Homo sapiens
ttgtcttattgaaaa

SEQ ID NO: 1162195 - DNA, 21 bp, Homo sapiens
ttgtcttcccccctctcctcc

SEQ ID NO: 1162196 - DNA, 16 bp, Homo sapiens
ttgtcttgaaaactgt

SEQ ID NO: 1162197 - DNA, 13 bp, Homo sapiens
ttgtcttgaaaga

SEQ ID NO: 1162198 - DNA, 13 bp, Homo sapiens
ttgtcttgtactt

SEQ ID NO: 1162199 - DNA, 16 bp, Homo sapiens
ttgtcttgtacttctg

SEQ ID NO: 1162200 - DNA, 19 bp, Homo sapiens
ttgtcttgttatgtacaaa

SEQ ID NO: 1162201 - DNA, 13 bp, Homo sapiens
ttgtctttcctcc

SEQ ID NO: 1162202 - DNA, 14 bp, Homo sapiens
ttgtctttgctgta

SEQ ID NO: 1162203 - DNA, 15 bp, Homo sapiens
ttgtctttttcctac

SEQ ID NO: 1162204 - DNA, 22 bp, Homo sapiens
ttgtctttttgtataaatgaca

SEQ ID NO: 1162205 - DNA, 15 bp, Homo sapiens
ttgtgaaataatttt

SEQ ID NO: 1162206 - DNA, 17 bp, Homo sapiens
ttgtgaaatgaaaacat

SEQ ID NO: 1162207 - DNA, 11 bp, Homo sapiens
ttgtgaaatgt

SEQ ID NO: 1162208 - DNA, 14 bp, Homo sapiens
ttgtgaacgctgtg

SEQ ID NO: 1162209 - DNA, 20 bp, Homo sapiens
ttgtgaacgctgtgatgctg

SEQ ID NO: 1162210 - DNA, 23 bp, Homo sapiens
ttgtgaactatatcagtagtgta

SEQ ID NO: 1162211 - DNA, 17 bp, Homo sapiens
ttgtgaactttttgtag

SEQ ID NO: 1162212 - DNA, 17 bp, Homo sapiens
ttgtgaagctaatgtca

SEQ ID NO: 1162213 - DNA, 21 bp, Homo sapiens
ttgtgaaggattatggaaaaa

SEQ ID NO: 1162214 - DNA, 13 bp, Homo sapiens
ttgtgaaggcagg

SEQ ID NO: 1162215 - DNA, 19 bp, Homo sapiens
ttgtgaattaggctgtaac

SEQ ID NO: 1162216 - DNA, 14 bp, Homo sapiens
ttgtgacaaaaaat

SEQ ID NO: 1162217 - DNA, 16 bp, Homo sapiens
ttgtgacaaaaaatta

SEQ ID NO: 1162218 - DNA, 21 bp, Homo sapiens
ttgtgacaggaaagccctccc

SEQ ID NO: 1162219 - DNA, 20 bp, Homo sapiens
ttgtgactcagcagaggcag

SEQ ID NO: 1162220 - DNA, 19 bp, Homo sapiens
ttgtgactgccaggataaa

SEQ ID NO: 1162221 - DNA, 15 bp, Homo sapiens
ttgtgacttacaatt

SEQ ID NO: 1162222 - DNA, 15 bp, Homo sapiens
ttgtgacttcactgt

SEQ ID NO: 1162223 - DNA, 18 bp, Homo sapiens
ttgtgacttcactgtata

SEQ ID NO: 1162224 - DNA, 17 bp, Homo sapiens
tatgattggttcagttt

SEQ ID NO: 1162225 - DNA, 17 bp, Homo sapiens
tatgatttataaacaga

SEQ ID NO: 1162226 - DNA, 16 bp, Homo sapiens
tatgatttcattatca

SEQ ID NO: 1162227 - DNA, 14 bp, Homo sapiens
tatgatttccttca

SEQ ID NO: 1162228 - DNA, 20 bp, Homo sapiens
tatgatttgttttgaatttt

SEQ ID NO: 1162229 - DNA, 14 bp, Homo sapiens
tatgcaaaagcagc

SEQ ID NO: 1162230 - DNA, 21 bp, Homo sapiens
tatgcaaacagttcttggacc

SEQ ID NO: 1162231 - DNA, 16 bp, Homo sapiens
tatgcaaagcactctc

SEQ ID NO: 1162232 - DNA, 18 bp, Homo sapiens
tatgcaaagcactctctg

SEQ ID NO: 1162233 - DNA, 20 bp, Homo sapiens
tatgcaaatggagataaaag

SEQ ID NO: 1162234 - DNA, 19 bp, Homo sapiens
tatgcaagatatttttgaa

SEQ ID NO: 1162235 - DNA, 12 bp, Homo sapiens
tatgcaagcagc

SEQ ID NO: 1162236 - DNA, 17 bp, Homo sapiens
tatgcaaggaaggaaag

SEQ ID NO: 1162237 - DNA, 20 bp, Homo sapiens
tatgcaaggaaggaaagaaa

SEQ ID NO: 1162238 - DNA, 18 bp, Homo sapiens
tatgcaatcaaatctgct

SEQ ID NO: 1162239 - DNA, 13 bp, Homo sapiens
tatgcacacattt

SEQ ID NO: 1162240 - DNA, 21 bp, Homo sapiens
tatgcactgtggtttcagatg

SEQ ID NO: 1162241 - DNA, 22 bp, Homo sapiens
tatgcacttataattttcctaa

SEQ ID NO: 1162242 - DNA, 20 bp, Homo sapiens
tatgcacttttagaaatgca

SEQ ID NO: 1162243 - DNA, 18 bp, Homo sapiens
tatgcagaaatagacaaa

SEQ ID NO: 1162244 - DNA, 20 bp, Homo sapiens
tatgcagaaatagacaaaaa

SEQ ID NO: 1162245 - DNA, 22 bp, Homo sapiens
tatgcagaaatagacaaaaagt

SEQ ID NO: 1162246 - DNA, 17 bp, Homo sapiens
tatgcagaagcatattt

SEQ ID NO: 1162247 - DNA, 16 bp, Homo sapiens
tatgcagaatggcatt

SEQ ID NO: 1162248 - DNA, 14 bp, Homo sapiens
tatgcagaatgttt

SEQ ID NO: 1162249 - DNA, 17 bp, Homo sapiens
tatgcagacagtctgtt

SEQ ID NO: 1162250 - DNA, 22 bp, Homo sapiens
tatgcagacagtctgttatgca

SEQ ID NO: 1162251 - DNA, 18 bp, Homo sapiens
tatgcagacatctctgga

SEQ ID NO: 1162252 - DNA, 21 bp, Homo sapiens
tatgcagacatctctggagcc

SEQ ID NO: 1162253 - DNA, 18 bp, Homo sapiens
tatgcagaggtccacaac

SEQ ID NO: 1162254 - DNA, 20 bp, Homo sapiens
tatgcagcatggggttttta

SEQ ID NO: 1162255 - DNA, 13 bp, Homo sapiens
tatgcagggaggc

SEQ ID NO: 1162256 - DNA, 20 bp, Homo sapiens
tatgcagggaggccacgtcc

SEQ ID NO: 1162257 - DNA, 13 bp, Homo sapiens
tatgcataaagcc

SEQ ID NO: 1162258 - DNA, 14 bp, Homo sapiens
tatgcataaagtca

SEQ ID NO: 1162259 - DNA, 15 bp, Homo sapiens
tatgcatactaattt

SEQ ID NO: 1162260 - DNA, 22 bp, Homo sapiens
tatgcatatattttagggctgt

SEQ ID NO: 1162261 - DNA, 15 bp, Homo sapiens
tatgcatatttgttt

SEQ ID NO: 1162262 - DNA, 12 bp, Homo sapiens
tatgcatcagat

SEQ ID NO: 1162263 - DNA, 13 bp, Homo sapiens
tatgcatgccagg

SEQ ID NO: 1162264 - DNA, 14 bp, Homo sapiens
tatgcattatatca

SEQ ID NO: 1162265 - DNA, 17 bp, Homo sapiens
tatgcattattaaattg

SEQ ID NO: 1162266 - DNA, 22 bp, Homo sapiens
tatgcattcacatttagaaaag

SEQ ID NO: 1162267 - DNA, 15 bp, Homo sapiens
tatgcattgccttgt

SEQ ID NO: 1162268 - DNA, 22 bp, Homo sapiens
tatgcatttaaatacagtcttc

SEQ ID NO: 1162269 - DNA, 13 bp, Homo sapiens
tatgcatttcatt

SEQ ID NO: 1162270 - DNA, 14 bp, Homo sapiens
tatgcatttcattc

SEQ ID NO: 1162271 - DNA, 17 bp, Homo sapiens
tatgcatttcattcaaa

SEQ ID NO: 1162272 - DNA, 23 bp, Homo sapiens
tatgcatttcattcaaatcagtg

SEQ ID NO: 1162273 - DNA, 14 bp, Homo sapiens
tatgcattttcttc

SEQ ID NO: 1162274 - DNA, 19 bp, Homo sapiens
tatgcattttcttcacagt

SEQ ID NO: 1162275 - DNA, 14 bp, Homo sapiens
tatgccacttcctt

SEQ ID NO: 1162276 - DNA, 15 bp, Homo sapiens
tatgccacttccttt

SEQ ID NO: 1162277 - DNA, 17 bp, Homo sapiens
tatgccagctcagtccc

SEQ ID NO: 1162278 - DNA, 18 bp, Homo sapiens
tatgccatgatttttggt

SEQ ID NO: 1162279 - DNA, 23 bp, Homo sapiens
tatgccatttcttctctctgttc

SEQ ID NO: 1162280 - DNA, 19 bp, Homo sapiens
tatgccccaccaaggctga

SEQ ID NO: 1162281 - DNA, 13 bp, Homo sapiens
tatgccctgcaga

SEQ ID NO: 1162282 - DNA, 14 bp, Homo sapiens
tatgccctgcagag

SEQ ID NO: 1162283 - DNA, 20 bp, Homo sapiens
tatgccctgcagagcaataa

SEQ ID NO: 1162284 - DNA, 20 bp, Homo sapiens
tatgccgaatgccctcaggg

SEQ ID NO: 1162285 - DNA, 22 bp, Homo sapiens
tatgccgtataggatgtcagac

SEQ ID NO: 1162286 - DNA, 12 bp, Homo sapiens
tatgcctgtggt

SEQ ID NO: 1162287 - DNA, 14 bp, Homo sapiens
tatgcctgtggtga

SEQ ID NO: 1162288 - DNA, 14 bp, Homo sapiens
tatgccttctgtat

SEQ ID NO: 1162289 - DNA, 19 bp, Homo sapiens
tatgccttcttattgcttt

SEQ ID NO: 1162290 - DNA, 21 bp, Homo sapiens
tatgcggttcttacagcacat

SEQ ID NO: 1162291 - DNA, 19 bp, Homo sapiens
tatgctacacagacattaa

SEQ ID NO: 1162292 - DNA, 20 bp, Homo sapiens
tatgctattgacaataaaat

SEQ ID NO: 1162293 - DNA, 19 bp, Homo sapiens
tatgctctcgcacctttcc

SEQ ID NO: 1162294 - DNA, 18 bp, Homo sapiens
tatgctctgcatgttaca

SEQ ID NO: 1162295 - DNA, 13 bp, Homo sapiens
tatgctctgcttt

SEQ ID NO: 1162296 - DNA, 21 bp, Homo sapiens
tatgctcttgaaatattcaga

SEQ ID NO: 1162297 - DNA, 14 bp, Homo sapiens
tatgctgacagctc

SEQ ID NO: 1162298 - DNA, 15 bp, Homo sapiens
tatgctgacagctct

SEQ ID NO: 1162299 - DNA, 15 bp, Homo sapiens
tatgctgatcatcgc

SEQ ID NO: 1162300 - DNA, 20 bp, Homo sapiens
tatgctgatcatcgccagag

SEQ ID NO: 1162301 - DNA, 15 bp, Homo sapiens
tatgctgatgatcaa

SEQ ID NO: 1162302 - DNA, 20 bp, Homo sapiens
tatgctgccaaattttggcc

SEQ ID NO: 1162303 - DNA, 12 bp, Homo sapiens
tatgctgctgtg

SEQ ID NO: 1162304 - DNA, 13 bp, Homo sapiens
tatgctgctgtga

SEQ ID NO: 1162305 - DNA, 11 bp, Homo sapiens
tatgctgcttt

SEQ ID NO: 1162306 - DNA, 20 bp, Homo sapiens
tatgctggccagcaccctct

SEQ ID NO: 1162307 - DNA, 22 bp, Homo sapiens
tatgctggccagcaccctctcc

SEQ ID NO: 1162308 - DNA, 15 bp, Homo sapiens
tatgctgtatctgtg

SEQ ID NO: 1162309 - DNA, 14 bp, Homo sapiens
tatgctgtatttct

SEQ ID NO: 1162310 - DNA, 23 bp, Homo sapiens
tatgctgtatttctttgtagaat

SEQ ID NO: 1162311 - DNA, 15 bp, Homo sapiens
tatgcttaaaatatg

SEQ ID NO: 1162312 - DNA, 15 bp, Homo sapiens
tatgcttactgatat

SEQ ID NO: 1162313 - DNA, 18 bp, Homo sapiens
tatgcttatacactgttg

SEQ ID NO: 1162314 - DNA, 14 bp, Homo sapiens
tatgcttgtgtata

SEQ ID NO: 1162315 - DNA, 21 bp, Homo sapiens
tatgctttccctgaggaatga

SEQ ID NO: 1162316 - DNA, 21 bp, Homo sapiens
tatgctttccttctttgggat

SEQ ID NO: 1162317 - DNA, 14 bp, Homo sapiens
tatggaaaaataaa

SEQ ID NO: 1162318 - DNA, 20 bp, Homo sapiens
tatggaaaaattgacaaaaa

SEQ ID NO: 1162319 - DNA, 15 bp, Homo sapiens
tatggaaaactgtgt

SEQ ID NO: 1162320 - DNA, 23 bp, Homo sapiens
tatggaaacattttatactgtac

SEQ ID NO: 1162321 - DNA, 20 bp, Homo sapiens
tatggaaccttccctccaaa

SEQ ID NO: 1162322 - DNA, 13 bp, Homo sapiens
tatggaactctct

SEQ ID NO: 1162323 - DNA, 16 bp, Homo sapiens
tatggaacttaacact

SEQ ID NO: 1162324 - DNA, 13 bp, Homo sapiens
tatggaaggattt

SEQ ID NO: 1162325 - DNA, 19 bp, Homo sapiens
tatggaagggtttgtggct

SEQ ID NO: 1162326 - DNA, 15 bp, Homo sapiens
tatggaatcaattca

SEQ ID NO: 1162327 - DNA, 20 bp, Homo sapiens
tatggacaaaattaatacat

SEQ ID NO: 1162328 - DNA, 14 bp, Homo sapiens
tatggacacagggt

SEQ ID NO: 1162329 - DNA, 22 bp, Homo sapiens
tatggacactgccttagcctct

SEQ ID NO: 1162330 - DNA, 13 bp, Homo sapiens
tatggacctagct

SEQ ID NO: 1162331 - DNA, 16 bp, Homo sapiens
tatggacctagcttga

SEQ ID NO: 1162332 - DNA, 15 bp, Homo sapiens
tatggagactttgct

SEQ ID NO: 1162333 - DNA, 19 bp, Homo sapiens
tatggagactttgctgtta

SEQ ID NO: 1162334 - DNA, 21 bp, Homo sapiens
tatggagactttgctgttact

SEQ ID NO: 1162335 - DNA, 21 bp, Homo sapiens
tatggaggattctttccccag

SEQ ID NO: 1162336 - DNA, 15 bp, Homo sapiens
tatggagtcttgtgc

SEQ ID NO: 1162337 - DNA, 20 bp, Homo sapiens
tatggagtgagtcacctgct

SEQ ID NO: 1162338 - DNA, 11 bp, Homo sapiens
tatggatgtgg

SEQ ID NO: 1162339 - DNA, 14 bp, Homo sapiens
tatggatttaagag

SEQ ID NO: 1162340 - DNA, 21 bp, Homo sapiens
tatggatttaagagtatttta

SEQ ID NO: 1162341 - DNA, 23 bp, Homo sapiens
tatggcaagtgatatcacctctc

SEQ ID NO: 1162342 - DNA, 13 bp, Homo sapiens
tatggcacttctc

SEQ ID NO: 1162343 - DNA, 18 bp, Homo sapiens
tatggcagagttgtaaat

SEQ ID NO: 1162344 - DNA, 19 bp, Homo sapiens
tatggcagagttgtaaata

SEQ ID NO: 1162345 - DNA, 14 bp, Homo sapiens
tatggcagcccggc

SEQ ID NO: 1162346 - DNA, 16 bp, Homo sapiens
tatggcagcccggctg

SEQ ID NO: 1162347 - DNA, 18 bp, Homo sapiens
tatggcagcccggctgct

SEQ ID NO: 1162348 - DNA, 21 bp, Homo sapiens
tatggcagcccggctgctgct

SEQ ID NO: 1162349 - DNA, 11 bp, Homo sapiens
ttgtgactttt

SEQ ID NO: 1162350 - DNA, 11 bp, Homo sapiens
ttgtgagagcg

SEQ ID NO: 1162351 - DNA, 14 bp, Homo sapiens
ttgttaataaaagt

SEQ ID NO: 1162352 - DNA, 22 bp, Homo sapiens
tatggcagcccggctgctgctt

SEQ ID NO: 1162353 - DNA, 14 bp, Homo sapiens
tatggcagcgaaag

SEQ ID NO: 1162354 - DNA, 21 bp, Homo sapiens
tatggcaggactcctggcagg

SEQ ID NO: 1162355 - DNA, 14 bp, Homo sapiens
tatggcatatttat

SEQ ID NO: 1162356 - DNA, 13 bp, Homo sapiens
tatggccatgccc

SEQ ID NO: 1162357 - DNA, 12 bp, Homo sapiens
tatggcctcagc

SEQ ID NO: 1162358 - DNA, 19 bp, Homo sapiens
tatggcctcagctgcctca

SEQ ID NO: 1162359 - DNA, 19 bp, Homo sapiens
tatggctatctatacctgc

SEQ ID NO: 1162360 - DNA, 22 bp, Homo sapiens
tatggctctgcacccctctgcc

SEQ ID NO: 1162361 - DNA, 13 bp, Homo sapiens
tatggctgcccag

SEQ ID NO: 1162362 - DNA, 18 bp, Homo sapiens
tatggctgtatttgctgt

SEQ ID NO: 1162363 - DNA, 16 bp, Homo sapiens
tatggcttttgtgcat

SEQ ID NO: 1162364 - DNA, 17 bp, Homo sapiens
tatggcttttgtgcatt

SEQ ID NO: 1162365 - DNA, 23 bp, Homo sapiens
tatggcttttgtgcattatctag

SEQ ID NO: 1162366 - DNA, 21 bp, Homo sapiens
tatgggagatggcagcagtga

SEQ ID NO: 1162367 - DNA, 20 bp, Homo sapiens
tatgggatattcccaagccg

SEQ ID NO: 1162368 - DNA, 20 bp, Homo sapiens
tatgggatcatttttccagg

SEQ ID NO: 1162369 - DNA, 14 bp, Homo sapiens
tatgggatccaagg

SEQ ID NO: 1162370 - DNA, 19 bp, Homo sapiens
tatgggatgtaaacaatgt

SEQ ID NO: 1162371 - DNA, 23 bp, Homo sapiens
tatgggatgtaaacaatgtaaag

SEQ ID NO: 1162372 - DNA, 23 bp, Homo sapiens
tatggggaaggttatcagtgctt

SEQ ID NO: 1162373 - DNA, 19 bp, Homo sapiens
tatggggggccaacaccag

SEQ ID NO: 1162374 - DNA, 13 bp, Homo sapiens
tatgggtcctctg

SEQ ID NO: 1162375 - DNA, 17 bp, Homo sapiens
tatgggtggctttcaag

SEQ ID NO: 1162376 - DNA, 22 bp, Homo sapiens
tatgggtttagttactttagat

SEQ ID NO: 1162377 - DNA, 16 bp, Homo sapiens
tatggtagaaaaattt

SEQ ID NO: 1162378 - DNA, 23 bp, Homo sapiens
tatggtatgctggccagcaccct

SEQ ID NO: 1162379 - DNA, 22 bp, Homo sapiens
tatggtatgtagccagctgtgc

SEQ ID NO: 1162380 - DNA, 16 bp, Homo sapiens
tatggtgaacccacaa

SEQ ID NO: 1162381 - DNA, 12 bp, Homo sapiens
tatggtgagatg

SEQ ID NO: 1162382 - DNA, 14 bp, Homo sapiens
tatggtgatgactt

SEQ ID NO: 1162383 - DNA, 16 bp, Homo sapiens
tatggtggaaaagaac

SEQ ID NO: 1162384 - DNA, 17 bp, Homo sapiens
tatggtggatccaaact

SEQ ID NO: 1162385 - DNA, 19 bp, Homo sapiens
tatggttacttcttctctt

SEQ ID NO: 1162386 - DNA, 22 bp, Homo sapiens
tatggttacttcttctcttaga

SEQ ID NO: 1162387 - DNA, 16 bp, Homo sapiens
tatggttcccaataaa

SEQ ID NO: 1162388 - DNA, 19 bp, Homo sapiens
tatggttcccaataaaagt

SEQ ID NO: 1162389 - DNA, 22 bp, Homo sapiens
tatggttcccaataaaagtgac

SEQ ID NO: 1162390 - DNA, 22 bp, Homo sapiens
tatggttctccaagaaactgaa

SEQ ID NO: 1162391 - DNA, 21 bp, Homo sapiens
tatggttgatagtttacctga

SEQ ID NO: 1162392 - DNA, 13 bp, Homo sapiens
tatggttggagag

SEQ ID NO: 1162393 - DNA, 15 bp, Homo sapiens
tatggttggagagcc

SEQ ID NO: 1162394 - DNA, 20 bp, Homo sapiens
tatggttggagagccctgga

SEQ ID NO: 1162395 - DNA, 15 bp, Homo sapiens
tatggttgtatacac

SEQ ID NO: 1162396 - DNA, 10 bp, Homo sapiens
tatgtaaaaa

SEQ ID NO: 1162397 - DNA, 22 bp, Homo sapiens
tatgtaaacaaaccacagcagg

SEQ ID NO: 1162398 - DNA, 15 bp, Homo sapiens
tatgtaaacaggaga

SEQ ID NO: 1162399 - DNA, 19 bp, Homo sapiens
tatgtaaactgcattagaa

SEQ ID NO: 1162400 - DNA, 23 bp, Homo sapiens
tatgtaaactgcattagaaatta

SEQ ID NO: 1162401 - DNA, 12 bp, Homo sapiens
tatgtaaagtat

SEQ ID NO: 1162402 - DNA, 19 bp, Homo sapiens
tatgtaaagtatgttttta

SEQ ID NO: 1162403 - DNA, 19 bp, Homo sapiens
tatgtaaataccaagagca

SEQ ID NO: 1162404 - DNA, 20 bp, Homo sapiens
tatgtaaatatgaagagttt

SEQ ID NO: 1162405 - DNA, 12 bp, Homo sapiens
tatgtaaatgtg

SEQ ID NO: 1162406 - DNA, 15 bp, Homo sapiens
tatgtaaattattgt

SEQ ID NO: 1162407 - DNA, 17 bp, Homo sapiens
tatgtaacagtcaaata

SEQ ID NO: 1162408 - DNA, 20 bp, Homo sapiens
tatgtaacagtcaaatatca

SEQ ID NO: 1162409 - DNA, 17 bp, Homo sapiens
tatgtaacatccagaag

SEQ ID NO: 1162410 - DNA, 18 bp, Homo sapiens
tatgtaacatgatgttaa

SEQ ID NO: 1162411 - DNA, 20 bp, Homo sapiens
tatgtaacatgatgttaact

SEQ ID NO: 1162412 - DNA, 23 bp, Homo sapiens
tatgtaatatattgtacaaatgt

SEQ ID NO: 1162413 - DNA, 23 bp, Homo sapiens
tatgtaatatttacataaagact

SEQ ID NO: 1162414 - DNA, 17 bp, Homo sapiens
tatgtaatcaaacttct

SEQ ID NO: 1162415 - DNA, 14 bp, Homo sapiens
tatgtaatgcaaaa

SEQ ID NO: 1162416 - DNA, 23 bp, Homo sapiens
tatgtaatgtgtggtggcctcag

SEQ ID NO: 1162417 - DNA, 17 bp, Homo sapiens
tatgtaatttcaaaata

SEQ ID NO: 1162418 - DNA, 15 bp, Homo sapiens
tatgtaatttgtaca

SEQ ID NO: 1162419 - DNA, 15 bp, Homo sapiens
tatgtacaaactagt

SEQ ID NO: 1162420 - DNA, 13 bp, Homo sapiens
tatgtacaaccct

SEQ ID NO: 1162421 - DNA, 15 bp, Homo sapiens
tatgtacaaccctga

SEQ ID NO: 1162422 - DNA, 17 bp, Homo sapiens
tatgtacaatacaatgt

SEQ ID NO: 1162423 - DNA, 13 bp, Homo sapiens
tatgtacagagct

SEQ ID NO: 1162424 - DNA, 17 bp, Homo sapiens
tatgtacagagctttct

SEQ ID NO: 1162425 - DNA, 22 bp, Homo sapiens
tatgtacagagctttcttttgt

SEQ ID NO: 1162426 - DNA, 12 bp, Homo sapiens
tatgtacagtta

SEQ ID NO: 1162427 - DNA, 15 bp, Homo sapiens
tatgtacatgagaag

SEQ ID NO: 1162428 - DNA, 19 bp, Homo sapiens
tatgtacgtttgtatgtgt

SEQ ID NO: 1162429 - DNA, 21 bp, Homo sapiens
tatgtacgtttgtatgtgtgt

SEQ ID NO: 1162430 - DNA, 19 bp, Homo sapiens
tatgtacttgtcaaagaag

SEQ ID NO: 1162431 - DNA, 20 bp, Homo sapiens
tatgtagatgtatgcacaca

SEQ ID NO: 1162432 - DNA, 15 bp, Homo sapiens
tatgtataattcaaa

SEQ ID NO: 1162433 - DNA, 21 bp, Homo sapiens
tatgtatacacacatatacat

SEQ ID NO: 1162434 - DNA, 14 bp, Homo sapiens
tatgtatcgctcct

SEQ ID NO: 1162435 - DNA, 13 bp, Homo sapiens
tatgtatgaagga

SEQ ID NO: 1162436 - DNA, 19 bp, Homo sapiens
tatgtatgggagatggcag

SEQ ID NO: 1162437 - DNA, 22 bp, Homo sapiens
tatgtatgggtagggtaaatca

SEQ ID NO: 1162438 - DNA, 16 bp, Homo sapiens
tatgtatgtaaaaatg

SEQ ID NO: 1162439 - DNA, 21 bp, Homo sapiens
tatgtattaagccaaacatga

SEQ ID NO: 1162440 - DNA, 19 bp, Homo sapiens
tatgtattatttacattta

SEQ ID NO: 1162441 - DNA, 21 bp, Homo sapiens
tatgtattatttataattcct

SEQ ID NO: 1162442 - DNA, 16 bp, Homo sapiens
tatgtattcccttgta

SEQ ID NO: 1162443 - DNA, 13 bp, Homo sapiens
tatgtatttaaaa

SEQ ID NO: 1162444 - DNA, 21 bp, Homo sapiens
tatgtatttaaaaacaaaaag

SEQ ID NO: 1162445 - DNA, 11 bp, Homo sapiens
tatgtatttcc

SEQ ID NO: 1162446 - DNA, 15 bp, Homo sapiens
tatgtattttcctaa

SEQ ID NO: 1162447 - DNA, 20 bp, Homo sapiens
tatgtattttgaaaaagaga

SEQ ID NO: 1162448 - DNA, 21 bp, Homo sapiens
tatgtcaataaacaacagctg

SEQ ID NO: 1162449 - DNA, 17 bp, Homo sapiens
tatgtcacgaacttgaa

SEQ ID NO: 1162450 - DNA, 19 bp, Homo sapiens
tatgtcatgcctcactttc

SEQ ID NO: 1162451 - DNA, 16 bp, Homo sapiens
tatgtcattatttatt

SEQ ID NO: 1162452 - DNA, 18 bp, Homo sapiens
tatgtcattatttattgt

SEQ ID NO: 1162453 - DNA, 22 bp, Homo sapiens
tatgtcattatttattgttaaa

SEQ ID NO: 1162454 - DNA, 17 bp, Homo sapiens
tatgtcatttttaatgt

SEQ ID NO: 1162455 - DNA, 19 bp, Homo sapiens
tatgtcatttttaatgtat

SEQ ID NO: 1162456 - DNA, 17 bp, Homo sapiens
tatgtccactgtgtata

SEQ ID NO: 1162457 - DNA, 17 bp, Homo sapiens
tatgtccagtcatcctg

SEQ ID NO: 1162458 - DNA, 15 bp, Homo sapiens
tatgtcccaagagcc

SEQ ID NO: 1162459 - DNA, 22 bp, Homo sapiens
tatgtcctgtgagatgtgtatc

SEQ ID NO: 1162460 - DNA, 16 bp, Homo sapiens
tatgtcgatgcacagt

SEQ ID NO: 1162461 - DNA, 19 bp, Homo sapiens
tatgtcgtagaattccttc

SEQ ID NO: 1162462 - DNA, 15 bp, Homo sapiens
tatgtctatttaagc

SEQ ID NO: 1162463 - DNA, 19 bp, Homo sapiens
tatgtctcttctgagctat

SEQ ID NO: 1162464 - DNA, 13 bp, Homo sapiens
tatgtctgcaggt

SEQ ID NO: 1162465 - DNA, 15 bp, Homo sapiens
tatgtctgtttttgt

SEQ ID NO: 1162466 - DNA, 23 bp, Homo sapiens
tatgtcttttgatgaatagaagt

SEQ ID NO: 1162467 - DNA, 20 bp, Homo sapiens
tatgtgaaaggaacattttt

SEQ ID NO: 1162468 - DNA, 22 bp, Homo sapiens
tatgtgaaaggatatgaatctg

SEQ ID NO: 1162469 - DNA, 23 bp, Homo sapiens
tatgtgaagaaaaagacctgcat

SEQ ID NO: 1162470 - DNA, 12 bp, Homo sapiens
tatgtgactttt

SEQ ID NO: 1162471 - DNA, 19 bp, Homo sapiens
tatgtgagaaatcagaatt

SEQ ID NO: 1162472 - DNA, 18 bp, Homo sapiens
ttgtttattaaatagtta

SEQ ID NO: 1162473 - DNA, 20 bp, Homo sapiens
ttgtttattctttttaaagt

SEQ ID NO: 1162474 - DNA, 20 bp, Homo sapiens
ttgtttatttatcagtgaca

SEQ ID NO: 1162475 - DNA, 14 bp, Homo sapiens
ttgtttcaagaacc

SEQ ID NO: 1162476 - DNA, 18 bp, Homo sapiens
ttgtttcaagaacctgga

SEQ ID NO: 1162477 - DNA, 21 bp, Homo sapiens
ttgtttcaatgaggtgtccaa

SEQ ID NO: 1162478 - DNA, 11 bp, Homo sapiens
ttgtttcagaa

SEQ ID NO: 1162479 - DNA, 20 bp, Homo sapiens
tatgtgagtagtcttatgta

SEQ ID NO: 1162480 - DNA, 13 bp, Homo sapiens
tatgtgatgccaa

SEQ ID NO: 1162481 - DNA, 20 bp, Homo sapiens
tatgtgatgccaaagatgtt

SEQ ID NO: 1162482 - DNA, 15 bp, Homo sapiens
tatgtgatgcctcta

SEQ ID NO: 1162483 - DNA, 20 bp, Homo sapiens
tatgtgcactgtcactttgc

SEQ ID NO: 1162484 - DNA, 20 bp, Homo sapiens
tatgtgcagcgacccttggt

SEQ ID NO: 1162485 - DNA, 21 bp, Homo sapiens
tatgtgcattattcataaaaa

SEQ ID NO: 1162486 - DNA, 17 bp, Homo sapiens
tatgtgccaggcttgcc

SEQ ID NO: 1162487 - DNA, 23 bp, Homo sapiens
tatgtgccaggcttgcctgggct

SEQ ID NO: 1162488 - DNA, 19 bp, Homo sapiens
tatgtgctatacacacaca

SEQ ID NO: 1162489 - DNA, 23 bp, Homo sapiens
tatgtgctattaatatttgttta

SEQ ID NO: 1162490 - DNA, 15 bp, Homo sapiens
tatgtggaagtatac

SEQ ID NO: 1162491 - DNA, 17 bp, Homo sapiens
tatgtgggcagattttc

SEQ ID NO: 1162492 - DNA, 15 bp, Homo sapiens
tatgtgtaaagattt

SEQ ID NO: 1162493 - DNA, 16 bp, Homo sapiens
tatgtgtaataaatat

SEQ ID NO: 1162494 - DNA, 13 bp, Homo sapiens
tatgtgtatgtac

SEQ ID NO: 1162495 - DNA, 15 bp, Homo sapiens
tatgtgtctgctaat

SEQ ID NO: 1162496 - DNA, 20 bp, Homo sapiens
tatgtgtctttatagatgta

SEQ ID NO: 1162497 - DNA, 17 bp, Homo sapiens
tatgtgtgaaacaatgt

SEQ ID NO: 1162498 - DNA, 21 bp, Homo sapiens
tatgtgtgcaggagcctccct

SEQ ID NO: 1162499 - DNA, 13 bp, Homo sapiens
tatgtgtgtaggt

SEQ ID NO: 1162500 - DNA, 19 bp, Homo sapiens
tatgtgtgtaggttatctt

SEQ ID NO: 1162501 - DNA, 11 bp, Homo sapiens
tatgtgtgtga

SEQ ID NO: 1162502 - DNA, 23 bp, Homo sapiens
tatgtgtgtgtatataaatacat

SEQ ID NO: 1162503 - DNA, 14 bp, Homo sapiens
tatgtgtgtttaaa

SEQ ID NO: 1162504 - DNA, 17 bp, Homo sapiens
tatgtgtgtttaaataa

SEQ ID NO: 1162505 - DNA, 14 bp, Homo sapiens
tatgtgtttctgta

SEQ ID NO: 1162506 - DNA, 15 bp, Homo sapiens
tatgtgtttctgtaa

SEQ ID NO: 1162507 - DNA, 17 bp, Homo sapiens
tatgtgtttctgtaaca

SEQ ID NO: 1162508 - DNA, 20 bp, Homo sapiens
tatgtgtttctgtaacaaat

SEQ ID NO: 1162509 - DNA, 21 bp, Homo sapiens
tatgtgtttggatacatctgc

SEQ ID NO: 1162510 - DNA, 15 bp, Homo sapiens
tatgtgtttttcaca

SEQ ID NO: 1162511 - DNA, 15 bp, Homo sapiens
tatgttaaactctgt

SEQ ID NO: 1162512 - DNA, 14 bp, Homo sapiens
tatgttaaatactg

SEQ ID NO: 1162513 - DNA, 21 bp, Homo sapiens
tatgttaaatactgtgcagaa

SEQ ID NO: 1162514 - DNA, 19 bp, Homo sapiens
tatgttaacctcagtgtca

SEQ ID NO: 1162515 - DNA, 20 bp, Homo sapiens
tatgttaacctcagtgtcat

SEQ ID NO: 1162516 - DNA, 19 bp, Homo sapiens
tatgttacatctgttttaa

SEQ ID NO: 1162517 - DNA, 12 bp, Homo sapiens
tatgttactatt

SEQ ID NO: 1162518 - DNA, 16 bp, Homo sapiens
tatgttactattttct

SEQ ID NO: 1162519 - DNA, 22 bp, Homo sapiens
tatgttatacaaccttcattta

SEQ ID NO: 1162520 - DNA, 17 bp, Homo sapiens
tatgttatacaaggcaa

SEQ ID NO: 1162521 - DNA, 18 bp, Homo sapiens
tatgttatcatcctccct

SEQ ID NO: 1162522 - DNA, 15 bp, Homo sapiens
tatgttatgaacatg

SEQ ID NO: 1162523 - DNA, 14 bp, Homo sapiens
tatgttatgaggat

SEQ ID NO: 1162524 - DNA, 12 bp, Homo sapiens
tatgttcaatgc

SEQ ID NO: 1162525 - DNA, 16 bp, Homo sapiens
tatgttcagaagaaat

SEQ ID NO: 1162526 - DNA, 16 bp, Homo sapiens
tatgttcagattattg

SEQ ID NO: 1162527 - DNA, 16 bp, Homo sapiens
tatgttcatattggat

SEQ ID NO: 1162528 - DNA, 12 bp, Homo sapiens
tatgttcatgta

SEQ ID NO: 1162529 - DNA, 19 bp, Homo sapiens
tatgttcccagcagtgggg

SEQ ID NO: 1162530 - DNA, 18 bp, Homo sapiens
tatgttctaacctttaca

SEQ ID NO: 1162531 - DNA, 22 bp, Homo sapiens
tatgttctaggtcagtctaaca

SEQ ID NO: 1162532 - DNA, 23 bp, Homo sapiens
tatgttctgcaagaattaaaact

SEQ ID NO: 1162533 - DNA, 13 bp, Homo sapiens
tatgttctgtctt

SEQ ID NO: 1162534 - DNA, 16 bp, Homo sapiens
tatgttctgtcttccc

SEQ ID NO: 1162535 - DNA, 22 bp, Homo sapiens
tatgttcttagtggatgttctg

SEQ ID NO: 1162536 - DNA, 17 bp, Homo sapiens
tatgttgagtgttcatt

SEQ ID NO: 1162537 - DNA, 16 bp, Homo sapiens
tatgttgatctgcata

SEQ ID NO: 1162538 - DNA, 20 bp, Homo sapiens
tatgttgcctttatggtttc

SEQ ID NO: 1162539 - DNA, 21 bp, Homo sapiens
tatgttgctataataaagaag

SEQ ID NO: 1162540 - DNA, 15 bp, Homo sapiens
tatgttggaaaaaag

SEQ ID NO: 1162541 - DNA, 15 bp, Homo sapiens
tatgttggtttcagt

SEQ ID NO: 1162542 - DNA, 20 bp, Homo sapiens
tatgttgtaataaaacttat

SEQ ID NO: 1162543 - DNA, 22 bp, Homo sapiens
tatgttgtaatatttcttcaaa

SEQ ID NO: 1162544 - DNA, 13 bp, Homo sapiens
tatgttgtatgat

SEQ ID NO: 1162545 - DNA, 13 bp, Homo sapiens
tatgttgtcaaag

SEQ ID NO: 1162546 - DNA, 15 bp, Homo sapiens
tatgttgtcataaca

SEQ ID NO: 1162547 - DNA, 16 bp, Homo sapiens
tatgttgtccaattgt

SEQ ID NO: 1162548 - DNA, 20 bp, Homo sapiens
tatgttgtttataataaaaa

SEQ ID NO: 1162549 - DNA, 19 bp, Homo sapiens
tatgtttaaaagaaatata

SEQ ID NO: 1162550 - DNA, 12 bp, Homo sapiens
tatgtttccaag

SEQ ID NO: 1162551 - DNA, 19 bp, Homo sapiens
tatgtttccccatctctgt

SEQ ID NO: 1162552 - DNA, 22 bp, Homo sapiens
tatgtttccccatctctgtctg

SEQ ID NO: 1162553 - DNA, 12 bp, Homo sapiens
tatgtttccttg

SEQ ID NO: 1162554 - DNA, 16 bp, Homo sapiens
tatgtttcttctttct

SEQ ID NO: 1162555 - DNA, 22 bp, Homo sapiens
tatgtttcttctttcttttaag

SEQ ID NO: 1162556 - DNA, 14 bp, Homo sapiens
tatgtttgcacact

SEQ ID NO: 1162557 - DNA, 19 bp, Homo sapiens
tatgtttgcacacttgtgt

SEQ ID NO: 1162558 - DNA, 18 bp, Homo sapiens
tatgttttagcatgtgtt

SEQ ID NO: 1162559 - DNA, 15 bp, Homo sapiens
tatgttttatatcaa

SEQ ID NO: 1162560 - DNA, 16 bp, Homo sapiens
tatgttttatatcaaa

SEQ ID NO: 1162561 - DNA, 17 bp, Homo sapiens
tatgttttatatcaaat

SEQ ID NO: 1162562 - DNA, 13 bp, Homo sapiens
tatgtttttaatg

SEQ ID NO: 1162563 - DNA, 22 bp, Homo sapiens
tatgtttttacattatgcaaat

SEQ ID NO: 1162564 - DNA, 16 bp, Homo sapiens
tatgtttttgttcaaa

SEQ ID NO: 1162565 - DNA, 17 bp, Homo sapiens
tatgttttttaaaatat

SEQ ID NO: 1162566 - DNA, 19 bp, Homo sapiens
tatgttttttagatcaaat

SEQ ID NO: 1162567 - DNA, 22 bp, Homo sapiens
tatgttttttttctgctggaaa

SEQ ID NO: 1162568 - DNA, 15 bp, Homo sapiens
tattaaaaaacttca

SEQ ID NO: 1162569 - DNA, 15 bp, Homo sapiens
tattaaaaaagtcta

SEQ ID NO: 1162570 - DNA, 14 bp, Homo sapiens
tattaaaaatagat

SEQ ID NO: 1162571 - DNA, 13 bp, Homo sapiens
tattaaaaatata

SEQ ID NO: 1162572 - DNA, 18 bp, Homo sapiens
tattaaaaatataaaact

SEQ ID NO: 1162573 - DNA, 16 bp, Homo sapiens
tattaaaaatgttctc

SEQ ID NO: 1162574 - DNA, 16 bp, Homo sapiens
tattaaaatatttcag

SEQ ID NO: 1162575 - DNA, 10 bp, Homo sapiens
tattaaaatc

SEQ ID NO: 1162576 - DNA, 18 bp, Homo sapiens
tattaaaatgattgtaaa

SEQ ID NO: 1162577 - DNA, 14 bp, Homo sapiens
tattaaaattccaa

SEQ ID NO: 1162578 - DNA, 19 bp, Homo sapiens
tattaaacaaagtttcaga

SEQ ID NO: 1162579 - DNA, 17 bp, Homo sapiens
tattaaacttgtcagaa

SEQ ID NO: 1162580 - DNA, 18 bp, Homo sapiens
tattaaacttgtcagaat

SEQ ID NO: 1162581 - DNA, 16 bp, Homo sapiens
tattaaagaaaaatgc

SEQ ID NO: 1162582 - DNA, 12 bp, Homo sapiens
tattaaagacag

SEQ ID NO: 1162583 - DNA, 17 bp, Homo sapiens
tattaaagattctcttt

SEQ ID NO: 1162584 - DNA, 19 bp, Homo sapiens
tattaaagattctctttaa

SEQ ID NO: 1162585 - DNA, 13 bp, Homo sapiens
tattaaagtgact

SEQ ID NO: 1162586 - DNA, 23 bp, Homo sapiens
tattaaatgcttcatttgtatgt

SEQ ID NO: 1162587 - DNA, 19 bp, Homo sapiens
tattaaattgtgattgttt

SEQ ID NO: 1162588 - DNA, 19 bp, Homo sapiens
tattaaattttttgttgac

SEQ ID NO: 1162589 - DNA, 14 bp, Homo sapiens
tattaacaaaagtt

SEQ ID NO: 1162590 - DNA, 16 bp, Homo sapiens
tattaacaaattatgt

SEQ ID NO: 1162591 - DNA, 18 bp, Homo sapiens
tattaacacgctgcctgg

SEQ ID NO: 1162592 - DNA, 23 bp, Homo sapiens
tattaaccctctgagtttttgta

SEQ ID NO: 1162593 - DNA, 16 bp, Homo sapiens
tattaaccttttttgt

SEQ ID NO: 1162594 - DNA, 16 bp, Homo sapiens
tttaaaatatttatct

SEQ ID NO: 1162595 - DNA, 22 bp, Homo sapiens
tttaaaatatttgaatgaaaac

SEQ ID NO: 1162596 - DNA, 20 bp, Homo sapiens
tttaaaatctcctaaatgct

SEQ ID NO: 1162597 - DNA, 12 bp, Homo sapiens
tttaaaatctga

SEQ ID NO: 1162598 - DNA, 20 bp, Homo sapiens
tttaaaatctgatttaatgt

SEQ ID NO: 1162599 - DNA, 12 bp, Homo sapiens
tttaaaatgatt

SEQ ID NO: 1162600 - DNA, 17 bp, Homo sapiens
tttaaaatgcagattca

SEQ ID NO: 1162601 - DNA, 19 bp, Homo sapiens
tttaaaatgcagattcata

SEQ ID NO: 1162602 - DNA, 21 bp, Homo sapiens
tttaaaatgcgaaattattgg

SEQ ID NO: 1162603 - DNA, 19 bp, Homo sapiens
tttaaaatgcttgggtaca

SEQ ID NO: 1162604 - DNA, 23 bp, Homo sapiens
tttaaaattaaaaaaaagaagag

SEQ ID NO: 1162605 - DNA, 17 bp, Homo sapiens
tttaaaattaagtagaa

SEQ ID NO: 1162606 - DNA, 18 bp, Homo sapiens
tttaaaattgatttttct

SEQ ID NO: 1162607 - DNA, 12 bp, Homo sapiens
tattaagtgact

SEQ ID NO: 1162608 - DNA, 23 bp, Homo sapiens
tattaagtgactgaccatgcact

SEQ ID NO: 1162609 - DNA, 15 bp, Homo sapiens
tattaagttgttaat

SEQ ID NO: 1162610 - DNA, 16 bp, Homo sapiens
tattaataaaaagaca

SEQ ID NO: 1162611 - DNA, 17 bp, Homo sapiens
tattaataaagcattct

SEQ ID NO: 1162612 - DNA, 14 bp, Homo sapiens
tattaataccaaat

SEQ ID NO: 1162613 - DNA, 16 bp, Homo sapiens
tattaataccaaatat

SEQ ID NO: 1162614 - DNA, 12 bp, Homo sapiens
tattaatatcaa

SEQ ID NO: 1162615 - DNA, 18 bp, Homo sapiens
tattaatcaagagaaact

SEQ ID NO: 1162616 - DNA, 14 bp, Homo sapiens
tattaatctctgtg

SEQ ID NO: 1162617 - DNA, 14 bp, Homo sapiens
tattaatcttagtg

SEQ ID NO: 1162618 - DNA, 17 bp, Homo sapiens
tattaatcttagtgtat

SEQ ID NO: 1162619 - DNA, 22 bp, Homo sapiens
tattaatgaggtctttaaacct

SEQ ID NO: 1162620 - DNA, 17 bp, Homo sapiens
tattaattcttcacctg

SEQ ID NO: 1162621 - DNA, 13 bp, Homo sapiens
tattaattgcctg

SEQ ID NO: 1162622 - DNA, 17 bp, Homo sapiens
tattaattgtcctgtgt

SEQ ID NO: 1162623 - DNA, 21 bp, Homo sapiens
tattaattgttttgcactttt

SEQ ID NO: 1162624 - DNA, 14 bp, Homo sapiens
tattacaaaaacaa

SEQ ID NO: 1162625 - DNA, 22 bp, Homo sapiens
tattacaaatattgtcatcttt

SEQ ID NO: 1162626 - DNA, 12 bp, Homo sapiens
tattacaaatgc

SEQ ID NO: 1162627 - DNA, 14 bp, Homo sapiens
tattacaaatgcaa

SEQ ID NO: 1162628 - DNA, 16 bp, Homo sapiens
tattacaaatgcaaat

SEQ ID NO: 1162629 - DNA, 19 bp, Homo sapiens
tattacaaatgcaaatttc

SEQ ID NO: 1162630 - DNA, 15 bp, Homo sapiens
tattacaatgatcac

SEQ ID NO: 1162631 - DNA, 16 bp, Homo sapiens
tattacaatgtatctt

SEQ ID NO: 1162632 - DNA, 17 bp, Homo sapiens
tattacaatgtatcttt

SEQ ID NO: 1162633 - DNA, 16 bp, Homo sapiens
tattacactctgtaat

SEQ ID NO: 1162634 - DNA, 13 bp, Homo sapiens
tattacactgtat

SEQ ID NO: 1162635 - DNA, 19 bp, Homo sapiens
tattacactgtatttgtat

SEQ ID NO: 1162636 - DNA, 21 bp, Homo sapiens
tattacactgtatttgtatct

SEQ ID NO: 1162637 - DNA, 15 bp, Homo sapiens
tattacagaaatgtt

SEQ ID NO: 1162638 - DNA, 16 bp, Homo sapiens
tattacagaaatgttt

SEQ ID NO: 1162639 - DNA, 22 bp, Homo sapiens
tattacagaaatgtttttaaca

SEQ ID NO: 1162640 - DNA, 15 bp, Homo sapiens
tattacagtgtttat

SEQ ID NO: 1162641 - DNA, 17 bp, Homo sapiens
tattacatatatcatta

SEQ ID NO: 1162642 - DNA, 14 bp, Homo sapiens
tattacatctaatg

SEQ ID NO: 1162643 - DNA, 17 bp, Homo sapiens
tattacatctttcacat

SEQ ID NO: 1162644 - DNA, 18 bp, Homo sapiens
tattacatgtaatttgat

SEQ ID NO: 1162645 - DNA, 21 bp, Homo sapiens
tattaccagcaagaataaaaa

SEQ ID NO: 1162646 - DNA, 16 bp, Homo sapiens
tattactaattctatt

SEQ ID NO: 1162647 - DNA, 22 bp, Homo sapiens
tattactaattctatttctcta

SEQ ID NO: 1162648 - DNA, 15 bp, Homo sapiens
tattactactccttt

SEQ ID NO: 1162649 - DNA, 16 bp, Homo sapiens
tattactactcctttg

SEQ ID NO: 1162650 - DNA, 16 bp, Homo sapiens
tattactctcaaaatc

SEQ ID NO: 1162651 - DNA, 22 bp, Homo sapiens
tattactcttcctctaacattt

SEQ ID NO: 1162652 - DNA, 18 bp, Homo sapiens
tattactgtctggtttta

SEQ ID NO: 1162653 - DNA, 22 bp, Homo sapiens
tattacttaggttattttgctt

SEQ ID NO: 1162654 - DNA, 23 bp, Homo sapiens
tattacttatttttgacagtgtt

SEQ ID NO: 1162655 - DNA, 12 bp, Homo sapiens
tattacttctgt

SEQ ID NO: 1162656 - DNA, 17 bp, Homo sapiens
tattacttctgtttctc

SEQ ID NO: 1162657 - DNA, 14 bp, Homo sapiens
tattacttgtgcac

SEQ ID NO: 1162658 - DNA, 23 bp, Homo sapiens
tattacttgtgcacttagtagtt

SEQ ID NO: 1162659 - DNA, 14 bp, Homo sapiens
tattacttttgtaa

SEQ ID NO: 1162660 - DNA, 15 bp, Homo sapiens
tattacttttgtaaa

SEQ ID NO: 1162661 - DNA, 18 bp, Homo sapiens
tattacttttgtaaatat

SEQ ID NO: 1162662 - DNA, 17 bp, Homo sapiens
tattagaacattcactt

SEQ ID NO: 1162663 - DNA, 22 bp, Homo sapiens
tattagaatcaaacattttgaa

SEQ ID NO: 1162664 - DNA, 12 bp, Homo sapiens
tattagagaaga

SEQ ID NO: 1162665 - DNA, 21 bp, Homo sapiens
tattagccaggtaatgtgaat

SEQ ID NO: 1162666 - DNA, 20 bp, Homo sapiens
tattagccctgcattttcat

SEQ ID NO: 1162667 - DNA, 22 bp, Homo sapiens
tattagccctgcattttcatag

SEQ ID NO: 1162668 - DNA, 13 bp, Homo sapiens
tattagctttctc

SEQ ID NO: 1162669 - DNA, 19 bp, Homo sapiens
tattaggaagtgtttatgt

SEQ ID NO: 1162670 - DNA, 22 bp, Homo sapiens
tattaggataatacataaatga

SEQ ID NO: 1162671 - DNA, 23 bp, Homo sapiens
tattaggataatacataaatgat

SEQ ID NO: 1162672 - DNA, 16 bp, Homo sapiens
tattaggatctgcaaa

SEQ ID NO: 1162673 - DNA, 15 bp, Homo sapiens
tattagggagaaaat

SEQ ID NO: 1162674 - DNA, 13 bp, Homo sapiens
tattagtattgtt

SEQ ID NO: 1162675 - DNA, 13 bp, Homo sapiens
tattagttaatat

SEQ ID NO: 1162676 - DNA, 15 bp, Homo sapiens
tattagttaatatta

SEQ ID NO: 1162677 - DNA, 22 bp, Homo sapiens
tattagtttaccacttgccttt

SEQ ID NO: 1162678 - DNA, 13 bp, Homo sapiens
tattataaactat

SEQ ID NO: 1162679 - DNA, 18 bp, Homo sapiens
tattataaaggataaaga

SEQ ID NO: 1162680 - DNA, 20 bp, Homo sapiens
tattataaaggataaagaag

SEQ ID NO: 1162681 - DNA, 19 bp, Homo sapiens
tattataactctgtataat

SEQ ID NO: 1162682 - DNA, 15 bp, Homo sapiens
tattataacttaaaa

SEQ ID NO: 1162683 - DNA, 23 bp, Homo sapiens
tattataatataatatggaacct

SEQ ID NO: 1162684 - DNA, 14 bp, Homo sapiens
tattataattgttg

SEQ ID NO: 1162685 - DNA, 18 bp, Homo sapiens
tattataattgttgatat

SEQ ID NO: 1162686 - DNA, 12 bp, Homo sapiens
tattataattta

SEQ ID NO: 1162687 - DNA, 15 bp, Homo sapiens
tattataatttaatg

SEQ ID NO: 1162688 - DNA, 19 bp, Homo sapiens
tattataatttttttcaat

SEQ ID NO: 1162689 - DNA, 19 bp, Homo sapiens
tattatagaaaattatttg

SEQ ID NO: 1162690 - DNA, 20 bp, Homo sapiens
tattatagagagttatgaac

SEQ ID NO: 1162691 - DNA, 16 bp, Homo sapiens
tattatatatttacag

SEQ ID NO: 1162692 - DNA, 20 bp, Homo sapiens
tattatatatttacagaaga

SEQ ID NO: 1162693 - DNA, 16 bp, Homo sapiens
tattatcaatgtttac

SEQ ID NO: 1162694 - DNA, 20 bp, Homo sapiens
tattatcaggggagaaaaat

SEQ ID NO: 1162695 - DNA, 14 bp, Homo sapiens
tattatcatggtat

SEQ ID NO: 1162696 - DNA, 23 bp, Homo sapiens
tattatcccagcttgctgagggg

SEQ ID NO: 1162697 - DNA, 14 bp, Homo sapiens
tattatccttctac

SEQ ID NO: 1162698 - DNA, 16 bp, Homo sapiens
tattatctaaatgaat

SEQ ID NO: 1162699 - DNA, 17 bp, Homo sapiens
tattatctacctgttct

SEQ ID NO: 1162700 - DNA, 14 bp, Homo sapiens
tattatctgggctt

SEQ ID NO: 1162701 - DNA, 14 bp, Homo sapiens
tattatctgtcagc

SEQ ID NO: 1162702 - DNA, 21 bp, Homo sapiens
tattatcttgttcaggaaaag

SEQ ID NO: 1162703 - DNA, 14 bp, Homo sapiens
tattatgaaaaaga

SEQ ID NO: 1162704 - DNA, 16 bp, Homo sapiens
tattatgaaggaattt

SEQ ID NO: 1162705 - DNA, 22 bp, Homo sapiens
tattatgaaggaatttgattgc

SEQ ID NO: 1162706 - DNA, 12 bp, Homo sapiens
tattatgcataa

SEQ ID NO: 1162707 - DNA, 19 bp, Homo sapiens
tattatgcattatatcaaa

SEQ ID NO: 1162708 - DNA, 19 bp, Homo sapiens
tattatgctttattggaaa

SEQ ID NO: 1162709 - DNA, 19 bp, Homo sapiens
tattatgtcctgtgagatg

SEQ ID NO: 1162710 - DNA, 17 bp, Homo sapiens
tattatgtctcttctga

SEQ ID NO: 1162711 - DNA, 17 bp, Homo sapiens
tattatgtgcctaattt

SEQ ID NO: 1162712 - DNA, 13 bp, Homo sapiens
tattatgtttatt

SEQ ID NO: 1162713 - DNA, 16 bp, Homo sapiens
tattatgtttattaca

SEQ ID NO: 1162714 - DNA, 17 bp, Homo sapiens
tattatgtttattacaa

SEQ ID NO: 1162715 - DNA, 17 bp, Homo sapiens
tattattaatataataa

SEQ ID NO: 1162716 - DNA, 22 bp, Homo sapiens
tattcttggtactgttgctttg

SEQ ID NO: 1162717 - DNA, 13 bp, Homo sapiens
tattcttggtttt

SEQ ID NO: 1162718 - DNA, 19 bp, Homo sapiens
tattcttgtccacattcta

SEQ ID NO: 1162719 - DNA, 20 bp, Homo sapiens
tattctttaaacaaatatga

SEQ ID NO: 1162720 - DNA, 14 bp, Homo sapiens
tattctttactatt

SEQ ID NO: 1162721 - DNA, 14 bp, Homo sapiens
tattctttgaaaac

SEQ ID NO: 1162722 - DNA, 18 bp, Homo sapiens
tattctttggttgtgaat

SEQ ID NO: 1162723 - DNA, 20 bp, Homo sapiens
tattcttttgatcacattgt

SEQ ID NO: 1162724 - DNA, 15 bp, Homo sapiens
tattcttttgtttcc

SEQ ID NO: 1162725 - DNA, 16 bp, Homo sapiens
tattcttttgtttcca

SEQ ID NO: 1162726 - DNA, 19 bp, Homo sapiens
tattgaaaacacttagtat

SEQ ID NO: 1162727 - DNA, 13 bp, Homo sapiens
tattgaaaacttc

SEQ ID NO: 1162728 - DNA, 16 bp, Homo sapiens
tattgaaaacttcaaa

SEQ ID NO: 1162729 - DNA, 20 bp, Homo sapiens
tattgaaagagtctgggacc

SEQ ID NO: 1162730 - DNA, 22 bp, Homo sapiens
tattgaaaggggacacctgtac

SEQ ID NO: 1162731 - DNA, 23 bp, Homo sapiens
tattgaaaggggacacctgtaca

SEQ ID NO: 1162732 - DNA, 21 bp, Homo sapiens
tattgaaatattatagagagt

SEQ ID NO: 1162733 - DNA, 21 bp, Homo sapiens
tattgaactgtattctagtgg

SEQ ID NO: 1162734 - DNA, 14 bp, Homo sapiens
tattgaagacaatt

SEQ ID NO: 1162735 - DNA, 12 bp, Homo sapiens
tttaaaattggc

SEQ ID NO: 1162736 - DNA, 15 bp, Homo sapiens
tttaaaattggcacc

SEQ ID NO: 1162737 - DNA, 19 bp, Homo sapiens
tttaaaatttaagtatctt

SEQ ID NO: 1162738 - DNA, 16 bp, Homo sapiens
tttaaaatttgttctt

SEQ ID NO: 1162739 - DNA, 16 bp, Homo sapiens
tttaaaattttggaat

SEQ ID NO: 1162740 - DNA, 13 bp, Homo sapiens
tttaaacaaaata

SEQ ID NO: 1162741 - DNA, 16 bp, Homo sapiens
tttaaacaaaatagaa

SEQ ID NO: 1162742 - DNA, 20 bp, Homo sapiens
tttaaacaaaatttcacagt

SEQ ID NO: 1162743 - DNA, 16 bp, Homo sapiens
tttaaacaaatatgaa

SEQ ID NO: 1162744 - DNA, 17 bp, Homo sapiens
tttaaacaaatatgaaa

SEQ ID NO: 1162745 - DNA, 14 bp, Homo sapiens
tttaaacaaattca

SEQ ID NO: 1162746 - DNA, 23 bp, Homo sapiens
tttaaacaaattcatattctgtc

SEQ ID NO: 1162747 - DNA, 16 bp, Homo sapiens
tttaaacatagaaagt

SEQ ID NO: 1162748 - DNA, 22 bp, Homo sapiens
tttaaacatatccaagtttgaa

SEQ ID NO: 1162749 - DNA, 15 bp, Homo sapiens
tttaaacattaatag

SEQ ID NO: 1162750 - DNA, 15 bp, Homo sapiens
tttaaacattatttt

SEQ ID NO: 1162751 - DNA, 20 bp, Homo sapiens
tttaaaccgctaaaagaaac

SEQ ID NO: 1162752 - DNA, 21 bp, Homo sapiens
tttaaaccgctaaaagaaact

SEQ ID NO: 1162753 - DNA, 22 bp, Homo sapiens
tttaaacctcacctttgtgggg

SEQ ID NO: 1162754 - DNA, 11 bp, Homo sapiens
tttaaaccttt

SEQ ID NO: 1162755 - DNA, 18 bp, Homo sapiens
tttaaaccttttattata

SEQ ID NO: 1162756 - DNA, 15 bp, Homo sapiens
tttaaacctttttct

SEQ ID NO: 1162757 - DNA, 16 bp, Homo sapiens
tttaaacctttttctt

SEQ ID NO: 1162758 - DNA, 18 bp, Homo sapiens
tttaaacgaagagacaga

SEQ ID NO: 1162759 - DNA, 18 bp, Homo sapiens
tttaaactaaattactgt

SEQ ID NO: 1162760 - DNA, 14 bp, Homo sapiens
tttaaactctgcca

SEQ ID NO: 1162761 - DNA, 15 bp, Homo sapiens
tttaaactgtgtaca

SEQ ID NO: 1162762 - DNA, 19 bp, Homo sapiens
tttaaactgtgtacataac

SEQ ID NO: 1162763 - DNA, 14 bp, Homo sapiens
tttaaacttgaaat

SEQ ID NO: 1162764 - DNA, 17 bp, Homo sapiens
tttaaagaaaagatgaa

SEQ ID NO: 1162765 - DNA, 21 bp, Homo sapiens
tttaaagaaaagatgaaaggc

SEQ ID NO: 1162766 - DNA, 16 bp, Homo sapiens
tttaaagaaagtgtat

SEQ ID NO: 1162767 - DNA, 12 bp, Homo sapiens
tttaaagaataa

SEQ ID NO: 1162768 - DNA, 21 bp, Homo sapiens
tttaaagacagggtcttgcta

SEQ ID NO: 1162769 - DNA, 15 bp, Homo sapiens
tttaaagagaggtta

SEQ ID NO: 1162770 - DNA, 15 bp, Homo sapiens
tttaaagcaggttct

SEQ ID NO: 1162771 - DNA, 18 bp, Homo sapiens
tttaaagcttactctgtc

SEQ ID NO: 1162772 - DNA, 15 bp, Homo sapiens
tttaaaggaaaaaat

SEQ ID NO: 1162773 - DNA, 19 bp, Homo sapiens
tttaaaggcccagccccta

SEQ ID NO: 1162774 - DNA, 23 bp, Homo sapiens
tttaaaggcccagcccctagaaa

SEQ ID NO: 1162775 - DNA, 22 bp, Homo sapiens
tttaaaggggcagaaaaactct

SEQ ID NO: 1162776 - DNA, 15 bp, Homo sapiens
tttaaagtaaacttg

SEQ ID NO: 1162777 - DNA, 20 bp, Homo sapiens
tttaaagtaaacttgtgtat

SEQ ID NO: 1162778 - DNA, 15 bp, Homo sapiens
tttaaagtatgcatt

SEQ ID NO: 1162779 - DNA, 21 bp, Homo sapiens
tttaaagtatgcattattaaa

SEQ ID NO: 1162780 - DNA, 19 bp, Homo sapiens
tttaaagtctaaactgtta

SEQ ID NO: 1162781 - DNA, 21 bp, Homo sapiens
tttaaagtttgttcacttaaa

SEQ ID NO: 1162782 - DNA, 20 bp, Homo sapiens
tttaaagttttatatgcata

SEQ ID NO: 1162783 - DNA, 16 bp, Homo sapiens
tttaaataaaaccctt

SEQ ID NO: 1162784 - DNA, 16 bp, Homo sapiens
tttaaataaaagcaca

SEQ ID NO: 1162785 - DNA, 17 bp, Homo sapiens
tttaaataaaagcacaa

SEQ ID NO: 1162786 - DNA, 15 bp, Homo sapiens
tttaaataaaattta

SEQ ID NO: 1162787 - DNA, 19 bp, Homo sapiens
tttaaataaacctataata

SEQ ID NO: 1162788 - DNA, 13 bp, Homo sapiens
tttaaataaagtt

SEQ ID NO: 1162789 - DNA, 16 bp, Homo sapiens
tttaaataaattaaga

SEQ ID NO: 1162790 - DNA, 12 bp, Homo sapiens
tttaaataacct

SEQ ID NO: 1162791 - DNA, 20 bp, Homo sapiens
tttaaataacctctggccct

SEQ ID NO: 1162792 - DNA, 14 bp, Homo sapiens
tttaaatagcctaa

SEQ ID NO: 1162793 - DNA, 12 bp, Homo sapiens
tttaaatataat

SEQ ID NO: 1162794 - DNA, 15 bp, Homo sapiens
tttaaatataattct

SEQ ID NO: 1162795 - DNA, 16 bp, Homo sapiens
tttaaatataattctg

SEQ ID NO: 1162796 - DNA, 21 bp, Homo sapiens
tttaaatataattctgtaaat

SEQ ID NO: 1162797 - DNA, 13 bp, Homo sapiens
tttaaatatttgt

SEQ ID NO: 1162798 - DNA, 13 bp, Homo sapiens
tttaaatattttc

SEQ ID NO: 1162799 - DNA, 14 bp, Homo sapiens
tttaaatattttct

SEQ ID NO: 1162800 - DNA, 15 bp, Homo sapiens
tttaaatattttcta

SEQ ID NO: 1162801 - DNA, 22 bp, Homo sapiens
tttaaatcaaggaaaggctcat

SEQ ID NO: 1162802 - DNA, 14 bp, Homo sapiens
tttaaatgaaagga

SEQ ID NO: 1162803 - DNA, 15 bp, Homo sapiens
tttaaatgcaacagt

SEQ ID NO: 1162804 - DNA, 19 bp, Homo sapiens
tttaaatgcatgtcttaaa

SEQ ID NO: 1162805 - DNA, 13 bp, Homo sapiens
tttaaatgtgaat

SEQ ID NO: 1162806 - DNA, 16 bp, Homo sapiens
tttaaattaatatctt

SEQ ID NO: 1162807 - DNA, 20 bp, Homo sapiens
tttaaattaatatctttctg

SEQ ID NO: 1162808 - DNA, 22 bp, Homo sapiens
tttaaattagaaaatattctct

SEQ ID NO: 1162809 - DNA, 20 bp, Homo sapiens
tttaaattccactgaaaatt

SEQ ID NO: 1162810 - DNA, 17 bp, Homo sapiens
tttaaattgtttcatat

SEQ ID NO: 1162811 - DNA, 14 bp, Homo sapiens
tttaaatttaagta

SEQ ID NO: 1162812 - DNA, 13 bp, Homo sapiens
tttaaatttgatt

SEQ ID NO: 1162813 - DNA, 18 bp, Homo sapiens
tttaaatttgatttccat

SEQ ID NO: 1162814 - DNA, 12 bp, Homo sapiens
tttaaattttta

SEQ ID NO: 1162815 - DNA, 23 bp, Homo sapiens
tttaacaaaaaacagattctata

SEQ ID NO: 1162816 - DNA, 18 bp, Homo sapiens
tttaacaataactactgt

SEQ ID NO: 1162817 - DNA, 21 bp, Homo sapiens
tttaacaatccattcacaagc

SEQ ID NO: 1162818 - DNA, 14 bp, Homo sapiens
tttaacaattgtct

SEQ ID NO: 1162819 - DNA, 19 bp, Homo sapiens
tttaacacaagtcctgtga

SEQ ID NO: 1162820 - DNA, 22 bp, Homo sapiens
tttaacacttctgtatgcatca

SEQ ID NO: 1162821 - DNA, 21 bp, Homo sapiens
tttaacactttgtattactta

SEQ ID NO: 1162822 - DNA, 13 bp, Homo sapiens
tttaacagaaatg

SEQ ID NO: 1162823 - DNA, 15 bp, Homo sapiens
tttaacagaaatgta

SEQ ID NO: 1162824 - DNA, 13 bp, Homo sapiens
tttaacagaaatt

SEQ ID NO: 1162825 - DNA, 14 bp, Homo sapiens
tttaacagaaattg

SEQ ID NO: 1162826 - DNA, 17 bp, Homo sapiens
tttaacagctgaattat

SEQ ID NO: 1162827 - DNA, 14 bp, Homo sapiens
tttaacagggtctc

SEQ ID NO: 1162828 - DNA, 21 bp, Homo sapiens
tttaacataatggttgtgaaa

SEQ ID NO: 1162829 - DNA, 18 bp, Homo sapiens
tttaacatacaagaaaat

SEQ ID NO: 1162830 - DNA, 16 bp, Homo sapiens
tttaacatctttgttt

SEQ ID NO: 1162831 - DNA, 16 bp, Homo sapiens
tttaacatgatttcaa

SEQ ID NO: 1162832 - DNA, 12 bp, Homo sapiens
tttaacattatt

SEQ ID NO: 1162833 - DNA, 22 bp, Homo sapiens
tttaacatttgccttgcagaac

SEQ ID NO: 1162834 - DNA, 12 bp, Homo sapiens
tttaaccaaagg

SEQ ID NO: 1162835 - DNA, 17 bp, Homo sapiens
tttaaccaaggaggggc

SEQ ID NO: 1162836 - DNA, 21 bp, Homo sapiens
tttaaccataaatcaattcat

SEQ ID NO: 1162837 - DNA, 21 bp, Homo sapiens
tttaaccattttaacctagat

SEQ ID NO: 1162838 - DNA, 13 bp, Homo sapiens
tattgtacataaa

SEQ ID NO: 1162839 - DNA, 15 bp, Homo sapiens
tattgtacataaaag

SEQ ID NO: 1162840 - DNA, 16 bp, Homo sapiens
tattgtacataaaaga

SEQ ID NO: 1162841 - DNA, 17 bp, Homo sapiens
tattgtacataaaagaa

SEQ ID NO: 1162842 - DNA, 13 bp, Homo sapiens
tattgtacctctc

SEQ ID NO: 1162843 - DNA, 14 bp, Homo sapiens
tattgtataaaaag

SEQ ID NO: 1162844 - DNA, 21 bp, Homo sapiens
tattgtataaactatcagttt

SEQ ID NO: 1162845 - DNA, 17 bp, Homo sapiens
tattgtatattacaatg

SEQ ID NO: 1162846 - DNA, 18 bp, Homo sapiens
tattgtatattctggaaa

SEQ ID NO: 1162847 - DNA, 19 bp, Homo sapiens
tattgtatattctggaaaa

SEQ ID NO: 1162848 - DNA, 13 bp, Homo sapiens
tattgtatgtaag

SEQ ID NO: 1162849 - DNA, 15 bp, Homo sapiens
tattgtatgtaagta

SEQ ID NO: 1162850 - DNA, 16 bp, Homo sapiens
tattgtattaggaaaa

SEQ ID NO: 1162851 - DNA, 15 bp, Homo sapiens
tattgtattatttgg

SEQ ID NO: 1162852 - DNA, 17 bp, Homo sapiens
tattgtccattgtccaa

SEQ ID NO: 1162853 - DNA, 20 bp, Homo sapiens
tattgtcccctttttagttt

SEQ ID NO: 1162854 - DNA, 18 bp, Homo sapiens
tattgtccttcagagctc

SEQ ID NO: 1162855 - DNA, 15 bp, Homo sapiens
tattgtctactctga

SEQ ID NO: 1162856 - DNA, 13 bp, Homo sapiens
tattgtctgtaaa

SEQ ID NO: 1162857 - DNA, 17 bp, Homo sapiens
tattgtgaagtacatat

SEQ ID NO: 1162858 - DNA, 13 bp, Homo sapiens
tattgtgaatgat

SEQ ID NO: 1162859 - DNA, 18 bp, Homo sapiens
tattgtgacttcactgta

SEQ ID NO: 1162860 - DNA, 19 bp, Homo sapiens
tattgtgcaatgtaaatat

SEQ ID NO: 1162861 - DNA, 17 bp, Homo sapiens
tattgtgtgttatttaa

SEQ ID NO: 1162862 - DNA, 19 bp, Homo sapiens
tattgtgtgttatttaaat

SEQ ID NO: 1162863 - DNA, 15 bp, Homo sapiens
tttaagaatatctgt

SEQ ID NO: 1162864 - DNA, 15 bp, Homo sapiens
tttaagaattgagta

SEQ ID NO: 1162865 - DNA, 22 bp, Homo sapiens
tttaagactgataattttacaa

SEQ ID NO: 1162866 - DNA, 11 bp, Homo sapiens
tttaagagaca

SEQ ID NO: 1162867 - DNA, 14 bp, Homo sapiens
tttaagagactctt

SEQ ID NO: 1162868 - DNA, 9 bp, Homo sapiens
tttaagata

SEQ ID NO: 1162869 - DNA, 20 bp, Homo sapiens
tttaagataatagtttacat

SEQ ID NO: 1162870 - DNA, 15 bp, Homo sapiens
tttaagataattata

SEQ ID NO: 1162871 - DNA, 19 bp, Homo sapiens
tttaagatatccatctttt

SEQ ID NO: 1162872 - DNA, 15 bp, Homo sapiens
tttaagatgtacatt

SEQ ID NO: 1162873 - DNA, 22 bp, Homo sapiens
tttaagatgtacatttaataat

SEQ ID NO: 1162874 - DNA, 20 bp, Homo sapiens
tttaagcactacataaactg

SEQ ID NO: 1162875 - DNA, 13 bp, Homo sapiens
tttaagcattgtt

SEQ ID NO: 1162876 - DNA, 14 bp, Homo sapiens
tttaagcattgttt

SEQ ID NO: 1162877 - DNA, 12 bp, Homo sapiens
tttaagccaaaa

SEQ ID NO: 1162878 - DNA, 17 bp, Homo sapiens
tttaagcctgcattctt

SEQ ID NO: 1162879 - DNA, 18 bp, Homo sapiens
tttaagcctgcattctta

SEQ ID NO: 1162880 - DNA, 16 bp, Homo sapiens
tttaagctccagcttt

SEQ ID NO: 1162881 - DNA, 20 bp, Homo sapiens
tttaagctccttgagtaaaa

SEQ ID NO: 1162882 - DNA, 11 bp, Homo sapiens
tttaagctgtt

SEQ ID NO: 1162883 - DNA, 12 bp, Homo sapiens
tttaaggaaaca

SEQ ID NO: 1162884 - DNA, 19 bp, Homo sapiens
tttaaggaatcaaatctta

SEQ ID NO: 1162885 - DNA, 18 bp, Homo sapiens
tttaaggctaaaacttaa

SEQ ID NO: 1162886 - DNA, 15 bp, Homo sapiens
tttaagggaaagaaa

SEQ ID NO: 1162887 - DNA, 23 bp, Homo sapiens
tttaaggtactaattaacttaaa

SEQ ID NO: 1162888 - DNA, 18 bp, Homo sapiens
tttaaggtattgtgcatc

SEQ ID NO: 1162889 - DNA, 17 bp, Homo sapiens
tttaaggtgaatgaaag

SEQ ID NO: 1162890 - DNA, 16 bp, Homo sapiens
tttaaggtttttactg

SEQ ID NO: 1162891 - DNA, 17 bp, Homo sapiens
tttaagtaaaaaagaaa

SEQ ID NO: 1162892 - DNA, 16 bp, Homo sapiens
tttaagtatggaatat

SEQ ID NO: 1162893 - DNA, 22 bp, Homo sapiens
tttaagtatggaatattcattt

SEQ ID NO: 1162894 - DNA, 15 bp, Homo sapiens
tttaagtattaactt

SEQ ID NO: 1162895 - DNA, 21 bp, Homo sapiens
tttaagtattgcatctgtata

SEQ ID NO: 1162896 - DNA, 12 bp, Homo sapiens
tttaagtattta

SEQ ID NO: 1162897 - DNA, 13 bp, Homo sapiens
tttaagtatttag

SEQ ID NO: 1162898 - DNA, 15 bp, Homo sapiens
tttaagtgaaaatgg

SEQ ID NO: 1162899 - DNA, 20 bp, Homo sapiens
tttaagtgaatacattaacg

SEQ ID NO: 1162900 - DNA, 12 bp, Homo sapiens
tttaagtgacat

SEQ ID NO: 1162901 - DNA, 23 bp, Homo sapiens
tttaagtgacataattgtccagt

SEQ ID NO: 1162902 - DNA, 14 bp, Homo sapiens
tttaagtgcttaca

SEQ ID NO: 1162903 - DNA, 19 bp, Homo sapiens
tttaagttcttatgaggag

SEQ ID NO: 1162904 - DNA, 11 bp, Homo sapiens
tttaagtttgt

SEQ ID NO: 1162905 - DNA, 12 bp, Homo sapiens
tttaagtttgtt

SEQ ID NO: 1162906 - DNA, 14 bp, Homo sapiens
tttaataaactact

SEQ ID NO: 1162907 - DNA, 13 bp, Homo sapiens
tttaataaacttt

SEQ ID NO: 1162908 - DNA, 15 bp, Homo sapiens
tttaataaagatgag

SEQ ID NO: 1162909 - DNA, 16 bp, Homo sapiens
tttaataaattgctta

SEQ ID NO: 1162910 - DNA, 22 bp, Homo sapiens
tttaataacaaggagatttctt

SEQ ID NO: 1162911 - DNA, 14 bp, Homo sapiens
tttaataacaattg

SEQ ID NO: 1162912 - DNA, 20 bp, Homo sapiens
tttaataagctactagcaaa

SEQ ID NO: 1162913 - DNA, 20 bp, Homo sapiens
tttaataattatttttaatt

SEQ ID NO: 1162914 - DNA, 11 bp, Homo sapiens
tttaataattt

SEQ ID NO: 1162915 - DNA, 17 bp, Homo sapiens
tttaatacaggaaattg

SEQ ID NO: 1162916 - DNA, 19 bp, Homo sapiens
tttaatagaatataattat

SEQ ID NO: 1162917 - DNA, 17 bp, Homo sapiens
tttaatagcaaagaatt

SEQ ID NO: 1162918 - DNA, 12 bp, Homo sapiens
tttaatagcact

SEQ ID NO: 1162919 - DNA, 13 bp, Homo sapiens
tttaatatcttca

SEQ ID NO: 1162920 - DNA, 20 bp, Homo sapiens
tttaatatgagcttcaatat

SEQ ID NO: 1162921 - DNA, 17 bp, Homo sapiens
tttaatattactgtctt

SEQ ID NO: 1162922 - DNA, 21 bp, Homo sapiens
tttaatattactgtctttatt

SEQ ID NO: 1162923 - DNA, 20 bp, Homo sapiens
tttaatattccagaagaaca

SEQ ID NO: 1162924 - DNA, 21 bp, Homo sapiens
tttaatattcttttgtttcca

SEQ ID NO: 1162925 - DNA, 15 bp, Homo sapiens
tttaatattgagaaa

SEQ ID NO: 1162926 - DNA, 13 bp, Homo sapiens
tttaatatttaaa

SEQ ID NO: 1162927 - DNA, 18 bp, Homo sapiens
tttaatattttgtaatat

SEQ ID NO: 1162928 - DNA, 20 bp, Homo sapiens
tttaatcatgaatatgatga

SEQ ID NO: 1162929 - DNA, 14 bp, Homo sapiens
tttaatcccaggaa

SEQ ID NO: 1162930 - DNA, 20 bp, Homo sapiens
tttaatcccattgcaaacat

SEQ ID NO: 1162931 - DNA, 12 bp, Homo sapiens
tttaatcccctg

SEQ ID NO: 1162932 - DNA, 17 bp, Homo sapiens
tttaatcccctgcacta

SEQ ID NO: 1162933 - DNA, 16 bp, Homo sapiens
tttaatctaaaatgat

SEQ ID NO: 1162934 - DNA, 19 bp, Homo sapiens
tttaatctctctctctttt

SEQ ID NO: 1162935 - DNA, 18 bp, Homo sapiens
tttaatctgttatgtact

SEQ ID NO: 1162936 - DNA, 23 bp, Homo sapiens
tttaatgaaagactgtacaaagt

SEQ ID NO: 1162937 - DNA, 16 bp, Homo sapiens
tttaatgaacaaatgg

SEQ ID NO: 1162938 - DNA, 23 bp, Homo sapiens
tttaatgatctcggatgaccaaa

SEQ ID NO: 1162939 - DNA, 22 bp, Homo sapiens
tttaatgatggtgttaaagctg

SEQ ID NO: 1162940 - DNA, 18 bp, Homo sapiens
tttaatgcattaaacctg

SEQ ID NO: 1162941 - DNA, 23 bp, Homo sapiens
tttaatgccgatatactctagat

SEQ ID NO: 1162942 - DNA, 12 bp, Homo sapiens
tttaatgctgcc

SEQ ID NO: 1162943 - DNA, 14 bp, Homo sapiens
tttaatgctgcctt

SEQ ID NO: 1162944 - DNA, 19 bp, Homo sapiens
tttaatgctgtctttgtgg

SEQ ID NO: 1162945 - DNA, 19 bp, Homo sapiens
tttaatgcttcattcaata

SEQ ID NO: 1162946 - DNA, 18 bp, Homo sapiens
tttaatggtgatggggta

SEQ ID NO: 1162947 - DNA, 14 bp, Homo sapiens
tttaatgtacaagt

SEQ ID NO: 1162948 - DNA, 20 bp, Homo sapiens
tttaatgtatatttgctgca

SEQ ID NO: 1162949 - DNA, 21 bp, Homo sapiens
tttaatgtatatttgctgcaa

SEQ ID NO: 1162950 - DNA, 15 bp, Homo sapiens
tttaatgtatctatt

SEQ ID NO: 1162951 - DNA, 21 bp, Homo sapiens
tttaatgtatctatttgtaca

SEQ ID NO: 1162952 - DNA, 13 bp, Homo sapiens
tttaatgtctgtt

SEQ ID NO: 1162953 - DNA, 12 bp, Homo sapiens
tttaatgtgaat

SEQ ID NO: 1162954 - DNA, 16 bp, Homo sapiens
tttaatgttcacattt

SEQ ID NO: 1162955 - DNA, 17 bp, Homo sapiens
tttaatgttcattttct

SEQ ID NO: 1162956 - DNA, 23 bp, Homo sapiens
tttaatgtttattatttacatca

SEQ ID NO: 1162957 - DNA, 15 bp, Homo sapiens
tttaatgttttaaat

SEQ ID NO: 1162958 - DNA, 18 bp, Homo sapiens
tttaatgttttaaatgta

SEQ ID NO: 1162959 - DNA, 14 bp, Homo sapiens
tttaatgttttctg

SEQ ID NO: 1162960 - DNA, 13 bp, Homo sapiens
tttaattaaataa

SEQ ID NO: 1162961 - DNA, 22 bp, Homo sapiens
tatttacgctttgattcatagt

SEQ ID NO: 1162962 - DNA, 19 bp, Homo sapiens
tatttactaactaaatacc

SEQ ID NO: 1162963 - DNA, 13 bp, Homo sapiens
tatttactctttg

SEQ ID NO: 1162964 - DNA, 19 bp, Homo sapiens
tatttactgagcttctctg

SEQ ID NO: 1162965 - DNA, 23 bp, Homo sapiens
tatttactgagcttctctgtgaa

SEQ ID NO: 1162966 - DNA, 23 bp, Homo sapiens
tatttacttttaccactatttaa

SEQ ID NO: 1162967 - DNA, 20 bp, Homo sapiens
tatttagacaagagatggga

SEQ ID NO: 1162968 - DNA, 20 bp, Homo sapiens
tatttagatctcctgtattc

SEQ ID NO: 1162969 - DNA, 22 bp, Homo sapiens
tatttagccattacccacgtga

SEQ ID NO: 1162970 - DNA, 19 bp, Homo sapiens
tatttagctctgtggaatt

SEQ ID NO: 1162971 - DNA, 15 bp, Homo sapiens
tatttaggaaacacc

SEQ ID NO: 1162972 - DNA, 16 bp, Homo sapiens
tatttaggaaacacca

SEQ ID NO: 1162973 - DNA, 18 bp, Homo sapiens
tatttaggaaacaccatt

SEQ ID NO: 1162974 - DNA, 17 bp, Homo sapiens
tatttaggcagattgaa

SEQ ID NO: 1162975 - DNA, 23 bp, Homo sapiens
tatttaggtttttggctgagtac

SEQ ID NO: 1162976 - DNA, 19 bp, Homo sapiens
tatttagttacgtataatg

SEQ ID NO: 1162977 - DNA, 22 bp, Homo sapiens
tatttagttgtaaaccaagtga

SEQ ID NO: 1162978 - DNA, 16 bp, Homo sapiens
tatttataaatatatt

SEQ ID NO: 1162979 - DNA, 20 bp, Homo sapiens
tatttataactcatcataaa

SEQ ID NO: 1162980 - DNA, 23 bp, Homo sapiens
tatttataactcatcataaaata

SEQ ID NO: 1162981 - DNA, 17 bp, Homo sapiens
tatttataagcagattt

SEQ ID NO: 1162982 - DNA, 16 bp, Homo sapiens
tatttataatacagaa

SEQ ID NO: 1162983 - DNA, 20 bp, Homo sapiens
tatttataatacagaatctt

SEQ ID NO: 1162984 - DNA, 22 bp, Homo sapiens
tatttataatagcaacttttgt

SEQ ID NO: 1162985 - DNA, 17 bp, Homo sapiens
tatttataatttaaatg

SEQ ID NO: 1162986 - DNA, 20 bp, Homo sapiens
tatttatacaagattgaaaa

SEQ ID NO: 1162987 - DNA, 23 bp, Homo sapiens
tatttatactctagaacatgcac

SEQ ID NO: 1162988 - DNA, 23 bp, Homo sapiens
tatttataggccagggcatgtgt

SEQ ID NO: 1162989 - DNA, 13 bp, Homo sapiens
tatttatataaat

SEQ ID NO: 1162990 - DNA, 16 bp, Homo sapiens
tatttatatatatgat

SEQ ID NO: 1162991 - DNA, 14 bp, Homo sapiens
tttaattttttact

SEQ ID NO: 1162992 - DNA, 18 bp, Homo sapiens
tttaattttttctctttg

SEQ ID NO: 1162993 - DNA, 16 bp, Homo sapiens
tttacaaaaatataaa

SEQ ID NO: 1162994 - DNA, 13 bp, Homo sapiens
tttacaaaactgc

SEQ ID NO: 1162995 - DNA, 21 bp, Homo sapiens
tttacaaacatggaaaacaga

SEQ ID NO: 1162996 - DNA, 20 bp, Homo sapiens
tttacaacataatctagttt

SEQ ID NO: 1162997 - DNA, 16 bp, Homo sapiens
tttacaactaaataac

SEQ ID NO: 1162998 - DNA, 20 bp, Homo sapiens
tttacaacttgattttttca

SEQ ID NO: 1162999 - DNA, 21 bp, Homo sapiens
tttacaacttgattttttcaa

SEQ ID NO: 1163000 - DNA, 12 bp, Homo sapiens
tttacaagaaaa

SEQ ID NO: 1163001 - DNA, 21 bp, Homo sapiens
tttacaagaagtttattctca

SEQ ID NO: 1163002 - DNA, 15 bp, Homo sapiens
tttacaagccccccc

SEQ ID NO: 1163003 - DNA, 20 bp, Homo sapiens
tttacaagggcataaagtaa

SEQ ID NO: 1163004 - DNA, 21 bp, Homo sapiens
tttacaatcagccacattcta

SEQ ID NO: 1163005 - DNA, 23 bp, Homo sapiens
tttacaatgatgccgaacattag

SEQ ID NO: 1163006 - DNA, 15 bp, Homo sapiens
tttacaatgtattaa

SEQ ID NO: 1163007 - DNA, 18 bp, Homo sapiens
tttacaatttacaaagtg

SEQ ID NO: 1163008 - DNA, 19 bp, Homo sapiens
tttacaattttttatcatg

SEQ ID NO: 1163009 - DNA, 22 bp, Homo sapiens
tttacacactgtacacataagc

SEQ ID NO: 1163010 - DNA, 15 bp, Homo sapiens
tttacacgcttttgt

SEQ ID NO: 1163011 - DNA, 16 bp, Homo sapiens
tttacacgcttttgtg

SEQ ID NO: 1163012 - DNA, 17 bp, Homo sapiens
tttacacgcttttgtga

SEQ ID NO: 1163013 - DNA, 22 bp, Homo sapiens
tttacactaatatatggaccta

SEQ ID NO: 1163014 - DNA, 22 bp, Homo sapiens
tttacactcaggctttcactat

SEQ ID NO: 1163015 - DNA, 14 bp, Homo sapiens
tttacactggtcta

SEQ ID NO: 1163016 - DNA, 13 bp, Homo sapiens
tttacagaaatgg

SEQ ID NO: 1163017 - DNA, 17 bp, Homo sapiens
tttacagaagaaaagca

SEQ ID NO: 1163018 - DNA, 15 bp, Homo sapiens
tttacagcactactc

SEQ ID NO: 1163019 - DNA, 19 bp, Homo sapiens
tttacagcattgtctttgc

SEQ ID NO: 1163020 - DNA, 20 bp, Homo sapiens
tttacagcattgtctttgct

SEQ ID NO: 1163021 - DNA, 21 bp, Homo sapiens
tttacagctcattaaactttt

SEQ ID NO: 1163022 - DNA, 23 bp, Homo sapiens
tttacagctcttggcattttcct

SEQ ID NO: 1163023 - DNA, 13 bp, Homo sapiens
tttacagctgcct

SEQ ID NO: 1163024 - DNA, 22 bp, Homo sapiens
tttacaggaaaaaaaattctgt

SEQ ID NO: 1163025 - DNA, 19 bp, Homo sapiens
tttacaggaacttcatcat

SEQ ID NO: 1163026 - DNA, 19 bp, Homo sapiens
tttacaggccctgctcctg

SEQ ID NO: 1163027 - DNA, 17 bp, Homo sapiens
tttacaggtttgaatta

SEQ ID NO: 1163028 - DNA, 22 bp, Homo sapiens
tttacagtctctttcttccttt

SEQ ID NO: 1163029 - DNA, 20 bp, Homo sapiens
tttacagtgaagaaagcctg

SEQ ID NO: 1163030 - DNA, 13 bp, Homo sapiens
tttacagtgagga

SEQ ID NO: 1163031 - DNA, 22 bp, Homo sapiens
tttacagtttgtgttttaaaaa

SEQ ID NO: 1163032 - DNA, 14 bp, Homo sapiens
tttacataaagact

SEQ ID NO: 1163033 - DNA, 21 bp, Homo sapiens
tttacatacactgtatgttat

SEQ ID NO: 1163034 - DNA, 23 bp, Homo sapiens
tttacatagtctgaagtgaagta

SEQ ID NO: 1163035 - DNA, 20 bp, Homo sapiens
tttacatagtgcaaaactgt

SEQ ID NO: 1163036 - DNA, 20 bp, Homo sapiens
tttacatgcaatttattaaa

SEQ ID NO: 1163037 - DNA, 20 bp, Homo sapiens
tttacatggcgccctgcctc

SEQ ID NO: 1163038 - DNA, 13 bp, Homo sapiens
tttacattatgca

SEQ ID NO: 1163039 - DNA, 14 bp, Homo sapiens
tttacattatgcaa

SEQ ID NO: 1163040 - DNA, 16 bp, Homo sapiens
tttacattcaactttt

SEQ ID NO: 1163041 - DNA, 16 bp, Homo sapiens
tttacattctgtgtgt

SEQ ID NO: 1163042 - DNA, 13 bp, Homo sapiens
tttacattttata

SEQ ID NO: 1163043 - DNA, 18 bp, Homo sapiens
tttaccaaaaaccatgtt

SEQ ID NO: 1163044 - DNA, 21 bp, Homo sapiens
tttaccaaagagatattgata

SEQ ID NO: 1163045 - DNA, 11 bp, Homo sapiens
tttaccaaagc

SEQ ID NO: 1163046 - DNA, 15 bp, Homo sapiens
tttaccataatctta

SEQ ID NO: 1163047 - DNA, 21 bp, Homo sapiens
tttaccatgctcaatgaaaag

SEQ ID NO: 1163048 - DNA, 20 bp, Homo sapiens
tttaccatttgtaataaagt

SEQ ID NO: 1163049 - DNA, 16 bp, Homo sapiens
tttacccacctagaac

SEQ ID NO: 1163050 - DNA, 18 bp, Homo sapiens
tttacccctgcacagttt

SEQ ID NO: 1163051 - DNA, 13 bp, Homo sapiens
tttacccttcagg

SEQ ID NO: 1163052 - DNA, 13 bp, Homo sapiens
tttacccttggct

SEQ ID NO: 1163053 - DNA, 19 bp, Homo sapiens
tttacctctctgtcatgtg

SEQ ID NO: 1163054 - DNA, 22 bp, Homo sapiens
tttacctggcagtggctctcag

SEQ ID NO: 1163055 - DNA, 23 bp, Homo sapiens
tttacctggcagtggctctcaga

SEQ ID NO: 1163056 - DNA, 21 bp, Homo sapiens
tttacctggcttatttaatat

SEQ ID NO: 1163057 - DNA, 18 bp, Homo sapiens
tttaccttcaaactttag

SEQ ID NO: 1163058 - DNA, 13 bp, Homo sapiens
tttaccttctaaa

SEQ ID NO: 1163059 - DNA, 16 bp, Homo sapiens
tttaccttttctataa

SEQ ID NO: 1163060 - DNA, 20 bp, Homo sapiens
tttaccttttttatacataa

SEQ ID NO: 1163061 - DNA, 20 bp, Homo sapiens
tttacgatctgtttccaaat

SEQ ID NO: 1163062 - DNA, 20 bp, Homo sapiens
tttacgtgcaaacaacctga

SEQ ID NO: 1163063 - DNA, 20 bp, Homo sapiens
tttactaaagatatcagagc

SEQ ID NO: 1163064 - DNA, 14 bp, Homo sapiens
tttactaactaaat

SEQ ID NO: 1163065 - DNA, 22 bp, Homo sapiens
tttactaagccacaagaaattt

SEQ ID NO: 1163066 - DNA, 14 bp, Homo sapiens
tttactaatagaca

SEQ ID NO: 1163067 - DNA, 17 bp, Homo sapiens
tttactaatagacaatt

SEQ ID NO: 1163068 - DNA, 18 bp, Homo sapiens
tttactaatagacaattt

SEQ ID NO: 1163069 - DNA, 12 bp, Homo sapiens
tttactactgtg

SEQ ID NO: 1163070 - DNA, 23 bp, Homo sapiens
tttactagggatccctcatctgt

SEQ ID NO: 1163071 - DNA, 12 bp, Homo sapiens
tttactatcatt

SEQ ID NO: 1163072 - DNA, 13 bp, Homo sapiens
tttactccccttg

SEQ ID NO: 1163073 - DNA, 18 bp, Homo sapiens
tttactccccttgagctg

SEQ ID NO: 1163074 - DNA, 12 bp, Homo sapiens
tttactctgtgt

SEQ ID NO: 1163075 - DNA, 15 bp, Homo sapiens
tttactctgtgttta

SEQ ID NO: 1163076 - DNA, 19 bp, Homo sapiens
tttactctgtgtttaaaaa

SEQ ID NO: 1163077 - DNA, 13 bp, Homo sapiens
tttactcttaaat

SEQ ID NO: 1163078 - DNA, 12 bp, Homo sapiens
tttactgaatgt

SEQ ID NO: 1163079 - DNA, 13 bp, Homo sapiens
tttactgcttttc

SEQ ID NO: 1163080 - DNA, 16 bp, Homo sapiens
tttactgcttttcatt

SEQ ID NO: 1163081 - DNA, 16 bp, Homo sapiens
tttactggttgcatgg

SEQ ID NO: 1163082 - DNA, 13 bp, Homo sapiens
tatttctattatt

SEQ ID NO: 1163083 - DNA, 11 bp, Homo sapiens
tatttctattc

SEQ ID NO: 1163084 - DNA, 20 bp, Homo sapiens
tatttctcattgcctcttct

SEQ ID NO: 1163085 - DNA, 15 bp, Homo sapiens
tatttctccagaccc

SEQ ID NO: 1163086 - DNA, 16 bp, Homo sapiens
tatttctctctcctgg

SEQ ID NO: 1163087 - DNA, 18 bp, Homo sapiens
tatttctctctcctggtg

SEQ ID NO: 1163088 - DNA, 15 bp, Homo sapiens
tatttctctggcaaa

SEQ ID NO: 1163089 - DNA, 14 bp, Homo sapiens
tatttctgaaggta

SEQ ID NO: 1163090 - DNA, 19 bp, Homo sapiens
tatttctgatttcataatt

SEQ ID NO: 1163091 - DNA, 22 bp, Homo sapiens
tatttctgatttcataattcag

SEQ ID NO: 1163092 - DNA, 17 bp, Homo sapiens
tatttctgcatatgttg

SEQ ID NO: 1163093 - DNA, 13 bp, Homo sapiens
tatttctgctctg

SEQ ID NO: 1163094 - DNA, 16 bp, Homo sapiens
tatttctgtatatttg

SEQ ID NO: 1163095 - DNA, 17 bp, Homo sapiens
tatttctgtatatttgt

SEQ ID NO: 1163096 - DNA, 19 bp, Homo sapiens
tatttctgtgtacacatct

SEQ ID NO: 1163097 - DNA, 21 bp, Homo sapiens
tatttctgttcttacaaatgt

SEQ ID NO: 1163098 - DNA, 23 bp, Homo sapiens
tatttcttaattattataaaaat

SEQ ID NO: 1163099 - DNA, 14 bp, Homo sapiens
tatttcttcacaaa

SEQ ID NO: 1163100 - DNA, 22 bp, Homo sapiens
tatttcttcctaccaagtcaaa

SEQ ID NO: 1163101 - DNA, 19 bp, Homo sapiens
tatttcttcgttcttttta

SEQ ID NO: 1163102 - DNA, 22 bp, Homo sapiens
tatttcttctcttatcctctct

SEQ ID NO: 1163103 - DNA, 23 bp, Homo sapiens
tatttcttcttctaagaagacat

SEQ ID NO: 1163104 - DNA, 14 bp, Homo sapiens
tatttcttgctttc

SEQ ID NO: 1163105 - DNA, 16 bp, Homo sapiens
tatttctttaaacctt

SEQ ID NO: 1163106 - DNA, 13 bp, Homo sapiens
tatttctttgtta

SEQ ID NO: 1163107 - DNA, 16 bp, Homo sapiens
tatttcttttgttgta

SEQ ID NO: 1163108 - DNA, 20 bp, Homo sapiens
tatttgaaaacatgtttatt

SEQ ID NO: 1163109 - DNA, 19 bp, Homo sapiens
tatttgaaaattacatgtt

SEQ ID NO: 1163110 - DNA, 19 bp, Homo sapiens
tatttgaaactgaatgttt

SEQ ID NO: 1163111 - DNA, 15 bp, Homo sapiens
tatttgaacaagtgg

SEQ ID NO: 1163112 - DNA, 21 bp, Homo sapiens
tatttgaacatgtgccttttc

SEQ ID NO: 1163113 - DNA, 22 bp, Homo sapiens
tatttgaacatgtgccttttct

SEQ ID NO: 1163114 - DNA, 12 bp, Homo sapiens
tatttgaagaaa

SEQ ID NO: 1163115 - DNA, 17 bp, Homo sapiens
tatttgaagaaaaaaat

SEQ ID NO: 1163116 - DNA, 23 bp, Homo sapiens
tatttgaataatgacagatggtg

SEQ ID NO: 1163117 - DNA, 19 bp, Homo sapiens
tatttgaatgaaaacattt

SEQ ID NO: 1163118 - DNA, 23 bp, Homo sapiens
tttagactgtggccatatatgct

SEQ ID NO: 1163119 - DNA, 21 bp, Homo sapiens
tttagagaaaataaatttaac

SEQ ID NO: 1163120 - DNA, 18 bp, Homo sapiens
tttagagttgatactaca

SEQ ID NO: 1163121 - DNA, 15 bp, Homo sapiens
tttagataatacacc

SEQ ID NO: 1163122 - DNA, 18 bp, Homo sapiens
tttagataatttgaaaaa

SEQ ID NO: 1163123 - DNA, 14 bp, Homo sapiens
tttagatagccctg

SEQ ID NO: 1163124 - DNA, 17 bp, Homo sapiens
tttagatctcctgtatt

SEQ ID NO: 1163125 - DNA, 21 bp, Homo sapiens
tttagcactatttaaaataag

SEQ ID NO: 1163126 - DNA, 13 bp, Homo sapiens
tttagcagcactt

SEQ ID NO: 1163127 - DNA, 18 bp, Homo sapiens
tttagcagcacttttgat

SEQ ID NO: 1163128 - DNA, 18 bp, Homo sapiens
tttagcagttctgcaaat

SEQ ID NO: 1163129 - DNA, 17 bp, Homo sapiens
tttagcataaaagaata

SEQ ID NO: 1163130 - DNA, 19 bp, Homo sapiens
tttagcataaaagaatatt

SEQ ID NO: 1163131 - DNA, 16 bp, Homo sapiens
tttagcataaaatttt

SEQ ID NO: 1163132 - DNA, 23 bp, Homo sapiens
tttagcatgacaagccccaggca

SEQ ID NO: 1163133 - DNA, 14 bp, Homo sapiens
tttagcatgttgtt

SEQ ID NO: 1163134 - DNA, 19 bp, Homo sapiens
tttagcattttaattctct

SEQ ID NO: 1163135 - DNA, 11 bp, Homo sapiens
tttagccagtg

SEQ ID NO: 1163136 - DNA, 19 bp, Homo sapiens
tttagccataattttgcat

SEQ ID NO: 1163137 - DNA, 13 bp, Homo sapiens
tttagccattacc

SEQ ID NO: 1163138 - DNA, 16 bp, Homo sapiens
tttagccctgaacatt

SEQ ID NO: 1163139 - DNA, 15 bp, Homo sapiens
tttagcctagttcat

SEQ ID NO: 1163140 - DNA, 20 bp, Homo sapiens
tttagctacctttttatatt

SEQ ID NO: 1163141 - DNA, 17 bp, Homo sapiens
tttagctagtatcttca

SEQ ID NO: 1163142 - DNA, 19 bp, Homo sapiens
tttagctagtatcttcaaa

SEQ ID NO: 1163143 - DNA, 14 bp, Homo sapiens
tttagctattactg

SEQ ID NO: 1163144 - DNA, 13 bp, Homo sapiens
tttagctgaggga

SEQ ID NO: 1163145 - DNA, 23 bp, Homo sapiens
tttagctgatgaacttattctgt

SEQ ID NO: 1163146 - DNA, 23 bp, Homo sapiens
tttagcttcagttgttctttaga

SEQ ID NO: 1163147 - DNA, 14 bp, Homo sapiens
tttagcttttcctt

SEQ ID NO: 1163148 - DNA, 21 bp, Homo sapiens
tttaggaaatgggcagtgaag

SEQ ID NO: 1163149 - DNA, 18 bp, Homo sapiens
tttaggaagcaagcttaa

SEQ ID NO: 1163150 - DNA, 17 bp, Homo sapiens
tttaggagattttaggt

SEQ ID NO: 1163151 - DNA, 20 bp, Homo sapiens
tttaggcagcctgccgccgt

SEQ ID NO: 1163152 - DNA, 16 bp, Homo sapiens
tttagggaacaatttg

SEQ ID NO: 1163153 - DNA, 20 bp, Homo sapiens
tttagggctgtaaaatgcat

SEQ ID NO: 1163154 - DNA, 19 bp, Homo sapiens
tttaggggtgttgacacac

SEQ ID NO: 1163155 - DNA, 14 bp, Homo sapiens
tttagggtgggtaa

SEQ ID NO: 1163156 - DNA, 18 bp, Homo sapiens
tttagggtgggtaagaaa

SEQ ID NO: 1163157 - DNA, 22 bp, Homo sapiens
tttaggtgttgattttctgttg

SEQ ID NO: 1163158 - DNA, 15 bp, Homo sapiens
tttaggttgttacca

SEQ ID NO: 1163159 - DNA, 16 bp, Homo sapiens
tttagtaaatgttatc

SEQ ID NO: 1163160 - DNA, 21 bp, Homo sapiens
tttagtagcagtgattgtctt

SEQ ID NO: 1163161 - DNA, 17 bp, Homo sapiens
tttagtatccacaggat

SEQ ID NO: 1163162 - DNA, 21 bp, Homo sapiens
tttagtattcattctgcattg

SEQ ID NO: 1163163 - DNA, 20 bp, Homo sapiens
tttagtattctcttgtgcat

SEQ ID NO: 1163164 - DNA, 17 bp, Homo sapiens
tttagtcactaagactt

SEQ ID NO: 1163165 - DNA, 17 bp, Homo sapiens
tttagtctttagctatt

SEQ ID NO: 1163166 - DNA, 17 bp, Homo sapiens
tttagtgactgtaatta

SEQ ID NO: 1163167 - DNA, 17 bp, Homo sapiens
tttagtggatggaatat

SEQ ID NO: 1163168 - DNA, 15 bp, Homo sapiens
tttagtgtacattta

SEQ ID NO: 1163169 - DNA, 22 bp, Homo sapiens
tttagtgtgaatattcctttat

SEQ ID NO: 1163170 - DNA, 19 bp, Homo sapiens
tttagtgtgtgtgcagagt

SEQ ID NO: 1163171 - DNA, 20 bp, Homo sapiens
tttagtgtttttttatttct

SEQ ID NO: 1163172 - DNA, 19 bp, Homo sapiens
tttagttacgtataatgct

SEQ ID NO: 1163173 - DNA, 21 bp, Homo sapiens
tttagttacgtataatgcttt

SEQ ID NO: 1163174 - DNA, 13 bp, Homo sapiens
tttagttatagtt

SEQ ID NO: 1163175 - DNA, 14 bp, Homo sapiens
tttagttatagttt

SEQ ID NO: 1163176 - DNA, 11 bp, Homo sapiens
tttagttcttt

SEQ ID NO: 1163177 - DNA, 19 bp, Homo sapiens
tttagttgcagaaacattt

SEQ ID NO: 1163178 - DNA, 17 bp, Homo sapiens
tttagttgccaacagtt

SEQ ID NO: 1163179 - DNA, 20 bp, Homo sapiens
tttagttgtatctcttttga

SEQ ID NO: 1163180 - DNA, 22 bp, Homo sapiens
tttagttttaaaagtctatgat

SEQ ID NO: 1163181 - DNA, 12 bp, Homo sapiens
tttagttttaca

SEQ ID NO: 1163182 - DNA, 15 bp, Homo sapiens
tttagttttctctta

SEQ ID NO: 1163183 - DNA, 21 bp, Homo sapiens
tttagttttgtaacttagctt

SEQ ID NO: 1163184 - DNA, 13 bp, Homo sapiens
tttagtttttcat

SEQ ID NO: 1163185 - DNA, 19 bp, Homo sapiens
tttataaaaatataaattg

SEQ ID NO: 1163186 - DNA, 12 bp, Homo sapiens
tttataaacaga

SEQ ID NO: 1163187 - DNA, 23 bp, Homo sapiens
tttataaacagacaatatgtgag

SEQ ID NO: 1163188 - DNA, 14 bp, Homo sapiens
tttataaactttac

SEQ ID NO: 1163189 - DNA, 14 bp, Homo sapiens
tttataaaggtctg

SEQ ID NO: 1163190 - DNA, 20 bp, Homo sapiens
tttataaataaaatcatgta

SEQ ID NO: 1163191 - DNA, 20 bp, Homo sapiens
tttataaataaactgttgct

SEQ ID NO: 1163192 - DNA, 15 bp, Homo sapiens
tttataaataacaaa

SEQ ID NO: 1163193 - DNA, 20 bp, Homo sapiens
tttataaatactgcaaatca

SEQ ID NO: 1163194 - DNA, 17 bp, Homo sapiens
tttataaatatcatgca

SEQ ID NO: 1163195 - DNA, 13 bp, Homo sapiens
tttataaatccaa

SEQ ID NO: 1163196 - DNA, 12 bp, Homo sapiens
tttataaatgct

SEQ ID NO: 1163197 - DNA, 13 bp, Homo sapiens
tttataaattaaa

SEQ ID NO: 1163198 - DNA, 18 bp, Homo sapiens
tttataaattaaatatat

SEQ ID NO: 1163199 - DNA, 20 bp, Homo sapiens
tttataacatctttattgaa

SEQ ID NO: 1163200 - DNA, 17 bp, Homo sapiens
tttataaccccagcctg

SEQ ID NO: 1163201 - DNA, 19 bp, Homo sapiens
tttataaccccagcctgac

SEQ ID NO: 1163202 - DNA, 18 bp, Homo sapiens
tttataacctgatgccat

SEQ ID NO: 1163203 - DNA, 22 bp, Homo sapiens
tttataaccttgttctctgctt

SEQ ID NO: 1163204 - DNA, 20 bp, Homo sapiens
tattttatttagacaagaga

SEQ ID NO: 1163205 - DNA, 15 bp, Homo sapiens
tattttatttcaatg

SEQ ID NO: 1163206 - DNA, 13 bp, Homo sapiens
tattttatttgct

SEQ ID NO: 1163207 - DNA, 15 bp, Homo sapiens
tattttcaaagagat

SEQ ID NO: 1163208 - DNA, 19 bp, Homo sapiens
tattttcaacgcagccctg

SEQ ID NO: 1163209 - DNA, 11 bp, Homo sapiens
tattttcaaga

SEQ ID NO: 1163210 - DNA, 16 bp, Homo sapiens
tattttcaagaaaaga

SEQ ID NO: 1163211 - DNA, 19 bp, Homo sapiens
tattttcagtatactgtgt

SEQ ID NO: 1163212 - DNA, 13 bp, Homo sapiens
tattttcatagtg

SEQ ID NO: 1163213 - DNA, 13 bp, Homo sapiens
tattttcatttgt

SEQ ID NO: 1163214 - DNA, 14 bp, Homo sapiens
tattttcatttgta

SEQ ID NO: 1163215 - DNA, 11 bp, Homo sapiens
tattttccagg

SEQ ID NO: 1163216 - DNA, 18 bp, Homo sapiens
tattttcccccttttctg

SEQ ID NO: 1163217 - DNA, 20 bp, Homo sapiens
tattttccctacttgcagcg

SEQ ID NO: 1163218 - DNA, 14 bp, Homo sapiens
tattttcctggatt

SEQ ID NO: 1163219 - DNA, 15 bp, Homo sapiens
tattttcctggattt

SEQ ID NO: 1163220 - DNA, 18 bp, Homo sapiens
tattttcctggatttata

SEQ ID NO: 1163221 - DNA, 19 bp, Homo sapiens
tattttccttgcttttctt

SEQ ID NO: 1163222 - DNA, 20 bp, Homo sapiens
tattttctatcccccttaaa

SEQ ID NO: 1163223 - DNA, 22 bp, Homo sapiens
tattttctggtagatagaaata

SEQ ID NO: 1163224 - DNA, 14 bp, Homo sapiens
tattttctgtcaga

SEQ ID NO: 1163225 - DNA, 21 bp, Homo sapiens
tattttctgtgcctgaatatt

SEQ ID NO: 1163226 - DNA, 14 bp, Homo sapiens
tattttctgttcta

SEQ ID NO: 1163227 - DNA, 14 bp, Homo sapiens
tattttctttgaaa

SEQ ID NO: 1163228 - DNA, 12 bp, Homo sapiens
tattttgaaatt

SEQ ID NO: 1163229 - DNA, 13 bp, Homo sapiens
tattttgaatcaa

SEQ ID NO: 1163230 - DNA, 22 bp, Homo sapiens
tattttgaatcaataatatatt

SEQ ID NO: 1163231 - DNA, 23 bp, Homo sapiens
tattttgaatcaataatatattt

SEQ ID NO: 1163232 - DNA, 16 bp, Homo sapiens
tattttgaatgtcaca

SEQ ID NO: 1163233 - DNA, 17 bp, Homo sapiens
tattttgaatgtcacaa

SEQ ID NO: 1163234 - DNA, 17 bp, Homo sapiens
tattttgacactggtat

SEQ ID NO: 1163235 - DNA, 12 bp, Homo sapiens
tattttgatcac

SEQ ID NO: 1163236 - DNA, 13 bp, Homo sapiens
tattttgcatact

SEQ ID NO: 1163237 - DNA, 16 bp, Homo sapiens
tattttgctccctctg

SEQ ID NO: 1163238 - DNA, 14 bp, Homo sapiens
tattttgctgagtt

SEQ ID NO: 1163239 - DNA, 18 bp, Homo sapiens
tattttgctgagttgttc

SEQ ID NO: 1163240 - DNA, 21 bp, Homo sapiens
tattttgctgagttgttctaa

SEQ ID NO: 1163241 - DNA, 13 bp, Homo sapiens
tattttgctttgt

SEQ ID NO: 1163242 - DNA, 12 bp, Homo sapiens
tattttggaaac

SEQ ID NO: 1163243 - DNA, 19 bp, Homo sapiens
tattttggaaactgctaaa

SEQ ID NO: 1163244 - DNA, 23 bp, Homo sapiens
tattttggaaactgctaaattct

SEQ ID NO: 1163245 - DNA, 21 bp, Homo sapiens
tttatataataaagtattcca

SEQ ID NO: 1163246 - DNA, 14 bp, Homo sapiens
tttatataatatct

SEQ ID NO: 1163247 - DNA, 22 bp, Homo sapiens
tttatataatatctaaagttat

SEQ ID NO: 1163248 - DNA, 11 bp, Homo sapiens
tttatatactt

SEQ ID NO: 1163249 - DNA, 13 bp, Homo sapiens
tttatatatatat

SEQ ID NO: 1163250 - DNA, 16 bp, Homo sapiens
tttatatatttataac

SEQ ID NO: 1163251 - DNA, 17 bp, Homo sapiens
tttatatcagcctgagt

SEQ ID NO: 1163252 - DNA, 17 bp, Homo sapiens
tttatatcatacagttt

SEQ ID NO: 1163253 - DNA, 16 bp, Homo sapiens
tttatatcatgcaaaa

SEQ ID NO: 1163254 - DNA, 17 bp, Homo sapiens
tttatatcatgcaaaat

SEQ ID NO: 1163255 - DNA, 17 bp, Homo sapiens
tttatatcccattttta

SEQ ID NO: 1163256 - DNA, 13 bp, Homo sapiens
tttatatcttgtt

SEQ ID NO: 1163257 - DNA, 17 bp, Homo sapiens
tttatatcttttggtta

SEQ ID NO: 1163258 - DNA, 15 bp, Homo sapiens
tttatatgaaataaa

SEQ ID NO: 1163259 - DNA, 13 bp, Homo sapiens
tttatatgcttca

SEQ ID NO: 1163260 - DNA, 23 bp, Homo sapiens
tttatatggatgattcagaaatt

SEQ ID NO: 1163261 - DNA, 17 bp, Homo sapiens
tttatatggcccagcct

SEQ ID NO: 1163262 - DNA, 18 bp, Homo sapiens
tttatatggggaatatat

SEQ ID NO: 1163263 - DNA, 19 bp, Homo sapiens
tttatatgtaaatgtgtta

SEQ ID NO: 1163264 - DNA, 16 bp, Homo sapiens
tttatattactctcat

SEQ ID NO: 1163265 - DNA, 20 bp, Homo sapiens
tttatattacttttgtaaat

SEQ ID NO: 1163266 - DNA, 12 bp, Homo sapiens
tttatattattg

SEQ ID NO: 1163267 - DNA, 18 bp, Homo sapiens
tttatattcagtgaaaag

SEQ ID NO: 1163268 - DNA, 13 bp, Homo sapiens
tttatattctaat

SEQ ID NO: 1163269 - DNA, 16 bp, Homo sapiens
tttatattgtaaatat

SEQ ID NO: 1163270 - DNA, 16 bp, Homo sapiens
tttatatttattgtta

SEQ ID NO: 1163271 - DNA, 20 bp, Homo sapiens
tttatatttattgttagaaa

SEQ ID NO: 1163272 - DNA, 15 bp, Homo sapiens
tttatatttccttta

SEQ ID NO: 1163273 - DNA, 22 bp, Homo sapiens
tttatatttcctttatgtgaat

SEQ ID NO: 1163274 - DNA, 19 bp, Homo sapiens
tttatatttggggtccttt

SEQ ID NO: 1163275 - DNA, 22 bp, Homo sapiens
tttatatttgtgtattttcctg

SEQ ID NO: 1163276 - DNA, 21 bp, Homo sapiens
tttatcaaaccctagccttgc

SEQ ID NO: 1163277 - DNA, 13 bp, Homo sapiens
tttatcaagaagt

SEQ ID NO: 1163278 - DNA, 20 bp, Homo sapiens
tttatcaatgtgtctttcta

SEQ ID NO: 1163279 - DNA, 23 bp, Homo sapiens
tttatcaattatattatgtttaa

SEQ ID NO: 1163280 - DNA, 17 bp, Homo sapiens
tttatcacacttctgtg

SEQ ID NO: 1163281 - DNA, 18 bp, Homo sapiens
tttatcacacttctgtga

SEQ ID NO: 1163282 - DNA, 17 bp, Homo sapiens
tttatcacctcattctg

SEQ ID NO: 1163283 - DNA, 19 bp, Homo sapiens
tttatcacctcattctgaa

SEQ ID NO: 1163284 - DNA, 13 bp, Homo sapiens
tttatcagataca

SEQ ID NO: 1163285 - DNA, 20 bp, Homo sapiens
tttatcagatacatcactgc

SEQ ID NO: 1163286 - DNA, 22 bp, Homo sapiens
tttatcagatacatcactgctt

SEQ ID NO: 1163287 - DNA, 14 bp, Homo sapiens
tttatcagcaaaaa

SEQ ID NO: 1163288 - DNA, 15 bp, Homo sapiens
tttatcagcaaaaaa

SEQ ID NO: 1163289 - DNA, 16 bp, Homo sapiens
tttatcagccatgttt

SEQ ID NO: 1163290 - DNA, 19 bp, Homo sapiens
tttatcagggaaactaaga

SEQ ID NO: 1163291 - DNA, 17 bp, Homo sapiens
tttatcatgaatgcttt

SEQ ID NO: 1163292 - DNA, 19 bp, Homo sapiens
tttatcatgaatgctttta

SEQ ID NO: 1163293 - DNA, 21 bp, Homo sapiens
tttatcatgaattccctttta

SEQ ID NO: 1163294 - DNA, 22 bp, Homo sapiens
tttatcatgaattcccttttaa

SEQ ID NO: 1163295 - DNA, 22 bp, Homo sapiens
tttatcatgcatgtcctgtaaa

SEQ ID NO: 1163296 - DNA, 22 bp, Homo sapiens
tttatcatgtcgtaggtaaact

SEQ ID NO: 1163297 - DNA, 23 bp, Homo sapiens
tttatcatgtcgtaggtaaacta

SEQ ID NO: 1163298 - DNA, 18 bp, Homo sapiens
tttatccaaaatgtgtat

SEQ ID NO: 1163299 - DNA, 14 bp, Homo sapiens
tttatccacaggaa

SEQ ID NO: 1163300 - DNA, 16 bp, Homo sapiens
tttatcccaaagttgt

SEQ ID NO: 1163301 - DNA, 21 bp, Homo sapiens
tttatcccaaagttgttgtaa

SEQ ID NO: 1163302 - DNA, 15 bp, Homo sapiens
tttatcccatttagt

SEQ ID NO: 1163303 - DNA, 16 bp, Homo sapiens
tttatcctgacatatt

SEQ ID NO: 1163304 - DNA, 23 bp, Homo sapiens
tttatcctgtattcttgtttgaa

SEQ ID NO: 1163305 - DNA, 16 bp, Homo sapiens
tttatcgtcactgctt

SEQ ID NO: 1163306 - DNA, 21 bp, Homo sapiens
tttatcgtcactgcttaactt

SEQ ID NO: 1163307 - DNA, 14 bp, Homo sapiens
tttatctataattt

SEQ ID NO: 1163308 - DNA, 15 bp, Homo sapiens
tttatctatataaaa

SEQ ID NO: 1163309 - DNA, 16 bp, Homo sapiens
tttatctcagatgtta

SEQ ID NO: 1163310 - DNA, 21 bp, Homo sapiens
tttatctcagatgttaaaata

SEQ ID NO: 1163311 - DNA, 14 bp, Homo sapiens
tttatctctattta

SEQ ID NO: 1163312 - DNA, 17 bp, Homo sapiens
tttatctctatttaata

SEQ ID NO: 1163313 - DNA, 12 bp, Homo sapiens
tttatctgcaga

SEQ ID NO: 1163314 - DNA, 13 bp, Homo sapiens
tttatctgttctt

SEQ ID NO: 1163315 - DNA, 15 bp, Homo sapiens
tttatcttctttcct

SEQ ID NO: 1163316 - DNA, 21 bp, Homo sapiens
tttatcttggactgacattta

SEQ ID NO: 1163317 - DNA, 14 bp, Homo sapiens
tttatcttgtctct

SEQ ID NO: 1163318 - DNA, 13 bp, Homo sapiens
tttatctttacca

SEQ ID NO: 1163319 - DNA, 12 bp, Homo sapiens
tttatctttata

SEQ ID NO: 1163320 - DNA, 13 bp, Homo sapiens
tttatctttgtgt

SEQ ID NO: 1163321 - DNA, 12 bp, Homo sapiens
tttatcttttaa

SEQ ID NO: 1163322 - DNA, 12 bp, Homo sapiens
tttatcttttta

SEQ ID NO: 1163323 - DNA, 16 bp, Homo sapiens
tttatctttttacctt

SEQ ID NO: 1163324 - DNA, 19 bp, Homo sapiens
tttatgaaaggtttacatt

SEQ ID NO: 1163325 - DNA, 14 bp, Homo sapiens
tttatgaatataat

SEQ ID NO: 1163326 - DNA, 14 bp, Homo sapiens
tttatgaattgtct

SEQ ID NO: 1163327 - DNA, 16 bp, Homo sapiens
tattttttgtataatt

SEQ ID NO: 1163328 - DNA, 14 bp, Homo sapiens
tattttttgtatag

SEQ ID NO: 1163329 - DNA, 21 bp, Homo sapiens
tattttttgtatagtattgga

SEQ ID NO: 1163330 - DNA, 16 bp, Homo sapiens
tatttttttaaatcaa

SEQ ID NO: 1163331 - DNA, 17 bp, Homo sapiens
tatttttttaaatcaag

SEQ ID NO: 1163332 - DNA, 19 bp, Homo sapiens
tatttttttaactgaaaat

SEQ ID NO: 1163333 - DNA, 22 bp, Homo sapiens
tatttttttaactgaaaatgta

SEQ ID NO: 1163334 - DNA, 15 bp, Homo sapiens
tatttttttaagcgt

SEQ ID NO: 1163335 - DNA, 20 bp, Homo sapiens
tatttttttaatttaacatg

SEQ ID NO: 1163336 - DNA, 14 bp, Homo sapiens
tatttttttactaa

SEQ ID NO: 1163337 - DNA, 15 bp, Homo sapiens
tatttttttactaat

SEQ ID NO: 1163338 - DNA, 19 bp, Homo sapiens
tatttttttagattgagaa

SEQ ID NO: 1163339 - DNA, 14 bp, Homo sapiens
tatttttttctaat

SEQ ID NO: 1163340 - DNA, 14 bp, Homo sapiens
tatttttttctacc

SEQ ID NO: 1163341 - DNA, 17 bp, Homo sapiens
tatttttttctattttt

SEQ ID NO: 1163342 - DNA, 17 bp, Homo sapiens
tatttttttgagactga

SEQ ID NO: 1163343 - DNA, 13 bp, Homo sapiens
tatttttttgcaa

SEQ ID NO: 1163344 - DNA, 17 bp, Homo sapiens
tattttttttaagtatt

SEQ ID NO: 1163345 - DNA, 13 bp, Homo sapiens
tattttttttggc

SEQ ID NO: 1163346 - DNA, 21 bp, Homo sapiens
tattttttttggcctgtttga

SEQ ID NO: 1163347 - DNA, 22 bp, Homo sapiens
tcaaaaaaaaaaaaaaagactg

SEQ ID NO: 1163348 - DNA, 19 bp, Homo sapiens
tcaaaaaaaaaaaaatgca

SEQ ID NO: 1163349 - DNA, 16 bp, Homo sapiens
tcaaaaaaacactagt

SEQ ID NO: 1163350 - DNA, 13 bp, Homo sapiens
tcaaaaaatgagc

SEQ ID NO: 1163351 - DNA, 19 bp, Homo sapiens
tcaaaaaattatttgctat

SEQ ID NO: 1163352 - DNA, 16 bp, Homo sapiens
tcaaaaacaaagctga

SEQ ID NO: 1163353 - DNA, 20 bp, Homo sapiens
tcaaaaacaggtttttgatt

SEQ ID NO: 1163354 - DNA, 17 bp, Homo sapiens
tcaaaaaccagccaggc

SEQ ID NO: 1163355 - DNA, 22 bp, Homo sapiens
tcaaaaaggtctcaccacatac

SEQ ID NO: 1163356 - DNA, 15 bp, Homo sapiens
tcaaaaatataactt

SEQ ID NO: 1163357 - DNA, 14 bp, Homo sapiens
tcaaaaatggaagc

SEQ ID NO: 1163358 - DNA, 20 bp, Homo sapiens
tcaaaacacccaaaaatatc

SEQ ID NO: 1163359 - DNA, 12 bp, Homo sapiens
tcaaaacactgt

SEQ ID NO: 1163360 - DNA, 13 bp, Homo sapiens
tcaaaacactgtg

SEQ ID NO: 1163361 - DNA, 19 bp, Homo sapiens
tcaaaacacttccagtctg

SEQ ID NO: 1163362 - DNA, 21 bp, Homo sapiens
tcaaaacagaagcagcttctt

SEQ ID NO: 1163363 - DNA, 16 bp, Homo sapiens
tcaaaacagattgttt

SEQ ID NO: 1163364 - DNA, 19 bp, Homo sapiens
tcaaaacctgcagttaaca

SEQ ID NO: 1163365 - DNA, 21 bp, Homo sapiens
tcaaaacctggagatgcagct

SEQ ID NO: 1163366 - DNA, 16 bp, Homo sapiens
tcaaaacctgtgccag

SEQ ID NO: 1163367 - DNA, 22 bp, Homo sapiens
tcaaaacggttttactgcagct

SEQ ID NO: 1163368 - DNA, 18 bp, Homo sapiens
tcaaaactcatttcctat

SEQ ID NO: 1163369 - DNA, 18 bp, Homo sapiens
tcaaaactttaaacctgt

SEQ ID NO: 1163370 - DNA, 18 bp, Homo sapiens
tcaaaagagccctggctc

SEQ ID NO: 1163371 - DNA, 19 bp, Homo sapiens
tcaaaagagccctggctct

SEQ ID NO: 1163372 - DNA, 12 bp, Homo sapiens
tcaaaagcctgg

SEQ ID NO: 1163373 - DNA, 12 bp, Homo sapiens
tttattaaatag

SEQ ID NO: 1163374 - DNA, 20 bp, Homo sapiens
tttattaaatttgttgacaa

SEQ ID NO: 1163375 - DNA, 12 bp, Homo sapiens
tttattaacaaa

SEQ ID NO: 1163376 - DNA, 15 bp, Homo sapiens
tttattaagatggat

SEQ ID NO: 1163377 - DNA, 20 bp, Homo sapiens
tttattaagctttttggaat

SEQ ID NO: 1163378 - DNA, 20 bp, Homo sapiens
tttattaatagaatgataaa

SEQ ID NO: 1163379 - DNA, 13 bp, Homo sapiens
tttattaatctta

SEQ ID NO: 1163380 - DNA, 17 bp, Homo sapiens
tttattaatgcactttc

SEQ ID NO: 1163381 - DNA, 16 bp, Homo sapiens
tttattaatttatttg

SEQ ID NO: 1163382 - DNA, 13 bp, Homo sapiens
tttattacaaatg

SEQ ID NO: 1163383 - DNA, 15 bp, Homo sapiens
tttattacaaatgca

SEQ ID NO: 1163384 - DNA, 19 bp, Homo sapiens
tttattacaaatgcaaatt

SEQ ID NO: 1163385 - DNA, 20 bp, Homo sapiens
tttattacaaattttcactg

SEQ ID NO: 1163386 - DNA, 14 bp, Homo sapiens
tttattacataatt

SEQ ID NO: 1163387 - DNA, 16 bp, Homo sapiens
tttattacatctttca

SEQ ID NO: 1163388 - DNA, 20 bp, Homo sapiens
tttattacctctgatacctc

SEQ ID NO: 1163389 - DNA, 10 bp, Homo sapiens
tttattactt

SEQ ID NO: 1163390 - DNA, 20 bp, Homo sapiens
tttattacttgtgcacttag

SEQ ID NO: 1163391 - DNA, 13 bp, Homo sapiens
tttattatacacc

SEQ ID NO: 1163392 - DNA, 24 bp, Homo sapiens
tttattatatatttacagaagaaa

SEQ ID NO: 1163393 - DNA, 15 bp, Homo sapiens
tttattatgagctac

SEQ ID NO: 1163394 - DNA, 13 bp, Homo sapiens
tttattatggcac

SEQ ID NO: 1163395 - DNA, 14 bp, Homo sapiens
tttattattcctag

SEQ ID NO: 1163396 - DNA, 16 bp, Homo sapiens
tttattatttatttat

SEQ ID NO: 1163397 - DNA, 17 bp, Homo sapiens
tttattattttcacctg

SEQ ID NO: 1163398 - DNA, 13 bp, Homo sapiens
tttattattttta

SEQ ID NO: 1163399 - DNA, 16 bp, Homo sapiens
tttattatttttacct

SEQ ID NO: 1163400 - DNA, 17 bp, Homo sapiens
tttattcaagttattgt

SEQ ID NO: 1163401 - DNA, 16 bp, Homo sapiens
tttattcactgtaagt

SEQ ID NO: 1163402 - DNA, 20 bp, Homo sapiens
tttattcagctagaatttct

SEQ ID NO: 1163403 - DNA, 17 bp, Homo sapiens
tttattcagcttcattt

SEQ ID NO: 1163404 - DNA, 22 bp, Homo sapiens
tttattcagcttcatttgtgtc

SEQ ID NO: 1163405 - DNA, 20 bp, Homo sapiens
tttattcatgccatctgttt

SEQ ID NO: 1163406 - DNA, 22 bp, Homo sapiens
tttattcattggtctaatttat

SEQ ID NO: 1163407 - DNA, 21 bp, Homo sapiens
tttattcccaagtatgcctta

SEQ ID NO: 1163408 - DNA, 22 bp, Homo sapiens
tttattcctatatagtttattg

SEQ ID NO: 1163409 - DNA, 16 bp, Homo sapiens
tttattcctgtatgtt

SEQ ID NO: 1163410 - DNA, 16 bp, Homo sapiens
tttattcctgttagta

SEQ ID NO: 1163411 - DNA, 20 bp, Homo sapiens
tttattctcaggtaatcatt

SEQ ID NO: 1163412 - DNA, 23 bp, Homo sapiens
tttattctcaggtaatcatttta

SEQ ID NO: 1163413 - DNA, 17 bp, Homo sapiens
tttattctctgctgcat

SEQ ID NO: 1163414 - DNA, 14 bp, Homo sapiens
tttattctgtccat

SEQ ID NO: 1163415 - DNA, 12 bp, Homo sapiens
tttattctgttt

SEQ ID NO: 1163416 - DNA, 15 bp, Homo sapiens
tttattctgttttct

SEQ ID NO: 1163417 - DNA, 17 bp, Homo sapiens
tttattctgttttcttg

SEQ ID NO: 1163418 - DNA, 16 bp, Homo sapiens
tttattcttccagaat

SEQ ID NO: 1163419 - DNA, 16 bp, Homo sapiens
tttattctttttaaag

SEQ ID NO: 1163420 - DNA, 12 bp, Homo sapiens
tttattgacaat

SEQ ID NO: 1163421 - DNA, 14 bp, Homo sapiens
tttattgacacaga

SEQ ID NO: 1163422 - DNA, 22 bp, Homo sapiens
tttattgactgggcaacactgc

SEQ ID NO: 1163423 - DNA, 12 bp, Homo sapiens
tttattgcatat

SEQ ID NO: 1163424 - DNA, 12 bp, Homo sapiens
tttattgtctgt

SEQ ID NO: 1163425 - DNA, 22 bp, Homo sapiens
tttattgtgggccatgaaccaa

SEQ ID NO: 1163426 - DNA, 17 bp, Homo sapiens
tttattgtgtttttaat

SEQ ID NO: 1163427 - DNA, 20 bp, Homo sapiens
tttattgttaactcttgtct

SEQ ID NO: 1163428 - DNA, 18 bp, Homo sapiens
tttattgtttgaaatgtc

SEQ ID NO: 1163429 - DNA, 15 bp, Homo sapiens
tttatttaaaactct

SEQ ID NO: 1163430 - DNA, 14 bp, Homo sapiens
tttatttaaatgca

SEQ ID NO: 1163431 - DNA, 13 bp, Homo sapiens
tttatttaaatgt

SEQ ID NO: 1163432 - DNA, 19 bp, Homo sapiens
tttatttaaattacaattt

SEQ ID NO: 1163433 - DNA, 18 bp, Homo sapiens
tttatttaattaaatgta

SEQ ID NO: 1163434 - DNA, 15 bp, Homo sapiens
tttatttacatttta

SEQ ID NO: 1163435 - DNA, 11 bp, Homo sapiens
tttatttacta

SEQ ID NO: 1163436 - DNA, 14 bp, Homo sapiens
tttatttagcttta

SEQ ID NO: 1163437 - DNA, 15 bp, Homo sapiens
tttatttaggaaaca

SEQ ID NO: 1163438 - DNA, 15 bp, Homo sapiens
tttatttatactatt

SEQ ID NO: 1163439 - DNA, 15 bp, Homo sapiens
tttatttatcaaaat

SEQ ID NO: 1163440 - DNA, 22 bp, Homo sapiens
tttatttatggaattaaccatt

SEQ ID NO: 1163441 - DNA, 14 bp, Homo sapiens
tttatttattaaga

SEQ ID NO: 1163442 - DNA, 16 bp, Homo sapiens
tttatttattcactgt

SEQ ID NO: 1163443 - DNA, 15 bp, Homo sapiens
tttatttcaatgtaa

SEQ ID NO: 1163444 - DNA, 16 bp, Homo sapiens
tttatttcatgattca

SEQ ID NO: 1163445 - DNA, 12 bp, Homo sapiens
tttatttccact

SEQ ID NO: 1163446 - DNA, 12 bp, Homo sapiens
tttatttcctgc

SEQ ID NO: 1163447 - DNA, 16 bp, Homo sapiens
tttatttctactgtca

SEQ ID NO: 1163448 - DNA, 15 bp, Homo sapiens
tttatttctctctta

SEQ ID NO: 1163449 - DNA, 13 bp, Homo sapiens
tttatttctctgg

SEQ ID NO: 1163450 - DNA, 21 bp, Homo sapiens
tcaaactttttccagcaaaat

SEQ ID NO: 1163451 - DNA, 22 bp, Homo sapiens
tcaaactttttccagcaaaatg

SEQ ID NO: 1163452 - DNA, 17 bp, Homo sapiens
tcaaagaaaaacaatga

SEQ ID NO: 1163453 - DNA, 17 bp, Homo sapiens
tcaaagaaaagactttt

SEQ ID NO: 1163454 - DNA, 16 bp, Homo sapiens
tcaaagaaatgctgat

SEQ ID NO: 1163455 - DNA, 15 bp, Homo sapiens
tcaaagaaattcaga

SEQ ID NO: 1163456 - DNA, 16 bp, Homo sapiens
tcaaagaagactcagt

SEQ ID NO: 1163457 - DNA, 12 bp, Homo sapiens
tcaaagaaggaa

SEQ ID NO: 1163458 - DNA, 22 bp, Homo sapiens
tcaaagaaggatggcacctaaa

SEQ ID NO: 1163459 - DNA, 20 bp, Homo sapiens
tcaaagaagtactttattgc

SEQ ID NO: 1163460 - DNA, 17 bp, Homo sapiens
tcaaagagaagatgcct

SEQ ID NO: 1163461 - DNA, 19 bp, Homo sapiens
tcaaagagaagatgcctgt

SEQ ID NO: 1163462 - DNA, 23 bp, Homo sapiens
tcaaagagaagatgcctgttaat

SEQ ID NO: 1163463 - DNA, 16 bp, Homo sapiens
tcaaagagattcgaat

SEQ ID NO: 1163464 - DNA, 21 bp, Homo sapiens
tcaaagagggggctctgccca

SEQ ID NO: 1163465 - DNA, 19 bp, Homo sapiens
tcaaagaggtgaacattaa

SEQ ID NO: 1163466 - DNA, 12 bp, Homo sapiens
tcaaagaggttt

SEQ ID NO: 1163467 - DNA, 22 bp, Homo sapiens
tcaaagatattttgctttgtga

SEQ ID NO: 1163468 - DNA, 15 bp, Homo sapiens
tcaaagatgatggaa

SEQ ID NO: 1163469 - DNA, 17 bp, Homo sapiens
tcaaagatgatggaaac

SEQ ID NO: 1163470 - DNA, 18 bp, Homo sapiens
tcaaagatgcatttttat

SEQ ID NO: 1163471 - DNA, 21 bp, Homo sapiens
tcaaagatgccccattccttg

SEQ ID NO: 1163472 - DNA, 18 bp, Homo sapiens
tcaaagatgcgtttgcct

SEQ ID NO: 1163473 - DNA, 23 bp, Homo sapiens
tcaaagatgcgtttgcctcctgg

SEQ ID NO: 1163474 - DNA, 18 bp, Homo sapiens
tcaaagcaacccgctgga

SEQ ID NO: 1163475 - DNA, 22 bp, Homo sapiens
tcaaagcaagcattcagaagaa

SEQ ID NO: 1163476 - DNA, 16 bp, Homo sapiens
tcaaagcaaggaaact

SEQ ID NO: 1163477 - DNA, 13 bp, Homo sapiens
tcaaagcaagggc

SEQ ID NO: 1163478 - DNA, 17 bp, Homo sapiens
tcaaagcaagggctcca

SEQ ID NO: 1163479 - DNA, 12 bp, Homo sapiens
tcaaagcaattg

SEQ ID NO: 1163480 - DNA, 21 bp, Homo sapiens
tcaaagcaccaaaataagaaa

SEQ ID NO: 1163481 - DNA, 20 bp, Homo sapiens
tcaaagcatggacatttaga

SEQ ID NO: 1163482 - DNA, 21 bp, Homo sapiens
tcaaagcatgggattattaga

SEQ ID NO: 1163483 - DNA, 15 bp, Homo sapiens
tcaaagccacactct

SEQ ID NO: 1163484 - DNA, 18 bp, Homo sapiens
tcaaagccacattatttc

SEQ ID NO: 1163485 - DNA, 20 bp, Homo sapiens
tcaaagccacattatttcta

SEQ ID NO: 1163486 - DNA, 22 bp, Homo sapiens
tcaaagccagcgtcctcctctg

SEQ ID NO: 1163487 - DNA, 15 bp, Homo sapiens
tcaaagctaaaaaat

SEQ ID NO: 1163488 - DNA, 13 bp, Homo sapiens
tcaaagctgaata

SEQ ID NO: 1163489 - DNA, 17 bp, Homo sapiens
tcaaagctgaatatttt

SEQ ID NO: 1163490 - DNA, 13 bp, Homo sapiens
tcaaagcttaaaa

SEQ ID NO: 1163491 - DNA, 20 bp, Homo sapiens
tcaaagcttgaagatcgtta

SEQ ID NO: 1163492 - DNA, 22 bp, Homo sapiens
tcaaagcttggattaaatacat

SEQ ID NO: 1163493 - DNA, 15 bp, Homo sapiens
tcaaaggagaaaaaa

SEQ ID NO: 1163494 - DNA, 17 bp, Homo sapiens
tcaaaggagctttctca

SEQ ID NO: 1163495 - DNA, 18 bp, Homo sapiens
tcaaaggagctttctcaa

SEQ ID NO: 1163496 - DNA, 17 bp, Homo sapiens
tcaaaggcatctccctt

SEQ ID NO: 1163497 - DNA, 18 bp, Homo sapiens
tcaaagggcccacagtga

SEQ ID NO: 1163498 - DNA, 18 bp, Homo sapiens
tcaaagtaggcaggacca

SEQ ID NO: 1163499 - DNA, 18 bp, Homo sapiens
tcaaagtctcaatgaaat

SEQ ID NO: 1163500 - DNA, 20 bp, Homo sapiens
tcaaagtctcaatgaaatag

SEQ ID NO: 1163501 - DNA, 22 bp, Homo sapiens
tttcaagatctaaatcatatat

SEQ ID NO: 1163502 - DNA, 22 bp, Homo sapiens
tttcaagcagtcgtgcctgtgt

SEQ ID NO: 1163503 - DNA, 20 bp, Homo sapiens
tttcaagcggtgcctaagaa

SEQ ID NO: 1163504 - DNA, 18 bp, Homo sapiens
tttcaagctttcaaatcc

SEQ ID NO: 1163505 - DNA, 15 bp, Homo sapiens
tttcaaggaaagtga

SEQ ID NO: 1163506 - DNA, 17 bp, Homo sapiens
tttcaaggaaggttcat

SEQ ID NO: 1163507 - DNA, 20 bp, Homo sapiens
tttcaaggaaggttcatgta

SEQ ID NO: 1163508 - DNA, 14 bp, Homo sapiens
tttcaaggccttca

SEQ ID NO: 1163509 - DNA, 15 bp, Homo sapiens
tttcaaggccttcag

SEQ ID NO: 1163510 - DNA, 17 bp, Homo sapiens
tttcaaggccttcagtt

SEQ ID NO: 1163511 - DNA, 21 bp, Homo sapiens
tttcaaggccttcagtttatt

SEQ ID NO: 1163512 - DNA, 21 bp, Homo sapiens
tttcaagttattcaaatttgt

SEQ ID NO: 1163513 - DNA, 16 bp, Homo sapiens
tttcaagtttacactt

SEQ ID NO: 1163514 - DNA, 22 bp, Homo sapiens
tttcaataaaagataaattatt

SEQ ID NO: 1163515 - DNA, 21 bp, Homo sapiens
tttcaataacaaaacgaaact

SEQ ID NO: 1163516 - DNA, 19 bp, Homo sapiens
tttcaataacaaagcacat

SEQ ID NO: 1163517 - DNA, 23 bp, Homo sapiens
tttcaataacaaagcacataact

SEQ ID NO: 1163518 - DNA, 13 bp, Homo sapiens
tttcaatagccac

SEQ ID NO: 1163519 - DNA, 21 bp, Homo sapiens
tttcaatagccactaaccttg

SEQ ID NO: 1163520 - DNA, 14 bp, Homo sapiens
tttcaatatattga

SEQ ID NO: 1163521 - DNA, 18 bp, Homo sapiens
tttcaatatattgaactt

SEQ ID NO: 1163522 - DNA, 22 bp, Homo sapiens
tttcaatatattgaacttttgt

SEQ ID NO: 1163523 - DNA, 17 bp, Homo sapiens
tttcaatattttccttc

SEQ ID NO: 1163524 - DNA, 15 bp, Homo sapiens
tttcaatcattgaag

SEQ ID NO: 1163525 - DNA, 18 bp, Homo sapiens
tttcaatcattgaagtat

SEQ ID NO: 1163526 - DNA, 18 bp, Homo sapiens
tttcaatggttgggacaa

SEQ ID NO: 1163527 - DNA, 23 bp, Homo sapiens
tttcaatggttgggacaatggca

SEQ ID NO: 1163528 - DNA, 15 bp, Homo sapiens
tttcaatgtaattaa

SEQ ID NO: 1163529 - DNA, 15 bp, Homo sapiens
tttcaatgtgaaaca

SEQ ID NO: 1163530 - DNA, 13 bp, Homo sapiens
tttcaatgtgatt

SEQ ID NO: 1163531 - DNA, 17 bp, Homo sapiens
tttcaatgtgattcttc

SEQ ID NO: 1163532 - DNA, 21 bp, Homo sapiens
tttcaatgtgattcttctaaa

SEQ ID NO: 1163533 - DNA, 14 bp, Homo sapiens
tttcaattcagatt

SEQ ID NO: 1163534 - DNA, 21 bp, Homo sapiens
tttcaattcagattgtcttgc

SEQ ID NO: 1163535 - DNA, 18 bp, Homo sapiens
tttcaattgcatctccca

SEQ ID NO: 1163536 - DNA, 16 bp, Homo sapiens
tttcaattttaaacat

SEQ ID NO: 1163537 - DNA, 18 bp, Homo sapiens
tttcaattttaaacatat

SEQ ID NO: 1163538 - DNA, 20 bp, Homo sapiens
tttcacaaatccttcaaaat

SEQ ID NO: 1163539 - DNA, 13 bp, Homo sapiens
tttcacaacagat

SEQ ID NO: 1163540 - DNA, 16 bp, Homo sapiens
tttcacaaccttctgt

SEQ ID NO: 1163541 - DNA, 20 bp, Homo sapiens
tttcacaccggaaggttttt

SEQ ID NO: 1163542 - DNA, 13 bp, Homo sapiens
tttcacactgata

SEQ ID NO: 1163543 - DNA, 16 bp, Homo sapiens
tttcacactgatacat

SEQ ID NO: 1163544 - DNA, 14 bp, Homo sapiens
tttcacagaaaata

SEQ ID NO: 1163545 - DNA, 13 bp, Homo sapiens
tttcacagctcct

SEQ ID NO: 1163546 - DNA, 17 bp, Homo sapiens
tttcacaggtcaataaa

SEQ ID NO: 1163547 - DNA, 13 bp, Homo sapiens
tttcacagttttt

SEQ ID NO: 1163548 - DNA, 15 bp, Homo sapiens
tttcacagtttttcc

SEQ ID NO: 1163549 - DNA, 19 bp, Homo sapiens
tttcacattgtttgctgct

SEQ ID NO: 1163550 - DNA, 14 bp, Homo sapiens
tttcacattttcct

SEQ ID NO: 1163551 - DNA, 17 bp, Homo sapiens
tttcaccagatttgcta

SEQ ID NO: 1163552 - DNA, 23 bp, Homo sapiens
tttcaccatctcttgtaaaagtt

SEQ ID NO: 1163553 - DNA, 18 bp, Homo sapiens
tttcaccatgttggccag

SEQ ID NO: 1163554 - DNA, 22 bp, Homo sapiens
tttcaccatttgattatgtagc

SEQ ID NO: 1163555 - DNA, 22 bp, Homo sapiens
tttcaccccacccttcccctcc

SEQ ID NO: 1163556 - DNA, 16 bp, Homo sapiens
tttcaccctcatgaaa

SEQ ID NO: 1163557 - DNA, 21 bp, Homo sapiens
tttcacccttaacccaaggag

SEQ ID NO: 1163558 - DNA, 20 bp, Homo sapiens
tttcacctactttgtaagtg

SEQ ID NO: 1163559 - DNA, 22 bp, Homo sapiens
tttcacctggaagcatttgttt

SEQ ID NO: 1163560 - DNA, 16 bp, Homo sapiens
tttcacctgtgacaaa

SEQ ID NO: 1163561 - DNA, 15 bp, Homo sapiens
tttcacgaactgttc

SEQ ID NO: 1163562 - DNA, 18 bp, Homo sapiens
tttcacggaaactcccga

SEQ ID NO: 1163563 - DNA, 16 bp, Homo sapiens
tttcacgtaaatattc

SEQ ID NO: 1163564 - DNA, 18 bp, Homo sapiens
tttcacgtaaatattcat

SEQ ID NO: 1163565 - DNA, 19 bp, Homo sapiens
tttcacgtaaatattcata

SEQ ID NO: 1163566 - DNA, 16 bp, Homo sapiens
tttcactattcctatg

SEQ ID NO: 1163567 - DNA, 14 bp, Homo sapiens
tttcactccaccat

SEQ ID NO: 1163568 - DNA, 14 bp, Homo sapiens
tttcactctaagtc

SEQ ID NO: 1163569 - DNA, 18 bp, Homo sapiens
tttcactctaagtcatgt

SEQ ID NO: 1163570 - DNA, 20 bp, Homo sapiens
tttcactctaagtcatgtat

SEQ ID NO: 1163571 - DNA, 16 bp, Homo sapiens
tcaaattctcaaccta

SEQ ID NO: 1163572 - DNA, 14 bp, Homo sapiens
tcaaattgctgctt

SEQ ID NO: 1163573 - DNA, 12 bp, Homo sapiens
tcaaattgtatc

SEQ ID NO: 1163574 - DNA, 22 bp, Homo sapiens
tcaaattgtgcagtactttgtg

SEQ ID NO: 1163575 - DNA, 15 bp, Homo sapiens
tcaaattgttaggaa

SEQ ID NO: 1163576 - DNA, 23 bp, Homo sapiens
tcaaatttagaaactaattgact

SEQ ID NO: 1163577 - DNA, 14 bp, Homo sapiens
tcaaatttctaaat

SEQ ID NO: 1163578 - DNA, 15 bp, Homo sapiens
tcaaatttctaaatc

SEQ ID NO: 1163579 - DNA, 23 bp, Homo sapiens
tcaaatttgtacaggactgtaaa

SEQ ID NO: 1163580 - DNA, 22 bp, Homo sapiens
tcaaatttgtctggttaaaaaa

SEQ ID NO: 1163581 - DNA, 14 bp, Homo sapiens
tcaaattttttgac

SEQ ID NO: 1163582 - DNA, 13 bp, Homo sapiens
tcaacaaactgca

SEQ ID NO: 1163583 - DNA, 14 bp, Homo sapiens
tcaacaaactgcaa

SEQ ID NO: 1163584 - DNA, 18 bp, Homo sapiens
tcaacaaagcacagtgtt

SEQ ID NO: 1163585 - DNA, 23 bp, Homo sapiens
tcaacaaagcacagtgttaaatg

SEQ ID NO: 1163586 - DNA, 13 bp, Homo sapiens
tcaacaactttgt

SEQ ID NO: 1163587 - DNA, 16 bp, Homo sapiens
tcaacaactttgtgct

SEQ ID NO: 1163588 - DNA, 17 bp, Homo sapiens
tcaacaagggagagacc

SEQ ID NO: 1163589 - DNA, 17 bp, Homo sapiens
tcaacaataaaattttt

SEQ ID NO: 1163590 - DNA, 18 bp, Homo sapiens
tcaacaataaaatttttt

SEQ ID NO: 1163591 - DNA, 17 bp, Homo sapiens
tcaacaattctaaaatg

SEQ ID NO: 1163592 - DNA, 22 bp, Homo sapiens
tcaacacattggaattgatgtc

SEQ ID NO: 1163593 - DNA, 18 bp, Homo sapiens
tcaacaccctgcttctcc

SEQ ID NO: 1163594 - DNA, 14 bp, Homo sapiens
tcaacactcttctt

SEQ ID NO: 1163595 - DNA, 14 bp, Homo sapiens
tcaacagaagcatt

SEQ ID NO: 1163596 - DNA, 15 bp, Homo sapiens
tcaacagaagcattt

SEQ ID NO: 1163597 - DNA, 12 bp, Homo sapiens
tcaacagagaag

SEQ ID NO: 1163598 - DNA, 22 bp, Homo sapiens
tcaacagagaaggcaggaatgt

SEQ ID NO: 1163599 - DNA, 21 bp, Homo sapiens
tcaacagatgaccgtgtacaa

SEQ ID NO: 1163600 - DNA, 13 bp, Homo sapiens
tcaacagatgata

SEQ ID NO: 1163601 - DNA, 18 bp, Homo sapiens
tcaacagctatgctggta

SEQ ID NO: 1163602 - DNA, 13 bp, Homo sapiens
tcaacagtaaacc

SEQ ID NO: 1163603 - DNA, 16 bp, Homo sapiens
tcaacagtgagagact

SEQ ID NO: 1163604 - DNA, 17 bp, Homo sapiens
tcaacatcaaaacttaa

SEQ ID NO: 1163605 - DNA, 19 bp, Homo sapiens
tcaacatcaatgttcattg

SEQ ID NO: 1163606 - DNA, 20 bp, Homo sapiens
tcaacatcaatgttcattgt

SEQ ID NO: 1163607 - DNA, 13 bp, Homo sapiens
tcaacatgtgttt

SEQ ID NO: 1163608 - DNA, 15 bp, Homo sapiens
tcaacatgtgtttct

SEQ ID NO: 1163609 - DNA, 22 bp, Homo sapiens
tcaacatttttttttctccata

SEQ ID NO: 1163610 - DNA, 15 bp, Homo sapiens
tcaaccataaaagaa

SEQ ID NO: 1163611 - DNA, 15 bp, Homo sapiens
tcaaccattccccat

SEQ ID NO: 1163612 - DNA, 18 bp, Homo sapiens
tcaaccattccccatggg

SEQ ID NO: 1163613 - DNA, 15 bp, Homo sapiens
tcaaccctccctcag

SEQ ID NO: 1163614 - DNA, 21 bp, Homo sapiens
tcaaccctccctcagcccctc

SEQ ID NO: 1163615 - DNA, 18 bp, Homo sapiens
tcaacctaccaccccttc

SEQ ID NO: 1163616 - DNA, 20 bp, Homo sapiens
tcaacctaccaccccttcct

SEQ ID NO: 1163617 - DNA, 13 bp, Homo sapiens
tcaacctgcctga

SEQ ID NO: 1163618 - DNA, 17 bp, Homo sapiens
tcaacctgggcaaagcc

SEQ ID NO: 1163619 - DNA, 17 bp, Homo sapiens
tcaacctggtggcacca

SEQ ID NO: 1163620 - DNA, 20 bp, Homo sapiens
tcaaccttatcaaggatttt

SEQ ID NO: 1163621 - DNA, 19 bp, Homo sapiens
tcaacctttgtgtggctcc

SEQ ID NO: 1163622 - DNA, 20 bp, Homo sapiens
tcaacctttgtgtggctcct

SEQ ID NO: 1163623 - DNA, 14 bp, Homo sapiens
tcaacgcagccctg

SEQ ID NO: 1163624 - DNA, 18 bp, Homo sapiens
tcaacgcagccctgcttt

SEQ ID NO: 1163625 - DNA, 23 bp, Homo sapiens
tcaacgcctcactgaaacatggc

SEQ ID NO: 1163626 - DNA, 21 bp, Homo sapiens
tcaacggaaagtgctgtctta

SEQ ID NO: 1163627 - DNA, 17 bp, Homo sapiens
tttcagcaacaagactg

SEQ ID NO: 1163628 - DNA, 16 bp, Homo sapiens
tttcagcacccccacc

SEQ ID NO: 1163629 - DNA, 21 bp, Homo sapiens
tttcagcagactatgaatatt

SEQ ID NO: 1163630 - DNA, 20 bp, Homo sapiens
tttcagccaatttgtctcct

SEQ ID NO: 1163631 - DNA, 23 bp, Homo sapiens
tttcagcctcctgtttggtgggg

SEQ ID NO: 1163632 - DNA, 23 bp, Homo sapiens
tttcagcgactccgttggccact

SEQ ID NO: 1163633 - DNA, 17 bp, Homo sapiens
tttcagcgatgtatgca

SEQ ID NO: 1163634 - DNA, 21 bp, Homo sapiens
tttcagcgatgtatgcagcta

SEQ ID NO: 1163635 - DNA, 13 bp, Homo sapiens
tttcagctccctt

SEQ ID NO: 1163636 - DNA, 17 bp, Homo sapiens
tttcagctcccttccct

SEQ ID NO: 1163637 - DNA, 18 bp, Homo sapiens
tttcagctcttaaaaaga

SEQ ID NO: 1163638 - DNA, 12 bp, Homo sapiens
tttcaggaaaat

SEQ ID NO: 1163639 - DNA, 21 bp, Homo sapiens
tttcaggaaaatgtattgatt

SEQ ID NO: 1163640 - DNA, 15 bp, Homo sapiens
tttcaggaatttaaa

SEQ ID NO: 1163641 - DNA, 19 bp, Homo sapiens
tttcaggaggaatactgaa

SEQ ID NO: 1163642 - DNA, 22 bp, Homo sapiens
tttcaggaggaatactgaacat

SEQ ID NO: 1163643 - DNA, 17 bp, Homo sapiens
tttcaggcattttgttc

SEQ ID NO: 1163644 - DNA, 19 bp, Homo sapiens
tttcaggctacctttttct

SEQ ID NO: 1163645 - DNA, 17 bp, Homo sapiens
tttcagggaaattaatc

SEQ ID NO: 1163646 - DNA, 19 bp, Homo sapiens
tttcagggaaattaatcaa

SEQ ID NO: 1163647 - DNA, 20 bp, Homo sapiens
tttcagggacctcaggggca

SEQ ID NO: 1163648 - DNA, 16 bp, Homo sapiens
tttcagggttttctga

SEQ ID NO: 1163649 - DNA, 18 bp, Homo sapiens
tttcaggttatatccaat

SEQ ID NO: 1163650 - DNA, 19 bp, Homo sapiens
tttcaggtttccattctgc

SEQ ID NO: 1163651 - DNA, 18 bp, Homo sapiens
tttcaggttttgtaaaga

SEQ ID NO: 1163652 - DNA, 19 bp, Homo sapiens
tttcaggttttgtaaagat

SEQ ID NO: 1163653 - DNA, 16 bp, Homo sapiens
tttcagtactttttta

SEQ ID NO: 1163654 - DNA, 14 bp, Homo sapiens
tttcagtagaattt

SEQ ID NO: 1163655 - DNA, 16 bp, Homo sapiens
tttcagtatactgtgt

SEQ ID NO: 1163656 - DNA, 21 bp, Homo sapiens
tttcagtattttggagaaatt

SEQ ID NO: 1163657 - DNA, 22 bp, Homo sapiens
tttcagtcaattctgatgttac

SEQ ID NO: 1163658 - DNA, 16 bp, Homo sapiens
tttcagtcccctctct

SEQ ID NO: 1163659 - DNA, 21 bp, Homo sapiens
tttcagtcccctctctctggg

SEQ ID NO: 1163660 - DNA, 21 bp, Homo sapiens
tttcagtggaccctgtggcca

SEQ ID NO: 1163661 - DNA, 14 bp, Homo sapiens
tttcagtgtacatg

SEQ ID NO: 1163662 - DNA, 16 bp, Homo sapiens
tttcagtgttacctgt

SEQ ID NO: 1163663 - DNA, 13 bp, Homo sapiens
tttcagttatttt

SEQ ID NO: 1163664 - DNA, 18 bp, Homo sapiens
tttcagtttttcatttgt

SEQ ID NO: 1163665 - DNA, 19 bp, Homo sapiens
tttcagtttttcatttgtt

SEQ ID NO: 1163666 - DNA, 17 bp, Homo sapiens
tttcagtttttttaaat

SEQ ID NO: 1163667 - DNA, 15 bp, Homo sapiens
tttcataaaaggaga

SEQ ID NO: 1163668 - DNA, 19 bp, Homo sapiens
tttcataaattatttgatt

SEQ ID NO: 1163669 - DNA, 14 bp, Homo sapiens
tttcataaggcctg

SEQ ID NO: 1163670 - DNA, 20 bp, Homo sapiens
tttcataaggcctgccctcc

SEQ ID NO: 1163671 - DNA, 22 bp, Homo sapiens
tttcataaggcctgccctccca

SEQ ID NO: 1163672 - DNA, 14 bp, Homo sapiens
tttcataatcagta

SEQ ID NO: 1163673 - DNA, 17 bp, Homo sapiens
tttcataatgaaaaact

SEQ ID NO: 1163674 - DNA, 14 bp, Homo sapiens
tttcataattcaga

SEQ ID NO: 1163675 - DNA, 19 bp, Homo sapiens
tttcataattctgaaacaa

SEQ ID NO: 1163676 - DNA, 13 bp, Homo sapiens
tttcataatttgt

SEQ ID NO: 1163677 - DNA, 22 bp, Homo sapiens
tttcatacatatatatatttgt

SEQ ID NO: 1163678 - DNA, 17 bp, Homo sapiens
tttcatagcctacattt

SEQ ID NO: 1163679 - DNA, 17 bp, Homo sapiens
tttcataggtctgaaat

SEQ ID NO: 1163680 - DNA, 14 bp, Homo sapiens
tttcatagttcaga

SEQ ID NO: 1163681 - DNA, 12 bp, Homo sapiens
tttcatatcatt

SEQ ID NO: 1163682 - DNA, 14 bp, Homo sapiens
tttcatattgtgcc

SEQ ID NO: 1163683 - DNA, 13 bp, Homo sapiens
tttcatatttctt

SEQ ID NO: 1163684 - DNA, 14 bp, Homo sapiens
tttcatatttgggg

SEQ ID NO: 1163685 - DNA, 16 bp, Homo sapiens
tttcatcattgtttct

SEQ ID NO: 1163686 - DNA, 17 bp, Homo sapiens
tttcatcatttcagcca

SEQ ID NO: 1163687 - DNA, 23 bp, Homo sapiens
tttcatccaaaatattttttgca

SEQ ID NO: 1163688 - DNA, 17 bp, Homo sapiens
tttcatccataactgaa

SEQ ID NO: 1163689 - DNA, 19 bp, Homo sapiens
tttcatccataactgaaca

SEQ ID NO: 1163690 - DNA, 22 bp, Homo sapiens
tttcatcccgtatcacagtgtt

SEQ ID NO: 1163691 - DNA, 17 bp, Homo sapiens
tttcatcctggcctcct

SEQ ID NO: 1163692 - DNA, 12 bp, Homo sapiens
tttcatcctgtg

SEQ ID NO: 1163693 - DNA, 20 bp, Homo sapiens
tcaagagtggggggaggaag

SEQ ID NO: 1163694 - DNA, 22 bp, Homo sapiens
tcaagataatcctagagtctta

SEQ ID NO: 1163695 - DNA, 22 bp, Homo sapiens
tcaagatactgctactgtaatt

SEQ ID NO: 1163696 - DNA, 20 bp, Homo sapiens
tcaagatatatgtgtataca

SEQ ID NO: 1163697 - DNA, 19 bp, Homo sapiens
tcaagatgggggcagggct

SEQ ID NO: 1163698 - DNA, 20 bp, Homo sapiens
tcaagatgggggcagggctg

SEQ ID NO: 1163699 - DNA, 18 bp, Homo sapiens
tcaagattctaaagctca

SEQ ID NO: 1163700 - DNA, 16 bp, Homo sapiens
tcaagatttgaccaaa

SEQ ID NO: 1163701 - DNA, 15 bp, Homo sapiens
tcaagattttagggc

SEQ ID NO: 1163702 - DNA, 22 bp, Homo sapiens
tcaagattttagggcttttatt

SEQ ID NO: 1163703 - DNA, 19 bp, Homo sapiens
tcaagattttgaatgcttc

SEQ ID NO: 1163704 - DNA, 16 bp, Homo sapiens
tcaagcaataattgtt

SEQ ID NO: 1163705 - DNA, 20 bp, Homo sapiens
tcaagcaatccacctgcctt

SEQ ID NO: 1163706 - DNA, 21 bp, Homo sapiens
tcaagcaatccacctgccttg

SEQ ID NO: 1163707 - DNA, 16 bp, Homo sapiens
tcaagcaatcctccta

SEQ ID NO: 1163708 - DNA, 17 bp, Homo sapiens
tcaagcaatcctcctgc

SEQ ID NO: 1163709 - DNA, 15 bp, Homo sapiens
tcaagcacactggaa

SEQ ID NO: 1163710 - DNA, 21 bp, Homo sapiens
tcaagcagacatagaagagcc

SEQ ID NO: 1163711 - DNA, 18 bp, Homo sapiens
tcaagcagcgaccgcccc

SEQ ID NO: 1163712 - DNA, 22 bp, Homo sapiens
tcaagcagcgaccgccccctcc

SEQ ID NO: 1163713 - DNA, 16 bp, Homo sapiens
tcaagcagtcgtgcct

SEQ ID NO: 1163714 - DNA, 22 bp, Homo sapiens
tcaagcagtcgtgcctgtgtcc

SEQ ID NO: 1163715 - DNA, 16 bp, Homo sapiens
tcaagcatcctcagaa

SEQ ID NO: 1163716 - DNA, 12 bp, Homo sapiens
tcaagcatgaag

SEQ ID NO: 1163717 - DNA, 18 bp, Homo sapiens
tcaagccaatcccctcct

SEQ ID NO: 1163718 - DNA, 24 bp, Homo sapiens
tcaagccccaccacatagcatgct

SEQ ID NO: 1163719 - DNA, 14 bp, Homo sapiens
tcaagcctctaaac

SEQ ID NO: 1163720 - DNA, 15 bp, Homo sapiens
tcaagcctgtgaata

SEQ ID NO: 1163721 - DNA, 15 bp, Homo sapiens
tcaagcctgtgcaaa

SEQ ID NO: 1163722 - DNA, 13 bp, Homo sapiens
tcaagcctgtggg

SEQ ID NO: 1163723 - DNA, 16 bp, Homo sapiens
tcaagcctgtgggcag

SEQ ID NO: 1163724 - DNA, 21 bp, Homo sapiens
tcaagcctgtgggcagcatgc

SEQ ID NO: 1163725 - DNA, 18 bp, Homo sapiens
tcaagcctttatggctgc

SEQ ID NO: 1163726 - DNA, 21 bp, Homo sapiens
tcaagcggtgcctaagaagtt

SEQ ID NO: 1163727 - DNA, 13 bp, Homo sapiens
tcaagctaagtaa

SEQ ID NO: 1163728 - DNA, 17 bp, Homo sapiens
tcaagctaagtaaaaat

SEQ ID NO: 1163729 - DNA, 16 bp, Homo sapiens
tcaagctagaaggcca

SEQ ID NO: 1163730 - DNA, 18 bp, Homo sapiens
tcaagctagaaggccaca

SEQ ID NO: 1163731 - DNA, 20 bp, Homo sapiens
tcaagctagaaggccacatg

SEQ ID NO: 1163732 - DNA, 15 bp, Homo sapiens
tcaagctagccagag

SEQ ID NO: 1163733 - DNA, 13 bp, Homo sapiens
tcaagctcctcct

SEQ ID NO: 1163734 - DNA, 15 bp, Homo sapiens
tcaagctcctcctcc

SEQ ID NO: 1163735 - DNA, 16 bp, Homo sapiens
tcaagctcctcctccc

SEQ ID NO: 1163736 - DNA, 18 bp, Homo sapiens
tcaagctcctcctccctg

SEQ ID NO: 1163737 - DNA, 14 bp, Homo sapiens
tcaagctgctctga

SEQ ID NO: 1163738 - DNA, 21 bp, Homo sapiens
tcaagctggtggcctctgcag

SEQ ID NO: 1163739 - DNA, 12 bp, Homo sapiens
tcaagctgtccc

SEQ ID NO: 1163740 - DNA, 13 bp, Homo sapiens
tcaagctgtcccc

SEQ ID NO: 1163741 - DNA, 19 bp, Homo sapiens
tcaagctgtcccctctgtc

SEQ ID NO: 1163742 - DNA, 19 bp, Homo sapiens
tcaagctgttgaagtctca

SEQ ID NO: 1163743 - DNA, 11 bp, Homo sapiens
tcaagcttgtg

SEQ ID NO: 1163744 - DNA, 17 bp, Homo sapiens
tcaagctttcaaatcct

SEQ ID NO: 1163745 - DNA, 15 bp, Homo sapiens
tcaagcttttctgta

SEQ ID NO: 1163746 - DNA, 15 bp, Homo sapiens
tcaaggaagaaaacg

SEQ ID NO: 1163747 - DNA, 18 bp, Homo sapiens
tcaaggaaggttcatgta

SEQ ID NO: 1163748 - DNA, 17 bp, Homo sapiens
tcaaggacaggagcctg

SEQ ID NO: 1163749 - DNA, 22 bp, Homo sapiens
tcaaggaccaagagcaattgca

SEQ ID NO: 1163750 - DNA, 20 bp, Homo sapiens
tcaaggacgaatttgcacag

SEQ ID NO: 1163751 - DNA, 19 bp, Homo sapiens
tcaaggatatactgcagct

SEQ ID NO: 1163752 - DNA, 14 bp, Homo sapiens
tcaaggatgttttt

SEQ ID NO: 1163753 - DNA, 14 bp, Homo sapiens
tcaaggcaaaagga

SEQ ID NO: 1163754 - DNA, 13 bp, Homo sapiens
tttccaaaggcat

SEQ ID NO: 1163755 - DNA, 12 bp, Homo sapiens
tttccaaagtac

SEQ ID NO: 1163756 - DNA, 22 bp, Homo sapiens
tttccaaatgtggcctccatgt

SEQ ID NO: 1163757 - DNA, 20 bp, Homo sapiens
tttccaaattaaaacaaata

SEQ ID NO: 1163758 - DNA, 14 bp, Homo sapiens
tttccaaattattt

SEQ ID NO: 1163759 - DNA, 15 bp, Homo sapiens
tttccaaattcacaa

SEQ ID NO: 1163760 - DNA, 23 bp, Homo sapiens
tttccaaattcacaagttgtgtt

SEQ ID NO: 1163761 - DNA, 18 bp, Homo sapiens
tttccaacaccacagaca

SEQ ID NO: 1163762 - DNA, 20 bp, Homo sapiens
tttccaacaccacagacaca

SEQ ID NO: 1163763 - DNA, 23 bp, Homo sapiens
tttccaacaccacagacacacac

SEQ ID NO: 1163764 - DNA, 17 bp, Homo sapiens
tttccaactggcactct

SEQ ID NO: 1163765 - DNA, 17 bp, Homo sapiens
tttccaagagaactaaa

SEQ ID NO: 1163766 - DNA, 13 bp, Homo sapiens
tttccaaggtgca

SEQ ID NO: 1163767 - DNA, 15 bp, Homo sapiens
tttccaagtaagagt

SEQ ID NO: 1163768 - DNA, 13 bp, Homo sapiens
tttccaatagaaa

SEQ ID NO: 1163769 - DNA, 14 bp, Homo sapiens
tttccaatcaacag

SEQ ID NO: 1163770 - DNA, 19 bp, Homo sapiens
tttccaatgaaggaaacat

SEQ ID NO: 1163771 - DNA, 19 bp, Homo sapiens
tttccacaaaatctgtcca

SEQ ID NO: 1163772 - DNA, 19 bp, Homo sapiens
tttccaccaggccgtgcct

SEQ ID NO: 1163773 - DNA, 16 bp, Homo sapiens
tttccacggaaacaga

SEQ ID NO: 1163774 - DNA, 16 bp, Homo sapiens
tttccactaaaaatat

SEQ ID NO: 1163775 - DNA, 12 bp, Homo sapiens
tttccactgaac

SEQ ID NO: 1163776 - DNA, 13 bp, Homo sapiens
tttccactgaaca

SEQ ID NO: 1163777 - DNA, 19 bp, Homo sapiens
tttccagaaatacctgtct

SEQ ID NO: 1163778 - DNA, 19 bp, Homo sapiens
tttccagacttccttgaga

SEQ ID NO: 1163779 - DNA, 18 bp, Homo sapiens
tttccagagaactgcaga

SEQ ID NO: 1163780 - DNA, 19 bp, Homo sapiens
tttccagaggctattattt

SEQ ID NO: 1163781 - DNA, 13 bp, Homo sapiens
tttccagcaaaat

SEQ ID NO: 1163782 - DNA, 23 bp, Homo sapiens
tttccagcaaaatggaagcaaag

SEQ ID NO: 1163783 - DNA, 16 bp, Homo sapiens
tttccagcagaagaca

SEQ ID NO: 1163784 - DNA, 21 bp, Homo sapiens
tttccagcagaagacaaaaag

SEQ ID NO: 1163785 - DNA, 16 bp, Homo sapiens
tttccaggaaaaaata

SEQ ID NO: 1163786 - DNA, 12 bp, Homo sapiens
tttccaggactc

SEQ ID NO: 1163787 - DNA, 21 bp, Homo sapiens
tttccaggagacatatatagg

SEQ ID NO: 1163788 - DNA, 16 bp, Homo sapiens
tttccagggttattta

SEQ ID NO: 1163789 - DNA, 14 bp, Homo sapiens
tttccagtattgaa

SEQ ID NO: 1163790 - DNA, 12 bp, Homo sapiens
tttccagtctgt

SEQ ID NO: 1163791 - DNA, 15 bp, Homo sapiens
tttccagtctgtaca

SEQ ID NO: 1163792 - DNA, 17 bp, Homo sapiens
tttccagtgagtgtaaa

SEQ ID NO: 1163793 - DNA, 15 bp, Homo sapiens
tttccataaatttgg

SEQ ID NO: 1163794 - DNA, 22 bp, Homo sapiens
tttccataaatttggactgtct

SEQ ID NO: 1163795 - DNA, 19 bp, Homo sapiens
tttccatagtgttaactgt

SEQ ID NO: 1163796 - DNA, 20 bp, Homo sapiens
tttccatcatgtctgtatac

SEQ ID NO: 1163797 - DNA, 16 bp, Homo sapiens
tttccatcatttctgt

SEQ ID NO: 1163798 - DNA, 19 bp, Homo sapiens
tttccatcttaatgttact

SEQ ID NO: 1163799 - DNA, 19 bp, Homo sapiens
tttccatgcgtgtttctga

SEQ ID NO: 1163800 - DNA, 20 bp, Homo sapiens
tttccatggcaaatgggcag

SEQ ID NO: 1163801 - DNA, 22 bp, Homo sapiens
tttccatgggcccgctgcctct

SEQ ID NO: 1163802 - DNA, 13 bp, Homo sapiens
tttccattattta

SEQ ID NO: 1163803 - DNA, 21 bp, Homo sapiens
tttccattatttatattagtt

SEQ ID NO: 1163804 - DNA, 13 bp, Homo sapiens
tttccattccaga

SEQ ID NO: 1163805 - DNA, 12 bp, Homo sapiens
tttccattcttc

SEQ ID NO: 1163806 - DNA, 18 bp, Homo sapiens
tttccattcttcttgcta

SEQ ID NO: 1163807 - DNA, 19 bp, Homo sapiens
tttccattcttcttgctac

SEQ ID NO: 1163808 - DNA, 14 bp, Homo sapiens
tttccattgtgtgg

SEQ ID NO: 1163809 - DNA, 16 bp, Homo sapiens
tttccattgtgtggcc

SEQ ID NO: 1163810 - DNA, 18 bp, Homo sapiens
tttccatttcttcagagg

SEQ ID NO: 1163811 - DNA, 13 bp, Homo sapiens
tttcccaaagcac

SEQ ID NO: 1163812 - DNA, 22 bp, Homo sapiens
tttcccaaagcatccctcttag

SEQ ID NO: 1163813 - DNA, 20 bp, Homo sapiens
tttcccacaccgtgtaaacc

SEQ ID NO: 1163814 - DNA, 13 bp, Homo sapiens
tttcccaccacct

SEQ ID NO: 1163815 - DNA, 14 bp, Homo sapiens
tcaataaattgcaa

SEQ ID NO: 1163816 - DNA, 21 bp, Homo sapiens
tcaataaattgttttttaatt

SEQ ID NO: 1163817 - DNA, 23 bp, Homo sapiens
tcaataacagatggtgctgctaa

SEQ ID NO: 1163818 - DNA, 15 bp, Homo sapiens
tcaatacagcttcat

SEQ ID NO: 1163819 - DNA, 15 bp, Homo sapiens
tcaatactcttgaaa

SEQ ID NO: 1163820 - DNA, 19 bp, Homo sapiens
tcaatactcttgaaatgta

SEQ ID NO: 1163821 - DNA, 20 bp, Homo sapiens
tcaatactgtatgccttctg

SEQ ID NO: 1163822 - DNA, 17 bp, Homo sapiens
tcaatacttgaatatgg

SEQ ID NO: 1163823 - DNA, 20 bp, Homo sapiens
tcaatagatttaggagcaga

SEQ ID NO: 1163824 - DNA, 21 bp, Homo sapiens
tcaatagatttaggagcagaa

SEQ ID NO: 1163825 - DNA, 16 bp, Homo sapiens
tcaatagcgtgtgtag

SEQ ID NO: 1163826 - DNA, 16 bp, Homo sapiens
tcaatagttgaattag

SEQ ID NO: 1163827 - DNA, 17 bp, Homo sapiens
tcaatatattgaacttt

SEQ ID NO: 1163828 - DNA, 15 bp, Homo sapiens
tcaatatcccaacat

SEQ ID NO: 1163829 - DNA, 18 bp, Homo sapiens
tcaatatcccaacattct

SEQ ID NO: 1163830 - DNA, 13 bp, Homo sapiens
tcaatatctaata

SEQ ID NO: 1163831 - DNA, 14 bp, Homo sapiens
tcaatatgaatcta

SEQ ID NO: 1163832 - DNA, 12 bp, Homo sapiens
tcaatatgcaag

SEQ ID NO: 1163833 - DNA, 15 bp, Homo sapiens
tcaatatgcaagcag

SEQ ID NO: 1163834 - DNA, 19 bp, Homo sapiens
tcaatatgcaagcagcttt

SEQ ID NO: 1163835 - DNA, 20 bp, Homo sapiens
tcaatatgcaagcagctttt

SEQ ID NO: 1163836 - DNA, 15 bp, Homo sapiens
tcaatattaaataca

SEQ ID NO: 1163837 - DNA, 21 bp, Homo sapiens
tcaatattaaatacagacact

SEQ ID NO: 1163838 - DNA, 21 bp, Homo sapiens
tcaatattcctgaatgaaata

SEQ ID NO: 1163839 - DNA, 12 bp, Homo sapiens
tcaatattgaat

SEQ ID NO: 1163840 - DNA, 13 bp, Homo sapiens
tcaatattgacat

SEQ ID NO: 1163841 - DNA, 18 bp, Homo sapiens
tcaatattgacatttgta

SEQ ID NO: 1163842 - DNA, 10 bp, Homo sapiens
tcaatattta

SEQ ID NO: 1163843 - DNA, 16 bp, Homo sapiens
tcaatatttagaaaat

SEQ ID NO: 1163844 - DNA, 17 bp, Homo sapiens
tcaatatttagaaaatt

SEQ ID NO: 1163845 - DNA, 11 bp, Homo sapiens
tcaatatttat

SEQ ID NO: 1163846 - DNA, 17 bp, Homo sapiens
tcaatattttcttttcc

SEQ ID NO: 1163847 - DNA, 16 bp, Homo sapiens
tcaatatttttagata

SEQ ID NO: 1163848 - DNA, 23 bp, Homo sapiens
tcaatatttttatttttaactct

SEQ ID NO: 1163849 - DNA, 16 bp, Homo sapiens
tcaatcaactttactg

SEQ ID NO: 1163850 - DNA, 11 bp, Homo sapiens
tcaatcaatgg

SEQ ID NO: 1163851 - DNA, 15 bp, Homo sapiens
tcaatcacagtctca

SEQ ID NO: 1163852 - DNA, 11 bp, Homo sapiens
tcaatcacatt

SEQ ID NO: 1163853 - DNA, 12 bp, Homo sapiens
tcaatcagcctt

SEQ ID NO: 1163854 - DNA, 16 bp, Homo sapiens
tcaatcagtgcagtga

SEQ ID NO: 1163855 - DNA, 16 bp, Homo sapiens
tcaatcattgaagtat

SEQ ID NO: 1163856 - DNA, 15 bp, Homo sapiens
tcaatccagctatgt

SEQ ID NO: 1163857 - DNA, 15 bp, Homo sapiens
tcaatcccaattctg

SEQ ID NO: 1163858 - DNA, 20 bp, Homo sapiens
tcaatcccaattctgtccca

SEQ ID NO: 1163859 - DNA, 20 bp, Homo sapiens
tcaatcccctcattcaggaa

SEQ ID NO: 1163860 - DNA, 15 bp, Homo sapiens
tcaatcctcaaatca

SEQ ID NO: 1163861 - DNA, 22 bp, Homo sapiens
tcaatcctgggcaatcagacac

SEQ ID NO: 1163862 - DNA, 12 bp, Homo sapiens
tcaatctctgtt

SEQ ID NO: 1163863 - DNA, 15 bp, Homo sapiens
tcaatctctgttctg

SEQ ID NO: 1163864 - DNA, 14 bp, Homo sapiens
tcaatctgtaaact

SEQ ID NO: 1163865 - DNA, 15 bp, Homo sapiens
tcaatcttgttactg

SEQ ID NO: 1163866 - DNA, 16 bp, Homo sapiens
tcaatgaagccagctc

SEQ ID NO: 1163867 - DNA, 22 bp, Homo sapiens
tcaatgaatccccgacccccct

SEQ ID NO: 1163868 - DNA, 18 bp, Homo sapiens
tcaatgaattaattcaga

SEQ ID NO: 1163869 - DNA, 21 bp, Homo sapiens
tcaatgaattttataatctgc

SEQ ID NO: 1163870 - DNA, 17 bp, Homo sapiens
tcaatgaggtgtccaac

SEQ ID NO: 1163871 - DNA, 16 bp, Homo sapiens
tcaatgcatacaataa

SEQ ID NO: 1163872 - DNA, 21 bp, Homo sapiens
tcaatgcattgtcttgtggag

SEQ ID NO: 1163873 - DNA, 14 bp, Homo sapiens
tcaatgccctgcca

SEQ ID NO: 1163874 - DNA, 18 bp, Homo sapiens
tcaatgccttgattagac

SEQ ID NO: 1163875 - DNA, 18 bp, Homo sapiens
tcaatgctttatttgtaa

SEQ ID NO: 1163876 - DNA, 14 bp, Homo sapiens
tcaatggaagaaat

SEQ ID NO: 1163877 - DNA, 18 bp, Homo sapiens
tcaatgggaagactcagg

SEQ ID NO: 1163878 - DNA, 23 bp, Homo sapiens
tcaatgggggtgtagtatttttg

SEQ ID NO: 1163879 - DNA, 15 bp, Homo sapiens
tcaatggtgcaaaaa

SEQ ID NO: 1163880 - DNA, 19 bp, Homo sapiens
tcaatggtttaacatataa

SEQ ID NO: 1163881 - DNA, 14 bp, Homo sapiens
tcaatgtacttgtt

SEQ ID NO: 1163882 - DNA, 20 bp, Homo sapiens
tcaatgtacttgtttgaata

SEQ ID NO: 1163883 - DNA, 14 bp, Homo sapiens
tttcctcatgtaac

SEQ ID NO: 1163884 - DNA, 22 bp, Homo sapiens
tttcctcatgtaacattggtga

SEQ ID NO: 1163885 - DNA, 22 bp, Homo sapiens
tttcctccaaatctgatttcat

SEQ ID NO: 1163886 - DNA, 12 bp, Homo sapiens
tttcctccccac

SEQ ID NO: 1163887 - DNA, 14 bp, Homo sapiens
tttcctccccagca

SEQ ID NO: 1163888 - DNA, 16 bp, Homo sapiens
tttcctccccagcagg

SEQ ID NO: 1163889 - DNA, 17 bp, Homo sapiens
tttcctccccatacaca

SEQ ID NO: 1163890 - DNA, 19 bp, Homo sapiens
tttcctccccatacacaca

SEQ ID NO: 1163891 - DNA, 15 bp, Homo sapiens
tttcctccccctgca

SEQ ID NO: 1163892 - DNA, 12 bp, Homo sapiens
tttcctcccttc

SEQ ID NO: 1163893 - DNA, 13 bp, Homo sapiens
tttcctcccttct

SEQ ID NO: 1163894 - DNA, 14 bp, Homo sapiens
tttcctcccttctg

SEQ ID NO: 1163895 - DNA, 20 bp, Homo sapiens
tttcctcccttctgctactg

SEQ ID NO: 1163896 - DNA, 22 bp, Homo sapiens
tttcctcccttgggttctgata

SEQ ID NO: 1163897 - DNA, 22 bp, Homo sapiens
tttcctcctaccttttgtctct

SEQ ID NO: 1163898 - DNA, 15 bp, Homo sapiens
tttcctcctccctgt

SEQ ID NO: 1163899 - DNA, 14 bp, Homo sapiens
tttcctcctctgcc

SEQ ID NO: 1163900 - DNA, 10 bp, Homo sapiens
tttcctcctg

SEQ ID NO: 1163901 - DNA, 22 bp, Homo sapiens
tttcctcctgaggctttggatt

SEQ ID NO: 1163902 - DNA, 18 bp, Homo sapiens
tttcctcgcctaggcctg

SEQ ID NO: 1163903 - DNA, 19 bp, Homo sapiens
tttcctctattgatgtaca

SEQ ID NO: 1163904 - DNA, 16 bp, Homo sapiens
tttcctctccactgct

SEQ ID NO: 1163905 - DNA, 20 bp, Homo sapiens
tttcctctctgtctgtctct

SEQ ID NO: 1163906 - DNA, 23 bp, Homo sapiens
tttcctctgaggatgatgtactt

SEQ ID NO: 1163907 - DNA, 14 bp, Homo sapiens
tttcctctgcagca

SEQ ID NO: 1163908 - DNA, 21 bp, Homo sapiens
tttcctgaaagcagtaaccaa

SEQ ID NO: 1163909 - DNA, 13 bp, Homo sapiens
tttcctgaaatat

SEQ ID NO: 1163910 - DNA, 23 bp, Homo sapiens
tttcctgacagaaggactcaggt

SEQ ID NO: 1163911 - DNA, 22 bp, Homo sapiens
tttcctgagcttggccagaagg

SEQ ID NO: 1163912 - DNA, 21 bp, Homo sapiens
tttcctgataaagcacagctg

SEQ ID NO: 1163913 - DNA, 12 bp, Homo sapiens
tttcctgcatgt

SEQ ID NO: 1163914 - DNA, 20 bp, Homo sapiens
tttcctgctatattaacatc

SEQ ID NO: 1163915 - DNA, 15 bp, Homo sapiens
tttcctggacttaaa

SEQ ID NO: 1163916 - DNA, 15 bp, Homo sapiens
tttcctggatttata

SEQ ID NO: 1163917 - DNA, 22 bp, Homo sapiens
tttcctgggaatggaataacta

SEQ ID NO: 1163918 - DNA, 22 bp, Homo sapiens
tttcctggtgccaatttcaagt

SEQ ID NO: 1163919 - DNA, 13 bp, Homo sapiens
tttcctgtacaat

SEQ ID NO: 1163920 - DNA, 18 bp, Homo sapiens
tttcctgtgtgtgttgcc

SEQ ID NO: 1163921 - DNA, 15 bp, Homo sapiens
tttcctgtgtttgtc

SEQ ID NO: 1163922 - DNA, 17 bp, Homo sapiens
tttcctgtgtttgtcct

SEQ ID NO: 1163923 - DNA, 22 bp, Homo sapiens
tttcctgtgtttgtcctgggtt

SEQ ID NO: 1163924 - DNA, 23 bp, Homo sapiens
tttccttaaactgtgtggactgt

SEQ ID NO: 1163925 - DNA, 22 bp, Homo sapiens
tttccttaccataccactttga

SEQ ID NO: 1163926 - DNA, 18 bp, Homo sapiens
tttccttacctatttcct

SEQ ID NO: 1163927 - DNA, 15 bp, Homo sapiens
tttccttatttcaag

SEQ ID NO: 1163928 - DNA, 14 bp, Homo sapiens
tttccttccactgt

SEQ ID NO: 1163929 - DNA, 11 bp, Homo sapiens
tttccttccct

SEQ ID NO: 1163930 - DNA, 16 bp, Homo sapiens
tttccttctaacatgt

SEQ ID NO: 1163931 - DNA, 17 bp, Homo sapiens
tttccttctctgaaagt

SEQ ID NO: 1163932 - DNA, 19 bp, Homo sapiens
tttccttctctgtaaccag

SEQ ID NO: 1163933 - DNA, 13 bp, Homo sapiens
tttccttctgtta

SEQ ID NO: 1163934 - DNA, 14 bp, Homo sapiens
tttccttctgttaa

SEQ ID NO: 1163935 - DNA, 17 bp, Homo sapiens
tttccttctgttaagaa

SEQ ID NO: 1163936 - DNA, 12 bp, Homo sapiens
tttccttgcttt

SEQ ID NO: 1163937 - DNA, 13 bp, Homo sapiens
tttccttgtatgt

SEQ ID NO: 1163938 - DNA, 20 bp, Homo sapiens
tcacaaaatatattttgttt

SEQ ID NO: 1163939 - DNA, 14 bp, Homo sapiens
tcacaaaattttat

SEQ ID NO: 1163940 - DNA, 17 bp, Homo sapiens
tcacaaactacctctgg

SEQ ID NO: 1163941 - DNA, 19 bp, Homo sapiens
tcacaaactgatctaaaat

SEQ ID NO: 1163942 - DNA, 20 bp, Homo sapiens
tcacaaactgatctaaaatg

SEQ ID NO: 1163943 - DNA, 21 bp, Homo sapiens
tcacaaacttttatactcttt

SEQ ID NO: 1163944 - DNA, 16 bp, Homo sapiens
tcacaaagcccaaggg

SEQ ID NO: 1163945 - DNA, 19 bp, Homo sapiens
tcacaaagggactttggaa

SEQ ID NO: 1163946 - DNA, 20 bp, Homo sapiens
tcacaaatcctaaaagaagc

SEQ ID NO: 1163947 - DNA, 20 bp, Homo sapiens
tcacaaattccgattagacc

SEQ ID NO: 1163948 - DNA, 16 bp, Homo sapiens
tcacaacaacctggtc

SEQ ID NO: 1163949 - DNA, 20 bp, Homo sapiens
tcacaacataaggagaatgt

SEQ ID NO: 1163950 - DNA, 18 bp, Homo sapiens
tcacaacctcaccaaact

SEQ ID NO: 1163951 - DNA, 20 bp, Homo sapiens
tcacaagaacacacacatat

SEQ ID NO: 1163952 - DNA, 14 bp, Homo sapiens
tcacaagaagacca

SEQ ID NO: 1163953 - DNA, 17 bp, Homo sapiens
tcacaagagcccagcag

SEQ ID NO: 1163954 - DNA, 15 bp, Homo sapiens
tcacaagcaacagac

SEQ ID NO: 1163955 - DNA, 18 bp, Homo sapiens
tcacaagcaatccatgat

SEQ ID NO: 1163956 - DNA, 13 bp, Homo sapiens
tcacaagcctcct

SEQ ID NO: 1163957 - DNA, 22 bp, Homo sapiens
tcacaaggcattcaagtgtaca

SEQ ID NO: 1163958 - DNA, 18 bp, Homo sapiens
tcacaagggacgctttgg

SEQ ID NO: 1163959 - DNA, 14 bp, Homo sapiens
tcacaaggtcagga

SEQ ID NO: 1163960 - DNA, 13 bp, Homo sapiens
tcacaataaatgg

SEQ ID NO: 1163961 - DNA, 18 bp, Homo sapiens
tcacaataaatggccagt

SEQ ID NO: 1163962 - DNA, 21 bp, Homo sapiens
tcacaataaatggccagtgct

SEQ ID NO: 1163963 - DNA, 15 bp, Homo sapiens
tcacaatgagattga

SEQ ID NO: 1163964 - DNA, 15 bp, Homo sapiens
tcacacacacagctg

SEQ ID NO: 1163965 - DNA, 12 bp, Homo sapiens
tcacacacctgt

SEQ ID NO: 1163966 - DNA, 21 bp, Homo sapiens
tcacacactcacaatttaaaa

SEQ ID NO: 1163967 - DNA, 13 bp, Homo sapiens
tcacacactggac

SEQ ID NO: 1163968 - DNA, 22 bp, Homo sapiens
tcacacaggacccccttcccct

SEQ ID NO: 1163969 - DNA, 17 bp, Homo sapiens
tcacacagggctctttg

SEQ ID NO: 1163970 - DNA, 23 bp, Homo sapiens
tcacacagggctctttgatggac

SEQ ID NO: 1163971 - DNA, 12 bp, Homo sapiens
tcacacagtgaa

SEQ ID NO: 1163972 - DNA, 20 bp, Homo sapiens
tcacacagtttaaaaaatca

SEQ ID NO: 1163973 - DNA, 20 bp, Homo sapiens
tcacacatccccagccaggg

SEQ ID NO: 1163974 - DNA, 16 bp, Homo sapiens
tcacacatctgggtgc

SEQ ID NO: 1163975 - DNA, 21 bp, Homo sapiens
tcacacatctgggtgccctga

SEQ ID NO: 1163976 - DNA, 22 bp, Homo sapiens
tcacacatctgggtgccctgaa

SEQ ID NO: 1163977 - DNA, 14 bp, Homo sapiens
tcacaccaaggaag

SEQ ID NO: 1163978 - DNA, 15 bp, Homo sapiens
tcacaccactgtact

SEQ ID NO: 1163979 - DNA, 11 bp, Homo sapiens
tcacacccacc

SEQ ID NO: 1163980 - DNA, 17 bp, Homo sapiens
tcacacctcagtgggaa

SEQ ID NO: 1163981 - DNA, 12 bp, Homo sapiens
tcacacctctgg

SEQ ID NO: 1163982 - DNA, 17 bp, Homo sapiens
tcacacctctgggcttc

SEQ ID NO: 1163983 - DNA, 12 bp, Homo sapiens
tcacacctgact

SEQ ID NO: 1163984 - DNA, 17 bp, Homo sapiens
tcacacctgccctaaac

SEQ ID NO: 1163985 - DNA, 18 bp, Homo sapiens
tcacactccagtggcaga

SEQ ID NO: 1163986 - DNA, 22 bp, Homo sapiens
tcacactccagtggcagacaaa

SEQ ID NO: 1163987 - DNA, 13 bp, Homo sapiens
tcacactccccgc

SEQ ID NO: 1163988 - DNA, 13 bp, Homo sapiens
tcacactcctggg

SEQ ID NO: 1163989 - DNA, 14 bp, Homo sapiens
tcacactctctgca

SEQ ID NO: 1163990 - DNA, 16 bp, Homo sapiens
tcacactctctgcagc

SEQ ID NO: 1163991 - DNA, 13 bp, Homo sapiens
tcacactctgggt

SEQ ID NO: 1163992 - DNA, 20 bp, Homo sapiens
tcacactgaatcagctgctg

SEQ ID NO: 1163993 - DNA, 16 bp, Homo sapiens
tcacactgatgggctg

SEQ ID NO: 1163994 - DNA, 21 bp, Homo sapiens
tcacactgatgggctggggca

SEQ ID NO: 1163995 - DNA, 16 bp, Homo sapiens
tcacactgcagagact

SEQ ID NO: 1163996 - DNA, 15 bp, Homo sapiens
tcacactgctgtcct

SEQ ID NO: 1163997 - DNA, 20 bp, Homo sapiens
tcacactgctgtcctctccc

SEQ ID NO: 1163998 - DNA, 21 bp, Homo sapiens
tcacactgctgtcctctcccc

SEQ ID NO: 1163999 - DNA, 23 bp, Homo sapiens
tcacactgctgtcctctccccct

SEQ ID NO: 1164000 - DNA, 22 bp, Homo sapiens
tcacactgggtggtggcctggt

SEQ ID NO: 1164001 - DNA, 16 bp, Homo sapiens
tcacactggtgctgag

SEQ ID NO: 1164002 - DNA, 16 bp, Homo sapiens
tcacactggttctcaa

SEQ ID NO: 1164003 - DNA, 20 bp, Homo sapiens
tcacactggttctcaatgaa

SEQ ID NO: 1164004 - DNA, 17 bp, Homo sapiens
tcacactgtcttcccga

SEQ ID NO: 1164005 - DNA, 18 bp, Homo sapiens
tcacacttatattttatg

SEQ ID NO: 1164006 - DNA, 23 bp, Homo sapiens
tcacacttctgtgagacccccac

SEQ ID NO: 1164007 - DNA, 14 bp, Homo sapiens
tcacagaaatcaga

SEQ ID NO: 1164008 - DNA, 16 bp, Homo sapiens
tcacagaaatcagagg

SEQ ID NO: 1164009 - DNA, 22 bp, Homo sapiens
tcacagaacctactgttccttt

SEQ ID NO: 1164010 - DNA, 23 bp, Homo sapiens
tttctaccagctcatacaaaata

SEQ ID NO: 1164011 - DNA, 20 bp, Homo sapiens
tttctaccctagccattcct

SEQ ID NO: 1164012 - DNA, 14 bp, Homo sapiens
tttctacctctttt

SEQ ID NO: 1164013 - DNA, 14 bp, Homo sapiens
tttctacgtcatgt

SEQ ID NO: 1164014 - DNA, 21 bp, Homo sapiens
tttctacgtcatgtattttat

SEQ ID NO: 1164015 - DNA, 22 bp, Homo sapiens
tttctactatgatcagaagaac

SEQ ID NO: 1164016 - DNA, 13 bp, Homo sapiens
tttctactgtaag

SEQ ID NO: 1164017 - DNA, 18 bp, Homo sapiens
tttctactttgaagtcat

SEQ ID NO: 1164018 - DNA, 22 bp, Homo sapiens
tttctactttgaagtcatacca

SEQ ID NO: 1164019 - DNA, 14 bp, Homo sapiens
tttctagaaatgtt

SEQ ID NO: 1164020 - DNA, 21 bp, Homo sapiens
tttctagaaatgtttaggtta

SEQ ID NO: 1164021 - DNA, 21 bp, Homo sapiens
tttctagaattatttttcact

SEQ ID NO: 1164022 - DNA, 21 bp, Homo sapiens
tttctagactataaatgttgc

SEQ ID NO: 1164023 - DNA, 15 bp, Homo sapiens
tttctagagacacat

SEQ ID NO: 1164024 - DNA, 16 bp, Homo sapiens
tttctagagacacatt

SEQ ID NO: 1164025 - DNA, 21 bp, Homo sapiens
tttctagaggtgctacatagt

SEQ ID NO: 1164026 - DNA, 21 bp, Homo sapiens
tttctagagttatcttcttta

SEQ ID NO: 1164027 - DNA, 17 bp, Homo sapiens
tttctagatacaataaa

SEQ ID NO: 1164028 - DNA, 19 bp, Homo sapiens
tttctagcaattttctttg

SEQ ID NO: 1164029 - DNA, 14 bp, Homo sapiens
tttctagccttaga

SEQ ID NO: 1164030 - DNA, 22 bp, Homo sapiens
tttctagcgaacgtatttctcc

SEQ ID NO: 1164031 - DNA, 22 bp, Homo sapiens
tttctagctagaaatatgattt

SEQ ID NO: 1164032 - DNA, 19 bp, Homo sapiens
tttctagctgttgagctgt

SEQ ID NO: 1164033 - DNA, 21 bp, Homo sapiens
tttctagctgttgagctgttt

SEQ ID NO: 1164034 - DNA, 20 bp, Homo sapiens
tttctaggcctacatgcttt

SEQ ID NO: 1164035 - DNA, 15 bp, Homo sapiens
tttctagtccaaaat

SEQ ID NO: 1164036 - DNA, 15 bp, Homo sapiens
tttctagtgtatact

SEQ ID NO: 1164037 - DNA, 15 bp, Homo sapiens
tttctataaatcagt

SEQ ID NO: 1164038 - DNA, 15 bp, Homo sapiens
tttctataagttgta

SEQ ID NO: 1164039 - DNA, 19 bp, Homo sapiens
tttctataagttgtaccaa

SEQ ID NO: 1164040 - DNA, 18 bp, Homo sapiens
tttctatagccaaaaata

SEQ ID NO: 1164041 - DNA, 22 bp, Homo sapiens
tttctatagccaaaaatagcta

SEQ ID NO: 1164042 - DNA, 21 bp, Homo sapiens
tttctatagccaactgctaat

SEQ ID NO: 1164043 - DNA, 15 bp, Homo sapiens
tttctatataaaatg

SEQ ID NO: 1164044 - DNA, 23 bp, Homo sapiens
tttctatataaaatgtattcaag

SEQ ID NO: 1164045 - DNA, 22 bp, Homo sapiens
tttctatatagttccttgcctt

SEQ ID NO: 1164046 - DNA, 21 bp, Homo sapiens
tttctatcagacgtgctccct

SEQ ID NO: 1164047 - DNA, 21 bp, Homo sapiens
tttctatcccccttaaagaaa

SEQ ID NO: 1164048 - DNA, 15 bp, Homo sapiens
tttctatcctctgta

SEQ ID NO: 1164049 - DNA, 20 bp, Homo sapiens
tttctatcgttctctctttg

SEQ ID NO: 1164050 - DNA, 15 bp, Homo sapiens
tttctatgtaaatta

SEQ ID NO: 1164051 - DNA, 21 bp, Homo sapiens
tttctatgtcatttttaatgt

SEQ ID NO: 1164052 - DNA, 20 bp, Homo sapiens
tttctattaatatcaactct

SEQ ID NO: 1164053 - DNA, 14 bp, Homo sapiens
tttctatttgactt

SEQ ID NO: 1164054 - DNA, 16 bp, Homo sapiens
tttctatttgacttgt

SEQ ID NO: 1164055 - DNA, 22 bp, Homo sapiens
tttctcaacaaagcacagtgtt

SEQ ID NO: 1164056 - DNA, 17 bp, Homo sapiens
tttctcaatcagtgcag

SEQ ID NO: 1164057 - DNA, 20 bp, Homo sapiens
tttctcaatcagtgcagtga

SEQ ID NO: 1164058 - DNA, 15 bp, Homo sapiens
tttctcaatgcttag

SEQ ID NO: 1164059 - DNA, 18 bp, Homo sapiens
tttctgtgacatttatgt

SEQ ID NO: 1164060 - DNA, 20 bp, Homo sapiens
tttctgtgataactctgcaa

SEQ ID NO: 1164061 - DNA, 14 bp, Homo sapiens
tttctgtgcttgga

SEQ ID NO: 1164062 - DNA, 17 bp, Homo sapiens
tttctgtggctggctct

SEQ ID NO: 1164063 - DNA, 14 bp, Homo sapiens
tttctgtgtagaaa

SEQ ID NO: 1164064 - DNA, 16 bp, Homo sapiens
tttctgttatttttaa

SEQ ID NO: 1164065 - DNA, 14 bp, Homo sapiens
tttctgttcatctt

SEQ ID NO: 1164066 - DNA, 14 bp, Homo sapiens
tttctgttccaaat

SEQ ID NO: 1164067 - DNA, 20 bp, Homo sapiens
tttctgttccaaattcagtt

SEQ ID NO: 1164068 - DNA, 19 bp, Homo sapiens
tttctgtttataattgttt

SEQ ID NO: 1164069 - DNA, 20 bp, Homo sapiens
tttctgtttcttcttgtgat

SEQ ID NO: 1164070 - DNA, 20 bp, Homo sapiens
tttcttaaaagtactttaaa

SEQ ID NO: 1164071 - DNA, 16 bp, Homo sapiens
tttcttaaaccttcag

SEQ ID NO: 1164072 - DNA, 13 bp, Homo sapiens
tttcttaaagctt

SEQ ID NO: 1164073 - DNA, 18 bp, Homo sapiens
tttcttaaataagaaact

SEQ ID NO: 1164074 - DNA, 13 bp, Homo sapiens
tttcttaaatatg

SEQ ID NO: 1164075 - DNA, 13 bp, Homo sapiens
tttcttaacttct

SEQ ID NO: 1164076 - DNA, 23 bp, Homo sapiens
tttcttaagtaatgatactgtgt

SEQ ID NO: 1164077 - DNA, 21 bp, Homo sapiens
tttcttaattttcaccgagca

SEQ ID NO: 1164078 - DNA, 16 bp, Homo sapiens
tttcttaattttgtct

SEQ ID NO: 1164079 - DNA, 18 bp, Homo sapiens
tttcttacacacccccag

SEQ ID NO: 1164080 - DNA, 17 bp, Homo sapiens
tttcttacataattttt

SEQ ID NO: 1164081 - DNA, 18 bp, Homo sapiens
tttcttaccagtctcctc

SEQ ID NO: 1164082 - DNA, 15 bp, Homo sapiens
tttcttagtcattac

SEQ ID NO: 1164083 - DNA, 21 bp, Homo sapiens
tttcttagtgcttcagagttt

SEQ ID NO: 1164084 - DNA, 23 bp, Homo sapiens
tttcttagtgcttcagagtttgt

SEQ ID NO: 1164085 - DNA, 21 bp, Homo sapiens
tttcttataccttctgacagc

SEQ ID NO: 1164086 - DNA, 22 bp, Homo sapiens
tttcttatcacataagagagat

SEQ ID NO: 1164087 - DNA, 17 bp, Homo sapiens
tttcttatcttctgcaa

SEQ ID NO: 1164088 - DNA, 17 bp, Homo sapiens
tttcttatgtgacatta

SEQ ID NO: 1164089 - DNA, 14 bp, Homo sapiens
tttcttattgcgct

SEQ ID NO: 1164090 - DNA, 18 bp, Homo sapiens
tttcttatttaacttaac

SEQ ID NO: 1164091 - DNA, 13 bp, Homo sapiens
tttcttattttag

SEQ ID NO: 1164092 - DNA, 15 bp, Homo sapiens
tttcttatttttgtc

SEQ ID NO: 1164093 - DNA, 19 bp, Homo sapiens
tttcttcaccaagtgcaat

SEQ ID NO: 1164094 - DNA, 12 bp, Homo sapiens
tttcttcagaat

SEQ ID NO: 1164095 - DNA, 17 bp, Homo sapiens
tttcttcaggtaacact

SEQ ID NO: 1164096 - DNA, 14 bp, Homo sapiens
tttcttcctctgct

SEQ ID NO: 1164097 - DNA, 15 bp, Homo sapiens
tttcttcctttactt

SEQ ID NO: 1164098 - DNA, 14 bp, Homo sapiens
tttcttcctttcta

SEQ ID NO: 1164099 - DNA, 15 bp, Homo sapiens
tttcttcgtgaacat

SEQ ID NO: 1164100 - DNA, 13 bp, Homo sapiens
tttcttctacttt

SEQ ID NO: 1164101 - DNA, 21 bp, Homo sapiens
tttcttctagctgagctttaa

SEQ ID NO: 1164102 - DNA, 13 bp, Homo sapiens
tttcttctctctg

SEQ ID NO: 1164103 - DNA, 19 bp, Homo sapiens
tttcttctctctgttccct

SEQ ID NO: 1164104 - DNA, 14 bp, Homo sapiens
tttcttctgccctt

SEQ ID NO: 1164105 - DNA, 17 bp, Homo sapiens
tttcttctggtagcata

SEQ ID NO: 1164106 - DNA, 13 bp, Homo sapiens
tttcttcttcatg

SEQ ID NO: 1164107 - DNA, 13 bp, Homo sapiens
tttcttcttccct

SEQ ID NO: 1164108 - DNA, 16 bp, Homo sapiens
tttcttcttctaagaa

SEQ ID NO: 1164109 - DNA, 19 bp, Homo sapiens
tttcttcttctaagaagac

SEQ ID NO: 1164110 - DNA, 20 bp, Homo sapiens
tttcttcttctaagaagaca

SEQ ID NO: 1164111 - DNA, 12 bp, Homo sapiens
tttcttctttcc

SEQ ID NO: 1164112 - DNA, 15 bp, Homo sapiens
tttcttctttccctg

SEQ ID NO: 1164113 - DNA, 18 bp, Homo sapiens
tttcttctttccctggac

SEQ ID NO: 1164114 - DNA, 16 bp, Homo sapiens
tttcttcttttccttt

SEQ ID NO: 1164115 - DNA, 15 bp, Homo sapiens
tttcttgaaaagcct

SEQ ID NO: 1164116 - DNA, 20 bp, Homo sapiens
tttcttgaagaataaattct

SEQ ID NO: 1164117 - DNA, 21 bp, Homo sapiens
tttcttgacaaaacctaactt

SEQ ID NO: 1164118 - DNA, 16 bp, Homo sapiens
tttcttgacaagctga

SEQ ID NO: 1164119 - DNA, 17 bp, Homo sapiens
tttcttgatcttaaaga

SEQ ID NO: 1164120 - DNA, 15 bp, Homo sapiens
tttcttgcactgaat

SEQ ID NO: 1164121 - DNA, 17 bp, Homo sapiens
tttcttgcactgaatat

SEQ ID NO: 1164122 - DNA, 18 bp, Homo sapiens
tttcttgctctctctccc

SEQ ID NO: 1164123 - DNA, 17 bp, Homo sapiens
tttcttggttcataaat

SEQ ID NO: 1164124 - DNA, 20 bp, Homo sapiens
tttcttgtagccatggctgg

SEQ ID NO: 1164125 - DNA, 13 bp, Homo sapiens
tttcttgtctata

SEQ ID NO: 1164126 - DNA, 18 bp, Homo sapiens
tttcttgtctataaagca

SEQ ID NO: 1164127 - DNA, 15 bp, Homo sapiens
tttcttgtctttcct

SEQ ID NO: 1164128 - DNA, 19 bp, Homo sapiens
tttcttgtgtagatttgaa

SEQ ID NO: 1164129 - DNA, 13 bp, Homo sapiens
tttcttgtttaac

SEQ ID NO: 1164130 - DNA, 15 bp, Homo sapiens
tttctttaaaaaaca

SEQ ID NO: 1164131 - DNA, 19 bp, Homo sapiens
tttctttaaaataaaaaag

SEQ ID NO: 1164132 - DNA, 13 bp, Homo sapiens
tttctttaactgc

SEQ ID NO: 1164133 - DNA, 15 bp, Homo sapiens
tttctttacaaaaca

SEQ ID NO: 1164134 - DNA, 13 bp, Homo sapiens
tttctttcaactt

SEQ ID NO: 1164135 - DNA, 19 bp, Homo sapiens
tttctttcaacttgcatcc

SEQ ID NO: 1164136 - DNA, 16 bp, Homo sapiens
tttctttcagatgttt

SEQ ID NO: 1164137 - DNA, 13 bp, Homo sapiens
tttctttccgaca

SEQ ID NO: 1164138 - DNA, 15 bp, Homo sapiens
tttctttcttccatt

SEQ ID NO: 1164139 - DNA, 14 bp, Homo sapiens
tttctttcttcctc

SEQ ID NO: 1164140 - DNA, 20 bp, Homo sapiens
tcaccaggacttggggtcag

SEQ ID NO: 1164141 - DNA, 23 bp, Homo sapiens
tcaccaggcccacgaggagcagc

SEQ ID NO: 1164142 - DNA, 15 bp, Homo sapiens
tcaccaggtgcatct

SEQ ID NO: 1164143 - DNA, 17 bp, Homo sapiens
tcaccaggtgcatctgc

SEQ ID NO: 1164144 - DNA, 19 bp, Homo sapiens
tcaccagtctgtctactgt

SEQ ID NO: 1164145 - DNA, 23 bp, Homo sapiens
tcaccagtctgtctactgtggtg

SEQ ID NO: 1164146 - DNA, 16 bp, Homo sapiens
tcaccagtggcctttc

SEQ ID NO: 1164147 - DNA, 23 bp, Homo sapiens
tcaccagtggcctttcagtgtag

SEQ ID NO: 1164148 - DNA, 21 bp, Homo sapiens
tcaccagtgtcccctccactg

SEQ ID NO: 1164149 - DNA, 15 bp, Homo sapiens
tcaccagtgttcctg

SEQ ID NO: 1164150 - DNA, 17 bp, Homo sapiens
tcaccagtgttcctgaa

SEQ ID NO: 1164151 - DNA, 20 bp, Homo sapiens
tcaccagtgttcctgaagct

SEQ ID NO: 1164152 - DNA, 18 bp, Homo sapiens
tcaccatccaccttccct

SEQ ID NO: 1164153 - DNA, 12 bp, Homo sapiens
tcaccatcctca

SEQ ID NO: 1164154 - DNA, 16 bp, Homo sapiens
tcaccatcctcagagg

SEQ ID NO: 1164155 - DNA, 19 bp, Homo sapiens
tcaccatcctcagaggctg

SEQ ID NO: 1164156 - DNA, 16 bp, Homo sapiens
tcaccatctcaggcca

SEQ ID NO: 1164157 - DNA, 22 bp, Homo sapiens
tcaccatgggaggtggggcctc

SEQ ID NO: 1164158 - DNA, 23 bp, Homo sapiens
tcaccatgggaggtggggcctca

SEQ ID NO: 1164159 - DNA, 15 bp, Homo sapiens
tcaccatgtaagcac

SEQ ID NO: 1164160 - DNA, 17 bp, Homo sapiens
tcaccatgtaagcactc

SEQ ID NO: 1164161 - DNA, 17 bp, Homo sapiens
tcaccatgttagcctta

SEQ ID NO: 1164162 - DNA, 21 bp, Homo sapiens
tcaccatgttggccaggctgg

SEQ ID NO: 1164163 - DNA, 18 bp, Homo sapiens
tcacccaaacacttctgc

SEQ ID NO: 1164164 - DNA, 20 bp, Homo sapiens
tcacccaaagcctgtcccag

SEQ ID NO: 1164165 - DNA, 23 bp, Homo sapiens
tcacccaaagcctgtcccaggac

SEQ ID NO: 1164166 - DNA, 13 bp, Homo sapiens
tcacccacccctg

SEQ ID NO: 1164167 - DNA, 13 bp, Homo sapiens
tcacccacctctg

SEQ ID NO: 1164168 - DNA, 13 bp, Homo sapiens
tcacccacctctt

SEQ ID NO: 1164169 - DNA, 11 bp, Homo sapiens
tcacccagagc

SEQ ID NO: 1164170 - DNA, 21 bp, Homo sapiens
tcacccagctaatctgtaggg

SEQ ID NO: 1164171 - DNA, 23 bp, Homo sapiens
tcacccaggctctggagccagag

SEQ ID NO: 1164172 - DNA, 17 bp, Homo sapiens
tcaccccaatccctgcc

SEQ ID NO: 1164173 - DNA, 21 bp, Homo sapiens
tcaccccaatccctgccactg

SEQ ID NO: 1164174 - DNA, 16 bp, Homo sapiens
tcaccccacttcccat

SEQ ID NO: 1164175 - DNA, 15 bp, Homo sapiens
tcaccccagcctcat

SEQ ID NO: 1164176 - DNA, 13 bp, Homo sapiens
tcaccccagctcc

SEQ ID NO: 1164177 - DNA, 19 bp, Homo sapiens
tcaccccatcccacaccct

SEQ ID NO: 1164178 - DNA, 18 bp, Homo sapiens
tcacccccacttcccact

SEQ ID NO: 1164179 - DNA, 15 bp, Homo sapiens
tcaccccccaatctc

SEQ ID NO: 1164180 - DNA, 20 bp, Homo sapiens
tcaccccctcccacccccag

SEQ ID NO: 1164181 - DNA, 22 bp, Homo sapiens
tcaccccctcccacccccagcc

SEQ ID NO: 1164182 - DNA, 15 bp, Homo sapiens
tttgatcatcccttt

SEQ ID NO: 1164183 - DNA, 16 bp, Homo sapiens
tttgatccttcccctc

SEQ ID NO: 1164184 - DNA, 13 bp, Homo sapiens
tttgatccttgga

SEQ ID NO: 1164185 - DNA, 17 bp, Homo sapiens
tttgatccttggaaacc

SEQ ID NO: 1164186 - DNA, 21 bp, Homo sapiens
tttgatctggacagaacattt

SEQ ID NO: 1164187 - DNA, 20 bp, Homo sapiens
tttgatgatgtctacagaaa

SEQ ID NO: 1164188 - DNA, 15 bp, Homo sapiens
tttgatgctgtttga

SEQ ID NO: 1164189 - DNA, 13 bp, Homo sapiens
tttgatggggaga

SEQ ID NO: 1164190 - DNA, 15 bp, Homo sapiens
tttgatggtatttct

SEQ ID NO: 1164191 - DNA, 18 bp, Homo sapiens
tttgatgtacatgtgtag

SEQ ID NO: 1164192 - DNA, 17 bp, Homo sapiens
tttgatgtatgtgtgaa

SEQ ID NO: 1164193 - DNA, 23 bp, Homo sapiens
tttgatgtgtgggcttctgagtt

SEQ ID NO: 1164194 - DNA, 21 bp, Homo sapiens
tttgattaaattcttgcaaag

SEQ ID NO: 1164195 - DNA, 23 bp, Homo sapiens
tttgattaaattcttgcaaagta

SEQ ID NO: 1164196 - DNA, 15 bp, Homo sapiens
tttgattaacatttg

SEQ ID NO: 1164197 - DNA, 17 bp, Homo sapiens
tttgattaatgtttctt

SEQ ID NO: 1164198 - DNA, 14 bp, Homo sapiens
tttgattattatgt

SEQ ID NO: 1164199 - DNA, 23 bp, Homo sapiens
tttgattattatgtttattacaa

SEQ ID NO: 1164200 - DNA, 16 bp, Homo sapiens
tttgattatttgcatg

SEQ ID NO: 1164201 - DNA, 15 bp, Homo sapiens
tttgattcaaaatat

SEQ ID NO: 1164202 - DNA, 18 bp, Homo sapiens
tttgattcagctcattat

SEQ ID NO: 1164203 - DNA, 20 bp, Homo sapiens
tttgattcatagtaacttct

SEQ ID NO: 1164204 - DNA, 17 bp, Homo sapiens
tttgatttacagcaagt

SEQ ID NO: 1164205 - DNA, 22 bp, Homo sapiens
tttgatttagtgaatggcattt

SEQ ID NO: 1164206 - DNA, 16 bp, Homo sapiens
tttgatttcaacatga

SEQ ID NO: 1164207 - DNA, 23 bp, Homo sapiens
tttgattttggaaagatgttaag

SEQ ID NO: 1164208 - DNA, 17 bp, Homo sapiens
tttgatttttgaagttg

SEQ ID NO: 1164209 - DNA, 22 bp, Homo sapiens
tttgcaaacaattttaatgatg

SEQ ID NO: 1164210 - DNA, 19 bp, Homo sapiens
tttgcaaacccgaaaataa

SEQ ID NO: 1164211 - DNA, 18 bp, Homo sapiens
tttgcaaagaccacctcc

SEQ ID NO: 1164212 - DNA, 15 bp, Homo sapiens
tttgcaaaggagctc

SEQ ID NO: 1164213 - DNA, 18 bp, Homo sapiens
tttgcaaagtgtattagg

SEQ ID NO: 1164214 - DNA, 23 bp, Homo sapiens
tttgcaacaggggaggaaaaaag

SEQ ID NO: 1164215 - DNA, 13 bp, Homo sapiens
tttgcaacattta

SEQ ID NO: 1164216 - DNA, 21 bp, Homo sapiens
tttgcaagggaaaagtctctt

SEQ ID NO: 1164217 - DNA, 16 bp, Homo sapiens
tttgcaagtgaaggtt

SEQ ID NO: 1164218 - DNA, 17 bp, Homo sapiens
tttgcaataacttctat

SEQ ID NO: 1164219 - DNA, 17 bp, Homo sapiens
tttgcaattgctcttct

SEQ ID NO: 1164220 - DNA, 18 bp, Homo sapiens
tttgcacaatatttcttt

SEQ ID NO: 1164221 - DNA, 13 bp, Homo sapiens
tttgcacatgtga

SEQ ID NO: 1164222 - DNA, 14 bp, Homo sapiens
tttgcacatgtgac

SEQ ID NO: 1164223 - DNA, 14 bp, Homo sapiens
tttgcacccctttc

SEQ ID NO: 1164224 - DNA, 18 bp, Homo sapiens
tttgcaccgcctgccctc

SEQ ID NO: 1164225 - DNA, 15 bp, Homo sapiens
tttgcacctgtcccc

SEQ ID NO: 1164226 - DNA, 17 bp, Homo sapiens
tttgcacctttctagtt

SEQ ID NO: 1164227 - DNA, 21 bp, Homo sapiens
tttgcacctttctagttgaaa

SEQ ID NO: 1164228 - DNA, 12 bp, Homo sapiens
tttgcactgagg

SEQ ID NO: 1164229 - DNA, 16 bp, Homo sapiens
tttgcactgagggcca

SEQ ID NO: 1164230 - DNA, 17 bp, Homo sapiens
tttgcactgagggccac

SEQ ID NO: 1164231 - DNA, 20 bp, Homo sapiens
tttgcactggagttctatgc

SEQ ID NO: 1164232 - DNA, 17 bp, Homo sapiens
tttgcactgtatgctgg

SEQ ID NO: 1164233 - DNA, 17 bp, Homo sapiens
tttgcagaagagggtgt

SEQ ID NO: 1164234 - DNA, 19 bp, Homo sapiens
tttgcagaaggaaatgatg

SEQ ID NO: 1164235 - DNA, 12 bp, Homo sapiens
tttgcagagcct

SEQ ID NO: 1164236 - DNA, 16 bp, Homo sapiens
tttgcaggattccctt

SEQ ID NO: 1164237 - DNA, 16 bp, Homo sapiens
tttgcaggctctgggc

SEQ ID NO: 1164238 - DNA, 17 bp, Homo sapiens
tttgcaggctctgggct

SEQ ID NO: 1164239 - DNA, 21 bp, Homo sapiens
tttgcaggctctgggctcagg

SEQ ID NO: 1164240 - DNA, 9 bp, Homo sapiens
tttgcagta

SEQ ID NO: 1164241 - DNA, 21 bp, Homo sapiens
tttgcagtagagtcatctcca

SEQ ID NO: 1164242 - DNA, 19 bp, Homo sapiens
tttgcagtgcagtatagaa

SEQ ID NO: 1164243 - DNA, 22 bp, Homo sapiens
tttgcagttggactctcaggga

SEQ ID NO: 1164244 - DNA, 17 bp, Homo sapiens
tttgcataacaattcct

SEQ ID NO: 1164245 - DNA, 14 bp, Homo sapiens
tttgcatctcagta

SEQ ID NO: 1164246 - DNA, 14 bp, Homo sapiens
tttgcatctgaccc

SEQ ID NO: 1164247 - DNA, 18 bp, Homo sapiens
tttgcatgatatcttcaa

SEQ ID NO: 1164248 - DNA, 19 bp, Homo sapiens
tttgcatgtcgcacaatgt

SEQ ID NO: 1164249 - DNA, 15 bp, Homo sapiens
tttgcatgttatgtt

SEQ ID NO: 1164250 - DNA, 18 bp, Homo sapiens
tttgcattaaattcacaa

SEQ ID NO: 1164251 - DNA, 21 bp, Homo sapiens
tttgcattaaattcacaaact

SEQ ID NO: 1164252 - DNA, 12 bp, Homo sapiens
tttgcattcaaa

SEQ ID NO: 1164253 - DNA, 18 bp, Homo sapiens
tttgcattgtgtcagaaa

SEQ ID NO: 1164254 - DNA, 12 bp, Homo sapiens
tttgcatttgtt

SEQ ID NO: 1164255 - DNA, 21 bp, Homo sapiens
tttgcatttgtttatgtaatt

SEQ ID NO: 1164256 - DNA, 23 bp, Homo sapiens
tttgcatttgtttatgtaatttc

SEQ ID NO: 1164257 - DNA, 22 bp, Homo sapiens
tttgcatttttgttttgaaagt

SEQ ID NO: 1164258 - DNA, 24 bp, Homo sapiens
tttgcatttttgttttgaaagttt

SEQ ID NO: 1164259 - DNA, 13 bp, Homo sapiens
tttgccaactgaa

SEQ ID NO: 1164260 - DNA, 20 bp, Homo sapiens
tttgccactaattttagtat

SEQ ID NO: 1164261 - DNA, 21 bp, Homo sapiens
tttgccactaattttagtatt

SEQ ID NO: 1164262 - DNA, 22 bp, Homo sapiens
tttgccactaattttagtattc

SEQ ID NO: 1164263 - DNA, 20 bp, Homo sapiens
tttgccactttggcttctcc

SEQ ID NO: 1164264 - DNA, 19 bp, Homo sapiens
tttgccagactctaggtta

SEQ ID NO: 1164265 - DNA, 12 bp, Homo sapiens
tttgccagagca

SEQ ID NO: 1164266 - DNA, 21 bp, Homo sapiens
tttgccagagccaaattttat

SEQ ID NO: 1164267 - DNA, 13 bp, Homo sapiens
tttgccagctgct

SEQ ID NO: 1164268 - DNA, 22 bp, Homo sapiens
tttgccatatggaggactgtga

SEQ ID NO: 1164269 - DNA, 14 bp, Homo sapiens
tttgccatgtcgct

SEQ ID NO: 1164270 - DNA, 18 bp, Homo sapiens
tttgcccagaaagaagat

SEQ ID NO: 1164271 - DNA, 17 bp, Homo sapiens
tttgcccagtcctgggt

SEQ ID NO: 1164272 - DNA, 17 bp, Homo sapiens
tttgccccaagtcctca

SEQ ID NO: 1164273 - DNA, 19 bp, Homo sapiens
tcactcattgctgagcctc

SEQ ID NO: 1164274 - DNA, 14 bp, Homo sapiens
tcactccaagacca

SEQ ID NO: 1164275 - DNA, 13 bp, Homo sapiens
tcactccaccacc

SEQ ID NO: 1164276 - DNA, 15 bp, Homo sapiens
tcactccaccatccc

SEQ ID NO: 1164277 - DNA, 15 bp, Homo sapiens
tcactccagccaaag

SEQ ID NO: 1164278 - DNA, 16 bp, Homo sapiens
tcactccagccaaaga

SEQ ID NO: 1164279 - DNA, 14 bp, Homo sapiens
tcactccagtagct

SEQ ID NO: 1164280 - DNA, 18 bp, Homo sapiens
tcactccccactccccca

SEQ ID NO: 1164281 - DNA, 16 bp, Homo sapiens
tcactccccagcctgg

SEQ ID NO: 1164282 - DNA, 17 bp, Homo sapiens
tcactccccagcctggg

SEQ ID NO: 1164283 - DNA, 18 bp, Homo sapiens
tcactccccagcctgggc

SEQ ID NO: 1164284 - DNA, 19 bp, Homo sapiens
tcactccccagggagctct

SEQ ID NO: 1164285 - DNA, 20 bp, Homo sapiens
tcactccccagggagctctg

SEQ ID NO: 1164286 - DNA, 17 bp, Homo sapiens
tcactccctctgccttc

SEQ ID NO: 1164287 - DNA, 12 bp, Homo sapiens
tcactccctgga

SEQ ID NO: 1164288 - DNA, 14 bp, Homo sapiens
tcactccggtgtgc

SEQ ID NO: 1164289 - DNA, 22 bp, Homo sapiens
tcactccggtgtgcctgcagcc

SEQ ID NO: 1164290 - DNA, 14 bp, Homo sapiens
tcactcctgcgctg

SEQ ID NO: 1164291 - DNA, 14 bp, Homo sapiens
tcactcctgcttct

SEQ ID NO: 1164292 - DNA, 22 bp, Homo sapiens
tcactcctgcttctctcagcca

SEQ ID NO: 1164293 - DNA, 14 bp, Homo sapiens
tcactcctggaggc

SEQ ID NO: 1164294 - DNA, 10 bp, Homo sapiens
tcactcctgt

SEQ ID NO: 1164295 - DNA, 20 bp, Homo sapiens
tcactcctgttacttaccta

SEQ ID NO: 1164296 - DNA, 13 bp, Homo sapiens
tcactccttttaa

SEQ ID NO: 1164297 - DNA, 16 bp, Homo sapiens
tcactccttttaaaga

SEQ ID NO: 1164298 - DNA, 17 bp, Homo sapiens
tcactccttttaaagaa

SEQ ID NO: 1164299 - DNA, 18 bp, Homo sapiens
tcactccttttaaagaaa

SEQ ID NO: 1164300 - DNA, 14 bp, Homo sapiens
tcactcgcaggacc

SEQ ID NO: 1164301 - DNA, 15 bp, Homo sapiens
tcactcgcccccggg

SEQ ID NO: 1164302 - DNA, 13 bp, Homo sapiens
tcactctcagtgc

SEQ ID NO: 1164303 - DNA, 14 bp, Homo sapiens
tcactctctattgt

SEQ ID NO: 1164304 - DNA, 13 bp, Homo sapiens
tcacttcagatct

SEQ ID NO: 1164305 - DNA, 14 bp, Homo sapiens
tcacttcagatctc

SEQ ID NO: 1164306 - DNA, 16 bp, Homo sapiens
tcacttcataatccag

SEQ ID NO: 1164307 - DNA, 16 bp, Homo sapiens
tcacttcatgttttgt

SEQ ID NO: 1164308 - DNA, 22 bp, Homo sapiens
tcacttccatacagctctacgt

SEQ ID NO: 1164309 - DNA, 12 bp, Homo sapiens
tcacttctaaat

SEQ ID NO: 1164310 - DNA, 16 bp, Homo sapiens
tcacttctaaatgcat

SEQ ID NO: 1164311 - DNA, 12 bp, Homo sapiens
tcacttctcctg

SEQ ID NO: 1164312 - DNA, 23 bp, Homo sapiens
tcacttctcctgctgctcctgtt

SEQ ID NO: 1164313 - DNA, 18 bp, Homo sapiens
tcacttctgaccacactt

SEQ ID NO: 1164314 - DNA, 12 bp, Homo sapiens
tcacttcttcac

SEQ ID NO: 1164315 - DNA, 18 bp, Homo sapiens
tcacttcttccactgtgt

SEQ ID NO: 1164316 - DNA, 18 bp, Homo sapiens
tcacttctttgcagagcc

SEQ ID NO: 1164317 - DNA, 12 bp, Homo sapiens
tcacttgagacc

SEQ ID NO: 1164318 - DNA, 22 bp, Homo sapiens
tcacttgaggccagtgagctgt

SEQ ID NO: 1164319 - DNA, 16 bp, Homo sapiens
tcacttgattcatctc

SEQ ID NO: 1164320 - DNA, 17 bp, Homo sapiens
tcacttgattcatctct

SEQ ID NO: 1164321 - DNA, 21 bp, Homo sapiens
tcacttgattcatctctggtt

SEQ ID NO: 1164322 - DNA, 11 bp, Homo sapiens
tcacttgccac

SEQ ID NO: 1164323 - DNA, 14 bp, Homo sapiens
tcacttgccacatg

SEQ ID NO: 1164324 - DNA, 16 bp, Homo sapiens
tcacttgggagctgct

SEQ ID NO: 1164325 - DNA, 22 bp, Homo sapiens
tcacttgggagctgctgggcta

SEQ ID NO: 1164326 - DNA, 23 bp, Homo sapiens
tcacttgggagctgctgggctag

SEQ ID NO: 1164327 - DNA, 13 bp, Homo sapiens
tcacttggggttt

SEQ ID NO: 1164328 - DNA, 16 bp, Homo sapiens
tcacttgtacaaaata

SEQ ID NO: 1164329 - DNA, 11 bp, Homo sapiens
tcacttgtatt

SEQ ID NO: 1164330 - DNA, 18 bp, Homo sapiens
tcacttgtcgggggccca

SEQ ID NO: 1164331 - DNA, 14 bp, Homo sapiens
tcacttgtctcctt

SEQ ID NO: 1164332 - DNA, 17 bp, Homo sapiens
tcacttgtctcctttct

SEQ ID NO: 1164333 - DNA, 16 bp, Homo sapiens
tcacttgtgctttgct

SEQ ID NO: 1164334 - DNA, 20 bp, Homo sapiens
tcacttgtgctttgctcttg

SEQ ID NO: 1164335 - DNA, 23 bp, Homo sapiens
tcacttgtgctttgctcttgtcc

SEQ ID NO: 1164336 - DNA, 13 bp, Homo sapiens
tcactttaagttt

SEQ ID NO: 1164337 - DNA, 15 bp, Homo sapiens
tcactttagatgctg

SEQ ID NO: 1164338 - DNA, 17 bp, Homo sapiens
tcactttagatgctgat

SEQ ID NO: 1164339 - DNA, 13 bp, Homo sapiens
tcactttattgct

SEQ ID NO: 1164340 - DNA, 18 bp, Homo sapiens
tcactttcacatagatgt

SEQ ID NO: 1164341 - DNA, 13 bp, Homo sapiens
tcactttcatttt

SEQ ID NO: 1164342 - DNA, 14 bp, Homo sapiens
tcactttctcagtt

SEQ ID NO: 1164343 - DNA, 21 bp, Homo sapiens
tcactttgaaaagttggaagg

SEQ ID NO: 1164344 - DNA, 17 bp, Homo sapiens
tcactttgctctgggtg

SEQ ID NO: 1164345 - DNA, 13 bp, Homo sapiens
tcactttgtctaa

SEQ ID NO: 1164346 - DNA, 13 bp, Homo sapiens
tcactttgtttat

SEQ ID NO: 1164347 - DNA, 18 bp, Homo sapiens
tcactttgtttatgcata

SEQ ID NO: 1164348 - DNA, 19 bp, Homo sapiens
tcacttttaatgaacaaat

SEQ ID NO: 1164349 - DNA, 14 bp, Homo sapiens
tcacttttcagtga

SEQ ID NO: 1164350 - DNA, 22 bp, Homo sapiens
tcacttttcatccttccccaac

SEQ ID NO: 1164351 - DNA, 15 bp, Homo sapiens
tcacttttccttttc

SEQ ID NO: 1164352 - DNA, 18 bp, Homo sapiens
tcacttttgacaaaggca

SEQ ID NO: 1164353 - DNA, 20 bp, Homo sapiens
tcacttttggcaatgactca

SEQ ID NO: 1164354 - DNA, 13 bp, Homo sapiens
tcacttttgttct

SEQ ID NO: 1164355 - DNA, 17 bp, Homo sapiens
tcacttttgttctgctt

SEQ ID NO: 1164356 - DNA, 23 bp, Homo sapiens
tcacttttgttgcccaggctgga

SEQ ID NO: 1164357 - DNA, 17 bp, Homo sapiens
tcactttttacccagaa

SEQ ID NO: 1164358 - DNA, 21 bp, Homo sapiens
tcactttttatgctatttctg

SEQ ID NO: 1164359 - DNA, 22 bp, Homo sapiens
tcactttttatgctatttctgt

SEQ ID NO: 1164360 - DNA, 18 bp, Homo sapiens
tcacttttttctgccttg

SEQ ID NO: 1164361 - DNA, 13 bp, Homo sapiens
tcactttttttct

SEQ ID NO: 1164362 - DNA, 18 bp, Homo sapiens
tcactttttttctttttc

SEQ ID NO: 1164363 - DNA, 19 bp, Homo sapiens
tcactttttttctttttct

SEQ ID NO: 1164364 - DNA, 17 bp, Homo sapiens
tcagaaaaaaataaatg

SEQ ID NO: 1164365 - DNA, 16 bp, Homo sapiens
tcagaaaaaaattcat

SEQ ID NO: 1164366 - DNA, 21 bp, Homo sapiens
tcagaaaacaacttggcattt

SEQ ID NO: 1164367 - DNA, 18 bp, Homo sapiens
tcagaaaatgttctgttt

SEQ ID NO: 1164368 - DNA, 20 bp, Homo sapiens
tcagaaacaatgacatccag

SEQ ID NO: 1164369 - DNA, 20 bp, Homo sapiens
tcagaaaccctcattgtgtt

SEQ ID NO: 1164370 - DNA, 21 bp, Homo sapiens
tcagaaaccctcattgtgttt

SEQ ID NO: 1164371 - DNA, 24 bp, Homo sapiens
tcagaaacgagatcgggaagcaga

SEQ ID NO: 1164372 - DNA, 15 bp, Homo sapiens
tcagaaactcccctg

SEQ ID NO: 1164373 - DNA, 12 bp, Homo sapiens
tcagaaactgtt

SEQ ID NO: 1164374 - DNA, 13 bp, Homo sapiens
tcagaaagacttg

SEQ ID NO: 1164375 - DNA, 13 bp, Homo sapiens
tcagaaagagctc

SEQ ID NO: 1164376 - DNA, 19 bp, Homo sapiens
tcagaaagcttcaaattat

SEQ ID NO: 1164377 - DNA, 15 bp, Homo sapiens
tcagaaaggatttta

SEQ ID NO: 1164378 - DNA, 18 bp, Homo sapiens
tcagaaagtaacaatcta

SEQ ID NO: 1164379 - DNA, 20 bp, Homo sapiens
tcagaaagtcaccaggactt

SEQ ID NO: 1164380 - DNA, 23 bp, Homo sapiens
tcagaaagtgcctgacacactaa

SEQ ID NO: 1164381 - DNA, 14 bp, Homo sapiens
tcagaaatgctgcc

SEQ ID NO: 1164382 - DNA, 15 bp, Homo sapiens
tcagaaatgctgcct

SEQ ID NO: 1164383 - DNA, 21 bp, Homo sapiens
tcagaaatgctgcctgcctgt

SEQ ID NO: 1164384 - DNA, 20 bp, Homo sapiens
tcagaaatggacaaagaaaa

SEQ ID NO: 1164385 - DNA, 17 bp, Homo sapiens
tcagaaatgtaaatgtt

SEQ ID NO: 1164386 - DNA, 23 bp, Homo sapiens
tcagaaattaaaatattatttga

SEQ ID NO: 1164387 - DNA, 21 bp, Homo sapiens
tcagaacacacagactttctg

SEQ ID NO: 1164388 - DNA, 22 bp, Homo sapiens
tcagaacacacagactttctgt

SEQ ID NO: 1164389 - DNA, 15 bp, Homo sapiens
tcagaacagaggcat

SEQ ID NO: 1164390 - DNA, 19 bp, Homo sapiens
tcagaacagcctgcctgtc

SEQ ID NO: 1164391 - DNA, 10 bp, Homo sapiens
tcagaacata

SEQ ID NO: 1164392 - DNA, 20 bp, Homo sapiens
tcagaacatactgattggga

SEQ ID NO: 1164393 - DNA, 15 bp, Homo sapiens
tcagaacatgaaatg

SEQ ID NO: 1164394 - DNA, 17 bp, Homo sapiens
tcagaacatgttaagat

SEQ ID NO: 1164395 - DNA, 20 bp, Homo sapiens
tcagaaccagagggcatgct

SEQ ID NO: 1164396 - DNA, 21 bp, Homo sapiens
tcagaaccagagggcatgctg

SEQ ID NO: 1164397 - DNA, 13 bp, Homo sapiens
tcagaacccaggg

SEQ ID NO: 1164398 - DNA, 14 bp, Homo sapiens
tcagaacccagggc

SEQ ID NO: 1164399 - DNA, 16 bp, Homo sapiens
tcagaacccagggctc

SEQ ID NO: 1164400 - DNA, 14 bp, Homo sapiens
tcagaacctgagct

SEQ ID NO: 1164401 - DNA, 19 bp, Homo sapiens
tcagaaccttgtcccagcc

SEQ ID NO: 1164402 - DNA, 20 bp, Homo sapiens
tcagaactaaatttttcata

SEQ ID NO: 1164403 - DNA, 14 bp, Homo sapiens
tcagaactaacttt

SEQ ID NO: 1164404 - DNA, 19 bp, Homo sapiens
tttggctaatttttttaat

SEQ ID NO: 1164405 - DNA, 13 bp, Homo sapiens
tttggctagagtt

SEQ ID NO: 1164406 - DNA, 16 bp, Homo sapiens
tttggctagtccttgt

SEQ ID NO: 1164407 - DNA, 15 bp, Homo sapiens
tttggctctcccacc

SEQ ID NO: 1164408 - DNA, 20 bp, Homo sapiens
tttggctgaaattctcctgg

SEQ ID NO: 1164409 - DNA, 21 bp, Homo sapiens
tttggctgaaattctcctgga

SEQ ID NO: 1164410 - DNA, 13 bp, Homo sapiens
tttggctgcttct

SEQ ID NO: 1164411 - DNA, 22 bp, Homo sapiens
tttggctggagcggagatgagg

SEQ ID NO: 1164412 - DNA, 14 bp, Homo sapiens
tttggctgtgtcta

SEQ ID NO: 1164413 - DNA, 18 bp, Homo sapiens
tttggcttataaacacat

SEQ ID NO: 1164414 - DNA, 16 bp, Homo sapiens
tttggcttcatttcaa

SEQ ID NO: 1164415 - DNA, 14 bp, Homo sapiens
tttggcttccatga

SEQ ID NO: 1164416 - DNA, 13 bp, Homo sapiens
tttggcttggcct

SEQ ID NO: 1164417 - DNA, 20 bp, Homo sapiens
tttgggaagtgaagactgga

SEQ ID NO: 1164418 - DNA, 22 bp, Homo sapiens
tttgggaagtgaagactggaag

SEQ ID NO: 1164419 - DNA, 17 bp, Homo sapiens
tttgggaatgtttgtct

SEQ ID NO: 1164420 - DNA, 18 bp, Homo sapiens
tttgggagacatgtgaca

SEQ ID NO: 1164421 - DNA, 18 bp, Homo sapiens
tttgggagagtggtgagt

SEQ ID NO: 1164422 - DNA, 14 bp, Homo sapiens
tttgggaggccaag

SEQ ID NO: 1164423 - DNA, 22 bp, Homo sapiens
tttgggaggccaaggtgggagg

SEQ ID NO: 1164424 - DNA, 15 bp, Homo sapiens
tttgggagtttttgt

SEQ ID NO: 1164425 - DNA, 19 bp, Homo sapiens
tttgggatagagaatgttc

SEQ ID NO: 1164426 - DNA, 21 bp, Homo sapiens
tttgtatctgcaggcagacac

SEQ ID NO: 1164427 - DNA, 13 bp, Homo sapiens
tttgtatctttat

SEQ ID NO: 1164428 - DNA, 16 bp, Homo sapiens
tttgtatctttatgct

SEQ ID NO: 1164429 - DNA, 18 bp, Homo sapiens
tttgtatctttatgctgt

SEQ ID NO: 1164430 - DNA, 21 bp, Homo sapiens
tttgtatctttatgctgtatt

SEQ ID NO: 1164431 - DNA, 22 bp, Homo sapiens
tttgtatgaaattataatctgt

SEQ ID NO: 1164432 - DNA, 23 bp, Homo sapiens
tttgtatgagatggttaaaaagg

SEQ ID NO: 1164433 - DNA, 20 bp, Homo sapiens
tttgtatgaggtcctcaggt

SEQ ID NO: 1164434 - DNA, 22 bp, Homo sapiens
tttgtatgccaagtgagaagat

SEQ ID NO: 1164435 - DNA, 13 bp, Homo sapiens
tttgtatgccttt

SEQ ID NO: 1164436 - DNA, 14 bp, Homo sapiens
tttgtatgtaaatg

SEQ ID NO: 1164437 - DNA, 16 bp, Homo sapiens
tttgtatgtcactatt

SEQ ID NO: 1164438 - DNA, 18 bp, Homo sapiens
tttgtatgttatgaacat

SEQ ID NO: 1164439 - DNA, 17 bp, Homo sapiens
tttgtattaataaagca

SEQ ID NO: 1164440 - DNA, 18 bp, Homo sapiens
tttgtattaataaagcat

SEQ ID NO: 1164441 - DNA, 19 bp, Homo sapiens
tttgtattaataaagcatt

SEQ ID NO: 1164442 - DNA, 14 bp, Homo sapiens
tttgtattataaaa

SEQ ID NO: 1164443 - DNA, 15 bp, Homo sapiens
tttgtattataaaag

SEQ ID NO: 1164444 - DNA, 15 bp, Homo sapiens
tttgtattataattg

SEQ ID NO: 1164445 - DNA, 13 bp, Homo sapiens
tttgtattcaaaa

SEQ ID NO: 1164446 - DNA, 21 bp, Homo sapiens
tttgtattcatgaacttggct

SEQ ID NO: 1164447 - DNA, 15 bp, Homo sapiens
tttgtattctctcct

SEQ ID NO: 1164448 - DNA, 22 bp, Homo sapiens
tttgtattgcttcctgattacc

SEQ ID NO: 1164449 - DNA, 12 bp, Homo sapiens
tttgtatttagt

SEQ ID NO: 1164450 - DNA, 17 bp, Homo sapiens
tttgtatttctctattt

SEQ ID NO: 1164451 - DNA, 15 bp, Homo sapiens
tttgtattttgcata

SEQ ID NO: 1164452 - DNA, 13 bp, Homo sapiens
tttgtatttttag

SEQ ID NO: 1164453 - DNA, 14 bp, Homo sapiens
tttgtattttttcc

SEQ ID NO: 1164454 - DNA, 17 bp, Homo sapiens
tttgtattttttcctta

SEQ ID NO: 1164455 - DNA, 23 bp, Homo sapiens
tttgtcaaaagttggtgttgaca

SEQ ID NO: 1164456 - DNA, 17 bp, Homo sapiens
tttgtcaatgacagttt

SEQ ID NO: 1164457 - DNA, 18 bp, Homo sapiens
tttgtcacattatttatt

SEQ ID NO: 1164458 - DNA, 14 bp, Homo sapiens
tttgtcactttttc

SEQ ID NO: 1164459 - DNA, 19 bp, Homo sapiens
tttgtcagtatttttgccg

SEQ ID NO: 1164460 - DNA, 21 bp, Homo sapiens
tttgtcatgaattcttatgct

SEQ ID NO: 1164461 - DNA, 20 bp, Homo sapiens
tttgtcatgacagtgcttgc

SEQ ID NO: 1164462 - DNA, 20 bp, Homo sapiens
tttgtccattgtaaatctga

SEQ ID NO: 1164463 - DNA, 10 bp, Homo sapiens
tttgtcccag

SEQ ID NO: 1164464 - DNA, 19 bp, Homo sapiens
tttgtcccagtcagaaata

SEQ ID NO: 1164465 - DNA, 17 bp, Homo sapiens
tttgtccccagggcccc

SEQ ID NO: 1164466 - DNA, 17 bp, Homo sapiens
tttgtccttttatttct

SEQ ID NO: 1164467 - DNA, 19 bp, Homo sapiens
tttgtcgctcatgtgtgca

SEQ ID NO: 1164468 - DNA, 17 bp, Homo sapiens
tttgtcgtggttcttaa

SEQ ID NO: 1164469 - DNA, 21 bp, Homo sapiens
tttgtcgtggttcttaaatgt

SEQ ID NO: 1164470 - DNA, 21 bp, Homo sapiens
tttgtctatgaagttgctgtt

SEQ ID NO: 1164471 - DNA, 22 bp, Homo sapiens
tttgtctcagaagtgaaaatct

SEQ ID NO: 1164472 - DNA, 12 bp, Homo sapiens
tttgtctcccag

SEQ ID NO: 1164473 - DNA, 14 bp, Homo sapiens
tttgtctgaaaaat

SEQ ID NO: 1164474 - DNA, 14 bp, Homo sapiens
tttgtctgaacaaa

SEQ ID NO: 1164475 - DNA, 13 bp, Homo sapiens
tttgtctggttaa

SEQ ID NO: 1164476 - DNA, 17 bp, Homo sapiens
tttgtctgtcttcatag

SEQ ID NO: 1164477 - DNA, 18 bp, Homo sapiens
tttgtctgtttgtttcaa

SEQ ID NO: 1164478 - DNA, 21 bp, Homo sapiens
tttgtctgtttgtttcaagaa

SEQ ID NO: 1164479 - DNA, 18 bp, Homo sapiens
tttgtcttaaaaaatgtg

SEQ ID NO: 1164480 - DNA, 14 bp, Homo sapiens
tttgtcttaaaaag

SEQ ID NO: 1164481 - DNA, 14 bp, Homo sapiens
tttgtcttattctt

SEQ ID NO: 1164482 - DNA, 17 bp, Homo sapiens
tttgtcttattcttaag

SEQ ID NO: 1164483 - DNA, 14 bp, Homo sapiens
tttgtcttctataa

SEQ ID NO: 1164484 - DNA, 16 bp, Homo sapiens
tttgtcttgtacttct

SEQ ID NO: 1164485 - DNA, 18 bp, Homo sapiens
tttgtctttttcctactc

SEQ ID NO: 1164486 - DNA, 22 bp, Homo sapiens
tttgtgaaatgatggtgaaagt

SEQ ID NO: 1164487 - DNA, 20 bp, Homo sapiens
tttgtgaacgctgtgatgct

SEQ ID NO: 1164488 - DNA, 18 bp, Homo sapiens
tttgtgaactatatcagt

SEQ ID NO: 1164489 - DNA, 12 bp, Homo sapiens
tttgtgaagaat

SEQ ID NO: 1164490 - DNA, 16 bp, Homo sapiens
tttgtgaatctttgtg

SEQ ID NO: 1164491 - DNA, 15 bp, Homo sapiens
tttgtgaattaggct

SEQ ID NO: 1164492 - DNA, 20 bp, Homo sapiens
tttgtgactatatagagatg

SEQ ID NO: 1164493 - DNA, 23 bp, Homo sapiens
tttgtgactctttcctaaagcca

SEQ ID NO: 1164494 - DNA, 20 bp, Homo sapiens
tttgtgagctttacttcttt

SEQ ID NO: 1164495 - DNA, 16 bp, Homo sapiens
tttgtgagttagcatg

SEQ ID NO: 1164496 - DNA, 19 bp, Homo sapiens
tttgtgatcagcattgtga

SEQ ID NO: 1164497 - DNA, 17 bp, Homo sapiens
tttgtgatgaacatatt

SEQ ID NO: 1164498 - DNA, 17 bp, Homo sapiens
tttgtgatgatgctgtg

SEQ ID NO: 1164499 - DNA, 18 bp, Homo sapiens
tttgtgatggagtgctgt

SEQ ID NO: 1164500 - DNA, 20 bp, Homo sapiens
tttgtgattcaatctgtaaa

SEQ ID NO: 1164501 - DNA, 17 bp, Homo sapiens
tttgtgatttagaactg

SEQ ID NO: 1164502 - DNA, 21 bp, Homo sapiens
tttgtgcaaaagcttcaaatt

SEQ ID NO: 1164503 - DNA, 13 bp, Homo sapiens
tttgtgcattctg

SEQ ID NO: 1164504 - DNA, 15 bp, Homo sapiens
tttgtgcattctttg

SEQ ID NO: 1164505 - DNA, 22 bp, Homo sapiens
tttgtgccacacgcatgggcat

SEQ ID NO: 1164506 - DNA, 23 bp, Homo sapiens
tttgtgccttaaaaggagagaag

SEQ ID NO: 1164507 - DNA, 14 bp, Homo sapiens
tttgtgctagaaat

SEQ ID NO: 1164508 - DNA, 21 bp, Homo sapiens
tttgtgctcatttaagtttca

SEQ ID NO: 1164509 - DNA, 17 bp, Homo sapiens
tttgtgctttcctgaaa

SEQ ID NO: 1164510 - DNA, 11 bp, Homo sapiens
tttgtggaaaa

SEQ ID NO: 1164511 - DNA, 17 bp, Homo sapiens
tttgtggatgtcttcct

SEQ ID NO: 1164512 - DNA, 17 bp, Homo sapiens
tttgtggcaccttttct

SEQ ID NO: 1164513 - DNA, 11 bp, Homo sapiens
tttgtggccaa

SEQ ID NO: 1164514 - DNA, 20 bp, Homo sapiens
tttgtggccaaggagctgct

SEQ ID NO: 1164515 - DNA, 21 bp, Homo sapiens
tttgtggccaaggagctgcta

SEQ ID NO: 1164516 - DNA, 15 bp, Homo sapiens
tttgtggcctcagaa

SEQ ID NO: 1164517 - DNA, 12 bp, Homo sapiens
tttgtggctggg

SEQ ID NO: 1164518 - DNA, 20 bp, Homo sapiens
tttgtgggtttctctgtgct

SEQ ID NO: 1164519 - DNA, 22 bp, Homo sapiens
tttgtggtacgacctttagatt

SEQ ID NO: 1164520 - DNA, 11 bp, Homo sapiens
tttgtgtatgg

SEQ ID NO: 1164521 - DNA, 18 bp, Homo sapiens
tttgtgtccgctaaatat

SEQ ID NO: 1164522 - DNA, 19 bp, Homo sapiens
tttgtgtcctccaggagct

SEQ ID NO: 1164523 - DNA, 14 bp, Homo sapiens
tttgtgtctgtgtt

SEQ ID NO: 1164524 - DNA, 21 bp, Homo sapiens
tttgtgtgaccaactgtgttg

SEQ ID NO: 1164525 - DNA, 13 bp, Homo sapiens
tttgtgtgattga

SEQ ID NO: 1164526 - DNA, 15 bp, Homo sapiens
tttgtgtgtgtgtca

SEQ ID NO: 1164527 - DNA, 17 bp, Homo sapiens
tttgtgtgttgtcttga

SEQ ID NO: 1164528 - DNA, 13 bp, Homo sapiens
tttgtgttcctat

SEQ ID NO: 1164529 - DNA, 14 bp, Homo sapiens
tttgtgttcttctt

SEQ ID NO: 1164530 - DNA, 20 bp, Homo sapiens
tttgtgttgttggaaaaagt

SEQ ID NO: 1164531 - DNA, 21 bp, Homo sapiens
tttgttaaaactggcatctga

SEQ ID NO: 1164532 - DNA, 24 bp, Homo sapiens
tttgttaaaatacagttctgtcat

SEQ ID NO: 1164533 - DNA, 13 bp, Homo sapiens
tttgttaaataat

SEQ ID NO: 1164534 - DNA, 15 bp, Homo sapiens
tttgttaaccttaaa

SEQ ID NO: 1164535 - DNA, 14 bp, Homo sapiens
tcagaggcagcacc

SEQ ID NO: 1164536 - DNA, 15 bp, Homo sapiens
tcagaggcagcacca

SEQ ID NO: 1164537 - DNA, 13 bp, Homo sapiens
tcagaggcagtga

SEQ ID NO: 1164538 - DNA, 12 bp, Homo sapiens
tcagaggccccc

SEQ ID NO: 1164539 - DNA, 17 bp, Homo sapiens
tcagaggcccccagtgg

SEQ ID NO: 1164540 - DNA, 18 bp, Homo sapiens
tcagaggcccccagtggg

SEQ ID NO: 1164541 - DNA, 19 bp, Homo sapiens
tcagaggcccccagtgggg

SEQ ID NO: 1164542 - DNA, 21 bp, Homo sapiens
tcagaggccctcgctgccagc

SEQ ID NO: 1164543 - DNA, 11 bp, Homo sapiens
tcagaggctga

SEQ ID NO: 1164544 - DNA, 14 bp, Homo sapiens
tcagaggctgagcc

SEQ ID NO: 1164545 - DNA, 21 bp, Homo sapiens
tcagagggaaactcagatgtc

SEQ ID NO: 1164546 - DNA, 14 bp, Homo sapiens
tcagagggaggaat

SEQ ID NO: 1164547 - DNA, 14 bp, Homo sapiens
tcagagggcccaaa

SEQ ID NO: 1164548 - DNA, 15 bp, Homo sapiens
tcagcattgtgactt

SEQ ID NO: 1164549 - DNA, 17 bp, Homo sapiens
tcagcatttgatctgtt

SEQ ID NO: 1164550 - DNA, 21 bp, Homo sapiens
tcagcattttagaaactacaa

SEQ ID NO: 1164551 - DNA, 14 bp, Homo sapiens
tcagccaagtttta

SEQ ID NO: 1164552 - DNA, 15 bp, Homo sapiens
tcagccaagttttat

SEQ ID NO: 1164553 - DNA, 16 bp, Homo sapiens
tcagccacactgggcc

SEQ ID NO: 1164554 - DNA, 18 bp, Homo sapiens
tcagccacactgggcctg

SEQ ID NO: 1164555 - DNA, 15 bp, Homo sapiens
tcagccacagcctga

SEQ ID NO: 1164556 - DNA, 20 bp, Homo sapiens
tcagccaccctgaggcctct

SEQ ID NO: 1164557 - DNA, 17 bp, Homo sapiens
tcagccacctccctctg

SEQ ID NO: 1164558 - DNA, 12 bp, Homo sapiens
tcagccacctgg

SEQ ID NO: 1164559 - DNA, 23 bp, Homo sapiens
tcagccagcacttgtccagctga

SEQ ID NO: 1164560 - DNA, 22 bp, Homo sapiens
tcagccagcccatggcccccaa

SEQ ID NO: 1164561 - DNA, 15 bp, Homo sapiens
tcagccagccgccct

SEQ ID NO: 1164562 - DNA, 19 bp, Homo sapiens
tcagccagccgccctgggc

SEQ ID NO: 1164563 - DNA, 18 bp, Homo sapiens
tcagccaggagctgtcac

SEQ ID NO: 1164564 - DNA, 12 bp, Homo sapiens
tcagccagggcc

SEQ ID NO: 1164565 - DNA, 18 bp, Homo sapiens
tcagccatcaacaagagt

SEQ ID NO: 1164566 - DNA, 23 bp, Homo sapiens
tcagccatccgcagactgcttgg

SEQ ID NO: 1164567 - DNA, 16 bp, Homo sapiens
tcagccatcgtcctgg

SEQ ID NO: 1164568 - DNA, 21 bp, Homo sapiens
tcagccatgggaacctcatat

SEQ ID NO: 1164569 - DNA, 22 bp, Homo sapiens
tcagccatgggaacctcatatg

SEQ ID NO: 1164570 - DNA, 12 bp, Homo sapiens
tcagccattaaa

SEQ ID NO: 1164571 - DNA, 16 bp, Homo sapiens
tcagccattaaaataa

SEQ ID NO: 1164572 - DNA, 23 bp, Homo sapiens
tcagccattaaaataaaacaagc

SEQ ID NO: 1164573 - DNA, 19 bp, Homo sapiens
tcagccattgtggaagaca

SEQ ID NO: 1164574 - DNA, 17 bp, Homo sapiens
tcagccatttccccctc

SEQ ID NO: 1164575 - DNA, 20 bp, Homo sapiens
tcagccatttccccctcctc

SEQ ID NO: 1164576 - DNA, 21 bp, Homo sapiens
tcagccatttccccctcctca

SEQ ID NO: 1164577 - DNA, 12 bp, Homo sapiens
tcagcccacccc

SEQ ID NO: 1164578 - DNA, 21 bp, Homo sapiens
tcagcccaggcttttgctaga

SEQ ID NO: 1164579 - DNA, 16 bp, Homo sapiens
tcagcccatatttcat

SEQ ID NO: 1164580 - DNA, 13 bp, Homo sapiens
tcagcccccagga

SEQ ID NO: 1164581 - DNA, 19 bp, Homo sapiens
tcagcccccaggatctggg

SEQ ID NO: 1164582 - DNA, 16 bp, Homo sapiens
tcagcccccaggccag

SEQ ID NO: 1164583 - DNA, 20 bp, Homo sapiens
tcagccccgcctgtcacaat

SEQ ID NO: 1164584 - DNA, 21 bp, Homo sapiens
tcagccccgcctgtcacaata

SEQ ID NO: 1164585 - DNA, 18 bp, Homo sapiens
tcagcccctacccctgcc

SEQ ID NO: 1164586 - DNA, 14 bp, Homo sapiens
tcagcccctcctct

SEQ ID NO: 1164587 - DNA, 20 bp, Homo sapiens
tcagcccctcctctgccacc

SEQ ID NO: 1164588 - DNA, 12 bp, Homo sapiens
tcagcccctctt

SEQ ID NO: 1164589 - DNA, 20 bp, Homo sapiens
tcagcccctcttcccttcct

SEQ ID NO: 1164590 - DNA, 21 bp, Homo sapiens
tcagcccctgatctctgacct

SEQ ID NO: 1164591 - DNA, 15 bp, Homo sapiens
tcagcccctggcaat

SEQ ID NO: 1164592 - DNA, 14 bp, Homo sapiens
tcagcccctgggaa

SEQ ID NO: 1164593 - DNA, 19 bp, Homo sapiens
tcagccctcagttccttca

SEQ ID NO: 1164594 - DNA, 13 bp, Homo sapiens
tcagccctccctg

SEQ ID NO: 1164595 - DNA, 15 bp, Homo sapiens
tcagccctccctgcc

SEQ ID NO: 1164596 - DNA, 18 bp, Homo sapiens
tcagccctggccaagctt

SEQ ID NO: 1164597 - DNA, 19 bp, Homo sapiens
tcagccctggcccctgtgg

SEQ ID NO: 1164598 - DNA, 19 bp, Homo sapiens
tcagccctggcctggctgg

SEQ ID NO: 1164599 - DNA, 23 bp, Homo sapiens
tcagccctgggccccaccaccta

SEQ ID NO: 1164600 - DNA, 15 bp, Homo sapiens
tcagccctgtgtctg

SEQ ID NO: 1164601 - DNA, 21 bp, Homo sapiens
tcagccctgtgtctgtcacag

SEQ ID NO: 1164602 - DNA, 21 bp, Homo sapiens
tcagcccttgcccccatccct

SEQ ID NO: 1164603 - DNA, 16 bp, Homo sapiens
tcagccgagaaattgg

SEQ ID NO: 1164604 - DNA, 20 bp, Homo sapiens
tcagccgagccgggcctggg

SEQ ID NO: 1164605 - DNA, 21 bp, Homo sapiens
tcagccgagccgggcctgggg

SEQ ID NO: 1164606 - DNA, 22 bp, Homo sapiens
tcagccgagccgggcctggggc

SEQ ID NO: 1164607 - DNA, 13 bp, Homo sapiens
tcagccgtgtggg

SEQ ID NO: 1164608 - DNA, 18 bp, Homo sapiens
tcagcctaggggtcaggg

SEQ ID NO: 1164609 - DNA, 18 bp, Homo sapiens
tcagcctcattcagcatg

SEQ ID NO: 1164610 - DNA, 23 bp, Homo sapiens
tcagcctcccaaagtgctgggat

SEQ ID NO: 1164611 - DNA, 20 bp, Homo sapiens
tcagcctccccagtagctgg

SEQ ID NO: 1164612 - DNA, 14 bp, Homo sapiens
tcagcctccccttc

SEQ ID NO: 1164613 - DNA, 15 bp, Homo sapiens
tcagcctccccttct

SEQ ID NO: 1164614 - DNA, 17 bp, Homo sapiens
tcagcctccccttcttc

SEQ ID NO: 1164615 - DNA, 22 bp, Homo sapiens
tcagcctccccttcttcccgcc

SEQ ID NO: 1164616 - DNA, 22 bp, Homo sapiens
tcagcctcccgagtagctggca

SEQ ID NO: 1164617 - DNA, 22 bp, Homo sapiens
tcagcctcccgagtagctggga

SEQ ID NO: 1164618 - DNA, 12 bp, Homo sapiens
tcagcctccctc

SEQ ID NO: 1164619 - DNA, 14 bp, Homo sapiens
tcagcctccctcag

SEQ ID NO: 1164620 - DNA, 15 bp, Homo sapiens
tcagcctccctcagc

SEQ ID NO: 1164621 - DNA, 20 bp, Homo sapiens
tcagcctccctcagccccca

SEQ ID NO: 1164622 - DNA, 13 bp, Homo sapiens
tcagcctcctgag

SEQ ID NO: 1164623 - DNA, 19 bp, Homo sapiens
tcagcctcctgagcctgtg

SEQ ID NO: 1164624 - DNA, 21 bp, Homo sapiens
tcagcctcctgagtagctgga

SEQ ID NO: 1164625 - DNA, 23 bp, Homo sapiens
tcagcctcctgagtagctgggat

SEQ ID NO: 1164626 - DNA, 13 bp, Homo sapiens
tcagcctcctggg

SEQ ID NO: 1164627 - DNA, 12 bp, Homo sapiens
tcagcctcctgt

SEQ ID NO: 1164628 - DNA, 20 bp, Homo sapiens
tcagcctgaggctgagactg

SEQ ID NO: 1164629 - DNA, 16 bp, Homo sapiens
tcagcctgcccacctc

SEQ ID NO: 1164630 - DNA, 17 bp, Homo sapiens
tcagcctgcccacctct

SEQ ID NO: 1164631 - DNA, 19 bp, Homo sapiens
tcagcctgctccagctgtt

SEQ ID NO: 1164632 - DNA, 13 bp, Homo sapiens
tcagcctggagag

SEQ ID NO: 1164633 - DNA, 11 bp, Homo sapiens
tcagcctgggg

SEQ ID NO: 1164634 - DNA, 12 bp, Homo sapiens
tcagcctgtgct

SEQ ID NO: 1164635 - DNA, 22 bp, Homo sapiens
tcagccttccaactagctggga

SEQ ID NO: 1164636 - DNA, 22 bp, Homo sapiens
tcagccttccccctcccagggc

SEQ ID NO: 1164637 - DNA, 24 bp, Homo sapiens
tcagccttccccctcccagggcca

SEQ ID NO: 1164638 - DNA, 21 bp, Homo sapiens
tcagccttccccttgcccagg

SEQ ID NO: 1164639 - DNA, 12 bp, Homo sapiens
tcagccttcttt

SEQ ID NO: 1164640 - DNA, 16 bp, Homo sapiens
tcagccttgcacaccc

SEQ ID NO: 1164641 - DNA, 20 bp, Homo sapiens
tcagccttgcacacccactg

SEQ ID NO: 1164642 - DNA, 23 bp, Homo sapiens
tcagccttgtgtttggtcatgtg

SEQ ID NO: 1164643 - DNA, 20 bp, Homo sapiens
tcagcgactccgttggccac

SEQ ID NO: 1164644 - DNA, 13 bp, Homo sapiens
tcagcgactggat

SEQ ID NO: 1164645 - DNA, 14 bp, Homo sapiens
tcagcgagaaggag

SEQ ID NO: 1164646 - DNA, 13 bp, Homo sapiens
tcagcgagaggca

SEQ ID NO: 1164647 - DNA, 17 bp, Homo sapiens
tcagcgagaggcagcaa

SEQ ID NO: 1164648 - DNA, 18 bp, Homo sapiens
tcagcgatgtatgcagct

SEQ ID NO: 1164649 - DNA, 18 bp, Homo sapiens
tcagcgcaggctgcagag

SEQ ID NO: 1164650 - DNA, 16 bp, Homo sapiens
tcagcgggagccagtg

SEQ ID NO: 1164651 - DNA, 18 bp, Homo sapiens
tcagcggggcgagctgag

SEQ ID NO: 1164652 - DNA, 18 bp, Homo sapiens
tcagctaaagaagtttga

SEQ ID NO: 1164653 - DNA, 15 bp, Homo sapiens
tcagctaagctcacg

SEQ ID NO: 1164654 - DNA, 18 bp, Homo sapiens
tcagctactctagttctg

SEQ ID NO: 1164655 - DNA, 22 bp, Homo sapiens
tcagctactctagttctgttgt

SEQ ID NO: 1164656 - DNA, 14 bp, Homo sapiens
tcagctactgccaa

SEQ ID NO: 1164657 - DNA, 22 bp, Homo sapiens
tcagctagaagatccacatcct

SEQ ID NO: 1164658 - DNA, 17 bp, Homo sapiens
tcagctagaatttctgg

SEQ ID NO: 1164659 - DNA, 16 bp, Homo sapiens
tcagctattaagaaaa

SEQ ID NO: 1164660 - DNA, 20 bp, Homo sapiens
tcagctatttactgccaaag

SEQ ID NO: 1164661 - DNA, 13 bp, Homo sapiens
tcagctcattatg

SEQ ID NO: 1164662 - DNA, 17 bp, Homo sapiens
tcagctcattatgaaaa

SEQ ID NO: 1164663 - DNA, 19 bp, Homo sapiens
tcagctcatttaatcccag

SEQ ID NO: 1164664 - DNA, 20 bp, Homo sapiens
tcagctcatttaatcccagg

SEQ ID NO: 1164665 - DNA, 13 bp, Homo sapiens
ttttaaaggcatt

SEQ ID NO: 1164666 - DNA, 19 bp, Homo sapiens
ttttaaaggcattagagtc

SEQ ID NO: 1164667 - DNA, 20 bp, Homo sapiens
ttttaaaggttggaatcttt

SEQ ID NO: 1164668 - DNA, 22 bp, Homo sapiens
ttttaaaggttggaatctttta

SEQ ID NO: 1164669 - DNA, 14 bp, Homo sapiens
ttttcaaaagataa

SEQ ID NO: 1164670 - DNA, 15 bp, Homo sapiens
ttttcaaaagataat

SEQ ID NO: 1164671 - DNA, 17 bp, Homo sapiens
ttttcaaaataaaaatg

SEQ ID NO: 1164672 - DNA, 20 bp, Homo sapiens
ttttcaaaatagaaaagtta

SEQ ID NO: 1164673 - DNA, 12 bp, Homo sapiens
ttttcaaacaaa

SEQ ID NO: 1164674 - DNA, 20 bp, Homo sapiens
ttttcaaacaaagatgccac

SEQ ID NO: 1164675 - DNA, 14 bp, Homo sapiens
ttttcaaagagatg

SEQ ID NO: 1164676 - DNA, 21 bp, Homo sapiens
ttttcaaatcattccttagat

SEQ ID NO: 1164677 - DNA, 21 bp, Homo sapiens
ttttcaaatgtttgaaaacaa

SEQ ID NO: 1164678 - DNA, 22 bp, Homo sapiens
ttttcaaccataaaagaagttt

SEQ ID NO: 1164679 - DNA, 17 bp, Homo sapiens
ttttcaacgcagccctg

SEQ ID NO: 1164680 - DNA, 21 bp, Homo sapiens
ttttcaacgcagccctgcttt

SEQ ID NO: 1164681 - DNA, 13 bp, Homo sapiens
ttttcaactgcca

SEQ ID NO: 1164682 - DNA, 23 bp, Homo sapiens
ttttcaactgccaaaatgctcta

SEQ ID NO: 1164683 - DNA, 14 bp, Homo sapiens
ttttcaagaaactg

SEQ ID NO: 1164684 - DNA, 20 bp, Homo sapiens
ttttcaaggcatttgtcttt

SEQ ID NO: 1164685 - DNA, 16 bp, Homo sapiens
ttttcaaggccctcag

SEQ ID NO: 1164686 - DNA, 22 bp, Homo sapiens
ttttcaagtaattttcatatta

SEQ ID NO: 1164687 - DNA, 14 bp, Homo sapiens
ttttcaataacaaa

SEQ ID NO: 1164688 - DNA, 16 bp, Homo sapiens
ttttcaataagatgta

SEQ ID NO: 1164689 - DNA, 19 bp, Homo sapiens
ttttcaatatatatttctt

SEQ ID NO: 1164690 - DNA, 21 bp, Homo sapiens
ttttcaatatattgaactttt

SEQ ID NO: 1164691 - DNA, 23 bp, Homo sapiens
ttttcaatatattgaacttttgt

SEQ ID NO: 1164692 - DNA, 17 bp, Homo sapiens
ttttcaatatgcaagca

SEQ ID NO: 1164693 - DNA, 16 bp, Homo sapiens
ttttcaatatttatta

SEQ ID NO: 1164694 - DNA, 14 bp, Homo sapiens
ttttcaatgtgatt

SEQ ID NO: 1164695 - DNA, 21 bp, Homo sapiens
ttttcacactggtaaatgtta

SEQ ID NO: 1164696 - DNA, 15 bp, Homo sapiens
ttttcacactgtctt

SEQ ID NO: 1164697 - DNA, 20 bp, Homo sapiens
ttttcaccccacccttcccc

SEQ ID NO: 1164698 - DNA, 18 bp, Homo sapiens
ttttcaccgagcagaggt

SEQ ID NO: 1164699 - DNA, 23 bp, Homo sapiens
ttttcacctgtttttaagctgtt

SEQ ID NO: 1164700 - DNA, 19 bp, Homo sapiens
ttttcacggaagttttcaa

SEQ ID NO: 1164701 - DNA, 23 bp, Homo sapiens
ttttcactctaagtcatgtatgt

SEQ ID NO: 1164702 - DNA, 20 bp, Homo sapiens
ttttcactgctggctgcctt

SEQ ID NO: 1164703 - DNA, 13 bp, Homo sapiens
ttttcacttctgt

SEQ ID NO: 1164704 - DNA, 21 bp, Homo sapiens
ttttcacttgtcttgctctta

SEQ ID NO: 1164705 - DNA, 22 bp, Homo sapiens
ttttcactttgggagtttttgt

SEQ ID NO: 1164706 - DNA, 17 bp, Homo sapiens
ttttcagaaaaagaaat

SEQ ID NO: 1164707 - DNA, 15 bp, Homo sapiens
ttttcagatataaaa

SEQ ID NO: 1164708 - DNA, 19 bp, Homo sapiens
ttttcagatataaaagact

SEQ ID NO: 1164709 - DNA, 19 bp, Homo sapiens
ttttcagcaaactcttttc

SEQ ID NO: 1164710 - DNA, 18 bp, Homo sapiens
ttttcagccaatttgtct

SEQ ID NO: 1164711 - DNA, 19 bp, Homo sapiens
ttttcagcccatatttcat

SEQ ID NO: 1164712 - DNA, 18 bp, Homo sapiens
ttttcagcgatgtatgca

SEQ ID NO: 1164713 - DNA, 17 bp, Homo sapiens
ttttcaggagcgcaaga

SEQ ID NO: 1164714 - DNA, 15 bp, Homo sapiens
ttttcagtatactgt

SEQ ID NO: 1164715 - DNA, 18 bp, Homo sapiens
ttttcagtatactgtgtg

SEQ ID NO: 1164716 - DNA, 23 bp, Homo sapiens
ttttcagtattttggagaaatta

SEQ ID NO: 1164717 - DNA, 19 bp, Homo sapiens
ttttcagtggaactctaaa

SEQ ID NO: 1164718 - DNA, 19 bp, Homo sapiens
ttttcagttacaagattgt

SEQ ID NO: 1164719 - DNA, 15 bp, Homo sapiens
ttttcagttgttctt

SEQ ID NO: 1164720 - DNA, 16 bp, Homo sapiens
ttttcagttgtttgtt

SEQ ID NO: 1164721 - DNA, 23 bp, Homo sapiens
ttttcataaattatttgattatt

SEQ ID NO: 1164722 - DNA, 23 bp, Homo sapiens
ttttcataacttgctgaatttca

SEQ ID NO: 1164723 - DNA, 18 bp, Homo sapiens
ttttcatacttttacctt

SEQ ID NO: 1164724 - DNA, 15 bp, Homo sapiens
ttttcatagatgtgt

SEQ ID NO: 1164725 - DNA, 16 bp, Homo sapiens
ttttcatagatttgaa

SEQ ID NO: 1164726 - DNA, 17 bp, Homo sapiens
ttttcataggtctgaaa

SEQ ID NO: 1164727 - DNA, 10 bp, Homo sapiens
ttttcatagt

SEQ ID NO: 1164728 - DNA, 13 bp, Homo sapiens
ttttcatatcatt

SEQ ID NO: 1164729 - DNA, 13 bp, Homo sapiens
ttttcatcatttc

SEQ ID NO: 1164730 - DNA, 16 bp, Homo sapiens
ttttcatcatttcagc

SEQ ID NO: 1164731 - DNA, 19 bp, Homo sapiens
ttttcatcatttcagccaa

SEQ ID NO: 1164732 - DNA, 18 bp, Homo sapiens
ttttcatccataactgaa

SEQ ID NO: 1164733 - DNA, 15 bp, Homo sapiens
ttttcatcctggcct

SEQ ID NO: 1164734 - DNA, 18 bp, Homo sapiens
ttttcatcctggcctcct

SEQ ID NO: 1164735 - DNA, 14 bp, Homo sapiens
ttttcatctgggaa

SEQ ID NO: 1164736 - DNA, 12 bp, Homo sapiens
ttttcatctgtt

SEQ ID NO: 1164737 - DNA, 22 bp, Homo sapiens
ttttcatggacactttgaaatg

SEQ ID NO: 1164738 - DNA, 14 bp, Homo sapiens
ttttcatgtacagc

SEQ ID NO: 1164739 - DNA, 13 bp, Homo sapiens
ttttcattaaact

SEQ ID NO: 1164740 - DNA, 16 bp, Homo sapiens
ttttcattagcagttg

SEQ ID NO: 1164741 - DNA, 18 bp, Homo sapiens
ttttcatttgtaaaaatg

SEQ ID NO: 1164742 - DNA, 15 bp, Homo sapiens
ttttcatttgtacaa

SEQ ID NO: 1164743 - DNA, 16 bp, Homo sapiens
ttttcatttgtacaag

SEQ ID NO: 1164744 - DNA, 11 bp, Homo sapiens
ttttcattttg

SEQ ID NO: 1164745 - DNA, 19 bp, Homo sapiens
ttttccaaagagtgatagt

SEQ ID NO: 1164746 - DNA, 13 bp, Homo sapiens
ttttccaagccct

SEQ ID NO: 1164747 - DNA, 18 bp, Homo sapiens
ttttccaatcatttgact

SEQ ID NO: 1164748 - DNA, 22 bp, Homo sapiens
ttttccacaagattcccagaga

SEQ ID NO: 1164749 - DNA, 15 bp, Homo sapiens
ttttccaccctggaa

SEQ ID NO: 1164750 - DNA, 18 bp, Homo sapiens
ttttccacggaaacagaa

SEQ ID NO: 1164751 - DNA, 18 bp, Homo sapiens
ttttccactccattgtcg

SEQ ID NO: 1164752 - DNA, 18 bp, Homo sapiens
ttttccactgtgctatta

SEQ ID NO: 1164753 - DNA, 20 bp, Homo sapiens
ttttccagctggatgagaat

SEQ ID NO: 1164754 - DNA, 17 bp, Homo sapiens
ttttccatctgtgtgca

SEQ ID NO: 1164755 - DNA, 16 bp, Homo sapiens
ttttccattggtttac

SEQ ID NO: 1164756 - DNA, 18 bp, Homo sapiens
ttttccatttcttcagag

SEQ ID NO: 1164757 - DNA, 18 bp, Homo sapiens
ttttcccaaaatgttgaa

SEQ ID NO: 1164758 - DNA, 19 bp, Homo sapiens
ttttcccaaagcactttta

SEQ ID NO: 1164759 - DNA, 20 bp, Homo sapiens
ttttcccaaagcatccctct

SEQ ID NO: 1164760 - DNA, 12 bp, Homo sapiens
ttttcccacgag

SEQ ID NO: 1164761 - DNA, 14 bp, Homo sapiens
ttttcccagtgagt

SEQ ID NO: 1164762 - DNA, 17 bp, Homo sapiens
ttttcccatcatccttt

SEQ ID NO: 1164763 - DNA, 20 bp, Homo sapiens
ttttcccatcatcctttgtt

SEQ ID NO: 1164764 - DNA, 19 bp, Homo sapiens
ttttcccatgactcttgga

SEQ ID NO: 1164765 - DNA, 20 bp, Homo sapiens
ttttcccatttatctaaata

SEQ ID NO: 1164766 - DNA, 22 bp, Homo sapiens
ttttccccgtgacattcactgg

SEQ ID NO: 1164767 - DNA, 12 bp, Homo sapiens
ttttcccctccc

SEQ ID NO: 1164768 - DNA, 14 bp, Homo sapiens
ttttcccctggcct

SEQ ID NO: 1164769 - DNA, 15 bp, Homo sapiens
ttttcccctgttaaa

SEQ ID NO: 1164770 - DNA, 16 bp, Homo sapiens
ttttccctatccacag

SEQ ID NO: 1164771 - DNA, 18 bp, Homo sapiens
ttttccctattagagaag

SEQ ID NO: 1164772 - DNA, 22 bp, Homo sapiens
ttttccctattagagaagagat

SEQ ID NO: 1164773 - DNA, 14 bp, Homo sapiens
ttttccctccccag

SEQ ID NO: 1164774 - DNA, 17 bp, Homo sapiens
ttttcctaaagagagta

SEQ ID NO: 1164775 - DNA, 17 bp, Homo sapiens
ttttcctaagcacaaat

SEQ ID NO: 1164776 - DNA, 21 bp, Homo sapiens
ttttcctaatgtgatcatatg

SEQ ID NO: 1164777 - DNA, 18 bp, Homo sapiens
ttttcctattctgttgcc

SEQ ID NO: 1164778 - DNA, 16 bp, Homo sapiens
ttttcctcaagcaata

SEQ ID NO: 1164779 - DNA, 16 bp, Homo sapiens
ttttcctcatcctttc

SEQ ID NO: 1164780 - DNA, 18 bp, Homo sapiens
ttttcctcatgtaacatt

SEQ ID NO: 1164781 - DNA, 13 bp, Homo sapiens
ttttcctccctca

SEQ ID NO: 1164782 - DNA, 22 bp, Homo sapiens
ttttcctcccttgggttctgat

SEQ ID NO: 1164783 - DNA, 19 bp, Homo sapiens
ttttcctccgggagagggg

SEQ ID NO: 1164784 - DNA, 13 bp, Homo sapiens
ttttcctcctctg

SEQ ID NO: 1164785 - DNA, 16 bp, Homo sapiens
ttttcctcctctgcct

SEQ ID NO: 1164786 - DNA, 21 bp, Homo sapiens
ttttcctctctgtctgtctct

SEQ ID NO: 1164787 - DNA, 16 bp, Homo sapiens
ttttcctctgttcaca

SEQ ID NO: 1164788 - DNA, 20 bp, Homo sapiens
ttttcctctgttcacaaact

SEQ ID NO: 1164789 - DNA, 18 bp, Homo sapiens
ttttcctcttctattttg

SEQ ID NO: 1164790 - DNA, 14 bp, Homo sapiens
ttttcctcttgtga

SEQ ID NO: 1164791 - DNA, 20 bp, Homo sapiens
ctcactgggaagctcccacc

SEQ ID NO: 1164792 - DNA, 18 bp, Homo sapiens
ctcactgggcctttccag

SEQ ID NO: 1164793 - DNA, 23 bp, Homo sapiens
ttctgtggttttcccctccctgg

SEQ ID NO: 1164794 - DNA, 13 bp, Homo sapiens
ttctgtgtacaca

SEQ ID NO: 1164795 - DNA, 16 bp, Homo sapiens
ttctgtgtagagaatg

SEQ ID NO: 1164796 - DNA, 22 bp, Homo sapiens
ttctgtgtcacagttcttggtg

SEQ ID NO: 1164797 - DNA, 21 bp, Homo sapiens
ttctgtgtgtatctaaaggat

SEQ ID NO: 1164798 - DNA, 17 bp, Homo sapiens
ttctgtgtgtcagtttt

SEQ ID NO: 1164799 - DNA, 20 bp, Homo sapiens
ttctgtgtgttttcataata

SEQ ID NO: 1164800 - DNA, 16 bp, Homo sapiens
ttctgtgttgaacaca

SEQ ID NO: 1164801 - DNA, 14 bp, Homo sapiens
ttctgttaaaatgg

SEQ ID NO: 1164802 - DNA, 24 bp, Homo sapiens
ttctgttaaaatggggataataat

SEQ ID NO: 1164803 - DNA, 17 bp, Homo sapiens
ttctgttaactcttgaa

SEQ ID NO: 1164804 - DNA, 21 bp, Homo sapiens
ttctgttaactgaataccact

SEQ ID NO: 1164805 - DNA, 15 bp, Homo sapiens
ttctgttaagaaagg

SEQ ID NO: 1164806 - DNA, 23 bp, Homo sapiens
ttctgttactaaatccttttgtt

SEQ ID NO: 1164807 - DNA, 21 bp, Homo sapiens
ttctgttatttttaagctttt

SEQ ID NO: 1164808 - DNA, 13 bp, Homo sapiens
ttctgttctagtt

SEQ ID NO: 1164809 - DNA, 14 bp, Homo sapiens
ttctgttctagttt

SEQ ID NO: 1164810 - DNA, 21 bp, Homo sapiens
ttctgttctagttttttactt

SEQ ID NO: 1164811 - DNA, 13 bp, Homo sapiens
ttctgttctcatt

SEQ ID NO: 1164812 - DNA, 13 bp, Homo sapiens
ttctgttctctgc

SEQ ID NO: 1164813 - DNA, 15 bp, Homo sapiens
ttctgttctggagga

SEQ ID NO: 1164814 - DNA, 17 bp, Homo sapiens
ttctgttcttacaaatg

SEQ ID NO: 1164815 - DNA, 17 bp, Homo sapiens
ttctgtttattcttcca

SEQ ID NO: 1164816 - DNA, 15 bp, Homo sapiens
ttctgtttcaaagca

SEQ ID NO: 1164817 - DNA, 18 bp, Homo sapiens
ttctgtttcctcttgatc

SEQ ID NO: 1164818 - DNA, 17 bp, Homo sapiens
ttctgtttcttgctctc

SEQ ID NO: 1164819 - DNA, 15 bp, Homo sapiens
ttctgtttgattctt

SEQ ID NO: 1164820 - DNA, 13 bp, Homo sapiens
ttctgtttgctgt

SEQ ID NO: 1164821 - DNA, 15 bp, Homo sapiens
ttctgtttggcactt

SEQ ID NO: 1164822 - DNA, 20 bp, Homo sapiens
ttctgtttggcacttgtatt

SEQ ID NO: 1164823 - DNA, 15 bp, Homo sapiens
ttctgtttgtaaatt

SEQ ID NO: 1164824 - DNA, 22 bp, Homo sapiens
ttctgtttgtaaattatttgct

SEQ ID NO: 1164825 - DNA, 18 bp, Homo sapiens
ttctgttttcccccagca

SEQ ID NO: 1164826 - DNA, 11 bp, Homo sapiens
ttctgttttct

SEQ ID NO: 1164827 - DNA, 16 bp, Homo sapiens
ttctgttttgcctgaa

SEQ ID NO: 1164828 - DNA, 17 bp, Homo sapiens
ttctgttttgcctgaag

SEQ ID NO: 1164829 - DNA, 21 bp, Homo sapiens
ttctgttttgcctgaagttgg

SEQ ID NO: 1164830 - DNA, 23 bp, Homo sapiens
ttctgttttgtttggcaaggaaa

SEQ ID NO: 1164831 - DNA, 13 bp, Homo sapiens
ttctgtttttaat

SEQ ID NO: 1164832 - DNA, 18 bp, Homo sapiens
ttcttaaaaactgtgtat

SEQ ID NO: 1164833 - DNA, 13 bp, Homo sapiens
ttcttaaaagaaa

SEQ ID NO: 1164834 - DNA, 18 bp, Homo sapiens
ttcttaaaagaaatcttg

SEQ ID NO: 1164835 - DNA, 20 bp, Homo sapiens
ttcttaaaagaaatcttgct

SEQ ID NO: 1164836 - DNA, 12 bp, Homo sapiens
ttcttaaaagta

SEQ ID NO: 1164837 - DNA, 17 bp, Homo sapiens
ttcttaaaagtacttta

SEQ ID NO: 1164838 - DNA, 19 bp, Homo sapiens
ttcttaaaagtactttaaa

SEQ ID NO: 1164839 - DNA, 14 bp, Homo sapiens
ttcttaaaattcaa

SEQ ID NO: 1164840 - DNA, 19 bp, Homo sapiens
ttcttaaaattcaagaaaa

SEQ ID NO: 1164841 - DNA, 23 bp, Homo sapiens
ttcttaaaattcaagaaaataaa

SEQ ID NO: 1164842 - DNA, 14 bp, Homo sapiens
ttcttaaaggcctg

SEQ ID NO: 1164843 - DNA, 16 bp, Homo sapiens
ttcttaaaggcctgga

SEQ ID NO: 1164844 - DNA, 15 bp, Homo sapiens
ttcttaaatgtttat

SEQ ID NO: 1164845 - DNA, 23 bp, Homo sapiens
ttcttaacaaactcttcagttaa

SEQ ID NO: 1164846 - DNA, 13 bp, Homo sapiens
ttcttaaccatct

SEQ ID NO: 1164847 - DNA, 22 bp, Homo sapiens
ttcttaacccctaagactgcct

SEQ ID NO: 1164848 - DNA, 13 bp, Homo sapiens
ttcttaactaaaa

SEQ ID NO: 1164849 - DNA, 18 bp, Homo sapiens
ttcttaagacatgtatca

SEQ ID NO: 1164850 - DNA, 21 bp, Homo sapiens
ttcttaagacgtgattttgct

SEQ ID NO: 1164851 - DNA, 14 bp, Homo sapiens
ttcttaagcacttt

SEQ ID NO: 1164852 - DNA, 23 bp, Homo sapiens
ttcttaagcactttgaaaatatt

SEQ ID NO: 1164853 - DNA, 22 bp, Homo sapiens
ttcttaaggattgtgatatttt

SEQ ID NO: 1164854 - DNA, 17 bp, Homo sapiens
ttcttaagggcacacac

SEQ ID NO: 1164855 - DNA, 20 bp, Homo sapiens
ttcttaaggttttgttgcta

SEQ ID NO: 1164856 - DNA, 22 bp, Homo sapiens
ttcttaagtatgttattttctg

SEQ ID NO: 1164857 - DNA, 19 bp, Homo sapiens
ttcttaattattataaaaa

SEQ ID NO: 1164858 - DNA, 21 bp, Homo sapiens
ttcttaattattataaaaata

SEQ ID NO: 1164859 - DNA, 19 bp, Homo sapiens
ttcttaattcatgaggagg

SEQ ID NO: 1164860 - DNA, 11 bp, Homo sapiens
ttcttaatttg

SEQ ID NO: 1164861 - DNA, 21 bp, Homo sapiens
ttcttaatttggataataaaa

SEQ ID NO: 1164862 - DNA, 13 bp, Homo sapiens
ttcttaattttgt

SEQ ID NO: 1164863 - DNA, 19 bp, Homo sapiens
ttcttacaagcttaaagct

SEQ ID NO: 1164864 - DNA, 14 bp, Homo sapiens
ttcttacacttctt

SEQ ID NO: 1164865 - DNA, 21 bp, Homo sapiens
ttcttacatctgtaaagaaaa

SEQ ID NO: 1164866 - DNA, 12 bp, Homo sapiens
ttcttaccagtc

SEQ ID NO: 1164867 - DNA, 15 bp, Homo sapiens
ttttgtctaattaaa

SEQ ID NO: 1164868 - DNA, 15 bp, Homo sapiens
ttttgtctacacacc

SEQ ID NO: 1164869 - DNA, 15 bp, Homo sapiens
ttttgtctatgaagt

SEQ ID NO: 1164870 - DNA, 16 bp, Homo sapiens
ttttgtcttattctta

SEQ ID NO: 1164871 - DNA, 16 bp, Homo sapiens
ttttgtcttattgaaa

SEQ ID NO: 1164872 - DNA, 17 bp, Homo sapiens
ttttgtctttaaataga

SEQ ID NO: 1164873 - DNA, 19 bp, Homo sapiens
ttttgtgatggagtgctgt

SEQ ID NO: 1164874 - DNA, 13 bp, Homo sapiens
ttttgtgcattct

SEQ ID NO: 1164875 - DNA, 19 bp, Homo sapiens
ttttgtgcattctttggta

SEQ ID NO: 1164876 - DNA, 21 bp, Homo sapiens
ttttgtgccattatatttgca

SEQ ID NO: 1164877 - DNA, 19 bp, Homo sapiens
ttttgtggcagattcaata

SEQ ID NO: 1164878 - DNA, 21 bp, Homo sapiens
ttttgtggtcattaagcattg

SEQ ID NO: 1164879 - DNA, 16 bp, Homo sapiens
ttttgtgtatattggt

SEQ ID NO: 1164880 - DNA, 22 bp, Homo sapiens
ttttgtgtatattggtgtatat

SEQ ID NO: 1164881 - DNA, 16 bp, Homo sapiens
ttttgtgtatgtactt

SEQ ID NO: 1164882 - DNA, 22 bp, Homo sapiens
ttttgtgtcctgctctgtttgg

SEQ ID NO: 1164883 - DNA, 18 bp, Homo sapiens
ttttgtgtgaccaactgt

SEQ ID NO: 1164884 - DNA, 13 bp, Homo sapiens
ttttgtgtgtata

SEQ ID NO: 1164885 - DNA, 17 bp, Homo sapiens
ttttgtgtgtatttgct

SEQ ID NO: 1164886 - DNA, 20 bp, Homo sapiens
ttttgtgtgtatttgctaat

SEQ ID NO: 1164887 - DNA, 19 bp, Homo sapiens
ttttgtgttcctatggaaa

SEQ ID NO: 1164888 - DNA, 13 bp, Homo sapiens
ttttgttaaagct

SEQ ID NO: 1164889 - DNA, 14 bp, Homo sapiens
ttttgttaaagctg

SEQ ID NO: 1164890 - DNA, 17 bp, Homo sapiens
ttttgttaacagtattt

SEQ ID NO: 1164891 - DNA, 16 bp, Homo sapiens
ttttgttacctttatg

SEQ ID NO: 1164892 - DNA, 11 bp, Homo sapiens
ttttgttactg

SEQ ID NO: 1164893 - DNA, 20 bp, Homo sapiens
ttttgttactgattcaatta

SEQ ID NO: 1164894 - DNA, 18 bp, Homo sapiens
ttttgttatcagtcaata

SEQ ID NO: 1164895 - DNA, 18 bp, Homo sapiens
ttttgttcaatgttccat

SEQ ID NO: 1164896 - DNA, 13 bp, Homo sapiens
ttttgttcagaat

SEQ ID NO: 1164897 - DNA, 21 bp, Homo sapiens
ttttgttccacaagttaaata

SEQ ID NO: 1164898 - DNA, 14 bp, Homo sapiens
ttttgttctcttct

SEQ ID NO: 1164899 - DNA, 15 bp, Homo sapiens
ttttgttctcttctg

SEQ ID NO: 1164900 - DNA, 12 bp, Homo sapiens
ttttgttgacat

SEQ ID NO: 1164901 - DNA, 13 bp, Homo sapiens
ttttgttgacatt

SEQ ID NO: 1164902 - DNA, 20 bp, Homo sapiens
ttttgttgaccattttgtta

SEQ ID NO: 1164903 - DNA, 20 bp, Homo sapiens
ttttgttgtgttctgttgaa

SEQ ID NO: 1164904 - DNA, 14 bp, Homo sapiens
ttttgtttaatttg

SEQ ID NO: 1164905 - DNA, 18 bp, Homo sapiens
ttttgtttcaatgaggtg

SEQ ID NO: 1164906 - DNA, 12 bp, Homo sapiens
ttttgtttcata

SEQ ID NO: 1164907 - DNA, 16 bp, Homo sapiens
ttttgtttcatcctgt

SEQ ID NO: 1164908 - DNA, 18 bp, Homo sapiens
ttttgtttggcaaggaaa

SEQ ID NO: 1164909 - DNA, 19 bp, Homo sapiens
ttttgtttggcaaggaaag

SEQ ID NO: 1164910 - DNA, 14 bp, Homo sapiens
ttttgtttgtttct

SEQ ID NO: 1164911 - DNA, 12 bp, Homo sapiens
ttttgttttaat

SEQ ID NO: 1164912 - DNA, 16 bp, Homo sapiens
ttttgttttacaatgt

SEQ ID NO: 1164913 - DNA, 20 bp, Homo sapiens
ttttgtttttattttcaaga

SEQ ID NO: 1164914 - DNA, 17 bp, Homo sapiens
ttttgtttttcattcag

SEQ ID NO: 1164915 - DNA, 16 bp, Homo sapiens
ttttgtttttgcatga

SEQ ID NO: 1164916 - DNA, 18 bp, Homo sapiens
ttttgttttttcaaaata

SEQ ID NO: 1164917 - DNA, 19 bp, Homo sapiens
ttttgttttttcaaaatag

SEQ ID NO: 1164918 - DNA, 17 bp, Homo sapiens
ttttgttttttgtaact

SEQ ID NO: 1164919 - DNA, 20 bp, Homo sapiens
tttttaggaagcaagcttaa

SEQ ID NO: 1164920 - DNA, 17 bp, Homo sapiens
tttttaggccacattga

SEQ ID NO: 1164921 - DNA, 12 bp, Homo sapiens
tttttagttaaa

SEQ ID NO: 1164922 - DNA, 12 bp, Homo sapiens
tttttagttttt

SEQ ID NO: 1164923 - DNA, 23 bp, Homo sapiens
tttttataacatctttattgaaa

SEQ ID NO: 1164924 - DNA, 13 bp, Homo sapiens
tttttataactaa

SEQ ID NO: 1164925 - DNA, 15 bp, Homo sapiens
tttttataatagatt

SEQ ID NO: 1164926 - DNA, 15 bp, Homo sapiens
tttttataccattca

SEQ ID NO: 1164927 - DNA, 17 bp, Homo sapiens
tttttataccattcaga

SEQ ID NO: 1164928 - DNA, 23 bp, Homo sapiens
tttttatacggaaaaaattgtat

SEQ ID NO: 1164929 - DNA, 15 bp, Homo sapiens
tttttatactttatt

SEQ ID NO: 1164930 - DNA, 17 bp, Homo sapiens
tttttatcatgcatgtc

SEQ ID NO: 1164931 - DNA, 22 bp, Homo sapiens
tttttatctatataaaataact

SEQ ID NO: 1164932 - DNA, 20 bp, Homo sapiens
tttttatctgatctgtgatt

SEQ ID NO: 1164933 - DNA, 17 bp, Homo sapiens
tttttatcttgggactg

SEQ ID NO: 1164934 - DNA, 15 bp, Homo sapiens
tttttatgcagacag

SEQ ID NO: 1164935 - DNA, 12 bp, Homo sapiens
tttttatgtgat

SEQ ID NO: 1164936 - DNA, 14 bp, Homo sapiens
tttttatgtgcagc

SEQ ID NO: 1164937 - DNA, 12 bp, Homo sapiens
tttttatgtgtt

SEQ ID NO: 1164938 - DNA, 14 bp, Homo sapiens
tttttattaaaata

SEQ ID NO: 1164939 - DNA, 23 bp, Homo sapiens
tttttattaaaatatttcaggtt

SEQ ID NO: 1164940 - DNA, 17 bp, Homo sapiens
tttttattagtattgtt

SEQ ID NO: 1164941 - DNA, 18 bp, Homo sapiens
tttttattagtattgttg

SEQ ID NO: 1164942 - DNA, 23 bp, Homo sapiens
tttttattatttttacctaaaga

SEQ ID NO: 1164943 - DNA, 15 bp, Homo sapiens
tttttatttaaatgt

SEQ ID NO: 1164944 - DNA, 15 bp, Homo sapiens
tttttatttctactg

SEQ ID NO: 1164945 - DNA, 15 bp, Homo sapiens
tttttatttcttcct

SEQ ID NO: 1164946 - DNA, 13 bp, Homo sapiens
tttttcaaaagaa

SEQ ID NO: 1164947 - DNA, 15 bp, Homo sapiens
tttttcaaagcaatt

SEQ ID NO: 1164948 - DNA, 17 bp, Homo sapiens
tttttcaagttgtaaat

SEQ ID NO: 1164949 - DNA, 13 bp, Homo sapiens
tttttcaatggtt

SEQ ID NO: 1164950 - DNA, 13 bp, Homo sapiens
tttttcacatttt

SEQ ID NO: 1164951 - DNA, 20 bp, Homo sapiens
tttttcaccaggttaaaatt

SEQ ID NO: 1164952 - DNA, 16 bp, Homo sapiens
tttttcacggaagttt

SEQ ID NO: 1164953 - DNA, 14 bp, Homo sapiens
tttttcagaaatat

SEQ ID NO: 1164954 - DNA, 17 bp, Homo sapiens
tttttcagtgttaaggt

SEQ ID NO: 1164955 - DNA, 14 bp, Homo sapiens
tttttcagttccaa

SEQ ID NO: 1164956 - DNA, 11 bp, Homo sapiens
tttttcagttg

SEQ ID NO: 1164957 - DNA, 16 bp, Homo sapiens
tttttcagttgttctt

SEQ ID NO: 1164958 - DNA, 12 bp, Homo sapiens
tttttcagtttt

SEQ ID NO: 1164959 - DNA, 17 bp, Homo sapiens
tttttcatagtgccttt

SEQ ID NO: 1164960 - DNA, 13 bp, Homo sapiens
tttttcatattgt

SEQ ID NO: 1164961 - DNA, 10 bp, Homo sapiens
tttttcatcc

SEQ ID NO: 1164962 - DNA, 23 bp, Homo sapiens
tttttcatcttcagttgtctctg

SEQ ID NO: 1164963 - DNA, 22 bp, Homo sapiens
tttttcattaaataaatttgac

SEQ ID NO: 1164964 - DNA, 18 bp, Homo sapiens
tttttcattttaaaaagt

SEQ ID NO: 1164965 - DNA, 15 bp, Homo sapiens
tttggaaagtacact

SEQ ID NO: 1164966 - DNA, 21 bp, Homo sapiens
tttggaaagtacactctgctg

SEQ ID NO: 1164967 - DNA, 10 bp, Homo sapiens
tttggaaata

SEQ ID NO: 1164968 - DNA, 12 bp, Homo sapiens
tttggaaattca

SEQ ID NO: 1164969 - DNA, 15 bp, Homo sapiens
tttggaaattttagt

SEQ ID NO: 1164970 - DNA, 21 bp, Homo sapiens
tttggaactgcgataactgag

SEQ ID NO: 1164971 - DNA, 21 bp, Homo sapiens
tttggaagaagttttttactt

SEQ ID NO: 1164972 - DNA, 15 bp, Homo sapiens
tttggaagctcttct

SEQ ID NO: 1164973 - DNA, 17 bp, Homo sapiens
tttggaataatttctat

SEQ ID NO: 1164974 - DNA, 18 bp, Homo sapiens
tttggaatatttgaataa

SEQ ID NO: 1164975 - DNA, 15 bp, Homo sapiens
tttggaatattttat

SEQ ID NO: 1164976 - DNA, 22 bp, Homo sapiens
tttggaatgaaattcctccttc

SEQ ID NO: 1164977 - DNA, 12 bp, Homo sapiens
tttggaattaca

SEQ ID NO: 1164978 - DNA, 19 bp, Homo sapiens
tttggaattgaactctctg

SEQ ID NO: 1164979 - DNA, 20 bp, Homo sapiens
tttggaccaatagcccacag

SEQ ID NO: 1164980 - DNA, 22 bp, Homo sapiens
tttggacccagggcctgacttg

SEQ ID NO: 1164981 - DNA, 15 bp, Homo sapiens
tttggactgttttca

SEQ ID NO: 1164982 - DNA, 17 bp, Homo sapiens
tttggactgttttcaat

SEQ ID NO: 1164983 - DNA, 19 bp, Homo sapiens
tttggagaacgccagtctc

SEQ ID NO: 1164984 - DNA, 19 bp, Homo sapiens
tttggagactctgtggggc

SEQ ID NO: 1164985 - DNA, 18 bp, Homo sapiens
tttggagggaagctcttg

SEQ ID NO: 1164986 - DNA, 17 bp, Homo sapiens
tttggagtcccctcacc

SEQ ID NO: 1164987 - DNA, 20 bp, Homo sapiens
tttggagtcccctcacctcc

SEQ ID NO: 1164988 - DNA, 13 bp, Homo sapiens
tttggataataaa

SEQ ID NO: 1164989 - DNA, 22 bp, Homo sapiens
tttggatacagctgctttgagc

SEQ ID NO: 1164990 - DNA, 17 bp, Homo sapiens
tttggatacatctgctg

SEQ ID NO: 1164991 - DNA, 20 bp, Homo sapiens
tttggatataggtcagtgag

SEQ ID NO: 1164992 - DNA, 19 bp, Homo sapiens
tttggatctggatctgtta

SEQ ID NO: 1164993 - DNA, 15 bp, Homo sapiens
tttggatcttgaatg

SEQ ID NO: 1164994 - DNA, 23 bp, Homo sapiens
tttggatggggctggcatgtttt

SEQ ID NO: 1164995 - DNA, 14 bp, Homo sapiens
tttggatggtttgt

SEQ ID NO: 1164996 - DNA, 14 bp, Homo sapiens
tttggattaaatta

SEQ ID NO: 1164997 - DNA, 14 bp, Homo sapiens
tttggattgtatat

SEQ ID NO: 1164998 - DNA, 14 bp, Homo sapiens
tttggatttgacat

SEQ ID NO: 1164999 - DNA, 16 bp, Homo sapiens
tttggatttgacattg

SEQ ID NO: 1165000 - DNA, 12 bp, Homo sapiens
tttggcagccag

SEQ ID NO: 1165001 - DNA, 23 bp, Homo sapiens
tttggccaatgcacctaaagaaa

SEQ ID NO: 1165002 - DNA, 11 bp, Homo sapiens
tttggccaggg

SEQ ID NO: 1165003 - DNA, 19 bp, Homo sapiens
tttggccagggaggcgcag

SEQ ID NO: 1165004 - DNA, 12 bp, Homo sapiens
tttggcccaaga

SEQ ID NO: 1165005 - DNA, 13 bp, Homo sapiens
tttggcccaagac

SEQ ID NO: 1165006 - DNA, 19 bp, Homo sapiens
tttggcccaatctctgcca

SEQ ID NO: 1165007 - DNA, 16 bp, Homo sapiens
tttggccctggagcca

SEQ ID NO: 1165008 - DNA, 19 bp, Homo sapiens
tttggcctacattctttat

SEQ ID NO: 1165009 - DNA, 22 bp, Homo sapiens
tttggcctgtgagccattgtcc

SEQ ID NO: 1165010 - DNA, 19 bp, Homo sapiens
tttggcctgtttgatgtat

SEQ ID NO: 1165011 - DNA, 22 bp, Homo sapiens
tttggcctgtttgatgtatgtg

SEQ ID NO: 1165012 - DNA, 14 bp, Homo sapiens
tttggccttaagaa

SEQ ID NO: 1165013 - DNA, 15 bp, Homo sapiens
tttggcctttccttg

SEQ ID NO: 1165014 - DNA, 18 bp, Homo sapiens
tttggctcctctagtaag

SEQ ID NO: 1165015 - DNA, 14 bp, Homo sapiens
tttggctctttcag

SEQ ID NO: 1165016 - DNA, 22 bp, Homo sapiens
tttggctgaaattctcctggag

SEQ ID NO: 1165017 - DNA, 17 bp, Homo sapiens
tttggctgagtactgga

SEQ ID NO: 1165018 - DNA, 17 bp, Homo sapiens
tttggctgtgtctaaac

SEQ ID NO: 1165019 - DNA, 18 bp, Homo sapiens
tttggcttctcctgtgac

SEQ ID NO: 1165020 - DNA, 22 bp, Homo sapiens
tttggctttatgtgcaaaatct

SEQ ID NO: 1165021 - DNA, 13 bp, Homo sapiens
tttggctttctcc

SEQ ID NO: 1165022 - DNA, 17 bp, Homo sapiens
tttggctttctccctgt

SEQ ID NO: 1165023 - DNA, 23 bp, Homo sapiens
tttgggaaagatggataaactga

SEQ ID NO: 1165024 - DNA, 24 bp, Homo sapiens
tttgggaaagatggataaactgag

SEQ ID NO: 1165025 - DNA, 17 bp, Homo sapiens
tttgggaaccaagctat

SEQ ID NO: 1165026 - DNA, 20 bp, Homo sapiens
tttgggaagcaacaaagagc

SEQ ID NO: 1165027 - DNA, 16 bp, Homo sapiens
tttgggagacatgtga

SEQ ID NO: 1165028 - DNA, 20 bp, Homo sapiens
tttgggaggaggaaaagaaa

SEQ ID NO: 1165029 - DNA, 17 bp, Homo sapiens
tttgggaggctgaggtg

SEQ ID NO: 1165030 - DNA, 16 bp, Homo sapiens
tttgggagggaaaagg

SEQ ID NO: 1165031 - DNA, 23 bp, Homo sapiens
tttgggagtttttatgagaaact

SEQ ID NO: 1165032 - DNA, 20 bp, Homo sapiens
tttgggcagaagggagaagg

SEQ ID NO: 1165033 - DNA, 13 bp, Homo sapiens
tttgggccattac

SEQ ID NO: 1165034 - DNA, 14 bp, Homo sapiens
tttgggccattacc

SEQ ID NO: 1165035 - DNA, 15 bp, Homo sapiens
tttgggcccctctcc

SEQ ID NO: 1165036 - DNA, 14 bp, Homo sapiens
tttgggctgaatgt

SEQ ID NO: 1165037 - DNA, 21 bp, Homo sapiens
tttgggcttagtatttctcag

SEQ ID NO: 1165038 - DNA, 23 bp, Homo sapiens
tttggggaagggtttgaattgtt

SEQ ID NO: 1165039 - DNA, 19 bp, Homo sapiens
tttggggacagggggtggg

SEQ ID NO: 1165040 - DNA, 15 bp, Homo sapiens
tttggggagggaggg

SEQ ID NO: 1165041 - DNA, 22 bp, Homo sapiens
tttggggagggaggggaaatgt

SEQ ID NO: 1165042 - DNA, 19 bp, Homo sapiens
tttggggatcgatgtgctc

SEQ ID NO: 1165043 - DNA, 13 bp, Homo sapiens
tttggggccctct

SEQ ID NO: 1165044 - DNA, 18 bp, Homo sapiens
tttgggggaaaaaaaaga

SEQ ID NO: 1165045 - DNA, 22 bp, Homo sapiens
tttgggggaaaaaaaagaaaaa

SEQ ID NO: 1165046 - DNA, 20 bp, Homo sapiens
tttggggggcagagaataaa

SEQ ID NO: 1165047 - DNA, 17 bp, Homo sapiens
tttggggtgcctaggtt

SEQ ID NO: 1165048 - DNA, 17 bp, Homo sapiens
tttggggttgggacagg

SEQ ID NO: 1165049 - DNA, 17 bp, Homo sapiens
tttgggtcataaatcag

SEQ ID NO: 1165050 - DNA, 20 bp, Homo sapiens
tttgggtggctcactactga

SEQ ID NO: 1165051 - DNA, 16 bp, Homo sapiens
tttgggtttggccagg

SEQ ID NO: 1165052 - DNA, 21 bp, Homo sapiens
tttggtaaatttttgaaaaat

SEQ ID NO: 1165053 - DNA, 16 bp, Homo sapiens
tttggtagatcttcaa

SEQ ID NO: 1165054 - DNA, 14 bp, Homo sapiens
tttggtataatgtt

SEQ ID NO: 1165055 - DNA, 18 bp, Homo sapiens
tttggtataatgtttaaa

SEQ ID NO: 1165056 - DNA, 15 bp, Homo sapiens
tttggtcaggggggc

SEQ ID NO: 1165057 - DNA, 13 bp, Homo sapiens
tttggtccaaaaa

SEQ ID NO: 1165058 - DNA, 22 bp, Homo sapiens
tttggtcgaggagtaacaatac

SEQ ID NO: 1165059 - DNA, 15 bp, Homo sapiens
tttggtctgccagaa

SEQ ID NO: 1165060 - DNA, 19 bp, Homo sapiens
tttggtctggactgacagc

SEQ ID NO: 1165061 - DNA, 14 bp, Homo sapiens
tttggtctgggact

SEQ ID NO: 1165062 - DNA, 20 bp, Homo sapiens
tttggtcttcagcctccctc

SEQ ID NO: 1165063 - DNA, 16 bp, Homo sapiens
tttggtgaacagtttt

SEQ ID NO: 1165064 - DNA, 21 bp, Homo sapiens
tttggtgagagtcaaagctga

SEQ ID NO: 1165065 - DNA, 15 bp, Homo sapiens
tttggtgcaaagtat

SEQ ID NO: 1165066 - DNA, 19 bp, Homo sapiens
tttggtggtttcagaaatg

SEQ ID NO: 1165067 - DNA, 18 bp, Homo sapiens
tttggtgttcctggaagc

SEQ ID NO: 1165068 - DNA, 14 bp, Homo sapiens
tttggttcctgtga

SEQ ID NO: 1165069 - DNA, 14 bp, Homo sapiens
tttggttgaataaa

SEQ ID NO: 1165070 - DNA, 21 bp, Homo sapiens
tttggttgcactttagacatt

SEQ ID NO: 1165071 - DNA, 20 bp, Homo sapiens
tttggttgtaaatgctcgtg

SEQ ID NO: 1165072 - DNA, 21 bp, Homo sapiens
tttgtaaaaatgagtcatttg

SEQ ID NO: 1165073 - DNA, 21 bp, Homo sapiens
tttgtaaaagatgaaggctgt

SEQ ID NO: 1165074 - DNA, 17 bp, Homo sapiens
tttgtaaaatcttgcag

SEQ ID NO: 1165075 - DNA, 14 bp, Homo sapiens
tttgtaaacattta

SEQ ID NO: 1165076 - DNA, 17 bp, Homo sapiens
tttgtaaactcaaaata

SEQ ID NO: 1165077 - DNA, 14 bp, Homo sapiens
tttgtaaataagag

SEQ ID NO: 1165078 - DNA, 18 bp, Homo sapiens
tttgtaaatactgcttga

SEQ ID NO: 1165079 - DNA, 11 bp, Homo sapiens
tttgtaaatga

SEQ ID NO: 1165080 - DNA, 13 bp, Homo sapiens
tttgtaaatgatt

SEQ ID NO: 1165081 - DNA, 15 bp, Homo sapiens
tttgtaacctcagct

SEQ ID NO: 1165082 - DNA, 18 bp, Homo sapiens
tttgtaagacatttgtat

SEQ ID NO: 1165083 - DNA, 19 bp, Homo sapiens
tttgtaagatatttgcagt

SEQ ID NO: 1165084 - DNA, 14 bp, Homo sapiens
tttgtaagatgctg

SEQ ID NO: 1165085 - DNA, 17 bp, Homo sapiens
tttgtaagcaacttgct

SEQ ID NO: 1165086 - DNA, 13 bp, Homo sapiens
tttgtaagtgtaa

SEQ ID NO: 1165087 - DNA, 16 bp, Homo sapiens
tttgtaagttgaagca

SEQ ID NO: 1165088 - DNA, 21 bp, Homo sapiens
tttgtaataaaatggtacatt

SEQ ID NO: 1165089 - DNA, 21 bp, Homo sapiens
tttgtaataaaggtctttgca

SEQ ID NO: 1165090 - DNA, 17 bp, Homo sapiens
tttacaaaccattacct

SEQ ID NO: 1165091 - DNA, 16 bp, Homo sapiens
tttacaaactgaagag

SEQ ID NO: 1165092 - DNA, 12 bp, Homo sapiens
tttacaaagtgt

SEQ ID NO: 1165093 - DNA, 19 bp, Homo sapiens
tttacaagaaaaaatgaat

SEQ ID NO: 1165094 - DNA, 16 bp, Homo sapiens
tttacaagtaacaaaa

SEQ ID NO: 1165095 - DNA, 15 bp, Homo sapiens
tttacaagtgtatat

SEQ ID NO: 1165096 - DNA, 21 bp, Homo sapiens
tttacaagtgtatatcagaaa

SEQ ID NO: 1165097 - DNA, 15 bp, Homo sapiens
tttacaataaatatt

SEQ ID NO: 1165098 - DNA, 17 bp, Homo sapiens
tttacaatagttctgtg

SEQ ID NO: 1165099 - DNA, 17 bp, Homo sapiens
tttacaatgatgccgaa

SEQ ID NO: 1165100 - DNA, 12 bp, Homo sapiens
tttacacaatta

SEQ ID NO: 1165101 - DNA, 21 bp, Homo sapiens
tttacacaattaattcatccc

SEQ ID NO: 1165102 - DNA, 18 bp, Homo sapiens
tttacacactgtacacat

SEQ ID NO: 1165103 - DNA, 19 bp, Homo sapiens
tttacacactgtacacata

SEQ ID NO: 1165104 - DNA, 21 bp, Homo sapiens
tttacacactgtacacataag

SEQ ID NO: 1165105 - DNA, 18 bp, Homo sapiens
tttacacagagaaataca

SEQ ID NO: 1165106 - DNA, 20 bp, Homo sapiens
tttacaccgactagccagga

SEQ ID NO: 1165107 - DNA, 14 bp, Homo sapiens
tttacacgagattt

SEQ ID NO: 1165108 - DNA, 17 bp, Homo sapiens
tttacacgagatttctt

SEQ ID NO: 1165109 - DNA, 21 bp, Homo sapiens
tttacactaatatatggacct

SEQ ID NO: 1165110 - DNA, 21 bp, Homo sapiens
tttacactattgtgaatattt

SEQ ID NO: 1165111 - DNA, 19 bp, Homo sapiens
tttacactctgtattgaaa

SEQ ID NO: 1165112 - DNA, 16 bp, Homo sapiens
tttacactctttgtaa

SEQ ID NO: 1165113 - DNA, 16 bp, Homo sapiens
tttacagaaaaatctt

SEQ ID NO: 1165114 - DNA, 17 bp, Homo sapiens
tttacagaaaaatcttg

SEQ ID NO: 1165115 - DNA, 15 bp, Homo sapiens
tttacagaatgcatt

SEQ ID NO: 1165116 - DNA, 20 bp, Homo sapiens
tttacagaatgcattaaaaa

SEQ ID NO: 1165117 - DNA, 21 bp, Homo sapiens
tttacagaatgcattaaaaaa

SEQ ID NO: 1165118 - DNA, 16 bp, Homo sapiens
tttacagcactactct

SEQ ID NO: 1165119 - DNA, 18 bp, Homo sapiens
tttacagcactactctgt

SEQ ID NO: 1165120 - DNA, 16 bp, Homo sapiens
tttacagcattgtctt

SEQ ID NO: 1165121 - DNA, 20 bp, Homo sapiens
tttacagcctcacttgaatg

SEQ ID NO: 1165122 - DNA, 16 bp, Homo sapiens
tttacagctgcctgca

SEQ ID NO: 1165123 - DNA, 23 bp, Homo sapiens
tttacagctttcatgattagcaa

SEQ ID NO: 1165124 - DNA, 21 bp, Homo sapiens
tttacaggaggttgtggatgc

SEQ ID NO: 1165125 - DNA, 13 bp, Homo sapiens
tttacaggccctg

SEQ ID NO: 1165126 - DNA, 15 bp, Homo sapiens
tttacaggtttgaat

SEQ ID NO: 1165127 - DNA, 19 bp, Homo sapiens
tttacagtatgatgaaaat

SEQ ID NO: 1165128 - DNA, 19 bp, Homo sapiens
tttacagtgaagaaagcct

SEQ ID NO: 1165129 - DNA, 21 bp, Homo sapiens
tttacataagttcctatacct

SEQ ID NO: 1165130 - DNA, 14 bp, Homo sapiens
tttacatactttat

SEQ ID NO: 1165131 - DNA, 14 bp, Homo sapiens
tttacatattcctt

SEQ ID NO: 1165132 - DNA, 19 bp, Homo sapiens
tttacatcactttgtgaat

SEQ ID NO: 1165133 - DNA, 17 bp, Homo sapiens
tttacatctaagaattt

SEQ ID NO: 1165134 - DNA, 18 bp, Homo sapiens
tttacatgaattgcattt

SEQ ID NO: 1165135 - DNA, 15 bp, Homo sapiens
tttacatgtagtagt

SEQ ID NO: 1165136 - DNA, 12 bp, Homo sapiens
tttacatgtttt

SEQ ID NO: 1165137 - DNA, 15 bp, Homo sapiens
tttacattgtcctgt

SEQ ID NO: 1165138 - DNA, 19 bp, Homo sapiens
tttacattgtcctgtagct

SEQ ID NO: 1165139 - DNA, 13 bp, Homo sapiens
tttacattttaca

SEQ ID NO: 1165140 - DNA, 21 bp, Homo sapiens
tttaccaaaaccatccatccc

SEQ ID NO: 1165141 - DNA, 14 bp, Homo sapiens
tttaccaaagcatc

SEQ ID NO: 1165142 - DNA, 15 bp, Homo sapiens
tttaccaaagcatca

SEQ ID NO: 1165143 - DNA, 16 bp, Homo sapiens
tttaccacttgctgca

SEQ ID NO: 1165144 - DNA, 19 bp, Homo sapiens
tttaccagttaattactca

SEQ ID NO: 1165145 - DNA, 16 bp, Homo sapiens
tttaccataatcttat

SEQ ID NO: 1165146 - DNA, 23 bp, Homo sapiens
tttaccataatcttatagcactt

SEQ ID NO: 1165147 - DNA, 19 bp, Homo sapiens
tttaccatttgtaataaag

SEQ ID NO: 1165148 - DNA, 23 bp, Homo sapiens
tttaccatttgtaataaagtata

SEQ ID NO: 1165149 - DNA, 19 bp, Homo sapiens
tttacccacacacagataa

SEQ ID NO: 1165150 - DNA, 22 bp, Homo sapiens
tttacccagtgggacagaggag

SEQ ID NO: 1165151 - DNA, 16 bp, Homo sapiens
tttaccctctttgctg

SEQ ID NO: 1165152 - DNA, 19 bp, Homo sapiens
tttaccctgtgtcagagcc

SEQ ID NO: 1165153 - DNA, 19 bp, Homo sapiens
tttacctaccacagtgtct

SEQ ID NO: 1165154 - DNA, 20 bp, Homo sapiens
tttgcttaaatcagttggag

SEQ ID NO: 1165155 - DNA, 16 bp, Homo sapiens
tttgcttaacattaga

SEQ ID NO: 1165156 - DNA, 22 bp, Homo sapiens
tttgcttaatttccttctgtta

SEQ ID NO: 1165157 - DNA, 17 bp, Homo sapiens
tttgcttaccttttcct

SEQ ID NO: 1165158 - DNA, 19 bp, Homo sapiens
tttgcttattgttccaaga

SEQ ID NO: 1165159 - DNA, 22 bp, Homo sapiens
tttgcttatttttataattaaa

SEQ ID NO: 1165160 - DNA, 12 bp, Homo sapiens
tttgcttcatag

SEQ ID NO: 1165161 - DNA, 14 bp, Homo sapiens
tttgcttctagagc

SEQ ID NO: 1165162 - DNA, 15 bp, Homo sapiens
tttgcttgatccaga

SEQ ID NO: 1165163 - DNA, 22 bp, Homo sapiens
tttgcttgcaatctaatctgaa

SEQ ID NO: 1165164 - DNA, 21 bp, Homo sapiens
tttgcttgctcatatgcatgt

SEQ ID NO: 1165165 - DNA, 17 bp, Homo sapiens
tttgcttgttatattaa

SEQ ID NO: 1165166 - DNA, 21 bp, Homo sapiens
tttgctttcggtactgtaata

SEQ ID NO: 1165167 - DNA, 15 bp, Homo sapiens
tttgctttctgctca

SEQ ID NO: 1165168 - DNA, 13 bp, Homo sapiens
tttgctttctggt

SEQ ID NO: 1165169 - DNA, 18 bp, Homo sapiens
tttgctttcttgtctttt

SEQ ID NO: 1165170 - DNA, 19 bp, Homo sapiens
tttggaaaaaactctgaag

SEQ ID NO: 1165171 - DNA, 23 bp, Homo sapiens
tttgtaataagcaatcaaggtta

SEQ ID NO: 1165172 - DNA, 14 bp, Homo sapiens
tttgtaatgaattc

SEQ ID NO: 1165173 - DNA, 17 bp, Homo sapiens
tttgtaatgcactgttt

SEQ ID NO: 1165174 - DNA, 14 bp, Homo sapiens
tttgtaattaaaag

SEQ ID NO: 1165175 - DNA, 22 bp, Homo sapiens
tttgtaattaaaagcaaatcat

SEQ ID NO: 1165176 - DNA, 23 bp, Homo sapiens
tttgtaattaaaagcaaatcatt

SEQ ID NO: 1165177 - DNA, 13 bp, Homo sapiens
tttgtaattctta

SEQ ID NO: 1165178 - DNA, 13 bp, Homo sapiens
tttgtaatttgaa

SEQ ID NO: 1165179 - DNA, 15 bp, Homo sapiens
tttgtaatttgaatt

SEQ ID NO: 1165180 - DNA, 23 bp, Homo sapiens
tttgtacaaaaaaaaagttttat

SEQ ID NO: 1165181 - DNA, 19 bp, Homo sapiens
tttgtacaattttaaagtt

SEQ ID NO: 1165182 - DNA, 14 bp, Homo sapiens
tttgtacaggggcc

SEQ ID NO: 1165183 - DNA, 22 bp, Homo sapiens
tttgtacaggggccatgcccca

SEQ ID NO: 1165184 - DNA, 19 bp, Homo sapiens
tttgtacatagttatttat

SEQ ID NO: 1165185 - DNA, 14 bp, Homo sapiens
tttgtacatattgt

SEQ ID NO: 1165186 - DNA, 19 bp, Homo sapiens
tttgtaccattccttcaaa

SEQ ID NO: 1165187 - DNA, 22 bp, Homo sapiens
tttgtaccattccttcaaataa

SEQ ID NO: 1165188 - DNA, 23 bp, Homo sapiens
tttgtaccattccttcaaataaa

SEQ ID NO: 1165189 - DNA, 14 bp, Homo sapiens
tttgtactgaaaaa

SEQ ID NO: 1165190 - DNA, 13 bp, Homo sapiens
tttgtactgttta

SEQ ID NO: 1165191 - DNA, 14 bp, Homo sapiens
tttgtactgtttaa

SEQ ID NO: 1165192 - DNA, 20 bp, Homo sapiens
tttgtacttccacctccacc

SEQ ID NO: 1165193 - DNA, 20 bp, Homo sapiens
tttgtacttgatttgatgtg

SEQ ID NO: 1165194 - DNA, 18 bp, Homo sapiens
tttgtacttttctggttc

SEQ ID NO: 1165195 - DNA, 16 bp, Homo sapiens
tttgtagcataactgt

SEQ ID NO: 1165196 - DNA, 21 bp, Homo sapiens
tttgtaggagaaactcccatg

SEQ ID NO: 1165197 - DNA, 16 bp, Homo sapiens
tttgtaggctgttccc

SEQ ID NO: 1165198 - DNA, 17 bp, Homo sapiens
tttgtaggctgttccct

SEQ ID NO: 1165199 - DNA, 19 bp, Homo sapiens
tttgtaggggtcaaagaaa

SEQ ID NO: 1165200 - DNA, 20 bp, Homo sapiens
tttgtaggggtcaaagaaat

SEQ ID NO: 1165201 - DNA, 21 bp, Homo sapiens
tttgtaggggtcaaagaaatg

SEQ ID NO: 1165202 - DNA, 14 bp, Homo sapiens
tttgtagtaaaagt

SEQ ID NO: 1165203 - DNA, 16 bp, Homo sapiens
tttgtagtaaaagtgg

SEQ ID NO: 1165204 - DNA, 18 bp, Homo sapiens
tttgtagtgaaataatag

SEQ ID NO: 1165205 - DNA, 12 bp, Homo sapiens
tttgtataaaaa

SEQ ID NO: 1165206 - DNA, 14 bp, Homo sapiens
tttgtataaaagtg

SEQ ID NO: 1165207 - DNA, 16 bp, Homo sapiens
tttgtataacttttga

SEQ ID NO: 1165208 - DNA, 18 bp, Homo sapiens
tttgtatagaccaaagca

SEQ ID NO: 1165209 - DNA, 15 bp, Homo sapiens
tttgtatagttgctt

SEQ ID NO: 1165210 - DNA, 21 bp, Homo sapiens
tttgtatagttgcttgcctga

SEQ ID NO: 1165211 - DNA, 20 bp, Homo sapiens
tttgtatatattttatatgt

SEQ ID NO: 1165212 - DNA, 23 bp, Homo sapiens
tttgtatatctcaacagaattaa

SEQ ID NO: 1165213 - DNA, 15 bp, Homo sapiens
tttgtatatttgcaa

SEQ ID NO: 1165214 - DNA, 21 bp, Homo sapiens
tttgtatctctgaagcatgtt

SEQ ID NO: 1165215 - DNA, 18 bp, Homo sapiens
tttgtatgaaattataat

SEQ ID NO: 1165216 - DNA, 21 bp, Homo sapiens
tttgtatgaaattataatctg

SEQ ID NO: 1165217 - DNA, 16 bp, Homo sapiens
tttgtatgagatggtt

SEQ ID NO: 1165218 - DNA, 18 bp, Homo sapiens
tttgtatgagatggttaa

SEQ ID NO: 1165219 - DNA, 16 bp, Homo sapiens
tttgtatgctaaatga

SEQ ID NO: 1165220 - DNA, 17 bp, Homo sapiens
tttgtatgtaaatacca

SEQ ID NO: 1165221 - DNA, 14 bp, Homo sapiens
tttgtatgtataat

SEQ ID NO: 1165222 - DNA, 15 bp, Homo sapiens
tttgtatgtataatt

SEQ ID NO: 1165223 - DNA, 15 bp, Homo sapiens
tttgtatgtggaagt

SEQ ID NO: 1165224 - DNA, 12 bp, Homo sapiens
tttgtatgtgtg

SEQ ID NO: 1165225 - DNA, 15 bp, Homo sapiens
tttgtatgtgtgggt

SEQ ID NO: 1165226 - DNA, 10 bp, Homo sapiens
tttgtatgtt

SEQ ID NO: 1165227 - DNA, 12 bp, Homo sapiens
tttgtattaata

SEQ ID NO: 1165228 - DNA, 13 bp, Homo sapiens
tttgtattaccat

SEQ ID NO: 1165229 - DNA, 22 bp, Homo sapiens
tttgtattataattgttgatat

SEQ ID NO: 1165230 - DNA, 16 bp, Homo sapiens
tttgtattctctgagc

SEQ ID NO: 1165231 - DNA, 16 bp, Homo sapiens
tttgtattgcttcctg

SEQ ID NO: 1165232 - DNA, 21 bp, Homo sapiens
tttgtattgtttcaattgcat

SEQ ID NO: 1165233 - DNA, 13 bp, Homo sapiens
tttgtattttcaa

SEQ ID NO: 1165234 - DNA, 16 bp, Homo sapiens
tttgtattttgtgtga

SEQ ID NO: 1165235 - DNA, 14 bp, Homo sapiens
tttgtatttttaat

SEQ ID NO: 1165236 - DNA, 17 bp, Homo sapiens
tttgtatttttttgcaa

SEQ ID NO: 1165237 - DNA, 16 bp, Homo sapiens
tttgtcaacattgtga

SEQ ID NO: 1165238 - DNA, 23 bp, Homo sapiens
tttgtcacaatcctaacacatta

SEQ ID NO: 1165239 - DNA, 16 bp, Homo sapiens
tttgtcacattattta

SEQ ID NO: 1165240 - DNA, 20 bp, Homo sapiens
tttgtcacattatttattaa

SEQ ID NO: 1165241 - DNA, 19 bp, Homo sapiens
tttgtcacttgccacatgg

SEQ ID NO: 1165242 - DNA, 23 bp, Homo sapiens
tttgtcacttgccacatggtgtc

SEQ ID NO: 1165243 - DNA, 15 bp, Homo sapiens
tttgtcactttttct

SEQ ID NO: 1165244 - DNA, 20 bp, Homo sapiens
tttgtcacttttttataaaa

SEQ ID NO: 1165245 - DNA, 14 bp, Homo sapiens
tttgtcagacttta

SEQ ID NO: 1165246 - DNA, 22 bp, Homo sapiens
tttgtcatgacagtgcttgcat

SEQ ID NO: 1165247 - DNA, 15 bp, Homo sapiens
tttgtcattatgatt

SEQ ID NO: 1165248 - DNA, 12 bp, Homo sapiens
tttgtcatttta

SEQ ID NO: 1165249 - DNA, 18 bp, Homo sapiens
tttgtcattttaaaatct

SEQ ID NO: 1165250 - DNA, 16 bp, Homo sapiens
tttgtcattttatgaa

SEQ ID NO: 1165251 - DNA, 14 bp, Homo sapiens
tttgtccaatgtgg

SEQ ID NO: 1165252 - DNA, 18 bp, Homo sapiens
tttgtccaattgtgtaga

SEQ ID NO: 1165253 - DNA, 14 bp, Homo sapiens
tttgtcccagcctg

SEQ ID NO: 1165254 - DNA, 19 bp, Homo sapiens
tttgtcccagcctggggct

SEQ ID NO: 1165255 - DNA, 18 bp, Homo sapiens
tttgtcccagtcagaaat

SEQ ID NO: 1165256 - DNA, 16 bp, Homo sapiens
tttgtcccccaacttg

SEQ ID NO: 1165257 - DNA, 18 bp, Homo sapiens
tttgtcctaagagattta

SEQ ID NO: 1165258 - DNA, 19 bp, Homo sapiens
tttgtcctgatgcttttgt

SEQ ID NO: 1165259 - DNA, 19 bp, Homo sapiens
tttgtcctgcagtgctcat

SEQ ID NO: 1165260 - DNA, 22 bp, Homo sapiens
tttgtcctgcgttttctccggg

SEQ ID NO: 1165261 - DNA, 17 bp, Homo sapiens
tttgtctatgaagttgc

SEQ ID NO: 1165262 - DNA, 18 bp, Homo sapiens
tttgtctatgaagttgct

SEQ ID NO: 1165263 - DNA, 22 bp, Homo sapiens
tttgtctcacttttaaaaagaa

SEQ ID NO: 1165264 - DNA, 18 bp, Homo sapiens
tttgtctcctactctgtg

SEQ ID NO: 1165265 - DNA, 22 bp, Homo sapiens
tttgtctcctactctgtgtaaa

SEQ ID NO: 1165266 - DNA, 20 bp, Homo sapiens
tttgtgctagaaattttcaa

SEQ ID NO: 1165267 - DNA, 21 bp, Homo sapiens
tttgtgctagaaattttcaag

SEQ ID NO: 1165268 - DNA, 23 bp, Homo sapiens
tttgtgctatcagactgtaggat

SEQ ID NO: 1165269 - DNA, 16 bp, Homo sapiens
tttgtgctccattttt

SEQ ID NO: 1165270 - DNA, 14 bp, Homo sapiens
tttgtgctgtgggc

SEQ ID NO: 1165271 - DNA, 17 bp, Homo sapiens
tttgtgctgtgggcagc

SEQ ID NO: 1165272 - DNA, 14 bp, Homo sapiens
tttgtggaaactgt

SEQ ID NO: 1165273 - DNA, 14 bp, Homo sapiens
tttgtggatgtctt

SEQ ID NO: 1165274 - DNA, 19 bp, Homo sapiens
tttgtggcagattcaatat

SEQ ID NO: 1165275 - DNA, 12 bp, Homo sapiens
tttgtggcctca

SEQ ID NO: 1165276 - DNA, 19 bp, Homo sapiens
tttgtgggttggccaggag

SEQ ID NO: 1165277 - DNA, 19 bp, Homo sapiens
tttgtgggtttctctgtgc

SEQ ID NO: 1165278 - DNA, 14 bp, Homo sapiens
tttgtggtctaaag

SEQ ID NO: 1165279 - DNA, 15 bp, Homo sapiens
tttgtggttctattt

SEQ ID NO: 1165280 - DNA, 18 bp, Homo sapiens
tttgtgtaaatttctcaa

SEQ ID NO: 1165281 - DNA, 14 bp, Homo sapiens
tttgtgtattaaat

SEQ ID NO: 1165282 - DNA, 15 bp, Homo sapiens
tttgtgtattaaatg

SEQ ID NO: 1165283 - DNA, 13 bp, Homo sapiens
tttgtgtatttaa

SEQ ID NO: 1165284 - DNA, 20 bp, Homo sapiens
tttgtgtatttaacagggag

SEQ ID NO: 1165285 - DNA, 22 bp, Homo sapiens
tttgtgtcaatgggcaatgaca

SEQ ID NO: 1165286 - DNA, 11 bp, Homo sapiens
tttgtgtcctc

SEQ ID NO: 1165287 - DNA, 17 bp, Homo sapiens
tttgtgtcctgctctgt

SEQ ID NO: 1165288 - DNA, 16 bp, Homo sapiens
tttgtgtctgtgttta

SEQ ID NO: 1165289 - DNA, 15 bp, Homo sapiens
tttgtgtctttgtct

SEQ ID NO: 1165290 - DNA, 20 bp, Homo sapiens
tttgtgtgaccaactgtgtt

SEQ ID NO: 1165291 - DNA, 14 bp, Homo sapiens
tttgtgtgattgaa

SEQ ID NO: 1165292 - DNA, 13 bp, Homo sapiens
tttgtgtgatttc

SEQ ID NO: 1165293 - DNA, 14 bp, Homo sapiens
tttgtgtgttatat

SEQ ID NO: 1165294 - DNA, 17 bp, Homo sapiens
tttgtgtgttgtctctt

SEQ ID NO: 1165295 - DNA, 15 bp, Homo sapiens
tttgtgtgttgtctt

SEQ ID NO: 1165296 - DNA, 18 bp, Homo sapiens
tttgtgtgttgtcttgaa

SEQ ID NO: 1165297 - DNA, 14 bp, Homo sapiens
tttgtgttcctatg

SEQ ID NO: 1165298 - DNA, 12 bp, Homo sapiens
tttgtgttctgt

SEQ ID NO: 1165299 - DNA, 21 bp, Homo sapiens
tttgtgttgttggaaaaagtc

SEQ ID NO: 1165300 - DNA, 15 bp, Homo sapiens
tttgtgttttaaaaa

SEQ ID NO: 1165301 - DNA, 20 bp, Homo sapiens
tttgtgttttaaaaaaactg

SEQ ID NO: 1165302 - DNA, 21 bp, Homo sapiens
tttgtgttttaaaaaaactga

SEQ ID NO: 1165303 - DNA, 18 bp, Homo sapiens
tttgttaaaaccaaactg

SEQ ID NO: 1165304 - DNA, 14 bp, Homo sapiens
tttgttaacttttg

SEQ ID NO: 1165305 - DNA, 23 bp, Homo sapiens
tttgttaatataccccaaattgt

SEQ ID NO: 1165306 - DNA, 16 bp, Homo sapiens
tttgttaatatcactc

SEQ ID NO: 1165307 - DNA, 13 bp, Homo sapiens
tttgttaatatta

SEQ ID NO: 1165308 - DNA, 23 bp, Homo sapiens
tttgttaatttagaaaactttaa

SEQ ID NO: 1165309 - DNA, 21 bp, Homo sapiens
tttgttagatagctgcatgtg

SEQ ID NO: 1165310 - DNA, 14 bp, Homo sapiens
tttgttagcaaaga

SEQ ID NO: 1165311 - DNA, 22 bp, Homo sapiens
tttgttagtatgaggcatttgt

SEQ ID NO: 1165312 - DNA, 17 bp, Homo sapiens
tttgttatagaatactt

SEQ ID NO: 1165313 - DNA, 19 bp, Homo sapiens
tttgttatagaatactttt

SEQ ID NO: 1165314 - DNA, 20 bp, Homo sapiens
tttgttatagattgtcttaa

SEQ ID NO: 1165315 - DNA, 16 bp, Homo sapiens
tttgttattgttttgt

SEQ ID NO: 1165316 - DNA, 20 bp, Homo sapiens
tttgttatttacactggtct

SEQ ID NO: 1165317 - DNA, 16 bp, Homo sapiens
tttgttattttgcaac

SEQ ID NO: 1165318 - DNA, 23 bp, Homo sapiens
tttgttcaagttttgggtatgtt

SEQ ID NO: 1165319 - DNA, 21 bp, Homo sapiens
tttgttccccattccttaatt

SEQ ID NO: 1165320 - DNA, 10 bp, Homo sapiens
tttgttcctg

SEQ ID NO: 1165321 - DNA, 11 bp, Homo sapiens
tttgttcctgg

SEQ ID NO: 1165322 - DNA, 12 bp, Homo sapiens
tttgttctagac

SEQ ID NO: 1165323 - DNA, 13 bp, Homo sapiens
tttgttctagact

SEQ ID NO: 1165324 - DNA, 21 bp, Homo sapiens
tttgttctccgggtgtggcct

SEQ ID NO: 1165325 - DNA, 13 bp, Homo sapiens
tttgttctcttct

SEQ ID NO: 1165326 - DNA, 22 bp, Homo sapiens
tttgttctgctacccactgcca

SEQ ID NO: 1165327 - DNA, 16 bp, Homo sapiens
tttgttgacattctga

SEQ ID NO: 1165328 - DNA, 17 bp, Homo sapiens
tttgttgacattctgaa

SEQ ID NO: 1165329 - DNA, 19 bp, Homo sapiens
tttgttgacattctgaatg

SEQ ID NO: 1165330 - DNA, 23 bp, Homo sapiens
tttgttggaaggtttggtgtgtg

SEQ ID NO: 1165331 - DNA, 20 bp, Homo sapiens
tttgttggttgattgtttaa

SEQ ID NO: 1165332 - DNA, 21 bp, Homo sapiens
tttgttgtggccaatgtcgaa

SEQ ID NO: 1165333 - DNA, 14 bp, Homo sapiens
tttgtttaaaaagg

SEQ ID NO: 1165334 - DNA, 20 bp, Homo sapiens
tttgtttaaaaagtaataaa

SEQ ID NO: 1165335 - DNA, 18 bp, Homo sapiens
tttgtttaaagaataaag

SEQ ID NO: 1165336 - DNA, 20 bp, Homo sapiens
tttgtttaagctgagccacg

SEQ ID NO: 1165337 - DNA, 15 bp, Homo sapiens
tttgtttacaaacat

SEQ ID NO: 1165338 - DNA, 13 bp, Homo sapiens
tttgtttagaaaa

SEQ ID NO: 1165339 - DNA, 18 bp, Homo sapiens
tttgtttcaacccaactg

SEQ ID NO: 1165340 - DNA, 12 bp, Homo sapiens
tttgtttcccta

SEQ ID NO: 1165341 - DNA, 12 bp, Homo sapiens
tttgtttctgta

SEQ ID NO: 1165342 - DNA, 10 bp, Homo sapiens
tttgtttctt

SEQ ID NO: 1165343 - DNA, 16 bp, Homo sapiens
tttgtttcttccaaag

SEQ ID NO: 1165344 - DNA, 18 bp, Homo sapiens
tttgtttcttcttttcct

SEQ ID NO: 1165345 - DNA, 16 bp, Homo sapiens
tttgtttgcttccatt

SEQ ID NO: 1165346 - DNA, 12 bp, Homo sapiens
tttgtttgtctg

SEQ ID NO: 1165347 - DNA, 11 bp, Homo sapiens
tttgtttgttt

SEQ ID NO: 1165348 - DNA, 15 bp, Homo sapiens
tttgtttgtttaatt

SEQ ID NO: 1165349 - DNA, 15 bp, Homo sapiens
tttgtttgtttgggt

SEQ ID NO: 1165350 - DNA, 16 bp, Homo sapiens
tttgttttaataaaca

SEQ ID NO: 1165351 - DNA, 15 bp, Homo sapiens
tttgttttagaacca

SEQ ID NO: 1165352 - DNA, 12 bp, Homo sapiens
tttgttttgaaa

SEQ ID NO: 1165353 - DNA, 12 bp, Homo sapiens
tttgttttgcac

SEQ ID NO: 1165354 - DNA, 10 bp, Homo sapiens
tttgttttgg

SEQ ID NO: 1165355 - DNA, 21 bp, Homo sapiens
tttgtttttaaactgtacagt

SEQ ID NO: 1165356 - DNA, 24 bp, Homo sapiens
ttttcctcccagttctacaagcat

SEQ ID NO: 1165357 - DNA, 20 bp, Homo sapiens
ttttcctcccttctgctact

SEQ ID NO: 1165358 - DNA, 21 bp, Homo sapiens
ttttcctcccttgggttctga

SEQ ID NO: 1165359 - DNA, 15 bp, Homo sapiens
ttttcctcctctgcc

SEQ ID NO: 1165360 - DNA, 11 bp, Homo sapiens
ttttcctctgg

SEQ ID NO: 1165361 - DNA, 13 bp, Homo sapiens
ttttcctctggcc

SEQ ID NO: 1165362 - DNA, 17 bp, Homo sapiens
ttttcctcttagaagaa

SEQ ID NO: 1165363 - DNA, 12 bp, Homo sapiens
ttttcctcttgt

SEQ ID NO: 1165364 - DNA, 13 bp, Homo sapiens
ttttcctgcatgt

SEQ ID NO: 1165365 - DNA, 14 bp, Homo sapiens
ttttcctgcatgtt

SEQ ID NO: 1165366 - DNA, 18 bp, Homo sapiens
ttttcctggacttaaaga

SEQ ID NO: 1165367 - DNA, 15 bp, Homo sapiens
ttttcctggatttat

SEQ ID NO: 1165368 - DNA, 12 bp, Homo sapiens
ttttccttaaaa

SEQ ID NO: 1165369 - DNA, 15 bp, Homo sapiens
ttttccttatttcaa

SEQ ID NO: 1165370 - DNA, 18 bp, Homo sapiens
ttttccttatttcaaggg

SEQ ID NO: 1165371 - DNA, 16 bp, Homo sapiens
ttttccttcaaagttt

SEQ ID NO: 1165372 - DNA, 16 bp, Homo sapiens
ttttccttcattcata

SEQ ID NO: 1165373 - DNA, 16 bp, Homo sapiens
ttttccttctgttaaa

SEQ ID NO: 1165374 - DNA, 13 bp, Homo sapiens
ttttcctttctgg

SEQ ID NO: 1165375 - DNA, 13 bp, Homo sapiens
ttttcctttgtgc

SEQ ID NO: 1165376 - DNA, 15 bp, Homo sapiens
ttttccttttcttaa

SEQ ID NO: 1165377 - DNA, 14 bp, Homo sapiens
ttttcgaaaatcaa

SEQ ID NO: 1165378 - DNA, 19 bp, Homo sapiens
ttttcgaagctcagcccac

SEQ ID NO: 1165379 - DNA, 13 bp, Homo sapiens
ttttcgtcctgta

SEQ ID NO: 1165380 - DNA, 17 bp, Homo sapiens
ttttcgtgcactctgct

SEQ ID NO: 1165381 - DNA, 20 bp, Homo sapiens
ttttctaaaacattcccctc

SEQ ID NO: 1165382 - DNA, 11 bp, Homo sapiens
ttttctaaaat

SEQ ID NO: 1165383 - DNA, 13 bp, Homo sapiens
ttttctaaaatct

SEQ ID NO: 1165384 - DNA, 14 bp, Homo sapiens
ttttctaaagactt

SEQ ID NO: 1165385 - DNA, 17 bp, Homo sapiens
ttttctaaataaaaata

SEQ ID NO: 1165386 - DNA, 22 bp, Homo sapiens
ttttctaaataaaaatatgtaa

SEQ ID NO: 1165387 - DNA, 13 bp, Homo sapiens
ttttctaagagaa

SEQ ID NO: 1165388 - DNA, 22 bp, Homo sapiens
ttttctaagtgtaacctcagta

SEQ ID NO: 1165389 - DNA, 20 bp, Homo sapiens
ttttctacacagtaaaaact

SEQ ID NO: 1165390 - DNA, 14 bp, Homo sapiens
ttttctacagtggt

SEQ ID NO: 1165391 - DNA, 15 bp, Homo sapiens
ttttctacgtcatgt

SEQ ID NO: 1165392 - DNA, 14 bp, Homo sapiens
ttttctagaattat

SEQ ID NO: 1165393 - DNA, 13 bp, Homo sapiens
ttttctagagtta

SEQ ID NO: 1165394 - DNA, 19 bp, Homo sapiens
ttttctagatacaataaat

SEQ ID NO: 1165395 - DNA, 15 bp, Homo sapiens
ttttctagtttcagt

SEQ ID NO: 1165396 - DNA, 17 bp, Homo sapiens
ttttctatatcaaaaaa

SEQ ID NO: 1165397 - DNA, 13 bp, Homo sapiens
ttttctatgttgc

SEQ ID NO: 1165398 - DNA, 19 bp, Homo sapiens
ttttctattatggaaaact

SEQ ID NO: 1165399 - DNA, 23 bp, Homo sapiens
ttttctattgttactctggttct

SEQ ID NO: 1165400 - DNA, 12 bp, Homo sapiens
ttttctatttct

SEQ ID NO: 1165401 - DNA, 23 bp, Homo sapiens
ttttctatttttgattgtgttga

SEQ ID NO: 1165402 - DNA, 20 bp, Homo sapiens
ttttctccaatatcagtgct

SEQ ID NO: 1165403 - DNA, 21 bp, Homo sapiens
ttttctccaatatcagtgctc

SEQ ID NO: 1165404 - DNA, 20 bp, Homo sapiens
ttttctcccatttcttgcta

SEQ ID NO: 1165405 - DNA, 23 bp, Homo sapiens
ttttctccccacgatgatatcta

SEQ ID NO: 1165406 - DNA, 12 bp, Homo sapiens
ttttctccctct

SEQ ID NO: 1165407 - DNA, 23 bp, Homo sapiens
ttttctcgtccccctccctgccc

SEQ ID NO: 1165408 - DNA, 17 bp, Homo sapiens
ttttctctgaacacatt

SEQ ID NO: 1165409 - DNA, 20 bp, Homo sapiens
ttttctctgcatttaaaaaa

SEQ ID NO: 1165410 - DNA, 14 bp, Homo sapiens
ttttctctggtaat

SEQ ID NO: 1165411 - DNA, 21 bp, Homo sapiens
ttttctctttaattttaactg

SEQ ID NO: 1165412 - DNA, 17 bp, Homo sapiens
ttttctctttctctcct

SEQ ID NO: 1165413 - DNA, 14 bp, Homo sapiens
ttttctctttgtgg

SEQ ID NO: 1165414 - DNA, 22 bp, Homo sapiens
ttttctcttttaaaatatcctg

SEQ ID NO: 1165415 - DNA, 9 bp, Homo sapiens
ttttctgaa

SEQ ID NO: 1165416 - DNA, 12 bp, Homo sapiens
ttttctgaataa

SEQ ID NO: 1165417 - DNA, 18 bp, Homo sapiens
ttttctgaataaaaaaga

SEQ ID NO: 1165418 - DNA, 19 bp, Homo sapiens
ttttctgaataaaaaagat

SEQ ID NO: 1165419 - DNA, 21 bp, Homo sapiens
ttttctgaataaaaaagattc

SEQ ID NO: 1165420 - DNA, 17 bp, Homo sapiens
ttttctgaataacattt

SEQ ID NO: 1165421 - DNA, 14 bp, Homo sapiens
ttttctgactttta

SEQ ID NO: 1165422 - DNA, 16 bp, Homo sapiens
ttttgaaggtttcaga

SEQ ID NO: 1165423 - DNA, 19 bp, Homo sapiens
ttttgaagtagtttgtata

SEQ ID NO: 1165424 - DNA, 11 bp, Homo sapiens
ttttgaataaa

SEQ ID NO: 1165425 - DNA, 20 bp, Homo sapiens
ttttgaataaaaagtgaact

SEQ ID NO: 1165426 - DNA, 18 bp, Homo sapiens
ttttgaatggtgttgtat

SEQ ID NO: 1165427 - DNA, 14 bp, Homo sapiens
ttttgaatgttatt

SEQ ID NO: 1165428 - DNA, 21 bp, Homo sapiens
ttttgaattagattatttctg

SEQ ID NO: 1165429 - DNA, 15 bp, Homo sapiens
ttttgaattgttaca

SEQ ID NO: 1165430 - DNA, 16 bp, Homo sapiens
ttttgaattgttacat

SEQ ID NO: 1165431 - DNA, 16 bp, Homo sapiens
ttttgaatttaaataa

SEQ ID NO: 1165432 - DNA, 11 bp, Homo sapiens
ttttgaatttt

SEQ ID NO: 1165433 - DNA, 16 bp, Homo sapiens
ttttgacaaagtgcct

SEQ ID NO: 1165434 - DNA, 13 bp, Homo sapiens
ttttgacactgaa

SEQ ID NO: 1165435 - DNA, 21 bp, Homo sapiens
ttttgacactgaaataaccgt

SEQ ID NO: 1165436 - DNA, 23 bp, Homo sapiens
ttttgacagtgttgaaaatgttc

SEQ ID NO: 1165437 - DNA, 24 bp, Homo sapiens
ttttgacagtgttgaaaatgttca

SEQ ID NO: 1165438 - DNA, 20 bp, Homo sapiens
ttttgaccttcatttcatgt

SEQ ID NO: 1165439 - DNA, 20 bp, Homo sapiens
ttttgacggatgattggatt

SEQ ID NO: 1165440 - DNA, 19 bp, Homo sapiens
ttttgacggccttcttggt

SEQ ID NO: 1165441 - DNA, 17 bp, Homo sapiens
ttttgagacagaatctc

SEQ ID NO: 1165442 - DNA, 17 bp, Homo sapiens
ttttgagacatgggatc

SEQ ID NO: 1165443 - DNA, 19 bp, Homo sapiens
ttttgagcgacatctctga

SEQ ID NO: 1165444 - DNA, 21 bp, Homo sapiens
ttttgagctgaaatgctgcat

SEQ ID NO: 1165445 - DNA, 15 bp, Homo sapiens
ttttgaggagcccca

SEQ ID NO: 1165446 - DNA, 18 bp, Homo sapiens
ttttgaggcttctccttc

SEQ ID NO: 1165447 - DNA, 18 bp, Homo sapiens
ttttgagggcatgaagct

SEQ ID NO: 1165448 - DNA, 22 bp, Homo sapiens
ttttgagtgaattagaccttta

SEQ ID NO: 1165449 - DNA, 16 bp, Homo sapiens
ttttgagtgggccctg

SEQ ID NO: 1165450 - DNA, 12 bp, Homo sapiens
ttttgataaaat

SEQ ID NO: 1165451 - DNA, 20 bp, Homo sapiens
ttttgataaagtaataatgt

SEQ ID NO: 1165452 - DNA, 20 bp, Homo sapiens
ttttgataaagtaattcata

SEQ ID NO: 1165453 - DNA, 10 bp, Homo sapiens
ttttgatata

SEQ ID NO: 1165454 - DNA, 15 bp, Homo sapiens
ttttgatataatctt

SEQ ID NO: 1165455 - DNA, 16 bp, Homo sapiens
ttttgatatacattgt

SEQ ID NO: 1165456 - DNA, 17 bp, Homo sapiens
ttttgatatacattgtg

SEQ ID NO: 1165457 - DNA, 20 bp, Homo sapiens
ttttgatatttatttcctgc

SEQ ID NO: 1165458 - DNA, 14 bp, Homo sapiens
ttttgatctctgct

SEQ ID NO: 1165459 - DNA, 16 bp, Homo sapiens
ttttgatgagttgtga

SEQ ID NO: 1165460 - DNA, 22 bp, Homo sapiens
ttttgatgatgtctacagaaaa

SEQ ID NO: 1165461 - DNA, 15 bp, Homo sapiens
ttttgatgtttgtgg

SEQ ID NO: 1165462 - DNA, 23 bp, Homo sapiens
ttttgattccaatccaattatca

SEQ ID NO: 1165463 - DNA, 12 bp, Homo sapiens
ttttgattgaag

SEQ ID NO: 1165464 - DNA, 13 bp, Homo sapiens
ttttgcaaaattt

SEQ ID NO: 1165465 - DNA, 13 bp, Homo sapiens
ttttgcaaagaaa

SEQ ID NO: 1165466 - DNA, 12 bp, Homo sapiens
ttttgcaaaggg

SEQ ID NO: 1165467 - DNA, 21 bp, Homo sapiens
ttttgcaaccaggaacagcaa

SEQ ID NO: 1165468 - DNA, 22 bp, Homo sapiens
ttttgcaagtgaaggtttacaa

SEQ ID NO: 1165469 - DNA, 17 bp, Homo sapiens
ttttgcacagccaaatt

SEQ ID NO: 1165470 - DNA, 23 bp, Homo sapiens
ttttgcacagttagttgtgaaag

SEQ ID NO: 1165471 - DNA, 12 bp, Homo sapiens
ttttgcactttt

SEQ ID NO: 1165472 - DNA, 13 bp, Homo sapiens
ttttgcagaagag

SEQ ID NO: 1165473 - DNA, 17 bp, Homo sapiens
ttttgcataagattaaa

SEQ ID NO: 1165474 - DNA, 20 bp, Homo sapiens
ttttgcatctcacaaacata

SEQ ID NO: 1165475 - DNA, 15 bp, Homo sapiens
ttttgcattcaaatt

SEQ ID NO: 1165476 - DNA, 14 bp, Homo sapiens
ttttgcattccaga

SEQ ID NO: 1165477 - DNA, 20 bp, Homo sapiens
ttttgccactgcctttcaga

SEQ ID NO: 1165478 - DNA, 16 bp, Homo sapiens
ttttgccagactctag

SEQ ID NO: 1165479 - DNA, 14 bp, Homo sapiens
ttttgcctggctgt

SEQ ID NO: 1165480 - DNA, 21 bp, Homo sapiens
ttttgcgtttggtttacttgt

SEQ ID NO: 1165481 - DNA, 15 bp, Homo sapiens
ttttgctcagttcca

SEQ ID NO: 1165482 - DNA, 18 bp, Homo sapiens
ttttgctcagttccatgg

SEQ ID NO: 1165483 - DNA, 19 bp, Homo sapiens
ttttgctgagactaatctt

SEQ ID NO: 1165484 - DNA, 15 bp, Homo sapiens
ttttgctgagttgtt

SEQ ID NO: 1165485 - DNA, 13 bp, Homo sapiens
ttttgctgctgct

SEQ ID NO: 1165486 - DNA, 14 bp, Homo sapiens
ttttgctgcttctg

SEQ ID NO: 1165487 - DNA, 13 bp, Homo sapiens
ttttgctggaata

SEQ ID NO: 1165488 - DNA, 14 bp, Homo sapiens
ttttgcttaacatt

SEQ ID NO: 1165489 - DNA, 12 bp, Homo sapiens
ttttgctttggt

SEQ ID NO: 1165490 - DNA, 19 bp, Homo sapiens
ttttgcttttaattaaata

SEQ ID NO: 1165491 - DNA, 11 bp, Homo sapiens
ttttggaatct

SEQ ID NO: 1165492 - DNA, 13 bp, Homo sapiens
ttttggaattgtc

SEQ ID NO: 1165493 - DNA, 13 bp, Homo sapiens
ttttggaatttgc

SEQ ID NO: 1165494 - DNA, 13 bp, Homo sapiens
ttttggagaaaaa

SEQ ID NO: 1165495 - DNA, 16 bp, Homo sapiens
ttttggattgtatatt

SEQ ID NO: 1165496 - DNA, 19 bp, Homo sapiens
ttttggcaaaactctactt

SEQ ID NO: 1165497 - DNA, 22 bp, Homo sapiens
ttttggcaatacatttgatttg

SEQ ID NO: 1165498 - DNA, 23 bp, Homo sapiens
ttttggcaatgactcaaagtctg

SEQ ID NO: 1165499 - DNA, 17 bp, Homo sapiens
ttttggccaaagtgtta

SEQ ID NO: 1165500 - DNA, 19 bp, Homo sapiens
ttttggcccccgagctggg

SEQ ID NO: 1165501 - DNA, 16 bp, Homo sapiens
ttttggcctgtttgat

SEQ ID NO: 1165502 - DNA, 17 bp, Homo sapiens
ttttggcgaatctcaaa

SEQ ID NO: 1165503 - DNA, 18 bp, Homo sapiens
ttttggctctttcagaga

SEQ ID NO: 1165504 - DNA, 20 bp, Homo sapiens
ttttggctgtgacctcttca

SEQ ID NO: 1165505 - DNA, 14 bp, Homo sapiens
ttttgggccattac

SEQ ID NO: 1165506 - DNA, 16 bp, Homo sapiens
ttttgggccattaccc

SEQ ID NO: 1165507 - DNA, 17 bp, Homo sapiens
ttttgggctcaaagccc

SEQ ID NO: 1165508 - DNA, 21 bp, Homo sapiens
ttttggggggcagagaataaa

SEQ ID NO: 1165509 - DNA, 18 bp, Homo sapiens
ttttgggggtgtgagtgt

SEQ ID NO: 1165510 - DNA, 19 bp, Homo sapiens
ttttggggttgtgttgtca

SEQ ID NO: 1165511 - DNA, 21 bp, Homo sapiens
ttttgggtaaaatctgtaatt

SEQ ID NO: 1165512 - DNA, 16 bp, Homo sapiens
ttttgggttaaaagat

SEQ ID NO: 1165513 - DNA, 22 bp, Homo sapiens
ttttggtaaatttttgaaaaat

SEQ ID NO: 1165514 - DNA, 21 bp, Homo sapiens
ttttggtataaggtacatatt

SEQ ID NO: 1165515 - DNA, 23 bp, Homo sapiens
ttttggtcttcagcctccctcag

SEQ ID NO: 1165516 - DNA, 13 bp, Homo sapiens
ttttggtgtgttg

SEQ ID NO: 1165517 - DNA, 20 bp, Homo sapiens
ttttggttttaaaagcacaa

SEQ ID NO: 1165518 - DNA, 12 bp, Homo sapiens
ttttgtaaaaga

SEQ ID NO: 1165519 - DNA, 16 bp, Homo sapiens
ttttgtaaaatgtatt

SEQ ID NO: 1165520 - DNA, 18 bp, Homo sapiens
ttttgtaaactcaaaata

SEQ ID NO: 1165521 - DNA, 15 bp, Homo sapiens
ttttgtaaagatgcc

SEQ ID NO: 1165522 - DNA, 11 bp, Homo sapiens
ttttgtaactt

SEQ ID NO: 1165523 - DNA, 22 bp, Homo sapiens
ttttgtaataagcaatcaaggt

SEQ ID NO: 1165524 - DNA, 14 bp, Homo sapiens
ttttgtacaattac

SEQ ID NO: 1165525 - DNA, 17 bp, Homo sapiens
ttttgtacaattactaa

SEQ ID NO: 1165526 - DNA, 11 bp, Homo sapiens
ttttgtacata

SEQ ID NO: 1165527 - DNA, 13 bp, Homo sapiens
ttttgtacatact

SEQ ID NO: 1165528 - DNA, 11 bp, Homo sapiens
ttttgtacatc

SEQ ID NO: 1165529 - DNA, 14 bp, Homo sapiens
ttttgtataaaaag

SEQ ID NO: 1165530 - DNA, 15 bp, Homo sapiens
ttttgtataaaaagg

SEQ ID NO: 1165531 - DNA, 22 bp, Homo sapiens
ttttgtataaaatccatagatt

SEQ ID NO: 1165532 - DNA, 14 bp, Homo sapiens
ttttgtataattgg

SEQ ID NO: 1165533 - DNA, 16 bp, Homo sapiens
ttttgtataattggat

SEQ ID NO: 1165534 - DNA, 23 bp, Homo sapiens
ttttgtataattggatttcctaa

SEQ ID NO: 1165535 - DNA, 24 bp, Homo sapiens
ttttgtataattggatttcctaat

SEQ ID NO: 1165536 - DNA, 13 bp, Homo sapiens
ttttgtatatgat

SEQ ID NO: 1165537 - DNA, 18 bp, Homo sapiens
ttttgtatattgtaggaa

SEQ ID NO: 1165538 - DNA, 18 bp, Homo sapiens
ttttgtatcttcctttct

SEQ ID NO: 1165539 - DNA, 18 bp, Homo sapiens
ttttgtatgacttctgct

SEQ ID NO: 1165540 - DNA, 20 bp, Homo sapiens
ttttgtatgaggtcctcagg

SEQ ID NO: 1165541 - DNA, 12 bp, Homo sapiens
ttttgtatgtaa

SEQ ID NO: 1165542 - DNA, 14 bp, Homo sapiens
ttttgtatgtgtgt

SEQ ID NO: 1165543 - DNA, 18 bp, Homo sapiens
ttttgtatgttatgaaca

SEQ ID NO: 1165544 - DNA, 10 bp, Homo sapiens
ttttgtattt

SEQ ID NO: 1165545 - DNA, 18 bp, Homo sapiens
ttttgtattttttaaaac

SEQ ID NO: 1165546 - DNA, 16 bp, Homo sapiens
ttttgtcccccaactt

SEQ ID NO: 1165547 - DNA, 15 bp, Homo sapiens
ttttgtcctgcctct

SEQ ID NO: 1165548 - DNA, 22 bp, Homo sapiens
ttggtaaaaacagcagctcata

SEQ ID NO: 1165549 - DNA, 14 bp, Homo sapiens
ttggtaaaaatgct

SEQ ID NO: 1165550 - DNA, 19 bp, Homo sapiens
ttggtaaaaatgctgctct

SEQ ID NO: 1165551 - DNA, 19 bp, Homo sapiens
ttggtaaaactcactgtga

SEQ ID NO: 1165552 - DNA, 16 bp, Homo sapiens
ttggtaaagactggct

SEQ ID NO: 1165553 - DNA, 22 bp, Homo sapiens
ttggtaaagggttaatagccag

SEQ ID NO: 1165554 - DNA, 17 bp, Homo sapiens
ttggtaaatttttgaaa

SEQ ID NO: 1165555 - DNA, 14 bp, Homo sapiens
ttggtaacttttgt

SEQ ID NO: 1165556 - DNA, 14 bp, Homo sapiens
ttggtaagagacag

SEQ ID NO: 1165557 - DNA, 14 bp, Homo sapiens
ttggtacaaaaata

SEQ ID NO: 1165558 - DNA, 17 bp, Homo sapiens
ttggtactataaaagct

SEQ ID NO: 1165559 - DNA, 23 bp, Homo sapiens
ttggtagacttggacatctctct

SEQ ID NO: 1165560 - DNA, 17 bp, Homo sapiens
ttggtagagccctcaga

SEQ ID NO: 1165561 - DNA, 16 bp, Homo sapiens
ttggtagatcttcaat

SEQ ID NO: 1165562 - DNA, 22 bp, Homo sapiens
ttggtagttctgtgcctccccc

SEQ ID NO: 1165563 - DNA, 16 bp, Homo sapiens
ttggtataatgtttaa

SEQ ID NO: 1165564 - DNA, 17 bp, Homo sapiens
ttggtcaaactttttcc

SEQ ID NO: 1165565 - DNA, 18 bp, Homo sapiens
ttggtcaaatcaactgaa

SEQ ID NO: 1165566 - DNA, 17 bp, Homo sapiens
ttggtcaagaaaggagg

SEQ ID NO: 1165567 - DNA, 12 bp, Homo sapiens
ttggtcagcttt

SEQ ID NO: 1165568 - DNA, 15 bp, Homo sapiens
ttggtcagcttttgt

SEQ ID NO: 1165569 - DNA, 16 bp, Homo sapiens
ttggtccaaaaaaagg

SEQ ID NO: 1165570 - DNA, 19 bp, Homo sapiens
ttggtccaaaaaaaggaaa

SEQ ID NO: 1165571 - DNA, 12 bp, Homo sapiens
ttggtccagagc

SEQ ID NO: 1165572 - DNA, 16 bp, Homo sapiens
ttggtcccaagcctga

SEQ ID NO: 1165573 - DNA, 15 bp, Homo sapiens
ttggtcccctccctc

SEQ ID NO: 1165574 - DNA, 12 bp, Homo sapiens
ttggtccctctc

SEQ ID NO: 1165575 - DNA, 12 bp, Homo sapiens
ttggtccctggt

SEQ ID NO: 1165576 - DNA, 19 bp, Homo sapiens
ttggtcctacctattatcc

SEQ ID NO: 1165577 - DNA, 20 bp, Homo sapiens
ttggtcctacctattatcct

SEQ ID NO: 1165578 - DNA, 14 bp, Homo sapiens
ttggtcctttacac

SEQ ID NO: 1165579 - DNA, 14 bp, Homo sapiens
ttggtcgagtcttt

SEQ ID NO: 1165580 - DNA, 22 bp, Homo sapiens
ttggtcgagtctttgtgtgtta

SEQ ID NO: 1165581 - DNA, 17 bp, Homo sapiens
ttggtctgggacttcct

SEQ ID NO: 1165582 - DNA, 21 bp, Homo sapiens
ttggtctgttttggtcccctc

SEQ ID NO: 1165583 - DNA, 19 bp, Homo sapiens
ttggtcttatttattattg

SEQ ID NO: 1165584 - DNA, 20 bp, Homo sapiens
ttggtcttcagcctccctca

SEQ ID NO: 1165585 - DNA, 14 bp, Homo sapiens
ttggtctttcattg

SEQ ID NO: 1165586 - DNA, 22 bp, Homo sapiens
ttggtgaatcggttgttctttc

SEQ ID NO: 1165587 - DNA, 17 bp, Homo sapiens
ttggtgaatttcacaag

SEQ ID NO: 1165588 - DNA, 21 bp, Homo sapiens
ttggtgacaaaattcatttgc

SEQ ID NO: 1165589 - DNA, 22 bp, Homo sapiens
ttggtgacaaaattcatttgct

SEQ ID NO: 1165590 - DNA, 22 bp, Homo sapiens
ttggtgagtcttggttctaaag

SEQ ID NO: 1165591 - DNA, 17 bp, Homo sapiens
ttggtgcacagtgattt

SEQ ID NO: 1165592 - DNA, 18 bp, Homo sapiens
ttggtgcacagtgatttt

SEQ ID NO: 1165593 - DNA, 16 bp, Homo sapiens
ttggtgccggtcacac

SEQ ID NO: 1165594 - DNA, 22 bp, Homo sapiens
ttggtgccggtcacactctaca

SEQ ID NO: 1165595 - DNA, 19 bp, Homo sapiens
ttggtgctatttgaagaaa

SEQ ID NO: 1165596 - DNA, 15 bp, Homo sapiens
ttggtgctctgtgtt

SEQ ID NO: 1165597 - DNA, 17 bp, Homo sapiens
ttggtgctttttataaa

SEQ ID NO: 1165598 - DNA, 21 bp, Homo sapiens
ttggtgctttttataaaaaga

SEQ ID NO: 1165599 - DNA, 16 bp, Homo sapiens
ttggtggagataaaga

SEQ ID NO: 1165600 - DNA, 17 bp, Homo sapiens
ttggtggagcagccaga

SEQ ID NO: 1165601 - DNA, 18 bp, Homo sapiens
ttggtgggctggcccagc

SEQ ID NO: 1165602 - DNA, 21 bp, Homo sapiens
ttggtggggctcgtggccttc

SEQ ID NO: 1165603 - DNA, 13 bp, Homo sapiens
ttggtggtacttt

SEQ ID NO: 1165604 - DNA, 19 bp, Homo sapiens
ttggtggtttcagaaatgt

SEQ ID NO: 1165605 - DNA, 15 bp, Homo sapiens
ttggtgtaatttgaa

SEQ ID NO: 1165606 - DNA, 17 bp, Homo sapiens
ttggtgtaatttgaaga

SEQ ID NO: 1165607 - DNA, 17 bp, Homo sapiens
ttggtgtatatcatgaa

SEQ ID NO: 1165608 - DNA, 14 bp, Homo sapiens
ttggtgtgaagaaa

SEQ ID NO: 1165609 - DNA, 19 bp, Homo sapiens
ttggtgtgattgcacagaa

SEQ ID NO: 1165610 - DNA, 21 bp, Homo sapiens
ttggtgtgattgcacagaatt

SEQ ID NO: 1165611 - DNA, 14 bp, Homo sapiens
ttggtgtgctgagg

SEQ ID NO: 1165612 - DNA, 19 bp, Homo sapiens
ttggtgtgttggacagaga

SEQ ID NO: 1165613 - DNA, 18 bp, Homo sapiens
ttggtgttgtcattgtaa

SEQ ID NO: 1165614 - DNA, 16 bp, Homo sapiens
ttggttaaaatgtgat

SEQ ID NO: 1165615 - DNA, 18 bp, Homo sapiens
ttggttaatttttacatg

SEQ ID NO: 1165616 - DNA, 22 bp, Homo sapiens
ttggttagacgccttccaggtc

SEQ ID NO: 1165617 - DNA, 14 bp, Homo sapiens
ttggttagaggaag

SEQ ID NO: 1165618 - DNA, 15 bp, Homo sapiens
ttggttcagtttttt

SEQ ID NO: 1165619 - DNA, 14 bp, Homo sapiens
ttggttcattaatt

SEQ ID NO: 1165620 - DNA, 14 bp, Homo sapiens
ttggttcctgggat

SEQ ID NO: 1165621 - DNA, 19 bp, Homo sapiens
ttggttcctgtttgaaact

SEQ ID NO: 1165622 - DNA, 14 bp, Homo sapiens
ttggttccttctct

SEQ ID NO: 1165623 - DNA, 15 bp, Homo sapiens
ttggttccttctctg

SEQ ID NO: 1165624 - DNA, 16 bp, Homo sapiens
ttggttccttgggggg

SEQ ID NO: 1165625 - DNA, 20 bp, Homo sapiens
ttggttctaaaggtaccaaa

SEQ ID NO: 1165626 - DNA, 18 bp, Homo sapiens
ttggttctagcgcagttt

SEQ ID NO: 1165627 - DNA, 20 bp, Homo sapiens
ttggttctagcgcagttttt

SEQ ID NO: 1165628 - DNA, 13 bp, Homo sapiens
ttggttctggggc

SEQ ID NO: 1165629 - DNA, 15 bp, Homo sapiens
ttggttctgtgaaca

SEQ ID NO: 1165630 - DNA, 12 bp, Homo sapiens
ttggttcttccc

SEQ ID NO: 1165631 - DNA, 20 bp, Homo sapiens
ttggttgaaaataaaaagat

SEQ ID NO: 1165632 - DNA, 13 bp, Homo sapiens
ttggttgaataaa

SEQ ID NO: 1165633 - DNA, 22 bp, Homo sapiens
ttggttggaagctaccagagct

SEQ ID NO: 1165634 - DNA, 18 bp, Homo sapiens
ttggttggtagggtggga

SEQ ID NO: 1165635 - DNA, 22 bp, Homo sapiens
ttggttgtaaatgctcgtgtga

SEQ ID NO: 1165636 - DNA, 16 bp, Homo sapiens
ttggttgtttaacact

SEQ ID NO: 1165637 - DNA, 23 bp, Homo sapiens
ttggtttaaagaaagtgtatttg

SEQ ID NO: 1165638 - DNA, 16 bp, Homo sapiens
ttggtttaatttaaag

SEQ ID NO: 1165639 - DNA, 14 bp, Homo sapiens
ttggtttattttca

SEQ ID NO: 1165640 - DNA, 16 bp, Homo sapiens
ttggtttggggagaaa

SEQ ID NO: 1165641 - DNA, 16 bp, Homo sapiens
ttggtttgtatgagat

SEQ ID NO: 1165642 - DNA, 23 bp, Homo sapiens
ttggttttatggttacttcttct

SEQ ID NO: 1165643 - DNA, 17 bp, Homo sapiens
ttggttttctctctgga

SEQ ID NO: 1165644 - DNA, 14 bp, Homo sapiens
ttggttttgccatt

SEQ ID NO: 1165645 - DNA, 18 bp, Homo sapiens
ttggtttttaaaacccag

SEQ ID NO: 1165646 - DNA, 13 bp, Homo sapiens
ttgtaaaaaaagc

SEQ ID NO: 1165647 - DNA, 15 bp, Homo sapiens
ttgtaaaaaaagcaa

SEQ ID NO: 1165648 - DNA, 18 bp, Homo sapiens
ttgtaaaaaaagcaaaaa

SEQ ID NO: 1165649 - DNA, 20 bp, Homo sapiens
ttgtaaaaacagcattgctt

SEQ ID NO: 1165650 - DNA, 18 bp, Homo sapiens
ttgtaaaaatgagacttt

SEQ ID NO: 1165651 - DNA, 19 bp, Homo sapiens
ttgtaaaaatgagactttt

SEQ ID NO: 1165652 - DNA, 23 bp, Homo sapiens
ttgtaaaaatgagactttttcag

SEQ ID NO: 1165653 - DNA, 22 bp, Homo sapiens
ttgtaaaaattaaaagttatgg

SEQ ID NO: 1165654 - DNA, 14 bp, Homo sapiens
ttgtaaaacaggta

SEQ ID NO: 1165655 - DNA, 14 bp, Homo sapiens
ttgtaaaactacac

SEQ ID NO: 1165656 - DNA, 13 bp, Homo sapiens
ttgtaaaagaaat

SEQ ID NO: 1165657 - DNA, 22 bp, Homo sapiens
ttgtaaaagaaatcatgtccat

SEQ ID NO: 1165658 - DNA, 23 bp, Homo sapiens
ttgtaaaagaacagtaaacattg

SEQ ID NO: 1165659 - DNA, 19 bp, Homo sapiens
ttgtaaaagcattttgtaa

SEQ ID NO: 1165660 - DNA, 17 bp, Homo sapiens
ttgtaaaatagaaaaag

SEQ ID NO: 1165661 - DNA, 15 bp, Homo sapiens
ttgtaaaatgtatta

SEQ ID NO: 1165662 - DNA, 16 bp, Homo sapiens
ttgtaaacaaactctt

SEQ ID NO: 1165663 - DNA, 14 bp, Homo sapiens
ttgtaaacatttat

SEQ ID NO: 1165664 - DNA, 16 bp, Homo sapiens
ttgtaaactcaaaata

SEQ ID NO: 1165665 - DNA, 22 bp, Homo sapiens
ttgtaaactcaaaatatttgta

SEQ ID NO: 1165666 - DNA, 15 bp, Homo sapiens
ttgtaaactgtatca

SEQ ID NO: 1165667 - DNA, 17 bp, Homo sapiens
ttgtaaagtatgtatta

SEQ ID NO: 1165668 - DNA, 11 bp, Homo sapiens
ttgtaaataaa

SEQ ID NO: 1165669 - DNA, 13 bp, Homo sapiens
ttgtaaataagag

SEQ ID NO: 1165670 - DNA, 14 bp, Homo sapiens
ttgtaaatacacat

SEQ ID NO: 1165671 - DNA, 21 bp, Homo sapiens
ttgtaaatactggactcagga

SEQ ID NO: 1165672 - DNA, 15 bp, Homo sapiens
ttgtaaatatataaa

SEQ ID NO: 1165673 - DNA, 19 bp, Homo sapiens
ttgtagattgattgtattg

SEQ ID NO: 1165674 - DNA, 16 bp, Homo sapiens
ttgtagcactgagggt

SEQ ID NO: 1165675 - DNA, 22 bp, Homo sapiens
ttgtagcagattgtttcctctt

SEQ ID NO: 1165676 - DNA, 16 bp, Homo sapiens
ttgtagcataactgta

SEQ ID NO: 1165677 - DNA, 23 bp, Homo sapiens
ttgtagcatataggtgatgtttg

SEQ ID NO: 1165678 - DNA, 23 bp, Homo sapiens
ttgtagcatttaaaatggaaaat

SEQ ID NO: 1165679 - DNA, 16 bp, Homo sapiens
ttgtagcattttcctg

SEQ ID NO: 1165680 - DNA, 18 bp, Homo sapiens
ttgtagccaggtactgca

SEQ ID NO: 1165681 - DNA, 22 bp, Homo sapiens
ttgtagccttcctccacatcct

SEQ ID NO: 1165682 - DNA, 20 bp, Homo sapiens
ttgtaggaatctgccttcca

SEQ ID NO: 1165683 - DNA, 16 bp, Homo sapiens
ttgtagggatgccttt

SEQ ID NO: 1165684 - DNA, 15 bp, Homo sapiens
ttgtccctctgcccc

SEQ ID NO: 1165685 - DNA, 17 bp, Homo sapiens
ttgtccctctttggaac

SEQ ID NO: 1165686 - DNA, 13 bp, Homo sapiens
ttgtccctttccc

SEQ ID NO: 1165687 - DNA, 16 bp, Homo sapiens
ttgtccgctgggtggt

SEQ ID NO: 1165688 - DNA, 18 bp, Homo sapiens
ttgtccgtgttcatacat

SEQ ID NO: 1165689 - DNA, 15 bp, Homo sapiens
ttgtcctaagagatt

SEQ ID NO: 1165690 - DNA, 16 bp, Homo sapiens
ttgtcctccttttcac

SEQ ID NO: 1165691 - DNA, 18 bp, Homo sapiens
ttgtcctgatttcttatt

SEQ ID NO: 1165692 - DNA, 15 bp, Homo sapiens
ttgtcctgccagctg

SEQ ID NO: 1165693 - DNA, 17 bp, Homo sapiens
ttgtcctgccagctgcc

SEQ ID NO: 1165694 - DNA, 19 bp, Homo sapiens
ttgtcctgccagctgcctt

SEQ ID NO: 1165695 - DNA, 21 bp, Homo sapiens
ttgtcctgccagctgccttcc

SEQ ID NO: 1165696 - DNA, 14 bp, Homo sapiens
ttgtcctgcctctt

SEQ ID NO: 1165697 - DNA, 17 bp, Homo sapiens
ttgtcctgcctcttgtt

SEQ ID NO: 1165698 - DNA, 12 bp, Homo sapiens
ttgtcctggccc

SEQ ID NO: 1165699 - DNA, 20 bp, Homo sapiens
ttgtcctgggttctggggca

SEQ ID NO: 1165700 - DNA, 15 bp, Homo sapiens
ttgtcctgtgaaata

SEQ ID NO: 1165701 - DNA, 14 bp, Homo sapiens
ttgtcctgtgtcta

SEQ ID NO: 1165702 - DNA, 19 bp, Homo sapiens
ttgtcctgtgtctatgtac

SEQ ID NO: 1165703 - DNA, 15 bp, Homo sapiens
ttgtccttcagagct

SEQ ID NO: 1165704 - DNA, 15 bp, Homo sapiens
ttgtccttgaaagta

SEQ ID NO: 1165705 - DNA, 23 bp, Homo sapiens
ttgtccttgccccactcctctcc

SEQ ID NO: 1165706 - DNA, 15 bp, Homo sapiens
ttgtcctttcccttc

SEQ ID NO: 1165707 - DNA, 14 bp, Homo sapiens
ttgtccttttcata

SEQ ID NO: 1165708 - DNA, 20 bp, Homo sapiens
ttgtcgcgcgtctcccatcc

SEQ ID NO: 1165709 - DNA, 15 bp, Homo sapiens
ttgtcgtggttctta

SEQ ID NO: 1165710 - DNA, 20 bp, Homo sapiens
ttgtcgtttttagctttgtg

SEQ ID NO: 1165711 - DNA, 16 bp, Homo sapiens
ttgtctaaaatgtcag

SEQ ID NO: 1165712 - DNA, 15 bp, Homo sapiens
ttgtctaactcagaa

SEQ ID NO: 1165713 - DNA, 18 bp, Homo sapiens
ttgtctacacaccctgca

SEQ ID NO: 1165714 - DNA, 18 bp, Homo sapiens
ttgtctataaagcattta

SEQ ID NO: 1165715 - DNA, 15 bp, Homo sapiens
ttgtctatgaagttg

SEQ ID NO: 1165716 - DNA, 19 bp, Homo sapiens
ttgtctatgaagttgctgt

SEQ ID NO: 1165717 - DNA, 22 bp, Homo sapiens
ttgtctatgaagttgctgttta

SEQ ID NO: 1165718 - DNA, 16 bp, Homo sapiens
ttgtctattctgagcc

SEQ ID NO: 1165719 - DNA, 18 bp, Homo sapiens
ttgtctattctgagcctt

SEQ ID NO: 1165720 - DNA, 12 bp, Homo sapiens
ttgtctatttat

SEQ ID NO: 1165721 - DNA, 17 bp, Homo sapiens
ttgtctatttttgtctt

SEQ ID NO: 1165722 - DNA, 18 bp, Homo sapiens
ttgtctatttttgtctta

SEQ ID NO: 1165723 - DNA, 11 bp, Homo sapiens
ttgtctcagaa

SEQ ID NO: 1165724 - DNA, 21 bp, Homo sapiens
ttgtctcattttggtctgttt

SEQ ID NO: 1165725 - DNA, 23 bp, Homo sapiens
ttgtctcccctgttcccctctcc

SEQ ID NO: 1165726 - DNA, 23 bp, Homo sapiens
ttgtctccctggttgcctctctt

SEQ ID NO: 1165727 - DNA, 17 bp, Homo sapiens
ttgtctcctttctgact

SEQ ID NO: 1165728 - DNA, 18 bp, Homo sapiens
ttgtctcctttctgactg

SEQ ID NO: 1165729 - DNA, 19 bp, Homo sapiens
ttgtctcctttctgactgt

SEQ ID NO: 1165730 - DNA, 21 bp, Homo sapiens
ttgtctctgatgcagcttata

SEQ ID NO: 1165731 - DNA, 13 bp, Homo sapiens
ttgtctctgggct

SEQ ID NO: 1165732 - DNA, 19 bp, Homo sapiens
ttgtctctgggctgaggaa

SEQ ID NO: 1165733 - DNA, 21 bp, Homo sapiens
ttgtctctgttggtccactgt

SEQ ID NO: 1165734 - DNA, 22 bp, Homo sapiens
ttgtctctgttggtccactgtg

SEQ ID NO: 1165735 - DNA, 24 bp, Homo sapiens
ttgtctctgttggtccactgtgtt

SEQ ID NO: 1165736 - DNA, 13 bp, Homo sapiens
ttgtctcttggtg

SEQ ID NO: 1165737 - DNA, 15 bp, Homo sapiens
ttgtctgaacttgca

SEQ ID NO: 1165738 - DNA, 18 bp, Homo sapiens
ttgtctgaagtcactgca

SEQ ID NO: 1165739 - DNA, 17 bp, Homo sapiens
ttgtctggatgcacact

SEQ ID NO: 1165740 - DNA, 13 bp, Homo sapiens
ttgtctggcctca

SEQ ID NO: 1165741 - DNA, 11 bp, Homo sapiens
ttgtctgtaca

SEQ ID NO: 1165742 - DNA, 17 bp, Homo sapiens
ttgtctgtccaggccct

SEQ ID NO: 1165743 - DNA, 11 bp, Homo sapiens
ttgtctgtctc

SEQ ID NO: 1165744 - DNA, 16 bp, Homo sapiens
ttgtcttaaaaattta

SEQ ID NO: 1165745 - DNA, 12 bp, Homo sapiens
ttgtcttaatat

SEQ ID NO: 1165746 - DNA, 17 bp, Homo sapiens
ttgtcttaatattgtgg

SEQ ID NO: 1165747 - DNA, 13 bp, Homo sapiens
ttgtcttatatat

SEQ ID NO: 1165748 - DNA, 12 bp, Homo sapiens
ttgtcttattga

SEQ ID NO: 1165749 - DNA, 17 bp, Homo sapiens
ttgtcttcaaactgtga

SEQ ID NO: 1165750 - DNA, 15 bp, Homo sapiens
ttgtcttcacttaat

SEQ ID NO: 1165751 - DNA, 11 bp, Homo sapiens
ttgtcttcccc

SEQ ID NO: 1165752 - DNA, 19 bp, Homo sapiens
ttgtcttcccccctctcct

SEQ ID NO: 1165753 - DNA, 23 bp, Homo sapiens
ttgtcttcccccctctcctccca

SEQ ID NO: 1165754 - DNA, 17 bp, Homo sapiens
ttgtcttgaaaactgtg

SEQ ID NO: 1165755 - DNA, 15 bp, Homo sapiens
ttgtcttgaatgtct

SEQ ID NO: 1165756 - DNA, 20 bp, Homo sapiens
ttgtcttgttatgtacaaac

SEQ ID NO: 1165757 - DNA, 19 bp, Homo sapiens
ttgtctttagtgccggctg

SEQ ID NO: 1165758 - DNA, 13 bp, Homo sapiens
ttgtctttcagga

SEQ ID NO: 1165759 - DNA, 12 bp, Homo sapiens
ttgtctttcctc

SEQ ID NO: 1165760 - DNA, 14 bp, Homo sapiens
ttgtctttttccta

SEQ ID NO: 1165761 - DNA, 22 bp, Homo sapiens
ttgtctttttcctactccgttc

SEQ ID NO: 1165762 - DNA, 17 bp, Homo sapiens
ttgtcttttttttcatc

SEQ ID NO: 1165763 - DNA, 20 bp, Homo sapiens
ttgtcttttttttcatcctt

SEQ ID NO: 1165764 - DNA, 19 bp, Homo sapiens
ttgtgaaaagagtatgtag

SEQ ID NO: 1165765 - DNA, 22 bp, Homo sapiens
ttgtgaaagaaagctgagaaga

SEQ ID NO: 1165766 - DNA, 21 bp, Homo sapiens
ttgtgaaatcagtatcagaat

SEQ ID NO: 1165767 - DNA, 15 bp, Homo sapiens
ttgtgaaatgtaaca

SEQ ID NO: 1165768 - DNA, 20 bp, Homo sapiens
ttgtgaaatgtaacatgaag

SEQ ID NO: 1165769 - DNA, 23 bp, Homo sapiens
ttgtgaaccatggtgaagtgctt

SEQ ID NO: 1165770 - DNA, 22 bp, Homo sapiens
ttgtgaacgctgtgatgctgtg

SEQ ID NO: 1165771 - DNA, 19 bp, Homo sapiens
ttgtgaagaaaaataaagt

SEQ ID NO: 1165772 - DNA, 22 bp, Homo sapiens
ttgtgaagccatgagttccaga

SEQ ID NO: 1165773 - DNA, 18 bp, Homo sapiens
ttgtgaaggattatggaa

SEQ ID NO: 1165774 - DNA, 22 bp, Homo sapiens
ttgtgaatgattcatgttatat

SEQ ID NO: 1165775 - DNA, 17 bp, Homo sapiens
ttgtgaattaatgaaat

SEQ ID NO: 1165776 - DNA, 13 bp, Homo sapiens
ttgtgacaaaaaa

SEQ ID NO: 1165777 - DNA, 22 bp, Homo sapiens
ttgtgacaaaaaattaaagcat

SEQ ID NO: 1165778 - DNA, 16 bp, Homo sapiens
ttgtgacaagaataat

SEQ ID NO: 1165779 - DNA, 21 bp, Homo sapiens
ttgtgacagcgatggcaggcc

SEQ ID NO: 1165780 - DNA, 23 bp, Homo sapiens
ttgtgacaggaaagccctccccc

SEQ ID NO: 1165781 - DNA, 19 bp, Homo sapiens
ttgtgacagtgcctcttcc

SEQ ID NO: 1165782 - DNA, 16 bp, Homo sapiens
ttgtgaccaagttata

SEQ ID NO: 1165783 - DNA, 21 bp, Homo sapiens
ttgtgactatatagagatgtt

SEQ ID NO: 1165784 - DNA, 22 bp, Homo sapiens
ttgtgactatatagagatgttt

SEQ ID NO: 1165785 - DNA, 23 bp, Homo sapiens
ttgtgcaatgtaaatattttaaa

SEQ ID NO: 1165786 - DNA, 13 bp, Homo sapiens
ttgtgcagggtgt

SEQ ID NO: 1165787 - DNA, 14 bp, Homo sapiens
ttgtgcatgtttac

SEQ ID NO: 1165788 - DNA, 17 bp, Homo sapiens
ttgtgcattatctagat

SEQ ID NO: 1165789 - DNA, 15 bp, Homo sapiens
ttgtgcatttgtaaa

SEQ ID NO: 1165790 - DNA, 19 bp, Homo sapiens
ttgtgcatttgtaaatgct

SEQ ID NO: 1165791 - DNA, 17 bp, Homo sapiens
ttgtgccaatatgtatt

SEQ ID NO: 1165792 - DNA, 21 bp, Homo sapiens
ttgtgccagaggaatcctggc

SEQ ID NO: 1165793 - DNA, 21 bp, Homo sapiens
ttgtgccatgtcaaacaaata

SEQ ID NO: 1165794 - DNA, 20 bp, Homo sapiens
ttgtgccattatatttgcat

SEQ ID NO: 1165795 - DNA, 21 bp, Homo sapiens
ttgtgctacttagtaaaaatt

SEQ ID NO: 1165796 - DNA, 21 bp, Homo sapiens
ttgtgctcctcttgattcctg

SEQ ID NO: 1165797 - DNA, 12 bp, Homo sapiens
ttgtgctcggga

SEQ ID NO: 1165798 - DNA, 13 bp, Homo sapiens
ttgtgctgcttct

SEQ ID NO: 1165799 - DNA, 15 bp, Homo sapiens
ttgtgctgtgggcag

SEQ ID NO: 1165800 - DNA, 17 bp, Homo sapiens
ttgtgctgtgggcagca

SEQ ID NO: 1165801 - DNA, 16 bp, Homo sapiens
ttgtgcttcacagtag

SEQ ID NO: 1165802 - DNA, 14 bp, Homo sapiens
ttgtgcttgtttac

SEQ ID NO: 1165803 - DNA, 19 bp, Homo sapiens
ttgtggaatgttggataag

SEQ ID NO: 1165804 - DNA, 15 bp, Homo sapiens
ttgtggactgtgggt

SEQ ID NO: 1165805 - DNA, 14 bp, Homo sapiens
ttgtggagtttgta

SEQ ID NO: 1165806 - DNA, 16 bp, Homo sapiens
ttgtggataagggaga

SEQ ID NO: 1165807 - DNA, 15 bp, Homo sapiens
ttgtggatgctccag

SEQ ID NO: 1165808 - DNA, 21 bp, Homo sapiens
ttgtggattataaaaaatgta

SEQ ID NO: 1165809 - DNA, 20 bp, Homo sapiens
ttgtggatttaacagaaatg

SEQ ID NO: 1165810 - DNA, 22 bp, Homo sapiens
ttgtggatttaacagaaatgta

SEQ ID NO: 1165811 - DNA, 23 bp, Homo sapiens
ttgtggatttaacagaaatgtac

SEQ ID NO: 1165812 - DNA, 18 bp, Homo sapiens
ttgtggcaaaagccacat

SEQ ID NO: 1165813 - DNA, 15 bp, Homo sapiens
ttgtggcaattttat

SEQ ID NO: 1165814 - DNA, 18 bp, Homo sapiens
ttgtggccaaggagctgc

SEQ ID NO: 1165815 - DNA, 19 bp, Homo sapiens
ttgtggcccccgccccctc

SEQ ID NO: 1165816 - DNA, 20 bp, Homo sapiens
ttgtggccccttttactttt

SEQ ID NO: 1165817 - DNA, 23 bp, Homo sapiens
ttgtggcctcaagcaatccacct

SEQ ID NO: 1165818 - DNA, 15 bp, Homo sapiens
ttgtggcgtctccct

SEQ ID NO: 1165819 - DNA, 14 bp, Homo sapiens
ttgtggctgggggc

SEQ ID NO: 1165820 - DNA, 19 bp, Homo sapiens
ttgtgggccccccttgcct

SEQ ID NO: 1165821 - DNA, 14 bp, Homo sapiens
ttgtgggcttcctg

SEQ ID NO: 1165822 - DNA, 21 bp, Homo sapiens
ttgtggggaagaggggctggg

SEQ ID NO: 1165823 - DNA, 15 bp, Homo sapiens
ttgtggggacccagg

SEQ ID NO: 1165824 - DNA, 13 bp, Homo sapiens
ttgtggggtgcag

SEQ ID NO: 1165825 - DNA, 18 bp, Homo sapiens
ttgtgggtttctctgtgc

SEQ ID NO: 1165826 - DNA, 13 bp, Homo sapiens
ttgtggtgtgacc

SEQ ID NO: 1165827 - DNA, 23 bp, Homo sapiens
ttgtggtgtgaccatgttcatta

SEQ ID NO: 1165828 - DNA, 15 bp, Homo sapiens
ttgtggttagaatct

SEQ ID NO: 1165829 - DNA, 22 bp, Homo sapiens
ttgtgtaacaattttaatgcta

SEQ ID NO: 1165830 - DNA, 19 bp, Homo sapiens
ttgtgtaatagaaaactga

SEQ ID NO: 1165831 - DNA, 24 bp, Homo sapiens
ttgtgtaatgaaaatgaatatcta

SEQ ID NO: 1165832 - DNA, 15 bp, Homo sapiens
ttgtgtacaagttgt

SEQ ID NO: 1165833 - DNA, 15 bp, Homo sapiens
ttgtgtacagttatt

SEQ ID NO: 1165834 - DNA, 14 bp, Homo sapiens
ttgtgtagatttga

SEQ ID NO: 1165835 - DNA, 15 bp, Homo sapiens
ttgtgtatatatctt

SEQ ID NO: 1165836 - DNA, 17 bp, Homo sapiens
ttgtgtatatatcttat

SEQ ID NO: 1165837 - DNA, 21 bp, Homo sapiens
ttgtgtatatatcttataact

SEQ ID NO: 1165838 - DNA, 24 bp, Homo sapiens
ttgtgtatatatcttataactgtt

SEQ ID NO: 1165839 - DNA, 17 bp, Homo sapiens
ttgtgtatatttgcttc

SEQ ID NO: 1165840 - DNA, 17 bp, Homo sapiens
ttgtgtattaaatggtt

SEQ ID NO: 1165841 - DNA, 16 bp, Homo sapiens
ttgtgtattgatgcaa

SEQ ID NO: 1165842 - DNA, 19 bp, Homo sapiens
ttgtgtatttacgctttga

SEQ ID NO: 1165843 - DNA, 22 bp, Homo sapiens
ttgtgtatttacgctttgattc

SEQ ID NO: 1165844 - DNA, 17 bp, Homo sapiens
ttgtgtattttctttgg

SEQ ID NO: 1165845 - DNA, 20 bp, Homo sapiens
ttgtgtcccaaaatcccctc

SEQ ID NO: 1165846 - DNA, 22 bp, Homo sapiens
ttgtgtcccaaaatcccctcag

SEQ ID NO: 1165847 - DNA, 18 bp, Homo sapiens
ttgtgtcccatgatccct

SEQ ID NO: 1165848 - DNA, 16 bp, Homo sapiens
ttgtgtctttgtctgg

SEQ ID NO: 1165849 - DNA, 16 bp, Homo sapiens
ttgtgtgaaaaaagaa

SEQ ID NO: 1165850 - DNA, 23 bp, Homo sapiens
ttgtgtgaaaaaagaaaatggct

SEQ ID NO: 1165851 - DNA, 18 bp, Homo sapiens
ttgtgtgaccaactgtgt

SEQ ID NO: 1165852 - DNA, 19 bp, Homo sapiens
ttgtgtgaccaactgtgtt

SEQ ID NO: 1165853 - DNA, 21 bp, Homo sapiens
ttgtgtgaccaactgtgttgt

SEQ ID NO: 1165854 - DNA, 23 bp, Homo sapiens
ttgtgtgaccaactgtgttgtat

SEQ ID NO: 1165855 - DNA, 13 bp, Homo sapiens
ttgtgtgattgaa

SEQ ID NO: 1165856 - DNA, 22 bp, Homo sapiens
ttgtgtggctgccccacctgcc

SEQ ID NO: 1165857 - DNA, 14 bp, Homo sapiens
ttgtgtgtatttgc

SEQ ID NO: 1165858 - DNA, 22 bp, Homo sapiens
ttgtgtgtgccctgggccaggc

SEQ ID NO: 1165859 - DNA, 19 bp, Homo sapiens
ttgtgtgtgggctgtgagt

SEQ ID NO: 1165860 - DNA, 15 bp, Homo sapiens
ttgtgtgttatattc

SEQ ID NO: 1165861 - DNA, 16 bp, Homo sapiens
ttgtgtgttgtgtcca

SEQ ID NO: 1165862 - DNA, 20 bp, Homo sapiens
ttgtgttcccatttcagctg

SEQ ID NO: 1165863 - DNA, 14 bp, Homo sapiens
ttgtgttcctatgg

SEQ ID NO: 1165864 - DNA, 18 bp, Homo sapiens
ttgtgttcctatggaaac

SEQ ID NO: 1165865 - DNA, 13 bp, Homo sapiens
ttgtgttcctggc

SEQ ID NO: 1165866 - DNA, 15 bp, Homo sapiens
ttgtgttcctggctg

SEQ ID NO: 1165867 - DNA, 20 bp, Homo sapiens
ttgtgttctgtttgttaaaa

SEQ ID NO: 1165868 - DNA, 19 bp, Homo sapiens
ttgtgttcttcttcatatt

SEQ ID NO: 1165869 - DNA, 13 bp, Homo sapiens
ttgtgttgaagaa

SEQ ID NO: 1165870 - DNA, 11 bp, Homo sapiens
ttgtgttgtca

SEQ ID NO: 1165871 - DNA, 12 bp, Homo sapiens
ttgtgtttagga

SEQ ID NO: 1165872 - DNA, 13 bp, Homo sapiens
ttgtgttttcttg

SEQ ID NO: 1165873 - DNA, 21 bp, Homo sapiens
ttgtgttttcttgtaaatgtt

SEQ ID NO: 1165874 - DNA, 22 bp, Homo sapiens
ttgtgtttttctatagaaaaag

SEQ ID NO: 1165875 - DNA, 17 bp, Homo sapiens
ttgtgttttttaagata

SEQ ID NO: 1165876 - DNA, 16 bp, Homo sapiens
ttgttaaaataactag

SEQ ID NO: 1165877 - DNA, 16 bp, Homo sapiens
ttgttaaaatctactt

SEQ ID NO: 1165878 - DNA, 19 bp, Homo sapiens
ttgttaaattacattttta

SEQ ID NO: 1165879 - DNA, 17 bp, Homo sapiens
ttgttaaccacagctgt

SEQ ID NO: 1165880 - DNA, 14 bp, Homo sapiens
ttgttaaccttaaa

SEQ ID NO: 1165881 - DNA, 18 bp, Homo sapiens
ttgttaaccttaaataca

SEQ ID NO: 1165882 - DNA, 22 bp, Homo sapiens
ttgttaacgtgatgtgccacta

SEQ ID NO: 1165883 - DNA, 22 bp, Homo sapiens
ttgttaactcttgtctattttt

SEQ ID NO: 1165884 - DNA, 17 bp, Homo sapiens
ttgttaagggcattttt

SEQ ID NO: 1165885 - DNA, 19 bp, Homo sapiens
ttgttaataaaagtacatg

SEQ ID NO: 1165886 - DNA, 21 bp, Homo sapiens
ttgttaatgctctatgtttgt

SEQ ID NO: 1165887 - DNA, 15 bp, Homo sapiens
ttgttaatgtcattg

SEQ ID NO: 1165888 - DNA, 16 bp, Homo sapiens
ttgttaatgtcattgc

SEQ ID NO: 1165889 - DNA, 19 bp, Homo sapiens
ttgttaatttagaaaactt

SEQ ID NO: 1165890 - DNA, 18 bp, Homo sapiens
ttgttactaactaaactc

SEQ ID NO: 1165891 - DNA, 22 bp, Homo sapiens
ttgttactctggttctttgttt

SEQ ID NO: 1165892 - DNA, 19 bp, Homo sapiens
ttgttactgttttaaaggg

SEQ ID NO: 1165893 - DNA, 13 bp, Homo sapiens
ttgttagagagaa

SEQ ID NO: 1165894 - DNA, 21 bp, Homo sapiens
ttgttagcccttcagattgtt

SEQ ID NO: 1165895 - DNA, 19 bp, Homo sapiens
ttgttagggtcagccattt

SEQ ID NO: 1165896 - DNA, 21 bp, Homo sapiens
ttgttagtatgaggcatttgt

SEQ ID NO: 1165897 - DNA, 22 bp, Homo sapiens
ttgttagtttagtgtgtgtgca

SEQ ID NO: 1165898 - DNA, 13 bp, Homo sapiens
ttgttatacttca

SEQ ID NO: 1165899 - DNA, 16 bp, Homo sapiens
ttgttatcaaaatagt

SEQ ID NO: 1165900 - DNA, 16 bp, Homo sapiens
ttgttatgaaaatcct

SEQ ID NO: 1165901 - DNA, 22 bp, Homo sapiens
ttgttatgaaaatcctatatct

SEQ ID NO: 1165902 - DNA, 13 bp, Homo sapiens
ttgttatgacagt

SEQ ID NO: 1165903 - DNA, 17 bp, Homo sapiens
ttgttatgtacaaacta

SEQ ID NO: 1165904 - DNA, 18 bp, Homo sapiens
ttgttatgtagataacaa

SEQ ID NO: 1165905 - DNA, 15 bp, Homo sapiens
ttgttattaaacaaa

SEQ ID NO: 1165906 - DNA, 15 bp, Homo sapiens
ttgttattaaatgta

SEQ ID NO: 1165907 - DNA, 18 bp, Homo sapiens
ttgttattaatgtttctt

SEQ ID NO: 1165908 - DNA, 14 bp, Homo sapiens
ttgttattgcctct

SEQ ID NO: 1165909 - DNA, 13 bp, Homo sapiens
tttaaaatctgat

SEQ ID NO: 1165910 - DNA, 18 bp, Homo sapiens
tttaaaatgcagattcat

SEQ ID NO: 1165911 - DNA, 22 bp, Homo sapiens
tttaaaatggaaaattttctcc

SEQ ID NO: 1165912 - DNA, 10 bp, Homo sapiens
tttaaaatta

SEQ ID NO: 1165913 - DNA, 15 bp, Homo sapiens
tttaaaattcagttt

SEQ ID NO: 1165914 - DNA, 17 bp, Homo sapiens
tttaaaatttatattgt

SEQ ID NO: 1165915 - DNA, 13 bp, Homo sapiens
tttaaaatttcat

SEQ ID NO: 1165916 - DNA, 12 bp, Homo sapiens
tttaaaatttgt

SEQ ID NO: 1165917 - DNA, 20 bp, Homo sapiens
tttaaacaaaatagaagctg

SEQ ID NO: 1165918 - DNA, 15 bp, Homo sapiens
tttaaacaagtattt

SEQ ID NO: 1165919 - DNA, 17 bp, Homo sapiens
tttaaacaatctttcat

SEQ ID NO: 1165920 - DNA, 14 bp, Homo sapiens
tttaaacacctcct

SEQ ID NO: 1165921 - DNA, 14 bp, Homo sapiens
tttaaacatgtaaa

SEQ ID NO: 1165922 - DNA, 19 bp, Homo sapiens
tttaaacattaatagcagc

SEQ ID NO: 1165923 - DNA, 20 bp, Homo sapiens
tttaaacatttgttcctgga

SEQ ID NO: 1165924 - DNA, 22 bp, Homo sapiens
tttaaaccgctaaaagaaactt

SEQ ID NO: 1165925 - DNA, 15 bp, Homo sapiens
tttaaactaaattac

SEQ ID NO: 1165926 - DNA, 21 bp, Homo sapiens
tttaaactgtgtacataactg

SEQ ID NO: 1165927 - DNA, 15 bp, Homo sapiens
tttaaacttgaaata

SEQ ID NO: 1165928 - DNA, 17 bp, Homo sapiens
tttaaactttttaaaat

SEQ ID NO: 1165929 - DNA, 21 bp, Homo sapiens
tttaaagaaaaaaattgaaat

SEQ ID NO: 1165930 - DNA, 22 bp, Homo sapiens
tttaaagaaaaaaattgaaatg

SEQ ID NO: 1165931 - DNA, 12 bp, Homo sapiens
tttaaagaaagt

SEQ ID NO: 1165932 - DNA, 14 bp, Homo sapiens
tttaaagaaagtgt

SEQ ID NO: 1165933 - DNA, 18 bp, Homo sapiens
tttaaagaagaaacgtct

SEQ ID NO: 1165934 - DNA, 20 bp, Homo sapiens
tttaaagaagggggctttct

SEQ ID NO: 1165935 - DNA, 12 bp, Homo sapiens
tttaaagaattg

SEQ ID NO: 1165936 - DNA, 14 bp, Homo sapiens
tttaaagagaggtt

SEQ ID NO: 1165937 - DNA, 16 bp, Homo sapiens
tttaaagaggctgtgt

SEQ ID NO: 1165938 - DNA, 14 bp, Homo sapiens
tttaaagatctttt

SEQ ID NO: 1165939 - DNA, 21 bp, Homo sapiens
tttaaagccgtgctcttttaa

SEQ ID NO: 1165940 - DNA, 17 bp, Homo sapiens
tttaaagcgtttgcaca

SEQ ID NO: 1165941 - DNA, 17 bp, Homo sapiens
tttaaagctcaggaggg

SEQ ID NO: 1165942 - DNA, 16 bp, Homo sapiens
tttaaagcttactctg

SEQ ID NO: 1165943 - DNA, 12 bp, Homo sapiens
tttaaaggaaaa

SEQ ID NO: 1165944 - DNA, 13 bp, Homo sapiens
tttaaaggaaaca

SEQ ID NO: 1165945 - DNA, 13 bp, Homo sapiens
tttaaaggcagag

SEQ ID NO: 1165946 - DNA, 16 bp, Homo sapiens
tttaaaggggcagaaa

SEQ ID NO: 1165947 - DNA, 14 bp, Homo sapiens
tttaaaggttttta

SEQ ID NO: 1165948 - DNA, 13 bp, Homo sapiens
tttaaagtaaact

SEQ ID NO: 1165949 - DNA, 14 bp, Homo sapiens
tttaaagtaaactt

SEQ ID NO: 1165950 - DNA, 16 bp, Homo sapiens
tttaaagtaaacttgt

SEQ ID NO: 1165951 - DNA, 19 bp, Homo sapiens
tttaacgtggcttgtagaa

SEQ ID NO: 1165952 - DNA, 12 bp, Homo sapiens
tttaactctgcg

SEQ ID NO: 1165953 - DNA, 15 bp, Homo sapiens
tttaactgaaaatgt

SEQ ID NO: 1165954 - DNA, 14 bp, Homo sapiens
tttaactgattaaa

SEQ ID NO: 1165955 - DNA, 21 bp, Homo sapiens
tttaactgattaaaaatacct

SEQ ID NO: 1165956 - DNA, 23 bp, Homo sapiens
tttaactgcactcatagggtgct

SEQ ID NO: 1165957 - DNA, 12 bp, Homo sapiens
tttaactgccgt

SEQ ID NO: 1165958 - DNA, 21 bp, Homo sapiens
tttaactgccgtaatttaact

SEQ ID NO: 1165959 - DNA, 24 bp, Homo sapiens
tttaactggcttcattttaggaat

SEQ ID NO: 1165960 - DNA, 22 bp, Homo sapiens
tttaactggtgcactttgtaaa

SEQ ID NO: 1165961 - DNA, 12 bp, Homo sapiens
tttaactgtgga

SEQ ID NO: 1165962 - DNA, 13 bp, Homo sapiens
tttaactgtggat

SEQ ID NO: 1165963 - DNA, 19 bp, Homo sapiens
tttaactttatcacattat

SEQ ID NO: 1165964 - DNA, 15 bp, Homo sapiens
tttaactttgaaagt

SEQ ID NO: 1165965 - DNA, 17 bp, Homo sapiens
tttaacttttggaatca

SEQ ID NO: 1165966 - DNA, 19 bp, Homo sapiens
tttaactttttttcttcta

SEQ ID NO: 1165967 - DNA, 18 bp, Homo sapiens
tttaagaaaaaataacac

SEQ ID NO: 1165968 - DNA, 11 bp, Homo sapiens
tttaagaaaat

SEQ ID NO: 1165969 - DNA, 13 bp, Homo sapiens
tttaagaaaatac

SEQ ID NO: 1165970 - DNA, 22 bp, Homo sapiens
tttaagaaaatacaataaacta

SEQ ID NO: 1165971 - DNA, 13 bp, Homo sapiens
tttaagaaagaga

SEQ ID NO: 1165972 - DNA, 17 bp, Homo sapiens
tttaagaaagagaatga

SEQ ID NO: 1165973 - DNA, 21 bp, Homo sapiens
tttaagaaagagaatgaactg

SEQ ID NO: 1165974 - DNA, 16 bp, Homo sapiens
tttaagaacttcattt

SEQ ID NO: 1165975 - DNA, 20 bp, Homo sapiens
tttaagaatagttctaaaat

SEQ ID NO: 1165976 - DNA, 21 bp, Homo sapiens
tttaagaatatctgtaatggt

SEQ ID NO: 1165977 - DNA, 20 bp, Homo sapiens
tttaagaggctttggcccaa

SEQ ID NO: 1165978 - DNA, 15 bp, Homo sapiens
tttaagataatagtt

SEQ ID NO: 1165979 - DNA, 14 bp, Homo sapiens
tttaagataattat

SEQ ID NO: 1165980 - DNA, 17 bp, Homo sapiens
tttaagatagaacacaa

SEQ ID NO: 1165981 - DNA, 19 bp, Homo sapiens
tttaagatatatacatgga

SEQ ID NO: 1165982 - DNA, 16 bp, Homo sapiens
tttaagatatccatct

SEQ ID NO: 1165983 - DNA, 18 bp, Homo sapiens
tttaagatgtacatttaa

SEQ ID NO: 1165984 - DNA, 22 bp, Homo sapiens
tttaagatgtgtcttcaatttg

SEQ ID NO: 1165985 - DNA, 15 bp, Homo sapiens
tttaagcaacatctt

SEQ ID NO: 1165986 - DNA, 17 bp, Homo sapiens
tttaagcaacatctttt

SEQ ID NO: 1165987 - DNA, 23 bp, Homo sapiens
tttaagcactacataaactgact

SEQ ID NO: 1165988 - DNA, 21 bp, Homo sapiens
tttaagcattgtttgcttatt

SEQ ID NO: 1165989 - DNA, 23 bp, Homo sapiens
tttaagcattgtttgcttattgt

SEQ ID NO: 1165990 - DNA, 18 bp, Homo sapiens
tttaagccaaaacaatgt

SEQ ID NO: 1165991 - DNA, 18 bp, Homo sapiens
tttaagccaaagaaacaa

SEQ ID NO: 1165992 - DNA, 21 bp, Homo sapiens
tttaagccaaagaaacaagct

SEQ ID NO: 1165993 - DNA, 11 bp, Homo sapiens
tttaagccata

SEQ ID NO: 1165994 - DNA, 21 bp, Homo sapiens
tttaagcctgcattcttaaca

SEQ ID NO: 1165995 - DNA, 17 bp, Homo sapiens
tttaagccttttgtgta

SEQ ID NO: 1165996 - DNA, 16 bp, Homo sapiens
tttaagctatcagcaa

SEQ ID NO: 1165997 - DNA, 18 bp, Homo sapiens
tttaagctccagacatac

SEQ ID NO: 1165998 - DNA, 20 bp, Homo sapiens
tttaagctccatgtgcatat

SEQ ID NO: 1165999 - DNA, 22 bp, Homo sapiens
tttaaggagattgggagacaat

SEQ ID NO: 1166000 - DNA, 20 bp, Homo sapiens
tttaaggatgcttgtacata

SEQ ID NO: 1166001 - DNA, 21 bp, Homo sapiens
tttaaggatgcttgtacataa

SEQ ID NO: 1166002 - DNA, 22 bp, Homo sapiens
tttaaggatgcttgtacataat

SEQ ID NO: 1166003 - DNA, 17 bp, Homo sapiens
tttaagggaaagaaaat

SEQ ID NO: 1166004 - DNA, 16 bp, Homo sapiens
tttaaggggagaaaat

SEQ ID NO: 1166005 - DNA, 14 bp, Homo sapiens
tttaagggggaaaa

SEQ ID NO: 1166006 - DNA, 16 bp, Homo sapiens
tttaagggttgtgagc

SEQ ID NO: 1166007 - DNA, 22 bp, Homo sapiens
tttaagggtttgtggaaaatga

SEQ ID NO: 1166008 - DNA, 16 bp, Homo sapiens
tttaaggttgaaaaga

SEQ ID NO: 1166009 - DNA, 21 bp, Homo sapiens
tttaagtagaaaagttgcaga

SEQ ID NO: 1166010 - DNA, 23 bp, Homo sapiens
tttaagtagaaaagttgcagatg

SEQ ID NO: 1166011 - DNA, 13 bp, Homo sapiens
tttaagtatatag

SEQ ID NO: 1166012 - DNA, 21 bp, Homo sapiens
tttaagtatggaatattcatt

SEQ ID NO: 1166013 - DNA, 18 bp, Homo sapiens
tttaagtattgtttcctg

SEQ ID NO: 1166014 - DNA, 19 bp, Homo sapiens
tttaagtattgtttcctga

SEQ ID NO: 1166015 - DNA, 18 bp, Homo sapiens
tttaagtatttaggtttt

SEQ ID NO: 1166016 - DNA, 13 bp, Homo sapiens
tttaagtatttat

SEQ ID NO: 1166017 - DNA, 15 bp, Homo sapiens
tttaagtatttatat

SEQ ID NO: 1166018 - DNA, 20 bp, Homo sapiens
tttaagtatttatatattta

SEQ ID NO: 1166019 - DNA, 20 bp, Homo sapiens
tttaagtcagtatggtctaa

SEQ ID NO: 1166020 - DNA, 19 bp, Homo sapiens
tttaagtcattttcatgtg

SEQ ID NO: 1166021 - DNA, 10 bp, Homo sapiens
tttaagtcct

SEQ ID NO: 1166022 - DNA, 15 bp, Homo sapiens
tttaagtctctcgta

SEQ ID NO: 1166023 - DNA, 17 bp, Homo sapiens
tttaagtgaaaatggtc

SEQ ID NO: 1166024 - DNA, 21 bp, Homo sapiens
tttaagtgacataattgtcca

SEQ ID NO: 1166025 - DNA, 14 bp, Homo sapiens
tttaagtgcaacat

SEQ ID NO: 1166026 - DNA, 21 bp, Homo sapiens
tttaagtgcaacatttctgta

SEQ ID NO: 1166027 - DNA, 15 bp, Homo sapiens
tttaagtgctgcatt

SEQ ID NO: 1166028 - DNA, 19 bp, Homo sapiens
tttaagtgcttcacatttg

SEQ ID NO: 1166029 - DNA, 17 bp, Homo sapiens
tttaagtgttggaaaaa

SEQ ID NO: 1166030 - DNA, 16 bp, Homo sapiens
tttaagtgtttagaaa

SEQ ID NO: 1166031 - DNA, 17 bp, Homo sapiens
tttaagttaatagattt

SEQ ID NO: 1166032 - DNA, 20 bp, Homo sapiens
tttaagttgtcaaagaagct

SEQ ID NO: 1166033 - DNA, 13 bp, Homo sapiens
tttaagtttgaaa

SEQ ID NO: 1166034 - DNA, 14 bp, Homo sapiens
tttaataaaaagga

SEQ ID NO: 1166035 - DNA, 20 bp, Homo sapiens
tttaataaaacaacaacaaa

SEQ ID NO: 1166036 - DNA, 14 bp, Homo sapiens
tttaataaaagatt

SEQ ID NO: 1166037 - DNA, 12 bp, Homo sapiens
tttaataaactg

SEQ ID NO: 1166038 - DNA, 14 bp, Homo sapiens
tttaataaagaaat

SEQ ID NO: 1166039 - DNA, 17 bp, Homo sapiens
tttaataaagaaatatt

SEQ ID NO: 1166040 - DNA, 16 bp, Homo sapiens
tttaataaagatgagt

SEQ ID NO: 1166041 - DNA, 20 bp, Homo sapiens
tttaataaattgcttactga

SEQ ID NO: 1166042 - DNA, 14 bp, Homo sapiens
tttaatacagcagt

SEQ ID NO: 1166043 - DNA, 11 bp, Homo sapiens
tttaatagact

SEQ ID NO: 1166044 - DNA, 15 bp, Homo sapiens
tttaatagactgagt

SEQ ID NO: 1166045 - DNA, 22 bp, Homo sapiens
tttaatagagatgaatcagttt

SEQ ID NO: 1166046 - DNA, 13 bp, Homo sapiens
tttaatagcacta

SEQ ID NO: 1166047 - DNA, 19 bp, Homo sapiens
tttaatagctatggaatca

SEQ ID NO: 1166048 - DNA, 17 bp, Homo sapiens
tttaatagtcattccaa

SEQ ID NO: 1166049 - DNA, 20 bp, Homo sapiens
tttaatagtcattccaaata

SEQ ID NO: 1166050 - DNA, 15 bp, Homo sapiens
tttaatataaagcct

SEQ ID NO: 1166051 - DNA, 23 bp, Homo sapiens
tttaatataaagtagtcctgtga

SEQ ID NO: 1166052 - DNA, 23 bp, Homo sapiens
tttaatatattgaataaaaaata

SEQ ID NO: 1166053 - DNA, 15 bp, Homo sapiens
tttaatatcttcagc

SEQ ID NO: 1166054 - DNA, 18 bp, Homo sapiens
tttaatatgagcttcaat

SEQ ID NO: 1166055 - DNA, 16 bp, Homo sapiens
tttaatatgcaaagtc

SEQ ID NO: 1166056 - DNA, 14 bp, Homo sapiens
tttaatattactgt

SEQ ID NO: 1166057 - DNA, 16 bp, Homo sapiens
tttaatattactgtct

SEQ ID NO: 1166058 - DNA, 20 bp, Homo sapiens
tttaatattactgtctttat

SEQ ID NO: 1166059 - DNA, 18 bp, Homo sapiens
tttaatattccagaagaa

SEQ ID NO: 1166060 - DNA, 23 bp, Homo sapiens
tttaatattccagaagaacaact

SEQ ID NO: 1166061 - DNA, 22 bp, Homo sapiens
tttaatattcttttgtttccat

SEQ ID NO: 1166062 - DNA, 22 bp, Homo sapiens
tttaatattgagaaagaaacta

SEQ ID NO: 1166063 - DNA, 12 bp, Homo sapiens
tttaatatttaa

SEQ ID NO: 1166064 - DNA, 15 bp, Homo sapiens
tttaatatttaaaca

SEQ ID NO: 1166065 - DNA, 17 bp, Homo sapiens
tttaatattttgtattt

SEQ ID NO: 1166066 - DNA, 14 bp, Homo sapiens
tttaatcagtgaag

SEQ ID NO: 1166067 - DNA, 21 bp, Homo sapiens
tttaatccagaattgaccttt

SEQ ID NO: 1166068 - DNA, 17 bp, Homo sapiens
tttaatctaaaatgatt

SEQ ID NO: 1166069 - DNA, 11 bp, Homo sapiens
ttctttgaatg

SEQ ID NO: 1166070 - DNA, 22 bp, Homo sapiens
ttctttgaccagatctttctct

SEQ ID NO: 1166071 - DNA, 15 bp, Homo sapiens
ttctttgatttgtac

SEQ ID NO: 1166072 - DNA, 18 bp, Homo sapiens
ttctttgatttgtaccat

SEQ ID NO: 1166073 - DNA, 19 bp, Homo sapiens
ttctttgatttgtaccatt

SEQ ID NO: 1166074 - DNA, 12 bp, Homo sapiens
ttctttgcaaag

SEQ ID NO: 1166075 - DNA, 22 bp, Homo sapiens
ttctttgcaccaaagacatcag

SEQ ID NO: 1166076 - DNA, 13 bp, Homo sapiens
ttctttgctgccc

SEQ ID NO: 1166077 - DNA, 20 bp, Homo sapiens
ttctttggcctacattcttt

SEQ ID NO: 1166078 - DNA, 23 bp, Homo sapiens
ttctttgggggtggaaaaggaaa

SEQ ID NO: 1166079 - DNA, 20 bp, Homo sapiens
ttctttgtagaataaatggt

SEQ ID NO: 1166080 - DNA, 12 bp, Homo sapiens
ttctttgtcttt

SEQ ID NO: 1166081 - DNA, 12 bp, Homo sapiens
ttctttgtgtag

SEQ ID NO: 1166082 - DNA, 16 bp, Homo sapiens
ttctttgttacaggca

SEQ ID NO: 1166083 - DNA, 15 bp, Homo sapiens
ttctttgttctgttt

SEQ ID NO: 1166084 - DNA, 20 bp, Homo sapiens
ttctttgtttctttcttcct

SEQ ID NO: 1166085 - DNA, 12 bp, Homo sapiens
ttcttttaagaa

SEQ ID NO: 1166086 - DNA, 16 bp, Homo sapiens
ttcttttacagactag

SEQ ID NO: 1166087 - DNA, 13 bp, Homo sapiens
ttcttttcacatt

SEQ ID NO: 1166088 - DNA, 12 bp, Homo sapiens
ttcttttccttt

SEQ ID NO: 1166089 - DNA, 13 bp, Homo sapiens
ttcttttctggaa

SEQ ID NO: 1166090 - DNA, 18 bp, Homo sapiens
ttcttttctggaaacata

SEQ ID NO: 1166091 - DNA, 12 bp, Homo sapiens
ttcttttgaatt

SEQ ID NO: 1166092 - DNA, 22 bp, Homo sapiens
ttcttttgcccttcacagtgtt

SEQ ID NO: 1166093 - DNA, 13 bp, Homo sapiens
ttcttttgtaatt

SEQ ID NO: 1166094 - DNA, 18 bp, Homo sapiens
ttcttttgtatgtaaatg

SEQ ID NO: 1166095 - DNA, 12 bp, Homo sapiens
ttcttttgtatt

SEQ ID NO: 1166096 - DNA, 13 bp, Homo sapiens
ttcttttgtctcc

SEQ ID NO: 1166097 - DNA, 22 bp, Homo sapiens
ttctttttaaagtttgttcact

SEQ ID NO: 1166098 - DNA, 16 bp, Homo sapiens
ttctttttaaattttt

SEQ ID NO: 1166099 - DNA, 18 bp, Homo sapiens
ttctttttacagcattgt

SEQ ID NO: 1166100 - DNA, 21 bp, Homo sapiens
ttctttttacagcattgtctt

SEQ ID NO: 1166101 - DNA, 16 bp, Homo sapiens
ttctttttctggaaat

SEQ ID NO: 1166102 - DNA, 14 bp, Homo sapiens
ttcttttttcagtt

SEQ ID NO: 1166103 - DNA, 22 bp, Homo sapiens
ttcttttttgtacttttctggt

SEQ ID NO: 1166104 - DNA, 19 bp, Homo sapiens
ttctttttttcctttttaa

SEQ ID NO: 1166105 - DNA, 22 bp, Homo sapiens
ttcttttttttttttttacagt

SEQ ID NO: 1166106 - DNA, 22 bp, Homo sapiens
ttcttttttttttttttgagac

SEQ ID NO: 1166107 - DNA, 18 bp, Homo sapiens
ttgaaaaaaaaaatgttg

SEQ ID NO: 1166108 - DNA, 15 bp, Homo sapiens
ttgaaaaaaacttca

SEQ ID NO: 1166109 - DNA, 22 bp, Homo sapiens
ttgaaaaaatagagcctgaggg

SEQ ID NO: 1166110 - DNA, 19 bp, Homo sapiens
ttgaaaaaatttaaaagta

SEQ ID NO: 1166111 - DNA, 12 bp, Homo sapiens
ttgaaaaacttt

SEQ ID NO: 1166112 - DNA, 22 bp, Homo sapiens
ttgaaaaagagaacagaaaaca

SEQ ID NO: 1166113 - DNA, 13 bp, Homo sapiens
ttgaaaaagcgaa

SEQ ID NO: 1166114 - DNA, 20 bp, Homo sapiens
ttgaaaaaggaaatattctt

SEQ ID NO: 1166115 - DNA, 17 bp, Homo sapiens
ttgaaaaagttccatag

SEQ ID NO: 1166116 - DNA, 13 bp, Homo sapiens
ttgaaaaatactg

SEQ ID NO: 1166117 - DNA, 15 bp, Homo sapiens
ttgaaaaatattgct

SEQ ID NO: 1166118 - DNA, 15 bp, Homo sapiens
ttgaaaaatctagtt

SEQ ID NO: 1166119 - DNA, 21 bp, Homo sapiens
ttgaaaacaaaaaaaatgtta

SEQ ID NO: 1166120 - DNA, 20 bp, Homo sapiens
ttgaaaacaattcagtggtc

SEQ ID NO: 1166121 - DNA, 18 bp, Homo sapiens
ttgaaaagacaatagccc

SEQ ID NO: 1166122 - DNA, 17 bp, Homo sapiens
ttgaaaagcagacattt

SEQ ID NO: 1166123 - DNA, 18 bp, Homo sapiens
ttgaaaagctgactgttt

SEQ ID NO: 1166124 - DNA, 19 bp, Homo sapiens
ttgaaaaggtctaagcaag

SEQ ID NO: 1166125 - DNA, 16 bp, Homo sapiens
ttgaaaagttggaagg

SEQ ID NO: 1166126 - DNA, 22 bp, Homo sapiens
ttgaaaatatttctatgtaaat

SEQ ID NO: 1166127 - DNA, 15 bp, Homo sapiens
ttgaaaatgctctta

SEQ ID NO: 1166128 - DNA, 21 bp, Homo sapiens
ttgaaaatgctcttaaaatat

SEQ ID NO: 1166129 - DNA, 19 bp, Homo sapiens
ttgaaaatgtatttcctga

SEQ ID NO: 1166130 - DNA, 18 bp, Homo sapiens
ttgaaaattatgcaaaag

SEQ ID NO: 1166131 - DNA, 19 bp, Homo sapiens
ttgaaaattattttaaaca

SEQ ID NO: 1166132 - DNA, 18 bp, Homo sapiens
ttgaaaattcaaaaagtg

SEQ ID NO: 1166133 - DNA, 12 bp, Homo sapiens
ttgaaaattgta

SEQ ID NO: 1166134 - DNA, 16 bp, Homo sapiens
ttgaaaattgtatacc

SEQ ID NO: 1166135 - DNA, 14 bp, Homo sapiens
ttgaaacagcagtc

SEQ ID NO: 1166136 - DNA, 21 bp, Homo sapiens
ttgaaaccaccgtgaaccaga

SEQ ID NO: 1166137 - DNA, 22 bp, Homo sapiens
ttgaaactcgcgagtgtaactt

SEQ ID NO: 1166138 - DNA, 17 bp, Homo sapiens
ttgaaactgcatttgtg

SEQ ID NO: 1166139 - DNA, 18 bp, Homo sapiens
ttgaaagaacttaagtct

SEQ ID NO: 1166140 - DNA, 13 bp, Homo sapiens
ttgaaagaccttc

SEQ ID NO: 1166141 - DNA, 20 bp, Homo sapiens
ttgaaagagaaccagtttca

SEQ ID NO: 1166142 - DNA, 15 bp, Homo sapiens
ttgaaagattcaggt

SEQ ID NO: 1166143 - DNA, 22 bp, Homo sapiens
ttgaaagattcaggtatgttgc

SEQ ID NO: 1166144 - DNA, 19 bp, Homo sapiens
ttgaaagccaacaactctg

SEQ ID NO: 1166145 - DNA, 22 bp, Homo sapiens
ttgaaagccaacaactctgcct

SEQ ID NO: 1166146 - DNA, 12 bp, Homo sapiens
ttgaaagctgtg

SEQ ID NO: 1166147 - DNA, 22 bp, Homo sapiens
ttgaaagctgtggccagcttgt

SEQ ID NO: 1166148 - DNA, 22 bp, Homo sapiens
ttgaaaggggacacctgtacat

SEQ ID NO: 1166149 - DNA, 23 bp, Homo sapiens
ttgaaaggggacacctgtacatt

SEQ ID NO: 1166150 - DNA, 22 bp, Homo sapiens
ttgaaaggttttttttcagttg

SEQ ID NO: 1166151 - DNA, 13 bp, Homo sapiens
ttgaaagtattca

SEQ ID NO: 1166152 - DNA, 16 bp, Homo sapiens
ttgaaagtattcagaa

SEQ ID NO: 1166153 - DNA, 21 bp, Homo sapiens
ttgaaagtattcagaaattaa

SEQ ID NO: 1166154 - DNA, 23 bp, Homo sapiens
ttgaaagtattcagaaattaaaa

SEQ ID NO: 1166155 - DNA, 23 bp, Homo sapiens
ttgaaagtgaaataatttgtgtc

SEQ ID NO: 1166156 - DNA, 17 bp, Homo sapiens
ttgaaagttttcagaac

SEQ ID NO: 1166157 - DNA, 16 bp, Homo sapiens
ttgaaataactggaac

SEQ ID NO: 1166158 - DNA, 20 bp, Homo sapiens
ttgaaatataggaacttaaa

SEQ ID NO: 1166159 - DNA, 15 bp, Homo sapiens
ttgaaatctgtatct

SEQ ID NO: 1166160 - DNA, 19 bp, Homo sapiens
ttgaaatgaggtctgttta

SEQ ID NO: 1166161 - DNA, 21 bp, Homo sapiens
ttgaaatgaggtctgtttaaa

SEQ ID NO: 1166162 - DNA, 21 bp, Homo sapiens
ttgaaatgagtaaaaactaga

SEQ ID NO: 1166163 - DNA, 12 bp, Homo sapiens
ttgaaatgggca

SEQ ID NO: 1166164 - DNA, 15 bp, Homo sapiens
ttgaaatgggcattt

SEQ ID NO: 1166165 - DNA, 16 bp, Homo sapiens
ttgaaatgggcattta

SEQ ID NO: 1166166 - DNA, 13 bp, Homo sapiens
ttgaaattactgt

SEQ ID NO: 1166167 - DNA, 15 bp, Homo sapiens
ttgaaattactgtgt

SEQ ID NO: 1166168 - DNA, 18 bp, Homo sapiens
ttgaaattatgtatgttt

SEQ ID NO: 1166169 - DNA, 19 bp, Homo sapiens
ttgaaattatgtatgttta

SEQ ID NO: 1166170 - DNA, 14 bp, Homo sapiens
ttgaaattctattt

SEQ ID NO: 1166171 - DNA, 21 bp, Homo sapiens
ttgaaattgtagtgcaaaatg

SEQ ID NO: 1166172 - DNA, 23 bp, Homo sapiens
ttgaacaaaaatgtttccactgg

SEQ ID NO: 1166173 - DNA, 14 bp, Homo sapiens
ttgaacacaaactg

SEQ ID NO: 1166174 - DNA, 21 bp, Homo sapiens
ttgaacacaaactgtaaataa

SEQ ID NO: 1166175 - DNA, 20 bp, Homo sapiens
ttgaacactagtctgtgtaa

SEQ ID NO: 1166176 - DNA, 20 bp, Homo sapiens
ttgaacactggctaaagata

SEQ ID NO: 1166177 - DNA, 21 bp, Homo sapiens
ttgaacagactagaagtattt

SEQ ID NO: 1166178 - DNA, 22 bp, Homo sapiens
ttgaacagatatgtttttattt

SEQ ID NO: 1166179 - DNA, 14 bp, Homo sapiens
ttgaacagctgtga

SEQ ID NO: 1166180 - DNA, 24 bp, Homo sapiens
ttgaacagctgtgagccatgcctc

SEQ ID NO: 1166181 - DNA, 13 bp, Homo sapiens
ttgaacatgaact

SEQ ID NO: 1166182 - DNA, 16 bp, Homo sapiens
ttgaaccacttccctc

SEQ ID NO: 1166183 - DNA, 13 bp, Homo sapiens
ttgaacccaggag

SEQ ID NO: 1166184 - DNA, 17 bp, Homo sapiens
ttgaaccccctccctgt

SEQ ID NO: 1166185 - DNA, 14 bp, Homo sapiens
ttgaacccctgtgt

SEQ ID NO: 1166186 - DNA, 18 bp, Homo sapiens
ttgaacctgggaggcaga

SEQ ID NO: 1166187 - DNA, 18 bp, Homo sapiens
ttgaacctttttttttga

SEQ ID NO: 1166188 - DNA, 21 bp, Homo sapiens
ttgaacctttttttttgaaac

SEQ ID NO: 1166189 - DNA, 23 bp, Homo sapiens
ttgaacctttttttttgaaacag

SEQ ID NO: 1166190 - DNA, 23 bp, Homo sapiens
ttgaacgactgtatattgctaag

SEQ ID NO: 1166191 - DNA, 12 bp, Homo sapiens
ttgaactatgaa

SEQ ID NO: 1166192 - DNA, 16 bp, Homo sapiens
ttgaactatgactgga

SEQ ID NO: 1166193 - DNA, 14 bp, Homo sapiens
ttgcgttcaaagag

SEQ ID NO: 1166194 - DNA, 13 bp, Homo sapiens
ttgctaaaagaag

SEQ ID NO: 1166195 - DNA, 22 bp, Homo sapiens
ttgctaaaatattttagatgtt

SEQ ID NO: 1166196 - DNA, 12 bp, Homo sapiens
ttgctaaagcac

SEQ ID NO: 1166197 - DNA, 14 bp, Homo sapiens
ttgctaaagcactt

SEQ ID NO: 1166198 - DNA, 16 bp, Homo sapiens
ttgctaaagcactttg

SEQ ID NO: 1166199 - DNA, 15 bp, Homo sapiens
ttgctaagaagccta

SEQ ID NO: 1166200 - DNA, 16 bp, Homo sapiens
ttgctaatcaaagcca

SEQ ID NO: 1166201 - DNA, 21 bp, Homo sapiens
ttgctaatcaaagccagggtc

SEQ ID NO: 1166202 - DNA, 18 bp, Homo sapiens
ttgctacaccccttttcc

SEQ ID NO: 1166203 - DNA, 16 bp, Homo sapiens
ttgctacataattatc

SEQ ID NO: 1166204 - DNA, 20 bp, Homo sapiens
ttgctaccagtatttagaag

SEQ ID NO: 1166205 - DNA, 23 bp, Homo sapiens
ttgctaccagtatttagaagcca

SEQ ID NO: 1166206 - DNA, 16 bp, Homo sapiens
ttgctagaaaagacat

SEQ ID NO: 1166207 - DNA, 18 bp, Homo sapiens
ttgctagactctagacaa

SEQ ID NO: 1166208 - DNA, 20 bp, Homo sapiens
ttgctagccagcattccata

SEQ ID NO: 1166209 - DNA, 15 bp, Homo sapiens
ttgctagggagaggg

SEQ ID NO: 1166210 - DNA, 17 bp, Homo sapiens
ttgctagtatcttgggt

SEQ ID NO: 1166211 - DNA, 17 bp, Homo sapiens
ttgctagttctgctgcc

SEQ ID NO: 1166212 - DNA, 22 bp, Homo sapiens
ttgctatctggaggccttccag

SEQ ID NO: 1166213 - DNA, 15 bp, Homo sapiens
ttgctatgttactat

SEQ ID NO: 1166214 - DNA, 18 bp, Homo sapiens
ttgctattgtaaggtctt

SEQ ID NO: 1166215 - DNA, 23 bp, Homo sapiens
ttgctcaaaacacttccagtctg

SEQ ID NO: 1166216 - DNA, 20 bp, Homo sapiens
ttgctcaattccaagacagt

SEQ ID NO: 1166217 - DNA, 18 bp, Homo sapiens
ttgctcagtgcctcctgg

SEQ ID NO: 1166218 - DNA, 21 bp, Homo sapiens
ttgctcagtgcctcctggccg

SEQ ID NO: 1166219 - DNA, 15 bp, Homo sapiens
ttgctcattcttgag

SEQ ID NO: 1166220 - DNA, 20 bp, Homo sapiens
ttgctcattcttgaggagca

SEQ ID NO: 1166221 - DNA, 14 bp, Homo sapiens
ttgctccagggtct

SEQ ID NO: 1166222 - DNA, 16 bp, Homo sapiens
ttgctccctccccgct

SEQ ID NO: 1166223 - DNA, 12 bp, Homo sapiens
ttgctccctctg

SEQ ID NO: 1166224 - DNA, 16 bp, Homo sapiens
ttgctccctctgttag

SEQ ID NO: 1166225 - DNA, 19 bp, Homo sapiens
ttgctccgctcccaccgcc

SEQ ID NO: 1166226 - DNA, 15 bp, Homo sapiens
ttgctcctagcagac

SEQ ID NO: 1166227 - DNA, 17 bp, Homo sapiens
ttgctcctagcagacag

SEQ ID NO: 1166228 - DNA, 20 bp, Homo sapiens
ttgctcctcccacttctcaa

SEQ ID NO: 1166229 - DNA, 19 bp, Homo sapiens
ttgctcctgcatgcaacta

SEQ ID NO: 1166230 - DNA, 17 bp, Homo sapiens
ttgctcctgccaaccac

SEQ ID NO: 1166231 - DNA, 12 bp, Homo sapiens
ttgctccttgac

SEQ ID NO: 1166232 - DNA, 15 bp, Homo sapiens
ttgctctaatgatca

SEQ ID NO: 1166233 - DNA, 20 bp, Homo sapiens
ttgctctatgtctgccttcg

SEQ ID NO: 1166234 - DNA, 23 bp, Homo sapiens
ttgctctattaagattggaaatg

SEQ ID NO: 1166235 - DNA, 21 bp, Homo sapiens
ttgctctcccctgccctgctg

SEQ ID NO: 1166236 - DNA, 20 bp, Homo sapiens
ttgctctctggccttttcct

SEQ ID NO: 1166237 - DNA, 13 bp, Homo sapiens
ttgctctctgggc

SEQ ID NO: 1166238 - DNA, 13 bp, Homo sapiens
ttgctctgcaccc

SEQ ID NO: 1166239 - DNA, 15 bp, Homo sapiens
ttgctctggagcagc

SEQ ID NO: 1166240 - DNA, 22 bp, Homo sapiens
ttgctctgtcccccaggctgga

SEQ ID NO: 1166241 - DNA, 20 bp, Homo sapiens
ttgctctgttacccaggctg

SEQ ID NO: 1166242 - DNA, 21 bp, Homo sapiens
ttgctgaaagccaaggcagct

SEQ ID NO: 1166243 - DNA, 11 bp, Homo sapiens
ttgctgaactc

SEQ ID NO: 1166244 - DNA, 24 bp, Homo sapiens
ttgctgaactcagcacattcggga

SEQ ID NO: 1166245 - DNA, 20 bp, Homo sapiens
ttgctgaactcttaggcaca

SEQ ID NO: 1166246 - DNA, 18 bp, Homo sapiens
ttgctgaagatgccttga

SEQ ID NO: 1166247 - DNA, 22 bp, Homo sapiens
ttgctgaccccaggtcagccct

SEQ ID NO: 1166248 - DNA, 23 bp, Homo sapiens
ttgctgaccccaggtcagccctg

SEQ ID NO: 1166249 - DNA, 23 bp, Homo sapiens
ttgctgactactactctgccaat

SEQ ID NO: 1166250 - DNA, 14 bp, Homo sapiens
ttgctgagcaccct

SEQ ID NO: 1166251 - DNA, 15 bp, Homo sapiens
ttgctgagcctctgc

SEQ ID NO: 1166252 - DNA, 22 bp, Homo sapiens
ttgctgagcctctgctccccag

SEQ ID NO: 1166253 - DNA, 18 bp, Homo sapiens
ttgctgatggctgctaga

SEQ ID NO: 1166254 - DNA, 13 bp, Homo sapiens
ttgctgatttcta

SEQ ID NO: 1166255 - DNA, 13 bp, Homo sapiens
ttgctgcaaacct

SEQ ID NO: 1166256 - DNA, 16 bp, Homo sapiens
ttgctgcaaagagaaa

SEQ ID NO: 1166257 - DNA, 15 bp, Homo sapiens
ttgctgcaggccctc

SEQ ID NO: 1166258 - DNA, 16 bp, Homo sapiens
ttgctgcaggccctcc

SEQ ID NO: 1166259 - DNA, 17 bp, Homo sapiens
ttgctgcaggccctccc

SEQ ID NO: 1166260 - DNA, 22 bp, Homo sapiens
ttgctgcaggccctccctctac

SEQ ID NO: 1166261 - DNA, 17 bp, Homo sapiens
ttgctgccaaaaccaca

SEQ ID NO: 1166262 - DNA, 21 bp, Homo sapiens
ttgctgccaaccataccttcc

SEQ ID NO: 1166263 - DNA, 23 bp, Homo sapiens
ttgctgccataattctaagttat

SEQ ID NO: 1166264 - DNA, 15 bp, Homo sapiens
ttgctgcccctgtct

SEQ ID NO: 1166265 - DNA, 11 bp, Homo sapiens
ttgctgccttt

SEQ ID NO: 1166266 - DNA, 21 bp, Homo sapiens
ttgctgctatgaaaatgagca

SEQ ID NO: 1166267 - DNA, 13 bp, Homo sapiens
ttgctgctgaagg

SEQ ID NO: 1166268 - DNA, 15 bp, Homo sapiens
ttgctgctgcctctt

SEQ ID NO: 1166269 - DNA, 11 bp, Homo sapiens
ttgctgctgct

SEQ ID NO: 1166270 - DNA, 15 bp, Homo sapiens
ttgctgctgctacca

SEQ ID NO: 1166271 - DNA, 16 bp, Homo sapiens
ttgctgctgctctcag

SEQ ID NO: 1166272 - DNA, 23 bp, Homo sapiens
ttgctgctgcttaatcctacccc

SEQ ID NO: 1166273 - DNA, 17 bp, Homo sapiens
ttgctgctgcttcctgt

SEQ ID NO: 1166274 - DNA, 12 bp, Homo sapiens
ttgctgctgtct

SEQ ID NO: 1166275 - DNA, 20 bp, Homo sapiens
ttgctgctgtgaatctgaaa

SEQ ID NO: 1166276 - DNA, 16 bp, Homo sapiens
ttgctgcttgaggcaa

SEQ ID NO: 1166277 - DNA, 23 bp, Homo sapiens
ttgctggaaaccaagtcaggcca

SEQ ID NO: 1166278 - DNA, 13 bp, Homo sapiens
ttgctggaggggc

SEQ ID NO: 1166279 - DNA, 13 bp, Homo sapiens
ttgctggccccag

SEQ ID NO: 1166280 - DNA, 14 bp, Homo sapiens
ttgctggccccagc

SEQ ID NO: 1166281 - DNA, 23 bp, Homo sapiens
ttgctggccccagccctgctggg

SEQ ID NO: 1166282 - DNA, 22 bp, Homo sapiens
ttgctgggacttggatcccagg

SEQ ID NO: 1166283 - DNA, 12 bp, Homo sapiens
ttgctgggcttt

SEQ ID NO: 1166284 - DNA, 21 bp, Homo sapiens
ttgctggggctcacggggcct

SEQ ID NO: 1166285 - DNA, 15 bp, Homo sapiens
ttgctggggtccagg

SEQ ID NO: 1166286 - DNA, 17 bp, Homo sapiens
ttgctggggtccagggc

SEQ ID NO: 1166287 - DNA, 20 bp, Homo sapiens
ttgctggggtccagggctgt

SEQ ID NO: 1166288 - DNA, 18 bp, Homo sapiens
ttgctggtcatccttggt

SEQ ID NO: 1166289 - DNA, 16 bp, Homo sapiens
ttgctgtactcttgct

SEQ ID NO: 1166290 - DNA, 19 bp, Homo sapiens
ttgctgtactcttgctgat

SEQ ID NO: 1166291 - DNA, 20 bp, Homo sapiens
ttgctgtagaagatggcact

SEQ ID NO: 1166292 - DNA, 21 bp, Homo sapiens
ttgctgtatgctgatcatcgc

SEQ ID NO: 1166293 - DNA, 16 bp, Homo sapiens
ttgctgtcctgatctg

SEQ ID NO: 1166294 - DNA, 19 bp, Homo sapiens
ttgctgtctacagtagctg

SEQ ID NO: 1166295 - DNA, 12 bp, Homo sapiens
ttgctgtctctg

SEQ ID NO: 1166296 - DNA, 16 bp, Homo sapiens
ttgctgtcttgcccca

SEQ ID NO: 1166297 - DNA, 17 bp, Homo sapiens
ttgctgtgaggctgtcc

SEQ ID NO: 1166298 - DNA, 14 bp, Homo sapiens
ttgctgtgcctccc

SEQ ID NO: 1166299 - DNA, 20 bp, Homo sapiens
ttgctgtgcttcaaactact

SEQ ID NO: 1166300 - DNA, 16 bp, Homo sapiens
ttgctgtggaccaatg

SEQ ID NO: 1166301 - DNA, 19 bp, Homo sapiens
ttgctgttagttataaaac

SEQ ID NO: 1166302 - DNA, 14 bp, Homo sapiens
ttgctgttcagtgc

SEQ ID NO: 1166303 - DNA, 14 bp, Homo sapiens
ttgctgttcttgaa

SEQ ID NO: 1166304 - DNA, 22 bp, Homo sapiens
ttgctgtttagcttcctccaga

SEQ ID NO: 1166305 - DNA, 12 bp, Homo sapiens
ttgctgtttatt

SEQ ID NO: 1166306 - DNA, 20 bp, Homo sapiens
ttgctgtttattttttttgg

SEQ ID NO: 1166307 - DNA, 13 bp, Homo sapiens
ttgctgttttgat

SEQ ID NO: 1166308 - DNA, 16 bp, Homo sapiens
ttgctgtttttcttgt

SEQ ID NO: 1166309 - DNA, 14 bp, Homo sapiens
ttgcttaaaagaca

SEQ ID NO: 1166310 - DNA, 14 bp, Homo sapiens
ttgcttaaaatata

SEQ ID NO: 1166311 - DNA, 16 bp, Homo sapiens
ttgcttaaaatatgtg

SEQ ID NO: 1166312 - DNA, 23 bp, Homo sapiens
ttgcttaaatttcttatgtgaca

SEQ ID NO: 1166313 - DNA, 16 bp, Homo sapiens
ttgcttaacattagat

SEQ ID NO: 1166314 - DNA, 17 bp, Homo sapiens
ttgcttaattttgattt

SEQ ID NO: 1166315 - DNA, 13 bp, Homo sapiens
ttgcttacatcct

SEQ ID NO: 1166316 - DNA, 18 bp, Homo sapiens
ttgcttacatttttacaa

SEQ ID NO: 1166317 - DNA, 22 bp, Homo sapiens
ttgcttagagtgcccagcagag

SEQ ID NO: 1166318 - DNA, 16 bp, Homo sapiens
ttgcttagcctgtgct

SEQ ID NO: 1166319 - DNA, 24 bp, Homo sapiens
ttgcttaggatgtttttcatgaaa

SEQ ID NO: 1166320 - DNA, 22 bp, Homo sapiens
ttgcttagtcacttatttcata

SEQ ID NO: 1166321 - DNA, 12 bp, Homo sapiens
ttgcttatgaat

SEQ ID NO: 1166322 - DNA, 15 bp, Homo sapiens
ttgcttattcttgag

SEQ ID NO: 1166323 - DNA, 15 bp, Homo sapiens
ttgcttcaaattggt

SEQ ID NO: 1166324 - DNA, 17 bp, Homo sapiens
ttgcttcaccatggcct

SEQ ID NO: 1166325 - DNA, 21 bp, Homo sapiens
ttgcttcatagtattggagca

SEQ ID NO: 1166326 - DNA, 16 bp, Homo sapiens
ttgcttccccttttgc

SEQ ID NO: 1166327 - DNA, 17 bp, Homo sapiens
ttgcttccccttttgcc

SEQ ID NO: 1166328 - DNA, 22 bp, Homo sapiens
ttgcttcctcagtaacatttct

SEQ ID NO: 1166329 - DNA, 19 bp, Homo sapiens
ttgcttctaaatgcccagt

SEQ ID NO: 1166330 - DNA, 19 bp, Homo sapiens
ttgcttctactttcatctt

SEQ ID NO: 1166331 - DNA, 18 bp, Homo sapiens
ttgcttctcccatttcct

SEQ ID NO: 1166332 - DNA, 13 bp, Homo sapiens
ttgcttctcttct

SEQ ID NO: 1166333 - DNA, 12 bp, Homo sapiens
ttgcttctgaat

SEQ ID NO: 1166334 - DNA, 18 bp, Homo sapiens
ttgcttcttactgataat

SEQ ID NO: 1166335 - DNA, 13 bp, Homo sapiens
ttgcttgaaacca

SEQ ID NO: 1166336 - DNA, 14 bp, Homo sapiens
ttgcttgagcccag

SEQ ID NO: 1166337 - DNA, 16 bp, Homo sapiens
ttgcttgccaaagtac

SEQ ID NO: 1166338 - DNA, 15 bp, Homo sapiens
ttgcttgccgagcct

SEQ ID NO: 1166339 - DNA, 23 bp, Homo sapiens
ttgcttgttgggattcctgaccc

SEQ ID NO: 1166340 - DNA, 16 bp, Homo sapiens
ttgctttaatatgagc

SEQ ID NO: 1166341 - DNA, 16 bp, Homo sapiens
ttgctttaccttttca

SEQ ID NO: 1166342 - DNA, 15 bp, Homo sapiens
ttgctttattccaga

SEQ ID NO: 1166343 - DNA, 23 bp, Homo sapiens
ttgctttcaattgacaaatgatg

SEQ ID NO: 1166344 - DNA, 17 bp, Homo sapiens
ttgctttcctgggcctt

SEQ ID NO: 1166345 - DNA, 20 bp, Homo sapiens
ttgctttctgctcagcttct

SEQ ID NO: 1166346 - DNA, 13 bp, Homo sapiens
ttgctttgcccaa

SEQ ID NO: 1166347 - DNA, 16 bp, Homo sapiens
ttgctttgccctggag

SEQ ID NO: 1166348 - DNA, 15 bp, Homo sapiens
ttgctttggaaacac

SEQ ID NO: 1166349 - DNA, 17 bp, Homo sapiens
ttgctttggaagtttta

SEQ ID NO: 1166350 - DNA, 17 bp, Homo sapiens
ttgctttggttaaaaat

SEQ ID NO: 1166351 - DNA, 16 bp, Homo sapiens
ttgctttgtatgcact

SEQ ID NO: 1166352 - DNA, 18 bp, Homo sapiens
ttgctttgtctggcctca

SEQ ID NO: 1166353 - DNA, 16 bp, Homo sapiens
ttgcttttcatgtaga

SEQ ID NO: 1166354 - DNA, 21 bp, Homo sapiens
ttgcttttcatgtagaactca

SEQ ID NO: 1166355 - DNA, 23 bp, Homo sapiens
ttgcttttcatgtagaactcagc

SEQ ID NO: 1166356 - DNA, 21 bp, Homo sapiens
ttgcttttccctcttttctta

SEQ ID NO: 1166357 - DNA, 20 bp, Homo sapiens
ttgcttttggcaaaactcta

SEQ ID NO: 1166358 - DNA, 15 bp, Homo sapiens
ttgctttttcttctc

SEQ ID NO: 1166359 - DNA, 15 bp, Homo sapiens
ttgcttttttccaaa

SEQ ID NO: 1166360 - DNA, 19 bp, Homo sapiens
ttgcttttttgtattggtt

SEQ ID NO: 1166361 - DNA, 17 bp, Homo sapiens
ttggaaaaaactctgaa

SEQ ID NO: 1166362 - DNA, 14 bp, Homo sapiens
ttggaaaagaatac

SEQ ID NO: 1166363 - DNA, 19 bp, Homo sapiens
ttggaaaagaatacagaaa

SEQ ID NO: 1166364 - DNA, 19 bp, Homo sapiens
ttggaaaagggcactcatt

SEQ ID NO: 1166365 - DNA, 15 bp, Homo sapiens
ttggaaacctgccct

SEQ ID NO: 1166366 - DNA, 16 bp, Homo sapiens
ttggaaactgctaaat

SEQ ID NO: 1166367 - DNA, 21 bp, Homo sapiens
ttggaaagacaggaagaccaa

SEQ ID NO: 1166368 - DNA, 17 bp, Homo sapiens
ttggaaaggttctaagg

SEQ ID NO: 1166369 - DNA, 21 bp, Homo sapiens
ttggaaagtacactctgctgt

SEQ ID NO: 1166370 - DNA, 12 bp, Homo sapiens
ttggaaagtcag

SEQ ID NO: 1166371 - DNA, 17 bp, Homo sapiens
ttggaaataaaaatgtt

SEQ ID NO: 1166372 - DNA, 15 bp, Homo sapiens
ttggaaataaaccat

SEQ ID NO: 1166373 - DNA, 20 bp, Homo sapiens
ttggaaataaaccattggac

SEQ ID NO: 1166374 - DNA, 21 bp, Homo sapiens
ttggaaataaaccattggaca

SEQ ID NO: 1166375 - DNA, 13 bp, Homo sapiens
ttggaaataaagt

SEQ ID NO: 1166376 - DNA, 13 bp, Homo sapiens
ttggaaatattca

SEQ ID NO: 1166377 - DNA, 21 bp, Homo sapiens
ttggaaatgtacttttggata

SEQ ID NO: 1166378 - DNA, 23 bp, Homo sapiens
ttggaaatgtacttttggataag

SEQ ID NO: 1166379 - DNA, 18 bp, Homo sapiens
ttggaaatgtctgctggt

SEQ ID NO: 1166380 - DNA, 14 bp, Homo sapiens
ttggaaattttagt

SEQ ID NO: 1166381 - DNA, 13 bp, Homo sapiens
ttggaacagaatg

SEQ ID NO: 1166382 - DNA, 22 bp, Homo sapiens
ttggaacattggaatgttctca

SEQ ID NO: 1166383 - DNA, 13 bp, Homo sapiens
ttggaacatttct

SEQ ID NO: 1166384 - DNA, 15 bp, Homo sapiens
ttggaacatttcttt

SEQ ID NO: 1166385 - DNA, 13 bp, Homo sapiens
ttggaaccagact

SEQ ID NO: 1166386 - DNA, 16 bp, Homo sapiens
ttggaactctgcttga

SEQ ID NO: 1166387 - DNA, 15 bp, Homo sapiens
ttggaagaccccacc

SEQ ID NO: 1166388 - DNA, 23 bp, Homo sapiens
ttggaagacttgggttgatctct

SEQ ID NO: 1166389 - DNA, 13 bp, Homo sapiens
ttggaagagaaag

SEQ ID NO: 1166390 - DNA, 21 bp, Homo sapiens
ttggaagattctatttaattg

SEQ ID NO: 1166391 - DNA, 19 bp, Homo sapiens
ttggaagcctgagcagggc

SEQ ID NO: 1166392 - DNA, 17 bp, Homo sapiens
ttggaagctaccagagc

SEQ ID NO: 1166393 - DNA, 17 bp, Homo sapiens
ttggaagctctgaagtc

SEQ ID NO: 1166394 - DNA, 12 bp, Homo sapiens
ttggaagctgct

SEQ ID NO: 1166395 - DNA, 15 bp, Homo sapiens
ttggaatataattgt

SEQ ID NO: 1166396 - DNA, 13 bp, Homo sapiens
ttggaatattaaa

SEQ ID NO: 1166397 - DNA, 16 bp, Homo sapiens
ttggaatattaaaaaa

SEQ ID NO: 1166398 - DNA, 15 bp, Homo sapiens
ttggaatattacaat

SEQ ID NO: 1166399 - DNA, 23 bp, Homo sapiens
ttggaatattgtccattgtccaa

SEQ ID NO: 1166400 - DNA, 13 bp, Homo sapiens
ttggaatatttga

SEQ ID NO: 1166401 - DNA, 18 bp, Homo sapiens
ttggaatatttgaataat

SEQ ID NO: 1166402 - DNA, 13 bp, Homo sapiens
ttggaatatttta

SEQ ID NO: 1166403 - DNA, 23 bp, Homo sapiens
ttggaatattttatcctgtattc

SEQ ID NO: 1166404 - DNA, 14 bp, Homo sapiens
ttggaatctaagct

SEQ ID NO: 1166405 - DNA, 14 bp, Homo sapiens
ttggaatcttcacc

SEQ ID NO: 1166406 - DNA, 19 bp, Homo sapiens
ttggaatgaaattcctcct

SEQ ID NO: 1166407 - DNA, 22 bp, Homo sapiens
ttggaatggaactactgtactt

SEQ ID NO: 1166408 - DNA, 23 bp, Homo sapiens
ttggaatggaactactgtacttt

SEQ ID NO: 1166409 - DNA, 11 bp, Homo sapiens
ttggaatgtta

SEQ ID NO: 1166410 - DNA, 19 bp, Homo sapiens
ttggaattctactggaaaa

SEQ ID NO: 1166411 - DNA, 15 bp, Homo sapiens
ttggacaacagctct

SEQ ID NO: 1166412 - DNA, 22 bp, Homo sapiens
ttggacagcaaaaccattgctt

SEQ ID NO: 1166413 - DNA, 23 bp, Homo sapiens
ttggacagcaaaaccattgcttc

SEQ ID NO: 1166414 - DNA, 16 bp, Homo sapiens
ttggacagctgcttgt

SEQ ID NO: 1166415 - DNA, 20 bp, Homo sapiens
ttggacaggagatcagcagc

SEQ ID NO: 1166416 - DNA, 15 bp, Homo sapiens
ttggacagtttacca

SEQ ID NO: 1166417 - DNA, 18 bp, Homo sapiens
ttggacattttcttcaga

SEQ ID NO: 1166418 - DNA, 15 bp, Homo sapiens
ttggaccatgccaga

SEQ ID NO: 1166419 - DNA, 14 bp, Homo sapiens
ttggacccagggcc

SEQ ID NO: 1166420 - DNA, 14 bp, Homo sapiens
ttggaccccagctg

SEQ ID NO: 1166421 - DNA, 17 bp, Homo sapiens
ttggaccccagctggga

SEQ ID NO: 1166422 - DNA, 22 bp, Homo sapiens
ttggaccccagctgggaggcaa

SEQ ID NO: 1166423 - DNA, 13 bp, Homo sapiens
ttggacccttcca

SEQ ID NO: 1166424 - DNA, 14 bp, Homo sapiens
ttggacccttccat

SEQ ID NO: 1166425 - DNA, 21 bp, Homo sapiens
ttggacctaaatggcctcatg

SEQ ID NO: 1166426 - DNA, 21 bp, Homo sapiens
ttggacctccaggggctcctg

SEQ ID NO: 1166427 - DNA, 16 bp, Homo sapiens
ttggacctctgctctg

SEQ ID NO: 1166428 - DNA, 21 bp, Homo sapiens
ttggacggcctgatgctccct

SEQ ID NO: 1166429 - DNA, 13 bp, Homo sapiens
ttggactcctccc

SEQ ID NO: 1166430 - DNA, 13 bp, Homo sapiens
ttggactctcagg

SEQ ID NO: 1166431 - DNA, 15 bp, Homo sapiens
ttggactctcaggga

SEQ ID NO: 1166432 - DNA, 20 bp, Homo sapiens
ttggactgttttcaataaca

SEQ ID NO: 1166433 - DNA, 20 bp, Homo sapiens
ttggacttttcgttaacatt

SEQ ID NO: 1166434 - DNA, 11 bp, Homo sapiens
ttggagaaaaa

SEQ ID NO: 1166435 - DNA, 12 bp, Homo sapiens
ttggagaaaaaa

SEQ ID NO: 1166436 - DNA, 19 bp, Homo sapiens
ttggagaaaaaaatcaacc

SEQ ID NO: 1166437 - DNA, 17 bp, Homo sapiens
ttggagaaaataacaag

SEQ ID NO: 1166438 - DNA, 16 bp, Homo sapiens
ttggagaagtctcagc

SEQ ID NO: 1166439 - DNA, 18 bp, Homo sapiens
ttggagaatttaggtttt

SEQ ID NO: 1166440 - DNA, 23 bp, Homo sapiens
ttggagaccctgcaaacagaaca

SEQ ID NO: 1166441 - DNA, 22 bp, Homo sapiens
ttggagagagaggctgcctcag

SEQ ID NO: 1166442 - DNA, 23 bp, Homo sapiens
ttggagagcaaaggcccatgccc

SEQ ID NO: 1166443 - DNA, 14 bp, Homo sapiens
ttgccaagctgaag

SEQ ID NO: 1166444 - DNA, 18 bp, Homo sapiens
ttgccaaggcaaaaaact

SEQ ID NO: 1166445 - DNA, 16 bp, Homo sapiens
ttgccaaggcagaggc

SEQ ID NO: 1166446 - DNA, 19 bp, Homo sapiens
ttgccaaggctctcccctc

SEQ ID NO: 1166447 - DNA, 13 bp, Homo sapiens
ttgccaagtgcct

SEQ ID NO: 1166448 - DNA, 23 bp, Homo sapiens
ttgccacaccaatcagagagcct

SEQ ID NO: 1166449 - DNA, 22 bp, Homo sapiens
ttgccacagatgatacttccaa

SEQ ID NO: 1166450 - DNA, 12 bp, Homo sapiens
ttgccacagctt

SEQ ID NO: 1166451 - DNA, 18 bp, Homo sapiens
ttgccacagtagaactgt

SEQ ID NO: 1166452 - DNA, 21 bp, Homo sapiens
ttgccacatggtgtctcccaa

SEQ ID NO: 1166453 - DNA, 23 bp, Homo sapiens
ttgccacatggtgtctcccaaca

SEQ ID NO: 1166454 - DNA, 21 bp, Homo sapiens
ttgccaccactagagctgaga

SEQ ID NO: 1166455 - DNA, 13 bp, Homo sapiens
ttgccaccaggag

SEQ ID NO: 1166456 - DNA, 19 bp, Homo sapiens
ttgccacccattcttcccg

SEQ ID NO: 1166457 - DNA, 17 bp, Homo sapiens
ttgccacctctggccaa

SEQ ID NO: 1166458 - DNA, 15 bp, Homo sapiens
ttgccactgcctctt

SEQ ID NO: 1166459 - DNA, 15 bp, Homo sapiens
ttgccactttgcacg

SEQ ID NO: 1166460 - DNA, 24 bp, Homo sapiens
ttgccactttggcttctcctgtga

SEQ ID NO: 1166461 - DNA, 20 bp, Homo sapiens
ttgccagaaagcataaaatt

SEQ ID NO: 1166462 - DNA, 23 bp, Homo sapiens
ttgccagactctaggttatacaa

SEQ ID NO: 1166463 - DNA, 21 bp, Homo sapiens
ttgccagcacaggggccccag

SEQ ID NO: 1166464 - DNA, 16 bp, Homo sapiens
ttgccagcatcactgg

SEQ ID NO: 1166465 - DNA, 18 bp, Homo sapiens
ttgccatactttgtctga

SEQ ID NO: 1166466 - DNA, 17 bp, Homo sapiens
ttgccatagccccatat

SEQ ID NO: 1166467 - DNA, 18 bp, Homo sapiens
ttgccatatggaggactg

SEQ ID NO: 1166468 - DNA, 18 bp, Homo sapiens
ttgccatcacactgttgc

SEQ ID NO: 1166469 - DNA, 13 bp, Homo sapiens
ttggagagcagct

SEQ ID NO: 1166470 - DNA, 13 bp, Homo sapiens
ttggagaggagag

SEQ ID NO: 1166471 - DNA, 22 bp, Homo sapiens
ttggagagtttgcctgttctat

SEQ ID NO: 1166472 - DNA, 20 bp, Homo sapiens
ttggagataatctagaacac

SEQ ID NO: 1166473 - DNA, 17 bp, Homo sapiens
ttggagcacctgggccc

SEQ ID NO: 1166474 - DNA, 20 bp, Homo sapiens
ttggagccccaggggacaag

SEQ ID NO: 1166475 - DNA, 14 bp, Homo sapiens
ttggagcccgtgca

SEQ ID NO: 1166476 - DNA, 17 bp, Homo sapiens
ttggagcctaaagagaa

SEQ ID NO: 1166477 - DNA, 13 bp, Homo sapiens
ttggagcctgcag

SEQ ID NO: 1166478 - DNA, 14 bp, Homo sapiens
ttggagctgagcct

SEQ ID NO: 1166479 - DNA, 14 bp, Homo sapiens
ttggagcttcatgg

SEQ ID NO: 1166480 - DNA, 16 bp, Homo sapiens
ttggagctttggaata

SEQ ID NO: 1166481 - DNA, 17 bp, Homo sapiens
ttggagctttggaatat

SEQ ID NO: 1166482 - DNA, 19 bp, Homo sapiens
ttggaggagcaaagttaaa

SEQ ID NO: 1166483 - DNA, 11 bp, Homo sapiens
ttggagggtct

SEQ ID NO: 1166484 - DNA, 17 bp, Homo sapiens
ttggagggtctgggggc

SEQ ID NO: 1166485 - DNA, 20 bp, Homo sapiens
ttggagggtctgggggcagc

SEQ ID NO: 1166486 - DNA, 22 bp, Homo sapiens
ttggagggtctgggggcagctg

SEQ ID NO: 1166487 - DNA, 22 bp, Homo sapiens
ttggagggtgggagagcccagc

SEQ ID NO: 1166488 - DNA, 23 bp, Homo sapiens
ttggaggtgcttaagcagaagca

SEQ ID NO: 1166489 - DNA, 23 bp, Homo sapiens
ttggagtcccctcacctcctcta

SEQ ID NO: 1166490 - DNA, 23 bp, Homo sapiens
ttggagtgataatattgtttccc

SEQ ID NO: 1166491 - DNA, 19 bp, Homo sapiens
ttggagtgttccccttcca

SEQ ID NO: 1166492 - DNA, 22 bp, Homo sapiens
ttggagtgttccccttccactg

SEQ ID NO: 1166493 - DNA, 15 bp, Homo sapiens
ttggataataaaaat

SEQ ID NO: 1166494 - DNA, 16 bp, Homo sapiens
ttggataataaaaatt

SEQ ID NO: 1166495 - DNA, 17 bp, Homo sapiens
ttggataataaaaattg

SEQ ID NO: 1166496 - DNA, 18 bp, Homo sapiens
ttggataataaaaattgt

SEQ ID NO: 1166497 - DNA, 22 bp, Homo sapiens
ttggataatgctgttgcctcat

SEQ ID NO: 1166498 - DNA, 13 bp, Homo sapiens
ttggatacagctg

SEQ ID NO: 1166499 - DNA, 18 bp, Homo sapiens
ttggatacatctgctgtg

SEQ ID NO: 1166500 - DNA, 22 bp, Homo sapiens
ttggatacatctgctgtgtgga

SEQ ID NO: 1166501 - DNA, 20 bp, Homo sapiens
ttggatatgtaaaacattta

SEQ ID NO: 1166502 - DNA, 12 bp, Homo sapiens
ttggatatttgg

SEQ ID NO: 1166503 - DNA, 14 bp, Homo sapiens
ttggatcaaaagga

SEQ ID NO: 1166504 - DNA, 15 bp, Homo sapiens
ttggatcaagtatta

SEQ ID NO: 1166505 - DNA, 19 bp, Homo sapiens
ttggatctccaattgcctc

SEQ ID NO: 1166506 - DNA, 13 bp, Homo sapiens
ttggatctggggt

SEQ ID NO: 1166507 - DNA, 24 bp, Homo sapiens
ttggatgggagtgggcacctcaga

SEQ ID NO: 1166508 - DNA, 20 bp, Homo sapiens
ttggatgtgggtctttttct

SEQ ID NO: 1166509 - DNA, 15 bp, Homo sapiens
ttggattaaatacat

SEQ ID NO: 1166510 - DNA, 18 bp, Homo sapiens
ttggattattcatttaaa

SEQ ID NO: 1166511 - DNA, 23 bp, Homo sapiens
ttggattattcatttaaaatgat

SEQ ID NO: 1166512 - DNA, 18 bp, Homo sapiens
ttggattgtatattgtgt

SEQ ID NO: 1166513 - DNA, 12 bp, Homo sapiens
ttggatttccta

SEQ ID NO: 1166514 - DNA, 14 bp, Homo sapiens
ttggatttgacatt

SEQ ID NO: 1166515 - DNA, 16 bp, Homo sapiens
ttggatttttgactct

SEQ ID NO: 1166516 - DNA, 20 bp, Homo sapiens
ttggcaagatgaaataattt

SEQ ID NO: 1166517 - DNA, 16 bp, Homo sapiens
ttggcaagatgtttct

SEQ ID NO: 1166518 - DNA, 20 bp, Homo sapiens
ttggcaagatgtttcttata

SEQ ID NO: 1166519 - DNA, 20 bp, Homo sapiens
ttggcaagtaacttctgact

SEQ ID NO: 1166520 - DNA, 16 bp, Homo sapiens
ttggcaatagtttgca

SEQ ID NO: 1166521 - DNA, 17 bp, Homo sapiens
ttggcaatgccatcatc

SEQ ID NO: 1166522 - DNA, 13 bp, Homo sapiens
ttggcaattttgt

SEQ ID NO: 1166523 - DNA, 14 bp, Homo sapiens
ttggcaattttgtg

SEQ ID NO: 1166524 - DNA, 15 bp, Homo sapiens
ttggcacagaaacac

SEQ ID NO: 1166525 - DNA, 16 bp, Homo sapiens
ttggcacagaaacaca

SEQ ID NO: 1166526 - DNA, 18 bp, Homo sapiens
ttggcaccaccagggtgg

SEQ ID NO: 1166527 - DNA, 12 bp, Homo sapiens
ttggcaccccca

SEQ ID NO: 1166528 - DNA, 22 bp, Homo sapiens
ttggcactcacagacctggagc

SEQ ID NO: 1166529 - DNA, 22 bp, Homo sapiens
ttggcactgagatatttattgt

SEQ ID NO: 1166530 - DNA, 14 bp, Homo sapiens
ttggcactggatgg

SEQ ID NO: 1166531 - DNA, 14 bp, Homo sapiens
ttggcacttgtatt

SEQ ID NO: 1166532 - DNA, 15 bp, Homo sapiens
ttggcacttgtattt

SEQ ID NO: 1166533 - DNA, 16 bp, Homo sapiens
ttggcagccaaggaat

SEQ ID NO: 1166534 - DNA, 20 bp, Homo sapiens
ttggcagccaaggaatgtgt

SEQ ID NO: 1166535 - DNA, 21 bp, Homo sapiens
ttggcagccagacttctggag

SEQ ID NO: 1166536 - DNA, 19 bp, Homo sapiens
ttggcagcttaacattgac

SEQ ID NO: 1166537 - DNA, 17 bp, Homo sapiens
ttggcaggataagaaaa

SEQ ID NO: 1166538 - DNA, 20 bp, Homo sapiens
ttggcaggcccactccccag

SEQ ID NO: 1166539 - DNA, 14 bp, Homo sapiens
ttggcagtgacttt

SEQ ID NO: 1166540 - DNA, 11 bp, Homo sapiens
ttggcagtgtt

SEQ ID NO: 1166541 - DNA, 20 bp, Homo sapiens
ttggcataatagtcaatttc

SEQ ID NO: 1166542 - DNA, 14 bp, Homo sapiens
ttggcatacaaaat

SEQ ID NO: 1166543 - DNA, 15 bp, Homo sapiens
ttggcatacaaaata

SEQ ID NO: 1166544 - DNA, 16 bp, Homo sapiens
ttggcatagctctggg

SEQ ID NO: 1166545 - DNA, 21 bp, Homo sapiens
ttggcatcacagggcagagcc

SEQ ID NO: 1166546 - DNA, 20 bp, Homo sapiens
ttggcatgggcgcaggccca

SEQ ID NO: 1166547 - DNA, 21 bp, Homo sapiens
ttggcatgggcgcaggcccag

SEQ ID NO: 1166548 - DNA, 14 bp, Homo sapiens
ttggccagggaggc

SEQ ID NO: 1166549 - DNA, 16 bp, Homo sapiens
ttggccccactttgaa

SEQ ID NO: 1166550 - DNA, 19 bp, Homo sapiens
ttggcccccgagctggggg

SEQ ID NO: 1166551 - DNA, 19 bp, Homo sapiens
ttggccccctttcccgggc

SEQ ID NO: 1166552 - DNA, 18 bp, Homo sapiens
ttggccctggagccaggg

SEQ ID NO: 1166553 - DNA, 19 bp, Homo sapiens
ttggccctttccttccaga

SEQ ID NO: 1166554 - DNA, 14 bp, Homo sapiens
ttggccgagctcct

SEQ ID NO: 1166555 - DNA, 17 bp, Homo sapiens
ttggccgagctcctggg

SEQ ID NO: 1166556 - DNA, 12 bp, Homo sapiens
ttggcctgctgt

SEQ ID NO: 1166557 - DNA, 14 bp, Homo sapiens
ttggcctgctgtga

SEQ ID NO: 1166558 - DNA, 12 bp, Homo sapiens
ttggcctggaga

SEQ ID NO: 1166559 - DNA, 19 bp, Homo sapiens
ttggcctgtagagttgctg

SEQ ID NO: 1166560 - DNA, 16 bp, Homo sapiens
ttggcctgtgggcctc

SEQ ID NO: 1166561 - DNA, 11 bp, Homo sapiens
ttggccttaag

SEQ ID NO: 1166562 - DNA, 13 bp, Homo sapiens
ttggccttgggcc

SEQ ID NO: 1166563 - DNA, 16 bp, Homo sapiens
ttggccttgggccggt

SEQ ID NO: 1166564 - DNA, 18 bp, Homo sapiens
ttggcgaatctcaaaatt

SEQ ID NO: 1166565 - DNA, 22 bp, Homo sapiens
ttggcgatgaggtaattctccc

SEQ ID NO: 1166566 - DNA, 22 bp, Homo sapiens
ttggcgtagcagagttaaatct

SEQ ID NO: 1166567 - DNA, 13 bp, Homo sapiens
ttggcgtgacccg

SEQ ID NO: 1166568 - DNA, 18 bp, Homo sapiens
ttggctagaggttcaaag

SEQ ID NO: 1166569 - DNA, 17 bp, Homo sapiens
ttggctataagtgctca

SEQ ID NO: 1166570 - DNA, 20 bp, Homo sapiens
ttggctatgaaaatgagccc

SEQ ID NO: 1166571 - DNA, 13 bp, Homo sapiens
ttggctcaatcct

SEQ ID NO: 1166572 - DNA, 14 bp, Homo sapiens
ttggctcagacatg

SEQ ID NO: 1166573 - DNA, 12 bp, Homo sapiens
ttggctcaggca

SEQ ID NO: 1166574 - DNA, 22 bp, Homo sapiens
ttggctctctgacgtcaaccca

SEQ ID NO: 1166575 - DNA, 14 bp, Homo sapiens
ttggctctttcaga

SEQ ID NO: 1166576 - DNA, 22 bp, Homo sapiens
ttggctgaaattctcctggagg

SEQ ID NO: 1166577 - DNA, 16 bp, Homo sapiens
ttggctgacccctctg

SEQ ID NO: 1166578 - DNA, 15 bp, Homo sapiens
ttggctgactggggc

SEQ ID NO: 1166579 - DNA, 12 bp, Homo sapiens
ttggctgcagcc

SEQ ID NO: 1166580 - DNA, 16 bp, Homo sapiens
ttggctgcgtactcca

SEQ ID NO: 1166581 - DNA, 24 bp, Homo sapiens
ttggctgcgtactccactggtctg

SEQ ID NO: 1166582 - DNA, 15 bp, Homo sapiens
ttggctgcttcctgt

SEQ ID NO: 1166583 - DNA, 16 bp, Homo sapiens
ttggctgcttcctgtg

SEQ ID NO: 1166584 - DNA, 21 bp, Homo sapiens
ttggctggactgtagaaggtg

SEQ ID NO: 1166585 - DNA, 17 bp, Homo sapiens
ttggctggatcagggaa

SEQ ID NO: 1166586 - DNA, 21 bp, Homo sapiens
ttggctggatgaaattttcta

SEQ ID NO: 1166587 - DNA, 16 bp, Homo sapiens
ttggctgggcccagaa

SEQ ID NO: 1166588 - DNA, 18 bp, Homo sapiens
ttggctgggcccagaagg

SEQ ID NO: 1166589 - DNA, 12 bp, Homo sapiens
ttggctgtcctt

SEQ ID NO: 1166590 - DNA, 11 bp, Homo sapiens
ttggctgtctg

SEQ ID NO: 1166591 - DNA, 13 bp, Homo sapiens
ttggctgtgacct

SEQ ID NO: 1166592 - DNA, 17 bp, Homo sapiens
ttggctgtgaggcccct

SEQ ID NO: 1166593 - DNA, 15 bp, Homo sapiens
ttggctgtgtctaaa

SEQ ID NO: 1166594 - DNA, 15 bp, Homo sapiens
ttggctgttccagac

SEQ ID NO: 1166595 - DNA, 18 bp, Homo sapiens
ttggcttaaagtgaagga

SEQ ID NO: 1166596 - DNA, 19 bp, Homo sapiens
ttggcttaaagtgaaggaa

SEQ ID NO: 1166597 - DNA, 20 bp, Homo sapiens
ttggcttaaagtgaaggaaa

SEQ ID NO: 1166598 - DNA, 17 bp, Homo sapiens
ttggcttactgcagcct

SEQ ID NO: 1166599 - DNA, 17 bp, Homo sapiens
ttggcttataaacacat

SEQ ID NO: 1166600 - DNA, 16 bp, Homo sapiens
ttggcttcatttcaat

SEQ ID NO: 1166601 - DNA, 21 bp, Homo sapiens
ttggcttccatgatggttatt

SEQ ID NO: 1166602 - DNA, 22 bp, Homo sapiens
ttggcttcctttcttggttcat

SEQ ID NO: 1166603 - DNA, 11 bp, Homo sapiens
ttggcttctgt

SEQ ID NO: 1166604 - DNA, 16 bp, Homo sapiens
ttggcttcttaaaaac

SEQ ID NO: 1166605 - DNA, 17 bp, Homo sapiens
ttggctttaaacaccct

SEQ ID NO: 1166606 - DNA, 14 bp, Homo sapiens
ttggctttgcccac

SEQ ID NO: 1166607 - DNA, 15 bp, Homo sapiens
ttggctttgcccacc

SEQ ID NO: 1166608 - DNA, 14 bp, Homo sapiens
ttggctttgtgctt

SEQ ID NO: 1166609 - DNA, 22 bp, Homo sapiens
ttgggaaatgtagccctgggtt

SEQ ID NO: 1166610 - DNA, 22 bp, Homo sapiens
ttgggaaattaaatccaataaa

SEQ ID NO: 1166611 - DNA, 23 bp, Homo sapiens
ttgggaaattaaatccaataaaa

SEQ ID NO: 1166612 - DNA, 22 bp, Homo sapiens
ttgggaacagcatggaggcaga

SEQ ID NO: 1166613 - DNA, 22 bp, Homo sapiens
ttgggaaccaagctattccttt

SEQ ID NO: 1166614 - DNA, 13 bp, Homo sapiens
ttgggaaggacac

SEQ ID NO: 1166615 - DNA, 21 bp, Homo sapiens
ttgggaaggggacccccgccc

SEQ ID NO: 1166616 - DNA, 20 bp, Homo sapiens
ttgggaaggggtcctgcagg

SEQ ID NO: 1166617 - DNA, 16 bp, Homo sapiens
ttgggaagtgtgttta

SEQ ID NO: 1166618 - DNA, 14 bp, Homo sapiens
ttgggaatgtttgt

SEQ ID NO: 1166619 - DNA, 17 bp, Homo sapiens
ttgggaccagaagtgtt

SEQ ID NO: 1166620 - DNA, 18 bp, Homo sapiens
ttgggaccagaagtgttt

SEQ ID NO: 1166621 - DNA, 22 bp, Homo sapiens
ttgggacgtgtacagcacagaa

SEQ ID NO: 1166622 - DNA, 13 bp, Homo sapiens
ttgggagaaatca

SEQ ID NO: 1166623 - DNA, 16 bp, Homo sapiens
ttgggagagcaggaat

SEQ ID NO: 1166624 - DNA, 17 bp, Homo sapiens
ttgggagagcaggaatg

SEQ ID NO: 1166625 - DNA, 21 bp, Homo sapiens
ttgggagagccatacataaaa

SEQ ID NO: 1166626 - DNA, 11 bp, Homo sapiens
ttgggagcact

SEQ ID NO: 1166627 - DNA, 16 bp, Homo sapiens
ttgggaggaggaaaag

SEQ ID NO: 1166628 - DNA, 19 bp, Homo sapiens
ttgggagggaaaagggaag

SEQ ID NO: 1166629 - DNA, 23 bp, Homo sapiens
ttgggagtatgttgtcataacat

SEQ ID NO: 1166630 - DNA, 14 bp, Homo sapiens
ttgggagtccaggc

SEQ ID NO: 1166631 - DNA, 15 bp, Homo sapiens
ttgggagtccaggca

SEQ ID NO: 1166632 - DNA, 17 bp, Homo sapiens
ttgggagtccaggcaca

SEQ ID NO: 1166633 - DNA, 20 bp, Homo sapiens
ttgggagtccaggcacagga

SEQ ID NO: 1166634 - DNA, 18 bp, Homo sapiens
ttgggagttttgaatgtt

SEQ ID NO: 1166635 - DNA, 17 bp, Homo sapiens
ttgggataaagcaaggg

SEQ ID NO: 1166636 - DNA, 20 bp, Homo sapiens
ttgggatagtgttctgctcc

SEQ ID NO: 1166637 - DNA, 15 bp, Homo sapiens
ttgggatatctcctg

SEQ ID NO: 1166638 - DNA, 17 bp, Homo sapiens
ttgggatcagcctccgc

SEQ ID NO: 1166639 - DNA, 15 bp, Homo sapiens
ttgggatcaggagcc

SEQ ID NO: 1166640 - DNA, 16 bp, Homo sapiens
ttgggatcaggagccc

SEQ ID NO: 1166641 - DNA, 18 bp, Homo sapiens
ttgggattcctgacccag

SEQ ID NO: 1166642 - DNA, 21 bp, Homo sapiens
ttgggattgggggctggtgcc

SEQ ID NO: 1166643 - DNA, 22 bp, Homo sapiens
ttgggattgggggctggtgcca

SEQ ID NO: 1166644 - DNA, 15 bp, Homo sapiens
ttgggattgggggga

SEQ ID NO: 1166645 - DNA, 23 bp, Homo sapiens
ttgggcactatttatttacaaat

SEQ ID NO: 1166646 - DNA, 19 bp, Homo sapiens
ttgggcagaatgaattcga

SEQ ID NO: 1166647 - DNA, 21 bp, Homo sapiens
ttgggcagagctggctctgag

SEQ ID NO: 1166648 - DNA, 11 bp, Homo sapiens
ttgggcagcca

SEQ ID NO: 1166649 - DNA, 23 bp, Homo sapiens
ttgggcagccaggagtgcccccg

SEQ ID NO: 1166650 - DNA, 16 bp, Homo sapiens
ttgggcagtgccccag

SEQ ID NO: 1166651 - DNA, 23 bp, Homo sapiens
ttgggcatccacccagtgctgcc

SEQ ID NO: 1166652 - DNA, 23 bp, Homo sapiens
ttgggccatggctttcatcctgt

SEQ ID NO: 1166653 - DNA, 22 bp, Homo sapiens
ttgggcccaagaactgcagata

SEQ ID NO: 1166654 - DNA, 16 bp, Homo sapiens
ttgggcccagctgggc

SEQ ID NO: 1166655 - DNA, 23 bp, Homo sapiens
ttgggcctctcctgccctctgct

SEQ ID NO: 1166656 - DNA, 17 bp, Homo sapiens
ttgggctactggcagct

SEQ ID NO: 1166657 - DNA, 20 bp, Homo sapiens
ttgggctactggcagctcct

SEQ ID NO: 1166658 - DNA, 14 bp, Homo sapiens
ttgggctcagggtt

SEQ ID NO: 1166659 - DNA, 16 bp, Homo sapiens
ttgggctcctggctgc

SEQ ID NO: 1166660 - DNA, 19 bp, Homo sapiens
ttgggctcctggctgccag

SEQ ID NO: 1166661 - DNA, 15 bp, Homo sapiens
ttgggctcctttttc

SEQ ID NO: 1166662 - DNA, 17 bp, Homo sapiens
ttgggctcgcactgccc

SEQ ID NO: 1166663 - DNA, 22 bp, Homo sapiens
ttgggctctctctagctcccca

SEQ ID NO: 1166664 - DNA, 22 bp, Homo sapiens
ttgggctgaatgtatgtaaata

SEQ ID NO: 1166665 - DNA, 15 bp, Homo sapiens
ttgggctgagactgg

SEQ ID NO: 1166666 - DNA, 21 bp, Homo sapiens
ttgggctgagtgcagccaaag

SEQ ID NO: 1166667 - DNA, 20 bp, Homo sapiens
ttgggctgggacttcttacc

SEQ ID NO: 1166668 - DNA, 21 bp, Homo sapiens
ttgggcttagtatttctcagg

SEQ ID NO: 1166669 - DNA, 17 bp, Homo sapiens
ttgggcttgtgatttcc

SEQ ID NO: 1166670 - DNA, 20 bp, Homo sapiens
ttgggctttgcaggctctgg

SEQ ID NO: 1166671 - DNA, 20 bp, Homo sapiens
ttggggaattaaatagtgtg

SEQ ID NO: 1166672 - DNA, 18 bp, Homo sapiens
ttggggacagttggcaga

SEQ ID NO: 1166673 - DNA, 23 bp, Homo sapiens
ttggggagcaggaggccaataaa

SEQ ID NO: 1166674 - DNA, 23 bp, Homo sapiens
ttggggagggaggggaaatgtaa

SEQ ID NO: 1166675 - DNA, 13 bp, Homo sapiens
ttggggaggggcg

SEQ ID NO: 1166676 - DNA, 23 bp, Homo sapiens
ttggggagggggaagagaaattt

SEQ ID NO: 1166677 - DNA, 15 bp, Homo sapiens
ttggggattttcaaa

SEQ ID NO: 1166678 - DNA, 19 bp, Homo sapiens
ttggggcaagactgcaaac

SEQ ID NO: 1166679 - DNA, 13 bp, Homo sapiens
ttggggcttcaca

SEQ ID NO: 1166680 - DNA, 21 bp, Homo sapiens
ttggggctttacatactttat

SEQ ID NO: 1166681 - DNA, 21 bp, Homo sapiens
ttgggggaaaaaaaagaaaaa

SEQ ID NO: 1166682 - DNA, 21 bp, Homo sapiens
ttgggggaatgcacctcccca

SEQ ID NO: 1166683 - DNA, 19 bp, Homo sapiens
ttgggggacgtttctcatt

SEQ ID NO: 1166684 - DNA, 14 bp, Homo sapiens
ttgggggagggaag

SEQ ID NO: 1166685 - DNA, 17 bp, Homo sapiens
ttgggggctcggggagg

SEQ ID NO: 1166686 - DNA, 14 bp, Homo sapiens
ttgggggctggtgc

SEQ ID NO: 1166687 - DNA, 17 bp, Homo sapiens
ttggggggactctgagc

SEQ ID NO: 1166688 - DNA, 15 bp, Homo sapiens
ttggggggccacccg

SEQ ID NO: 1166689 - DNA, 20 bp, Homo sapiens
ttggggggccgggcaggtcc

SEQ ID NO: 1166690 - DNA, 22 bp, Homo sapiens
ttggggggctgaggtgggagga

SEQ ID NO: 1166691 - DNA, 17 bp, Homo sapiens
ttgggggggctgccttt

SEQ ID NO: 1166692 - DNA, 13 bp, Homo sapiens
ttgggggggtggc

SEQ ID NO: 1166693 - DNA, 20 bp, Homo sapiens
ttgggggtcagtgctgcctg

SEQ ID NO: 1166694 - DNA, 23 bp, Homo sapiens
ttggggtagaccttgagggtggg

SEQ ID NO: 1166695 - DNA, 13 bp, Homo sapiens
ttggggtcagcca

SEQ ID NO: 1166696 - DNA, 16 bp, Homo sapiens
ttggggtcagccaggg

SEQ ID NO: 1166697 - DNA, 13 bp, Homo sapiens
ttggggtgacagt

SEQ ID NO: 1166698 - DNA, 22 bp, Homo sapiens
ttggggtgataaggggccttgc

SEQ ID NO: 1166699 - DNA, 10 bp, Homo sapiens
ttggggtgcc

SEQ ID NO: 1166700 - DNA, 17 bp, Homo sapiens
ttggggtgggggccagg

SEQ ID NO: 1166701 - DNA, 19 bp, Homo sapiens
ttggggtgtggggtggggt

SEQ ID NO: 1166702 - DNA, 15 bp, Homo sapiens
ttggggttgtgttgt

SEQ ID NO: 1166703 - DNA, 16 bp, Homo sapiens
ttggggttgtgttgtc

SEQ ID NO: 1166704 - DNA, 20 bp, Homo sapiens
ttgggtacatggcccgcagt

SEQ ID NO: 1166705 - DNA, 14 bp, Homo sapiens
ttgggtagaaaaat

SEQ ID NO: 1166706 - DNA, 14 bp, Homo sapiens
ttgggtaggcggga

SEQ ID NO: 1166707 - DNA, 19 bp, Homo sapiens
ttgggtcaaggacagggct

SEQ ID NO: 1166708 - DNA, 20 bp, Homo sapiens
ttgggtcaggttcttgcctt

SEQ ID NO: 1166709 - DNA, 22 bp, Homo sapiens
ttgggtcataaatcagaaagtt

SEQ ID NO: 1166710 - DNA, 16 bp, Homo sapiens
ttgggtcctgggcagg

SEQ ID NO: 1166711 - DNA, 15 bp, Homo sapiens
ttgggtgcctcctgc

SEQ ID NO: 1166712 - DNA, 19 bp, Homo sapiens
ttgggtggccccctctcct

SEQ ID NO: 1166713 - DNA, 19 bp, Homo sapiens
ttgggtggctcactactga

SEQ ID NO: 1166714 - DNA, 21 bp, Homo sapiens
ttgggtgtaacaggtctcctc

SEQ ID NO: 1166715 - DNA, 23 bp, Homo sapiens
ttgggttgattctcgactgcttt

SEQ ID NO: 1166716 - DNA, 18 bp, Homo sapiens
ttgggtttggccagggag

SEQ ID NO: 1166717 - DNA, 16 bp, Homo sapiens
tgcgcttctgctggag

SEQ ID NO: 1166718 - DNA, 21 bp, Homo sapiens
tgcgcttggtaggtgtggtgg

SEQ ID NO: 1166719 - DNA, 18 bp, Homo sapiens
tgcgctttattgcccatg

SEQ ID NO: 1166720 - DNA, 22 bp, Homo sapiens
tgcgctttattgcccatgggat

SEQ ID NO: 1166721 - DNA, 12 bp, Homo sapiens
tgcggaagccat

SEQ ID NO: 1166722 - DNA, 13 bp, Homo sapiens
tgcggaagccata

SEQ ID NO: 1166723 - DNA, 19 bp, Homo sapiens
tgcggacaccgtggcctgg

SEQ ID NO: 1166724 - DNA, 13 bp, Homo sapiens
tgcggagccagca

SEQ ID NO: 1166725 - DNA, 23 bp, Homo sapiens
tgcggaggaaggaggacccagga

SEQ ID NO: 1166726 - DNA, 15 bp, Homo sapiens
tgcggagtgaagagg

SEQ ID NO: 1166727 - DNA, 15 bp, Homo sapiens
tgcggatctcagctt

SEQ ID NO: 1166728 - DNA, 13 bp, Homo sapiens
tgcggatggccgg

SEQ ID NO: 1166729 - DNA, 14 bp, Homo sapiens
tgcggcctcaccag

SEQ ID NO: 1166730 - DNA, 23 bp, Homo sapiens
tgcggcctcaccaggcccacgag

SEQ ID NO: 1166731 - DNA, 17 bp, Homo sapiens
tgcggcctttggcttca

SEQ ID NO: 1166732 - DNA, 19 bp, Homo sapiens
tgcggcctttggcttcacg

SEQ ID NO: 1166733 - DNA, 15 bp, Homo sapiens
tgcggcgccagcctc

SEQ ID NO: 1166734 - DNA, 13 bp, Homo sapiens
tgcggcggtccca

SEQ ID NO: 1166735 - DNA, 17 bp, Homo sapiens
tgcggcggtcccagctc

SEQ ID NO: 1166736 - DNA, 17 bp, Homo sapiens
tgcggctcagccttgca

SEQ ID NO: 1166737 - DNA, 19 bp, Homo sapiens
tgcggctcagccttgcaca

SEQ ID NO: 1166738 - DNA, 16 bp, Homo sapiens
tgcggctttctctgcc

SEQ ID NO: 1166739 - DNA, 22 bp, Homo sapiens
tgcggctttctctgcctctggg

SEQ ID NO: 1166740 - DNA, 23 bp, Homo sapiens
tgcggctttctctgcctctgggc

SEQ ID NO: 1166741 - DNA, 15 bp, Homo sapiens
tgcgggaccatctga

SEQ ID NO: 1166742 - DNA, 18 bp, Homo sapiens
tgcgggatggtcctgggg

SEQ ID NO: 1166743 - DNA, 19 bp, Homo sapiens
tgcgggatggtcctggggc

SEQ ID NO: 1166744 - DNA, 13 bp, Homo sapiens
tgcgggccacagg

SEQ ID NO: 1166745 - DNA, 12 bp, Homo sapiens
tgcgggctccct

SEQ ID NO: 1166746 - DNA, 14 bp, Homo sapiens
tgcgggctccctcc

SEQ ID NO: 1166747 - DNA, 18 bp, Homo sapiens
tgcgggctccctcctctg

SEQ ID NO: 1166748 - DNA, 12 bp, Homo sapiens
tgcgggctcgcc

SEQ ID NO: 1166749 - DNA, 17 bp, Homo sapiens
tgcgggctcgcccatac

SEQ ID NO: 1166750 - DNA, 13 bp, Homo sapiens
tgcggggacaggc

SEQ ID NO: 1166751 - DNA, 14 bp, Homo sapiens
tgcggggacaggct

SEQ ID NO: 1166752 - DNA, 18 bp, Homo sapiens
tgcggggagacagaagcc

SEQ ID NO: 1166753 - DNA, 18 bp, Homo sapiens
tgcgggtcctcagctgct

SEQ ID NO: 1166754 - DNA, 22 bp, Homo sapiens
tgcgggtgaacaaagcagccac

SEQ ID NO: 1166755 - DNA, 15 bp, Homo sapiens
tgcggtagccagcac

SEQ ID NO: 1166756 - DNA, 18 bp, Homo sapiens
tgcggtagccagcacaca

SEQ ID NO: 1166757 - DNA, 21 bp, Homo sapiens
tgcggtggctcacgcctgtaa

SEQ ID NO: 1166758 - DNA, 15 bp, Homo sapiens
tgcggtgggtgctgc

SEQ ID NO: 1166759 - DNA, 20 bp, Homo sapiens
tgcggttataaaaaatggtt

SEQ ID NO: 1166760 - DNA, 20 bp, Homo sapiens
tgcggtttccaaggtgcaca

SEQ ID NO: 1166761 - DNA, 21 bp, Homo sapiens
tgcggtttgttggatcttcaa

SEQ ID NO: 1166762 - DNA, 15 bp, Homo sapiens
tgcgtaatttaatgg

SEQ ID NO: 1166763 - DNA, 13 bp, Homo sapiens
tgcgtacacagag

SEQ ID NO: 1166764 - DNA, 15 bp, Homo sapiens
tgcgtacgtttcctg

SEQ ID NO: 1166765 - DNA, 20 bp, Homo sapiens
tgcgtacgtttcctgagaag

SEQ ID NO: 1166766 - DNA, 23 bp, Homo sapiens
tgcgtacgtttcctgagaagtgt

SEQ ID NO: 1166767 - DNA, 14 bp, Homo sapiens
tgcgtactccactg

SEQ ID NO: 1166768 - DNA, 13 bp, Homo sapiens
tgcgtagaggcta

SEQ ID NO: 1166769 - DNA, 17 bp, Homo sapiens
tgcgtagaggctacagg

SEQ ID NO: 1166770 - DNA, 16 bp, Homo sapiens
tgcgtatatgtgcgtc

SEQ ID NO: 1166771 - DNA, 23 bp, Homo sapiens
tgcgtatatgtgcgtctctcttt

SEQ ID NO: 1166772 - DNA, 16 bp, Homo sapiens
tgcgtatgcagtgtag

SEQ ID NO: 1166773 - DNA, 13 bp, Homo sapiens
tgcgtattctgtg

SEQ ID NO: 1166774 - DNA, 15 bp, Homo sapiens
tgcgtattctgtggc

SEQ ID NO: 1166775 - DNA, 15 bp, Homo sapiens
tgcgtccaccaggcc

SEQ ID NO: 1166776 - DNA, 16 bp, Homo sapiens
tgcgtcctcctcacct

SEQ ID NO: 1166777 - DNA, 19 bp, Homo sapiens
tgcgtcctgacgccctgcg

SEQ ID NO: 1166778 - DNA, 13 bp, Homo sapiens
tgcgtcctgcaga

SEQ ID NO: 1166779 - DNA, 16 bp, Homo sapiens
tgcgtcggtcctggtg

SEQ ID NO: 1166780 - DNA, 15 bp, Homo sapiens
tgcgtctccagtcat

SEQ ID NO: 1166781 - DNA, 20 bp, Homo sapiens
tgcgtctccagtcatctgta

SEQ ID NO: 1166782 - DNA, 21 bp, Homo sapiens
tgcgtctctctttctccctca

SEQ ID NO: 1166783 - DNA, 22 bp, Homo sapiens
tgcgtctctgtcgtggacacgc

SEQ ID NO: 1166784 - DNA, 13 bp, Homo sapiens
tgcgtctgaggcc

SEQ ID NO: 1166785 - DNA, 16 bp, Homo sapiens
tgcgtctgaggcctgc

SEQ ID NO: 1166786 - DNA, 15 bp, Homo sapiens
tgcgtgacaataaaa

SEQ ID NO: 1166787 - DNA, 16 bp, Homo sapiens
tgcgtgcccttttcat

SEQ ID NO: 1166788 - DNA, 15 bp, Homo sapiens
tgcgtgccgtgtgag

SEQ ID NO: 1166789 - DNA, 13 bp, Homo sapiens
tgcgtgcgtgtgc

SEQ ID NO: 1166790 - DNA, 14 bp, Homo sapiens
tgcgtggctgtggc

SEQ ID NO: 1166791 - DNA, 12 bp, Homo sapiens
tgcgtgggaggc

SEQ ID NO: 1166792 - DNA, 23 bp, Homo sapiens
tgcgtgggtgtgtgcgtgtttgg

SEQ ID NO: 1166793 - DNA, 20 bp, Homo sapiens
tgcgtgtgacagtgtatggg

SEQ ID NO: 1166794 - DNA, 18 bp, Homo sapiens
tgcgtgtgcgtgcatgtg

SEQ ID NO: 1166795 - DNA, 14 bp, Homo sapiens
tgcgtgtgtcaggg

SEQ ID NO: 1166796 - DNA, 16 bp, Homo sapiens
tgcgtgtgtcagggat

SEQ ID NO: 1166797 - DNA, 21 bp, Homo sapiens
tgttggttttgggggtgtgag

SEQ ID NO: 1166798 - DNA, 14 bp, Homo sapiens
tgttgtacttgaaa

SEQ ID NO: 1166799 - DNA, 21 bp, Homo sapiens
tgttgtagattgattgtattg

SEQ ID NO: 1166800 - DNA, 17 bp, Homo sapiens
tgttgtagtaagagctt

SEQ ID NO: 1166801 - DNA, 20 bp, Homo sapiens
tgtttgtacacaacaatcct

SEQ ID NO: 1166802 - DNA, 15 bp, Homo sapiens
tgtttgtatatttgc

SEQ ID NO: 1166803 - DNA, 15 bp, Homo sapiens
tgtttgtatttggaa

SEQ ID NO: 1166804 - DNA, 16 bp, Homo sapiens
tgtttgtcagatatga

SEQ ID NO: 1166805 - DNA, 21 bp, Homo sapiens
tgttttttaagatagtgtaac

SEQ ID NO: 1166806 - DNA, 21 bp, Homo sapiens
tgttttttaatttaaaaaaag

SEQ ID NO: 1166807 - DNA, 15 bp, Homo sapiens
tgttttttatgaagt

SEQ ID NO: 1166808 - DNA, 17 bp, Homo sapiens
tgttttttatgaagtgc

SEQ ID NO: 1166809 - DNA, 13 bp, Homo sapiens
tgttttttcaaaa

SEQ ID NO: 1166810 - DNA, 18 bp, Homo sapiens
tgttttttcatagtgcct

SEQ ID NO: 1166811 - DNA, 12 bp, Homo sapiens
tgttttttgata

SEQ ID NO: 1166812 - DNA, 18 bp, Homo sapiens
tgttttttgccacagctt

SEQ ID NO: 1166813 - DNA, 17 bp, Homo sapiens
tgttttttggaaattca

SEQ ID NO: 1166814 - DNA, 23 bp, Homo sapiens
ttaaagaataaagtccaaagtca

SEQ ID NO: 1166815 - DNA, 20 bp, Homo sapiens
ttaaagaatatgacttttta

SEQ ID NO: 1166816 - DNA, 14 bp, Homo sapiens
ttaaagaatgttag

SEQ ID NO: 1166817 - DNA, 21 bp, Homo sapiens
ttaaagaatgttagtaaagga

SEQ ID NO: 1166818 - DNA, 9 bp, Homo sapiens
ttaaagaca

SEQ ID NO: 1166819 - DNA, 22 bp, Homo sapiens
ttaaagagaaaagggaaaaaag

SEQ ID NO: 1166820 - DNA, 13 bp, Homo sapiens
ttaaagagaggtt

SEQ ID NO: 1166821 - DNA, 17 bp, Homo sapiens
ttaaagagatagcttct

SEQ ID NO: 1166822 - DNA, 23 bp, Homo sapiens
ttaaagagatttcccttcattta

SEQ ID NO: 1166823 - DNA, 22 bp, Homo sapiens
ttaaagagcatggaaaaatact

SEQ ID NO: 1166824 - DNA, 20 bp, Homo sapiens
ttaaagaggagaaggaaaac

SEQ ID NO: 1166825 - DNA, 22 bp, Homo sapiens
ttaaagataagtctacattaaa

SEQ ID NO: 1166826 - DNA, 14 bp, Homo sapiens
ttaaagatgccata

SEQ ID NO: 1166827 - DNA, 17 bp, Homo sapiens
ttaaagatgccatagca

SEQ ID NO: 1166828 - DNA, 18 bp, Homo sapiens
ttaaagatgccatagcat

SEQ ID NO: 1166829 - DNA, 19 bp, Homo sapiens
ttaaagatggatttgaaaa

SEQ ID NO: 1166830 - DNA, 14 bp, Homo sapiens
ttaaagattctctt

SEQ ID NO: 1166831 - DNA, 13 bp, Homo sapiens
ttaaagatttctt

SEQ ID NO: 1166832 - DNA, 17 bp, Homo sapiens
ttacacttcttacccca

SEQ ID NO: 1166833 - DNA, 21 bp, Homo sapiens
ttacacttggagcccgtgcag

SEQ ID NO: 1166834 - DNA, 23 bp, Homo sapiens
ttacactttatgccggatgtgct

SEQ ID NO: 1166835 - DNA, 19 bp, Homo sapiens
ttacagaaatggactggag

SEQ ID NO: 1166836 - DNA, 14 bp, Homo sapiens
ttacagaaatgttt

SEQ ID NO: 1166837 - DNA, 18 bp, Homo sapiens
ttacagaatgcattaaaa

SEQ ID NO: 1166838 - DNA, 19 bp, Homo sapiens
ttacagaatgcattaaaaa

SEQ ID NO: 1166839 - DNA, 20 bp, Homo sapiens
ttacagaatgcattaaaaaa

SEQ ID NO: 1166840 - DNA, 19 bp, Homo sapiens
ttacagacgctgctgtcac

SEQ ID NO: 1166841 - DNA, 23 bp, Homo sapiens
ttacagagaatttctaaagtaaa

SEQ ID NO: 1166842 - DNA, 14 bp, Homo sapiens
ttacagagaggaga

SEQ ID NO: 1166843 - DNA, 20 bp, Homo sapiens
ttacagagaggagaaacaca

SEQ ID NO: 1166844 - DNA, 23 bp, Homo sapiens
ttacagatagtatctagcaatca

SEQ ID NO: 1166845 - DNA, 18 bp, Homo sapiens
ttacagatatttgtcatg

SEQ ID NO: 1166846 - DNA, 23 bp, Homo sapiens
ttacagatgtttttaattctagt

SEQ ID NO: 1166847 - DNA, 19 bp, Homo sapiens
ttacagattgcctccttat

SEQ ID NO: 1166848 - DNA, 16 bp, Homo sapiens
ttacagatttaataca

SEQ ID NO: 1166849 - DNA, 20 bp, Homo sapiens
ttacagcattgtctttgctg

SEQ ID NO: 1166850 - DNA, 15 bp, Homo sapiens
ttacagcctctgact

SEQ ID NO: 1166851 - DNA, 15 bp, Homo sapiens
ttacagcgagaggca

SEQ ID NO: 1166852 - DNA, 15 bp, Homo sapiens
ttacaggaagctttt

SEQ ID NO: 1166853 - DNA, 12 bp, Homo sapiens
ttacaggagggc

SEQ ID NO: 1166854 - DNA, 19 bp, Homo sapiens
ttacaggaggttgtggatg

SEQ ID NO: 1166855 - DNA, 21 bp, Homo sapiens
ttacaggaggttgtggatgct

SEQ ID NO: 1166856 - DNA, 18 bp, Homo sapiens
ttacaggcaccgagaatg

SEQ ID NO: 1166857 - DNA, 14 bp, Homo sapiens
ttacagggtgactc

SEQ ID NO: 1166858 - DNA, 18 bp, Homo sapiens
ttacaggtgtgagccaca

SEQ ID NO: 1166859 - DNA, 15 bp, Homo sapiens
ttacaggttcttagg

SEQ ID NO: 1166860 - DNA, 19 bp, Homo sapiens
ttacagtaactaattttgt

SEQ ID NO: 1166861 - DNA, 22 bp, Homo sapiens
ttacagtaatcccatttcccaa

SEQ ID NO: 1166862 - DNA, 17 bp, Homo sapiens
ttacagtaatgtcataa

SEQ ID NO: 1166863 - DNA, 22 bp, Homo sapiens
ttacagtaatgtcataaagtga

SEQ ID NO: 1166864 - DNA, 20 bp, Homo sapiens
ttacagtatgatgaaaataa

SEQ ID NO: 1166865 - DNA, 16 bp, Homo sapiens
ttacagtgcagacagg

SEQ ID NO: 1166866 - DNA, 17 bp, Homo sapiens
ttacagttaaggaatat

SEQ ID NO: 1166867 - DNA, 14 bp, Homo sapiens
ttacagttctgtgg

SEQ ID NO: 1166868 - DNA, 22 bp, Homo sapiens
ttacagttctttcctctttctg

SEQ ID NO: 1166869 - DNA, 13 bp, Homo sapiens
ttacagtttgtgt

SEQ ID NO: 1166870 - DNA, 21 bp, Homo sapiens
ttacagtttgtgttttaaaaa

SEQ ID NO: 1166871 - DNA, 22 bp, Homo sapiens
ttacagtttgtgttttaaaaaa

SEQ ID NO: 1166872 - DNA, 16 bp, Homo sapiens
ttacataaagctccct

SEQ ID NO: 1166873 - DNA, 19 bp, Homo sapiens
ttacataaagctcccttga

SEQ ID NO: 1166874 - DNA, 14 bp, Homo sapiens
ttacataaataaat

SEQ ID NO: 1166875 - DNA, 13 bp, Homo sapiens
ttacatacagatt

SEQ ID NO: 1166876 - DNA, 14 bp, Homo sapiens
ttacatactgctgt

SEQ ID NO: 1166877 - DNA, 21 bp, Homo sapiens
ttacatactttatcaatgtgt

SEQ ID NO: 1166878 - DNA, 18 bp, Homo sapiens
ttacatcagtagcatttt

SEQ ID NO: 1166879 - DNA, 23 bp, Homo sapiens
ttacatcagtagcatttttctaa

SEQ ID NO: 1166880 - DNA, 19 bp, Homo sapiens
ttacatctgggatcatgat

SEQ ID NO: 1166881 - DNA, 18 bp, Homo sapiens
ttacatctgttttaaatt

SEQ ID NO: 1166882 - DNA, 21 bp, Homo sapiens
ttacatctgttttaaatttat

SEQ ID NO: 1166883 - DNA, 18 bp, Homo sapiens
ttacatcttctgtgaaat

SEQ ID NO: 1166884 - DNA, 21 bp, Homo sapiens
ttacatcttctgtgaaatata

SEQ ID NO: 1166885 - DNA, 21 bp, Homo sapiens
ttacatcttgttggtaccttt

SEQ ID NO: 1166886 - DNA, 15 bp, Homo sapiens
ttacatctttcacat

SEQ ID NO: 1166887 - DNA, 17 bp, Homo sapiens
ttacatcttttctaatc

SEQ ID NO: 1166888 - DNA, 12 bp, Homo sapiens
ttacatgaagct

SEQ ID NO: 1166889 - DNA, 17 bp, Homo sapiens
ttacatgaattgcattt

SEQ ID NO: 1166890 - DNA, 14 bp, Homo sapiens
ttacatgactgttt

SEQ ID NO: 1166891 - DNA, 13 bp, Homo sapiens
ttacatgcatttg

SEQ ID NO: 1166892 - DNA, 23 bp, Homo sapiens
ttacatggcgccctgcctcctgg

SEQ ID NO: 1166893 - DNA, 12 bp, Homo sapiens
ttacatgtttcc

SEQ ID NO: 1166894 - DNA, 22 bp, Homo sapiens
ttacatgttttttcatttgtaa

SEQ ID NO: 1166895 - DNA, 20 bp, Homo sapiens
ttacattaaagccctgtgtt

SEQ ID NO: 1166896 - DNA, 22 bp, Homo sapiens
ttacattaatgcccagccagcc

SEQ ID NO: 1166897 - DNA, 19 bp, Homo sapiens
ttacattattccaatgata

SEQ ID NO: 1166898 - DNA, 18 bp, Homo sapiens
ttacattcagaaatgtgg

SEQ ID NO: 1166899 - DNA, 15 bp, Homo sapiens
ttagcaaactgatgc

SEQ ID NO: 1166900 - DNA, 15 bp, Homo sapiens
ttagcaaagaggttg

SEQ ID NO: 1166901 - DNA, 13 bp, Homo sapiens
ttagcaaagagtt

SEQ ID NO: 1166902 - DNA, 12 bp, Homo sapiens
ttagcaaggatt

SEQ ID NO: 1166903 - DNA, 10 bp, Homo sapiens
ttagcacaga

SEQ ID NO: 1166904 - DNA, 15 bp, Homo sapiens
ttagcacagagaggg

SEQ ID NO: 1166905 - DNA, 21 bp, Homo sapiens
ttagcactgttgatgtatctg

SEQ ID NO: 1166906 - DNA, 21 bp, Homo sapiens
ttagcacttgggtgacggcag

SEQ ID NO: 1166907 - DNA, 13 bp, Homo sapiens
ttagcagaatgga

SEQ ID NO: 1166908 - DNA, 17 bp, Homo sapiens
ttagcagaatggagaaa

SEQ ID NO: 1166909 - DNA, 16 bp, Homo sapiens
ttagcagacccagctt

SEQ ID NO: 1166910 - DNA, 16 bp, Homo sapiens
ttagcagagtctgtct

SEQ ID NO: 1166911 - DNA, 21 bp, Homo sapiens
ttagcagcagcctttaatgca

SEQ ID NO: 1166912 - DNA, 15 bp, Homo sapiens
ttagcagcttccaga

SEQ ID NO: 1166913 - DNA, 22 bp, Homo sapiens
ttagcagggattctctcatcta

SEQ ID NO: 1166914 - DNA, 13 bp, Homo sapiens
ttagcatcaagtt

SEQ ID NO: 1166915 - DNA, 21 bp, Homo sapiens
ttagcatgacaagccccaggc

SEQ ID NO: 1166916 - DNA, 13 bp, Homo sapiens
ttagcatgcaagc

SEQ ID NO: 1166917 - DNA, 15 bp, Homo sapiens
ttagcatgcaagctt

SEQ ID NO: 1166918 - DNA, 16 bp, Homo sapiens
ttagcatgcaagcttg

SEQ ID NO: 1166919 - DNA, 20 bp, Homo sapiens
ttagcatgttcctccttttc

SEQ ID NO: 1166920 - DNA, 21 bp, Homo sapiens
ttagcatttttatgcagacag

SEQ ID NO: 1166921 - DNA, 17 bp, Homo sapiens
ttagccagatttgtctt

SEQ ID NO: 1166922 - DNA, 19 bp, Homo sapiens
ttagccaggtaatgtgaat

SEQ ID NO: 1166923 - DNA, 13 bp, Homo sapiens
ttagccattgaaa

SEQ ID NO: 1166924 - DNA, 15 bp, Homo sapiens
ttagccattgaaatg

SEQ ID NO: 1166925 - DNA, 19 bp, Homo sapiens
ttagccatttctccatggg

SEQ ID NO: 1166926 - DNA, 22 bp, Homo sapiens
ttagcccaagaggtctgagccc

SEQ ID NO: 1166927 - DNA, 14 bp, Homo sapiens
ttagccccataatt

SEQ ID NO: 1166928 - DNA, 14 bp, Homo sapiens
ttagccctgtctgc

SEQ ID NO: 1166929 - DNA, 20 bp, Homo sapiens
ttagcctcaatttctgaaca

SEQ ID NO: 1166930 - DNA, 17 bp, Homo sapiens
ttagcctctcccacccg

SEQ ID NO: 1166931 - DNA, 13 bp, Homo sapiens
ttagcgctctgga

SEQ ID NO: 1166932 - DNA, 21 bp, Homo sapiens
ttagcggctcctcgcccccac

SEQ ID NO: 1166933 - DNA, 19 bp, Homo sapiens
ttagcgggactcagtgagc

SEQ ID NO: 1166934 - DNA, 21 bp, Homo sapiens
ttagcgtagctaagtgaaaag

SEQ ID NO: 1166935 - DNA, 16 bp, Homo sapiens
ttagcgtcaagacatt

SEQ ID NO: 1166936 - DNA, 19 bp, Homo sapiens
ttagcgtcaagacatttgc

SEQ ID NO: 1166937 - DNA, 15 bp, Homo sapiens
ttagctactgtatgc

SEQ ID NO: 1166938 - DNA, 17 bp, Homo sapiens
ttagctcaggtgcctta

SEQ ID NO: 1166939 - DNA, 13 bp, Homo sapiens
ttagctcctgtgg

SEQ ID NO: 1166940 - DNA, 14 bp, Homo sapiens
ttagctcctgtggc

SEQ ID NO: 1166941 - DNA, 22 bp, Homo sapiens
ttagctcttaattgttcatttt

SEQ ID NO: 1166942 - DNA, 13 bp, Homo sapiens
ttagctctttctc

SEQ ID NO: 1166943 - DNA, 13 bp, Homo sapiens
ttagctgcagaac

SEQ ID NO: 1166944 - DNA, 18 bp, Homo sapiens
ttagctgtactataagta

SEQ ID NO: 1166945 - DNA, 14 bp, Homo sapiens
ttagcttacaggaa

SEQ ID NO: 1166946 - DNA, 16 bp, Homo sapiens
ttagcttacaggaagc

SEQ ID NO: 1166947 - DNA, 19 bp, Homo sapiens
ttagcttattgatcccaca

SEQ ID NO: 1166948 - DNA, 20 bp, Homo sapiens
ttagcttcagttgttcttta

SEQ ID NO: 1166949 - DNA, 15 bp, Homo sapiens
ttagcttcctccaga

SEQ ID NO: 1166950 - DNA, 17 bp, Homo sapiens
ttagcttgcaccttgtc

SEQ ID NO: 1166951 - DNA, 14 bp, Homo sapiens
ttagctttgaaact

SEQ ID NO: 1166952 - DNA, 12 bp, Homo sapiens
ttagctttgtgt

SEQ ID NO: 1166953 - DNA, 18 bp, Homo sapiens
ttaggaaaatcactttgt

SEQ ID NO: 1166954 - DNA, 12 bp, Homo sapiens
ttaggaaacacc

SEQ ID NO: 1166955 - DNA, 16 bp, Homo sapiens
ttaggaaaggagatca

SEQ ID NO: 1166956 - DNA, 11 bp, Homo sapiens
ttaggaaataa

SEQ ID NO: 1166957 - DNA, 12 bp, Homo sapiens
ttaggaaataaa

SEQ ID NO: 1166958 - DNA, 17 bp, Homo sapiens
ttaggaaataaaacctt

SEQ ID NO: 1166959 - DNA, 21 bp, Homo sapiens
ttaggaaataaaacctttcaa

SEQ ID NO: 1166960 - DNA, 23 bp, Homo sapiens
ttaggaaccttctcccttcttgg

SEQ ID NO: 1166961 - DNA, 15 bp, Homo sapiens
ttaggaagagaaacc

SEQ ID NO: 1166962 - DNA, 19 bp, Homo sapiens
ttaggaagtgtaacagctg

SEQ ID NO: 1166963 - DNA, 21 bp, Homo sapiens
ttaggaagtgtaacagctgag

SEQ ID NO: 1166964 - DNA, 22 bp, Homo sapiens
ttaggaagttgacttatagtac

SEQ ID NO: 1166965 - DNA, 12 bp, Homo sapiens
ttaggaatctct

SEQ ID NO: 1166966 - DNA, 19 bp, Homo sapiens
ttaggaattaagttatctt

SEQ ID NO: 1166967 - DNA, 17 bp, Homo sapiens
ttaggaattgtttatac

SEQ ID NO: 1166968 - DNA, 13 bp, Homo sapiens
ttaggacatctta

SEQ ID NO: 1166969 - DNA, 19 bp, Homo sapiens
ttaggagcaagaagaaaat

SEQ ID NO: 1166970 - DNA, 19 bp, Homo sapiens
ttaggaggctgcatgctct

SEQ ID NO: 1166971 - DNA, 16 bp, Homo sapiens
ttaggataatacataa

SEQ ID NO: 1166972 - DNA, 20 bp, Homo sapiens
ttaggatattgatttaaaat

SEQ ID NO: 1166973 - DNA, 18 bp, Homo sapiens
ttaggatggggctcccag

SEQ ID NO: 1166974 - DNA, 22 bp, Homo sapiens
ttaggatggggctcccagctcc

SEQ ID NO: 1166975 - DNA, 22 bp, Homo sapiens
ttaggattttgtgtcttttaaa

SEQ ID NO: 1166976 - DNA, 20 bp, Homo sapiens
ttaggcaaggctatgtgatt

SEQ ID NO: 1166977 - DNA, 19 bp, Homo sapiens
ttaggcacatcaattaatt

SEQ ID NO: 1166978 - DNA, 15 bp, Homo sapiens
ttaggcagattgaaa

SEQ ID NO: 1166979 - DNA, 13 bp, Homo sapiens
ttaggcagcagct

SEQ ID NO: 1166980 - DNA, 18 bp, Homo sapiens
ttaggcatgcacagctgt

SEQ ID NO: 1166981 - DNA, 17 bp, Homo sapiens
ttaggcatgtcccaccc

SEQ ID NO: 1166982 - DNA, 13 bp, Homo sapiens
ttaggcattattt

SEQ ID NO: 1166983 - DNA, 18 bp, Homo sapiens
ttaggcattatttaatgt

SEQ ID NO: 1166984 - DNA, 20 bp, Homo sapiens
ttaggccacattgacagtgg

SEQ ID NO: 1166985 - DNA, 10 bp, Homo sapiens
ttaggccagc

SEQ ID NO: 1166986 - DNA, 16 bp, Homo sapiens
ttaggccttcctctct

SEQ ID NO: 1166987 - DNA, 16 bp, Homo sapiens
ttaggctattcacaac

SEQ ID NO: 1166988 - DNA, 16 bp, Homo sapiens
ttaggctatttgtaaa

SEQ ID NO: 1166989 - DNA, 23 bp, Homo sapiens
ttaggctatttgtaaatctgcca

SEQ ID NO: 1166990 - DNA, 16 bp, Homo sapiens
ttaggctggtggccca

SEQ ID NO: 1166991 - DNA, 18 bp, Homo sapiens
ttaggctggtggcccagg

SEQ ID NO: 1166992 - DNA, 14 bp, Homo sapiens
ttaggctgtaacta

SEQ ID NO: 1166993 - DNA, 19 bp, Homo sapiens
ttaggctttgtatgacagt

SEQ ID NO: 1166994 - DNA, 16 bp, Homo sapiens
ttaggcttttaagaaa

SEQ ID NO: 1166995 - DNA, 22 bp, Homo sapiens
ttagggaaaatggatatagaaa

SEQ ID NO: 1166996 - DNA, 20 bp, Homo sapiens
ttagggaaggatacaaaagc

SEQ ID NO: 1166997 - DNA, 21 bp, Homo sapiens
ttagggaagttgtctccttcc

SEQ ID NO: 1166998 - DNA, 14 bp, Homo sapiens
ttagggaatgagag

SEQ ID NO: 1166999 - DNA, 22 bp, Homo sapiens
ttagggacaggaccccagctct

SEQ ID NO: 1167000 - DNA, 12 bp, Homo sapiens
ttagggaggggt

SEQ ID NO: 1167001 - DNA, 12 bp, Homo sapiens
ttagggcagctt

SEQ ID NO: 1167002 - DNA, 14 bp, Homo sapiens
ttagggcagcttgc

SEQ ID NO: 1167003 - DNA, 13 bp, Homo sapiens
ttagggctgcttt

SEQ ID NO: 1167004 - DNA, 12 bp, Homo sapiens
ttaggggtgtgt

SEQ ID NO: 1167005 - DNA, 17 bp, Homo sapiens
ttaggggttctatttat

SEQ ID NO: 1167006 - DNA, 13 bp, Homo sapiens
ttagggtcagcca

SEQ ID NO: 1167007 - DNA, 15 bp, Homo sapiens
ttagggtcagccatt

SEQ ID NO: 1167008 - DNA, 17 bp, Homo sapiens
ttaggtaatttttttca

SEQ ID NO: 1167009 - DNA, 15 bp, Homo sapiens
ttaggttatgctatt

SEQ ID NO: 1167010 - DNA, 14 bp, Homo sapiens
ttaggttattttgc

SEQ ID NO: 1167011 - DNA, 16 bp, Homo sapiens
ttaggttattttgctt

SEQ ID NO: 1167012 - DNA, 20 bp, Homo sapiens
ttaggttattttgctttggt

SEQ ID NO: 1167013 - DNA, 16 bp, Homo sapiens
ttaggttgaaacatat

SEQ ID NO: 1167014 - DNA, 14 bp, Homo sapiens
ttaggttgttacca

SEQ ID NO: 1167015 - DNA, 12 bp, Homo sapiens
ttaggtttgttt

SEQ ID NO: 1167016 - DNA, 13 bp, Homo sapiens
ttagtaaatgtta

SEQ ID NO: 1167017 - DNA, 16 bp, Homo sapiens
ttagtaatttcctaga

SEQ ID NO: 1167018 - DNA, 23 bp, Homo sapiens
ttagtagaaacggggtttcacca

SEQ ID NO: 1167019 - DNA, 12 bp, Homo sapiens
ttagtagcatgt

SEQ ID NO: 1167020 - DNA, 19 bp, Homo sapiens
ttagtagcccttcagtctt

SEQ ID NO: 1167021 - DNA, 20 bp, Homo sapiens
ttagtataatatttcttaat

SEQ ID NO: 1167022 - DNA, 15 bp, Homo sapiens
ttagtatagtagaaa

SEQ ID NO: 1167023 - DNA, 16 bp, Homo sapiens
ttagtatgaggcattt

SEQ ID NO: 1167024 - DNA, 18 bp, Homo sapiens
ttagtatgaggcatttgt

SEQ ID NO: 1167025 - DNA, 20 bp, Homo sapiens
ttagtatggttcaagattgt

SEQ ID NO: 1167026 - DNA, 19 bp, Homo sapiens
ttagtatgtctgtttttgt

SEQ ID NO: 1167027 - DNA, 20 bp, Homo sapiens
ttagtattcaggcactgaga

SEQ ID NO: 1167028 - DNA, 22 bp, Homo sapiens
ttagtattgttgtccttttcat

SEQ ID NO: 1167029 - DNA, 22 bp, Homo sapiens
ttagtatttatttaatgttatg

SEQ ID NO: 1167030 - DNA, 15 bp, Homo sapiens
ttagtatttctcagg

SEQ ID NO: 1167031 - DNA, 16 bp, Homo sapiens
ttagtcactaagactt

SEQ ID NO: 1167032 - DNA, 23 bp, Homo sapiens
ttagtcactgcctgcagaggtct

SEQ ID NO: 1167033 - DNA, 18 bp, Homo sapiens
ttagtcatccaacaagaa

SEQ ID NO: 1167034 - DNA, 22 bp, Homo sapiens
ttagtcccccaactctgagccc

SEQ ID NO: 1167035 - DNA, 21 bp, Homo sapiens
ttagtctatcaaatgaaactc

SEQ ID NO: 1167036 - DNA, 22 bp, Homo sapiens
ttagtctcagtttgtgtgtctt

SEQ ID NO: 1167037 - DNA, 15 bp, Homo sapiens
ttagtgacaaaatag

SEQ ID NO: 1167038 - DNA, 17 bp, Homo sapiens
ttagtgaccattattca

SEQ ID NO: 1167039 - DNA, 21 bp, Homo sapiens
ttagtgaccattattcacagg

SEQ ID NO: 1167040 - DNA, 15 bp, Homo sapiens
ttagtgcaacttaga

SEQ ID NO: 1167041 - DNA, 17 bp, Homo sapiens
ttagtgcggacaagttt

SEQ ID NO: 1167042 - DNA, 23 bp, Homo sapiens
ttagtgcttaacattttcccaag

SEQ ID NO: 1167043 - DNA, 15 bp, Homo sapiens
ttagtggatggaata

SEQ ID NO: 1167044 - DNA, 16 bp, Homo sapiens
ttagtggatggaatat

SEQ ID NO: 1167045 - DNA, 15 bp, Homo sapiens
ttagtggtatgtctc

SEQ ID NO: 1167046 - DNA, 18 bp, Homo sapiens
ttagtggtatgtctcttt

SEQ ID NO: 1167047 - DNA, 19 bp, Homo sapiens
ttagtggtatgtctcttta

SEQ ID NO: 1167048 - DNA, 18 bp, Homo sapiens
ttagtgtatgattactgg

SEQ ID NO: 1167049 - DNA, 13 bp, Homo sapiens
ttagtgtattaat

SEQ ID NO: 1167050 - DNA, 22 bp, Homo sapiens
ttagtgtgaaatagttctgcca

SEQ ID NO: 1167051 - DNA, 17 bp, Homo sapiens
ttagtgtgacagtttcc

SEQ ID NO: 1167052 - DNA, 20 bp, Homo sapiens
ttagtgtgacagtttccaaa

SEQ ID NO: 1167053 - DNA, 15 bp, Homo sapiens
ttagtgtgtgtgcat

SEQ ID NO: 1167054 - DNA, 19 bp, Homo sapiens
ttagtgtgtgtgcatgtgt

SEQ ID NO: 1167055 - DNA, 16 bp, Homo sapiens
ttagtgttaaaaatct

SEQ ID NO: 1167056 - DNA, 15 bp, Homo sapiens
ttagttaatgagcca

SEQ ID NO: 1167057 - DNA, 20 bp, Homo sapiens
ttagttacgtataatgcttt

SEQ ID NO: 1167058 - DNA, 15 bp, Homo sapiens
ttagttactttagat

SEQ ID NO: 1167059 - DNA, 13 bp, Homo sapiens
ttagttataaaac

SEQ ID NO: 1167060 - DNA, 14 bp, Homo sapiens
ttagttatagtgtt

SEQ ID NO: 1167061 - DNA, 20 bp, Homo sapiens
ttagttatagtgtttaactg

SEQ ID NO: 1167062 - DNA, 12 bp, Homo sapiens
ttagttcaatac

SEQ ID NO: 1167063 - DNA, 13 bp, Homo sapiens
ttagttcaataca

SEQ ID NO: 1167064 - DNA, 15 bp, Homo sapiens
ttagttccactgaga

SEQ ID NO: 1167065 - DNA, 16 bp, Homo sapiens
ttagttccactgagac

SEQ ID NO: 1167066 - DNA, 15 bp, Homo sapiens
ttagttccagtttct

SEQ ID NO: 1167067 - DNA, 16 bp, Homo sapiens
ttagttcctcattagc

SEQ ID NO: 1167068 - DNA, 20 bp, Homo sapiens
ttagttccttactgtttaca

SEQ ID NO: 1167069 - DNA, 12 bp, Homo sapiens
ttagttctgttg

SEQ ID NO: 1167070 - DNA, 11 bp, Homo sapiens
ttagttcttga

SEQ ID NO: 1167071 - DNA, 19 bp, Homo sapiens
ttagttcttgaattgttat

SEQ ID NO: 1167072 - DNA, 17 bp, Homo sapiens
ttagttcttgggggagg

SEQ ID NO: 1167073 - DNA, 21 bp, Homo sapiens
ttagttgacaacctagaatgt

SEQ ID NO: 1167074 - DNA, 21 bp, Homo sapiens
ttagttgatattcaaggcttt

SEQ ID NO: 1167075 - DNA, 15 bp, Homo sapiens
ttagttgccaacagt

SEQ ID NO: 1167076 - DNA, 15 bp, Homo sapiens
ttagttgctgtatgt

SEQ ID NO: 1167077 - DNA, 18 bp, Homo sapiens
ttagttggacagtttaaa

SEQ ID NO: 1167078 - DNA, 22 bp, Homo sapiens
ttagtttcagtagattgcagaa

SEQ ID NO: 1167079 - DNA, 22 bp, Homo sapiens
ttagtttgcagttacactaaaa

SEQ ID NO: 1167080 - DNA, 14 bp, Homo sapiens
ttagtttgcattta

SEQ ID NO: 1167081 - DNA, 18 bp, Homo sapiens
ttagtttggattcttatg

SEQ ID NO: 1167082 - DNA, 20 bp, Homo sapiens
ttagttttacactaggaaac

SEQ ID NO: 1167083 - DNA, 23 bp, Homo sapiens
ttagttttacattttaaaatgtt

SEQ ID NO: 1167084 - DNA, 16 bp, Homo sapiens
ttagttttgatgagtt

SEQ ID NO: 1167085 - DNA, 21 bp, Homo sapiens
ttagttttgtaaaaactgaag

SEQ ID NO: 1167086 - DNA, 17 bp, Homo sapiens
ttagtttttcattaaat

SEQ ID NO: 1167087 - DNA, 18 bp, Homo sapiens
ttagtttttgtgaagttt

SEQ ID NO: 1167088 - DNA, 21 bp, Homo sapiens
ttagtttttgtgaagtttaat

SEQ ID NO: 1167089 - DNA, 18 bp, Homo sapiens
ttataaaaaatggttcag

SEQ ID NO: 1167090 - DNA, 13 bp, Homo sapiens
ttataaaaaatgt

SEQ ID NO: 1167091 - DNA, 14 bp, Homo sapiens
ttataaaaaatgta

SEQ ID NO: 1167092 - DNA, 18 bp, Homo sapiens
ttataaaaaatgtaacat

SEQ ID NO: 1167093 - DNA, 19 bp, Homo sapiens
ttataaaaaggtgttttga

SEQ ID NO: 1167094 - DNA, 13 bp, Homo sapiens
ttataaaacttct

SEQ ID NO: 1167095 - DNA, 21 bp, Homo sapiens
ttataaaagctcagatgacat

SEQ ID NO: 1167096 - DNA, 16 bp, Homo sapiens
ttataaaatggacaca

SEQ ID NO: 1167097 - DNA, 13 bp, Homo sapiens
ttataaaatggct

SEQ ID NO: 1167098 - DNA, 20 bp, Homo sapiens
ttataaaatggctgtaatca

SEQ ID NO: 1167099 - DNA, 13 bp, Homo sapiens
ttataaaatgtat

SEQ ID NO: 1167100 - DNA, 14 bp, Homo sapiens
ttataaactataaa

SEQ ID NO: 1167101 - DNA, 19 bp, Homo sapiens
ttataaactataaacttaa

SEQ ID NO: 1167102 - DNA, 13 bp, Homo sapiens
ttataaactttac

SEQ ID NO: 1167103 - DNA, 19 bp, Homo sapiens
ttataaatactgcaaatca

SEQ ID NO: 1167104 - DNA, 18 bp, Homo sapiens
ttataaatcttatgctct

SEQ ID NO: 1167105 - DNA, 15 bp, Homo sapiens
ttataaatgagcaaa

SEQ ID NO: 1167106 - DNA, 15 bp, Homo sapiens
ttataaatgtttgga

SEQ ID NO: 1167107 - DNA, 15 bp, Homo sapiens
ttataaattaaatat

SEQ ID NO: 1167108 - DNA, 22 bp, Homo sapiens
ttataacagcaaatgaaagact

SEQ ID NO: 1167109 - DNA, 16 bp, Homo sapiens
ttataacagttatatt

SEQ ID NO: 1167110 - DNA, 18 bp, Homo sapiens
ttataacatgttaaaatg

SEQ ID NO: 1167111 - DNA, 15 bp, Homo sapiens
ttataaccccagcct

SEQ ID NO: 1167112 - DNA, 16 bp, Homo sapiens
ttataaccttaattta

SEQ ID NO: 1167113 - DNA, 19 bp, Homo sapiens
ttataactaacatgtcctg

SEQ ID NO: 1167114 - DNA, 12 bp, Homo sapiens
ttataactagac

SEQ ID NO: 1167115 - DNA, 15 bp, Homo sapiens
ttataactagacatc

SEQ ID NO: 1167116 - DNA, 18 bp, Homo sapiens
ttataactcatcataaaa

SEQ ID NO: 1167117 - DNA, 19 bp, Homo sapiens
ttataactcatcataaaat

SEQ ID NO: 1167118 - DNA, 14 bp, Homo sapiens
ttataactctaggg

SEQ ID NO: 1167119 - DNA, 21 bp, Homo sapiens
ttataactctagggatataaa

SEQ ID NO: 1167120 - DNA, 19 bp, Homo sapiens
ttataactgttttagaaat

SEQ ID NO: 1167121 - DNA, 20 bp, Homo sapiens
ttataactgttttagaaatt

SEQ ID NO: 1167122 - DNA, 15 bp, Homo sapiens
ttataacttaaaaaa

SEQ ID NO: 1167123 - DNA, 14 bp, Homo sapiens
ttataagggagagc

SEQ ID NO: 1167124 - DNA, 20 bp, Homo sapiens
ttataagggccctgccctgt

SEQ ID NO: 1167125 - DNA, 17 bp, Homo sapiens
ttataagtgaagtgata

SEQ ID NO: 1167126 - DNA, 15 bp, Homo sapiens
ttataataactgaac

SEQ ID NO: 1167127 - DNA, 17 bp, Homo sapiens
ttataataactgaactg

SEQ ID NO: 1167128 - DNA, 19 bp, Homo sapiens
ttataataactgaactgtt

SEQ ID NO: 1167129 - DNA, 19 bp, Homo sapiens
ttataataagcaaaaagat

SEQ ID NO: 1167130 - DNA, 15 bp, Homo sapiens
ttataataatgttaa

SEQ ID NO: 1167131 - DNA, 19 bp, Homo sapiens
ttataatactaaaactcag

SEQ ID NO: 1167132 - DNA, 16 bp, Homo sapiens
ttataatcagaatgga

SEQ ID NO: 1167133 - DNA, 16 bp, Homo sapiens
ttataatccttaaatc

SEQ ID NO: 1167134 - DNA, 15 bp, Homo sapiens
ttataatctcaaagg

SEQ ID NO: 1167135 - DNA, 15 bp, Homo sapiens
ttataatgaatgaaa

SEQ ID NO: 1167136 - DNA, 19 bp, Homo sapiens
ttataatgaggatgattat

SEQ ID NO: 1167137 - DNA, 11 bp, Homo sapiens
ttataatgtgt

SEQ ID NO: 1167138 - DNA, 15 bp, Homo sapiens
ttataatgtgtgttg

SEQ ID NO: 1167139 - DNA, 11 bp, Homo sapiens
ttataattcag

SEQ ID NO: 1167140 - DNA, 21 bp, Homo sapiens
ttataattggtgctatttgaa

SEQ ID NO: 1167141 - DNA, 22 bp, Homo sapiens
ttataattggtgctatttgaag

SEQ ID NO: 1167142 - DNA, 14 bp, Homo sapiens
ttataatttaaatg

SEQ ID NO: 1167143 - DNA, 17 bp, Homo sapiens
ttataatttaaatgata

SEQ ID NO: 1167144 - DNA, 21 bp, Homo sapiens
ttataatttttttattactga

SEQ ID NO: 1167145 - DNA, 16 bp, Homo sapiens
ttataatttttttcaa

SEQ ID NO: 1167146 - DNA, 17 bp, Homo sapiens
ttatacaataacccagt

SEQ ID NO: 1167147 - DNA, 17 bp, Homo sapiens
ttatacacaactttgca

SEQ ID NO: 1167148 - DNA, 13 bp, Homo sapiens
ttatacactgtgt

SEQ ID NO: 1167149 - DNA, 23 bp, Homo sapiens
ttatacacttctggctcacagga

SEQ ID NO: 1167150 - DNA, 22 bp, Homo sapiens
ttatacagatagagttccatat

SEQ ID NO: 1167151 - DNA, 21 bp, Homo sapiens
ttatacagctgtattgtctga

SEQ ID NO: 1167152 - DNA, 17 bp, Homo sapiens
ttatacagttataaaat

SEQ ID NO: 1167153 - DNA, 17 bp, Homo sapiens
ttatacccccaggaaac

SEQ ID NO: 1167154 - DNA, 15 bp, Homo sapiens
ttatacggaaaaaat

SEQ ID NO: 1167155 - DNA, 23 bp, Homo sapiens
ttatactactttgttaggatttt

SEQ ID NO: 1167156 - DNA, 22 bp, Homo sapiens
ttatactctagaacatgcacat

SEQ ID NO: 1167157 - DNA, 18 bp, Homo sapiens
ttatactgagcttttgag

SEQ ID NO: 1167158 - DNA, 17 bp, Homo sapiens
ttatactgtacaataaa

SEQ ID NO: 1167159 - DNA, 14 bp, Homo sapiens
ttatactgtacatg

SEQ ID NO: 1167160 - DNA, 22 bp, Homo sapiens
ttatactgtacttaataaattc

SEQ ID NO: 1167161 - DNA, 17 bp, Homo sapiens
ttatactgtatttctaa

SEQ ID NO: 1167162 - DNA, 20 bp, Homo sapiens
ttatactgtatttctaagaa

SEQ ID NO: 1167163 - DNA, 12 bp, Homo sapiens
ttatagaaaatt

SEQ ID NO: 1167164 - DNA, 18 bp, Homo sapiens
ttatagaaacaatactgt

SEQ ID NO: 1167165 - DNA, 12 bp, Homo sapiens
ttatagaataaa

SEQ ID NO: 1167166 - DNA, 17 bp, Homo sapiens
ttatagattgtcttaat

SEQ ID NO: 1167167 - DNA, 19 bp, Homo sapiens
ttatagcaactaatgtttg

SEQ ID NO: 1167168 - DNA, 22 bp, Homo sapiens
ttatagccacatccctttgaaa

SEQ ID NO: 1167169 - DNA, 21 bp, Homo sapiens
ttataggagagattgggagaa

SEQ ID NO: 1167170 - DNA, 16 bp, Homo sapiens
ttataggatcatttgt

SEQ ID NO: 1167171 - DNA, 18 bp, Homo sapiens
ttataggatttatttaaa

SEQ ID NO: 1167172 - DNA, 23 bp, Homo sapiens
ttataggccagggcatgtgtatg

SEQ ID NO: 1167173 - DNA, 15 bp, Homo sapiens
ttataggcgtttttt

SEQ ID NO: 1167174 - DNA, 15 bp, Homo sapiens
ttataggtaacgtga

SEQ ID NO: 1167175 - DNA, 14 bp, Homo sapiens
ttataggtgagaaa

SEQ ID NO: 1167176 - DNA, 18 bp, Homo sapiens
ttataggtgagaaaaaaa

SEQ ID NO: 1167177 - DNA, 22 bp, Homo sapiens
ttataggtgttggttttggggg

SEQ ID NO: 1167178 - DNA, 15 bp, Homo sapiens
ttatagtatgtgact

SEQ ID NO: 1167179 - DNA, 13 bp, Homo sapiens
ttatagttactgt

SEQ ID NO: 1167180 - DNA, 14 bp, Homo sapiens
ttatagttactgtg

SEQ ID NO: 1167181 - DNA, 15 bp, Homo sapiens
ttatagtttgtacat

SEQ ID NO: 1167182 - DNA, 16 bp, Homo sapiens
ttatagtttgtacatg

SEQ ID NO: 1167183 - DNA, 14 bp, Homo sapiens
ttatataaagtatt

SEQ ID NO: 1167184 - DNA, 22 bp, Homo sapiens
ttatataaatatatatttttca

SEQ ID NO: 1167185 - DNA, 15 bp, Homo sapiens
ttatataactctttg

SEQ ID NO: 1167186 - DNA, 12 bp, Homo sapiens
ttatataactgt

SEQ ID NO: 1167187 - DNA, 18 bp, Homo sapiens
ttatataactgtatttga

SEQ ID NO: 1167188 - DNA, 12 bp, Homo sapiens
ttatataattgt

SEQ ID NO: 1167189 - DNA, 16 bp, Homo sapiens
ttatataattgttgaa

SEQ ID NO: 1167190 - DNA, 16 bp, Homo sapiens
ttatatagtctacagt

SEQ ID NO: 1167191 - DNA, 14 bp, Homo sapiens
ttatatatatatgt

SEQ ID NO: 1167192 - DNA, 15 bp, Homo sapiens
ttatatatatatgta

SEQ ID NO: 1167193 - DNA, 14 bp, Homo sapiens
ttatatatggacat

SEQ ID NO: 1167194 - DNA, 15 bp, Homo sapiens
ttatatatggcatat

SEQ ID NO: 1167195 - DNA, 15 bp, Homo sapiens
ttatatattgaaagt

SEQ ID NO: 1167196 - DNA, 14 bp, Homo sapiens
ttatatatttataa

SEQ ID NO: 1167197 - DNA, 19 bp, Homo sapiens
ttatatatttctaactata

SEQ ID NO: 1167198 - DNA, 20 bp, Homo sapiens
ttatatatttttctgagatt

SEQ ID NO: 1167199 - DNA, 16 bp, Homo sapiens
ttatatcagcctgagt

SEQ ID NO: 1167200 - DNA, 14 bp, Homo sapiens
ttatatcatacagt

SEQ ID NO: 1167201 - DNA, 16 bp, Homo sapiens
ttatatcatgcaaaat

SEQ ID NO: 1167202 - DNA, 18 bp, Homo sapiens
ttatatccccctaaacta

SEQ ID NO: 1167203 - DNA, 14 bp, Homo sapiens
ttatatcttgttta

SEQ ID NO: 1167204 - DNA, 19 bp, Homo sapiens
ttatatcttgtttacaata

SEQ ID NO: 1167205 - DNA, 21 bp, Homo sapiens
ttatatcttgtttacaataaa

SEQ ID NO: 1167206 - DNA, 14 bp, Homo sapiens
ttatatcttttggt

SEQ ID NO: 1167207 - DNA, 13 bp, Homo sapiens
ttatatgaaataa

SEQ ID NO: 1167208 - DNA, 16 bp, Homo sapiens
ttatatgaagataagt

SEQ ID NO: 1167209 - DNA, 16 bp, Homo sapiens
ttatatgaagtttaaa

SEQ ID NO: 1167210 - DNA, 20 bp, Homo sapiens
ttatatgactaatataactt

SEQ ID NO: 1167211 - DNA, 20 bp, Homo sapiens
ttatatgccaagctaattta

SEQ ID NO: 1167212 - DNA, 13 bp, Homo sapiens
ttatatgcttact

SEQ ID NO: 1167213 - DNA, 20 bp, Homo sapiens
ttatatggatgattcagaaa

SEQ ID NO: 1167214 - DNA, 22 bp, Homo sapiens
ttatatggccctgcacagacct

SEQ ID NO: 1167215 - DNA, 13 bp, Homo sapiens
ttatatgtaaatg

SEQ ID NO: 1167216 - DNA, 14 bp, Homo sapiens
ttatatgtaaatgt

SEQ ID NO: 1167217 - DNA, 16 bp, Homo sapiens
ttatatgtacatgaga

SEQ ID NO: 1167218 - DNA, 14 bp, Homo sapiens
ttatatgtaccgta

SEQ ID NO: 1167219 - DNA, 16 bp, Homo sapiens
ttatatgtaccgtagg

SEQ ID NO: 1167220 - DNA, 14 bp, Homo sapiens
ttatattacttttg

SEQ ID NO: 1167221 - DNA, 13 bp, Homo sapiens
ttatattccaagg

SEQ ID NO: 1167222 - DNA, 15 bp, Homo sapiens
ttatattccaaggaa

SEQ ID NO: 1167223 - DNA, 16 bp, Homo sapiens
ttatattccaaggaaa

SEQ ID NO: 1167224 - DNA, 21 bp, Homo sapiens
ttatattccaaggaaaattga

SEQ ID NO: 1167225 - DNA, 17 bp, Homo sapiens
ttatattgaatatatca

SEQ ID NO: 1167226 - DNA, 17 bp, Homo sapiens
ttatattgtatattctg

SEQ ID NO: 1167227 - DNA, 17 bp, Homo sapiens
ttatatttagttatagt

SEQ ID NO: 1167228 - DNA, 22 bp, Homo sapiens
ttatatttagttatagtttcag

SEQ ID NO: 1167229 - DNA, 17 bp, Homo sapiens
ttatatttattgttaga

SEQ ID NO: 1167230 - DNA, 16 bp, Homo sapiens
ttatatttcctgtatt

SEQ ID NO: 1167231 - DNA, 20 bp, Homo sapiens
ttatatttcctttatgtgaa

SEQ ID NO: 1167232 - DNA, 14 bp, Homo sapiens
ttatatttgacatg

SEQ ID NO: 1167233 - DNA, 14 bp, Homo sapiens
ttatatttgcatta

SEQ ID NO: 1167234 - DNA, 15 bp, Homo sapiens
ttatatttgtaggag

SEQ ID NO: 1167235 - DNA, 17 bp, Homo sapiens
ttatattttatgaacat

SEQ ID NO: 1167236 - DNA, 21 bp, Homo sapiens
ttatattttatgaacattgta

SEQ ID NO: 1167237 - DNA, 18 bp, Homo sapiens
ttatattttcagcaaaga

SEQ ID NO: 1167238 - DNA, 24 bp, Homo sapiens
ttatattttctatttctctgtgta

SEQ ID NO: 1167239 - DNA, 19 bp, Homo sapiens
ttatatttttgtacatatt

SEQ ID NO: 1167240 - DNA, 16 bp, Homo sapiens
ttatattttttcagtt

SEQ ID NO: 1167241 - DNA, 21 bp, Homo sapiens
ttatcaaaaaaagactcagcc

SEQ ID NO: 1167242 - DNA, 12 bp, Homo sapiens
ttatcaaaaagc

SEQ ID NO: 1167243 - DNA, 22 bp, Homo sapiens
ttatcaaaaagtattatcattg

SEQ ID NO: 1167244 - DNA, 16 bp, Homo sapiens
ttatcaaaatgtagct

SEQ ID NO: 1167245 - DNA, 15 bp, Homo sapiens
ttatcaagtgtcttc

SEQ ID NO: 1167246 - DNA, 17 bp, Homo sapiens
ttatcaagtgtcttcca

SEQ ID NO: 1167247 - DNA, 22 bp, Homo sapiens
ttatcaatatctaatatatatg

SEQ ID NO: 1167248 - DNA, 19 bp, Homo sapiens
ttatcaattacaacagtga

SEQ ID NO: 1167249 - DNA, 14 bp, Homo sapiens
ttatcaattatatt

SEQ ID NO: 1167250 - DNA, 17 bp, Homo sapiens
ttatcaattatattatg

SEQ ID NO: 1167251 - DNA, 20 bp, Homo sapiens
ttatcaattatattatgttt

SEQ ID NO: 1167252 - DNA, 21 bp, Homo sapiens
ttatcaatttttcccagtatt

SEQ ID NO: 1167253 - DNA, 22 bp, Homo sapiens
ttatcaatttttcccagtattt

SEQ ID NO: 1167254 - DNA, 22 bp, Homo sapiens
ttatcacagaaataaaatatct

SEQ ID NO: 1167255 - DNA, 12 bp, Homo sapiens
ttatcacatcaa

SEQ ID NO: 1167256 - DNA, 22 bp, Homo sapiens
ttatcacatcaagcatgcaata

SEQ ID NO: 1167257 - DNA, 22 bp, Homo sapiens
ttatcaccacagtaagttccta

SEQ ID NO: 1167258 - DNA, 19 bp, Homo sapiens
ttatcaccagctgcctctt

SEQ ID NO: 1167259 - DNA, 17 bp, Homo sapiens
ttatcacccagaagaaa

SEQ ID NO: 1167260 - DNA, 18 bp, Homo sapiens
ttatcacccagaagaaaa

SEQ ID NO: 1167261 - DNA, 22 bp, Homo sapiens
ttatcaccctaattaatagaat

SEQ ID NO: 1167262 - DNA, 22 bp, Homo sapiens
ttatcacctaagcacttctaga

SEQ ID NO: 1167263 - DNA, 14 bp, Homo sapiens
ttatcagatacatc

SEQ ID NO: 1167264 - DNA, 14 bp, Homo sapiens
ttatcagcaaaaaa

SEQ ID NO: 1167265 - DNA, 14 bp, Homo sapiens
ttatcagcaaagaa

SEQ ID NO: 1167266 - DNA, 16 bp, Homo sapiens
ttatcagtaaataact

SEQ ID NO: 1167267 - DNA, 20 bp, Homo sapiens
ttatcagtaagaaaaagaag

SEQ ID NO: 1167268 - DNA, 15 bp, Homo sapiens
ttatcagtcaatatt

SEQ ID NO: 1167269 - DNA, 23 bp, Homo sapiens
ttatcagtcaatatttttagata

SEQ ID NO: 1167270 - DNA, 16 bp, Homo sapiens
ttatcagtgacagagt

SEQ ID NO: 1167271 - DNA, 20 bp, Homo sapiens
ttatcagtttgctaatgttt

SEQ ID NO: 1167272 - DNA, 16 bp, Homo sapiens
ttatcatactgagact

SEQ ID NO: 1167273 - DNA, 14 bp, Homo sapiens
ttatcatgaatttt

SEQ ID NO: 1167274 - DNA, 17 bp, Homo sapiens
ttatcattaaaaattac

SEQ ID NO: 1167275 - DNA, 18 bp, Homo sapiens
ttactgtttctcaagtgt

SEQ ID NO: 1167276 - DNA, 21 bp, Homo sapiens
ttactgtttctcaagtgtttt

SEQ ID NO: 1167277 - DNA, 15 bp, Homo sapiens
ttactgtttgttatg

SEQ ID NO: 1167278 - DNA, 13 bp, Homo sapiens
ttactgtttttga

SEQ ID NO: 1167279 - DNA, 19 bp, Homo sapiens
ttacttaggttattttgct

SEQ ID NO: 1167280 - DNA, 21 bp, Homo sapiens
ttacttcactatacaaacaaa

SEQ ID NO: 1167281 - DNA, 22 bp, Homo sapiens
ttacttcaggggaagagaagac

SEQ ID NO: 1167282 - DNA, 11 bp, Homo sapiens
ttacttcatat

SEQ ID NO: 1167283 - DNA, 18 bp, Homo sapiens
ttacttccagcaagcaaa

SEQ ID NO: 1167284 - DNA, 14 bp, Homo sapiens
ttacttccatgaat

SEQ ID NO: 1167285 - DNA, 18 bp, Homo sapiens
ttacttcctggcctcttc

SEQ ID NO: 1167286 - DNA, 16 bp, Homo sapiens
ttacttgaatttcaaa

SEQ ID NO: 1167287 - DNA, 13 bp, Homo sapiens
ttacttgcttcag

SEQ ID NO: 1167288 - DNA, 14 bp, Homo sapiens
ttacttgcttctct

SEQ ID NO: 1167289 - DNA, 15 bp, Homo sapiens
ttacttgtggtgtga

SEQ ID NO: 1167290 - DNA, 23 bp, Homo sapiens
ttacttgttttcggggagaaata

SEQ ID NO: 1167291 - DNA, 13 bp, Homo sapiens
ttactttaaagta

SEQ ID NO: 1167292 - DNA, 20 bp, Homo sapiens
ttactttactgcctgaataa

SEQ ID NO: 1167293 - DNA, 23 bp, Homo sapiens
ttactttcccttgcttttccctc

SEQ ID NO: 1167294 - DNA, 14 bp, Homo sapiens
ttactttctgccgc

SEQ ID NO: 1167295 - DNA, 21 bp, Homo sapiens
ttactttggggctaatttaac

SEQ ID NO: 1167296 - DNA, 14 bp, Homo sapiens
ttacttttaaactg

SEQ ID NO: 1167297 - DNA, 15 bp, Homo sapiens
ttacttttaaactgt

SEQ ID NO: 1167298 - DNA, 23 bp, Homo sapiens
ttacttttataataaaaggaaaa

SEQ ID NO: 1167299 - DNA, 16 bp, Homo sapiens
ttacttttcacactgt

SEQ ID NO: 1167300 - DNA, 21 bp, Homo sapiens
ttacttttcacactgtcttcc

SEQ ID NO: 1167301 - DNA, 18 bp, Homo sapiens
ttacttttcctcttagaa

SEQ ID NO: 1167302 - DNA, 21 bp, Homo sapiens
ttacttttgcaaactgtcctc

SEQ ID NO: 1167303 - DNA, 18 bp, Homo sapiens
ttactttttcttgtattc

SEQ ID NO: 1167304 - DNA, 16 bp, Homo sapiens
ttactttttggctgga

SEQ ID NO: 1167305 - DNA, 15 bp, Homo sapiens
ttagaaaaaaattac

SEQ ID NO: 1167306 - DNA, 21 bp, Homo sapiens
ttagaaaaacatttaaacttt

SEQ ID NO: 1167307 - DNA, 23 bp, Homo sapiens
ttagaaaagggagtttaaaaatg

SEQ ID NO: 1167308 - DNA, 14 bp, Homo sapiens
ttagaaaatgactt

SEQ ID NO: 1167309 - DNA, 20 bp, Homo sapiens
ttagaaaatgacttatttct

SEQ ID NO: 1167310 - DNA, 19 bp, Homo sapiens
ttagaaaatgttatttaac

SEQ ID NO: 1167311 - DNA, 16 bp, Homo sapiens
ttagaaacaccattca

SEQ ID NO: 1167312 - DNA, 16 bp, Homo sapiens
ttagaaactacaaata

SEQ ID NO: 1167313 - DNA, 19 bp, Homo sapiens
ttagaaactacaaatatag

SEQ ID NO: 1167314 - DNA, 13 bp, Homo sapiens
ttagaaaggacaa

SEQ ID NO: 1167315 - DNA, 23 bp, Homo sapiens
ttagaaaggacaacagttctgag

SEQ ID NO: 1167316 - DNA, 19 bp, Homo sapiens
ttagaaataaatgtacctg

SEQ ID NO: 1167317 - DNA, 16 bp, Homo sapiens
ttagaaataacagaag

SEQ ID NO: 1167318 - DNA, 13 bp, Homo sapiens
ttagaaatagaca

SEQ ID NO: 1167319 - DNA, 12 bp, Homo sapiens
ttagaaatataa

SEQ ID NO: 1167320 - DNA, 14 bp, Homo sapiens
ttagaaatataatt

SEQ ID NO: 1167321 - DNA, 18 bp, Homo sapiens
ttagaaatgaccaatatt

SEQ ID NO: 1167322 - DNA, 16 bp, Homo sapiens
ttagaaatgcagaatc

SEQ ID NO: 1167323 - DNA, 23 bp, Homo sapiens
ttagaaattacctgtggatattt

SEQ ID NO: 1167324 - DNA, 12 bp, Homo sapiens
ttagaaattggt

SEQ ID NO: 1167325 - DNA, 20 bp, Homo sapiens
ttagaacattcacttttgtt

SEQ ID NO: 1167326 - DNA, 12 bp, Homo sapiens
ttagaacatttt

SEQ ID NO: 1167327 - DNA, 20 bp, Homo sapiens
ttagaagcaaagatttcagt

SEQ ID NO: 1167328 - DNA, 21 bp, Homo sapiens
ttagaagccatctgacagcag

SEQ ID NO: 1167329 - DNA, 23 bp, Homo sapiens
ttagaagcctgcataatgtttct

SEQ ID NO: 1167330 - DNA, 19 bp, Homo sapiens
ttagaaggcttaagaactg

SEQ ID NO: 1167331 - DNA, 20 bp, Homo sapiens
ttagaaggcttaagaactgc

SEQ ID NO: 1167332 - DNA, 18 bp, Homo sapiens
ttagaatcaaacattttg

SEQ ID NO: 1167333 - DNA, 12 bp, Homo sapiens
ttattgcatttg

SEQ ID NO: 1167334 - DNA, 14 bp, Homo sapiens
ttattgctattaaa

SEQ ID NO: 1167335 - DNA, 14 bp, Homo sapiens
ttattgctgccaaa

SEQ ID NO: 1167336 - DNA, 20 bp, Homo sapiens
ttattggaaatgtacttttg

SEQ ID NO: 1167337 - DNA, 18 bp, Homo sapiens
ttattggcagccaaggaa

SEQ ID NO: 1167338 - DNA, 19 bp, Homo sapiens
ttattggcagccaaggaat

SEQ ID NO: 1167339 - DNA, 16 bp, Homo sapiens
ttattggctgagatat

SEQ ID NO: 1167340 - DNA, 17 bp, Homo sapiens
ttattgggctcttttag

SEQ ID NO: 1167341 - DNA, 20 bp, Homo sapiens
ttattggttggtgtgaagaa

SEQ ID NO: 1167342 - DNA, 20 bp, Homo sapiens
ttattggttttccaatcatt

SEQ ID NO: 1167343 - DNA, 14 bp, Homo sapiens
ttattgtaaacttt

SEQ ID NO: 1167344 - DNA, 15 bp, Homo sapiens
ttattgtaaactttt

SEQ ID NO: 1167345 - DNA, 14 bp, Homo sapiens
ttattgtacctctc

SEQ ID NO: 1167346 - DNA, 15 bp, Homo sapiens
ttattgtacctctct

SEQ ID NO: 1167347 - DNA, 14 bp, Homo sapiens
ttattgtagacatg

SEQ ID NO: 1167348 - DNA, 14 bp, Homo sapiens
ttattgtataaact

SEQ ID NO: 1167349 - DNA, 13 bp, Homo sapiens
ttattgtcagttt

SEQ ID NO: 1167350 - DNA, 14 bp, Homo sapiens
ttattgtcagtttt

SEQ ID NO: 1167351 - DNA, 14 bp, Homo sapiens
ttattgtctgtaaa

SEQ ID NO: 1167352 - DNA, 22 bp, Homo sapiens
ttattgtgaatgattcatgtta

SEQ ID NO: 1167353 - DNA, 17 bp, Homo sapiens
ttattgttaaattacat

SEQ ID NO: 1167354 - DNA, 13 bp, Homo sapiens
ttattgttccaag

SEQ ID NO: 1167355 - DNA, 16 bp, Homo sapiens
ttattgttccaagaca

SEQ ID NO: 1167356 - DNA, 21 bp, Homo sapiens
ttattgttcccctaagtggat

SEQ ID NO: 1167357 - DNA, 14 bp, Homo sapiens
ttattgttgaacat

SEQ ID NO: 1167358 - DNA, 17 bp, Homo sapiens
ttatttaaaaaactaaa

SEQ ID NO: 1167359 - DNA, 13 bp, Homo sapiens
ttatttaaaactc

SEQ ID NO: 1167360 - DNA, 16 bp, Homo sapiens
ttatttaaaactctgg

SEQ ID NO: 1167361 - DNA, 18 bp, Homo sapiens
ttatttaaaactctggtg

SEQ ID NO: 1167362 - DNA, 23 bp, Homo sapiens
ttatttaaaccgctaaaagaaac

SEQ ID NO: 1167363 - DNA, 14 bp, Homo sapiens
ttatttaaagaaag

SEQ ID NO: 1167364 - DNA, 19 bp, Homo sapiens
ttatttaaagaaagtgaaa

SEQ ID NO: 1167365 - DNA, 15 bp, Homo sapiens
ttatttaaataaaat

SEQ ID NO: 1167366 - DNA, 18 bp, Homo sapiens
ttatttaaataaaatcac

SEQ ID NO: 1167367 - DNA, 19 bp, Homo sapiens
ttatttaaataaaatcacc

SEQ ID NO: 1167368 - DNA, 14 bp, Homo sapiens
ttatttaaatgcat

SEQ ID NO: 1167369 - DNA, 20 bp, Homo sapiens
ttatttaacaaaaaatgtaa

SEQ ID NO: 1167370 - DNA, 23 bp, Homo sapiens
ttatttaacagctgaattatcta

SEQ ID NO: 1167371 - DNA, 14 bp, Homo sapiens
ttatttaagactaa

SEQ ID NO: 1167372 - DNA, 15 bp, Homo sapiens
ttatttaatgtgagt

SEQ ID NO: 1167373 - DNA, 13 bp, Homo sapiens
ttatttaatgttt

SEQ ID NO: 1167374 - DNA, 18 bp, Homo sapiens
ttatttaattaaatgtat

SEQ ID NO: 1167375 - DNA, 19 bp, Homo sapiens
ttatttaattaaatgtatt

SEQ ID NO: 1167376 - DNA, 13 bp, Homo sapiens
ttatttaatttgt

SEQ ID NO: 1167377 - DNA, 21 bp, Homo sapiens
ttatttacatcactttgtgaa

SEQ ID NO: 1167378 - DNA, 22 bp, Homo sapiens
ttatttacatcactttgtgaat

SEQ ID NO: 1167379 - DNA, 24 bp, Homo sapiens
ttatttacatcactttgtgaatta

SEQ ID NO: 1167380 - DNA, 17 bp, Homo sapiens
ttatttactaattttct

SEQ ID NO: 1167381 - DNA, 21 bp, Homo sapiens
ttatttactcctcctgctcct

SEQ ID NO: 1167382 - DNA, 15 bp, Homo sapiens
ttatttagacaagag

SEQ ID NO: 1167383 - DNA, 16 bp, Homo sapiens
ttatttagacaagaga

SEQ ID NO: 1167384 - DNA, 18 bp, Homo sapiens
ttatttagacaagagatg

SEQ ID NO: 1167385 - DNA, 23 bp, Homo sapiens
ttatttagactcatcttactgta

SEQ ID NO: 1167386 - DNA, 17 bp, Homo sapiens
ttatttagggaactgct

SEQ ID NO: 1167387 - DNA, 16 bp, Homo sapiens
ttatttagtaaagttt

SEQ ID NO: 1167388 - DNA, 19 bp, Homo sapiens
ttatttagtaaagtttgtt

SEQ ID NO: 1167389 - DNA, 22 bp, Homo sapiens
ttatttagttgaaaaatctagt

SEQ ID NO: 1167390 - DNA, 16 bp, Homo sapiens
ttatttatatcttgtt

SEQ ID NO: 1167391 - DNA, 21 bp, Homo sapiens
ttatttatcaatttttcccag

SEQ ID NO: 1167392 - DNA, 14 bp, Homo sapiens
ttatttatcagtga

SEQ ID NO: 1167393 - DNA, 22 bp, Homo sapiens
ttatttatgcgtaatttaatgg

SEQ ID NO: 1167394 - DNA, 14 bp, Homo sapiens
ttatttatggtttc

SEQ ID NO: 1167395 - DNA, 15 bp, Homo sapiens
ttatttattaagatg

SEQ ID NO: 1167396 - DNA, 15 bp, Homo sapiens
ttatttattactgtc

SEQ ID NO: 1167397 - DNA, 15 bp, Homo sapiens
ttatttattattaat

SEQ ID NO: 1167398 - DNA, 13 bp, Homo sapiens
ttatttattcact

SEQ ID NO: 1167399 - DNA, 21 bp, Homo sapiens
ttatttattgttaaattacat

SEQ ID NO: 1167400 - DNA, 13 bp, Homo sapiens
ttatttatttcct

SEQ ID NO: 1167401 - DNA, 16 bp, Homo sapiens
ttatttcaatgtaatt

SEQ ID NO: 1167402 - DNA, 18 bp, Homo sapiens
ttatttcaatgtaattaa

SEQ ID NO: 1167403 - DNA, 24 bp, Homo sapiens
ttatttcaatgtaattaaactgtt

SEQ ID NO: 1167404 - DNA, 17 bp, Homo sapiens
ttatttcagtgtgcata

SEQ ID NO: 1167405 - DNA, 19 bp, Homo sapiens
ttatttccaaataaaatga

SEQ ID NO: 1167406 - DNA, 19 bp, Homo sapiens
ttatttccactattttcaa

SEQ ID NO: 1167407 - DNA, 20 bp, Homo sapiens
ttatttccctatggctgagc

SEQ ID NO: 1167408 - DNA, 13 bp, Homo sapiens
ttatttcctgcta

SEQ ID NO: 1167409 - DNA, 16 bp, Homo sapiens
ttatttctaagtattt

SEQ ID NO: 1167410 - DNA, 19 bp, Homo sapiens
ttatttctaagtatttaaa

SEQ ID NO: 1167411 - DNA, 19 bp, Homo sapiens
ttatttctagttctttcct

SEQ ID NO: 1167412 - DNA, 12 bp, Homo sapiens
ttatttctatga

SEQ ID NO: 1167413 - DNA, 14 bp, Homo sapiens
ttatttctctctcc

SEQ ID NO: 1167414 - DNA, 17 bp, Homo sapiens
ttatttctctctcctgg

SEQ ID NO: 1167415 - DNA, 19 bp, Homo sapiens
ttatttctgctctggaata

SEQ ID NO: 1167416 - DNA, 11 bp, Homo sapiens
ttatttctgtt

SEQ ID NO: 1167417 - DNA, 16 bp, Homo sapiens
ttatttgagaaaatat

SEQ ID NO: 1167418 - DNA, 13 bp, Homo sapiens
ttatttgcatgtg

SEQ ID NO: 1167419 - DNA, 21 bp, Homo sapiens
ttatttgcatgttatgtttaa

SEQ ID NO: 1167420 - DNA, 16 bp, Homo sapiens
ttatttgccagagcca

SEQ ID NO: 1167421 - DNA, 13 bp, Homo sapiens
ttatttggaaatt

SEQ ID NO: 1167422 - DNA, 18 bp, Homo sapiens
ttatttggaaattttagt

SEQ ID NO: 1167423 - DNA, 18 bp, Homo sapiens
ttatttggaaccttgttt

SEQ ID NO: 1167424 - DNA, 15 bp, Homo sapiens
ttatttgtaaattta

SEQ ID NO: 1167425 - DNA, 16 bp, Homo sapiens
ttatttgtctgtaaaa

SEQ ID NO: 1167426 - DNA, 23 bp, Homo sapiens
ttatttgtctgtaaaaaatggag

SEQ ID NO: 1167427 - DNA, 16 bp, Homo sapiens
ttatttgtcttaaaaa

SEQ ID NO: 1167428 - DNA, 21 bp, Homo sapiens
ttatttgtgtaatagaaaact

SEQ ID NO: 1167429 - DNA, 16 bp, Homo sapiens
ttattttaaaatttca

SEQ ID NO: 1167430 - DNA, 14 bp, Homo sapiens
ttattttgctccct

SEQ ID NO: 1167431 - DNA, 17 bp, Homo sapiens
ttattttgctccctctg

SEQ ID NO: 1167432 - DNA, 11 bp, Homo sapiens
ttattttgctg

SEQ ID NO: 1167433 - DNA, 18 bp, Homo sapiens
ttattttggtacttttat

SEQ ID NO: 1167434 - DNA, 16 bp, Homo sapiens
ttatttttaaaaagaa

SEQ ID NO: 1167435 - DNA, 20 bp, Homo sapiens
ttatttttaagaaaaattca

SEQ ID NO: 1167436 - DNA, 14 bp, Homo sapiens
ttatttttagccat

SEQ ID NO: 1167437 - DNA, 14 bp, Homo sapiens
ttatttttataatt

SEQ ID NO: 1167438 - DNA, 14 bp, Homo sapiens
ttatttttcatatt

SEQ ID NO: 1167439 - DNA, 14 bp, Homo sapiens
ttatttttctaaaa

SEQ ID NO: 1167440 - DNA, 16 bp, Homo sapiens
ttatttttcttttcct

SEQ ID NO: 1167441 - DNA, 21 bp, Homo sapiens
ttatttttgcaaaataagttt

SEQ ID NO: 1167442 - DNA, 22 bp, Homo sapiens
ttatttttgggtttggccaggg

SEQ ID NO: 1167443 - DNA, 23 bp, Homo sapiens
ttatttttgggtttggccaggga

SEQ ID NO: 1167444 - DNA, 18 bp, Homo sapiens
ttatttttgtatgccttt

SEQ ID NO: 1167445 - DNA, 23 bp, Homo sapiens
ttatttttgtttcttccaaagca

SEQ ID NO: 1167446 - DNA, 14 bp, Homo sapiens
ttattttttaatta

SEQ ID NO: 1167447 - DNA, 14 bp, Homo sapiens
ttattttttacatt

SEQ ID NO: 1167448 - DNA, 13 bp, Homo sapiens
ttattttttccca

SEQ ID NO: 1167449 - DNA, 14 bp, Homo sapiens
ttattttttctaca

SEQ ID NO: 1167450 - DNA, 18 bp, Homo sapiens
ttattttttctacacagt

SEQ ID NO: 1167451 - DNA, 20 bp, Homo sapiens
ttattttttctacacagtaa

SEQ ID NO: 1167452 - DNA, 15 bp, Homo sapiens
ttattttttctatga

SEQ ID NO: 1167453 - DNA, 15 bp, Homo sapiens
ttattttttgggcca

SEQ ID NO: 1167454 - DNA, 16 bp, Homo sapiens
ttcaaaaacatttcat

SEQ ID NO: 1167455 - DNA, 18 bp, Homo sapiens
ttcaaaacattgtgccat

SEQ ID NO: 1167456 - DNA, 22 bp, Homo sapiens
ttcaaaacctgcagttaacagg

SEQ ID NO: 1167457 - DNA, 12 bp, Homo sapiens
ttcaaaagaaag

SEQ ID NO: 1167458 - DNA, 13 bp, Homo sapiens
ttcaaaagaaagt

SEQ ID NO: 1167459 - DNA, 16 bp, Homo sapiens
ttcaaaagaagagttt

SEQ ID NO: 1167460 - DNA, 15 bp, Homo sapiens
ttcaaaagataatat

SEQ ID NO: 1167461 - DNA, 23 bp, Homo sapiens
ttcaaaagcaaaacatctctgca

SEQ ID NO: 1167462 - DNA, 21 bp, Homo sapiens
ttcaaaagccataacttgaaa

SEQ ID NO: 1167463 - DNA, 17 bp, Homo sapiens
ttcaaaagttgaaatta

SEQ ID NO: 1167464 - DNA, 17 bp, Homo sapiens
ttcaaaataaaaatgag

SEQ ID NO: 1167465 - DNA, 20 bp, Homo sapiens
ttcaaaatagggtatatttt

SEQ ID NO: 1167466 - DNA, 14 bp, Homo sapiens
ttcaaaatattgag

SEQ ID NO: 1167467 - DNA, 16 bp, Homo sapiens
ttcaaaatattgagca

SEQ ID NO: 1167468 - DNA, 23 bp, Homo sapiens
ttcaaaatattgagcagaattca

SEQ ID NO: 1167469 - DNA, 17 bp, Homo sapiens
ttcaaaatgctttttat

SEQ ID NO: 1167470 - DNA, 18 bp, Homo sapiens
ttcaaaatgtctgtagct

SEQ ID NO: 1167471 - DNA, 16 bp, Homo sapiens
ttcaaaccaaagctgc

SEQ ID NO: 1167472 - DNA, 17 bp, Homo sapiens
ttcaaaccaaagctgcc

SEQ ID NO: 1167473 - DNA, 21 bp, Homo sapiens
ttcaaaccaatttcttccttc

SEQ ID NO: 1167474 - DNA, 21 bp, Homo sapiens
ttcaaaccagtgttttggaag

SEQ ID NO: 1167475 - DNA, 18 bp, Homo sapiens
ttcaaactactgtacatt

SEQ ID NO: 1167476 - DNA, 14 bp, Homo sapiens
ttcaaactgctgca

SEQ ID NO: 1167477 - DNA, 23 bp, Homo sapiens
ttcaaactgctgcatactttgac

SEQ ID NO: 1167478 - DNA, 13 bp, Homo sapiens
ttcaaactgtgaa

SEQ ID NO: 1167479 - DNA, 19 bp, Homo sapiens
ttcaaacttactattttga

SEQ ID NO: 1167480 - DNA, 14 bp, Homo sapiens
ttcaaagaaatcca

SEQ ID NO: 1167481 - DNA, 21 bp, Homo sapiens
ttcaaagacggagtattcttt

SEQ ID NO: 1167482 - DNA, 15 bp, Homo sapiens
ttcaaagagaaaaca

SEQ ID NO: 1167483 - DNA, 23 bp, Homo sapiens
ttcaaagagaaaacatctcatca

SEQ ID NO: 1167484 - DNA, 19 bp, Homo sapiens
ttcaaagagtctgtcttga

SEQ ID NO: 1167485 - DNA, 19 bp, Homo sapiens
ttcaaagcaattgaaatgc

SEQ ID NO: 1167486 - DNA, 21 bp, Homo sapiens
ttcaaagcaccaaaataagaa

SEQ ID NO: 1167487 - DNA, 13 bp, Homo sapiens
ttcaaagccacat

SEQ ID NO: 1167488 - DNA, 15 bp, Homo sapiens
ttcaaagccctgcct

SEQ ID NO: 1167489 - DNA, 21 bp, Homo sapiens
ttcaaagccctgcctctgtgt

SEQ ID NO: 1167490 - DNA, 12 bp, Homo sapiens
ttcaaagctgag

SEQ ID NO: 1167491 - DNA, 16 bp, Homo sapiens
ttcaaagcttgaagat

SEQ ID NO: 1167492 - DNA, 11 bp, Homo sapiens
ttcaaagtctc

SEQ ID NO: 1167493 - DNA, 19 bp, Homo sapiens
ttcaaagtctcaatgaaat

SEQ ID NO: 1167494 - DNA, 20 bp, Homo sapiens
ttcaaagtctcaatgaaata

SEQ ID NO: 1167495 - DNA, 14 bp, Homo sapiens
ttcaaagtgtatat

SEQ ID NO: 1167496 - DNA, 22 bp, Homo sapiens
ttcaaagtgtatatttattcat

SEQ ID NO: 1167497 - DNA, 19 bp, Homo sapiens
ttcaaagtttaataaattt

SEQ ID NO: 1167498 - DNA, 17 bp, Homo sapiens
ttcaaataaagaaattt

SEQ ID NO: 1167499 - DNA, 19 bp, Homo sapiens
ttcaaataattaaatctct

SEQ ID NO: 1167500 - DNA, 14 bp, Homo sapiens
ttcaaatcagtgat

SEQ ID NO: 1167501 - DNA, 15 bp, Homo sapiens
ttcaaatcagtgatc

SEQ ID NO: 1167502 - DNA, 22 bp, Homo sapiens
ttcaaatcagtgatctatgttt

SEQ ID NO: 1167503 - DNA, 23 bp, Homo sapiens
ttcaaatcattccttagatacct

SEQ ID NO: 1167504 - DNA, 17 bp, Homo sapiens
ttcaaatccttattgtt

SEQ ID NO: 1167505 - DNA, 13 bp, Homo sapiens
ttcaaatctgtaa

SEQ ID NO: 1167506 - DNA, 22 bp, Homo sapiens
ttcaaatgggagactctttgaa

SEQ ID NO: 1167507 - DNA, 23 bp, Homo sapiens
ttcaaatgggagactctttgaaa

SEQ ID NO: 1167508 - DNA, 19 bp, Homo sapiens
ttcaaattcttctgaactc

SEQ ID NO: 1167509 - DNA, 18 bp, Homo sapiens
ttcaaattgagagaatgg

SEQ ID NO: 1167510 - DNA, 15 bp, Homo sapiens
ttcaaatttgtacag

SEQ ID NO: 1167511 - DNA, 16 bp, Homo sapiens
ttcaaatttgtacagg

SEQ ID NO: 1167512 - DNA, 22 bp, Homo sapiens
ttcaacaaagaaacaaagatgt

SEQ ID NO: 1167513 - DNA, 22 bp, Homo sapiens
ttcaacaaatattcactggccc

SEQ ID NO: 1167514 - DNA, 18 bp, Homo sapiens
ttcaacaactttgtgctt

SEQ ID NO: 1167515 - DNA, 20 bp, Homo sapiens
ttcaacaactttgtgctttc

SEQ ID NO: 1167516 - DNA, 15 bp, Homo sapiens
ttcaacaattctaaa

SEQ ID NO: 1167517 - DNA, 17 bp, Homo sapiens
ttcaacaatttcaataa

SEQ ID NO: 1167518 - DNA, 18 bp, Homo sapiens
ttcaacatcaaaacttaa

SEQ ID NO: 1167519 - DNA, 21 bp, Homo sapiens
ttcaacatcaatgttcattgt

SEQ ID NO: 1167520 - DNA, 22 bp, Homo sapiens
ttcaacatcaatgttcattgta

SEQ ID NO: 1167521 - DNA, 20 bp, Homo sapiens
ttcaacatttttttttctcc

SEQ ID NO: 1167522 - DNA, 15 bp, Homo sapiens
ttcaaccattcccca

SEQ ID NO: 1167523 - DNA, 17 bp, Homo sapiens
ttcaaccattccccatg

SEQ ID NO: 1167524 - DNA, 17 bp, Homo sapiens
ttcaacccacagctact

SEQ ID NO: 1167525 - DNA, 14 bp, Homo sapiens
ttcaacgcagccct

SEQ ID NO: 1167526 - DNA, 12 bp, Homo sapiens
ttcaactaatgt

SEQ ID NO: 1167527 - DNA, 13 bp, Homo sapiens
ttcaactcctggc

SEQ ID NO: 1167528 - DNA, 14 bp, Homo sapiens
ttcaagaaaataaa

SEQ ID NO: 1167529 - DNA, 22 bp, Homo sapiens
ttcaagaaaatctttgttgaag

SEQ ID NO: 1167530 - DNA, 13 bp, Homo sapiens
ttcaagaaactga

SEQ ID NO: 1167531 - DNA, 23 bp, Homo sapiens
ttcaagaaactgaggaattttct

SEQ ID NO: 1167532 - DNA, 15 bp, Homo sapiens
ttccaaacttttgca

SEQ ID NO: 1167533 - DNA, 12 bp, Homo sapiens
ttccaaagaaag

SEQ ID NO: 1167534 - DNA, 12 bp, Homo sapiens
ttccaaagcaaa

SEQ ID NO: 1167535 - DNA, 19 bp, Homo sapiens
ttccaaagcacattgaaag

SEQ ID NO: 1167536 - DNA, 19 bp, Homo sapiens
ttccaaagcttcgtcttgt

SEQ ID NO: 1167537 - DNA, 13 bp, Homo sapiens
ttccaaaggttcc

SEQ ID NO: 1167538 - DNA, 13 bp, Homo sapiens
ttccaaagtacac

SEQ ID NO: 1167539 - DNA, 14 bp, Homo sapiens
ttccaaagttaaca

SEQ ID NO: 1167540 - DNA, 11 bp, Homo sapiens
ttccaaataaa

SEQ ID NO: 1167541 - DNA, 17 bp, Homo sapiens
ttccaaataaaacttga

SEQ ID NO: 1167542 - DNA, 15 bp, Homo sapiens
ttccaaataaaatgt

SEQ ID NO: 1167543 - DNA, 17 bp, Homo sapiens
ttccaaatcctggaagg

SEQ ID NO: 1167544 - DNA, 13 bp, Homo sapiens
ttccaaatgaact

SEQ ID NO: 1167545 - DNA, 17 bp, Homo sapiens
ttccaaatgaatgttgt

SEQ ID NO: 1167546 - DNA, 19 bp, Homo sapiens
ttccaaatgatcctagtaa

SEQ ID NO: 1167547 - DNA, 21 bp, Homo sapiens
ttccaaatgtaataaacttta

SEQ ID NO: 1167548 - DNA, 16 bp, Homo sapiens
ttccaaatgtccctcc

SEQ ID NO: 1167549 - DNA, 19 bp, Homo sapiens
ttccaaatgtgtcagaata

SEQ ID NO: 1167550 - DNA, 16 bp, Homo sapiens
ttccaaattattaatt

SEQ ID NO: 1167551 - DNA, 18 bp, Homo sapiens
ttccaaattcagtttcat

SEQ ID NO: 1167552 - DNA, 23 bp, Homo sapiens
ttccaaattgccctatgctgtgc

SEQ ID NO: 1167553 - DNA, 17 bp, Homo sapiens
ttccaacaaggacagcc

SEQ ID NO: 1167554 - DNA, 17 bp, Homo sapiens
ttccaacaccacagaca

SEQ ID NO: 1167555 - DNA, 19 bp, Homo sapiens
ttccaacaccacagacaca

SEQ ID NO: 1167556 - DNA, 20 bp, Homo sapiens
ttccaacaccacagacacac

SEQ ID NO: 1167557 - DNA, 16 bp, Homo sapiens
ttccaactcctgatgc

SEQ ID NO: 1167558 - DNA, 20 bp, Homo sapiens
ttccaactggcactctgtgg

SEQ ID NO: 1167559 - DNA, 22 bp, Homo sapiens
ttccaactgtatatattcccaa

SEQ ID NO: 1167560 - DNA, 16 bp, Homo sapiens
ttccaacttgaaggat

SEQ ID NO: 1167561 - DNA, 15 bp, Homo sapiens
ttccaacttgatgtc

SEQ ID NO: 1167562 - DNA, 21 bp, Homo sapiens
ttccaagaaagatgaatacat

SEQ ID NO: 1167563 - DNA, 12 bp, Homo sapiens
ttccaagacatt

SEQ ID NO: 1167564 - DNA, 17 bp, Homo sapiens
ttccaagacattgtcaa

SEQ ID NO: 1167565 - DNA, 12 bp, Homo sapiens
ttccaagactga

SEQ ID NO: 1167566 - DNA, 16 bp, Homo sapiens
ttccaagagaactaaa

SEQ ID NO: 1167567 - DNA, 15 bp, Homo sapiens
ttccaagcttcatat

SEQ ID NO: 1167568 - DNA, 16 bp, Homo sapiens
ttccaagcttcatatt

SEQ ID NO: 1167569 - DNA, 22 bp, Homo sapiens
ttccaaggaaaattgaaagtat

SEQ ID NO: 1167570 - DNA, 19 bp, Homo sapiens
ttccaaggagcagagaggt

SEQ ID NO: 1167571 - DNA, 13 bp, Homo sapiens
ttccaaggcttct

SEQ ID NO: 1167572 - DNA, 23 bp, Homo sapiens
ttccaaggtcactcttggtccct

SEQ ID NO: 1167573 - DNA, 15 bp, Homo sapiens
ttccaatagaaagaa

SEQ ID NO: 1167574 - DNA, 15 bp, Homo sapiens
ttccaatcaacagca

SEQ ID NO: 1167575 - DNA, 23 bp, Homo sapiens
ttccaattatttataataaatca

SEQ ID NO: 1167576 - DNA, 11 bp, Homo sapiens
ttccacaaaat

SEQ ID NO: 1167577 - DNA, 18 bp, Homo sapiens
ttccacaaaatctgtcca

SEQ ID NO: 1167578 - DNA, 12 bp, Homo sapiens
ttccacaaaatt

SEQ ID NO: 1167579 - DNA, 15 bp, Homo sapiens
ttccacaaaattaga

SEQ ID NO: 1167580 - DNA, 21 bp, Homo sapiens
ttccacaagattcccagagac

SEQ ID NO: 1167581 - DNA, 22 bp, Homo sapiens
ttccacagcagcagaacaagtg

SEQ ID NO: 1167582 - DNA, 22 bp, Homo sapiens
ttccacaggtcatcagatgcct

SEQ ID NO: 1167583 - DNA, 16 bp, Homo sapiens
ttccacagttatctta

SEQ ID NO: 1167584 - DNA, 20 bp, Homo sapiens
ttccaccccaagagaactcg

SEQ ID NO: 1167585 - DNA, 13 bp, Homo sapiens
ttccaccccctcc

SEQ ID NO: 1167586 - DNA, 14 bp, Homo sapiens
ttccaccccctccc

SEQ ID NO: 1167587 - DNA, 14 bp, Homo sapiens
ttccacctcagcct

SEQ ID NO: 1167588 - DNA, 12 bp, Homo sapiens
ttccacctccct

SEQ ID NO: 1167589 - DNA, 13 bp, Homo sapiens
ttccacctccctc

SEQ ID NO: 1167590 - DNA, 15 bp, Homo sapiens
ttccacctccctccc

SEQ ID NO: 1167591 - DNA, 19 bp, Homo sapiens
ttccacctgtgccctcacc

SEQ ID NO: 1167592 - DNA, 16 bp, Homo sapiens
ttccaccttaaattaa

SEQ ID NO: 1167593 - DNA, 20 bp, Homo sapiens
ttccaccttaaattaaacaa

SEQ ID NO: 1167594 - DNA, 15 bp, Homo sapiens
ttccaccttcccatg

SEQ ID NO: 1167595 - DNA, 14 bp, Homo sapiens
ttccacgatgaaaa

SEQ ID NO: 1167596 - DNA, 18 bp, Homo sapiens
ttccacgctgtctccaga

SEQ ID NO: 1167597 - DNA, 22 bp, Homo sapiens
ttccacggagccactcctctga

SEQ ID NO: 1167598 - DNA, 24 bp, Homo sapiens
ttccacggagccactcctctgact

SEQ ID NO: 1167599 - DNA, 21 bp, Homo sapiens
ttccacggcatcgcatccgtc

SEQ ID NO: 1167600 - DNA, 19 bp, Homo sapiens
ttccacgtccccctggggc

SEQ ID NO: 1167601 - DNA, 17 bp, Homo sapiens
ttccactaatccattat

SEQ ID NO: 1167602 - DNA, 15 bp, Homo sapiens
ttccactacacctgg

SEQ ID NO: 1167603 - DNA, 16 bp, Homo sapiens
ttccactacacctggc

SEQ ID NO: 1167604 - DNA, 18 bp, Homo sapiens
ttccactacacctggctg

SEQ ID NO: 1167605 - DNA, 21 bp, Homo sapiens
ttccactatcccaatcaaaga

SEQ ID NO: 1167606 - DNA, 18 bp, Homo sapiens
ttccactattttcaaaga

SEQ ID NO: 1167607 - DNA, 16 bp, Homo sapiens
ttccactccattgtcg

SEQ ID NO: 1167608 - DNA, 18 bp, Homo sapiens
ttccactgaaaatttaac

SEQ ID NO: 1167609 - DNA, 21 bp, Homo sapiens
ttccactgcaaataaagcctt

SEQ ID NO: 1167610 - DNA, 23 bp, Homo sapiens
ttccactggcttttgcctgtaag

SEQ ID NO: 1167611 - DNA, 23 bp, Homo sapiens
ttccactgtatattttttaatgt

SEQ ID NO: 1167612 - DNA, 13 bp, Homo sapiens
ttccactgtgcta

SEQ ID NO: 1167613 - DNA, 13 bp, Homo sapiens
ttccacttctctg

SEQ ID NO: 1167614 - DNA, 19 bp, Homo sapiens
ttccacttcttcctttctc

SEQ ID NO: 1167615 - DNA, 20 bp, Homo sapiens
ttccacttcttcctttctct

SEQ ID NO: 1167616 - DNA, 21 bp, Homo sapiens
ttccacttcttcctttctctt

SEQ ID NO: 1167617 - DNA, 15 bp, Homo sapiens
ttccactttgttctt

SEQ ID NO: 1167618 - DNA, 18 bp, Homo sapiens
ttccagaaatacctgtct

SEQ ID NO: 1167619 - DNA, 19 bp, Homo sapiens
ttccagaaatacctgtcta

SEQ ID NO: 1167620 - DNA, 20 bp, Homo sapiens
ttccagaacagccctcggcc

SEQ ID NO: 1167621 - DNA, 22 bp, Homo sapiens
ttccagaacagccctcggcctc

SEQ ID NO: 1167622 - DNA, 16 bp, Homo sapiens
ttccagaagaagagaa

SEQ ID NO: 1167623 - DNA, 20 bp, Homo sapiens
ttccagaagaagagaagctg

SEQ ID NO: 1167624 - DNA, 22 bp, Homo sapiens
ttccagaagaagagaagctgct

SEQ ID NO: 1167625 - DNA, 19 bp, Homo sapiens
ttccagaatatctgggatt

SEQ ID NO: 1167626 - DNA, 21 bp, Homo sapiens
ttccagaatcttgactttctg

SEQ ID NO: 1167627 - DNA, 22 bp, Homo sapiens
ttccagaatcttgactttctga

SEQ ID NO: 1167628 - DNA, 15 bp, Homo sapiens
ttccagaatgctgta

SEQ ID NO: 1167629 - DNA, 16 bp, Homo sapiens
ttccagaatgctgtac

SEQ ID NO: 1167630 - DNA, 20 bp, Homo sapiens
ttccagactcaggttccaga

SEQ ID NO: 1167631 - DNA, 23 bp, Homo sapiens
ttccagactgcttccaattttct

SEQ ID NO: 1167632 - DNA, 20 bp, Homo sapiens
ttccagagaactgcagacct

SEQ ID NO: 1167633 - DNA, 11 bp, Homo sapiens
ttccagagaag

SEQ ID NO: 1167634 - DNA, 20 bp, Homo sapiens
ttccagagagtggctcctcc

SEQ ID NO: 1167635 - DNA, 15 bp, Homo sapiens
ttccagagcccaagg

SEQ ID NO: 1167636 - DNA, 11 bp, Homo sapiens
ttccagaggac

SEQ ID NO: 1167637 - DNA, 19 bp, Homo sapiens
ttccagaggctattatttt

SEQ ID NO: 1167638 - DNA, 18 bp, Homo sapiens
ttccagagtccggaggca

SEQ ID NO: 1167639 - DNA, 19 bp, Homo sapiens
ttccagagtccggaggcag

SEQ ID NO: 1167640 - DNA, 15 bp, Homo sapiens
ttccagagttgttgt

SEQ ID NO: 1167641 - DNA, 18 bp, Homo sapiens
ttccagataaccagctgt

SEQ ID NO: 1167642 - DNA, 14 bp, Homo sapiens
ttccagatgtggat

SEQ ID NO: 1167643 - DNA, 16 bp, Homo sapiens
ttccagcaaaatggaa

SEQ ID NO: 1167644 - DNA, 13 bp, Homo sapiens
ttccagcaataag

SEQ ID NO: 1167645 - DNA, 14 bp, Homo sapiens
ttccagctcctgta

SEQ ID NO: 1167646 - DNA, 14 bp, Homo sapiens
ttccagctctgccc

SEQ ID NO: 1167647 - DNA, 15 bp, Homo sapiens
ttccagctgctgtct

SEQ ID NO: 1167648 - DNA, 21 bp, Homo sapiens
ttccaggaaaaaataaaaaga

SEQ ID NO: 1167649 - DNA, 18 bp, Homo sapiens
ttccaggaagatccagga

SEQ ID NO: 1167650 - DNA, 14 bp, Homo sapiens
ttccaggactcttt

SEQ ID NO: 1167651 - DNA, 12 bp, Homo sapiens
ttccaggagaag

SEQ ID NO: 1167652 - DNA, 16 bp, Homo sapiens
ttccaggagacatata

SEQ ID NO: 1167653 - DNA, 21 bp, Homo sapiens
ttccaggagccaccttgccac

SEQ ID NO: 1167654 - DNA, 13 bp, Homo sapiens
ttccaggcccctg

SEQ ID NO: 1167655 - DNA, 21 bp, Homo sapiens
ttccaggctcttcctggacct

SEQ ID NO: 1167656 - DNA, 10 bp, Homo sapiens
ttccagggct

SEQ ID NO: 1167657 - DNA, 11 bp, Homo sapiens
ttccagggctg

SEQ ID NO: 1167658 - DNA, 19 bp, Homo sapiens
ttccagggctggggtgagc

SEQ ID NO: 1167659 - DNA, 22 bp, Homo sapiens
ttccagggctggggtgagcctg

SEQ ID NO: 1167660 - DNA, 22 bp, Homo sapiens
ttccagggtcaaagtacagaat

SEQ ID NO: 1167661 - DNA, 16 bp, Homo sapiens
ttccagggtccctctg

SEQ ID NO: 1167662 - DNA, 19 bp, Homo sapiens
ttccagggtccctctgtgt

SEQ ID NO: 1167663 - DNA, 17 bp, Homo sapiens
ttccaggtatctccagg

SEQ ID NO: 1167664 - DNA, 18 bp, Homo sapiens
ttccaggtatctccagga

SEQ ID NO: 1167665 - DNA, 13 bp, Homo sapiens
ttccagtaacttt

SEQ ID NO: 1167666 - DNA, 16 bp, Homo sapiens
ttccagtacagtattc

SEQ ID NO: 1167667 - DNA, 18 bp, Homo sapiens
ttccagtacctttgtcac

SEQ ID NO: 1167668 - DNA, 21 bp, Homo sapiens
ttccagtattgaaaacttcaa

SEQ ID NO: 1167669 - DNA, 18 bp, Homo sapiens
ttccagtgtccttagaac

SEQ ID NO: 1167670 - DNA, 22 bp, Homo sapiens
ttccagtgtctataaaagaaac

SEQ ID NO: 1167671 - DNA, 13 bp, Homo sapiens
ttccagtgttcta

SEQ ID NO: 1167672 - DNA, 16 bp, Homo sapiens
ttccagttaacctatt

SEQ ID NO: 1167673 - DNA, 14 bp, Homo sapiens
ttccagttgctgtg

SEQ ID NO: 1167674 - DNA, 22 bp, Homo sapiens
ttccataatctggactcctctg

SEQ ID NO: 1167675 - DNA, 16 bp, Homo sapiens
ttccataatgtataaa

SEQ ID NO: 1167676 - DNA, 19 bp, Homo sapiens
ttccataatgtataaagaa

SEQ ID NO: 1167677 - DNA, 22 bp, Homo sapiens
ttccataattatgacagttata

SEQ ID NO: 1167678 - DNA, 14 bp, Homo sapiens
ttccatacttctct

SEQ ID NO: 1167679 - DNA, 15 bp, Homo sapiens
ttccatagcaacagg

SEQ ID NO: 1167680 - DNA, 22 bp, Homo sapiens
ttccataggacatactgcatgt

SEQ ID NO: 1167681 - DNA, 23 bp, Homo sapiens
ttccataggacatactgcatgta

SEQ ID NO: 1167682 - DNA, 15 bp, Homo sapiens
ttccatatcttgcga

SEQ ID NO: 1167683 - DNA, 19 bp, Homo sapiens
ttccatcatcactgtaaag

SEQ ID NO: 1167684 - DNA, 22 bp, Homo sapiens
ttccatcatcactgtaaagaca

SEQ ID NO: 1167685 - DNA, 13 bp, Homo sapiens
ttccatcatgtct

SEQ ID NO: 1167686 - DNA, 15 bp, Homo sapiens
ttccatcatttctgt

SEQ ID NO: 1167687 - DNA, 18 bp, Homo sapiens
ttccatcctttacgtgtt

SEQ ID NO: 1167688 - DNA, 14 bp, Homo sapiens
ttccatctaggact

SEQ ID NO: 1167689 - DNA, 22 bp, Homo sapiens
ttccatctcctataatctgtca

SEQ ID NO: 1167690 - DNA, 23 bp, Homo sapiens
ttccatctcctataatctgtcaa

SEQ ID NO: 1167691 - DNA, 21 bp, Homo sapiens
ttccatcttgtggggccagga

SEQ ID NO: 1167692 - DNA, 15 bp, Homo sapiens
ttccatgaaaacgtt

SEQ ID NO: 1167693 - DNA, 22 bp, Homo sapiens
ttccatgacctcccctccccag

SEQ ID NO: 1167694 - DNA, 18 bp, Homo sapiens
ttccatgagaacagcagg

SEQ ID NO: 1167695 - DNA, 20 bp, Homo sapiens
ttccatgatggattcccccc

SEQ ID NO: 1167696 - DNA, 22 bp, Homo sapiens
ttccatgccctgggatgcctca

SEQ ID NO: 1167697 - DNA, 18 bp, Homo sapiens
ttccatggcttcctgaga

SEQ ID NO: 1167698 - DNA, 12 bp, Homo sapiens
ttccatgggaat

SEQ ID NO: 1167699 - DNA, 21 bp, Homo sapiens
ttccatgggcccgctgcctct

SEQ ID NO: 1167700 - DNA, 22 bp, Homo sapiens
ttccatgggcccgctgcctctt

SEQ ID NO: 1167701 - DNA, 23 bp, Homo sapiens
ttccatgtataagtgtaaatata

SEQ ID NO: 1167702 - DNA, 18 bp, Homo sapiens
ttccatgtcgcctctgca

SEQ ID NO: 1167703 - DNA, 13 bp, Homo sapiens
ttccatgttgctg

SEQ ID NO: 1167704 - DNA, 15 bp, Homo sapiens
ttccatgttgctgcc

SEQ ID NO: 1167705 - DNA, 15 bp, Homo sapiens
ttccattaacagcaa

SEQ ID NO: 1167706 - DNA, 16 bp, Homo sapiens
ttccattatgttcatc

SEQ ID NO: 1167707 - DNA, 13 bp, Homo sapiens
ttccattccagaa

SEQ ID NO: 1167708 - DNA, 13 bp, Homo sapiens
ttccattccttca

SEQ ID NO: 1167709 - DNA, 16 bp, Homo sapiens
ttccattggatctcat

SEQ ID NO: 1167710 - DNA, 22 bp, Homo sapiens
ttccattgtttgaaacaaagaa

SEQ ID NO: 1167711 - DNA, 15 bp, Homo sapiens
ttccatttacagtct

SEQ ID NO: 1167712 - DNA, 14 bp, Homo sapiens
ttccatttcatttg

SEQ ID NO: 1167713 - DNA, 12 bp, Homo sapiens
ttccatttccaa

SEQ ID NO: 1167714 - DNA, 11 bp, Homo sapiens
ttccatttctg

SEQ ID NO: 1167715 - DNA, 17 bp, Homo sapiens
ttccatttcttcagagg

SEQ ID NO: 1167716 - DNA, 14 bp, Homo sapiens
ttccatttgtgtgt

SEQ ID NO: 1167717 - DNA, 18 bp, Homo sapiens
ttccattttcccccacta

SEQ ID NO: 1167718 - DNA, 17 bp, Homo sapiens
ttccatttttcctctgt

SEQ ID NO: 1167719 - DNA, 19 bp, Homo sapiens
ttccatttttcctctgttc

SEQ ID NO: 1167720 - DNA, 23 bp, Homo sapiens
ttccatttttcctctgttcacaa

SEQ ID NO: 1167721 - DNA, 23 bp, Homo sapiens
ttcccaaaggcattataaaaaga

SEQ ID NO: 1167722 - DNA, 16 bp, Homo sapiens
ttcccaaagtcctctg

SEQ ID NO: 1167723 - DNA, 17 bp, Homo sapiens
ttcccaaagtcctctgc

SEQ ID NO: 1167724 - DNA, 13 bp, Homo sapiens
ttcccaaatgtat

SEQ ID NO: 1167725 - DNA, 18 bp, Homo sapiens
ttcccaactctagctggg

SEQ ID NO: 1167726 - DNA, 23 bp, Homo sapiens
ttcccaacttcatactggcagga

SEQ ID NO: 1167727 - DNA, 20 bp, Homo sapiens
ttcccaacttctcttgcttt

SEQ ID NO: 1167728 - DNA, 21 bp, Homo sapiens
ttcccaaggaagctccttcct

SEQ ID NO: 1167729 - DNA, 18 bp, Homo sapiens
ttcccaagtatgccttaa

SEQ ID NO: 1167730 - DNA, 14 bp, Homo sapiens
ttcccaataaaagt

SEQ ID NO: 1167731 - DNA, 19 bp, Homo sapiens
ttcccacaaaagacagacc

SEQ ID NO: 1167732 - DNA, 20 bp, Homo sapiens
ttcccacaaaagacagaccc

SEQ ID NO: 1167733 - DNA, 22 bp, Homo sapiens
ttcccacatctttcctcaagta

SEQ ID NO: 1167734 - DNA, 15 bp, Homo sapiens
ttcccacatgcctgc

SEQ ID NO: 1167735 - DNA, 15 bp, Homo sapiens
ttcccacccatcgct

SEQ ID NO: 1167736 - DNA, 13 bp, Homo sapiens
ttcccaccctcca

SEQ ID NO: 1167737 - DNA, 20 bp, Homo sapiens
ttcccaccctccacctctca

SEQ ID NO: 1167738 - DNA, 14 bp, Homo sapiens
ttcccacgaggaat

SEQ ID NO: 1167739 - DNA, 18 bp, Homo sapiens
ttcccactcaccagccct

SEQ ID NO: 1167740 - DNA, 14 bp, Homo sapiens
ttcccactccttca

SEQ ID NO: 1167741 - DNA, 15 bp, Homo sapiens
ttcccagagacagga

SEQ ID NO: 1167742 - DNA, 14 bp, Homo sapiens
ttcccagatacttc

SEQ ID NO: 1167743 - DNA, 14 bp, Homo sapiens
ttcccagcacatga

SEQ ID NO: 1167744 - DNA, 23 bp, Homo sapiens
ttcccagcactatgctttccttc

SEQ ID NO: 1167745 - DNA, 17 bp, Homo sapiens
ttcccagccctcatccc

SEQ ID NO: 1167746 - DNA, 19 bp, Homo sapiens
ttcccagcggttcctgtgc

SEQ ID NO: 1167747 - DNA, 21 bp, Homo sapiens
ttcccagcggttcctgtgcag

SEQ ID NO: 1167748 - DNA, 14 bp, Homo sapiens
ttcccagctccccc

SEQ ID NO: 1167749 - DNA, 16 bp, Homo sapiens
ttcccagctctccctc

SEQ ID NO: 1167750 - DNA, 18 bp, Homo sapiens
ttcccagcttctgccaca

SEQ ID NO: 1167751 - DNA, 10 bp, Homo sapiens
ttcccaggcc

SEQ ID NO: 1167752 - DNA, 22 bp, Homo sapiens
ttccctggcatgatggacaaag

SEQ ID NO: 1167753 - DNA, 23 bp, Homo sapiens
ttccctggcttgtaactccacca

SEQ ID NO: 1167754 - DNA, 14 bp, Homo sapiens
ttccctgggaaggc

SEQ ID NO: 1167755 - DNA, 17 bp, Homo sapiens
ttccctgggccaacaga

SEQ ID NO: 1167756 - DNA, 11 bp, Homo sapiens
ttccctgggga

SEQ ID NO: 1167757 - DNA, 22 bp, Homo sapiens
ttccctggggagccctcaggct

SEQ ID NO: 1167758 - DNA, 22 bp, Homo sapiens
ttccctggtcaccaaggcagtg

SEQ ID NO: 1167759 - DNA, 16 bp, Homo sapiens
ttccctgttctccctt

SEQ ID NO: 1167760 - DNA, 12 bp, Homo sapiens
ttccctgttctt

SEQ ID NO: 1167761 - DNA, 17 bp, Homo sapiens
ttccctgttcttcctcc

SEQ ID NO: 1167762 - DNA, 13 bp, Homo sapiens
ttcccttaacttt

SEQ ID NO: 1167763 - DNA, 14 bp, Homo sapiens
ttcccttagcctct

SEQ ID NO: 1167764 - DNA, 15 bp, Homo sapiens
ttcccttagcctctc

SEQ ID NO: 1167765 - DNA, 14 bp, Homo sapiens
ttcccttattgcct

SEQ ID NO: 1167766 - DNA, 15 bp, Homo sapiens
ttcccttccctcacc

SEQ ID NO: 1167767 - DNA, 16 bp, Homo sapiens
ttcccttccctcaccc

SEQ ID NO: 1167768 - DNA, 14 bp, Homo sapiens
ttcccttcctcacc

SEQ ID NO: 1167769 - DNA, 22 bp, Homo sapiens
ttcccttcctcttcctgccctt

SEQ ID NO: 1167770 - DNA, 12 bp, Homo sapiens
ttcccttcctgt

SEQ ID NO: 1167771 - DNA, 13 bp, Homo sapiens
ttcccttcctgtt

SEQ ID NO: 1167772 - DNA, 14 bp, Homo sapiens
ttcccttcctgttc

SEQ ID NO: 1167773 - DNA, 21 bp, Homo sapiens
ttcccttctacaaggactcca

SEQ ID NO: 1167774 - DNA, 22 bp, Homo sapiens
ttcccttcttggtttccaaagg

SEQ ID NO: 1167775 - DNA, 23 bp, Homo sapiens
ttcccttgaaattttaaactata

SEQ ID NO: 1167776 - DNA, 21 bp, Homo sapiens
ttcccttgagatgagtttctg

SEQ ID NO: 1167777 - DNA, 14 bp, Homo sapiens
ttcccttggaggga

SEQ ID NO: 1167778 - DNA, 16 bp, Homo sapiens
ttcccttgtaaacaga

SEQ ID NO: 1167779 - DNA, 15 bp, Homo sapiens
ttccctttgacttca

SEQ ID NO: 1167780 - DNA, 17 bp, Homo sapiens
ttccctttggagatgct

SEQ ID NO: 1167781 - DNA, 12 bp, Homo sapiens
ttccctttgtga

SEQ ID NO: 1167782 - DNA, 19 bp, Homo sapiens
ttcccttttacatactgct

SEQ ID NO: 1167783 - DNA, 20 bp, Homo sapiens
ttcccttttccctcccagtt

SEQ ID NO: 1167784 - DNA, 20 bp, Homo sapiens
ttccgaaaaatcctcttcct

SEQ ID NO: 1167785 - DNA, 23 bp, Homo sapiens
ttccgaaaaatcctcttcctctg

SEQ ID NO: 1167786 - DNA, 15 bp, Homo sapiens
ttccgaagaattcca

SEQ ID NO: 1167787 - DNA, 14 bp, Homo sapiens
ttccgaatctcttt

SEQ ID NO: 1167788 - DNA, 20 bp, Homo sapiens
ttccgacaaccgatgctcca

SEQ ID NO: 1167789 - DNA, 18 bp, Homo sapiens
ttccgacacatttaccaa

SEQ ID NO: 1167790 - DNA, 21 bp, Homo sapiens
ttccgacacatttaccaaatt

SEQ ID NO: 1167791 - DNA, 16 bp, Homo sapiens
ttccgaccctctggga

SEQ ID NO: 1167792 - DNA, 18 bp, Homo sapiens
ttccgaccctctgggaac

SEQ ID NO: 1167793 - DNA, 21 bp, Homo sapiens
ttccgagctgctttgtgggct

SEQ ID NO: 1167794 - DNA, 16 bp, Homo sapiens
ttccgatcaacattta

SEQ ID NO: 1167795 - DNA, 21 bp, Homo sapiens
ttccgatcaacatttatgacc

SEQ ID NO: 1167796 - DNA, 22 bp, Homo sapiens
ttccgatcaacatttatgacct

SEQ ID NO: 1167797 - DNA, 22 bp, Homo sapiens
ttccgcactttccacttcttcc

SEQ ID NO: 1167798 - DNA, 17 bp, Homo sapiens
ttccgcaggcagactac

SEQ ID NO: 1167799 - DNA, 16 bp, Homo sapiens
ttccgccactcagcca

SEQ ID NO: 1167800 - DNA, 16 bp, Homo sapiens
ttccgcccctgcctgc

SEQ ID NO: 1167801 - DNA, 18 bp, Homo sapiens
ttccgcccctgcctgcca

SEQ ID NO: 1167802 - DNA, 22 bp, Homo sapiens
ttccgctgtcgccccaggccct

SEQ ID NO: 1167803 - DNA, 19 bp, Homo sapiens
ttccgcttggagcagaggg

SEQ ID NO: 1167804 - DNA, 20 bp, Homo sapiens
ttccgggtctcgcagcctga

SEQ ID NO: 1167805 - DNA, 13 bp, Homo sapiens
ttccgtccatccc

SEQ ID NO: 1167806 - DNA, 14 bp, Homo sapiens
ttccgtccatcccc

SEQ ID NO: 1167807 - DNA, 13 bp, Homo sapiens
ttccgtctccccc

SEQ ID NO: 1167808 - DNA, 16 bp, Homo sapiens
ttccgtgcatcccaga

SEQ ID NO: 1167809 - DNA, 19 bp, Homo sapiens
ttccgtgtcctctccccca

SEQ ID NO: 1167810 - DNA, 14 bp, Homo sapiens
ttccgttgtctgtg

SEQ ID NO: 1167811 - DNA, 15 bp, Homo sapiens
ttccgtttgcttttg

SEQ ID NO: 1167812 - DNA, 12 bp, Homo sapiens
ttcctaaacata

SEQ ID NO: 1167813 - DNA, 13 bp, Homo sapiens
ttcctaaagccaa

SEQ ID NO: 1167814 - DNA, 13 bp, Homo sapiens
ttcctaaatatcc

SEQ ID NO: 1167815 - DNA, 13 bp, Homo sapiens
ttcctaactagaa

SEQ ID NO: 1167816 - DNA, 15 bp, Homo sapiens
ttcctaactagaatt

SEQ ID NO: 1167817 - DNA, 24 bp, Homo sapiens
ttcctaactagaattagtatgtct

SEQ ID NO: 1167818 - DNA, 14 bp, Homo sapiens
ttcctaactgtgat

SEQ ID NO: 1167819 - DNA, 14 bp, Homo sapiens
ttcctaacttttca

SEQ ID NO: 1167820 - DNA, 21 bp, Homo sapiens
ttcctaagagtggaggaggag

SEQ ID NO: 1167821 - DNA, 16 bp, Homo sapiens
ttcctaattccacagc

SEQ ID NO: 1167822 - DNA, 17 bp, Homo sapiens
ttcctaattccacagct

SEQ ID NO: 1167823 - DNA, 16 bp, Homo sapiens
ttcctacaaagatgtt

SEQ ID NO: 1167824 - DNA, 20 bp, Homo sapiens
ttcctacaacttaatggaaa

SEQ ID NO: 1167825 - DNA, 23 bp, Homo sapiens
ttcctacaagagcagcctgtggc

SEQ ID NO: 1167826 - DNA, 14 bp, Homo sapiens
ttcctacagcacta

SEQ ID NO: 1167827 - DNA, 17 bp, Homo sapiens
ttcctacagcactactg

SEQ ID NO: 1167828 - DNA, 21 bp, Homo sapiens
ttcctacagcactactgggtg

SEQ ID NO: 1167829 - DNA, 20 bp, Homo sapiens
ttcctacatgccccctccct

SEQ ID NO: 1167830 - DNA, 17 bp, Homo sapiens
ttcctacccctcttcca

SEQ ID NO: 1167831 - DNA, 18 bp, Homo sapiens
ttcctacccctcttccag

SEQ ID NO: 1167832 - DNA, 18 bp, Homo sapiens
ttcctaccctccttccac

SEQ ID NO: 1167833 - DNA, 20 bp, Homo sapiens
ttcctaccgtactccctgca

SEQ ID NO: 1167834 - DNA, 18 bp, Homo sapiens
ttcctactccctcttcca

SEQ ID NO: 1167835 - DNA, 20 bp, Homo sapiens
ttcctactccgttcctggca

SEQ ID NO: 1167836 - DNA, 20 bp, Homo sapiens
ttcctagactaattaaaatc

SEQ ID NO: 1167837 - DNA, 23 bp, Homo sapiens
ttcctagactaattaaaatctgg

SEQ ID NO: 1167838 - DNA, 21 bp, Homo sapiens
ttcctagcaaatttctctctt

SEQ ID NO: 1167839 - DNA, 18 bp, Homo sapiens
ttcctagctgtgtgaata

SEQ ID NO: 1167840 - DNA, 21 bp, Homo sapiens
ttcctaggaaaaaaggaataa

SEQ ID NO: 1167841 - DNA, 21 bp, Homo sapiens
ttcctaggcccaggcctgggt

SEQ ID NO: 1167842 - DNA, 17 bp, Homo sapiens
ttcctaggtccaagccc

SEQ ID NO: 1167843 - DNA, 22 bp, Homo sapiens
ttcctataataaaatggcacct

SEQ ID NO: 1167844 - DNA, 14 bp, Homo sapiens
ttcctatatcctgt

SEQ ID NO: 1167845 - DNA, 18 bp, Homo sapiens
ttcctatgctattgacaa

SEQ ID NO: 1167846 - DNA, 15 bp, Homo sapiens
ttcctattctcctgc

SEQ ID NO: 1167847 - DNA, 22 bp, Homo sapiens
ttcctattctgttgccaatttt

SEQ ID NO: 1167848 - DNA, 23 bp, Homo sapiens
ttcctgacttgagtgttcctttt

SEQ ID NO: 1167849 - DNA, 11 bp, Homo sapiens
ttcctgagctt

SEQ ID NO: 1167850 - DNA, 13 bp, Homo sapiens
ttcctgagcttgg

SEQ ID NO: 1167851 - DNA, 13 bp, Homo sapiens
ttcctgagggcta

SEQ ID NO: 1167852 - DNA, 17 bp, Homo sapiens
ttcctgattgtttacag

SEQ ID NO: 1167853 - DNA, 15 bp, Homo sapiens
ttcctgcaaagggaa

SEQ ID NO: 1167854 - DNA, 19 bp, Homo sapiens
ttcctgcagccccagaaga

SEQ ID NO: 1167855 - DNA, 21 bp, Homo sapiens
ttcctgcaggccaggccagct

SEQ ID NO: 1167856 - DNA, 12 bp, Homo sapiens
ttcctgcattca

SEQ ID NO: 1167857 - DNA, 16 bp, Homo sapiens
ttcctgcatttgtgaa

SEQ ID NO: 1167858 - DNA, 15 bp, Homo sapiens
ttcctgccaccagtc

SEQ ID NO: 1167859 - DNA, 14 bp, Homo sapiens
ttcctgcccttccc

SEQ ID NO: 1167860 - DNA, 15 bp, Homo sapiens
ttcctgcccttccct

SEQ ID NO: 1167861 - DNA, 17 bp, Homo sapiens
ttcctgcccttcctcag

SEQ ID NO: 1167862 - DNA, 12 bp, Homo sapiens
ttcctgcccttg

SEQ ID NO: 1167863 - DNA, 13 bp, Homo sapiens
ttcctgcccttga

SEQ ID NO: 1167864 - DNA, 23 bp, Homo sapiens
ttcctgcccttgaaccccctccc

SEQ ID NO: 1167865 - DNA, 19 bp, Homo sapiens
ttcctgcggagtgaagagg

SEQ ID NO: 1167866 - DNA, 20 bp, Homo sapiens
ttcctgcggagtgaagaggg

SEQ ID NO: 1167867 - DNA, 23 bp, Homo sapiens
ttcctgcggagtgaagaggggca

SEQ ID NO: 1167868 - DNA, 17 bp, Homo sapiens
ttcctgcgtcctcctca

SEQ ID NO: 1167869 - DNA, 19 bp, Homo sapiens
ttcctgcgtcctcctcacc

SEQ ID NO: 1167870 - DNA, 19 bp, Homo sapiens
ttcctgctacttaaatttg

SEQ ID NO: 1167871 - DNA, 13 bp, Homo sapiens
ttcctgctccagt

SEQ ID NO: 1167872 - DNA, 19 bp, Homo sapiens
ttcctgctccgtggactgc

SEQ ID NO: 1167873 - DNA, 13 bp, Homo sapiens
ttcctgctctctg

SEQ ID NO: 1167874 - DNA, 15 bp, Homo sapiens
ttcctgctcttccca

SEQ ID NO: 1167875 - DNA, 11 bp, Homo sapiens
ttcctgctgca

SEQ ID NO: 1167876 - DNA, 13 bp, Homo sapiens
ttcctgctgtggg

SEQ ID NO: 1167877 - DNA, 14 bp, Homo sapiens
ttcctgctgtgggg

SEQ ID NO: 1167878 - DNA, 13 bp, Homo sapiens
ttcctgcttgcca

SEQ ID NO: 1167879 - DNA, 20 bp, Homo sapiens
ttcctgctttccatgggccc

SEQ ID NO: 1167880 - DNA, 21 bp, Homo sapiens
ttcctggaaaagaagaaactt

SEQ ID NO: 1167881 - DNA, 17 bp, Homo sapiens
ttcctggaaacagcatg

SEQ ID NO: 1167882 - DNA, 21 bp, Homo sapiens
ttcctggaaacagcatgaata

SEQ ID NO: 1167883 - DNA, 13 bp, Homo sapiens
ttcctttctcttt

SEQ ID NO: 1167884 - DNA, 17 bp, Homo sapiens
ttcctttctctttctct

SEQ ID NO: 1167885 - DNA, 20 bp, Homo sapiens
ttcctttcttgtctttcctc

SEQ ID NO: 1167886 - DNA, 14 bp, Homo sapiens
ttcctttgaagata

SEQ ID NO: 1167887 - DNA, 19 bp, Homo sapiens
ttcctttgcatattataaa

SEQ ID NO: 1167888 - DNA, 14 bp, Homo sapiens
ttcctttggactgt

SEQ ID NO: 1167889 - DNA, 22 bp, Homo sapiens
ttcctttggactgttcaagcaa

SEQ ID NO: 1167890 - DNA, 16 bp, Homo sapiens
ttcctttgtcttcaaa

SEQ ID NO: 1167891 - DNA, 21 bp, Homo sapiens
ttccttttaaaacacttccat

SEQ ID NO: 1167892 - DNA, 22 bp, Homo sapiens
ttccttttaaaacacttccata

SEQ ID NO: 1167893 - DNA, 12 bp, Homo sapiens
ttccttttaatt

SEQ ID NO: 1167894 - DNA, 12 bp, Homo sapiens
ttccttttatca

SEQ ID NO: 1167895 - DNA, 16 bp, Homo sapiens
ttccttttctctcctg

SEQ ID NO: 1167896 - DNA, 15 bp, Homo sapiens
ttccttttcttaaaa

SEQ ID NO: 1167897 - DNA, 14 bp, Homo sapiens
ttccttttgtaaaa

SEQ ID NO: 1167898 - DNA, 18 bp, Homo sapiens
ttcctttttaaatgtgaa

SEQ ID NO: 1167899 - DNA, 22 bp, Homo sapiens
ttcctttttaaatgtgaatttt

SEQ ID NO: 1167900 - DNA, 15 bp, Homo sapiens
ttcctttttgacact

SEQ ID NO: 1167901 - DNA, 15 bp, Homo sapiens
ttcctttttggggag

SEQ ID NO: 1167902 - DNA, 15 bp, Homo sapiens
ttccttttttcaata

SEQ ID NO: 1167903 - DNA, 13 bp, Homo sapiens
ttccttttttccc

SEQ ID NO: 1167904 - DNA, 15 bp, Homo sapiens
ttccttttttgtcta

SEQ ID NO: 1167905 - DNA, 19 bp, Homo sapiens
ttccttttttgtctatgaa

SEQ ID NO: 1167906 - DNA, 14 bp, Homo sapiens
ttcgaaactgccaa

SEQ ID NO: 1167907 - DNA, 13 bp, Homo sapiens
ttcgaaaggcctt

SEQ ID NO: 1167908 - DNA, 22 bp, Homo sapiens
ttcgaagctcagcccacccccc

SEQ ID NO: 1167909 - DNA, 19 bp, Homo sapiens
ttcgaaggagcagtgtgac

SEQ ID NO: 1167910 - DNA, 15 bp, Homo sapiens
ttcgaatgacactgt

SEQ ID NO: 1167911 - DNA, 14 bp, Homo sapiens
ttcgacatgctgcc

SEQ ID NO: 1167912 - DNA, 16 bp, Homo sapiens
ttcgactactgctcct

SEQ ID NO: 1167913 - DNA, 16 bp, Homo sapiens
ttcgactggtccagct

SEQ ID NO: 1167914 - DNA, 18 bp, Homo sapiens
ttcgactggtccagctct

SEQ ID NO: 1167915 - DNA, 21 bp, Homo sapiens
ttcgactggtccagctctgac

SEQ ID NO: 1167916 - DNA, 17 bp, Homo sapiens
ttcgacttatttcttaa

SEQ ID NO: 1167917 - DNA, 18 bp, Homo sapiens
ttcgagaccaacctgacc

SEQ ID NO: 1167918 - DNA, 22 bp, Homo sapiens
ttcgagatcatcacttccttgc

SEQ ID NO: 1167919 - DNA, 16 bp, Homo sapiens
ttcgatgaaggctgcc

SEQ ID NO: 1167920 - DNA, 17 bp, Homo sapiens
ttcgatgcccccctaga

SEQ ID NO: 1167921 - DNA, 23 bp, Homo sapiens
ttcgcagcacagagtcgctggca

SEQ ID NO: 1167922 - DNA, 14 bp, Homo sapiens
ttcgcatggtcaca

SEQ ID NO: 1167923 - DNA, 23 bp, Homo sapiens
ttcgcatggtcacacactgatgc

SEQ ID NO: 1167924 - DNA, 17 bp, Homo sapiens
ttcgcattaagcacaca

SEQ ID NO: 1167925 - DNA, 19 bp, Homo sapiens
ttcgccctctgaaattaaa

SEQ ID NO: 1167926 - DNA, 16 bp, Homo sapiens
ttcgcctttgtcttgt

SEQ ID NO: 1167927 - DNA, 19 bp, Homo sapiens
ttcgcgggtaactggggtt

SEQ ID NO: 1167928 - DNA, 19 bp, Homo sapiens
ttcgctgctagagaagggg

SEQ ID NO: 1167929 - DNA, 15 bp, Homo sapiens
ttcgctgctctagct

SEQ ID NO: 1167930 - DNA, 19 bp, Homo sapiens
ttcgctgctctagctggca

SEQ ID NO: 1167931 - DNA, 13 bp, Homo sapiens
ttcgctttcctct

SEQ ID NO: 1167932 - DNA, 18 bp, Homo sapiens
ttcggaaaaaaaaaaaga

SEQ ID NO: 1167933 - DNA, 22 bp, Homo sapiens
ttcggaaaaaaaaaaagaaaaa

SEQ ID NO: 1167934 - DNA, 20 bp, Homo sapiens
ttcggaaggggttcctcaaa

SEQ ID NO: 1167935 - DNA, 17 bp, Homo sapiens
ttcggacagacatatgg

SEQ ID NO: 1167936 - DNA, 19 bp, Homo sapiens
ttcggacagtttatttgtt

SEQ ID NO: 1167937 - DNA, 23 bp, Homo sapiens
ttcggacatgcttttctgccact

SEQ ID NO: 1167938 - DNA, 20 bp, Homo sapiens
ttcggcatttaacttacatt

SEQ ID NO: 1167939 - DNA, 22 bp, Homo sapiens
ttcggctgcttttatgtagttt

SEQ ID NO: 1167940 - DNA, 17 bp, Homo sapiens
ttcggggaactcctgga

SEQ ID NO: 1167941 - DNA, 13 bp, Homo sapiens
ttcggggcctgct

SEQ ID NO: 1167942 - DNA, 13 bp, Homo sapiens
ttcggtgtgcacc

SEQ ID NO: 1167943 - DNA, 19 bp, Homo sapiens
ttcggttctccagaatgta

SEQ ID NO: 1167944 - DNA, 14 bp, Homo sapiens
ttcggttgcagggc

SEQ ID NO: 1167945 - DNA, 16 bp, Homo sapiens
ttcggtttctgagcat

SEQ ID NO: 1167946 - DNA, 13 bp, Homo sapiens
ttcgtaacacagc

SEQ ID NO: 1167947 - DNA, 19 bp, Homo sapiens
ttcgtacataataagtttc

SEQ ID NO: 1167948 - DNA, 18 bp, Homo sapiens
ttcgtatgatcagtactg

SEQ ID NO: 1167949 - DNA, 21 bp, Homo sapiens
ttcgtcctgatccctccaccc

SEQ ID NO: 1167950 - DNA, 16 bp, Homo sapiens
ttcgtcttctaatttc

SEQ ID NO: 1167951 - DNA, 17 bp, Homo sapiens
ttcgtgaacatcccctc

SEQ ID NO: 1167952 - DNA, 21 bp, Homo sapiens
ttcgtgaagtatactgtattt

SEQ ID NO: 1167953 - DNA, 15 bp, Homo sapiens
ttcgtgagctgggga

SEQ ID NO: 1167954 - DNA, 18 bp, Homo sapiens
ttcgtgagctggggactc

SEQ ID NO: 1167955 - DNA, 13 bp, Homo sapiens
ttcgtgcattttt

SEQ ID NO: 1167956 - DNA, 14 bp, Homo sapiens
ttcgtgctggagga

SEQ ID NO: 1167957 - DNA, 20 bp, Homo sapiens
ttcgtgtagtggaagagcag

SEQ ID NO: 1167958 - DNA, 18 bp, Homo sapiens
ttcgtgtgctgctgctgc

SEQ ID NO: 1167959 - DNA, 17 bp, Homo sapiens
ttcgtgtgtgtctgctt

SEQ ID NO: 1167960 - DNA, 19 bp, Homo sapiens
ttcgttaactgtgtatgta

SEQ ID NO: 1167961 - DNA, 12 bp, Homo sapiens
ttcgttctgtgg

SEQ ID NO: 1167962 - DNA, 14 bp, Homo sapiens
ttcgtttctgtata

SEQ ID NO: 1167963 - DNA, 17 bp, Homo sapiens
ttcgtttgtttgtttca

SEQ ID NO: 1167964 - DNA, 20 bp, Homo sapiens
ttctaaaaagtcagatgttt

SEQ ID NO: 1167965 - DNA, 18 bp, Homo sapiens
ttctaaaaattgtgatca

SEQ ID NO: 1167966 - DNA, 14 bp, Homo sapiens
ttctaaaagccatt

SEQ ID NO: 1167967 - DNA, 16 bp, Homo sapiens
ttctaaaagttttcta

SEQ ID NO: 1167968 - DNA, 15 bp, Homo sapiens
ttctaaaatgattgt

SEQ ID NO: 1167969 - DNA, 13 bp, Homo sapiens
ttctacacagtaa

SEQ ID NO: 1167970 - DNA, 22 bp, Homo sapiens
ttctacacagtaaaaacttgta

SEQ ID NO: 1167971 - DNA, 18 bp, Homo sapiens
ttctacagaacctgaggg

SEQ ID NO: 1167972 - DNA, 14 bp, Homo sapiens
ttctacagaataat

SEQ ID NO: 1167973 - DNA, 21 bp, Homo sapiens
ttctacagtggttttatactg

SEQ ID NO: 1167974 - DNA, 14 bp, Homo sapiens
ttctacatgactgg

SEQ ID NO: 1167975 - DNA, 15 bp, Homo sapiens
ttctacatgactggg

SEQ ID NO: 1167976 - DNA, 14 bp, Homo sapiens
ttctacatttcacc

SEQ ID NO: 1167977 - DNA, 16 bp, Homo sapiens
ttctacatttcttaga

SEQ ID NO: 1167978 - DNA, 17 bp, Homo sapiens
ttctacatttcttagac

SEQ ID NO: 1167979 - DNA, 19 bp, Homo sapiens
ttctaccaaggtcttctta

SEQ ID NO: 1167980 - DNA, 19 bp, Homo sapiens
ttctaccaggcaaattcac

SEQ ID NO: 1167981 - DNA, 22 bp, Homo sapiens
ttctaccatgaacagaaaacat

SEQ ID NO: 1167982 - DNA, 18 bp, Homo sapiens
ttctaccctagccattcc

SEQ ID NO: 1167983 - DNA, 21 bp, Homo sapiens
ttctaccctagccattcctgg

SEQ ID NO: 1167984 - DNA, 15 bp, Homo sapiens
ttctactatatacat

SEQ ID NO: 1167985 - DNA, 19 bp, Homo sapiens
ttctactgtcaaatgatgt

SEQ ID NO: 1167986 - DNA, 18 bp, Homo sapiens
ttctacttcccctgggat

SEQ ID NO: 1167987 - DNA, 13 bp, Homo sapiens
ttctacttgaagt

SEQ ID NO: 1167988 - DNA, 17 bp, Homo sapiens
ttctactttcatcttaa

SEQ ID NO: 1167989 - DNA, 21 bp, Homo sapiens
ttctagaaacaaacatctaat

SEQ ID NO: 1167990 - DNA, 19 bp, Homo sapiens
ttctagaaactctggctca

SEQ ID NO: 1167991 - DNA, 17 bp, Homo sapiens
ttctagaaagcctgttc

SEQ ID NO: 1167992 - DNA, 15 bp, Homo sapiens
ttctagaagcacatg

SEQ ID NO: 1167993 - DNA, 16 bp, Homo sapiens
ttctagaagcacatgt

SEQ ID NO: 1167994 - DNA, 12 bp, Homo sapiens
ttctagacagag

SEQ ID NO: 1167995 - DNA, 22 bp, Homo sapiens
ttctagactcaaaacctggaga

SEQ ID NO: 1167996 - DNA, 15 bp, Homo sapiens
ttctagactttctgt

SEQ ID NO: 1167997 - DNA, 11 bp, Homo sapiens
ttctagagaca

SEQ ID NO: 1167998 - DNA, 14 bp, Homo sapiens
ttctagagacacat

SEQ ID NO: 1167999 - DNA, 14 bp, Homo sapiens
ttctagagcctcga

SEQ ID NO: 1168000 - DNA, 18 bp, Homo sapiens
ttctagatacaataaatt

SEQ ID NO: 1168001 - DNA, 19 bp, Homo sapiens
ttctagatcctgcacccca

SEQ ID NO: 1168002 - DNA, 16 bp, Homo sapiens
ttctagcaattttctt

SEQ ID NO: 1168003 - DNA, 18 bp, Homo sapiens
ttctagcaattttctttg

SEQ ID NO: 1168004 - DNA, 14 bp, Homo sapiens
ttctagcagagacc

SEQ ID NO: 1168005 - DNA, 22 bp, Homo sapiens
ttctagcagagaccctggtttt

SEQ ID NO: 1168006 - DNA, 14 bp, Homo sapiens
ttctagcagagtga

SEQ ID NO: 1168007 - DNA, 17 bp, Homo sapiens
ttctagcccctctggat

SEQ ID NO: 1168008 - DNA, 13 bp, Homo sapiens
ttctagcctctga

SEQ ID NO: 1168009 - DNA, 17 bp, Homo sapiens
ttctagctagaaatatg

SEQ ID NO: 1168010 - DNA, 15 bp, Homo sapiens
ttctagctgtctgtg

SEQ ID NO: 1168011 - DNA, 16 bp, Homo sapiens
ttctagctgtctgtga

SEQ ID NO: 1168012 - DNA, 20 bp, Homo sapiens
ttctagcttttctctttccc

SEQ ID NO: 1168013 - DNA, 19 bp, Homo sapiens
ttctaggagtcaactggct

SEQ ID NO: 1168014 - DNA, 23 bp, Homo sapiens
ttctaggcacaaggttggttgct

SEQ ID NO: 1168015 - DNA, 19 bp, Homo sapiens
ttctaggcatctctgtact

SEQ ID NO: 1168016 - DNA, 15 bp, Homo sapiens
ttctagggaaatgaa

SEQ ID NO: 1168017 - DNA, 14 bp, Homo sapiens
ttctaggggtagct

SEQ ID NO: 1168018 - DNA, 20 bp, Homo sapiens
ttctaggtcagtctaacagt

SEQ ID NO: 1168019 - DNA, 21 bp, Homo sapiens
ttctaggtcagtctaacagtt

SEQ ID NO: 1168020 - DNA, 14 bp, Homo sapiens
ttctaggtggcagg

SEQ ID NO: 1168021 - DNA, 15 bp, Homo sapiens
ttctaggtggcagga

SEQ ID NO: 1168022 - DNA, 22 bp, Homo sapiens
ttctagtacataattgattaaa

SEQ ID NO: 1168023 - DNA, 23 bp, Homo sapiens
ttctagtacataattgattaaaa

SEQ ID NO: 1168024 - DNA, 23 bp, Homo sapiens
ttctagtctcctttgcactgagg

SEQ ID NO: 1168025 - DNA, 16 bp, Homo sapiens
ttctagtgagcctggg

SEQ ID NO: 1168026 - DNA, 14 bp, Homo sapiens
ttctagtgctgctg

SEQ ID NO: 1168027 - DNA, 16 bp, Homo sapiens
ttctagtgctgctgaa

SEQ ID NO: 1168028 - DNA, 14 bp, Homo sapiens
ttctagtggctgtt

SEQ ID NO: 1168029 - DNA, 15 bp, Homo sapiens
ttctagtggctgttc

SEQ ID NO: 1168030 - DNA, 16 bp, Homo sapiens
ttctagtgtccataaa

SEQ ID NO: 1168031 - DNA, 11 bp, Homo sapiens
ttctagttcaa

SEQ ID NO: 1168032 - DNA, 14 bp, Homo sapiens
ttctagttgaaaat

SEQ ID NO: 1168033 - DNA, 19 bp, Homo sapiens
ttctagttgccctctacct

SEQ ID NO: 1168034 - DNA, 22 bp, Homo sapiens
ttctagtttcccacaatataaa

SEQ ID NO: 1168035 - DNA, 14 bp, Homo sapiens
ttctagttttcagt

SEQ ID NO: 1168036 - DNA, 21 bp, Homo sapiens
ttctataaatttaagaaaaca

SEQ ID NO: 1168037 - DNA, 23 bp, Homo sapiens
ttctataaggccataaaacaggt

SEQ ID NO: 1168038 - DNA, 17 bp, Homo sapiens
ttctataagttgtacca

SEQ ID NO: 1168039 - DNA, 12 bp, Homo sapiens
ttctataataag

SEQ ID NO: 1168040 - DNA, 14 bp, Homo sapiens
ttctatagccaaaa

SEQ ID NO: 1168041 - DNA, 17 bp, Homo sapiens
ttctatagccaaaaata

SEQ ID NO: 1168042 - DNA, 21 bp, Homo sapiens
ttctatagccaaaaatagcta

SEQ ID NO: 1168043 - DNA, 23 bp, Homo sapiens
ttctatagccaaaaatagctaaa

SEQ ID NO: 1168044 - DNA, 14 bp, Homo sapiens
ttctatagccaact

SEQ ID NO: 1168045 - DNA, 20 bp, Homo sapiens
ttctataggaacatatgaaa

SEQ ID NO: 1168046 - DNA, 21 bp, Homo sapiens
ttctatataaaatgtattcaa

SEQ ID NO: 1168047 - DNA, 23 bp, Homo sapiens
ttctatatagttccttgccttaa

SEQ ID NO: 1168048 - DNA, 12 bp, Homo sapiens
ttctatatcaaa

SEQ ID NO: 1168049 - DNA, 23 bp, Homo sapiens
ttctatatgaatttaaatataat

SEQ ID NO: 1168050 - DNA, 15 bp, Homo sapiens
ttctatattttaata

SEQ ID NO: 1168051 - DNA, 14 bp, Homo sapiens
ttctatcacatatt

SEQ ID NO: 1168052 - DNA, 14 bp, Homo sapiens
ttctgaataaaaaa

SEQ ID NO: 1168053 - DNA, 20 bp, Homo sapiens
ttctgaataaaaaagattct

SEQ ID NO: 1168054 - DNA, 22 bp, Homo sapiens
ttctgaataaaaaagattctac

SEQ ID NO: 1168055 - DNA, 22 bp, Homo sapiens
ttctgaatcaagcacactgtat

SEQ ID NO: 1168056 - DNA, 22 bp, Homo sapiens
ttctgaatcctggtaattaaaa

SEQ ID NO: 1168057 - DNA, 14 bp, Homo sapiens
ttctgaatgctgct

SEQ ID NO: 1168058 - DNA, 18 bp, Homo sapiens
ttctgaatgctgctactt

SEQ ID NO: 1168059 - DNA, 18 bp, Homo sapiens
ttctgaatgcttctaagt

SEQ ID NO: 1168060 - DNA, 23 bp, Homo sapiens
ttctgaatgcttctaagtaaata

SEQ ID NO: 1168061 - DNA, 16 bp, Homo sapiens
ttctgaattgtccttt

SEQ ID NO: 1168062 - DNA, 19 bp, Homo sapiens
ttctgacaaaaagtttcca

SEQ ID NO: 1168063 - DNA, 22 bp, Homo sapiens
ttctgacagcccaacttccaga

SEQ ID NO: 1168064 - DNA, 18 bp, Homo sapiens
ttctgacagtttttctgt

SEQ ID NO: 1168065 - DNA, 14 bp, Homo sapiens
ttctgacataaaat

SEQ ID NO: 1168066 - DNA, 19 bp, Homo sapiens
ttctgacatcaaaacttgg

SEQ ID NO: 1168067 - DNA, 23 bp, Homo sapiens
ttctgacatgtaagaaaatgtta

SEQ ID NO: 1168068 - DNA, 22 bp, Homo sapiens
ttctgacattaacagttttcca

SEQ ID NO: 1168069 - DNA, 19 bp, Homo sapiens
ttctgacatttatatttgt

SEQ ID NO: 1168070 - DNA, 13 bp, Homo sapiens
ttctgaccacact

SEQ ID NO: 1168071 - DNA, 17 bp, Homo sapiens
ttctgaccacagcatca

SEQ ID NO: 1168072 - DNA, 14 bp, Homo sapiens
ttctgaccccactt

SEQ ID NO: 1168073 - DNA, 18 bp, Homo sapiens
ttctgaccctgcttcaaa

SEQ ID NO: 1168074 - DNA, 21 bp, Homo sapiens
ttctgacgtcagcgcaccaaa

SEQ ID NO: 1168075 - DNA, 15 bp, Homo sapiens
ttctgactctgagct

SEQ ID NO: 1168076 - DNA, 14 bp, Homo sapiens
ttctgactgtccct

SEQ ID NO: 1168077 - DNA, 21 bp, Homo sapiens
ttctgacttctagctgtctgt

SEQ ID NO: 1168078 - DNA, 22 bp, Homo sapiens
ttctgacttctagctgtctgtg

SEQ ID NO: 1168079 - DNA, 15 bp, Homo sapiens
ttctgagaccacagt

SEQ ID NO: 1168080 - DNA, 15 bp, Homo sapiens
ttctgagcattcgct

SEQ ID NO: 1168081 - DNA, 13 bp, Homo sapiens
ttctgagccttga

SEQ ID NO: 1168082 - DNA, 16 bp, Homo sapiens
ttctgagctatttcat

SEQ ID NO: 1168083 - DNA, 20 bp, Homo sapiens
ttctgagctccacctctggt

SEQ ID NO: 1168084 - DNA, 16 bp, Homo sapiens
ttctgagctccccatc

SEQ ID NO: 1168085 - DNA, 18 bp, Homo sapiens
ttctgagctccccatcac

SEQ ID NO: 1168086 - DNA, 13 bp, Homo sapiens
ttctgagctgggc

SEQ ID NO: 1168087 - DNA, 23 bp, Homo sapiens
ttctgaggaccgctgataagcat

SEQ ID NO: 1168088 - DNA, 20 bp, Homo sapiens
ttctgagtgtttttactaca

SEQ ID NO: 1168089 - DNA, 21 bp, Homo sapiens
ttctgagtttatattctgaaa

SEQ ID NO: 1168090 - DNA, 21 bp, Homo sapiens
ttctgagttttgtgtttgttg

SEQ ID NO: 1168091 - DNA, 19 bp, Homo sapiens
ttctgataaaagatggcca

SEQ ID NO: 1168092 - DNA, 19 bp, Homo sapiens
ttctgataaagttccttaa

SEQ ID NO: 1168093 - DNA, 16 bp, Homo sapiens
ttctgatctgtacttt

SEQ ID NO: 1168094 - DNA, 14 bp, Homo sapiens
ttctgatgaaatgt

SEQ ID NO: 1168095 - DNA, 18 bp, Homo sapiens
ttctgatgaaatgttaac

SEQ ID NO: 1168096 - DNA, 13 bp, Homo sapiens
ttctgatgagcaa

SEQ ID NO: 1168097 - DNA, 13 bp, Homo sapiens
ttctgatgatgtc

SEQ ID NO: 1168098 - DNA, 14 bp, Homo sapiens
ttctgatgatgtcg

SEQ ID NO: 1168099 - DNA, 23 bp, Homo sapiens
ttctgatgtctccagattggcac

SEQ ID NO: 1168100 - DNA, 17 bp, Homo sapiens
ttctgattagaaatgac

SEQ ID NO: 1168101 - DNA, 13 bp, Homo sapiens
ttctgattagagt

SEQ ID NO: 1168102 - DNA, 12 bp, Homo sapiens
ttctgattccac

SEQ ID NO: 1168103 - DNA, 18 bp, Homo sapiens
ttctgattcttttttcag

SEQ ID NO: 1168104 - DNA, 18 bp, Homo sapiens
ttctgattgtgttgaaga

SEQ ID NO: 1168105 - DNA, 18 bp, Homo sapiens
ttctgatttcataattca

SEQ ID NO: 1168106 - DNA, 14 bp, Homo sapiens
ttctgcaaaataca

SEQ ID NO: 1168107 - DNA, 23 bp, Homo sapiens
ttctgcaaatagaaaacaggaaa

SEQ ID NO: 1168108 - DNA, 20 bp, Homo sapiens
ttctgcaactagccaaggct

SEQ ID NO: 1168109 - DNA, 15 bp, Homo sapiens
ttctgcaagaattaa

SEQ ID NO: 1168110 - DNA, 17 bp, Homo sapiens
ttctgcaagaattaaaa

SEQ ID NO: 1168111 - DNA, 18 bp, Homo sapiens
ttctgcaagaattaaaac

SEQ ID NO: 1168112 - DNA, 21 bp, Homo sapiens
ttctgcaagaattaaaactga

SEQ ID NO: 1168113 - DNA, 15 bp, Homo sapiens
ttctgcacacagcac

SEQ ID NO: 1168114 - DNA, 14 bp, Homo sapiens
ttctgcactgttgc

SEQ ID NO: 1168115 - DNA, 20 bp, Homo sapiens
ttctgcagcatgacctgtga

SEQ ID NO: 1168116 - DNA, 17 bp, Homo sapiens
ttctgcagcctcggcct

SEQ ID NO: 1168117 - DNA, 22 bp, Homo sapiens
ttctgcagcctcggcctaggtc

SEQ ID NO: 1168118 - DNA, 18 bp, Homo sapiens
ttctgcagtaaatctttt

SEQ ID NO: 1168119 - DNA, 19 bp, Homo sapiens
ttctgcagtagtctctgtg

SEQ ID NO: 1168120 - DNA, 21 bp, Homo sapiens
ttctgcagtagtctctgtgct

SEQ ID NO: 1168121 - DNA, 21 bp, Homo sapiens
ttctgcatatgttgaatactt

SEQ ID NO: 1168122 - DNA, 16 bp, Homo sapiens
ttctgcatgtactagt

SEQ ID NO: 1168123 - DNA, 19 bp, Homo sapiens
ttctgcattcatttttata

SEQ ID NO: 1168124 - DNA, 21 bp, Homo sapiens
ttctgcattcatttttatagc

SEQ ID NO: 1168125 - DNA, 16 bp, Homo sapiens
ttctgcattgctagat

SEQ ID NO: 1168126 - DNA, 22 bp, Homo sapiens
ttctgcattgctagataaaagc

SEQ ID NO: 1168127 - DNA, 18 bp, Homo sapiens
ttctgccaacgcctcctg

SEQ ID NO: 1168128 - DNA, 14 bp, Homo sapiens
ttctgccacataaa

SEQ ID NO: 1168129 - DNA, 11 bp, Homo sapiens
ttctggaaatt

SEQ ID NO: 1168130 - DNA, 19 bp, Homo sapiens
ttctggaagactgctcccg

SEQ ID NO: 1168131 - DNA, 19 bp, Homo sapiens
ttctggaaggctggctgag

SEQ ID NO: 1168132 - DNA, 17 bp, Homo sapiens
ttctggaatacatgaaa

SEQ ID NO: 1168133 - DNA, 19 bp, Homo sapiens
ttctggaatacatgaaata

SEQ ID NO: 1168134 - DNA, 15 bp, Homo sapiens
ttctggaatgtaatc

SEQ ID NO: 1168135 - DNA, 20 bp, Homo sapiens
ttctggaatgtaatcaatgt

SEQ ID NO: 1168136 - DNA, 14 bp, Homo sapiens
ttctggaatttgtt

SEQ ID NO: 1168137 - DNA, 18 bp, Homo sapiens
ttctggaatttgttcaag

SEQ ID NO: 1168138 - DNA, 21 bp, Homo sapiens
ttctggaatttgttcaagttt

SEQ ID NO: 1168139 - DNA, 20 bp, Homo sapiens
ttctggactatagctgttct

SEQ ID NO: 1168140 - DNA, 17 bp, Homo sapiens
ttctggactctgcccca

SEQ ID NO: 1168141 - DNA, 20 bp, Homo sapiens
ttctggactctgccccaatc

SEQ ID NO: 1168142 - DNA, 11 bp, Homo sapiens
ttctggactgg

SEQ ID NO: 1168143 - DNA, 19 bp, Homo sapiens
ttctggagcaggtggcttg

SEQ ID NO: 1168144 - DNA, 13 bp, Homo sapiens
ttctggagccctt

SEQ ID NO: 1168145 - DNA, 20 bp, Homo sapiens
ttctggagctgggagacaaa

SEQ ID NO: 1168146 - DNA, 19 bp, Homo sapiens
ttctggaggggagagcttt

SEQ ID NO: 1168147 - DNA, 17 bp, Homo sapiens
ttctggagtctccagtg

SEQ ID NO: 1168148 - DNA, 17 bp, Homo sapiens
ttctggagtttctctaa

SEQ ID NO: 1168149 - DNA, 18 bp, Homo sapiens
ttctggataaaccaccct

SEQ ID NO: 1168150 - DNA, 14 bp, Homo sapiens
ttctggatctcctg

SEQ ID NO: 1168151 - DNA, 22 bp, Homo sapiens
ttctggatctgaccctcccagt

SEQ ID NO: 1168152 - DNA, 10 bp, Homo sapiens
ttctggcagg

SEQ ID NO: 1168153 - DNA, 15 bp, Homo sapiens
ttctggcctcccaca

SEQ ID NO: 1168154 - DNA, 15 bp, Homo sapiens
ttctggcctcctaag

SEQ ID NO: 1168155 - DNA, 14 bp, Homo sapiens
ttctggcctgcctt

SEQ ID NO: 1168156 - DNA, 22 bp, Homo sapiens
ttctggcgcccctgcctgtgcc

SEQ ID NO: 1168157 - DNA, 20 bp, Homo sapiens
ttctggctatgcatttgaaa

SEQ ID NO: 1168158 - DNA, 19 bp, Homo sapiens
ttctggctgaacactggca

SEQ ID NO: 1168159 - DNA, 20 bp, Homo sapiens
ttctggctgccccaacctgc

SEQ ID NO: 1168160 - DNA, 16 bp, Homo sapiens
ttctggcttcagcccc

SEQ ID NO: 1168161 - DNA, 17 bp, Homo sapiens
ttctgggaaatggcttg

SEQ ID NO: 1168162 - DNA, 16 bp, Homo sapiens
ttctgggaactctcct

SEQ ID NO: 1168163 - DNA, 22 bp, Homo sapiens
ttctgggagctcaaggccacct

SEQ ID NO: 1168164 - DNA, 21 bp, Homo sapiens
ttctgggagggcagcagggct

SEQ ID NO: 1168165 - DNA, 15 bp, Homo sapiens
ttctgggatgtcaca

SEQ ID NO: 1168166 - DNA, 23 bp, Homo sapiens
ttctgggcacagtggactcagca

SEQ ID NO: 1168167 - DNA, 20 bp, Homo sapiens
ttctgggcaccacaaaatat

SEQ ID NO: 1168168 - DNA, 13 bp, Homo sapiens
ttctgggcagagc

SEQ ID NO: 1168169 - DNA, 15 bp, Homo sapiens
ttctgggcctgacca

SEQ ID NO: 1168170 - DNA, 15 bp, Homo sapiens
ttctgggctctgcca

SEQ ID NO: 1168171 - DNA, 10 bp, Homo sapiens
ttctgggctg

SEQ ID NO: 1168172 - DNA, 14 bp, Homo sapiens
ttctgggcttcatt

SEQ ID NO: 1168173 - DNA, 19 bp, Homo sapiens
ttctgggcttggggtgtgg

SEQ ID NO: 1168174 - DNA, 13 bp, Homo sapiens
ttctgggctttct

SEQ ID NO: 1168175 - DNA, 18 bp, Homo sapiens
ttctggggcaggctgggc

SEQ ID NO: 1168176 - DNA, 19 bp, Homo sapiens
ttctggggcaggctgggcc

SEQ ID NO: 1168177 - DNA, 14 bp, Homo sapiens
ttctggggcccctt

SEQ ID NO: 1168178 - DNA, 23 bp, Homo sapiens
ttctggggcccctttttactccc

SEQ ID NO: 1168179 - DNA, 21 bp, Homo sapiens
ttctgggggtaggatgaagag

SEQ ID NO: 1168180 - DNA, 14 bp, Homo sapiens
ttctgggtccctgc

SEQ ID NO: 1168181 - DNA, 15 bp, Homo sapiens
ttctgggtccctgct

SEQ ID NO: 1168182 - DNA, 18 bp, Homo sapiens
ttctgggtccctgctccc

SEQ ID NO: 1168183 - DNA, 14 bp, Homo sapiens
ttctgggtggcctc

SEQ ID NO: 1168184 - DNA, 16 bp, Homo sapiens
ttctgggtgttgacca

SEQ ID NO: 1168185 - DNA, 14 bp, Homo sapiens
ttctgggtttgccc

SEQ ID NO: 1168186 - DNA, 17 bp, Homo sapiens
ttctgggtttgcccagt

SEQ ID NO: 1168187 - DNA, 23 bp, Homo sapiens
ttctgggtttgcccagtcctggg

SEQ ID NO: 1168188 - DNA, 19 bp, Homo sapiens
ttctggtagatagaaataa

SEQ ID NO: 1168189 - DNA, 14 bp, Homo sapiens
ttctggtatacatt

SEQ ID NO: 1168190 - DNA, 18 bp, Homo sapiens
ttctggtatttcccctgt

SEQ ID NO: 1168191 - DNA, 16 bp, Homo sapiens
ttctggtgggacaatg

SEQ ID NO: 1168192 - DNA, 19 bp, Homo sapiens
ttctggtggggtgtgttcc

SEQ ID NO: 1168193 - DNA, 14 bp, Homo sapiens
ttctggtgggttga

SEQ ID NO: 1168194 - DNA, 21 bp, Homo sapiens
ttctggtgttcctaccaggac

SEQ ID NO: 1168195 - DNA, 21 bp, Homo sapiens
ttctggtgttttatttcctat

SEQ ID NO: 1168196 - DNA, 15 bp, Homo sapiens
ttctggttatttatg

SEQ ID NO: 1168197 - DNA, 23 bp, Homo sapiens
ttctggttatttatggtttctgt

SEQ ID NO: 1168198 - DNA, 12 bp, Homo sapiens
ttctggttccaa

SEQ ID NO: 1168199 - DNA, 14 bp, Homo sapiens
ttctggttccaaac

SEQ ID NO: 1168200 - DNA, 23 bp, Homo sapiens
ttctggttctgtgtcctctgcct

SEQ ID NO: 1168201 - DNA, 14 bp, Homo sapiens
ttctggttgatttg

SEQ ID NO: 1168202 - DNA, 18 bp, Homo sapiens
ttctggttgtatttctat

SEQ ID NO: 1168203 - DNA, 17 bp, Homo sapiens
ttctgtaaaatgtctgt

SEQ ID NO: 1168204 - DNA, 19 bp, Homo sapiens
ttctgtaaactcaaaactt

SEQ ID NO: 1168205 - DNA, 12 bp, Homo sapiens
ttcttcctcaca

SEQ ID NO: 1168206 - DNA, 23 bp, Homo sapiens
ttcttcctcacactgctgtcctc

SEQ ID NO: 1168207 - DNA, 14 bp, Homo sapiens
ttcttcctcccctc

SEQ ID NO: 1168208 - DNA, 14 bp, Homo sapiens
ttcttcctctcctt

SEQ ID NO: 1168209 - DNA, 12 bp, Homo sapiens
ttcttcctctgc

SEQ ID NO: 1168210 - DNA, 15 bp, Homo sapiens
ttcttcctgccagca

SEQ ID NO: 1168211 - DNA, 22 bp, Homo sapiens
ttcttccttaattcactcccac

SEQ ID NO: 1168212 - DNA, 14 bp, Homo sapiens
ttcttccttcctag

SEQ ID NO: 1168213 - DNA, 17 bp, Homo sapiens
ttcttcctttactttcc

SEQ ID NO: 1168214 - DNA, 18 bp, Homo sapiens
ttcttcctttactttccc

SEQ ID NO: 1168215 - DNA, 23 bp, Homo sapiens
ttcttcgaggtggatcacagagg

SEQ ID NO: 1168216 - DNA, 16 bp, Homo sapiens
ttcttcgctgctctag

SEQ ID NO: 1168217 - DNA, 20 bp, Homo sapiens
ttcttcgctgctctagctgg

SEQ ID NO: 1168218 - DNA, 23 bp, Homo sapiens
ttcttcgctgctctagctggcag

SEQ ID NO: 1168219 - DNA, 17 bp, Homo sapiens
ttcttcgtatatacaca

SEQ ID NO: 1168220 - DNA, 18 bp, Homo sapiens
ttcttctaagaagacatt

SEQ ID NO: 1168221 - DNA, 21 bp, Homo sapiens
ttcttctaattatttaaataa

SEQ ID NO: 1168222 - DNA, 23 bp, Homo sapiens
ttcttctaccacacctggaaaca

SEQ ID NO: 1168223 - DNA, 21 bp, Homo sapiens
ttcttctaggttctaaaaatt

SEQ ID NO: 1168224 - DNA, 13 bp, Homo sapiens
ttcttctctgtga

SEQ ID NO: 1168225 - DNA, 19 bp, Homo sapiens
ttcttctcttagattctta

SEQ ID NO: 1168226 - DNA, 16 bp, Homo sapiens
ttcttctcttatcctc

SEQ ID NO: 1168227 - DNA, 14 bp, Homo sapiens
ttcttctctttagt

SEQ ID NO: 1168228 - DNA, 12 bp, Homo sapiens
ttcttctgccct

SEQ ID NO: 1168229 - DNA, 13 bp, Homo sapiens
ttcttctgccctt

SEQ ID NO: 1168230 - DNA, 15 bp, Homo sapiens
ttcttctgtaatatt

SEQ ID NO: 1168231 - DNA, 15 bp, Homo sapiens
ttcttcttctaagaa

SEQ ID NO: 1168232 - DNA, 13 bp, Homo sapiens
ttcttctttctag

SEQ ID NO: 1168233 - DNA, 15 bp, Homo sapiens
ttcttctttctagag

SEQ ID NO: 1168234 - DNA, 14 bp, Homo sapiens
ttcttgaaaagcct

SEQ ID NO: 1168235 - DNA, 15 bp, Homo sapiens
ttcttgaaaagcctt

SEQ ID NO: 1168236 - DNA, 16 bp, Homo sapiens
ttcttgaaaagccttg

SEQ ID NO: 1168237 - DNA, 14 bp, Homo sapiens
ttcttgaaagctgt

SEQ ID NO: 1168238 - DNA, 15 bp, Homo sapiens
ttcttgaaagctgtg

SEQ ID NO: 1168239 - DNA, 16 bp, Homo sapiens
ttcttgaatataaaaa

SEQ ID NO: 1168240 - DNA, 15 bp, Homo sapiens
ttcttgaatatctgc

SEQ ID NO: 1168241 - DNA, 12 bp, Homo sapiens
ttcttgaattgt

SEQ ID NO: 1168242 - DNA, 21 bp, Homo sapiens
ttcttgaatttaataatctgt

SEQ ID NO: 1168243 - DNA, 23 bp, Homo sapiens
ttcttgacaagctgacttggcac

SEQ ID NO: 1168244 - DNA, 21 bp, Homo sapiens
ttcttgaggggaagctagtct

SEQ ID NO: 1168245 - DNA, 16 bp, Homo sapiens
ttcttgagttttgata

SEQ ID NO: 1168246 - DNA, 15 bp, Homo sapiens
ttcttgattttcaag

SEQ ID NO: 1168247 - DNA, 13 bp, Homo sapiens
ttcttgcaaagta

SEQ ID NO: 1168248 - DNA, 16 bp, Homo sapiens
ttcttgcaaatacctc

SEQ ID NO: 1168249 - DNA, 16 bp, Homo sapiens
ttcttgcactccttcc

SEQ ID NO: 1168250 - DNA, 18 bp, Homo sapiens
ttcttgcactccttccct

SEQ ID NO: 1168251 - DNA, 14 bp, Homo sapiens
ttcttgcactgaat

SEQ ID NO: 1168252 - DNA, 19 bp, Homo sapiens
ttcttgcactgaatatata

SEQ ID NO: 1168253 - DNA, 15 bp, Homo sapiens
ttcttgcagattcta

SEQ ID NO: 1168254 - DNA, 11 bp, Homo sapiens
ttcttgcatct

SEQ ID NO: 1168255 - DNA, 16 bp, Homo sapiens
ttcttgccaatgaggt

SEQ ID NO: 1168256 - DNA, 14 bp, Homo sapiens
ttcttgccaccctc

SEQ ID NO: 1168257 - DNA, 16 bp, Homo sapiens
ttcttgccatcactgg

SEQ ID NO: 1168258 - DNA, 20 bp, Homo sapiens
ttcttgccatcactggtcca

SEQ ID NO: 1168259 - DNA, 21 bp, Homo sapiens
ttcttgcctactatgccagat

SEQ ID NO: 1168260 - DNA, 16 bp, Homo sapiens
ttcttgcctctgtgct

SEQ ID NO: 1168261 - DNA, 18 bp, Homo sapiens
ttcttgcctgaactcctg

SEQ ID NO: 1168262 - DNA, 21 bp, Homo sapiens
ttcttgctacaccccttttcc

SEQ ID NO: 1168263 - DNA, 18 bp, Homo sapiens
ttcttgctgccctgcccc

SEQ ID NO: 1168264 - DNA, 14 bp, Homo sapiens
ttcttgctggttgt

SEQ ID NO: 1168265 - DNA, 23 bp, Homo sapiens
ttcttgctggttgtcatttttgc

SEQ ID NO: 1168266 - DNA, 14 bp, Homo sapiens
ttcttgctgttcag

SEQ ID NO: 1168267 - DNA, 17 bp, Homo sapiens
ttcttgctgttcagtgc

SEQ ID NO: 1168268 - DNA, 17 bp, Homo sapiens
ttcttgcttcagtcatc

SEQ ID NO: 1168269 - DNA, 17 bp, Homo sapiens
ttcttgcttggaagcca

SEQ ID NO: 1168270 - DNA, 19 bp, Homo sapiens
ttcttgctttagaaaacat

SEQ ID NO: 1168271 - DNA, 12 bp, Homo sapiens
ttcttgctttca

SEQ ID NO: 1168272 - DNA, 18 bp, Homo sapiens
ttcttgctttggggaaaa

SEQ ID NO: 1168273 - DNA, 20 bp, Homo sapiens
ttcttggaccagtttgcaga

SEQ ID NO: 1168274 - DNA, 15 bp, Homo sapiens
ttcttggacccctga

SEQ ID NO: 1168275 - DNA, 15 bp, Homo sapiens
ttcttggcttctggg

SEQ ID NO: 1168276 - DNA, 19 bp, Homo sapiens
ttcttggcttctgggacct

SEQ ID NO: 1168277 - DNA, 21 bp, Homo sapiens
ttcttgggagtatgttgtcat

SEQ ID NO: 1168278 - DNA, 22 bp, Homo sapiens
ttcttgggagtatgttgtcata

SEQ ID NO: 1168279 - DNA, 18 bp, Homo sapiens
ttcttgggatagtgttct

SEQ ID NO: 1168280 - DNA, 22 bp, Homo sapiens
ttcttgggatagtgttctgctc

SEQ ID NO: 1168281 - DNA, 18 bp, Homo sapiens
ttcttggggccctacacc

SEQ ID NO: 1168282 - DNA, 18 bp, Homo sapiens
ttcttggggtactcttga

SEQ ID NO: 1168283 - DNA, 12 bp, Homo sapiens
ttcttgggtagt

SEQ ID NO: 1168284 - DNA, 17 bp, Homo sapiens
ttcttgggtctgccctg

SEQ ID NO: 1168285 - DNA, 16 bp, Homo sapiens
ttcttggtcaagaaag

SEQ ID NO: 1168286 - DNA, 18 bp, Homo sapiens
ttcttggttcataaatga

SEQ ID NO: 1168287 - DNA, 19 bp, Homo sapiens
ttcttggttcataaatgaa

SEQ ID NO: 1168288 - DNA, 13 bp, Homo sapiens
ttcttggttcctg

SEQ ID NO: 1168289 - DNA, 16 bp, Homo sapiens
ttcttggttgttaatt

SEQ ID NO: 1168290 - DNA, 17 bp, Homo sapiens
ttcttggtttctggata

SEQ ID NO: 1168291 - DNA, 12 bp, Homo sapiens
ttcttgtacagt

SEQ ID NO: 1168292 - DNA, 14 bp, Homo sapiens
ttcttgtatctgga

SEQ ID NO: 1168293 - DNA, 13 bp, Homo sapiens
ttcttgtctataa

SEQ ID NO: 1168294 - DNA, 16 bp, Homo sapiens
ttcttgtctttcctcc

SEQ ID NO: 1168295 - DNA, 23 bp, Homo sapiens
ttcttgtgcatgtttactttatt

SEQ ID NO: 1168296 - DNA, 21 bp, Homo sapiens
ttcttgtgggagacagcagcc

SEQ ID NO: 1168297 - DNA, 17 bp, Homo sapiens
ttcttgttggtgcacag

SEQ ID NO: 1168298 - DNA, 15 bp, Homo sapiens
ttcttgtttccttgt

SEQ ID NO: 1168299 - DNA, 16 bp, Homo sapiens
ttcttgtttccttgtt

SEQ ID NO: 1168300 - DNA, 15 bp, Homo sapiens
ttcttgttttatata

SEQ ID NO: 1168301 - DNA, 23 bp, Homo sapiens
ttctttaaaaaacaactatggat

SEQ ID NO: 1168302 - DNA, 19 bp, Homo sapiens
ttctttaactgccgtaatt

SEQ ID NO: 1168303 - DNA, 22 bp, Homo sapiens
ttctttacaaaacaaactcatt

SEQ ID NO: 1168304 - DNA, 15 bp, Homo sapiens
ttctttactattaaa

SEQ ID NO: 1168305 - DNA, 16 bp, Homo sapiens
ttctttagaattttta

SEQ ID NO: 1168306 - DNA, 15 bp, Homo sapiens
ttctttagaggcttt

SEQ ID NO: 1168307 - DNA, 22 bp, Homo sapiens
ttctttagcatttttatgcaga

SEQ ID NO: 1168308 - DNA, 12 bp, Homo sapiens
ttctttagtctt

SEQ ID NO: 1168309 - DNA, 13 bp, Homo sapiens
ttctttataaact

SEQ ID NO: 1168310 - DNA, 21 bp, Homo sapiens
ttctttattgcactaggaatt

SEQ ID NO: 1168311 - DNA, 14 bp, Homo sapiens
ttctttatttttgt

SEQ ID NO: 1168312 - DNA, 19 bp, Homo sapiens
ttctttcacaaaaaagaag

SEQ ID NO: 1168313 - DNA, 17 bp, Homo sapiens
ttctttcacttgatgtt

SEQ ID NO: 1168314 - DNA, 18 bp, Homo sapiens
ttctttcacttgatgttt

SEQ ID NO: 1168315 - DNA, 20 bp, Homo sapiens
ttctttcacttgatgtttgt

SEQ ID NO: 1168316 - DNA, 13 bp, Homo sapiens
ttctttcagatgt

SEQ ID NO: 1168317 - DNA, 17 bp, Homo sapiens
ttctttccatgcagact

SEQ ID NO: 1168318 - DNA, 14 bp, Homo sapiens
ttctttccattatg

SEQ ID NO: 1168319 - DNA, 20 bp, Homo sapiens
ttctttccattatgattctt

SEQ ID NO: 1168320 - DNA, 21 bp, Homo sapiens
ttctttccattcttcttgcta

SEQ ID NO: 1168321 - DNA, 16 bp, Homo sapiens
ttctttcccagtctgt

SEQ ID NO: 1168322 - DNA, 16 bp, Homo sapiens
ttctttccccagaggc

SEQ ID NO: 1168323 - DNA, 20 bp, Homo sapiens
ttctttcctctttctgctct

SEQ ID NO: 1168324 - DNA, 12 bp, Homo sapiens
ttctttcctgcc

SEQ ID NO: 1168325 - DNA, 18 bp, Homo sapiens
ttctttcctttactcctg

SEQ ID NO: 1168326 - DNA, 18 bp, Homo sapiens
ttctttctcacccaggca

SEQ ID NO: 1168327 - DNA, 14 bp, Homo sapiens
ttctttctgaagat

SEQ ID NO: 1168328 - DNA, 14 bp, Homo sapiens
ttctttctggactg

SEQ ID NO: 1168329 - DNA, 12 bp, Homo sapiens
ttctttctggct

SEQ ID NO: 1168330 - DNA, 19 bp, Homo sapiens
ttctttgaaaaaaaataaa

SEQ ID NO: 1168331 - DNA, 21 bp, Homo sapiens
agaggcaggaatgggggtcag

SEQ ID NO: 1168332 - DNA, 13 bp, Homo sapiens
agaggcaggctgg

SEQ ID NO: 1168333 - DNA, 21 bp, Homo sapiens
agaggcagtgatgacttgctg

SEQ ID NO: 1168334 - DNA, 17 bp, Homo sapiens
agaggcatttaaaatgg

SEQ ID NO: 1168335 - DNA, 19 bp, Homo sapiens
agaggccaaggtattctat

SEQ ID NO: 1168336 - DNA, 13 bp, Homo sapiens
agaggccaatgcc

SEQ ID NO: 1168337 - DNA, 22 bp, Homo sapiens
agaggccactgtgggtgaagcg

SEQ ID NO: 1168338 - DNA, 16 bp, Homo sapiens
agaggccagccccacc

SEQ ID NO: 1168339 - DNA, 21 bp, Homo sapiens
agaggccagccccacccagga

SEQ ID NO: 1168340 - DNA, 19 bp, Homo sapiens
agaggccatgattcgccca

SEQ ID NO: 1168341 - DNA, 14 bp, Homo sapiens
agaggccatggcag

SEQ ID NO: 1168342 - DNA, 15 bp, Homo sapiens
agaggccatggcaga

SEQ ID NO: 1168343 - DNA, 16 bp, Homo sapiens
agaggcccaggcacca

SEQ ID NO: 1168344 - DNA, 21 bp, Homo sapiens
agaggtgaaattccagatgag

SEQ ID NO: 1168345 - DNA, 18 bp, Homo sapiens
agaggtgagaaaactcaa

SEQ ID NO: 1168346 - DNA, 16 bp, Homo sapiens
agaggtgccagcaact

SEQ ID NO: 1168347 - DNA, 21 bp, Homo sapiens
agaggtgccagcaactgaata

SEQ ID NO: 1168348 - DNA, 23 bp, Homo sapiens
agaggtgccggggaggggcagag

SEQ ID NO: 1168349 - DNA, 14 bp, Homo sapiens
agaggtggatgtta

SEQ ID NO: 1168350 - DNA, 22 bp, Homo sapiens
agaggtggatgttatgaacagc

SEQ ID NO: 1168351 - DNA, 23 bp, Homo sapiens
agaggtggatgttatgaacagct

SEQ ID NO: 1168352 - DNA, 14 bp, Homo sapiens
agaggtggcccttg

SEQ ID NO: 1168353 - DNA, 20 bp, Homo sapiens
agaggtgggatcctccctca

SEQ ID NO: 1168354 - DNA, 21 bp, Homo sapiens
agaggtgggatcctccctcat

SEQ ID NO: 1168355 - DNA, 13 bp, Homo sapiens
agaggtgggcagc

SEQ ID NO: 1168356 - DNA, 17 bp, Homo sapiens
agaggtgggcagctggg

SEQ ID NO: 1168357 - DNA, 19 bp, Homo sapiens
agaggtgggcaggtggtgg

SEQ ID NO: 1168358 - DNA, 22 bp, Homo sapiens
agaggtgtttttataatatcca

SEQ ID NO: 1168359 - DNA, 23 bp, Homo sapiens
agaggttaaggtgggtccaggaa

SEQ ID NO: 1168360 - DNA, 18 bp, Homo sapiens
agaggttatctgcctggc

SEQ ID NO: 1168361 - DNA, 20 bp, Homo sapiens
agaggttatctgcctggcct

SEQ ID NO: 1168362 - DNA, 17 bp, Homo sapiens
agaggttcatttcaaat

SEQ ID NO: 1168363 - DNA, 14 bp, Homo sapiens
agaggttgcagtga

SEQ ID NO: 1168364 - DNA, 13 bp, Homo sapiens
agaggtttaaatg

SEQ ID NO: 1168365 - DNA, 14 bp, Homo sapiens
agaggtttaaatgt

SEQ ID NO: 1168366 - DNA, 15 bp, Homo sapiens
agaggtttcttgaat

SEQ ID NO: 1168367 - DNA, 22 bp, Homo sapiens
agaggtttgactagatgatgga

SEQ ID NO: 1168368 - DNA, 13 bp, Homo sapiens
agaggtttgctga

SEQ ID NO: 1168369 - DNA, 19 bp, Homo sapiens
agaggttttaaagtgatta

SEQ ID NO: 1168370 - DNA, 19 bp, Homo sapiens
agaggttttaatgtctgtt

SEQ ID NO: 1168371 - DNA, 13 bp, Homo sapiens
agaggttttgtat

SEQ ID NO: 1168372 - DNA, 12 bp, Homo sapiens
agaggttttgtt

SEQ ID NO: 1168373 - DNA, 16 bp, Homo sapiens
agaggtttttcttggg

SEQ ID NO: 1168374 - DNA, 21 bp, Homo sapiens
agagtaaaggaaataagagca

SEQ ID NO: 1168375 - DNA, 15 bp, Homo sapiens
agagtaagcagtgtt

SEQ ID NO: 1168376 - DNA, 20 bp, Homo sapiens
agagtacagactgcagacat

SEQ ID NO: 1168377 - DNA, 15 bp, Homo sapiens
agagtactgggagaa

SEQ ID NO: 1168378 - DNA, 12 bp, Homo sapiens
agagtactttgg

SEQ ID NO: 1168379 - DNA, 17 bp, Homo sapiens
agagtactttggtttct

SEQ ID NO: 1168380 - DNA, 15 bp, Homo sapiens
agagtagaattgcat

SEQ ID NO: 1168381 - DNA, 16 bp, Homo sapiens
agagtagaattgcatt

SEQ ID NO: 1168382 - DNA, 23 bp, Homo sapiens
agagtagccgagagcctgctccc

SEQ ID NO: 1168383 - DNA, 17 bp, Homo sapiens
agagtagcctaaaatta

SEQ ID NO: 1168384 - DNA, 20 bp, Homo sapiens
agagtaggtgggtaggagcc

SEQ ID NO: 1168385 - DNA, 14 bp, Homo sapiens
agagtagtttttca

SEQ ID NO: 1168386 - DNA, 18 bp, Homo sapiens
agagtatattatgtattt

SEQ ID NO: 1168387 - DNA, 17 bp, Homo sapiens
agagtatccttccttca

SEQ ID NO: 1168388 - DNA, 21 bp, Homo sapiens
agagtatctttaaaagtgcct

SEQ ID NO: 1168389 - DNA, 21 bp, Homo sapiens
agagtatttcccttccaaaga

SEQ ID NO: 1168390 - DNA, 11 bp, Homo sapiens
agagtatttct

SEQ ID NO: 1168391 - DNA, 13 bp, Homo sapiens
agagtatttctgg

SEQ ID NO: 1168392 - DNA, 13 bp, Homo sapiens
agagtatttttaa

SEQ ID NO: 1168393 - DNA, 17 bp, Homo sapiens
agagtcaatttgctgaa

SEQ ID NO: 1168394 - DNA, 22 bp, Homo sapiens
agagtcagaactaactttggtc

SEQ ID NO: 1168395 - DNA, 18 bp, Homo sapiens
agagtcagccttccccct

SEQ ID NO: 1168396 - DNA, 16 bp, Homo sapiens
agagtcagctctctgc

SEQ ID NO: 1168397 - DNA, 18 bp, Homo sapiens
agagtcagctctctgccc

SEQ ID NO: 1168398 - DNA, 19 bp, Homo sapiens
agagtcagctctctgccct

SEQ ID NO: 1168399 - DNA, 21 bp, Homo sapiens
agagtcagctctctgccctgt

SEQ ID NO: 1168400 - DNA, 12 bp, Homo sapiens
agagtcaggagt

SEQ ID NO: 1168401 - DNA, 21 bp, Homo sapiens
agagtcatctccatcagctgt

SEQ ID NO: 1168402 - DNA, 17 bp, Homo sapiens
agagtcatgtgagcctc

SEQ ID NO: 1168403 - DNA, 20 bp, Homo sapiens
agagtcatgtgagcctcgtg

SEQ ID NO: 1168404 - DNA, 22 bp, Homo sapiens
agagtcatgtgagcctcgtgtc

SEQ ID NO: 1168405 - DNA, 22 bp, Homo sapiens
agagtccaactcacttccagtg

SEQ ID NO: 1168406 - DNA, 16 bp, Homo sapiens
agagtccactgtggca

SEQ ID NO: 1168407 - DNA, 15 bp, Homo sapiens
agagtccaggcccca

SEQ ID NO: 1168408 - DNA, 16 bp, Homo sapiens
agagtccagtgctctg

SEQ ID NO: 1168409 - DNA, 22 bp, Homo sapiens
agagtccatttcccacatcttt

SEQ ID NO: 1168410 - DNA, 12 bp, Homo sapiens
agagtcccaggc

SEQ ID NO: 1168411 - DNA, 16 bp, Homo sapiens
agagtccgtggttgcc

SEQ ID NO: 1168412 - DNA, 14 bp, Homo sapiens
agagtcctctggat

SEQ ID NO: 1168413 - DNA, 14 bp, Homo sapiens
agagtcgctgtgcc

SEQ ID NO: 1168414 - DNA, 21 bp, Homo sapiens
agagtctaatagtctttgcca

SEQ ID NO: 1168415 - DNA, 17 bp, Homo sapiens
agagtctccagttactg

SEQ ID NO: 1168416 - DNA, 20 bp, Homo sapiens
agagtctctgatacacagta

SEQ ID NO: 1168417 - DNA, 17 bp, Homo sapiens
agagtctgggcctctga

SEQ ID NO: 1168418 - DNA, 13 bp, Homo sapiens
agagtctgtctct

SEQ ID NO: 1168419 - DNA, 13 bp, Homo sapiens
agagtctgtcttg

SEQ ID NO: 1168420 - DNA, 21 bp, Homo sapiens
agagtcttacaatcaaatctc

SEQ ID NO: 1168421 - DNA, 23 bp, Homo sapiens
agagtcttccaaggccagaagga

SEQ ID NO: 1168422 - DNA, 14 bp, Homo sapiens
agagtgaagggaag

SEQ ID NO: 1168423 - DNA, 14 bp, Homo sapiens
agagtgaatttcag

SEQ ID NO: 1168424 - DNA, 14 bp, Homo sapiens
agagtgacagtcat

SEQ ID NO: 1168425 - DNA, 23 bp, Homo sapiens
agagtgacagtcataaatactgt

SEQ ID NO: 1168426 - DNA, 18 bp, Homo sapiens
agagtgagaccatgtttc

SEQ ID NO: 1168427 - DNA, 22 bp, Homo sapiens
agagtgagagacattaactcat

SEQ ID NO: 1168428 - DNA, 21 bp, Homo sapiens
agagtgagagggcatgcgcac

SEQ ID NO: 1168429 - DNA, 23 bp, Homo sapiens
agagtgattcgggggctgaccta

SEQ ID NO: 1168430 - DNA, 15 bp, Homo sapiens
agagtgattgcagct

SEQ ID NO: 1168431 - DNA, 14 bp, Homo sapiens
agagtgcccagcag

SEQ ID NO: 1168432 - DNA, 16 bp, Homo sapiens
agagtgcccagcagag

SEQ ID NO: 1168433 - DNA, 17 bp, Homo sapiens
agagtgcccagcagagg

SEQ ID NO: 1168434 - DNA, 12 bp, Homo sapiens
agagtgctctga

SEQ ID NO: 1168435 - DNA, 16 bp, Homo sapiens
agagtgctctgaccct

SEQ ID NO: 1168436 - DNA, 17 bp, Homo sapiens
agagtgctctgaccctg

SEQ ID NO: 1168437 - DNA, 18 bp, Homo sapiens
agagtgctctgaccctgg

SEQ ID NO: 1168438 - DNA, 22 bp, Homo sapiens
agagtgctgaggggcactctcc

SEQ ID NO: 1168439 - DNA, 15 bp, Homo sapiens
agagtgctggactgt

SEQ ID NO: 1168440 - DNA, 12 bp, Homo sapiens
agagtgctggga

SEQ ID NO: 1168441 - DNA, 16 bp, Homo sapiens
agagtggactgcattt

SEQ ID NO: 1168442 - DNA, 17 bp, Homo sapiens
agagtggactgcattta

SEQ ID NO: 1168443 - DNA, 23 bp, Homo sapiens
agagtggaggaggaggaggagcc

SEQ ID NO: 1168444 - DNA, 15 bp, Homo sapiens
agagtggaggcgggc

SEQ ID NO: 1168445 - DNA, 14 bp, Homo sapiens
agagtggagttgaa

SEQ ID NO: 1168446 - DNA, 14 bp, Homo sapiens
agagtggcaggtgg

SEQ ID NO: 1168447 - DNA, 23 bp, Homo sapiens
agagtggcaggtgggctgcctgc

SEQ ID NO: 1168448 - DNA, 12 bp, Homo sapiens
agagtggcccac

SEQ ID NO: 1168449 - DNA, 16 bp, Homo sapiens
agagtggcctagagca

SEQ ID NO: 1168450 - DNA, 19 bp, Homo sapiens
agagtggcctagagcactc

SEQ ID NO: 1168451 - DNA, 15 bp, Homo sapiens
agagtggcctccctg

SEQ ID NO: 1168452 - DNA, 22 bp, Homo sapiens
agagtggcctccctgctgtgcc

SEQ ID NO: 1168453 - DNA, 11 bp, Homo sapiens
agagtggcctg

SEQ ID NO: 1168454 - DNA, 15 bp, Homo sapiens
agagtggcctggcca

SEQ ID NO: 1168455 - DNA, 19 bp, Homo sapiens
agagtggcctggccaggag

SEQ ID NO: 1168456 - DNA, 22 bp, Homo sapiens
agagtggcctggccaggagctc

SEQ ID NO: 1168457 - DNA, 14 bp, Homo sapiens
agagtggcgtggcc

SEQ ID NO: 1168458 - DNA, 19 bp, Homo sapiens
agagtggctcactggctgg

SEQ ID NO: 1168459 - DNA, 13 bp, Homo sapiens
agagtggctcctc

SEQ ID NO: 1168460 - DNA, 14 bp, Homo sapiens
agagtgggagaggc

SEQ ID NO: 1168461 - DNA, 22 bp, Homo sapiens
agagactgtagattgcttctgt

SEQ ID NO: 1168462 - DNA, 19 bp, Homo sapiens
agagacttttaatcagaca

SEQ ID NO: 1168463 - DNA, 13 bp, Homo sapiens
agagagaaaaaaa

SEQ ID NO: 1168464 - DNA, 19 bp, Homo sapiens
agagagaagtgcccctgct

SEQ ID NO: 1168465 - DNA, 16 bp, Homo sapiens
agagagaatagagctg

SEQ ID NO: 1168466 - DNA, 15 bp, Homo sapiens
agagagacaggcagc

SEQ ID NO: 1168467 - DNA, 18 bp, Homo sapiens
agagagacctcatcctgc

SEQ ID NO: 1168468 - DNA, 15 bp, Homo sapiens
agagagagaccctca

SEQ ID NO: 1168469 - DNA, 12 bp, Homo sapiens
agagagagaggt

SEQ ID NO: 1168470 - DNA, 22 bp, Homo sapiens
agagagaggaggcagccccctc

SEQ ID NO: 1168471 - DNA, 14 bp, Homo sapiens
agagagaggctgcc

SEQ ID NO: 1168472 - DNA, 19 bp, Homo sapiens
agagagaggtatttaactg

SEQ ID NO: 1168473 - DNA, 21 bp, Homo sapiens
agagagattggccagcaaaaa

SEQ ID NO: 1168474 - DNA, 20 bp, Homo sapiens
agagagcagctccctttctc

SEQ ID NO: 1168475 - DNA, 22 bp, Homo sapiens
agagagcagctccctttctcag

SEQ ID NO: 1168476 - DNA, 23 bp, Homo sapiens
agagagcagctccctttctcagg

SEQ ID NO: 1168477 - DNA, 16 bp, Homo sapiens
agagagcaggggagct

SEQ ID NO: 1168478 - DNA, 17 bp, Homo sapiens
agagagcaggggagctt

SEQ ID NO: 1168479 - DNA, 21 bp, Homo sapiens
agagagcaggggagcttggga

SEQ ID NO: 1168480 - DNA, 13 bp, Homo sapiens
agagagcctccct

SEQ ID NO: 1168481 - DNA, 23 bp, Homo sapiens
agagagcctccctgcagccacca

SEQ ID NO: 1168482 - DNA, 18 bp, Homo sapiens
agagagcgagcgctaccc

SEQ ID NO: 1168483 - DNA, 14 bp, Homo sapiens
agagagctgtatta

SEQ ID NO: 1168484 - DNA, 14 bp, Homo sapiens
agagaggagaaaca

SEQ ID NO: 1168485 - DNA, 16 bp, Homo sapiens
agagaggagaaacaca

SEQ ID NO: 1168486 - DNA, 18 bp, Homo sapiens
agagaggaggcagccccc

SEQ ID NO: 1168487 - DNA, 18 bp, Homo sapiens
agagaggatacatttaat

SEQ ID NO: 1168488 - DNA, 20 bp, Homo sapiens
agagaggatacatttaataa

SEQ ID NO: 1168489 - DNA, 17 bp, Homo sapiens
agagaggcacctgctgg

SEQ ID NO: 1168490 - DNA, 15 bp, Homo sapiens
agagccaagctgcac

SEQ ID NO: 1168491 - DNA, 12 bp, Homo sapiens
agagccaaggcc

SEQ ID NO: 1168492 - DNA, 13 bp, Homo sapiens
agagccaaggcca

SEQ ID NO: 1168493 - DNA, 21 bp, Homo sapiens
agagccaagtagtcagtggaa

SEQ ID NO: 1168494 - DNA, 23 bp, Homo sapiens
agagccacaggccccttttgtgg

SEQ ID NO: 1168495 - DNA, 15 bp, Homo sapiens
agagccacctgcaag

SEQ ID NO: 1168496 - DNA, 19 bp, Homo sapiens
agagccacctgcaagatgg

SEQ ID NO: 1168497 - DNA, 13 bp, Homo sapiens
agagccactgggc

SEQ ID NO: 1168498 - DNA, 15 bp, Homo sapiens
agagccactgggccc

SEQ ID NO: 1168499 - DNA, 17 bp, Homo sapiens
agagccactgggcccct

SEQ ID NO: 1168500 - DNA, 18 bp, Homo sapiens
agagccactgggcccctg

SEQ ID NO: 1168501 - DNA, 23 bp, Homo sapiens
agagccactgggcccctgtcccc

SEQ ID NO: 1168502 - DNA, 13 bp, Homo sapiens
agagccagaccaa

SEQ ID NO: 1168503 - DNA, 13 bp, Homo sapiens
agagccagcagca

SEQ ID NO: 1168504 - DNA, 17 bp, Homo sapiens
agagccagccctccctg

SEQ ID NO: 1168505 - DNA, 11 bp, Homo sapiens
agagccagccg

SEQ ID NO: 1168506 - DNA, 12 bp, Homo sapiens
agagccagcctg

SEQ ID NO: 1168507 - DNA, 19 bp, Homo sapiens
agagccagcctggctctgc

SEQ ID NO: 1168508 - DNA, 15 bp, Homo sapiens
agagccagcctggga

SEQ ID NO: 1168509 - DNA, 16 bp, Homo sapiens
agagccagcctgggac

SEQ ID NO: 1168510 - DNA, 16 bp, Homo sapiens
agagccagctctctct

SEQ ID NO: 1168511 - DNA, 18 bp, Homo sapiens
agagccagctctctctac

SEQ ID NO: 1168512 - DNA, 11 bp, Homo sapiens
agagccagctt

SEQ ID NO: 1168513 - DNA, 12 bp, Homo sapiens
agagccaggaga

SEQ ID NO: 1168514 - DNA, 15 bp, Homo sapiens
agagccaggagaagc

SEQ ID NO: 1168515 - DNA, 10 bp, Homo sapiens
agagccaggg

SEQ ID NO: 1168516 - DNA, 13 bp, Homo sapiens
agagccagggctg

SEQ ID NO: 1168517 - DNA, 13 bp, Homo sapiens
agagccatacata

SEQ ID NO: 1168518 - DNA, 16 bp, Homo sapiens
agagccatacataaaa

SEQ ID NO: 1168519 - DNA, 21 bp, Homo sapiens
agagccatacataaaagaaat

SEQ ID NO: 1168520 - DNA, 14 bp, Homo sapiens
agagccatgaagca

SEQ ID NO: 1168521 - DNA, 17 bp, Homo sapiens
agagccatgggcctggg

SEQ ID NO: 1168522 - DNA, 14 bp, Homo sapiens
agagcccaccagcc

SEQ ID NO: 1168523 - DNA, 20 bp, Homo sapiens
agagcccaccagccagccct

SEQ ID NO: 1168524 - DNA, 10 bp, Homo sapiens
agagcccagc

SEQ ID NO: 1168525 - DNA, 14 bp, Homo sapiens
agagcccagccatt

SEQ ID NO: 1168526 - DNA, 12 bp, Homo sapiens
agagcccagctc

SEQ ID NO: 1168527 - DNA, 12 bp, Homo sapiens
agagcccagggg

SEQ ID NO: 1168528 - DNA, 16 bp, Homo sapiens
agagcccaggggagaa

SEQ ID NO: 1168529 - DNA, 15 bp, Homo sapiens
agagccccacacgga

SEQ ID NO: 1168530 - DNA, 17 bp, Homo sapiens
agagccccacacggagg

SEQ ID NO: 1168531 - DNA, 13 bp, Homo sapiens
agagcccccagcc

SEQ ID NO: 1168532 - DNA, 14 bp, Homo sapiens
agagcccccagccc

SEQ ID NO: 1168533 - DNA, 23 bp, Homo sapiens
agagcccctcctccagcccctgt

SEQ ID NO: 1168534 - DNA, 14 bp, Homo sapiens
agagcccgcagggc

SEQ ID NO: 1168535 - DNA, 19 bp, Homo sapiens
agagcccgccgtctgcagg

SEQ ID NO: 1168536 - DNA, 20 bp, Homo sapiens
agagcccgccgtctgcaggg

SEQ ID NO: 1168537 - DNA, 16 bp, Homo sapiens
agagccctgccctgca

SEQ ID NO: 1168538 - DNA, 14 bp, Homo sapiens
agagccctgctgtg

SEQ ID NO: 1168539 - DNA, 16 bp, Homo sapiens
agagccctgctgtggg

SEQ ID NO: 1168540 - DNA, 20 bp, Homo sapiens
agagccctgctgtgggagag

SEQ ID NO: 1168541 - DNA, 11 bp, Homo sapiens
agagccctgga

SEQ ID NO: 1168542 - DNA, 18 bp, Homo sapiens
agagccctggacacccct

SEQ ID NO: 1168543 - DNA, 22 bp, Homo sapiens
agagccctggacacccctgctc

SEQ ID NO: 1168544 - DNA, 16 bp, Homo sapiens
agagccctggctgggt

SEQ ID NO: 1168545 - DNA, 18 bp, Homo sapiens
agagccctgtggccgcca

SEQ ID NO: 1168546 - DNA, 18 bp, Homo sapiens
agagccgacaatgccctg

SEQ ID NO: 1168547 - DNA, 23 bp, Homo sapiens
agagccgacaatgccctgctggc

SEQ ID NO: 1168548 - DNA, 20 bp, Homo sapiens
agagccggccgccttctccc

SEQ ID NO: 1168549 - DNA, 13 bp, Homo sapiens
agagccgggaagc

SEQ ID NO: 1168550 - DNA, 16 bp, Homo sapiens
agagcctaccttcacc

SEQ ID NO: 1168551 - DNA, 21 bp, Homo sapiens
agagcctaccttcaccaccta

SEQ ID NO: 1168552 - DNA, 16 bp, Homo sapiens
agagcctagaacatcc

SEQ ID NO: 1168553 - DNA, 13 bp, Homo sapiens
agagcctcctggg

SEQ ID NO: 1168554 - DNA, 22 bp, Homo sapiens
agagcctcctgggaacacatct

SEQ ID NO: 1168555 - DNA, 13 bp, Homo sapiens
agagcctctgaga

SEQ ID NO: 1168556 - DNA, 15 bp, Homo sapiens
agagcctgaagctgg

SEQ ID NO: 1168557 - DNA, 17 bp, Homo sapiens
agagcctgacctgagag

SEQ ID NO: 1168558 - DNA, 11 bp, Homo sapiens
agagcctgagg

SEQ ID NO: 1168559 - DNA, 16 bp, Homo sapiens
agagcctgatctcttc

SEQ ID NO: 1168560 - DNA, 19 bp, Homo sapiens
agagcctgatctcttcctg

SEQ ID NO: 1168561 - DNA, 12 bp, Homo sapiens
agagcctgctgc

SEQ ID NO: 1168562 - DNA, 24 bp, Homo sapiens
agagcctgctggcacccaccgtgg

SEQ ID NO: 1168563 - DNA, 13 bp, Homo sapiens
agagcctggagaa

SEQ ID NO: 1168564 - DNA, 12 bp, Homo sapiens
agagcctggctt

SEQ ID NO: 1168565 - DNA, 12 bp, Homo sapiens
agagcctggggg

SEQ ID NO: 1168566 - DNA, 18 bp, Homo sapiens
agagcctgggggtggggg

SEQ ID NO: 1168567 - DNA, 16 bp, Homo sapiens
agagcctggtgctgct

SEQ ID NO: 1168568 - DNA, 19 bp, Homo sapiens
agagcctgtccccgccttc

SEQ ID NO: 1168569 - DNA, 22 bp, Homo sapiens
agagcctgtccccgccttccct

SEQ ID NO: 1168570 - DNA, 23 bp, Homo sapiens
agagcctgtccccgccttccctc

SEQ ID NO: 1168571 - DNA, 23 bp, Homo sapiens
agagccttcagaatgctcctgag

SEQ ID NO: 1168572 - DNA, 14 bp, Homo sapiens
agagccttcagcct

SEQ ID NO: 1168573 - DNA, 16 bp, Homo sapiens
agagccttcagcctta

SEQ ID NO: 1168574 - DNA, 18 bp, Homo sapiens
agagccttctcagaagca

SEQ ID NO: 1168575 - DNA, 14 bp, Homo sapiens
agagcctttgcctt

SEQ ID NO: 1168576 - DNA, 19 bp, Homo sapiens
agagccttttatctgcaga

SEQ ID NO: 1168577 - DNA, 15 bp, Homo sapiens
agagccttttgtgca

SEQ ID NO: 1168578 - DNA, 19 bp, Homo sapiens
agagcgagagatcaaagat

SEQ ID NO: 1168579 - DNA, 18 bp, Homo sapiens
agagcgccaggaagccag

SEQ ID NO: 1168580 - DNA, 17 bp, Homo sapiens
agagcgcctcttcctct

SEQ ID NO: 1168581 - DNA, 18 bp, Homo sapiens
agagcgcctcttcctctg

SEQ ID NO: 1168582 - DNA, 21 bp, Homo sapiens
agagcgcctcttcctctgggc

SEQ ID NO: 1168583 - DNA, 20 bp, Homo sapiens
agagcgctcctctgccttgg

SEQ ID NO: 1168584 - DNA, 14 bp, Homo sapiens
agagcggaggagga

SEQ ID NO: 1168585 - DNA, 13 bp, Homo sapiens
agagcggctgccc

SEQ ID NO: 1168586 - DNA, 19 bp, Homo sapiens
agagcggggtcccctctgt

SEQ ID NO: 1168587 - DNA, 21 bp, Homo sapiens
agagcggggtcccctctgtgc

SEQ ID NO: 1168588 - DNA, 22 bp, Homo sapiens
agagcggtatctctggcaccac

SEQ ID NO: 1168589 - DNA, 13 bp, Homo sapiens
agagcgtttggtt

SEQ ID NO: 1168590 - DNA, 14 bp, Homo sapiens
agagctacgtattt

SEQ ID NO: 1168591 - DNA, 17 bp, Homo sapiens
agagctacgtatttaat

SEQ ID NO: 1168592 - DNA, 21 bp, Homo sapiens
agattagagcctgtaaacttt

SEQ ID NO: 1168593 - DNA, 14 bp, Homo sapiens
agattagagggagg

SEQ ID NO: 1168594 - DNA, 14 bp, Homo sapiens
agattagctctgga

SEQ ID NO: 1168595 - DNA, 14 bp, Homo sapiens
agattaggtagact

SEQ ID NO: 1168596 - DNA, 18 bp, Homo sapiens
agattaggtttgtcccag

SEQ ID NO: 1168597 - DNA, 15 bp, Homo sapiens
agattatatgaatgc

SEQ ID NO: 1168598 - DNA, 13 bp, Homo sapiens
agattatctgatt

SEQ ID NO: 1168599 - DNA, 17 bp, Homo sapiens
agattattataaactat

SEQ ID NO: 1168600 - DNA, 18 bp, Homo sapiens
agattattataaactata

SEQ ID NO: 1168601 - DNA, 16 bp, Homo sapiens
agattattgaaatatt

SEQ ID NO: 1168602 - DNA, 22 bp, Homo sapiens
agattattgtgacttcactgta

SEQ ID NO: 1168603 - DNA, 23 bp, Homo sapiens
agattattgtgacttcactgtat

SEQ ID NO: 1168604 - DNA, 18 bp, Homo sapiens
agattatttctgtatttg

SEQ ID NO: 1168605 - DNA, 23 bp, Homo sapiens
agattcaatattgaatttttcct

SEQ ID NO: 1168606 - DNA, 15 bp, Homo sapiens
agattcacctgtaaa

SEQ ID NO: 1168607 - DNA, 23 bp, Homo sapiens
agattcactttgacacttttcat

SEQ ID NO: 1168608 - DNA, 23 bp, Homo sapiens
agattcactttgtttatgcatat

SEQ ID NO: 1168609 - DNA, 13 bp, Homo sapiens
agattcaggggaa

SEQ ID NO: 1168610 - DNA, 18 bp, Homo sapiens
agattcaggtaatacaaa

SEQ ID NO: 1168611 - DNA, 20 bp, Homo sapiens
agattcaggtaatacaaact

SEQ ID NO: 1168612 - DNA, 18 bp, Homo sapiens
agattcaggtatgttgcc

SEQ ID NO: 1168613 - DNA, 15 bp, Homo sapiens
agattcataaagtaa

SEQ ID NO: 1168614 - DNA, 22 bp, Homo sapiens
agattcatatttacttcttata

SEQ ID NO: 1168615 - DNA, 15 bp, Homo sapiens
agattcattttctag

SEQ ID NO: 1168616 - DNA, 18 bp, Homo sapiens
agattccagagagtggct

SEQ ID NO: 1168617 - DNA, 20 bp, Homo sapiens
agattcccagaccttaagac

SEQ ID NO: 1168618 - DNA, 12 bp, Homo sapiens
agattcccagag

SEQ ID NO: 1168619 - DNA, 15 bp, Homo sapiens
agattcccctgtgtc

SEQ ID NO: 1168620 - DNA, 12 bp, Homo sapiens
agattcctatta

SEQ ID NO: 1168621 - DNA, 22 bp, Homo sapiens
agattcctcgaagttctaggaa

SEQ ID NO: 1168622 - DNA, 21 bp, Homo sapiens
agattcctcttgcctctctca

SEQ ID NO: 1168623 - DNA, 13 bp, Homo sapiens
agattcctgggcc

SEQ ID NO: 1168624 - DNA, 14 bp, Homo sapiens
agattcctgggcct

SEQ ID NO: 1168625 - DNA, 16 bp, Homo sapiens
agattcctgggcctgt

SEQ ID NO: 1168626 - DNA, 13 bp, Homo sapiens
agattctaaagct

SEQ ID NO: 1168627 - DNA, 13 bp, Homo sapiens
agattctactaac

SEQ ID NO: 1168628 - DNA, 13 bp, Homo sapiens
agattctcaaagg

SEQ ID NO: 1168629 - DNA, 19 bp, Homo sapiens
agattctcataacttgaga

SEQ ID NO: 1168630 - DNA, 16 bp, Homo sapiens
agattctctttaaaaa

SEQ ID NO: 1168631 - DNA, 20 bp, Homo sapiens
agattctctttaaaaaagac

SEQ ID NO: 1168632 - DNA, 17 bp, Homo sapiens
agattctgacatttata

SEQ ID NO: 1168633 - DNA, 18 bp, Homo sapiens
agattctgacatttatat

SEQ ID NO: 1168634 - DNA, 14 bp, Homo sapiens
agattctgatgcat

SEQ ID NO: 1168635 - DNA, 15 bp, Homo sapiens
agattctgattccct

SEQ ID NO: 1168636 - DNA, 19 bp, Homo sapiens
agattctgcctctctggaa

SEQ ID NO: 1168637 - DNA, 14 bp, Homo sapiens
agattctggatctc

SEQ ID NO: 1168638 - DNA, 11 bp, Homo sapiens
agattctgggt

SEQ ID NO: 1168639 - DNA, 20 bp, Homo sapiens
agattctgggtttgcccagt

SEQ ID NO: 1168640 - DNA, 15 bp, Homo sapiens
agattctgtcttata

SEQ ID NO: 1168641 - DNA, 19 bp, Homo sapiens
agattctgtgatcttttaa

SEQ ID NO: 1168642 - DNA, 20 bp, Homo sapiens
agattctgttaaaaaaataa

SEQ ID NO: 1168643 - DNA, 22 bp, Homo sapiens
agattcttctaggggtagctgg

SEQ ID NO: 1168644 - DNA, 19 bp, Homo sapiens
agattctttatatctgaac

SEQ ID NO: 1168645 - DNA, 11 bp, Homo sapiens
agattctttta

SEQ ID NO: 1168646 - DNA, 20 bp, Homo sapiens
agattcttttaaattagaaa

SEQ ID NO: 1168647 - DNA, 21 bp, Homo sapiens
agattcttttaaattagaaaa

SEQ ID NO: 1168648 - DNA, 14 bp, Homo sapiens
agattgaaaatctt

SEQ ID NO: 1168649 - DNA, 15 bp, Homo sapiens
agattgaagaatctg

SEQ ID NO: 1168650 - DNA, 19 bp, Homo sapiens
agattgaagaatctgcccc

SEQ ID NO: 1168651 - DNA, 15 bp, Homo sapiens
agattgacgacaagt

SEQ ID NO: 1168652 - DNA, 13 bp, Homo sapiens
agattgagaaatg

SEQ ID NO: 1168653 - DNA, 14 bp, Homo sapiens
agattgagaaatgt

SEQ ID NO: 1168654 - DNA, 20 bp, Homo sapiens
agattgagacctacaggctg

SEQ ID NO: 1168655 - DNA, 22 bp, Homo sapiens
agattgagtataaaaacttgaa

SEQ ID NO: 1168656 - DNA, 23 bp, Homo sapiens
agattgagtataaaaacttgaaa

SEQ ID NO: 1168657 - DNA, 18 bp, Homo sapiens
agattgcagaaaattctg

SEQ ID NO: 1168658 - DNA, 19 bp, Homo sapiens
agattgcagaaaattctgt

SEQ ID NO: 1168659 - DNA, 21 bp, Homo sapiens
agattgcagaaaattctgtgc

SEQ ID NO: 1168660 - DNA, 23 bp, Homo sapiens
agattgcagaaaattctgtgcct

SEQ ID NO: 1168661 - DNA, 14 bp, Homo sapiens
agattgctgaaact

SEQ ID NO: 1168662 - DNA, 14 bp, Homo sapiens
agattgctgcttct

SEQ ID NO: 1168663 - DNA, 21 bp, Homo sapiens
agattgctggaaaccaagtca

SEQ ID NO: 1168664 - DNA, 23 bp, Homo sapiens
agattgctggaaaccaagtcagg

SEQ ID NO: 1168665 - DNA, 15 bp, Homo sapiens
agattgcttaaaata

SEQ ID NO: 1168666 - DNA, 15 bp, Homo sapiens
agattgcttctgtag

SEQ ID NO: 1168667 - DNA, 14 bp, Homo sapiens
agattggaaaaggg

SEQ ID NO: 1168668 - DNA, 16 bp, Homo sapiens
agattggaaagacagg

SEQ ID NO: 1168669 - DNA, 12 bp, Homo sapiens
agattggaaatg

SEQ ID NO: 1168670 - DNA, 22 bp, Homo sapiens
agattggatcaagtattactaa

SEQ ID NO: 1168671 - DNA, 16 bp, Homo sapiens
agattggatttgctgt

SEQ ID NO: 1168672 - DNA, 14 bp, Homo sapiens
agattggccagcaa

SEQ ID NO: 1168673 - DNA, 20 bp, Homo sapiens
agattgggagacaattagca

SEQ ID NO: 1168674 - DNA, 15 bp, Homo sapiens
agattgggtgccagc

SEQ ID NO: 1168675 - DNA, 21 bp, Homo sapiens
agattggtgggattttttgtt

SEQ ID NO: 1168676 - DNA, 14 bp, Homo sapiens
agattggttctgtt

SEQ ID NO: 1168677 - DNA, 13 bp, Homo sapiens
agattgtcttgca

SEQ ID NO: 1168678 - DNA, 23 bp, Homo sapiens
agattgtcttgcaacttcagttt

SEQ ID NO: 1168679 - DNA, 15 bp, Homo sapiens
agattgttaaaataa

SEQ ID NO: 1168680 - DNA, 15 bp, Homo sapiens
agattgttattaaat

SEQ ID NO: 1168681 - DNA, 16 bp, Homo sapiens
agattgttattaaatg

SEQ ID NO: 1168682 - DNA, 14 bp, Homo sapiens
agattgttggtgaa

SEQ ID NO: 1168683 - DNA, 17 bp, Homo sapiens
agattgttggtgaattt

SEQ ID NO: 1168684 - DNA, 15 bp, Homo sapiens
agattgttgtttgcc

SEQ ID NO: 1168685 - DNA, 13 bp, Homo sapiens
agatttaaatgca

SEQ ID NO: 1168686 - DNA, 15 bp, Homo sapiens
agatttacactggga

SEQ ID NO: 1168687 - DNA, 16 bp, Homo sapiens
agatttacactgggag

SEQ ID NO: 1168688 - DNA, 21 bp, Homo sapiens
agatttactgctctagaaagt

SEQ ID NO: 1168689 - DNA, 23 bp, Homo sapiens
agatttacttcagtataaattat

SEQ ID NO: 1168690 - DNA, 18 bp, Homo sapiens
agatttagtgaaagctag

SEQ ID NO: 1168691 - DNA, 13 bp, Homo sapiens
agatttatcttta

SEQ ID NO: 1168692 - DNA, 14 bp, Homo sapiens
agatttattttaca

SEQ ID NO: 1168693 - DNA, 14 bp, Homo sapiens
agatttcagtaatg

SEQ ID NO: 1168694 - DNA, 16 bp, Homo sapiens
agatttcagtagaatt

SEQ ID NO: 1168695 - DNA, 12 bp, Homo sapiens
agatttcatagt

SEQ ID NO: 1168696 - DNA, 11 bp, Homo sapiens
agatttctctt

SEQ ID NO: 1168697 - DNA, 15 bp, Homo sapiens
agatttctgacatca

SEQ ID NO: 1168698 - DNA, 14 bp, Homo sapiens
agatctgcctgggc

SEQ ID NO: 1168699 - DNA, 17 bp, Homo sapiens
agatctgcctgggcctg

SEQ ID NO: 1168700 - DNA, 19 bp, Homo sapiens
agatctgcctgggcctgtg

SEQ ID NO: 1168701 - DNA, 24 bp, Homo sapiens
agatctgcctgggcctgtgcagca

SEQ ID NO: 1168702 - DNA, 17 bp, Homo sapiens
agatctggggaggcagg

SEQ ID NO: 1168703 - DNA, 15 bp, Homo sapiens
agatctgtctccaag

SEQ ID NO: 1168704 - DNA, 13 bp, Homo sapiens
agatctgtgcccc

SEQ ID NO: 1168705 - DNA, 15 bp, Homo sapiens
agatctgtgcctggg

SEQ ID NO: 1168706 - DNA, 18 bp, Homo sapiens
agatctgtgcctgggatc

SEQ ID NO: 1168707 - DNA, 18 bp, Homo sapiens
agatctgttttgaaggca

SEQ ID NO: 1168708 - DNA, 19 bp, Homo sapiens
agatcttaatataaattca

SEQ ID NO: 1168709 - DNA, 23 bp, Homo sapiens
agatcttaggtatagaggaccct

SEQ ID NO: 1168710 - DNA, 13 bp, Homo sapiens
agatcttccttcc

SEQ ID NO: 1168711 - DNA, 15 bp, Homo sapiens
agatcttctgaaatg

SEQ ID NO: 1168712 - DNA, 16 bp, Homo sapiens
agatctttctccttga

SEQ ID NO: 1168713 - DNA, 19 bp, Homo sapiens
agatctttctcttccctga

SEQ ID NO: 1168714 - DNA, 15 bp, Homo sapiens
agatcttttagaagt

SEQ ID NO: 1168715 - DNA, 20 bp, Homo sapiens
agatcttttagaagtgagag

SEQ ID NO: 1168716 - DNA, 13 bp, Homo sapiens
agatgaaagagga

SEQ ID NO: 1168717 - DNA, 21 bp, Homo sapiens
agatgaaataaagacccaggg

SEQ ID NO: 1168718 - DNA, 14 bp, Homo sapiens
agatgaaataattt

SEQ ID NO: 1168719 - DNA, 22 bp, Homo sapiens
agatgaaatatatattgtaaag

SEQ ID NO: 1168720 - DNA, 14 bp, Homo sapiens
agatgaaatgcact

SEQ ID NO: 1168721 - DNA, 15 bp, Homo sapiens
agatgaaatgcactg

SEQ ID NO: 1168722 - DNA, 13 bp, Homo sapiens
agatgaacatttc

SEQ ID NO: 1168723 - DNA, 14 bp, Homo sapiens
agatgaacatttca

SEQ ID NO: 1168724 - DNA, 16 bp, Homo sapiens
agatgaacatttcaaa

SEQ ID NO: 1168725 - DNA, 19 bp, Homo sapiens
agatgaactcttagaaatg

SEQ ID NO: 1168726 - DNA, 19 bp, Homo sapiens
agatgaactgactgaagga

SEQ ID NO: 1168727 - DNA, 15 bp, Homo sapiens
agatgaacttgagct

SEQ ID NO: 1168728 - DNA, 16 bp, Homo sapiens
agatgaacttgagctc

SEQ ID NO: 1168729 - DNA, 19 bp, Homo sapiens
agatgaacttgagctctgt

SEQ ID NO: 1168730 - DNA, 16 bp, Homo sapiens
agatgaatttgtccaa

SEQ ID NO: 1168731 - DNA, 12 bp, Homo sapiens
agatgacaacct

SEQ ID NO: 1168732 - DNA, 17 bp, Homo sapiens
agatgacaacctccatt

SEQ ID NO: 1168733 - DNA, 23 bp, Homo sapiens
agatgaccataattttttttaaa

SEQ ID NO: 1168734 - DNA, 16 bp, Homo sapiens
agatgacccctacccc

SEQ ID NO: 1168735 - DNA, 21 bp, Homo sapiens
agatgacccctaccccctcat

SEQ ID NO: 1168736 - DNA, 23 bp, Homo sapiens
agatgacccctaccccctcatcc

SEQ ID NO: 1168737 - DNA, 20 bp, Homo sapiens
agatgactatgcagaggcct

SEQ ID NO: 1168738 - DNA, 13 bp, Homo sapiens
agatgactctgag

SEQ ID NO: 1168739 - DNA, 15 bp, Homo sapiens
agatgactgagtcct

SEQ ID NO: 1168740 - DNA, 15 bp, Homo sapiens
agatgacttcttttc

SEQ ID NO: 1168741 - DNA, 20 bp, Homo sapiens
agatgagaaagcttttattc

SEQ ID NO: 1168742 - DNA, 22 bp, Homo sapiens
agatgagaaagcttttattcct

SEQ ID NO: 1168743 - DNA, 13 bp, Homo sapiens
agatgagaacaaa

SEQ ID NO: 1168744 - DNA, 14 bp, Homo sapiens
agatgagaagccag

SEQ ID NO: 1168745 - DNA, 16 bp, Homo sapiens
agatgagaagccagga

SEQ ID NO: 1168746 - DNA, 13 bp, Homo sapiens
agatgagaattag

SEQ ID NO: 1168747 - DNA, 19 bp, Homo sapiens
agatgagattggcatggct

SEQ ID NO: 1168748 - DNA, 18 bp, Homo sapiens
agatgagatttgccagca

SEQ ID NO: 1168749 - DNA, 19 bp, Homo sapiens
agatgagatttgccagcac

SEQ ID NO: 1168750 - DNA, 16 bp, Homo sapiens
agatgagcttttctag

SEQ ID NO: 1168751 - DNA, 17 bp, Homo sapiens
agatgaggacagagtgg

SEQ ID NO: 1168752 - DNA, 18 bp, Homo sapiens
agatgaggagtaaaattc

SEQ ID NO: 1168753 - DNA, 20 bp, Homo sapiens
agatgaggagtaaaattcag

SEQ ID NO: 1168754 - DNA, 21 bp, Homo sapiens
agatgaggcaaacagcaagag

SEQ ID NO: 1168755 - DNA, 13 bp, Homo sapiens
agatgaggccaga

SEQ ID NO: 1168756 - DNA, 22 bp, Homo sapiens
agatgaggccagaccatggaca

SEQ ID NO: 1168757 - DNA, 19 bp, Homo sapiens
agatgagggatgggcctgg

SEQ ID NO: 1168758 - DNA, 13 bp, Homo sapiens
agatgaggggcca

SEQ ID NO: 1168759 - DNA, 15 bp, Homo sapiens
agatgaggggccact

SEQ ID NO: 1168760 - DNA, 16 bp, Homo sapiens
agatgagggtgactgt

SEQ ID NO: 1168761 - DNA, 13 bp, Homo sapiens
agatgagtttctg

SEQ ID NO: 1168762 - DNA, 18 bp, Homo sapiens
agatgataaaaggaatct

SEQ ID NO: 1168763 - DNA, 16 bp, Homo sapiens
agatgataaagagaca

SEQ ID NO: 1168764 - DNA, 18 bp, Homo sapiens
agatgataaagagacagt

SEQ ID NO: 1168765 - DNA, 20 bp, Homo sapiens
agatgatacatccaaagcag

SEQ ID NO: 1168766 - DNA, 24 bp, Homo sapiens
agatgatacttccaagtgataatt

SEQ ID NO: 1168767 - DNA, 13 bp, Homo sapiens
agatgatcaggga

SEQ ID NO: 1168768 - DNA, 13 bp, Homo sapiens
agatgatcatttg

SEQ ID NO: 1168769 - DNA, 23 bp, Homo sapiens
agatgatcccagtcactcctctc

SEQ ID NO: 1168770 - DNA, 16 bp, Homo sapiens
agatgatgaagaaatg

SEQ ID NO: 1168771 - DNA, 19 bp, Homo sapiens
agatgatggatgccaatat

SEQ ID NO: 1168772 - DNA, 21 bp, Homo sapiens
agatgatttctagcaggcagg

SEQ ID NO: 1168773 - DNA, 13 bp, Homo sapiens
agatgcaaatgca

SEQ ID NO: 1168774 - DNA, 16 bp, Homo sapiens
agatgcaaatgtcaca

SEQ ID NO: 1168775 - DNA, 15 bp, Homo sapiens
agatgcaaggaccag

SEQ ID NO: 1168776 - DNA, 15 bp, Homo sapiens
agatgcaaggtgctg

SEQ ID NO: 1168777 - DNA, 20 bp, Homo sapiens
agatgcaatgactcaggaca

SEQ ID NO: 1168778 - DNA, 19 bp, Homo sapiens
agatgcaatgtgctactga

SEQ ID NO: 1168779 - DNA, 23 bp, Homo sapiens
agatgcaccaccaagccaaggga

SEQ ID NO: 1168780 - DNA, 19 bp, Homo sapiens
agatgcacgtggggcccac

SEQ ID NO: 1168781 - DNA, 22 bp, Homo sapiens
agatgcagccaccacatccctt

SEQ ID NO: 1168782 - DNA, 15 bp, Homo sapiens
agatgcagctggaaa

SEQ ID NO: 1168783 - DNA, 16 bp, Homo sapiens
agatgcaggaggctca

SEQ ID NO: 1168784 - DNA, 13 bp, Homo sapiens
agatgcagggcag

SEQ ID NO: 1168785 - DNA, 18 bp, Homo sapiens
agatgcatcgggaaagaa

SEQ ID NO: 1168786 - DNA, 20 bp, Homo sapiens
agatgcatcgggaaagaaga

SEQ ID NO: 1168787 - DNA, 22 bp, Homo sapiens
agatgcatcgggaaagaagaaa

SEQ ID NO: 1168788 - DNA, 17 bp, Homo sapiens
agatgccaccctagcca

SEQ ID NO: 1168789 - DNA, 22 bp, Homo sapiens
agatgccagcttctctctccag

SEQ ID NO: 1168790 - DNA, 15 bp, Homo sapiens
agatgccatagcata

SEQ ID NO: 1168791 - DNA, 22 bp, Homo sapiens
agatgcccagagggcccaggca

SEQ ID NO: 1168792 - DNA, 12 bp, Homo sapiens
agatgccccaga

SEQ ID NO: 1168793 - DNA, 15 bp, Homo sapiens
agatgccccattcct

SEQ ID NO: 1168794 - DNA, 17 bp, Homo sapiens
agatgccccattccttg

SEQ ID NO: 1168795 - DNA, 21 bp, Homo sapiens
agatgccctttggaaagccat

SEQ ID NO: 1168796 - DNA, 15 bp, Homo sapiens
agatgcctccaccgc

SEQ ID NO: 1168797 - DNA, 21 bp, Homo sapiens
agatgcctccaccgctgccta

SEQ ID NO: 1168798 - DNA, 17 bp, Homo sapiens
agatgcctcctgtcaga

SEQ ID NO: 1168799 - DNA, 16 bp, Homo sapiens
agatgcctgttaattt

SEQ ID NO: 1168800 - DNA, 21 bp, Homo sapiens
agatgccttctagattcactg

SEQ ID NO: 1168801 - DNA, 22 bp, Homo sapiens
agatgccttttttgtagttttt

SEQ ID NO: 1168802 - DNA, 21 bp, Homo sapiens
agatgcgaaccacccaaaaca

SEQ ID NO: 1168803 - DNA, 22 bp, Homo sapiens
agatgcgaaccacccaaaacac

SEQ ID NO: 1168804 - DNA, 15 bp, Homo sapiens
agatgcggggacagg

SEQ ID NO: 1168805 - DNA, 17 bp, Homo sapiens
agatgcgtttgcctcct

SEQ ID NO: 1168806 - DNA, 14 bp, Homo sapiens
agatgctaatttat

SEQ ID NO: 1168807 - DNA, 23 bp, Homo sapiens
agatgctactggacttgaatggt

SEQ ID NO: 1168808 - DNA, 16 bp, Homo sapiens
agatgctagaaaaatg

SEQ ID NO: 1168809 - DNA, 15 bp, Homo sapiens
agatgctcactttat

SEQ ID NO: 1168810 - DNA, 13 bp, Homo sapiens
agatgctccaggg

SEQ ID NO: 1168811 - DNA, 20 bp, Homo sapiens
agatgctccttgggcccttt

SEQ ID NO: 1168812 - DNA, 15 bp, Homo sapiens
agatgctcttctgtg

SEQ ID NO: 1168813 - DNA, 13 bp, Homo sapiens
agatgctgaatat

SEQ ID NO: 1168814 - DNA, 17 bp, Homo sapiens
agatgtttgtcagatat

SEQ ID NO: 1168815 - DNA, 19 bp, Homo sapiens
agatgtttgtcagatatga

SEQ ID NO: 1168816 - DNA, 22 bp, Homo sapiens
agatgttttacgcaaggaagga

SEQ ID NO: 1168817 - DNA, 23 bp, Homo sapiens
agatgttttacgcaaggaaggac

SEQ ID NO: 1168818 - DNA, 23 bp, Homo sapiens
agatgttttgggatcaggagccc

SEQ ID NO: 1168819 - DNA, 22 bp, Homo sapiens
agatgtttttaaaagtttcaat

SEQ ID NO: 1168820 - DNA, 19 bp, Homo sapiens
agatgtttttaattctagt

SEQ ID NO: 1168821 - DNA, 11 bp, Homo sapiens
agattaaagga

SEQ ID NO: 1168822 - DNA, 14 bp, Homo sapiens
agattaaaggaagg

SEQ ID NO: 1168823 - DNA, 15 bp, Homo sapiens
agattaagaaataga

SEQ ID NO: 1168824 - DNA, 20 bp, Homo sapiens
agattaatactctattttta

SEQ ID NO: 1168825 - DNA, 20 bp, Homo sapiens
agattacaaatcagaagtca

SEQ ID NO: 1168826 - DNA, 20 bp, Homo sapiens
agattacctcttgcccttgg

SEQ ID NO: 1168827 - DNA, 16 bp, Homo sapiens
agattacttagaggaa

SEQ ID NO: 1168828 - DNA, 18 bp, Homo sapiens
agatctgatggtgagctg

SEQ ID NO: 1168829 - DNA, 12 bp, Homo sapiens
agatctgatttt

SEQ ID NO: 1168830 - DNA, 20 bp, Homo sapiens
agatctgattttttccccct

SEQ ID NO: 1168831 - DNA, 21 bp, Homo sapiens
agatctgcagggggtgtgtct

SEQ ID NO: 1168832 - DNA, 22 bp, Homo sapiens
agactgagtacgttgtgcattt

SEQ ID NO: 1168833 - DNA, 23 bp, Homo sapiens
agactgagtacgttgtgcatttg

SEQ ID NO: 1168834 - DNA, 14 bp, Homo sapiens
agactgataatttt

SEQ ID NO: 1168835 - DNA, 18 bp, Homo sapiens
agactgataattttacaa

SEQ ID NO: 1168836 - DNA, 19 bp, Homo sapiens
agactgataattttacaat

SEQ ID NO: 1168837 - DNA, 19 bp, Homo sapiens
agactgatcatccaggcct

SEQ ID NO: 1168838 - DNA, 15 bp, Homo sapiens
agactgatgaagaaa

SEQ ID NO: 1168839 - DNA, 14 bp, Homo sapiens
agactgatgagcac

SEQ ID NO: 1168840 - DNA, 20 bp, Homo sapiens
agactgattggaattctttc

SEQ ID NO: 1168841 - DNA, 22 bp, Homo sapiens
agactgattggaattctttctg

SEQ ID NO: 1168842 - DNA, 17 bp, Homo sapiens
agactgcagacattctc

SEQ ID NO: 1168843 - DNA, 18 bp, Homo sapiens
agactgcagacattctca

SEQ ID NO: 1168844 - DNA, 12 bp, Homo sapiens
agactgcagctg

SEQ ID NO: 1168845 - DNA, 14 bp, Homo sapiens
agactgcagctgct

SEQ ID NO: 1168846 - DNA, 23 bp, Homo sapiens
agactgcatcccgtacctcttcc

SEQ ID NO: 1168847 - DNA, 18 bp, Homo sapiens
agactgccccagccaacg

SEQ ID NO: 1168848 - DNA, 15 bp, Homo sapiens
agactgcctccctct

SEQ ID NO: 1168849 - DNA, 16 bp, Homo sapiens
agactgcctccctctc

SEQ ID NO: 1168850 - DNA, 19 bp, Homo sapiens
agactgcctccctctcttc

SEQ ID NO: 1168851 - DNA, 23 bp, Homo sapiens
agactgcgatttgtcccaggtcc

SEQ ID NO: 1168852 - DNA, 20 bp, Homo sapiens
agactgcgggatggtcctgg

SEQ ID NO: 1168853 - DNA, 21 bp, Homo sapiens
agactgctcccggcccgcctg

SEQ ID NO: 1168854 - DNA, 19 bp, Homo sapiens
agactgctgggactggcca

SEQ ID NO: 1168855 - DNA, 16 bp, Homo sapiens
agactgcttcccatcc

SEQ ID NO: 1168856 - DNA, 21 bp, Homo sapiens
agactgcttcccatcctaccc

SEQ ID NO: 1168857 - DNA, 13 bp, Homo sapiens
agactggaacttg

SEQ ID NO: 1168858 - DNA, 20 bp, Homo sapiens
agactggaagctaatttgca

SEQ ID NO: 1168859 - DNA, 14 bp, Homo sapiens
agactggacagctt

SEQ ID NO: 1168860 - DNA, 15 bp, Homo sapiens
agactggacagcttg

SEQ ID NO: 1168861 - DNA, 17 bp, Homo sapiens
agactggacagcttgtg

SEQ ID NO: 1168862 - DNA, 16 bp, Homo sapiens
agactggacccccagc

SEQ ID NO: 1168863 - DNA, 23 bp, Homo sapiens
agactggagaaaacccctcccac

SEQ ID NO: 1168864 - DNA, 15 bp, Homo sapiens
agactggagcatctg

SEQ ID NO: 1168865 - DNA, 19 bp, Homo sapiens
agactggagtgaggcttcc

SEQ ID NO: 1168866 - DNA, 15 bp, Homo sapiens
agactggcaataaac

SEQ ID NO: 1168867 - DNA, 14 bp, Homo sapiens
agactggctggctg

SEQ ID NO: 1168868 - DNA, 22 bp, Homo sapiens
agactggcttttattaatgcac

SEQ ID NO: 1168869 - DNA, 21 bp, Homo sapiens
agactgggaagataggctctg

SEQ ID NO: 1168870 - DNA, 14 bp, Homo sapiens
agactgggcccagg

SEQ ID NO: 1168871 - DNA, 18 bp, Homo sapiens
agactgggcccaggcagg

SEQ ID NO: 1168872 - DNA, 16 bp, Homo sapiens
agactgggctagggag

SEQ ID NO: 1168873 - DNA, 18 bp, Homo sapiens
agactgggctctggctct

SEQ ID NO: 1168874 - DNA, 18 bp, Homo sapiens
agactgggtaggaaagag

SEQ ID NO: 1168875 - DNA, 15 bp, Homo sapiens
agactggtcctgtgt

SEQ ID NO: 1168876 - DNA, 13 bp, Homo sapiens
agactggtttgtt

SEQ ID NO: 1168877 - DNA, 17 bp, Homo sapiens
agactggtttgtttgct

SEQ ID NO: 1168878 - DNA, 18 bp, Homo sapiens
agactggtttgtttgctt

SEQ ID NO: 1168879 - DNA, 21 bp, Homo sapiens
agactggtttgtttgcttaat

SEQ ID NO: 1168880 - DNA, 18 bp, Homo sapiens
agactggttttctgccaa

SEQ ID NO: 1168881 - DNA, 21 bp, Homo sapiens
agactgtaacttccaaataaa

SEQ ID NO: 1168882 - DNA, 22 bp, Homo sapiens
agactgtaacttccaaataaat

SEQ ID NO: 1168883 - DNA, 15 bp, Homo sapiens
agactgtacaaagta

SEQ ID NO: 1168884 - DNA, 12 bp, Homo sapiens
agactgtactgg

SEQ ID NO: 1168885 - DNA, 21 bp, Homo sapiens
agactgtactggccagtgtca

SEQ ID NO: 1168886 - DNA, 16 bp, Homo sapiens
agactgtcaaatgaac

SEQ ID NO: 1168887 - DNA, 18 bp, Homo sapiens
agactgtcaaatgaactt

SEQ ID NO: 1168888 - DNA, 21 bp, Homo sapiens
agactgtcaaatgaactttta

SEQ ID NO: 1168889 - DNA, 14 bp, Homo sapiens
agactgtctcaaga

SEQ ID NO: 1168890 - DNA, 20 bp, Homo sapiens
agactgtgaacagcttgctg

SEQ ID NO: 1168891 - DNA, 16 bp, Homo sapiens
agactgtgctctctgt

SEQ ID NO: 1168892 - DNA, 16 bp, Homo sapiens
agactgtgctgagaag

SEQ ID NO: 1168893 - DNA, 19 bp, Homo sapiens
agactgtggctagtgacaa

SEQ ID NO: 1168894 - DNA, 14 bp, Homo sapiens
agactgtggctgct

SEQ ID NO: 1168895 - DNA, 22 bp, Homo sapiens
agactgtgggtggggaggccct

SEQ ID NO: 1168896 - DNA, 23 bp, Homo sapiens
agactgtggtaggggcagggagg

SEQ ID NO: 1168897 - DNA, 15 bp, Homo sapiens
agactgttgctcaaa

SEQ ID NO: 1168898 - DNA, 23 bp, Homo sapiens
agactgttgctcaaatctattca

SEQ ID NO: 1168899 - DNA, 18 bp, Homo sapiens
agactgtttttaagtaac

SEQ ID NO: 1168900 - DNA, 22 bp, Homo sapiens
agacttaaaaaatacttgcatg

SEQ ID NO: 1168901 - DNA, 19 bp, Homo sapiens
agacttactttactcattt

SEQ ID NO: 1168902 - DNA, 20 bp, Homo sapiens
agacttactttactcatttt

SEQ ID NO: 1168903 - DNA, 18 bp, Homo sapiens
agacttcaaaatattgag

SEQ ID NO: 1168904 - DNA, 21 bp, Homo sapiens
agacttcagtatgttgtcaaa

SEQ ID NO: 1168905 - DNA, 15 bp, Homo sapiens
agacttccccatccc

SEQ ID NO: 1168906 - DNA, 13 bp, Homo sapiens
agacttctctgta

SEQ ID NO: 1168907 - DNA, 15 bp, Homo sapiens
agacttctcttacat

SEQ ID NO: 1168908 - DNA, 18 bp, Homo sapiens
agacttctcttacatttt

SEQ ID NO: 1168909 - DNA, 18 bp, Homo sapiens
agacttctggaaggctgg

SEQ ID NO: 1168910 - DNA, 14 bp, Homo sapiens
agacttgaaagttt

SEQ ID NO: 1168911 - DNA, 15 bp, Homo sapiens
agacttgaaagtttt

SEQ ID NO: 1168912 - DNA, 19 bp, Homo sapiens
agacttgacaacatcccac

SEQ ID NO: 1168913 - DNA, 12 bp, Homo sapiens
agacttgacagt

SEQ ID NO: 1168914 - DNA, 15 bp, Homo sapiens
agacttgagacaatg

SEQ ID NO: 1168915 - DNA, 13 bp, Homo sapiens
agacttgctctct

SEQ ID NO: 1168916 - DNA, 16 bp, Homo sapiens
agacttggacatctct

SEQ ID NO: 1168917 - DNA, 16 bp, Homo sapiens
agccgattctctgccc

SEQ ID NO: 1168918 - DNA, 21 bp, Homo sapiens
agccgcaccctgcacctgctg

SEQ ID NO: 1168919 - DNA, 23 bp, Homo sapiens
agccgcaccctgcacctgctgcg

SEQ ID NO: 1168920 - DNA, 14 bp, Homo sapiens
agccgcagcctccc

SEQ ID NO: 1168921 - DNA, 18 bp, Homo sapiens
agccgcagcctccctctg

SEQ ID NO: 1168922 - DNA, 16 bp, Homo sapiens
agccgcatcttctcca

SEQ ID NO: 1168923 - DNA, 13 bp, Homo sapiens
agccgccagctgg

SEQ ID NO: 1168924 - DNA, 14 bp, Homo sapiens
agccgccagctggg

SEQ ID NO: 1168925 - DNA, 18 bp, Homo sapiens
agccgccagtacttgtca

SEQ ID NO: 1168926 - DNA, 22 bp, Homo sapiens
agccgccattgccaccaggaga

SEQ ID NO: 1168927 - DNA, 13 bp, Homo sapiens
agccgccccagcc

SEQ ID NO: 1168928 - DNA, 14 bp, Homo sapiens
agccgccccagccc

SEQ ID NO: 1168929 - DNA, 22 bp, Homo sapiens
agccgccctgggctgtctgtca

SEQ ID NO: 1168930 - DNA, 24 bp, Homo sapiens
agccgccctgggctgtctgtcacc

SEQ ID NO: 1168931 - DNA, 17 bp, Homo sapiens
agccgccgggcaggcct

SEQ ID NO: 1168932 - DNA, 22 bp, Homo sapiens
agccgcctgcttcttctctcca

SEQ ID NO: 1168933 - DNA, 19 bp, Homo sapiens
agccgcggggaagctggct

SEQ ID NO: 1168934 - DNA, 19 bp, Homo sapiens
agccgctaggagagactga

SEQ ID NO: 1168935 - DNA, 14 bp, Homo sapiens
agccgctcctgtct

SEQ ID NO: 1168936 - DNA, 15 bp, Homo sapiens
agccgctgagcgagg

SEQ ID NO: 1168937 - DNA, 19 bp, Homo sapiens
agccgctgagcgaggagat

SEQ ID NO: 1168938 - DNA, 21 bp, Homo sapiens
agccgctgcagggctcccatg

SEQ ID NO: 1168939 - DNA, 22 bp, Homo sapiens
agccgctgcagggctcccatgg

SEQ ID NO: 1168940 - DNA, 15 bp, Homo sapiens
agccggaggaggaga

SEQ ID NO: 1168941 - DNA, 17 bp, Homo sapiens
agccggaggaggagatg

SEQ ID NO: 1168942 - DNA, 17 bp, Homo sapiens
agccggccgccttctcc

SEQ ID NO: 1168943 - DNA, 18 bp, Homo sapiens
agccggccgccttctccc

SEQ ID NO: 1168944 - DNA, 23 bp, Homo sapiens
agccggccgccttctcccctctc

SEQ ID NO: 1168945 - DNA, 18 bp, Homo sapiens
agccggcctctctggcct

SEQ ID NO: 1168946 - DNA, 19 bp, Homo sapiens
agccggcctctctggcctc

SEQ ID NO: 1168947 - DNA, 23 bp, Homo sapiens
agccggcctctctggcctcccac

SEQ ID NO: 1168948 - DNA, 13 bp, Homo sapiens
agccggcggccca

SEQ ID NO: 1168949 - DNA, 18 bp, Homo sapiens
agccggcggcccaagccc

SEQ ID NO: 1168950 - DNA, 15 bp, Homo sapiens
agccgggaccctcag

SEQ ID NO: 1168951 - DNA, 17 bp, Homo sapiens
agcctccgagagggaga

SEQ ID NO: 1168952 - DNA, 18 bp, Homo sapiens
agcctccgagagggagag

SEQ ID NO: 1168953 - DNA, 15 bp, Homo sapiens
agcctccgtcatcca

SEQ ID NO: 1168954 - DNA, 19 bp, Homo sapiens
agcctccgtttatgggcct

SEQ ID NO: 1168955 - DNA, 20 bp, Homo sapiens
agcctccgtttatgggcctt

SEQ ID NO: 1168956 - DNA, 13 bp, Homo sapiens
agcctcctcaggg

SEQ ID NO: 1168957 - DNA, 12 bp, Homo sapiens
agcctcctcctg

SEQ ID NO: 1168958 - DNA, 13 bp, Homo sapiens
agcctcctctctc

SEQ ID NO: 1168959 - DNA, 14 bp, Homo sapiens
agcctcctgagcct

SEQ ID NO: 1168960 - DNA, 16 bp, Homo sapiens
agcctcctgccccctg

SEQ ID NO: 1168961 - DNA, 18 bp, Homo sapiens
agcctcctgccccctgcc

SEQ ID NO: 1168962 - DNA, 19 bp, Homo sapiens
agcctcctgtacctcagtg

SEQ ID NO: 1168963 - DNA, 14 bp, Homo sapiens
agcctcctgtgcct

SEQ ID NO: 1168964 - DNA, 16 bp, Homo sapiens
agcctcctgtgcctgg

SEQ ID NO: 1168965 - DNA, 18 bp, Homo sapiens
agcctcctgtgcctggcc

SEQ ID NO: 1168966 - DNA, 17 bp, Homo sapiens
agcctccttagaaaaaa

SEQ ID NO: 1168967 - DNA, 16 bp, Homo sapiens
agcctccttgctgacc

SEQ ID NO: 1168968 - DNA, 15 bp, Homo sapiens
agcctcgaggctggt

SEQ ID NO: 1168969 - DNA, 17 bp, Homo sapiens
agcctcgaggctggtgg

SEQ ID NO: 1168970 - DNA, 15 bp, Homo sapiens
agcctcgcccctcca

SEQ ID NO: 1168971 - DNA, 20 bp, Homo sapiens
agcctcggggatggggaggg

SEQ ID NO: 1168972 - DNA, 14 bp, Homo sapiens
agcctcgggtgggg

SEQ ID NO: 1168973 - DNA, 21 bp, Homo sapiens
agcctcgttggaagaggaaca

SEQ ID NO: 1168974 - DNA, 17 bp, Homo sapiens
agcctcgttttgatgcc

SEQ ID NO: 1168975 - DNA, 18 bp, Homo sapiens
agcctctcagtgccctcc

SEQ ID NO: 1168976 - DNA, 20 bp, Homo sapiens
agcctctcagtgccctccag

SEQ ID NO: 1168977 - DNA, 12 bp, Homo sapiens
agcctctccagg

SEQ ID NO: 1168978 - DNA, 13 bp, Homo sapiens
agcctctcccacc

SEQ ID NO: 1168979 - DNA, 14 bp, Homo sapiens
agcctctcccaccc

SEQ ID NO: 1168980 - DNA, 18 bp, Homo sapiens
agcctctcccacccggcc

SEQ ID NO: 1168981 - DNA, 16 bp, Homo sapiens
agcctctccccaggtc

SEQ ID NO: 1168982 - DNA, 18 bp, Homo sapiens
agcctctccccaggtcca

SEQ ID NO: 1168983 - DNA, 16 bp, Homo sapiens
agcctctcccggctgc

SEQ ID NO: 1168984 - DNA, 20 bp, Homo sapiens
agcctctcccggctgcctgc

SEQ ID NO: 1168985 - DNA, 22 bp, Homo sapiens
agcctctcccggctgcctgccg

SEQ ID NO: 1168986 - DNA, 18 bp, Homo sapiens
agcctctctccttggcca

SEQ ID NO: 1168987 - DNA, 20 bp, Homo sapiens
agcctctctccttggccaca

SEQ ID NO: 1168988 - DNA, 15 bp, Homo sapiens
agcctctctctccct

SEQ ID NO: 1168989 - DNA, 16 bp, Homo sapiens
agcctctctctccctc

SEQ ID NO: 1168990 - DNA, 20 bp, Homo sapiens
agcctctctctccctccctc

SEQ ID NO: 1168991 - DNA, 16 bp, Homo sapiens
agcctctctggctggt

SEQ ID NO: 1168992 - DNA, 17 bp, Homo sapiens
agcctctgcaactgcaa

SEQ ID NO: 1168993 - DNA, 13 bp, Homo sapiens
agcctctgccctg

SEQ ID NO: 1168994 - DNA, 17 bp, Homo sapiens
agcctctgccctgcctc

SEQ ID NO: 1168995 - DNA, 15 bp, Homo sapiens
agcctctgctcccca

SEQ ID NO: 1168996 - DNA, 15 bp, Homo sapiens
agcctctggcccctc

SEQ ID NO: 1168997 - DNA, 16 bp, Homo sapiens
agcctctggcccctca

SEQ ID NO: 1168998 - DNA, 17 bp, Homo sapiens
agcctctgttttgatat

SEQ ID NO: 1168999 - DNA, 22 bp, Homo sapiens
agcctcttaaagctgcctgtag

SEQ ID NO: 1169000 - DNA, 23 bp, Homo sapiens
agcctcttaaagctgcctgtagt

SEQ ID NO: 1169001 - DNA, 22 bp, Homo sapiens
agcctcttagtgattgtgtctg

SEQ ID NO: 1169002 - DNA, 17 bp, Homo sapiens
agcctcttattccagga

SEQ ID NO: 1169003 - DNA, 18 bp, Homo sapiens
agcctcttattccaggag

SEQ ID NO: 1169004 - DNA, 13 bp, Homo sapiens
agcctcttccctc

SEQ ID NO: 1169005 - DNA, 17 bp, Homo sapiens
agcctcttccctctgat

SEQ ID NO: 1169006 - DNA, 15 bp, Homo sapiens
agcctcttctctgca

SEQ ID NO: 1169007 - DNA, 15 bp, Homo sapiens
agcctcttctgaaga

SEQ ID NO: 1169008 - DNA, 17 bp, Homo sapiens
agcctcttctgaagatg

SEQ ID NO: 1169009 - DNA, 13 bp, Homo sapiens
agcctcttgcccg

SEQ ID NO: 1169010 - DNA, 23 bp, Homo sapiens
agcctcttgcccgtcggccctgc

SEQ ID NO: 1169011 - DNA, 16 bp, Homo sapiens
agcctcttggaaatca

SEQ ID NO: 1169012 - DNA, 23 bp, Homo sapiens
agcctctttcctaacttccttta

SEQ ID NO: 1169013 - DNA, 18 bp, Homo sapiens
agcctctttgctggagtc

SEQ ID NO: 1169014 - DNA, 19 bp, Homo sapiens
agcctctttttccttcttc

SEQ ID NO: 1169015 - DNA, 21 bp, Homo sapiens
agcctctttttccttcttcag

SEQ ID NO: 1169016 - DNA, 17 bp, Homo sapiens
agcctgaaagatacagg

SEQ ID NO: 1169017 - DNA, 20 bp, Homo sapiens
agcctgaaagatacagggga

SEQ ID NO: 1169018 - DNA, 23 bp, Homo sapiens
agcctgaaagatacaggggatca

SEQ ID NO: 1169019 - DNA, 15 bp, Homo sapiens
agcctgaaagtttag

SEQ ID NO: 1169020 - DNA, 16 bp, Homo sapiens
agcctgaagcctggat

SEQ ID NO: 1169021 - DNA, 20 bp, Homo sapiens
agcctgaagctggcctggac

SEQ ID NO: 1169022 - DNA, 22 bp, Homo sapiens
agcctgaaggggcgtctgttcc

SEQ ID NO: 1169023 - DNA, 16 bp, Homo sapiens
agcctgacctgagact

SEQ ID NO: 1169024 - DNA, 18 bp, Homo sapiens
agcctgacctgagactgt

SEQ ID NO: 1169025 - DNA, 19 bp, Homo sapiens
agcctgaccttccttcctg

SEQ ID NO: 1169026 - DNA, 17 bp, Homo sapiens
agcctgactgccaggac

SEQ ID NO: 1169027 - DNA, 18 bp, Homo sapiens
agcctgactttctctcca

SEQ ID NO: 1169028 - DNA, 12 bp, Homo sapiens
agcctgagagag

SEQ ID NO: 1169029 - DNA, 21 bp, Homo sapiens
agcctgagcggaggctcggcc

SEQ ID NO: 1169030 - DNA, 14 bp, Homo sapiens
agcctgaggcagga

SEQ ID NO: 1169031 - DNA, 15 bp, Homo sapiens
agcctgaggcaggag

SEQ ID NO: 1169032 - DNA, 11 bp, Homo sapiens
agcctgaggct

SEQ ID NO: 1169033 - DNA, 17 bp, Homo sapiens
agcctgaggctgagact

SEQ ID NO: 1169034 - DNA, 14 bp, Homo sapiens
agcctgaggtcccc

SEQ ID NO: 1169035 - DNA, 15 bp, Homo sapiens
agcctgaggtcccct

SEQ ID NO: 1169036 - DNA, 14 bp, Homo sapiens
agcctgatccagcc

SEQ ID NO: 1169037 - DNA, 17 bp, Homo sapiens
agcctgatctcttcctg

SEQ ID NO: 1169038 - DNA, 18 bp, Homo sapiens
agcctgatctcttcctgt

SEQ ID NO: 1169039 - DNA, 13 bp, Homo sapiens
agcctgatggcca

SEQ ID NO: 1169040 - DNA, 23 bp, Homo sapiens
agcctgatggccaagggggtgga

SEQ ID NO: 1169041 - DNA, 17 bp, Homo sapiens
agcctgcaaactcactg

SEQ ID NO: 1169042 - DNA, 19 bp, Homo sapiens
agcctgcaaactcactgct

SEQ ID NO: 1169043 - DNA, 17 bp, Homo sapiens
agcctgcaccgccgcca

SEQ ID NO: 1169044 - DNA, 20 bp, Homo sapiens
agcctgcaggacctcgtgcc

SEQ ID NO: 1169045 - DNA, 21 bp, Homo sapiens
agcctgcaggacctcgtgcca

SEQ ID NO: 1169046 - DNA, 23 bp, Homo sapiens
agcctgcagggtggtgctgggac

SEQ ID NO: 1169047 - DNA, 19 bp, Homo sapiens
agcccaccagccagccctg

SEQ ID NO: 1169048 - DNA, 14 bp, Homo sapiens
agcccaccaggagc

SEQ ID NO: 1169049 - DNA, 19 bp, Homo sapiens
agcccaccaggagcacctg

SEQ ID NO: 1169050 - DNA, 21 bp, Homo sapiens
agcccaccaggagcacctgga

SEQ ID NO: 1169051 - DNA, 9 bp, Homo sapiens
agcccacct

SEQ ID NO: 1169052 - DNA, 21 bp, Homo sapiens
agcccacctgaaagcctgtct

SEQ ID NO: 1169053 - DNA, 22 bp, Homo sapiens
agcccacctgaaagcctgtctc

SEQ ID NO: 1169054 - DNA, 16 bp, Homo sapiens
agcccacctgggctgg

SEQ ID NO: 1169055 - DNA, 22 bp, Homo sapiens
agcccacgcccgactagcaggc

SEQ ID NO: 1169056 - DNA, 13 bp, Homo sapiens
agcccactccctg

SEQ ID NO: 1169057 - DNA, 20 bp, Homo sapiens
agcccactgcccaccccctc

SEQ ID NO: 1169058 - DNA, 14 bp, Homo sapiens
agcccactgcctcc

SEQ ID NO: 1169059 - DNA, 18 bp, Homo sapiens
agcccagaaagtgataag

SEQ ID NO: 1169060 - DNA, 18 bp, Homo sapiens
agcccagaatccccaagt

SEQ ID NO: 1169061 - DNA, 14 bp, Homo sapiens
agcccagagaagct

SEQ ID NO: 1169062 - DNA, 15 bp, Homo sapiens
agcccagagccacct

SEQ ID NO: 1169063 - DNA, 20 bp, Homo sapiens
agcccagatggaaagacgtt

SEQ ID NO: 1169064 - DNA, 18 bp, Homo sapiens
agcccagattcccctgtg

SEQ ID NO: 1169065 - DNA, 15 bp, Homo sapiens
agcccagcactgctt

SEQ ID NO: 1169066 - DNA, 19 bp, Homo sapiens
agcccagccccactcctct

SEQ ID NO: 1169067 - DNA, 21 bp, Homo sapiens
agcccagcctagtcagggcac

SEQ ID NO: 1169068 - DNA, 12 bp, Homo sapiens
agcccagcctgc

SEQ ID NO: 1169069 - DNA, 15 bp, Homo sapiens
agcccagcctgcccc

SEQ ID NO: 1169070 - DNA, 20 bp, Homo sapiens
agcccagcctgccccctatc

SEQ ID NO: 1169071 - DNA, 16 bp, Homo sapiens
agcccagcctgggagc

SEQ ID NO: 1169072 - DNA, 19 bp, Homo sapiens
agcccagctacattcctca

SEQ ID NO: 1169073 - DNA, 14 bp, Homo sapiens
agcccagctctgaa

SEQ ID NO: 1169074 - DNA, 14 bp, Homo sapiens
agcccagctcttgc

SEQ ID NO: 1169075 - DNA, 13 bp, Homo sapiens
agcccagctgggt

SEQ ID NO: 1169076 - DNA, 20 bp, Homo sapiens
agcccagctgggtcaggcag

SEQ ID NO: 1169077 - DNA, 14 bp, Homo sapiens
agcccagcttcctg

SEQ ID NO: 1169078 - DNA, 20 bp, Homo sapiens
agcccaggagcaacagccta

SEQ ID NO: 1169079 - DNA, 16 bp, Homo sapiens
agcccaggagctgagt

SEQ ID NO: 1169080 - DNA, 20 bp, Homo sapiens
agcccaggagtttgagacaa

SEQ ID NO: 1169081 - DNA, 19 bp, Homo sapiens
agcccaggagtttgaggct

SEQ ID NO: 1169082 - DNA, 19 bp, Homo sapiens
agcccaggcagctatttca

SEQ ID NO: 1169083 - DNA, 17 bp, Homo sapiens
agcccaggcatctcctt

SEQ ID NO: 1169084 - DNA, 18 bp, Homo sapiens
agcccaggcatctccttg

SEQ ID NO: 1169085 - DNA, 21 bp, Homo sapiens
agcccaggcatctccttgggc

SEQ ID NO: 1169086 - DNA, 12 bp, Homo sapiens
agcccaggctcg

SEQ ID NO: 1169087 - DNA, 19 bp, Homo sapiens
agcccaggctgatgcttga

SEQ ID NO: 1169088 - DNA, 19 bp, Homo sapiens
agcccagggcatcttgctg

SEQ ID NO: 1169089 - DNA, 22 bp, Homo sapiens
agcccagggcatcttgctggct

SEQ ID NO: 1169090 - DNA, 23 bp, Homo sapiens
agcccagggttcccccagccctg

SEQ ID NO: 1169091 - DNA, 15 bp, Homo sapiens
agcccagtcgagacc

SEQ ID NO: 1169092 - DNA, 18 bp, Homo sapiens
agcccagtgcactgaaag

SEQ ID NO: 1169093 - DNA, 15 bp, Homo sapiens
agcccagtgcttctc

SEQ ID NO: 1169094 - DNA, 20 bp, Homo sapiens
agcccagtgggctgcacgct

SEQ ID NO: 1169095 - DNA, 14 bp, Homo sapiens
agcccagtggtgag

SEQ ID NO: 1169096 - DNA, 22 bp, Homo sapiens
agcccagtgttttctttgagga

SEQ ID NO: 1169097 - DNA, 21 bp, Homo sapiens
agcccctcttgccccccaccc

SEQ ID NO: 1169098 - DNA, 22 bp, Homo sapiens
agcccctcttgccccccacccc

SEQ ID NO: 1169099 - DNA, 23 bp, Homo sapiens
agcccctcttgccccccacccca

SEQ ID NO: 1169100 - DNA, 15 bp, Homo sapiens
agcccctcttggaga

SEQ ID NO: 1169101 - DNA, 17 bp, Homo sapiens
agcccctcttggagaag

SEQ ID NO: 1169102 - DNA, 22 bp, Homo sapiens
agcccctctttctgtcccctct

SEQ ID NO: 1169103 - DNA, 14 bp, Homo sapiens
agcccctgaaagcc

SEQ ID NO: 1169104 - DNA, 18 bp, Homo sapiens
agcccctgatctctgacc

SEQ ID NO: 1169105 - DNA, 12 bp, Homo sapiens
agcccctgccct

SEQ ID NO: 1169106 - DNA, 13 bp, Homo sapiens
agcccctgccctg

SEQ ID NO: 1169107 - DNA, 16 bp, Homo sapiens
agcccctgccctgggg

SEQ ID NO: 1169108 - DNA, 17 bp, Homo sapiens
agcccctgccctgggga

SEQ ID NO: 1169109 - DNA, 19 bp, Homo sapiens
agcccctggacccctgggg

SEQ ID NO: 1169110 - DNA, 22 bp, Homo sapiens
agcccctgggaacaggccccac

SEQ ID NO: 1169111 - DNA, 14 bp, Homo sapiens
agcccctgggccca

SEQ ID NO: 1169112 - DNA, 16 bp, Homo sapiens
agcccctgggcccagt

SEQ ID NO: 1169113 - DNA, 14 bp, Homo sapiens
agcccctgggccct

SEQ ID NO: 1169114 - DNA, 17 bp, Homo sapiens
agcccctgggcccttgt

SEQ ID NO: 1169115 - DNA, 12 bp, Homo sapiens
agcccctggggc

SEQ ID NO: 1169116 - DNA, 21 bp, Homo sapiens
agcccctggggctgtatttat

SEQ ID NO: 1169117 - DNA, 21 bp, Homo sapiens
agcccctggggtggccaccag

SEQ ID NO: 1169118 - DNA, 12 bp, Homo sapiens
agcccctgtccc

SEQ ID NO: 1169119 - DNA, 23 bp, Homo sapiens
agcccctgtcgcccacccagctg

SEQ ID NO: 1169120 - DNA, 22 bp, Homo sapiens
agcccctgtctagagagggagg

SEQ ID NO: 1169121 - DNA, 15 bp, Homo sapiens
agccccttctcagaa

SEQ ID NO: 1169122 - DNA, 16 bp, Homo sapiens
agccccttctcagaat

SEQ ID NO: 1169123 - DNA, 19 bp, Homo sapiens
agccccttctcagaatcta

SEQ ID NO: 1169124 - DNA, 15 bp, Homo sapiens
agccccttctgctca

SEQ ID NO: 1169125 - DNA, 16 bp, Homo sapiens
agccccttctgctcag

SEQ ID NO: 1169126 - DNA, 21 bp, Homo sapiens
agccccttcttccaaggagca

SEQ ID NO: 1169127 - DNA, 22 bp, Homo sapiens
agccccttggagagagaggctg

SEQ ID NO: 1169128 - DNA, 18 bp, Homo sapiens
agcccctttgcctctgtc

SEQ ID NO: 1169129 - DNA, 21 bp, Homo sapiens
agccccttttctctgctcttg

SEQ ID NO: 1169130 - DNA, 16 bp, Homo sapiens
agcccgacagtgccat

SEQ ID NO: 1169131 - DNA, 20 bp, Homo sapiens
agcccgacagtgccatcccc

SEQ ID NO: 1169132 - DNA, 16 bp, Homo sapiens
agcccgatattctccc

SEQ ID NO: 1169133 - DNA, 18 bp, Homo sapiens
agcccgatattctccctg

SEQ ID NO: 1169134 - DNA, 19 bp, Homo sapiens
agcccgatattctccctga

SEQ ID NO: 1169135 - DNA, 16 bp, Homo sapiens
agcccgcacccccacc

SEQ ID NO: 1169136 - DNA, 19 bp, Homo sapiens
agcccgcacccccaccctt

SEQ ID NO: 1169137 - DNA, 20 bp, Homo sapiens
agcccgcagggccatgcaga

SEQ ID NO: 1169138 - DNA, 21 bp, Homo sapiens
agcccgcagggccatgcagac

SEQ ID NO: 1169139 - DNA, 16 bp, Homo sapiens
agcccgccgtctgcag

SEQ ID NO: 1169140 - DNA, 18 bp, Homo sapiens
agcccgccgtctgcaggg

SEQ ID NO: 1169141 - DNA, 13 bp, Homo sapiens
agcccgcctgaca

SEQ ID NO: 1169142 - DNA, 18 bp, Homo sapiens
agcccgcctgacagaaac

SEQ ID NO: 1169143 - DNA, 13 bp, Homo sapiens
agcccgcggcctg

SEQ ID NO: 1169144 - DNA, 17 bp, Homo sapiens
agcccgcggcctggacc

SEQ ID NO: 1169145 - DNA, 14 bp, Homo sapiens
agcccgctaggctc

SEQ ID NO: 1169146 - DNA, 15 bp, Homo sapiens
agcccgctctctggc

SEQ ID NO: 1169147 - DNA, 20 bp, Homo sapiens
agcccgcttcaagctctctg

SEQ ID NO: 1169148 - DNA, 24 bp, Homo sapiens
agcccgcttcaagctctctgttgc

SEQ ID NO: 1169149 - DNA, 14 bp, Homo sapiens
agcccggatgcttc

SEQ ID NO: 1169150 - DNA, 20 bp, Homo sapiens
agcccggccccacctccctg

SEQ ID NO: 1169151 - DNA, 19 bp, Homo sapiens
agcccggccctcccccagc

SEQ ID NO: 1169152 - DNA, 20 bp, Homo sapiens
agcccggccctcccccagct

SEQ ID NO: 1169153 - DNA, 21 bp, Homo sapiens
agcccggcgcccctgccacct

SEQ ID NO: 1169154 - DNA, 16 bp, Homo sapiens
agcccggctgctgctt

SEQ ID NO: 1169155 - DNA, 13 bp, Homo sapiens
agcccggctggtt

SEQ ID NO: 1169156 - DNA, 15 bp, Homo sapiens
agcccggctggtttt

SEQ ID NO: 1169157 - DNA, 21 bp, Homo sapiens
agcccgggagcctaggaccac

SEQ ID NO: 1169158 - DNA, 16 bp, Homo sapiens
agcccgggctgcctgg

SEQ ID NO: 1169159 - DNA, 17 bp, Homo sapiens
agcccgggctgcctggg

SEQ ID NO: 1169160 - DNA, 22 bp, Homo sapiens
agcccgggtgtgcctgccctgg

SEQ ID NO: 1169161 - DNA, 23 bp, Homo sapiens
agcccgggtgtgcctgccctgga

SEQ ID NO: 1169162 - DNA, 15 bp, Homo sapiens
agcccggtaagagca

SEQ ID NO: 1169163 - DNA, 21 bp, Homo sapiens
agcccggtaagagcaaaagaa

SEQ ID NO: 1169164 - DNA, 17 bp, Homo sapiens
agcccgtgtggcccctt

SEQ ID NO: 1169165 - DNA, 19 bp, Homo sapiens
agcccgtgtggccccttca

SEQ ID NO: 1169166 - DNA, 14 bp, Homo sapiens
agcccgttaaataa

SEQ ID NO: 1169167 - DNA, 19 bp, Homo sapiens
agccctaaaaatccagact

SEQ ID NO: 1169168 - DNA, 22 bp, Homo sapiens
agccctaaaattccactgcgtt

SEQ ID NO: 1169169 - DNA, 17 bp, Homo sapiens
agccctaaccccttcca

SEQ ID NO: 1169170 - DNA, 18 bp, Homo sapiens
agccctaaccccttccag

SEQ ID NO: 1169171 - DNA, 21 bp, Homo sapiens
agccctaaccccttccagatc

SEQ ID NO: 1169172 - DNA, 21 bp, Homo sapiens
agccctaagcctgtccccaga

SEQ ID NO: 1169173 - DNA, 16 bp, Homo sapiens
agccctaaggatctct

SEQ ID NO: 1169174 - DNA, 21 bp, Homo sapiens
agccctaaggatctctcagga

SEQ ID NO: 1169175 - DNA, 18 bp, Homo sapiens
agccctacagagctgtgg

SEQ ID NO: 1169176 - DNA, 18 bp, Homo sapiens
agccaacaactctgcctt

SEQ ID NO: 1169177 - DNA, 15 bp, Homo sapiens
agccaacaagaccgc

SEQ ID NO: 1169178 - DNA, 20 bp, Homo sapiens
agccaacaagaccgccccag

SEQ ID NO: 1169179 - DNA, 18 bp, Homo sapiens
agccaacacgcacctgcc

SEQ ID NO: 1169180 - DNA, 17 bp, Homo sapiens
agccaacaggtggcagg

SEQ ID NO: 1169181 - DNA, 21 bp, Homo sapiens
agccaacagtcaaaacagaga

SEQ ID NO: 1169182 - DNA, 16 bp, Homo sapiens
agccaacatgtggctc

SEQ ID NO: 1169183 - DNA, 14 bp, Homo sapiens
agccaaccagcctt

SEQ ID NO: 1169184 - DNA, 16 bp, Homo sapiens
agccaactagcccctg

SEQ ID NO: 1169185 - DNA, 17 bp, Homo sapiens
agccaactatgattatt

SEQ ID NO: 1169186 - DNA, 13 bp, Homo sapiens
agccaactctggg

SEQ ID NO: 1169187 - DNA, 16 bp, Homo sapiens
agccaactgattttgt

SEQ ID NO: 1169188 - DNA, 18 bp, Homo sapiens
agccaactgattttgtat

SEQ ID NO: 1169189 - DNA, 15 bp, Homo sapiens
agccaacttgtaaat

SEQ ID NO: 1169190 - DNA, 15 bp, Homo sapiens
agccaacttttgcat

SEQ ID NO: 1169191 - DNA, 16 bp, Homo sapiens
agccaagaagcctgca

SEQ ID NO: 1169192 - DNA, 22 bp, Homo sapiens
agccaagattttcctcttgtga

SEQ ID NO: 1169193 - DNA, 19 bp, Homo sapiens
agccaagccctaagcctgt

SEQ ID NO: 1169194 - DNA, 23 bp, Homo sapiens
agccaagccctaagcctgtcccc

SEQ ID NO: 1169195 - DNA, 15 bp, Homo sapiens
agccaagcgctcatg

SEQ ID NO: 1169196 - DNA, 18 bp, Homo sapiens
agccaagctccctggagc

SEQ ID NO: 1169197 - DNA, 19 bp, Homo sapiens
agccaagctccctggagcc

SEQ ID NO: 1169198 - DNA, 22 bp, Homo sapiens
agccaagctccctggagccctg

SEQ ID NO: 1169199 - DNA, 14 bp, Homo sapiens
agccaagctgcaca

SEQ ID NO: 1169200 - DNA, 19 bp, Homo sapiens
agccaagctttaaattatg

SEQ ID NO: 1169201 - DNA, 20 bp, Homo sapiens
agccaagctttaaattatgt

SEQ ID NO: 1169202 - DNA, 16 bp, Homo sapiens
agccaaggaggcctgg

SEQ ID NO: 1169203 - DNA, 19 bp, Homo sapiens
agccaaggaggcctgggga

SEQ ID NO: 1169204 - DNA, 20 bp, Homo sapiens
agccaaggaggcctggggag

SEQ ID NO: 1169205 - DNA, 20 bp, Homo sapiens
agccaaggagtcactgagac

SEQ ID NO: 1169206 - DNA, 23 bp, Homo sapiens
agccaaggccctgagttggcagt

SEQ ID NO: 1169207 - DNA, 18 bp, Homo sapiens
agccaaggccgccagcgt

SEQ ID NO: 1169208 - DNA, 19 bp, Homo sapiens
agccaagggaacctgtgtc

SEQ ID NO: 1169209 - DNA, 20 bp, Homo sapiens
agccaagggaacctgtgtcc

SEQ ID NO: 1169210 - DNA, 12 bp, Homo sapiens
agccaagggagg

SEQ ID NO: 1169211 - DNA, 14 bp, Homo sapiens
agccaagggaggga

SEQ ID NO: 1169212 - DNA, 17 bp, Homo sapiens
agccaaggggctgcgct

SEQ ID NO: 1169213 - DNA, 23 bp, Homo sapiens
agccaaggggctgcgctagcagc

SEQ ID NO: 1169214 - DNA, 18 bp, Homo sapiens
agccaagggttcagagac

SEQ ID NO: 1169215 - DNA, 19 bp, Homo sapiens
agccaaggtgggctgagcc

SEQ ID NO: 1169216 - DNA, 14 bp, Homo sapiens
agccaagtagcctc

SEQ ID NO: 1169217 - DNA, 20 bp, Homo sapiens
agccaagtagcctctcctgt

SEQ ID NO: 1169218 - DNA, 23 bp, Homo sapiens
agccaagtcagctttgccttcca

SEQ ID NO: 1169219 - DNA, 15 bp, Homo sapiens
agccaagtccagatt

SEQ ID NO: 1169220 - DNA, 17 bp, Homo sapiens
agccaagtcctccctct

SEQ ID NO: 1169221 - DNA, 13 bp, Homo sapiens
agccaagtggggt

SEQ ID NO: 1169222 - DNA, 23 bp, Homo sapiens
agccaagtgtggtagagtgtgcc

SEQ ID NO: 1169223 - DNA, 23 bp, Homo sapiens
agccaagttatattgaatatatc

SEQ ID NO: 1169224 - DNA, 15 bp, Homo sapiens
agccaagttttataa

SEQ ID NO: 1169225 - DNA, 15 bp, Homo sapiens
agccaatcccctcct

SEQ ID NO: 1169226 - DNA, 16 bp, Homo sapiens
agccaatcccctcctt

SEQ ID NO: 1169227 - DNA, 16 bp, Homo sapiens
agccaatgtctcctcc

SEQ ID NO: 1169228 - DNA, 17 bp, Homo sapiens
agccaatttgtctccta

SEQ ID NO: 1169229 - DNA, 19 bp, Homo sapiens
agccacaaaataaatgttg

SEQ ID NO: 1169230 - DNA, 18 bp, Homo sapiens
agccacaaggctggccag

SEQ ID NO: 1169231 - DNA, 20 bp, Homo sapiens
agccacaaggctggccagca

SEQ ID NO: 1169232 - DNA, 18 bp, Homo sapiens
agccacaagtcttccaga

SEQ ID NO: 1169233 - DNA, 22 bp, Homo sapiens
agccacacctggactgaccctg

SEQ ID NO: 1169234 - DNA, 18 bp, Homo sapiens
agccacacgcaggcggcc

SEQ ID NO: 1169235 - DNA, 22 bp, Homo sapiens
agccacacgcaggcggccaggg

SEQ ID NO: 1169236 - DNA, 16 bp, Homo sapiens
agccacacggagaggc

SEQ ID NO: 1169237 - DNA, 13 bp, Homo sapiens
agccacactgggc

SEQ ID NO: 1169238 - DNA, 10 bp, Homo sapiens
agccacagaa

SEQ ID NO: 1169239 - DNA, 23 bp, Homo sapiens
agccacagctgctgttctcagga

SEQ ID NO: 1169240 - DNA, 23 bp, Homo sapiens
agccagccctccctgtcctcctc

SEQ ID NO: 1169241 - DNA, 13 bp, Homo sapiens
agccagccctggc

SEQ ID NO: 1169242 - DNA, 15 bp, Homo sapiens
agccagccctggccc

SEQ ID NO: 1169243 - DNA, 16 bp, Homo sapiens
agccagccctggccca

SEQ ID NO: 1169244 - DNA, 17 bp, Homo sapiens
agccagccctggcccac

SEQ ID NO: 1169245 - DNA, 17 bp, Homo sapiens
agccagcccttccctgg

SEQ ID NO: 1169246 - DNA, 10 bp, Homo sapiens
agccagcctc

SEQ ID NO: 1169247 - DNA, 11 bp, Homo sapiens
agccagcctga

SEQ ID NO: 1169248 - DNA, 15 bp, Homo sapiens
agccagcctgacctt

SEQ ID NO: 1169249 - DNA, 16 bp, Homo sapiens
agccagcctggctctg

SEQ ID NO: 1169250 - DNA, 19 bp, Homo sapiens
agccagcctggctctgccc

SEQ ID NO: 1169251 - DNA, 14 bp, Homo sapiens
agccagcctgggac

SEQ ID NO: 1169252 - DNA, 15 bp, Homo sapiens
agccagcctgggact

SEQ ID NO: 1169253 - DNA, 23 bp, Homo sapiens
agccagcctgggactcccagtga

SEQ ID NO: 1169254 - DNA, 13 bp, Homo sapiens
agccagcctggtc

SEQ ID NO: 1169255 - DNA, 13 bp, Homo sapiens
agccagccttccc

SEQ ID NO: 1169256 - DNA, 15 bp, Homo sapiens
agccagcgcctccct

SEQ ID NO: 1169257 - DNA, 17 bp, Homo sapiens
agccagcgcctccctcc

SEQ ID NO: 1169258 - DNA, 18 bp, Homo sapiens
agccagcgcctccctcca

SEQ ID NO: 1169259 - DNA, 23 bp, Homo sapiens
agccagcgcctccctccacccca

SEQ ID NO: 1169260 - DNA, 16 bp, Homo sapiens
agccagcgtcctcctc

SEQ ID NO: 1169261 - DNA, 17 bp, Homo sapiens
agccagcgtcctcctct

SEQ ID NO: 1169262 - DNA, 15 bp, Homo sapiens
agccagctcacagtg

SEQ ID NO: 1169263 - DNA, 23 bp, Homo sapiens
agccagctcacagtgctgtgtgc

SEQ ID NO: 1169264 - DNA, 14 bp, Homo sapiens
agccagctccctct

SEQ ID NO: 1169265 - DNA, 14 bp, Homo sapiens
agccagctctcagc

SEQ ID NO: 1169266 - DNA, 16 bp, Homo sapiens
agccagctctcagcca

SEQ ID NO: 1169267 - DNA, 11 bp, Homo sapiens
agccagctgca

SEQ ID NO: 1169268 - DNA, 15 bp, Homo sapiens
agccagctgcagggc

SEQ ID NO: 1169269 - DNA, 12 bp, Homo sapiens
agccagctgctt

SEQ ID NO: 1169270 - DNA, 13 bp, Homo sapiens
agccagcttagca

SEQ ID NO: 1169271 - DNA, 14 bp, Homo sapiens
agccagctttccct

SEQ ID NO: 1169272 - DNA, 18 bp, Homo sapiens
agccagctttccctgcct

SEQ ID NO: 1169273 - DNA, 20 bp, Homo sapiens
agccaggaagatcccccaga

SEQ ID NO: 1169274 - DNA, 15 bp, Homo sapiens
agccaggacagtcag

SEQ ID NO: 1169275 - DNA, 13 bp, Homo sapiens
agccaggagaagc

SEQ ID NO: 1169276 - DNA, 17 bp, Homo sapiens
agccaggagaaggtcag

SEQ ID NO: 1169277 - DNA, 14 bp, Homo sapiens
agccaggagctgtc

SEQ ID NO: 1169278 - DNA, 17 bp, Homo sapiens
agccaggagctgtcacc

SEQ ID NO: 1169279 - DNA, 14 bp, Homo sapiens
agccaggaggcctg

SEQ ID NO: 1169280 - DNA, 19 bp, Homo sapiens
agccaggaggcctgctagg

SEQ ID NO: 1169281 - DNA, 17 bp, Homo sapiens
agccaggagtctgtgct

SEQ ID NO: 1169282 - DNA, 21 bp, Homo sapiens
agccaggagtctgtgctcttt

SEQ ID NO: 1169283 - DNA, 16 bp, Homo sapiens
agccaggatgcccaga

SEQ ID NO: 1169284 - DNA, 23 bp, Homo sapiens
agccaggcagaggttttaatgtc

SEQ ID NO: 1169285 - DNA, 15 bp, Homo sapiens
agccaggccccaggc

SEQ ID NO: 1169286 - DNA, 13 bp, Homo sapiens
agccaggcgggct

SEQ ID NO: 1169287 - DNA, 15 bp, Homo sapiens
agccaggctgggccg

SEQ ID NO: 1169288 - DNA, 13 bp, Homo sapiens
agccagggccagg

SEQ ID NO: 1169289 - DNA, 11 bp, Homo sapiens
agccagggccc

SEQ ID NO: 1169290 - DNA, 13 bp, Homo sapiens
agccagggcccag

SEQ ID NO: 1169291 - DNA, 21 bp, Homo sapiens
agccagggcccagagcccttg

SEQ ID NO: 1169292 - DNA, 22 bp, Homo sapiens
agccagggcccagagcccttga

SEQ ID NO: 1169293 - DNA, 17 bp, Homo sapiens
agccagggcccctggat

SEQ ID NO: 1169294 - DNA, 18 bp, Homo sapiens
agccagggcccctggatc

SEQ ID NO: 1169295 - DNA, 19 bp, Homo sapiens
agccagggcccctggatct

SEQ ID NO: 1169296 - DNA, 16 bp, Homo sapiens
agccagggctggagaa

SEQ ID NO: 1169297 - DNA, 16 bp, Homo sapiens
agccagggctgtcctt

SEQ ID NO: 1169298 - DNA, 16 bp, Homo sapiens
agccagggtctctccc

SEQ ID NO: 1169299 - DNA, 20 bp, Homo sapiens
agccagggtctctccctcag

SEQ ID NO: 1169300 - DNA, 21 bp, Homo sapiens
agccagggtctctccctcagg

SEQ ID NO: 1169301 - DNA, 22 bp, Homo sapiens
agccagggtctctccctcaggt

SEQ ID NO: 1169302 - DNA, 20 bp, Homo sapiens
agccagggtgagagtctggg

SEQ ID NO: 1169303 - DNA, 21 bp, Homo sapiens
agccagggtgtggccctgcca

SEQ ID NO: 1169304 - DNA, 19 bp, Homo sapiens
agccaggtacaggagaggc

SEQ ID NO: 1169305 - DNA, 20 bp, Homo sapiens
agccaggtacaggagaggca

SEQ ID NO: 1169306 - DNA, 19 bp, Homo sapiens
agcagcctcgaggctggtg

SEQ ID NO: 1169307 - DNA, 23 bp, Homo sapiens
agcagcctcgaggctggtggttt

SEQ ID NO: 1169308 - DNA, 12 bp, Homo sapiens
agcagcctcgca

SEQ ID NO: 1169309 - DNA, 20 bp, Homo sapiens
agcagcctcgcacaggccct

SEQ ID NO: 1169310 - DNA, 15 bp, Homo sapiens
agcagcctcgtggag

SEQ ID NO: 1169311 - DNA, 15 bp, Homo sapiens
agcagcctctcccca

SEQ ID NO: 1169312 - DNA, 20 bp, Homo sapiens
agcagcctctccccaggtcc

SEQ ID NO: 1169313 - DNA, 12 bp, Homo sapiens
agcagcctctga

SEQ ID NO: 1169314 - DNA, 14 bp, Homo sapiens
agcagcctgatggc

SEQ ID NO: 1169315 - DNA, 16 bp, Homo sapiens
agcagcctggaccctg

SEQ ID NO: 1169316 - DNA, 16 bp, Homo sapiens
agcagcctttaatgca

SEQ ID NO: 1169317 - DNA, 14 bp, Homo sapiens
agcagcgcccaggc

SEQ ID NO: 1169318 - DNA, 15 bp, Homo sapiens
agcagcgcccaggcc

SEQ ID NO: 1169319 - DNA, 19 bp, Homo sapiens
agcagcgcccaggcctgct

SEQ ID NO: 1169320 - DNA, 20 bp, Homo sapiens
agcagcgcccaggcctgctg

SEQ ID NO: 1169321 - DNA, 14 bp, Homo sapiens
agcagcgcctttcc

SEQ ID NO: 1169322 - DNA, 17 bp, Homo sapiens
agcagcgctcggcccgg

SEQ ID NO: 1169323 - DNA, 15 bp, Homo sapiens
agcagcggctctggt

SEQ ID NO: 1169324 - DNA, 23 bp, Homo sapiens
agcagcggtaccccagggcctac

SEQ ID NO: 1169325 - DNA, 16 bp, Homo sapiens
agcagctaactccgag

SEQ ID NO: 1169326 - DNA, 19 bp, Homo sapiens
agcagctaactccgagagc

SEQ ID NO: 1169327 - DNA, 14 bp, Homo sapiens
agcagctaggactg

SEQ ID NO: 1169328 - DNA, 19 bp, Homo sapiens
agcagctattttaagccat

SEQ ID NO: 1169329 - DNA, 23 bp, Homo sapiens
agcagctcatagaattttgagta

SEQ ID NO: 1169330 - DNA, 23 bp, Homo sapiens
agcagctctgctatgagtgtgtg

SEQ ID NO: 1169331 - DNA, 13 bp, Homo sapiens
agcagctgcaccc

SEQ ID NO: 1169332 - DNA, 13 bp, Homo sapiens
agcagctggacta

SEQ ID NO: 1169333 - DNA, 18 bp, Homo sapiens
agcagctggactacccac

SEQ ID NO: 1169334 - DNA, 12 bp, Homo sapiens
agcagctggcct

SEQ ID NO: 1169335 - DNA, 21 bp, Homo sapiens
agcagctgggacccctcccaa

SEQ ID NO: 1169336 - DNA, 17 bp, Homo sapiens
agcagctggtcagtctt

SEQ ID NO: 1169337 - DNA, 22 bp, Homo sapiens
agcagctgtctaaaatgcagtg

SEQ ID NO: 1169338 - DNA, 18 bp, Homo sapiens
agcagcttagactaaggc

SEQ ID NO: 1169339 - DNA, 21 bp, Homo sapiens
agcagcttccttctgggactg

SEQ ID NO: 1169340 - DNA, 18 bp, Homo sapiens
agcagcttcggtgtgcag

SEQ ID NO: 1169341 - DNA, 11 bp, Homo sapiens
agcagcttctt

SEQ ID NO: 1169342 - DNA, 14 bp, Homo sapiens
agcagcttcttggg

SEQ ID NO: 1169343 - DNA, 17 bp, Homo sapiens
agcagcttcttgggctg

SEQ ID NO: 1169344 - DNA, 24 bp, Homo sapiens
agcagcttcttgggctgagtgcag

SEQ ID NO: 1169345 - DNA, 14 bp, Homo sapiens
agcagcttggggag

SEQ ID NO: 1169346 - DNA, 16 bp, Homo sapiens
agcagctttgtctctg

SEQ ID NO: 1169347 - DNA, 21 bp, Homo sapiens
agcagctttttattccctgcc

SEQ ID NO: 1169348 - DNA, 23 bp, Homo sapiens
agcaggaaatgaaaatgtcttgt

SEQ ID NO: 1169349 - DNA, 24 bp, Homo sapiens
agcaggaaggaacaaagacaggca

SEQ ID NO: 1169350 - DNA, 16 bp, Homo sapiens
agcaggaatttctttt

SEQ ID NO: 1169351 - DNA, 17 bp, Homo sapiens
agcaggacctcccttcc

SEQ ID NO: 1169352 - DNA, 18 bp, Homo sapiens
agcaggacctgtgctttg

SEQ ID NO: 1169353 - DNA, 19 bp, Homo sapiens
agcaggacctgtgctttga

SEQ ID NO: 1169354 - DNA, 16 bp, Homo sapiens
agcaggactaggcatg

SEQ ID NO: 1169355 - DNA, 14 bp, Homo sapiens
agcaggactccagg

SEQ ID NO: 1169356 - DNA, 22 bp, Homo sapiens
agcaggactccaggcccaaggc

SEQ ID NO: 1169357 - DNA, 23 bp, Homo sapiens
agcaggactccaggcccaaggct

SEQ ID NO: 1169358 - DNA, 23 bp, Homo sapiens
agcaggacttgctaaagcacttt

SEQ ID NO: 1169359 - DNA, 21 bp, Homo sapiens
agcaggagagactgagcagcc

SEQ ID NO: 1169360 - DNA, 14 bp, Homo sapiens
agcaggagcccctg

SEQ ID NO: 1169361 - DNA, 17 bp, Homo sapiens
agcaggaggccaataaa

SEQ ID NO: 1169362 - DNA, 18 bp, Homo sapiens
agcaggaggccaataaaa

SEQ ID NO: 1169363 - DNA, 18 bp, Homo sapiens
agcaggagtggtgcagac

SEQ ID NO: 1169364 - DNA, 21 bp, Homo sapiens
agcaggagtggtgcagacaga

SEQ ID NO: 1169365 - DNA, 20 bp, Homo sapiens
agcaggatcgaagggttttt

SEQ ID NO: 1169366 - DNA, 14 bp, Homo sapiens
agcaggcacatgga

SEQ ID NO: 1169367 - DNA, 16 bp, Homo sapiens
agcaggcaccgccacg

SEQ ID NO: 1169368 - DNA, 16 bp, Homo sapiens
agcaggccactagtga

SEQ ID NO: 1169369 - DNA, 19 bp, Homo sapiens
agcaggccactagtgacag

SEQ ID NO: 1169370 - DNA, 11 bp, Homo sapiens
agcaggcccag

SEQ ID NO: 1169371 - DNA, 14 bp, Homo sapiens
agcaggcccagcat

SEQ ID NO: 1169372 - DNA, 18 bp, Homo sapiens
agcaggcccagcatgcag

SEQ ID NO: 1169373 - DNA, 14 bp, Homo sapiens
agcaggcctctggt

SEQ ID NO: 1169374 - DNA, 18 bp, Homo sapiens
agcaggctcagactctgg

SEQ ID NO: 1169375 - DNA, 16 bp, Homo sapiens
agcaggctcctggctg

SEQ ID NO: 1169376 - DNA, 17 bp, Homo sapiens
agcaggctcctggctgt

SEQ ID NO: 1169377 - DNA, 14 bp, Homo sapiens
agcaggctggcagc

SEQ ID NO: 1169378 - DNA, 24 bp, Homo sapiens
agcaggctggcagctctccagtca

SEQ ID NO: 1169379 - DNA, 16 bp, Homo sapiens
agcagggaaagctcca

SEQ ID NO: 1169380 - DNA, 19 bp, Homo sapiens
agcagggaaagctccacgg

SEQ ID NO: 1169381 - DNA, 21 bp, Homo sapiens
agcagggaaagctccacggtg

SEQ ID NO: 1169382 - DNA, 12 bp, Homo sapiens
agcagggaaggc

SEQ ID NO: 1169383 - DNA, 14 bp, Homo sapiens
agcagggaaggcct

SEQ ID NO: 1169384 - DNA, 19 bp, Homo sapiens
agcagggaattcctggggt

SEQ ID NO: 1169385 - DNA, 19 bp, Homo sapiens
agcagggcaggaaggggaa

SEQ ID NO: 1169386 - DNA, 14 bp, Homo sapiens
agcagggctgggcc

SEQ ID NO: 1169387 - DNA, 15 bp, Homo sapiens
agcagggctgggcct

SEQ ID NO: 1169388 - DNA, 20 bp, Homo sapiens
agcagggctgggcctgcgag

SEQ ID NO: 1169389 - DNA, 21 bp, Homo sapiens
agcaggggaattccctccccc

SEQ ID NO: 1169390 - DNA, 22 bp, Homo sapiens
agcaggggaattccctccccct

SEQ ID NO: 1169391 - DNA, 23 bp, Homo sapiens
agcaggggaattccctccccctc

SEQ ID NO: 1169392 - DNA, 13 bp, Homo sapiens
agcaggggagaag

SEQ ID NO: 1169393 - DNA, 22 bp, Homo sapiens
agcaggggagcttgggactcag

SEQ ID NO: 1169394 - DNA, 13 bp, Homo sapiens
agcaggggcaggc

SEQ ID NO: 1169395 - DNA, 15 bp, Homo sapiens
agcaggggcaggcgc

SEQ ID NO: 1169396 - DNA, 16 bp, Homo sapiens
agcaggggcaggcgca

SEQ ID NO: 1169397 - DNA, 17 bp, Homo sapiens
agcaggggccagatgat

SEQ ID NO: 1169398 - DNA, 13 bp, Homo sapiens
agcaggggctcca

SEQ ID NO: 1169399 - DNA, 14 bp, Homo sapiens
agcaggggctccag

SEQ ID NO: 1169400 - DNA, 16 bp, Homo sapiens
agcaggggctccagca

SEQ ID NO: 1169401 - DNA, 18 bp, Homo sapiens
agcaggggggctgtgcca

SEQ ID NO: 1169402 - DNA, 19 bp, Homo sapiens
agcaggggggctgtgccaa

SEQ ID NO: 1169403 - DNA, 20 bp, Homo sapiens
agcaggggggctgtgccaac

SEQ ID NO: 1169404 - DNA, 23 bp, Homo sapiens
agcaggggggctgtgccaacctg

SEQ ID NO: 1169405 - DNA, 22 bp, Homo sapiens
agcaggggtccttggtgtgacc

SEQ ID NO: 1169406 - DNA, 21 bp, Homo sapiens
agcagggtagtctggtttcta

SEQ ID NO: 1169407 - DNA, 19 bp, Homo sapiens
agcagggtcttttcatctg

SEQ ID NO: 1169408 - DNA, 23 bp, Homo sapiens
agcagggtcttttcatctgggaa

SEQ ID NO: 1169409 - DNA, 23 bp, Homo sapiens
agcagggtggggtctgggagggg

SEQ ID NO: 1169410 - DNA, 22 bp, Homo sapiens
agcaggtagaagaaaagttggg

SEQ ID NO: 1169411 - DNA, 16 bp, Homo sapiens
agcaggtgctgggctg

SEQ ID NO: 1169412 - DNA, 17 bp, Homo sapiens
agcaggtggtcctgaga

SEQ ID NO: 1169413 - DNA, 18 bp, Homo sapiens
agcaggtggtcctgagac

SEQ ID NO: 1169414 - DNA, 14 bp, Homo sapiens
agcaggttcttgat

SEQ ID NO: 1169415 - DNA, 22 bp, Homo sapiens
agcaggttgaggggctcctgga

SEQ ID NO: 1169416 - DNA, 13 bp, Homo sapiens
agcaggtttgttt

SEQ ID NO: 1169417 - DNA, 20 bp, Homo sapiens
agcaggtttgttttcagcac

SEQ ID NO: 1169418 - DNA, 21 bp, Homo sapiens
agcaggtttgttttcagcact

SEQ ID NO: 1169419 - DNA, 15 bp, Homo sapiens
agcagtaaaaactgt

SEQ ID NO: 1169420 - DNA, 22 bp, Homo sapiens
agcagtagaaataatatgcatt

SEQ ID NO: 1169421 - DNA, 16 bp, Homo sapiens
agcagtagtgagccac

SEQ ID NO: 1169422 - DNA, 15 bp, Homo sapiens
agcagtatatgttaa

SEQ ID NO: 1169423 - DNA, 20 bp, Homo sapiens
agcagtatatgttaatttgt

SEQ ID NO: 1169424 - DNA, 16 bp, Homo sapiens
agcagtatattagtat

SEQ ID NO: 1169425 - DNA, 18 bp, Homo sapiens
agcagtcagggtgggaag

SEQ ID NO: 1169426 - DNA, 21 bp, Homo sapiens
agcagtcccagtattctcaga

SEQ ID NO: 1169427 - DNA, 20 bp, Homo sapiens
agcagtcccattcatattaa

SEQ ID NO: 1169428 - DNA, 17 bp, Homo sapiens
agcagtcctgttcaaat

SEQ ID NO: 1169429 - DNA, 19 bp, Homo sapiens
agcagtcgtgcctgtgtcc

SEQ ID NO: 1169430 - DNA, 18 bp, Homo sapiens
agattttcctccattttt

SEQ ID NO: 1169431 - DNA, 23 bp, Homo sapiens
agattttcctccatttttatttc

SEQ ID NO: 1169432 - DNA, 17 bp, Homo sapiens
agattttcctcttgtga

SEQ ID NO: 1169433 - DNA, 20 bp, Homo sapiens
agattttcctcttgtgattt

SEQ ID NO: 1169434 - DNA, 14 bp, Homo sapiens
agattttctctgga

SEQ ID NO: 1169435 - DNA, 15 bp, Homo sapiens
agattttctctggaa

SEQ ID NO: 1169436 - DNA, 17 bp, Homo sapiens
agattttctctggaaat

SEQ ID NO: 1169437 - DNA, 22 bp, Homo sapiens
agattttcttaaggaattttgt

SEQ ID NO: 1169438 - DNA, 14 bp, Homo sapiens
agattttgaatgct

SEQ ID NO: 1169439 - DNA, 23 bp, Homo sapiens
agattttgttttgttggacattt

SEQ ID NO: 1169440 - DNA, 17 bp, Homo sapiens
agatttttaacaaaaaa

SEQ ID NO: 1169441 - DNA, 13 bp, Homo sapiens
agatttttaagaa

SEQ ID NO: 1169442 - DNA, 14 bp, Homo sapiens
agatttttaagaac

SEQ ID NO: 1169443 - DNA, 15 bp, Homo sapiens
agatttttaagaact

SEQ ID NO: 1169444 - DNA, 16 bp, Homo sapiens
agatttttaagaactt

SEQ ID NO: 1169445 - DNA, 17 bp, Homo sapiens
agatttttaagaacttc

SEQ ID NO: 1169446 - DNA, 18 bp, Homo sapiens
agatttttaagaacttca

SEQ ID NO: 1169447 - DNA, 15 bp, Homo sapiens
agatttttatgtttt

SEQ ID NO: 1169448 - DNA, 19 bp, Homo sapiens
agatttttattttgaaaaa

SEQ ID NO: 1169449 - DNA, 20 bp, Homo sapiens
agatttttcatacttttctt

SEQ ID NO: 1169450 - DNA, 22 bp, Homo sapiens
agatttttctgaagggcataca

SEQ ID NO: 1169451 - DNA, 16 bp, Homo sapiens
agatttttgattcagc

SEQ ID NO: 1169452 - DNA, 16 bp, Homo sapiens
agattttttaaaattt

SEQ ID NO: 1169453 - DNA, 19 bp, Homo sapiens
agattttttaaaattttgg

SEQ ID NO: 1169454 - DNA, 13 bp, Homo sapiens
agattttttaata

SEQ ID NO: 1169455 - DNA, 16 bp, Homo sapiens
agattttttaataatt

SEQ ID NO: 1169456 - DNA, 17 bp, Homo sapiens
agattttttaattgttt

SEQ ID NO: 1169457 - DNA, 21 bp, Homo sapiens
agattttttcagacttgtcaa

SEQ ID NO: 1169458 - DNA, 22 bp, Homo sapiens
agattttttcagacttgtcaag

SEQ ID NO: 1169459 - DNA, 16 bp, Homo sapiens
agatttttttgtgtat

SEQ ID NO: 1169460 - DNA, 18 bp, Homo sapiens
agatttttttgtgtatgt

SEQ ID NO: 1169461 - DNA, 17 bp, Homo sapiens
agatttttttttctctt

SEQ ID NO: 1169462 - DNA, 12 bp, Homo sapiens
agcaaaaaagaa

SEQ ID NO: 1169463 - DNA, 22 bp, Homo sapiens
agcaaaaaagtccaattttaat

SEQ ID NO: 1169464 - DNA, 16 bp, Homo sapiens
agcaaaaaataatgac

SEQ ID NO: 1169465 - DNA, 20 bp, Homo sapiens
agcaaaaactgtgggaagat

SEQ ID NO: 1169466 - DNA, 11 bp, Homo sapiens
agcaaaaagat

SEQ ID NO: 1169467 - DNA, 15 bp, Homo sapiens
agcaaaaagcaaaat

SEQ ID NO: 1169468 - DNA, 13 bp, Homo sapiens
agcaaaaatctcc

SEQ ID NO: 1169469 - DNA, 21 bp, Homo sapiens
agcaaaaatctcccagtgaca

SEQ ID NO: 1169470 - DNA, 14 bp, Homo sapiens
agcaaaaatgacaa

SEQ ID NO: 1169471 - DNA, 18 bp, Homo sapiens
agcaaaacatcacattcc

SEQ ID NO: 1169472 - DNA, 17 bp, Homo sapiens
agcaaaacatctctgca

SEQ ID NO: 1169473 - DNA, 16 bp, Homo sapiens
agcaaaaccattgctt

SEQ ID NO: 1169474 - DNA, 17 bp, Homo sapiens
agcaaaactccatctca

SEQ ID NO: 1169475 - DNA, 13 bp, Homo sapiens
agcaaaagaaact

SEQ ID NO: 1169476 - DNA, 15 bp, Homo sapiens
agcaaaaggcagctc

SEQ ID NO: 1169477 - DNA, 21 bp, Homo sapiens
agcaaaatggaagcaaagaca

SEQ ID NO: 1169478 - DNA, 16 bp, Homo sapiens
agcaaacaatggtgtc

SEQ ID NO: 1169479 - DNA, 13 bp, Homo sapiens
agcaaacatcaaa

SEQ ID NO: 1169480 - DNA, 19 bp, Homo sapiens
agcaaacatttctaactct

SEQ ID NO: 1169481 - DNA, 20 bp, Homo sapiens
agcaaaccaatggtgatcct

SEQ ID NO: 1169482 - DNA, 13 bp, Homo sapiens
agcaaacccagag

SEQ ID NO: 1169483 - DNA, 19 bp, Homo sapiens
agcaaacgtctattttgta

SEQ ID NO: 1169484 - DNA, 13 bp, Homo sapiens
agcaaactctttt

SEQ ID NO: 1169485 - DNA, 13 bp, Homo sapiens
agcaaagaagctt

SEQ ID NO: 1169486 - DNA, 13 bp, Homo sapiens
agcaaagacaaaa

SEQ ID NO: 1169487 - DNA, 15 bp, Homo sapiens
agcaaagacaaaaga

SEQ ID NO: 1169488 - DNA, 22 bp, Homo sapiens
agcaaagaggggcgctgtcctg

SEQ ID NO: 1169489 - DNA, 17 bp, Homo sapiens
agcaaagatcaaaataa

SEQ ID NO: 1169490 - DNA, 21 bp, Homo sapiens
agcaaagattaaatgtgtcat

SEQ ID NO: 1169491 - DNA, 16 bp, Homo sapiens
agcaaagatttcagta

SEQ ID NO: 1169492 - DNA, 20 bp, Homo sapiens
agcaaagcgcccacccaggt

SEQ ID NO: 1169493 - DNA, 15 bp, Homo sapiens
agcaaagctacagga

SEQ ID NO: 1169494 - DNA, 21 bp, Homo sapiens
agcaaaggagacaaagcagga

SEQ ID NO: 1169495 - DNA, 23 bp, Homo sapiens
agcaaaggagacaaagcaggagt

SEQ ID NO: 1169496 - DNA, 19 bp, Homo sapiens
agcaaaggcagtcccggga

SEQ ID NO: 1169497 - DNA, 20 bp, Homo sapiens
agcaaagggaatgggtctgc

SEQ ID NO: 1169498 - DNA, 15 bp, Homo sapiens
agcaaataaatacgt

SEQ ID NO: 1169499 - DNA, 20 bp, Homo sapiens
agcaaatcatctgcattcct

SEQ ID NO: 1169500 - DNA, 22 bp, Homo sapiens
agcaaatcatctgcattcctga

SEQ ID NO: 1169501 - DNA, 14 bp, Homo sapiens
agcaaatcccattt

SEQ ID NO: 1169502 - DNA, 20 bp, Homo sapiens
agcaaatcgaatgaaattaa

SEQ ID NO: 1169503 - DNA, 15 bp, Homo sapiens
agcaaatctgccacc

SEQ ID NO: 1169504 - DNA, 15 bp, Homo sapiens
agcaaatgaaggatg

SEQ ID NO: 1169505 - DNA, 19 bp, Homo sapiens
agcaaatgaaggatgaagt

SEQ ID NO: 1169506 - DNA, 16 bp, Homo sapiens
agcaaatgtggctcct

SEQ ID NO: 1169507 - DNA, 17 bp, Homo sapiens
agcaaatgttatgcata

SEQ ID NO: 1169508 - DNA, 13 bp, Homo sapiens
agcaaatgtttct

SEQ ID NO: 1169509 - DNA, 19 bp, Homo sapiens
agcaaattctgtttttcta

SEQ ID NO: 1169510 - DNA, 20 bp, Homo sapiens
agcaaatttctctctttctt

SEQ ID NO: 1169511 - DNA, 13 bp, Homo sapiens
agcaacaaagagc

SEQ ID NO: 1169512 - DNA, 23 bp, Homo sapiens
agcaacaacaattggtaaaactc

SEQ ID NO: 1169513 - DNA, 18 bp, Homo sapiens
agcaacaagactgccagg

SEQ ID NO: 1169514 - DNA, 13 bp, Homo sapiens
agcaacaataaat

SEQ ID NO: 1169515 - DNA, 15 bp, Homo sapiens
agcaacaatttatga

SEQ ID NO: 1169516 - DNA, 21 bp, Homo sapiens
agcaacaatttatgaattgaa

SEQ ID NO: 1169517 - DNA, 22 bp, Homo sapiens
agcaacagagtgagaccctgtc

SEQ ID NO: 1169518 - DNA, 18 bp, Homo sapiens
agcaacatatctctgccg

SEQ ID NO: 1169519 - DNA, 21 bp, Homo sapiens
agcaacatctagcaaatgtta

SEQ ID NO: 1169520 - DNA, 15 bp, Homo sapiens
agcaaccccaggctg

SEQ ID NO: 1169521 - DNA, 17 bp, Homo sapiens
agcaacccgctggagcc

SEQ ID NO: 1169522 - DNA, 21 bp, Homo sapiens
agcaacccgctggagcccaca

SEQ ID NO: 1169523 - DNA, 19 bp, Homo sapiens
agcaacctgtaactcacat

SEQ ID NO: 1169524 - DNA, 23 bp, Homo sapiens
agcaacctttcacctttgtgtat

SEQ ID NO: 1169525 - DNA, 14 bp, Homo sapiens
agcaacgcccctcc

SEQ ID NO: 1169526 - DNA, 23 bp, Homo sapiens
agcaacggcccatagccttgggg

SEQ ID NO: 1169527 - DNA, 16 bp, Homo sapiens
agcaactaatgtttga

SEQ ID NO: 1169528 - DNA, 21 bp, Homo sapiens
agcaactacagtctaaagctg

SEQ ID NO: 1169529 - DNA, 15 bp, Homo sapiens
agcaactccgtgtgc

SEQ ID NO: 1169530 - DNA, 22 bp, Homo sapiens
agcttatgggatccttgtcttt

SEQ ID NO: 1169531 - DNA, 16 bp, Homo sapiens
agcttattacagaaaa

SEQ ID NO: 1169532 - DNA, 19 bp, Homo sapiens
agcttattatagaattgca

SEQ ID NO: 1169533 - DNA, 15 bp, Homo sapiens
agcttattgatccca

SEQ ID NO: 1169534 - DNA, 19 bp, Homo sapiens
agcttattgatcccacatt

SEQ ID NO: 1169535 - DNA, 18 bp, Homo sapiens
agcttcaacttttctctt

SEQ ID NO: 1169536 - DNA, 13 bp, Homo sapiens
agcttcaatataa

SEQ ID NO: 1169537 - DNA, 18 bp, Homo sapiens
agcttcaccccaatccca

SEQ ID NO: 1169538 - DNA, 20 bp, Homo sapiens
agcttcaccccaatcccagc

SEQ ID NO: 1169539 - DNA, 21 bp, Homo sapiens
agcttcaccccaatcccagct

SEQ ID NO: 1169540 - DNA, 18 bp, Homo sapiens
agcttcagctagctttta

SEQ ID NO: 1169541 - DNA, 17 bp, Homo sapiens
agcttcagctatactta

SEQ ID NO: 1169542 - DNA, 17 bp, Homo sapiens
agcttcatataccagca

SEQ ID NO: 1169543 - DNA, 20 bp, Homo sapiens
agcttcatgcacttaaagaa

SEQ ID NO: 1169544 - DNA, 19 bp, Homo sapiens
agcttcatggcagaaggca

SEQ ID NO: 1169545 - DNA, 16 bp, Homo sapiens
agcttcatgtggcttc

SEQ ID NO: 1169546 - DNA, 17 bp, Homo sapiens
agcttcatttgtgtcaa

SEQ ID NO: 1169547 - DNA, 15 bp, Homo sapiens
agcttccaaaatata

SEQ ID NO: 1169548 - DNA, 13 bp, Homo sapiens
agcttccaaagcc

SEQ ID NO: 1169549 - DNA, 20 bp, Homo sapiens
agcttcctcacacccctgtc

SEQ ID NO: 1169550 - DNA, 22 bp, Homo sapiens
agcttcctcacacccctgtccc

SEQ ID NO: 1169551 - DNA, 23 bp, Homo sapiens
agcttcctcacacccctgtccca

SEQ ID NO: 1169552 - DNA, 14 bp, Homo sapiens
agcttcctccagag

SEQ ID NO: 1169553 - DNA, 20 bp, Homo sapiens
agcttcctgctgctggggcc

SEQ ID NO: 1169554 - DNA, 17 bp, Homo sapiens
agcttcctggctctggg

SEQ ID NO: 1169555 - DNA, 15 bp, Homo sapiens
agcttcctgtctgtt

SEQ ID NO: 1169556 - DNA, 18 bp, Homo sapiens
agcttcctgtctgtttat

SEQ ID NO: 1169557 - DNA, 11 bp, Homo sapiens
agcttcctgtg

SEQ ID NO: 1169558 - DNA, 15 bp, Homo sapiens
agcttcctgtgccct

SEQ ID NO: 1169559 - DNA, 16 bp, Homo sapiens
agcttcctgtgccctc

SEQ ID NO: 1169560 - DNA, 15 bp, Homo sapiens
agcttcgaggacagg

SEQ ID NO: 1169561 - DNA, 19 bp, Homo sapiens
agcttcgaggacaggaaag

SEQ ID NO: 1169562 - DNA, 15 bp, Homo sapiens
agcttcgtcttgtgt

SEQ ID NO: 1169563 - DNA, 18 bp, Homo sapiens
agcttctatcccaggagg

SEQ ID NO: 1169564 - DNA, 12 bp, Homo sapiens
agcttctccaag

SEQ ID NO: 1169565 - DNA, 16 bp, Homo sapiens
agcttctccaagcatc

SEQ ID NO: 1169566 - DNA, 12 bp, Homo sapiens
agcttctccagg

SEQ ID NO: 1169567 - DNA, 15 bp, Homo sapiens
agcttctccaggctc

SEQ ID NO: 1169568 - DNA, 23 bp, Homo sapiens
agcttctccaggctctttggggt

SEQ ID NO: 1169569 - DNA, 12 bp, Homo sapiens
agcttctcctgt

SEQ ID NO: 1169570 - DNA, 14 bp, Homo sapiens
agcttctctctcca

SEQ ID NO: 1169571 - DNA, 13 bp, Homo sapiens
agcttctctgtga

SEQ ID NO: 1169572 - DNA, 14 bp, Homo sapiens
agcttctctgtgaa

SEQ ID NO: 1169573 - DNA, 20 bp, Homo sapiens
agcttctcttctttctgaag

SEQ ID NO: 1169574 - DNA, 13 bp, Homo sapiens
agcttctgagaca

SEQ ID NO: 1169575 - DNA, 17 bp, Homo sapiens
agcttctgccacataaa

SEQ ID NO: 1169576 - DNA, 19 bp, Homo sapiens
agcttctgcttttctgccc

SEQ ID NO: 1169577 - DNA, 21 bp, Homo sapiens
agcttctggaatttgttcaag

SEQ ID NO: 1169578 - DNA, 20 bp, Homo sapiens
agcttctggtactctcctag

SEQ ID NO: 1169579 - DNA, 21 bp, Homo sapiens
agcttctggtactctcctaga

SEQ ID NO: 1169580 - DNA, 19 bp, Homo sapiens
agcttcttcatctttaaaa

SEQ ID NO: 1169581 - DNA, 14 bp, Homo sapiens
agcttcttcctagg

SEQ ID NO: 1169582 - DNA, 12 bp, Homo sapiens
agcttcttctgc

SEQ ID NO: 1169583 - DNA, 13 bp, Homo sapiens
agcttcttctgcc

SEQ ID NO: 1169584 - DNA, 14 bp, Homo sapiens
agcttcttgggctg

SEQ ID NO: 1169585 - DNA, 17 bp, Homo sapiens
agcttcttgggctgagt

SEQ ID NO: 1169586 - DNA, 20 bp, Homo sapiens
agcttcttgggctgagtgca

SEQ ID NO: 1169587 - DNA, 13 bp, Homo sapiens
agcttcttgtttc

SEQ ID NO: 1169588 - DNA, 14 bp, Homo sapiens
agcttcttgtttcc

SEQ ID NO: 1169589 - DNA, 16 bp, Homo sapiens
agcttgaacctgcttc

SEQ ID NO: 1169590 - DNA, 20 bp, Homo sapiens
agcttgacctgaggctgtgg

SEQ ID NO: 1169591 - DNA, 20 bp, Homo sapiens
agcttgactaatggaatgat

SEQ ID NO: 1169592 - DNA, 15 bp, Homo sapiens
agcttgactcccaag

SEQ ID NO: 1169593 - DNA, 19 bp, Homo sapiens
agcttgaggcaattttaat

SEQ ID NO: 1169594 - DNA, 22 bp, Homo sapiens
agcttgagtctcaagggtggca

SEQ ID NO: 1169595 - DNA, 15 bp, Homo sapiens
agcttgatctgtgat

SEQ ID NO: 1169596 - DNA, 23 bp, Homo sapiens
agcttgatctgtgatttcttctc

SEQ ID NO: 1169597 - DNA, 17 bp, Homo sapiens
agcttgatttgatcttt

SEQ ID NO: 1169598 - DNA, 12 bp, Homo sapiens
agcttgcacagc

SEQ ID NO: 1169599 - DNA, 15 bp, Homo sapiens
agcttgcctaatggc

SEQ ID NO: 1169600 - DNA, 14 bp, Homo sapiens
agcttgctccagat

SEQ ID NO: 1169601 - DNA, 15 bp, Homo sapiens
agcttgctccctgtg

SEQ ID NO: 1169602 - DNA, 16 bp, Homo sapiens
agcttgctccctgtgt

SEQ ID NO: 1169603 - DNA, 14 bp, Homo sapiens
agcttgctgagggg

SEQ ID NO: 1169604 - DNA, 21 bp, Homo sapiens
agcttgctgaggggcagggag

SEQ ID NO: 1169605 - DNA, 20 bp, Homo sapiens
agcttgctgtcacttcttca

SEQ ID NO: 1169606 - DNA, 12 bp, Homo sapiens
agcttggcagcc

SEQ ID NO: 1169607 - DNA, 17 bp, Homo sapiens
agcttggcagccgagct

SEQ ID NO: 1169608 - DNA, 13 bp, Homo sapiens
agcttggccttgg

SEQ ID NO: 1169609 - DNA, 16 bp, Homo sapiens
agcttggctgtaggac

SEQ ID NO: 1169610 - DNA, 17 bp, Homo sapiens
agcttgggactcaggtc

SEQ ID NO: 1169611 - DNA, 18 bp, Homo sapiens
agcttgggataaagcaag

SEQ ID NO: 1169612 - DNA, 20 bp, Homo sapiens
agcttgggcagtgccccagg

SEQ ID NO: 1169613 - DNA, 23 bp, Homo sapiens
agcttgggcagtgccccagggag

SEQ ID NO: 1169614 - DNA, 12 bp, Homo sapiens
agcttgggccca

SEQ ID NO: 1169615 - DNA, 17 bp, Homo sapiens
agcttgggcccagctgg

SEQ ID NO: 1169616 - DNA, 21 bp, Homo sapiens
agcttgggcccagctgggctc

SEQ ID NO: 1169617 - DNA, 16 bp, Homo sapiens
agcttgggcttcttcc

SEQ ID NO: 1169618 - DNA, 20 bp, Homo sapiens
agcttggggaacccatgagt

SEQ ID NO: 1169619 - DNA, 14 bp, Homo sapiens
agcttggggagagg

SEQ ID NO: 1169620 - DNA, 21 bp, Homo sapiens
agcttgggggatgactagagg

SEQ ID NO: 1169621 - DNA, 23 bp, Homo sapiens
agcttgggtcaggttcttgcctt

SEQ ID NO: 1169622 - DNA, 16 bp, Homo sapiens
agcttgggtccaccat

SEQ ID NO: 1169623 - DNA, 22 bp, Homo sapiens
agcttgggtccaccatgcagaa

SEQ ID NO: 1169624 - DNA, 17 bp, Homo sapiens
agcttggtattgcagag

SEQ ID NO: 1169625 - DNA, 16 bp, Homo sapiens
agcttggtcaaacttt

SEQ ID NO: 1169626 - DNA, 16 bp, Homo sapiens
agcttgtatcaaatgt

SEQ ID NO: 1169627 - DNA, 17 bp, Homo sapiens
agcttgtatcaaatgtt

SEQ ID NO: 1169628 - DNA, 20 bp, Homo sapiens
agcttgtgattcctacccct

SEQ ID NO: 1169629 - DNA, 19 bp, Homo sapiens
agcttgtgctcctcttgat

SEQ ID NO: 1169630 - DNA, 23 bp, Homo sapiens
agcttgtgctcctcttgattcct

SEQ ID NO: 1169631 - DNA, 22 bp, Homo sapiens
agcttgttgtcccaatgaaata

SEQ ID NO: 1169632 - DNA, 18 bp, Homo sapiens
agctttaaaaccacagct

SEQ ID NO: 1169633 - DNA, 15 bp, Homo sapiens
agctttaaaagaaaa

SEQ ID NO: 1169634 - DNA, 17 bp, Homo sapiens
agctttaaaagtatctt

SEQ ID NO: 1169635 - DNA, 15 bp, Homo sapiens
agctttaaacaaatt

SEQ ID NO: 1169636 - DNA, 16 bp, Homo sapiens
agctttaaatcattag

SEQ ID NO: 1169637 - DNA, 18 bp, Homo sapiens
agctttacatattccttt

SEQ ID NO: 1169638 - DNA, 19 bp, Homo sapiens
agctttacatgcaatttat

SEQ ID NO: 1169639 - DNA, 21 bp, Homo sapiens
agctttacatgcaatttatta

SEQ ID NO: 1169640 - DNA, 14 bp, Homo sapiens
agctttaccagctg

SEQ ID NO: 1169641 - DNA, 17 bp, Homo sapiens
agctttaccctcaggca

SEQ ID NO: 1169642 - DNA, 18 bp, Homo sapiens
agctttaccctcaggcat

SEQ ID NO: 1169643 - DNA, 19 bp, Homo sapiens
agctttagaccctgggtgg

SEQ ID NO: 1169644 - DNA, 13 bp, Homo sapiens
agctttatttcta

SEQ ID NO: 1169645 - DNA, 14 bp, Homo sapiens
agctttatttctag

SEQ ID NO: 1169646 - DNA, 14 bp, Homo sapiens
agctttatttgcat

SEQ ID NO: 1169647 - DNA, 22 bp, Homo sapiens
agctttattttttaagtattta

SEQ ID NO: 1169648 - DNA, 12 bp, Homo sapiens
agctttcagagc

SEQ ID NO: 1169649 - DNA, 13 bp, Homo sapiens
agctttcagagcc

SEQ ID NO: 1169650 - DNA, 15 bp, Homo sapiens
agctttcagagccag

SEQ ID NO: 1169651 - DNA, 19 bp, Homo sapiens
agctttcagagccagtgaa

SEQ ID NO: 1169652 - DNA, 22 bp, Homo sapiens
agctttcatgtaaactgtgcac

SEQ ID NO: 1169653 - DNA, 16 bp, Homo sapiens
agctttccatgttgct

SEQ ID NO: 1169654 - DNA, 19 bp, Homo sapiens
agctttccatgttgctgcc

SEQ ID NO: 1169655 - DNA, 21 bp, Homo sapiens
agctttcccaaataaactcta

SEQ ID NO: 1169656 - DNA, 13 bp, Homo sapiens
agctttcctgaca

SEQ ID NO: 1169657 - DNA, 14 bp, Homo sapiens
agctttcctgcccc

SEQ ID NO: 1169658 - DNA, 16 bp, Homo sapiens
agctttccttctccag

SEQ ID NO: 1169659 - DNA, 12 bp, Homo sapiens
agctttctcaat

SEQ ID NO: 1169660 - DNA, 18 bp, Homo sapiens
agctttctcaatgtcttc

SEQ ID NO: 1169661 - DNA, 20 bp, Homo sapiens
agctttctcaatgtcttccc

SEQ ID NO: 1169662 - DNA, 23 bp, Homo sapiens
agctttctcctcatccatttctt

SEQ ID NO: 1169663 - DNA, 19 bp, Homo sapiens
agctttctcctctgctatg

SEQ ID NO: 1169664 - DNA, 17 bp, Homo sapiens
agctttctctcagaaat

SEQ ID NO: 1169665 - DNA, 21 bp, Homo sapiens
agctttctctccgacttcccc

SEQ ID NO: 1169666 - DNA, 21 bp, Homo sapiens
agctttctgaggccctgagca

SEQ ID NO: 1169667 - DNA, 13 bp, Homo sapiens
agctttctgccac

SEQ ID NO: 1169668 - DNA, 20 bp, Homo sapiens
agctttctgggatgtcacag

SEQ ID NO: 1169669 - DNA, 20 bp, Homo sapiens
agctttctgtccttttggca

SEQ ID NO: 1169670 - DNA, 20 bp, Homo sapiens
agctttctttcacaaaaaag

SEQ ID NO: 1169671 - DNA, 12 bp, Homo sapiens
agctttgaaaat

SEQ ID NO: 1169672 - DNA, 16 bp, Homo sapiens
agctttgaaaattcag

SEQ ID NO: 1169673 - DNA, 12 bp, Homo sapiens
agctttgaagta

SEQ ID NO: 1169674 - DNA, 17 bp, Homo sapiens
agctttgagaagccttc

SEQ ID NO: 1169675 - DNA, 18 bp, Homo sapiens
agctttgaggctctgtca

SEQ ID NO: 1169676 - DNA, 21 bp, Homo sapiens
agctttgaggctctgtcactg

SEQ ID NO: 1169677 - DNA, 14 bp, Homo sapiens
agctttgcacccct

SEQ ID NO: 1169678 - DNA, 16 bp, Homo sapiens
agctttgccagctgct

SEQ ID NO: 1169679 - DNA, 18 bp, Homo sapiens
agctttgctacaaattta

SEQ ID NO: 1169680 - DNA, 22 bp, Homo sapiens
agctttgctacaaatttatgca

SEQ ID NO: 1169681 - DNA, 12 bp, Homo sapiens
agctttgctgct

SEQ ID NO: 1169682 - DNA, 14 bp, Homo sapiens
agctttggaatatt

SEQ ID NO: 1169683 - DNA, 15 bp, Homo sapiens
agctttggaatattt

SEQ ID NO: 1169684 - DNA, 22 bp, Homo sapiens
agctttggaatattttatcctg

SEQ ID NO: 1169685 - DNA, 22 bp, Homo sapiens
agctttggctgagacctgggat

SEQ ID NO: 1169686 - DNA, 16 bp, Homo sapiens
agctttgggtgccttt

SEQ ID NO: 1169687 - DNA, 17 bp, Homo sapiens
agctttgtcacttgcca

SEQ ID NO: 1169688 - DNA, 18 bp, Homo sapiens
agctttgtgtttactttt

SEQ ID NO: 1169689 - DNA, 19 bp, Homo sapiens
agctttgtgtttacttttt

SEQ ID NO: 1169690 - DNA, 21 bp, Homo sapiens
agctttgtttgttgtcagctg

SEQ ID NO: 1169691 - DNA, 22 bp, Homo sapiens
agctttgtttgttgtcagctga

SEQ ID NO: 1169692 - DNA, 23 bp, Homo sapiens
agctttgtttgttgtcagctgaa

SEQ ID NO: 1169693 - DNA, 12 bp, Homo sapiens
agcttttaaaaa

SEQ ID NO: 1169694 - DNA, 17 bp, Homo sapiens
agcttttaaaaaatatt

SEQ ID NO: 1169695 - DNA, 18 bp, Homo sapiens
agcttttaaaaaatattt

SEQ ID NO: 1169696 - DNA, 19 bp, Homo sapiens
agcttttaagaaaaacaaa

SEQ ID NO: 1169697 - DNA, 15 bp, Homo sapiens
agcttttattgtata

SEQ ID NO: 1169698 - DNA, 17 bp, Homo sapiens
agcttttattgtataaa

SEQ ID NO: 1169699 - DNA, 18 bp, Homo sapiens
agcttttcccaggagacc

SEQ ID NO: 1169700 - DNA, 13 bp, Homo sapiens
agcttttcccttc

SEQ ID NO: 1169701 - DNA, 20 bp, Homo sapiens
agcttttcctcagggtgtcc

SEQ ID NO: 1169702 - DNA, 14 bp, Homo sapiens
agcttttcctccct

SEQ ID NO: 1169703 - DNA, 15 bp, Homo sapiens
agcttttctgatggt

SEQ ID NO: 1169704 - DNA, 20 bp, Homo sapiens
agcttttgatgccaggtgca

SEQ ID NO: 1169705 - DNA, 17 bp, Homo sapiens
agcttttgccagtatta

SEQ ID NO: 1169706 - DNA, 16 bp, Homo sapiens
agcttttggggaggga

SEQ ID NO: 1169707 - DNA, 13 bp, Homo sapiens
agcttttgtctac

SEQ ID NO: 1169708 - DNA, 16 bp, Homo sapiens
agcttttgttctagac

SEQ ID NO: 1169709 - DNA, 15 bp, Homo sapiens
agctttttaatagca

SEQ ID NO: 1169710 - DNA, 17 bp, Homo sapiens
agctttttaatagcact

SEQ ID NO: 1169711 - DNA, 17 bp, Homo sapiens
agctttttaattaagca

SEQ ID NO: 1169712 - DNA, 13 bp, Homo sapiens
agctttttattaa

SEQ ID NO: 1169713 - DNA, 22 bp, Homo sapiens
agctttttattcctcctgctca

SEQ ID NO: 1169714 - DNA, 13 bp, Homo sapiens
agctttttctgtg

SEQ ID NO: 1169715 - DNA, 14 bp, Homo sapiens
agctttttggtttg

SEQ ID NO: 1169716 - DNA, 16 bp, Homo sapiens
agcttttttattttaa

SEQ ID NO: 1169717 - DNA, 17 bp, Homo sapiens
agcttttttattttaat

SEQ ID NO: 1169718 - DNA, 19 bp, Homo sapiens
aggaaaaaaaaacagccac

SEQ ID NO: 1169719 - DNA, 18 bp, Homo sapiens
aggaaaaaaaacacaaaa

SEQ ID NO: 1169720 - DNA, 17 bp, Homo sapiens
aggaaaaaaacttttat

SEQ ID NO: 1169721 - DNA, 21 bp, Homo sapiens
aggaaaaaaacttttataaat

SEQ ID NO: 1169722 - DNA, 15 bp, Homo sapiens
aggaaaaaaatgact

SEQ ID NO: 1169723 - DNA, 13 bp, Homo sapiens
aggaaaaaagaac

SEQ ID NO: 1169724 - DNA, 19 bp, Homo sapiens
aggaaaaaagaaccaaaac

SEQ ID NO: 1169725 - DNA, 17 bp, Homo sapiens
aggaaaaaataaaaaga

SEQ ID NO: 1169726 - DNA, 18 bp, Homo sapiens
aggaaaaaataaaaagag

SEQ ID NO: 1169727 - DNA, 21 bp, Homo sapiens
aggaaaaaattgaaagaactt

SEQ ID NO: 1169728 - DNA, 13 bp, Homo sapiens
aggaaaaataatc

SEQ ID NO: 1169729 - DNA, 13 bp, Homo sapiens
aggaaaaatgagg

SEQ ID NO: 1169730 - DNA, 19 bp, Homo sapiens
aggaaaaatgtgtaatttt

SEQ ID NO: 1169731 - DNA, 22 bp, Homo sapiens
aggaaaacaattcaagctgaga

SEQ ID NO: 1169732 - DNA, 17 bp, Homo sapiens
aggaaaacacagcctcc

SEQ ID NO: 1169733 - DNA, 21 bp, Homo sapiens
aggaaaacacagcctccctga

SEQ ID NO: 1169734 - DNA, 21 bp, Homo sapiens
aggaaaaccaagccgtggctt

SEQ ID NO: 1169735 - DNA, 12 bp, Homo sapiens
aggaaaagcaag

SEQ ID NO: 1169736 - DNA, 21 bp, Homo sapiens
aggaaaaggcccctgcaatgt

SEQ ID NO: 1169737 - DNA, 17 bp, Homo sapiens
aggaaaaggttgaataa

SEQ ID NO: 1169738 - DNA, 22 bp, Homo sapiens
aggaaaaggttgaataatatat

SEQ ID NO: 1169739 - DNA, 16 bp, Homo sapiens
aggaaaagtacattta

SEQ ID NO: 1169740 - DNA, 22 bp, Homo sapiens
aggaaaataatgtaattgtaat

SEQ ID NO: 1169741 - DNA, 13 bp, Homo sapiens
aggacacagcagt

SEQ ID NO: 1169742 - DNA, 15 bp, Homo sapiens
aggacacagcagtat

SEQ ID NO: 1169743 - DNA, 12 bp, Homo sapiens
aggacacaggca

SEQ ID NO: 1169744 - DNA, 13 bp, Homo sapiens
aggacacatcccg

SEQ ID NO: 1169745 - DNA, 19 bp, Homo sapiens
aggacacatcccggcctct

SEQ ID NO: 1169746 - DNA, 23 bp, Homo sapiens
aggacacatcccggcctcttcca

SEQ ID NO: 1169747 - DNA, 11 bp, Homo sapiens
aggacactggt

SEQ ID NO: 1169748 - DNA, 14 bp, Homo sapiens
aggacacttcctgc

SEQ ID NO: 1169749 - DNA, 15 bp, Homo sapiens
aggacacttcctgcc

SEQ ID NO: 1169750 - DNA, 19 bp, Homo sapiens
aggacagaacattgccttc

SEQ ID NO: 1169751 - DNA, 17 bp, Homo sapiens
aggacagaatgtgttct

SEQ ID NO: 1169752 - DNA, 21 bp, Homo sapiens
aggacagagggagacagggct

SEQ ID NO: 1169753 - DNA, 12 bp, Homo sapiens
aggacagcagca

SEQ ID NO: 1169754 - DNA, 23 bp, Homo sapiens
aggacagcctgtggcggtgcctg

SEQ ID NO: 1169755 - DNA, 13 bp, Homo sapiens
aggacagctctgg

SEQ ID NO: 1169756 - DNA, 18 bp, Homo sapiens
aggacaggaaaggcccca

SEQ ID NO: 1169757 - DNA, 13 bp, Homo sapiens
aggacaggcaggc

SEQ ID NO: 1169758 - DNA, 17 bp, Homo sapiens
aggacaggcaggccaga

SEQ ID NO: 1169759 - DNA, 20 bp, Homo sapiens
aggacaggcgggaggaggtg

SEQ ID NO: 1169760 - DNA, 16 bp, Homo sapiens
aggacaggctctagag

SEQ ID NO: 1169761 - DNA, 17 bp, Homo sapiens
aggacaggctctagaga

SEQ ID NO: 1169762 - DNA, 13 bp, Homo sapiens
aggacagggctga

SEQ ID NO: 1169763 - DNA, 15 bp, Homo sapiens
aggacagggctgagc

SEQ ID NO: 1169764 - DNA, 15 bp, Homo sapiens
aggacagtgcttcag

SEQ ID NO: 1169765 - DNA, 16 bp, Homo sapiens
aggacagtgcttcagc

SEQ ID NO: 1169766 - DNA, 17 bp, Homo sapiens
aggacagtgcttcagcc

SEQ ID NO: 1169767 - DNA, 20 bp, Homo sapiens
aggacagtgcttcagcctga

SEQ ID NO: 1169768 - DNA, 15 bp, Homo sapiens
aggacataatggggt

SEQ ID NO: 1169769 - DNA, 24 bp, Homo sapiens
aggacataatggggtcctggccat

SEQ ID NO: 1169770 - DNA, 15 bp, Homo sapiens
aggacatcagcaaac

SEQ ID NO: 1169771 - DNA, 20 bp, Homo sapiens
aggacatccccccgccaaaa

SEQ ID NO: 1169772 - DNA, 11 bp, Homo sapiens
aggacatctta

SEQ ID NO: 1169773 - DNA, 20 bp, Homo sapiens
aggacatgcggtagccagca

SEQ ID NO: 1169774 - DNA, 22 bp, Homo sapiens
aggacatgcggtagccagcaca

SEQ ID NO: 1169775 - DNA, 17 bp, Homo sapiens
aggacatgcgtgtgtca

SEQ ID NO: 1169776 - DNA, 22 bp, Homo sapiens
aggacatgggacttgcgtggac

SEQ ID NO: 1169777 - DNA, 15 bp, Homo sapiens
aggacatgtttttgt

SEQ ID NO: 1169778 - DNA, 13 bp, Homo sapiens
aggacattcactg

SEQ ID NO: 1169779 - DNA, 19 bp, Homo sapiens
aggacattgtatgcaggga

SEQ ID NO: 1169780 - DNA, 20 bp, Homo sapiens
aggacattgtatgcagggag

SEQ ID NO: 1169781 - DNA, 22 bp, Homo sapiens
aggacattgtatgcagggagca

SEQ ID NO: 1169782 - DNA, 21 bp, Homo sapiens
aggaccaactggcttctgtgc

SEQ ID NO: 1169783 - DNA, 17 bp, Homo sapiens
aggaccaagcatcttgg

SEQ ID NO: 1169784 - DNA, 19 bp, Homo sapiens
aggaccaagcatcttgggg

SEQ ID NO: 1169785 - DNA, 13 bp, Homo sapiens
aggaccaaggggg

SEQ ID NO: 1169786 - DNA, 23 bp, Homo sapiens
aggaccaataaaatttctaagag

SEQ ID NO: 1169787 - DNA, 16 bp, Homo sapiens
aggaccacagtgggtg

SEQ ID NO: 1169788 - DNA, 15 bp, Homo sapiens
aggaccactcagccc

SEQ ID NO: 1169789 - DNA, 23 bp, Homo sapiens
aggaccagagcggtatctctggc

SEQ ID NO: 1169790 - DNA, 15 bp, Homo sapiens
aggaccagctggggc

SEQ ID NO: 1169791 - DNA, 12 bp, Homo sapiens
aggaccaggact

SEQ ID NO: 1169792 - DNA, 11 bp, Homo sapiens
aaaacaaaaag

SEQ ID NO: 1169793 - DNA, 20 bp, Homo sapiens
aaaacaaaaccaagccttgg

SEQ ID NO: 1169794 - DNA, 15 bp, Homo sapiens
aaaacaaaattttat

SEQ ID NO: 1169795 - DNA, 15 bp, Homo sapiens
aaaacaaactcattc

SEQ ID NO: 1169796 - DNA, 18 bp, Homo sapiens
aaaacaaattcaaataat

SEQ ID NO: 1169797 - DNA, 12 bp, Homo sapiens
aaaacaacaaaa

SEQ ID NO: 1169798 - DNA, 13 bp, Homo sapiens
aaaacaaccgtcc

SEQ ID NO: 1169799 - DNA, 19 bp, Homo sapiens
aaaacaacttggcatttct

SEQ ID NO: 1169800 - DNA, 20 bp, Homo sapiens
aaaacaactttcacttcttc

SEQ ID NO: 1169801 - DNA, 21 bp, Homo sapiens
aaaacaactttcacttcttcc

SEQ ID NO: 1169802 - DNA, 11 bp, Homo sapiens
aaaacaagaaa

SEQ ID NO: 1169803 - DNA, 12 bp, Homo sapiens
aaaacaagaaac

SEQ ID NO: 1169804 - DNA, 17 bp, Homo sapiens
aaaacaagactgcctcc

SEQ ID NO: 1169805 - DNA, 12 bp, Homo sapiens
aaaacaagcctt

SEQ ID NO: 1169806 - DNA, 13 bp, Homo sapiens
aaaacaagcctta

SEQ ID NO: 1169807 - DNA, 14 bp, Homo sapiens
aaaacaagccttaa

SEQ ID NO: 1169808 - DNA, 22 bp, Homo sapiens
aaaacaagtactggttgacttt

SEQ ID NO: 1169809 - DNA, 15 bp, Homo sapiens
aaaacaatatctgca

SEQ ID NO: 1169810 - DNA, 17 bp, Homo sapiens
aaaacaatattgtttct

SEQ ID NO: 1169811 - DNA, 15 bp, Homo sapiens
aaaacaatgactttt

SEQ ID NO: 1169812 - DNA, 13 bp, Homo sapiens
aaaacaattcagt

SEQ ID NO: 1169813 - DNA, 16 bp, Homo sapiens
aaaacacacctcgtgg

SEQ ID NO: 1169814 - DNA, 17 bp, Homo sapiens
aaaacacatttttctta

SEQ ID NO: 1169815 - DNA, 22 bp, Homo sapiens
aaaacaccgcttctgccttttc

SEQ ID NO: 1169816 - DNA, 10 bp, Homo sapiens
aaaacactaa

SEQ ID NO: 1169817 - DNA, 15 bp, Homo sapiens
aaaacactgccctct

SEQ ID NO: 1169818 - DNA, 17 bp, Homo sapiens
aaaacacttagtatgca

SEQ ID NO: 1169819 - DNA, 13 bp, Homo sapiens
aaaacacttattc

SEQ ID NO: 1169820 - DNA, 22 bp, Homo sapiens
aaaacacttggcatacaaaata

SEQ ID NO: 1169821 - DNA, 14 bp, Homo sapiens
aaaacagaacactt

SEQ ID NO: 1169822 - DNA, 21 bp, Homo sapiens
aaaacagaacatcattagaac

SEQ ID NO: 1169823 - DNA, 22 bp, Homo sapiens
aaaacagaacatcattagaaca

SEQ ID NO: 1169824 - DNA, 17 bp, Homo sapiens
aaaacagaatcttctgg

SEQ ID NO: 1169825 - DNA, 18 bp, Homo sapiens
aaaacagatgaccataat

SEQ ID NO: 1169826 - DNA, 18 bp, Homo sapiens
aaaacagattctatatta

SEQ ID NO: 1169827 - DNA, 18 bp, Homo sapiens
aaaacaggcaaagtttta

SEQ ID NO: 1169828 - DNA, 18 bp, Homo sapiens
aaaacagggccacataga

SEQ ID NO: 1169829 - DNA, 17 bp, Homo sapiens
aaaacaggtagaattat

SEQ ID NO: 1169830 - DNA, 19 bp, Homo sapiens
aaaacagtggatcacaaag

SEQ ID NO: 1169831 - DNA, 20 bp, Homo sapiens
aaaacataatcttctgcctt

SEQ ID NO: 1169832 - DNA, 24 bp, Homo sapiens
aaaacataatcttctgccttctca

SEQ ID NO: 1169833 - DNA, 17 bp, Homo sapiens
aaaacatacttacattt

SEQ ID NO: 1169834 - DNA, 23 bp, Homo sapiens
aaaacatagaaatggaaattttg

SEQ ID NO: 1169835 - DNA, 16 bp, Homo sapiens
aaaacatagcatctca

SEQ ID NO: 1169836 - DNA, 23 bp, Homo sapiens
aaaacatattcaaagcagcagcc

SEQ ID NO: 1169837 - DNA, 16 bp, Homo sapiens
aaaacatatttcattt

SEQ ID NO: 1169838 - DNA, 16 bp, Homo sapiens
aaaacatcccaaactt

SEQ ID NO: 1169839 - DNA, 20 bp, Homo sapiens
aaaacatcccaaactttaaa

SEQ ID NO: 1169840 - DNA, 21 bp, Homo sapiens
aaaacatcccaaactttaaaa

SEQ ID NO: 1169841 - DNA, 22 bp, Homo sapiens
aaaacatcccaaactttaaaat

SEQ ID NO: 1169842 - DNA, 23 bp, Homo sapiens
aaaacatcccaaactttaaaatg

SEQ ID NO: 1169843 - DNA, 14 bp, Homo sapiens
aaaacatggtagaa

SEQ ID NO: 1169844 - DNA, 13 bp, Homo sapiens
aaaacatgtatgt

SEQ ID NO: 1169845 - DNA, 20 bp, Homo sapiens
aaaacatgtttaaatagcct

SEQ ID NO: 1169846 - DNA, 23 bp, Homo sapiens
aaaacatgtttaaatagcctaaa

SEQ ID NO: 1169847 - DNA, 16 bp, Homo sapiens
aaaacattaagaaaat

SEQ ID NO: 1169848 - DNA, 18 bp, Homo sapiens
aaaacattaagaaaatca

SEQ ID NO: 1169849 - DNA, 12 bp, Homo sapiens
aaaacattcatg

SEQ ID NO: 1169850 - DNA, 13 bp, Homo sapiens
aaaacattcatgt

SEQ ID NO: 1169851 - DNA, 16 bp, Homo sapiens
aaaacattctatctac

SEQ ID NO: 1169852 - DNA, 17 bp, Homo sapiens
aaaacattgcttttgaa

SEQ ID NO: 1169853 - DNA, 14 bp, Homo sapiens
aaaacatttaacat

SEQ ID NO: 1169854 - DNA, 17 bp, Homo sapiens
aaaacatttactgacca

SEQ ID NO: 1169855 - DNA, 16 bp, Homo sapiens
aaaacatttattttga

SEQ ID NO: 1169856 - DNA, 22 bp, Homo sapiens
aaaacatttattttgacataaa

SEQ ID NO: 1169857 - DNA, 16 bp, Homo sapiens
aaaacatttgtttccc

SEQ ID NO: 1169858 - DNA, 21 bp, Homo sapiens
aaaacattttttaatagaata

SEQ ID NO: 1169859 - DNA, 17 bp, Homo sapiens
aaaaccaaattttaaaa

SEQ ID NO: 1169860 - DNA, 12 bp, Homo sapiens
aaaaccaacagg

SEQ ID NO: 1169861 - DNA, 19 bp, Homo sapiens
aaaaccaagccgtggcttc

SEQ ID NO: 1169862 - DNA, 11 bp, Homo sapiens
aaaaccacagc

SEQ ID NO: 1169863 - DNA, 17 bp, Homo sapiens
aaaaccacagctgggca

SEQ ID NO: 1169864 - DNA, 14 bp, Homo sapiens
aaaagagacttctc

SEQ ID NO: 1169865 - DNA, 19 bp, Homo sapiens
aaaagagatctgggcatta

SEQ ID NO: 1169866 - DNA, 12 bp, Homo sapiens
aaaagagccctg

SEQ ID NO: 1169867 - DNA, 14 bp, Homo sapiens
aaaagagctgtctg

SEQ ID NO: 1169868 - DNA, 12 bp, Homo sapiens
aaaagagcttta

SEQ ID NO: 1169869 - DNA, 19 bp, Homo sapiens
aaaagaggatgatttcaga

SEQ ID NO: 1169870 - DNA, 20 bp, Homo sapiens
aaaagaggatgatttcagaa

SEQ ID NO: 1169871 - DNA, 18 bp, Homo sapiens
aaaagaggtgtcatgctt

SEQ ID NO: 1169872 - DNA, 19 bp, Homo sapiens
aaaagagtagaataacctt

SEQ ID NO: 1169873 - DNA, 12 bp, Homo sapiens
aaaagagtatgt

SEQ ID NO: 1169874 - DNA, 22 bp, Homo sapiens
aaaagataaagaccagaaattc

SEQ ID NO: 1169875 - DNA, 13 bp, Homo sapiens
aaaagataaagat

SEQ ID NO: 1169876 - DNA, 18 bp, Homo sapiens
aaaagataaagatgatct

SEQ ID NO: 1169877 - DNA, 15 bp, Homo sapiens
aaaagataatatttt

SEQ ID NO: 1169878 - DNA, 22 bp, Homo sapiens
aaaagatatattaaaaatataa

SEQ ID NO: 1169879 - DNA, 13 bp, Homo sapiens
aaaagatgaattt

SEQ ID NO: 1169880 - DNA, 14 bp, Homo sapiens
aaaagatgtatatt

SEQ ID NO: 1169881 - DNA, 14 bp, Homo sapiens
aaaagatgtatcct

SEQ ID NO: 1169882 - DNA, 14 bp, Homo sapiens
aaaagattctacta

SEQ ID NO: 1169883 - DNA, 15 bp, Homo sapiens
aaaagattctactaa

SEQ ID NO: 1169884 - DNA, 15 bp, Homo sapiens
aaaagattgccaatt

SEQ ID NO: 1169885 - DNA, 14 bp, Homo sapiens
aaaagattgctgaa

SEQ ID NO: 1169886 - DNA, 14 bp, Homo sapiens
aaaagatttacatt

SEQ ID NO: 1169887 - DNA, 13 bp, Homo sapiens
aaaagatttgttt

SEQ ID NO: 1169888 - DNA, 14 bp, Homo sapiens
aaaagattttaatc

SEQ ID NO: 1169889 - DNA, 16 bp, Homo sapiens
aaaagcaaaaaagaaa

SEQ ID NO: 1169890 - DNA, 12 bp, Homo sapiens
aaaagcaagact

SEQ ID NO: 1169891 - DNA, 20 bp, Homo sapiens
aaaagcaagtactctggagc

SEQ ID NO: 1169892 - DNA, 19 bp, Homo sapiens
aaaagcacaagtacttttg

SEQ ID NO: 1169893 - DNA, 22 bp, Homo sapiens
aaaagcacaatcactaaacttt

SEQ ID NO: 1169894 - DNA, 14 bp, Homo sapiens
aaaagcagaatttt

SEQ ID NO: 1169895 - DNA, 20 bp, Homo sapiens
aaaagcagctaaatgtaact

SEQ ID NO: 1169896 - DNA, 23 bp, Homo sapiens
aaaagcagctaaatgtaacttat

SEQ ID NO: 1169897 - DNA, 15 bp, Homo sapiens
aaaagcataaatgca

SEQ ID NO: 1169898 - DNA, 17 bp, Homo sapiens
aaaagcatgatgggaaa

SEQ ID NO: 1169899 - DNA, 17 bp, Homo sapiens
aaaagcatttttcaata

SEQ ID NO: 1169900 - DNA, 11 bp, Homo sapiens
aaaagccaagc

SEQ ID NO: 1169901 - DNA, 14 bp, Homo sapiens
aaaagccacattac

SEQ ID NO: 1169902 - DNA, 17 bp, Homo sapiens
aaaagccataacttgaa

SEQ ID NO: 1169903 - DNA, 12 bp, Homo sapiens
aaaagccattat

SEQ ID NO: 1169904 - DNA, 16 bp, Homo sapiens
aaaagcccacaggcct

SEQ ID NO: 1169905 - DNA, 17 bp, Homo sapiens
aaaagcctaacaaatgg

SEQ ID NO: 1169906 - DNA, 20 bp, Homo sapiens
aaaagcctctgttttgatat

SEQ ID NO: 1169907 - DNA, 13 bp, Homo sapiens
aaaagcctggttt

SEQ ID NO: 1169908 - DNA, 19 bp, Homo sapiens
aaaagcgtgagcttaaaat

SEQ ID NO: 1169909 - DNA, 22 bp, Homo sapiens
aaaagctaacatctttacgtac

SEQ ID NO: 1169910 - DNA, 20 bp, Homo sapiens
aaaagctacagttttgtgaa

SEQ ID NO: 1169911 - DNA, 15 bp, Homo sapiens
aaaagctataaagta

SEQ ID NO: 1169912 - DNA, 22 bp, Homo sapiens
aaaagctataaagtatatatta

SEQ ID NO: 1169913 - DNA, 16 bp, Homo sapiens
aaaagctatcttcatg

SEQ ID NO: 1169914 - DNA, 19 bp, Homo sapiens
aaaagctatcttcatgtaa

SEQ ID NO: 1169915 - DNA, 13 bp, Homo sapiens
aaaagctcagagt

SEQ ID NO: 1169916 - DNA, 14 bp, Homo sapiens
aaaagctcagatga

SEQ ID NO: 1169917 - DNA, 20 bp, Homo sapiens
aaaagctcttacactacatt

SEQ ID NO: 1169918 - DNA, 14 bp, Homo sapiens
aaaagctgggcagg

SEQ ID NO: 1169919 - DNA, 18 bp, Homo sapiens
aaaaggaaaaataatcaa

SEQ ID NO: 1169920 - DNA, 14 bp, Homo sapiens
aaaaggaaagaaaa

SEQ ID NO: 1169921 - DNA, 13 bp, Homo sapiens
aaaaggaaagctg

SEQ ID NO: 1169922 - DNA, 14 bp, Homo sapiens
aaaaggaagactag

SEQ ID NO: 1169923 - DNA, 21 bp, Homo sapiens
aaaaggaagtggggacagatt

SEQ ID NO: 1169924 - DNA, 20 bp, Homo sapiens
aggagaatcgcttgaacctg

SEQ ID NO: 1169925 - DNA, 21 bp, Homo sapiens
aggagaatcgcttgaacctgg

SEQ ID NO: 1169926 - DNA, 15 bp, Homo sapiens
aggagaatgagcctc

SEQ ID NO: 1169927 - DNA, 20 bp, Homo sapiens
aggagaatggggttcctgct

SEQ ID NO: 1169928 - DNA, 20 bp, Homo sapiens
aggagaatggtgtgaacccg

SEQ ID NO: 1169929 - DNA, 13 bp, Homo sapiens
aggagaattgctt

SEQ ID NO: 1169930 - DNA, 18 bp, Homo sapiens
aggagacaagaaatccag

SEQ ID NO: 1169931 - DNA, 15 bp, Homo sapiens
aggagacattgctct

SEQ ID NO: 1169932 - DNA, 23 bp, Homo sapiens
aggagacattgctctatgtctgc

SEQ ID NO: 1169933 - DNA, 12 bp, Homo sapiens
aggagaccctgg

SEQ ID NO: 1169934 - DNA, 13 bp, Homo sapiens
aggagaccctgga

SEQ ID NO: 1169935 - DNA, 15 bp, Homo sapiens
aggagaccctggaat

SEQ ID NO: 1169936 - DNA, 21 bp, Homo sapiens
aggagacctggcactggatgc

SEQ ID NO: 1169937 - DNA, 22 bp, Homo sapiens
aggagacgaagtgaaaacaaat

SEQ ID NO: 1169938 - DNA, 16 bp, Homo sapiens
aggagacggaggggag

SEQ ID NO: 1169939 - DNA, 13 bp, Homo sapiens
aggagactcacct

SEQ ID NO: 1169940 - DNA, 15 bp, Homo sapiens
aggagactcacctct

SEQ ID NO: 1169941 - DNA, 19 bp, Homo sapiens
aggagactcacctctgcct

SEQ ID NO: 1169942 - DNA, 19 bp, Homo sapiens
aggagactccaaggagcta

SEQ ID NO: 1169943 - DNA, 22 bp, Homo sapiens
aggagacttgtgaattcccaga

SEQ ID NO: 1169944 - DNA, 23 bp, Homo sapiens
aggagagacggtgttgggagccc

SEQ ID NO: 1169945 - DNA, 16 bp, Homo sapiens
aggagagactgaaagc

SEQ ID NO: 1169946 - DNA, 17 bp, Homo sapiens
aggagagactgaaagca

SEQ ID NO: 1169947 - DNA, 18 bp, Homo sapiens
aggagagactgagcagcc

SEQ ID NO: 1169948 - DNA, 17 bp, Homo sapiens
aggagagagatggacat

SEQ ID NO: 1169949 - DNA, 14 bp, Homo sapiens
aggagagagccagg

SEQ ID NO: 1169950 - DNA, 20 bp, Homo sapiens
aggagagatgacccctaccc

SEQ ID NO: 1169951 - DNA, 17 bp, Homo sapiens
aggagagcactgcctct

SEQ ID NO: 1169952 - DNA, 18 bp, Homo sapiens
aggagagccaacctcggc

SEQ ID NO: 1169953 - DNA, 21 bp, Homo sapiens
aggagagcccccaccagcagc

SEQ ID NO: 1169954 - DNA, 16 bp, Homo sapiens
aggagagcccttcatt

SEQ ID NO: 1169955 - DNA, 15 bp, Homo sapiens
aggagagcctgctgc

SEQ ID NO: 1169956 - DNA, 20 bp, Homo sapiens
aggagagcctgctgcatggg

SEQ ID NO: 1169957 - DNA, 15 bp, Homo sapiens
aggagagcctggggg

SEQ ID NO: 1169958 - DNA, 15 bp, Homo sapiens
aggagaggaaaagta

SEQ ID NO: 1169959 - DNA, 22 bp, Homo sapiens
aggagaggaaactactgccttt

SEQ ID NO: 1169960 - DNA, 16 bp, Homo sapiens
aggagaggagaaaaaa

SEQ ID NO: 1169961 - DNA, 20 bp, Homo sapiens
aggagagggcgctcctctct

SEQ ID NO: 1169962 - DNA, 19 bp, Homo sapiens
aggagaggggaagggccag

SEQ ID NO: 1169963 - DNA, 14 bp, Homo sapiens
aggagaggggcaca

SEQ ID NO: 1169964 - DNA, 18 bp, Homo sapiens
aggagaggggcacagggt

SEQ ID NO: 1169965 - DNA, 18 bp, Homo sapiens
aggagaggggcagaacag

SEQ ID NO: 1169966 - DNA, 21 bp, Homo sapiens
aggagagtcccagagcaggag

SEQ ID NO: 1169967 - DNA, 18 bp, Homo sapiens
aggagagtggcaggtggg

SEQ ID NO: 1169968 - DNA, 22 bp, Homo sapiens
aggagagttcaagcctgtggga

SEQ ID NO: 1169969 - DNA, 18 bp, Homo sapiens
aggagatatctgagggag

SEQ ID NO: 1169970 - DNA, 20 bp, Homo sapiens
aggagatatctgagggagga

SEQ ID NO: 1169971 - DNA, 22 bp, Homo sapiens
aggagatccagggcaaggccat

SEQ ID NO: 1169972 - DNA, 16 bp, Homo sapiens
aggagatgctccttgg

SEQ ID NO: 1169973 - DNA, 18 bp, Homo sapiens
aggagatgctccttgggc

SEQ ID NO: 1169974 - DNA, 14 bp, Homo sapiens
aggagattggccag

SEQ ID NO: 1169975 - DNA, 19 bp, Homo sapiens
aggagatttaccacttttt

SEQ ID NO: 1169976 - DNA, 20 bp, Homo sapiens
aggagcaaaaatctgagaaa

SEQ ID NO: 1169977 - DNA, 19 bp, Homo sapiens
aggagcaaacactgaaata

SEQ ID NO: 1169978 - DNA, 15 bp, Homo sapiens
aggagcaaagttaaa

SEQ ID NO: 1169979 - DNA, 18 bp, Homo sapiens
aggagcaaatgtttctgc

SEQ ID NO: 1169980 - DNA, 17 bp, Homo sapiens
aggagcaagaagaaaat

SEQ ID NO: 1169981 - DNA, 18 bp, Homo sapiens
aggagcaatcacaggaaa

SEQ ID NO: 1169982 - DNA, 16 bp, Homo sapiens
aggagcacaagccaca

SEQ ID NO: 1169983 - DNA, 15 bp, Homo sapiens
aggagcacaggtccc

SEQ ID NO: 1169984 - DNA, 17 bp, Homo sapiens
aggagcacaggtcccac

SEQ ID NO: 1169985 - DNA, 16 bp, Homo sapiens
aggagcacctgaaccc

SEQ ID NO: 1169986 - DNA, 12 bp, Homo sapiens
aggagcagccag

SEQ ID NO: 1169987 - DNA, 13 bp, Homo sapiens
aggagggtggggg

SEQ ID NO: 1169988 - DNA, 23 bp, Homo sapiens
aggagggttcctcttaggtcaga

SEQ ID NO: 1169989 - DNA, 18 bp, Homo sapiens
aggaggtccttaggcctc

SEQ ID NO: 1169990 - DNA, 23 bp, Homo sapiens
aggaggtccttaggcctctgaga

SEQ ID NO: 1169991 - DNA, 13 bp, Homo sapiens
aggaggtgaggga

SEQ ID NO: 1169992 - DNA, 14 bp, Homo sapiens
aggaggtggaggtt

SEQ ID NO: 1169993 - DNA, 20 bp, Homo sapiens
aggaggtggaggttgcagtg

SEQ ID NO: 1169994 - DNA, 17 bp, Homo sapiens
aggaggtggcagccctg

SEQ ID NO: 1169995 - DNA, 20 bp, Homo sapiens
aggaggtggcagccctgtag

SEQ ID NO: 1169996 - DNA, 15 bp, Homo sapiens
aggaggtgggccaca

SEQ ID NO: 1169997 - DNA, 20 bp, Homo sapiens
aggaggtgtgaggaggaggc

SEQ ID NO: 1169998 - DNA, 20 bp, Homo sapiens
aggaggttctgggcctctga

SEQ ID NO: 1169999 - DNA, 15 bp, Homo sapiens
aggaggttgtggatg

SEQ ID NO: 1170000 - DNA, 16 bp, Homo sapiens
aggagtaagtgtacaa

SEQ ID NO: 1170001 - DNA, 21 bp, Homo sapiens
aggagtaatctgtgtacaaag

SEQ ID NO: 1170002 - DNA, 12 bp, Homo sapiens
aggagtattttg

SEQ ID NO: 1170003 - DNA, 14 bp, Homo sapiens
aggagtcactgaga

SEQ ID NO: 1170004 - DNA, 14 bp, Homo sapiens
aggagtcaggggct

SEQ ID NO: 1170005 - DNA, 21 bp, Homo sapiens
aggagtcaggggctctgtgtt

SEQ ID NO: 1170006 - DNA, 22 bp, Homo sapiens
aggagtctctgccacccactca

SEQ ID NO: 1170007 - DNA, 24 bp, Homo sapiens
aggagtctgcacatgcagctgcac

SEQ ID NO: 1170008 - DNA, 19 bp, Homo sapiens
aggagtctgccacttgtca

SEQ ID NO: 1170009 - DNA, 13 bp, Homo sapiens
aggagtctgtgct

SEQ ID NO: 1170010 - DNA, 14 bp, Homo sapiens
aggagtctgtgctc

SEQ ID NO: 1170011 - DNA, 19 bp, Homo sapiens
aggagtcttcagacccaga

SEQ ID NO: 1170012 - DNA, 17 bp, Homo sapiens
aggagtgagaggggaca

SEQ ID NO: 1170013 - DNA, 16 bp, Homo sapiens
aggagtgagtgtatgt

SEQ ID NO: 1170014 - DNA, 21 bp, Homo sapiens
aggagtgagtgtatgtgtgtg

SEQ ID NO: 1170015 - DNA, 20 bp, Homo sapiens
aggagtgggtgacaagagcc

SEQ ID NO: 1170016 - DNA, 23 bp, Homo sapiens
aggagtgggttttattgtccttc

SEQ ID NO: 1170017 - DNA, 14 bp, Homo sapiens
aggagtggtgcaga

SEQ ID NO: 1170018 - DNA, 18 bp, Homo sapiens
aggagtggtgcagacaga

SEQ ID NO: 1170019 - DNA, 19 bp, Homo sapiens
aggagtgtatgagtgtgag

SEQ ID NO: 1170020 - DNA, 15 bp, Homo sapiens
aggagtgtcctgccc

SEQ ID NO: 1170021 - DNA, 18 bp, Homo sapiens
aggagtgtcctgcccatg

SEQ ID NO: 1170022 - DNA, 17 bp, Homo sapiens
aggagttaagagtagca

SEQ ID NO: 1170023 - DNA, 16 bp, Homo sapiens
aggagttcgagaccag

SEQ ID NO: 1170024 - DNA, 21 bp, Homo sapiens
aggagttcgagaccagcctgg

SEQ ID NO: 1170025 - DNA, 13 bp, Homo sapiens
aggagttctctga

SEQ ID NO: 1170026 - DNA, 23 bp, Homo sapiens
aggagttctctgatgcagaaatt

SEQ ID NO: 1170027 - DNA, 13 bp, Homo sapiens
aggagttgcctga

SEQ ID NO: 1170028 - DNA, 14 bp, Homo sapiens
aggagttgcctgac

SEQ ID NO: 1170029 - DNA, 21 bp, Homo sapiens
aggagttgctgtttgtttgac

SEQ ID NO: 1170030 - DNA, 20 bp, Homo sapiens
aggagttgtttctgacccac

SEQ ID NO: 1170031 - DNA, 19 bp, Homo sapiens
aggagtttaagaccagcct

SEQ ID NO: 1170032 - DNA, 21 bp, Homo sapiens
aggagtttaagaccagcctgg

SEQ ID NO: 1170033 - DNA, 18 bp, Homo sapiens
aggagtttatccatcctg

SEQ ID NO: 1170034 - DNA, 15 bp, Homo sapiens
aggagtttattacaa

SEQ ID NO: 1170035 - DNA, 19 bp, Homo sapiens
aggagtttcgaggtagagt

SEQ ID NO: 1170036 - DNA, 17 bp, Homo sapiens
aggagtttgagacaagc

SEQ ID NO: 1170037 - DNA, 24 bp, Homo sapiens
aggagtttgagacaagccctggca

SEQ ID NO: 1170038 - DNA, 16 bp, Homo sapiens
aggagtttgagaccag

SEQ ID NO: 1170039 - DNA, 21 bp, Homo sapiens
aggagtttgagaccagcttag

SEQ ID NO: 1170040 - DNA, 19 bp, Homo sapiens
aggagtttgaggctgcagc

SEQ ID NO: 1170041 - DNA, 21 bp, Homo sapiens
aggagttttctccatatcaaa

SEQ ID NO: 1170042 - DNA, 18 bp, Homo sapiens
aggataaaaaggaaggag

SEQ ID NO: 1170043 - DNA, 19 bp, Homo sapiens
aggataaaaaggaaggaga

SEQ ID NO: 1170044 - DNA, 13 bp, Homo sapiens
aggataactctgt

SEQ ID NO: 1170045 - DNA, 21 bp, Homo sapiens
aggataagaaagcctaaaatt

SEQ ID NO: 1170046 - DNA, 21 bp, Homo sapiens
aggatacaaaagcatgtgaga

SEQ ID NO: 1170047 - DNA, 15 bp, Homo sapiens
aggatacagaggaga

SEQ ID NO: 1170048 - DNA, 14 bp, Homo sapiens
aggatacatgtgcc

SEQ ID NO: 1170049 - DNA, 13 bp, Homo sapiens
aggatacatttaa

SEQ ID NO: 1170050 - DNA, 18 bp, Homo sapiens
aggatacatttaataaaa

SEQ ID NO: 1170051 - DNA, 16 bp, Homo sapiens
aggataccttcttatt

SEQ ID NO: 1170052 - DNA, 15 bp, Homo sapiens
aaaatacaattttta

SEQ ID NO: 1170053 - DNA, 18 bp, Homo sapiens
aaaatacacgtttatctt

SEQ ID NO: 1170054 - DNA, 19 bp, Homo sapiens
aaaatacacgtttatctta

SEQ ID NO: 1170055 - DNA, 10 bp, Homo sapiens
aaaatacatg

SEQ ID NO: 1170056 - DNA, 13 bp, Homo sapiens
aaaatacatgaag

SEQ ID NO: 1170057 - DNA, 12 bp, Homo sapiens
aaaatacatgta

SEQ ID NO: 1170058 - DNA, 16 bp, Homo sapiens
aaaataccattgaaat

SEQ ID NO: 1170059 - DNA, 19 bp, Homo sapiens
aaaatacctaattgtggat

SEQ ID NO: 1170060 - DNA, 21 bp, Homo sapiens
aaaatactatgcagtatctct

SEQ ID NO: 1170061 - DNA, 15 bp, Homo sapiens
aaaatactttgagtt

SEQ ID NO: 1170062 - DNA, 18 bp, Homo sapiens
aaaatactttgagttttg

SEQ ID NO: 1170063 - DNA, 17 bp, Homo sapiens
aaaatagaaaaagtgga

SEQ ID NO: 1170064 - DNA, 12 bp, Homo sapiens
aaaatagaaaag

SEQ ID NO: 1170065 - DNA, 21 bp, Homo sapiens
aaaatagaaattttgtaagaa

SEQ ID NO: 1170066 - DNA, 15 bp, Homo sapiens
aaaatagaagctgta

SEQ ID NO: 1170067 - DNA, 11 bp, Homo sapiens
aaaatagacat

SEQ ID NO: 1170068 - DNA, 20 bp, Homo sapiens
aaaatagacctaactgaata

SEQ ID NO: 1170069 - DNA, 16 bp, Homo sapiens
aaaatagactaacttc

SEQ ID NO: 1170070 - DNA, 17 bp, Homo sapiens
aaaatagagcaaaatca

SEQ ID NO: 1170071 - DNA, 20 bp, Homo sapiens
aaaatagagcaaaatcaaca

SEQ ID NO: 1170072 - DNA, 15 bp, Homo sapiens
aaaatagatatataa

SEQ ID NO: 1170073 - DNA, 12 bp, Homo sapiens
aaaatagatttt

SEQ ID NO: 1170074 - DNA, 19 bp, Homo sapiens
aaaatagcaagagtgtgaa

SEQ ID NO: 1170075 - DNA, 18 bp, Homo sapiens
aaaatagcatactgtgta

SEQ ID NO: 1170076 - DNA, 21 bp, Homo sapiens
aaaatagcatactgtgtatgt

SEQ ID NO: 1170077 - DNA, 13 bp, Homo sapiens
aaaatagccctgc

SEQ ID NO: 1170078 - DNA, 12 bp, Homo sapiens
aaaatagcctgc

SEQ ID NO: 1170079 - DNA, 19 bp, Homo sapiens
aaaatagcgttcttgtaat

SEQ ID NO: 1170080 - DNA, 20 bp, Homo sapiens
aaaatagtatgttaatatgt

SEQ ID NO: 1170081 - DNA, 15 bp, Homo sapiens
aaaatagtattgctg

SEQ ID NO: 1170082 - DNA, 22 bp, Homo sapiens
aaaatagtattgctgaactctt

SEQ ID NO: 1170083 - DNA, 18 bp, Homo sapiens
aaaatagtggtgtgattt

SEQ ID NO: 1170084 - DNA, 12 bp, Homo sapiens
aaaatagtgtaa

SEQ ID NO: 1170085 - DNA, 19 bp, Homo sapiens
aaaatagttccctttgcca

SEQ ID NO: 1170086 - DNA, 22 bp, Homo sapiens
aaaatagtttaggagaaaccag

SEQ ID NO: 1170087 - DNA, 19 bp, Homo sapiens
aaaatagtttggatatgta

SEQ ID NO: 1170088 - DNA, 20 bp, Homo sapiens
aaaatagtttggatatgtaa

SEQ ID NO: 1170089 - DNA, 22 bp, Homo sapiens
aaaatagtttggatatgtaaaa

SEQ ID NO: 1170090 - DNA, 14 bp, Homo sapiens
aaaatataaaactg

SEQ ID NO: 1170091 - DNA, 21 bp, Homo sapiens
aaaatataaattgtacatttt

SEQ ID NO: 1170092 - DNA, 12 bp, Homo sapiens
aaaatataagta

SEQ ID NO: 1170093 - DNA, 18 bp, Homo sapiens
aaaatataagtaaagtga

SEQ ID NO: 1170094 - DNA, 15 bp, Homo sapiens
aaaatatagagacag

SEQ ID NO: 1170095 - DNA, 19 bp, Homo sapiens
aaaatatagagacaggaca

SEQ ID NO: 1170096 - DNA, 16 bp, Homo sapiens
aaaatatagctgtaca

SEQ ID NO: 1170097 - DNA, 20 bp, Homo sapiens
aaaatatagctgtacaaata

SEQ ID NO: 1170098 - DNA, 16 bp, Homo sapiens
aaaatataggtgatgg

SEQ ID NO: 1170099 - DNA, 14 bp, Homo sapiens
aaaatatatactaa

SEQ ID NO: 1170100 - DNA, 13 bp, Homo sapiens
aaaatatatgttc

SEQ ID NO: 1170101 - DNA, 14 bp, Homo sapiens
aaaatatcttcctt

SEQ ID NO: 1170102 - DNA, 16 bp, Homo sapiens
aaaatatggaacttct

SEQ ID NO: 1170103 - DNA, 17 bp, Homo sapiens
aaaatatgtaatttcaa

SEQ ID NO: 1170104 - DNA, 11 bp, Homo sapiens
aaaatatgtat

SEQ ID NO: 1170105 - DNA, 21 bp, Homo sapiens
aaaatattaaatcaagagtga

SEQ ID NO: 1170106 - DNA, 17 bp, Homo sapiens
aaaatattaacattctt

SEQ ID NO: 1170107 - DNA, 13 bp, Homo sapiens
aaaatattatttg

SEQ ID NO: 1170108 - DNA, 14 bp, Homo sapiens
aaaatattatttga

SEQ ID NO: 1170109 - DNA, 17 bp, Homo sapiens
aggcaccaccaggagca

SEQ ID NO: 1170110 - DNA, 19 bp, Homo sapiens
aggcaccaccaggagcagc

SEQ ID NO: 1170111 - DNA, 22 bp, Homo sapiens
aggcaccaccaggagcagcagc

SEQ ID NO: 1170112 - DNA, 17 bp, Homo sapiens
aggcaccagctctgtgg

SEQ ID NO: 1170113 - DNA, 21 bp, Homo sapiens
aggcaccagctctgtggcctg

SEQ ID NO: 1170114 - DNA, 22 bp, Homo sapiens
aggcaccagctctgtggcctgt

SEQ ID NO: 1170115 - DNA, 13 bp, Homo sapiens
aggcaccaggaag

SEQ ID NO: 1170116 - DNA, 16 bp, Homo sapiens
aggcaccaggaagccg

SEQ ID NO: 1170117 - DNA, 20 bp, Homo sapiens
aggcacccttctttcctctt

SEQ ID NO: 1170118 - DNA, 18 bp, Homo sapiens
aggcaccgagaatgttgt

SEQ ID NO: 1170119 - DNA, 19 bp, Homo sapiens
aggcaccggcgctgcaggt

SEQ ID NO: 1170120 - DNA, 23 bp, Homo sapiens
aggcacctacactcacctgcact

SEQ ID NO: 1170121 - DNA, 15 bp, Homo sapiens
aggcacctccaggca

SEQ ID NO: 1170122 - DNA, 14 bp, Homo sapiens
aggcacctcttcct

SEQ ID NO: 1170123 - DNA, 15 bp, Homo sapiens
aggcacctggcctgc

SEQ ID NO: 1170124 - DNA, 20 bp, Homo sapiens
aggcacctggcctgctggga

SEQ ID NO: 1170125 - DNA, 21 bp, Homo sapiens
aggcacctggcctgctgggaa

SEQ ID NO: 1170126 - DNA, 17 bp, Homo sapiens
aggcacgggtggtcccc

SEQ ID NO: 1170127 - DNA, 15 bp, Homo sapiens
aggcactagtcaccg

SEQ ID NO: 1170128 - DNA, 19 bp, Homo sapiens
aggcactcagtgagcctcc

SEQ ID NO: 1170129 - DNA, 20 bp, Homo sapiens
aggcactcagtgagcctcct

SEQ ID NO: 1170130 - DNA, 19 bp, Homo sapiens
aggcactcatgggtaataa

SEQ ID NO: 1170131 - DNA, 19 bp, Homo sapiens
aggcactgaacaggctggg

SEQ ID NO: 1170132 - DNA, 16 bp, Homo sapiens
aggcactgagaatgat

SEQ ID NO: 1170133 - DNA, 13 bp, Homo sapiens
aggcactgaggga

SEQ ID NO: 1170134 - DNA, 14 bp, Homo sapiens
aggcactgagggat

SEQ ID NO: 1170135 - DNA, 13 bp, Homo sapiens
aggcactgccctt

SEQ ID NO: 1170136 - DNA, 18 bp, Homo sapiens
aggcactgcccttttcag

SEQ ID NO: 1170137 - DNA, 22 bp, Homo sapiens
aggcactgcccttttcaggaag

SEQ ID NO: 1170138 - DNA, 20 bp, Homo sapiens
aggcactgccttctcctctc

SEQ ID NO: 1170139 - DNA, 23 bp, Homo sapiens
aggcactgccttctcctctctgg

SEQ ID NO: 1170140 - DNA, 18 bp, Homo sapiens
aggcactgtcaggaatgg

SEQ ID NO: 1170141 - DNA, 15 bp, Homo sapiens
aggcactgtggccct

SEQ ID NO: 1170142 - DNA, 19 bp, Homo sapiens
aggcactgtggcccttctg

SEQ ID NO: 1170143 - DNA, 20 bp, Homo sapiens
aggcactgttcaatactgta

SEQ ID NO: 1170144 - DNA, 15 bp, Homo sapiens
aggcactttaaaaca

SEQ ID NO: 1170145 - DNA, 20 bp, Homo sapiens
aggcacttttattttcattg

SEQ ID NO: 1170146 - DNA, 21 bp, Homo sapiens
aggcagaaacctatctcaggg

SEQ ID NO: 1170147 - DNA, 16 bp, Homo sapiens
aggcagaaagcaaaat

SEQ ID NO: 1170148 - DNA, 21 bp, Homo sapiens
aggcagaagaattgaacccag

SEQ ID NO: 1170149 - DNA, 22 bp, Homo sapiens
aggcagaatgaacccataggga

SEQ ID NO: 1170150 - DNA, 18 bp, Homo sapiens
aggcagaatggctgcacg

SEQ ID NO: 1170151 - DNA, 14 bp, Homo sapiens
aggcagacaagagc

SEQ ID NO: 1170152 - DNA, 15 bp, Homo sapiens
aggcagacaagagct

SEQ ID NO: 1170153 - DNA, 16 bp, Homo sapiens
aggcagacaagagctg

SEQ ID NO: 1170154 - DNA, 18 bp, Homo sapiens
aggcagacagcagctcag

SEQ ID NO: 1170155 - DNA, 15 bp, Homo sapiens
aggcagacagcaggc

SEQ ID NO: 1170156 - DNA, 22 bp, Homo sapiens
aggcagagaatcatacttagca

SEQ ID NO: 1170157 - DNA, 16 bp, Homo sapiens
aggcagagaatctctt

SEQ ID NO: 1170158 - DNA, 20 bp, Homo sapiens
aggcagagaatctcttggga

SEQ ID NO: 1170159 - DNA, 18 bp, Homo sapiens
aggcagagacctccaata

SEQ ID NO: 1170160 - DNA, 23 bp, Homo sapiens
aggcagagagtacagactgcaga

SEQ ID NO: 1170161 - DNA, 14 bp, Homo sapiens
aggcagagcgggag

SEQ ID NO: 1170162 - DNA, 15 bp, Homo sapiens
aggcagagcgggagg

SEQ ID NO: 1170163 - DNA, 11 bp, Homo sapiens
aggcagagctg

SEQ ID NO: 1170164 - DNA, 22 bp, Homo sapiens
aggcagagctgagggccctgtg

SEQ ID NO: 1170165 - DNA, 13 bp, Homo sapiens
aggcagagctgga

SEQ ID NO: 1170166 - DNA, 24 bp, Homo sapiens
aggcagaggcaactgacttcattt

SEQ ID NO: 1170167 - DNA, 14 bp, Homo sapiens
aggcagaggcctgg

SEQ ID NO: 1170168 - DNA, 22 bp, Homo sapiens
aggcagaggcctgggctgggaa

SEQ ID NO: 1170169 - DNA, 12 bp, Homo sapiens
aggcagaggctg

SEQ ID NO: 1170170 - DNA, 13 bp, Homo sapiens
aggcagaggctgc

SEQ ID NO: 1170171 - DNA, 14 bp, Homo sapiens
aggcagaggctggc

SEQ ID NO: 1170172 - DNA, 21 bp, Homo sapiens
aggcagagtggcgtggcctcc

SEQ ID NO: 1170173 - DNA, 22 bp, Homo sapiens
aggcagagtggcgtggcctccc

SEQ ID NO: 1170174 - DNA, 18 bp, Homo sapiens
aggcagatcctctggaca

SEQ ID NO: 1170175 - DNA, 15 bp, Homo sapiens
aggcagatctgtgcc

SEQ ID NO: 1170176 - DNA, 16 bp, Homo sapiens
aggcagatctgtgccc

SEQ ID NO: 1170177 - DNA, 23 bp, Homo sapiens
aggcagatctgtgccccatgcct

SEQ ID NO: 1170178 - DNA, 12 bp, Homo sapiens
aggcagatggag

SEQ ID NO: 1170179 - DNA, 17 bp, Homo sapiens
aggcagattgaaaagga

SEQ ID NO: 1170180 - DNA, 20 bp, Homo sapiens
aggcagattttacagagcgc

SEQ ID NO: 1170181 - DNA, 14 bp, Homo sapiens
aggcagcaaagagg

SEQ ID NO: 1170182 - DNA, 21 bp, Homo sapiens
aggcagcaaagaggggcgctg

SEQ ID NO: 1170183 - DNA, 20 bp, Homo sapiens
aggcagcaagtcttaacaaa

SEQ ID NO: 1170184 - DNA, 23 bp, Homo sapiens
aaaattctgtgccttgttttttg

SEQ ID NO: 1170185 - DNA, 20 bp, Homo sapiens
aaaattctttcacttgatgt

SEQ ID NO: 1170186 - DNA, 14 bp, Homo sapiens
aaaattgaaaaaag

SEQ ID NO: 1170187 - DNA, 14 bp, Homo sapiens
aaaattgaaatgta

SEQ ID NO: 1170188 - DNA, 12 bp, Homo sapiens
aaaattgaactg

SEQ ID NO: 1170189 - DNA, 12 bp, Homo sapiens
aaaattgaatgc

SEQ ID NO: 1170190 - DNA, 23 bp, Homo sapiens
aaaattgacttagatattaaaat

SEQ ID NO: 1170191 - DNA, 23 bp, Homo sapiens
aaaattgagttcttcctgtaatc

SEQ ID NO: 1170192 - DNA, 23 bp, Homo sapiens
aaaattgatatacttttttctta

SEQ ID NO: 1170193 - DNA, 15 bp, Homo sapiens
aaaattgcaaatctt

SEQ ID NO: 1170194 - DNA, 19 bp, Homo sapiens
aaaattgcagtttcatgta

SEQ ID NO: 1170195 - DNA, 13 bp, Homo sapiens
aaaattgccaagt

SEQ ID NO: 1170196 - DNA, 21 bp, Homo sapiens
aaaattgctgtgcctcccaaa

SEQ ID NO: 1170197 - DNA, 17 bp, Homo sapiens
aaaattggttggagaat

SEQ ID NO: 1170198 - DNA, 16 bp, Homo sapiens
aaaattgtagcttttt

SEQ ID NO: 1170199 - DNA, 21 bp, Homo sapiens
aaaattgtataccaatgtgtt

SEQ ID NO: 1170200 - DNA, 23 bp, Homo sapiens
aaaattgtgatgttttgttcaaa

SEQ ID NO: 1170201 - DNA, 20 bp, Homo sapiens
aaaattgttaatttttccta

SEQ ID NO: 1170202 - DNA, 13 bp, Homo sapiens
aaaattgttattt

SEQ ID NO: 1170203 - DNA, 17 bp, Homo sapiens
aaaattgtttcttgaca

SEQ ID NO: 1170204 - DNA, 12 bp, Homo sapiens
aaaattgttttc

SEQ ID NO: 1170205 - DNA, 21 bp, Homo sapiens
aaaattgttttgagctttcca

SEQ ID NO: 1170206 - DNA, 14 bp, Homo sapiens
aaaatttaaaatta

SEQ ID NO: 1170207 - DNA, 12 bp, Homo sapiens
aaaatttaactt

SEQ ID NO: 1170208 - DNA, 16 bp, Homo sapiens
aaaatttaagcattgt

SEQ ID NO: 1170209 - DNA, 23 bp, Homo sapiens
aaaatttaagcattgtttgctta

SEQ ID NO: 1170210 - DNA, 12 bp, Homo sapiens
aaaatttataac

SEQ ID NO: 1170211 - DNA, 12 bp, Homo sapiens
aaaatttataca

SEQ ID NO: 1170212 - DNA, 20 bp, Homo sapiens
aaaatttatacaccagcaat

SEQ ID NO: 1170213 - DNA, 12 bp, Homo sapiens
aaaatttattct

SEQ ID NO: 1170214 - DNA, 15 bp, Homo sapiens
aaaatttattctcag

SEQ ID NO: 1170215 - DNA, 20 bp, Homo sapiens
aaaatttattttataagaaa

SEQ ID NO: 1170216 - DNA, 13 bp, Homo sapiens
aaaatttctaaga

SEQ ID NO: 1170217 - DNA, 19 bp, Homo sapiens
aaaatttgactaattttac

SEQ ID NO: 1170218 - DNA, 24 bp, Homo sapiens
aaaatttgtcttaaaaatttatac

SEQ ID NO: 1170219 - DNA, 16 bp, Homo sapiens
aaaatttgtgtaaatt

SEQ ID NO: 1170220 - DNA, 19 bp, Homo sapiens
aaaatttgtttgaaatctt

SEQ ID NO: 1170221 - DNA, 18 bp, Homo sapiens
aaaattttagaacagtcc

SEQ ID NO: 1170222 - DNA, 21 bp, Homo sapiens
aaaattttaggcactcttaaa

SEQ ID NO: 1170223 - DNA, 17 bp, Homo sapiens
aaaattttggaatattt

SEQ ID NO: 1170224 - DNA, 23 bp, Homo sapiens
aaaattttgtattaatttctgat

SEQ ID NO: 1170225 - DNA, 16 bp, Homo sapiens
aaaattttgtgacatt

SEQ ID NO: 1170226 - DNA, 20 bp, Homo sapiens
aaaattttgtgacattcctt

SEQ ID NO: 1170227 - DNA, 21 bp, Homo sapiens
aaaattttgtgacattccttc

SEQ ID NO: 1170228 - DNA, 19 bp, Homo sapiens
aaaatttttgacacttttt

SEQ ID NO: 1170229 - DNA, 9 bp, Homo sapiens
aaacaaaaa

SEQ ID NO: 1170230 - DNA, 15 bp, Homo sapiens
aaaccacatgggctg

SEQ ID NO: 1170231 - DNA, 22 bp, Homo sapiens
aaaccacatgggctgggggcca

SEQ ID NO: 1170232 - DNA, 23 bp, Homo sapiens
aaaccaccagtgcccaaagtctg

SEQ ID NO: 1170233 - DNA, 19 bp, Homo sapiens
aaaccaccgtgaaccagag

SEQ ID NO: 1170234 - DNA, 16 bp, Homo sapiens
aaaccactgaaaaaat

SEQ ID NO: 1170235 - DNA, 18 bp, Homo sapiens
aaaccacttctctgctgc

SEQ ID NO: 1170236 - DNA, 17 bp, Homo sapiens
aaaccacttgcctgggg

SEQ ID NO: 1170237 - DNA, 15 bp, Homo sapiens
aaaccagccaggcag

SEQ ID NO: 1170238 - DNA, 16 bp, Homo sapiens
aaaccagccttcggag

SEQ ID NO: 1170239 - DNA, 22 bp, Homo sapiens
aaaccagctctgaacttccaag

SEQ ID NO: 1170240 - DNA, 13 bp, Homo sapiens
aaaccaggaaaaa

SEQ ID NO: 1170241 - DNA, 12 bp, Homo sapiens
aaaccagttacc

SEQ ID NO: 1170242 - DNA, 16 bp, Homo sapiens
aaaccagtttattctg

SEQ ID NO: 1170243 - DNA, 17 bp, Homo sapiens
aaaccatcagatatttc

SEQ ID NO: 1170244 - DNA, 16 bp, Homo sapiens
aaaccatcctgtttga

SEQ ID NO: 1170245 - DNA, 17 bp, Homo sapiens
aaaccatgagaatttgc

SEQ ID NO: 1170246 - DNA, 18 bp, Homo sapiens
aaaccattactgagggga

SEQ ID NO: 1170247 - DNA, 13 bp, Homo sapiens
aaaccattgcttc

SEQ ID NO: 1170248 - DNA, 18 bp, Homo sapiens
aaaccattggacagattt

SEQ ID NO: 1170249 - DNA, 22 bp, Homo sapiens
aaaccattggacagatttcagt

SEQ ID NO: 1170250 - DNA, 12 bp, Homo sapiens
aaaccattgtaa

SEQ ID NO: 1170251 - DNA, 23 bp, Homo sapiens
aaaccattttcccatcatccttt

SEQ ID NO: 1170252 - DNA, 16 bp, Homo sapiens
aaaccatttttgttac

SEQ ID NO: 1170253 - DNA, 21 bp, Homo sapiens
aaacccaagtttatttctctc

SEQ ID NO: 1170254 - DNA, 17 bp, Homo sapiens
aaacccaatcagatgcc

SEQ ID NO: 1170255 - DNA, 17 bp, Homo sapiens
aaacccacaagctgcct

SEQ ID NO: 1170256 - DNA, 19 bp, Homo sapiens
aaacccacttctggcctcc

SEQ ID NO: 1170257 - DNA, 15 bp, Homo sapiens
aaacccatacaatgt

SEQ ID NO: 1170258 - DNA, 21 bp, Homo sapiens
aaacccgttttatgatttact

SEQ ID NO: 1170259 - DNA, 17 bp, Homo sapiens
aaaccctagccttgctt

SEQ ID NO: 1170260 - DNA, 18 bp, Homo sapiens
aaaccctagccttgcttg

SEQ ID NO: 1170261 - DNA, 18 bp, Homo sapiens
aaaccctcattgtgtttc

SEQ ID NO: 1170262 - DNA, 12 bp, Homo sapiens
aaaccctgtctc

SEQ ID NO: 1170263 - DNA, 21 bp, Homo sapiens
aaaccctgtctctactaaaaa

SEQ ID NO: 1170264 - DNA, 16 bp, Homo sapiens
aaaccgaataaatgtt

SEQ ID NO: 1170265 - DNA, 20 bp, Homo sapiens
aaaccgagtagaaaatgtga

SEQ ID NO: 1170266 - DNA, 16 bp, Homo sapiens
aaaccgcctagtttac

SEQ ID NO: 1170267 - DNA, 20 bp, Homo sapiens
aaaccgcctagtttactgtt

SEQ ID NO: 1170268 - DNA, 16 bp, Homo sapiens
aaaccgctaaaagaaa

SEQ ID NO: 1170269 - DNA, 17 bp, Homo sapiens
aaacctaaaaaagatat

SEQ ID NO: 1170270 - DNA, 19 bp, Homo sapiens
aaacctagcttttaaaaaa

SEQ ID NO: 1170271 - DNA, 11 bp, Homo sapiens
aaacctaggtc

SEQ ID NO: 1170272 - DNA, 23 bp, Homo sapiens
aaacctcactgagaggcctggag

SEQ ID NO: 1170273 - DNA, 12 bp, Homo sapiens
aaacctcactgg

SEQ ID NO: 1170274 - DNA, 11 bp, Homo sapiens
aaacctcaggg

SEQ ID NO: 1170275 - DNA, 15 bp, Homo sapiens
aaacctcagggctgt

SEQ ID NO: 1170276 - DNA, 19 bp, Homo sapiens
aaacctcagggctgtccca

SEQ ID NO: 1170277 - DNA, 18 bp, Homo sapiens
aaacctccagcctccctg

SEQ ID NO: 1170278 - DNA, 17 bp, Homo sapiens
aaacctcctgctgtgcc

SEQ ID NO: 1170279 - DNA, 16 bp, Homo sapiens
aaacctgaaaaaaagt

SEQ ID NO: 1170280 - DNA, 12 bp, Homo sapiens
aaacctgaagat

SEQ ID NO: 1170281 - DNA, 16 bp, Homo sapiens
aaacctgaagatgtct

SEQ ID NO: 1170282 - DNA, 18 bp, Homo sapiens
aaacctgaagatgtctcc

SEQ ID NO: 1170283 - DNA, 14 bp, Homo sapiens
aaacctgatgttaa

SEQ ID NO: 1170284 - DNA, 16 bp, Homo sapiens
aaacctgcactgaaac

SEQ ID NO: 1170285 - DNA, 15 bp, Homo sapiens
aaacctgcatggtgt

SEQ ID NO: 1170286 - DNA, 19 bp, Homo sapiens
aaacctgcctttgtatgtg

SEQ ID NO: 1170287 - DNA, 21 bp, Homo sapiens
aaacctgcctttgtatgtgga

SEQ ID NO: 1170288 - DNA, 13 bp, Homo sapiens
aaacctgcttcct

SEQ ID NO: 1170289 - DNA, 14 bp, Homo sapiens
aaacctgcttcctt

SEQ ID NO: 1170290 - DNA, 16 bp, Homo sapiens
aaacctggagctgagg

SEQ ID NO: 1170291 - DNA, 15 bp, Homo sapiens
aaacctggatgtcac

SEQ ID NO: 1170292 - DNA, 17 bp, Homo sapiens
aaacctgggctcagcct

SEQ ID NO: 1170293 - DNA, 16 bp, Homo sapiens
aaacctgtagaatcaa

SEQ ID NO: 1170294 - DNA, 18 bp, Homo sapiens
aaacctgtctccactgtg

SEQ ID NO: 1170295 - DNA, 13 bp, Homo sapiens
aaaccttaagtgc

SEQ ID NO: 1170296 - DNA, 21 bp, Homo sapiens
aaaccttaatatttcttcaaa

SEQ ID NO: 1170297 - DNA, 12 bp, Homo sapiens
aaaccttcctgg

SEQ ID NO: 1170298 - DNA, 13 bp, Homo sapiens
aaaccttcctggg

SEQ ID NO: 1170299 - DNA, 15 bp, Homo sapiens
aaaccttgtaaaaaa

SEQ ID NO: 1170300 - DNA, 17 bp, Homo sapiens
aaaccttgtaaaaaaag

SEQ ID NO: 1170301 - DNA, 20 bp, Homo sapiens
aaaccttgtaaaaaaagcaa

SEQ ID NO: 1170302 - DNA, 12 bp, Homo sapiens
aaacctttcccc

SEQ ID NO: 1170303 - DNA, 15 bp, Homo sapiens
aaaccttttattata

SEQ ID NO: 1170304 - DNA, 18 bp, Homo sapiens
aaacgaagccatctttct

SEQ ID NO: 1170305 - DNA, 19 bp, Homo sapiens
aaacgaagccatctttctt

SEQ ID NO: 1170306 - DNA, 21 bp, Homo sapiens
aaacgaagtctttttcatttt

SEQ ID NO: 1170307 - DNA, 18 bp, Homo sapiens
aaacgactaacctatcta

SEQ ID NO: 1170308 - DNA, 22 bp, Homo sapiens
aaacgactaacctatctatgaa

SEQ ID NO: 1170309 - DNA, 16 bp, Homo sapiens
aaacgactcaaaatga

SEQ ID NO: 1170310 - DNA, 18 bp, Homo sapiens
aaacgactcaaaatgaca

SEQ ID NO: 1170311 - DNA, 21 bp, Homo sapiens
aaacgactcaaaatgacagtt

SEQ ID NO: 1170312 - DNA, 23 bp, Homo sapiens
aaacgagggctgatggaggaaaa

SEQ ID NO: 1170313 - DNA, 16 bp, Homo sapiens
aaacgcacttacaagt

SEQ ID NO: 1170314 - DNA, 19 bp, Homo sapiens
aaacgcacttacaagtggt

SEQ ID NO: 1170315 - DNA, 17 bp, Homo sapiens
aaacgcgtctgcctggg

SEQ ID NO: 1170316 - DNA, 22 bp, Homo sapiens
aaacgctaaagagcccttgcct

SEQ ID NO: 1170317 - DNA, 12 bp, Homo sapiens
aaacgctacctc

SEQ ID NO: 1170318 - DNA, 21 bp, Homo sapiens
aaacgctacctctctgtccct

SEQ ID NO: 1170319 - DNA, 14 bp, Homo sapiens
aaacgctcctttgt

SEQ ID NO: 1170320 - DNA, 19 bp, Homo sapiens
aggcccagcctgtcctggt

SEQ ID NO: 1170321 - DNA, 21 bp, Homo sapiens
aggcccagcctgtcctggtac

SEQ ID NO: 1170322 - DNA, 15 bp, Homo sapiens
aggcccagctgctcc

SEQ ID NO: 1170323 - DNA, 21 bp, Homo sapiens
aggcccaggatatttctgaga

SEQ ID NO: 1170324 - DNA, 13 bp, Homo sapiens
aggcccaggcacc

SEQ ID NO: 1170325 - DNA, 18 bp, Homo sapiens
aggcccaggcaccaccag

SEQ ID NO: 1170326 - DNA, 12 bp, Homo sapiens
aggcccaggcca

SEQ ID NO: 1170327 - DNA, 22 bp, Homo sapiens
aggcccaggccagcccccccac

SEQ ID NO: 1170328 - DNA, 17 bp, Homo sapiens
aggcccaggcctgggtt

SEQ ID NO: 1170329 - DNA, 12 bp, Homo sapiens
aggcccagggag

SEQ ID NO: 1170330 - DNA, 17 bp, Homo sapiens
aggcccagggaggcagc

SEQ ID NO: 1170331 - DNA, 20 bp, Homo sapiens
aggcccagggaggcagcgtg

SEQ ID NO: 1170332 - DNA, 19 bp, Homo sapiens
aggcccagtgcatatgcaa

SEQ ID NO: 1170333 - DNA, 18 bp, Homo sapiens
aggcccatctcaggtgcc

SEQ ID NO: 1170334 - DNA, 19 bp, Homo sapiens
aggcccatctcaggtgcca

SEQ ID NO: 1170335 - DNA, 20 bp, Homo sapiens
aggcccatctcaggtgccac

SEQ ID NO: 1170336 - DNA, 21 bp, Homo sapiens
aggcccatctcaggtgccact

SEQ ID NO: 1170337 - DNA, 16 bp, Homo sapiens
aggcccatgccccctt

SEQ ID NO: 1170338 - DNA, 17 bp, Homo sapiens
aggcccatgcccccttc

SEQ ID NO: 1170339 - DNA, 22 bp, Homo sapiens
aggcccatgcccccttcgctcc

SEQ ID NO: 1170340 - DNA, 21 bp, Homo sapiens
aggccccaaaaccacagccct

SEQ ID NO: 1170341 - DNA, 13 bp, Homo sapiens
aggccccacgccc

SEQ ID NO: 1170342 - DNA, 13 bp, Homo sapiens
aggccccagacag

SEQ ID NO: 1170343 - DNA, 13 bp, Homo sapiens
aggccccagagac

SEQ ID NO: 1170344 - DNA, 14 bp, Homo sapiens
aggccccagcctcc

SEQ ID NO: 1170345 - DNA, 18 bp, Homo sapiens
aggccccagggacagagg

SEQ ID NO: 1170346 - DNA, 20 bp, Homo sapiens
aggccccagggacagaggcc

SEQ ID NO: 1170347 - DNA, 18 bp, Homo sapiens
aggcccccagcccagggc

SEQ ID NO: 1170348 - DNA, 13 bp, Homo sapiens
aggcccccagtgg

SEQ ID NO: 1170349 - DNA, 14 bp, Homo sapiens
aggcccccagtggg

SEQ ID NO: 1170350 - DNA, 20 bp, Homo sapiens
aggccccccagaaagctgcc

SEQ ID NO: 1170351 - DNA, 21 bp, Homo sapiens
aggccccccagaaagctgcca

SEQ ID NO: 1170352 - DNA, 21 bp, Homo sapiens
aggcctgaaagaggctgaggc

SEQ ID NO: 1170353 - DNA, 23 bp, Homo sapiens
aggcctgaaagaggctgaggcct

SEQ ID NO: 1170354 - DNA, 23 bp, Homo sapiens
aggcctgaatcatgagcctgctg

SEQ ID NO: 1170355 - DNA, 14 bp, Homo sapiens
aggcctgacccacg

SEQ ID NO: 1170356 - DNA, 16 bp, Homo sapiens
aggcctgacttctgct

SEQ ID NO: 1170357 - DNA, 12 bp, Homo sapiens
aggcctgagaat

SEQ ID NO: 1170358 - DNA, 16 bp, Homo sapiens
aggcctgaggatgagc

SEQ ID NO: 1170359 - DNA, 20 bp, Homo sapiens
aggcctgaggatgagctgga

SEQ ID NO: 1170360 - DNA, 20 bp, Homo sapiens
aggcctgatcttgcctgtct

SEQ ID NO: 1170361 - DNA, 19 bp, Homo sapiens
aggcctgcaaaccttcctg

SEQ ID NO: 1170362 - DNA, 18 bp, Homo sapiens
aggcctgcagacagacct

SEQ ID NO: 1170363 - DNA, 12 bp, Homo sapiens
aggcctgccctc

SEQ ID NO: 1170364 - DNA, 17 bp, Homo sapiens
aggcctgccctcaggga

SEQ ID NO: 1170365 - DNA, 18 bp, Homo sapiens
aggcctgctgccagtgca

SEQ ID NO: 1170366 - DNA, 22 bp, Homo sapiens
aggcctgctgccagtgcagcca

SEQ ID NO: 1170367 - DNA, 19 bp, Homo sapiens
aggcctgctggcatcaggt

SEQ ID NO: 1170368 - DNA, 20 bp, Homo sapiens
aggcctggaaccagggagga

SEQ ID NO: 1170369 - DNA, 13 bp, Homo sapiens
aggcctggaccga

SEQ ID NO: 1170370 - DNA, 21 bp, Homo sapiens
aggcctggacgggccctcctt

SEQ ID NO: 1170371 - DNA, 17 bp, Homo sapiens
aggcctggactttcctg

SEQ ID NO: 1170372 - DNA, 11 bp, Homo sapiens
aggcctggcca

SEQ ID NO: 1170373 - DNA, 15 bp, Homo sapiens
aggcctggccaggca

SEQ ID NO: 1170374 - DNA, 18 bp, Homo sapiens
aggcctggcctcgcctgc

SEQ ID NO: 1170375 - DNA, 19 bp, Homo sapiens
aggcctggcctcgcctgcc

SEQ ID NO: 1170376 - DNA, 12 bp, Homo sapiens
aggcctggctcc

SEQ ID NO: 1170377 - DNA, 13 bp, Homo sapiens
aggcctggctgga

SEQ ID NO: 1170378 - DNA, 16 bp, Homo sapiens
aggcctgggacccagc

SEQ ID NO: 1170379 - DNA, 16 bp, Homo sapiens
aggcctgggatgcagt

SEQ ID NO: 1170380 - DNA, 14 bp, Homo sapiens
aggcctgggcagga

SEQ ID NO: 1170381 - DNA, 17 bp, Homo sapiens
aggcctgggcaggaccc

SEQ ID NO: 1170382 - DNA, 22 bp, Homo sapiens
aggcctgggcaggaccctgctg

SEQ ID NO: 1170383 - DNA, 20 bp, Homo sapiens
aggcctgggccgctgccacg

SEQ ID NO: 1170384 - DNA, 18 bp, Homo sapiens
aggcctggggaggcccta

SEQ ID NO: 1170385 - DNA, 15 bp, Homo sapiens
aggcctggggtggga

SEQ ID NO: 1170386 - DNA, 12 bp, Homo sapiens
aggcctgggtgc

SEQ ID NO: 1170387 - DNA, 17 bp, Homo sapiens
aggcctgggtgctggct

SEQ ID NO: 1170388 - DNA, 23 bp, Homo sapiens
aggcctgggtgctggctgcccag

SEQ ID NO: 1170389 - DNA, 23 bp, Homo sapiens
aggcctgggtttgtacttccacc

SEQ ID NO: 1170390 - DNA, 17 bp, Homo sapiens
aggcctggtgtttcttg

SEQ ID NO: 1170391 - DNA, 15 bp, Homo sapiens
aggcctgtccaccct

SEQ ID NO: 1170392 - DNA, 23 bp, Homo sapiens
aggcctgtgtgtgaaaggaagct

SEQ ID NO: 1170393 - DNA, 18 bp, Homo sapiens
aggcctgtttggcctctc

SEQ ID NO: 1170394 - DNA, 17 bp, Homo sapiens
aggccttacatctggct

SEQ ID NO: 1170395 - DNA, 20 bp, Homo sapiens
aggccttatcattcattctt

SEQ ID NO: 1170396 - DNA, 18 bp, Homo sapiens
aggccttcctctctccag

SEQ ID NO: 1170397 - DNA, 13 bp, Homo sapiens
aggccttctcctc

SEQ ID NO: 1170398 - DNA, 22 bp, Homo sapiens
aggccttctcctccccacccgc

SEQ ID NO: 1170399 - DNA, 19 bp, Homo sapiens
aggccttctcttgaggcct

SEQ ID NO: 1170400 - DNA, 15 bp, Homo sapiens
aggccttctgtgggg

SEQ ID NO: 1170401 - DNA, 17 bp, Homo sapiens
aggccttctgtggggct

SEQ ID NO: 1170402 - DNA, 22 bp, Homo sapiens
aggccttctgtggggctgggca

SEQ ID NO: 1170403 - DNA, 23 bp, Homo sapiens
aggccttctgtggggctgggcac

SEQ ID NO: 1170404 - DNA, 15 bp, Homo sapiens
aggccttgcctggcc

SEQ ID NO: 1170405 - DNA, 18 bp, Homo sapiens
aggccttgcctggcctga

SEQ ID NO: 1170406 - DNA, 22 bp, Homo sapiens
aggccttgctgactctctgagc

SEQ ID NO: 1170407 - DNA, 21 bp, Homo sapiens
aggccttgctggggtccaggg

SEQ ID NO: 1170408 - DNA, 23 bp, Homo sapiens
aggccttggggtgggggccaggc

SEQ ID NO: 1170409 - DNA, 22 bp, Homo sapiens
aggccttggtggagcagccaga

SEQ ID NO: 1170410 - DNA, 17 bp, Homo sapiens
aggccttgtgtgtcagg

SEQ ID NO: 1170411 - DNA, 21 bp, Homo sapiens
aggccttgtgtgtcaggccct

SEQ ID NO: 1170412 - DNA, 13 bp, Homo sapiens
aggcctttcttct

SEQ ID NO: 1170413 - DNA, 14 bp, Homo sapiens
aggcctttcttctg

SEQ ID NO: 1170414 - DNA, 22 bp, Homo sapiens
aggcgaccaccgcccctggccg

SEQ ID NO: 1170415 - DNA, 20 bp, Homo sapiens
aggcgcagaggtcccagccc

SEQ ID NO: 1170416 - DNA, 13 bp, Homo sapiens
aggcgcagggaca

SEQ ID NO: 1170417 - DNA, 19 bp, Homo sapiens
aggcgcagggacatggggc

SEQ ID NO: 1170418 - DNA, 21 bp, Homo sapiens
aggcgcagtgcttctctacag

SEQ ID NO: 1170419 - DNA, 14 bp, Homo sapiens
aggcgcccccgccc

SEQ ID NO: 1170420 - DNA, 18 bp, Homo sapiens
aggcgcccccgccccagg

SEQ ID NO: 1170421 - DNA, 20 bp, Homo sapiens
aggcgcccccgccccaggct

SEQ ID NO: 1170422 - DNA, 15 bp, Homo sapiens
aggcgcctgccttgg

SEQ ID NO: 1170423 - DNA, 19 bp, Homo sapiens
aggcgcggcggctctgccc

SEQ ID NO: 1170424 - DNA, 22 bp, Homo sapiens
aggcgcgtctgccccaccctca

SEQ ID NO: 1170425 - DNA, 17 bp, Homo sapiens
aggcgcgtttgtgcata

SEQ ID NO: 1170426 - DNA, 14 bp, Homo sapiens
aggcgctaatttat

SEQ ID NO: 1170427 - DNA, 19 bp, Homo sapiens
aggcgctgagactgtgctg

SEQ ID NO: 1170428 - DNA, 13 bp, Homo sapiens
aggcgctgggtgc

SEQ ID NO: 1170429 - DNA, 17 bp, Homo sapiens
aggcgctgggtgcctgc

SEQ ID NO: 1170430 - DNA, 19 bp, Homo sapiens
aggcggacaaagttcagtg

SEQ ID NO: 1170431 - DNA, 20 bp, Homo sapiens
aggcggagagtacagtgagc

SEQ ID NO: 1170432 - DNA, 20 bp, Homo sapiens
aggcggaggttgcagtgagc

SEQ ID NO: 1170433 - DNA, 13 bp, Homo sapiens
aggcggccagggc

SEQ ID NO: 1170434 - DNA, 14 bp, Homo sapiens
aggcggccagggcg

SEQ ID NO: 1170435 - DNA, 16 bp, Homo sapiens
aggcggccagggcggc

SEQ ID NO: 1170436 - DNA, 18 bp, Homo sapiens
aggcggccagggcggcca

SEQ ID NO: 1170437 - DNA, 15 bp, Homo sapiens
aggcggccctcagtg

SEQ ID NO: 1170438 - DNA, 18 bp, Homo sapiens
aggcggccctcagtgcat

SEQ ID NO: 1170439 - DNA, 16 bp, Homo sapiens
aggcggctcctcctca

SEQ ID NO: 1170440 - DNA, 15 bp, Homo sapiens
aggcgggagatggac

SEQ ID NO: 1170441 - DNA, 20 bp, Homo sapiens
aggcgggaggaggtgtgagg

SEQ ID NO: 1170442 - DNA, 13 bp, Homo sapiens
aggcgggccagcc

SEQ ID NO: 1170443 - DNA, 15 bp, Homo sapiens
aggcgggccagccag

SEQ ID NO: 1170444 - DNA, 21 bp, Homo sapiens
aggcgggccagccaggcgggc

SEQ ID NO: 1170445 - DNA, 15 bp, Homo sapiens
aggcgggcggtcagg

SEQ ID NO: 1170446 - DNA, 12 bp, Homo sapiens
aggcggggagga

SEQ ID NO: 1170447 - DNA, 13 bp, Homo sapiens
aggcggggaggag

SEQ ID NO: 1170448 - DNA, 19 bp, Homo sapiens
aggcggggtattcccactc

SEQ ID NO: 1170449 - DNA, 17 bp, Homo sapiens
aggcggtcatgtgtgca

SEQ ID NO: 1170450 - DNA, 22 bp, Homo sapiens
aaactgtaaataaaatgtgtac

SEQ ID NO: 1170451 - DNA, 18 bp, Homo sapiens
aaactgtacagtgtcttt

SEQ ID NO: 1170452 - DNA, 13 bp, Homo sapiens
aaactgtactgtg

SEQ ID NO: 1170453 - DNA, 20 bp, Homo sapiens
aaactgtagcgaccccagac

SEQ ID NO: 1170454 - DNA, 22 bp, Homo sapiens
aaactgtagcgaccccagactg

SEQ ID NO: 1170455 - DNA, 16 bp, Homo sapiens
aaactgtgaaaatagt

SEQ ID NO: 1170456 - DNA, 18 bp, Homo sapiens
aaactgtgaaaatagtgt

SEQ ID NO: 1170457 - DNA, 22 bp, Homo sapiens
aaactgtgaaaatagtgtaaga

SEQ ID NO: 1170458 - DNA, 22 bp, Homo sapiens
aaactgtgactaggcatacact

SEQ ID NO: 1170459 - DNA, 14 bp, Homo sapiens
aaactgtgcaatcc

SEQ ID NO: 1170460 - DNA, 13 bp, Homo sapiens
aaactgtgtaaac

SEQ ID NO: 1170461 - DNA, 15 bp, Homo sapiens
aaactgtgtatcatt

SEQ ID NO: 1170462 - DNA, 17 bp, Homo sapiens
aaactgtgtatcattaa

SEQ ID NO: 1170463 - DNA, 23 bp, Homo sapiens
aaactgtgtatcattaaaatata

SEQ ID NO: 1170464 - DNA, 18 bp, Homo sapiens
aaactgtgtattccaaga

SEQ ID NO: 1170465 - DNA, 15 bp, Homo sapiens
aaactgtgttgccac

SEQ ID NO: 1170466 - DNA, 22 bp, Homo sapiens
aaactgttaacttattcaaaga

SEQ ID NO: 1170467 - DNA, 19 bp, Homo sapiens
aaactgttagcactgttga

SEQ ID NO: 1170468 - DNA, 21 bp, Homo sapiens
aaactgttagcactgttgatg

SEQ ID NO: 1170469 - DNA, 20 bp, Homo sapiens
aaactgttcccacctgctgg

SEQ ID NO: 1170470 - DNA, 23 bp, Homo sapiens
aaactgtttgaaaacttcagaag

SEQ ID NO: 1170471 - DNA, 17 bp, Homo sapiens
aaacttaaaaaaaaaat

SEQ ID NO: 1170472 - DNA, 15 bp, Homo sapiens
aaacttaaagcaaaa

SEQ ID NO: 1170473 - DNA, 19 bp, Homo sapiens
aggctgcatgctctggaag

SEQ ID NO: 1170474 - DNA, 17 bp, Homo sapiens
aggctgccccaggccgg

SEQ ID NO: 1170475 - DNA, 19 bp, Homo sapiens
aggctgccccaggccggag

SEQ ID NO: 1170476 - DNA, 24 bp, Homo sapiens
aggctgccccaggccggagcccag

SEQ ID NO: 1170477 - DNA, 15 bp, Homo sapiens
aggctgcccccatcc

SEQ ID NO: 1170478 - DNA, 21 bp, Homo sapiens
aggctgcccccatccagccac

SEQ ID NO: 1170479 - DNA, 12 bp, Homo sapiens
aggctgcccctc

SEQ ID NO: 1170480 - DNA, 18 bp, Homo sapiens
aggctgcctcggactcca

SEQ ID NO: 1170481 - DNA, 16 bp, Homo sapiens
aggctgcgtccctccg

SEQ ID NO: 1170482 - DNA, 20 bp, Homo sapiens
aggctgcgtccctccgagct

SEQ ID NO: 1170483 - DNA, 14 bp, Homo sapiens
aggctgctggagtg

SEQ ID NO: 1170484 - DNA, 20 bp, Homo sapiens
aggctgctggcttcagggag

SEQ ID NO: 1170485 - DNA, 20 bp, Homo sapiens
aggctgctggggcctcagac

SEQ ID NO: 1170486 - DNA, 22 bp, Homo sapiens
aggctgctggggcctcagacga

SEQ ID NO: 1170487 - DNA, 13 bp, Homo sapiens
aggctgcttggga

SEQ ID NO: 1170488 - DNA, 14 bp, Homo sapiens
aggctggaaatggt

SEQ ID NO: 1170489 - DNA, 15 bp, Homo sapiens
aggctggagaccccc

SEQ ID NO: 1170490 - DNA, 21 bp, Homo sapiens
aggctggagactggaccgctg

SEQ ID NO: 1170491 - DNA, 12 bp, Homo sapiens
aggctggagctg

SEQ ID NO: 1170492 - DNA, 14 bp, Homo sapiens
aggctggagctggc

SEQ ID NO: 1170493 - DNA, 18 bp, Homo sapiens
aggctggagctggcgtct

SEQ ID NO: 1170494 - DNA, 15 bp, Homo sapiens
aggctggaggcaggg

SEQ ID NO: 1170495 - DNA, 17 bp, Homo sapiens
aggctggaggcagggcc

SEQ ID NO: 1170496 - DNA, 19 bp, Homo sapiens
aggctggaggcagggcctt

SEQ ID NO: 1170497 - DNA, 23 bp, Homo sapiens
aggctggaggcagggccttgccc

SEQ ID NO: 1170498 - DNA, 11 bp, Homo sapiens
aggctggagtg

SEQ ID NO: 1170499 - DNA, 18 bp, Homo sapiens
aggctggagtgcaatggt

SEQ ID NO: 1170500 - DNA, 22 bp, Homo sapiens
aggctggagtgcaatggtgtga

SEQ ID NO: 1170501 - DNA, 15 bp, Homo sapiens
aggctggagtgcagt

SEQ ID NO: 1170502 - DNA, 17 bp, Homo sapiens
aggctggagtgcagtgg

SEQ ID NO: 1170503 - DNA, 20 bp, Homo sapiens
aggctggagtgcagtggcac

SEQ ID NO: 1170504 - DNA, 20 bp, Homo sapiens
aggctggatggcacctcagg

SEQ ID NO: 1170505 - DNA, 14 bp, Homo sapiens
aggctggcacagga

SEQ ID NO: 1170506 - DNA, 19 bp, Homo sapiens
aggctggccagtccaggct

SEQ ID NO: 1170507 - DNA, 14 bp, Homo sapiens
aggctggcgcagcc

SEQ ID NO: 1170508 - DNA, 20 bp, Homo sapiens
aggctggcgcagccaaggcc

SEQ ID NO: 1170509 - DNA, 22 bp, Homo sapiens
aggctggcgcagccaaggccga

SEQ ID NO: 1170510 - DNA, 19 bp, Homo sapiens
aggctggctccagatgcag

SEQ ID NO: 1170511 - DNA, 15 bp, Homo sapiens
aggctggctgagtgg

SEQ ID NO: 1170512 - DNA, 17 bp, Homo sapiens
aggctggctttcagagt

SEQ ID NO: 1170513 - DNA, 14 bp, Homo sapiens
aggctgggagtccc

SEQ ID NO: 1170514 - DNA, 19 bp, Homo sapiens
aggctgggagtccctacct

SEQ ID NO: 1170515 - DNA, 22 bp, Homo sapiens
aggctgggagtccctacctgct

SEQ ID NO: 1170516 - DNA, 10 bp, Homo sapiens
aggctgggcc

SEQ ID NO: 1170517 - DNA, 20 bp, Homo sapiens
aggctgggccatgtccaaag

SEQ ID NO: 1170518 - DNA, 12 bp, Homo sapiens
aggctgggcccc

SEQ ID NO: 1170519 - DNA, 15 bp, Homo sapiens
aggctgggcccctgg

SEQ ID NO: 1170520 - DNA, 22 bp, Homo sapiens
aggctgggccgcaagggcctgg

SEQ ID NO: 1170521 - DNA, 16 bp, Homo sapiens
aggctggggaggccag

SEQ ID NO: 1170522 - DNA, 17 bp, Homo sapiens
aggctggggaggtgctg

SEQ ID NO: 1170523 - DNA, 17 bp, Homo sapiens
aggctgggggagagccg

SEQ ID NO: 1170524 - DNA, 20 bp, Homo sapiens
aggctgggtaatgtgaaggc

SEQ ID NO: 1170525 - DNA, 17 bp, Homo sapiens
aggctgggtcaaaagag

SEQ ID NO: 1170526 - DNA, 16 bp, Homo sapiens
aggctggtctcaaact

SEQ ID NO: 1170527 - DNA, 20 bp, Homo sapiens
aggctggtctcaaactcctg

SEQ ID NO: 1170528 - DNA, 21 bp, Homo sapiens
aggctggtctcaaactcctgg

SEQ ID NO: 1170529 - DNA, 21 bp, Homo sapiens
aggctggtctcgaactcctga

SEQ ID NO: 1170530 - DNA, 23 bp, Homo sapiens
aggctggtgctgtggccagggtg

SEQ ID NO: 1170531 - DNA, 20 bp, Homo sapiens
aggctggtggagaactctgg

SEQ ID NO: 1170532 - DNA, 16 bp, Homo sapiens
aggctggtggcccagg

SEQ ID NO: 1170533 - DNA, 16 bp, Homo sapiens
aggctggtggccttgg

SEQ ID NO: 1170534 - DNA, 19 bp, Homo sapiens
aggctggtggttttcagag

SEQ ID NO: 1170535 - DNA, 21 bp, Homo sapiens
aggctggttttggcatctctg

SEQ ID NO: 1170536 - DNA, 17 bp, Homo sapiens
aggctgtaactgagaga

SEQ ID NO: 1170537 - DNA, 20 bp, Homo sapiens
aggctgtcacagtcctgagt

SEQ ID NO: 1170538 - DNA, 19 bp, Homo sapiens
aggctgtctgtgccatggc

SEQ ID NO: 1170539 - DNA, 14 bp, Homo sapiens
aggctgtgctccgc

SEQ ID NO: 1170540 - DNA, 16 bp, Homo sapiens
aggctgtgctgccctg

SEQ ID NO: 1170541 - DNA, 17 bp, Homo sapiens
aggctgtgctgccctga

SEQ ID NO: 1170542 - DNA, 21 bp, Homo sapiens
aggctgtgctgccctgaagaa

SEQ ID NO: 1170543 - DNA, 14 bp, Homo sapiens
aggctgtggagaga

SEQ ID NO: 1170544 - DNA, 17 bp, Homo sapiens
aggctgtggctggtgag

SEQ ID NO: 1170545 - DNA, 13 bp, Homo sapiens
aggctgtgggact

SEQ ID NO: 1170546 - DNA, 18 bp, Homo sapiens
aggctgtgggcctcaagg

SEQ ID NO: 1170547 - DNA, 13 bp, Homo sapiens
aggctgtggggtg

SEQ ID NO: 1170548 - DNA, 15 bp, Homo sapiens
aggctgtggggtggg

SEQ ID NO: 1170549 - DNA, 16 bp, Homo sapiens
aggctgtggtcacagc

SEQ ID NO: 1170550 - DNA, 19 bp, Homo sapiens
aggctgtgtaagatttgtt

SEQ ID NO: 1170551 - DNA, 22 bp, Homo sapiens
aggctgtgtccctcttctcttc

SEQ ID NO: 1170552 - DNA, 16 bp, Homo sapiens
aggctgtgtctctgcc

SEQ ID NO: 1170553 - DNA, 14 bp, Homo sapiens
aggctgtgtggcca

SEQ ID NO: 1170554 - DNA, 18 bp, Homo sapiens
aggctgtgtggccaacca

SEQ ID NO: 1170555 - DNA, 20 bp, Homo sapiens
aggctgtgtggccaaccagg

SEQ ID NO: 1170556 - DNA, 19 bp, Homo sapiens
aggctgttaaatacaggaa

SEQ ID NO: 1170557 - DNA, 23 bp, Homo sapiens
aggctgttaaatacaggaaacag

SEQ ID NO: 1170558 - DNA, 17 bp, Homo sapiens
aggctgttattatgaag

SEQ ID NO: 1170559 - DNA, 19 bp, Homo sapiens
aggctgttattatgaagga

SEQ ID NO: 1170560 - DNA, 14 bp, Homo sapiens
aggctgttcccttt

SEQ ID NO: 1170561 - DNA, 23 bp, Homo sapiens
aggctgttctcgaactcctgacc

SEQ ID NO: 1170562 - DNA, 21 bp, Homo sapiens
aggctgttggttcaaactttt

SEQ ID NO: 1170563 - DNA, 23 bp, Homo sapiens
aggcttaagaactgcttcatgtg

SEQ ID NO: 1170564 - DNA, 15 bp, Homo sapiens
aggcttaggtgccag

SEQ ID NO: 1170565 - DNA, 17 bp, Homo sapiens
aggcttaggtgccaggc

SEQ ID NO: 1170566 - DNA, 18 bp, Homo sapiens
aggcttaggtgccaggct

SEQ ID NO: 1170567 - DNA, 19 bp, Homo sapiens
aggcttataagttaaaaca

SEQ ID NO: 1170568 - DNA, 14 bp, Homo sapiens
aggcttatgagatc

SEQ ID NO: 1170569 - DNA, 12 bp, Homo sapiens
aggcttcaccct

SEQ ID NO: 1170570 - DNA, 14 bp, Homo sapiens
aggcttccagagag

SEQ ID NO: 1170571 - DNA, 12 bp, Homo sapiens
aggcttccaggc

SEQ ID NO: 1170572 - DNA, 20 bp, Homo sapiens
aggcttccaggctcttcctg

SEQ ID NO: 1170573 - DNA, 23 bp, Homo sapiens
aggcttccgtgtcctctccccca

SEQ ID NO: 1170574 - DNA, 15 bp, Homo sapiens
aggcttctattacct

SEQ ID NO: 1170575 - DNA, 14 bp, Homo sapiens
aggcttctccgcca

SEQ ID NO: 1170576 - DNA, 19 bp, Homo sapiens
aggcttctccgccagcctc

SEQ ID NO: 1170577 - DNA, 23 bp, Homo sapiens
aggcttcttcagatcagtgcttg

SEQ ID NO: 1170578 - DNA, 20 bp, Homo sapiens
aggcttgagggagggctggg

SEQ ID NO: 1170579 - DNA, 18 bp, Homo sapiens
aggcttgcataataagct

SEQ ID NO: 1170580 - DNA, 19 bp, Homo sapiens
aggcttggatggaacatgc

SEQ ID NO: 1170581 - DNA, 22 bp, Homo sapiens
aggcttggggaaaatggccatg

SEQ ID NO: 1170582 - DNA, 18 bp, Homo sapiens
aaagatttcttttcatta

SEQ ID NO: 1170583 - DNA, 18 bp, Homo sapiens
aaagattttaatcaagtt

SEQ ID NO: 1170584 - DNA, 12 bp, Homo sapiens
aaagattttatt

SEQ ID NO: 1170585 - DNA, 18 bp, Homo sapiens
aaagattttattgtataa

SEQ ID NO: 1170586 - DNA, 15 bp, Homo sapiens
aaagattttatttat

SEQ ID NO: 1170587 - DNA, 14 bp, Homo sapiens
aaagattttgtttt

SEQ ID NO: 1170588 - DNA, 13 bp, Homo sapiens
aaagattttttaa

SEQ ID NO: 1170589 - DNA, 16 bp, Homo sapiens
aaagcaaaaaagaaaa

SEQ ID NO: 1170590 - DNA, 17 bp, Homo sapiens
aaagcaaaaactcttgt

SEQ ID NO: 1170591 - DNA, 16 bp, Homo sapiens
aaagcaaaaatgacaa

SEQ ID NO: 1170592 - DNA, 14 bp, Homo sapiens
aaagcaaaacaaaa

SEQ ID NO: 1170593 - DNA, 19 bp, Homo sapiens
aaagcaaaacatctctgca

SEQ ID NO: 1170594 - DNA, 21 bp, Homo sapiens
aaagcaaaactcccaatggat

SEQ ID NO: 1170595 - DNA, 22 bp, Homo sapiens
agggacttcaggatcaagtcct

SEQ ID NO: 1170596 - DNA, 14 bp, Homo sapiens
agggacttgcctcc

SEQ ID NO: 1170597 - DNA, 14 bp, Homo sapiens
agggacttggctgt

SEQ ID NO: 1170598 - DNA, 16 bp, Homo sapiens
agggacttggctgtcc

SEQ ID NO: 1170599 - DNA, 22 bp, Homo sapiens
agggagaaacaagtggacctcg

SEQ ID NO: 1170600 - DNA, 18 bp, Homo sapiens
agggagaaggaagggcag

SEQ ID NO: 1170601 - DNA, 19 bp, Homo sapiens
agggagaaggaagggcaga

SEQ ID NO: 1170602 - DNA, 22 bp, Homo sapiens
agggagaaggatctagaatgtg

SEQ ID NO: 1170603 - DNA, 16 bp, Homo sapiens
agggagaatccaaggg

SEQ ID NO: 1170604 - DNA, 13 bp, Homo sapiens
agggagaatctga

SEQ ID NO: 1170605 - DNA, 13 bp, Homo sapiens
agggagaatgcag

SEQ ID NO: 1170606 - DNA, 21 bp, Homo sapiens
agggagaatggtgctgtttaa

SEQ ID NO: 1170607 - DNA, 20 bp, Homo sapiens
agggagacagggctgctccc

SEQ ID NO: 1170608 - DNA, 17 bp, Homo sapiens
agggagacatctgcacc

SEQ ID NO: 1170609 - DNA, 15 bp, Homo sapiens
agggagacggccctg

SEQ ID NO: 1170610 - DNA, 11 bp, Homo sapiens
agggagagaga

SEQ ID NO: 1170611 - DNA, 23 bp, Homo sapiens
agggagagagagagagagaggac

SEQ ID NO: 1170612 - DNA, 16 bp, Homo sapiens
agggagagggaagagg

SEQ ID NO: 1170613 - DNA, 13 bp, Homo sapiens
agggagaggtcac

SEQ ID NO: 1170614 - DNA, 21 bp, Homo sapiens
agggagaggttattcacaacc

SEQ ID NO: 1170615 - DNA, 22 bp, Homo sapiens
agggagatatttaagtataaaa

SEQ ID NO: 1170616 - DNA, 16 bp, Homo sapiens
agggagcaactctcca

SEQ ID NO: 1170617 - DNA, 15 bp, Homo sapiens
agggagcaagacaga

SEQ ID NO: 1170618 - DNA, 17 bp, Homo sapiens
agggagcaagacagaga

SEQ ID NO: 1170619 - DNA, 16 bp, Homo sapiens
agggagcacctgtctg

SEQ ID NO: 1170620 - DNA, 17 bp, Homo sapiens
agggagcagacaggagg

SEQ ID NO: 1170621 - DNA, 17 bp, Homo sapiens
agggagccatttgagag

SEQ ID NO: 1170622 - DNA, 20 bp, Homo sapiens
agggagcctagaagctggtg

SEQ ID NO: 1170623 - DNA, 19 bp, Homo sapiens
agggagcgaggtcagagga

SEQ ID NO: 1170624 - DNA, 18 bp, Homo sapiens
agggagcgatccagggga

SEQ ID NO: 1170625 - DNA, 19 bp, Homo sapiens
agggagcggccggccagcc

SEQ ID NO: 1170626 - DNA, 14 bp, Homo sapiens
agggagctctgggg

SEQ ID NO: 1170627 - DNA, 20 bp, Homo sapiens
agggagctgctggctgacct

SEQ ID NO: 1170628 - DNA, 22 bp, Homo sapiens
agggagcttcctggctctgggg

SEQ ID NO: 1170629 - DNA, 18 bp, Homo sapiens
agggagcttgccacactc

SEQ ID NO: 1170630 - DNA, 22 bp, Homo sapiens
agggagcttgccacactcttct

SEQ ID NO: 1170631 - DNA, 19 bp, Homo sapiens
agggaggaagaaggcagtg

SEQ ID NO: 1170632 - DNA, 13 bp, Homo sapiens
agggaggaagata

SEQ ID NO: 1170633 - DNA, 19 bp, Homo sapiens
agggaggaagatggctccc

SEQ ID NO: 1170634 - DNA, 22 bp, Homo sapiens
agggaggaaggcctttcttctg

SEQ ID NO: 1170635 - DNA, 22 bp, Homo sapiens
agggaggaatcgaggaaccaga

SEQ ID NO: 1170636 - DNA, 14 bp, Homo sapiens
agggaggagcagca

SEQ ID NO: 1170637 - DNA, 23 bp, Homo sapiens
agggaggaggccacctctccaag

SEQ ID NO: 1170638 - DNA, 14 bp, Homo sapiens
agggaggagtggag

SEQ ID NO: 1170639 - DNA, 14 bp, Homo sapiens
agggaggcaagccc

SEQ ID NO: 1170640 - DNA, 16 bp, Homo sapiens
agggaggcaagccctg

SEQ ID NO: 1170641 - DNA, 13 bp, Homo sapiens
agggaggcagcgt

SEQ ID NO: 1170642 - DNA, 21 bp, Homo sapiens
agggaggcagcgtgggctctg

SEQ ID NO: 1170643 - DNA, 13 bp, Homo sapiens
agggaggcagggg

SEQ ID NO: 1170644 - DNA, 12 bp, Homo sapiens
agggaggcgcag

SEQ ID NO: 1170645 - DNA, 14 bp, Homo sapiens
agggaggcgcaggg

SEQ ID NO: 1170646 - DNA, 14 bp, Homo sapiens
agggaggcggggag

SEQ ID NO: 1170647 - DNA, 23 bp, Homo sapiens
agggaggcgtcttcatctccctg

SEQ ID NO: 1170648 - DNA, 17 bp, Homo sapiens
agggaggctgggcgggt

SEQ ID NO: 1170649 - DNA, 13 bp, Homo sapiens
agggagggaaggg

SEQ ID NO: 1170650 - DNA, 17 bp, Homo sapiens
agggagggaagggccac

SEQ ID NO: 1170651 - DNA, 18 bp, Homo sapiens
agggagggaagggccacc

SEQ ID NO: 1170652 - DNA, 22 bp, Homo sapiens
agggagggaagggccaccctgc

SEQ ID NO: 1170653 - DNA, 15 bp, Homo sapiens
agggagggaagggga

SEQ ID NO: 1170654 - DNA, 13 bp, Homo sapiens
agggagggaagtc

SEQ ID NO: 1170655 - DNA, 22 bp, Homo sapiens
agggagggagccatggaaggtg

SEQ ID NO: 1170656 - DNA, 17 bp, Homo sapiens
agggagggcagctggcc

SEQ ID NO: 1170657 - DNA, 17 bp, Homo sapiens
agggagggcagttttct

SEQ ID NO: 1170658 - DNA, 15 bp, Homo sapiens
agggagggccaggga

SEQ ID NO: 1170659 - DNA, 17 bp, Homo sapiens
agggagggccagggagg

SEQ ID NO: 1170660 - DNA, 17 bp, Homo sapiens
agggaggggaaatgtaa

SEQ ID NO: 1170661 - DNA, 13 bp, Homo sapiens
agggaggggaagg

SEQ ID NO: 1170662 - DNA, 16 bp, Homo sapiens
agggaggggaaggggc

SEQ ID NO: 1170663 - DNA, 17 bp, Homo sapiens
agggaggggacagaggc

SEQ ID NO: 1170664 - DNA, 22 bp, Homo sapiens
agggaggggccggctggcctgg

SEQ ID NO: 1170665 - DNA, 11 bp, Homo sapiens
agggaggggct

SEQ ID NO: 1170666 - DNA, 23 bp, Homo sapiens
agggaggggctggggcaggctct

SEQ ID NO: 1170667 - DNA, 21 bp, Homo sapiens
agggagggggcgctcaggacc

SEQ ID NO: 1170668 - DNA, 21 bp, Homo sapiens
agggagggtgcagccctcttg

SEQ ID NO: 1170669 - DNA, 18 bp, Homo sapiens
agggagggttagcctgca

SEQ ID NO: 1170670 - DNA, 20 bp, Homo sapiens
agggagggttagcctgcacc

SEQ ID NO: 1170671 - DNA, 20 bp, Homo sapiens
agggaggtcactggaaaggg

SEQ ID NO: 1170672 - DNA, 20 bp, Homo sapiens
agggaggtgtttaaagagag

SEQ ID NO: 1170673 - DNA, 18 bp, Homo sapiens
agggaggtttgtgagagc

SEQ ID NO: 1170674 - DNA, 16 bp, Homo sapiens
agggagtacctgctgc

SEQ ID NO: 1170675 - DNA, 19 bp, Homo sapiens
agggagtacctgctgcccc

SEQ ID NO: 1170676 - DNA, 16 bp, Homo sapiens
agggagtcccctcccc

SEQ ID NO: 1170677 - DNA, 16 bp, Homo sapiens
agggagtctcaggagg

SEQ ID NO: 1170678 - DNA, 22 bp, Homo sapiens
agggagtgatgatttgggggag

SEQ ID NO: 1170679 - DNA, 15 bp, Homo sapiens
agggagtgcagaaca

SEQ ID NO: 1170680 - DNA, 20 bp, Homo sapiens
agggagtgcagaacacctgg

SEQ ID NO: 1170681 - DNA, 23 bp, Homo sapiens
agggagtgctggctcacagtaca

SEQ ID NO: 1170682 - DNA, 14 bp, Homo sapiens
agggagttcatctg

SEQ ID NO: 1170683 - DNA, 21 bp, Homo sapiens
agggagtttaatacaggaaat

SEQ ID NO: 1170684 - DNA, 21 bp, Homo sapiens
agggagttttgtctgtctccc

SEQ ID NO: 1170685 - DNA, 14 bp, Homo sapiens
agggatacactgaa

SEQ ID NO: 1170686 - DNA, 16 bp, Homo sapiens
agggatacccagtgat

SEQ ID NO: 1170687 - DNA, 15 bp, Homo sapiens
agggatataaaaaca

SEQ ID NO: 1170688 - DNA, 23 bp, Homo sapiens
agggatataaaaacagattctga

SEQ ID NO: 1170689 - DNA, 15 bp, Homo sapiens
agggatatggcagga

SEQ ID NO: 1170690 - DNA, 20 bp, Homo sapiens
agggatatggcaggactcct

SEQ ID NO: 1170691 - DNA, 22 bp, Homo sapiens
agggatatggcaggactcctgg

SEQ ID NO: 1170692 - DNA, 15 bp, Homo sapiens
agggatattgcctta

SEQ ID NO: 1170693 - DNA, 22 bp, Homo sapiens
agggatcaaccagctaagaaaa

SEQ ID NO: 1170694 - DNA, 15 bp, Homo sapiens
agggatcacagggcc

SEQ ID NO: 1170695 - DNA, 19 bp, Homo sapiens
agggatctctagtttttgt

SEQ ID NO: 1170696 - DNA, 20 bp, Homo sapiens
agggatcttgcattcccagt

SEQ ID NO: 1170697 - DNA, 22 bp, Homo sapiens
agggatcttgcattcccagtgg

SEQ ID NO: 1170698 - DNA, 18 bp, Homo sapiens
agggatgaaggcctccct

SEQ ID NO: 1170699 - DNA, 17 bp, Homo sapiens
agggatgaagggcgagt

SEQ ID NO: 1170700 - DNA, 17 bp, Homo sapiens
agggatgagttgaggtg

SEQ ID NO: 1170701 - DNA, 19 bp, Homo sapiens
agggatgattcaagccatt

SEQ ID NO: 1170702 - DNA, 17 bp, Homo sapiens
agggatgcccccaggca

SEQ ID NO: 1170703 - DNA, 19 bp, Homo sapiens
agggatgcccccaggcagc

SEQ ID NO: 1170704 - DNA, 20 bp, Homo sapiens
agggatgcccccaggcagcc

SEQ ID NO: 1170705 - DNA, 15 bp, Homo sapiens
agggatgccctggag

SEQ ID NO: 1170706 - DNA, 17 bp, Homo sapiens
agggatgccctggaggt

SEQ ID NO: 1170707 - DNA, 20 bp, Homo sapiens
agggatgccctggaggtggc

SEQ ID NO: 1170708 - DNA, 19 bp, Homo sapiens
agggatgctgcctgagtca

SEQ ID NO: 1170709 - DNA, 15 bp, Homo sapiens
agggatgctgtgagc

SEQ ID NO: 1170710 - DNA, 15 bp, Homo sapiens
agggatggaaaagga

SEQ ID NO: 1170711 - DNA, 13 bp, Homo sapiens
agggatggcacca

SEQ ID NO: 1170712 - DNA, 15 bp, Homo sapiens
agggatggcaccact

SEQ ID NO: 1170713 - DNA, 15 bp, Homo sapiens
agggatgggcctggc

SEQ ID NO: 1170714 - DNA, 20 bp, Homo sapiens
aaaggcagctgcctctgctc

SEQ ID NO: 1170715 - DNA, 22 bp, Homo sapiens
aaaggcagctgcctctgctccc

SEQ ID NO: 1170716 - DNA, 20 bp, Homo sapiens
aaataaaaaaaagaaaaaag

SEQ ID NO: 1170717 - DNA, 22 bp, Homo sapiens
aaataaaaaaaagaaaaaagag

SEQ ID NO: 1170718 - DNA, 16 bp, Homo sapiens
aaataaaaacttattt

SEQ ID NO: 1170719 - DNA, 21 bp, Homo sapiens
aaataaaaagtgacacagcag

SEQ ID NO: 1170720 - DNA, 12 bp, Homo sapiens
agggcccacctt

SEQ ID NO: 1170721 - DNA, 20 bp, Homo sapiens
agggcccaccttggaccctg

SEQ ID NO: 1170722 - DNA, 11 bp, Homo sapiens
agggcccagag

SEQ ID NO: 1170723 - DNA, 14 bp, Homo sapiens
agggcccagccagg

SEQ ID NO: 1170724 - DNA, 12 bp, Homo sapiens
agggcccagccc

SEQ ID NO: 1170725 - DNA, 15 bp, Homo sapiens
agggcccagcccaga

SEQ ID NO: 1170726 - DNA, 23 bp, Homo sapiens
agggcccagcccagagccacctg

SEQ ID NO: 1170727 - DNA, 14 bp, Homo sapiens
agggcccagctgta

SEQ ID NO: 1170728 - DNA, 17 bp, Homo sapiens
agggcccagctgtagcc

SEQ ID NO: 1170729 - DNA, 22 bp, Homo sapiens
agggcccagctgtagccatggc

SEQ ID NO: 1170730 - DNA, 13 bp, Homo sapiens
agggcccaggcca

SEQ ID NO: 1170731 - DNA, 14 bp, Homo sapiens
agggcccaggccat

SEQ ID NO: 1170732 - DNA, 17 bp, Homo sapiens
agggcccaggcctggag

SEQ ID NO: 1170733 - DNA, 17 bp, Homo sapiens
agggcccatcaggcagt

SEQ ID NO: 1170734 - DNA, 12 bp, Homo sapiens
agggccccagca

SEQ ID NO: 1170735 - DNA, 18 bp, Homo sapiens
agggccccagcactaaag

SEQ ID NO: 1170736 - DNA, 17 bp, Homo sapiens
agggccccaggggcagc

SEQ ID NO: 1170737 - DNA, 13 bp, Homo sapiens
agggcccccaccg

SEQ ID NO: 1170738 - DNA, 11 bp, Homo sapiens
agggcccctcc

SEQ ID NO: 1170739 - DNA, 20 bp, Homo sapiens
agggcccctccctctgcccc

SEQ ID NO: 1170740 - DNA, 13 bp, Homo sapiens
agggcccctctgc

SEQ ID NO: 1170741 - DNA, 14 bp, Homo sapiens
agggcccctctgcc

SEQ ID NO: 1170742 - DNA, 18 bp, Homo sapiens
agggcccctctgcccagc

SEQ ID NO: 1170743 - DNA, 20 bp, Homo sapiens
agggcccctctgcccagctt

SEQ ID NO: 1170744 - DNA, 16 bp, Homo sapiens
agggcccggccacacc

SEQ ID NO: 1170745 - DNA, 20 bp, Homo sapiens
agggcccggccacacccagc

SEQ ID NO: 1170746 - DNA, 18 bp, Homo sapiens
agggcccgggcacccaca

SEQ ID NO: 1170747 - DNA, 13 bp, Homo sapiens
agggccctcccag

SEQ ID NO: 1170748 - DNA, 14 bp, Homo sapiens
agggccctcccagc

SEQ ID NO: 1170749 - DNA, 16 bp, Homo sapiens
agggccctcccagccc

SEQ ID NO: 1170750 - DNA, 17 bp, Homo sapiens
agggccctcccagccca

SEQ ID NO: 1170751 - DNA, 14 bp, Homo sapiens
agggccctgcccca

SEQ ID NO: 1170752 - DNA, 13 bp, Homo sapiens
agggccctgccct

SEQ ID NO: 1170753 - DNA, 16 bp, Homo sapiens
agggccctgccctgta

SEQ ID NO: 1170754 - DNA, 20 bp, Homo sapiens
agggccctgtggagtccagc

SEQ ID NO: 1170755 - DNA, 14 bp, Homo sapiens
agggccctttcatc

SEQ ID NO: 1170756 - DNA, 19 bp, Homo sapiens
agggccgactaagagaagt

SEQ ID NO: 1170757 - DNA, 14 bp, Homo sapiens
agggccgcctgcct

SEQ ID NO: 1170758 - DNA, 15 bp, Homo sapiens
agggccgcctgcctt

SEQ ID NO: 1170759 - DNA, 23 bp, Homo sapiens
agggccggggggggtaggagagg

SEQ ID NO: 1170760 - DNA, 18 bp, Homo sapiens
agggccgtaccccaccct

SEQ ID NO: 1170761 - DNA, 20 bp, Homo sapiens
agggccgtaccccaccctca

SEQ ID NO: 1170762 - DNA, 16 bp, Homo sapiens
agggccgtgcccttgc

SEQ ID NO: 1170763 - DNA, 22 bp, Homo sapiens
agggccgtgcccttgcccttgg

SEQ ID NO: 1170764 - DNA, 20 bp, Homo sapiens
agggcctcaaaggcccgctc

SEQ ID NO: 1170765 - DNA, 14 bp, Homo sapiens
agggcctcagagcc

SEQ ID NO: 1170766 - DNA, 15 bp, Homo sapiens
agggcctcagagcct

SEQ ID NO: 1170767 - DNA, 21 bp, Homo sapiens
agggcctcagagcctgacctg

SEQ ID NO: 1170768 - DNA, 15 bp, Homo sapiens
agggcctcatctcac

SEQ ID NO: 1170769 - DNA, 12 bp, Homo sapiens
agggcctccagg

SEQ ID NO: 1170770 - DNA, 13 bp, Homo sapiens
agggcctccaggg

SEQ ID NO: 1170771 - DNA, 20 bp, Homo sapiens
agggcctcctgggggacctt

SEQ ID NO: 1170772 - DNA, 18 bp, Homo sapiens
agggcctgaaacccgccc

SEQ ID NO: 1170773 - DNA, 19 bp, Homo sapiens
agggcctgaaacccgccct

SEQ ID NO: 1170774 - DNA, 19 bp, Homo sapiens
agggcctgacaccccctcc

SEQ ID NO: 1170775 - DNA, 17 bp, Homo sapiens
agggcctgacttgagcc

SEQ ID NO: 1170776 - DNA, 18 bp, Homo sapiens
agggcctgacttgagcca

SEQ ID NO: 1170777 - DNA, 23 bp, Homo sapiens
agggcctgcatggagaagggttc

SEQ ID NO: 1170778 - DNA, 15 bp, Homo sapiens
agggcctgctggagg

SEQ ID NO: 1170779 - DNA, 17 bp, Homo sapiens
agggcctgctggaggcc

SEQ ID NO: 1170780 - DNA, 12 bp, Homo sapiens
agggcctggacg

SEQ ID NO: 1170781 - DNA, 14 bp, Homo sapiens
agggcctggagccc

SEQ ID NO: 1170782 - DNA, 16 bp, Homo sapiens
agggcctggccagtcc

SEQ ID NO: 1170783 - DNA, 17 bp, Homo sapiens
agggcctggccagtcct

SEQ ID NO: 1170784 - DNA, 18 bp, Homo sapiens
agggcctggccagtcctg

SEQ ID NO: 1170785 - DNA, 14 bp, Homo sapiens
agggcctgggggca

SEQ ID NO: 1170786 - DNA, 21 bp, Homo sapiens
agggcctggtccctgggagga

SEQ ID NO: 1170787 - DNA, 19 bp, Homo sapiens
agggcctgtgggagcctgc

SEQ ID NO: 1170788 - DNA, 14 bp, Homo sapiens
agggccttgcccag

SEQ ID NO: 1170789 - DNA, 17 bp, Homo sapiens
agggccttgcccagaga

SEQ ID NO: 1170790 - DNA, 17 bp, Homo sapiens
agggccttgcttctctt

SEQ ID NO: 1170791 - DNA, 23 bp, Homo sapiens
agggcctttctcctccccacctg

SEQ ID NO: 1170792 - DNA, 15 bp, Homo sapiens
agggccttttctgtg

SEQ ID NO: 1170793 - DNA, 14 bp, Homo sapiens
agggcgaaggccat

SEQ ID NO: 1170794 - DNA, 13 bp, Homo sapiens
agggcgagtgaat

SEQ ID NO: 1170795 - DNA, 21 bp, Homo sapiens
agggcgcccattcgtctgtcc

SEQ ID NO: 1170796 - DNA, 13 bp, Homo sapiens
agggcggcagggg

SEQ ID NO: 1170797 - DNA, 12 bp, Homo sapiens
agggcggccagg

SEQ ID NO: 1170798 - DNA, 13 bp, Homo sapiens
agggcggccaggg

SEQ ID NO: 1170799 - DNA, 17 bp, Homo sapiens
agggcggccagggacag

SEQ ID NO: 1170800 - DNA, 17 bp, Homo sapiens
agggcgggcagagggct

SEQ ID NO: 1170801 - DNA, 18 bp, Homo sapiens
agggcgggcagagggctg

SEQ ID NO: 1170802 - DNA, 14 bp, Homo sapiens
agggcgtcaggcag

SEQ ID NO: 1170803 - DNA, 16 bp, Homo sapiens
agggcgtcaggcagag

SEQ ID NO: 1170804 - DNA, 17 bp, Homo sapiens
agggcgtcaggcagagg

SEQ ID NO: 1170805 - DNA, 19 bp, Homo sapiens
agggcgtgtggtttccctg

SEQ ID NO: 1170806 - DNA, 23 bp, Homo sapiens
agggcgtgtggtttccctgcccc

SEQ ID NO: 1170807 - DNA, 14 bp, Homo sapiens
agggctaagagcta

SEQ ID NO: 1170808 - DNA, 23 bp, Homo sapiens
agggctaattctgggaagggaga

SEQ ID NO: 1170809 - DNA, 15 bp, Homo sapiens
agggctaccctgagc

SEQ ID NO: 1170810 - DNA, 15 bp, Homo sapiens
agggctagccctgag

SEQ ID NO: 1170811 - DNA, 16 bp, Homo sapiens
agggctagccctgagc

SEQ ID NO: 1170812 - DNA, 21 bp, Homo sapiens
agggctagccctgagcccggc

SEQ ID NO: 1170813 - DNA, 18 bp, Homo sapiens
agggctagtagaactgga

SEQ ID NO: 1170814 - DNA, 23 bp, Homo sapiens
agggctagtgaagtggcctcttg

SEQ ID NO: 1170815 - DNA, 17 bp, Homo sapiens
agggctatatttcagtg

SEQ ID NO: 1170816 - DNA, 20 bp, Homo sapiens
agggctatatttcagtgaca

SEQ ID NO: 1170817 - DNA, 16 bp, Homo sapiens
agggctcacagggcag

SEQ ID NO: 1170818 - DNA, 13 bp, Homo sapiens
agggctcagcctg

SEQ ID NO: 1170819 - DNA, 13 bp, Homo sapiens
agggctccagcat

SEQ ID NO: 1170820 - DNA, 18 bp, Homo sapiens
agggctccagcatccagc

SEQ ID NO: 1170821 - DNA, 23 bp, Homo sapiens
agggctccagcccctcttggaga

SEQ ID NO: 1170822 - DNA, 22 bp, Homo sapiens
agggctccctcctggagcatcc

SEQ ID NO: 1170823 - DNA, 14 bp, Homo sapiens
agggctcctatctt

SEQ ID NO: 1170824 - DNA, 15 bp, Homo sapiens
agggctcctcccagc

SEQ ID NO: 1170825 - DNA, 14 bp, Homo sapiens
agggctcctgcagg

SEQ ID NO: 1170826 - DNA, 12 bp, Homo sapiens
agggctcctggg

SEQ ID NO: 1170827 - DNA, 15 bp, Homo sapiens
agggctctgccccag

SEQ ID NO: 1170828 - DNA, 14 bp, Homo sapiens
agggctgagcgtgg

SEQ ID NO: 1170829 - DNA, 19 bp, Homo sapiens
agggctgagcgtggaaggg

SEQ ID NO: 1170830 - DNA, 17 bp, Homo sapiens
agggctgagctctctgt

SEQ ID NO: 1170831 - DNA, 14 bp, Homo sapiens
agggctgaggagca

SEQ ID NO: 1170832 - DNA, 21 bp, Homo sapiens
agggctgaggagcagccagga

SEQ ID NO: 1170833 - DNA, 23 bp, Homo sapiens
agggctgaggagcagccaggacc

SEQ ID NO: 1170834 - DNA, 21 bp, Homo sapiens
agggctgaggggcctgcgccc

SEQ ID NO: 1170835 - DNA, 18 bp, Homo sapiens
agggctgatggaggaaaa

SEQ ID NO: 1170836 - DNA, 19 bp, Homo sapiens
agggctgatggaggaaaaa

SEQ ID NO: 1170837 - DNA, 16 bp, Homo sapiens
agggctgcagagggag

SEQ ID NO: 1170838 - DNA, 12 bp, Homo sapiens
agggctgcatga

SEQ ID NO: 1170839 - DNA, 17 bp, Homo sapiens
aaatatatcttataaag

SEQ ID NO: 1170840 - DNA, 12 bp, Homo sapiens
aaatatatgtat

SEQ ID NO: 1170841 - DNA, 20 bp, Homo sapiens
aaatatatgtatgtaaaaat

SEQ ID NO: 1170842 - DNA, 16 bp, Homo sapiens
aaatatatgtatttaa

SEQ ID NO: 1170843 - DNA, 15 bp, Homo sapiens
aaatatatgttctgc

SEQ ID NO: 1170844 - DNA, 20 bp, Homo sapiens
aaatatatgttctgcaagaa

SEQ ID NO: 1170845 - DNA, 18 bp, Homo sapiens
aaatatattatatatgga

SEQ ID NO: 1170846 - DNA, 23 bp, Homo sapiens
aaatatattcaggagttggaatg

SEQ ID NO: 1170847 - DNA, 12 bp, Homo sapiens
aaatatatttaa

SEQ ID NO: 1170848 - DNA, 21 bp, Homo sapiens
aaatatatttaagataattat

SEQ ID NO: 1170849 - DNA, 21 bp, Homo sapiens
aaatatcaaagtcattaaaga

SEQ ID NO: 1170850 - DNA, 15 bp, Homo sapiens
aaatatcagactagt

SEQ ID NO: 1170851 - DNA, 17 bp, Homo sapiens
aaatatcagtattctga

SEQ ID NO: 1170852 - DNA, 19 bp, Homo sapiens
aaatatcagtattctgaca

SEQ ID NO: 1170853 - DNA, 13 bp, Homo sapiens
aaatatcatgtta

SEQ ID NO: 1170854 - DNA, 17 bp, Homo sapiens
aaatatccaaagactgt

SEQ ID NO: 1170855 - DNA, 17 bp, Homo sapiens
aggggcattcacaaggc

SEQ ID NO: 1170856 - DNA, 12 bp, Homo sapiens
aggggccacctc

SEQ ID NO: 1170857 - DNA, 20 bp, Homo sapiens
aggggccacctcctccccct

SEQ ID NO: 1170858 - DNA, 12 bp, Homo sapiens
aggggccagagg

SEQ ID NO: 1170859 - DNA, 22 bp, Homo sapiens
aggggccagaggaactgtccag

SEQ ID NO: 1170860 - DNA, 15 bp, Homo sapiens
aggggccagaggctc

SEQ ID NO: 1170861 - DNA, 21 bp, Homo sapiens
aggggccagatgattttcctc

SEQ ID NO: 1170862 - DNA, 15 bp, Homo sapiens
aggggccagcagagg

SEQ ID NO: 1170863 - DNA, 13 bp, Homo sapiens
aggggccatgccc

SEQ ID NO: 1170864 - DNA, 18 bp, Homo sapiens
aggggccatgccccaccc

SEQ ID NO: 1170865 - DNA, 20 bp, Homo sapiens
aggggccatgccccaccccc

SEQ ID NO: 1170866 - DNA, 22 bp, Homo sapiens
aggggcccaaattctttcagtg

SEQ ID NO: 1170867 - DNA, 18 bp, Homo sapiens
aggggcccacttggggcc

SEQ ID NO: 1170868 - DNA, 19 bp, Homo sapiens
aggggcccacttggggcct

SEQ ID NO: 1170869 - DNA, 19 bp, Homo sapiens
aggggccccagatctgcct

SEQ ID NO: 1170870 - DNA, 22 bp, Homo sapiens
aggggccccagcgtctgcaggg

SEQ ID NO: 1170871 - DNA, 18 bp, Homo sapiens
aggggcccccgtgttcag

SEQ ID NO: 1170872 - DNA, 20 bp, Homo sapiens
aggggccccggggctggcaa

SEQ ID NO: 1170873 - DNA, 13 bp, Homo sapiens
aggggcccggcca

SEQ ID NO: 1170874 - DNA, 17 bp, Homo sapiens
aggggcccggccagcca

SEQ ID NO: 1170875 - DNA, 19 bp, Homo sapiens
aggggcccggccagccatg

SEQ ID NO: 1170876 - DNA, 12 bp, Homo sapiens
aggggccctcag

SEQ ID NO: 1170877 - DNA, 15 bp, Homo sapiens
aggggccctcaggcc

SEQ ID NO: 1170878 - DNA, 14 bp, Homo sapiens
aggggccctgagcc

SEQ ID NO: 1170879 - DNA, 23 bp, Homo sapiens
aggggcccttgggacagccagag

SEQ ID NO: 1170880 - DNA, 16 bp, Homo sapiens
aggggccctttgcata

SEQ ID NO: 1170881 - DNA, 17 bp, Homo sapiens
aggggccgctgccaccc

SEQ ID NO: 1170882 - DNA, 15 bp, Homo sapiens
aggggccggggaggg

SEQ ID NO: 1170883 - DNA, 18 bp, Homo sapiens
aggggccggggagggggc

SEQ ID NO: 1170884 - DNA, 19 bp, Homo sapiens
aggggccggggagggggca

SEQ ID NO: 1170885 - DNA, 16 bp, Homo sapiens
aggggcctaggcctca

SEQ ID NO: 1170886 - DNA, 23 bp, Homo sapiens
aggggcctaggcctcagccagag

SEQ ID NO: 1170887 - DNA, 12 bp, Homo sapiens
aggggcctaggg

SEQ ID NO: 1170888 - DNA, 20 bp, Homo sapiens
aggggcctcccggggcccag

SEQ ID NO: 1170889 - DNA, 13 bp, Homo sapiens
aggggcctctctc

SEQ ID NO: 1170890 - DNA, 16 bp, Homo sapiens
aggggcctctctcctg

SEQ ID NO: 1170891 - DNA, 15 bp, Homo sapiens
aggggcctgcgccca

SEQ ID NO: 1170892 - DNA, 22 bp, Homo sapiens
aggggcctggagatcctcctgc

SEQ ID NO: 1170893 - DNA, 13 bp, Homo sapiens
aggggcctggcag

SEQ ID NO: 1170894 - DNA, 12 bp, Homo sapiens
aggggcctgggc

SEQ ID NO: 1170895 - DNA, 18 bp, Homo sapiens
aggggcctgggcagcccc

SEQ ID NO: 1170896 - DNA, 21 bp, Homo sapiens
aggggcctgggcagccccaca

SEQ ID NO: 1170897 - DNA, 16 bp, Homo sapiens
aggggccttgctctga

SEQ ID NO: 1170898 - DNA, 18 bp, Homo sapiens
aggggccttgctctgagc

SEQ ID NO: 1170899 - DNA, 22 bp, Homo sapiens
aggggccttgctctgagcacag

SEQ ID NO: 1170900 - DNA, 13 bp, Homo sapiens
aggggcgagcacc

SEQ ID NO: 1170901 - DNA, 21 bp, Homo sapiens
aggggcgccttttcagccctt

SEQ ID NO: 1170902 - DNA, 14 bp, Homo sapiens
aggggcgctggccc

SEQ ID NO: 1170903 - DNA, 15 bp, Homo sapiens
aggggcgctggccca

SEQ ID NO: 1170904 - DNA, 16 bp, Homo sapiens
aggggcgctggcccag

SEQ ID NO: 1170905 - DNA, 18 bp, Homo sapiens
aggggcgctggcccagcc

SEQ ID NO: 1170906 - DNA, 15 bp, Homo sapiens
aggggcgctgtcctg

SEQ ID NO: 1170907 - DNA, 16 bp, Homo sapiens
aggggcgctgtcctgc

SEQ ID NO: 1170908 - DNA, 14 bp, Homo sapiens
aggggcgggctcag

SEQ ID NO: 1170909 - DNA, 16 bp, Homo sapiens
aggggcgggctcagag

SEQ ID NO: 1170910 - DNA, 23 bp, Homo sapiens
aggggcgggctcagagctttgtc

SEQ ID NO: 1170911 - DNA, 13 bp, Homo sapiens
aggggcggggcag

SEQ ID NO: 1170912 - DNA, 15 bp, Homo sapiens
aggggcgggggcgga

SEQ ID NO: 1170913 - DNA, 16 bp, Homo sapiens
aggggcgtctgttccc

SEQ ID NO: 1170914 - DNA, 22 bp, Homo sapiens
aggggcgtctgttcccccttca

SEQ ID NO: 1170915 - DNA, 22 bp, Homo sapiens
aggggctaaaggggagaaactg

SEQ ID NO: 1170916 - DNA, 14 bp, Homo sapiens
aggggctaccagga

SEQ ID NO: 1170917 - DNA, 17 bp, Homo sapiens
aggggctaccaggaaag

SEQ ID NO: 1170918 - DNA, 15 bp, Homo sapiens
aggggctcaggaaaa

SEQ ID NO: 1170919 - DNA, 20 bp, Homo sapiens
aggggctccgggtcactgct

SEQ ID NO: 1170920 - DNA, 12 bp, Homo sapiens
aggggctcctgg

SEQ ID NO: 1170921 - DNA, 17 bp, Homo sapiens
aggggctctcagctcag

SEQ ID NO: 1170922 - DNA, 15 bp, Homo sapiens
aggggctctgagccc

SEQ ID NO: 1170923 - DNA, 24 bp, Homo sapiens
aggggctcttcatctgcctgcgct

SEQ ID NO: 1170924 - DNA, 20 bp, Homo sapiens
aggggctgaaagaacatgga

SEQ ID NO: 1170925 - DNA, 21 bp, Homo sapiens
aggggctgcgctagcagccct

SEQ ID NO: 1170926 - DNA, 13 bp, Homo sapiens
aggggctgctggg

SEQ ID NO: 1170927 - DNA, 16 bp, Homo sapiens
aggggctgctggggca

SEQ ID NO: 1170928 - DNA, 20 bp, Homo sapiens
aggggctgctggggcatgtg

SEQ ID NO: 1170929 - DNA, 15 bp, Homo sapiens
aggggctgcttcctc

SEQ ID NO: 1170930 - DNA, 14 bp, Homo sapiens
aggggctggggact

SEQ ID NO: 1170931 - DNA, 18 bp, Homo sapiens
aggggctggggacttgtg

SEQ ID NO: 1170932 - DNA, 13 bp, Homo sapiens
aggggctggggag

SEQ ID NO: 1170933 - DNA, 22 bp, Homo sapiens
aggggctggggagggggtacct

SEQ ID NO: 1170934 - DNA, 21 bp, Homo sapiens
aggggctgtcctccttcctgg

SEQ ID NO: 1170935 - DNA, 22 bp, Homo sapiens
aggggctgtcctccttcctggg

SEQ ID NO: 1170936 - DNA, 23 bp, Homo sapiens
aggggctgtcctccttcctggga

SEQ ID NO: 1170937 - DNA, 14 bp, Homo sapiens
aggggctgttcttc

SEQ ID NO: 1170938 - DNA, 13 bp, Homo sapiens
aggggcttcctgg

SEQ ID NO: 1170939 - DNA, 15 bp, Homo sapiens
aggggcttcctgggt

SEQ ID NO: 1170940 - DNA, 13 bp, Homo sapiens
aggggctttctct

SEQ ID NO: 1170941 - DNA, 19 bp, Homo sapiens
aggggctttctcttcccct

SEQ ID NO: 1170942 - DNA, 16 bp, Homo sapiens
aggggctttctggaga

SEQ ID NO: 1170943 - DNA, 23 bp, Homo sapiens
aggggctttgggcccaagaactg

SEQ ID NO: 1170944 - DNA, 19 bp, Homo sapiens
agggggaaaaagtgtcaac

SEQ ID NO: 1170945 - DNA, 18 bp, Homo sapiens
agggggaagaagcagaga

SEQ ID NO: 1170946 - DNA, 17 bp, Homo sapiens
agggggaagagaaattt

SEQ ID NO: 1170947 - DNA, 20 bp, Homo sapiens
agggggacaaccccccaaga

SEQ ID NO: 1170948 - DNA, 17 bp, Homo sapiens
agggggacctgtccccc

SEQ ID NO: 1170949 - DNA, 22 bp, Homo sapiens
agggggactgctgctgcctggc

SEQ ID NO: 1170950 - DNA, 21 bp, Homo sapiens
agggggagccccttctgctca

SEQ ID NO: 1170951 - DNA, 22 bp, Homo sapiens
agggggagccccttctgctcag

SEQ ID NO: 1170952 - DNA, 23 bp, Homo sapiens
agggggagccggtaactgtcctg

SEQ ID NO: 1170953 - DNA, 21 bp, Homo sapiens
agggggaggaagttggctgag

SEQ ID NO: 1170954 - DNA, 15 bp, Homo sapiens
agggggaggagtcag

SEQ ID NO: 1170955 - DNA, 14 bp, Homo sapiens
agggggataaggtc

SEQ ID NO: 1170956 - DNA, 20 bp, Homo sapiens
agggggatccgactgctttg

SEQ ID NO: 1170957 - DNA, 23 bp, Homo sapiens
agggggatgccactcctccctcc

SEQ ID NO: 1170958 - DNA, 21 bp, Homo sapiens
agggggcacggcaggcgtgtg

SEQ ID NO: 1170959 - DNA, 10 bp, Homo sapiens
agggggccag

SEQ ID NO: 1170960 - DNA, 17 bp, Homo sapiens
agggggccagctgggga

SEQ ID NO: 1170961 - DNA, 20 bp, Homo sapiens
agggttttttttaatgtgaa

SEQ ID NO: 1170962 - DNA, 20 bp, Homo sapiens
agggttttttttttttcctt

SEQ ID NO: 1170963 - DNA, 18 bp, Homo sapiens
aggtaaagggcaaataat

SEQ ID NO: 1170964 - DNA, 22 bp, Homo sapiens
aggtaaatggttaaattttaca

SEQ ID NO: 1170965 - DNA, 14 bp, Homo sapiens
aggtaacactacag

SEQ ID NO: 1170966 - DNA, 14 bp, Homo sapiens
aggtaacagttata

SEQ ID NO: 1170967 - DNA, 20 bp, Homo sapiens
aggtaacatttatagaagaa

SEQ ID NO: 1170968 - DNA, 15 bp, Homo sapiens
aggtaacgtgattga

SEQ ID NO: 1170969 - DNA, 23 bp, Homo sapiens
aggtaacgtgattgattcagtat

SEQ ID NO: 1170970 - DNA, 19 bp, Homo sapiens
aggtaacttattagaaacc

SEQ ID NO: 1170971 - DNA, 18 bp, Homo sapiens
aggtaaggaaaaggattt

SEQ ID NO: 1170972 - DNA, 22 bp, Homo sapiens
aggtaataataaaggttgagtt

SEQ ID NO: 1170973 - DNA, 17 bp, Homo sapiens
aggtaattccttagaga

SEQ ID NO: 1170974 - DNA, 16 bp, Homo sapiens
aggtaattctccctaa

SEQ ID NO: 1170975 - DNA, 22 bp, Homo sapiens
aggtacactggtatttatattt

SEQ ID NO: 1170976 - DNA, 15 bp, Homo sapiens
aggtacagcgggctg

SEQ ID NO: 1170977 - DNA, 22 bp, Homo sapiens
aggtaccaaacaaggaagccaa

SEQ ID NO: 1170978 - DNA, 20 bp, Homo sapiens
aggtaccacccttcagaccc

SEQ ID NO: 1170979 - DNA, 19 bp, Homo sapiens
aggtacgattatacttgag

SEQ ID NO: 1170980 - DNA, 19 bp, Homo sapiens
aggtactggtcccttcctt

SEQ ID NO: 1170981 - DNA, 13 bp, Homo sapiens
aggtacttcctcc

SEQ ID NO: 1170982 - DNA, 19 bp, Homo sapiens
aggtacttcctcctgatgg

SEQ ID NO: 1170983 - DNA, 17 bp, Homo sapiens
aggtacttggagggctc

SEQ ID NO: 1170984 - DNA, 19 bp, Homo sapiens
aggtagaatgtaaagcttg

SEQ ID NO: 1170985 - DNA, 22 bp, Homo sapiens
aggtagaattatctaatttata

SEQ ID NO: 1170986 - DNA, 18 bp, Homo sapiens
aggtagagtcattcatat

SEQ ID NO: 1170987 - DNA, 15 bp, Homo sapiens
aggtagatccagatc

SEQ ID NO: 1170988 - DNA, 21 bp, Homo sapiens
aggtagatcgcttgagcccag

SEQ ID NO: 1170989 - DNA, 22 bp, Homo sapiens
aaatgacaccatcttttattct

SEQ ID NO: 1170990 - DNA, 13 bp, Homo sapiens
aaatgacacccag

SEQ ID NO: 1170991 - DNA, 15 bp, Homo sapiens
aaatgacacccagac

SEQ ID NO: 1170992 - DNA, 19 bp, Homo sapiens
aaatgacagattctgacat

SEQ ID NO: 1170993 - DNA, 16 bp, Homo sapiens
aaatgacagtttcaga

SEQ ID NO: 1170994 - DNA, 17 bp, Homo sapiens
aaatgacatgttccttt

SEQ ID NO: 1170995 - DNA, 19 bp, Homo sapiens
aaatgaccaacgaaattgt

SEQ ID NO: 1170996 - DNA, 15 bp, Homo sapiens
aaatgaccaatatta

SEQ ID NO: 1170997 - DNA, 14 bp, Homo sapiens
aaatgacccaaaga

SEQ ID NO: 1170998 - DNA, 17 bp, Homo sapiens
aaatgacccaaagacca

SEQ ID NO: 1170999 - DNA, 17 bp, Homo sapiens
aaatgactaaaaatatt

SEQ ID NO: 1171000 - DNA, 20 bp, Homo sapiens
aaatgactaaaaatattata

SEQ ID NO: 1171001 - DNA, 13 bp, Homo sapiens
aaatgacttattt

SEQ ID NO: 1171002 - DNA, 18 bp, Homo sapiens
aaatgactttgaactgaa

SEQ ID NO: 1171003 - DNA, 20 bp, Homo sapiens
aaatgactttgaactgaaac

SEQ ID NO: 1171004 - DNA, 17 bp, Homo sapiens
aaatgacttttcttaag

SEQ ID NO: 1171005 - DNA, 20 bp, Homo sapiens
aaatgagaattttatattct

SEQ ID NO: 1171006 - DNA, 12 bp, Homo sapiens
aaatgagacttt

SEQ ID NO: 1171007 - DNA, 15 bp, Homo sapiens
aaatgagagcagaaa

SEQ ID NO: 1171008 - DNA, 13 bp, Homo sapiens
aaatgagccatga

SEQ ID NO: 1171009 - DNA, 13 bp, Homo sapiens
aaatgagcctggc

SEQ ID NO: 1171010 - DNA, 19 bp, Homo sapiens
aaatgagcttgattaaatc

SEQ ID NO: 1171011 - DNA, 15 bp, Homo sapiens
aaatgaggaatagca

SEQ ID NO: 1171012 - DNA, 19 bp, Homo sapiens
aaatgaggaatccaaaaga

SEQ ID NO: 1171013 - DNA, 17 bp, Homo sapiens
aaatgaggaatgtatat

SEQ ID NO: 1171014 - DNA, 19 bp, Homo sapiens
aaatgaggaatgtatatgt

SEQ ID NO: 1171015 - DNA, 18 bp, Homo sapiens
aaatgagggctgcacatt

SEQ ID NO: 1171016 - DNA, 15 bp, Homo sapiens
aaatgaggtctgttt

SEQ ID NO: 1171017 - DNA, 16 bp, Homo sapiens
aaatgaggtctgttta

SEQ ID NO: 1171018 - DNA, 21 bp, Homo sapiens
aaatgaggtctgtttaaagtg

SEQ ID NO: 1171019 - DNA, 14 bp, Homo sapiens
aaatgagtcatttg

SEQ ID NO: 1171020 - DNA, 19 bp, Homo sapiens
aaatgagtcatttgtttaa

SEQ ID NO: 1171021 - DNA, 12 bp, Homo sapiens
aaatgagtgtgt

SEQ ID NO: 1171022 - DNA, 21 bp, Homo sapiens
aaatgatcaccatgttagcct

SEQ ID NO: 1171023 - DNA, 13 bp, Homo sapiens
aaatgatctaaac

SEQ ID NO: 1171024 - DNA, 16 bp, Homo sapiens
aaatgatgcagctgtt

SEQ ID NO: 1171025 - DNA, 12 bp, Homo sapiens
aaatgatggaag

SEQ ID NO: 1171026 - DNA, 16 bp, Homo sapiens
aaatgatgtgttggtt

SEQ ID NO: 1171027 - DNA, 18 bp, Homo sapiens
aaatgattatattcacag

SEQ ID NO: 1171028 - DNA, 21 bp, Homo sapiens
aaatgattcaaattgctgctt

SEQ ID NO: 1171029 - DNA, 11 bp, Homo sapiens
aaatgattcca

SEQ ID NO: 1171030 - DNA, 12 bp, Homo sapiens
aaatgattccaa

SEQ ID NO: 1171031 - DNA, 15 bp, Homo sapiens
aaatgattcttagtg

SEQ ID NO: 1171032 - DNA, 23 bp, Homo sapiens
aaatgattgtttcttcttcatgc

SEQ ID NO: 1171033 - DNA, 23 bp, Homo sapiens
aaatgatttttacaagttttaaa

SEQ ID NO: 1171034 - DNA, 19 bp, Homo sapiens
aaatgcaaaaactctttga

SEQ ID NO: 1171035 - DNA, 15 bp, Homo sapiens
aaatgcaaaaatctc

SEQ ID NO: 1171036 - DNA, 16 bp, Homo sapiens
aaatgcaaaaatctct

SEQ ID NO: 1171037 - DNA, 17 bp, Homo sapiens
aaatgcaaacacacaaa

SEQ ID NO: 1171038 - DNA, 13 bp, Homo sapiens
aaatgcaaatgaa

SEQ ID NO: 1171039 - DNA, 19 bp, Homo sapiens
aaatgcaaatgaatcattg

SEQ ID NO: 1171040 - DNA, 21 bp, Homo sapiens
aaatgcaaatttctataaatt

SEQ ID NO: 1171041 - DNA, 20 bp, Homo sapiens
aaatgcaacagtttttaaaa

SEQ ID NO: 1171042 - DNA, 17 bp, Homo sapiens
aaatgcaagtgcctaga

SEQ ID NO: 1171043 - DNA, 16 bp, Homo sapiens
aaatgcaataatttta

SEQ ID NO: 1171044 - DNA, 17 bp, Homo sapiens
aaatgcaataattttac

SEQ ID NO: 1171045 - DNA, 22 bp, Homo sapiens
aaatgcaatcaggattttaaac

SEQ ID NO: 1171046 - DNA, 19 bp, Homo sapiens
aaatgcacatagctatcaa

SEQ ID NO: 1171047 - DNA, 18 bp, Homo sapiens
aaatgcaccaagaaagct

SEQ ID NO: 1171048 - DNA, 11 bp, Homo sapiens
aaatgcagaaa

SEQ ID NO: 1171049 - DNA, 19 bp, Homo sapiens
aaatgcagaaccacaaaca

SEQ ID NO: 1171050 - DNA, 14 bp, Homo sapiens
aaatgcagaactta

SEQ ID NO: 1171051 - DNA, 21 bp, Homo sapiens
aaatgcagggaggggaggcag

SEQ ID NO: 1171052 - DNA, 22 bp, Homo sapiens
aaatgcagggaggggaggcaga

SEQ ID NO: 1171053 - DNA, 12 bp, Homo sapiens
aaatgcagtgaa

SEQ ID NO: 1171054 - DNA, 17 bp, Homo sapiens
aaatgcagttttaagaa

SEQ ID NO: 1171055 - DNA, 20 bp, Homo sapiens
aaatgcatatcctgagccat

SEQ ID NO: 1171056 - DNA, 20 bp, Homo sapiens
aaatgcatccattcctcagg

SEQ ID NO: 1171057 - DNA, 14 bp, Homo sapiens
aaatgcatgaacaa

SEQ ID NO: 1171058 - DNA, 14 bp, Homo sapiens
aaatgcatgatttt

SEQ ID NO: 1171059 - DNA, 18 bp, Homo sapiens
aaatgcatgattttgtaa

SEQ ID NO: 1171060 - DNA, 13 bp, Homo sapiens
aaatgcatggagg

SEQ ID NO: 1171061 - DNA, 11 bp, Homo sapiens
aaatgcatttt

SEQ ID NO: 1171062 - DNA, 12 bp, Homo sapiens
aaatgcattttc

SEQ ID NO: 1171063 - DNA, 18 bp, Homo sapiens
aaatgccaaaatgtactt

SEQ ID NO: 1171064 - DNA, 20 bp, Homo sapiens
aaatgccaagggggtgactg

SEQ ID NO: 1171065 - DNA, 22 bp, Homo sapiens
aaatgccaagggggtgactgga

SEQ ID NO: 1171066 - DNA, 18 bp, Homo sapiens
aaatgccactccctaccc

SEQ ID NO: 1171067 - DNA, 19 bp, Homo sapiens
aaatgccactccctaccca

SEQ ID NO: 1171068 - DNA, 14 bp, Homo sapiens
aaatgccatgaaaa

SEQ ID NO: 1171069 - DNA, 15 bp, Homo sapiens
aaatgccatgtttat

SEQ ID NO: 1171070 - DNA, 14 bp, Homo sapiens
aaatgcccaaggat

SEQ ID NO: 1171071 - DNA, 16 bp, Homo sapiens
aaatgcccaaggatgc

SEQ ID NO: 1171072 - DNA, 11 bp, Homo sapiens
aaatgcccagt

SEQ ID NO: 1171073 - DNA, 15 bp, Homo sapiens
aaatgcccagttcac

SEQ ID NO: 1171074 - DNA, 15 bp, Homo sapiens
aaatgcccatttcga

SEQ ID NO: 1171075 - DNA, 22 bp, Homo sapiens
aaatgccctcttctcgtgcctc

SEQ ID NO: 1171076 - DNA, 18 bp, Homo sapiens
aaatgccctttgatgttt

SEQ ID NO: 1171077 - DNA, 17 bp, Homo sapiens
aaatgcctcagtgtatt

SEQ ID NO: 1171078 - DNA, 21 bp, Homo sapiens
aaatgcctcagtgtatttgta

SEQ ID NO: 1171079 - DNA, 23 bp, Homo sapiens
aaatgcctcagtgtatttgtatt

SEQ ID NO: 1171080 - DNA, 21 bp, Homo sapiens
aaatgcctgttgtatttatgg

SEQ ID NO: 1171081 - DNA, 18 bp, Homo sapiens
aaatgccttcatgaatct

SEQ ID NO: 1171082 - DNA, 19 bp, Homo sapiens
aaatgccttcatgaatctt

SEQ ID NO: 1171083 - DNA, 14 bp, Homo sapiens
aggtcccctccaca

SEQ ID NO: 1171084 - DNA, 21 bp, Homo sapiens
aggtcccctccacatcccagc

SEQ ID NO: 1171085 - DNA, 22 bp, Homo sapiens
aggtcccctccacatcccagca

SEQ ID NO: 1171086 - DNA, 20 bp, Homo sapiens
aggtcccctcgtcccatcca

SEQ ID NO: 1171087 - DNA, 12 bp, Homo sapiens
aggtccctgggg

SEQ ID NO: 1171088 - DNA, 19 bp, Homo sapiens
aggtcccttcaaggcctcc

SEQ ID NO: 1171089 - DNA, 14 bp, Homo sapiens
aggtccgtgggccg

SEQ ID NO: 1171090 - DNA, 15 bp, Homo sapiens
aggtcctcagagaat

SEQ ID NO: 1171091 - DNA, 12 bp, Homo sapiens
aggtcctcaggt

SEQ ID NO: 1171092 - DNA, 17 bp, Homo sapiens
aggtcctcaggtcagct

SEQ ID NO: 1171093 - DNA, 13 bp, Homo sapiens
aggtcctctcagt

SEQ ID NO: 1171094 - DNA, 13 bp, Homo sapiens
aggtcctctgtca

SEQ ID NO: 1171095 - DNA, 19 bp, Homo sapiens
aggtcctctgtcagtcaca

SEQ ID NO: 1171096 - DNA, 23 bp, Homo sapiens
aggtcctgcccatgtgtcccctc

SEQ ID NO: 1171097 - DNA, 12 bp, Homo sapiens
aggtcctgccct

SEQ ID NO: 1171098 - DNA, 11 bp, Homo sapiens
aggtcctgtct

SEQ ID NO: 1171099 - DNA, 16 bp, Homo sapiens
aggtccttgcctcctg

SEQ ID NO: 1171100 - DNA, 17 bp, Homo sapiens
aggtccttgcctcctgg

SEQ ID NO: 1171101 - DNA, 22 bp, Homo sapiens
aggtccttgcctgaactccaga

SEQ ID NO: 1171102 - DNA, 14 bp, Homo sapiens
aggtcgaggcagga

SEQ ID NO: 1171103 - DNA, 18 bp, Homo sapiens
aggtctaaataggatcct

SEQ ID NO: 1171104 - DNA, 19 bp, Homo sapiens
aggtctaactgtggaatat

SEQ ID NO: 1171105 - DNA, 23 bp, Homo sapiens
aggtctaactgtggaatataaat

SEQ ID NO: 1171106 - DNA, 15 bp, Homo sapiens
aggtctaatttagta

SEQ ID NO: 1171107 - DNA, 21 bp, Homo sapiens
aggtctattggccaacaatcc

SEQ ID NO: 1171108 - DNA, 21 bp, Homo sapiens
aggtctatttaaaaaaaaagt

SEQ ID NO: 1171109 - DNA, 13 bp, Homo sapiens
aggtctcacgggc

SEQ ID NO: 1171110 - DNA, 20 bp, Homo sapiens
aggtctcataggttgagcaa

SEQ ID NO: 1171111 - DNA, 16 bp, Homo sapiens
aggtctcatctcttca

SEQ ID NO: 1171112 - DNA, 17 bp, Homo sapiens
aggtctcatctcttcag

SEQ ID NO: 1171113 - DNA, 18 bp, Homo sapiens
aggtctcattgcttctga

SEQ ID NO: 1171114 - DNA, 21 bp, Homo sapiens
aggtctccaaaccagacggtg

SEQ ID NO: 1171115 - DNA, 23 bp, Homo sapiens
aggtctccaagggagggtgcagc

SEQ ID NO: 1171116 - DNA, 17 bp, Homo sapiens
aggtctcccacgtggga

SEQ ID NO: 1171117 - DNA, 19 bp, Homo sapiens
aaatggccagtgctgcttc

SEQ ID NO: 1171118 - DNA, 18 bp, Homo sapiens
aaatggccatgcaggagg

SEQ ID NO: 1171119 - DNA, 19 bp, Homo sapiens
aaatggccattttaaaatg

SEQ ID NO: 1171120 - DNA, 20 bp, Homo sapiens
aaatggctaataaactgtat

SEQ ID NO: 1171121 - DNA, 23 bp, Homo sapiens
aaatggctaataaactgtattaa

SEQ ID NO: 1171122 - DNA, 15 bp, Homo sapiens
aaatggctatgaaca

SEQ ID NO: 1171123 - DNA, 17 bp, Homo sapiens
aaatggctggtttttag

SEQ ID NO: 1171124 - DNA, 23 bp, Homo sapiens
aaatggcttcggacaaaatatct

SEQ ID NO: 1171125 - DNA, 15 bp, Homo sapiens
aaatggctttctcag

SEQ ID NO: 1171126 - DNA, 13 bp, Homo sapiens
aaatgggaaaaaa

SEQ ID NO: 1171127 - DNA, 16 bp, Homo sapiens
aaatgggaggaggaaa

SEQ ID NO: 1171128 - DNA, 11 bp, Homo sapiens
aaatgggcagt

SEQ ID NO: 1171129 - DNA, 15 bp, Homo sapiens
aaatgggcatttatt

SEQ ID NO: 1171130 - DNA, 15 bp, Homo sapiens
aaatgggcctgcctg

SEQ ID NO: 1171131 - DNA, 11 bp, Homo sapiens
aaatggggaaa

SEQ ID NO: 1171132 - DNA, 17 bp, Homo sapiens
aaatgggggtgcatttg

SEQ ID NO: 1171133 - DNA, 19 bp, Homo sapiens
aaatgggggtgcatttgag

SEQ ID NO: 1171134 - DNA, 18 bp, Homo sapiens
aaatggtagcattttaaa

SEQ ID NO: 1171135 - DNA, 19 bp, Homo sapiens
aaatggtcccaattaagaa

SEQ ID NO: 1171136 - DNA, 17 bp, Homo sapiens
aaatggtcgcccaggag

SEQ ID NO: 1171137 - DNA, 21 bp, Homo sapiens
aaatggtgagcgatcatttat

SEQ ID NO: 1171138 - DNA, 22 bp, Homo sapiens
aaatggtgatttaaaaacttgt

SEQ ID NO: 1171139 - DNA, 14 bp, Homo sapiens
aaatggtgtacata

SEQ ID NO: 1171140 - DNA, 16 bp, Homo sapiens
aaatggtgtacataat

SEQ ID NO: 1171141 - DNA, 13 bp, Homo sapiens
aaatggtgtcatg

SEQ ID NO: 1171142 - DNA, 14 bp, Homo sapiens
aaatggtgtcatgg

SEQ ID NO: 1171143 - DNA, 17 bp, Homo sapiens
aaatggtgttacattaa

SEQ ID NO: 1171144 - DNA, 19 bp, Homo sapiens
aaatggtgttttcatgtaa

SEQ ID NO: 1171145 - DNA, 17 bp, Homo sapiens
aaatggttaaattttac

SEQ ID NO: 1171146 - DNA, 21 bp, Homo sapiens
aaatggttaaattttacatga

SEQ ID NO: 1171147 - DNA, 15 bp, Homo sapiens
aaatggttcagaatt

SEQ ID NO: 1171148 - DNA, 23 bp, Homo sapiens
aaatggttcagaattaaactttt

SEQ ID NO: 1171149 - DNA, 16 bp, Homo sapiens
aaatggtttcctctgg

SEQ ID NO: 1171150 - DNA, 13 bp, Homo sapiens
aaatggtttttgt

SEQ ID NO: 1171151 - DNA, 18 bp, Homo sapiens
aaatgtaaaaatgaagga

SEQ ID NO: 1171152 - DNA, 17 bp, Homo sapiens
aaatgtaaaagtactct

SEQ ID NO: 1171153 - DNA, 14 bp, Homo sapiens
aaatgtaaactgcc

SEQ ID NO: 1171154 - DNA, 15 bp, Homo sapiens
aaatgtaaatattct

SEQ ID NO: 1171155 - DNA, 18 bp, Homo sapiens
aaatgtaacatgaagcaa

SEQ ID NO: 1171156 - DNA, 18 bp, Homo sapiens
aaatgtaactgtgccagt

SEQ ID NO: 1171157 - DNA, 23 bp, Homo sapiens
aaatgtaactgtgccagttcttt

SEQ ID NO: 1171158 - DNA, 22 bp, Homo sapiens
aaatgtaagatcgttctctgcc

SEQ ID NO: 1171159 - DNA, 10 bp, Homo sapiens
aaatgtaata

SEQ ID NO: 1171160 - DNA, 16 bp, Homo sapiens
aaatgtaatactggaa

SEQ ID NO: 1171161 - DNA, 18 bp, Homo sapiens
aaatgtaatactggaata

SEQ ID NO: 1171162 - DNA, 16 bp, Homo sapiens
aaatgtaatagtttat

SEQ ID NO: 1171163 - DNA, 16 bp, Homo sapiens
aaatgtaatgtcagac

SEQ ID NO: 1171164 - DNA, 22 bp, Homo sapiens
aaatgtaatgtcagactttgct

SEQ ID NO: 1171165 - DNA, 15 bp, Homo sapiens
aaatgtaatttagaa

SEQ ID NO: 1171166 - DNA, 18 bp, Homo sapiens
aaatgtaatttagaaact

SEQ ID NO: 1171167 - DNA, 22 bp, Homo sapiens
aaatgtacactaccaaacactc

SEQ ID NO: 1171168 - DNA, 16 bp, Homo sapiens
aaatgtacagacatat

SEQ ID NO: 1171169 - DNA, 19 bp, Homo sapiens
aaatgtacagacatattta

SEQ ID NO: 1171170 - DNA, 20 bp, Homo sapiens
aaatgtacagacatatttaa

SEQ ID NO: 1171171 - DNA, 19 bp, Homo sapiens
aaatgtacccgagcacata

SEQ ID NO: 1171172 - DNA, 20 bp, Homo sapiens
aaatgtacccgagcacatag

SEQ ID NO: 1171173 - DNA, 16 bp, Homo sapiens
aaatgtacctgatgta

SEQ ID NO: 1171174 - DNA, 15 bp, Homo sapiens
aaatgtactgagatt

SEQ ID NO: 1171175 - DNA, 18 bp, Homo sapiens
aaatgtagaatattcaga

SEQ ID NO: 1171176 - DNA, 20 bp, Homo sapiens
aaatgtagaatattcagaca

SEQ ID NO: 1171177 - DNA, 19 bp, Homo sapiens
aaatgtagcttcagtcatt

SEQ ID NO: 1171178 - DNA, 21 bp, Homo sapiens
aaatgtagcttcagtcattaa

SEQ ID NO: 1171179 - DNA, 14 bp, Homo sapiens
aaatgtagcttttg

SEQ ID NO: 1171180 - DNA, 20 bp, Homo sapiens
aaatgtaggcttagtttgtg

SEQ ID NO: 1171181 - DNA, 17 bp, Homo sapiens
aaatgtagttttgtata

SEQ ID NO: 1171182 - DNA, 17 bp, Homo sapiens
aaatgtataattaactt

SEQ ID NO: 1171183 - DNA, 21 bp, Homo sapiens
aaatgtataattaacttaact

SEQ ID NO: 1171184 - DNA, 11 bp, Homo sapiens
aaatgtatact

SEQ ID NO: 1171185 - DNA, 14 bp, Homo sapiens
aaatgtatcttatt

SEQ ID NO: 1171186 - DNA, 13 bp, Homo sapiens
aaatgtattatgt

SEQ ID NO: 1171187 - DNA, 23 bp, Homo sapiens
aaatgtattatgtcctgtgagat

SEQ ID NO: 1171188 - DNA, 14 bp, Homo sapiens
aaatgtattcaaat

SEQ ID NO: 1171189 - DNA, 15 bp, Homo sapiens
aaatgtattcaagca

SEQ ID NO: 1171190 - DNA, 13 bp, Homo sapiens
aaatgtcaattta

SEQ ID NO: 1171191 - DNA, 17 bp, Homo sapiens
aaatgtcacagaagcag

SEQ ID NO: 1171192 - DNA, 12 bp, Homo sapiens
aaatgtcactgc

SEQ ID NO: 1171193 - DNA, 14 bp, Homo sapiens
aaatgtcactgcca

SEQ ID NO: 1171194 - DNA, 19 bp, Homo sapiens
aaatgtcagtgtttgggaa

SEQ ID NO: 1171195 - DNA, 21 bp, Homo sapiens
aaatgtcagtgtttgggaaat

SEQ ID NO: 1171196 - DNA, 15 bp, Homo sapiens
aaatgtcagttctga

SEQ ID NO: 1171197 - DNA, 13 bp, Homo sapiens
aaatgtccctgca

SEQ ID NO: 1171198 - DNA, 22 bp, Homo sapiens
aaatgtcctgtggtgacaggcc

SEQ ID NO: 1171199 - DNA, 18 bp, Homo sapiens
aaatgtctaatagcccat

SEQ ID NO: 1171200 - DNA, 19 bp, Homo sapiens
aaatgtctagttgtaacac

SEQ ID NO: 1171201 - DNA, 14 bp, Homo sapiens
aaatgtctgctggt

SEQ ID NO: 1171202 - DNA, 13 bp, Homo sapiens
aaatgtctgtttc

SEQ ID NO: 1171203 - DNA, 21 bp, Homo sapiens
aaatgtctgttttagttggaa

SEQ ID NO: 1171204 - DNA, 12 bp, Homo sapiens
aaatgtcttgtg

SEQ ID NO: 1171205 - DNA, 13 bp, Homo sapiens
aaatttaagcatt

SEQ ID NO: 1171206 - DNA, 15 bp, Homo sapiens
aaatttaagtatctt

SEQ ID NO: 1171207 - DNA, 23 bp, Homo sapiens
aaatttaagtatcttttttcaaa

SEQ ID NO: 1171208 - DNA, 17 bp, Homo sapiens
aaatttaattcatgttt

SEQ ID NO: 1171209 - DNA, 12 bp, Homo sapiens
aaatttagaaca

SEQ ID NO: 1171210 - DNA, 22 bp, Homo sapiens
aaatttaggtcagggaaaagac

SEQ ID NO: 1171211 - DNA, 10 bp, Homo sapiens
aaatttataa

SEQ ID NO: 1171212 - DNA, 20 bp, Homo sapiens
aaatttatgcatttcattca

SEQ ID NO: 1171213 - DNA, 14 bp, Homo sapiens
aaatttattaaata

SEQ ID NO: 1171214 - DNA, 20 bp, Homo sapiens
aaatttatttaatgtgagtt

SEQ ID NO: 1171215 - DNA, 14 bp, Homo sapiens
aaatttatttactg

SEQ ID NO: 1171216 - DNA, 21 bp, Homo sapiens
aaatttatttactgctagtct

SEQ ID NO: 1171217 - DNA, 19 bp, Homo sapiens
aaatttatttccaatgttt

SEQ ID NO: 1171218 - DNA, 18 bp, Homo sapiens
aaatttattttataagaa

SEQ ID NO: 1171219 - DNA, 23 bp, Homo sapiens
aaatttattttataagaaaaact

SEQ ID NO: 1171220 - DNA, 21 bp, Homo sapiens
aaatttcacgattcatttttg

SEQ ID NO: 1171221 - DNA, 12 bp, Homo sapiens
aaatttcagatt

SEQ ID NO: 1171222 - DNA, 18 bp, Homo sapiens
aaatttcatgattggctt

SEQ ID NO: 1171223 - DNA, 22 bp, Homo sapiens
aaatttccagtacctttgtcac

SEQ ID NO: 1171224 - DNA, 20 bp, Homo sapiens
aaatttcgcttcttagaaca

SEQ ID NO: 1171225 - DNA, 12 bp, Homo sapiens
aaatttctaaat

SEQ ID NO: 1171226 - DNA, 11 bp, Homo sapiens
aaatttcttat

SEQ ID NO: 1171227 - DNA, 18 bp, Homo sapiens
aaatttctttgtttaaca

SEQ ID NO: 1171228 - DNA, 14 bp, Homo sapiens
aaatttgattgatt

SEQ ID NO: 1171229 - DNA, 21 bp, Homo sapiens
aaatttgccaccactagagct

SEQ ID NO: 1171230 - DNA, 23 bp, Homo sapiens
aaatttgccaccactagagctga

SEQ ID NO: 1171231 - DNA, 15 bp, Homo sapiens
aaatttgcctctgtc

SEQ ID NO: 1171232 - DNA, 13 bp, Homo sapiens
aaatttggcctta

SEQ ID NO: 1171233 - DNA, 19 bp, Homo sapiens
aaatttggccttaagaact

SEQ ID NO: 1171234 - DNA, 21 bp, Homo sapiens
aaatttggccttaagaactgt

SEQ ID NO: 1171235 - DNA, 20 bp, Homo sapiens
aaatttggctcacttgcctt

SEQ ID NO: 1171236 - DNA, 16 bp, Homo sapiens
aaatttgtctgaaaca

SEQ ID NO: 1171237 - DNA, 19 bp, Homo sapiens
aaatttgtgtaaatttgta

SEQ ID NO: 1171238 - DNA, 13 bp, Homo sapiens
aaatttgtgtgct

SEQ ID NO: 1171239 - DNA, 18 bp, Homo sapiens
aaatttgttcttgtattt

SEQ ID NO: 1171240 - DNA, 18 bp, Homo sapiens
aaatttgttgaaattatg

SEQ ID NO: 1171241 - DNA, 15 bp, Homo sapiens
aaatttgttgtttgt

SEQ ID NO: 1171242 - DNA, 14 bp, Homo sapiens
aaatttgtttgaaa

SEQ ID NO: 1171243 - DNA, 13 bp, Homo sapiens
aaatttgtttgta

SEQ ID NO: 1171244 - DNA, 14 bp, Homo sapiens
aaatttgtttgtat

SEQ ID NO: 1171245 - DNA, 18 bp, Homo sapiens
aaatttgtttgtattttt

SEQ ID NO: 1171246 - DNA, 16 bp, Homo sapiens
aaattttaatattcca

SEQ ID NO: 1171247 - DNA, 15 bp, Homo sapiens
aaattttagaaatat

SEQ ID NO: 1171248 - DNA, 12 bp, Homo sapiens
aaattttagagc

SEQ ID NO: 1171249 - DNA, 23 bp, Homo sapiens
aaattttagcgtgctcactgacc

SEQ ID NO: 1171250 - DNA, 20 bp, Homo sapiens
aaattttagttatagtgttt

SEQ ID NO: 1171251 - DNA, 18 bp, Homo sapiens
cattctgtttcctcttga

SEQ ID NO: 1171252 - DNA, 12 bp, Homo sapiens
cattcttactaa

SEQ ID NO: 1171253 - DNA, 14 bp, Homo sapiens
cattcttagctctt

SEQ ID NO: 1171254 - DNA, 17 bp, Homo sapiens
cattcttagctcttaat

SEQ ID NO: 1171255 - DNA, 18 bp, Homo sapiens
cattcttcagtgtctctg

SEQ ID NO: 1171256 - DNA, 21 bp, Homo sapiens
cattcttcagtgtctctgttt

SEQ ID NO: 1171257 - DNA, 13 bp, Homo sapiens
cattcttcctagt

SEQ ID NO: 1171258 - DNA, 18 bp, Homo sapiens
cattcttctctgttgtcg

SEQ ID NO: 1171259 - DNA, 19 bp, Homo sapiens
cattcttggcttaatcatt

SEQ ID NO: 1171260 - DNA, 18 bp, Homo sapiens
cattcttgtcacaataaa

SEQ ID NO: 1171261 - DNA, 14 bp, Homo sapiens
cattcttgtgggag

SEQ ID NO: 1171262 - DNA, 21 bp, Homo sapiens
cattcttgtgggagacagcag

SEQ ID NO: 1171263 - DNA, 21 bp, Homo sapiens
cattcttgttggtagcatgta

SEQ ID NO: 1171264 - DNA, 19 bp, Homo sapiens
cattctttataaaatgtat

SEQ ID NO: 1171265 - DNA, 12 bp, Homo sapiens
cattctttggta

SEQ ID NO: 1171266 - DNA, 16 bp, Homo sapiens
cattcttttaaaagac

SEQ ID NO: 1171267 - DNA, 17 bp, Homo sapiens
cattcttttaacttctt

SEQ ID NO: 1171268 - DNA, 18 bp, Homo sapiens
cattcttttaacttcttt

SEQ ID NO: 1171269 - DNA, 16 bp, Homo sapiens
cattcttttgtaattt

SEQ ID NO: 1171270 - DNA, 18 bp, Homo sapiens
cattcttttgtaatttaa

SEQ ID NO: 1171271 - DNA, 12 bp, Homo sapiens
cattgaaagaag

SEQ ID NO: 1171272 - DNA, 19 bp, Homo sapiens
cattgaaatgagcacctcc

SEQ ID NO: 1171273 - DNA, 21 bp, Homo sapiens
cattgaaatgagcacctccat

SEQ ID NO: 1171274 - DNA, 16 bp, Homo sapiens
cattgaacacaaactg

SEQ ID NO: 1171275 - DNA, 15 bp, Homo sapiens
cattgaacagcaaag

SEQ ID NO: 1171276 - DNA, 14 bp, Homo sapiens
cattgaacagctgt

SEQ ID NO: 1171277 - DNA, 23 bp, Homo sapiens
cattgaagaagaaccagcccagc

SEQ ID NO: 1171278 - DNA, 22 bp, Homo sapiens
cattgaagaatgttagagtaat

SEQ ID NO: 1171279 - DNA, 19 bp, Homo sapiens
cattgaagcagatttctgc

SEQ ID NO: 1171280 - DNA, 13 bp, Homo sapiens
cattgaaggctta

SEQ ID NO: 1171281 - DNA, 19 bp, Homo sapiens
cattgaagtaatgaatttt

SEQ ID NO: 1171282 - DNA, 20 bp, Homo sapiens
cattgaatgcgctttattgc

SEQ ID NO: 1171283 - DNA, 16 bp, Homo sapiens
cattgacaagaactga

SEQ ID NO: 1171284 - DNA, 14 bp, Homo sapiens
cattgacatgatat

SEQ ID NO: 1171285 - DNA, 17 bp, Homo sapiens
cattgaccaagaactgc

SEQ ID NO: 1171286 - DNA, 18 bp, Homo sapiens
cattgaccaagaactgca

SEQ ID NO: 1171287 - DNA, 19 bp, Homo sapiens
cattgaccaagaactgcat

SEQ ID NO: 1171288 - DNA, 21 bp, Homo sapiens
cattgaccgcgactaatttca

SEQ ID NO: 1171289 - DNA, 19 bp, Homo sapiens
cattgactatcaaactgaa

SEQ ID NO: 1171290 - DNA, 22 bp, Homo sapiens
cattgactggtttacaggccct

SEQ ID NO: 1171291 - DNA, 19 bp, Homo sapiens
cattgagaactgcatatgt

SEQ ID NO: 1171292 - DNA, 18 bp, Homo sapiens
cattgagagttttgtctt

SEQ ID NO: 1171293 - DNA, 13 bp, Homo sapiens
cattgagcctggc

SEQ ID NO: 1171294 - DNA, 19 bp, Homo sapiens
cattgagcttgcatgcttg

SEQ ID NO: 1171295 - DNA, 16 bp, Homo sapiens
cattgaggaagagtct

SEQ ID NO: 1171296 - DNA, 16 bp, Homo sapiens
cattgagttggttact

SEQ ID NO: 1171297 - DNA, 16 bp, Homo sapiens
cattgataatcttcag

SEQ ID NO: 1171298 - DNA, 17 bp, Homo sapiens
cattgataatcttcagg

SEQ ID NO: 1171299 - DNA, 22 bp, Homo sapiens
cattgatacaaagtacagaaaa

SEQ ID NO: 1171300 - DNA, 19 bp, Homo sapiens
cattgatccaggagataat

SEQ ID NO: 1171301 - DNA, 17 bp, Homo sapiens
cattgatggatgtcttc

SEQ ID NO: 1171302 - DNA, 14 bp, Homo sapiens
cattgatggttttt

SEQ ID NO: 1171303 - DNA, 15 bp, Homo sapiens
cattgattcagcctg

SEQ ID NO: 1171304 - DNA, 16 bp, Homo sapiens
cattgattgtcagcta

SEQ ID NO: 1171305 - DNA, 20 bp, Homo sapiens
cattgcactctagcctgggc

SEQ ID NO: 1171306 - DNA, 12 bp, Homo sapiens
cattgcagttta

SEQ ID NO: 1171307 - DNA, 15 bp, Homo sapiens
cattgccaagggctt

SEQ ID NO: 1171308 - DNA, 21 bp, Homo sapiens
cattgccacggaaacatacag

SEQ ID NO: 1171309 - DNA, 18 bp, Homo sapiens
cattgccaggagatggcc

SEQ ID NO: 1171310 - DNA, 21 bp, Homo sapiens
cattgccaggagatggcccca

SEQ ID NO: 1171311 - DNA, 20 bp, Homo sapiens
cattgccatgtaactatgta

SEQ ID NO: 1171312 - DNA, 23 bp, Homo sapiens
cattgcctcctgttctgcccacg

SEQ ID NO: 1171313 - DNA, 19 bp, Homo sapiens
cattgcctcttctacttgt

SEQ ID NO: 1171314 - DNA, 14 bp, Homo sapiens
cattgcctgttctg

SEQ ID NO: 1171315 - DNA, 15 bp, Homo sapiens
cattgcctgttctgc

SEQ ID NO: 1171316 - DNA, 13 bp, Homo sapiens
cattgccttcctc

SEQ ID NO: 1171317 - DNA, 17 bp, Homo sapiens
cattgccttcgctccat

SEQ ID NO: 1171318 - DNA, 18 bp, Homo sapiens
cattgccttcgctccatg

SEQ ID NO: 1171319 - DNA, 14 bp, Homo sapiens
cattgcctttgaat

SEQ ID NO: 1171320 - DNA, 15 bp, Homo sapiens
cattgctagataaaa

SEQ ID NO: 1171321 - DNA, 17 bp, Homo sapiens
cattgctagataaaagc

SEQ ID NO: 1171322 - DNA, 20 bp, Homo sapiens
cattgctctatgtctgcctt

SEQ ID NO: 1171323 - DNA, 15 bp, Homo sapiens
cattgctctctgggc

SEQ ID NO: 1171324 - DNA, 16 bp, Homo sapiens
cattgctctctgggct

SEQ ID NO: 1171325 - DNA, 17 bp, Homo sapiens
cattgctctctgggctt

SEQ ID NO: 1171326 - DNA, 14 bp, Homo sapiens
cattgctgagcctc

SEQ ID NO: 1171327 - DNA, 21 bp, Homo sapiens
cattgctgccaaggtggaggg

SEQ ID NO: 1171328 - DNA, 12 bp, Homo sapiens
cattgctgcctt

SEQ ID NO: 1171329 - DNA, 16 bp, Homo sapiens
agtgggaactgtgcaa

SEQ ID NO: 1171330 - DNA, 22 bp, Homo sapiens
agtgggaagcccatcctgacca

SEQ ID NO: 1171331 - DNA, 20 bp, Homo sapiens
agtgggaaggacttggcgcg

SEQ ID NO: 1171332 - DNA, 15 bp, Homo sapiens
agtgggaagtgaatc

SEQ ID NO: 1171333 - DNA, 17 bp, Homo sapiens
agtgggacagagtctgg

SEQ ID NO: 1171334 - DNA, 22 bp, Homo sapiens
agtgggacagcccagagcctgg

SEQ ID NO: 1171335 - DNA, 18 bp, Homo sapiens
agtgggacccatagatct

SEQ ID NO: 1171336 - DNA, 23 bp, Homo sapiens
agtgggacccatagatcttctga

SEQ ID NO: 1171337 - DNA, 13 bp, Homo sapiens
agtgggagaaaac

SEQ ID NO: 1171338 - DNA, 15 bp, Homo sapiens
agtgggagaaggcag

SEQ ID NO: 1171339 - DNA, 14 bp, Homo sapiens
agtgggagaggctg

SEQ ID NO: 1171340 - DNA, 15 bp, Homo sapiens
agtgggagaggctgg

SEQ ID NO: 1171341 - DNA, 18 bp, Homo sapiens
agtgggagaggctgggag

SEQ ID NO: 1171342 - DNA, 23 bp, Homo sapiens
agtgggagcagcttcttgggctg

SEQ ID NO: 1171343 - DNA, 15 bp, Homo sapiens
agtgggagctgagct

SEQ ID NO: 1171344 - DNA, 17 bp, Homo sapiens
agtgggagctgagctgg

SEQ ID NO: 1171345 - DNA, 14 bp, Homo sapiens
agtgggaggggcag

SEQ ID NO: 1171346 - DNA, 16 bp, Homo sapiens
agtgggaggggcaggc

SEQ ID NO: 1171347 - DNA, 19 bp, Homo sapiens
agtgggaggggcaggctga

SEQ ID NO: 1171348 - DNA, 15 bp, Homo sapiens
agtgggatgaaccag

SEQ ID NO: 1171349 - DNA, 13 bp, Homo sapiens
agtgggcaggtgg

SEQ ID NO: 1171350 - DNA, 23 bp, Homo sapiens
agtgggcagtcaccacccagccc

SEQ ID NO: 1171351 - DNA, 16 bp, Homo sapiens
agtgggccaggacagg

SEQ ID NO: 1171352 - DNA, 14 bp, Homo sapiens
agtgggccagggct

SEQ ID NO: 1171353 - DNA, 22 bp, Homo sapiens
agtgggccagggctgccctgag

SEQ ID NO: 1171354 - DNA, 18 bp, Homo sapiens
agtgggccctctctctgg

SEQ ID NO: 1171355 - DNA, 12 bp, Homo sapiens
agtgggccctgc

SEQ ID NO: 1171356 - DNA, 19 bp, Homo sapiens
agtgggccctgcccgggga

SEQ ID NO: 1171357 - DNA, 19 bp, Homo sapiens
agtgggcctgctgaggcct

SEQ ID NO: 1171358 - DNA, 15 bp, Homo sapiens
agtgggcgttgggag

SEQ ID NO: 1171359 - DNA, 21 bp, Homo sapiens
agtgggctgcacgctcccctc

SEQ ID NO: 1171360 - DNA, 21 bp, Homo sapiens
agtgggctggtattctctcta

SEQ ID NO: 1171361 - DNA, 16 bp, Homo sapiens
agtgggcttgattctg

SEQ ID NO: 1171362 - DNA, 16 bp, Homo sapiens
agtggggacagggagg

SEQ ID NO: 1171363 - DNA, 12 bp, Homo sapiens
agtggggagagg

SEQ ID NO: 1171364 - DNA, 12 bp, Homo sapiens
agtggggcctgt

SEQ ID NO: 1171365 - DNA, 13 bp, Homo sapiens
agtggggcctgtg

SEQ ID NO: 1171366 - DNA, 15 bp, Homo sapiens
agtggggcctgtgga

SEQ ID NO: 1171367 - DNA, 18 bp, Homo sapiens
agtggggctcgccatgcc

SEQ ID NO: 1171368 - DNA, 18 bp, Homo sapiens
agtggggctgcaggcagg

SEQ ID NO: 1171369 - DNA, 23 bp, Homo sapiens
agtgggggagagcaggctggcag

SEQ ID NO: 1171370 - DNA, 16 bp, Homo sapiens
agtggggggacagaga

SEQ ID NO: 1171371 - DNA, 18 bp, Homo sapiens
agtggggggaggaagcag

SEQ ID NO: 1171372 - DNA, 20 bp, Homo sapiens
agtggggtctccctctcctg

SEQ ID NO: 1171373 - DNA, 16 bp, Homo sapiens
agtgtgaatagcctgg

SEQ ID NO: 1171374 - DNA, 21 bp, Homo sapiens
agtgtgaatataaatgtgtgt

SEQ ID NO: 1171375 - DNA, 20 bp, Homo sapiens
agtgtgaattgcaaaaccca

SEQ ID NO: 1171376 - DNA, 14 bp, Homo sapiens
agtgtgacagggcc

SEQ ID NO: 1171377 - DNA, 17 bp, Homo sapiens
agtgtgacagggccagt

SEQ ID NO: 1171378 - DNA, 22 bp, Homo sapiens
agtgtgacagggccagtggggc

SEQ ID NO: 1171379 - DNA, 17 bp, Homo sapiens
agtgtgacagtttccaa

SEQ ID NO: 1171380 - DNA, 14 bp, Homo sapiens
agtgtgaccaggca

SEQ ID NO: 1171381 - DNA, 12 bp, Homo sapiens
agtgtgagaatc

SEQ ID NO: 1171382 - DNA, 19 bp, Homo sapiens
agtgtgaggacctccctgt

SEQ ID NO: 1171383 - DNA, 18 bp, Homo sapiens
agtgtgaggccagggcag

SEQ ID NO: 1171384 - DNA, 14 bp, Homo sapiens
agtgtgagggcagc

SEQ ID NO: 1171385 - DNA, 19 bp, Homo sapiens
agtgtgagggtcctgcagc

SEQ ID NO: 1171386 - DNA, 16 bp, Homo sapiens
agtgtgagtggcagcc

SEQ ID NO: 1171387 - DNA, 19 bp, Homo sapiens
agtgtgagtggcagccatg

SEQ ID NO: 1171388 - DNA, 22 bp, Homo sapiens
agtgtgagtggcagccatgcct

SEQ ID NO: 1171389 - DNA, 19 bp, Homo sapiens
agtgtgagtgtgtgtgcat

SEQ ID NO: 1171390 - DNA, 23 bp, Homo sapiens
agtgtgatgtatgtgtaataaat

SEQ ID NO: 1171391 - DNA, 18 bp, Homo sapiens
agtgtgcaactggccagc

SEQ ID NO: 1171392 - DNA, 20 bp, Homo sapiens
agtgtgcaactggccagcca

SEQ ID NO: 1171393 - DNA, 19 bp, Homo sapiens
agtgtgcacgagtgggaag

SEQ ID NO: 1171394 - DNA, 22 bp, Homo sapiens
agtgtgcacgagtgggaaggac

SEQ ID NO: 1171395 - DNA, 14 bp, Homo sapiens
agtgtgcagactga

SEQ ID NO: 1171396 - DNA, 13 bp, Homo sapiens
agtgtgcccatct

SEQ ID NO: 1171397 - DNA, 20 bp, Homo sapiens
agtgtgcctgaagtcccaga

SEQ ID NO: 1171398 - DNA, 16 bp, Homo sapiens
agtgtgctaaaaatga

SEQ ID NO: 1171399 - DNA, 23 bp, Homo sapiens
agtgtgctctccccggcaggcct

SEQ ID NO: 1171400 - DNA, 22 bp, Homo sapiens
agtgtgctctttttttaaaagg

SEQ ID NO: 1171401 - DNA, 19 bp, Homo sapiens
agtgtgctttgcattttct

SEQ ID NO: 1171402 - DNA, 23 bp, Homo sapiens
agtgtggaaaaatagctctgtgt

SEQ ID NO: 1171403 - DNA, 17 bp, Homo sapiens
agtgtggacttggcagg

SEQ ID NO: 1171404 - DNA, 12 bp, Homo sapiens
agtgtggagacc

SEQ ID NO: 1171405 - DNA, 13 bp, Homo sapiens
agtgtggagaggg

SEQ ID NO: 1171406 - DNA, 19 bp, Homo sapiens
agtgtggcctgtgccagca

SEQ ID NO: 1171407 - DNA, 14 bp, Homo sapiens
agtgtggctcccct

SEQ ID NO: 1171408 - DNA, 17 bp, Homo sapiens
agtgtggctcccctcta

SEQ ID NO: 1171409 - DNA, 22 bp, Homo sapiens
agtgtggctggtgtccccttcc

SEQ ID NO: 1171410 - DNA, 15 bp, Homo sapiens
agtgtgggaagggag

SEQ ID NO: 1171411 - DNA, 18 bp, Homo sapiens
agtgtgggagtgcagaga

SEQ ID NO: 1171412 - DNA, 11 bp, Homo sapiens
agtgtgtaaag

SEQ ID NO: 1171413 - DNA, 18 bp, Homo sapiens
agtgtgtatgtcagtggt

SEQ ID NO: 1171414 - DNA, 16 bp, Homo sapiens
agtgtgtatgtgcgtg

SEQ ID NO: 1171415 - DNA, 19 bp, Homo sapiens
agtgtgtattgttcccagt

SEQ ID NO: 1171416 - DNA, 13 bp, Homo sapiens
agtgtgtcagagc

SEQ ID NO: 1171417 - DNA, 18 bp, Homo sapiens
agtgtgtcagagcccagg

SEQ ID NO: 1171418 - DNA, 14 bp, Homo sapiens
agtgtgtccatcct

SEQ ID NO: 1171419 - DNA, 11 bp, Homo sapiens
agtgtgtctgc

SEQ ID NO: 1171420 - DNA, 12 bp, Homo sapiens
agtgtgtctgct

SEQ ID NO: 1171421 - DNA, 14 bp, Homo sapiens
agtgtgtgaagccg

SEQ ID NO: 1171422 - DNA, 14 bp, Homo sapiens
agtgtgtgagtgtg

SEQ ID NO: 1171423 - DNA, 19 bp, Homo sapiens
agtgtgtgcacatgtgtgc

SEQ ID NO: 1171424 - DNA, 18 bp, Homo sapiens
agtgtgtgcatgtgtgtg

SEQ ID NO: 1171425 - DNA, 14 bp, Homo sapiens
agtgtgtggctggg

SEQ ID NO: 1171426 - DNA, 15 bp, Homo sapiens
agtgtgtgggcaggg

SEQ ID NO: 1171427 - DNA, 13 bp, Homo sapiens
agtgtgtggggga

SEQ ID NO: 1171428 - DNA, 14 bp, Homo sapiens
agtgtgtgtgcaga

SEQ ID NO: 1171429 - DNA, 17 bp, Homo sapiens
agtgtgtgtgcagagtc

SEQ ID NO: 1171430 - DNA, 20 bp, Homo sapiens
agtgtgtgtgcatgtgtgtg

SEQ ID NO: 1171431 - DNA, 21 bp, Homo sapiens
agtgtgttctgattagaaatg

SEQ ID NO: 1171432 - DNA, 18 bp, Homo sapiens
agtgtgttggtgctttag

SEQ ID NO: 1171433 - DNA, 15 bp, Homo sapiens
agtgttacctgtgtg

SEQ ID NO: 1171434 - DNA, 17 bp, Homo sapiens
agtgttacctgtgtgct

SEQ ID NO: 1171435 - DNA, 22 bp, Homo sapiens
agtgttactacagccttaatat

SEQ ID NO: 1171436 - DNA, 17 bp, Homo sapiens
agtgttactttttgtaa

SEQ ID NO: 1171437 - DNA, 17 bp, Homo sapiens
agtgttagagaaatcct

SEQ ID NO: 1171438 - DNA, 19 bp, Homo sapiens
agtgttagggaagggcctg

SEQ ID NO: 1171439 - DNA, 23 bp, Homo sapiens
agtgttagggaagggcctgccac

SEQ ID NO: 1171440 - DNA, 17 bp, Homo sapiens
agtgttagtgctggtca

SEQ ID NO: 1171441 - DNA, 16 bp, Homo sapiens
agtgttatcagtcata

SEQ ID NO: 1171442 - DNA, 23 bp, Homo sapiens
agtgttatcagtcataactaaat

SEQ ID NO: 1171443 - DNA, 14 bp, Homo sapiens
agtgttatgtattt

SEQ ID NO: 1171444 - DNA, 22 bp, Homo sapiens
agtgttattttctttgaaattg

SEQ ID NO: 1171445 - DNA, 16 bp, Homo sapiens
agtgttcaaaatacta

SEQ ID NO: 1171446 - DNA, 22 bp, Homo sapiens
agtgttcaaactactgtacatt

SEQ ID NO: 1171447 - DNA, 16 bp, Homo sapiens
agtgttcacaaactgt

SEQ ID NO: 1171448 - DNA, 19 bp, Homo sapiens
agtgttcacaaactgtgaa

SEQ ID NO: 1171449 - DNA, 20 bp, Homo sapiens
agtgttcacaaactgtgaaa

SEQ ID NO: 1171450 - DNA, 14 bp, Homo sapiens
agtgttcactgctc

SEQ ID NO: 1171451 - DNA, 21 bp, Homo sapiens
agtgttcattttagtgactgt

SEQ ID NO: 1171452 - DNA, 16 bp, Homo sapiens
agtgttccccttccac

SEQ ID NO: 1171453 - DNA, 18 bp, Homo sapiens
agtgttccctttcctact

SEQ ID NO: 1171454 - DNA, 15 bp, Homo sapiens
agtgttcctgaagct

SEQ ID NO: 1171455 - DNA, 17 bp, Homo sapiens
agtgttctgagctgtat

SEQ ID NO: 1171456 - DNA, 17 bp, Homo sapiens
agtgttctgcaaaaata

SEQ ID NO: 1171457 - DNA, 23 bp, Homo sapiens
agtgttctgctcctgcttttctg

SEQ ID NO: 1171458 - DNA, 17 bp, Homo sapiens
agtgttctgtgggcttg

SEQ ID NO: 1171459 - DNA, 17 bp, Homo sapiens
catttagaagaaagatg

SEQ ID NO: 1171460 - DNA, 22 bp, Homo sapiens
catttagataatttgaaaaagt

SEQ ID NO: 1171461 - DNA, 22 bp, Homo sapiens
catttagatcctggtttcataa

SEQ ID NO: 1171462 - DNA, 15 bp, Homo sapiens
catttagtcatgtga

SEQ ID NO: 1171463 - DNA, 16 bp, Homo sapiens
catttataaccccagc

SEQ ID NO: 1171464 - DNA, 14 bp, Homo sapiens
catttataatgttt

SEQ ID NO: 1171465 - DNA, 11 bp, Homo sapiens
catttatactc

SEQ ID NO: 1171466 - DNA, 15 bp, Homo sapiens
catttatactctttt

SEQ ID NO: 1171467 - DNA, 17 bp, Homo sapiens
catttatatatatatgt

SEQ ID NO: 1171468 - DNA, 18 bp, Homo sapiens
catttatatatatatgta

SEQ ID NO: 1171469 - DNA, 13 bp, Homo sapiens
catttatatgtac

SEQ ID NO: 1171470 - DNA, 16 bp, Homo sapiens
catttatatttgtgta

SEQ ID NO: 1171471 - DNA, 18 bp, Homo sapiens
catttatccacaggaaag

SEQ ID NO: 1171472 - DNA, 22 bp, Homo sapiens
catttatccacaggaaagtgtt

SEQ ID NO: 1171473 - DNA, 20 bp, Homo sapiens
catttatctaaatatggact

SEQ ID NO: 1171474 - DNA, 14 bp, Homo sapiens
catttatgacctaa

SEQ ID NO: 1171475 - DNA, 22 bp, Homo sapiens
catttatgacctaagtcaggta

SEQ ID NO: 1171476 - DNA, 18 bp, Homo sapiens
catttatttattactgtc

SEQ ID NO: 1171477 - DNA, 17 bp, Homo sapiens
catttattttttacatt

SEQ ID NO: 1171478 - DNA, 16 bp, Homo sapiens
catttcaaagccctgc

SEQ ID NO: 1171479 - DNA, 17 bp, Homo sapiens
catttcaaagccctgcc

SEQ ID NO: 1171480 - DNA, 19 bp, Homo sapiens
catttcaaagccctgcctc

SEQ ID NO: 1171481 - DNA, 15 bp, Homo sapiens
catttcaagcagctg

SEQ ID NO: 1171482 - DNA, 23 bp, Homo sapiens
catttcaaggaatggaatcttct

SEQ ID NO: 1171483 - DNA, 23 bp, Homo sapiens
catttcaatgtcagcctttgtta

SEQ ID NO: 1171484 - DNA, 18 bp, Homo sapiens
catttcaatgtgtataaa

SEQ ID NO: 1171485 - DNA, 15 bp, Homo sapiens
catttcagagggtaa

SEQ ID NO: 1171486 - DNA, 14 bp, Homo sapiens
catttcagccaaag

SEQ ID NO: 1171487 - DNA, 14 bp, Homo sapiens
catttcaggaattt

SEQ ID NO: 1171488 - DNA, 17 bp, Homo sapiens
catttcaggaatttaaa

SEQ ID NO: 1171489 - DNA, 13 bp, Homo sapiens
catttcaggaggg

SEQ ID NO: 1171490 - DNA, 15 bp, Homo sapiens
catttcagtggcttc

SEQ ID NO: 1171491 - DNA, 16 bp, Homo sapiens
catttcagtggcttcc

SEQ ID NO: 1171492 - DNA, 18 bp, Homo sapiens
catttcagtgtattgttt

SEQ ID NO: 1171493 - DNA, 14 bp, Homo sapiens
catttcatctattt

SEQ ID NO: 1171494 - DNA, 15 bp, Homo sapiens
catttcatctatttc

SEQ ID NO: 1171495 - DNA, 16 bp, Homo sapiens
agttaaagcatatgct

SEQ ID NO: 1171496 - DNA, 12 bp, Homo sapiens
agttaaagccac

SEQ ID NO: 1171497 - DNA, 12 bp, Homo sapiens
agttaaaggcag

SEQ ID NO: 1171498 - DNA, 23 bp, Homo sapiens
agttaaatagagtatatgcactt

SEQ ID NO: 1171499 - DNA, 13 bp, Homo sapiens
agttaacaaggaa

SEQ ID NO: 1171500 - DNA, 19 bp, Homo sapiens
agttaacaggatattagac

SEQ ID NO: 1171501 - DNA, 21 bp, Homo sapiens
agttaacatcatgaatttatt

SEQ ID NO: 1171502 - DNA, 17 bp, Homo sapiens
agttaactattgcattt

SEQ ID NO: 1171503 - DNA, 12 bp, Homo sapiens
agttaactgaat

SEQ ID NO: 1171504 - DNA, 18 bp, Homo sapiens
agttaactttaagactga

SEQ ID NO: 1171505 - DNA, 16 bp, Homo sapiens
agttaagaagccctgc

SEQ ID NO: 1171506 - DNA, 19 bp, Homo sapiens
agttaagacatgatttcct

SEQ ID NO: 1171507 - DNA, 22 bp, Homo sapiens
agttaagcaaatagattaatga

SEQ ID NO: 1171508 - DNA, 12 bp, Homo sapiens
agttaaggaaat

SEQ ID NO: 1171509 - DNA, 19 bp, Homo sapiens
agttaaggaaatgttgagg

SEQ ID NO: 1171510 - DNA, 18 bp, Homo sapiens
agttaataacagctcctt

SEQ ID NO: 1171511 - DNA, 19 bp, Homo sapiens
agttaataacagctccttt

SEQ ID NO: 1171512 - DNA, 11 bp, Homo sapiens
agttaataatg

SEQ ID NO: 1171513 - DNA, 13 bp, Homo sapiens
agttaataatgta

SEQ ID NO: 1171514 - DNA, 18 bp, Homo sapiens
agttaatactccagagac

SEQ ID NO: 1171515 - DNA, 20 bp, Homo sapiens
agttaatatatcccagaaat

SEQ ID NO: 1171516 - DNA, 14 bp, Homo sapiens
agttaatgagccat

SEQ ID NO: 1171517 - DNA, 19 bp, Homo sapiens
agttaatgtatataaaaat

SEQ ID NO: 1171518 - DNA, 17 bp, Homo sapiens
agttaatttttccaact

SEQ ID NO: 1171519 - DNA, 16 bp, Homo sapiens
agttacacaattaatt

SEQ ID NO: 1171520 - DNA, 20 bp, Homo sapiens
agttacacagaaatgctgct

SEQ ID NO: 1171521 - DNA, 21 bp, Homo sapiens
agttacacagaaatgctgctg

SEQ ID NO: 1171522 - DNA, 17 bp, Homo sapiens
agttacagcgagaggca

SEQ ID NO: 1171523 - DNA, 20 bp, Homo sapiens
agttacattaatgcccagcc

SEQ ID NO: 1171524 - DNA, 22 bp, Homo sapiens
agttaccaaacattacaaaaaa

SEQ ID NO: 1171525 - DNA, 15 bp, Homo sapiens
agttaccagtgcctt

SEQ ID NO: 1171526 - DNA, 21 bp, Homo sapiens
agttacgtataatgctttctg

SEQ ID NO: 1171527 - DNA, 22 bp, Homo sapiens
agttacgtataatgctttctga

SEQ ID NO: 1171528 - DNA, 18 bp, Homo sapiens
agttactaagaagaaaat

SEQ ID NO: 1171529 - DNA, 23 bp, Homo sapiens
agttactaagaagaaaattgctg

SEQ ID NO: 1171530 - DNA, 16 bp, Homo sapiens
agttactactgatttt

SEQ ID NO: 1171531 - DNA, 22 bp, Homo sapiens
agttactaggtaacttcatatt

SEQ ID NO: 1171532 - DNA, 19 bp, Homo sapiens
agttactatagtggtgaga

SEQ ID NO: 1171533 - DNA, 12 bp, Homo sapiens
agttactcagcc

SEQ ID NO: 1171534 - DNA, 23 bp, Homo sapiens
agttactcagccctgggccccac

SEQ ID NO: 1171535 - DNA, 15 bp, Homo sapiens
agttactgtgtaatt

SEQ ID NO: 1171536 - DNA, 19 bp, Homo sapiens
agttactgtgtaattagtg

SEQ ID NO: 1171537 - DNA, 19 bp, Homo sapiens
agttacttaattgccagca

SEQ ID NO: 1171538 - DNA, 23 bp, Homo sapiens
agttacttaattgccagcaaata

SEQ ID NO: 1171539 - DNA, 14 bp, Homo sapiens
agttacttgaattt

SEQ ID NO: 1171540 - DNA, 15 bp, Homo sapiens
agttacttgaatttc

SEQ ID NO: 1171541 - DNA, 19 bp, Homo sapiens
agttacttgtctgaggcct

SEQ ID NO: 1171542 - DNA, 20 bp, Homo sapiens
agttacttgtctgaggcctc

SEQ ID NO: 1171543 - DNA, 14 bp, Homo sapiens
agttactttatgtt

SEQ ID NO: 1171544 - DNA, 14 bp, Homo sapiens
agttactttttgta

SEQ ID NO: 1171545 - DNA, 16 bp, Homo sapiens
agttagagcagcctcg

SEQ ID NO: 1171546 - DNA, 17 bp, Homo sapiens
agttagattcactttga

SEQ ID NO: 1171547 - DNA, 18 bp, Homo sapiens
agttagcaactagggcta

SEQ ID NO: 1171548 - DNA, 20 bp, Homo sapiens
agttagcatgtatgaatgta

SEQ ID NO: 1171549 - DNA, 23 bp, Homo sapiens
agttagccatctaatgcttgttt

SEQ ID NO: 1171550 - DNA, 15 bp, Homo sapiens
agttagcctccacca

SEQ ID NO: 1171551 - DNA, 18 bp, Homo sapiens
agttagctaataaaaagc

SEQ ID NO: 1171552 - DNA, 15 bp, Homo sapiens
agttagctccataaa

SEQ ID NO: 1171553 - DNA, 17 bp, Homo sapiens
agttagctccataaagt

SEQ ID NO: 1171554 - DNA, 20 bp, Homo sapiens
agttagctttaacttaaata

SEQ ID NO: 1171555 - DNA, 21 bp, Homo sapiens
agttagctttaacttaaatag

SEQ ID NO: 1171556 - DNA, 16 bp, Homo sapiens
agttagggtctatgta

SEQ ID NO: 1171557 - DNA, 15 bp, Homo sapiens
agttagtagcatgtt

SEQ ID NO: 1171558 - DNA, 16 bp, Homo sapiens
agttagtagcatgttg

SEQ ID NO: 1171559 - DNA, 20 bp, Homo sapiens
agttagtatcttttgatatg

SEQ ID NO: 1171560 - DNA, 15 bp, Homo sapiens
agttagtgatcctgt

SEQ ID NO: 1171561 - DNA, 16 bp, Homo sapiens
agttagttaagttggg

SEQ ID NO: 1171562 - DNA, 15 bp, Homo sapiens
agttagttccactga

SEQ ID NO: 1171563 - DNA, 17 bp, Homo sapiens
agttagttccactgaga

SEQ ID NO: 1171564 - DNA, 21 bp, Homo sapiens
agttagttgtgaaagaaagct

SEQ ID NO: 1171565 - DNA, 15 bp, Homo sapiens
agttagtttgtatat

SEQ ID NO: 1171566 - DNA, 18 bp, Homo sapiens
agttataaaattaaaagt

SEQ ID NO: 1171567 - DNA, 12 bp, Homo sapiens
agttataaatca

SEQ ID NO: 1171568 - DNA, 21 bp, Homo sapiens
agttataagtagcaggccaag

SEQ ID NO: 1171569 - DNA, 16 bp, Homo sapiens
agttataataactgaa

SEQ ID NO: 1171570 - DNA, 22 bp, Homo sapiens
agttataataactgaactgttt

SEQ ID NO: 1171571 - DNA, 16 bp, Homo sapiens
agttatagtttcagat

SEQ ID NO: 1171572 - DNA, 18 bp, Homo sapiens
agttatagtttcagatat

SEQ ID NO: 1171573 - DNA, 16 bp, Homo sapiens
agttatatgtacagtt

SEQ ID NO: 1171574 - DNA, 13 bp, Homo sapiens
agttatattcact

SEQ ID NO: 1171575 - DNA, 19 bp, Homo sapiens
agttatatttcagatgtaa

SEQ ID NO: 1171576 - DNA, 16 bp, Homo sapiens
agttatatttttgtgt

SEQ ID NO: 1171577 - DNA, 21 bp, Homo sapiens
agttatcaaaaagtattatca

SEQ ID NO: 1171578 - DNA, 15 bp, Homo sapiens
agttatcatctcacc

SEQ ID NO: 1171579 - DNA, 22 bp, Homo sapiens
agttatcatgaattttaaagta

SEQ ID NO: 1171580 - DNA, 16 bp, Homo sapiens
agttatctaaaagaaa

SEQ ID NO: 1171581 - DNA, 22 bp, Homo sapiens
agttatctaagttaatttaaag

SEQ ID NO: 1171582 - DNA, 14 bp, Homo sapiens
agttatctgatttt

SEQ ID NO: 1171583 - DNA, 22 bp, Homo sapiens
agttatcttctttattattcct

SEQ ID NO: 1171584 - DNA, 23 bp, Homo sapiens
agttatgaacacttaaattatga

SEQ ID NO: 1171585 - DNA, 12 bp, Homo sapiens
agttatgatgta

SEQ ID NO: 1171586 - DNA, 18 bp, Homo sapiens
catttgccaagggaggcg

SEQ ID NO: 1171587 - DNA, 12 bp, Homo sapiens
catttgccttgc

SEQ ID NO: 1171588 - DNA, 21 bp, Homo sapiens
catttgccttgcagaactgcc

SEQ ID NO: 1171589 - DNA, 19 bp, Homo sapiens
catttgctagttctgctgc

SEQ ID NO: 1171590 - DNA, 11 bp, Homo sapiens
catttgctgaa

SEQ ID NO: 1171591 - DNA, 20 bp, Homo sapiens
catttgctgaatagctacta

SEQ ID NO: 1171592 - DNA, 14 bp, Homo sapiens
catttggaaccaaa

SEQ ID NO: 1171593 - DNA, 15 bp, Homo sapiens
catttggattggatg

SEQ ID NO: 1171594 - DNA, 20 bp, Homo sapiens
catttggcaatgccatcatc

SEQ ID NO: 1171595 - DNA, 18 bp, Homo sapiens
catttggccccaggggac

SEQ ID NO: 1171596 - DNA, 15 bp, Homo sapiens
catttggcttgctgt

SEQ ID NO: 1171597 - DNA, 18 bp, Homo sapiens
catttgggagacatgtga

SEQ ID NO: 1171598 - DNA, 23 bp, Homo sapiens
catttgggagtttttatgagaaa

SEQ ID NO: 1171599 - DNA, 16 bp, Homo sapiens
catttgggatggagaa

SEQ ID NO: 1171600 - DNA, 14 bp, Homo sapiens
catttggtcctttc

SEQ ID NO: 1171601 - DNA, 16 bp, Homo sapiens
catttggtctcaggca

SEQ ID NO: 1171602 - DNA, 18 bp, Homo sapiens
catttggtctcaggcagc

SEQ ID NO: 1171603 - DNA, 21 bp, Homo sapiens
catttggtctcaggcagcacc

SEQ ID NO: 1171604 - DNA, 17 bp, Homo sapiens
catttggtctgccagaa

SEQ ID NO: 1171605 - DNA, 20 bp, Homo sapiens
catttggtgctggtctattt

SEQ ID NO: 1171606 - DNA, 22 bp, Homo sapiens
catttggtggtactttattctt

SEQ ID NO: 1171607 - DNA, 17 bp, Homo sapiens
catttggtgttcctgga

SEQ ID NO: 1171608 - DNA, 18 bp, Homo sapiens
catttggtgttcctggaa

SEQ ID NO: 1171609 - DNA, 19 bp, Homo sapiens
catttggttctaagaaacc

SEQ ID NO: 1171610 - DNA, 14 bp, Homo sapiens
catttgtaaaaatg

SEQ ID NO: 1171611 - DNA, 21 bp, Homo sapiens
catttgtaaaaatgagtcatt

SEQ ID NO: 1171612 - DNA, 13 bp, Homo sapiens
catttgtaacttt

SEQ ID NO: 1171613 - DNA, 13 bp, Homo sapiens
catttgtaataaa

SEQ ID NO: 1171614 - DNA, 17 bp, Homo sapiens
catttgtacaaggtaat

SEQ ID NO: 1171615 - DNA, 21 bp, Homo sapiens
catttgtacaaggtaattgtt

SEQ ID NO: 1171616 - DNA, 23 bp, Homo sapiens
catttgtactttatttttgtata

SEQ ID NO: 1171617 - DNA, 15 bp, Homo sapiens
catttgtattttgtg

SEQ ID NO: 1171618 - DNA, 23 bp, Homo sapiens
catttgtcctaatctgctgccag

SEQ ID NO: 1171619 - DNA, 12 bp, Homo sapiens
catttgtgccac

SEQ ID NO: 1171620 - DNA, 15 bp, Homo sapiens
catttgtgccagagg

SEQ ID NO: 1171621 - DNA, 16 bp, Homo sapiens
catttgtgcgtatgca

SEQ ID NO: 1171622 - DNA, 20 bp, Homo sapiens
catttgtgctccattttttc

SEQ ID NO: 1171623 - DNA, 18 bp, Homo sapiens
catttgtggcagtccctt

SEQ ID NO: 1171624 - DNA, 14 bp, Homo sapiens
catttgtgtcaatg

SEQ ID NO: 1171625 - DNA, 19 bp, Homo sapiens
catttgtgtgtgtgcaagt

SEQ ID NO: 1171626 - DNA, 15 bp, Homo sapiens
catttgttaaaatta

SEQ ID NO: 1171627 - DNA, 16 bp, Homo sapiens
catttgttaatatcac

SEQ ID NO: 1171628 - DNA, 23 bp, Homo sapiens
catttgttatcctcttgtatact

SEQ ID NO: 1171629 - DNA, 14 bp, Homo sapiens
catttgttcactga

SEQ ID NO: 1171630 - DNA, 14 bp, Homo sapiens
catttgttcctgct

SEQ ID NO: 1171631 - DNA, 20 bp, Homo sapiens
catttgttcctggagttttg

SEQ ID NO: 1171632 - DNA, 20 bp, Homo sapiens
catttgtttacatttgatgc

SEQ ID NO: 1171633 - DNA, 19 bp, Homo sapiens
catttgtttatgtaatttc

SEQ ID NO: 1171634 - DNA, 21 bp, Homo sapiens
catttgtttctttctctgagg

SEQ ID NO: 1171635 - DNA, 14 bp, Homo sapiens
catttgttttgctt

SEQ ID NO: 1171636 - DNA, 18 bp, Homo sapiens
catttgttttgcttttgt

SEQ ID NO: 1171637 - DNA, 15 bp, Homo sapiens
cattttaaaaacttt

SEQ ID NO: 1171638 - DNA, 18 bp, Homo sapiens
cattttaaaaactttatt

SEQ ID NO: 1171639 - DNA, 16 bp, Homo sapiens
cattttaaaatgttta

SEQ ID NO: 1171640 - DNA, 17 bp, Homo sapiens
cattttaaacaaaatag

SEQ ID NO: 1171641 - DNA, 18 bp, Homo sapiens
cattttaaactcctgaaa

SEQ ID NO: 1171642 - DNA, 13 bp, Homo sapiens
cattttaaataaa

SEQ ID NO: 1171643 - DNA, 20 bp, Homo sapiens
cattttaaattccactgaaa

SEQ ID NO: 1171644 - DNA, 18 bp, Homo sapiens
cattttaaccctatttta

SEQ ID NO: 1171645 - DNA, 17 bp, Homo sapiens
cattttaacgctgccta

SEQ ID NO: 1171646 - DNA, 19 bp, Homo sapiens
cattttaagaagacatgac

SEQ ID NO: 1171647 - DNA, 14 bp, Homo sapiens
cattttaagtgctt

SEQ ID NO: 1171648 - DNA, 14 bp, Homo sapiens
cattttaatagaga

SEQ ID NO: 1171649 - DNA, 16 bp, Homo sapiens
cattttaattctctcc

SEQ ID NO: 1171650 - DNA, 22 bp, Homo sapiens
cattttaatttattaattgctt

SEQ ID NO: 1171651 - DNA, 19 bp, Homo sapiens
cattttaattttaaccaaa

SEQ ID NO: 1171652 - DNA, 12 bp, Homo sapiens
cattttacacat

SEQ ID NO: 1171653 - DNA, 20 bp, Homo sapiens
cattttacacatgtgctgat

SEQ ID NO: 1171654 - DNA, 22 bp, Homo sapiens
cattttaccatcacacatgttc

SEQ ID NO: 1171655 - DNA, 17 bp, Homo sapiens
cattttactttttcctg

SEQ ID NO: 1171656 - DNA, 23 bp, Homo sapiens
cattttagaaactacaaatatag

SEQ ID NO: 1171657 - DNA, 16 bp, Homo sapiens
cattttagtgactgta

SEQ ID NO: 1171658 - DNA, 12 bp, Homo sapiens
cattttatacaa

SEQ ID NO: 1171659 - DNA, 15 bp, Homo sapiens
cattttatacaattt

SEQ ID NO: 1171660 - DNA, 16 bp, Homo sapiens
cattttatactgtaca

SEQ ID NO: 1171661 - DNA, 21 bp, Homo sapiens
cattttattttattatgcatg

SEQ ID NO: 1171662 - DNA, 15 bp, Homo sapiens
cattttattttcatg

SEQ ID NO: 1171663 - DNA, 14 bp, Homo sapiens
cattttatttttga

SEQ ID NO: 1171664 - DNA, 19 bp, Homo sapiens
cattttattttttcttgca

SEQ ID NO: 1171665 - DNA, 20 bp, Homo sapiens
cattttattttttgggccat

SEQ ID NO: 1171666 - DNA, 17 bp, Homo sapiens
cattttcaccccaccct

SEQ ID NO: 1171667 - DNA, 18 bp, Homo sapiens
cattttcagttccctcct

SEQ ID NO: 1171668 - DNA, 13 bp, Homo sapiens
cattttcatcctg

SEQ ID NO: 1171669 - DNA, 19 bp, Homo sapiens
cattttccacggaaacaga

SEQ ID NO: 1171670 - DNA, 16 bp, Homo sapiens
cattttcccatcatcc

SEQ ID NO: 1171671 - DNA, 21 bp, Homo sapiens
cattttcccccactactgcag

SEQ ID NO: 1171672 - DNA, 22 bp, Homo sapiens
cattttccccccactctcccca

SEQ ID NO: 1171673 - DNA, 16 bp, Homo sapiens
cattttccccttcctc

SEQ ID NO: 1171674 - DNA, 16 bp, Homo sapiens
cattttcctcctctgc

SEQ ID NO: 1171675 - DNA, 20 bp, Homo sapiens
cattttcctcgcctaggcct

SEQ ID NO: 1171676 - DNA, 10 bp, Homo sapiens
cattttcctg

SEQ ID NO: 1171677 - DNA, 16 bp, Homo sapiens
cattttcctgtttact

SEQ ID NO: 1171678 - DNA, 18 bp, Homo sapiens
cattttcctgtttactga

SEQ ID NO: 1171679 - DNA, 19 bp, Homo sapiens
cattttcctgtttactgat

SEQ ID NO: 1171680 - DNA, 15 bp, Homo sapiens
cattttcgtcctgta

SEQ ID NO: 1171681 - DNA, 18 bp, Homo sapiens
cattttctaaataaaaat

SEQ ID NO: 1171682 - DNA, 12 bp, Homo sapiens
cattttctagat

SEQ ID NO: 1171683 - DNA, 20 bp, Homo sapiens
cattttctagatacaataaa

SEQ ID NO: 1171684 - DNA, 15 bp, Homo sapiens
cattttctataacat

SEQ ID NO: 1171685 - DNA, 12 bp, Homo sapiens
cattttctctaa

SEQ ID NO: 1171686 - DNA, 22 bp, Homo sapiens
cattttcttcagaattatccat

SEQ ID NO: 1171687 - DNA, 16 bp, Homo sapiens
cattttcttttattat

SEQ ID NO: 1171688 - DNA, 18 bp, Homo sapiens
cattttcttttcacttcg

SEQ ID NO: 1171689 - DNA, 19 bp, Homo sapiens
cattttgaaagtctgtcct

SEQ ID NO: 1171690 - DNA, 21 bp, Homo sapiens
cattttgagctgaaatgctgc

SEQ ID NO: 1171691 - DNA, 20 bp, Homo sapiens
cattttgagtgactcgaggg

SEQ ID NO: 1171692 - DNA, 20 bp, Homo sapiens
cattttgcagaaggaaatga

SEQ ID NO: 1171693 - DNA, 21 bp, Homo sapiens
cattttgcagaaggaaatgat

SEQ ID NO: 1171694 - DNA, 18 bp, Homo sapiens
cattttgcagcagtgagt

SEQ ID NO: 1171695 - DNA, 22 bp, Homo sapiens
cattttgcagcagtgagtctct

SEQ ID NO: 1171696 - DNA, 19 bp, Homo sapiens
cattttgctattgtaaata

SEQ ID NO: 1171697 - DNA, 16 bp, Homo sapiens
cattttggatgtcatt

SEQ ID NO: 1171698 - DNA, 23 bp, Homo sapiens
cattttggtaagagacagaatgt

SEQ ID NO: 1171699 - DNA, 20 bp, Homo sapiens
cattttggttttgtgttttg

SEQ ID NO: 1171700 - DNA, 19 bp, Homo sapiens
cattttgtaacaaatgaac

SEQ ID NO: 1171701 - DNA, 16 bp, Homo sapiens
cattttgtaataataa

SEQ ID NO: 1171702 - DNA, 14 bp, Homo sapiens
cattttgtaatatt

SEQ ID NO: 1171703 - DNA, 17 bp, Homo sapiens
cattttgttaagaagtt

SEQ ID NO: 1171704 - DNA, 18 bp, Homo sapiens
cattttgttaagaagttg

SEQ ID NO: 1171705 - DNA, 12 bp, Homo sapiens
cattttgttaca

SEQ ID NO: 1171706 - DNA, 17 bp, Homo sapiens
cattttgttatagaata

SEQ ID NO: 1171707 - DNA, 17 bp, Homo sapiens
cattttgtttctgtata

SEQ ID NO: 1171708 - DNA, 13 bp, Homo sapiens
cattttgtttgaa

SEQ ID NO: 1171709 - DNA, 13 bp, Homo sapiens
catttttaaactt

SEQ ID NO: 1171710 - DNA, 23 bp, Homo sapiens
catttttaaagtagaagagggtt

SEQ ID NO: 1171711 - DNA, 20 bp, Homo sapiens
agttatgatttttttttcat

SEQ ID NO: 1171712 - DNA, 18 bp, Homo sapiens
agttatggcctatacact

SEQ ID NO: 1171713 - DNA, 14 bp, Homo sapiens
agttatgtgaatga

SEQ ID NO: 1171714 - DNA, 20 bp, Homo sapiens
agttattacatgtaatttga

SEQ ID NO: 1171715 - DNA, 12 bp, Homo sapiens
agttattacctc

SEQ ID NO: 1171716 - DNA, 18 bp, Homo sapiens
agttattacctctccagt

SEQ ID NO: 1171717 - DNA, 19 bp, Homo sapiens
agttattatctatggaaat

SEQ ID NO: 1171718 - DNA, 16 bp, Homo sapiens
agttattcaaatgaag

SEQ ID NO: 1171719 - DNA, 18 bp, Homo sapiens
agttattcaaatttgtac

SEQ ID NO: 1171720 - DNA, 19 bp, Homo sapiens
agttattcatattctgttg

SEQ ID NO: 1171721 - DNA, 13 bp, Homo sapiens
agttattgcagtt

SEQ ID NO: 1171722 - DNA, 16 bp, Homo sapiens
agttattgcagtttat

SEQ ID NO: 1171723 - DNA, 13 bp, Homo sapiens
agttattgtacag

SEQ ID NO: 1171724 - DNA, 18 bp, Homo sapiens
agttattgtacagctgtt

SEQ ID NO: 1171725 - DNA, 19 bp, Homo sapiens
agttattgtacagctgttt

SEQ ID NO: 1171726 - DNA, 21 bp, Homo sapiens
agttattgtacagctgtttaa

SEQ ID NO: 1171727 - DNA, 22 bp, Homo sapiens
agttattgtacagctgtttaag

SEQ ID NO: 1171728 - DNA, 22 bp, Homo sapiens
agttatttttctttttaagaga

SEQ ID NO: 1171729 - DNA, 20 bp, Homo sapiens
agttcaaaattctaaatgta

SEQ ID NO: 1171730 - DNA, 13 bp, Homo sapiens
agttcaaacaaga

SEQ ID NO: 1171731 - DNA, 23 bp, Homo sapiens
agttcaaatcctcaccatccaca

SEQ ID NO: 1171732 - DNA, 13 bp, Homo sapiens
agttcaacatgtt

SEQ ID NO: 1171733 - DNA, 14 bp, Homo sapiens
agttcaagaagata

SEQ ID NO: 1171734 - DNA, 15 bp, Homo sapiens
agttcaagaccagcc

SEQ ID NO: 1171735 - DNA, 20 bp, Homo sapiens
agttcaatactcttgaaatg

SEQ ID NO: 1171736 - DNA, 13 bp, Homo sapiens
agttcaatcctac

SEQ ID NO: 1171737 - DNA, 15 bp, Homo sapiens
agttcaatctcccgc

SEQ ID NO: 1171738 - DNA, 18 bp, Homo sapiens
agttcaccttggaagggc

SEQ ID NO: 1171739 - DNA, 13 bp, Homo sapiens
catttttgtgcca

SEQ ID NO: 1171740 - DNA, 14 bp, Homo sapiens
catttttgttttga

SEQ ID NO: 1171741 - DNA, 16 bp, Homo sapiens
catttttgttttgaaa

SEQ ID NO: 1171742 - DNA, 15 bp, Homo sapiens
cattttttaaatgca

SEQ ID NO: 1171743 - DNA, 16 bp, Homo sapiens
cattttttaaatgcac

SEQ ID NO: 1171744 - DNA, 19 bp, Homo sapiens
cattttttaaatgcacctg

SEQ ID NO: 1171745 - DNA, 15 bp, Homo sapiens
cattttttaagagac

SEQ ID NO: 1171746 - DNA, 19 bp, Homo sapiens
cattttttaaggactcagc

SEQ ID NO: 1171747 - DNA, 14 bp, Homo sapiens
cattttttaggaca

SEQ ID NO: 1171748 - DNA, 19 bp, Homo sapiens
cattttttgctataatcat

SEQ ID NO: 1171749 - DNA, 16 bp, Homo sapiens
catttttttctaccta

SEQ ID NO: 1171750 - DNA, 23 bp, Homo sapiens
catttttttctacctataacact

SEQ ID NO: 1171751 - DNA, 16 bp, Homo sapiens
catttttttctctctg

SEQ ID NO: 1171752 - DNA, 17 bp, Homo sapiens
catttttttctctctgg

SEQ ID NO: 1171753 - DNA, 21 bp, Homo sapiens
catttttttctgatttgtcct

SEQ ID NO: 1171754 - DNA, 21 bp, Homo sapiens
catttttttttcaatcaactt

SEQ ID NO: 1171755 - DNA, 22 bp, Homo sapiens
catttttttttcaatcaacttt

SEQ ID NO: 1171756 - DNA, 17 bp, Homo sapiens
ccaaaaaaaggaaaaat

SEQ ID NO: 1171757 - DNA, 12 bp, Homo sapiens
ccaaaaaactac

SEQ ID NO: 1171758 - DNA, 15 bp, Homo sapiens
ccaaaaagagactga

SEQ ID NO: 1171759 - DNA, 14 bp, Homo sapiens
ccaaaaaggcaaat

SEQ ID NO: 1171760 - DNA, 18 bp, Homo sapiens
ccaaaaatacaacacaga

SEQ ID NO: 1171761 - DNA, 17 bp, Homo sapiens
ccaaaaatatctcctcc

SEQ ID NO: 1171762 - DNA, 19 bp, Homo sapiens
ccaaaaatgtgtaagaaca

SEQ ID NO: 1171763 - DNA, 22 bp, Homo sapiens
ccaaaaattgccaagtgcctat

SEQ ID NO: 1171764 - DNA, 21 bp, Homo sapiens
ccaaaacatccacttaagttc

SEQ ID NO: 1171765 - DNA, 22 bp, Homo sapiens
ccaaaacatccacttaagttct

SEQ ID NO: 1171766 - DNA, 18 bp, Homo sapiens
ccaaaacattttaaatga

SEQ ID NO: 1171767 - DNA, 21 bp, Homo sapiens
ccaaaacattttaaatgaaag

SEQ ID NO: 1171768 - DNA, 14 bp, Homo sapiens
ccaaaaccaatgct

SEQ ID NO: 1171769 - DNA, 18 bp, Homo sapiens
ccaaaaccacatgggctg

SEQ ID NO: 1171770 - DNA, 22 bp, Homo sapiens
ccaaaaccacatgggctggggg

SEQ ID NO: 1171771 - DNA, 17 bp, Homo sapiens
ccaaaactgagcataag

SEQ ID NO: 1171772 - DNA, 11 bp, Homo sapiens
ccaaaactgct

SEQ ID NO: 1171773 - DNA, 16 bp, Homo sapiens
ccaaaagaaactgaca

SEQ ID NO: 1171774 - DNA, 22 bp, Homo sapiens
ccaaaagattgctgaaatttta

SEQ ID NO: 1171775 - DNA, 14 bp, Homo sapiens
ccaaaagcacttac

SEQ ID NO: 1171776 - DNA, 15 bp, Homo sapiens
ccaaaagcgccctca

SEQ ID NO: 1171777 - DNA, 22 bp, Homo sapiens
ccaaaagcgccctcactattct

SEQ ID NO: 1171778 - DNA, 15 bp, Homo sapiens
ccaaaagctttttat

SEQ ID NO: 1171779 - DNA, 23 bp, Homo sapiens
ccaaaaggtttaagaaatagaat

SEQ ID NO: 1171780 - DNA, 21 bp, Homo sapiens
ccaaaagtcaaaaggtgcctg

SEQ ID NO: 1171781 - DNA, 22 bp, Homo sapiens
ccaaaagtcaaaaggtgcctgt

SEQ ID NO: 1171782 - DNA, 19 bp, Homo sapiens
ccaaaagtccctccctgcc

SEQ ID NO: 1171783 - DNA, 18 bp, Homo sapiens
ccaaaataaaacttttta

SEQ ID NO: 1171784 - DNA, 16 bp, Homo sapiens
ccaaaataagaaaaga

SEQ ID NO: 1171785 - DNA, 17 bp, Homo sapiens
ccaaaatgactttgaac

SEQ ID NO: 1171786 - DNA, 18 bp, Homo sapiens
ccaaaatgactttgaact

SEQ ID NO: 1171787 - DNA, 20 bp, Homo sapiens
ccaaaatgttggtcatttta

SEQ ID NO: 1171788 - DNA, 20 bp, Homo sapiens
ccaaaattgttttgagcttt

SEQ ID NO: 1171789 - DNA, 16 bp, Homo sapiens
ccaaaatttattttat

SEQ ID NO: 1171790 - DNA, 12 bp, Homo sapiens
ccaaaattttta

SEQ ID NO: 1171791 - DNA, 13 bp, Homo sapiens
ccaaacaaggaag

SEQ ID NO: 1171792 - DNA, 18 bp, Homo sapiens
ccaaacaaggaagccaaa

SEQ ID NO: 1171793 - DNA, 14 bp, Homo sapiens
ccaaacaccggcag

SEQ ID NO: 1171794 - DNA, 19 bp, Homo sapiens
ccaaacaccttccagctcc

SEQ ID NO: 1171795 - DNA, 15 bp, Homo sapiens
ccaaacactcagtcc

SEQ ID NO: 1171796 - DNA, 13 bp, Homo sapiens
ccaaacacttctg

SEQ ID NO: 1171797 - DNA, 16 bp, Homo sapiens
ccaaacacttctgctt

SEQ ID NO: 1171798 - DNA, 18 bp, Homo sapiens
ccaaacagcaagaagctg

SEQ ID NO: 1171799 - DNA, 16 bp, Homo sapiens
ccaaacagccacactg

SEQ ID NO: 1171800 - DNA, 14 bp, Homo sapiens
ccaaacaggaacta

SEQ ID NO: 1171801 - DNA, 17 bp, Homo sapiens
ccaaacagtgctgtttc

SEQ ID NO: 1171802 - DNA, 20 bp, Homo sapiens
ccaaacatcctacaagacac

SEQ ID NO: 1171803 - DNA, 19 bp, Homo sapiens
ccaaaccattactgagggg

SEQ ID NO: 1171804 - DNA, 19 bp, Homo sapiens
ccaaacccacttctggcct

SEQ ID NO: 1171805 - DNA, 11 bp, Homo sapiens
ccaaacccagc

SEQ ID NO: 1171806 - DNA, 15 bp, Homo sapiens
ccaaacccagccact

SEQ ID NO: 1171807 - DNA, 17 bp, Homo sapiens
ccaaacccagtctcctc

SEQ ID NO: 1171808 - DNA, 14 bp, Homo sapiens
ccaaaccccagccc

SEQ ID NO: 1171809 - DNA, 14 bp, Homo sapiens
ccaaaccctgtctg

SEQ ID NO: 1171810 - DNA, 16 bp, Homo sapiens
ccaaacccttcaactc

SEQ ID NO: 1171811 - DNA, 19 bp, Homo sapiens
ccaaacccttcaactcctg

SEQ ID NO: 1171812 - DNA, 20 bp, Homo sapiens
ccaaacccttcaactcctgg

SEQ ID NO: 1171813 - DNA, 15 bp, Homo sapiens
ccaaacctgacagat

SEQ ID NO: 1171814 - DNA, 22 bp, Homo sapiens
ccaaacgccctttcctcctcag

SEQ ID NO: 1171815 - DNA, 20 bp, Homo sapiens
ccaaactccccttccctggg

SEQ ID NO: 1171816 - DNA, 22 bp, Homo sapiens
ccaaactccccttccctgggga

SEQ ID NO: 1171817 - DNA, 20 bp, Homo sapiens
ccaaactgcacacacagctc

SEQ ID NO: 1171818 - DNA, 21 bp, Homo sapiens
ccaaacttatggacactgcct

SEQ ID NO: 1171819 - DNA, 22 bp, Homo sapiens
ccaaacttatggacactgcctt

SEQ ID NO: 1171820 - DNA, 18 bp, Homo sapiens
ccaaacttggatttttga

SEQ ID NO: 1171821 - DNA, 16 bp, Homo sapiens
ccaaacttgttcattt

SEQ ID NO: 1171822 - DNA, 16 bp, Homo sapiens
ccaaactttaaaatgc

SEQ ID NO: 1171823 - DNA, 19 bp, Homo sapiens
ccaaactttaaaatgcgaa

SEQ ID NO: 1171824 - DNA, 22 bp, Homo sapiens
ccaaacttttgcagaaaaaaca

SEQ ID NO: 1171825 - DNA, 12 bp, Homo sapiens
ccaaagaaacaa

SEQ ID NO: 1171826 - DNA, 17 bp, Homo sapiens
ccaaagaaacaagctgt

SEQ ID NO: 1171827 - DNA, 19 bp, Homo sapiens
ccaaagaaatgggcctgcc

SEQ ID NO: 1171828 - DNA, 15 bp, Homo sapiens
ccaaagaaccaaaga

SEQ ID NO: 1171829 - DNA, 20 bp, Homo sapiens
ccaaagaacttgatttgcat

SEQ ID NO: 1171830 - DNA, 15 bp, Homo sapiens
ccaaagaaggcaggg

SEQ ID NO: 1171831 - DNA, 21 bp, Homo sapiens
ccaaagaattcctgaagccag

SEQ ID NO: 1171832 - DNA, 14 bp, Homo sapiens
ccaaagaattggaa

SEQ ID NO: 1171833 - DNA, 14 bp, Homo sapiens
ccaaagactgtact

SEQ ID NO: 1171834 - DNA, 21 bp, Homo sapiens
ccaaagagactggagcatctg

SEQ ID NO: 1171835 - DNA, 14 bp, Homo sapiens
ccaaagagcctgga

SEQ ID NO: 1171836 - DNA, 18 bp, Homo sapiens
ccaaagagcctggagaag

SEQ ID NO: 1171837 - DNA, 16 bp, Homo sapiens
ccaaagagcctttcca

SEQ ID NO: 1171838 - DNA, 17 bp, Homo sapiens
ccaaagagggcttcctc

SEQ ID NO: 1171839 - DNA, 15 bp, Homo sapiens
agttctgcaaataga

SEQ ID NO: 1171840 - DNA, 16 bp, Homo sapiens
agttctgcaaatagaa

SEQ ID NO: 1171841 - DNA, 15 bp, Homo sapiens
agttctgccaggcaa

SEQ ID NO: 1171842 - DNA, 22 bp, Homo sapiens
agttctgcccaaattatgtgaa

SEQ ID NO: 1171843 - DNA, 16 bp, Homo sapiens
agttctgctcctctcc

SEQ ID NO: 1171844 - DNA, 21 bp, Homo sapiens
agttctgctcctctccaggca

SEQ ID NO: 1171845 - DNA, 12 bp, Homo sapiens
agttctgctgcc

SEQ ID NO: 1171846 - DNA, 16 bp, Homo sapiens
agttctgctgccctct

SEQ ID NO: 1171847 - DNA, 15 bp, Homo sapiens
agttctgtgcctccc

SEQ ID NO: 1171848 - DNA, 17 bp, Homo sapiens
agttctgtgcctccccc

SEQ ID NO: 1171849 - DNA, 20 bp, Homo sapiens
agttctgtgcctccccccag

SEQ ID NO: 1171850 - DNA, 16 bp, Homo sapiens
agttctgtggtttcat

SEQ ID NO: 1171851 - DNA, 17 bp, Homo sapiens
agttctgtgtagagaat

SEQ ID NO: 1171852 - DNA, 20 bp, Homo sapiens
agttctgttgttttgtgtat

SEQ ID NO: 1171853 - DNA, 21 bp, Homo sapiens
agttctgtttggtgtgtccca

SEQ ID NO: 1171854 - DNA, 15 bp, Homo sapiens
agttctgttttctgt

SEQ ID NO: 1171855 - DNA, 23 bp, Homo sapiens
agttcttagattcaggggaaggg

SEQ ID NO: 1171856 - DNA, 21 bp, Homo sapiens
agttcttatgaggaggggagg

SEQ ID NO: 1171857 - DNA, 14 bp, Homo sapiens
agttcttattttag

SEQ ID NO: 1171858 - DNA, 14 bp, Homo sapiens
agttcttcaagagg

SEQ ID NO: 1171859 - DNA, 17 bp, Homo sapiens
agttcttcaagaggaaa

SEQ ID NO: 1171860 - DNA, 12 bp, Homo sapiens
agttcttcacct

SEQ ID NO: 1171861 - DNA, 18 bp, Homo sapiens
ccaaagtacactgtttca

SEQ ID NO: 1171862 - DNA, 20 bp, Homo sapiens
ccaaagtacactgtttcaaa

SEQ ID NO: 1171863 - DNA, 17 bp, Homo sapiens
ccaaagtaccacactga

SEQ ID NO: 1171864 - DNA, 16 bp, Homo sapiens
ccaaagtcccttcctg

SEQ ID NO: 1171865 - DNA, 17 bp, Homo sapiens
ccaaagtcccttcctgc

SEQ ID NO: 1171866 - DNA, 14 bp, Homo sapiens
ccaaagtgcagccc

SEQ ID NO: 1171867 - DNA, 22 bp, Homo sapiens
ccaaagtgcagcccttcctcct

SEQ ID NO: 1171868 - DNA, 17 bp, Homo sapiens
ccaaagtgcctgggaag

SEQ ID NO: 1171869 - DNA, 13 bp, Homo sapiens
ccaaagtgctgag

SEQ ID NO: 1171870 - DNA, 15 bp, Homo sapiens
ccaaagtgctgggat

SEQ ID NO: 1171871 - DNA, 16 bp, Homo sapiens
ccaaagtgctgggatt

SEQ ID NO: 1171872 - DNA, 19 bp, Homo sapiens
ccaaagtgctgggattaca

SEQ ID NO: 1171873 - DNA, 22 bp, Homo sapiens
ccaaagtgctgggattacaggg

SEQ ID NO: 1171874 - DNA, 22 bp, Homo sapiens
ccaaagtgctgggattacaggt

SEQ ID NO: 1171875 - DNA, 23 bp, Homo sapiens
ccaaagtgctgggattacaggtg

SEQ ID NO: 1171876 - DNA, 16 bp, Homo sapiens
ccaaagtggagctggg

SEQ ID NO: 1171877 - DNA, 19 bp, Homo sapiens
ccaaagtggtatagaaatg

SEQ ID NO: 1171878 - DNA, 22 bp, Homo sapiens
ccaaagtggtatagaaatgctg

SEQ ID NO: 1171879 - DNA, 15 bp, Homo sapiens
ccaaagttgttgtaa

SEQ ID NO: 1171880 - DNA, 18 bp, Homo sapiens
ccaaagttttcaaactgc

SEQ ID NO: 1171881 - DNA, 15 bp, Homo sapiens
ccaaataagaaacct

SEQ ID NO: 1171882 - DNA, 16 bp, Homo sapiens
ccaaataagaaaccta

SEQ ID NO: 1171883 - DNA, 17 bp, Homo sapiens
ccaaataagaaacctaa

SEQ ID NO: 1171884 - DNA, 16 bp, Homo sapiens
ccaaatacctcaattt

SEQ ID NO: 1171885 - DNA, 15 bp, Homo sapiens
ccaaatagccccaga

SEQ ID NO: 1171886 - DNA, 20 bp, Homo sapiens
ccaaataggagggagactgt

SEQ ID NO: 1171887 - DNA, 13 bp, Homo sapiens
ccaaatatgcact

SEQ ID NO: 1171888 - DNA, 14 bp, Homo sapiens
ccaaatatgcactt

SEQ ID NO: 1171889 - DNA, 16 bp, Homo sapiens
ccaaatatgcactttc

SEQ ID NO: 1171890 - DNA, 17 bp, Homo sapiens
ccaaatatgcactttcc

SEQ ID NO: 1171891 - DNA, 20 bp, Homo sapiens
ccaaatatgcactttcccta

SEQ ID NO: 1171892 - DNA, 22 bp, Homo sapiens
ccaaatatgcactttccctaga

SEQ ID NO: 1171893 - DNA, 19 bp, Homo sapiens
ccaaatatgtattttccta

SEQ ID NO: 1171894 - DNA, 20 bp, Homo sapiens
ccaaatcaataagaaggtag

SEQ ID NO: 1171895 - DNA, 23 bp, Homo sapiens
ccaaatcagctgctactactcct

SEQ ID NO: 1171896 - DNA, 14 bp, Homo sapiens
ccaaatcatcctga

SEQ ID NO: 1171897 - DNA, 19 bp, Homo sapiens
ccaaatcatcctgaatctg

SEQ ID NO: 1171898 - DNA, 16 bp, Homo sapiens
ccaaatccacaagcca

SEQ ID NO: 1171899 - DNA, 21 bp, Homo sapiens
ccaaatctcagttgtttgctt

SEQ ID NO: 1171900 - DNA, 22 bp, Homo sapiens
ccaaatctcagttgtttgcttc

SEQ ID NO: 1171901 - DNA, 15 bp, Homo sapiens
ccaaatctgtcctct

SEQ ID NO: 1171902 - DNA, 17 bp, Homo sapiens
ccaaatctgtcctctgt

SEQ ID NO: 1171903 - DNA, 17 bp, Homo sapiens
ccaaatgcacaagctca

SEQ ID NO: 1171904 - DNA, 16 bp, Homo sapiens
ccaaatgcagttcatt

SEQ ID NO: 1171905 - DNA, 15 bp, Homo sapiens
ccaaatgcccaagga

SEQ ID NO: 1171906 - DNA, 19 bp, Homo sapiens
ccaaatgcccaaggatgcc

SEQ ID NO: 1171907 - DNA, 21 bp, Homo sapiens
ccaaatgcccaaggatgcctt

SEQ ID NO: 1171908 - DNA, 16 bp, Homo sapiens
ccaaatgcctgttgta

SEQ ID NO: 1171909 - DNA, 17 bp, Homo sapiens
ccaaatgcctgttgtat

SEQ ID NO: 1171910 - DNA, 21 bp, Homo sapiens
ccaaatggagaagctgcaggc

SEQ ID NO: 1171911 - DNA, 22 bp, Homo sapiens
ccaaatggccagttttctggta

SEQ ID NO: 1171912 - DNA, 22 bp, Homo sapiens
ccaaatgtaattgaataaagtt

SEQ ID NO: 1171913 - DNA, 19 bp, Homo sapiens
ccaaatgtcggggttgggg

SEQ ID NO: 1171914 - DNA, 20 bp, Homo sapiens
ccaaatgtcggggttggggt

SEQ ID NO: 1171915 - DNA, 12 bp, Homo sapiens
ccaaatgtttat

SEQ ID NO: 1171916 - DNA, 13 bp, Homo sapiens
ccaaatgtttata

SEQ ID NO: 1171917 - DNA, 22 bp, Homo sapiens
ccaaatgtttataaaggtaaaa

SEQ ID NO: 1171918 - DNA, 23 bp, Homo sapiens
ccaaattataagggccctgccct

SEQ ID NO: 1171919 - DNA, 18 bp, Homo sapiens
ccaaattatgtgaaatgc

SEQ ID NO: 1171920 - DNA, 17 bp, Homo sapiens
ccaaattattaattgtc

SEQ ID NO: 1171921 - DNA, 18 bp, Homo sapiens
ccaaattattaattgtcc

SEQ ID NO: 1171922 - DNA, 20 bp, Homo sapiens
ccaaattattaattgtcctg

SEQ ID NO: 1171923 - DNA, 22 bp, Homo sapiens
ccaaattattaattgtcctgtg

SEQ ID NO: 1171924 - DNA, 19 bp, Homo sapiens
ccaaattatttcttaatta

SEQ ID NO: 1171925 - DNA, 12 bp, Homo sapiens
ccaaattatttg

SEQ ID NO: 1171926 - DNA, 18 bp, Homo sapiens
ccaaattatttgtgtaat

SEQ ID NO: 1171927 - DNA, 22 bp, Homo sapiens
ccaaattctttcagtggctacc

SEQ ID NO: 1171928 - DNA, 18 bp, Homo sapiens
ccaaattgcttgagcctg

SEQ ID NO: 1171929 - DNA, 21 bp, Homo sapiens
ccaaattgcttgagcctggct

SEQ ID NO: 1171930 - DNA, 16 bp, Homo sapiens
ccaaattgtttgtaca

SEQ ID NO: 1171931 - DNA, 18 bp, Homo sapiens
ccaaatttaaaactgttg

SEQ ID NO: 1171932 - DNA, 22 bp, Homo sapiens
ccaaatttcctgtttgaaatat

SEQ ID NO: 1171933 - DNA, 15 bp, Homo sapiens
ccaaatttgattgat

SEQ ID NO: 1171934 - DNA, 17 bp, Homo sapiens
ccaaattttaaaagcca

SEQ ID NO: 1171935 - DNA, 20 bp, Homo sapiens
ccaaattttaatattccaga

SEQ ID NO: 1171936 - DNA, 23 bp, Homo sapiens
ccaaattttaatttttgctttta

SEQ ID NO: 1171937 - DNA, 17 bp, Homo sapiens
ccaaattttctttttat

SEQ ID NO: 1171938 - DNA, 19 bp, Homo sapiens
ccaaatttttttcttagga

SEQ ID NO: 1171939 - DNA, 11 bp, Homo sapiens
ccaacaaacca

SEQ ID NO: 1171940 - DNA, 12 bp, Homo sapiens
ccaacaaaccat

SEQ ID NO: 1171941 - DNA, 17 bp, Homo sapiens
ccaacaactctgccttt

SEQ ID NO: 1171942 - DNA, 18 bp, Homo sapiens
ccaacaactctgccttta

SEQ ID NO: 1171943 - DNA, 14 bp, Homo sapiens
ccaacaagaagaaa

SEQ ID NO: 1171944 - DNA, 19 bp, Homo sapiens
ccaacaagaagaaatatga

SEQ ID NO: 1171945 - DNA, 21 bp, Homo sapiens
ccaacaagaagggactgagag

SEQ ID NO: 1171946 - DNA, 12 bp, Homo sapiens
ccaacaagaatg

SEQ ID NO: 1171947 - DNA, 21 bp, Homo sapiens
ccaacaagattgcttaataaa

SEQ ID NO: 1171948 - DNA, 18 bp, Homo sapiens
ccaacaagcaccccgctt

SEQ ID NO: 1171949 - DNA, 18 bp, Homo sapiens
ccaacaaggttggcaccc

SEQ ID NO: 1171950 - DNA, 22 bp, Homo sapiens
ccaacaaggttggcaccccagc

SEQ ID NO: 1171951 - DNA, 23 bp, Homo sapiens
ccaacaataaacaggaattttat

SEQ ID NO: 1171952 - DNA, 14 bp, Homo sapiens
ccaacacaggcaag

SEQ ID NO: 1171953 - DNA, 17 bp, Homo sapiens
ccaacacagttgggacc

SEQ ID NO: 1171954 - DNA, 14 bp, Homo sapiens
ccaacaccacagac

SEQ ID NO: 1171955 - DNA, 15 bp, Homo sapiens
ccaacaccacagaca

SEQ ID NO: 1171956 - DNA, 17 bp, Homo sapiens
ccaacaccacagacaca

SEQ ID NO: 1171957 - DNA, 18 bp, Homo sapiens
ccaacaccacagacacac

SEQ ID NO: 1171958 - DNA, 15 bp, Homo sapiens
ccaacacctgcctct

SEQ ID NO: 1171959 - DNA, 14 bp, Homo sapiens
ccaacacctgctgc

SEQ ID NO: 1171960 - DNA, 16 bp, Homo sapiens
ccaacacgcacctgcc

SEQ ID NO: 1171961 - DNA, 20 bp, Homo sapiens
ccaacacgcacctgcctcag

SEQ ID NO: 1171962 - DNA, 14 bp, Homo sapiens
ccaacactgtgccc

SEQ ID NO: 1171963 - DNA, 15 bp, Homo sapiens
ccaacactgtgccct

SEQ ID NO: 1171964 - DNA, 19 bp, Homo sapiens
ccaacactgtgccctggtg

SEQ ID NO: 1171965 - DNA, 20 bp, Homo sapiens
ccaacactttgagcattttt

SEQ ID NO: 1171966 - DNA, 14 bp, Homo sapiens
agttgtaaataatt

SEQ ID NO: 1171967 - DNA, 22 bp, Homo sapiens
agttgtaaataatttatttaat

SEQ ID NO: 1171968 - DNA, 18 bp, Homo sapiens
agttgtaacttatattga

SEQ ID NO: 1171969 - DNA, 19 bp, Homo sapiens
agttgtaacttatattgaa

SEQ ID NO: 1171970 - DNA, 18 bp, Homo sapiens
agttgtaccaaaacatcc

SEQ ID NO: 1171971 - DNA, 13 bp, Homo sapiens
agttgtacttctg

SEQ ID NO: 1171972 - DNA, 20 bp, Homo sapiens
agttgtagcaggtttcacta

SEQ ID NO: 1171973 - DNA, 21 bp, Homo sapiens
agttgtaggcgaatcatttgt

SEQ ID NO: 1171974 - DNA, 22 bp, Homo sapiens
agttgtaggcgaatcatttgtt

SEQ ID NO: 1171975 - DNA, 14 bp, Homo sapiens
agttgtatctcttt

SEQ ID NO: 1171976 - DNA, 22 bp, Homo sapiens
agttgtatctcttttgaatcca

SEQ ID NO: 1171977 - DNA, 18 bp, Homo sapiens
agttgtatgtttgctgat

SEQ ID NO: 1171978 - DNA, 19 bp, Homo sapiens
agttgtatttaacagaaat

SEQ ID NO: 1171979 - DNA, 16 bp, Homo sapiens
agttgtcctatggaca

SEQ ID NO: 1171980 - DNA, 18 bp, Homo sapiens
agttgtcctatggacaac

SEQ ID NO: 1171981 - DNA, 18 bp, Homo sapiens
agttgtcctgatttctta

SEQ ID NO: 1171982 - DNA, 22 bp, Homo sapiens
agtttcctgagggttttctcat

SEQ ID NO: 1171983 - DNA, 12 bp, Homo sapiens
agtttcctggaa

SEQ ID NO: 1171984 - DNA, 20 bp, Homo sapiens
agtttcgacttatttcttaa

SEQ ID NO: 1171985 - DNA, 19 bp, Homo sapiens
agtttcgctccatcgccca

SEQ ID NO: 1171986 - DNA, 13 bp, Homo sapiens
agtttctaaaatt

SEQ ID NO: 1171987 - DNA, 18 bp, Homo sapiens
agtttctagaggcctcag

SEQ ID NO: 1171988 - DNA, 21 bp, Homo sapiens
agtttctagctagaaatatga

SEQ ID NO: 1171989 - DNA, 18 bp, Homo sapiens
agtttctagtgtcactga

SEQ ID NO: 1171990 - DNA, 13 bp, Homo sapiens
agtttctattctg

SEQ ID NO: 1171991 - DNA, 21 bp, Homo sapiens
agtttctcagggtcactgtcc

SEQ ID NO: 1171992 - DNA, 18 bp, Homo sapiens
agtttctctaaagtcact

SEQ ID NO: 1171993 - DNA, 12 bp, Homo sapiens
agtttctgcttg

SEQ ID NO: 1171994 - DNA, 23 bp, Homo sapiens
agtttctgtcgttaaaaacagat

SEQ ID NO: 1171995 - DNA, 14 bp, Homo sapiens
agtttctgttgaat

SEQ ID NO: 1171996 - DNA, 14 bp, Homo sapiens
agtttctgtttgat

SEQ ID NO: 1171997 - DNA, 19 bp, Homo sapiens
agtttctgtttgattcttt

SEQ ID NO: 1171998 - DNA, 21 bp, Homo sapiens
agtttcttctgcgcctcaggc

SEQ ID NO: 1171999 - DNA, 18 bp, Homo sapiens
agtttcttgcttggaagc

SEQ ID NO: 1172000 - DNA, 16 bp, Homo sapiens
agtttcttgtgtagat

SEQ ID NO: 1172001 - DNA, 14 bp, Homo sapiens
agtttctttacatt

SEQ ID NO: 1172002 - DNA, 13 bp, Homo sapiens
agtttctttggga

SEQ ID NO: 1172003 - DNA, 17 bp, Homo sapiens
agtttgaaaagcaatat

SEQ ID NO: 1172004 - DNA, 22 bp, Homo sapiens
agtttgaacctttttttttgaa

SEQ ID NO: 1172005 - DNA, 22 bp, Homo sapiens
agtttgacaccttagagaagct

SEQ ID NO: 1172006 - DNA, 20 bp, Homo sapiens
agtttgagacaagccctggc

SEQ ID NO: 1172007 - DNA, 23 bp, Homo sapiens
agtttgagacaagccctggcaac

SEQ ID NO: 1172008 - DNA, 18 bp, Homo sapiens
agtttgagatcagcctgg

SEQ ID NO: 1172009 - DNA, 17 bp, Homo sapiens
agtttgaggctgcagcg

SEQ ID NO: 1172010 - DNA, 16 bp, Homo sapiens
agtttgattattatgt

SEQ ID NO: 1172011 - DNA, 21 bp, Homo sapiens
agtttgattattatgtttatt

SEQ ID NO: 1172012 - DNA, 17 bp, Homo sapiens
agtttgattattcagtg

SEQ ID NO: 1172013 - DNA, 18 bp, Homo sapiens
agtttgattattcagtgt

SEQ ID NO: 1172014 - DNA, 21 bp, Homo sapiens
agtttgattgaggagctgcac

SEQ ID NO: 1172015 - DNA, 21 bp, Homo sapiens
agtttgcaaataggcagaatg

SEQ ID NO: 1172016 - DNA, 23 bp, Homo sapiens
agtttgcaaataggcagaatgga

SEQ ID NO: 1172017 - DNA, 20 bp, Homo sapiens
agtttgcactgtatgctgga

SEQ ID NO: 1172018 - DNA, 23 bp, Homo sapiens
agtttgcagaaaagcacctgccg

SEQ ID NO: 1172019 - DNA, 11 bp, Homo sapiens
agtttgcagtt

SEQ ID NO: 1172020 - DNA, 22 bp, Homo sapiens
agtttgccggatacaaactggt

SEQ ID NO: 1172021 - DNA, 16 bp, Homo sapiens
agtttgcctgctgtat

SEQ ID NO: 1172022 - DNA, 15 bp, Homo sapiens
agtttgctaaaagaa

SEQ ID NO: 1172023 - DNA, 16 bp, Homo sapiens
agtttgctaaaagaag

SEQ ID NO: 1172024 - DNA, 20 bp, Homo sapiens
agtttgctaaaagaagagag

SEQ ID NO: 1172025 - DNA, 21 bp, Homo sapiens
agtttgctaaaagaagagagg

SEQ ID NO: 1172026 - DNA, 23 bp, Homo sapiens
agtttgctagcagaaatctagaa

SEQ ID NO: 1172027 - DNA, 13 bp, Homo sapiens
agtttgcttagaa

SEQ ID NO: 1172028 - DNA, 22 bp, Homo sapiens
agtttggaaataaaaatgttct

SEQ ID NO: 1172029 - DNA, 22 bp, Homo sapiens
agtttggaattattgtagacat

SEQ ID NO: 1172030 - DNA, 20 bp, Homo sapiens
agtttggagcactagtttga

SEQ ID NO: 1172031 - DNA, 22 bp, Homo sapiens
agtttggatatgtaaaacattt

SEQ ID NO: 1172032 - DNA, 12 bp, Homo sapiens
agtttggccctg

SEQ ID NO: 1172033 - DNA, 18 bp, Homo sapiens
agtttggccctggagcca

SEQ ID NO: 1172034 - DNA, 18 bp, Homo sapiens
agtttggctataagtgct

SEQ ID NO: 1172035 - DNA, 20 bp, Homo sapiens
agtttggctataagtgctca

SEQ ID NO: 1172036 - DNA, 13 bp, Homo sapiens
agtttgggtaaaa

SEQ ID NO: 1172037 - DNA, 20 bp, Homo sapiens
agtttgggtaaaatactttt

SEQ ID NO: 1172038 - DNA, 16 bp, Homo sapiens
agtttggtctggactg

SEQ ID NO: 1172039 - DNA, 16 bp, Homo sapiens
agtttggtgtgtcctc

SEQ ID NO: 1172040 - DNA, 13 bp, Homo sapiens
agtttgtaaagtc

SEQ ID NO: 1172041 - DNA, 19 bp, Homo sapiens
agtttgtagtaaaagtggt

SEQ ID NO: 1172042 - DNA, 14 bp, Homo sapiens
agtttgtcagactt

SEQ ID NO: 1172043 - DNA, 19 bp, Homo sapiens
agtttgtgtgtatttgtat

SEQ ID NO: 1172044 - DNA, 14 bp, Homo sapiens
agtttgtgtgtctt

SEQ ID NO: 1172045 - DNA, 18 bp, Homo sapiens
agtttgtgtgttgtcttg

SEQ ID NO: 1172046 - DNA, 18 bp, Homo sapiens
agtttgtgttagaaaagt

SEQ ID NO: 1172047 - DNA, 18 bp, Homo sapiens
agtttgttacctacctta

SEQ ID NO: 1172048 - DNA, 21 bp, Homo sapiens
agtttgttcacttaaattctt

SEQ ID NO: 1172049 - DNA, 15 bp, Homo sapiens
agtttgttctccggg

SEQ ID NO: 1172050 - DNA, 21 bp, Homo sapiens
agtttgttctccgggtgtggc

SEQ ID NO: 1172051 - DNA, 22 bp, Homo sapiens
agttttaaaaagccagtttggg

SEQ ID NO: 1172052 - DNA, 14 bp, Homo sapiens
agttttaaaagtct

SEQ ID NO: 1172053 - DNA, 18 bp, Homo sapiens
agttttaactgtggatat

SEQ ID NO: 1172054 - DNA, 22 bp, Homo sapiens
agttttaagaattgtttttgaa

SEQ ID NO: 1172055 - DNA, 16 bp, Homo sapiens
agttttaatccagaat

SEQ ID NO: 1172056 - DNA, 15 bp, Homo sapiens
agttttactcttaaa

SEQ ID NO: 1172057 - DNA, 19 bp, Homo sapiens
agttttactcttaaatcat

SEQ ID NO: 1172058 - DNA, 20 bp, Homo sapiens
agttttactcttaaatcatt

SEQ ID NO: 1172059 - DNA, 22 bp, Homo sapiens
agttttactcttaaatcatttg

SEQ ID NO: 1172060 - DNA, 15 bp, Homo sapiens
agttttataaaactc

SEQ ID NO: 1172061 - DNA, 13 bp, Homo sapiens
agttttatcattt

SEQ ID NO: 1172062 - DNA, 13 bp, Homo sapiens
agttttatggcat

SEQ ID NO: 1172063 - DNA, 16 bp, Homo sapiens
agttttattgagaatt

SEQ ID NO: 1172064 - DNA, 21 bp, Homo sapiens
agttttcaagtcaaattaata

SEQ ID NO: 1172065 - DNA, 17 bp, Homo sapiens
agttttcagaacctctt

SEQ ID NO: 1172066 - DNA, 20 bp, Homo sapiens
agttttcagaacctcttccc

SEQ ID NO: 1172067 - DNA, 13 bp, Homo sapiens
agttttcagcctt

SEQ ID NO: 1172068 - DNA, 12 bp, Homo sapiens
agttttcagtgg

SEQ ID NO: 1172069 - DNA, 21 bp, Homo sapiens
agttttcatccataactgaac

SEQ ID NO: 1172070 - DNA, 21 bp, Homo sapiens
agttttcatttagaaaataga

SEQ ID NO: 1172071 - DNA, 13 bp, Homo sapiens
agttttccagtat

SEQ ID NO: 1172072 - DNA, 12 bp, Homo sapiens
agttttccatga

SEQ ID NO: 1172073 - DNA, 18 bp, Homo sapiens
agttttcccctggcctca

SEQ ID NO: 1172074 - DNA, 14 bp, Homo sapiens
agttttccctgcac

SEQ ID NO: 1172075 - DNA, 10 bp, Homo sapiens
agttttccta

SEQ ID NO: 1172076 - DNA, 12 bp, Homo sapiens
agttttccttct

SEQ ID NO: 1172077 - DNA, 22 bp, Homo sapiens
agttttccttctcatctgtgat

SEQ ID NO: 1172078 - DNA, 22 bp, Homo sapiens
agttttctagcaattttctttg

SEQ ID NO: 1172079 - DNA, 17 bp, Homo sapiens
agttttctcctcccagg

SEQ ID NO: 1172080 - DNA, 13 bp, Homo sapiens
agttttctccttt

SEQ ID NO: 1172081 - DNA, 13 bp, Homo sapiens
agttttctggctg

SEQ ID NO: 1172082 - DNA, 19 bp, Homo sapiens
agttttctggctggagcct

SEQ ID NO: 1172083 - DNA, 11 bp, Homo sapiens
agttttgatat

SEQ ID NO: 1172084 - DNA, 18 bp, Homo sapiens
agttttgatatttctagc

SEQ ID NO: 1172085 - DNA, 13 bp, Homo sapiens
agttttgatgaaa

SEQ ID NO: 1172086 - DNA, 15 bp, Homo sapiens
agttttgatgaaatt

SEQ ID NO: 1172087 - DNA, 19 bp, Homo sapiens
agttttgattaatgtttct

SEQ ID NO: 1172088 - DNA, 20 bp, Homo sapiens
agttttgattaatgtttctt

SEQ ID NO: 1172089 - DNA, 23 bp, Homo sapiens
agttttgcctttctaagggaggg

SEQ ID NO: 1172090 - DNA, 20 bp, Homo sapiens
agttttgggaaatgtagccc

SEQ ID NO: 1172091 - DNA, 19 bp, Homo sapiens
agttttgtaacttagcttt

SEQ ID NO: 1172092 - DNA, 15 bp, Homo sapiens
agttttgtataaata

SEQ ID NO: 1172093 - DNA, 17 bp, Homo sapiens
agttttgtataaataat

SEQ ID NO: 1172094 - DNA, 13 bp, Homo sapiens
agttttgtcttga

SEQ ID NO: 1172095 - DNA, 13 bp, Homo sapiens
ccaagaactgcag

SEQ ID NO: 1172096 - DNA, 15 bp, Homo sapiens
ccaagaactgcatgg

SEQ ID NO: 1172097 - DNA, 18 bp, Homo sapiens
ccaagaagcagtggcctt

SEQ ID NO: 1172098 - DNA, 15 bp, Homo sapiens
ccaagaaggagacct

SEQ ID NO: 1172099 - DNA, 19 bp, Homo sapiens
ccaagaatagatgctgact

SEQ ID NO: 1172100 - DNA, 22 bp, Homo sapiens
ccaagaatattgcaaaatacat

SEQ ID NO: 1172101 - DNA, 23 bp, Homo sapiens
ccaagaatattgcaaaatacatg

SEQ ID NO: 1172102 - DNA, 14 bp, Homo sapiens
ccaagacaaatcaa

SEQ ID NO: 1172103 - DNA, 22 bp, Homo sapiens
ccaagacaaatcaacagaagca

SEQ ID NO: 1172104 - DNA, 16 bp, Homo sapiens
agtttttatgagaaac

SEQ ID NO: 1172105 - DNA, 18 bp, Homo sapiens
agtttttattccttgtga

SEQ ID NO: 1172106 - DNA, 15 bp, Homo sapiens
agtttttcatttgtt

SEQ ID NO: 1172107 - DNA, 16 bp, Homo sapiens
agtttttcatttgttt

SEQ ID NO: 1172108 - DNA, 14 bp, Homo sapiens
agtttttcctccca

SEQ ID NO: 1172109 - DNA, 13 bp, Homo sapiens
agtttttctgtca

SEQ ID NO: 1172110 - DNA, 17 bp, Homo sapiens
agtttttctgtttcctc

SEQ ID NO: 1172111 - DNA, 19 bp, Homo sapiens
agtttttctttaatatgat

SEQ ID NO: 1172112 - DNA, 13 bp, Homo sapiens
agtttttgaaaat

SEQ ID NO: 1172113 - DNA, 13 bp, Homo sapiens
agtttttgatagt

SEQ ID NO: 1172114 - DNA, 15 bp, Homo sapiens
agtttttgtatcttg

SEQ ID NO: 1172115 - DNA, 19 bp, Homo sapiens
agtttttgtatgtattatt

SEQ ID NO: 1172116 - DNA, 12 bp, Homo sapiens
agttttttcatc

SEQ ID NO: 1172117 - DNA, 20 bp, Homo sapiens
agttttttcatcttcagttg

SEQ ID NO: 1172118 - DNA, 12 bp, Homo sapiens
agttttttgctt

SEQ ID NO: 1172119 - DNA, 12 bp, Homo sapiens
agtttttttgct

SEQ ID NO: 1172120 - DNA, 14 bp, Homo sapiens
agttttttttgtaa

SEQ ID NO: 1172121 - DNA, 18 bp, Homo sapiens
agttttttttgtttgcct

SEQ ID NO: 1172122 - DNA, 21 bp, Homo sapiens
ataaaaaaaaaaggatgaaag

SEQ ID NO: 1172123 - DNA, 22 bp, Homo sapiens
ataaaaaaaaacctagtgctga

SEQ ID NO: 1172124 - DNA, 13 bp, Homo sapiens
ataaaaaaaagaa

SEQ ID NO: 1172125 - DNA, 18 bp, Homo sapiens
ataaaaaaaagaaaaaag

SEQ ID NO: 1172126 - DNA, 19 bp, Homo sapiens
ataaaaaaaagaaatgaaa

SEQ ID NO: 1172127 - DNA, 17 bp, Homo sapiens
ataaaaaaacaatcatt

SEQ ID NO: 1172128 - DNA, 15 bp, Homo sapiens
ataaaaaacaagaaa

SEQ ID NO: 1172129 - DNA, 12 bp, Homo sapiens
ataaaaaagatt

SEQ ID NO: 1172130 - DNA, 16 bp, Homo sapiens
ataaaaaagattctac

SEQ ID NO: 1172131 - DNA, 17 bp, Homo sapiens
ataaaaaagattctact

SEQ ID NO: 1172132 - DNA, 14 bp, Homo sapiens
ataaaaaagcaaaa

SEQ ID NO: 1172133 - DNA, 14 bp, Homo sapiens
ataaaaaatagaca

SEQ ID NO: 1172134 - DNA, 15 bp, Homo sapiens
ataaaaaatgtaaca

SEQ ID NO: 1172135 - DNA, 16 bp, Homo sapiens
ataaaaaatgtaacat

SEQ ID NO: 1172136 - DNA, 21 bp, Homo sapiens
ataaaaactcaggcaaagaaa

SEQ ID NO: 1172137 - DNA, 14 bp, Homo sapiens
ataaaaagaaaggc

SEQ ID NO: 1172138 - DNA, 13 bp, Homo sapiens
ataaaaagaaatt

SEQ ID NO: 1172139 - DNA, 19 bp, Homo sapiens
ataaaaagataatctcagt

SEQ ID NO: 1172140 - DNA, 18 bp, Homo sapiens
ataaaaagatcactttct

SEQ ID NO: 1172141 - DNA, 22 bp, Homo sapiens
ataaaaagatcactttctcagt

SEQ ID NO: 1172142 - DNA, 12 bp, Homo sapiens
ataaaaagcaaa

SEQ ID NO: 1172143 - DNA, 18 bp, Homo sapiens
ataaaaagccagggctgg

SEQ ID NO: 1172144 - DNA, 20 bp, Homo sapiens
ataaaaaggaaattagtctt

SEQ ID NO: 1172145 - DNA, 18 bp, Homo sapiens
ataaaaagtgaacttttg

SEQ ID NO: 1172146 - DNA, 19 bp, Homo sapiens
ataaaaagtgacacagcag

SEQ ID NO: 1172147 - DNA, 13 bp, Homo sapiens
ataaaaataatag

SEQ ID NO: 1172148 - DNA, 14 bp, Homo sapiens
ataaaaatataaat

SEQ ID NO: 1172149 - DNA, 17 bp, Homo sapiens
ataaaaatataaattgt

SEQ ID NO: 1172150 - DNA, 19 bp, Homo sapiens
ataaaaatataaattgtac

SEQ ID NO: 1172151 - DNA, 13 bp, Homo sapiens
ataaaaatatatt

SEQ ID NO: 1172152 - DNA, 15 bp, Homo sapiens
ataaaaatatgtaat

SEQ ID NO: 1172153 - DNA, 12 bp, Homo sapiens
ataaaaatggat

SEQ ID NO: 1172154 - DNA, 22 bp, Homo sapiens
ataaaaatgtctcagcaacagt

SEQ ID NO: 1172155 - DNA, 12 bp, Homo sapiens
ataaaaatgttt

SEQ ID NO: 1172156 - DNA, 20 bp, Homo sapiens
ataaaaattatcaaaaagct

SEQ ID NO: 1172157 - DNA, 11 bp, Homo sapiens
ataaaacaagc

SEQ ID NO: 1172158 - DNA, 13 bp, Homo sapiens
ataaaacaagcct

SEQ ID NO: 1172159 - DNA, 15 bp, Homo sapiens
ataaaacaagcctta

SEQ ID NO: 1172160 - DNA, 17 bp, Homo sapiens
ataaaacaatgactttt

SEQ ID NO: 1172161 - DNA, 12 bp, Homo sapiens
ataaaacatcat

SEQ ID NO: 1172162 - DNA, 19 bp, Homo sapiens
ataaaacatcataaatctt

SEQ ID NO: 1172163 - DNA, 17 bp, Homo sapiens
ataaaacattaagaaaa

SEQ ID NO: 1172164 - DNA, 18 bp, Homo sapiens
ataaaacattaagaaaat

SEQ ID NO: 1172165 - DNA, 20 bp, Homo sapiens
ataaaacctttcaaatttca

SEQ ID NO: 1172166 - DNA, 14 bp, Homo sapiens
ataaaactatgtgt

SEQ ID NO: 1172167 - DNA, 15 bp, Homo sapiens
ataaaactatttaaa

SEQ ID NO: 1172168 - DNA, 21 bp, Homo sapiens
ataaaactatttaaaattggc

SEQ ID NO: 1172169 - DNA, 14 bp, Homo sapiens
ataaaactgtgtaa

SEQ ID NO: 1172170 - DNA, 19 bp, Homo sapiens
ataaaacttatgctagttt

SEQ ID NO: 1172171 - DNA, 14 bp, Homo sapiens
ataaaactttaaaa

SEQ ID NO: 1172172 - DNA, 15 bp, Homo sapiens
ataaaactttaaaag

SEQ ID NO: 1172173 - DNA, 20 bp, Homo sapiens
ataaaactttaaaaggcaac

SEQ ID NO: 1172174 - DNA, 15 bp, Homo sapiens
ataaaactttccaaa

SEQ ID NO: 1172175 - DNA, 13 bp, Homo sapiens
ataaaagaaataa

SEQ ID NO: 1172176 - DNA, 13 bp, Homo sapiens
ataaaagaacatg

SEQ ID NO: 1172177 - DNA, 14 bp, Homo sapiens
ataaaagacacaga

SEQ ID NO: 1172178 - DNA, 16 bp, Homo sapiens
ataaaagagctgtctg

SEQ ID NO: 1172179 - DNA, 13 bp, Homo sapiens
ataaaagagcttt

SEQ ID NO: 1172180 - DNA, 15 bp, Homo sapiens
ataaaagagctttat

SEQ ID NO: 1172181 - DNA, 17 bp, Homo sapiens
ataaaagataaattatt

SEQ ID NO: 1172182 - DNA, 21 bp, Homo sapiens
ataaaagcaattctgactgtc

SEQ ID NO: 1172183 - DNA, 20 bp, Homo sapiens
ataaaagcacaagtactttt

SEQ ID NO: 1172184 - DNA, 16 bp, Homo sapiens
ataaaagcacactgct

SEQ ID NO: 1172185 - DNA, 20 bp, Homo sapiens
ataaaagcagcatctgctaa

SEQ ID NO: 1172186 - DNA, 13 bp, Homo sapiens
ataaaagcattgt

SEQ ID NO: 1172187 - DNA, 12 bp, Homo sapiens
ataaaagccttg

SEQ ID NO: 1172188 - DNA, 15 bp, Homo sapiens
ataaaagctatggtg

SEQ ID NO: 1172189 - DNA, 19 bp, Homo sapiens
ataaaagctttgactccct

SEQ ID NO: 1172190 - DNA, 17 bp, Homo sapiens
ataaaaggaagccaaag

SEQ ID NO: 1172191 - DNA, 20 bp, Homo sapiens
ataaaaggcaaatgtgtaca

SEQ ID NO: 1172192 - DNA, 20 bp, Homo sapiens
ataaaaggcttgaagctgtg

SEQ ID NO: 1172193 - DNA, 16 bp, Homo sapiens
ataaaaggtttctttt

SEQ ID NO: 1172194 - DNA, 23 bp, Homo sapiens
ataaaagtgaagtgaatctgatt

SEQ ID NO: 1172195 - DNA, 13 bp, Homo sapiens
ataaaagtgactc

SEQ ID NO: 1172196 - DNA, 22 bp, Homo sapiens
ataaaagtgatcaataaaatgt

SEQ ID NO: 1172197 - DNA, 23 bp, Homo sapiens
ataaaagttaataacagctcctt

SEQ ID NO: 1172198 - DNA, 21 bp, Homo sapiens
ataaaagttcctctcccttcc

SEQ ID NO: 1172199 - DNA, 21 bp, Homo sapiens
ataaaataaatatatataaac

SEQ ID NO: 1172200 - DNA, 22 bp, Homo sapiens
ataaaatactctagcctgggcc

SEQ ID NO: 1172201 - DNA, 22 bp, Homo sapiens
ataaaatagtatgttaatatgt

SEQ ID NO: 1172202 - DNA, 12 bp, Homo sapiens
ataaaatatcat

SEQ ID NO: 1172203 - DNA, 15 bp, Homo sapiens
ataaaatatcataaa

SEQ ID NO: 1172204 - DNA, 21 bp, Homo sapiens
ataaaatattttgttaacttt

SEQ ID NO: 1172205 - DNA, 18 bp, Homo sapiens
ataaaatccaatattgta

SEQ ID NO: 1172206 - DNA, 19 bp, Homo sapiens
ataaaatccaatattgtaa

SEQ ID NO: 1172207 - DNA, 13 bp, Homo sapiens
ataaaatgaaaat

SEQ ID NO: 1172208 - DNA, 17 bp, Homo sapiens
ataaaatgacaataact

SEQ ID NO: 1172209 - DNA, 13 bp, Homo sapiens
ataaaatgcaaat

SEQ ID NO: 1172210 - DNA, 16 bp, Homo sapiens
ataaaatgcaaatgaa

SEQ ID NO: 1172211 - DNA, 18 bp, Homo sapiens
ataaaatgcatactgttg

SEQ ID NO: 1172212 - DNA, 19 bp, Homo sapiens
ataaaatgcatactgttga

SEQ ID NO: 1172213 - DNA, 17 bp, Homo sapiens
ataaaatggacacaaat

SEQ ID NO: 1172214 - DNA, 16 bp, Homo sapiens
ataaaatggctgtaat

SEQ ID NO: 1172215 - DNA, 22 bp, Homo sapiens
ataaaatggtgttttcatgtaa

SEQ ID NO: 1172216 - DNA, 13 bp, Homo sapiens
ataaaatgtattc

SEQ ID NO: 1172217 - DNA, 16 bp, Homo sapiens
ataaaatgtattcaag

SEQ ID NO: 1172218 - DNA, 13 bp, Homo sapiens
ataaaatgtgatt

SEQ ID NO: 1172219 - DNA, 20 bp, Homo sapiens
ataaaatgtgatttttctga

SEQ ID NO: 1172220 - DNA, 14 bp, Homo sapiens
ataaaatgtgtaca

SEQ ID NO: 1172221 - DNA, 18 bp, Homo sapiens
ataaaatgtgtacagtga

SEQ ID NO: 1172222 - DNA, 13 bp, Homo sapiens
ataaaatgttgaa

SEQ ID NO: 1172223 - DNA, 17 bp, Homo sapiens
ataaaatgttgaaaagt

SEQ ID NO: 1172224 - DNA, 19 bp, Homo sapiens
ccaaggagcacaggtccca

SEQ ID NO: 1172225 - DNA, 20 bp, Homo sapiens
ccaaggagcacaggtcccac

SEQ ID NO: 1172226 - DNA, 23 bp, Homo sapiens
ccaaggagcagagaggtggccac

SEQ ID NO: 1172227 - DNA, 14 bp, Homo sapiens
ataaaatgtttcat

SEQ ID NO: 1172228 - DNA, 18 bp, Homo sapiens
ataaaatgtttcattatg

SEQ ID NO: 1172229 - DNA, 23 bp, Homo sapiens
ataaaattaaatgccttgtataa

SEQ ID NO: 1172230 - DNA, 16 bp, Homo sapiens
ataaaattcatttcta

SEQ ID NO: 1172231 - DNA, 19 bp, Homo sapiens
ataaaattcgctttctaaa

SEQ ID NO: 1172232 - DNA, 20 bp, Homo sapiens
ataaaatttccttcaggttt

SEQ ID NO: 1172233 - DNA, 18 bp, Homo sapiens
ataaaatttgataaacat

SEQ ID NO: 1172234 - DNA, 13 bp, Homo sapiens
ataaaatttgttg

SEQ ID NO: 1172235 - DNA, 15 bp, Homo sapiens
ataaaattttttaaa

SEQ ID NO: 1172236 - DNA, 23 bp, Homo sapiens
ataaacaagaccacgtttctaaa

SEQ ID NO: 1172237 - DNA, 13 bp, Homo sapiens
ataaacaatgaaa

SEQ ID NO: 1172238 - DNA, 23 bp, Homo sapiens
ataaacacatagattcacctgta

SEQ ID NO: 1172239 - DNA, 19 bp, Homo sapiens
ataaacaccaacccaggaa

SEQ ID NO: 1172240 - DNA, 16 bp, Homo sapiens
ataaacacgattttat

SEQ ID NO: 1172241 - DNA, 14 bp, Homo sapiens
ataaacagatgtat

SEQ ID NO: 1172242 - DNA, 22 bp, Homo sapiens
ataaacagcttcatgcctttgt

SEQ ID NO: 1172243 - DNA, 15 bp, Homo sapiens
ataaacaggaatttt

SEQ ID NO: 1172244 - DNA, 21 bp, Homo sapiens
ataaacaggaattttattttg

SEQ ID NO: 1172245 - DNA, 19 bp, Homo sapiens
ataaacagtgagcatatct

SEQ ID NO: 1172246 - DNA, 22 bp, Homo sapiens
ataaacagtggaatataaggaa

SEQ ID NO: 1172247 - DNA, 19 bp, Homo sapiens
ataaacatatttttatact

SEQ ID NO: 1172248 - DNA, 20 bp, Homo sapiens
ataaacatatttttatactt

SEQ ID NO: 1172249 - DNA, 22 bp, Homo sapiens
ataaacatatttttatacttta

SEQ ID NO: 1172250 - DNA, 12 bp, Homo sapiens
ataaacattaaa

SEQ ID NO: 1172251 - DNA, 13 bp, Homo sapiens
ataaacattaaac

SEQ ID NO: 1172252 - DNA, 17 bp, Homo sapiens
ataaacattaattttgt

SEQ ID NO: 1172253 - DNA, 17 bp, Homo sapiens
ataaaccaaacccagcc

SEQ ID NO: 1172254 - DNA, 18 bp, Homo sapiens
ataaaccaaacccagcca

SEQ ID NO: 1172255 - DNA, 16 bp, Homo sapiens
ataaaccaccctctgg

SEQ ID NO: 1172256 - DNA, 21 bp, Homo sapiens
ataaaccaggtttagacagta

SEQ ID NO: 1172257 - DNA, 16 bp, Homo sapiens
ataaaccattggacag

SEQ ID NO: 1172258 - DNA, 22 bp, Homo sapiens
ataaaccattggacagatttca

SEQ ID NO: 1172259 - DNA, 19 bp, Homo sapiens
ataaaccatttttgttact

SEQ ID NO: 1172260 - DNA, 23 bp, Homo sapiens
ataaaccgtgtatttattacatt

SEQ ID NO: 1172261 - DNA, 18 bp, Homo sapiens
ataaacctaaaaaagata

SEQ ID NO: 1172262 - DNA, 19 bp, Homo sapiens
ataaacctaaaaaagatat

SEQ ID NO: 1172263 - DNA, 13 bp, Homo sapiens
ataaacctggaga

SEQ ID NO: 1172264 - DNA, 18 bp, Homo sapiens
ataaaccttcagaagcta

SEQ ID NO: 1172265 - DNA, 23 bp, Homo sapiens
ataaaccttcagaagctattttt

SEQ ID NO: 1172266 - DNA, 19 bp, Homo sapiens
ataaactaattttgtacgt

SEQ ID NO: 1172267 - DNA, 17 bp, Homo sapiens
ataaactagattacatt

SEQ ID NO: 1172268 - DNA, 19 bp, Homo sapiens
ataaactagattacattca

SEQ ID NO: 1172269 - DNA, 14 bp, Homo sapiens
ataaactaggtaaa

SEQ ID NO: 1172270 - DNA, 21 bp, Homo sapiens
ataaactcaaaactcttgaaa

SEQ ID NO: 1172271 - DNA, 16 bp, Homo sapiens
ataaactcataaaact

SEQ ID NO: 1172272 - DNA, 18 bp, Homo sapiens
ataaactccttaacttca

SEQ ID NO: 1172273 - DNA, 19 bp, Homo sapiens
ataaactgaaaaatgtcag

SEQ ID NO: 1172274 - DNA, 17 bp, Homo sapiens
ataaactgaatattttg

SEQ ID NO: 1172275 - DNA, 20 bp, Homo sapiens
ataaactgaatattttggaa

SEQ ID NO: 1172276 - DNA, 22 bp, Homo sapiens
ataaactgaatattttggaaac

SEQ ID NO: 1172277 - DNA, 15 bp, Homo sapiens
ataaactgactttat

SEQ ID NO: 1172278 - DNA, 13 bp, Homo sapiens
ataaactgagcct

SEQ ID NO: 1172279 - DNA, 14 bp, Homo sapiens
ataaactgagcctc

SEQ ID NO: 1172280 - DNA, 12 bp, Homo sapiens
ataaactgctgt

SEQ ID NO: 1172281 - DNA, 21 bp, Homo sapiens
ataaactgtagcgaccccaga

SEQ ID NO: 1172282 - DNA, 23 bp, Homo sapiens
ataaactgtagcgaccccagact

SEQ ID NO: 1172283 - DNA, 14 bp, Homo sapiens
ataaactgttttca

SEQ ID NO: 1172284 - DNA, 16 bp, Homo sapiens
ataaacttagaggaaa

SEQ ID NO: 1172285 - DNA, 18 bp, Homo sapiens
ataaacttagaggaaaat

SEQ ID NO: 1172286 - DNA, 20 bp, Homo sapiens
ataaacttcttaacatgctt

SEQ ID NO: 1172287 - DNA, 13 bp, Homo sapiens
ataaactttacct

SEQ ID NO: 1172288 - DNA, 16 bp, Homo sapiens
ataaactttacctttt

SEQ ID NO: 1172289 - DNA, 24 bp, Homo sapiens
ataaactttaccttttttatacat

SEQ ID NO: 1172290 - DNA, 12 bp, Homo sapiens
ataaagaaaaat

SEQ ID NO: 1172291 - DNA, 19 bp, Homo sapiens
ataaagaaaacttccatag

SEQ ID NO: 1172292 - DNA, 20 bp, Homo sapiens
ataaagaaaagacattttaa

SEQ ID NO: 1172293 - DNA, 21 bp, Homo sapiens
ataaagaaaagacattttaag

SEQ ID NO: 1172294 - DNA, 18 bp, Homo sapiens
ataaagaaatagaacaag

SEQ ID NO: 1172295 - DNA, 16 bp, Homo sapiens
ataaagaaatatttac

SEQ ID NO: 1172296 - DNA, 17 bp, Homo sapiens
ataaagaaattgcaata

SEQ ID NO: 1172297 - DNA, 17 bp, Homo sapiens
ataaagaaatttggtac

SEQ ID NO: 1172298 - DNA, 21 bp, Homo sapiens
ataaagaacaaggtagttttt

SEQ ID NO: 1172299 - DNA, 23 bp, Homo sapiens
ataaagaactccttattttgtat

SEQ ID NO: 1172300 - DNA, 11 bp, Homo sapiens
ataaagacagg

SEQ ID NO: 1172301 - DNA, 16 bp, Homo sapiens
ataaagacccaggggg

SEQ ID NO: 1172302 - DNA, 12 bp, Homo sapiens
ataaagactttt

SEQ ID NO: 1172303 - DNA, 21 bp, Homo sapiens
ataaagaggagtgttattgca

SEQ ID NO: 1172304 - DNA, 22 bp, Homo sapiens
ataaagaggagtgttattgcat

SEQ ID NO: 1172305 - DNA, 23 bp, Homo sapiens
ataaagaggagtgttattgcatg

SEQ ID NO: 1172306 - DNA, 13 bp, Homo sapiens
ataaagataaaat

SEQ ID NO: 1172307 - DNA, 21 bp, Homo sapiens
ataaagatgagtgagcatgcc

SEQ ID NO: 1172308 - DNA, 14 bp, Homo sapiens
ataaagatgttaaa

SEQ ID NO: 1172309 - DNA, 19 bp, Homo sapiens
ataaagatgttaaatggaa

SEQ ID NO: 1172310 - DNA, 13 bp, Homo sapiens
ataaagatttttt

SEQ ID NO: 1172311 - DNA, 19 bp, Homo sapiens
ataaagcagagccaaggcc

SEQ ID NO: 1172312 - DNA, 17 bp, Homo sapiens
ataaagcagattacctc

SEQ ID NO: 1172313 - DNA, 19 bp, Homo sapiens
ataaagcagattacctctt

SEQ ID NO: 1172314 - DNA, 23 bp, Homo sapiens
ataaagcagcctcattctgaggc

SEQ ID NO: 1172315 - DNA, 13 bp, Homo sapiens
ataaagcagcgtt

SEQ ID NO: 1172316 - DNA, 20 bp, Homo sapiens
ataaagcagttaatttatat

SEQ ID NO: 1172317 - DNA, 11 bp, Homo sapiens
ataaagcattc

SEQ ID NO: 1172318 - DNA, 12 bp, Homo sapiens
ataaagcattct

SEQ ID NO: 1172319 - DNA, 16 bp, Homo sapiens
ataaagcattctttaa

SEQ ID NO: 1172320 - DNA, 12 bp, Homo sapiens
ataaagcattta

SEQ ID NO: 1172321 - DNA, 14 bp, Homo sapiens
ataaagcatttata

SEQ ID NO: 1172322 - DNA, 13 bp, Homo sapiens
ataaagcctttaa

SEQ ID NO: 1172323 - DNA, 19 bp, Homo sapiens
ataaagcctttaaaaccag

SEQ ID NO: 1172324 - DNA, 15 bp, Homo sapiens
ataaagccttttaaa

SEQ ID NO: 1172325 - DNA, 15 bp, Homo sapiens
ataaagctaccattt

SEQ ID NO: 1172326 - DNA, 19 bp, Homo sapiens
ataaaggaccctgtttctg

SEQ ID NO: 1172327 - DNA, 16 bp, Homo sapiens
ataaaggataactctg

SEQ ID NO: 1172328 - DNA, 19 bp, Homo sapiens
ataaaggataactctgtat

SEQ ID NO: 1172329 - DNA, 11 bp, Homo sapiens
ataaaggcagc

SEQ ID NO: 1172330 - DNA, 13 bp, Homo sapiens
ataaaggcagctg

SEQ ID NO: 1172331 - DNA, 16 bp, Homo sapiens
ataaaggcagttttct

SEQ ID NO: 1172332 - DNA, 17 bp, Homo sapiens
ataaagggtgccaggtc

SEQ ID NO: 1172333 - DNA, 15 bp, Homo sapiens
ataaaggtaaaatca

SEQ ID NO: 1172334 - DNA, 19 bp, Homo sapiens
ataaaggttatgaaacata

SEQ ID NO: 1172335 - DNA, 22 bp, Homo sapiens
ataaaggttatgaaacatatca

SEQ ID NO: 1172336 - DNA, 23 bp, Homo sapiens
ataaaggttatgaaacatatcat

SEQ ID NO: 1172337 - DNA, 16 bp, Homo sapiens
ataaaggttgacaata

SEQ ID NO: 1172338 - DNA, 17 bp, Homo sapiens
ataaagtaaagctaaaa

SEQ ID NO: 1172339 - DNA, 12 bp, Homo sapiens
ataaagtacaaa

SEQ ID NO: 1172340 - DNA, 17 bp, Homo sapiens
ataaagtacaaatgaag

SEQ ID NO: 1172341 - DNA, 23 bp, Homo sapiens
ataaagtactttagcctggtacc

SEQ ID NO: 1172342 - DNA, 13 bp, Homo sapiens
ataaagtagaaat

SEQ ID NO: 1172343 - DNA, 16 bp, Homo sapiens
ataaagtagcaaaaca

SEQ ID NO: 1172344 - DNA, 15 bp, Homo sapiens
ataaagtatcatgca

SEQ ID NO: 1172345 - DNA, 18 bp, Homo sapiens
ataaagtattccacctta

SEQ ID NO: 1172346 - DNA, 14 bp, Homo sapiens
ataaagtattcttt

SEQ ID NO: 1172347 - DNA, 19 bp, Homo sapiens
ataaagtcacttccagtgt

SEQ ID NO: 1172348 - DNA, 21 bp, Homo sapiens
ataaagtcacttccagtgttg

SEQ ID NO: 1172349 - DNA, 18 bp, Homo sapiens
ccacacagggcactgact

SEQ ID NO: 1172350 - DNA, 14 bp, Homo sapiens
ccacacagggtggc

SEQ ID NO: 1172351 - DNA, 15 bp, Homo sapiens
ccacacattccagcc

SEQ ID NO: 1172352 - DNA, 16 bp, Homo sapiens
ccacacattccagcca

SEQ ID NO: 1172353 - DNA, 19 bp, Homo sapiens
ccacacattccagccaggc

SEQ ID NO: 1172354 - DNA, 17 bp, Homo sapiens
ataaagtgatctgtgtt

SEQ ID NO: 1172355 - DNA, 22 bp, Homo sapiens
ataaagtggaagtatgtatatt

SEQ ID NO: 1172356 - DNA, 13 bp, Homo sapiens
ataaagtgtaata

SEQ ID NO: 1172357 - DNA, 22 bp, Homo sapiens
ataaagtgttacgttttattgg

SEQ ID NO: 1172358 - DNA, 22 bp, Homo sapiens
ataaagttgaagctaagattta

SEQ ID NO: 1172359 - DNA, 17 bp, Homo sapiens
ataaagttggtgacaga

SEQ ID NO: 1172360 - DNA, 18 bp, Homo sapiens
ataaagttggtgacagat

SEQ ID NO: 1172361 - DNA, 23 bp, Homo sapiens
ataaagttggttcacttcaaagc

SEQ ID NO: 1172362 - DNA, 19 bp, Homo sapiens
ataaagtttgcttagaaaa

SEQ ID NO: 1172363 - DNA, 17 bp, Homo sapiens
ataaataaaaatggata

SEQ ID NO: 1172364 - DNA, 13 bp, Homo sapiens
ataaataaaactg

SEQ ID NO: 1172365 - DNA, 14 bp, Homo sapiens
ataaataaaagcta

SEQ ID NO: 1172366 - DNA, 22 bp, Homo sapiens
ataaataaaagctagatactgg

SEQ ID NO: 1172367 - DNA, 12 bp, Homo sapiens
ataaataaatgt

SEQ ID NO: 1172368 - DNA, 12 bp, Homo sapiens
ataaataacttt

SEQ ID NO: 1172369 - DNA, 17 bp, Homo sapiens
ataaataagagcatgat

SEQ ID NO: 1172370 - DNA, 19 bp, Homo sapiens
ataaatacatacggtcagg

SEQ ID NO: 1172371 - DNA, 18 bp, Homo sapiens
ataaatacctcttagctg

SEQ ID NO: 1172372 - DNA, 23 bp, Homo sapiens
ataaatacgtgtcaaaaaagaat

SEQ ID NO: 1172373 - DNA, 14 bp, Homo sapiens
ataaatagctatat

SEQ ID NO: 1172374 - DNA, 17 bp, Homo sapiens
ataaatagctgaaaact

SEQ ID NO: 1172375 - DNA, 12 bp, Homo sapiens
ataaatatatat

SEQ ID NO: 1172376 - DNA, 15 bp, Homo sapiens
ataaatatatataaa

SEQ ID NO: 1172377 - DNA, 21 bp, Homo sapiens
ataaatatatataaacctaaa

SEQ ID NO: 1172378 - DNA, 22 bp, Homo sapiens
ataaatatatatttttcaaata

SEQ ID NO: 1172379 - DNA, 18 bp, Homo sapiens
ataaatatgtttcacaca

SEQ ID NO: 1172380 - DNA, 17 bp, Homo sapiens
ataaatcaattcatgtt

SEQ ID NO: 1172381 - DNA, 14 bp, Homo sapiens
ataaatcagtattt

SEQ ID NO: 1172382 - DNA, 18 bp, Homo sapiens
ataaatcataaagtcagt

SEQ ID NO: 1172383 - DNA, 12 bp, Homo sapiens
ataaatcatgtt

SEQ ID NO: 1172384 - DNA, 21 bp, Homo sapiens
ataaatcatgttgttgtgtgt

SEQ ID NO: 1172385 - DNA, 14 bp, Homo sapiens
ataaatcatttcag

SEQ ID NO: 1172386 - DNA, 16 bp, Homo sapiens
ataaatcatttcagta

SEQ ID NO: 1172387 - DNA, 15 bp, Homo sapiens
ataaatctaggatgt

SEQ ID NO: 1172388 - DNA, 20 bp, Homo sapiens
ataaatctaggatgtgatga

SEQ ID NO: 1172389 - DNA, 14 bp, Homo sapiens
ataaatctgttgcc

SEQ ID NO: 1172390 - DNA, 11 bp, Homo sapiens
ataaatgaagc

SEQ ID NO: 1172391 - DNA, 17 bp, Homo sapiens
ataaatgaagcagcttt

SEQ ID NO: 1172392 - DNA, 11 bp, Homo sapiens
ataaatgaatg

SEQ ID NO: 1172393 - DNA, 12 bp, Homo sapiens
ataaatgaatgt

SEQ ID NO: 1172394 - DNA, 18 bp, Homo sapiens
ataaatgattcttagtga

SEQ ID NO: 1172395 - DNA, 15 bp, Homo sapiens
ataaatgcaatatta

SEQ ID NO: 1172396 - DNA, 17 bp, Homo sapiens
ataaatgcacatttcag

SEQ ID NO: 1172397 - DNA, 19 bp, Homo sapiens
ataaatgctattttttatt

SEQ ID NO: 1172398 - DNA, 13 bp, Homo sapiens
ataaatggctggt

SEQ ID NO: 1172399 - DNA, 13 bp, Homo sapiens
ataaatgggtgta

SEQ ID NO: 1172400 - DNA, 21 bp, Homo sapiens
ataaatgggtgtatataattt

SEQ ID NO: 1172401 - DNA, 20 bp, Homo sapiens
ataaatggtttggtgctttt

SEQ ID NO: 1172402 - DNA, 17 bp, Homo sapiens
ataaatgtaaaaatgaa

SEQ ID NO: 1172403 - DNA, 21 bp, Homo sapiens
ataaatgtatcatagaaatgt

SEQ ID NO: 1172404 - DNA, 23 bp, Homo sapiens
ataaatgtatcatttttgtgcac

SEQ ID NO: 1172405 - DNA, 15 bp, Homo sapiens
ataaatgtatcttat

SEQ ID NO: 1172406 - DNA, 22 bp, Homo sapiens
ataaatgtattcaaataccaat

SEQ ID NO: 1172407 - DNA, 12 bp, Homo sapiens
ataaatgtttaa

SEQ ID NO: 1172408 - DNA, 15 bp, Homo sapiens
ataaatgtttggaaa

SEQ ID NO: 1172409 - DNA, 12 bp, Homo sapiens
ataaatgtttgt

SEQ ID NO: 1172410 - DNA, 19 bp, Homo sapiens
ataaatgtttgttatttac

SEQ ID NO: 1172411 - DNA, 15 bp, Homo sapiens
ataaattaagatcct

SEQ ID NO: 1172412 - DNA, 21 bp, Homo sapiens
ataaattaagatcctaaactc

SEQ ID NO: 1172413 - DNA, 13 bp, Homo sapiens
ataaattaataca

SEQ ID NO: 1172414 - DNA, 16 bp, Homo sapiens
ataaattaatacagag

SEQ ID NO: 1172415 - DNA, 19 bp, Homo sapiens
ataaattacacaataaagc

SEQ ID NO: 1172416 - DNA, 11 bp, Homo sapiens
ataaattacag

SEQ ID NO: 1172417 - DNA, 18 bp, Homo sapiens
ataaattacagtcatctg

SEQ ID NO: 1172418 - DNA, 14 bp, Homo sapiens
ataaattactatct

SEQ ID NO: 1172419 - DNA, 23 bp, Homo sapiens
ataaattactatctgttgaaaag

SEQ ID NO: 1172420 - DNA, 14 bp, Homo sapiens
ataaattagttgtt

SEQ ID NO: 1172421 - DNA, 15 bp, Homo sapiens
ataaattatatccgt

SEQ ID NO: 1172422 - DNA, 18 bp, Homo sapiens
ataaattatggcatttct

SEQ ID NO: 1172423 - DNA, 13 bp, Homo sapiens
ataaattattcag

SEQ ID NO: 1172424 - DNA, 15 bp, Homo sapiens
ataaattcactttca

SEQ ID NO: 1172425 - DNA, 13 bp, Homo sapiens
ataaattcagata

SEQ ID NO: 1172426 - DNA, 16 bp, Homo sapiens
ataaattcagatatat

SEQ ID NO: 1172427 - DNA, 15 bp, Homo sapiens
ataaattcagtattt

SEQ ID NO: 1172428 - DNA, 12 bp, Homo sapiens
ataaattccaga

SEQ ID NO: 1172429 - DNA, 18 bp, Homo sapiens
ataaattccatctatcag

SEQ ID NO: 1172430 - DNA, 21 bp, Homo sapiens
ataaattcctctttgctttgc

SEQ ID NO: 1172431 - DNA, 23 bp, Homo sapiens
ataaattctacctccttgtgttg

SEQ ID NO: 1172432 - DNA, 21 bp, Homo sapiens
ataaattctataggaacatat

SEQ ID NO: 1172433 - DNA, 16 bp, Homo sapiens
ataaattgatcctttg

SEQ ID NO: 1172434 - DNA, 21 bp, Homo sapiens
ataaattgcacaccttggaat

SEQ ID NO: 1172435 - DNA, 16 bp, Homo sapiens
ataaattgctccttga

SEQ ID NO: 1172436 - DNA, 20 bp, Homo sapiens
ataaattgggataaacatca

SEQ ID NO: 1172437 - DNA, 17 bp, Homo sapiens
ataaattgtacattttg

SEQ ID NO: 1172438 - DNA, 18 bp, Homo sapiens
ataaattgtacattttgt

SEQ ID NO: 1172439 - DNA, 21 bp, Homo sapiens
ataaattgtctttaaaaactg

SEQ ID NO: 1172440 - DNA, 22 bp, Homo sapiens
ataaattgtctttaaaaactgt

SEQ ID NO: 1172441 - DNA, 16 bp, Homo sapiens
ataaatttaactttaa

SEQ ID NO: 1172442 - DNA, 17 bp, Homo sapiens
ataaatttatatacttt

SEQ ID NO: 1172443 - DNA, 19 bp, Homo sapiens
ataaatttatttactgcta

SEQ ID NO: 1172444 - DNA, 22 bp, Homo sapiens
ataaatttcccagttaaagatt

SEQ ID NO: 1172445 - DNA, 23 bp, Homo sapiens
ataaatttcccagttaaagatta

SEQ ID NO: 1172446 - DNA, 18 bp, Homo sapiens
ataaatttctatttttat

SEQ ID NO: 1172447 - DNA, 20 bp, Homo sapiens
ataaatttctgggatattta

SEQ ID NO: 1172448 - DNA, 21 bp, Homo sapiens
ataaatttctgggatatttaa

SEQ ID NO: 1172449 - DNA, 20 bp, Homo sapiens
ataaatttgacttttctgta

SEQ ID NO: 1172450 - DNA, 19 bp, Homo sapiens
ataaattttttttgtttca

SEQ ID NO: 1172451 - DNA, 20 bp, Homo sapiens
ataacaaacgtgttttttaa

SEQ ID NO: 1172452 - DNA, 14 bp, Homo sapiens
ataacaacttcata

SEQ ID NO: 1172453 - DNA, 14 bp, Homo sapiens
ataacaagatcttt

SEQ ID NO: 1172454 - DNA, 19 bp, Homo sapiens
ataacaagatctttcagga

SEQ ID NO: 1172455 - DNA, 18 bp, Homo sapiens
ataacaaggagatttctt

SEQ ID NO: 1172456 - DNA, 15 bp, Homo sapiens
ataacaattcctcta

SEQ ID NO: 1172457 - DNA, 13 bp, Homo sapiens
ataacacagagag

SEQ ID NO: 1172458 - DNA, 16 bp, Homo sapiens
ataacacagatattgt

SEQ ID NO: 1172459 - DNA, 16 bp, Homo sapiens
ataacactaaatgctg

SEQ ID NO: 1172460 - DNA, 17 bp, Homo sapiens
ataacactatatttatt

SEQ ID NO: 1172461 - DNA, 21 bp, Homo sapiens
ataacactctaggatgtatat

SEQ ID NO: 1172462 - DNA, 14 bp, Homo sapiens
ataacagagagaat

SEQ ID NO: 1172463 - DNA, 16 bp, Homo sapiens
ataacagatcctttca

SEQ ID NO: 1172464 - DNA, 18 bp, Homo sapiens
ataacagatggtgctgct

SEQ ID NO: 1172465 - DNA, 13 bp, Homo sapiens
ataacagcctctt

SEQ ID NO: 1172466 - DNA, 14 bp, Homo sapiens
ataacagctccttt

SEQ ID NO: 1172467 - DNA, 16 bp, Homo sapiens
ataacagctcctttat

SEQ ID NO: 1172468 - DNA, 19 bp, Homo sapiens
ataacagctgcaattccct

SEQ ID NO: 1172469 - DNA, 22 bp, Homo sapiens
ataacagctgcaattccctgga

SEQ ID NO: 1172470 - DNA, 18 bp, Homo sapiens
ataacaggcatttgttca

SEQ ID NO: 1172471 - DNA, 18 bp, Homo sapiens
ccacaggactgagccctc

SEQ ID NO: 1172472 - DNA, 19 bp, Homo sapiens
ccacaggactgagccctct

SEQ ID NO: 1172473 - DNA, 20 bp, Homo sapiens
ccacaggactgagccctctc

SEQ ID NO: 1172474 - DNA, 15 bp, Homo sapiens
ccacaggactttgat

SEQ ID NO: 1172475 - DNA, 17 bp, Homo sapiens
ccacaggcaaaactcag

SEQ ID NO: 1172476 - DNA, 15 bp, Homo sapiens
ccacaggcataagct

SEQ ID NO: 1172477 - DNA, 15 bp, Homo sapiens
ccacaggccctggct

SEQ ID NO: 1172478 - DNA, 16 bp, Homo sapiens
ccacaggcccttcctc

SEQ ID NO: 1172479 - DNA, 20 bp, Homo sapiens
ccacaggcctgttcccttgt

SEQ ID NO: 1172480 - DNA, 16 bp, Homo sapiens
ccacaggctagatccc

SEQ ID NO: 1172481 - DNA, 18 bp, Homo sapiens
ccacaggcttagggacag

SEQ ID NO: 1172482 - DNA, 22 bp, Homo sapiens
ataacattgcactttataaaca

SEQ ID NO: 1172483 - DNA, 17 bp, Homo sapiens
ataacattttatacaat

SEQ ID NO: 1172484 - DNA, 19 bp, Homo sapiens
ataacattttatacaattt

SEQ ID NO: 1172485 - DNA, 20 bp, Homo sapiens
ataaccaaagcccaaagtgg

SEQ ID NO: 1172486 - DNA, 14 bp, Homo sapiens
ataaccacaaggtc

SEQ ID NO: 1172487 - DNA, 20 bp, Homo sapiens
ataaccagtgttgtggattt

SEQ ID NO: 1172488 - DNA, 22 bp, Homo sapiens
ataaccatttaaagaaagaatg

SEQ ID NO: 1172489 - DNA, 18 bp, Homo sapiens
ataaccccaggcactgtt

SEQ ID NO: 1172490 - DNA, 18 bp, Homo sapiens
ataaccctgccagtgcca

SEQ ID NO: 1172491 - DNA, 17 bp, Homo sapiens
ataaccctgggctgtcc

SEQ ID NO: 1172492 - DNA, 17 bp, Homo sapiens
ataacctagttaaagaa

SEQ ID NO: 1172493 - DNA, 19 bp, Homo sapiens
ataacctagttaaagaaag

SEQ ID NO: 1172494 - DNA, 18 bp, Homo sapiens
ataacctatatgatttat

SEQ ID NO: 1172495 - DNA, 12 bp, Homo sapiens
ataacctctggc

SEQ ID NO: 1172496 - DNA, 18 bp, Homo sapiens
ataacctgccagtcccag

SEQ ID NO: 1172497 - DNA, 13 bp, Homo sapiens
ataacctggcaaa

SEQ ID NO: 1172498 - DNA, 14 bp, Homo sapiens
ataaccttaattta

SEQ ID NO: 1172499 - DNA, 15 bp, Homo sapiens
ataaccttcattttt

SEQ ID NO: 1172500 - DNA, 13 bp, Homo sapiens
ataacctttctgg

SEQ ID NO: 1172501 - DNA, 21 bp, Homo sapiens
ataacgccccagataccagcc

SEQ ID NO: 1172502 - DNA, 15 bp, Homo sapiens
ataactaacatgtcc

SEQ ID NO: 1172503 - DNA, 16 bp, Homo sapiens
ataactaagagattct

SEQ ID NO: 1172504 - DNA, 19 bp, Homo sapiens
ataactaatgctaagaaat

SEQ ID NO: 1172505 - DNA, 20 bp, Homo sapiens
ataactactccggagacagg

SEQ ID NO: 1172506 - DNA, 16 bp, Homo sapiens
ataactactgtgttcc

SEQ ID NO: 1172507 - DNA, 16 bp, Homo sapiens
ataactagccagacaa

SEQ ID NO: 1172508 - DNA, 21 bp, Homo sapiens
ataactattttgttttaatct

SEQ ID NO: 1172509 - DNA, 15 bp, Homo sapiens
ataactcatcataaa

SEQ ID NO: 1172510 - DNA, 16 bp, Homo sapiens
ataactcatcataaaa

SEQ ID NO: 1172511 - DNA, 17 bp, Homo sapiens
ataactcatcataaaat

SEQ ID NO: 1172512 - DNA, 12 bp, Homo sapiens
ataactccttct

SEQ ID NO: 1172513 - DNA, 12 bp, Homo sapiens
ataactctgcaa

SEQ ID NO: 1172514 - DNA, 13 bp, Homo sapiens
ataactctgtaaa

SEQ ID NO: 1172515 - DNA, 19 bp, Homo sapiens
ataactctgtaaaaacact

SEQ ID NO: 1172516 - DNA, 14 bp, Homo sapiens
ataactgaaaatta

SEQ ID NO: 1172517 - DNA, 17 bp, Homo sapiens
ataactgaaaattattt

SEQ ID NO: 1172518 - DNA, 21 bp, Homo sapiens
ataactgaaaattatttaaac

SEQ ID NO: 1172519 - DNA, 15 bp, Homo sapiens
ataactggattttga

SEQ ID NO: 1172520 - DNA, 20 bp, Homo sapiens
ataactgtagctcaagttta

SEQ ID NO: 1172521 - DNA, 19 bp, Homo sapiens
ataactgtcttgtttcagt

SEQ ID NO: 1172522 - DNA, 21 bp, Homo sapiens
ataactgttttagaaattggt

SEQ ID NO: 1172523 - DNA, 12 bp, Homo sapiens
ataacttaaaaa

SEQ ID NO: 1172524 - DNA, 21 bp, Homo sapiens
ataacttaaaaatgtaaatat

SEQ ID NO: 1172525 - DNA, 20 bp, Homo sapiens
ataacttactgtatatgtat

SEQ ID NO: 1172526 - DNA, 23 bp, Homo sapiens
ataacttatattgtaagaaatac

SEQ ID NO: 1172527 - DNA, 13 bp, Homo sapiens
ataacttcagtcc

SEQ ID NO: 1172528 - DNA, 20 bp, Homo sapiens
ataacttcagtcctgctcca

SEQ ID NO: 1172529 - DNA, 14 bp, Homo sapiens
ataacttcctggct

SEQ ID NO: 1172530 - DNA, 19 bp, Homo sapiens
ataacttcttaaaagttgt

SEQ ID NO: 1172531 - DNA, 15 bp, Homo sapiens
ataacttgatataga

SEQ ID NO: 1172532 - DNA, 16 bp, Homo sapiens
ataacttgctgaattt

SEQ ID NO: 1172533 - DNA, 18 bp, Homo sapiens
ataacttgctgaatttca

SEQ ID NO: 1172534 - DNA, 21 bp, Homo sapiens
ataacttgctttcttctttcc

SEQ ID NO: 1172535 - DNA, 16 bp, Homo sapiens
ataagaaaaaattctt

SEQ ID NO: 1172536 - DNA, 11 bp, Homo sapiens
ataagaaaaac

SEQ ID NO: 1172537 - DNA, 17 bp, Homo sapiens
ataagaaaaatcatgtt

SEQ ID NO: 1172538 - DNA, 18 bp, Homo sapiens
ataagaaaagatgtagat

SEQ ID NO: 1172539 - DNA, 22 bp, Homo sapiens
ataagaaaagatgtagatttat

SEQ ID NO: 1172540 - DNA, 14 bp, Homo sapiens
ataagaaaagtaat

SEQ ID NO: 1172541 - DNA, 11 bp, Homo sapiens
ataagaagaat

SEQ ID NO: 1172542 - DNA, 19 bp, Homo sapiens
ataagaagaatgcttaatc

SEQ ID NO: 1172543 - DNA, 21 bp, Homo sapiens
ataagaagcaatctttgaaat

SEQ ID NO: 1172544 - DNA, 22 bp, Homo sapiens
ataagaagcaatctttgaaata

SEQ ID NO: 1172545 - DNA, 20 bp, Homo sapiens
ataagaatctatagttcact

SEQ ID NO: 1172546 - DNA, 13 bp, Homo sapiens
ataagaattagac

SEQ ID NO: 1172547 - DNA, 22 bp, Homo sapiens
ataagaattagacatcttcaga

SEQ ID NO: 1172548 - DNA, 16 bp, Homo sapiens
ataagaattcagacat

SEQ ID NO: 1172549 - DNA, 23 bp, Homo sapiens
ataagacaaatattcctttgcat

SEQ ID NO: 1172550 - DNA, 21 bp, Homo sapiens
ataagacaatgacatacgctt

SEQ ID NO: 1172551 - DNA, 17 bp, Homo sapiens
ataagactataaataaa

SEQ ID NO: 1172552 - DNA, 20 bp, Homo sapiens
ataagagaattatatatttc

SEQ ID NO: 1172553 - DNA, 15 bp, Homo sapiens
ataagagagatgaga

SEQ ID NO: 1172554 - DNA, 15 bp, Homo sapiens
ataagagcagtcaca

SEQ ID NO: 1172555 - DNA, 20 bp, Homo sapiens
ataagagcatgatttgaaaa

SEQ ID NO: 1172556 - DNA, 18 bp, Homo sapiens
ataagagggctttttaaa

SEQ ID NO: 1172557 - DNA, 23 bp, Homo sapiens
ataagagttgctttgccagagca

SEQ ID NO: 1172558 - DNA, 19 bp, Homo sapiens
ataagatatatacaaggtg

SEQ ID NO: 1172559 - DNA, 15 bp, Homo sapiens
ataagatctgtatct

SEQ ID NO: 1172560 - DNA, 23 bp, Homo sapiens
ataagattagttggacagtttaa

SEQ ID NO: 1172561 - DNA, 14 bp, Homo sapiens
ataagattcatatt

SEQ ID NO: 1172562 - DNA, 22 bp, Homo sapiens
ataagattccaaaaagcacata

SEQ ID NO: 1172563 - DNA, 13 bp, Homo sapiens
ataagcaaaaaga

SEQ ID NO: 1172564 - DNA, 14 bp, Homo sapiens
ataagcaaaaagat

SEQ ID NO: 1172565 - DNA, 20 bp, Homo sapiens
ataagcaagagacaataata

SEQ ID NO: 1172566 - DNA, 15 bp, Homo sapiens
ataagcaagagagat

SEQ ID NO: 1172567 - DNA, 17 bp, Homo sapiens
ataagcaagagagatgt

SEQ ID NO: 1172568 - DNA, 21 bp, Homo sapiens
ataagcacttgcctggaataa

SEQ ID NO: 1172569 - DNA, 13 bp, Homo sapiens
ataagcaggtgga

SEQ ID NO: 1172570 - DNA, 17 bp, Homo sapiens
ataagcaggtggatcta

SEQ ID NO: 1172571 - DNA, 20 bp, Homo sapiens
ataagcattgacttgccgtc

SEQ ID NO: 1172572 - DNA, 22 bp, Homo sapiens
ataagcccagtgctgctgtaaa

SEQ ID NO: 1172573 - DNA, 13 bp, Homo sapiens
ataagctaaagag

SEQ ID NO: 1172574 - DNA, 17 bp, Homo sapiens
ataagctaaagaggctg

SEQ ID NO: 1172575 - DNA, 19 bp, Homo sapiens
ataagctactagcaaaata

SEQ ID NO: 1172576 - DNA, 23 bp, Homo sapiens
ataagctatcacctagcagcctc

SEQ ID NO: 1172577 - DNA, 19 bp, Homo sapiens
ataagctggactagtgtcc

SEQ ID NO: 1172578 - DNA, 15 bp, Homo sapiens
ataagcttaaatagg

SEQ ID NO: 1172579 - DNA, 15 bp, Homo sapiens
ataagctttctcaga

SEQ ID NO: 1172580 - DNA, 20 bp, Homo sapiens
ataagctttctcagaatgtt

SEQ ID NO: 1172581 - DNA, 19 bp, Homo sapiens
ataagctttctctcagaaa

SEQ ID NO: 1172582 - DNA, 13 bp, Homo sapiens
ataaggaaacttt

SEQ ID NO: 1172583 - DNA, 15 bp, Homo sapiens
ataaggaaactttat

SEQ ID NO: 1172584 - DNA, 20 bp, Homo sapiens
ataaggaaactttatttaaa

SEQ ID NO: 1172585 - DNA, 23 bp, Homo sapiens
ataaggaaactttatttaaatgc

SEQ ID NO: 1172586 - DNA, 18 bp, Homo sapiens
ataaggaaagcaataaat

SEQ ID NO: 1172587 - DNA, 17 bp, Homo sapiens
ataaggaattatagacc

SEQ ID NO: 1172588 - DNA, 15 bp, Homo sapiens
ataaggaatttcctc

SEQ ID NO: 1172589 - DNA, 22 bp, Homo sapiens
ataaggatcagaacagcagagg

SEQ ID NO: 1172590 - DNA, 23 bp, Homo sapiens
ataaggcccagagcgaggaaagg

SEQ ID NO: 1172591 - DNA, 19 bp, Homo sapiens
ataaggcctactatacatt

SEQ ID NO: 1172592 - DNA, 16 bp, Homo sapiens
ataaggcctgccctcc

SEQ ID NO: 1172593 - DNA, 22 bp, Homo sapiens
ccaccagtggacctagcctgga

SEQ ID NO: 1172594 - DNA, 15 bp, Homo sapiens
ccaccagtgtgtggg

SEQ ID NO: 1172595 - DNA, 19 bp, Homo sapiens
ccaccagtgtgtgggggag

SEQ ID NO: 1172596 - DNA, 18 bp, Homo sapiens
ccaccatcaccaccgcct

SEQ ID NO: 1172597 - DNA, 16 bp, Homo sapiens
ccaccatgaccccttc

SEQ ID NO: 1172598 - DNA, 13 bp, Homo sapiens
ccaccatgcttgc

SEQ ID NO: 1172599 - DNA, 17 bp, Homo sapiens
ccaccatggaccagccc

SEQ ID NO: 1172600 - DNA, 16 bp, Homo sapiens
ccaccattcctgcctt

SEQ ID NO: 1172601 - DNA, 15 bp, Homo sapiens
ccaccatttaaaaat

SEQ ID NO: 1172602 - DNA, 14 bp, Homo sapiens
ccacccaacagctc

SEQ ID NO: 1172603 - DNA, 20 bp, Homo sapiens
ccacccaagcctgctggctg

SEQ ID NO: 1172604 - DNA, 15 bp, Homo sapiens
ccacccaagcttggc

SEQ ID NO: 1172605 - DNA, 16 bp, Homo sapiens
ccacccaagcttggca

SEQ ID NO: 1172606 - DNA, 14 bp, Homo sapiens
ccacccacacagct

SEQ ID NO: 1172607 - DNA, 15 bp, Homo sapiens
ccacccacacagctg

SEQ ID NO: 1172608 - DNA, 17 bp, Homo sapiens
ccacccacacagctgcc

SEQ ID NO: 1172609 - DNA, 18 bp, Homo sapiens
ccacccacacagctgccc

SEQ ID NO: 1172610 - DNA, 24 bp, Homo sapiens
ccacccacacagctgccctagctg

SEQ ID NO: 1172611 - DNA, 14 bp, Homo sapiens
ccacccacccccag

SEQ ID NO: 1172612 - DNA, 13 bp, Homo sapiens
ccacccaccctct

SEQ ID NO: 1172613 - DNA, 12 bp, Homo sapiens
ccacccacctcc

SEQ ID NO: 1172614 - DNA, 16 bp, Homo sapiens
ccacccacctcctgcg

SEQ ID NO: 1172615 - DNA, 17 bp, Homo sapiens
ccacccagaggcagcag

SEQ ID NO: 1172616 - DNA, 18 bp, Homo sapiens
ccacccagagtagagcca

SEQ ID NO: 1172617 - DNA, 11 bp, Homo sapiens
ccacccagccc

SEQ ID NO: 1172618 - DNA, 13 bp, Homo sapiens
ccacccagcccat

SEQ ID NO: 1172619 - DNA, 12 bp, Homo sapiens
ccacccagcccc

SEQ ID NO: 1172620 - DNA, 13 bp, Homo sapiens
ccacccagcccct

SEQ ID NO: 1172621 - DNA, 21 bp, Homo sapiens
ccacccagcccctctcccctc

SEQ ID NO: 1172622 - DNA, 14 bp, Homo sapiens
ccacccagcccctg

SEQ ID NO: 1172623 - DNA, 12 bp, Homo sapiens
ccacccagccct

SEQ ID NO: 1172624 - DNA, 16 bp, Homo sapiens
ccacccagcccttcct

SEQ ID NO: 1172625 - DNA, 13 bp, Homo sapiens
ccacccagctggt

SEQ ID NO: 1172626 - DNA, 12 bp, Homo sapiens
ccacccaggctg

SEQ ID NO: 1172627 - DNA, 21 bp, Homo sapiens
ccacccagggctccctcctgg

SEQ ID NO: 1172628 - DNA, 14 bp, Homo sapiens
ccacccagtgctgc

SEQ ID NO: 1172629 - DNA, 19 bp, Homo sapiens
ccacccagtgctgccatgc

SEQ ID NO: 1172630 - DNA, 21 bp, Homo sapiens
ccacccagtgctgccatgcca

SEQ ID NO: 1172631 - DNA, 19 bp, Homo sapiens
ccacccatcgtccacccca

SEQ ID NO: 1172632 - DNA, 19 bp, Homo sapiens
ccacccatcttcctgctgc

SEQ ID NO: 1172633 - DNA, 23 bp, Homo sapiens
ccacccatggggaggagaccttt

SEQ ID NO: 1172634 - DNA, 13 bp, Homo sapiens
ccaccccaactct

SEQ ID NO: 1172635 - DNA, 13 bp, Homo sapiens
ccaccccaagaga

SEQ ID NO: 1172636 - DNA, 17 bp, Homo sapiens
ccaccccaagagaactc

SEQ ID NO: 1172637 - DNA, 12 bp, Homo sapiens
ccaccccacact

SEQ ID NO: 1172638 - DNA, 13 bp, Homo sapiens
ccaccccacactt

SEQ ID NO: 1172639 - DNA, 14 bp, Homo sapiens
ccaccccaccccct

SEQ ID NO: 1172640 - DNA, 16 bp, Homo sapiens
ccaccccacctcttgt

SEQ ID NO: 1172641 - DNA, 17 bp, Homo sapiens
ccaccccactcagggga

SEQ ID NO: 1172642 - DNA, 15 bp, Homo sapiens
ccaccccagaaatca

SEQ ID NO: 1172643 - DNA, 18 bp, Homo sapiens
ccaccccagaaatcactg

SEQ ID NO: 1172644 - DNA, 12 bp, Homo sapiens
ccaccccagcac

SEQ ID NO: 1172645 - DNA, 23 bp, Homo sapiens
ccaccccagcacagccacctccg

SEQ ID NO: 1172646 - DNA, 13 bp, Homo sapiens
ccaccccaggacg

SEQ ID NO: 1172647 - DNA, 13 bp, Homo sapiens
ccaccccagtggg

SEQ ID NO: 1172648 - DNA, 18 bp, Homo sapiens
ccaccccatccagttcat

SEQ ID NO: 1172649 - DNA, 18 bp, Homo sapiens
ccaccccattttctgtgg

SEQ ID NO: 1172650 - DNA, 19 bp, Homo sapiens
ccacccccaacccccagag

SEQ ID NO: 1172651 - DNA, 14 bp, Homo sapiens
ccacccccagccag

SEQ ID NO: 1172652 - DNA, 16 bp, Homo sapiens
ccacccccagccaggc

SEQ ID NO: 1172653 - DNA, 14 bp, Homo sapiens
ccacccccagcccc

SEQ ID NO: 1172654 - DNA, 16 bp, Homo sapiens
ccacccccagccccga

SEQ ID NO: 1172655 - DNA, 13 bp, Homo sapiens
ccacccccaggcc

SEQ ID NO: 1172656 - DNA, 14 bp, Homo sapiens
ccacccccaggtct

SEQ ID NO: 1172657 - DNA, 14 bp, Homo sapiens
ccacccccaggtgc

SEQ ID NO: 1172658 - DNA, 13 bp, Homo sapiens
ccacccccagttc

SEQ ID NO: 1172659 - DNA, 17 bp, Homo sapiens
ccaccccccagcctcca

SEQ ID NO: 1172660 - DNA, 20 bp, Homo sapiens
ccacccccgggatcctgccc

SEQ ID NO: 1172661 - DNA, 12 bp, Homo sapiens
ccaccccctcaa

SEQ ID NO: 1172662 - DNA, 18 bp, Homo sapiens
ccaccccctccccagggg

SEQ ID NO: 1172663 - DNA, 22 bp, Homo sapiens
ccaccccctccctggcctgttc

SEQ ID NO: 1172664 - DNA, 14 bp, Homo sapiens
ccaccccctgtccc

SEQ ID NO: 1172665 - DNA, 19 bp, Homo sapiens
ccacccccttctctgctcc

SEQ ID NO: 1172666 - DNA, 23 bp, Homo sapiens
ccaccccgaaatcagcccccagc

SEQ ID NO: 1172667 - DNA, 23 bp, Homo sapiens
ccaccccgagggctgagcctggt

SEQ ID NO: 1172668 - DNA, 18 bp, Homo sapiens
ccaccccgccgttccctg

SEQ ID NO: 1172669 - DNA, 22 bp, Homo sapiens
ccaccccgccgttccctgcgct

SEQ ID NO: 1172670 - DNA, 17 bp, Homo sapiens
ccaccccggcctccact

SEQ ID NO: 1172671 - DNA, 19 bp, Homo sapiens
ccaccccggggaccctgtg

SEQ ID NO: 1172672 - DNA, 12 bp, Homo sapiens
ccacccctccac

SEQ ID NO: 1172673 - DNA, 21 bp, Homo sapiens
ccacccctccacgtgtccgtc

SEQ ID NO: 1172674 - DNA, 20 bp, Homo sapiens
ccacccctgccactcaccct

SEQ ID NO: 1172675 - DNA, 17 bp, Homo sapiens
ccacccctgggggctct

SEQ ID NO: 1172676 - DNA, 20 bp, Homo sapiens
ccacccctgggggctctcat

SEQ ID NO: 1172677 - DNA, 13 bp, Homo sapiens
ccacccctgtgct

SEQ ID NO: 1172678 - DNA, 13 bp, Homo sapiens
ccaccccttcccc

SEQ ID NO: 1172679 - DNA, 14 bp, Homo sapiens
ccaccccttcccca

SEQ ID NO: 1172680 - DNA, 15 bp, Homo sapiens
ccaccccttccccac

SEQ ID NO: 1172681 - DNA, 16 bp, Homo sapiens
ccaccccttccccagg

SEQ ID NO: 1172682 - DNA, 18 bp, Homo sapiens
ccaccccttccccaggcc

SEQ ID NO: 1172683 - DNA, 13 bp, Homo sapiens
ccaccccttcctg

SEQ ID NO: 1172684 - DNA, 15 bp, Homo sapiens
ccaccccttcctgtc

SEQ ID NO: 1172685 - DNA, 22 bp, Homo sapiens
ccaccccttcgacatgctgcca

SEQ ID NO: 1172686 - DNA, 22 bp, Homo sapiens
ccacccgagtacctccagtcac

SEQ ID NO: 1172687 - DNA, 13 bp, Homo sapiens
ccacccgatgctg

SEQ ID NO: 1172688 - DNA, 17 bp, Homo sapiens
ccacccgatgctgcttt

SEQ ID NO: 1172689 - DNA, 17 bp, Homo sapiens
ccacccgctgcccctcc

SEQ ID NO: 1172690 - DNA, 13 bp, Homo sapiens
ccacccggacagg

SEQ ID NO: 1172691 - DNA, 17 bp, Homo sapiens
ccacccggacaggtggg

SEQ ID NO: 1172692 - DNA, 14 bp, Homo sapiens
ccacccggccacag

SEQ ID NO: 1172693 - DNA, 18 bp, Homo sapiens
ccacccggccacagctgc

SEQ ID NO: 1172694 - DNA, 22 bp, Homo sapiens
ccacccggccacagctgctgga

SEQ ID NO: 1172695 - DNA, 13 bp, Homo sapiens
ccacccggctggc

SEQ ID NO: 1172696 - DNA, 18 bp, Homo sapiens
ccacccgggggagcccag

SEQ ID NO: 1172697 - DNA, 14 bp, Homo sapiens
ccacccgtcctccc

SEQ ID NO: 1172698 - DNA, 16 bp, Homo sapiens
ccaccctaccagctcc

SEQ ID NO: 1172699 - DNA, 19 bp, Homo sapiens
ccaccctaccagctcctcc

SEQ ID NO: 1172700 - DNA, 22 bp, Homo sapiens
ccaccctaccagctcctccagc

SEQ ID NO: 1172701 - DNA, 17 bp, Homo sapiens
ccaccctactccctcca

SEQ ID NO: 1172702 - DNA, 14 bp, Homo sapiens
ccaccctcactggc

SEQ ID NO: 1172703 - DNA, 17 bp, Homo sapiens
ccaccctcactggctct

SEQ ID NO: 1172704 - DNA, 13 bp, Homo sapiens
ccaccctcagcac

SEQ ID NO: 1172705 - DNA, 16 bp, Homo sapiens
ccaccctcaggtgcct

SEQ ID NO: 1172706 - DNA, 20 bp, Homo sapiens
ccaccctcatttttccttta

SEQ ID NO: 1172707 - DNA, 13 bp, Homo sapiens
ccaccctccactc

SEQ ID NO: 1172708 - DNA, 15 bp, Homo sapiens
ccaccctcctctagc

SEQ ID NO: 1172709 - DNA, 12 bp, Homo sapiens
ccaccctctgcc

SEQ ID NO: 1172710 - DNA, 18 bp, Homo sapiens
ccaccctctgcccaggga

SEQ ID NO: 1172711 - DNA, 15 bp, Homo sapiens
ccaccctctgggagt

SEQ ID NO: 1172712 - DNA, 13 bp, Homo sapiens
ccaccctctgggg

SEQ ID NO: 1172713 - DNA, 15 bp, Homo sapiens
ccaccctctggggac

SEQ ID NO: 1172714 - DNA, 18 bp, Homo sapiens
ccaccctgaaagccctga

SEQ ID NO: 1172715 - DNA, 21 bp, Homo sapiens
ccaccctgagccggccccagg

SEQ ID NO: 1172716 - DNA, 20 bp, Homo sapiens
ccaccctgagttgcttttca

SEQ ID NO: 1172717 - DNA, 22 bp, Homo sapiens
agctcagaatccaagtgaacac

SEQ ID NO: 1172718 - DNA, 18 bp, Homo sapiens
agctcagacccccactct

SEQ ID NO: 1172719 - DNA, 11 bp, Homo sapiens
agctcagccca

SEQ ID NO: 1172720 - DNA, 21 bp, Homo sapiens
agctcagcccacccccctcat

SEQ ID NO: 1172721 - DNA, 23 bp, Homo sapiens
agctcagccccgagctgtccccg

SEQ ID NO: 1172722 - DNA, 12 bp, Homo sapiens
agctcagccctg

SEQ ID NO: 1172723 - DNA, 13 bp, Homo sapiens
agctcagccctgg

SEQ ID NO: 1172724 - DNA, 14 bp, Homo sapiens
agctcagccctggc

SEQ ID NO: 1172725 - DNA, 22 bp, Homo sapiens
agctcagccctggcctggctgg

SEQ ID NO: 1172726 - DNA, 12 bp, Homo sapiens
agctcagcgcca

SEQ ID NO: 1172727 - DNA, 19 bp, Homo sapiens
agctcagctgcattccgca

SEQ ID NO: 1172728 - DNA, 16 bp, Homo sapiens
agctcagcttcttcct

SEQ ID NO: 1172729 - DNA, 20 bp, Homo sapiens
agctcaggaagaagagatgc

SEQ ID NO: 1172730 - DNA, 21 bp, Homo sapiens
agctcaggaagaagagatgca

SEQ ID NO: 1172731 - DNA, 17 bp, Homo sapiens
agctcaggaggcttgga

SEQ ID NO: 1172732 - DNA, 16 bp, Homo sapiens
agctcaggatatggct

SEQ ID NO: 1172733 - DNA, 12 bp, Homo sapiens
agctcagggcag

SEQ ID NO: 1172734 - DNA, 19 bp, Homo sapiens
agctcagtcatcaaagcag

SEQ ID NO: 1172735 - DNA, 13 bp, Homo sapiens
agctcagtcccat

SEQ ID NO: 1172736 - DNA, 21 bp, Homo sapiens
agctcagttctagtctctctg

SEQ ID NO: 1172737 - DNA, 21 bp, Homo sapiens
agctcatagaggtgagaaaac

SEQ ID NO: 1172738 - DNA, 20 bp, Homo sapiens
agctcatatgctgacagctc

SEQ ID NO: 1172739 - DNA, 14 bp, Homo sapiens
agctcatattttgt

SEQ ID NO: 1172740 - DNA, 13 bp, Homo sapiens
agctcatcccccc

SEQ ID NO: 1172741 - DNA, 16 bp, Homo sapiens
agctcatcccccctgc

SEQ ID NO: 1172742 - DNA, 17 bp, Homo sapiens
agctcatcccccctgct

SEQ ID NO: 1172743 - DNA, 21 bp, Homo sapiens
agctcatcccccctgctgccc

SEQ ID NO: 1172744 - DNA, 17 bp, Homo sapiens
agctcatctccaaggat

SEQ ID NO: 1172745 - DNA, 22 bp, Homo sapiens
agctcatgacactgtttggcct

SEQ ID NO: 1172746 - DNA, 23 bp, Homo sapiens
agctcatgtaggtgagcctgggc

SEQ ID NO: 1172747 - DNA, 21 bp, Homo sapiens
agctcattaaacttttttaac

SEQ ID NO: 1172748 - DNA, 15 bp, Homo sapiens
agctccaagccccat

SEQ ID NO: 1172749 - DNA, 21 bp, Homo sapiens
agctccacacattccagccag

SEQ ID NO: 1172750 - DNA, 22 bp, Homo sapiens
agctccacacattccagccagg

SEQ ID NO: 1172751 - DNA, 17 bp, Homo sapiens
agctccaccctggccga

SEQ ID NO: 1172752 - DNA, 19 bp, Homo sapiens
agctccacggtgcgtggct

SEQ ID NO: 1172753 - DNA, 21 bp, Homo sapiens
agctccacggtgcgtggctgt

SEQ ID NO: 1172754 - DNA, 17 bp, Homo sapiens
agctccactctgcttct

SEQ ID NO: 1172755 - DNA, 18 bp, Homo sapiens
agctccactctgcttctc

SEQ ID NO: 1172756 - DNA, 22 bp, Homo sapiens
agctccactctgcttctctgac

SEQ ID NO: 1172757 - DNA, 23 bp, Homo sapiens
agctccactctgcttctctgact

SEQ ID NO: 1172758 - DNA, 18 bp, Homo sapiens
agctccactgtcaccctc

SEQ ID NO: 1172759 - DNA, 18 bp, Homo sapiens
agctccagacccccagca

SEQ ID NO: 1172760 - DNA, 14 bp, Homo sapiens
agctccagctttct

SEQ ID NO: 1172761 - DNA, 13 bp, Homo sapiens
agctccaggacac

SEQ ID NO: 1172762 - DNA, 21 bp, Homo sapiens
agctccagggaatccaagcct

SEQ ID NO: 1172763 - DNA, 15 bp, Homo sapiens
agctccaggggccct

SEQ ID NO: 1172764 - DNA, 22 bp, Homo sapiens
agctccatcaatgaggtatctt

SEQ ID NO: 1172765 - DNA, 18 bp, Homo sapiens
agctccatcctcttgact

SEQ ID NO: 1172766 - DNA, 13 bp, Homo sapiens
agctccatctcca

SEQ ID NO: 1172767 - DNA, 16 bp, Homo sapiens
agctccatctccactc

SEQ ID NO: 1172768 - DNA, 14 bp, Homo sapiens
agctccatgtgcat

SEQ ID NO: 1172769 - DNA, 16 bp, Homo sapiens
agctccatgtgcatat

SEQ ID NO: 1172770 - DNA, 17 bp, Homo sapiens
agctccatgtgcatata

SEQ ID NO: 1172771 - DNA, 20 bp, Homo sapiens
agctccatgtgcatataaag

SEQ ID NO: 1172772 - DNA, 22 bp, Homo sapiens
agctccatgtgcatataaaggt

SEQ ID NO: 1172773 - DNA, 13 bp, Homo sapiens
agctccattttct

SEQ ID NO: 1172774 - DNA, 23 bp, Homo sapiens
agctcccaccccacccccttcag

SEQ ID NO: 1172775 - DNA, 16 bp, Homo sapiens
agctcccaccccactc

SEQ ID NO: 1172776 - DNA, 13 bp, Homo sapiens
agctcccacctcc

SEQ ID NO: 1172777 - DNA, 16 bp, Homo sapiens
agctccccaactccct

SEQ ID NO: 1172778 - DNA, 14 bp, Homo sapiens
agctccccagatct

SEQ ID NO: 1172779 - DNA, 20 bp, Homo sapiens
agctccccgcttctgcctgc

SEQ ID NO: 1172780 - DNA, 21 bp, Homo sapiens
agctccccgcttctgcctgca

SEQ ID NO: 1172781 - DNA, 18 bp, Homo sapiens
agctcccctccacagctg

SEQ ID NO: 1172782 - DNA, 17 bp, Homo sapiens
agctccctaggagacca

SEQ ID NO: 1172783 - DNA, 12 bp, Homo sapiens
agctccctcctg

SEQ ID NO: 1172784 - DNA, 21 bp, Homo sapiens
agctccctcctgcacacagaa

SEQ ID NO: 1172785 - DNA, 13 bp, Homo sapiens
agctccctgcacc

SEQ ID NO: 1172786 - DNA, 16 bp, Homo sapiens
agctccctgcaccgcc

SEQ ID NO: 1172787 - DNA, 18 bp, Homo sapiens
agctccctgcaccgccgc

SEQ ID NO: 1172788 - DNA, 14 bp, Homo sapiens
agctccctgcccca

SEQ ID NO: 1172789 - DNA, 16 bp, Homo sapiens
agctccctggagccct

SEQ ID NO: 1172790 - DNA, 18 bp, Homo sapiens
agctccctgtggggcagg

SEQ ID NO: 1172791 - DNA, 23 bp, Homo sapiens
agctccctgtggggcaggagtgc

SEQ ID NO: 1172792 - DNA, 21 bp, Homo sapiens
agctcccttcccttgagatga

SEQ ID NO: 1172793 - DNA, 16 bp, Homo sapiens
agctcccttctctgta

SEQ ID NO: 1172794 - DNA, 23 bp, Homo sapiens
agctcccttctctgtagggaact

SEQ ID NO: 1172795 - DNA, 17 bp, Homo sapiens
agctccgcctcccgggt

SEQ ID NO: 1172796 - DNA, 16 bp, Homo sapiens
agctccgcctgctggg

SEQ ID NO: 1172797 - DNA, 20 bp, Homo sapiens
agctccggagggggtcctcc

SEQ ID NO: 1172798 - DNA, 23 bp, Homo sapiens
agctcctcaactcacctaatgtt

SEQ ID NO: 1172799 - DNA, 10 bp, Homo sapiens
agctcctcac

SEQ ID NO: 1172800 - DNA, 19 bp, Homo sapiens
agctcctccagccctgccg

SEQ ID NO: 1172801 - DNA, 16 bp, Homo sapiens
agctcctcctccctgc

SEQ ID NO: 1172802 - DNA, 16 bp, Homo sapiens
agctcctcctcggaac

SEQ ID NO: 1172803 - DNA, 19 bp, Homo sapiens
agctcctctaggggcagcc

SEQ ID NO: 1172804 - DNA, 20 bp, Homo sapiens
agctcctctaggggcagcct

SEQ ID NO: 1172805 - DNA, 15 bp, Homo sapiens
agctcctctccttgg

SEQ ID NO: 1172806 - DNA, 19 bp, Homo sapiens
agctcctctccttgggctc

SEQ ID NO: 1172807 - DNA, 20 bp, Homo sapiens
agctcctctccttgggctcc

SEQ ID NO: 1172808 - DNA, 24 bp, Homo sapiens
agctcctctccttgggctcctggc

SEQ ID NO: 1172809 - DNA, 19 bp, Homo sapiens
agctcctctctgaagcgac

SEQ ID NO: 1172810 - DNA, 19 bp, Homo sapiens
agctcctctgggcaggacc

SEQ ID NO: 1172811 - DNA, 20 bp, Homo sapiens
agctcctcttaccgtagcct

SEQ ID NO: 1172812 - DNA, 16 bp, Homo sapiens
agctcctgagtagctg

SEQ ID NO: 1172813 - DNA, 13 bp, Homo sapiens
agctcctgccaca

SEQ ID NO: 1172814 - DNA, 14 bp, Homo sapiens
agctcctgccaggg

SEQ ID NO: 1172815 - DNA, 20 bp, Homo sapiens
agctcctggggagctcctgg

SEQ ID NO: 1172816 - DNA, 20 bp, Homo sapiens
agctcctggtcttgagatgt

SEQ ID NO: 1172817 - DNA, 11 bp, Homo sapiens
agctcctgtaa

SEQ ID NO: 1172818 - DNA, 12 bp, Homo sapiens
agctcctgtcct

SEQ ID NO: 1172819 - DNA, 14 bp, Homo sapiens
agctcctgtcctcc

SEQ ID NO: 1172820 - DNA, 16 bp, Homo sapiens
agctcctgtggcccca

SEQ ID NO: 1172821 - DNA, 19 bp, Homo sapiens
agctcctgtggccccaccc

SEQ ID NO: 1172822 - DNA, 12 bp, Homo sapiens
agctccttcctg

SEQ ID NO: 1172823 - DNA, 22 bp, Homo sapiens
agctccttggctgcagccatcc

SEQ ID NO: 1172824 - DNA, 16 bp, Homo sapiens
agctcctttctcctgt

SEQ ID NO: 1172825 - DNA, 19 bp, Homo sapiens
agctcgaattaagaatatg

SEQ ID NO: 1172826 - DNA, 13 bp, Homo sapiens
agctcgcagcccc

SEQ ID NO: 1172827 - DNA, 23 bp, Homo sapiens
agctcgcagcccccgcgccctcc

SEQ ID NO: 1172828 - DNA, 18 bp, Homo sapiens
agctcgcatccagacagt

SEQ ID NO: 1172829 - DNA, 12 bp, Homo sapiens
agctcgcccctc

SEQ ID NO: 1172830 - DNA, 13 bp, Homo sapiens
agctcgcccctcc

SEQ ID NO: 1172831 - DNA, 15 bp, Homo sapiens
agctcggggtccacc

SEQ ID NO: 1172832 - DNA, 16 bp, Homo sapiens
agctcggggtccacca

SEQ ID NO: 1172833 - DNA, 22 bp, Homo sapiens
agctcggttaagtacccgaggc

SEQ ID NO: 1172834 - DNA, 17 bp, Homo sapiens
agctcgtgtatcctggg

SEQ ID NO: 1172835 - DNA, 18 bp, Homo sapiens
agctcgtgtatcctgggg

SEQ ID NO: 1172836 - DNA, 20 bp, Homo sapiens
agctcgtgtatcctggggct

SEQ ID NO: 1172837 - DNA, 13 bp, Homo sapiens
agctcgtgtgtcc

SEQ ID NO: 1172838 - DNA, 23 bp, Homo sapiens
agctcgtgtgtcctcatggagaa

SEQ ID NO: 1172839 - DNA, 23 bp, Homo sapiens
agctcgtttttcagcacccccac

SEQ ID NO: 1172840 - DNA, 17 bp, Homo sapiens
agctctagacaaccctg

SEQ ID NO: 1172841 - DNA, 22 bp, Homo sapiens
agctaataattcttcacctaag

SEQ ID NO: 1172842 - DNA, 16 bp, Homo sapiens
agctaatctgaccgtt

SEQ ID NO: 1172843 - DNA, 12 bp, Homo sapiens
agctaattattt

SEQ ID NO: 1172844 - DNA, 13 bp, Homo sapiens
agctaattcaggt

SEQ ID NO: 1172845 - DNA, 22 bp, Homo sapiens
agctaattgtactaatctgaga

SEQ ID NO: 1172846 - DNA, 14 bp, Homo sapiens
agctaatttgcatt

SEQ ID NO: 1172847 - DNA, 20 bp, Homo sapiens
agctaatttgcattaaattc

SEQ ID NO: 1172848 - DNA, 13 bp, Homo sapiens
agctaatttttgt

SEQ ID NO: 1172849 - DNA, 15 bp, Homo sapiens
agctaatttttgtat

SEQ ID NO: 1172850 - DNA, 20 bp, Homo sapiens
agctacacagtgcagaggct

SEQ ID NO: 1172851 - DNA, 14 bp, Homo sapiens
agctacactgagca

SEQ ID NO: 1172852 - DNA, 22 bp, Homo sapiens
agctacaggaagcaccccatgc

SEQ ID NO: 1172853 - DNA, 15 bp, Homo sapiens
agctacaggacaaag

SEQ ID NO: 1172854 - DNA, 17 bp, Homo sapiens
agctacaggttgtgaaa

SEQ ID NO: 1172855 - DNA, 13 bp, Homo sapiens
agctacattcctc

SEQ ID NO: 1172856 - DNA, 22 bp, Homo sapiens
agctaccaccacggccaccact

SEQ ID NO: 1172857 - DNA, 17 bp, Homo sapiens
agctacccactatcctt

SEQ ID NO: 1172858 - DNA, 16 bp, Homo sapiens
agctacccctcaaact

SEQ ID NO: 1172859 - DNA, 21 bp, Homo sapiens
agctacccctcaaactgcaca

SEQ ID NO: 1172860 - DNA, 13 bp, Homo sapiens
agctaccccttct

SEQ ID NO: 1172861 - DNA, 23 bp, Homo sapiens
agctaccccttgtgggcaaaggc

SEQ ID NO: 1172862 - DNA, 19 bp, Homo sapiens
agctaccggaaggagggga

SEQ ID NO: 1172863 - DNA, 12 bp, Homo sapiens
agctacctgaga

SEQ ID NO: 1172864 - DNA, 21 bp, Homo sapiens
agctacctgagacgggcatcg

SEQ ID NO: 1172865 - DNA, 16 bp, Homo sapiens
agctacctttttatat

SEQ ID NO: 1172866 - DNA, 16 bp, Homo sapiens
agctactaaaatcagt

SEQ ID NO: 1172867 - DNA, 21 bp, Homo sapiens
agctactcaagaggctgaggc

SEQ ID NO: 1172868 - DNA, 14 bp, Homo sapiens
agctactcagaagc

SEQ ID NO: 1172869 - DNA, 15 bp, Homo sapiens
agctactcaggaggc

SEQ ID NO: 1172870 - DNA, 22 bp, Homo sapiens
agctactcccctttcttccaaa

SEQ ID NO: 1172871 - DNA, 20 bp, Homo sapiens
agctactcgatagcctgagg

SEQ ID NO: 1172872 - DNA, 18 bp, Homo sapiens
agctactctagttctgtt

SEQ ID NO: 1172873 - DNA, 23 bp, Homo sapiens
agctactctccccacgagggctg

SEQ ID NO: 1172874 - DNA, 13 bp, Homo sapiens
agctactctcttg

SEQ ID NO: 1172875 - DNA, 17 bp, Homo sapiens
agctactctgtccaggc

SEQ ID NO: 1172876 - DNA, 19 bp, Homo sapiens
agctactgcggaaaaggaa

SEQ ID NO: 1172877 - DNA, 15 bp, Homo sapiens
agctactgtaacttt

SEQ ID NO: 1172878 - DNA, 17 bp, Homo sapiens
agctactgtaacttttt

SEQ ID NO: 1172879 - DNA, 21 bp, Homo sapiens
agctacttcctcctccccact

SEQ ID NO: 1172880 - DNA, 22 bp, Homo sapiens
agctacttgggaagctgaggcg

SEQ ID NO: 1172881 - DNA, 17 bp, Homo sapiens
agctacttggtttgtgt

SEQ ID NO: 1172882 - DNA, 21 bp, Homo sapiens
agctacttggtttgtgttctt

SEQ ID NO: 1172883 - DNA, 18 bp, Homo sapiens
agctagaaaaataaaatg

SEQ ID NO: 1172884 - DNA, 15 bp, Homo sapiens
agctagaaggccaca

SEQ ID NO: 1172885 - DNA, 16 bp, Homo sapiens
agctagaaggccacat

SEQ ID NO: 1172886 - DNA, 21 bp, Homo sapiens
agctagaagtgggccaggaca

SEQ ID NO: 1172887 - DNA, 17 bp, Homo sapiens
agctagactggagtgag

SEQ ID NO: 1172888 - DNA, 21 bp, Homo sapiens
agctagactggagtgaggctt

SEQ ID NO: 1172889 - DNA, 16 bp, Homo sapiens
agctagatactggaaa

SEQ ID NO: 1172890 - DNA, 16 bp, Homo sapiens
agctagatgcccctgc

SEQ ID NO: 1172891 - DNA, 23 bp, Homo sapiens
agctagcctccagctttggggac

SEQ ID NO: 1172892 - DNA, 14 bp, Homo sapiens
agctagcgctgccg

SEQ ID NO: 1172893 - DNA, 21 bp, Homo sapiens
agctagcgctgccgcacccca

SEQ ID NO: 1172894 - DNA, 16 bp, Homo sapiens
agctagcgtgtgccag

SEQ ID NO: 1172895 - DNA, 15 bp, Homo sapiens
agctagctgccactt

SEQ ID NO: 1172896 - DNA, 17 bp, Homo sapiens
agctagctgccactttc

SEQ ID NO: 1172897 - DNA, 16 bp, Homo sapiens
agctagcttttaggaa

SEQ ID NO: 1172898 - DNA, 20 bp, Homo sapiens
agctagcttttaggaaaatc

SEQ ID NO: 1172899 - DNA, 21 bp, Homo sapiens
agctaggaagagcaggactcc

SEQ ID NO: 1172900 - DNA, 13 bp, Homo sapiens
agctaggaatgaa

SEQ ID NO: 1172901 - DNA, 17 bp, Homo sapiens
agctagggctgctgctt

SEQ ID NO: 1172902 - DNA, 15 bp, Homo sapiens
agctagtagcaatgt

SEQ ID NO: 1172903 - DNA, 19 bp, Homo sapiens
agctagtagcaatgtgcct

SEQ ID NO: 1172904 - DNA, 13 bp, Homo sapiens
agctagtatcttc

SEQ ID NO: 1172905 - DNA, 16 bp, Homo sapiens
agctagtatcttcaaa

SEQ ID NO: 1172906 - DNA, 16 bp, Homo sapiens
agctagtcttttgctt

SEQ ID NO: 1172907 - DNA, 21 bp, Homo sapiens
agctagtgccaaataattgat

SEQ ID NO: 1172908 - DNA, 19 bp, Homo sapiens
agctagtgtacctcctctc

SEQ ID NO: 1172909 - DNA, 21 bp, Homo sapiens
agctagtgtacctcctctcag

SEQ ID NO: 1172910 - DNA, 20 bp, Homo sapiens
agctagttaatgtcagtgac

SEQ ID NO: 1172911 - DNA, 23 bp, Homo sapiens
agctataaattcctctttgcttt

SEQ ID NO: 1172912 - DNA, 14 bp, Homo sapiens
agctatatccatgt

SEQ ID NO: 1172913 - DNA, 17 bp, Homo sapiens
agctatatccatgtact

SEQ ID NO: 1172914 - DNA, 19 bp, Homo sapiens
agctatattagctgaaaca

SEQ ID NO: 1172915 - DNA, 22 bp, Homo sapiens
agctatcaagtgtgctttagct

SEQ ID NO: 1172916 - DNA, 14 bp, Homo sapiens
agctatcaggaaca

SEQ ID NO: 1172917 - DNA, 16 bp, Homo sapiens
agctatccagtgactt

SEQ ID NO: 1172918 - DNA, 16 bp, Homo sapiens
agctatctaaagtttg

SEQ ID NO: 1172919 - DNA, 18 bp, Homo sapiens
agctatctaggtggagtt

SEQ ID NO: 1172920 - DNA, 22 bp, Homo sapiens
agctatctgcactctaaactgc

SEQ ID NO: 1172921 - DNA, 20 bp, Homo sapiens
agctatcttcatgtaaattg

SEQ ID NO: 1172922 - DNA, 21 bp, Homo sapiens
agctatgaagagctagagaaa

SEQ ID NO: 1172923 - DNA, 22 bp, Homo sapiens
agctatgaagtgctgggcaagt

SEQ ID NO: 1172924 - DNA, 20 bp, Homo sapiens
agctatgatttttttttcca

SEQ ID NO: 1172925 - DNA, 17 bp, Homo sapiens
agctatgcgcaatgtgg

SEQ ID NO: 1172926 - DNA, 17 bp, Homo sapiens
agctatgctgtatctgt

SEQ ID NO: 1172927 - DNA, 22 bp, Homo sapiens
agctatgctgtatctgtgcttt

SEQ ID NO: 1172928 - DNA, 22 bp, Homo sapiens
agctatgggagccccagggtct

SEQ ID NO: 1172929 - DNA, 13 bp, Homo sapiens
agctatggtgagg

SEQ ID NO: 1172930 - DNA, 18 bp, Homo sapiens
agctatgttatattgaaa

SEQ ID NO: 1172931 - DNA, 20 bp, Homo sapiens
agctatgttatattgaaaaa

SEQ ID NO: 1172932 - DNA, 19 bp, Homo sapiens
agctatgttccctccagca

SEQ ID NO: 1172933 - DNA, 15 bp, Homo sapiens
agctattactgtctg

SEQ ID NO: 1172934 - DNA, 21 bp, Homo sapiens
agctattcacctcagtagaaa

SEQ ID NO: 1172935 - DNA, 20 bp, Homo sapiens
agctattcctttcccttcct

SEQ ID NO: 1172936 - DNA, 21 bp, Homo sapiens
agctattcctttcccttcctc

SEQ ID NO: 1172937 - DNA, 15 bp, Homo sapiens
agctatttaaagcat

SEQ ID NO: 1172938 - DNA, 12 bp, Homo sapiens
agctatttaata

SEQ ID NO: 1172939 - DNA, 21 bp, Homo sapiens
agctatttcatctatttttgg

SEQ ID NO: 1172940 - DNA, 16 bp, Homo sapiens
agctattttaagccat

SEQ ID NO: 1172941 - DNA, 17 bp, Homo sapiens
agctattttcctctggc

SEQ ID NO: 1172942 - DNA, 20 bp, Homo sapiens
agctcaaaggtttggaagga

SEQ ID NO: 1172943 - DNA, 23 bp, Homo sapiens
agctcaaaggtttggaaggagca

SEQ ID NO: 1172944 - DNA, 12 bp, Homo sapiens
agctcaaatgaa

SEQ ID NO: 1172945 - DNA, 24 bp, Homo sapiens
agctcaactcacagcttctccaag

SEQ ID NO: 1172946 - DNA, 22 bp, Homo sapiens
agctcaagcccttggggagggg

SEQ ID NO: 1172947 - DNA, 16 bp, Homo sapiens
agctcaaggccacctt

SEQ ID NO: 1172948 - DNA, 21 bp, Homo sapiens
agctcaagggaccctgggtgg

SEQ ID NO: 1172949 - DNA, 18 bp, Homo sapiens
agctcaagtcttccctga

SEQ ID NO: 1172950 - DNA, 22 bp, Homo sapiens
agctcaagtttaaaagccatgt

SEQ ID NO: 1172951 - DNA, 16 bp, Homo sapiens
agctcaattgttaatg

SEQ ID NO: 1172952 - DNA, 20 bp, Homo sapiens
agctcaattgttaatgtgat

SEQ ID NO: 1172953 - DNA, 21 bp, Homo sapiens
agctcaattgttaatgtgatg

SEQ ID NO: 1172954 - DNA, 19 bp, Homo sapiens
agctcacatccagccttgg

SEQ ID NO: 1172955 - DNA, 19 bp, Homo sapiens
agctcacatgggactggga

SEQ ID NO: 1172956 - DNA, 21 bp, Homo sapiens
agctcacatgggactgggata

SEQ ID NO: 1172957 - DNA, 17 bp, Homo sapiens
agctcacccaataaaca

SEQ ID NO: 1172958 - DNA, 13 bp, Homo sapiens
agctcacccctgg

SEQ ID NO: 1172959 - DNA, 22 bp, Homo sapiens
agctcaccctgcccgctcccaa

SEQ ID NO: 1172960 - DNA, 21 bp, Homo sapiens
agctcacgtcctgagaaagct

SEQ ID NO: 1172961 - DNA, 21 bp, Homo sapiens
agctcactgtaacctcaaact

SEQ ID NO: 1172962 - DNA, 23 bp, Homo sapiens
agctcacttctgggcttcatctg

SEQ ID NO: 1172963 - DNA, 14 bp, Homo sapiens
agctcagaacccag

SEQ ID NO: 1172964 - DNA, 14 bp, Homo sapiens
agcgcccaggcctg

SEQ ID NO: 1172965 - DNA, 17 bp, Homo sapiens
agcgcccccatctgtct

SEQ ID NO: 1172966 - DNA, 19 bp, Homo sapiens
agcgcccccatctgtcttc

SEQ ID NO: 1172967 - DNA, 20 bp, Homo sapiens
agcgcccctcactcctgcgc

SEQ ID NO: 1172968 - DNA, 22 bp, Homo sapiens
agcgccctcactattcttggac

SEQ ID NO: 1172969 - DNA, 14 bp, Homo sapiens
agcgccgactccct

SEQ ID NO: 1172970 - DNA, 22 bp, Homo sapiens
agcgcctagtggggtctccctc

SEQ ID NO: 1172971 - DNA, 18 bp, Homo sapiens
agcgcctattgtttgtaa

SEQ ID NO: 1172972 - DNA, 21 bp, Homo sapiens
agcgcctcagttacacaggaa

SEQ ID NO: 1172973 - DNA, 18 bp, Homo sapiens
agcgcctccaaccctagc

SEQ ID NO: 1172974 - DNA, 22 bp, Homo sapiens
agcgcctccaaccctagcaaaa

SEQ ID NO: 1172975 - DNA, 23 bp, Homo sapiens
agcgcctccaaccctagcaaaag

SEQ ID NO: 1172976 - DNA, 23 bp, Homo sapiens
agcgcctccatccaaggccaggt

SEQ ID NO: 1172977 - DNA, 18 bp, Homo sapiens
agcgcctccctccacccc

SEQ ID NO: 1172978 - DNA, 19 bp, Homo sapiens
agcgcctccctccacccca

SEQ ID NO: 1172979 - DNA, 22 bp, Homo sapiens
agcgcctccctccaccccagga

SEQ ID NO: 1172980 - DNA, 16 bp, Homo sapiens
agcgcctcttcctctg

SEQ ID NO: 1172981 - DNA, 22 bp, Homo sapiens
agcgcctgaccctggtgggctg

SEQ ID NO: 1172982 - DNA, 13 bp, Homo sapiens
agcgcctggcctt

SEQ ID NO: 1172983 - DNA, 22 bp, Homo sapiens
agcgctagtgccttgcccacag

SEQ ID NO: 1172984 - DNA, 18 bp, Homo sapiens
agcgctcatgttgagcca

SEQ ID NO: 1172985 - DNA, 13 bp, Homo sapiens
agcgctccagggc

SEQ ID NO: 1172986 - DNA, 17 bp, Homo sapiens
agcgctcctctgccttg

SEQ ID NO: 1172987 - DNA, 15 bp, Homo sapiens
agcgctcgccacgct

SEQ ID NO: 1172988 - DNA, 16 bp, Homo sapiens
agcgctcgccacgctc

SEQ ID NO: 1172989 - DNA, 21 bp, Homo sapiens
agcgctcgccacgctcagtgc

SEQ ID NO: 1172990 - DNA, 23 bp, Homo sapiens
agcgctcgccacgctcagtgccc

SEQ ID NO: 1172991 - DNA, 18 bp, Homo sapiens
agcgctcggcccggagca

SEQ ID NO: 1172992 - DNA, 22 bp, Homo sapiens
agcgctcggcccggagcagcag

SEQ ID NO: 1172993 - DNA, 20 bp, Homo sapiens
agcgctctcttccagaagat

SEQ ID NO: 1172994 - DNA, 18 bp, Homo sapiens
agcgctgccgcaccccag

SEQ ID NO: 1172995 - DNA, 16 bp, Homo sapiens
agcgctgtggactgtc

SEQ ID NO: 1172996 - DNA, 19 bp, Homo sapiens
agcgctgtggactgtcctg

SEQ ID NO: 1172997 - DNA, 20 bp, Homo sapiens
agcgctgtggactgtcctga

SEQ ID NO: 1172998 - DNA, 22 bp, Homo sapiens
agcggaacaaggagtcagacat

SEQ ID NO: 1172999 - DNA, 15 bp, Homo sapiens
agcggagcccagcct

SEQ ID NO: 1173000 - DNA, 17 bp, Homo sapiens
agcggagcccagcctgg

SEQ ID NO: 1173001 - DNA, 18 bp, Homo sapiens
agcggagcccagcctggg

SEQ ID NO: 1173002 - DNA, 23 bp, Homo sapiens
agcggagcccgatattctccctg

SEQ ID NO: 1173003 - DNA, 16 bp, Homo sapiens
agcggaggctgtgtgc

SEQ ID NO: 1173004 - DNA, 23 bp, Homo sapiens
agcggaggggtttgggagtcagg

SEQ ID NO: 1173005 - DNA, 22 bp, Homo sapiens
agcggaggttgcagtgagctga

SEQ ID NO: 1173006 - DNA, 16 bp, Homo sapiens
agcggcaccctggtct

SEQ ID NO: 1173007 - DNA, 17 bp, Homo sapiens
agcggcaccctggtctg

SEQ ID NO: 1173008 - DNA, 20 bp, Homo sapiens
agcggcagtgggcctgctga

SEQ ID NO: 1173009 - DNA, 12 bp, Homo sapiens
agcggcccctcc

SEQ ID NO: 1173010 - DNA, 13 bp, Homo sapiens
agcggcccctccc

SEQ ID NO: 1173011 - DNA, 23 bp, Homo sapiens
agcggccgatgggagtctccctc

SEQ ID NO: 1173012 - DNA, 11 bp, Homo sapiens
agcggccggcc

SEQ ID NO: 1173013 - DNA, 22 bp, Homo sapiens
agcggccggccagcccctggcc

SEQ ID NO: 1173014 - DNA, 21 bp, Homo sapiens
agcggcctcagggtctaagga

SEQ ID NO: 1173015 - DNA, 14 bp, Homo sapiens
agcggctacaaagc

SEQ ID NO: 1173016 - DNA, 15 bp, Homo sapiens
agcggctcaagaata

SEQ ID NO: 1173017 - DNA, 16 bp, Homo sapiens
agcggctgagtcatga

SEQ ID NO: 1173018 - DNA, 19 bp, Homo sapiens
agcggctgagtcatgatct

SEQ ID NO: 1173019 - DNA, 20 bp, Homo sapiens
agcggctgttccccctgccg

SEQ ID NO: 1173020 - DNA, 11 bp, Homo sapiens
agcgggagccc

SEQ ID NO: 1173021 - DNA, 12 bp, Homo sapiens
agcgggaggcag

SEQ ID NO: 1173022 - DNA, 14 bp, Homo sapiens
agcgggcagggccg

SEQ ID NO: 1173023 - DNA, 17 bp, Homo sapiens
agcgggcgctgctggga

SEQ ID NO: 1173024 - DNA, 21 bp, Homo sapiens
agcgggctgtgcccggcccca

SEQ ID NO: 1173025 - DNA, 21 bp, Homo sapiens
agcggggccccagggctaccc

SEQ ID NO: 1173026 - DNA, 14 bp, Homo sapiens
agcgggggcgtggc

SEQ ID NO: 1173027 - DNA, 15 bp, Homo sapiens
agcgggggcgtggct

SEQ ID NO: 1173028 - DNA, 19 bp, Homo sapiens
agcgggtgacgtgtgttct

SEQ ID NO: 1173029 - DNA, 15 bp, Homo sapiens
agcggtatctctggc

SEQ ID NO: 1173030 - DNA, 21 bp, Homo sapiens
agcggtccatgggtctggcct

SEQ ID NO: 1173031 - DNA, 22 bp, Homo sapiens
agcggtggaggaaggctctgtc

SEQ ID NO: 1173032 - DNA, 23 bp, Homo sapiens
agcggtggaggaaggctctgtca

SEQ ID NO: 1173033 - DNA, 18 bp, Homo sapiens
agcggtgggaaggaaagg

SEQ ID NO: 1173034 - DNA, 20 bp, Homo sapiens
agcggtgggggaggagggtt

SEQ ID NO: 1173035 - DNA, 16 bp, Homo sapiens
agcggttcctgtgcag

SEQ ID NO: 1173036 - DNA, 14 bp, Homo sapiens
agcggtttggggag

SEQ ID NO: 1173037 - DNA, 23 bp, Homo sapiens
agcgtagctaagtgaaaaggtca

SEQ ID NO: 1173038 - DNA, 22 bp, Homo sapiens
agcgtcactgcccaccaaaggt

SEQ ID NO: 1173039 - DNA, 15 bp, Homo sapiens
agcgtcagtttcact

SEQ ID NO: 1173040 - DNA, 22 bp, Homo sapiens
agcgtcagtttcactccctctt

SEQ ID NO: 1173041 - DNA, 13 bp, Homo sapiens
agcgtcccagtct

SEQ ID NO: 1173042 - DNA, 22 bp, Homo sapiens
agcgtcctccatcttccaggat

SEQ ID NO: 1173043 - DNA, 15 bp, Homo sapiens
agcgtcctcctctgt

SEQ ID NO: 1173044 - DNA, 13 bp, Homo sapiens
agcgtcctgagga

SEQ ID NO: 1173045 - DNA, 15 bp, Homo sapiens
agcgtcctgaggaat

SEQ ID NO: 1173046 - DNA, 16 bp, Homo sapiens
agcgtccttccccctg

SEQ ID NO: 1173047 - DNA, 20 bp, Homo sapiens
agcgtctgggaacttgcgag

SEQ ID NO: 1173048 - DNA, 12 bp, Homo sapiens
agcgtgagctta

SEQ ID NO: 1173049 - DNA, 20 bp, Homo sapiens
agcgtgagcttaaaatacaa

SEQ ID NO: 1173050 - DNA, 16 bp, Homo sapiens
agcgtggaagggggag

SEQ ID NO: 1173051 - DNA, 19 bp, Homo sapiens
agcgtggaagggggaggag

SEQ ID NO: 1173052 - DNA, 13 bp, Homo sapiens
agcgtggactggt

SEQ ID NO: 1173053 - DNA, 13 bp, Homo sapiens
agcgtggccttgg

SEQ ID NO: 1173054 - DNA, 14 bp, Homo sapiens
agcgtggccttggg

SEQ ID NO: 1173055 - DNA, 15 bp, Homo sapiens
agcgtggccttggga

SEQ ID NO: 1173056 - DNA, 13 bp, Homo sapiens
agcgtgggctctg

SEQ ID NO: 1173057 - DNA, 20 bp, Homo sapiens
agcgtgtagcgtcctgagga

SEQ ID NO: 1173058 - DNA, 12 bp, Homo sapiens
agcgtgtggagc

SEQ ID NO: 1173059 - DNA, 15 bp, Homo sapiens
agcgttcccttctcc

SEQ ID NO: 1173060 - DNA, 21 bp, Homo sapiens
agcgttcccttctcccccttg

SEQ ID NO: 1173061 - DNA, 13 bp, Homo sapiens
agcgttctggact

SEQ ID NO: 1173062 - DNA, 16 bp, Homo sapiens
agcgttctggactctg

SEQ ID NO: 1173063 - DNA, 16 bp, Homo sapiens
agcgttggatgtagca

SEQ ID NO: 1173064 - DNA, 23 bp, Homo sapiens
agcgtttagtttctagaggcctc

SEQ ID NO: 1173065 - DNA, 18 bp, Homo sapiens
agcgtttgctgtgccagg

SEQ ID NO: 1173066 - DNA, 18 bp, Homo sapiens
agcgttttgttgagcatg

SEQ ID NO: 1173067 - DNA, 14 bp, Homo sapiens
agctaaaaggaaaa

SEQ ID NO: 1173068 - DNA, 16 bp, Homo sapiens
agctaaaatgatttta

SEQ ID NO: 1173069 - DNA, 11 bp, Homo sapiens
agctaaaccaa

SEQ ID NO: 1173070 - DNA, 17 bp, Homo sapiens
agctaaaccaaggactg

SEQ ID NO: 1173071 - DNA, 18 bp, Homo sapiens
agctaaaccaaggactga

SEQ ID NO: 1173072 - DNA, 19 bp, Homo sapiens
agctaaaccaaggactgag

SEQ ID NO: 1173073 - DNA, 16 bp, Homo sapiens
agctaaagaagtttga

SEQ ID NO: 1173074 - DNA, 15 bp, Homo sapiens
agctaaagaggctga

SEQ ID NO: 1173075 - DNA, 21 bp, Homo sapiens
agctaaagtgcaagactgaat

SEQ ID NO: 1173076 - DNA, 19 bp, Homo sapiens
agctaaatgcagggaaact

SEQ ID NO: 1173077 - DNA, 18 bp, Homo sapiens
agctaaatgtaacttatt

SEQ ID NO: 1173078 - DNA, 16 bp, Homo sapiens
agctaacactggcccc

SEQ ID NO: 1173079 - DNA, 17 bp, Homo sapiens
agctaacattttaaata

SEQ ID NO: 1173080 - DNA, 17 bp, Homo sapiens
agctaactccgagagca

SEQ ID NO: 1173081 - DNA, 19 bp, Homo sapiens
agctaagccttatgtgagc

SEQ ID NO: 1173082 - DNA, 23 bp, Homo sapiens
agctaagctcacgtcctgagaaa

SEQ ID NO: 1173083 - DNA, 22 bp, Homo sapiens
agctaagggtgggtgctcagaa

SEQ ID NO: 1173084 - DNA, 21 bp, Homo sapiens
agctaataaaaagcttttgtc

SEQ ID NO: 1173085 - DNA, 19 bp, Homo sapiens
agctaataaatctcttctt

SEQ ID NO: 1173086 - DNA, 18 bp, Homo sapiens
agctaataacatgtgaaa

SEQ ID NO: 1173087 - DNA, 16 bp, Homo sapiens
agctaataattcttca

SEQ ID NO: 1173088 - DNA, 17 bp, Homo sapiens
atatttatattgtatat

SEQ ID NO: 1173089 - DNA, 15 bp, Homo sapiens
atatttatatttcac

SEQ ID NO: 1173090 - DNA, 12 bp, Homo sapiens
atatttatccaa

SEQ ID NO: 1173091 - DNA, 15 bp, Homo sapiens
atatttatccaaaat

SEQ ID NO: 1173092 - DNA, 19 bp, Homo sapiens
atatttatgcttaaaatat

SEQ ID NO: 1173093 - DNA, 19 bp, Homo sapiens
atatttatgtctatttaag

SEQ ID NO: 1173094 - DNA, 18 bp, Homo sapiens
atatttattcataatgaa

SEQ ID NO: 1173095 - DNA, 13 bp, Homo sapiens
atatttattgatt

SEQ ID NO: 1173096 - DNA, 21 bp, Homo sapiens
atatttattgcattgctggta

SEQ ID NO: 1173097 - DNA, 11 bp, Homo sapiens
atatttattgt

SEQ ID NO: 1173098 - DNA, 14 bp, Homo sapiens
atatttatttcctg

SEQ ID NO: 1173099 - DNA, 15 bp, Homo sapiens
atatttatttcctgc

SEQ ID NO: 1173100 - DNA, 15 bp, Homo sapiens
atatttcacttttgt

SEQ ID NO: 1173101 - DNA, 18 bp, Homo sapiens
atatttcacttttgttct

SEQ ID NO: 1173102 - DNA, 19 bp, Homo sapiens
atatttcacttttgttctg

SEQ ID NO: 1173103 - DNA, 21 bp, Homo sapiens
atatttcacttttgttctgct

SEQ ID NO: 1173104 - DNA, 17 bp, Homo sapiens
atatttcagatatcaaa

SEQ ID NO: 1173105 - DNA, 15 bp, Homo sapiens
atcaaagtaaaaaat

SEQ ID NO: 1173106 - DNA, 18 bp, Homo sapiens
atcaaagtaggcaggacc

SEQ ID NO: 1173107 - DNA, 15 bp, Homo sapiens
atcaaagtgatttta

SEQ ID NO: 1173108 - DNA, 16 bp, Homo sapiens
atcaaagtggtaaata

SEQ ID NO: 1173109 - DNA, 18 bp, Homo sapiens
atcaaagtggtaaatact

SEQ ID NO: 1173110 - DNA, 19 bp, Homo sapiens
atcaaagtggtaaatactg

SEQ ID NO: 1173111 - DNA, 17 bp, Homo sapiens
atcaaataaatttctgg

SEQ ID NO: 1173112 - DNA, 14 bp, Homo sapiens
atcaaataataaag

SEQ ID NO: 1173113 - DNA, 15 bp, Homo sapiens
atcaaataataaagt

SEQ ID NO: 1173114 - DNA, 20 bp, Homo sapiens
atcaaatactttaaaggaaa

SEQ ID NO: 1173115 - DNA, 21 bp, Homo sapiens
atcaaatactttaaaggaaaa

SEQ ID NO: 1173116 - DNA, 18 bp, Homo sapiens
atcaaatctcctgctgat

SEQ ID NO: 1173117 - DNA, 22 bp, Homo sapiens
atcaaatctgtatatgttgtaa

SEQ ID NO: 1173118 - DNA, 17 bp, Homo sapiens
atcaaatcttacaaaat

SEQ ID NO: 1173119 - DNA, 19 bp, Homo sapiens
atcaaatgcagtatatttc

SEQ ID NO: 1173120 - DNA, 21 bp, Homo sapiens
atcaaatgccttcatgaatct

SEQ ID NO: 1173121 - DNA, 23 bp, Homo sapiens
atcaaatgccttcatgaatcttt

SEQ ID NO: 1173122 - DNA, 23 bp, Homo sapiens
atcaaatttgccatgacatttca

SEQ ID NO: 1173123 - DNA, 16 bp, Homo sapiens
atcaacaagatttcca

SEQ ID NO: 1173124 - DNA, 22 bp, Homo sapiens
atcaacaataaaatttttttaa

SEQ ID NO: 1173125 - DNA, 13 bp, Homo sapiens
atcaacagaagca

SEQ ID NO: 1173126 - DNA, 20 bp, Homo sapiens
atcaacattaggagtaactt

SEQ ID NO: 1173127 - DNA, 14 bp, Homo sapiens
atcaacatttatga

SEQ ID NO: 1173128 - DNA, 19 bp, Homo sapiens
atcaacatttatgacctaa

SEQ ID NO: 1173129 - DNA, 14 bp, Homo sapiens
atcaaccaggaaga

SEQ ID NO: 1173130 - DNA, 16 bp, Homo sapiens
atcaaccctctcctgt

SEQ ID NO: 1173131 - DNA, 21 bp, Homo sapiens
atcaactctgaagctaattgt

SEQ ID NO: 1173132 - DNA, 21 bp, Homo sapiens
atcaacttaccaggcaccaaa

SEQ ID NO: 1173133 - DNA, 17 bp, Homo sapiens
atcaacttcgctagaaa

SEQ ID NO: 1173134 - DNA, 15 bp, Homo sapiens
atcaactttactgta

SEQ ID NO: 1173135 - DNA, 19 bp, Homo sapiens
atcaactttactgtaatat

SEQ ID NO: 1173136 - DNA, 13 bp, Homo sapiens
atcaagaagggct

SEQ ID NO: 1173137 - DNA, 16 bp, Homo sapiens
atcaagaagggctgca

SEQ ID NO: 1173138 - DNA, 19 bp, Homo sapiens
atcaagaagggctgcatga

SEQ ID NO: 1173139 - DNA, 22 bp, Homo sapiens
atcaagaagggctgcatgatgt

SEQ ID NO: 1173140 - DNA, 13 bp, Homo sapiens
atcaagagaaact

SEQ ID NO: 1173141 - DNA, 14 bp, Homo sapiens
atcaagagaaactt

SEQ ID NO: 1173142 - DNA, 13 bp, Homo sapiens
atcaagagaatca

SEQ ID NO: 1173143 - DNA, 14 bp, Homo sapiens
atcaagagaatcaa

SEQ ID NO: 1173144 - DNA, 22 bp, Homo sapiens
atcaagaggcaggttagaagaa

SEQ ID NO: 1173145 - DNA, 13 bp, Homo sapiens
atcaagatacctt

SEQ ID NO: 1173146 - DNA, 14 bp, Homo sapiens
atcaagatatatgt

SEQ ID NO: 1173147 - DNA, 16 bp, Homo sapiens
atcaagatatatgtgt

SEQ ID NO: 1173148 - DNA, 20 bp, Homo sapiens
atcaagcatgcaataatgtg

SEQ ID NO: 1173149 - DNA, 19 bp, Homo sapiens
atcaagcctttatggctgc

SEQ ID NO: 1173150 - DNA, 12 bp, Homo sapiens
atcaagctgtga

SEQ ID NO: 1173151 - DNA, 12 bp, Homo sapiens
atcaagcttgtg

SEQ ID NO: 1173152 - DNA, 15 bp, Homo sapiens
atcaagcttgtgtac

SEQ ID NO: 1173153 - DNA, 16 bp, Homo sapiens
atcaaggaaaggctca

SEQ ID NO: 1173154 - DNA, 21 bp, Homo sapiens
atcaaggaaaggctcatttaa

SEQ ID NO: 1173155 - DNA, 18 bp, Homo sapiens
atcaaggattttcatgtt

SEQ ID NO: 1173156 - DNA, 23 bp, Homo sapiens
atcaaggattttcatgttgatga

SEQ ID NO: 1173157 - DNA, 18 bp, Homo sapiens
atcaaggcaaaaggaatt

SEQ ID NO: 1173158 - DNA, 16 bp, Homo sapiens
atcaagggaagaacta

SEQ ID NO: 1173159 - DNA, 15 bp, Homo sapiens
atcaagtatagaaaa

SEQ ID NO: 1173160 - DNA, 16 bp, Homo sapiens
atcaagtatagaaaat

SEQ ID NO: 1173161 - DNA, 22 bp, Homo sapiens
atcaagtccatgttattctctc

SEQ ID NO: 1173162 - DNA, 13 bp, Homo sapiens
atcaagtgtcttc

SEQ ID NO: 1173163 - DNA, 15 bp, Homo sapiens
atcaagtgtgcttta

SEQ ID NO: 1173164 - DNA, 16 bp, Homo sapiens
atcaagttcttaaaat

SEQ ID NO: 1173165 - DNA, 22 bp, Homo sapiens
atcaagttgtaacttatattga

SEQ ID NO: 1173166 - DNA, 23 bp, Homo sapiens
atcaagttgtaacttatattgaa

SEQ ID NO: 1173167 - DNA, 16 bp, Homo sapiens
atcaagttgttgactg

SEQ ID NO: 1173168 - DNA, 20 bp, Homo sapiens
atcaagttgttgactgtgat

SEQ ID NO: 1173169 - DNA, 19 bp, Homo sapiens
atcaagtttgaccagtgca

SEQ ID NO: 1173170 - DNA, 13 bp, Homo sapiens
atcaagttttaag

SEQ ID NO: 1173171 - DNA, 17 bp, Homo sapiens
atcaagttttaagtgaa

SEQ ID NO: 1173172 - DNA, 17 bp, Homo sapiens
atcaataaaatgtgatt

SEQ ID NO: 1173173 - DNA, 19 bp, Homo sapiens
atcaatacactagttgttt

SEQ ID NO: 1173174 - DNA, 11 bp, Homo sapiens
atcaatacaga

SEQ ID NO: 1173175 - DNA, 17 bp, Homo sapiens
atcaatacagacaaggt

SEQ ID NO: 1173176 - DNA, 17 bp, Homo sapiens
atcaatacagcttcatt

SEQ ID NO: 1173177 - DNA, 19 bp, Homo sapiens
atcaatatcccaacattct

SEQ ID NO: 1173178 - DNA, 20 bp, Homo sapiens
atcaatatcccaacattctg

SEQ ID NO: 1173179 - DNA, 23 bp, Homo sapiens
atcaatatcccaacattctgcaa

SEQ ID NO: 1173180 - DNA, 15 bp, Homo sapiens
atcaatatgcagaat

SEQ ID NO: 1173181 - DNA, 15 bp, Homo sapiens
atcaatcaaataagt

SEQ ID NO: 1173182 - DNA, 19 bp, Homo sapiens
atcaatcaaataagtattt

SEQ ID NO: 1173183 - DNA, 20 bp, Homo sapiens
atcaatcatgtcagtctgct

SEQ ID NO: 1173184 - DNA, 22 bp, Homo sapiens
atcaatcctgggcaatcagaca

SEQ ID NO: 1173185 - DNA, 14 bp, Homo sapiens
atcaatgagtaaca

SEQ ID NO: 1173186 - DNA, 18 bp, Homo sapiens
atcaatggtgcaaaaaaa

SEQ ID NO: 1173187 - DNA, 22 bp, Homo sapiens
atcaatggtgcaaaaaaaaact

SEQ ID NO: 1173188 - DNA, 23 bp, Homo sapiens
atcaatggtgcaaaaaaaaactt

SEQ ID NO: 1173189 - DNA, 14 bp, Homo sapiens
atcaattaaatgta

SEQ ID NO: 1173190 - DNA, 20 bp, Homo sapiens
atcaattaactgagtagctc

SEQ ID NO: 1173191 - DNA, 16 bp, Homo sapiens
atcaattattacattt

SEQ ID NO: 1173192 - DNA, 17 bp, Homo sapiens
atcaatttaagtgttgg

SEQ ID NO: 1173193 - DNA, 20 bp, Homo sapiens
atcaatttgtaattgcttac

SEQ ID NO: 1173194 - DNA, 12 bp, Homo sapiens
atcaattttcat

SEQ ID NO: 1173195 - DNA, 20 bp, Homo sapiens
atcaattttcattaaacttg

SEQ ID NO: 1173196 - DNA, 23 bp, Homo sapiens
atcaattttcattaaacttgaag

SEQ ID NO: 1173197 - DNA, 14 bp, Homo sapiens
atcaatttttccca

SEQ ID NO: 1173198 - DNA, 20 bp, Homo sapiens
atcaatttttcccagtattt

SEQ ID NO: 1173199 - DNA, 24 bp, Homo sapiens
atcacaaagtggaacgaaaatgaa

SEQ ID NO: 1173200 - DNA, 20 bp, Homo sapiens
atcacaagaatcacctcaaa

SEQ ID NO: 1173201 - DNA, 19 bp, Homo sapiens
atcacacactttctcttca

SEQ ID NO: 1173202 - DNA, 23 bp, Homo sapiens
atcacacatcaagactatctaca

SEQ ID NO: 1173203 - DNA, 21 bp, Homo sapiens
atcacacatccagctgcccct

SEQ ID NO: 1173204 - DNA, 16 bp, Homo sapiens
atcacacatgttcaga

SEQ ID NO: 1173205 - DNA, 17 bp, Homo sapiens
atcacaccactgtactc

SEQ ID NO: 1173206 - DNA, 15 bp, Homo sapiens
atcacacctcagtgg

SEQ ID NO: 1173207 - DNA, 17 bp, Homo sapiens
atcacacctcagtggga

SEQ ID NO: 1173208 - DNA, 19 bp, Homo sapiens
atcacacctcagtgggaag

SEQ ID NO: 1173209 - DNA, 14 bp, Homo sapiens
atcacacctgccct

SEQ ID NO: 1173210 - DNA, 23 bp, Homo sapiens
atcacactcaaggacaggagcct

SEQ ID NO: 1173211 - DNA, 15 bp, Homo sapiens
atcacacttatattt

SEQ ID NO: 1173212 - DNA, 16 bp, Homo sapiens
atcacacttctgtgag

SEQ ID NO: 1173213 - DNA, 22 bp, Homo sapiens
atcacagatgggtattaaactt

SEQ ID NO: 1173214 - DNA, 19 bp, Homo sapiens
atcacagcctccagggccc

SEQ ID NO: 1173215 - DNA, 18 bp, Homo sapiens
attgaaagagaaccagtt

SEQ ID NO: 1173216 - DNA, 20 bp, Homo sapiens
attgaaaggggacacctgta

SEQ ID NO: 1173217 - DNA, 23 bp, Homo sapiens
attgaaagtattcagaaattaaa

SEQ ID NO: 1173218 - DNA, 14 bp, Homo sapiens
attgaaatcagcat

SEQ ID NO: 1173219 - DNA, 21 bp, Homo sapiens
attgaaatcagcatgacaaaa

SEQ ID NO: 1173220 - DNA, 21 bp, Homo sapiens
attgaaatgtataattaactt

SEQ ID NO: 1173221 - DNA, 12 bp, Homo sapiens
attgaaattcta

SEQ ID NO: 1173222 - DNA, 13 bp, Homo sapiens
attgaaattctga

SEQ ID NO: 1173223 - DNA, 17 bp, Homo sapiens
attgaaattctgagaaa

SEQ ID NO: 1173224 - DNA, 22 bp, Homo sapiens
attgaacaagttgtttcattga

SEQ ID NO: 1173225 - DNA, 16 bp, Homo sapiens
attgaacacaaactgt

SEQ ID NO: 1173226 - DNA, 18 bp, Homo sapiens
attgaacacaaactgtaa

SEQ ID NO: 1173227 - DNA, 19 bp, Homo sapiens
attgaacacaaactgtaaa

SEQ ID NO: 1173228 - DNA, 14 bp, Homo sapiens
attgaacagctgtg

SEQ ID NO: 1173229 - DNA, 16 bp, Homo sapiens
attgaacagctgtgag

SEQ ID NO: 1173230 - DNA, 15 bp, Homo sapiens
attgaaccagctcat

SEQ ID NO: 1173231 - DNA, 18 bp, Homo sapiens
attgaaccagctcatctc

SEQ ID NO: 1173232 - DNA, 23 bp, Homo sapiens
attgaaccagctcatctccaagg

SEQ ID NO: 1173233 - DNA, 14 bp, Homo sapiens
attgaacccaggag

SEQ ID NO: 1173234 - DNA, 18 bp, Homo sapiens
attgaacgactgtatatt

SEQ ID NO: 1173235 - DNA, 15 bp, Homo sapiens
attgaactgtaaact

SEQ ID NO: 1173236 - DNA, 21 bp, Homo sapiens
attgaagaagaaccagcccag

SEQ ID NO: 1173237 - DNA, 12 bp, Homo sapiens
attgaagaatct

SEQ ID NO: 1173238 - DNA, 13 bp, Homo sapiens
attgaagaatctg

SEQ ID NO: 1173239 - DNA, 19 bp, Homo sapiens
attgaagaatctgcccctg

SEQ ID NO: 1173240 - DNA, 20 bp, Homo sapiens
attgaagacaatttgataca

SEQ ID NO: 1173241 - DNA, 20 bp, Homo sapiens
attgaaggaatttgggagga

SEQ ID NO: 1173242 - DNA, 18 bp, Homo sapiens
attgaaggatcatctgaa

SEQ ID NO: 1173243 - DNA, 15 bp, Homo sapiens
attgaaggcttaaac

SEQ ID NO: 1173244 - DNA, 19 bp, Homo sapiens
attgaaggcttaaacccat

SEQ ID NO: 1173245 - DNA, 22 bp, Homo sapiens
attgaaggtgataagggaaaag

SEQ ID NO: 1173246 - DNA, 14 bp, Homo sapiens
attgaagtaatgaa

SEQ ID NO: 1173247 - DNA, 15 bp, Homo sapiens
attgaagtaatgaat

SEQ ID NO: 1173248 - DNA, 13 bp, Homo sapiens
attgaagtatatt

SEQ ID NO: 1173249 - DNA, 16 bp, Homo sapiens
attgaagtatattctt

SEQ ID NO: 1173250 - DNA, 14 bp, Homo sapiens
attgaagtcctcca

SEQ ID NO: 1173251 - DNA, 15 bp, Homo sapiens
attgaagtgtcttct

SEQ ID NO: 1173252 - DNA, 16 bp, Homo sapiens
attgaagtgtcttctg

SEQ ID NO: 1173253 - DNA, 15 bp, Homo sapiens
attgaagtttcaagt

SEQ ID NO: 1173254 - DNA, 22 bp, Homo sapiens
attgaataaaaaatagacatgt

SEQ ID NO: 1173255 - DNA, 13 bp, Homo sapiens
attgaataaagag

SEQ ID NO: 1173256 - DNA, 23 bp, Homo sapiens
attgaatataatatatttgtgta

SEQ ID NO: 1173257 - DNA, 14 bp, Homo sapiens
attgaatatatcag

SEQ ID NO: 1173258 - DNA, 21 bp, Homo sapiens
attgaatatatcagaatctgt

SEQ ID NO: 1173259 - DNA, 18 bp, Homo sapiens
attgaatctatttaagta

SEQ ID NO: 1173260 - DNA, 15 bp, Homo sapiens
attgaatgcgcttta

SEQ ID NO: 1173261 - DNA, 23 bp, Homo sapiens
attgaatggctatgtttttaatg

SEQ ID NO: 1173262 - DNA, 15 bp, Homo sapiens
attgaattagaaaat

SEQ ID NO: 1173263 - DNA, 16 bp, Homo sapiens
attgacaataaaatat

SEQ ID NO: 1173264 - DNA, 14 bp, Homo sapiens
attgacacagaaaa

SEQ ID NO: 1173265 - DNA, 12 bp, Homo sapiens
attgacactgaa

SEQ ID NO: 1173266 - DNA, 15 bp, Homo sapiens
attgacattgaaatc

SEQ ID NO: 1173267 - DNA, 18 bp, Homo sapiens
attgacattgaaatctag

SEQ ID NO: 1173268 - DNA, 13 bp, Homo sapiens
attgacatttgta

SEQ ID NO: 1173269 - DNA, 15 bp, Homo sapiens
attgaccaagaactg

SEQ ID NO: 1173270 - DNA, 17 bp, Homo sapiens
attgaccaagaactgca

SEQ ID NO: 1173271 - DNA, 19 bp, Homo sapiens
attgacctcagctgcacat

SEQ ID NO: 1173272 - DNA, 23 bp, Homo sapiens
attgacctcagctgcacattcct

SEQ ID NO: 1173273 - DNA, 19 bp, Homo sapiens
attgacctgaggagacatc

SEQ ID NO: 1173274 - DNA, 17 bp, Homo sapiens
attgacctgctccgctg

SEQ ID NO: 1173275 - DNA, 22 bp, Homo sapiens
attgacgacaagtgctgaacag

SEQ ID NO: 1173276 - DNA, 23 bp, Homo sapiens
attgacgtctagctatgctgtat

SEQ ID NO: 1173277 - DNA, 19 bp, Homo sapiens
attgactaaataaaaagta

SEQ ID NO: 1173278 - DNA, 21 bp, Homo sapiens
attgactatcaaactgaagcc

SEQ ID NO: 1173279 - DNA, 22 bp, Homo sapiens
attgactcctttccaatagaaa

SEQ ID NO: 1173280 - DNA, 23 bp, Homo sapiens
attgactcctttccaatagaaag

SEQ ID NO: 1173281 - DNA, 20 bp, Homo sapiens
attgactgggcaacactgca

SEQ ID NO: 1173282 - DNA, 22 bp, Homo sapiens
attgactggtttacaggccctg

SEQ ID NO: 1173283 - DNA, 15 bp, Homo sapiens
attgacttagatatt

SEQ ID NO: 1173284 - DNA, 18 bp, Homo sapiens
attgacttcaatgatagt

SEQ ID NO: 1173285 - DNA, 16 bp, Homo sapiens
attgacttcgactgtg

SEQ ID NO: 1173286 - DNA, 22 bp, Homo sapiens
attgacttcttggtttggggag

SEQ ID NO: 1173287 - DNA, 21 bp, Homo sapiens
attgactttagaaagctgaca

SEQ ID NO: 1173288 - DNA, 20 bp, Homo sapiens
attgagaaaaatatatacta

SEQ ID NO: 1173289 - DNA, 12 bp, Homo sapiens
attgagaaagag

SEQ ID NO: 1173290 - DNA, 21 bp, Homo sapiens
attgagaaagagcacttaaga

SEQ ID NO: 1173291 - DNA, 22 bp, Homo sapiens
attgagaaagagcacttaagag

SEQ ID NO: 1173292 - DNA, 13 bp, Homo sapiens
attgagaaatgtg

SEQ ID NO: 1173293 - DNA, 21 bp, Homo sapiens
attgagaactgacaaaggagc

SEQ ID NO: 1173294 - DNA, 14 bp, Homo sapiens
attgagaactgcat

SEQ ID NO: 1173295 - DNA, 17 bp, Homo sapiens
attgagaattttaaatt

SEQ ID NO: 1173296 - DNA, 16 bp, Homo sapiens
attgagagttttgtct

SEQ ID NO: 1173297 - DNA, 20 bp, Homo sapiens
attgagagttttgtcttgaa

SEQ ID NO: 1173298 - DNA, 12 bp, Homo sapiens
attgagatttct

SEQ ID NO: 1173299 - DNA, 21 bp, Homo sapiens
cattaattttgtgcattcttt

SEQ ID NO: 1173300 - DNA, 13 bp, Homo sapiens
cattacagagagg

SEQ ID NO: 1173301 - DNA, 20 bp, Homo sapiens
cattacagagaggagaaaca

SEQ ID NO: 1173302 - DNA, 22 bp, Homo sapiens
cattacagagaggagaaacaca

SEQ ID NO: 1173303 - DNA, 15 bp, Homo sapiens
cattacatggctgtg

SEQ ID NO: 1173304 - DNA, 20 bp, Homo sapiens
cattacatgtttaaattgta

SEQ ID NO: 1173305 - DNA, 22 bp, Homo sapiens
cattacatgtttaaattgtaaa

SEQ ID NO: 1173306 - DNA, 23 bp, Homo sapiens
cattacatgtttaaattgtaaat

SEQ ID NO: 1173307 - DNA, 12 bp, Homo sapiens
cattacctgtac

SEQ ID NO: 1173308 - DNA, 13 bp, Homo sapiens
cattacgtgagcc

SEQ ID NO: 1173309 - DNA, 12 bp, Homo sapiens
cattactactgt

SEQ ID NO: 1173310 - DNA, 14 bp, Homo sapiens
cattactgagggga

SEQ ID NO: 1173311 - DNA, 21 bp, Homo sapiens
cattactgaggggattctcta

SEQ ID NO: 1173312 - DNA, 15 bp, Homo sapiens
cattactgtcccctt

SEQ ID NO: 1173313 - DNA, 16 bp, Homo sapiens
cattactgttccagat

SEQ ID NO: 1173314 - DNA, 20 bp, Homo sapiens
cattactgttccagattcct

SEQ ID NO: 1173315 - DNA, 18 bp, Homo sapiens
cattacttgggaaatttt

SEQ ID NO: 1173316 - DNA, 18 bp, Homo sapiens
cattagaaattagctgtg

SEQ ID NO: 1173317 - DNA, 14 bp, Homo sapiens
cattagaatgtgat

SEQ ID NO: 1173318 - DNA, 15 bp, Homo sapiens
cattagaatgtgatt

SEQ ID NO: 1173319 - DNA, 14 bp, Homo sapiens
cattagaattattt

SEQ ID NO: 1173320 - DNA, 16 bp, Homo sapiens
cattagactggaactt

SEQ ID NO: 1173321 - DNA, 20 bp, Homo sapiens
cattagactggaacttgaac

SEQ ID NO: 1173322 - DNA, 23 bp, Homo sapiens
cattagagaaatgaattataact

SEQ ID NO: 1173323 - DNA, 18 bp, Homo sapiens
cattagagcacagcttct

SEQ ID NO: 1173324 - DNA, 19 bp, Homo sapiens
cattagagcacagcttctt

SEQ ID NO: 1173325 - DNA, 23 bp, Homo sapiens
cattagcagttgctcacatgtct

SEQ ID NO: 1173326 - DNA, 18 bp, Homo sapiens
cattagcagtttgctttg

SEQ ID NO: 1173327 - DNA, 18 bp, Homo sapiens
cattagccagatttgtct

SEQ ID NO: 1173328 - DNA, 12 bp, Homo sapiens
cattaggaattg

SEQ ID NO: 1173329 - DNA, 19 bp, Homo sapiens
cattaggacaatcagtccc

SEQ ID NO: 1173330 - DNA, 14 bp, Homo sapiens
cattaggcaaagta

SEQ ID NO: 1173331 - DNA, 18 bp, Homo sapiens
cattaggcaaagtacaaa

SEQ ID NO: 1173332 - DNA, 19 bp, Homo sapiens
cattaggctgttggttcaa

SEQ ID NO: 1173333 - DNA, 18 bp, Homo sapiens
cattaggggattcttctt

SEQ ID NO: 1173334 - DNA, 22 bp, Homo sapiens
cattaggtccctcactccacag

SEQ ID NO: 1173335 - DNA, 16 bp, Homo sapiens
cattagtgaaaattct

SEQ ID NO: 1173336 - DNA, 19 bp, Homo sapiens
cattagtgtccccccttga

SEQ ID NO: 1173337 - DNA, 22 bp, Homo sapiens
cattagttactttattgaaggt

SEQ ID NO: 1173338 - DNA, 13 bp, Homo sapiens
cattagttttaga

SEQ ID NO: 1173339 - DNA, 16 bp, Homo sapiens
cattagttttagaggc

SEQ ID NO: 1173340 - DNA, 13 bp, Homo sapiens
cattataaaaaca

SEQ ID NO: 1173341 - DNA, 19 bp, Homo sapiens
cattataaaaacacttata

SEQ ID NO: 1173342 - DNA, 14 bp, Homo sapiens
cattataatctcaa

SEQ ID NO: 1173343 - DNA, 14 bp, Homo sapiens
cattataatttata

SEQ ID NO: 1173344 - DNA, 15 bp, Homo sapiens
cattatattctctta

SEQ ID NO: 1173345 - DNA, 17 bp, Homo sapiens
cattatatttgcattat

SEQ ID NO: 1173346 - DNA, 16 bp, Homo sapiens
cattatcgggagcagt

SEQ ID NO: 1173347 - DNA, 12 bp, Homo sapiens
cattatctagat

SEQ ID NO: 1173348 - DNA, 16 bp, Homo sapiens
cattatctagatactg

SEQ ID NO: 1173349 - DNA, 17 bp, Homo sapiens
cattatctagatactgt

SEQ ID NO: 1173350 - DNA, 16 bp, Homo sapiens
cattatctatgcagca

SEQ ID NO: 1173351 - DNA, 15 bp, Homo sapiens
cattatcttcatatg

SEQ ID NO: 1173352 - DNA, 16 bp, Homo sapiens
cattatgaaaaacatc

SEQ ID NO: 1173353 - DNA, 23 bp, Homo sapiens
cattatgatttcattatcacatg

SEQ ID NO: 1173354 - DNA, 18 bp, Homo sapiens
cattatgcaaatggagat

SEQ ID NO: 1173355 - DNA, 21 bp, Homo sapiens
cattatgcaaatggagataaa

SEQ ID NO: 1173356 - DNA, 16 bp, Homo sapiens
cattatgccacttcct

SEQ ID NO: 1173357 - DNA, 12 bp, Homo sapiens
cattatgctttg

SEQ ID NO: 1173358 - DNA, 15 bp, Homo sapiens
cattatgctttgaac

SEQ ID NO: 1173359 - DNA, 17 bp, Homo sapiens
cattatgctttgaactt

SEQ ID NO: 1173360 - DNA, 21 bp, Homo sapiens
cattatgggttaggcattaat

SEQ ID NO: 1173361 - DNA, 17 bp, Homo sapiens
cattatgtccactgtgt

SEQ ID NO: 1173362 - DNA, 22 bp, Homo sapiens
cattatgtccactgtgtataga

SEQ ID NO: 1173363 - DNA, 16 bp, Homo sapiens
cattatgttagagagg

SEQ ID NO: 1173364 - DNA, 17 bp, Homo sapiens
cattattaaattgtaaa

SEQ ID NO: 1173365 - DNA, 23 bp, Homo sapiens
cattattacttttcctcttagaa

SEQ ID NO: 1173366 - DNA, 18 bp, Homo sapiens
agtgcttcagcctgaggc

SEQ ID NO: 1173367 - DNA, 18 bp, Homo sapiens
agtgcttctccaacactg

SEQ ID NO: 1173368 - DNA, 17 bp, Homo sapiens
agtgcttgcatcctatt

SEQ ID NO: 1173369 - DNA, 20 bp, Homo sapiens
agtgcttgcatcctatttgg

SEQ ID NO: 1173370 - DNA, 21 bp, Homo sapiens
agtgcttgcatcctatttggt

SEQ ID NO: 1173371 - DNA, 23 bp, Homo sapiens
agtgcttgcatcctatttggtgt

SEQ ID NO: 1173372 - DNA, 13 bp, Homo sapiens
agtgcttggaaca

SEQ ID NO: 1173373 - DNA, 19 bp, Homo sapiens
agtgcttgtcccctaagag

SEQ ID NO: 1173374 - DNA, 19 bp, Homo sapiens
agtgctttacatgctgtgc

SEQ ID NO: 1173375 - DNA, 23 bp, Homo sapiens
agtgctttacatgctgtgctctt

SEQ ID NO: 1173376 - DNA, 13 bp, Homo sapiens
agtgctttgtaat

SEQ ID NO: 1173377 - DNA, 13 bp, Homo sapiens
agtgctttgtgat

SEQ ID NO: 1173378 - DNA, 23 bp, Homo sapiens
agtgcttttaagtgaaaatggtc

SEQ ID NO: 1173379 - DNA, 15 bp, Homo sapiens
agtgctttttccttt

SEQ ID NO: 1173380 - DNA, 20 bp, Homo sapiens
agtgcttttttttttttgac

SEQ ID NO: 1173381 - DNA, 11 bp, Homo sapiens
agtggaaaaat

SEQ ID NO: 1173382 - DNA, 20 bp, Homo sapiens
agtggaaactatgtgttttt

SEQ ID NO: 1173383 - DNA, 16 bp, Homo sapiens
agtggaacagcgggag

SEQ ID NO: 1173384 - DNA, 16 bp, Homo sapiens
agtggaacgaaaatga

SEQ ID NO: 1173385 - DNA, 24 bp, Homo sapiens
agtggaacgaaaatgaaagctact

SEQ ID NO: 1173386 - DNA, 13 bp, Homo sapiens
agtggaagaaaca

SEQ ID NO: 1173387 - DNA, 14 bp, Homo sapiens
agtggaagagcagc

SEQ ID NO: 1173388 - DNA, 15 bp, Homo sapiens
agtggaagagcagcc

SEQ ID NO: 1173389 - DNA, 20 bp, Homo sapiens
agtggaagagcagcctgatg

SEQ ID NO: 1173390 - DNA, 23 bp, Homo sapiens
agtggaagagcagcctgatggcc

SEQ ID NO: 1173391 - DNA, 13 bp, Homo sapiens
agtggaagggagg

SEQ ID NO: 1173392 - DNA, 17 bp, Homo sapiens
agtggaaggtctattgg

SEQ ID NO: 1173393 - DNA, 16 bp, Homo sapiens
agtggaagttcttcaa

SEQ ID NO: 1173394 - DNA, 17 bp, Homo sapiens
agtggaagttcttcaag

SEQ ID NO: 1173395 - DNA, 22 bp, Homo sapiens
agtggaagttcttcaagaggaa

SEQ ID NO: 1173396 - DNA, 16 bp, Homo sapiens
agtggaatgcagggaa

SEQ ID NO: 1173397 - DNA, 17 bp, Homo sapiens
agtggaatgcagggaag

SEQ ID NO: 1173398 - DNA, 22 bp, Homo sapiens
agtggaattccaacttgaagga

SEQ ID NO: 1173399 - DNA, 23 bp, Homo sapiens
agtggaattccaacttgaaggat

SEQ ID NO: 1173400 - DNA, 20 bp, Homo sapiens
agtggacaccaggagtccct

SEQ ID NO: 1173401 - DNA, 13 bp, Homo sapiens
agtggacaggagt

SEQ ID NO: 1173402 - DNA, 17 bp, Homo sapiens
agtggacatggtcacag

SEQ ID NO: 1173403 - DNA, 13 bp, Homo sapiens
agtggaccaggac

SEQ ID NO: 1173404 - DNA, 16 bp, Homo sapiens
agtggaccaggacagg

SEQ ID NO: 1173405 - DNA, 16 bp, Homo sapiens
agtggacctagcctgg

SEQ ID NO: 1173406 - DNA, 18 bp, Homo sapiens
agtggacctagcctggat

SEQ ID NO: 1173407 - DNA, 17 bp, Homo sapiens
agtggaccttaggcctt

SEQ ID NO: 1173408 - DNA, 20 bp, Homo sapiens
agtggaccttaggccttcct

SEQ ID NO: 1173409 - DNA, 13 bp, Homo sapiens
agtggactcaggg

SEQ ID NO: 1173410 - DNA, 15 bp, Homo sapiens
agtggactgcattta

SEQ ID NO: 1173411 - DNA, 22 bp, Homo sapiens
agtggactggcctcaaagcaag

SEQ ID NO: 1173412 - DNA, 22 bp, Homo sapiens
agtggactttccaccccctccc

SEQ ID NO: 1173413 - DNA, 12 bp, Homo sapiens
agtggagacagt

SEQ ID NO: 1173414 - DNA, 21 bp, Homo sapiens
agtggagacagtcctttccca

SEQ ID NO: 1173415 - DNA, 15 bp, Homo sapiens
agtggagctgggagg

SEQ ID NO: 1173416 - DNA, 16 bp, Homo sapiens
agtggagctggtctgc

SEQ ID NO: 1173417 - DNA, 17 bp, Homo sapiens
agtggagctggtctgcc

SEQ ID NO: 1173418 - DNA, 15 bp, Homo sapiens
agtggaggaagccca

SEQ ID NO: 1173419 - DNA, 13 bp, Homo sapiens
agtggaggaggag

SEQ ID NO: 1173420 - DNA, 22 bp, Homo sapiens
agtggaggaggaggaggagcct

SEQ ID NO: 1173421 - DNA, 11 bp, Homo sapiens
cattcattttt

SEQ ID NO: 1173422 - DNA, 17 bp, Homo sapiens
cattcatttttgttgtt

SEQ ID NO: 1173423 - DNA, 17 bp, Homo sapiens
cattccaaagctttatt

SEQ ID NO: 1173424 - DNA, 23 bp, Homo sapiens
cattccaacagctcaagtcttcc

SEQ ID NO: 1173425 - DNA, 23 bp, Homo sapiens
cattccaagggtatgggaagcca

SEQ ID NO: 1173426 - DNA, 20 bp, Homo sapiens
cattccaagtcaacactctt

SEQ ID NO: 1173427 - DNA, 17 bp, Homo sapiens
cattccaattctaaatc

SEQ ID NO: 1173428 - DNA, 12 bp, Homo sapiens
cattccagccag

SEQ ID NO: 1173429 - DNA, 13 bp, Homo sapiens
cattccagcccct

SEQ ID NO: 1173430 - DNA, 15 bp, Homo sapiens
cattccagcccctct

SEQ ID NO: 1173431 - DNA, 19 bp, Homo sapiens
cattccagcccctctggtc

SEQ ID NO: 1173432 - DNA, 13 bp, Homo sapiens
cattccagctctg

SEQ ID NO: 1173433 - DNA, 15 bp, Homo sapiens
cattccaggaaaact

SEQ ID NO: 1173434 - DNA, 15 bp, Homo sapiens
cattccagggctggg

SEQ ID NO: 1173435 - DNA, 18 bp, Homo sapiens
cattccagtaactttttt

SEQ ID NO: 1173436 - DNA, 13 bp, Homo sapiens
cattccagtctga

SEQ ID NO: 1173437 - DNA, 21 bp, Homo sapiens
cattccagtgctagaaaattt

SEQ ID NO: 1173438 - DNA, 21 bp, Homo sapiens
cattccattgcctagctcttt

SEQ ID NO: 1173439 - DNA, 19 bp, Homo sapiens
cattcccatggtggcctca

SEQ ID NO: 1173440 - DNA, 21 bp, Homo sapiens
cattcccatggtggcctcaag

SEQ ID NO: 1173441 - DNA, 21 bp, Homo sapiens
cattccccagagtgggatcca

SEQ ID NO: 1173442 - DNA, 19 bp, Homo sapiens
cattcccccatgtggctga

SEQ ID NO: 1173443 - DNA, 16 bp, Homo sapiens
cattcccctcccacct

SEQ ID NO: 1173444 - DNA, 16 bp, Homo sapiens
cattcccgaggtcagc

SEQ ID NO: 1173445 - DNA, 16 bp, Homo sapiens
cattccctacagccta

SEQ ID NO: 1173446 - DNA, 18 bp, Homo sapiens
cattccctgagtcaccag

SEQ ID NO: 1173447 - DNA, 10 bp, Homo sapiens
cattccctgg

SEQ ID NO: 1173448 - DNA, 20 bp, Homo sapiens
cattccggccacatcattct

SEQ ID NO: 1173449 - DNA, 21 bp, Homo sapiens
cattcctaacacagcatgtgt

SEQ ID NO: 1173450 - DNA, 16 bp, Homo sapiens
cattcctaactagaat

SEQ ID NO: 1173451 - DNA, 21 bp, Homo sapiens
cattcctaactagaattagta

SEQ ID NO: 1173452 - DNA, 22 bp, Homo sapiens
cattcctaagagtggaggagga

SEQ ID NO: 1173453 - DNA, 19 bp, Homo sapiens
cattcctcaggaaggacat

SEQ ID NO: 1173454 - DNA, 23 bp, Homo sapiens
cattcctcaggaaggacatgggt

SEQ ID NO: 1173455 - DNA, 16 bp, Homo sapiens
cattcctccagcctcc

SEQ ID NO: 1173456 - DNA, 21 bp, Homo sapiens
cattcctccagcctcccctcc

SEQ ID NO: 1173457 - DNA, 13 bp, Homo sapiens
cattcctgaaaga

SEQ ID NO: 1173458 - DNA, 19 bp, Homo sapiens
cattcctgaaagaaacagt

SEQ ID NO: 1173459 - DNA, 15 bp, Homo sapiens
cattcctgcctttaa

SEQ ID NO: 1173460 - DNA, 22 bp, Homo sapiens
cattcctgcctttaagccaaag

SEQ ID NO: 1173461 - DNA, 13 bp, Homo sapiens
cattcctggcccc

SEQ ID NO: 1173462 - DNA, 21 bp, Homo sapiens
cattcctgggaaatattccct

SEQ ID NO: 1173463 - DNA, 15 bp, Homo sapiens
cattcctggtaccca

SEQ ID NO: 1173464 - DNA, 19 bp, Homo sapiens
cattcctggtacccagcca

SEQ ID NO: 1173465 - DNA, 20 bp, Homo sapiens
cattcctggtacccagccat

SEQ ID NO: 1173466 - DNA, 21 bp, Homo sapiens
cattcctggtacccagccatc

SEQ ID NO: 1173467 - DNA, 15 bp, Homo sapiens
cattcctgtcccttt

SEQ ID NO: 1173468 - DNA, 16 bp, Homo sapiens
cattcctgtccctttg

SEQ ID NO: 1173469 - DNA, 15 bp, Homo sapiens
cattccttaattgta

SEQ ID NO: 1173470 - DNA, 16 bp, Homo sapiens
cattccttaattgtat

SEQ ID NO: 1173471 - DNA, 18 bp, Homo sapiens
cattccttacttgcactg

SEQ ID NO: 1173472 - DNA, 14 bp, Homo sapiens
cattccttcaaata

SEQ ID NO: 1173473 - DNA, 19 bp, Homo sapiens
cattccttcaaataaagaa

SEQ ID NO: 1173474 - DNA, 17 bp, Homo sapiens
cattccttgaggacaga

SEQ ID NO: 1173475 - DNA, 17 bp, Homo sapiens
cattccttgcgcctcag

SEQ ID NO: 1173476 - DNA, 20 bp, Homo sapiens
cattccttgcgcctcagccc

SEQ ID NO: 1173477 - DNA, 15 bp, Homo sapiens
cattccttgtcacca

SEQ ID NO: 1173478 - DNA, 16 bp, Homo sapiens
cattccttgtcaccag

SEQ ID NO: 1173479 - DNA, 17 bp, Homo sapiens
cattccttgtcaccagc

SEQ ID NO: 1173480 - DNA, 18 bp, Homo sapiens
cattccttgtcaccagca

SEQ ID NO: 1173481 - DNA, 21 bp, Homo sapiens
cattcgacctataagaagcct

SEQ ID NO: 1173482 - DNA, 16 bp, Homo sapiens
cattcgatctcattca

SEQ ID NO: 1173483 - DNA, 17 bp, Homo sapiens
cattcgcctttgtcttg

SEQ ID NO: 1173484 - DNA, 24 bp, Homo sapiens
cattcgcctttgtcttgtacttct

SEQ ID NO: 1173485 - DNA, 19 bp, Homo sapiens
cattcgcgtggctcgggac

SEQ ID NO: 1173486 - DNA, 21 bp, Homo sapiens
cattcgctgtaccctttaaga

SEQ ID NO: 1173487 - DNA, 15 bp, Homo sapiens
cattcggctccctgg

SEQ ID NO: 1173488 - DNA, 16 bp, Homo sapiens
cattcgggaccaatat

SEQ ID NO: 1173489 - DNA, 16 bp, Homo sapiens
cattcgtctgtcccag

SEQ ID NO: 1173490 - DNA, 20 bp, Homo sapiens
cattcgtctgtcccagagct

SEQ ID NO: 1173491 - DNA, 17 bp, Homo sapiens
cattcgtgagctgggga

SEQ ID NO: 1173492 - DNA, 14 bp, Homo sapiens
ccacccttggcctg

SEQ ID NO: 1173493 - DNA, 19 bp, Homo sapiens
ccaccctttcatagagagg

SEQ ID NO: 1173494 - DNA, 15 bp, Homo sapiens
ccaccgaccaactgc

SEQ ID NO: 1173495 - DNA, 16 bp, Homo sapiens
ccaccgaccaactgcc

SEQ ID NO: 1173496 - DNA, 13 bp, Homo sapiens
ccaccgactgccc

SEQ ID NO: 1173497 - DNA, 16 bp, Homo sapiens
ccaccgaggttcccag

SEQ ID NO: 1173498 - DNA, 14 bp, Homo sapiens
ccaccgatggagcc

SEQ ID NO: 1173499 - DNA, 18 bp, Homo sapiens
ccaccgatggagccccca

SEQ ID NO: 1173500 - DNA, 20 bp, Homo sapiens
ccaccgatggagcccccaga

SEQ ID NO: 1173501 - DNA, 19 bp, Homo sapiens
ccaccgcatatgcatgcca

SEQ ID NO: 1173502 - DNA, 21 bp, Homo sapiens
ccaccgcatatgcatgccagg

SEQ ID NO: 1173503 - DNA, 17 bp, Homo sapiens
ccaccgcccagagaccc

SEQ ID NO: 1173504 - DNA, 12 bp, Homo sapiens
ccaccgccccca

SEQ ID NO: 1173505 - DNA, 19 bp, Homo sapiens
ccaccgccctcctccactt

SEQ ID NO: 1173506 - DNA, 13 bp, Homo sapiens
ccaccgcctctgg

SEQ ID NO: 1173507 - DNA, 16 bp, Homo sapiens
ccaccgctcagtgtca

SEQ ID NO: 1173508 - DNA, 17 bp, Homo sapiens
ccaccgctccccagccc

SEQ ID NO: 1173509 - DNA, 21 bp, Homo sapiens
ccaccgctccccagcccaggg

SEQ ID NO: 1173510 - DNA, 16 bp, Homo sapiens
ccaccgctgccagcac

SEQ ID NO: 1173511 - DNA, 20 bp, Homo sapiens
ccaccgctgccagcacagag

SEQ ID NO: 1173512 - DNA, 21 bp, Homo sapiens
ccaccgctgccagcacagagc

SEQ ID NO: 1173513 - DNA, 15 bp, Homo sapiens
ccaccgctgcctaag

SEQ ID NO: 1173514 - DNA, 21 bp, Homo sapiens
ccaccgctgcctaagtggctg

SEQ ID NO: 1173515 - DNA, 16 bp, Homo sapiens
ccaccggaactgggct

SEQ ID NO: 1173516 - DNA, 20 bp, Homo sapiens
ccaccggatgctgtgcctgg

SEQ ID NO: 1173517 - DNA, 17 bp, Homo sapiens
ccaccggcccctggcag

SEQ ID NO: 1173518 - DNA, 22 bp, Homo sapiens
ccaccggcccctggcagcacag

SEQ ID NO: 1173519 - DNA, 16 bp, Homo sapiens
ccaccgggagcctccc

SEQ ID NO: 1173520 - DNA, 21 bp, Homo sapiens
ccaccgggctgcaggtgctgc

SEQ ID NO: 1173521 - DNA, 22 bp, Homo sapiens
ccaccgggctgggagctctgca

SEQ ID NO: 1173522 - DNA, 18 bp, Homo sapiens
ccaccgggggtggctctg

SEQ ID NO: 1173523 - DNA, 14 bp, Homo sapiens
ccaccgtccgccct

SEQ ID NO: 1173524 - DNA, 17 bp, Homo sapiens
ccaccgtccgccctgct

SEQ ID NO: 1173525 - DNA, 18 bp, Homo sapiens
ccaccgtccgccctgctc

SEQ ID NO: 1173526 - DNA, 16 bp, Homo sapiens
ccaccgtctcggccct

SEQ ID NO: 1173527 - DNA, 17 bp, Homo sapiens
ccaccgtctcggccctg

SEQ ID NO: 1173528 - DNA, 18 bp, Homo sapiens
ccaccgtctcggccctga

SEQ ID NO: 1173529 - DNA, 13 bp, Homo sapiens
ccaccgtgcctgg

SEQ ID NO: 1173530 - DNA, 16 bp, Homo sapiens
ccaccgtggaggagga

SEQ ID NO: 1173531 - DNA, 14 bp, Homo sapiens
ccaccgttcagtca

SEQ ID NO: 1173532 - DNA, 15 bp, Homo sapiens
ccaccgttcagtcat

SEQ ID NO: 1173533 - DNA, 23 bp, Homo sapiens
ccacctaattcgatgaaggctgc

SEQ ID NO: 1173534 - DNA, 15 bp, Homo sapiens
ccacctacacaggag

SEQ ID NO: 1173535 - DNA, 17 bp, Homo sapiens
ccacctacacaggagtc

SEQ ID NO: 1173536 - DNA, 19 bp, Homo sapiens
ccacctacttgtgactgaa

SEQ ID NO: 1173537 - DNA, 16 bp, Homo sapiens
ccacctagaacactaa

SEQ ID NO: 1173538 - DNA, 16 bp, Homo sapiens
ccacctaggccactcc

SEQ ID NO: 1173539 - DNA, 18 bp, Homo sapiens
ccacctaggccactcctc

SEQ ID NO: 1173540 - DNA, 18 bp, Homo sapiens
ccacctagtgccccagac

SEQ ID NO: 1173541 - DNA, 20 bp, Homo sapiens
ccacctagtgccccagactg

SEQ ID NO: 1173542 - DNA, 18 bp, Homo sapiens
ccacctatctcgtgggag

SEQ ID NO: 1173543 - DNA, 13 bp, Homo sapiens
ccacctatgcctg

SEQ ID NO: 1173544 - DNA, 18 bp, Homo sapiens
ccacctatgcctgtggtg

SEQ ID NO: 1173545 - DNA, 21 bp, Homo sapiens
ccacctatgcctgtggtgaag

SEQ ID NO: 1173546 - DNA, 16 bp, Homo sapiens
ccacctcaagaccccc

SEQ ID NO: 1173547 - DNA, 15 bp, Homo sapiens
ccacctcagaaagga

SEQ ID NO: 1173548 - DNA, 19 bp, Homo sapiens
ccacctcagcctcccaggt

SEQ ID NO: 1173549 - DNA, 15 bp, Homo sapiens
ccacctcagccttgg

SEQ ID NO: 1173550 - DNA, 12 bp, Homo sapiens
ccacctcagggc

SEQ ID NO: 1173551 - DNA, 15 bp, Homo sapiens
ccacctcatcactgg

SEQ ID NO: 1173552 - DNA, 21 bp, Homo sapiens
ccacctcatggattgccacag

SEQ ID NO: 1173553 - DNA, 22 bp, Homo sapiens
ccacctcatggattgccacagc

SEQ ID NO: 1173554 - DNA, 15 bp, Homo sapiens
ccacctccacccagc

SEQ ID NO: 1173555 - DNA, 17 bp, Homo sapiens
ccacctccacccagccc

SEQ ID NO: 1173556 - DNA, 18 bp, Homo sapiens
ccacctccacccagcccc

SEQ ID NO: 1173557 - DNA, 22 bp, Homo sapiens
ccacctccacccagcccctggc

SEQ ID NO: 1173558 - DNA, 14 bp, Homo sapiens
ccacctccagcccg

SEQ ID NO: 1173559 - DNA, 15 bp, Homo sapiens
ccacctccccacaca

SEQ ID NO: 1173560 - DNA, 17 bp, Homo sapiens
ccacctcccctatccac

SEQ ID NO: 1173561 - DNA, 13 bp, Homo sapiens
ccacctccctgcg

SEQ ID NO: 1173562 - DNA, 21 bp, Homo sapiens
ccacctccctgcgcccttgag

SEQ ID NO: 1173563 - DNA, 15 bp, Homo sapiens
ccacctccgccagac

SEQ ID NO: 1173564 - DNA, 17 bp, Homo sapiens
ccacctccgccagaccc

SEQ ID NO: 1173565 - DNA, 13 bp, Homo sapiens
ccacctcctaccc

SEQ ID NO: 1173566 - DNA, 21 bp, Homo sapiens
ccacctcctaccccttcctgt

SEQ ID NO: 1173567 - DNA, 23 bp, Homo sapiens
ccacctcctagaggtgggcagct

SEQ ID NO: 1173568 - DNA, 11 bp, Homo sapiens
ccacctcctcc

SEQ ID NO: 1173569 - DNA, 17 bp, Homo sapiens
ccacctcctccccctgt

SEQ ID NO: 1173570 - DNA, 21 bp, Homo sapiens
ccacctcctgcggctcagcct

SEQ ID NO: 1173571 - DNA, 15 bp, Homo sapiens
ccacctcgctcccct

SEQ ID NO: 1173572 - DNA, 17 bp, Homo sapiens
ccacctcgctcccctct

SEQ ID NO: 1173573 - DNA, 19 bp, Homo sapiens
ccacctcgctcccctctgg

SEQ ID NO: 1173574 - DNA, 18 bp, Homo sapiens
ccacctcggcctcccaaa

SEQ ID NO: 1173575 - DNA, 20 bp, Homo sapiens
ccacctctcacgggccctgc

SEQ ID NO: 1173576 - DNA, 13 bp, Homo sapiens
ccacctctccaag

SEQ ID NO: 1173577 - DNA, 18 bp, Homo sapiens
ccacctctccctgaccct

SEQ ID NO: 1173578 - DNA, 17 bp, Homo sapiens
ccacctctccctgcatc

SEQ ID NO: 1173579 - DNA, 18 bp, Homo sapiens
ccacctctccctgcatcc

SEQ ID NO: 1173580 - DNA, 24 bp, Homo sapiens
ccacctctccctgcatcctgaggc

SEQ ID NO: 1173581 - DNA, 21 bp, Homo sapiens
ccacctctgacgcaccactgc

SEQ ID NO: 1173582 - DNA, 23 bp, Homo sapiens
ccacctctggccaaatatgcact

SEQ ID NO: 1173583 - DNA, 14 bp, Homo sapiens
ccacctctgtgggc

SEQ ID NO: 1173584 - DNA, 19 bp, Homo sapiens
ccacctcttctcttcctgt

SEQ ID NO: 1173585 - DNA, 17 bp, Homo sapiens
ccacctgaaagcctgtc

SEQ ID NO: 1173586 - DNA, 21 bp, Homo sapiens
ccacctgacaatggcagctag

SEQ ID NO: 1173587 - DNA, 23 bp, Homo sapiens
ccacctgacacaccaggcgctaa

SEQ ID NO: 1173588 - DNA, 17 bp, Homo sapiens
ccacctgagaccctggg

SEQ ID NO: 1173589 - DNA, 15 bp, Homo sapiens
ccacctgaggtgggc

SEQ ID NO: 1173590 - DNA, 20 bp, Homo sapiens
ccacctgaggtgggcccagg

SEQ ID NO: 1173591 - DNA, 16 bp, Homo sapiens
ccagaagcttccatag

SEQ ID NO: 1173592 - DNA, 13 bp, Homo sapiens
ccagaaggaaggt

SEQ ID NO: 1173593 - DNA, 17 bp, Homo sapiens
ccagaaggaatcttctc

SEQ ID NO: 1173594 - DNA, 17 bp, Homo sapiens
ccagaaggagggcagag

SEQ ID NO: 1173595 - DNA, 19 bp, Homo sapiens
ccagaaggagggcagagcc

SEQ ID NO: 1173596 - DNA, 20 bp, Homo sapiens
ccagaaggagggcagagcca

SEQ ID NO: 1173597 - DNA, 12 bp, Homo sapiens
ccagaaggcagg

SEQ ID NO: 1173598 - DNA, 20 bp, Homo sapiens
ccagaaggggctgcttgctt

SEQ ID NO: 1173599 - DNA, 21 bp, Homo sapiens
ccagaaggggctgcttgcttt

SEQ ID NO: 1173600 - DNA, 20 bp, Homo sapiens
ccagaagtaccagactagat

SEQ ID NO: 1173601 - DNA, 12 bp, Homo sapiens
ccagaagtgttt

SEQ ID NO: 1173602 - DNA, 22 bp, Homo sapiens
ccagaagtttgagatcagcctg

SEQ ID NO: 1173603 - DNA, 23 bp, Homo sapiens
ccagaagtttgagatcagcctgg

SEQ ID NO: 1173604 - DNA, 22 bp, Homo sapiens
ccagaataagttattgcagttt

SEQ ID NO: 1173605 - DNA, 23 bp, Homo sapiens
ccagaataagttattgcagttta

SEQ ID NO: 1173606 - DNA, 23 bp, Homo sapiens
ccagaatccataaatgtgttcct

SEQ ID NO: 1173607 - DNA, 14 bp, Homo sapiens
ccagaatcccagcc

SEQ ID NO: 1173608 - DNA, 13 bp, Homo sapiens
ccagaatctgctg

SEQ ID NO: 1173609 - DNA, 15 bp, Homo sapiens
ccagaatctgctgtt

SEQ ID NO: 1173610 - DNA, 18 bp, Homo sapiens
ccagaatctgctgttgcc

SEQ ID NO: 1173611 - DNA, 23 bp, Homo sapiens
ccagaatctgctgttgccatagc

SEQ ID NO: 1173612 - DNA, 17 bp, Homo sapiens
ccagaatcttgactttc

SEQ ID NO: 1173613 - DNA, 19 bp, Homo sapiens
ccagaatcttgactttctg

SEQ ID NO: 1173614 - DNA, 22 bp, Homo sapiens
ccagaatgctgaactccttgtt

SEQ ID NO: 1173615 - DNA, 17 bp, Homo sapiens
ccagaatgctgtacatc

SEQ ID NO: 1173616 - DNA, 15 bp, Homo sapiens
ccagaatggagcctg

SEQ ID NO: 1173617 - DNA, 12 bp, Homo sapiens
ccagaatgtaag

SEQ ID NO: 1173618 - DNA, 17 bp, Homo sapiens
ccagaatgtaagaaaac

SEQ ID NO: 1173619 - DNA, 12 bp, Homo sapiens
ccagaattccct

SEQ ID NO: 1173620 - DNA, 17 bp, Homo sapiens
ccagaattcccttgaat

SEQ ID NO: 1173621 - DNA, 22 bp, Homo sapiens
ccagaattcccttgaattgtgt

SEQ ID NO: 1173622 - DNA, 20 bp, Homo sapiens
ccagacaaaaaaatttaaaa

SEQ ID NO: 1173623 - DNA, 18 bp, Homo sapiens
ccagacaaaatttgagaa

SEQ ID NO: 1173624 - DNA, 20 bp, Homo sapiens
ccagacaaataggagtgagt

SEQ ID NO: 1173625 - DNA, 16 bp, Homo sapiens
ccagacaaccaaaaca

SEQ ID NO: 1173626 - DNA, 14 bp, Homo sapiens
ccagacaaggagag

SEQ ID NO: 1173627 - DNA, 22 bp, Homo sapiens
ccagacaaggagagcggaggag

SEQ ID NO: 1173628 - DNA, 16 bp, Homo sapiens
ccagacacagactggc

SEQ ID NO: 1173629 - DNA, 16 bp, Homo sapiens
ccagacaccatgtgca

SEQ ID NO: 1173630 - DNA, 11 bp, Homo sapiens
ccagacactgg

SEQ ID NO: 1173631 - DNA, 12 bp, Homo sapiens
ccagacactggt

SEQ ID NO: 1173632 - DNA, 17 bp, Homo sapiens
ccagacagacaacactg

SEQ ID NO: 1173633 - DNA, 13 bp, Homo sapiens
ccagacaggccct

SEQ ID NO: 1173634 - DNA, 15 bp, Homo sapiens
ccagacaggccctcc

SEQ ID NO: 1173635 - DNA, 18 bp, Homo sapiens
ccagacaggccctccctg

SEQ ID NO: 1173636 - DNA, 21 bp, Homo sapiens
ccagacaggccctccctgtct

SEQ ID NO: 1173637 - DNA, 22 bp, Homo sapiens
ccagacagtggatatgacccac

SEQ ID NO: 1173638 - DNA, 19 bp, Homo sapiens
ccagacatgtggtgggaca

SEQ ID NO: 1173639 - DNA, 17 bp, Homo sapiens
ccagaccagccctgcag

SEQ ID NO: 1173640 - DNA, 16 bp, Homo sapiens
atacatagatcttcat

SEQ ID NO: 1173641 - DNA, 23 bp, Homo sapiens
atacatatatatatacacataca

SEQ ID NO: 1173642 - DNA, 20 bp, Homo sapiens
atacatatatatatttgtaa

SEQ ID NO: 1173643 - DNA, 24 bp, Homo sapiens
atacatatatatatttgtaacatt

SEQ ID NO: 1173644 - DNA, 14 bp, Homo sapiens
atacatatatatct

SEQ ID NO: 1173645 - DNA, 21 bp, Homo sapiens
atacatatcgctgacttcatg

SEQ ID NO: 1173646 - DNA, 16 bp, Homo sapiens
atacatatctttatta

SEQ ID NO: 1173647 - DNA, 17 bp, Homo sapiens
atacatatctttattaa

SEQ ID NO: 1173648 - DNA, 15 bp, Homo sapiens
atacatatgagaata

SEQ ID NO: 1173649 - DNA, 22 bp, Homo sapiens
atacatatgagtgtggaagccg

SEQ ID NO: 1173650 - DNA, 18 bp, Homo sapiens
atacatcacgttaaagta

SEQ ID NO: 1173651 - DNA, 18 bp, Homo sapiens
atacatcactgcttgatg

SEQ ID NO: 1173652 - DNA, 15 bp, Homo sapiens
atacatctctcccca

SEQ ID NO: 1173653 - DNA, 15 bp, Homo sapiens
atacatctttcccta

SEQ ID NO: 1173654 - DNA, 22 bp, Homo sapiens
atacatgaagaatagaaacaag

SEQ ID NO: 1173655 - DNA, 15 bp, Homo sapiens
atacatgatacattt

SEQ ID NO: 1173656 - DNA, 15 bp, Homo sapiens
atacatgctgctaat

SEQ ID NO: 1173657 - DNA, 20 bp, Homo sapiens
atacatggaatcgaagtgtt

SEQ ID NO: 1173658 - DNA, 14 bp, Homo sapiens
atacatggataaca

SEQ ID NO: 1173659 - DNA, 19 bp, Homo sapiens
atacatgtacctatagaaa

SEQ ID NO: 1173660 - DNA, 21 bp, Homo sapiens
atacatgtactccagagggac

SEQ ID NO: 1173661 - DNA, 16 bp, Homo sapiens
atacatgtttttctat

SEQ ID NO: 1173662 - DNA, 23 bp, Homo sapiens
atacatgtttttctattaaaaat

SEQ ID NO: 1173663 - DNA, 20 bp, Homo sapiens
atacattctatgacattttt

SEQ ID NO: 1173664 - DNA, 16 bp, Homo sapiens
atacattgaattcatt

SEQ ID NO: 1173665 - DNA, 20 bp, Homo sapiens
atacattgtatatatgtgta

SEQ ID NO: 1173666 - DNA, 21 bp, Homo sapiens
atacatttaaaacattaaaat

SEQ ID NO: 1173667 - DNA, 18 bp, Homo sapiens
atacatttaataaaactg

SEQ ID NO: 1173668 - DNA, 21 bp, Homo sapiens
atacatttataatgtttgcta

SEQ ID NO: 1173669 - DNA, 12 bp, Homo sapiens
atacatttctga

SEQ ID NO: 1173670 - DNA, 17 bp, Homo sapiens
atacattttctaaataa

SEQ ID NO: 1173671 - DNA, 24 bp, Homo sapiens
atacattttctaaataaaaatatg

SEQ ID NO: 1173672 - DNA, 13 bp, Homo sapiens
ataccaaacatgc

SEQ ID NO: 1173673 - DNA, 18 bp, Homo sapiens
ataccaaagcacatttta

SEQ ID NO: 1173674 - DNA, 24 bp, Homo sapiens
ataccaaatagcttctgttttgtt

SEQ ID NO: 1173675 - DNA, 17 bp, Homo sapiens
ataccaaattaaaaaaa

SEQ ID NO: 1173676 - DNA, 18 bp, Homo sapiens
ataccacaaaccctgctg

SEQ ID NO: 1173677 - DNA, 18 bp, Homo sapiens
ataccaccatttaaaaat

SEQ ID NO: 1173678 - DNA, 22 bp, Homo sapiens
ataccaccatttaaaaatgtta

SEQ ID NO: 1173679 - DNA, 14 bp, Homo sapiens
ataccacgaggaaa

SEQ ID NO: 1173680 - DNA, 18 bp, Homo sapiens
ataccactctgtaattgc

SEQ ID NO: 1173681 - DNA, 17 bp, Homo sapiens
ataccacttttgttctt

SEQ ID NO: 1173682 - DNA, 22 bp, Homo sapiens
ataccagcgaggaggctccaga

SEQ ID NO: 1173683 - DNA, 15 bp, Homo sapiens
ataccagctcagggg

SEQ ID NO: 1173684 - DNA, 16 bp, Homo sapiens
ataccataggaagaca

SEQ ID NO: 1173685 - DNA, 21 bp, Homo sapiens
ataccatatgtctgcttctgt

SEQ ID NO: 1173686 - DNA, 23 bp, Homo sapiens
ataccattatatgttccccctgt

SEQ ID NO: 1173687 - DNA, 18 bp, Homo sapiens
ataccattattatgtaaa

SEQ ID NO: 1173688 - DNA, 14 bp, Homo sapiens
atacccaaaggaat

SEQ ID NO: 1173689 - DNA, 13 bp, Homo sapiens
atacccaacagtt

SEQ ID NO: 1173690 - DNA, 15 bp, Homo sapiens
atacccccaggaaac

SEQ ID NO: 1173691 - DNA, 22 bp, Homo sapiens
atacccccgtcggaatggtaac

SEQ ID NO: 1173692 - DNA, 15 bp, Homo sapiens
ataccccttattgct

SEQ ID NO: 1173693 - DNA, 17 bp, Homo sapiens
ataccccttattgctgc

SEQ ID NO: 1173694 - DNA, 21 bp, Homo sapiens
ataccccttattgctgccaaa

SEQ ID NO: 1173695 - DNA, 23 bp, Homo sapiens
ataccccttattgctgccaaaac

SEQ ID NO: 1173696 - DNA, 15 bp, Homo sapiens
ataccctaccctatg

SEQ ID NO: 1173697 - DNA, 19 bp, Homo sapiens
ataccctactgtggggaga

SEQ ID NO: 1173698 - DNA, 22 bp, Homo sapiens
ataccgctcagtattttaaatg

SEQ ID NO: 1173699 - DNA, 18 bp, Homo sapiens
atacctcaacctatggta

SEQ ID NO: 1173700 - DNA, 14 bp, Homo sapiens
atacctcaattttt

SEQ ID NO: 1173701 - DNA, 20 bp, Homo sapiens
atacctcatcatccacccgc

SEQ ID NO: 1173702 - DNA, 17 bp, Homo sapiens
atacctccaaccctgcc

SEQ ID NO: 1173703 - DNA, 21 bp, Homo sapiens
atacctcctccctaatgctca

SEQ ID NO: 1173704 - DNA, 16 bp, Homo sapiens
atacctcttagctgag

SEQ ID NO: 1173705 - DNA, 17 bp, Homo sapiens
atacctcttagctgagt

SEQ ID NO: 1173706 - DNA, 20 bp, Homo sapiens
atacctgattttttttcctt

SEQ ID NO: 1173707 - DNA, 14 bp, Homo sapiens
atacctgcccctgc

SEQ ID NO: 1173708 - DNA, 19 bp, Homo sapiens
atacctgcccctgcctgac

SEQ ID NO: 1173709 - DNA, 17 bp, Homo sapiens
atacctggcttttactt

SEQ ID NO: 1173710 - DNA, 22 bp, Homo sapiens
atacctggcttttactttatta

SEQ ID NO: 1173711 - DNA, 13 bp, Homo sapiens
atacctggtttac

SEQ ID NO: 1173712 - DNA, 17 bp, Homo sapiens
ccagagagcaggcaggg

SEQ ID NO: 1173713 - DNA, 24 bp, Homo sapiens
ccagagagcaggcaggggcatctg

SEQ ID NO: 1173714 - DNA, 19 bp, Homo sapiens
ccagagagcaggggagctt

SEQ ID NO: 1173715 - DNA, 20 bp, Homo sapiens
ccagagagcaggggagcttg

SEQ ID NO: 1173716 - DNA, 22 bp, Homo sapiens
ccagagagcaggggagcttggg

SEQ ID NO: 1173717 - DNA, 23 bp, Homo sapiens
ccagagagcaggggagcttggga

SEQ ID NO: 1173718 - DNA, 15 bp, Homo sapiens
ccagagagcctccct

SEQ ID NO: 1173719 - DNA, 16 bp, Homo sapiens
ccagagaggcactcag

SEQ ID NO: 1173720 - DNA, 23 bp, Homo sapiens
ccagagagggcccagctgtagcc

SEQ ID NO: 1173721 - DNA, 14 bp, Homo sapiens
ccagagagtcctct

SEQ ID NO: 1173722 - DNA, 14 bp, Homo sapiens
ccagagagtcctgt

SEQ ID NO: 1173723 - DNA, 23 bp, Homo sapiens
ccagagatgactattacttttct

SEQ ID NO: 1173724 - DNA, 15 bp, Homo sapiens
ccagagatgcctcca

SEQ ID NO: 1173725 - DNA, 17 bp, Homo sapiens
ccagagatgcctccacc

SEQ ID NO: 1173726 - DNA, 23 bp, Homo sapiens
ccagagatgcctccaccgctgcc

SEQ ID NO: 1173727 - DNA, 16 bp, Homo sapiens
ccagagcaacctctca

SEQ ID NO: 1173728 - DNA, 18 bp, Homo sapiens
ccagagcacaggagctgc

SEQ ID NO: 1173729 - DNA, 12 bp, Homo sapiens
ccagagcacccc

SEQ ID NO: 1173730 - DNA, 24 bp, Homo sapiens
ccagagcagagcctacagaagggc

SEQ ID NO: 1173731 - DNA, 15 bp, Homo sapiens
ccagagcagagttta

SEQ ID NO: 1173732 - DNA, 16 bp, Homo sapiens
ccagagcagagtttac

SEQ ID NO: 1173733 - DNA, 22 bp, Homo sapiens
ccagagcagagtttacgggtct

SEQ ID NO: 1173734 - DNA, 14 bp, Homo sapiens
ccagagcaggagcc

SEQ ID NO: 1173735 - DNA, 19 bp, Homo sapiens
ccagagcaggagcccctgg

SEQ ID NO: 1173736 - DNA, 15 bp, Homo sapiens
ccagagcaggaggcc

SEQ ID NO: 1173737 - DNA, 21 bp, Homo sapiens
ccagagcattacgtgagccag

SEQ ID NO: 1173738 - DNA, 18 bp, Homo sapiens
ccagagcatttccaacac

SEQ ID NO: 1173739 - DNA, 21 bp, Homo sapiens
ccagagcatttccaacaccac

SEQ ID NO: 1173740 - DNA, 13 bp, Homo sapiens
ccagagccacctg

SEQ ID NO: 1173741 - DNA, 15 bp, Homo sapiens
ccagagccacctgga

SEQ ID NO: 1173742 - DNA, 12 bp, Homo sapiens
ccagagccagcc

SEQ ID NO: 1173743 - DNA, 15 bp, Homo sapiens
ccagagccagcctgg

SEQ ID NO: 1173744 - DNA, 17 bp, Homo sapiens
ccagagccagcctggga

SEQ ID NO: 1173745 - DNA, 18 bp, Homo sapiens
ccagagccatgccaggct

SEQ ID NO: 1173746 - DNA, 15 bp, Homo sapiens
ccagagccatggact

SEQ ID NO: 1173747 - DNA, 13 bp, Homo sapiens
ccagagcccagct

SEQ ID NO: 1173748 - DNA, 17 bp, Homo sapiens
ccagagcccagctcttg

SEQ ID NO: 1173749 - DNA, 15 bp, Homo sapiens
ccagagccccaagca

SEQ ID NO: 1173750 - DNA, 17 bp, Homo sapiens
ccagagccccaagcagg

SEQ ID NO: 1173751 - DNA, 21 bp, Homo sapiens
ccagagcccctcctccagccc

SEQ ID NO: 1173752 - DNA, 17 bp, Homo sapiens
ccagagcccttcactgc

SEQ ID NO: 1173753 - DNA, 18 bp, Homo sapiens
ccagagcccttcactgcc

SEQ ID NO: 1173754 - DNA, 20 bp, Homo sapiens
ccagagcccttcactgccat

SEQ ID NO: 1173755 - DNA, 21 bp, Homo sapiens
ccagagcccttgactgtacag

SEQ ID NO: 1173756 - DNA, 19 bp, Homo sapiens
ccagagcctggctgcccat

SEQ ID NO: 1173757 - DNA, 16 bp, Homo sapiens
ccagagcgaggaaagg

SEQ ID NO: 1173758 - DNA, 22 bp, Homo sapiens
ccagagcggtatctctggcacc

SEQ ID NO: 1173759 - DNA, 18 bp, Homo sapiens
ccagagctagggctgctg

SEQ ID NO: 1173760 - DNA, 12 bp, Homo sapiens
ccagagctggaa

SEQ ID NO: 1173761 - DNA, 13 bp, Homo sapiens
ccagagctggaag

SEQ ID NO: 1173762 - DNA, 20 bp, Homo sapiens
ccagagctggaaggcagggc

SEQ ID NO: 1173763 - DNA, 20 bp, Homo sapiens
ccagagctgggtggggacag

SEQ ID NO: 1173764 - DNA, 19 bp, Homo sapiens
ccagagctgtgccagcagg

SEQ ID NO: 1173765 - DNA, 17 bp, Homo sapiens
ccagagctgtgcctgct

SEQ ID NO: 1173766 - DNA, 22 bp, Homo sapiens
atactgactccaaccattcaaa

SEQ ID NO: 1173767 - DNA, 22 bp, Homo sapiens
atactgactgctggacataaat

SEQ ID NO: 1173768 - DNA, 16 bp, Homo sapiens
atactgagatgctggg

SEQ ID NO: 1173769 - DNA, 13 bp, Homo sapiens
atactgagctttt

SEQ ID NO: 1173770 - DNA, 14 bp, Homo sapiens
atactgagggacca

SEQ ID NO: 1173771 - DNA, 17 bp, Homo sapiens
atactgattgggaggtg

SEQ ID NO: 1173772 - DNA, 22 bp, Homo sapiens
atactgcccggggcagctgcca

SEQ ID NO: 1173773 - DNA, 23 bp, Homo sapiens
atactgcttgtcatctgcatgtc

SEQ ID NO: 1173774 - DNA, 19 bp, Homo sapiens
atactggaagttttgcatt

SEQ ID NO: 1173775 - DNA, 15 bp, Homo sapiens
atactggaataattt

SEQ ID NO: 1173776 - DNA, 21 bp, Homo sapiens
atactggaataatttgtaaat

SEQ ID NO: 1173777 - DNA, 22 bp, Homo sapiens
atactggaataatttgtaaatg

SEQ ID NO: 1173778 - DNA, 12 bp, Homo sapiens
atactggactca

SEQ ID NO: 1173779 - DNA, 15 bp, Homo sapiens
atactggactcagga

SEQ ID NO: 1173780 - DNA, 11 bp, Homo sapiens
atactggcctc

SEQ ID NO: 1173781 - DNA, 12 bp, Homo sapiens
atactggcctct

SEQ ID NO: 1173782 - DNA, 17 bp, Homo sapiens
atactgggtttcaagaa

SEQ ID NO: 1173783 - DNA, 22 bp, Homo sapiens
atactgggtttcaagaaaatct

SEQ ID NO: 1173784 - DNA, 21 bp, Homo sapiens
atactggtgcagtcattatga

SEQ ID NO: 1173785 - DNA, 17 bp, Homo sapiens
atactgtaaaagttata

SEQ ID NO: 1173786 - DNA, 20 bp, Homo sapiens
atactgtaaaagttataata

SEQ ID NO: 1173787 - DNA, 24 bp, Homo sapiens
atactgtaaaagttataataactg

SEQ ID NO: 1173788 - DNA, 20 bp, Homo sapiens
atactgtacaataaaaacat

SEQ ID NO: 1173789 - DNA, 17 bp, Homo sapiens
atactgtacttaataaa

SEQ ID NO: 1173790 - DNA, 19 bp, Homo sapiens
atactgtatattcaggact

SEQ ID NO: 1173791 - DNA, 19 bp, Homo sapiens
atactgtatgccttctgta

SEQ ID NO: 1173792 - DNA, 15 bp, Homo sapiens
atactgtatttctaa

SEQ ID NO: 1173793 - DNA, 21 bp, Homo sapiens
atactgtcaaacaataaaggg

SEQ ID NO: 1173794 - DNA, 21 bp, Homo sapiens
atactgtcggttttttttaaa

SEQ ID NO: 1173795 - DNA, 13 bp, Homo sapiens
atactgtctctgg

SEQ ID NO: 1173796 - DNA, 14 bp, Homo sapiens
atactgtctctgga

SEQ ID NO: 1173797 - DNA, 18 bp, Homo sapiens
atactgtctttgtgctga

SEQ ID NO: 1173798 - DNA, 14 bp, Homo sapiens
atactgtgaaatac

SEQ ID NO: 1173799 - DNA, 14 bp, Homo sapiens
atactgtgtatgtt

SEQ ID NO: 1173800 - DNA, 22 bp, Homo sapiens
atactgtgtgcttgttttataa

SEQ ID NO: 1173801 - DNA, 14 bp, Homo sapiens
atactgtgtgggat

SEQ ID NO: 1173802 - DNA, 18 bp, Homo sapiens
atactgtgtgggatactt

SEQ ID NO: 1173803 - DNA, 21 bp, Homo sapiens
atactgtgtgtgagtgtgaat

SEQ ID NO: 1173804 - DNA, 13 bp, Homo sapiens
atactgtttcttg

SEQ ID NO: 1173805 - DNA, 15 bp, Homo sapiens
atacttaacatttca

SEQ ID NO: 1173806 - DNA, 22 bp, Homo sapiens
atacttaacatttcattgtaca

SEQ ID NO: 1173807 - DNA, 20 bp, Homo sapiens
atacttaatctaagaaacaa

SEQ ID NO: 1173808 - DNA, 15 bp, Homo sapiens
atacttaatctcaca

SEQ ID NO: 1173809 - DNA, 13 bp, Homo sapiens
atacttacatttc

SEQ ID NO: 1173810 - DNA, 15 bp, Homo sapiens
atacttacatttcag

SEQ ID NO: 1173811 - DNA, 21 bp, Homo sapiens
atacttacatttcagacatat

SEQ ID NO: 1173812 - DNA, 14 bp, Homo sapiens
atacttacatttcc

SEQ ID NO: 1173813 - DNA, 22 bp, Homo sapiens
atacttacatttccatttattg

SEQ ID NO: 1173814 - DNA, 22 bp, Homo sapiens
atacttagcaaagttttacctg

SEQ ID NO: 1173815 - DNA, 19 bp, Homo sapiens
atacttatatggaaattct

SEQ ID NO: 1173816 - DNA, 22 bp, Homo sapiens
atacttatgcaagatatttttg

SEQ ID NO: 1173817 - DNA, 21 bp, Homo sapiens
atacttattaaaaaatttgta

SEQ ID NO: 1173818 - DNA, 21 bp, Homo sapiens
atacttattttcagtgcatca

SEQ ID NO: 1173819 - DNA, 17 bp, Homo sapiens
atacttcaaaaataatg

SEQ ID NO: 1173820 - DNA, 18 bp, Homo sapiens
atacttcaaaaataatgt

SEQ ID NO: 1173821 - DNA, 17 bp, Homo sapiens
atacttcaaaactgttt

SEQ ID NO: 1173822 - DNA, 17 bp, Homo sapiens
atacttcaaaagccata

SEQ ID NO: 1173823 - DNA, 18 bp, Homo sapiens
atacttcacctttcctct

SEQ ID NO: 1173824 - DNA, 24 bp, Homo sapiens
atacttcactggtgtacatcgttt

SEQ ID NO: 1173825 - DNA, 13 bp, Homo sapiens
atacttcccaaag

SEQ ID NO: 1173826 - DNA, 15 bp, Homo sapiens
atacttgacctctgt

SEQ ID NO: 1173827 - DNA, 19 bp, Homo sapiens
atacttgagaccaactttt

SEQ ID NO: 1173828 - DNA, 21 bp, Homo sapiens
atacttgagaccaacttttca

SEQ ID NO: 1173829 - DNA, 20 bp, Homo sapiens
atacttgagattttcctcca

SEQ ID NO: 1173830 - DNA, 21 bp, Homo sapiens
atacttgcaactaaggacaaa

SEQ ID NO: 1173831 - DNA, 17 bp, Homo sapiens
atacttgcactctttaa

SEQ ID NO: 1173832 - DNA, 17 bp, Homo sapiens
atacttgccttctgata

SEQ ID NO: 1173833 - DNA, 15 bp, Homo sapiens
ccagagttgctggga

SEQ ID NO: 1173834 - DNA, 15 bp, Homo sapiens
ccagagttgctgtgc

SEQ ID NO: 1173835 - DNA, 16 bp, Homo sapiens
ccagagttgctgtgcc

SEQ ID NO: 1173836 - DNA, 13 bp, Homo sapiens
ccagataaataga

SEQ ID NO: 1173837 - DNA, 19 bp, Homo sapiens
ccagataactctctttcct

SEQ ID NO: 1173838 - DNA, 24 bp, Homo sapiens
ccagataactctctttccttgagc

SEQ ID NO: 1173839 - DNA, 14 bp, Homo sapiens
ccagataagaatgc

SEQ ID NO: 1173840 - DNA, 14 bp, Homo sapiens
ccagataaggcaag

SEQ ID NO: 1173841 - DNA, 21 bp, Homo sapiens
ccagatacacccaaagtatca

SEQ ID NO: 1173842 - DNA, 21 bp, Homo sapiens
ccagatacgggggctgtgact

SEQ ID NO: 1173843 - DNA, 13 bp, Homo sapiens
ccagatagagaaa

SEQ ID NO: 1173844 - DNA, 22 bp, Homo sapiens
ccagatagagctgggtggcctg

SEQ ID NO: 1173845 - DNA, 17 bp, Homo sapiens
ccagatagtagaaccag

SEQ ID NO: 1173846 - DNA, 19 bp, Homo sapiens
ccagatataactgtcttgt

SEQ ID NO: 1173847 - DNA, 20 bp, Homo sapiens
ccagatataactgtcttgtt

SEQ ID NO: 1173848 - DNA, 22 bp, Homo sapiens
ccagatatccacataaatgctc

SEQ ID NO: 1173849 - DNA, 22 bp, Homo sapiens
ccagatatgaacagggcccagg

SEQ ID NO: 1173850 - DNA, 16 bp, Homo sapiens
ccagatcactgccaca

SEQ ID NO: 1173851 - DNA, 20 bp, Homo sapiens
ccagatcactgccacactct

SEQ ID NO: 1173852 - DNA, 13 bp, Homo sapiens
ccagatccaccct

SEQ ID NO: 1173853 - DNA, 18 bp, Homo sapiens
ccagatccagactgtaag

SEQ ID NO: 1173854 - DNA, 12 bp, Homo sapiens
ccagatcctggg

SEQ ID NO: 1173855 - DNA, 18 bp, Homo sapiens
ccagatctgcctgggcct

SEQ ID NO: 1173856 - DNA, 17 bp, Homo sapiens
ccagatctggaatgcca

SEQ ID NO: 1173857 - DNA, 19 bp, Homo sapiens
ccagatctggtcccttgca

SEQ ID NO: 1173858 - DNA, 17 bp, Homo sapiens
ccagatctgtctccaag

SEQ ID NO: 1173859 - DNA, 14 bp, Homo sapiens
ccagatctttctct

SEQ ID NO: 1173860 - DNA, 21 bp, Homo sapiens
ccagatctttctcttccctga

SEQ ID NO: 1173861 - DNA, 22 bp, Homo sapiens
ccagatctttctcttccctgaa

SEQ ID NO: 1173862 - DNA, 21 bp, Homo sapiens
ccagatgattttcctccctgg

SEQ ID NO: 1173863 - DNA, 18 bp, Homo sapiens
ccagatgcacatccctgg

SEQ ID NO: 1173864 - DNA, 18 bp, Homo sapiens
ccagatgcagggcagtca

SEQ ID NO: 1173865 - DNA, 13 bp, Homo sapiens
ccagatgctgtca

SEQ ID NO: 1173866 - DNA, 16 bp, Homo sapiens
ccagatggaacactgg

SEQ ID NO: 1173867 - DNA, 22 bp, Homo sapiens
ccagatggctggaaggggtcca

SEQ ID NO: 1173868 - DNA, 20 bp, Homo sapiens
ccagatggcttcggagggcc

SEQ ID NO: 1173869 - DNA, 13 bp, Homo sapiens
ccagatgtggcta

SEQ ID NO: 1173870 - DNA, 21 bp, Homo sapiens
ccagatgtgtcccccccaggc

SEQ ID NO: 1173871 - DNA, 23 bp, Homo sapiens
ccagatgtttccagacttccttg

SEQ ID NO: 1173872 - DNA, 19 bp, Homo sapiens
ccagatgttttacgtctgg

SEQ ID NO: 1173873 - DNA, 17 bp, Homo sapiens
ccagattcccctgtgtc

SEQ ID NO: 1173874 - DNA, 20 bp, Homo sapiens
ccagattctatcctcatctt

SEQ ID NO: 1173875 - DNA, 13 bp, Homo sapiens
ccagattctgatg

SEQ ID NO: 1173876 - DNA, 15 bp, Homo sapiens
ccagattctgcctct

SEQ ID NO: 1173877 - DNA, 16 bp, Homo sapiens
ccagattctgcctctc

SEQ ID NO: 1173878 - DNA, 19 bp, Homo sapiens
ccagattctgcctctctgg

SEQ ID NO: 1173879 - DNA, 12 bp, Homo sapiens
ccagattcttca

SEQ ID NO: 1173880 - DNA, 21 bp, Homo sapiens
ccagattgacgacaagtgctg

SEQ ID NO: 1173881 - DNA, 15 bp, Homo sapiens
ccagattgtggggtg

SEQ ID NO: 1173882 - DNA, 23 bp, Homo sapiens
ccagatttggggtataggtctca

SEQ ID NO: 1173883 - DNA, 15 bp, Homo sapiens
ccagattttgctgta

SEQ ID NO: 1173884 - DNA, 18 bp, Homo sapiens
ccagattttgctgtatat

SEQ ID NO: 1173885 - DNA, 23 bp, Homo sapiens
ccagcaaaatggaagcaaagaca

SEQ ID NO: 1173886 - DNA, 15 bp, Homo sapiens
ccagcaaacagctga

SEQ ID NO: 1173887 - DNA, 21 bp, Homo sapiens
ccagcaaagagtgggctgcat

SEQ ID NO: 1173888 - DNA, 15 bp, Homo sapiens
ccagcaacacaagct

SEQ ID NO: 1173889 - DNA, 22 bp, Homo sapiens
ccagcaacactccggtcagccc

SEQ ID NO: 1173890 - DNA, 23 bp, Homo sapiens
ccagcaacactccggtcagcccc

SEQ ID NO: 1173891 - DNA, 22 bp, Homo sapiens
ccagcaacatctcgagccccct

SEQ ID NO: 1173892 - DNA, 16 bp, Homo sapiens
atagaatagcctgagg

SEQ ID NO: 1173893 - DNA, 13 bp, Homo sapiens
atagaatatttat

SEQ ID NO: 1173894 - DNA, 13 bp, Homo sapiens
atagaatgacagt

SEQ ID NO: 1173895 - DNA, 13 bp, Homo sapiens
atagaattgacat

SEQ ID NO: 1173896 - DNA, 16 bp, Homo sapiens
atagacaaaaagtata

SEQ ID NO: 1173897 - DNA, 16 bp, Homo sapiens
atagacaaatagaaaa

SEQ ID NO: 1173898 - DNA, 15 bp, Homo sapiens
atagacacatcaaat

SEQ ID NO: 1173899 - DNA, 18 bp, Homo sapiens
atagacagaagaaacaag

SEQ ID NO: 1173900 - DNA, 15 bp, Homo sapiens
atagacagcatgaga

SEQ ID NO: 1173901 - DNA, 20 bp, Homo sapiens
atagacagtatatttatagt

SEQ ID NO: 1173902 - DNA, 15 bp, Homo sapiens
atagacattctcaca

SEQ ID NO: 1173903 - DNA, 15 bp, Homo sapiens
atagaccaaagcaaa

SEQ ID NO: 1173904 - DNA, 22 bp, Homo sapiens
atagaccttttttttttttcca

SEQ ID NO: 1173905 - DNA, 19 bp, Homo sapiens
atagacgagttgatttcct

SEQ ID NO: 1173906 - DNA, 19 bp, Homo sapiens
atagactgtaacttccaaa

SEQ ID NO: 1173907 - DNA, 18 bp, Homo sapiens
atagacttctcttacatt

SEQ ID NO: 1173908 - DNA, 21 bp, Homo sapiens
atagacttctcttacattttc

SEQ ID NO: 1173909 - DNA, 12 bp, Homo sapiens
atagacttggga

SEQ ID NO: 1173910 - DNA, 14 bp, Homo sapiens
atagacttgggatg

SEQ ID NO: 1173911 - DNA, 14 bp, Homo sapiens
atagagaatttaag

SEQ ID NO: 1173912 - DNA, 21 bp, Homo sapiens
atagagacaggacagaatgtg

SEQ ID NO: 1173913 - DNA, 14 bp, Homo sapiens
atagagacgggact

SEQ ID NO: 1173914 - DNA, 15 bp, Homo sapiens
atagagattgtacat

SEQ ID NO: 1173915 - DNA, 13 bp, Homo sapiens
atagagcaaaatc

SEQ ID NO: 1173916 - DNA, 18 bp, Homo sapiens
atagagcaaaatcaacat

SEQ ID NO: 1173917 - DNA, 22 bp, Homo sapiens
atagagcaaaatcaacatgact

SEQ ID NO: 1173918 - DNA, 21 bp, Homo sapiens
atagagccaactgattttgta

SEQ ID NO: 1173919 - DNA, 15 bp, Homo sapiens
atagagcccctcctg

SEQ ID NO: 1173920 - DNA, 11 bp, Homo sapiens
atagagcctcg

SEQ ID NO: 1173921 - DNA, 13 bp, Homo sapiens
atagagcctgagg

SEQ ID NO: 1173922 - DNA, 15 bp, Homo sapiens
atagagcctgaggga

SEQ ID NO: 1173923 - DNA, 22 bp, Homo sapiens
atagagctgcagggtggattgt

SEQ ID NO: 1173924 - DNA, 12 bp, Homo sapiens
atagagctgcca

SEQ ID NO: 1173925 - DNA, 13 bp, Homo sapiens
atagagctgccac

SEQ ID NO: 1173926 - DNA, 16 bp, Homo sapiens
atagaggcattacttg

SEQ ID NO: 1173927 - DNA, 12 bp, Homo sapiens
atagaggctagc

SEQ ID NO: 1173928 - DNA, 19 bp, Homo sapiens
atagaggctagcttctgct

SEQ ID NO: 1173929 - DNA, 18 bp, Homo sapiens
atagaggcttctccgcca

SEQ ID NO: 1173930 - DNA, 22 bp, Homo sapiens
atagaggcttctccgccagcct

SEQ ID NO: 1173931 - DNA, 16 bp, Homo sapiens
atagaggtaccagcaa

SEQ ID NO: 1173932 - DNA, 15 bp, Homo sapiens
atagagtatatgcac

SEQ ID NO: 1173933 - DNA, 16 bp, Homo sapiens
atagagtttaacacaa

SEQ ID NO: 1173934 - DNA, 19 bp, Homo sapiens
atagagtttggtgtcaact

SEQ ID NO: 1173935 - DNA, 18 bp, Homo sapiens
atagatcagccattaaaa

SEQ ID NO: 1173936 - DNA, 19 bp, Homo sapiens
atagatcagccattaaaat

SEQ ID NO: 1173937 - DNA, 21 bp, Homo sapiens
atagatcagccattaaaataa

SEQ ID NO: 1173938 - DNA, 22 bp, Homo sapiens
atagatcagccattaaaataaa

SEQ ID NO: 1173939 - DNA, 16 bp, Homo sapiens
atagatcagtatttca

SEQ ID NO: 1173940 - DNA, 15 bp, Homo sapiens
atagatcctgagctc

SEQ ID NO: 1173941 - DNA, 12 bp, Homo sapiens
atagatcttctg

SEQ ID NO: 1173942 - DNA, 18 bp, Homo sapiens
atagatgataaaagagaa

SEQ ID NO: 1173943 - DNA, 13 bp, Homo sapiens
atagatgggtctg

SEQ ID NO: 1173944 - DNA, 22 bp, Homo sapiens
atagatgggtctggctgagctg

SEQ ID NO: 1173945 - DNA, 18 bp, Homo sapiens
atagatgtctaggtactt

SEQ ID NO: 1173946 - DNA, 16 bp, Homo sapiens
atagattattataaac

SEQ ID NO: 1173947 - DNA, 21 bp, Homo sapiens
atagattattataaactataa

SEQ ID NO: 1173948 - DNA, 23 bp, Homo sapiens
atagattcacctgtaaaacttta

SEQ ID NO: 1173949 - DNA, 20 bp, Homo sapiens
atagattgtccttttgcaaa

SEQ ID NO: 1173950 - DNA, 14 bp, Homo sapiens
atagattgttttgc

SEQ ID NO: 1173951 - DNA, 20 bp, Homo sapiens
atagatttagttttgtaact

SEQ ID NO: 1173952 - DNA, 21 bp, Homo sapiens
atagatttagttttgtaactt

SEQ ID NO: 1173953 - DNA, 13 bp, Homo sapiens
atagatttgaaaa

SEQ ID NO: 1173954 - DNA, 16 bp, Homo sapiens
atagattttctctgga

SEQ ID NO: 1173955 - DNA, 19 bp, Homo sapiens
ccagcagcctggaccctgt

SEQ ID NO: 1173956 - DNA, 19 bp, Homo sapiens
ccagcagcgcctttcccaa

SEQ ID NO: 1173957 - DNA, 15 bp, Homo sapiens
ccagcagctgcaccc

SEQ ID NO: 1173958 - DNA, 23 bp, Homo sapiens
ccagcagctgcgggtctgaagga

SEQ ID NO: 1173959 - DNA, 24 bp, Homo sapiens
ccagcagctgcgggtctgaaggaa

SEQ ID NO: 1173960 - DNA, 19 bp, Homo sapiens
ccagcaggaaggaccccac

SEQ ID NO: 1173961 - DNA, 15 bp, Homo sapiens
ccagcaggaatttct

SEQ ID NO: 1173962 - DNA, 21 bp, Homo sapiens
ccagcaggaggttctgggcct

SEQ ID NO: 1173963 - DNA, 23 bp, Homo sapiens
ccagcaggcagagtggcgtggcc

SEQ ID NO: 1173964 - DNA, 13 bp, Homo sapiens
ccagcaggcaggc

SEQ ID NO: 1173965 - DNA, 22 bp, Homo sapiens
ccagcaggcaggcactgtggcc

SEQ ID NO: 1173966 - DNA, 23 bp, Homo sapiens
ccagcaggcaggcactgtggccc

SEQ ID NO: 1173967 - DNA, 20 bp, Homo sapiens
ccagcaggccagggactcag

SEQ ID NO: 1173968 - DNA, 13 bp, Homo sapiens
ccagcaggcccag

SEQ ID NO: 1173969 - DNA, 16 bp, Homo sapiens
ccagcaggcccagcat

SEQ ID NO: 1173970 - DNA, 23 bp, Homo sapiens
ccagcaggccggatcggtactgt

SEQ ID NO: 1173971 - DNA, 23 bp, Homo sapiens
ccagcaggcgtcaccatccacct

SEQ ID NO: 1173972 - DNA, 23 bp, Homo sapiens
ccagcaggctcctggctgtgccc

SEQ ID NO: 1173973 - DNA, 16 bp, Homo sapiens
ccagcaggggggctgt

SEQ ID NO: 1173974 - DNA, 23 bp, Homo sapiens
ccagcaggggggctgtgccaacc

SEQ ID NO: 1173975 - DNA, 20 bp, Homo sapiens
ccagcagtgaaacttgtgct

SEQ ID NO: 1173976 - DNA, 22 bp, Homo sapiens
ccagcagttgaatgacaacaga

SEQ ID NO: 1173977 - DNA, 22 bp, Homo sapiens
ccagcagttttcaagtcaaatt

SEQ ID NO: 1173978 - DNA, 14 bp, Homo sapiens
ccagcatacagttt

SEQ ID NO: 1173979 - DNA, 18 bp, Homo sapiens
ccagcataggggggaggg

SEQ ID NO: 1173980 - DNA, 13 bp, Homo sapiens
ccagcatccagcc

SEQ ID NO: 1173981 - DNA, 14 bp, Homo sapiens
ccagcatccagcct

SEQ ID NO: 1173982 - DNA, 15 bp, Homo sapiens
ccagcatccagcctg

SEQ ID NO: 1173983 - DNA, 16 bp, Homo sapiens
ccagcatccagcctgt

SEQ ID NO: 1173984 - DNA, 14 bp, Homo sapiens
ccagcatccctgga

SEQ ID NO: 1173985 - DNA, 18 bp, Homo sapiens
ccagcatcgggggcctgc

SEQ ID NO: 1173986 - DNA, 20 bp, Homo sapiens
ccagcatcgggggcctgcaa

SEQ ID NO: 1173987 - DNA, 18 bp, Homo sapiens
ccagcatctcagcgccag

SEQ ID NO: 1173988 - DNA, 18 bp, Homo sapiens
ccagcatctggaagatgt

SEQ ID NO: 1173989 - DNA, 14 bp, Homo sapiens
ccagcatctggtct

SEQ ID NO: 1173990 - DNA, 19 bp, Homo sapiens
ccagcatctggtcttgttt

SEQ ID NO: 1173991 - DNA, 14 bp, Homo sapiens
ccagcattccagcc

SEQ ID NO: 1173992 - DNA, 18 bp, Homo sapiens
ccagcattccagcccctc

SEQ ID NO: 1173993 - DNA, 22 bp, Homo sapiens
ccagcattccagcccctctggt

SEQ ID NO: 1173994 - DNA, 14 bp, Homo sapiens
ccagcattccagct

SEQ ID NO: 1173995 - DNA, 23 bp, Homo sapiens
ccagcattccagctctgcccccg

SEQ ID NO: 1173996 - DNA, 14 bp, Homo sapiens
ccagcattccctac

SEQ ID NO: 1173997 - DNA, 13 bp, Homo sapiens
ccagcatttgtcc

SEQ ID NO: 1173998 - DNA, 18 bp, Homo sapiens
ccagccaaaccctgtctg

SEQ ID NO: 1173999 - DNA, 22 bp, Homo sapiens
ccagccaccaccctcaggtgcc

SEQ ID NO: 1174000 - DNA, 13 bp, Homo sapiens
ccagccaccccgg

SEQ ID NO: 1174001 - DNA, 17 bp, Homo sapiens
ccagccacccctcagat

SEQ ID NO: 1174002 - DNA, 22 bp, Homo sapiens
ccagccacccctgccactcacc

SEQ ID NO: 1174003 - DNA, 20 bp, Homo sapiens
ccagccacggagggaggcac

SEQ ID NO: 1174004 - DNA, 21 bp, Homo sapiens
ccagccacggagggaggcacc

SEQ ID NO: 1174005 - DNA, 19 bp, Homo sapiens
ccagccactccaagccccc

SEQ ID NO: 1174006 - DNA, 21 bp, Homo sapiens
ccagccactcgggaggctgag

SEQ ID NO: 1174007 - DNA, 14 bp, Homo sapiens
ccagccactgccaa

SEQ ID NO: 1174008 - DNA, 17 bp, Homo sapiens
ccagccactgccaagct

SEQ ID NO: 1174009 - DNA, 17 bp, Homo sapiens
ccagccacttgactggc

SEQ ID NO: 1174010 - DNA, 22 bp, Homo sapiens
ccagccagcaatgatgtccaga

SEQ ID NO: 1174011 - DNA, 22 bp, Homo sapiens
ccagccagcagcagcccaagct

SEQ ID NO: 1174012 - DNA, 16 bp, Homo sapiens
ccagccagcagccagc

SEQ ID NO: 1174013 - DNA, 19 bp, Homo sapiens
ccagccagcagccagctct

SEQ ID NO: 1174014 - DNA, 23 bp, Homo sapiens
ccagccagcagccagctctcagc

SEQ ID NO: 1174015 - DNA, 16 bp, Homo sapiens
ccagccagccacccct

SEQ ID NO: 1174016 - DNA, 12 bp, Homo sapiens
ccagccagcccg

SEQ ID NO: 1174017 - DNA, 13 bp, Homo sapiens
ccagccagccctg

SEQ ID NO: 1174018 - DNA, 14 bp, Homo sapiens
ccagccagccctgg

SEQ ID NO: 1174019 - DNA, 18 bp, Homo sapiens
atagcctggccaccagcc

SEQ ID NO: 1174020 - DNA, 23 bp, Homo sapiens
atagcctggccaccagccatcct

SEQ ID NO: 1174021 - DNA, 14 bp, Homo sapiens
atagcgtcctgccc

SEQ ID NO: 1174022 - DNA, 16 bp, Homo sapiens
atagcgtcctgccctg

SEQ ID NO: 1174023 - DNA, 18 bp, Homo sapiens
atagcgtcctgccctgcc

SEQ ID NO: 1174024 - DNA, 12 bp, Homo sapiens
atagcgtgtgta

SEQ ID NO: 1174025 - DNA, 13 bp, Homo sapiens
atagctaaatacc

SEQ ID NO: 1174026 - DNA, 14 bp, Homo sapiens
atagctaactgtaa

SEQ ID NO: 1174027 - DNA, 16 bp, Homo sapiens
atagctaactgtaaat

SEQ ID NO: 1174028 - DNA, 17 bp, Homo sapiens
atagctaactgtaaatc

SEQ ID NO: 1174029 - DNA, 15 bp, Homo sapiens
atagctaagtacaca

SEQ ID NO: 1174030 - DNA, 15 bp, Homo sapiens
atagctacaggaagc

SEQ ID NO: 1174031 - DNA, 16 bp, Homo sapiens
atagctactaaatata

SEQ ID NO: 1174032 - DNA, 23 bp, Homo sapiens
atagctccccgcttctgcctgca

SEQ ID NO: 1174033 - DNA, 12 bp, Homo sapiens
atagctctgggg

SEQ ID NO: 1174034 - DNA, 22 bp, Homo sapiens
atagctctggggtgggcagttt

SEQ ID NO: 1174035 - DNA, 23 bp, Homo sapiens
atagctgaaaactaatgtactgt

SEQ ID NO: 1174036 - DNA, 21 bp, Homo sapiens
atagctgagattcctggttcg

SEQ ID NO: 1174037 - DNA, 12 bp, Homo sapiens
atagctggggct

SEQ ID NO: 1174038 - DNA, 18 bp, Homo sapiens
atagctgtacaaatataa

SEQ ID NO: 1174039 - DNA, 15 bp, Homo sapiens
atagctgtacttctt

SEQ ID NO: 1174040 - DNA, 22 bp, Homo sapiens
atagctgtacttcttgaatata

SEQ ID NO: 1174041 - DNA, 16 bp, Homo sapiens
atagctgtttcaaatg

SEQ ID NO: 1174042 - DNA, 21 bp, Homo sapiens
atagctgttttagctgaggga

SEQ ID NO: 1174043 - DNA, 16 bp, Homo sapiens
atagctgttttgtgta

SEQ ID NO: 1174044 - DNA, 19 bp, Homo sapiens
atagctgttttgtgtatat

SEQ ID NO: 1174045 - DNA, 20 bp, Homo sapiens
atagcttaactaatttgaat

SEQ ID NO: 1174046 - DNA, 22 bp, Homo sapiens
atagcttacaagccagctggag

SEQ ID NO: 1174047 - DNA, 17 bp, Homo sapiens
atagcttgtatagtgta

SEQ ID NO: 1174048 - DNA, 19 bp, Homo sapiens
atagctttactgtttctca

SEQ ID NO: 1174049 - DNA, 10 bp, Homo sapiens
atagctttat

SEQ ID NO: 1174050 - DNA, 15 bp, Homo sapiens
atagctttatactct

SEQ ID NO: 1174051 - DNA, 18 bp, Homo sapiens
atagctttattttttaag

SEQ ID NO: 1174052 - DNA, 23 bp, Homo sapiens
atagctttattttttaagtattt

SEQ ID NO: 1174053 - DNA, 18 bp, Homo sapiens
ataggaaaagtacattta

SEQ ID NO: 1174054 - DNA, 19 bp, Homo sapiens
ataggaaaagtacatttaa

SEQ ID NO: 1174055 - DNA, 19 bp, Homo sapiens
ataggaaactaagcattgt

SEQ ID NO: 1174056 - DNA, 19 bp, Homo sapiens
ataggaacttaaataatgt

SEQ ID NO: 1174057 - DNA, 17 bp, Homo sapiens
ataggaagacataaaac

SEQ ID NO: 1174058 - DNA, 16 bp, Homo sapiens
ataggaagcgtctggc

SEQ ID NO: 1174059 - DNA, 18 bp, Homo sapiens
ataggaagggatctgaga

SEQ ID NO: 1174060 - DNA, 13 bp, Homo sapiens
ataggaagtggct

SEQ ID NO: 1174061 - DNA, 19 bp, Homo sapiens
ataggaagtggctggtctg

SEQ ID NO: 1174062 - DNA, 19 bp, Homo sapiens
ataggaatagaggaagaaa

SEQ ID NO: 1174063 - DNA, 12 bp, Homo sapiens
ataggaatttgt

SEQ ID NO: 1174064 - DNA, 14 bp, Homo sapiens
ataggacctttcca

SEQ ID NO: 1174065 - DNA, 19 bp, Homo sapiens
ataggactaccgcaggccc

SEQ ID NO: 1174066 - DNA, 20 bp, Homo sapiens
ataggactccatttctttct

SEQ ID NO: 1174067 - DNA, 23 bp, Homo sapiens
ataggactccatttctttcttcc

SEQ ID NO: 1174068 - DNA, 12 bp, Homo sapiens
ataggagactgc

SEQ ID NO: 1174069 - DNA, 20 bp, Homo sapiens
ataggagagattgggagaaa

SEQ ID NO: 1174070 - DNA, 19 bp, Homo sapiens
ataggagcttaagaaagaa

SEQ ID NO: 1174071 - DNA, 21 bp, Homo sapiens
ataggagggggcggcagggct

SEQ ID NO: 1174072 - DNA, 19 bp, Homo sapiens
ataggagtgagtgtatgtg

SEQ ID NO: 1174073 - DNA, 22 bp, Homo sapiens
ataggagtgagtgtatgtgtgt

SEQ ID NO: 1174074 - DNA, 14 bp, Homo sapiens
ataggattaaacac

SEQ ID NO: 1174075 - DNA, 19 bp, Homo sapiens
ataggattgcttcaattaa

SEQ ID NO: 1174076 - DNA, 18 bp, Homo sapiens
ccagcccccgccccagag

SEQ ID NO: 1174077 - DNA, 19 bp, Homo sapiens
ccagccccctccagctcat

SEQ ID NO: 1174078 - DNA, 16 bp, Homo sapiens
ccagccccgactccag

SEQ ID NO: 1174079 - DNA, 19 bp, Homo sapiens
ccagccccgactccagcca

SEQ ID NO: 1174080 - DNA, 21 bp, Homo sapiens
ccagccccggcaagccacagg

SEQ ID NO: 1174081 - DNA, 18 bp, Homo sapiens
ccagccccggccttgctt

SEQ ID NO: 1174082 - DNA, 22 bp, Homo sapiens
ccagcccctagaaacccaagct

SEQ ID NO: 1174083 - DNA, 23 bp, Homo sapiens
ccagcccctagaaacccaagctc

SEQ ID NO: 1174084 - DNA, 21 bp, Homo sapiens
ccagcccctcccaccacagca

SEQ ID NO: 1174085 - DNA, 21 bp, Homo sapiens
ccagcccctctcccctctctg

SEQ ID NO: 1174086 - DNA, 15 bp, Homo sapiens
ccagcccctctggtc

SEQ ID NO: 1174087 - DNA, 15 bp, Homo sapiens
ccagcccctcttccc

SEQ ID NO: 1174088 - DNA, 10 bp, Homo sapiens
ccagcccctg

SEQ ID NO: 1174089 - DNA, 14 bp, Homo sapiens
ccagcccctggacc

SEQ ID NO: 1174090 - DNA, 21 bp, Homo sapiens
ccagcccctggacccctgggg

SEQ ID NO: 1174091 - DNA, 15 bp, Homo sapiens
ccagcccctggggcc

SEQ ID NO: 1174092 - DNA, 12 bp, Homo sapiens
ccagccccttcc

SEQ ID NO: 1174093 - DNA, 15 bp, Homo sapiens
ccagcccggcctgct

SEQ ID NO: 1174094 - DNA, 22 bp, Homo sapiens
ccagcccgggagcctaggacca

SEQ ID NO: 1174095 - DNA, 16 bp, Homo sapiens
ccagccctactcctgc

SEQ ID NO: 1174096 - DNA, 17 bp, Homo sapiens
ccagccctagctgtccc

SEQ ID NO: 1174097 - DNA, 18 bp, Homo sapiens
ccagccctagctgtccca

SEQ ID NO: 1174098 - DNA, 15 bp, Homo sapiens
ccagccctatggatg

SEQ ID NO: 1174099 - DNA, 15 bp, Homo sapiens
ccagccctcagtcac

SEQ ID NO: 1174100 - DNA, 19 bp, Homo sapiens
ccagccctcagtcaccccc

SEQ ID NO: 1174101 - DNA, 13 bp, Homo sapiens
ccagccctcatcc

SEQ ID NO: 1174102 - DNA, 14 bp, Homo sapiens
ccagccctcatccc

SEQ ID NO: 1174103 - DNA, 20 bp, Homo sapiens
ccagccctccccatggagcc

SEQ ID NO: 1174104 - DNA, 16 bp, Homo sapiens
ccagccctccctgtcc

SEQ ID NO: 1174105 - DNA, 18 bp, Homo sapiens
ccagccctccctgtcctc

SEQ ID NO: 1174106 - DNA, 19 bp, Homo sapiens
ccagccctccctgtcctcc

SEQ ID NO: 1174107 - DNA, 21 bp, Homo sapiens
ccagccctccctgtcctcctc

SEQ ID NO: 1174108 - DNA, 22 bp, Homo sapiens
ccagccctccctgtcctcctcg

SEQ ID NO: 1174109 - DNA, 15 bp, Homo sapiens
ccagccctccttcag

SEQ ID NO: 1174110 - DNA, 14 bp, Homo sapiens
ccagccctgcagcc

SEQ ID NO: 1174111 - DNA, 16 bp, Homo sapiens
ccagccctgctgggga

SEQ ID NO: 1174112 - DNA, 19 bp, Homo sapiens
ccagccctgctggggatcc

SEQ ID NO: 1174113 - DNA, 13 bp, Homo sapiens
ccagccctggctc

SEQ ID NO: 1174114 - DNA, 17 bp, Homo sapiens
ccagccctggctctgca

SEQ ID NO: 1174115 - DNA, 19 bp, Homo sapiens
ccagccctggttctggctg

SEQ ID NO: 1174116 - DNA, 14 bp, Homo sapiens
ccagccctgtcctg

SEQ ID NO: 1174117 - DNA, 14 bp, Homo sapiens
ccagccctgtggaa

SEQ ID NO: 1174118 - DNA, 15 bp, Homo sapiens
ccagccctgtggaag

SEQ ID NO: 1174119 - DNA, 16 bp, Homo sapiens
ccagcccttagcacag

SEQ ID NO: 1174120 - DNA, 22 bp, Homo sapiens
ccagcccttagcacagagaggg

SEQ ID NO: 1174121 - DNA, 23 bp, Homo sapiens
ccagcccttagcacagagaggga

SEQ ID NO: 1174122 - DNA, 14 bp, Homo sapiens
ccagcccttccttg

SEQ ID NO: 1174123 - DNA, 14 bp, Homo sapiens
ccagccgaccctcc

SEQ ID NO: 1174124 - DNA, 15 bp, Homo sapiens
ccagccgaccctcct

SEQ ID NO: 1174125 - DNA, 16 bp, Homo sapiens
ccagccgaccctcctg

SEQ ID NO: 1174126 - DNA, 14 bp, Homo sapiens
ccagccgcccaccc

SEQ ID NO: 1174127 - DNA, 15 bp, Homo sapiens
ccagccgccccagcc

SEQ ID NO: 1174128 - DNA, 16 bp, Homo sapiens
ccagccgccccagccc

SEQ ID NO: 1174129 - DNA, 14 bp, Homo sapiens
ccagccgccctggg

SEQ ID NO: 1174130 - DNA, 20 bp, Homo sapiens
ccagccgctgcagggctccc

SEQ ID NO: 1174131 - DNA, 23 bp, Homo sapiens
ccagccgctgcagggctcccatg

SEQ ID NO: 1174132 - DNA, 17 bp, Homo sapiens
ccagccggccaatggaa

SEQ ID NO: 1174133 - DNA, 19 bp, Homo sapiens
ccagccggccaatggaaac

SEQ ID NO: 1174134 - DNA, 22 bp, Homo sapiens
ccagccggccaatggaaacctc

SEQ ID NO: 1174135 - DNA, 13 bp, Homo sapiens
ccagccggcctct

SEQ ID NO: 1174136 - DNA, 18 bp, Homo sapiens
ccagccgtgatgctcagg

SEQ ID NO: 1174137 - DNA, 19 bp, Homo sapiens
ccagccgtgatgctcaggc

SEQ ID NO: 1174138 - DNA, 21 bp, Homo sapiens
ccagccgtgatgctcaggctt

SEQ ID NO: 1174139 - DNA, 18 bp, Homo sapiens
ccagcctacccttcctgc

SEQ ID NO: 1174140 - DNA, 19 bp, Homo sapiens
ccagcctaggtggaggcaa

SEQ ID NO: 1174141 - DNA, 23 bp, Homo sapiens
ccagcctatgagcatcctgagcc

SEQ ID NO: 1174142 - DNA, 13 bp, Homo sapiens
ccagcctcagccc

SEQ ID NO: 1174143 - DNA, 15 bp, Homo sapiens
ccagcctcagcccaa

SEQ ID NO: 1174144 - DNA, 15 bp, Homo sapiens
ccagcctcagtgcca

SEQ ID NO: 1174145 - DNA, 17 bp, Homo sapiens
ccagcctcagtgccact

SEQ ID NO: 1174146 - DNA, 17 bp, Homo sapiens
atagtagttaaataact

SEQ ID NO: 1174147 - DNA, 18 bp, Homo sapiens
atagtagttaaataactg

SEQ ID NO: 1174148 - DNA, 15 bp, Homo sapiens
atagtatatttatac

SEQ ID NO: 1174149 - DNA, 20 bp, Homo sapiens
atagtatgagggttgaagac

SEQ ID NO: 1174150 - DNA, 19 bp, Homo sapiens
atagtatgggaaaaaaact

SEQ ID NO: 1174151 - DNA, 22 bp, Homo sapiens
atagtatgtgacttttctgatt

SEQ ID NO: 1174152 - DNA, 22 bp, Homo sapiens
atagtattggagcacatgttac

SEQ ID NO: 1174153 - DNA, 17 bp, Homo sapiens
atagtcctttttccaat

SEQ ID NO: 1174154 - DNA, 20 bp, Homo sapiens
atagtctagatggctcctct

SEQ ID NO: 1174155 - DNA, 18 bp, Homo sapiens
atagtcttagtaatagca

SEQ ID NO: 1174156 - DNA, 17 bp, Homo sapiens
atagtcttttgcatgtc

SEQ ID NO: 1174157 - DNA, 15 bp, Homo sapiens
atagtgaatacttac

SEQ ID NO: 1174158 - DNA, 19 bp, Homo sapiens
atagtgcaaaactgtgtca

SEQ ID NO: 1174159 - DNA, 18 bp, Homo sapiens
atagtgcaacatctctga

SEQ ID NO: 1174160 - DNA, 12 bp, Homo sapiens
atagtgcctttt

SEQ ID NO: 1174161 - DNA, 20 bp, Homo sapiens
atagtgctgggatggagggg

SEQ ID NO: 1174162 - DNA, 18 bp, Homo sapiens
atagtgctgtttaagcta

SEQ ID NO: 1174163 - DNA, 18 bp, Homo sapiens
atagtggaccacttggaa

SEQ ID NO: 1174164 - DNA, 16 bp, Homo sapiens
atagtggggagacttc

SEQ ID NO: 1174165 - DNA, 16 bp, Homo sapiens
atagtgtaagaactgt

SEQ ID NO: 1174166 - DNA, 17 bp, Homo sapiens
atagtgtaagaactgta

SEQ ID NO: 1174167 - DNA, 13 bp, Homo sapiens
atagtgtaataat

SEQ ID NO: 1174168 - DNA, 19 bp, Homo sapiens
atagtgtaataatgttatt

SEQ ID NO: 1174169 - DNA, 18 bp, Homo sapiens
atagtgtataccacctgt

SEQ ID NO: 1174170 - DNA, 19 bp, Homo sapiens
atagtgtataccacctgta

SEQ ID NO: 1174171 - DNA, 21 bp, Homo sapiens
atagtgtataccacctgtaca

SEQ ID NO: 1174172 - DNA, 21 bp, Homo sapiens
atagtgtcatataaactcatt

SEQ ID NO: 1174173 - DNA, 15 bp, Homo sapiens
atagtgtgaaatata

SEQ ID NO: 1174174 - DNA, 14 bp, Homo sapiens
atagtgtgttctga

SEQ ID NO: 1174175 - DNA, 17 bp, Homo sapiens
atagtgtgttctgatta

SEQ ID NO: 1174176 - DNA, 22 bp, Homo sapiens
atagtgtgttgtgctttcaaga

SEQ ID NO: 1174177 - DNA, 20 bp, Homo sapiens
atagtgttcacaaactgtga

SEQ ID NO: 1174178 - DNA, 22 bp, Homo sapiens
atagtgttctgcaaaaatattt

SEQ ID NO: 1174179 - DNA, 18 bp, Homo sapiens
atagtgttctgctcctgc

SEQ ID NO: 1174180 - DNA, 23 bp, Homo sapiens
atagtgttctgctcctgcttttc

SEQ ID NO: 1174181 - DNA, 16 bp, Homo sapiens
atagtgtttaactggc

SEQ ID NO: 1174182 - DNA, 19 bp, Homo sapiens
atagtgtttaactggcatg

SEQ ID NO: 1174183 - DNA, 14 bp, Homo sapiens
atagttaacacact

SEQ ID NO: 1174184 - DNA, 17 bp, Homo sapiens
atagttaacacactacc

SEQ ID NO: 1174185 - DNA, 22 bp, Homo sapiens
atagttaagcgtgcataagtta

SEQ ID NO: 1174186 - DNA, 18 bp, Homo sapiens
atagttactgtgtaatta

SEQ ID NO: 1174187 - DNA, 14 bp, Homo sapiens
atagttagccctca

SEQ ID NO: 1174188 - DNA, 14 bp, Homo sapiens
atagttcaccccct

SEQ ID NO: 1174189 - DNA, 19 bp, Homo sapiens
atagttcactgacacagta

SEQ ID NO: 1174190 - DNA, 22 bp, Homo sapiens
atagttccttgccttaataaat

SEQ ID NO: 1174191 - DNA, 19 bp, Homo sapiens
atagttgaagggaggtgaa

SEQ ID NO: 1174192 - DNA, 21 bp, Homo sapiens
atagttgcatagcagtatatg

SEQ ID NO: 1174193 - DNA, 18 bp, Homo sapiens
atagttgtagacaaagta

SEQ ID NO: 1174194 - DNA, 15 bp, Homo sapiens
atagtttaggaaaat

SEQ ID NO: 1174195 - DNA, 13 bp, Homo sapiens
atagtttatctta

SEQ ID NO: 1174196 - DNA, 13 bp, Homo sapiens
atagtttattgac

SEQ ID NO: 1174197 - DNA, 16 bp, Homo sapiens
atagtttcaaatctgt

SEQ ID NO: 1174198 - DNA, 16 bp, Homo sapiens
ccagcgagccacagga

SEQ ID NO: 1174199 - DNA, 23 bp, Homo sapiens
ccagcgccaaatgttcatcctca

SEQ ID NO: 1174200 - DNA, 14 bp, Homo sapiens
ccagcgccagggcc

SEQ ID NO: 1174201 - DNA, 22 bp, Homo sapiens
ccagcgcctagtggggtctccc

SEQ ID NO: 1174202 - DNA, 16 bp, Homo sapiens
ccagcgcctccctcca

SEQ ID NO: 1174203 - DNA, 20 bp, Homo sapiens
ccagcgcctccctccacccc

SEQ ID NO: 1174204 - DNA, 21 bp, Homo sapiens
ccagcgcctccctccacccca

SEQ ID NO: 1174205 - DNA, 19 bp, Homo sapiens
ccagcgctcgccacgctca

SEQ ID NO: 1174206 - DNA, 14 bp, Homo sapiens
ccagcgctgagtgg

SEQ ID NO: 1174207 - DNA, 15 bp, Homo sapiens
ccagcgcttctggtc

SEQ ID NO: 1174208 - DNA, 18 bp, Homo sapiens
ccagcggaaacaggtgtg

SEQ ID NO: 1174209 - DNA, 21 bp, Homo sapiens
ccagcggccccccgcacagcc

SEQ ID NO: 1174210 - DNA, 13 bp, Homo sapiens
ccagcggcccctc

SEQ ID NO: 1174211 - DNA, 15 bp, Homo sapiens
ccagcggcccctccc

SEQ ID NO: 1174212 - DNA, 15 bp, Homo sapiens
ccagcggccctgtca

SEQ ID NO: 1174213 - DNA, 16 bp, Homo sapiens
ccagcggcctcagggt

SEQ ID NO: 1174214 - DNA, 17 bp, Homo sapiens
ccagcggcctcagggtc

SEQ ID NO: 1174215 - DNA, 20 bp, Homo sapiens
ccagcggcttagccaagccc

SEQ ID NO: 1174216 - DNA, 17 bp, Homo sapiens
ccagcgggaatggcagc

SEQ ID NO: 1174217 - DNA, 12 bp, Homo sapiens
ccagcggggctg

SEQ ID NO: 1174218 - DNA, 19 bp, Homo sapiens
ccagcggtccatgggtctg

SEQ ID NO: 1174219 - DNA, 13 bp, Homo sapiens
ccagcgtcaggcc

SEQ ID NO: 1174220 - DNA, 23 bp, Homo sapiens
ccagcgtcagtttcactccctct

SEQ ID NO: 1174221 - DNA, 15 bp, Homo sapiens
ccagcgtcccagtct

SEQ ID NO: 1174222 - DNA, 21 bp, Homo sapiens
ccagcgtcccagtctctggca

SEQ ID NO: 1174223 - DNA, 17 bp, Homo sapiens
ccagcgtcctcctctgt

SEQ ID NO: 1174224 - DNA, 15 bp, Homo sapiens
ccagcgtctgcaggg

SEQ ID NO: 1174225 - DNA, 19 bp, Homo sapiens
ccagcgtctgcagggtgac

SEQ ID NO: 1174226 - DNA, 14 bp, Homo sapiens
ccagcgtggcccag

SEQ ID NO: 1174227 - DNA, 19 bp, Homo sapiens
ccagcgtggcccaggccgg

SEQ ID NO: 1174228 - DNA, 22 bp, Homo sapiens
ccagcgtggcccaggccgggaa

SEQ ID NO: 1174229 - DNA, 16 bp, Homo sapiens
ccagcgtgtggagcag

SEQ ID NO: 1174230 - DNA, 18 bp, Homo sapiens
ccagcgtgtggagcagag

SEQ ID NO: 1174231 - DNA, 22 bp, Homo sapiens
ccagcgttgggtttgctcatgt

SEQ ID NO: 1174232 - DNA, 22 bp, Homo sapiens
ccagcgtttgaggggctggcct

SEQ ID NO: 1174233 - DNA, 22 bp, Homo sapiens
ccagctaatctgtagggctgga

SEQ ID NO: 1174234 - DNA, 13 bp, Homo sapiens
ccagctacattcc

SEQ ID NO: 1174235 - DNA, 13 bp, Homo sapiens
ccagctaccacca

SEQ ID NO: 1174236 - DNA, 23 bp, Homo sapiens
ccagctaccccttctttgcaggg

SEQ ID NO: 1174237 - DNA, 21 bp, Homo sapiens
ccagctaccccttgtgggcaa

SEQ ID NO: 1174238 - DNA, 17 bp, Homo sapiens
ccagctactcagaagcc

SEQ ID NO: 1174239 - DNA, 20 bp, Homo sapiens
ccagctactcagaagcctga

SEQ ID NO: 1174240 - DNA, 13 bp, Homo sapiens
ccagctactcagg

SEQ ID NO: 1174241 - DNA, 21 bp, Homo sapiens
ccagctactcgggaggctgag

SEQ ID NO: 1174242 - DNA, 16 bp, Homo sapiens
ccagctactctgtcca

SEQ ID NO: 1174243 - DNA, 17 bp, Homo sapiens
ccagctactctgtccag

SEQ ID NO: 1174244 - DNA, 14 bp, Homo sapiens
ccagctacttggga

SEQ ID NO: 1174245 - DNA, 16 bp, Homo sapiens
ccagctacttgggaag

SEQ ID NO: 1174246 - DNA, 15 bp, Homo sapiens
ccagctacttgggag

SEQ ID NO: 1174247 - DNA, 16 bp, Homo sapiens
ccagctacttgggagc

SEQ ID NO: 1174248 - DNA, 21 bp, Homo sapiens
ccagctacttgggagcctgag

SEQ ID NO: 1174249 - DNA, 22 bp, Homo sapiens
ccagctacttgggagcctgagg

SEQ ID NO: 1174250 - DNA, 19 bp, Homo sapiens
ccagctacttgggaggctg

SEQ ID NO: 1174251 - DNA, 21 bp, Homo sapiens
ccagctagtgccaaataattg

SEQ ID NO: 1174252 - DNA, 15 bp, Homo sapiens
ccagctatctgtcat

SEQ ID NO: 1174253 - DNA, 16 bp, Homo sapiens
ccagctatctttcttg

SEQ ID NO: 1174254 - DNA, 15 bp, Homo sapiens
ccagctcagaaccca

SEQ ID NO: 1174255 - DNA, 19 bp, Homo sapiens
ccagctcagaacccagggc

SEQ ID NO: 1174256 - DNA, 21 bp, Homo sapiens
ccagctcagaacccagggctc

SEQ ID NO: 1174257 - DNA, 15 bp, Homo sapiens
ccagctcagccctgg

SEQ ID NO: 1174258 - DNA, 12 bp, Homo sapiens
ccagctcagggg

SEQ ID NO: 1174259 - DNA, 22 bp, Homo sapiens
ccagctcagtcccatcagagag

SEQ ID NO: 1174260 - DNA, 22 bp, Homo sapiens
ccagctcatatgctgacagctc

SEQ ID NO: 1174261 - DNA, 20 bp, Homo sapiens
ccagctcatgtaggtgagcc

SEQ ID NO: 1174262 - DNA, 12 bp, Homo sapiens
ccagctcccagg

SEQ ID NO: 1174263 - DNA, 23 bp, Homo sapiens
ccagctccccaagaaagcctcag

SEQ ID NO: 1174264 - DNA, 19 bp, Homo sapiens
ccagctccccccgcccacc

SEQ ID NO: 1174265 - DNA, 18 bp, Homo sapiens
ccagctcccgctgtggcc

SEQ ID NO: 1174266 - DNA, 17 bp, Homo sapiens
ccagctccgacctctct

SEQ ID NO: 1174267 - DNA, 18 bp, Homo sapiens
ccagctccgacctctctc

SEQ ID NO: 1174268 - DNA, 12 bp, Homo sapiens
ccagctcctcac

SEQ ID NO: 1174269 - DNA, 13 bp, Homo sapiens
ccagctcctccag

SEQ ID NO: 1174270 - DNA, 16 bp, Homo sapiens
ccagctcctccagccc

SEQ ID NO: 1174271 - DNA, 23 bp, Homo sapiens
ccagctcctctaggggcagcctc

SEQ ID NO: 1174272 - DNA, 13 bp, Homo sapiens
ccagctcctctga

SEQ ID NO: 1174273 - DNA, 11 bp, Homo sapiens
atataatttta

SEQ ID NO: 1174274 - DNA, 21 bp, Homo sapiens
atataatttttttatgttttg

SEQ ID NO: 1174275 - DNA, 21 bp, Homo sapiens
atatacaactgtaaagcaaat

SEQ ID NO: 1174276 - DNA, 17 bp, Homo sapiens
atatacacgaatagaca

SEQ ID NO: 1174277 - DNA, 20 bp, Homo sapiens
atatacacgaatagacatca

SEQ ID NO: 1174278 - DNA, 21 bp, Homo sapiens
atatacacgaatagacatcaa

SEQ ID NO: 1174279 - DNA, 22 bp, Homo sapiens
atatacacgaatagacatcaaa

SEQ ID NO: 1174280 - DNA, 14 bp, Homo sapiens
atatacagtaactt

SEQ ID NO: 1174281 - DNA, 16 bp, Homo sapiens
atatacagtaacttta

SEQ ID NO: 1174282 - DNA, 17 bp, Homo sapiens
atatacagtaactttat

SEQ ID NO: 1174283 - DNA, 22 bp, Homo sapiens
atatacagtaactttatgtgta

SEQ ID NO: 1174284 - DNA, 11 bp, Homo sapiens
atatacagttt

SEQ ID NO: 1174285 - DNA, 14 bp, Homo sapiens
atatacagtttgac

SEQ ID NO: 1174286 - DNA, 22 bp, Homo sapiens
atatacatacttacatgtgtgt

SEQ ID NO: 1174287 - DNA, 19 bp, Homo sapiens
atatacatgaaaattttaa

SEQ ID NO: 1174288 - DNA, 19 bp, Homo sapiens
atatacatgaagaatagaa

SEQ ID NO: 1174289 - DNA, 12 bp, Homo sapiens
atatacattgtg

SEQ ID NO: 1174290 - DNA, 14 bp, Homo sapiens
atatacattttcta

SEQ ID NO: 1174291 - DNA, 15 bp, Homo sapiens
atatacattttctaa

SEQ ID NO: 1174292 - DNA, 23 bp, Homo sapiens
atatacattttctaaataaaaat

SEQ ID NO: 1174293 - DNA, 12 bp, Homo sapiens
atataccaaagc

SEQ ID NO: 1174294 - DNA, 17 bp, Homo sapiens
atataccaaagcacatt

SEQ ID NO: 1174295 - DNA, 14 bp, Homo sapiens
atataccaaattaa

SEQ ID NO: 1174296 - DNA, 19 bp, Homo sapiens
atataccaaattaaaaaaa

SEQ ID NO: 1174297 - DNA, 19 bp, Homo sapiens
atataccccaaattgtgta

SEQ ID NO: 1174298 - DNA, 20 bp, Homo sapiens
atataccccaaattgtgtat

SEQ ID NO: 1174299 - DNA, 19 bp, Homo sapiens
atatacctggcttttactt

SEQ ID NO: 1174300 - DNA, 16 bp, Homo sapiens
atatacctggtttact

SEQ ID NO: 1174301 - DNA, 15 bp, Homo sapiens
atatacgaaaagcca

SEQ ID NO: 1174302 - DNA, 18 bp, Homo sapiens
atatacgaaaagccagct

SEQ ID NO: 1174303 - DNA, 23 bp, Homo sapiens
atatactataattgtaaatattt

SEQ ID NO: 1174304 - DNA, 13 bp, Homo sapiens
atatactcattag

SEQ ID NO: 1174305 - DNA, 19 bp, Homo sapiens
atatactcattagaattac

SEQ ID NO: 1174306 - DNA, 22 bp, Homo sapiens
atatactctagatgaagtttta

SEQ ID NO: 1174307 - DNA, 20 bp, Homo sapiens
atatactgaagtcttttctg

SEQ ID NO: 1174308 - DNA, 17 bp, Homo sapiens
atatactgcttgtcatc

SEQ ID NO: 1174309 - DNA, 21 bp, Homo sapiens
atatactgggttcttgtttta

SEQ ID NO: 1174310 - DNA, 13 bp, Homo sapiens
atatactgtgtgc

SEQ ID NO: 1174311 - DNA, 20 bp, Homo sapiens
atatactttgaaaggagatg

SEQ ID NO: 1174312 - DNA, 18 bp, Homo sapiens
atatacttttacaagtaa

SEQ ID NO: 1174313 - DNA, 22 bp, Homo sapiens
atatacttttttcttatttaac

SEQ ID NO: 1174314 - DNA, 20 bp, Homo sapiens
atatacttttttttctttaa

SEQ ID NO: 1174315 - DNA, 14 bp, Homo sapiens
atatagaaaatctt

SEQ ID NO: 1174316 - DNA, 18 bp, Homo sapiens
atatagaaagctgtttat

SEQ ID NO: 1174317 - DNA, 14 bp, Homo sapiens
atatagaagcattt

SEQ ID NO: 1174318 - DNA, 14 bp, Homo sapiens
atatagagaataag

SEQ ID NO: 1174319 - DNA, 11 bp, Homo sapiens
ccagctgctgt

SEQ ID NO: 1174320 - DNA, 13 bp, Homo sapiens
ccagctgctgtct

SEQ ID NO: 1174321 - DNA, 19 bp, Homo sapiens
ccagctgctgtcttctgga

SEQ ID NO: 1174322 - DNA, 15 bp, Homo sapiens
ccagctgctgtgccc

SEQ ID NO: 1174323 - DNA, 16 bp, Homo sapiens
ccagctgctgtgcccc

SEQ ID NO: 1174324 - DNA, 24 bp, Homo sapiens
ccagctggagaaatatggtactca

SEQ ID NO: 1174325 - DNA, 14 bp, Homo sapiens
ccagctgggaccta

SEQ ID NO: 1174326 - DNA, 14 bp, Homo sapiens
ccagctgggaggca

SEQ ID NO: 1174327 - DNA, 15 bp, Homo sapiens
ccagctgggctctgc

SEQ ID NO: 1174328 - DNA, 17 bp, Homo sapiens
ccagctgggctctgcca

SEQ ID NO: 1174329 - DNA, 13 bp, Homo sapiens
ccagctggggaga

SEQ ID NO: 1174330 - DNA, 16 bp, Homo sapiens
ccagctggggagatgg

SEQ ID NO: 1174331 - DNA, 16 bp, Homo sapiens
ccagctggggccagag

SEQ ID NO: 1174332 - DNA, 21 bp, Homo sapiens
ccagctggggccagaggctgg

SEQ ID NO: 1174333 - DNA, 21 bp, Homo sapiens
ccagctggggcgtggggaggg

SEQ ID NO: 1174334 - DNA, 16 bp, Homo sapiens
ccagctgggtcaggca

SEQ ID NO: 1174335 - DNA, 17 bp, Homo sapiens
ccagctgggtcaggcag

SEQ ID NO: 1174336 - DNA, 18 bp, Homo sapiens
ccagctgggtcaggcagg

SEQ ID NO: 1174337 - DNA, 22 bp, Homo sapiens
ccagctggtcctgtggatggga

SEQ ID NO: 1174338 - DNA, 24 bp, Homo sapiens
ccagctggtggccctgtgcctggg

SEQ ID NO: 1174339 - DNA, 16 bp, Homo sapiens
ccagctgtagccatgg

SEQ ID NO: 1174340 - DNA, 21 bp, Homo sapiens
ccagctgtagccatggctcag

SEQ ID NO: 1174341 - DNA, 15 bp, Homo sapiens
ccagctgtgcacttt

SEQ ID NO: 1174342 - DNA, 17 bp, Homo sapiens
ccagctgttcagctggt

SEQ ID NO: 1174343 - DNA, 21 bp, Homo sapiens
ccagcttaaacccatacaatg

SEQ ID NO: 1174344 - DNA, 19 bp, Homo sapiens
ccagcttagagttcttctt

SEQ ID NO: 1174345 - DNA, 18 bp, Homo sapiens
ccagcttccaaagcctag

SEQ ID NO: 1174346 - DNA, 13 bp, Homo sapiens
ccagcttcctggt

SEQ ID NO: 1174347 - DNA, 15 bp, Homo sapiens
ccagcttcctggtgt

SEQ ID NO: 1174348 - DNA, 14 bp, Homo sapiens
ccagcttctccagg

SEQ ID NO: 1174349 - DNA, 15 bp, Homo sapiens
ccagcttctccaggc

SEQ ID NO: 1174350 - DNA, 13 bp, Homo sapiens
ccagcttctctct

SEQ ID NO: 1174351 - DNA, 15 bp, Homo sapiens
ccagcttctctctcc

SEQ ID NO: 1174352 - DNA, 17 bp, Homo sapiens
ccagcttctctctccag

SEQ ID NO: 1174353 - DNA, 18 bp, Homo sapiens
ccagcttctctctccagg

SEQ ID NO: 1174354 - DNA, 19 bp, Homo sapiens
ccagcttctctctccaggg

SEQ ID NO: 1174355 - DNA, 20 bp, Homo sapiens
ccagcttctctctccctgtc

SEQ ID NO: 1174356 - DNA, 22 bp, Homo sapiens
ccagcttctctctccctgtcac

SEQ ID NO: 1174357 - DNA, 18 bp, Homo sapiens
ccagcttgaaaccttcac

SEQ ID NO: 1174358 - DNA, 20 bp, Homo sapiens
ccagcttgaaaccttcactt

SEQ ID NO: 1174359 - DNA, 18 bp, Homo sapiens
ccagcttgggcccagctg

SEQ ID NO: 1174360 - DNA, 21 bp, Homo sapiens
ccagcttgggcccagctgggc

SEQ ID NO: 1174361 - DNA, 23 bp, Homo sapiens
ccagcttgggcccagctgggctc

SEQ ID NO: 1174362 - DNA, 15 bp, Homo sapiens
ccagcttgttattta

SEQ ID NO: 1174363 - DNA, 12 bp, Homo sapiens
ccagctttccct

SEQ ID NO: 1174364 - DNA, 14 bp, Homo sapiens
ccagctttccctgc

SEQ ID NO: 1174365 - DNA, 21 bp, Homo sapiens
ccagctttgacgtattatctg

SEQ ID NO: 1174366 - DNA, 17 bp, Homo sapiens
ccagcttttcctcaggg

SEQ ID NO: 1174367 - DNA, 12 bp, Homo sapiens
ccaggaaaaaat

SEQ ID NO: 1174368 - DNA, 17 bp, Homo sapiens
ccaggaaacaagggaag

SEQ ID NO: 1174369 - DNA, 13 bp, Homo sapiens
ccaggaaacatga

SEQ ID NO: 1174370 - DNA, 16 bp, Homo sapiens
ccaggaaagagcagtc

SEQ ID NO: 1174371 - DNA, 15 bp, Homo sapiens
ccaggaaagccacac

SEQ ID NO: 1174372 - DNA, 18 bp, Homo sapiens
ccaggaacagcaaatgca

SEQ ID NO: 1174373 - DNA, 19 bp, Homo sapiens
ccaggaacagcaaatgcaa

SEQ ID NO: 1174374 - DNA, 24 bp, Homo sapiens
ccaggaaccacaccacatctaagc

SEQ ID NO: 1174375 - DNA, 14 bp, Homo sapiens
ccaggaactgggcc

SEQ ID NO: 1174376 - DNA, 13 bp, Homo sapiens
ccaggaagatcca

SEQ ID NO: 1174377 - DNA, 19 bp, Homo sapiens
ccaggaagatcccccagaa

SEQ ID NO: 1174378 - DNA, 14 bp, Homo sapiens
ccaggaagcaggga

SEQ ID NO: 1174379 - DNA, 16 bp, Homo sapiens
ccaggaagcagggaga

SEQ ID NO: 1174380 - DNA, 20 bp, Homo sapiens
ccaggaagcagggagagttg

SEQ ID NO: 1174381 - DNA, 16 bp, Homo sapiens
ccaggaagccagagcc

SEQ ID NO: 1174382 - DNA, 16 bp, Homo sapiens
ccaggaagccgtcctg

SEQ ID NO: 1174383 - DNA, 13 bp, Homo sapiens
ccaggaaggcagc

SEQ ID NO: 1174384 - DNA, 16 bp, Homo sapiens
ccaggaaggcagctgc

SEQ ID NO: 1174385 - DNA, 19 bp, Homo sapiens
ccaggaaggcagctgctct

SEQ ID NO: 1174386 - DNA, 20 bp, Homo sapiens
ccaggaaggcagctgctctt

SEQ ID NO: 1174387 - DNA, 22 bp, Homo sapiens
ccaggaaggccaaaatcaagag

SEQ ID NO: 1174388 - DNA, 16 bp, Homo sapiens
ccaggaagggagtgag

SEQ ID NO: 1174389 - DNA, 22 bp, Homo sapiens
ccaggaatagtggacatggtca

SEQ ID NO: 1174390 - DNA, 14 bp, Homo sapiens
ccaggaatatgaca

SEQ ID NO: 1174391 - DNA, 19 bp, Homo sapiens
ccaggaatgcctcctccct

SEQ ID NO: 1174392 - DNA, 18 bp, Homo sapiens
ccaggacaagcacgaggc

SEQ ID NO: 1174393 - DNA, 22 bp, Homo sapiens
ccaggacaatgaaatactccag

SEQ ID NO: 1174394 - DNA, 15 bp, Homo sapiens
ccaggacaggatcca

SEQ ID NO: 1174395 - DNA, 19 bp, Homo sapiens
ccaggacaggatccaggcc

SEQ ID NO: 1174396 - DNA, 14 bp, Homo sapiens
ccaggacaggcccg

SEQ ID NO: 1174397 - DNA, 15 bp, Homo sapiens
ccaggacaggcccgg

SEQ ID NO: 1174398 - DNA, 11 bp, Homo sapiens
ccaggaccagc

SEQ ID NO: 1174399 - DNA, 14 bp, Homo sapiens
ccaggaccagcctg

SEQ ID NO: 1174400 - DNA, 16 bp, Homo sapiens
atatatgctgtatttc

SEQ ID NO: 1174401 - DNA, 18 bp, Homo sapiens
atatatgctgtatttctt

SEQ ID NO: 1174402 - DNA, 13 bp, Homo sapiens
atatatgcttttg

SEQ ID NO: 1174403 - DNA, 14 bp, Homo sapiens
atatatggacatgg

SEQ ID NO: 1174404 - DNA, 14 bp, Homo sapiens
atatatggacctag

SEQ ID NO: 1174405 - DNA, 15 bp, Homo sapiens
atatatggatgtgtg

SEQ ID NO: 1174406 - DNA, 20 bp, Homo sapiens
atatatggcagagttgtaaa

SEQ ID NO: 1174407 - DNA, 22 bp, Homo sapiens
atatatggcagagttgtaaata

SEQ ID NO: 1174408 - DNA, 14 bp, Homo sapiens
atatatggcatatt

SEQ ID NO: 1174409 - DNA, 23 bp, Homo sapiens
atatatggcatatttatattgta

SEQ ID NO: 1174410 - DNA, 20 bp, Homo sapiens
atatatggggatggtagttt

SEQ ID NO: 1174411 - DNA, 15 bp, Homo sapiens
atatatgtatataca

SEQ ID NO: 1174412 - DNA, 15 bp, Homo sapiens
atatatgtatatgta

SEQ ID NO: 1174413 - DNA, 19 bp, Homo sapiens
atatatgtatatgtatata

SEQ ID NO: 1174414 - DNA, 15 bp, Homo sapiens
atatatgtatgtaaa

SEQ ID NO: 1174415 - DNA, 20 bp, Homo sapiens
atatatgtattatttataat

SEQ ID NO: 1174416 - DNA, 13 bp, Homo sapiens
atatatgtatttt

SEQ ID NO: 1174417 - DNA, 12 bp, Homo sapiens
atatatgtgtat

SEQ ID NO: 1174418 - DNA, 15 bp, Homo sapiens
atatatgtgtataca

SEQ ID NO: 1174419 - DNA, 22 bp, Homo sapiens
atatatgtgtatacatacatgt

SEQ ID NO: 1174420 - DNA, 15 bp, Homo sapiens
atatatgtgtatgta

SEQ ID NO: 1174421 - DNA, 18 bp, Homo sapiens
atatatgtgtgtttaaat

SEQ ID NO: 1174422 - DNA, 20 bp, Homo sapiens
atatatgtgtgtttaaataa

SEQ ID NO: 1174423 - DNA, 21 bp, Homo sapiens
atatatgtgtgtttaaataaa

SEQ ID NO: 1174424 - DNA, 21 bp, Homo sapiens
atatatgttctgcaagaatta

SEQ ID NO: 1174425 - DNA, 17 bp, Homo sapiens
atatatgtttttgaagg

SEQ ID NO: 1174426 - DNA, 16 bp, Homo sapiens
atatattaaaaatata

SEQ ID NO: 1174427 - DNA, 22 bp, Homo sapiens
atatattaaaaatataaaactg

SEQ ID NO: 1174428 - DNA, 19 bp, Homo sapiens
atatattaccgttatgtct

SEQ ID NO: 1174429 - DNA, 12 bp, Homo sapiens
atatattactga

SEQ ID NO: 1174430 - DNA, 19 bp, Homo sapiens
atatattactgatttagaa

SEQ ID NO: 1174431 - DNA, 21 bp, Homo sapiens
atatattatatatttttctga

SEQ ID NO: 1174432 - DNA, 15 bp, Homo sapiens
atatattcccaatag

SEQ ID NO: 1174433 - DNA, 15 bp, Homo sapiens
atatattgaactttt

SEQ ID NO: 1174434 - DNA, 18 bp, Homo sapiens
atatattgaacttttgta

SEQ ID NO: 1174435 - DNA, 13 bp, Homo sapiens
atatattgtacaa

SEQ ID NO: 1174436 - DNA, 23 bp, Homo sapiens
atatattgtgttgactttataaa

SEQ ID NO: 1174437 - DNA, 12 bp, Homo sapiens
atatatttaaag

SEQ ID NO: 1174438 - DNA, 13 bp, Homo sapiens
atatatttaagca

SEQ ID NO: 1174439 - DNA, 20 bp, Homo sapiens
atatatttaatatattgaat

SEQ ID NO: 1174440 - DNA, 17 bp, Homo sapiens
atatatttaatatgtca

SEQ ID NO: 1174441 - DNA, 17 bp, Homo sapiens
ccaggagatgggtccag

SEQ ID NO: 1174442 - DNA, 21 bp, Homo sapiens
ccaggagatgggtccaggggt

SEQ ID NO: 1174443 - DNA, 15 bp, Homo sapiens
ccaggagcaaatgtt

SEQ ID NO: 1174444 - DNA, 20 bp, Homo sapiens
ccaggagcagcagccagcac

SEQ ID NO: 1174445 - DNA, 23 bp, Homo sapiens
ccaggagcagcagccagcaccac

SEQ ID NO: 1174446 - DNA, 15 bp, Homo sapiens
ccaggagcaggcacg

SEQ ID NO: 1174447 - DNA, 21 bp, Homo sapiens
ccaggagcatagaagccacat

SEQ ID NO: 1174448 - DNA, 22 bp, Homo sapiens
ccaggagcatagaagccacatc

SEQ ID NO: 1174449 - DNA, 16 bp, Homo sapiens
ccaggagcctgtgcct

SEQ ID NO: 1174450 - DNA, 20 bp, Homo sapiens
ccaggagctctgcgccaggc

SEQ ID NO: 1174451 - DNA, 21 bp, Homo sapiens
ccaggagctcttcaggcctcc

SEQ ID NO: 1174452 - DNA, 23 bp, Homo sapiens
ccaggagctcttcaggcctccct

SEQ ID NO: 1174453 - DNA, 23 bp, Homo sapiens
ccaggagctgagtcacctcctcc

SEQ ID NO: 1174454 - DNA, 16 bp, Homo sapiens
ccaggagctgcccaga

SEQ ID NO: 1174455 - DNA, 22 bp, Homo sapiens
ccaggagcttcttgtttccttg

SEQ ID NO: 1174456 - DNA, 23 bp, Homo sapiens
ccaggaggccctggtcctggcct

SEQ ID NO: 1174457 - DNA, 16 bp, Homo sapiens
ccaggaggcctgcacc

SEQ ID NO: 1174458 - DNA, 14 bp, Homo sapiens
ccaggaggcggcag

SEQ ID NO: 1174459 - DNA, 16 bp, Homo sapiens
ccaggaggctgaggtg

SEQ ID NO: 1174460 - DNA, 12 bp, Homo sapiens
ccaggaggcttt

SEQ ID NO: 1174461 - DNA, 15 bp, Homo sapiens
ccaggagggcacagc

SEQ ID NO: 1174462 - DNA, 17 bp, Homo sapiens
ccaggaggggcctgggc

SEQ ID NO: 1174463 - DNA, 22 bp, Homo sapiens
ccaggaggggcctgggcagccc

SEQ ID NO: 1174464 - DNA, 18 bp, Homo sapiens
ccaggaggtcgaccccaa

SEQ ID NO: 1174465 - DNA, 22 bp, Homo sapiens
ccaggaggtgggagtgaggagc

SEQ ID NO: 1174466 - DNA, 15 bp, Homo sapiens
ccaggagtctgtgct

SEQ ID NO: 1174467 - DNA, 18 bp, Homo sapiens
ccaggagtctgtgctctt

SEQ ID NO: 1174468 - DNA, 17 bp, Homo sapiens
ccaggagtgcccccggg

SEQ ID NO: 1174469 - DNA, 17 bp, Homo sapiens
ccaggagtttgagacaa

SEQ ID NO: 1174470 - DNA, 21 bp, Homo sapiens
ccaggagtttgagacaagccc

SEQ ID NO: 1174471 - DNA, 22 bp, Homo sapiens
ccaggagtttgagacaagccct

SEQ ID NO: 1174472 - DNA, 23 bp, Homo sapiens
ccaggagtttgagacaagccctg

SEQ ID NO: 1174473 - DNA, 17 bp, Homo sapiens
ccaggagtttgagacca

SEQ ID NO: 1174474 - DNA, 17 bp, Homo sapiens
ccaggagtttgaggctg

SEQ ID NO: 1174475 - DNA, 23 bp, Homo sapiens
ccaggatagtgggcaccccactg

SEQ ID NO: 1174476 - DNA, 18 bp, Homo sapiens
ccaggatatttctgagag

SEQ ID NO: 1174477 - DNA, 19 bp, Homo sapiens
ccaggatcccaagcctcct

SEQ ID NO: 1174478 - DNA, 21 bp, Homo sapiens
ccaggatcccaagcctcctgc

SEQ ID NO: 1174479 - DNA, 18 bp, Homo sapiens
ccaggatcctgcaggaac

SEQ ID NO: 1174480 - DNA, 22 bp, Homo sapiens
ccaggatggaattcttcctcct

SEQ ID NO: 1174481 - DNA, 23 bp, Homo sapiens
ccaggatggaattcttcctcctc

SEQ ID NO: 1174482 - DNA, 15 bp, Homo sapiens
ccaggatggagggtc

SEQ ID NO: 1174483 - DNA, 17 bp, Homo sapiens
ccaggattgaagagcat

SEQ ID NO: 1174484 - DNA, 14 bp, Homo sapiens
ccaggatttataaa

SEQ ID NO: 1174485 - DNA, 23 bp, Homo sapiens
ccaggattttaacaaaagcaaga

SEQ ID NO: 1174486 - DNA, 23 bp, Homo sapiens
ccaggattttaatttcaggaaaa

SEQ ID NO: 1174487 - DNA, 12 bp, Homo sapiens
ccaggcaaatca

SEQ ID NO: 1174488 - DNA, 20 bp, Homo sapiens
ccaggcaagcagctggtcag

SEQ ID NO: 1174489 - DNA, 17 bp, Homo sapiens
ccaggcaaggctgactt

SEQ ID NO: 1174490 - DNA, 16 bp, Homo sapiens
ccaggcacacacagcc

SEQ ID NO: 1174491 - DNA, 13 bp, Homo sapiens
ccaggcacaggat

SEQ ID NO: 1174492 - DNA, 17 bp, Homo sapiens
ccaggcaccaaaagaag

SEQ ID NO: 1174493 - DNA, 17 bp, Homo sapiens
ccaggcaccaccaggag

SEQ ID NO: 1174494 - DNA, 18 bp, Homo sapiens
ccaggcaccaccaggagc

SEQ ID NO: 1174495 - DNA, 18 bp, Homo sapiens
ccaggcaccccctggaga

SEQ ID NO: 1174496 - DNA, 19 bp, Homo sapiens
ccaggcaccccctggagag

SEQ ID NO: 1174497 - DNA, 18 bp, Homo sapiens
ccaggcaccctcagggag

SEQ ID NO: 1174498 - DNA, 12 bp, Homo sapiens
ccaggcacctgg

SEQ ID NO: 1174499 - DNA, 13 bp, Homo sapiens
ccaggcacctggc

SEQ ID NO: 1174500 - DNA, 15 bp, Homo sapiens
ccaggcacctggcct

SEQ ID NO: 1174501 - DNA, 16 bp, Homo sapiens
ccaggcacctggcctg

SEQ ID NO: 1174502 - DNA, 17 bp, Homo sapiens
ccaggcacctggcctgc

SEQ ID NO: 1174503 - DNA, 18 bp, Homo sapiens
ccaggcacctggcctgct

SEQ ID NO: 1174504 - DNA, 20 bp, Homo sapiens
ccaggcacctggcctgctgg

SEQ ID NO: 1174505 - DNA, 20 bp, Homo sapiens
ccaggcacgaacccacctgc

SEQ ID NO: 1174506 - DNA, 16 bp, Homo sapiens
ccaggcacggtttgga

SEQ ID NO: 1174507 - DNA, 13 bp, Homo sapiens
ccaggcactgcct

SEQ ID NO: 1174508 - DNA, 18 bp, Homo sapiens
ccaggcactgccttctcc

SEQ ID NO: 1174509 - DNA, 16 bp, Homo sapiens
ccaggcactgctgccc

SEQ ID NO: 1174510 - DNA, 17 bp, Homo sapiens
ccaggcagaatggctgc

SEQ ID NO: 1174511 - DNA, 20 bp, Homo sapiens
ccaggcagaatggctgcacg

SEQ ID NO: 1174512 - DNA, 18 bp, Homo sapiens
ccaggcagacaaccttgt

SEQ ID NO: 1174513 - DNA, 17 bp, Homo sapiens
ccaggcagatcctctgg

SEQ ID NO: 1174514 - DNA, 21 bp, Homo sapiens
ccaggcagatcctctggacac

SEQ ID NO: 1174515 - DNA, 21 bp, Homo sapiens
ccaggcagatctgtgccccat

SEQ ID NO: 1174516 - DNA, 11 bp, Homo sapiens
ccaggcagcca

SEQ ID NO: 1174517 - DNA, 15 bp, Homo sapiens
ccaggcagccaccag

SEQ ID NO: 1174518 - DNA, 18 bp, Homo sapiens
ccaggcagctatttcagc

SEQ ID NO: 1174519 - DNA, 17 bp, Homo sapiens
ccaggcagctgagacca

SEQ ID NO: 1174520 - DNA, 19 bp, Homo sapiens
ccaggcagctgagaccagg

SEQ ID NO: 1174521 - DNA, 22 bp, Homo sapiens
ccaggcagctgagaccagggtc

SEQ ID NO: 1174522 - DNA, 15 bp, Homo sapiens
ccaggcaggccaggc

SEQ ID NO: 1174523 - DNA, 11 bp, Homo sapiens
ccaggcaggcg

SEQ ID NO: 1174524 - DNA, 14 bp, Homo sapiens
ccaggcaggctgtg

SEQ ID NO: 1174525 - DNA, 19 bp, Homo sapiens
ccaggcagggccaaccctt

SEQ ID NO: 1174526 - DNA, 16 bp, Homo sapiens
ccaggcaggggtggga

SEQ ID NO: 1174527 - DNA, 14 bp, Homo sapiens
atatcctgtgactg

SEQ ID NO: 1174528 - DNA, 17 bp, Homo sapiens
atatccttatcagagct

SEQ ID NO: 1174529 - DNA, 18 bp, Homo sapiens
atatccttatcagagcta

SEQ ID NO: 1174530 - DNA, 22 bp, Homo sapiens
atatccttctagatcatacaca

SEQ ID NO: 1174531 - DNA, 18 bp, Homo sapiens
atatcgaatatagttctg

SEQ ID NO: 1174532 - DNA, 19 bp, Homo sapiens
atatcgaatatagttctgt

SEQ ID NO: 1174533 - DNA, 16 bp, Homo sapiens
atatctaaagttatat

SEQ ID NO: 1174534 - DNA, 19 bp, Homo sapiens
atatctaaagttatatttc

SEQ ID NO: 1174535 - DNA, 21 bp, Homo sapiens
atatctaaagttatatttcag

SEQ ID NO: 1174536 - DNA, 14 bp, Homo sapiens
atatctaatatata

SEQ ID NO: 1174537 - DNA, 18 bp, Homo sapiens
atatctaattatttccac

SEQ ID NO: 1174538 - DNA, 21 bp, Homo sapiens
atatctatatatgtatctaca

SEQ ID NO: 1174539 - DNA, 12 bp, Homo sapiens
atatctattaat

SEQ ID NO: 1174540 - DNA, 14 bp, Homo sapiens
atatctattaatat

SEQ ID NO: 1174541 - DNA, 15 bp, Homo sapiens
atatctattaatata

SEQ ID NO: 1174542 - DNA, 13 bp, Homo sapiens
atatctctatttg

SEQ ID NO: 1174543 - DNA, 22 bp, Homo sapiens
atatctctgccgtctctcctgc

SEQ ID NO: 1174544 - DNA, 15 bp, Homo sapiens
atatctgaaccaaga

SEQ ID NO: 1174545 - DNA, 20 bp, Homo sapiens
atatctgaagagtatccttc

SEQ ID NO: 1174546 - DNA, 14 bp, Homo sapiens
atatctgataaaat

SEQ ID NO: 1174547 - DNA, 12 bp, Homo sapiens
atatctgcaaaa

SEQ ID NO: 1174548 - DNA, 13 bp, Homo sapiens
atatctgcatgtg

SEQ ID NO: 1174549 - DNA, 16 bp, Homo sapiens
atatctgcttcagtgg

SEQ ID NO: 1174550 - DNA, 13 bp, Homo sapiens
atatctggcactg

SEQ ID NO: 1174551 - DNA, 19 bp, Homo sapiens
atatctggcactgttaata

SEQ ID NO: 1174552 - DNA, 18 bp, Homo sapiens
atatctgggttaagtgtt

SEQ ID NO: 1174553 - DNA, 21 bp, Homo sapiens
atatctggtatatgtcattat

SEQ ID NO: 1174554 - DNA, 22 bp, Homo sapiens
atatctggtatatgtcattatt

SEQ ID NO: 1174555 - DNA, 15 bp, Homo sapiens
atatctgtgaaatat

SEQ ID NO: 1174556 - DNA, 17 bp, Homo sapiens
atatctgtgaaatatca

SEQ ID NO: 1174557 - DNA, 14 bp, Homo sapiens
atatctgtttgtat

SEQ ID NO: 1174558 - DNA, 19 bp, Homo sapiens
atatctgtttgtatatttg

SEQ ID NO: 1174559 - DNA, 14 bp, Homo sapiens
atatcttaaagaaa

SEQ ID NO: 1174560 - DNA, 17 bp, Homo sapiens
atatcttataactgttt

SEQ ID NO: 1174561 - DNA, 21 bp, Homo sapiens
atatcttataactgttttaga

SEQ ID NO: 1174562 - DNA, 19 bp, Homo sapiens
ccaggcccaaggctcccgg

SEQ ID NO: 1174563 - DNA, 19 bp, Homo sapiens
ccaggcccacgaggagcag

SEQ ID NO: 1174564 - DNA, 22 bp, Homo sapiens
ccaggcccacgaggagcagcag

SEQ ID NO: 1174565 - DNA, 17 bp, Homo sapiens
ccaggcccactgtgcct

SEQ ID NO: 1174566 - DNA, 11 bp, Homo sapiens
ccaggcccagc

SEQ ID NO: 1174567 - DNA, 18 bp, Homo sapiens
ccaggcccagccctcctt

SEQ ID NO: 1174568 - DNA, 13 bp, Homo sapiens
ccaggcccaggcc

SEQ ID NO: 1174569 - DNA, 15 bp, Homo sapiens
ccaggcccaggccag

SEQ ID NO: 1174570 - DNA, 14 bp, Homo sapiens
ccaggcccatctca

SEQ ID NO: 1174571 - DNA, 13 bp, Homo sapiens
ccaggccccagcc

SEQ ID NO: 1174572 - DNA, 11 bp, Homo sapiens
ccaggcccccg

SEQ ID NO: 1174573 - DNA, 19 bp, Homo sapiens
ccaggcccccggctttcct

SEQ ID NO: 1174574 - DNA, 23 bp, Homo sapiens
ccaggcccccggctttcctccgg

SEQ ID NO: 1174575 - DNA, 22 bp, Homo sapiens
ccaggcccctgaggactggaga

SEQ ID NO: 1174576 - DNA, 22 bp, Homo sapiens
ccaggcccgcgggcacagccag

SEQ ID NO: 1174577 - DNA, 18 bp, Homo sapiens
ccaggcccgtgggcgcaa

SEQ ID NO: 1174578 - DNA, 14 bp, Homo sapiens
ccaggccctactac

SEQ ID NO: 1174579 - DNA, 15 bp, Homo sapiens
ccaggccctccatgg

SEQ ID NO: 1174580 - DNA, 20 bp, Homo sapiens
ccaggccctccatgggctag

SEQ ID NO: 1174581 - DNA, 13 bp, Homo sapiens
ccaggccctccca

SEQ ID NO: 1174582 - DNA, 17 bp, Homo sapiens
ccaggccgcagctcttg

SEQ ID NO: 1174583 - DNA, 13 bp, Homo sapiens
ccaggccggagcc

SEQ ID NO: 1174584 - DNA, 16 bp, Homo sapiens
ccaggccggagcccag

SEQ ID NO: 1174585 - DNA, 16 bp, Homo sapiens
ccaggccgggaagagc

SEQ ID NO: 1174586 - DNA, 19 bp, Homo sapiens
ccaggccgggaagagccac

SEQ ID NO: 1174587 - DNA, 21 bp, Homo sapiens
ccaggccgggaagagccacct

SEQ ID NO: 1174588 - DNA, 22 bp, Homo sapiens
ccaggccgggaagagccacctg

SEQ ID NO: 1174589 - DNA, 23 bp, Homo sapiens
ccaggccgggaagagccacctgg

SEQ ID NO: 1174590 - DNA, 21 bp, Homo sapiens
ccaggccggggtggagcatgg

SEQ ID NO: 1174591 - DNA, 22 bp, Homo sapiens
ccaggccgtcctcccgggccct

SEQ ID NO: 1174592 - DNA, 21 bp, Homo sapiens
ccaggccgttccccttggctt

SEQ ID NO: 1174593 - DNA, 17 bp, Homo sapiens
ccaggcctcactggctc

SEQ ID NO: 1174594 - DNA, 20 bp, Homo sapiens
ccaggcctcactggctcatg

SEQ ID NO: 1174595 - DNA, 21 bp, Homo sapiens
ccaggcctcactggctcatgc

SEQ ID NO: 1174596 - DNA, 22 bp, Homo sapiens
ccaggcctcactggctcatgcc

SEQ ID NO: 1174597 - DNA, 13 bp, Homo sapiens
ccaggcctcagcc

SEQ ID NO: 1174598 - DNA, 14 bp, Homo sapiens
ccaggcctcagcct

SEQ ID NO: 1174599 - DNA, 20 bp, Homo sapiens
ccaggcctccagcctctccc

SEQ ID NO: 1174600 - DNA, 11 bp, Homo sapiens
ccaggcctcct

SEQ ID NO: 1174601 - DNA, 18 bp, Homo sapiens
ccaggcctgcagcaggag

SEQ ID NO: 1174602 - DNA, 13 bp, Homo sapiens
ccaggcctgcctc

SEQ ID NO: 1174603 - DNA, 15 bp, Homo sapiens
ccaggcctgctggca

SEQ ID NO: 1174604 - DNA, 20 bp, Homo sapiens
ccaggcctgctggcatcagg

SEQ ID NO: 1174605 - DNA, 19 bp, Homo sapiens
ccaggcctggacgggccct

SEQ ID NO: 1174606 - DNA, 12 bp, Homo sapiens
ccaggcctggag

SEQ ID NO: 1174607 - DNA, 16 bp, Homo sapiens
ccaggcctggagcgtt

SEQ ID NO: 1174608 - DNA, 13 bp, Homo sapiens
ccaggcctggagg

SEQ ID NO: 1174609 - DNA, 12 bp, Homo sapiens
ccaggcctggcc

SEQ ID NO: 1174610 - DNA, 12 bp, Homo sapiens
ccaggcctggct

SEQ ID NO: 1174611 - DNA, 17 bp, Homo sapiens
ccaggcctggctccccg

SEQ ID NO: 1174612 - DNA, 13 bp, Homo sapiens
ccaggcctggctg

SEQ ID NO: 1174613 - DNA, 18 bp, Homo sapiens
ccaggcctgggatgcagt

SEQ ID NO: 1174614 - DNA, 12 bp, Homo sapiens
ccaggcctgggt

SEQ ID NO: 1174615 - DNA, 15 bp, Homo sapiens
ccaggcctgtccacc

SEQ ID NO: 1174616 - DNA, 18 bp, Homo sapiens
ccaggcctgtccaccctg

SEQ ID NO: 1174617 - DNA, 19 bp, Homo sapiens
ccaggccttacatctggct

SEQ ID NO: 1174618 - DNA, 18 bp, Homo sapiens
ccaggccttgctgactct

SEQ ID NO: 1174619 - DNA, 14 bp, Homo sapiens
ccaggcgagcctga

SEQ ID NO: 1174620 - DNA, 20 bp, Homo sapiens
ccaggcgagcctgactctgt

SEQ ID NO: 1174621 - DNA, 18 bp, Homo sapiens
ccaggcgatgtgcaagtg

SEQ ID NO: 1174622 - DNA, 17 bp, Homo sapiens
ccaggcgcatgtctgca

SEQ ID NO: 1174623 - DNA, 19 bp, Homo sapiens
ccaggcgcatgtctgcacc

SEQ ID NO: 1174624 - DNA, 21 bp, Homo sapiens
ccaggcgcatgtctgcacctc

SEQ ID NO: 1174625 - DNA, 18 bp, Homo sapiens
ccaggcgccccttccccc

SEQ ID NO: 1174626 - DNA, 22 bp, Homo sapiens
ccaggcgggctcaaggaaaggg

SEQ ID NO: 1174627 - DNA, 18 bp, Homo sapiens
ccaggcgttggtgccact

SEQ ID NO: 1174628 - DNA, 24 bp, Homo sapiens
ccaggctaatttttttgtatttta

SEQ ID NO: 1174629 - DNA, 20 bp, Homo sapiens
ccaggctagagtgcaatggt

SEQ ID NO: 1174630 - DNA, 20 bp, Homo sapiens
ccaggctatggttgccaccc

SEQ ID NO: 1174631 - DNA, 21 bp, Homo sapiens
ccaggctatggttgccacccc

SEQ ID NO: 1174632 - DNA, 23 bp, Homo sapiens
ccaggctatggttgccaccccaa

SEQ ID NO: 1174633 - DNA, 18 bp, Homo sapiens
ccaggctccgcccttagt

SEQ ID NO: 1174634 - DNA, 18 bp, Homo sapiens
ccaggctcgtggactgag

SEQ ID NO: 1174635 - DNA, 20 bp, Homo sapiens
ccaggctcgtggactgagtg

SEQ ID NO: 1174636 - DNA, 21 bp, Homo sapiens
ccaggctcgtggactgagtgg

SEQ ID NO: 1174637 - DNA, 22 bp, Homo sapiens
ccaggctctgggcacagtgctg

SEQ ID NO: 1174638 - DNA, 12 bp, Homo sapiens
ccaggctcttcc

SEQ ID NO: 1174639 - DNA, 14 bp, Homo sapiens
ccaggctcttcctg

SEQ ID NO: 1174640 - DNA, 18 bp, Homo sapiens
ccaggctcttcctggacc

SEQ ID NO: 1174641 - DNA, 22 bp, Homo sapiens
ccaggctcttcctggacctgag

SEQ ID NO: 1174642 - DNA, 15 bp, Homo sapiens
ccaggctgaccacag

SEQ ID NO: 1174643 - DNA, 20 bp, Homo sapiens
ccaggctgaccacagcacag

SEQ ID NO: 1174644 - DNA, 21 bp, Homo sapiens
ccaggctgaccacagcacagc

SEQ ID NO: 1174645 - DNA, 16 bp, Homo sapiens
ccaggctgagcctcag

SEQ ID NO: 1174646 - DNA, 19 bp, Homo sapiens
ccaggctgagcctcagtct

SEQ ID NO: 1174647 - DNA, 22 bp, Homo sapiens
ccaggctgagcctcagtctccc

SEQ ID NO: 1174648 - DNA, 12 bp, Homo sapiens
ccaggctgcact

SEQ ID NO: 1174649 - DNA, 16 bp, Homo sapiens
ccaggctgcactgcag

SEQ ID NO: 1174650 - DNA, 13 bp, Homo sapiens
ccaggctgccaag

SEQ ID NO: 1174651 - DNA, 13 bp, Homo sapiens
ccaggctgcctcc

SEQ ID NO: 1174652 - DNA, 20 bp, Homo sapiens
ccaggctgcctcggactcca

SEQ ID NO: 1174653 - DNA, 22 bp, Homo sapiens
ccaggctgcctcggactccatg

SEQ ID NO: 1174654 - DNA, 15 bp, Homo sapiens
ccaggctggagaccc

SEQ ID NO: 1174655 - DNA, 14 bp, Homo sapiens
atatgtatgctttt

SEQ ID NO: 1174656 - DNA, 12 bp, Homo sapiens
atatgtatgggt

SEQ ID NO: 1174657 - DNA, 17 bp, Homo sapiens
atatgtatgggtagggt

SEQ ID NO: 1174658 - DNA, 23 bp, Homo sapiens
atatgtatgggtagggtaaatca

SEQ ID NO: 1174659 - DNA, 15 bp, Homo sapiens
atatgtatgtaaaaa

SEQ ID NO: 1174660 - DNA, 14 bp, Homo sapiens
atatgtatgtctaa

SEQ ID NO: 1174661 - DNA, 16 bp, Homo sapiens
atatgtattcccttgt

SEQ ID NO: 1174662 - DNA, 18 bp, Homo sapiens
atatgtattcccttgtat

SEQ ID NO: 1174663 - DNA, 10 bp, Homo sapiens
atatgtattt

SEQ ID NO: 1174664 - DNA, 17 bp, Homo sapiens
atatgtatttaaaaaca

SEQ ID NO: 1174665 - DNA, 14 bp, Homo sapiens
atatgtatttaaga

SEQ ID NO: 1174666 - DNA, 14 bp, Homo sapiens
atatgtattttcct

SEQ ID NO: 1174667 - DNA, 20 bp, Homo sapiens
atatgtcacgaacttgaaag

SEQ ID NO: 1174668 - DNA, 20 bp, Homo sapiens
atatgtcatgcctcactttc

SEQ ID NO: 1174669 - DNA, 22 bp, Homo sapiens
atatgtcattatttattgttaa

SEQ ID NO: 1174670 - DNA, 19 bp, Homo sapiens
atatgtcgtagaattcctt

SEQ ID NO: 1174671 - DNA, 16 bp, Homo sapiens
atatgtctgcttctgt

SEQ ID NO: 1174672 - DNA, 22 bp, Homo sapiens
atatgtctgcttctgtccagga

SEQ ID NO: 1174673 - DNA, 13 bp, Homo sapiens
atatgtgaagaaa

SEQ ID NO: 1174674 - DNA, 14 bp, Homo sapiens
atatgtgaagaaaa

SEQ ID NO: 1174675 - DNA, 13 bp, Homo sapiens
atatgtgaagttt

SEQ ID NO: 1174676 - DNA, 14 bp, Homo sapiens
atatgtgaagtttt

SEQ ID NO: 1174677 - DNA, 16 bp, Homo sapiens
atatgtgatctgggca

SEQ ID NO: 1174678 - DNA, 17 bp, Homo sapiens
atatgtgccacattttc

SEQ ID NO: 1174679 - DNA, 22 bp, Homo sapiens
atatgtgtatgcacagtaaaaa

SEQ ID NO: 1174680 - DNA, 12 bp, Homo sapiens
atatgtgtatgt

SEQ ID NO: 1174681 - DNA, 16 bp, Homo sapiens
atatgtgtatgtacgt

SEQ ID NO: 1174682 - DNA, 22 bp, Homo sapiens
atatgtgtatgtacgtttgtat

SEQ ID NO: 1174683 - DNA, 20 bp, Homo sapiens
atatgtgtgtgtatgtttgc

SEQ ID NO: 1174684 - DNA, 20 bp, Homo sapiens
atattctattccatgtccat

SEQ ID NO: 1174685 - DNA, 15 bp, Homo sapiens
atattctattgtatt

SEQ ID NO: 1174686 - DNA, 21 bp, Homo sapiens
atattctgctctattatataa

SEQ ID NO: 1174687 - DNA, 16 bp, Homo sapiens
atattctgttgcttta

SEQ ID NO: 1174688 - DNA, 18 bp, Homo sapiens
atattctgttgctttaca

SEQ ID NO: 1174689 - DNA, 13 bp, Homo sapiens
atattcttattgg

SEQ ID NO: 1174690 - DNA, 17 bp, Homo sapiens
atattcttattggaaat

SEQ ID NO: 1174691 - DNA, 22 bp, Homo sapiens
atattcttattggaaatgtact

SEQ ID NO: 1174692 - DNA, 24 bp, Homo sapiens
atattctttctcataaaactgtga

SEQ ID NO: 1174693 - DNA, 12 bp, Homo sapiens
atattctttctt

SEQ ID NO: 1174694 - DNA, 17 bp, Homo sapiens
atattcttttgtttcca

SEQ ID NO: 1174695 - DNA, 20 bp, Homo sapiens
atattgaaaattgaaaagta

SEQ ID NO: 1174696 - DNA, 21 bp, Homo sapiens
atattgaaagttgcttttatt

SEQ ID NO: 1174697 - DNA, 12 bp, Homo sapiens
atattgaacttt

SEQ ID NO: 1174698 - DNA, 19 bp, Homo sapiens
atattgaagaatttgtttt

SEQ ID NO: 1174699 - DNA, 14 bp, Homo sapiens
atattgaagacaat

SEQ ID NO: 1174700 - DNA, 15 bp, Homo sapiens
atattgaagacaatt

SEQ ID NO: 1174701 - DNA, 16 bp, Homo sapiens
atattgaagacaattt

SEQ ID NO: 1174702 - DNA, 17 bp, Homo sapiens
atattgaagacaatttg

SEQ ID NO: 1174703 - DNA, 20 bp, Homo sapiens
atattgaagacaatttgata

SEQ ID NO: 1174704 - DNA, 12 bp, Homo sapiens
atattgaataaa

SEQ ID NO: 1174705 - DNA, 22 bp, Homo sapiens
atattgaataaaaaatagacat

SEQ ID NO: 1174706 - DNA, 16 bp, Homo sapiens
atattgaatttttcct

SEQ ID NO: 1174707 - DNA, 14 bp, Homo sapiens
atattgacatttgt

SEQ ID NO: 1174708 - DNA, 15 bp, Homo sapiens
atattgacatttgta

SEQ ID NO: 1174709 - DNA, 14 bp, Homo sapiens
atattgagcagaat

SEQ ID NO: 1174710 - DNA, 16 bp, Homo sapiens
atattgaggctgcagc

SEQ ID NO: 1174711 - DNA, 18 bp, Homo sapiens
atattgatattgaaggaa

SEQ ID NO: 1174712 - DNA, 14 bp, Homo sapiens
atattgatcaaata

SEQ ID NO: 1174713 - DNA, 17 bp, Homo sapiens
atattgatttaaaagtg

SEQ ID NO: 1174714 - DNA, 19 bp, Homo sapiens
atattgatttccgttaaaa

SEQ ID NO: 1174715 - DNA, 16 bp, Homo sapiens
atattgcaaaatacat

SEQ ID NO: 1174716 - DNA, 12 bp, Homo sapiens
atattgccttat

SEQ ID NO: 1174717 - DNA, 12 bp, Homo sapiens
atattgctaaaa

SEQ ID NO: 1174718 - DNA, 14 bp, Homo sapiens
atattgctaaaagt

SEQ ID NO: 1174719 - DNA, 15 bp, Homo sapiens
atattgctaaaagtg

SEQ ID NO: 1174720 - DNA, 21 bp, Homo sapiens
atattgctaaaatattttaga

SEQ ID NO: 1174721 - DNA, 17 bp, Homo sapiens
atattgctgtatagctc

SEQ ID NO: 1174722 - DNA, 18 bp, Homo sapiens
atattgctttttctaatg

SEQ ID NO: 1174723 - DNA, 21 bp, Homo sapiens
atattggattgcgcctttgta

SEQ ID NO: 1174724 - DNA, 22 bp, Homo sapiens
atattggattgcgcctttgtat

SEQ ID NO: 1174725 - DNA, 19 bp, Homo sapiens
atattgggaaggaaatata

SEQ ID NO: 1174726 - DNA, 13 bp, Homo sapiens
atattggtattca

SEQ ID NO: 1174727 - DNA, 15 bp, Homo sapiens
atattggtattcact

SEQ ID NO: 1174728 - DNA, 15 bp, Homo sapiens
atattggtgcgtttt

SEQ ID NO: 1174729 - DNA, 20 bp, Homo sapiens
atattggtgcgtttttacag

SEQ ID NO: 1174730 - DNA, 21 bp, Homo sapiens
atattggtgcgtttttacagt

SEQ ID NO: 1174731 - DNA, 16 bp, Homo sapiens
atattggtgtatatta

SEQ ID NO: 1174732 - DNA, 18 bp, Homo sapiens
atattggtgtatattata

SEQ ID NO: 1174733 - DNA, 21 bp, Homo sapiens
atattggtgtatattatataa

SEQ ID NO: 1174734 - DNA, 15 bp, Homo sapiens
atattggttcttccc

SEQ ID NO: 1174735 - DNA, 16 bp, Homo sapiens
atattgtaaaacaggt

SEQ ID NO: 1174736 - DNA, 14 bp, Homo sapiens
atattgtaaagaag

SEQ ID NO: 1174737 - DNA, 13 bp, Homo sapiens
atattgtaagaaa

SEQ ID NO: 1174738 - DNA, 14 bp, Homo sapiens
atattgtacataaa

SEQ ID NO: 1174739 - DNA, 16 bp, Homo sapiens
atattgtatattctgg

SEQ ID NO: 1174740 - DNA, 12 bp, Homo sapiens
atattgtatgta

SEQ ID NO: 1174741 - DNA, 15 bp, Homo sapiens
atattgtcagatatt

SEQ ID NO: 1174742 - DNA, 16 bp, Homo sapiens
atattgtcagatattt

SEQ ID NO: 1174743 - DNA, 13 bp, Homo sapiens
atattgtgaagta

SEQ ID NO: 1174744 - DNA, 13 bp, Homo sapiens
atattgtgattct

SEQ ID NO: 1174745 - DNA, 19 bp, Homo sapiens
atattgtgccaatatgtat

SEQ ID NO: 1174746 - DNA, 20 bp, Homo sapiens
atattgtgccaatatgtatt

SEQ ID NO: 1174747 - DNA, 23 bp, Homo sapiens
atattgtgcttactcaagtgtta

SEQ ID NO: 1174748 - DNA, 15 bp, Homo sapiens
atattgttgacaact

SEQ ID NO: 1174749 - DNA, 14 bp, Homo sapiens
atattgtttaaaat

SEQ ID NO: 1174750 - DNA, 15 bp, Homo sapiens
atattgtttaaaatt

SEQ ID NO: 1174751 - DNA, 18 bp, Homo sapiens
atattgtttaaaattcag

SEQ ID NO: 1174752 - DNA, 19 bp, Homo sapiens
atattgtttaaaattcagt

SEQ ID NO: 1174753 - DNA, 19 bp, Homo sapiens
atattgtttctgcattcat

SEQ ID NO: 1174754 - DNA, 14 bp, Homo sapiens
atattgtttgctgt

SEQ ID NO: 1174755 - DNA, 19 bp, Homo sapiens
atattgttttacaatagtt

SEQ ID NO: 1174756 - DNA, 12 bp, Homo sapiens
atattgttttct

SEQ ID NO: 1174757 - DNA, 19 bp, Homo sapiens
atattgttttctcctttct

SEQ ID NO: 1174758 - DNA, 19 bp, Homo sapiens
atattgttttctgtaaata

SEQ ID NO: 1174759 - DNA, 14 bp, Homo sapiens
atatttaaaaattg

SEQ ID NO: 1174760 - DNA, 22 bp, Homo sapiens
atatttaaaaattgtttcttga

SEQ ID NO: 1174761 - DNA, 18 bp, Homo sapiens
atatttaaacagcagtgt

SEQ ID NO: 1174762 - DNA, 23 bp, Homo sapiens
atatttaaactcaagacaatgca

SEQ ID NO: 1174763 - DNA, 15 bp, Homo sapiens
atatttaaagaatga

SEQ ID NO: 1174764 - DNA, 20 bp, Homo sapiens
atatttaaagaatgagaaac

SEQ ID NO: 1174765 - DNA, 14 bp, Homo sapiens
atatttaaagacag

SEQ ID NO: 1174766 - DNA, 22 bp, Homo sapiens
atatttaacattatttatatgg

SEQ ID NO: 1174767 - DNA, 23 bp, Homo sapiens
atatttaagaaaatacaataaac

SEQ ID NO: 1174768 - DNA, 20 bp, Homo sapiens
atatttaagtatatagtata

SEQ ID NO: 1174769 - DNA, 22 bp, Homo sapiens
atatttaatgcattaaacctgt

SEQ ID NO: 1174770 - DNA, 23 bp, Homo sapiens
atatttaatgcattaaacctgtc

SEQ ID NO: 1174771 - DNA, 13 bp, Homo sapiens
atatttaatgttt

SEQ ID NO: 1174772 - DNA, 14 bp, Homo sapiens
atatttaatgtttt

SEQ ID NO: 1174773 - DNA, 18 bp, Homo sapiens
atatttactctttgcaaa

SEQ ID NO: 1174774 - DNA, 12 bp, Homo sapiens
atatttagaaaa

SEQ ID NO: 1174775 - DNA, 15 bp, Homo sapiens
atatttagaaaattt

SEQ ID NO: 1174776 - DNA, 17 bp, Homo sapiens
atatttagaaaattttg

SEQ ID NO: 1174777 - DNA, 20 bp, Homo sapiens
atatttagctctgtggaatt

SEQ ID NO: 1174778 - DNA, 21 bp, Homo sapiens
atatttagttatagtttcaga

SEQ ID NO: 1174779 - DNA, 15 bp, Homo sapiens
atatttataactcat

SEQ ID NO: 1174780 - DNA, 23 bp, Homo sapiens
atatttataactcatcataaaat

SEQ ID NO: 1174781 - DNA, 14 bp, Homo sapiens
atatttatactcta

SEQ ID NO: 1174782 - DNA, 12 bp, Homo sapiens
atatttatattg

SEQ ID NO: 1174783 - DNA, 23 bp, Homo sapiens
cccaggggcatgtattggcctgg

SEQ ID NO: 1174784 - DNA, 18 bp, Homo sapiens
cccaggggtcccagccac

SEQ ID NO: 1174785 - DNA, 19 bp, Homo sapiens
cccaggggtcccagccacc

SEQ ID NO: 1174786 - DNA, 14 bp, Homo sapiens
cccaggggtctccc

SEQ ID NO: 1174787 - DNA, 19 bp, Homo sapiens
cccaggggtctccctggct

SEQ ID NO: 1174788 - DNA, 20 bp, Homo sapiens
cccaggggtctccctggctc

SEQ ID NO: 1174789 - DNA, 22 bp, Homo sapiens
cccaggggtctccctggctccc

SEQ ID NO: 1174790 - DNA, 19 bp, Homo sapiens
cccaggggtgccccctcct

SEQ ID NO: 1174791 - DNA, 21 bp, Homo sapiens
cccaggggtgccccctcctct

SEQ ID NO: 1174792 - DNA, 19 bp, Homo sapiens
cccagggtcccacccccaa

SEQ ID NO: 1174793 - DNA, 23 bp, Homo sapiens
cccagggtcttccctacctcagg

SEQ ID NO: 1174794 - DNA, 14 bp, Homo sapiens
cccagggtgcagtg

SEQ ID NO: 1174795 - DNA, 19 bp, Homo sapiens
cccagggtggagagggaga

SEQ ID NO: 1174796 - DNA, 16 bp, Homo sapiens
cccagggtggctgcca

SEQ ID NO: 1174797 - DNA, 17 bp, Homo sapiens
cccagggtggctgccag

SEQ ID NO: 1174798 - DNA, 20 bp, Homo sapiens
cccaggtagctgggattaca

SEQ ID NO: 1174799 - DNA, 16 bp, Homo sapiens
cccaggtcagccctgt

SEQ ID NO: 1174800 - DNA, 15 bp, Homo sapiens
cccaggtccccaaac

SEQ ID NO: 1174801 - DNA, 15 bp, Homo sapiens
cccaggtcctctgat

SEQ ID NO: 1174802 - DNA, 13 bp, Homo sapiens
cccaggtcctgtc

SEQ ID NO: 1174803 - DNA, 15 bp, Homo sapiens
cccaggtcctgtctc

SEQ ID NO: 1174804 - DNA, 13 bp, Homo sapiens
cccaggtcttcct

SEQ ID NO: 1174805 - DNA, 16 bp, Homo sapiens
cccaggtcttcctgct

SEQ ID NO: 1174806 - DNA, 15 bp, Homo sapiens
cccaggtcttttctt

SEQ ID NO: 1174807 - DNA, 14 bp, Homo sapiens
cccaggtgcagccc

SEQ ID NO: 1174808 - DNA, 20 bp, Homo sapiens
cccaggtgcgtgtgtctctg

SEQ ID NO: 1174809 - DNA, 22 bp, Homo sapiens
cccaggtgcgtgtgtctctgtc

SEQ ID NO: 1174810 - DNA, 21 bp, Homo sapiens
cccaggtggaaggcagacagc

SEQ ID NO: 1174811 - DNA, 19 bp, Homo sapiens
cccaggtggcctcctggcc

SEQ ID NO: 1174812 - DNA, 19 bp, Homo sapiens
cccagtagctgggattaca

SEQ ID NO: 1174813 - DNA, 16 bp, Homo sapiens
cccagtattactgctg

SEQ ID NO: 1174814 - DNA, 23 bp, Homo sapiens
cccagtattactgctgctgtgct

SEQ ID NO: 1174815 - DNA, 19 bp, Homo sapiens
cccagtcactcctctctag

SEQ ID NO: 1174816 - DNA, 13 bp, Homo sapiens
cccagtcagaaat

SEQ ID NO: 1174817 - DNA, 16 bp, Homo sapiens
cccagtcccacactgt

SEQ ID NO: 1174818 - DNA, 15 bp, Homo sapiens
cccagtcccagggaa

SEQ ID NO: 1174819 - DNA, 15 bp, Homo sapiens
cccagtccccacccc

SEQ ID NO: 1174820 - DNA, 18 bp, Homo sapiens
cccagtccccacccctgc

SEQ ID NO: 1174821 - DNA, 21 bp, Homo sapiens
cccagtccccacccctgcccc

SEQ ID NO: 1174822 - DNA, 13 bp, Homo sapiens
cccagtccccagc

SEQ ID NO: 1174823 - DNA, 14 bp, Homo sapiens
cccagtccccagcc

SEQ ID NO: 1174824 - DNA, 16 bp, Homo sapiens
cccagtccccagccct

SEQ ID NO: 1174825 - DNA, 13 bp, Homo sapiens
cccagtccccgtg

SEQ ID NO: 1174826 - DNA, 23 bp, Homo sapiens
cccagtccccgtgccccgcctcc

SEQ ID NO: 1174827 - DNA, 13 bp, Homo sapiens
cccagtcctcact

SEQ ID NO: 1174828 - DNA, 17 bp, Homo sapiens
cccagtcctcactgtcc

SEQ ID NO: 1174829 - DNA, 19 bp, Homo sapiens
cccagtcctcactgtcctg

SEQ ID NO: 1174830 - DNA, 15 bp, Homo sapiens
cccagtcctctccca

SEQ ID NO: 1174831 - DNA, 17 bp, Homo sapiens
cccagtccttccacctc

SEQ ID NO: 1174832 - DNA, 13 bp, Homo sapiens
cccagtctcagac

SEQ ID NO: 1174833 - DNA, 15 bp, Homo sapiens
cccagtctcatctcc

SEQ ID NO: 1174834 - DNA, 16 bp, Homo sapiens
cccagtctcatctcct

SEQ ID NO: 1174835 - DNA, 19 bp, Homo sapiens
cccagtctcatctcctgac

SEQ ID NO: 1174836 - DNA, 15 bp, Homo sapiens
cccagtctcctctcc

SEQ ID NO: 1174837 - DNA, 20 bp, Homo sapiens
cccagtctctggcagttctg

SEQ ID NO: 1174838 - DNA, 17 bp, Homo sapiens
cccagtgaactcctgcc

SEQ ID NO: 1174839 - DNA, 23 bp, Homo sapiens
cccagtgaactcctgccaggcac

SEQ ID NO: 1174840 - DNA, 14 bp, Homo sapiens
cccagtgaagcctc

SEQ ID NO: 1174841 - DNA, 18 bp, Homo sapiens
cccagtgaagcctctgag

SEQ ID NO: 1174842 - DNA, 13 bp, Homo sapiens
cccagtgacactt

SEQ ID NO: 1174843 - DNA, 13 bp, Homo sapiens
cccagtgagactg

SEQ ID NO: 1174844 - DNA, 15 bp, Homo sapiens
cccagtgccactgcc

SEQ ID NO: 1174845 - DNA, 12 bp, Homo sapiens
cccagtgcctgc

SEQ ID NO: 1174846 - DNA, 16 bp, Homo sapiens
cccagtgcctgccact

SEQ ID NO: 1174847 - DNA, 14 bp, Homo sapiens
cccagtgctgccat

SEQ ID NO: 1174848 - DNA, 15 bp, Homo sapiens
cccagtgctgccatg

SEQ ID NO: 1174849 - DNA, 16 bp, Homo sapiens
cccagtgctgccatgc

SEQ ID NO: 1174850 - DNA, 19 bp, Homo sapiens
cccagtgctgccatgccac

SEQ ID NO: 1174851 - DNA, 22 bp, Homo sapiens
cccagtgctgccatgccactgc

SEQ ID NO: 1174852 - DNA, 15 bp, Homo sapiens
cccagtgctgctgta

SEQ ID NO: 1174853 - DNA, 13 bp, Homo sapiens
cccagtgcttctc

SEQ ID NO: 1174854 - DNA, 13 bp, Homo sapiens
cccagtggcctca

SEQ ID NO: 1174855 - DNA, 18 bp, Homo sapiens
cccagtgggacagaggag

SEQ ID NO: 1174856 - DNA, 16 bp, Homo sapiens
cccagtgggaggggca

SEQ ID NO: 1174857 - DNA, 17 bp, Homo sapiens
cccagtgggaggggcag

SEQ ID NO: 1174858 - DNA, 20 bp, Homo sapiens
cccagtgggaggggcaggct

SEQ ID NO: 1174859 - DNA, 22 bp, Homo sapiens
cccagtgggaggggcaggctga

SEQ ID NO: 1174860 - DNA, 15 bp, Homo sapiens
cccagtggggacagg

SEQ ID NO: 1174861 - DNA, 18 bp, Homo sapiens
cccagtggggacagggag

SEQ ID NO: 1174862 - DNA, 20 bp, Homo sapiens
cccagtgtgcacgcctgcag

SEQ ID NO: 1174863 - DNA, 18 bp, Homo sapiens
cccagtgttgtttgtaaa

SEQ ID NO: 1174864 - DNA, 21 bp, Homo sapiens
cccagttcatcaccatttcct

SEQ ID NO: 1174865 - DNA, 18 bp, Homo sapiens
cccagttcctgtggctcc

SEQ ID NO: 1174866 - DNA, 16 bp, Homo sapiens
cccagttctgctcctc

SEQ ID NO: 1174867 - DNA, 22 bp, Homo sapiens
cccagttctgctcctctccagg

SEQ ID NO: 1174868 - DNA, 16 bp, Homo sapiens
cccagtttgcagaaaa

SEQ ID NO: 1174869 - DNA, 23 bp, Homo sapiens
cccagtttgcagaaaagcacctg

SEQ ID NO: 1174870 - DNA, 17 bp, Homo sapiens
cccagttttgaaaaggt

SEQ ID NO: 1174871 - DNA, 19 bp, Homo sapiens
cccagttttgttgccccag

SEQ ID NO: 1174872 - DNA, 20 bp, Homo sapiens
cccataaaatgatcctgcca

SEQ ID NO: 1174873 - DNA, 14 bp, Homo sapiens
cccataactcaatg

SEQ ID NO: 1174874 - DNA, 20 bp, Homo sapiens
cccataatagttagccctca

SEQ ID NO: 1174875 - DNA, 21 bp, Homo sapiens
cccataatagttagccctcag

SEQ ID NO: 1174876 - DNA, 23 bp, Homo sapiens
cccataatagttagccctcagtc

SEQ ID NO: 1174877 - DNA, 19 bp, Homo sapiens
cccataatcatgtaaatgc

SEQ ID NO: 1174878 - DNA, 19 bp, Homo sapiens
cccataattttcttcatgc

SEQ ID NO: 1174879 - DNA, 23 bp, Homo sapiens
cccataattttttttttcctttt

SEQ ID NO: 1174880 - DNA, 16 bp, Homo sapiens
cccatacaatgtatgt

SEQ ID NO: 1174881 - DNA, 23 bp, Homo sapiens
cccatacaatgtatgtacaatac

SEQ ID NO: 1174882 - DNA, 12 bp, Homo sapiens
cccatacacaca

SEQ ID NO: 1174883 - DNA, 15 bp, Homo sapiens
cccatacacacacaa

SEQ ID NO: 1174884 - DNA, 21 bp, Homo sapiens
cccataccccttattgctgcc

SEQ ID NO: 1174885 - DNA, 15 bp, Homo sapiens
cccatactcagcctg

SEQ ID NO: 1174886 - DNA, 22 bp, Homo sapiens
cccatactcagcctgctgccca

SEQ ID NO: 1174887 - DNA, 17 bp, Homo sapiens
cccatagatcttctgaa

SEQ ID NO: 1174888 - DNA, 13 bp, Homo sapiens
cccatagccttgg

SEQ ID NO: 1174889 - DNA, 14 bp, Homo sapiens
cccatagccttggg

SEQ ID NO: 1174890 - DNA, 15 bp, Homo sapiens
cccatagccttgggg

SEQ ID NO: 1174891 - DNA, 16 bp, Homo sapiens
cccatagcttccatga

SEQ ID NO: 1174892 - DNA, 17 bp, Homo sapiens
cccataggccaccccct

SEQ ID NO: 1174893 - DNA, 18 bp, Homo sapiens
cccataggccacccccta

SEQ ID NO: 1174894 - DNA, 20 bp, Homo sapiens
cccatagtggggcctgggag

SEQ ID NO: 1174895 - DNA, 18 bp, Homo sapiens
cccatagtttatttttct

SEQ ID NO: 1174896 - DNA, 14 bp, Homo sapiens
cccatatcctgcct

SEQ ID NO: 1174897 - DNA, 23 bp, Homo sapiens
cccatcacctctaatagaggcag

SEQ ID NO: 1174898 - DNA, 15 bp, Homo sapiens
cccatcactgcgcca

SEQ ID NO: 1174899 - DNA, 21 bp, Homo sapiens
cccatcactgcgccactgctc

SEQ ID NO: 1174900 - DNA, 14 bp, Homo sapiens
cccatcagaaggag

SEQ ID NO: 1174901 - DNA, 14 bp, Homo sapiens
cccatcagctccca

SEQ ID NO: 1174902 - DNA, 15 bp, Homo sapiens
cccatcaggcagtgt

SEQ ID NO: 1174903 - DNA, 23 bp, Homo sapiens
cccatcagtgctccctcacatgt

SEQ ID NO: 1174904 - DNA, 19 bp, Homo sapiens
cccatcatgtggccccacc

SEQ ID NO: 1174905 - DNA, 14 bp, Homo sapiens
cccatcattccttc

SEQ ID NO: 1174906 - DNA, 12 bp, Homo sapiens
cccatccagcca

SEQ ID NO: 1174907 - DNA, 13 bp, Homo sapiens
cccatccagccac

SEQ ID NO: 1174908 - DNA, 15 bp, Homo sapiens
cccatccagccacgg

SEQ ID NO: 1174909 - DNA, 17 bp, Homo sapiens
cccatccagccacggag

SEQ ID NO: 1174910 - DNA, 14 bp, Homo sapiens
cccatccagccaga

SEQ ID NO: 1174911 - DNA, 13 bp, Homo sapiens
cccatccagggcc

SEQ ID NO: 1174912 - DNA, 20 bp, Homo sapiens
cccatccagtctcccaactt

SEQ ID NO: 1174913 - DNA, 14 bp, Homo sapiens
cccatccagttcat

SEQ ID NO: 1174914 - DNA, 21 bp, Homo sapiens
cccatccagttcatgagaatc

SEQ ID NO: 1174915 - DNA, 19 bp, Homo sapiens
cccatccattaggccagca

SEQ ID NO: 1174916 - DNA, 13 bp, Homo sapiens
cccatcccacacc

SEQ ID NO: 1174917 - DNA, 15 bp, Homo sapiens
cccatcccacaccct

SEQ ID NO: 1174918 - DNA, 23 bp, Homo sapiens
cccatcccagggtcccaccccca

SEQ ID NO: 1174919 - DNA, 20 bp, Homo sapiens
cccatcccattttcatcctg

SEQ ID NO: 1174920 - DNA, 12 bp, Homo sapiens
cccatccccagg

SEQ ID NO: 1174921 - DNA, 16 bp, Homo sapiens
cccatccccgcagtgt

SEQ ID NO: 1174922 - DNA, 12 bp, Homo sapiens
cccatcccctca

SEQ ID NO: 1174923 - DNA, 17 bp, Homo sapiens
cccatccccttcctaaa

SEQ ID NO: 1174924 - DNA, 12 bp, Homo sapiens
cccatccccttt

SEQ ID NO: 1174925 - DNA, 16 bp, Homo sapiens
cccatcccctttcctc

SEQ ID NO: 1174926 - DNA, 17 bp, Homo sapiens
cccatcccctttcctcc

SEQ ID NO: 1174927 - DNA, 19 bp, Homo sapiens
cccatcccctttcctcccc

SEQ ID NO: 1174928 - DNA, 12 bp, Homo sapiens
cccatccctacc

SEQ ID NO: 1174929 - DNA, 12 bp, Homo sapiens
cccatccctgct

SEQ ID NO: 1174930 - DNA, 16 bp, Homo sapiens
cccatcccttttcctt

SEQ ID NO: 1174931 - DNA, 20 bp, Homo sapiens
cccatcctaccaatgcatgc

SEQ ID NO: 1174932 - DNA, 21 bp, Homo sapiens
cccatcctaccaatgcatgca

SEQ ID NO: 1174933 - DNA, 12 bp, Homo sapiens
cccatcctaccc

SEQ ID NO: 1174934 - DNA, 14 bp, Homo sapiens
cccatcctaccctc

SEQ ID NO: 1174935 - DNA, 18 bp, Homo sapiens
cccatcctccagcaggga

SEQ ID NO: 1174936 - DNA, 15 bp, Homo sapiens
cccatcctccagccc

SEQ ID NO: 1174937 - DNA, 18 bp, Homo sapiens
cccatcctccagccctgc

SEQ ID NO: 1174938 - DNA, 14 bp, Homo sapiens
cccatcctccagct

SEQ ID NO: 1174939 - DNA, 12 bp, Homo sapiens
cccatcctcccc

SEQ ID NO: 1174940 - DNA, 14 bp, Homo sapiens
cccatcctcccctt

SEQ ID NO: 1174941 - DNA, 19 bp, Homo sapiens
cccatcctctaaagcagag

SEQ ID NO: 1174942 - DNA, 14 bp, Homo sapiens
cccatcctggggca

SEQ ID NO: 1174943 - DNA, 23 bp, Homo sapiens
cccatcgccccaccgcagctact

SEQ ID NO: 1174944 - DNA, 16 bp, Homo sapiens
cccatcggccctgtcc

SEQ ID NO: 1174945 - DNA, 17 bp, Homo sapiens
cccatcggccctgtccc

SEQ ID NO: 1174946 - DNA, 17 bp, Homo sapiens
cccatcgtccaccccag

SEQ ID NO: 1174947 - DNA, 14 bp, Homo sapiens
cccatctcagcctc

SEQ ID NO: 1174948 - DNA, 17 bp, Homo sapiens
cccatctcagcctcctg

SEQ ID NO: 1174949 - DNA, 20 bp, Homo sapiens
cccatctcagcctcctgagc

SEQ ID NO: 1174950 - DNA, 13 bp, Homo sapiens
cccatctcaggac

SEQ ID NO: 1174951 - DNA, 15 bp, Homo sapiens
cccatctcaggtgcc

SEQ ID NO: 1174952 - DNA, 19 bp, Homo sapiens
cccatctcaggtgccactc

SEQ ID NO: 1174953 - DNA, 23 bp, Homo sapiens
cccatctcaggtgccactccctg

SEQ ID NO: 1174954 - DNA, 15 bp, Homo sapiens
cccatctcatcctgg

SEQ ID NO: 1174955 - DNA, 14 bp, Homo sapiens
cccatctcatgccc

SEQ ID NO: 1174956 - DNA, 16 bp, Homo sapiens
cccatctccccaggcc

SEQ ID NO: 1174957 - DNA, 17 bp, Homo sapiens
cccatctccccaggcct

SEQ ID NO: 1174958 - DNA, 22 bp, Homo sapiens
cccatctccccaggcctccagc

SEQ ID NO: 1174959 - DNA, 13 bp, Homo sapiens
cccatctccctgc

SEQ ID NO: 1174960 - DNA, 18 bp, Homo sapiens
cccatctccctgcctggc

SEQ ID NO: 1174961 - DNA, 12 bp, Homo sapiens
cccatctcctga

SEQ ID NO: 1174962 - DNA, 21 bp, Homo sapiens
cccatctccttacctctggaa

SEQ ID NO: 1174963 - DNA, 22 bp, Homo sapiens
cccatctccttacctctggaac

SEQ ID NO: 1174964 - DNA, 13 bp, Homo sapiens
cccatctcggagc

SEQ ID NO: 1174965 - DNA, 18 bp, Homo sapiens
cccatctcggagcatccc

SEQ ID NO: 1174966 - DNA, 15 bp, Homo sapiens
cccatctctcccact

SEQ ID NO: 1174967 - DNA, 18 bp, Homo sapiens
cccatctctcccacttcc

SEQ ID NO: 1174968 - DNA, 22 bp, Homo sapiens
cccatctctcccacttcctcct

SEQ ID NO: 1174969 - DNA, 18 bp, Homo sapiens
cccatctctccctcccct

SEQ ID NO: 1174970 - DNA, 15 bp, Homo sapiens
cccatctctgagtgg

SEQ ID NO: 1174971 - DNA, 13 bp, Homo sapiens
cccatctctgtct

SEQ ID NO: 1174972 - DNA, 16 bp, Homo sapiens
cccatctctgtctggg

SEQ ID NO: 1174973 - DNA, 18 bp, Homo sapiens
cccatctgggtccttgca

SEQ ID NO: 1174974 - DNA, 22 bp, Homo sapiens
cccatctgggtccttgcacccc

SEQ ID NO: 1174975 - DNA, 16 bp, Homo sapiens
cccatctggtcatttg

SEQ ID NO: 1174976 - DNA, 12 bp, Homo sapiens
cccatctgtcca

SEQ ID NO: 1174977 - DNA, 13 bp, Homo sapiens
cccatctgtccag

SEQ ID NO: 1174978 - DNA, 22 bp, Homo sapiens
cccatctgtccagctggggcca

SEQ ID NO: 1174979 - DNA, 13 bp, Homo sapiens
cccatctgtgaat

SEQ ID NO: 1174980 - DNA, 15 bp, Homo sapiens
cccatcttccacctg

SEQ ID NO: 1174981 - DNA, 22 bp, Homo sapiens
cccatcttccacctgtgccctc

SEQ ID NO: 1174982 - DNA, 18 bp, Homo sapiens
cccatcttggcctcccag

SEQ ID NO: 1174983 - DNA, 22 bp, Homo sapiens
cccatgaagaaagcccctcgtt

SEQ ID NO: 1174984 - DNA, 18 bp, Homo sapiens
cccatgaagacaggacag

SEQ ID NO: 1174985 - DNA, 16 bp, Homo sapiens
cccatgaatcaaagac

SEQ ID NO: 1174986 - DNA, 13 bp, Homo sapiens
cccatgactgcac

SEQ ID NO: 1174987 - DNA, 24 bp, Homo sapiens
cccatgagctcggggtccaccagt

SEQ ID NO: 1174988 - DNA, 20 bp, Homo sapiens
cccatgagttgtcagctttg

SEQ ID NO: 1174989 - DNA, 17 bp, Homo sapiens
cccatgcacctcagggc

SEQ ID NO: 1174990 - DNA, 19 bp, Homo sapiens
cccatgcaggccctttgaa

SEQ ID NO: 1174991 - DNA, 21 bp, Homo sapiens
cccatgccaaagctagggtgg

SEQ ID NO: 1174992 - DNA, 18 bp, Homo sapiens
cccatgccacgttccaca

SEQ ID NO: 1174993 - DNA, 13 bp, Homo sapiens
cccatgccagaga

SEQ ID NO: 1174994 - DNA, 13 bp, Homo sapiens
cccatgccccctt

SEQ ID NO: 1174995 - DNA, 14 bp, Homo sapiens
cccatgcctgtcca

SEQ ID NO: 1174996 - DNA, 20 bp, Homo sapiens
cccatgcctgtccagcctgg

SEQ ID NO: 1174997 - DNA, 13 bp, Homo sapiens
cccatgctctgcc

SEQ ID NO: 1174998 - DNA, 12 bp, Homo sapiens
cccatgctgcct

SEQ ID NO: 1174999 - DNA, 19 bp, Homo sapiens
cccatgctgccttcaggga

SEQ ID NO: 1175000 - DNA, 16 bp, Homo sapiens
atctgtataatacttt

SEQ ID NO: 1175001 - DNA, 18 bp, Homo sapiens
atctgtataatactttgt

SEQ ID NO: 1175002 - DNA, 22 bp, Homo sapiens
atctgtatataagttgctgtgt

SEQ ID NO: 1175003 - DNA, 22 bp, Homo sapiens
atctgtcaaaacactgtggaac

SEQ ID NO: 1175004 - DNA, 20 bp, Homo sapiens
atctgtcacaataaatggcc

SEQ ID NO: 1175005 - DNA, 21 bp, Homo sapiens
atctgtcacaataaatggcca

SEQ ID NO: 1175006 - DNA, 23 bp, Homo sapiens
atctgtcacaataaatggccagt

SEQ ID NO: 1175007 - DNA, 18 bp, Homo sapiens
atctgtcagcatctggct

SEQ ID NO: 1175008 - DNA, 12 bp, Homo sapiens
atctgtcagttc

SEQ ID NO: 1175009 - DNA, 17 bp, Homo sapiens
atctgtcatctctctgg

SEQ ID NO: 1175010 - DNA, 18 bp, Homo sapiens
atctgtccaaaggaggct

SEQ ID NO: 1175011 - DNA, 23 bp, Homo sapiens
atctgtccaaaggaggctggcag

SEQ ID NO: 1175012 - DNA, 14 bp, Homo sapiens
atctgtccaaggaa

SEQ ID NO: 1175013 - DNA, 20 bp, Homo sapiens
atctgtccacatccccagag

SEQ ID NO: 1175014 - DNA, 22 bp, Homo sapiens
atctgtccacatccccagagcc

SEQ ID NO: 1175015 - DNA, 18 bp, Homo sapiens
atctgtcctcaccctgtg

SEQ ID NO: 1175016 - DNA, 21 bp, Homo sapiens
atctgtcctcaccctgtggga

SEQ ID NO: 1175017 - DNA, 13 bp, Homo sapiens
atctgtcctctgt

SEQ ID NO: 1175018 - DNA, 17 bp, Homo sapiens
atctgtcctctgtagta

SEQ ID NO: 1175019 - DNA, 14 bp, Homo sapiens
atctgtctggtggc

SEQ ID NO: 1175020 - DNA, 17 bp, Homo sapiens
atctgtctgtctgtggg

SEQ ID NO: 1175021 - DNA, 14 bp, Homo sapiens
atctgtcttggcat

SEQ ID NO: 1175022 - DNA, 19 bp, Homo sapiens
atctgtcttggcattaaac

SEQ ID NO: 1175023 - DNA, 17 bp, Homo sapiens
atctgtctttccactct

SEQ ID NO: 1175024 - DNA, 21 bp, Homo sapiens
atctgtctttccactctggat

SEQ ID NO: 1175025 - DNA, 21 bp, Homo sapiens
atctgtcttttatttaacaaa

SEQ ID NO: 1175026 - DNA, 16 bp, Homo sapiens
atctgtgaaatatcat

SEQ ID NO: 1175027 - DNA, 20 bp, Homo sapiens
atctgtgaagaaagaggtta

SEQ ID NO: 1175028 - DNA, 15 bp, Homo sapiens
cccatgtcacctcag

SEQ ID NO: 1175029 - DNA, 23 bp, Homo sapiens
cccatgtgctgggaaatgcagaa

SEQ ID NO: 1175030 - DNA, 19 bp, Homo sapiens
cccatgtgtacattctgcc

SEQ ID NO: 1175031 - DNA, 20 bp, Homo sapiens
cccatgtgtcccctcactct

SEQ ID NO: 1175032 - DNA, 19 bp, Homo sapiens
cccatgtgtgagtgtgtgc

SEQ ID NO: 1175033 - DNA, 19 bp, Homo sapiens
cccatgttctgcccccagc

SEQ ID NO: 1175034 - DNA, 21 bp, Homo sapiens
cccatgttctgcccccagccc

SEQ ID NO: 1175035 - DNA, 16 bp, Homo sapiens
cccatgttgcatgcct

SEQ ID NO: 1175036 - DNA, 23 bp, Homo sapiens
cccatgtttaaactttgtgcctt

SEQ ID NO: 1175037 - DNA, 18 bp, Homo sapiens
cccattattatttctgtt

SEQ ID NO: 1175038 - DNA, 18 bp, Homo sapiens
cccattccaaagctttat

SEQ ID NO: 1175039 - DNA, 21 bp, Homo sapiens
cccattcccccatgtggctga

SEQ ID NO: 1175040 - DNA, 19 bp, Homo sapiens
cccattccctgggatctgg

SEQ ID NO: 1175041 - DNA, 14 bp, Homo sapiens
cccattccttagct

SEQ ID NO: 1175042 - DNA, 21 bp, Homo sapiens
cccattccttgcgcctcagcc

SEQ ID NO: 1175043 - DNA, 17 bp, Homo sapiens
cccattcgtctgtccca

SEQ ID NO: 1175044 - DNA, 19 bp, Homo sapiens
cccattcgtctgtcccaga

SEQ ID NO: 1175045 - DNA, 20 bp, Homo sapiens
cccattctctctcctgtcca

SEQ ID NO: 1175046 - DNA, 21 bp, Homo sapiens
cccattctgcctccattctga

SEQ ID NO: 1175047 - DNA, 12 bp, Homo sapiens
cccattcttgag

SEQ ID NO: 1175048 - DNA, 13 bp, Homo sapiens
cccattgctgcca

SEQ ID NO: 1175049 - DNA, 23 bp, Homo sapiens
cccattgctgccaaggtggaggg

SEQ ID NO: 1175050 - DNA, 21 bp, Homo sapiens
cccattggagcacctgggccc

SEQ ID NO: 1175051 - DNA, 14 bp, Homo sapiens
cccattggccgagc

SEQ ID NO: 1175052 - DNA, 18 bp, Homo sapiens
cccattgtccctctgccc

SEQ ID NO: 1175053 - DNA, 17 bp, Homo sapiens
cccattgttcccttcct

SEQ ID NO: 1175054 - DNA, 18 bp, Homo sapiens
cccattgttcccttcctc

SEQ ID NO: 1175055 - DNA, 18 bp, Homo sapiens
cccatttagtgtgaatat

SEQ ID NO: 1175056 - DNA, 16 bp, Homo sapiens
cccatttcccatctgc

SEQ ID NO: 1175057 - DNA, 19 bp, Homo sapiens
cccatttcccatctgcacc

SEQ ID NO: 1175058 - DNA, 20 bp, Homo sapiens
cccatttctatttatttact

SEQ ID NO: 1175059 - DNA, 15 bp, Homo sapiens
cccatttctgcctcg

SEQ ID NO: 1175060 - DNA, 13 bp, Homo sapiens
cccatttctgttg

SEQ ID NO: 1175061 - DNA, 15 bp, Homo sapiens
cccatttgtcccaga

SEQ ID NO: 1175062 - DNA, 16 bp, Homo sapiens
cccatttgtgccagag

SEQ ID NO: 1175063 - DNA, 19 bp, Homo sapiens
cccattttcaactgctttg

SEQ ID NO: 1175064 - DNA, 14 bp, Homo sapiens
cccattttcccctt

SEQ ID NO: 1175065 - DNA, 17 bp, Homo sapiens
cccattttgaatcacat

SEQ ID NO: 1175066 - DNA, 17 bp, Homo sapiens
cccattttgagtgactc

SEQ ID NO: 1175067 - DNA, 18 bp, Homo sapiens
cccattttgagtgactcg

SEQ ID NO: 1175068 - DNA, 19 bp, Homo sapiens
cccattttgcaaaatttcc

SEQ ID NO: 1175069 - DNA, 22 bp, Homo sapiens
cccatttttgctaattatcaat

SEQ ID NO: 1175070 - DNA, 15 bp, Homo sapiens
ccccaaaaccacagc

SEQ ID NO: 1175071 - DNA, 16 bp, Homo sapiens
ccccaaaaccacagcc

SEQ ID NO: 1175072 - DNA, 22 bp, Homo sapiens
ccccaaaaccacagccctgtca

SEQ ID NO: 1175073 - DNA, 17 bp, Homo sapiens
ccccaaacaactcagct

SEQ ID NO: 1175074 - DNA, 23 bp, Homo sapiens
ccccaaacattaatcaccaaagt

SEQ ID NO: 1175075 - DNA, 14 bp, Homo sapiens
ccccaaagagcctg

SEQ ID NO: 1175076 - DNA, 21 bp, Homo sapiens
ccccaaagcagcaggcctctg

SEQ ID NO: 1175077 - DNA, 12 bp, Homo sapiens
ccccaaagcccc

SEQ ID NO: 1175078 - DNA, 16 bp, Homo sapiens
ccccaaagctttcctg

SEQ ID NO: 1175079 - DNA, 18 bp, Homo sapiens
ccccaaagctttcctgcc

SEQ ID NO: 1175080 - DNA, 22 bp, Homo sapiens
ccccaaaggacgcctgcaggag

SEQ ID NO: 1175081 - DNA, 13 bp, Homo sapiens
ccccaacacctgc

SEQ ID NO: 1175082 - DNA, 15 bp, Homo sapiens
ccccaacacctgctg

SEQ ID NO: 1175083 - DNA, 19 bp, Homo sapiens
ccccaacactgtgccctgg

SEQ ID NO: 1175084 - DNA, 22 bp, Homo sapiens
ccccaacatctccctcccacat

SEQ ID NO: 1175085 - DNA, 17 bp, Homo sapiens
ccccaaccaaggaagga

SEQ ID NO: 1175086 - DNA, 22 bp, Homo sapiens
ccccaaccaaggaaggagcccc

SEQ ID NO: 1175087 - DNA, 21 bp, Homo sapiens
ccccaacccaataaaactgat

SEQ ID NO: 1175088 - DNA, 21 bp, Homo sapiens
ccccaacccccgcaccaagca

SEQ ID NO: 1175089 - DNA, 15 bp, Homo sapiens
ccccaaccccctgca

SEQ ID NO: 1175090 - DNA, 21 bp, Homo sapiens
ccccaaccccgcggtgctctg

SEQ ID NO: 1175091 - DNA, 22 bp, Homo sapiens
ccccaaccccgcggtgctctgg

SEQ ID NO: 1175092 - DNA, 21 bp, Homo sapiens
ccccaacctcagggctcccag

SEQ ID NO: 1175093 - DNA, 22 bp, Homo sapiens
ccccaacctcagggctcccagg

SEQ ID NO: 1175094 - DNA, 21 bp, Homo sapiens
ccccaacctttccctcacccc

SEQ ID NO: 1175095 - DNA, 16 bp, Homo sapiens
ccccaacggggtgggg

SEQ ID NO: 1175096 - DNA, 13 bp, Homo sapiens
ccccaactcctgg

SEQ ID NO: 1175097 - DNA, 20 bp, Homo sapiens
ccccaactcgggctcccggg

SEQ ID NO: 1175098 - DNA, 19 bp, Homo sapiens
ccccaactctccccagtgc

SEQ ID NO: 1175099 - DNA, 14 bp, Homo sapiens
ccccaactctgagc

SEQ ID NO: 1175100 - DNA, 20 bp, Homo sapiens
ccccaagaggaagttcagat

SEQ ID NO: 1175101 - DNA, 17 bp, Homo sapiens
ccccaagaggggcgggc

SEQ ID NO: 1175102 - DNA, 18 bp, Homo sapiens
ccccaagaggggcgggct

SEQ ID NO: 1175103 - DNA, 15 bp, Homo sapiens
ccccaagcagccagc

SEQ ID NO: 1175104 - DNA, 14 bp, Homo sapiens
ccccaagcctggca

SEQ ID NO: 1175105 - DNA, 13 bp, Homo sapiens
ccccaagcctggg

SEQ ID NO: 1175106 - DNA, 13 bp, Homo sapiens
ccccaagctgggc

SEQ ID NO: 1175107 - DNA, 17 bp, Homo sapiens
ccccaaggatgaccaca

SEQ ID NO: 1175108 - DNA, 14 bp, Homo sapiens
ccccaagggctggg

SEQ ID NO: 1175109 - DNA, 13 bp, Homo sapiens
ccccaataaaggc

SEQ ID NO: 1175110 - DNA, 16 bp, Homo sapiens
ccccaataaaggcagc

SEQ ID NO: 1175111 - DNA, 17 bp, Homo sapiens
ccccaataaaggcagct

SEQ ID NO: 1175112 - DNA, 24 bp, Homo sapiens
ccccaataaaggcagctgcctctg

SEQ ID NO: 1175113 - DNA, 18 bp, Homo sapiens
ccccaatatttttggact

SEQ ID NO: 1175114 - DNA, 18 bp, Homo sapiens
ccccaatcggactgccaa

SEQ ID NO: 1175115 - DNA, 20 bp, Homo sapiens
ccccaatcgggtccagagac

SEQ ID NO: 1175116 - DNA, 23 bp, Homo sapiens
ccccaatgacacccatgccagag

SEQ ID NO: 1175117 - DNA, 13 bp, Homo sapiens
ccccaatgtctgt

SEQ ID NO: 1175118 - DNA, 21 bp, Homo sapiens
ccccaattacagggtgactca

SEQ ID NO: 1175119 - DNA, 13 bp, Homo sapiens
ccccacaacacgc

SEQ ID NO: 1175120 - DNA, 14 bp, Homo sapiens
ccccacacacaggc

SEQ ID NO: 1175121 - DNA, 17 bp, Homo sapiens
ccccacacacaggcctt

SEQ ID NO: 1175122 - DNA, 22 bp, Homo sapiens
ccccacacacaggccttctgtg

SEQ ID NO: 1175123 - DNA, 14 bp, Homo sapiens
ccccacacagcctc

SEQ ID NO: 1175124 - DNA, 13 bp, Homo sapiens
ccccacacagggc

SEQ ID NO: 1175125 - DNA, 16 bp, Homo sapiens
ccccacactccactct

SEQ ID NO: 1175126 - DNA, 16 bp, Homo sapiens
ccccacacttccctgg

SEQ ID NO: 1175127 - DNA, 21 bp, Homo sapiens
atcttctccccgaggctgccc

SEQ ID NO: 1175128 - DNA, 22 bp, Homo sapiens
atcttctccccgaggctgcccc

SEQ ID NO: 1175129 - DNA, 17 bp, Homo sapiens
atcttctctttgacaat

SEQ ID NO: 1175130 - DNA, 14 bp, Homo sapiens
atcttctgccttct

SEQ ID NO: 1175131 - DNA, 24 bp, Homo sapiens
atcttctgtgaaatataattgtac

SEQ ID NO: 1175132 - DNA, 12 bp, Homo sapiens
atcttcttgcat

SEQ ID NO: 1175133 - DNA, 17 bp, Homo sapiens
atcttctttataattct

SEQ ID NO: 1175134 - DNA, 16 bp, Homo sapiens
atcttctttattattc

SEQ ID NO: 1175135 - DNA, 18 bp, Homo sapiens
atcttctttattattcct

SEQ ID NO: 1175136 - DNA, 19 bp, Homo sapiens
atcttgaaaatattgaaga

SEQ ID NO: 1175137 - DNA, 17 bp, Homo sapiens
atcttgaaatgaaagta

SEQ ID NO: 1175138 - DNA, 14 bp, Homo sapiens
atcttgaatgtggt

SEQ ID NO: 1175139 - DNA, 20 bp, Homo sapiens
atcttgaatgtggtctcagg

SEQ ID NO: 1175140 - DNA, 20 bp, Homo sapiens
atcttgactaggtattgtct

SEQ ID NO: 1175141 - DNA, 22 bp, Homo sapiens
atcttgagccacagtcactgga

SEQ ID NO: 1175142 - DNA, 17 bp, Homo sapiens
atcttgatctttgagcc

SEQ ID NO: 1175143 - DNA, 15 bp, Homo sapiens
atcttgatggtgttt

SEQ ID NO: 1175144 - DNA, 16 bp, Homo sapiens
atcttgcccactggcc

SEQ ID NO: 1175145 - DNA, 19 bp, Homo sapiens
atcttgctaccagtattta

SEQ ID NO: 1175146 - DNA, 17 bp, Homo sapiens
atcttgctgcaggccct

SEQ ID NO: 1175147 - DNA, 20 bp, Homo sapiens
atcttgctgcaggccctccc

SEQ ID NO: 1175148 - DNA, 13 bp, Homo sapiens
atcttgctttctt

SEQ ID NO: 1175149 - DNA, 19 bp, Homo sapiens
ccccaccccggggaccctg

SEQ ID NO: 1175150 - DNA, 23 bp, Homo sapiens
ccccaccccggggaccctgtgac

SEQ ID NO: 1175151 - DNA, 16 bp, Homo sapiens
ccccacccctccacgt

SEQ ID NO: 1175152 - DNA, 13 bp, Homo sapiens
ccccacccctgcc

SEQ ID NO: 1175153 - DNA, 17 bp, Homo sapiens
ccccacccctgccccca

SEQ ID NO: 1175154 - DNA, 19 bp, Homo sapiens
ccccacccctgggggctct

SEQ ID NO: 1175155 - DNA, 22 bp, Homo sapiens
ccccaccccttccccaggccca

SEQ ID NO: 1175156 - DNA, 15 bp, Homo sapiens
ccccaccctccactc

SEQ ID NO: 1175157 - DNA, 17 bp, Homo sapiens
ccccaccctccatgctc

SEQ ID NO: 1175158 - DNA, 12 bp, Homo sapiens
ccccaccctggg

SEQ ID NO: 1175159 - DNA, 20 bp, Homo sapiens
ccccaccctgggccctgggc

SEQ ID NO: 1175160 - DNA, 16 bp, Homo sapiens
ccccaccgccgtggag

SEQ ID NO: 1175161 - DNA, 16 bp, Homo sapiens
ccccaccggaactggg

SEQ ID NO: 1175162 - DNA, 12 bp, Homo sapiens
ccccaccgggct

SEQ ID NO: 1175163 - DNA, 17 bp, Homo sapiens
ccccaccggtccagctg

SEQ ID NO: 1175164 - DNA, 22 bp, Homo sapiens
ccccaccggtccagctggcctg

SEQ ID NO: 1175165 - DNA, 11 bp, Homo sapiens
ccccacctccc

SEQ ID NO: 1175166 - DNA, 18 bp, Homo sapiens
ccccacctcccatttctg

SEQ ID NO: 1175167 - DNA, 13 bp, Homo sapiens
ccccacctcccca

SEQ ID NO: 1175168 - DNA, 14 bp, Homo sapiens
ccccacctcccgcc

SEQ ID NO: 1175169 - DNA, 14 bp, Homo sapiens
ccccacctctccaa

SEQ ID NO: 1175170 - DNA, 19 bp, Homo sapiens
ccccacctcttgtttctgg

SEQ ID NO: 1175171 - DNA, 21 bp, Homo sapiens
ccccaccttcaattcctgggc

SEQ ID NO: 1175172 - DNA, 13 bp, Homo sapiens
ccccaccttcccc

SEQ ID NO: 1175173 - DNA, 17 bp, Homo sapiens
ccccaccttccccagac

SEQ ID NO: 1175174 - DNA, 18 bp, Homo sapiens
ccccacgagggctggctg

SEQ ID NO: 1175175 - DNA, 17 bp, Homo sapiens
ccccacgagggtcagga

SEQ ID NO: 1175176 - DNA, 21 bp, Homo sapiens
ccccacggagacagaggaaag

SEQ ID NO: 1175177 - DNA, 21 bp, Homo sapiens
ccccacggggcctcgggacct

SEQ ID NO: 1175178 - DNA, 22 bp, Homo sapiens
ccccacggggcctcgggacctc

SEQ ID NO: 1175179 - DNA, 19 bp, Homo sapiens
ccccacgtgacagtgcctg

SEQ ID NO: 1175180 - DNA, 19 bp, Homo sapiens
ccccactactgcagcacct

SEQ ID NO: 1175181 - DNA, 16 bp, Homo sapiens
ccccactcaggggacc

SEQ ID NO: 1175182 - DNA, 11 bp, Homo sapiens
ccccactcagt

SEQ ID NO: 1175183 - DNA, 17 bp, Homo sapiens
ccccactccagcccgca

SEQ ID NO: 1175184 - DNA, 14 bp, Homo sapiens
ccccactccccacc

SEQ ID NO: 1175185 - DNA, 11 bp, Homo sapiens
ccccactcccg

SEQ ID NO: 1175186 - DNA, 21 bp, Homo sapiens
ccccactcccttgctggcccc

SEQ ID NO: 1175187 - DNA, 23 bp, Homo sapiens
ccccactcccttgctggccccag

SEQ ID NO: 1175188 - DNA, 19 bp, Homo sapiens
ccccactcctctcccacag

SEQ ID NO: 1175189 - DNA, 16 bp, Homo sapiens
ccccactcctctgctg

SEQ ID NO: 1175190 - DNA, 21 bp, Homo sapiens
ccccactctaggggtcaggct

SEQ ID NO: 1175191 - DNA, 15 bp, Homo sapiens
ccccactctcattcc

SEQ ID NO: 1175192 - DNA, 22 bp, Homo sapiens
ccccactctctcacccaccagc

SEQ ID NO: 1175193 - DNA, 21 bp, Homo sapiens
ccccactgacagcctcccacc

SEQ ID NO: 1175194 - DNA, 12 bp, Homo sapiens
ccccactgcagg

SEQ ID NO: 1175195 - DNA, 22 bp, Homo sapiens
ccccactgccagcagcagcagg

SEQ ID NO: 1175196 - DNA, 20 bp, Homo sapiens
ccccactgctaaggctgctg

SEQ ID NO: 1175197 - DNA, 23 bp, Homo sapiens
ccccactgctaaggctgctggct

SEQ ID NO: 1175198 - DNA, 13 bp, Homo sapiens
ccccactggacaa

SEQ ID NO: 1175199 - DNA, 13 bp, Homo sapiens
ccccactgggcca

SEQ ID NO: 1175200 - DNA, 19 bp, Homo sapiens
ccccactgggccagccctg

SEQ ID NO: 1175201 - DNA, 23 bp, Homo sapiens
ccccactgggccagccctgcagc

SEQ ID NO: 1175202 - DNA, 16 bp, Homo sapiens
ccccacttcccatctc

SEQ ID NO: 1175203 - DNA, 12 bp, Homo sapiens
ccccacttctgg

SEQ ID NO: 1175204 - DNA, 16 bp, Homo sapiens
ccccacttctggccac

SEQ ID NO: 1175205 - DNA, 14 bp, Homo sapiens
ccccagaaagcctc

SEQ ID NO: 1175206 - DNA, 16 bp, Homo sapiens
ccccagaaagcctcct

SEQ ID NO: 1175207 - DNA, 19 bp, Homo sapiens
ccccagaaagcctcctgcc

SEQ ID NO: 1175208 - DNA, 19 bp, Homo sapiens
ccccagaaatcactgtgaa

SEQ ID NO: 1175209 - DNA, 22 bp, Homo sapiens
ccccagaaatcactgtgaaatt

SEQ ID NO: 1175210 - DNA, 15 bp, Homo sapiens
ccccagaactggctg

SEQ ID NO: 1175211 - DNA, 17 bp, Homo sapiens
ccccagaactggctggg

SEQ ID NO: 1175212 - DNA, 19 bp, Homo sapiens
ccccagaactggctgggcc

SEQ ID NO: 1175213 - DNA, 16 bp, Homo sapiens
ccccagaaggcaggga

SEQ ID NO: 1175214 - DNA, 21 bp, Homo sapiens
ccccagaccaaccctgggacc

SEQ ID NO: 1175215 - DNA, 17 bp, Homo sapiens
ccccagacccatgtgct

SEQ ID NO: 1175216 - DNA, 17 bp, Homo sapiens
ccccagaccccagggca

SEQ ID NO: 1175217 - DNA, 15 bp, Homo sapiens
ccccagactgggccc

SEQ ID NO: 1175218 - DNA, 16 bp, Homo sapiens
ccccagactgggccca

SEQ ID NO: 1175219 - DNA, 22 bp, Homo sapiens
ccccagactgggcccaggcagg

SEQ ID NO: 1175220 - DNA, 23 bp, Homo sapiens
ccccagactgtagagatttttat

SEQ ID NO: 1175221 - DNA, 10 bp, Homo sapiens
ccccagagag

SEQ ID NO: 1175222 - DNA, 22 bp, Homo sapiens
ccccagagagagctctgcacgt

SEQ ID NO: 1175223 - DNA, 15 bp, Homo sapiens
ccccagagagcaggc

SEQ ID NO: 1175224 - DNA, 17 bp, Homo sapiens
ccccagagagcaggcag

SEQ ID NO: 1175225 - DNA, 18 bp, Homo sapiens
ccccagagagcaggcagg

SEQ ID NO: 1175226 - DNA, 21 bp, Homo sapiens
ccccagagcacccccaagcct

SEQ ID NO: 1175227 - DNA, 19 bp, Homo sapiens
ccccagagcccagctcttg

SEQ ID NO: 1175228 - DNA, 20 bp, Homo sapiens
ccccagagcccagctcttgc

SEQ ID NO: 1175229 - DNA, 21 bp, Homo sapiens
ccccagagcccagctcttgct

SEQ ID NO: 1175230 - DNA, 22 bp, Homo sapiens
ccccagagcccagctcttgctc

SEQ ID NO: 1175231 - DNA, 15 bp, Homo sapiens
ccccagagccccact

SEQ ID NO: 1175232 - DNA, 11 bp, Homo sapiens
ccccagagctg

SEQ ID NO: 1175233 - DNA, 16 bp, Homo sapiens
ccccagaggacacagg

SEQ ID NO: 1175234 - DNA, 14 bp, Homo sapiens
ccccagaggctccc

SEQ ID NO: 1175235 - DNA, 21 bp, Homo sapiens
ccccagagtgctgtcgggacc

SEQ ID NO: 1175236 - DNA, 15 bp, Homo sapiens
ccccagagtggccca

SEQ ID NO: 1175237 - DNA, 21 bp, Homo sapiens
ccccagagtgggagaggctgg

SEQ ID NO: 1175238 - DNA, 23 bp, Homo sapiens
ccccagagtgggagaggctggga

SEQ ID NO: 1175239 - DNA, 15 bp, Homo sapiens
ccccagataccagcc

SEQ ID NO: 1175240 - DNA, 18 bp, Homo sapiens
ccccagatcaccagcccg

SEQ ID NO: 1175241 - DNA, 18 bp, Homo sapiens
ccccagatctgcctgggc

SEQ ID NO: 1175242 - DNA, 20 bp, Homo sapiens
ccccagatctgcctgggcct

SEQ ID NO: 1175243 - DNA, 19 bp, Homo sapiens
ccccagattcttcagcttg

SEQ ID NO: 1175244 - DNA, 22 bp, Homo sapiens
ccccagcagaggcaggctggga

SEQ ID NO: 1175245 - DNA, 11 bp, Homo sapiens
ccccagcaggt

SEQ ID NO: 1175246 - DNA, 18 bp, Homo sapiens
ccccagcaggtgctgact

SEQ ID NO: 1175247 - DNA, 15 bp, Homo sapiens
ccccagcagtttctg

SEQ ID NO: 1175248 - DNA, 19 bp, Homo sapiens
ccccagcatcgggggcctg

SEQ ID NO: 1175249 - DNA, 22 bp, Homo sapiens
ccccagcatcgggggcctgcaa

SEQ ID NO: 1175250 - DNA, 16 bp, Homo sapiens
ccccagcattccagct

SEQ ID NO: 1175251 - DNA, 18 bp, Homo sapiens
ccccagcattccagctct

SEQ ID NO: 1175252 - DNA, 9 bp, Homo sapiens
ccccagcca

SEQ ID NO: 1175253 - DNA, 18 bp, Homo sapiens
ccccagccagcccttccc

SEQ ID NO: 1175254 - DNA, 13 bp, Homo sapiens
ccccagccaggct

SEQ ID NO: 1175255 - DNA, 15 bp, Homo sapiens
atgaaaaagattatt

SEQ ID NO: 1175256 - DNA, 17 bp, Homo sapiens
atgaaaaagctgcttct

SEQ ID NO: 1175257 - DNA, 13 bp, Homo sapiens
atgaaaaatataa

SEQ ID NO: 1175258 - DNA, 16 bp, Homo sapiens
atgaaaaatgtaaata

SEQ ID NO: 1175259 - DNA, 17 bp, Homo sapiens
atgaaaaatgtaaatac

SEQ ID NO: 1175260 - DNA, 13 bp, Homo sapiens
atgaaaaattctc

SEQ ID NO: 1175261 - DNA, 21 bp, Homo sapiens
atgaaaaatttaagcattgtt

SEQ ID NO: 1175262 - DNA, 22 bp, Homo sapiens
atgaaaaatttaagcattgttt

SEQ ID NO: 1175263 - DNA, 22 bp, Homo sapiens
atgaaaacaaataaaagttgaa

SEQ ID NO: 1175264 - DNA, 14 bp, Homo sapiens
atgaaaacacattt

SEQ ID NO: 1175265 - DNA, 18 bp, Homo sapiens
atgaaaacattcagagga

SEQ ID NO: 1175266 - DNA, 18 bp, Homo sapiens
atgaaaacgttttattgt

SEQ ID NO: 1175267 - DNA, 23 bp, Homo sapiens
atgaaaactagcattacattatt

SEQ ID NO: 1175268 - DNA, 12 bp, Homo sapiens
atgaaaactcat

SEQ ID NO: 1175269 - DNA, 12 bp, Homo sapiens
atgaaaacttat

SEQ ID NO: 1175270 - DNA, 17 bp, Homo sapiens
atgaaaacttttgtaaa

SEQ ID NO: 1175271 - DNA, 16 bp, Homo sapiens
atgaaggctgtatcta

SEQ ID NO: 1175272 - DNA, 19 bp, Homo sapiens
atgaagggaaattgtttat

SEQ ID NO: 1175273 - DNA, 17 bp, Homo sapiens
atgaagggcgagtgaat

SEQ ID NO: 1175274 - DNA, 16 bp, Homo sapiens
atgaaggttaggattt

SEQ ID NO: 1175275 - DNA, 21 bp, Homo sapiens
atgaaggttaggatttaacag

SEQ ID NO: 1175276 - DNA, 18 bp, Homo sapiens
atgaaggttttcatttgc

SEQ ID NO: 1175277 - DNA, 16 bp, Homo sapiens
atgaagtaaattatgt

SEQ ID NO: 1175278 - DNA, 19 bp, Homo sapiens
atgaagtaaattatgtaac

SEQ ID NO: 1175279 - DNA, 14 bp, Homo sapiens
atgaagtaatatgc

SEQ ID NO: 1175280 - DNA, 23 bp, Homo sapiens
atgaagtacagtagtttccctac

SEQ ID NO: 1175281 - DNA, 18 bp, Homo sapiens
atgaagtgttagatagaa

SEQ ID NO: 1175282 - DNA, 13 bp, Homo sapiens
atgaagttgctgt

SEQ ID NO: 1175283 - DNA, 17 bp, Homo sapiens
atgaagttgctgtttat

SEQ ID NO: 1175284 - DNA, 19 bp, Homo sapiens
atgaagttgctgtttattt

SEQ ID NO: 1175285 - DNA, 22 bp, Homo sapiens
atgaagttgctgtttatttttt

SEQ ID NO: 1175286 - DNA, 15 bp, Homo sapiens
atgaagtttaaattc

SEQ ID NO: 1175287 - DNA, 14 bp, Homo sapiens
atgaagttttacat

SEQ ID NO: 1175288 - DNA, 17 bp, Homo sapiens
atgaataaaacactcat

SEQ ID NO: 1175289 - DNA, 14 bp, Homo sapiens
atgaataaactgaa

SEQ ID NO: 1175290 - DNA, 15 bp, Homo sapiens
atgaataaactgaat

SEQ ID NO: 1175291 - DNA, 18 bp, Homo sapiens
atgaataaactgaatatt

SEQ ID NO: 1175292 - DNA, 23 bp, Homo sapiens
atgaataaactgaatattttgga

SEQ ID NO: 1175293 - DNA, 17 bp, Homo sapiens
atgaataaagacaccta

SEQ ID NO: 1175294 - DNA, 14 bp, Homo sapiens
atgaataacattta

SEQ ID NO: 1175295 - DNA, 19 bp, Homo sapiens
atgaataacatttaaattc

SEQ ID NO: 1175296 - DNA, 18 bp, Homo sapiens
atgaataatgcctttgta

SEQ ID NO: 1175297 - DNA, 15 bp, Homo sapiens
atgaataatttccca

SEQ ID NO: 1175298 - DNA, 12 bp, Homo sapiens
atgaatactttg

SEQ ID NO: 1175299 - DNA, 15 bp, Homo sapiens
atgaatatttataac

SEQ ID NO: 1175300 - DNA, 18 bp, Homo sapiens
atgaatatttataacagc

SEQ ID NO: 1175301 - DNA, 14 bp, Homo sapiens
atgaatcaaagaca

SEQ ID NO: 1175302 - DNA, 13 bp, Homo sapiens
atgaatgaaaata

SEQ ID NO: 1175303 - DNA, 17 bp, Homo sapiens
atgaatgaatggcttgg

SEQ ID NO: 1175304 - DNA, 20 bp, Homo sapiens
atgaatgaggtcccaggcag

SEQ ID NO: 1175305 - DNA, 16 bp, Homo sapiens
atgaatgcaaaattgt

SEQ ID NO: 1175306 - DNA, 15 bp, Homo sapiens
atgaatgcacactag

SEQ ID NO: 1175307 - DNA, 21 bp, Homo sapiens
atgaatgcccccagctggccc

SEQ ID NO: 1175308 - DNA, 18 bp, Homo sapiens
atgaatggtctggcaata

SEQ ID NO: 1175309 - DNA, 16 bp, Homo sapiens
atgaatgtatattttg

SEQ ID NO: 1175310 - DNA, 19 bp, Homo sapiens
atgaatgtatattttgtgt

SEQ ID NO: 1175311 - DNA, 13 bp, Homo sapiens
atgaatgtatcag

SEQ ID NO: 1175312 - DNA, 15 bp, Homo sapiens
atgaatgtatcagga

SEQ ID NO: 1175313 - DNA, 16 bp, Homo sapiens
atgaatgtatgtgcac

SEQ ID NO: 1175314 - DNA, 15 bp, Homo sapiens
atgaatgtatttatt

SEQ ID NO: 1175315 - DNA, 20 bp, Homo sapiens
atgaatgtatttatttggga

SEQ ID NO: 1175316 - DNA, 22 bp, Homo sapiens
atgaatgtcacatttgaattct

SEQ ID NO: 1175317 - DNA, 22 bp, Homo sapiens
atgaatgtcttttttcaaactt

SEQ ID NO: 1175318 - DNA, 12 bp, Homo sapiens
atgaatgtgctg

SEQ ID NO: 1175319 - DNA, 22 bp, Homo sapiens
atgaatgtttacactctttgta

SEQ ID NO: 1175320 - DNA, 16 bp, Homo sapiens
atgaattaaataaacc

SEQ ID NO: 1175321 - DNA, 15 bp, Homo sapiens
atgaattaattcaga

SEQ ID NO: 1175322 - DNA, 21 bp, Homo sapiens
atgaattactgtatataaact

SEQ ID NO: 1175323 - DNA, 16 bp, Homo sapiens
atgaattataacagtt

SEQ ID NO: 1175324 - DNA, 19 bp, Homo sapiens
atgaattataacagttata

SEQ ID NO: 1175325 - DNA, 22 bp, Homo sapiens
atgaattcccttttaatcaact

SEQ ID NO: 1175326 - DNA, 16 bp, Homo sapiens
atgaattcctagaatt

SEQ ID NO: 1175327 - DNA, 21 bp, Homo sapiens
atgaattcgatgcgtattctg

SEQ ID NO: 1175328 - DNA, 23 bp, Homo sapiens
atgaattcttcctctccttccca

SEQ ID NO: 1175329 - DNA, 13 bp, Homo sapiens
atgaatttaaata

SEQ ID NO: 1175330 - DNA, 15 bp, Homo sapiens
atgaatttaaggcaa

SEQ ID NO: 1175331 - DNA, 16 bp, Homo sapiens
atgaatttaaggcaaa

SEQ ID NO: 1175332 - DNA, 19 bp, Homo sapiens
atgaatttaaggcaaaaaa

SEQ ID NO: 1175333 - DNA, 15 bp, Homo sapiens
atgaatttagaaata

SEQ ID NO: 1175334 - DNA, 23 bp, Homo sapiens
atgaatttagaaatattcaaaat

SEQ ID NO: 1175335 - DNA, 15 bp, Homo sapiens
atgaatttatcttta

SEQ ID NO: 1175336 - DNA, 12 bp, Homo sapiens
atgaatttctac

SEQ ID NO: 1175337 - DNA, 18 bp, Homo sapiens
atgaatttcttctaatta

SEQ ID NO: 1175338 - DNA, 21 bp, Homo sapiens
atgaatttggagactctgtgg

SEQ ID NO: 1175339 - DNA, 14 bp, Homo sapiens
atgaattttaaagt

SEQ ID NO: 1175340 - DNA, 15 bp, Homo sapiens
atgaattttaaagta

SEQ ID NO: 1175341 - DNA, 16 bp, Homo sapiens
atgaattttaaagtat

SEQ ID NO: 1175342 - DNA, 22 bp, Homo sapiens
atgaattttaaagtatgcatta

SEQ ID NO: 1175343 - DNA, 18 bp, Homo sapiens
atgaattttcaagtaatt

SEQ ID NO: 1175344 - DNA, 14 bp, Homo sapiens
atgaattttttaat

SEQ ID NO: 1175345 - DNA, 21 bp, Homo sapiens
atgaatttttttcatcttctc

SEQ ID NO: 1175346 - DNA, 21 bp, Homo sapiens
atgacaaacctagcttttaaa

SEQ ID NO: 1175347 - DNA, 17 bp, Homo sapiens
atgacaaagccattctt

SEQ ID NO: 1175348 - DNA, 19 bp, Homo sapiens
atgacaaagccattctttt

SEQ ID NO: 1175349 - DNA, 14 bp, Homo sapiens
atgacaaagtgttg

SEQ ID NO: 1175350 - DNA, 13 bp, Homo sapiens
atgacaaattata

SEQ ID NO: 1175351 - DNA, 17 bp, Homo sapiens
atgacaaattggggctg

SEQ ID NO: 1175352 - DNA, 14 bp, Homo sapiens
atgacaacacttaa

SEQ ID NO: 1175353 - DNA, 20 bp, Homo sapiens
atgacaacagaaaaacaatc

SEQ ID NO: 1175354 - DNA, 19 bp, Homo sapiens
atgacaacttttaaagaaa

SEQ ID NO: 1175355 - DNA, 18 bp, Homo sapiens
atgacaagccccaggcag

SEQ ID NO: 1175356 - DNA, 17 bp, Homo sapiens
atgacaatgtgaaacca

SEQ ID NO: 1175357 - DNA, 17 bp, Homo sapiens
atgacacatttggcagt

SEQ ID NO: 1175358 - DNA, 17 bp, Homo sapiens
atgacacccatgccaga

SEQ ID NO: 1175359 - DNA, 13 bp, Homo sapiens
atgacaccctggc

SEQ ID NO: 1175360 - DNA, 14 bp, Homo sapiens
atgacagattctga

SEQ ID NO: 1175361 - DNA, 15 bp, Homo sapiens
atgacagattctgac

SEQ ID NO: 1175362 - DNA, 12 bp, Homo sapiens
atgacagctggc

SEQ ID NO: 1175363 - DNA, 13 bp, Homo sapiens
atgacagctggct

SEQ ID NO: 1175364 - DNA, 21 bp, Homo sapiens
atgacagctgtccctgtcacc

SEQ ID NO: 1175365 - DNA, 21 bp, Homo sapiens
atgacaggcgcctgccatcat

SEQ ID NO: 1175366 - DNA, 15 bp, Homo sapiens
atgacaggctgttca

SEQ ID NO: 1175367 - DNA, 17 bp, Homo sapiens
atgacaggtgtgagcca

SEQ ID NO: 1175368 - DNA, 18 bp, Homo sapiens
atgacaggtgtgagccac

SEQ ID NO: 1175369 - DNA, 22 bp, Homo sapiens
atgacagtccgtcaaaacagat

SEQ ID NO: 1175370 - DNA, 23 bp, Homo sapiens
atgacagtgcttgcatcctattt

SEQ ID NO: 1175371 - DNA, 23 bp, Homo sapiens
atgacatacgcttttaatgaaaa

SEQ ID NO: 1175372 - DNA, 17 bp, Homo sapiens
atgacatcaaaatgagt

SEQ ID NO: 1175373 - DNA, 16 bp, Homo sapiens
atgacatctcaggggc

SEQ ID NO: 1175374 - DNA, 22 bp, Homo sapiens
atgacattaaatgcaataattt

SEQ ID NO: 1175375 - DNA, 15 bp, Homo sapiens
atgacattatgtgga

SEQ ID NO: 1175376 - DNA, 20 bp, Homo sapiens
atgacattggatagaacatg

SEQ ID NO: 1175377 - DNA, 16 bp, Homo sapiens
atgacatttcatctgg

SEQ ID NO: 1175378 - DNA, 21 bp, Homo sapiens
atgacattttttttaactact

SEQ ID NO: 1175379 - DNA, 23 bp, Homo sapiens
atgaccaatattatactaagaaa

SEQ ID NO: 1175380 - DNA, 20 bp, Homo sapiens
atgaccacacccgaagtcct

SEQ ID NO: 1175381 - DNA, 17 bp, Homo sapiens
atgaccacgcacctcca

SEQ ID NO: 1175382 - DNA, 14 bp, Homo sapiens
atgaccagaaacag

SEQ ID NO: 1175383 - DNA, 19 bp, Homo sapiens
atgaccagaaacagggaca

SEQ ID NO: 1175384 - DNA, 12 bp, Homo sapiens
atgaccagaagc

SEQ ID NO: 1175385 - DNA, 18 bp, Homo sapiens
atgaccagggatgctggg

SEQ ID NO: 1175386 - DNA, 19 bp, Homo sapiens
ccccatctgggtccttgca

SEQ ID NO: 1175387 - DNA, 14 bp, Homo sapiens
ccccatctgtccag

SEQ ID NO: 1175388 - DNA, 17 bp, Homo sapiens
ccccatctgtcttcagc

SEQ ID NO: 1175389 - DNA, 12 bp, Homo sapiens
ccccatctgtga

SEQ ID NO: 1175390 - DNA, 14 bp, Homo sapiens
ccccatctgtgaat

SEQ ID NO: 1175391 - DNA, 23 bp, Homo sapiens
ccccatcttgatctttgagccca

SEQ ID NO: 1175392 - DNA, 14 bp, Homo sapiens
ccccatcttgcttc

SEQ ID NO: 1175393 - DNA, 17 bp, Homo sapiens
cccccgcagaggcagaa

SEQ ID NO: 1175394 - DNA, 23 bp, Homo sapiens
cccccgcagtccccagcccttct

SEQ ID NO: 1175395 - DNA, 14 bp, Homo sapiens
cccccgccacctca

SEQ ID NO: 1175396 - DNA, 13 bp, Homo sapiens
cccccgccacggc

SEQ ID NO: 1175397 - DNA, 17 bp, Homo sapiens
cccccgccacggccacc

SEQ ID NO: 1175398 - DNA, 19 bp, Homo sapiens
cccccgccacggccaccct

SEQ ID NO: 1175399 - DNA, 14 bp, Homo sapiens
cccccgccccacag

SEQ ID NO: 1175400 - DNA, 13 bp, Homo sapiens
cccccgccccaga

SEQ ID NO: 1175401 - DNA, 14 bp, Homo sapiens
cccccgccccaggc

SEQ ID NO: 1175402 - DNA, 13 bp, Homo sapiens
cccccgccccctg

SEQ ID NO: 1175403 - DNA, 12 bp, Homo sapiens
cccccgcgccct

SEQ ID NO: 1175404 - DNA, 18 bp, Homo sapiens
cccccgcgctcgcccagc

SEQ ID NO: 1175405 - DNA, 19 bp, Homo sapiens
cccccgcgctcgcccagca

SEQ ID NO: 1175406 - DNA, 17 bp, Homo sapiens
cccccgcttagccccgc

SEQ ID NO: 1175407 - DNA, 21 bp, Homo sapiens
cccccggctgggcctccttct

SEQ ID NO: 1175408 - DNA, 13 bp, Homo sapiens
cccccgggcctgc

SEQ ID NO: 1175409 - DNA, 13 bp, Homo sapiens
ccccctacccata

SEQ ID NO: 1175410 - DNA, 19 bp, Homo sapiens
ccccctcagccttgggacc

SEQ ID NO: 1175411 - DNA, 21 bp, Homo sapiens
ccccctcatctcattcaaacc

SEQ ID NO: 1175412 - DNA, 12 bp, Homo sapiens
ccccctccacac

SEQ ID NO: 1175413 - DNA, 22 bp, Homo sapiens
ccccctccaggagagagccagg

SEQ ID NO: 1175414 - DNA, 13 bp, Homo sapiens
ccccctccccagg

SEQ ID NO: 1175415 - DNA, 17 bp, Homo sapiens
ccccctccgcctccagg

SEQ ID NO: 1175416 - DNA, 13 bp, Homo sapiens
ccccctcctccag

SEQ ID NO: 1175417 - DNA, 13 bp, Homo sapiens
ccccctcctctct

SEQ ID NO: 1175418 - DNA, 23 bp, Homo sapiens
ccccctcctgctcctccctgccc

SEQ ID NO: 1175419 - DNA, 13 bp, Homo sapiens
ccccctcctggca

SEQ ID NO: 1175420 - DNA, 16 bp, Homo sapiens
ccccctcgccagcttg

SEQ ID NO: 1175421 - DNA, 18 bp, Homo sapiens
ccccctcgccagcttggc

SEQ ID NO: 1175422 - DNA, 10 bp, Homo sapiens
ccccctctcc

SEQ ID NO: 1175423 - DNA, 14 bp, Homo sapiens
ccccctctcctccc

SEQ ID NO: 1175424 - DNA, 21 bp, Homo sapiens
ccccctctcctcccagctgct

SEQ ID NO: 1175425 - DNA, 13 bp, Homo sapiens
ccccctctcgggc

SEQ ID NO: 1175426 - DNA, 13 bp, Homo sapiens
ccccctctgcttc

SEQ ID NO: 1175427 - DNA, 12 bp, Homo sapiens
ccccctctgtcc

SEQ ID NO: 1175428 - DNA, 14 bp, Homo sapiens
ccccctcttcaaag

SEQ ID NO: 1175429 - DNA, 22 bp, Homo sapiens
ccccctgagatcccctgagccc

SEQ ID NO: 1175430 - DNA, 19 bp, Homo sapiens
ccccctgcaaagcccagct

SEQ ID NO: 1175431 - DNA, 20 bp, Homo sapiens
ccccctgcaacttccgctga

SEQ ID NO: 1175432 - DNA, 22 bp, Homo sapiens
ccccctgccccccagcctctgg

SEQ ID NO: 1175433 - DNA, 13 bp, Homo sapiens
ccccctgccctcc

SEQ ID NO: 1175434 - DNA, 12 bp, Homo sapiens
ccccctgccctg

SEQ ID NO: 1175435 - DNA, 14 bp, Homo sapiens
ccccctgccctgca

SEQ ID NO: 1175436 - DNA, 20 bp, Homo sapiens
ccccctgctccaccagcagc

SEQ ID NO: 1175437 - DNA, 12 bp, Homo sapiens
ccccctgctgcc

SEQ ID NO: 1175438 - DNA, 14 bp, Homo sapiens
ccccctgctgccat

SEQ ID NO: 1175439 - DNA, 14 bp, Homo sapiens
ccccctgctgctgc

SEQ ID NO: 1175440 - DNA, 22 bp, Homo sapiens
ccccctggatgtcccctgtccc

SEQ ID NO: 1175441 - DNA, 21 bp, Homo sapiens
ccccctggcagctgcccctcc

SEQ ID NO: 1175442 - DNA, 15 bp, Homo sapiens
ccccctggcctctgt

SEQ ID NO: 1175443 - DNA, 19 bp, Homo sapiens
ccccctgggctggggcctc

SEQ ID NO: 1175444 - DNA, 19 bp, Homo sapiens
ccccctggggcttctcctg

SEQ ID NO: 1175445 - DNA, 23 bp, Homo sapiens
ccccctggggcttctcctgaccc

SEQ ID NO: 1175446 - DNA, 23 bp, Homo sapiens
ccccctggtggacagtcctggga

SEQ ID NO: 1175447 - DNA, 17 bp, Homo sapiens
ccccctgttccctgttc

SEQ ID NO: 1175448 - DNA, 21 bp, Homo sapiens
cccccttaaacttccaaagct

SEQ ID NO: 1175449 - DNA, 13 bp, Homo sapiens
cccccttcagctc

SEQ ID NO: 1175450 - DNA, 15 bp, Homo sapiens
cccccttcagtgccc

SEQ ID NO: 1175451 - DNA, 17 bp, Homo sapiens
cccccttcccttggagg

SEQ ID NO: 1175452 - DNA, 13 bp, Homo sapiens
cccccttctccca

SEQ ID NO: 1175453 - DNA, 16 bp, Homo sapiens
cccccttctctgctcc

SEQ ID NO: 1175454 - DNA, 15 bp, Homo sapiens
cccccttcttcctcc

SEQ ID NO: 1175455 - DNA, 18 bp, Homo sapiens
cccccttgaagcaataac

SEQ ID NO: 1175456 - DNA, 19 bp, Homo sapiens
cccccttgaagcaataact

SEQ ID NO: 1175457 - DNA, 18 bp, Homo sapiens
cccccttgatcgacttct

SEQ ID NO: 1175458 - DNA, 19 bp, Homo sapiens
cccccttgccctccgcctg

SEQ ID NO: 1175459 - DNA, 15 bp, Homo sapiens
cccccttgtcttccc

SEQ ID NO: 1175460 - DNA, 15 bp, Homo sapiens
ccccctttcacactg

SEQ ID NO: 1175461 - DNA, 13 bp, Homo sapiens
ccccctttcccgg

SEQ ID NO: 1175462 - DNA, 14 bp, Homo sapiens
ccccctttcccggg

SEQ ID NO: 1175463 - DNA, 20 bp, Homo sapiens
ccccctttcctggacactca

SEQ ID NO: 1175464 - DNA, 16 bp, Homo sapiens
ccccctttgaccttcc

SEQ ID NO: 1175465 - DNA, 18 bp, Homo sapiens
ccccgacactgctgcacc

SEQ ID NO: 1175466 - DNA, 15 bp, Homo sapiens
ccccgacagtggctc

SEQ ID NO: 1175467 - DNA, 14 bp, Homo sapiens
ccccgacggcctcc

SEQ ID NO: 1175468 - DNA, 20 bp, Homo sapiens
ccccgacggcctccaggagg

SEQ ID NO: 1175469 - DNA, 15 bp, Homo sapiens
ccccgactgcctgtc

SEQ ID NO: 1175470 - DNA, 16 bp, Homo sapiens
ccccgagaagtgctct

SEQ ID NO: 1175471 - DNA, 14 bp, Homo sapiens
ccccgagggctgag

SEQ ID NO: 1175472 - DNA, 13 bp, Homo sapiens
ccccgagtcctca

SEQ ID NO: 1175473 - DNA, 19 bp, Homo sapiens
ccccgatgtcccctgcggg

SEQ ID NO: 1175474 - DNA, 14 bp, Homo sapiens
ccccgcagacacct

SEQ ID NO: 1175475 - DNA, 12 bp, Homo sapiens
ccccgcagggtc

SEQ ID NO: 1175476 - DNA, 19 bp, Homo sapiens
ccccgcagtccccagccct

SEQ ID NO: 1175477 - DNA, 12 bp, Homo sapiens
ccccgccacagc

SEQ ID NO: 1175478 - DNA, 21 bp, Homo sapiens
ccccgccacggccaccctcct

SEQ ID NO: 1175479 - DNA, 13 bp, Homo sapiens
ccccgccccacat

SEQ ID NO: 1175480 - DNA, 16 bp, Homo sapiens
ccccgccccacattcc

SEQ ID NO: 1175481 - DNA, 13 bp, Homo sapiens
ccccgccccagcc

SEQ ID NO: 1175482 - DNA, 21 bp, Homo sapiens
ccccgccccagccctcagtca

SEQ ID NO: 1175483 - DNA, 18 bp, Homo sapiens
ccccgccccaggcttccg

SEQ ID NO: 1175484 - DNA, 22 bp, Homo sapiens
ccccgccccaggcttccgcgcc

SEQ ID NO: 1175485 - DNA, 16 bp, Homo sapiens
ccccgcccccagtccc

SEQ ID NO: 1175486 - DNA, 17 bp, Homo sapiens
ccccgccccccagagcc

SEQ ID NO: 1175487 - DNA, 19 bp, Homo sapiens
ccccgccccccagagccag

SEQ ID NO: 1175488 - DNA, 18 bp, Homo sapiens
ccccgcccccgccccgcg

SEQ ID NO: 1175489 - DNA, 13 bp, Homo sapiens
ccccgcctccact

SEQ ID NO: 1175490 - DNA, 19 bp, Homo sapiens
ccccgcctcctcccactgg

SEQ ID NO: 1175491 - DNA, 16 bp, Homo sapiens
ccccgcctgagtcagt

SEQ ID NO: 1175492 - DNA, 18 bp, Homo sapiens
ccccgcctgccctcatgg

SEQ ID NO: 1175493 - DNA, 12 bp, Homo sapiens
ccccgcctgcct

SEQ ID NO: 1175494 - DNA, 15 bp, Homo sapiens
ccccgccttcgtgtg

SEQ ID NO: 1175495 - DNA, 21 bp, Homo sapiens
ccccgcgctcgcccagcagga

SEQ ID NO: 1175496 - DNA, 12 bp, Homo sapiens
ccccgcggccca

SEQ ID NO: 1175497 - DNA, 13 bp, Homo sapiens
ccccgcggcccag

SEQ ID NO: 1175498 - DNA, 16 bp, Homo sapiens
ccccgcgggttctaga

SEQ ID NO: 1175499 - DNA, 23 bp, Homo sapiens
ccccgcggttcatacgcatccca

SEQ ID NO: 1175500 - DNA, 17 bp, Homo sapiens
ccccgctcccgctccca

SEQ ID NO: 1175501 - DNA, 13 bp, Homo sapiens
ccccgctccgtct

SEQ ID NO: 1175502 - DNA, 16 bp, Homo sapiens
ccccgctccgtctctg

SEQ ID NO: 1175503 - DNA, 21 bp, Homo sapiens
ccccgctccgtctctgtcctc

SEQ ID NO: 1175504 - DNA, 23 bp, Homo sapiens
ccccgctggaggatgtgggcagc

SEQ ID NO: 1175505 - DNA, 13 bp, Homo sapiens
ccccgctggctca

SEQ ID NO: 1175506 - DNA, 14 bp, Homo sapiens
ccccgctggctcac

SEQ ID NO: 1175507 - DNA, 21 bp, Homo sapiens
ccccgcttagccccgctgagc

SEQ ID NO: 1175508 - DNA, 21 bp, Homo sapiens
ccccgcttttgcagcagagga

SEQ ID NO: 1175509 - DNA, 15 bp, Homo sapiens
ccccggatcagagca

SEQ ID NO: 1175510 - DNA, 22 bp, Homo sapiens
ccccggcaagccacaggaagga

SEQ ID NO: 1175511 - DNA, 17 bp, Homo sapiens
ccccggccccagccaga

SEQ ID NO: 1175512 - DNA, 15 bp, Homo sapiens
ccccggcggcgccgg

SEQ ID NO: 1175513 - DNA, 21 bp, Homo sapiens
ccccggctttcctccggagcc

SEQ ID NO: 1175514 - DNA, 16 bp, Homo sapiens
ccccgggcctgcacag

SEQ ID NO: 1175515 - DNA, 17 bp, Homo sapiens
ccccgggctctctgctg

SEQ ID NO: 1175516 - DNA, 16 bp, Homo sapiens
cccctctcctcccagc

SEQ ID NO: 1175517 - DNA, 17 bp, Homo sapiens
cccctctcctcccagct

SEQ ID NO: 1175518 - DNA, 18 bp, Homo sapiens
cccctctcctcccagctg

SEQ ID NO: 1175519 - DNA, 20 bp, Homo sapiens
cccctctcctcccagctgct

SEQ ID NO: 1175520 - DNA, 14 bp, Homo sapiens
cccctctccttcct

SEQ ID NO: 1175521 - DNA, 13 bp, Homo sapiens
cccctctcgcccc

SEQ ID NO: 1175522 - DNA, 18 bp, Homo sapiens
cccctctcgccccatccc

SEQ ID NO: 1175523 - DNA, 18 bp, Homo sapiens
atgattcttctcttgtga

SEQ ID NO: 1175524 - DNA, 20 bp, Homo sapiens
atgattcttctcttgtgatt

SEQ ID NO: 1175525 - DNA, 19 bp, Homo sapiens
atgattgaattatatgttc

SEQ ID NO: 1175526 - DNA, 13 bp, Homo sapiens
atgattggattat

SEQ ID NO: 1175527 - DNA, 23 bp, Homo sapiens
atgattggcttaaagtgaaggaa

SEQ ID NO: 1175528 - DNA, 19 bp, Homo sapiens
atgattggttaaaatgtga

SEQ ID NO: 1175529 - DNA, 14 bp, Homo sapiens
atgattgtaaaata

SEQ ID NO: 1175530 - DNA, 15 bp, Homo sapiens
atgattgtaaaatag

SEQ ID NO: 1175531 - DNA, 18 bp, Homo sapiens
atgattgtaaaatagctt

SEQ ID NO: 1175532 - DNA, 16 bp, Homo sapiens
atgatttacagagaag

SEQ ID NO: 1175533 - DNA, 20 bp, Homo sapiens
atgatttatagtttgtacat

SEQ ID NO: 1175534 - DNA, 18 bp, Homo sapiens
atgatttatatatggcat

SEQ ID NO: 1175535 - DNA, 22 bp, Homo sapiens
atgatttatatatggcatattt

SEQ ID NO: 1175536 - DNA, 14 bp, Homo sapiens
atgatttcagtagc

SEQ ID NO: 1175537 - DNA, 13 bp, Homo sapiens
atgatttccttga

SEQ ID NO: 1175538 - DNA, 17 bp, Homo sapiens
atgatttccttgaatgt

SEQ ID NO: 1175539 - DNA, 18 bp, Homo sapiens
atgatttccttgaatgtg

SEQ ID NO: 1175540 - DNA, 18 bp, Homo sapiens
atgatttctagcaggcag

SEQ ID NO: 1175541 - DNA, 17 bp, Homo sapiens
atgatttgtcccagcct

SEQ ID NO: 1175542 - DNA, 13 bp, Homo sapiens
atgatttgtggaa

SEQ ID NO: 1175543 - DNA, 15 bp, Homo sapiens
atgatttgttttgaa

SEQ ID NO: 1175544 - DNA, 21 bp, Homo sapiens
atgattttaagtttctctgca

SEQ ID NO: 1175545 - DNA, 14 bp, Homo sapiens
atgattttattaca

SEQ ID NO: 1175546 - DNA, 12 bp, Homo sapiens
atgattttcctc

SEQ ID NO: 1175547 - DNA, 23 bp, Homo sapiens
atgattttgttttcatcccattt

SEQ ID NO: 1175548 - DNA, 15 bp, Homo sapiens
atgatttttctttac

SEQ ID NO: 1175549 - DNA, 15 bp, Homo sapiens
atgatttttgtcatc

SEQ ID NO: 1175550 - DNA, 23 bp, Homo sapiens
atgattttttgaaagttaacatt

SEQ ID NO: 1175551 - DNA, 17 bp, Homo sapiens
atgcaaaaactctttga

SEQ ID NO: 1175552 - DNA, 23 bp, Homo sapiens
atgcaaaaggttcactaaagcag

SEQ ID NO: 1175553 - DNA, 21 bp, Homo sapiens
atgcaaaagtcagcgtgacaa

SEQ ID NO: 1175554 - DNA, 24 bp, Homo sapiens
atgcaaaagtcagcgtgacaatat

SEQ ID NO: 1175555 - DNA, 17 bp, Homo sapiens
atgcaaaattgttttca

SEQ ID NO: 1175556 - DNA, 18 bp, Homo sapiens
atgcaaaatttttttaat

SEQ ID NO: 1175557 - DNA, 14 bp, Homo sapiens
atgcaaacagttct

SEQ ID NO: 1175558 - DNA, 14 bp, Homo sapiens
atgcaaactgcttt

SEQ ID NO: 1175559 - DNA, 15 bp, Homo sapiens
atgcaaactgcttta

SEQ ID NO: 1175560 - DNA, 17 bp, Homo sapiens
atgcaaactgctttatt

SEQ ID NO: 1175561 - DNA, 21 bp, Homo sapiens
atgcaaactgctttattttcc

SEQ ID NO: 1175562 - DNA, 15 bp, Homo sapiens
atgcaaagaaaatca

SEQ ID NO: 1175563 - DNA, 23 bp, Homo sapiens
atgcaaataaaacccaatacttt

SEQ ID NO: 1175564 - DNA, 11 bp, Homo sapiens
atgcaaatgaa

SEQ ID NO: 1175565 - DNA, 12 bp, Homo sapiens
atgcaaatgaat

SEQ ID NO: 1175566 - DNA, 17 bp, Homo sapiens
atgcaaatgaatcattg

SEQ ID NO: 1175567 - DNA, 18 bp, Homo sapiens
atgcaagagtggactgaa

SEQ ID NO: 1175568 - DNA, 15 bp, Homo sapiens
atgcaagatacagga

SEQ ID NO: 1175569 - DNA, 22 bp, Homo sapiens
atgcaagcttggtcaaactttt

SEQ ID NO: 1175570 - DNA, 15 bp, Homo sapiens
atgcaaggaaggaaa

SEQ ID NO: 1175571 - DNA, 16 bp, Homo sapiens
atgcaaggaaggaaag

SEQ ID NO: 1175572 - DNA, 22 bp, Homo sapiens
atgcaaggaccaggactccctc

SEQ ID NO: 1175573 - DNA, 16 bp, Homo sapiens
atgcaataaccagcat

SEQ ID NO: 1175574 - DNA, 15 bp, Homo sapiens
atgcaataactctgg

SEQ ID NO: 1175575 - DNA, 15 bp, Homo sapiens
atgcaatataagcat

SEQ ID NO: 1175576 - DNA, 21 bp, Homo sapiens
atgcaatcttggctcactgca

SEQ ID NO: 1175577 - DNA, 21 bp, Homo sapiens
atgcaatgaaacagatgataa

SEQ ID NO: 1175578 - DNA, 21 bp, Homo sapiens
atgcaatgtcttaaataaaac

SEQ ID NO: 1175579 - DNA, 22 bp, Homo sapiens
atgcaatgtcttaaataaaact

SEQ ID NO: 1175580 - DNA, 23 bp, Homo sapiens
atgcaatgtcttaaataaaacta

SEQ ID NO: 1175581 - DNA, 18 bp, Homo sapiens
atgcaatttaaaattatt

SEQ ID NO: 1175582 - DNA, 15 bp, Homo sapiens
atgcacaaaactact

SEQ ID NO: 1175583 - DNA, 21 bp, Homo sapiens
atgcacacacacacgctttct

SEQ ID NO: 1175584 - DNA, 15 bp, Homo sapiens
atgcacacacatata

SEQ ID NO: 1175585 - DNA, 21 bp, Homo sapiens
atgcacacagtgctttccgtg

SEQ ID NO: 1175586 - DNA, 19 bp, Homo sapiens
atgcacacattttttaaat

SEQ ID NO: 1175587 - DNA, 22 bp, Homo sapiens
atgcacacattttttaaatgca

SEQ ID NO: 1175588 - DNA, 23 bp, Homo sapiens
atgcacacattttttaaatgcac

SEQ ID NO: 1175589 - DNA, 15 bp, Homo sapiens
atgcacacggctggt

SEQ ID NO: 1175590 - DNA, 18 bp, Homo sapiens
atgcacacggctggtcac

SEQ ID NO: 1175591 - DNA, 21 bp, Homo sapiens
atgcacacggctggtcactct

SEQ ID NO: 1175592 - DNA, 22 bp, Homo sapiens
atgcacacggctggtcactctg

SEQ ID NO: 1175593 - DNA, 22 bp, Homo sapiens
atgcacactcatgcacacagat

SEQ ID NO: 1175594 - DNA, 16 bp, Homo sapiens
atgcacagagaagctg

SEQ ID NO: 1175595 - DNA, 16 bp, Homo sapiens
atgcacagagttgtta

SEQ ID NO: 1175596 - DNA, 17 bp, Homo sapiens
atgcacagagttgttac

SEQ ID NO: 1175597 - DNA, 16 bp, Homo sapiens
atgcacagctgcttgt

SEQ ID NO: 1175598 - DNA, 20 bp, Homo sapiens
atgcacagctgcttgtcctg

SEQ ID NO: 1175599 - DNA, 22 bp, Homo sapiens
atgcacagctgcttgtcctgct

SEQ ID NO: 1175600 - DNA, 12 bp, Homo sapiens
atgcacagctgt

SEQ ID NO: 1175601 - DNA, 17 bp, Homo sapiens
atgcacagtaaaaatgg

SEQ ID NO: 1175602 - DNA, 19 bp, Homo sapiens
atgcacagtatcttttctt

SEQ ID NO: 1175603 - DNA, 21 bp, Homo sapiens
atgcacagtatttgtaattaa

SEQ ID NO: 1175604 - DNA, 15 bp, Homo sapiens
atgcacagtggaaag

SEQ ID NO: 1175605 - DNA, 14 bp, Homo sapiens
atgcacatccctgg

SEQ ID NO: 1175606 - DNA, 21 bp, Homo sapiens
atgcacatgctgtctggccct

SEQ ID NO: 1175607 - DNA, 13 bp, Homo sapiens
atgcacatttata

SEQ ID NO: 1175608 - DNA, 15 bp, Homo sapiens
atgcacatttcagaa

SEQ ID NO: 1175609 - DNA, 12 bp, Homo sapiens
atgcacatttct

SEQ ID NO: 1175610 - DNA, 15 bp, Homo sapiens
atgcacatttctgga

SEQ ID NO: 1175611 - DNA, 15 bp, Homo sapiens
atgcaccaccaagcc

SEQ ID NO: 1175612 - DNA, 21 bp, Homo sapiens
atgcaccaccaagccaaggga

SEQ ID NO: 1175613 - DNA, 16 bp, Homo sapiens
atgcaccatggagacg

SEQ ID NO: 1175614 - DNA, 18 bp, Homo sapiens
atgcacccctggaaccag

SEQ ID NO: 1175615 - DNA, 15 bp, Homo sapiens
atgcacctcagggcc

SEQ ID NO: 1175616 - DNA, 16 bp, Homo sapiens
atgcacctcagggcca

SEQ ID NO: 1175617 - DNA, 13 bp, Homo sapiens
atgcacctggaat

SEQ ID NO: 1175618 - DNA, 14 bp, Homo sapiens
atgcacctggaata

SEQ ID NO: 1175619 - DNA, 19 bp, Homo sapiens
atgcacctggaatatataa

SEQ ID NO: 1175620 - DNA, 20 bp, Homo sapiens
atgcaccttatatttctgtg

SEQ ID NO: 1175621 - DNA, 21 bp, Homo sapiens
atgcaccttatatttctgtgt

SEQ ID NO: 1175622 - DNA, 15 bp, Homo sapiens
atgcactatatgttt

SEQ ID NO: 1175623 - DNA, 20 bp, Homo sapiens
atgcactatatgtttacaca

SEQ ID NO: 1175624 - DNA, 23 bp, Homo sapiens
atgcactatatgtttacacaatt

SEQ ID NO: 1175625 - DNA, 21 bp, Homo sapiens
atgcactatatttgtatatat

SEQ ID NO: 1175626 - DNA, 14 bp, Homo sapiens
atgcactatgtata

SEQ ID NO: 1175627 - DNA, 22 bp, Homo sapiens
atgcactgaaaacttagccaga

SEQ ID NO: 1175628 - DNA, 11 bp, Homo sapiens
atgcactgagg

SEQ ID NO: 1175629 - DNA, 15 bp, Homo sapiens
atgcactgtggtttc

SEQ ID NO: 1175630 - DNA, 18 bp, Homo sapiens
atgcactgtggtttcaga

SEQ ID NO: 1175631 - DNA, 20 bp, Homo sapiens
atgcactgtggtttcagatg

SEQ ID NO: 1175632 - DNA, 23 bp, Homo sapiens
atgcactgtggtttcagatgtgc

SEQ ID NO: 1175633 - DNA, 21 bp, Homo sapiens
atgcactgttccccctgtgca

SEQ ID NO: 1175634 - DNA, 12 bp, Homo sapiens
atgcactgtttt

SEQ ID NO: 1175635 - DNA, 21 bp, Homo sapiens
atgcacttaaagaagtatttt

SEQ ID NO: 1175636 - DNA, 23 bp, Homo sapiens
atgcacttcaaataattaaatct

SEQ ID NO: 1175637 - DNA, 18 bp, Homo sapiens
atgccactgccaggcacc

SEQ ID NO: 1175638 - DNA, 19 bp, Homo sapiens
atgccactgccaggcacct

SEQ ID NO: 1175639 - DNA, 14 bp, Homo sapiens
atgccactgccttc

SEQ ID NO: 1175640 - DNA, 19 bp, Homo sapiens
atgccacttctcactcacc

SEQ ID NO: 1175641 - DNA, 14 bp, Homo sapiens
atgccagaaacagt

SEQ ID NO: 1175642 - DNA, 14 bp, Homo sapiens
atgccagcttctct

SEQ ID NO: 1175643 - DNA, 15 bp, Homo sapiens
atgccagcttctctc

SEQ ID NO: 1175644 - DNA, 21 bp, Homo sapiens
atgccagggccatgtcagaca

SEQ ID NO: 1175645 - DNA, 14 bp, Homo sapiens
atgccagggcccag

SEQ ID NO: 1175646 - DNA, 21 bp, Homo sapiens
atgccaggttaggaaggcagc

SEQ ID NO: 1175647 - DNA, 13 bp, Homo sapiens
atgccagtatttt

SEQ ID NO: 1175648 - DNA, 14 bp, Homo sapiens
atgccagtattttt

SEQ ID NO: 1175649 - DNA, 22 bp, Homo sapiens
atgccagtatttttaaaggcat

SEQ ID NO: 1175650 - DNA, 18 bp, Homo sapiens
atgccataaatacaagat

SEQ ID NO: 1175651 - DNA, 16 bp, Homo sapiens
atgccatcagcccctg

SEQ ID NO: 1175652 - DNA, 18 bp, Homo sapiens
atgccatcagcccctggg

SEQ ID NO: 1175653 - DNA, 19 bp, Homo sapiens
atgccatcagcccctggga

SEQ ID NO: 1175654 - DNA, 15 bp, Homo sapiens
atgccatcatctcct

SEQ ID NO: 1175655 - DNA, 23 bp, Homo sapiens
atgccatgatttttggtatttat

SEQ ID NO: 1175656 - DNA, 16 bp, Homo sapiens
atgccattacagaacc

SEQ ID NO: 1175657 - DNA, 15 bp, Homo sapiens
atgccatttctcacg

SEQ ID NO: 1175658 - DNA, 22 bp, Homo sapiens
atgccatttcttctctctgttc

SEQ ID NO: 1175659 - DNA, 17 bp, Homo sapiens
atgcccaagccctgaga

SEQ ID NO: 1175660 - DNA, 18 bp, Homo sapiens
atgcccaccccctgccct

SEQ ID NO: 1175661 - DNA, 20 bp, Homo sapiens
atgcccaccccctgccctgc

SEQ ID NO: 1175662 - DNA, 16 bp, Homo sapiens
atgcccacctgcccat

SEQ ID NO: 1175663 - DNA, 19 bp, Homo sapiens
atgcccacctgcccatcac

SEQ ID NO: 1175664 - DNA, 12 bp, Homo sapiens
atgcccagaaga

SEQ ID NO: 1175665 - DNA, 20 bp, Homo sapiens
atgcccagagggcccaggca

SEQ ID NO: 1175666 - DNA, 21 bp, Homo sapiens
atgcccagagggcccaggcag

SEQ ID NO: 1175667 - DNA, 23 bp, Homo sapiens
atgcccagagggcccaggcaggc

SEQ ID NO: 1175668 - DNA, 13 bp, Homo sapiens
atgcccagatgaa

SEQ ID NO: 1175669 - DNA, 19 bp, Homo sapiens
atgcccagatgaactgact

SEQ ID NO: 1175670 - DNA, 17 bp, Homo sapiens
atgcccagattcccaga

SEQ ID NO: 1175671 - DNA, 15 bp, Homo sapiens
atgcccagccagcca

SEQ ID NO: 1175672 - DNA, 23 bp, Homo sapiens
atgcccagccagccacccctgcc

SEQ ID NO: 1175673 - DNA, 13 bp, Homo sapiens
atgcccagctctc

SEQ ID NO: 1175674 - DNA, 18 bp, Homo sapiens
atgcccagctctctgacg

SEQ ID NO: 1175675 - DNA, 18 bp, Homo sapiens
atgcccaggtaccaccct

SEQ ID NO: 1175676 - DNA, 13 bp, Homo sapiens
atgccccaaagtt

SEQ ID NO: 1175677 - DNA, 20 bp, Homo sapiens
atgccccacccccctcctcc

SEQ ID NO: 1175678 - DNA, 22 bp, Homo sapiens
atgccccacccccctcctcccc

SEQ ID NO: 1175679 - DNA, 15 bp, Homo sapiens
atgccccagagctgt

SEQ ID NO: 1175680 - DNA, 15 bp, Homo sapiens
atgccccagctctgg

SEQ ID NO: 1175681 - DNA, 20 bp, Homo sapiens
atgccccattccttgcgcct

SEQ ID NO: 1175682 - DNA, 23 bp, Homo sapiens
atgccccattccttgcgcctcag

SEQ ID NO: 1175683 - DNA, 14 bp, Homo sapiens
atgcccccaggcag

SEQ ID NO: 1175684 - DNA, 17 bp, Homo sapiens
atgcccccattctccca

SEQ ID NO: 1175685 - DNA, 13 bp, Homo sapiens
atgcccccctcaa

SEQ ID NO: 1175686 - DNA, 22 bp, Homo sapiens
atgcccccgacccccgcagagg

SEQ ID NO: 1175687 - DNA, 17 bp, Homo sapiens
atgccccctccaggaga

SEQ ID NO: 1175688 - DNA, 24 bp, Homo sapiens
atgccccctccaggagagagccag

SEQ ID NO: 1175689 - DNA, 16 bp, Homo sapiens
atgccccctgcttact

SEQ ID NO: 1175690 - DNA, 21 bp, Homo sapiens
atgcccccttcgctcctcctc

SEQ ID NO: 1175691 - DNA, 13 bp, Homo sapiens
atgcccctccccc

SEQ ID NO: 1175692 - DNA, 14 bp, Homo sapiens
atgcccctccccca

SEQ ID NO: 1175693 - DNA, 22 bp, Homo sapiens
atgcccctgcagtttggccctg

SEQ ID NO: 1175694 - DNA, 22 bp, Homo sapiens
atgccccttcttgggccccaga

SEQ ID NO: 1175695 - DNA, 16 bp, Homo sapiens
atgccccttggctgga

SEQ ID NO: 1175696 - DNA, 19 bp, Homo sapiens
atgccccttggctggatca

SEQ ID NO: 1175697 - DNA, 23 bp, Homo sapiens
atgcccgagtccgcccatccctg

SEQ ID NO: 1175698 - DNA, 20 bp, Homo sapiens
atgcccgggggacgcctgcc

SEQ ID NO: 1175699 - DNA, 14 bp, Homo sapiens
atgccctcagggga

SEQ ID NO: 1175700 - DNA, 15 bp, Homo sapiens
atgccctcccaggac

SEQ ID NO: 1175701 - DNA, 18 bp, Homo sapiens
atgccctcccaggaccct

SEQ ID NO: 1175702 - DNA, 13 bp, Homo sapiens
atgccctcctctc

SEQ ID NO: 1175703 - DNA, 14 bp, Homo sapiens
atgccctcctctcc

SEQ ID NO: 1175704 - DNA, 15 bp, Homo sapiens
atgccctcctctccc

SEQ ID NO: 1175705 - DNA, 17 bp, Homo sapiens
atgccctcttctccttg

SEQ ID NO: 1175706 - DNA, 20 bp, Homo sapiens
atgccctcttctccttgcct

SEQ ID NO: 1175707 - DNA, 13 bp, Homo sapiens
atgccctgcagag

SEQ ID NO: 1175708 - DNA, 13 bp, Homo sapiens
atgccctgccatt

SEQ ID NO: 1175709 - DNA, 16 bp, Homo sapiens
atgccctgcccttcct

SEQ ID NO: 1175710 - DNA, 14 bp, Homo sapiens
atgccctgctggcc

SEQ ID NO: 1175711 - DNA, 14 bp, Homo sapiens
atgccctggaggtg

SEQ ID NO: 1175712 - DNA, 15 bp, Homo sapiens
atgccctggaggtgg

SEQ ID NO: 1175713 - DNA, 16 bp, Homo sapiens
atgccctggaggtggc

SEQ ID NO: 1175714 - DNA, 16 bp, Homo sapiens
atgccctgggatgcct

SEQ ID NO: 1175715 - DNA, 16 bp, Homo sapiens
atgcccttctccttat

SEQ ID NO: 1175716 - DNA, 20 bp, Homo sapiens
atgccgaacattaggaattg

SEQ ID NO: 1175717 - DNA, 19 bp, Homo sapiens
atgccgatatactctagat

SEQ ID NO: 1175718 - DNA, 19 bp, Homo sapiens
atgccgcagggagggctgt

SEQ ID NO: 1175719 - DNA, 22 bp, Homo sapiens
atgccgtataggatgtcagaca

SEQ ID NO: 1175720 - DNA, 19 bp, Homo sapiens
atgccgtcctgctggagtg

SEQ ID NO: 1175721 - DNA, 20 bp, Homo sapiens
atgccgtcctgctggagtga

SEQ ID NO: 1175722 - DNA, 14 bp, Homo sapiens
atgcctaggtccct

SEQ ID NO: 1175723 - DNA, 17 bp, Homo sapiens
atgcctataaaatgccc

SEQ ID NO: 1175724 - DNA, 15 bp, Homo sapiens
atgcctcaatgtgac

SEQ ID NO: 1175725 - DNA, 19 bp, Homo sapiens
atgcctcaccacacccagg

SEQ ID NO: 1175726 - DNA, 16 bp, Homo sapiens
atgcctcactaatttt

SEQ ID NO: 1175727 - DNA, 21 bp, Homo sapiens
atgcctcactaatttttgtat

SEQ ID NO: 1175728 - DNA, 16 bp, Homo sapiens
atgcctcagtgtattt

SEQ ID NO: 1175729 - DNA, 20 bp, Homo sapiens
atgcctcagtgtatttgtat

SEQ ID NO: 1175730 - DNA, 13 bp, Homo sapiens
atgcctccaccgc

SEQ ID NO: 1175731 - DNA, 21 bp, Homo sapiens
atgcctccaccgctgcctaag

SEQ ID NO: 1175732 - DNA, 14 bp, Homo sapiens
atgcctcctcagga

SEQ ID NO: 1175733 - DNA, 15 bp, Homo sapiens
atgcctcctgtgggg

SEQ ID NO: 1175734 - DNA, 20 bp, Homo sapiens
atgcctctgacagtccacag

SEQ ID NO: 1175735 - DNA, 21 bp, Homo sapiens
atgcctctggaggcctctggc

SEQ ID NO: 1175736 - DNA, 15 bp, Homo sapiens
atgcctgaacttgaa

SEQ ID NO: 1175737 - DNA, 12 bp, Homo sapiens
atgcctgacccc

SEQ ID NO: 1175738 - DNA, 15 bp, Homo sapiens
atgcctgagggtgga

SEQ ID NO: 1175739 - DNA, 21 bp, Homo sapiens
atgcctgattcggacggccaa

SEQ ID NO: 1175740 - DNA, 12 bp, Homo sapiens
atgcctgccaaa

SEQ ID NO: 1175741 - DNA, 18 bp, Homo sapiens
atgcctgcgcctgctgcc

SEQ ID NO: 1175742 - DNA, 23 bp, Homo sapiens
atgcctgctttgaataaatgtgt

SEQ ID NO: 1175743 - DNA, 23 bp, Homo sapiens
atgcctgctttttggaaagtcag

SEQ ID NO: 1175744 - DNA, 15 bp, Homo sapiens
atgcctggagacaga

SEQ ID NO: 1175745 - DNA, 14 bp, Homo sapiens
atgcctggtatttt

SEQ ID NO: 1175746 - DNA, 16 bp, Homo sapiens
atgcctggtctttcct

SEQ ID NO: 1175747 - DNA, 18 bp, Homo sapiens
atgcctgtccagcctggg

SEQ ID NO: 1175748 - DNA, 21 bp, Homo sapiens
atgcctgtctctagctgttct

SEQ ID NO: 1175749 - DNA, 22 bp, Homo sapiens
atgcctgtctctgttcagatgt

SEQ ID NO: 1175750 - DNA, 16 bp, Homo sapiens
atgcctgtgaagcagt

SEQ ID NO: 1175751 - DNA, 13 bp, Homo sapiens
atgcctgttaatt

SEQ ID NO: 1175752 - DNA, 15 bp, Homo sapiens
atgccttaagcagaa

SEQ ID NO: 1175753 - DNA, 17 bp, Homo sapiens
atgccttaagcagaaca

SEQ ID NO: 1175754 - DNA, 18 bp, Homo sapiens
atgccttactcttcttga

SEQ ID NO: 1175755 - DNA, 16 bp, Homo sapiens
atgccttcatgaatct

SEQ ID NO: 1175756 - DNA, 13 bp, Homo sapiens
atgccttctgtat

SEQ ID NO: 1175757 - DNA, 16 bp, Homo sapiens
atgccttctgtggcca

SEQ ID NO: 1175758 - DNA, 23 bp, Homo sapiens
atgccttgaataataagcaggat

SEQ ID NO: 1175759 - DNA, 13 bp, Homo sapiens
atgctgctactta

SEQ ID NO: 1175760 - DNA, 21 bp, Homo sapiens
atgctgctctggtgcacgcct

SEQ ID NO: 1175761 - DNA, 15 bp, Homo sapiens
atgctgctgtgaatt

SEQ ID NO: 1175762 - DNA, 13 bp, Homo sapiens
atgctgctttccc

SEQ ID NO: 1175763 - DNA, 18 bp, Homo sapiens
atgctgctttcccctgtg

SEQ ID NO: 1175764 - DNA, 17 bp, Homo sapiens
atgctgctttgtccagg

SEQ ID NO: 1175765 - DNA, 20 bp, Homo sapiens
atgctgctttttggcacagt

SEQ ID NO: 1175766 - DNA, 23 bp, Homo sapiens
atgctggaacctgcaaaaaatac

SEQ ID NO: 1175767 - DNA, 12 bp, Homo sapiens
atgctggccagc

SEQ ID NO: 1175768 - DNA, 18 bp, Homo sapiens
atgctggccgctcctccc

SEQ ID NO: 1175769 - DNA, 15 bp, Homo sapiens
atgctggcctgactg

SEQ ID NO: 1175770 - DNA, 9 bp, Homo sapiens
atgctggga

SEQ ID NO: 1175771 - DNA, 16 bp, Homo sapiens
atgctgggactcagcc

SEQ ID NO: 1175772 - DNA, 14 bp, Homo sapiens
atgctgggccactg

SEQ ID NO: 1175773 - DNA, 19 bp, Homo sapiens
atgctgggccactggggac

SEQ ID NO: 1175774 - DNA, 16 bp, Homo sapiens
atgctgggctgggccc

SEQ ID NO: 1175775 - DNA, 16 bp, Homo sapiens
atgctggggtacacag

SEQ ID NO: 1175776 - DNA, 20 bp, Homo sapiens
atgctggggtacacagtgag

SEQ ID NO: 1175777 - DNA, 11 bp, Homo sapiens
atgctgggttg

SEQ ID NO: 1175778 - DNA, 23 bp, Homo sapiens
atgctgggttggtgcacagtgat

SEQ ID NO: 1175779 - DNA, 18 bp, Homo sapiens
atgctggtggctggtgag

SEQ ID NO: 1175780 - DNA, 21 bp, Homo sapiens
atgctggttttcctaaatgca

SEQ ID NO: 1175781 - DNA, 20 bp, Homo sapiens
atgctgtaacttaaaatagg

SEQ ID NO: 1175782 - DNA, 23 bp, Homo sapiens
atgctgtacatctattttggatt

SEQ ID NO: 1175783 - DNA, 19 bp, Homo sapiens
cccgatgtcccctgcgggc

SEQ ID NO: 1175784 - DNA, 16 bp, Homo sapiens
cccgcaaggcctctca

SEQ ID NO: 1175785 - DNA, 15 bp, Homo sapiens
cccgcacagccaccc

SEQ ID NO: 1175786 - DNA, 14 bp, Homo sapiens
cccgcacccccgcc

SEQ ID NO: 1175787 - DNA, 14 bp, Homo sapiens
cccgcactgcagac

SEQ ID NO: 1175788 - DNA, 19 bp, Homo sapiens
cccgcagacggtctgtgtg

SEQ ID NO: 1175789 - DNA, 20 bp, Homo sapiens
cccgcagacggtctgtgtgc

SEQ ID NO: 1175790 - DNA, 22 bp, Homo sapiens
cccgcagacggtctgtgtgctg

SEQ ID NO: 1175791 - DNA, 17 bp, Homo sapiens
cccgcagcccgcctgcc

SEQ ID NO: 1175792 - DNA, 15 bp, Homo sapiens
cccgcagcctggcat

SEQ ID NO: 1175793 - DNA, 19 bp, Homo sapiens
cccgcagcctggcatctgt

SEQ ID NO: 1175794 - DNA, 23 bp, Homo sapiens
cccgcagcctggcatctgtgcgt

SEQ ID NO: 1175795 - DNA, 22 bp, Homo sapiens
cccgcagcgcccccatctgtct

SEQ ID NO: 1175796 - DNA, 21 bp, Homo sapiens
cccgcaggaactgggctgggc

SEQ ID NO: 1175797 - DNA, 15 bp, Homo sapiens
cccgcagggccatgc

SEQ ID NO: 1175798 - DNA, 14 bp, Homo sapiens
cccgcagtccccag

SEQ ID NO: 1175799 - DNA, 22 bp, Homo sapiens
cccgcagtgtgcactaaggggc

SEQ ID NO: 1175800 - DNA, 13 bp, Homo sapiens
cccgcatgtgtgc

SEQ ID NO: 1175801 - DNA, 15 bp, Homo sapiens
cccgcatttctcatg

SEQ ID NO: 1175802 - DNA, 15 bp, Homo sapiens
cccgccaaaagctgc

SEQ ID NO: 1175803 - DNA, 15 bp, Homo sapiens
cccgccacctcaggg

SEQ ID NO: 1175804 - DNA, 16 bp, Homo sapiens
cccgccacctcagggc

SEQ ID NO: 1175805 - DNA, 15 bp, Homo sapiens
cccgccacggccacc

SEQ ID NO: 1175806 - DNA, 16 bp, Homo sapiens
cccgccacggccaccc

SEQ ID NO: 1175807 - DNA, 19 bp, Homo sapiens
cccgccacggccaccctcc

SEQ ID NO: 1175808 - DNA, 13 bp, Homo sapiens
cccgccagcctca

SEQ ID NO: 1175809 - DNA, 16 bp, Homo sapiens
cccgccagcctcagtg

SEQ ID NO: 1175810 - DNA, 17 bp, Homo sapiens
cccgccagggctgggga

SEQ ID NO: 1175811 - DNA, 18 bp, Homo sapiens
cccgcccactgtcctggg

SEQ ID NO: 1175812 - DNA, 20 bp, Homo sapiens
cccgcccactgtcctgggcg

SEQ ID NO: 1175813 - DNA, 19 bp, Homo sapiens
cccgccccacattccgaca

SEQ ID NO: 1175814 - DNA, 15 bp, Homo sapiens
cccgccccagccctc

SEQ ID NO: 1175815 - DNA, 14 bp, Homo sapiens
cccgccccaggctt

SEQ ID NO: 1175816 - DNA, 15 bp, Homo sapiens
cccgccccaggcttc

SEQ ID NO: 1175817 - DNA, 23 bp, Homo sapiens
cccgccccccacacttccctggc

SEQ ID NO: 1175818 - DNA, 15 bp, Homo sapiens
cccgccccccagagc

SEQ ID NO: 1175819 - DNA, 17 bp, Homo sapiens
cccgccccccagagcca

SEQ ID NO: 1175820 - DNA, 14 bp, Homo sapiens
cccgccccctccct

SEQ ID NO: 1175821 - DNA, 16 bp, Homo sapiens
cccgccccctgccctc

SEQ ID NO: 1175822 - DNA, 17 bp, Homo sapiens
cccgccccctgccctcc

SEQ ID NO: 1175823 - DNA, 16 bp, Homo sapiens
cccgccccgggctggc

SEQ ID NO: 1175824 - DNA, 21 bp, Homo sapiens
cccgccccgttgtgagctgga

SEQ ID NO: 1175825 - DNA, 16 bp, Homo sapiens
cccgcccctcgcccgc

SEQ ID NO: 1175826 - DNA, 19 bp, Homo sapiens
cccgcccctcgctgctgct

SEQ ID NO: 1175827 - DNA, 19 bp, Homo sapiens
cccgcccctgtggccctgg

SEQ ID NO: 1175828 - DNA, 12 bp, Homo sapiens
cccgccctcacc

SEQ ID NO: 1175829 - DNA, 18 bp, Homo sapiens
cccgccctcacctgcaga

SEQ ID NO: 1175830 - DNA, 13 bp, Homo sapiens
cccgccctcaggg

SEQ ID NO: 1175831 - DNA, 21 bp, Homo sapiens
cccgccctcaggggcctctct

SEQ ID NO: 1175832 - DNA, 15 bp, Homo sapiens
cccgccctcttcctg

SEQ ID NO: 1175833 - DNA, 22 bp, Homo sapiens
cccgccgccctggacagatggc

SEQ ID NO: 1175834 - DNA, 23 bp, Homo sapiens
cccgccgtctgcaggggcctgga

SEQ ID NO: 1175835 - DNA, 12 bp, Homo sapiens
cccgcctccact

SEQ ID NO: 1175836 - DNA, 24 bp, Homo sapiens
cccgcctccctctcagaggcctgc

SEQ ID NO: 1175837 - DNA, 14 bp, Homo sapiens
cccgcctgccaccg

SEQ ID NO: 1175838 - DNA, 21 bp, Homo sapiens
cccgcctgcccagactgatga

SEQ ID NO: 1175839 - DNA, 16 bp, Homo sapiens
cccgcctgccgtgcat

SEQ ID NO: 1175840 - DNA, 18 bp, Homo sapiens
cccgcctgccgtgcatgg

SEQ ID NO: 1175841 - DNA, 13 bp, Homo sapiens
cccgcctgcctgc

SEQ ID NO: 1175842 - DNA, 23 bp, Homo sapiens
cccgcctgctcccatcctcaccc

SEQ ID NO: 1175843 - DNA, 17 bp, Homo sapiens
cccgcctggccaggagc

SEQ ID NO: 1175844 - DNA, 21 bp, Homo sapiens
cccgcctggccaggagcaggc

SEQ ID NO: 1175845 - DNA, 14 bp, Homo sapiens
cccgcctgtcacaa

SEQ ID NO: 1175846 - DNA, 12 bp, Homo sapiens
cccgccttccaa

SEQ ID NO: 1175847 - DNA, 12 bp, Homo sapiens
cccgccttccct

SEQ ID NO: 1175848 - DNA, 17 bp, Homo sapiens
cccgccttcctcctcca

SEQ ID NO: 1175849 - DNA, 19 bp, Homo sapiens
cccgccttcctcctccaca

SEQ ID NO: 1175850 - DNA, 23 bp, Homo sapiens
cccgccttcctgggcagcctttc

SEQ ID NO: 1175851 - DNA, 14 bp, Homo sapiens
cccgcgctcaggag

SEQ ID NO: 1175852 - DNA, 16 bp, Homo sapiens
cccgcgctcaggaggt

SEQ ID NO: 1175853 - DNA, 19 bp, Homo sapiens
cccgcgctcgcccagcagg

SEQ ID NO: 1175854 - DNA, 13 bp, Homo sapiens
cccgcggcccaga

SEQ ID NO: 1175855 - DNA, 12 bp, Homo sapiens
cccgcggcctgg

SEQ ID NO: 1175856 - DNA, 19 bp, Homo sapiens
cccgcggcgcgaccctccc

SEQ ID NO: 1175857 - DNA, 16 bp, Homo sapiens
cccgcgggttctagac

SEQ ID NO: 1175858 - DNA, 19 bp, Homo sapiens
cccgcggtgctctggcggc

SEQ ID NO: 1175859 - DNA, 15 bp, Homo sapiens
cccgcgttcaagact

SEQ ID NO: 1175860 - DNA, 13 bp, Homo sapiens
cccgctcagccct

SEQ ID NO: 1175861 - DNA, 16 bp, Homo sapiens
cccgctccgtctctgt

SEQ ID NO: 1175862 - DNA, 20 bp, Homo sapiens
cccgctccgtctctgtcctc

SEQ ID NO: 1175863 - DNA, 20 bp, Homo sapiens
cccgctcctcccctcttgag

SEQ ID NO: 1175864 - DNA, 11 bp, Homo sapiens
cccgctctgga

SEQ ID NO: 1175865 - DNA, 18 bp, Homo sapiens
cccgctgagcttggagga

SEQ ID NO: 1175866 - DNA, 19 bp, Homo sapiens
cccgctgcaatgcctagac

SEQ ID NO: 1175867 - DNA, 12 bp, Homo sapiens
cccgctgcctct

SEQ ID NO: 1175868 - DNA, 12 bp, Homo sapiens
cccgctgctgct

SEQ ID NO: 1175869 - DNA, 14 bp, Homo sapiens
cccgctggagccca

SEQ ID NO: 1175870 - DNA, 18 bp, Homo sapiens
cccgctggagcccacagc

SEQ ID NO: 1175871 - DNA, 12 bp, Homo sapiens
cccgctggagga

SEQ ID NO: 1175872 - DNA, 13 bp, Homo sapiens
cccgctggaggat

SEQ ID NO: 1175873 - DNA, 21 bp, Homo sapiens
cccgctgggatttcttcgctg

SEQ ID NO: 1175874 - DNA, 15 bp, Homo sapiens
cccgctgggctgagc

SEQ ID NO: 1175875 - DNA, 21 bp, Homo sapiens
cccgctgggctgagcccctac

SEQ ID NO: 1175876 - DNA, 15 bp, Homo sapiens
cccgctgtgtcctcc

SEQ ID NO: 1175877 - DNA, 16 bp, Homo sapiens
cccgctgtgtcctccc

SEQ ID NO: 1175878 - DNA, 18 bp, Homo sapiens
cccgctgtgtcctccctc

SEQ ID NO: 1175879 - DNA, 12 bp, Homo sapiens
cccgcttagcct

SEQ ID NO: 1175880 - DNA, 19 bp, Homo sapiens
cccgcttagcctgcctcac

SEQ ID NO: 1175881 - DNA, 21 bp, Homo sapiens
cccgcttagcctgcctcaccc

SEQ ID NO: 1175882 - DNA, 21 bp, Homo sapiens
cccgtggcttggcatctgtgt

SEQ ID NO: 1175883 - DNA, 22 bp, Homo sapiens
cccgtggcttggcatctgtgtg

SEQ ID NO: 1175884 - DNA, 16 bp, Homo sapiens
cccgtggggtgctgcc

SEQ ID NO: 1175885 - DNA, 14 bp, Homo sapiens
cccgtgtaaataat

SEQ ID NO: 1175886 - DNA, 19 bp, Homo sapiens
cccgtgtggtaccttcagc

SEQ ID NO: 1175887 - DNA, 20 bp, Homo sapiens
cccgtgtggtaccttcagcc

SEQ ID NO: 1175888 - DNA, 18 bp, Homo sapiens
cccgtgtgtatttctaag

SEQ ID NO: 1175889 - DNA, 15 bp, Homo sapiens
cccgtgttcaggaca

SEQ ID NO: 1175890 - DNA, 18 bp, Homo sapiens
cccgttccaccccaagag

SEQ ID NO: 1175891 - DNA, 17 bp, Homo sapiens
cccgttctgctggcctg

SEQ ID NO: 1175892 - DNA, 19 bp, Homo sapiens
cccgttctgctggcctgga

SEQ ID NO: 1175893 - DNA, 15 bp, Homo sapiens
cccgttgtattcacc

SEQ ID NO: 1175894 - DNA, 22 bp, Homo sapiens
cccgtttcagtggaccctgtgg

SEQ ID NO: 1175895 - DNA, 12 bp, Homo sapiens
cccgtttctcca

SEQ ID NO: 1175896 - DNA, 14 bp, Homo sapiens
cccgtttctggtgg

SEQ ID NO: 1175897 - DNA, 23 bp, Homo sapiens
cccgtttggggcttttttttcct

SEQ ID NO: 1175898 - DNA, 17 bp, Homo sapiens
ccctaaactttggcctt

SEQ ID NO: 1175899 - DNA, 17 bp, Homo sapiens
ccctaaagatgggagga

SEQ ID NO: 1175900 - DNA, 21 bp, Homo sapiens
ccctaaccccttccagatcac

SEQ ID NO: 1175901 - DNA, 19 bp, Homo sapiens
ccctaactctgcccaccct

SEQ ID NO: 1175902 - DNA, 15 bp, Homo sapiens
ccctaagccagcctg

SEQ ID NO: 1175903 - DNA, 17 bp, Homo sapiens
ccctaagcccccagggc

SEQ ID NO: 1175904 - DNA, 13 bp, Homo sapiens
ccctaagccccgt

SEQ ID NO: 1175905 - DNA, 21 bp, Homo sapiens
ccctaagccccgtcccctaac

SEQ ID NO: 1175906 - DNA, 20 bp, Homo sapiens
ccctaagcctgtccccagac

SEQ ID NO: 1175907 - DNA, 23 bp, Homo sapiens
ccctaaggaatctgaaagtatat

SEQ ID NO: 1175908 - DNA, 19 bp, Homo sapiens
ccctaaggatctctcagga

SEQ ID NO: 1175909 - DNA, 22 bp, Homo sapiens
ccctaagggcagccctccatgg

SEQ ID NO: 1175910 - DNA, 21 bp, Homo sapiens
ccctaagtgatttccacaggt

SEQ ID NO: 1175911 - DNA, 15 bp, Homo sapiens
ccctaatctatggtc

SEQ ID NO: 1175912 - DNA, 23 bp, Homo sapiens
ccctaatctttcacttgaaagat

SEQ ID NO: 1175913 - DNA, 19 bp, Homo sapiens
ccctaatttaacccagctc

SEQ ID NO: 1175914 - DNA, 13 bp, Homo sapiens
ccctacaccttga

SEQ ID NO: 1175915 - DNA, 18 bp, Homo sapiens
atggacaatataaactga

SEQ ID NO: 1175916 - DNA, 20 bp, Homo sapiens
atggacacaaattttcaagt

SEQ ID NO: 1175917 - DNA, 16 bp, Homo sapiens
atggacacccccagct

SEQ ID NO: 1175918 - DNA, 21 bp, Homo sapiens
atggacaccccttatccagga

SEQ ID NO: 1175919 - DNA, 14 bp, Homo sapiens
atggacacgagcca

SEQ ID NO: 1175920 - DNA, 16 bp, Homo sapiens
atggacactacaccca

SEQ ID NO: 1175921 - DNA, 17 bp, Homo sapiens
atggacactacacccag

SEQ ID NO: 1175922 - DNA, 18 bp, Homo sapiens
atggacactacacccagc

SEQ ID NO: 1175923 - DNA, 22 bp, Homo sapiens
atggacactacacccagcaata

SEQ ID NO: 1175924 - DNA, 15 bp, Homo sapiens
atggacactccaggg

SEQ ID NO: 1175925 - DNA, 15 bp, Homo sapiens
atggacactccagtg

SEQ ID NO: 1175926 - DNA, 16 bp, Homo sapiens
atggacactgccaaga

SEQ ID NO: 1175927 - DNA, 20 bp, Homo sapiens
atggacactgccttagcctc

SEQ ID NO: 1175928 - DNA, 22 bp, Homo sapiens
atggacactgccttagcctctt

SEQ ID NO: 1175929 - DNA, 15 bp, Homo sapiens
atggacactttgaaa

SEQ ID NO: 1175930 - DNA, 22 bp, Homo sapiens
atggacactttgaaatgtgttt

SEQ ID NO: 1175931 - DNA, 23 bp, Homo sapiens
atggacactttgaaatgtgtttc

SEQ ID NO: 1175932 - DNA, 13 bp, Homo sapiens
atggacagacacc

SEQ ID NO: 1175933 - DNA, 23 bp, Homo sapiens
atggacagacacctccccctacc

SEQ ID NO: 1175934 - DNA, 14 bp, Homo sapiens
atggacaggctggc

SEQ ID NO: 1175935 - DNA, 18 bp, Homo sapiens
atggacagggcatgccac

SEQ ID NO: 1175936 - DNA, 14 bp, Homo sapiens
atggacagggccag

SEQ ID NO: 1175937 - DNA, 22 bp, Homo sapiens
atggacatcctgtataagcact

SEQ ID NO: 1175938 - DNA, 23 bp, Homo sapiens
atggacatcctgtataagcactg

SEQ ID NO: 1175939 - DNA, 23 bp, Homo sapiens
atggaccaacctgctctgtcccc

SEQ ID NO: 1175940 - DNA, 22 bp, Homo sapiens
atggaccagcccattggccgag

SEQ ID NO: 1175941 - DNA, 13 bp, Homo sapiens
atggacccctccc

SEQ ID NO: 1175942 - DNA, 18 bp, Homo sapiens
atggaccgggtgggcctg

SEQ ID NO: 1175943 - DNA, 19 bp, Homo sapiens
atggaccgggtgggcctgg

SEQ ID NO: 1175944 - DNA, 22 bp, Homo sapiens
atggaccgggtgggcctggcct

SEQ ID NO: 1175945 - DNA, 15 bp, Homo sapiens
atggacctaacattc

SEQ ID NO: 1175946 - DNA, 18 bp, Homo sapiens
atggacgaatatgaatgt

SEQ ID NO: 1175947 - DNA, 15 bp, Homo sapiens
atggacgcaggccct

SEQ ID NO: 1175948 - DNA, 16 bp, Homo sapiens
atggacgcaggccctg

SEQ ID NO: 1175949 - DNA, 20 bp, Homo sapiens
atggactaagtgggagaaat

SEQ ID NO: 1175950 - DNA, 20 bp, Homo sapiens
atggactatctgtctggtgg

SEQ ID NO: 1175951 - DNA, 19 bp, Homo sapiens
atggactcaggatccagtg

SEQ ID NO: 1175952 - DNA, 21 bp, Homo sapiens
atggactcaggatccagtgac

SEQ ID NO: 1175953 - DNA, 21 bp, Homo sapiens
atggactccagcctgcctggc

SEQ ID NO: 1175954 - DNA, 18 bp, Homo sapiens
atggactctacactgtga

SEQ ID NO: 1175955 - DNA, 22 bp, Homo sapiens
atggactggggagcacaggtgt

SEQ ID NO: 1175956 - DNA, 14 bp, Homo sapiens
atggacttctggat

SEQ ID NO: 1175957 - DNA, 16 bp, Homo sapiens
atggacttgtatattt

SEQ ID NO: 1175958 - DNA, 22 bp, Homo sapiens
atggacttgtatatttgtacaa

SEQ ID NO: 1175959 - DNA, 23 bp, Homo sapiens
atggacttgtatatttgtacaaa

SEQ ID NO: 1175960 - DNA, 19 bp, Homo sapiens
atggagaaagaagtggaga

SEQ ID NO: 1175961 - DNA, 22 bp, Homo sapiens
atggagaaagaagtggagacag

SEQ ID NO: 1175962 - DNA, 16 bp, Homo sapiens
atggagaagctgcagg

SEQ ID NO: 1175963 - DNA, 20 bp, Homo sapiens
atggagaatcacttttctag

SEQ ID NO: 1175964 - DNA, 21 bp, Homo sapiens
atggagactggtcctgtgtgc

SEQ ID NO: 1175965 - DNA, 15 bp, Homo sapiens
atggagagaggggaa

SEQ ID NO: 1175966 - DNA, 17 bp, Homo sapiens
atggagagaggggaata

SEQ ID NO: 1175967 - DNA, 19 bp, Homo sapiens
atggagaggacagagcagg

SEQ ID NO: 1175968 - DNA, 14 bp, Homo sapiens
atggagatgtaaaa

SEQ ID NO: 1175969 - DNA, 20 bp, Homo sapiens
atggagattcagttttcatt

SEQ ID NO: 1175970 - DNA, 15 bp, Homo sapiens
atggagcaaatgtcc

SEQ ID NO: 1175971 - DNA, 18 bp, Homo sapiens
atggagcatcaagccact

SEQ ID NO: 1175972 - DNA, 23 bp, Homo sapiens
atggagcccccagatagagctgg

SEQ ID NO: 1175973 - DNA, 22 bp, Homo sapiens
atggagctcagtaacataactg

SEQ ID NO: 1175974 - DNA, 19 bp, Homo sapiens
atggaggactccaggcagc

SEQ ID NO: 1175975 - DNA, 13 bp, Homo sapiens
atggaggagaaga

SEQ ID NO: 1175976 - DNA, 18 bp, Homo sapiens
atggaggattctttcccc

SEQ ID NO: 1175977 - DNA, 19 bp, Homo sapiens
atggaggattctttcccca

SEQ ID NO: 1175978 - DNA, 20 bp, Homo sapiens
atggaggattctttccccag

SEQ ID NO: 1175979 - DNA, 16 bp, Homo sapiens
atggaggcagagacct

SEQ ID NO: 1175980 - DNA, 12 bp, Homo sapiens
atggaggccaga

SEQ ID NO: 1175981 - DNA, 20 bp, Homo sapiens
atggaggccagagtctccca

SEQ ID NO: 1175982 - DNA, 14 bp, Homo sapiens
atggaggcttttca

SEQ ID NO: 1175983 - DNA, 15 bp, Homo sapiens
atggaggggaattca

SEQ ID NO: 1175984 - DNA, 17 bp, Homo sapiens
atggaggggagtgttgg

SEQ ID NO: 1175985 - DNA, 15 bp, Homo sapiens
atggaggggcagagc

SEQ ID NO: 1175986 - DNA, 16 bp, Homo sapiens
atggaggggggtgctg

SEQ ID NO: 1175987 - DNA, 18 bp, Homo sapiens
atggaggggtggtcctga

SEQ ID NO: 1175988 - DNA, 21 bp, Homo sapiens
atggagtcttgctctgtcacc

SEQ ID NO: 1175989 - DNA, 19 bp, Homo sapiens
atggagtgcaccaaagaga

SEQ ID NO: 1175990 - DNA, 18 bp, Homo sapiens
atggagtgctgttttgtt

SEQ ID NO: 1175991 - DNA, 19 bp, Homo sapiens
atggagtgctgttttgtta

SEQ ID NO: 1175992 - DNA, 12 bp, Homo sapiens
atggagtgtgca

SEQ ID NO: 1175993 - DNA, 18 bp, Homo sapiens
atggagtgtgtattgttc

SEQ ID NO: 1175994 - DNA, 14 bp, Homo sapiens
atggagtttctctc

SEQ ID NO: 1175995 - DNA, 15 bp, Homo sapiens
atggagtttctctct

SEQ ID NO: 1175996 - DNA, 16 bp, Homo sapiens
atggagtttctctctt

SEQ ID NO: 1175997 - DNA, 14 bp, Homo sapiens
atggataaatcagt

SEQ ID NO: 1175998 - DNA, 19 bp, Homo sapiens
atggataacctatatgatt

SEQ ID NO: 1175999 - DNA, 14 bp, Homo sapiens
atggatacataaag

SEQ ID NO: 1176000 - DNA, 17 bp, Homo sapiens
atggatacttcctgggt

SEQ ID NO: 1176001 - DNA, 18 bp, Homo sapiens
atggatatagaaaatctt

SEQ ID NO: 1176002 - DNA, 22 bp, Homo sapiens
atggatatagttttacttttaa

SEQ ID NO: 1176003 - DNA, 16 bp, Homo sapiens
atggctaattcccaga

SEQ ID NO: 1176004 - DNA, 16 bp, Homo sapiens
atggctagtactgtat

SEQ ID NO: 1176005 - DNA, 21 bp, Homo sapiens
atggctagtactgtattggct

SEQ ID NO: 1176006 - DNA, 16 bp, Homo sapiens
atggctataaatatat

SEQ ID NO: 1176007 - DNA, 14 bp, Homo sapiens
atggctatatggca

SEQ ID NO: 1176008 - DNA, 14 bp, Homo sapiens
atggctatgcttaa

SEQ ID NO: 1176009 - DNA, 13 bp, Homo sapiens
atggctattttat

SEQ ID NO: 1176010 - DNA, 14 bp, Homo sapiens
atggctcaagtaga

SEQ ID NO: 1176011 - DNA, 19 bp, Homo sapiens
atggctcagagcttgaaga

SEQ ID NO: 1176012 - DNA, 13 bp, Homo sapiens
atggctcagaggg

SEQ ID NO: 1176013 - DNA, 20 bp, Homo sapiens
atggctcattgtagcacaat

SEQ ID NO: 1176014 - DNA, 15 bp, Homo sapiens
atggctccagaaatg

SEQ ID NO: 1176015 - DNA, 16 bp, Homo sapiens
atggctccagaaatgt

SEQ ID NO: 1176016 - DNA, 17 bp, Homo sapiens
atggctccagaaatgtc

SEQ ID NO: 1176017 - DNA, 13 bp, Homo sapiens
atggctccagtct

SEQ ID NO: 1176018 - DNA, 17 bp, Homo sapiens
atggctcccaaggttcc

SEQ ID NO: 1176019 - DNA, 17 bp, Homo sapiens
atggctcctgtctggct

SEQ ID NO: 1176020 - DNA, 15 bp, Homo sapiens
atggctgaagctgga

SEQ ID NO: 1176021 - DNA, 21 bp, Homo sapiens
atggctgaaggaaaccagtgc

SEQ ID NO: 1176022 - DNA, 22 bp, Homo sapiens
atggctgaaggaaaccagtgca

SEQ ID NO: 1176023 - DNA, 14 bp, Homo sapiens
atggctgagatgga

SEQ ID NO: 1176024 - DNA, 13 bp, Homo sapiens
atggctgagcctc

SEQ ID NO: 1176025 - DNA, 18 bp, Homo sapiens
atggctgatttatttcta

SEQ ID NO: 1176026 - DNA, 19 bp, Homo sapiens
atggctgcacctttttgca

SEQ ID NO: 1176027 - DNA, 19 bp, Homo sapiens
atggctgtatttgctgttg

SEQ ID NO: 1176028 - DNA, 13 bp, Homo sapiens
atggctgtctgca

SEQ ID NO: 1176029 - DNA, 18 bp, Homo sapiens
atggctgtgcctctgcct

SEQ ID NO: 1176030 - DNA, 21 bp, Homo sapiens
atggctgtgtttgcagcctgc

SEQ ID NO: 1176031 - DNA, 14 bp, Homo sapiens
atggcttatttcta

SEQ ID NO: 1176032 - DNA, 17 bp, Homo sapiens
atggcttcctcctccct

SEQ ID NO: 1176033 - DNA, 17 bp, Homo sapiens
atggcttgttctctgga

SEQ ID NO: 1176034 - DNA, 20 bp, Homo sapiens
atggctttaaataaattaag

SEQ ID NO: 1176035 - DNA, 22 bp, Homo sapiens
atggctttcaatacccttttaa

SEQ ID NO: 1176036 - DNA, 17 bp, Homo sapiens
atggctttcatcctgtg

SEQ ID NO: 1176037 - DNA, 16 bp, Homo sapiens
atggcttttgtgcatt

SEQ ID NO: 1176038 - DNA, 18 bp, Homo sapiens
atggcttttgtgcattat

SEQ ID NO: 1176039 - DNA, 17 bp, Homo sapiens
atgggaaaatatttcct

SEQ ID NO: 1176040 - DNA, 18 bp, Homo sapiens
atgggaaaatatttcctg

SEQ ID NO: 1176041 - DNA, 21 bp, Homo sapiens
atgggaaagcggcgccacaga

SEQ ID NO: 1176042 - DNA, 18 bp, Homo sapiens
atgggaacaaattagagg

SEQ ID NO: 1176043 - DNA, 17 bp, Homo sapiens
atgggaacaattgaagt

SEQ ID NO: 1176044 - DNA, 23 bp, Homo sapiens
atgggaacctagtactctctgct

SEQ ID NO: 1176045 - DNA, 18 bp, Homo sapiens
ccctcagtcagttcccgg

SEQ ID NO: 1176046 - DNA, 22 bp, Homo sapiens
ccctcagtttggtagtgcccca

SEQ ID NO: 1176047 - DNA, 21 bp, Homo sapiens
ccctcataaaccaatgtggca

SEQ ID NO: 1176048 - DNA, 17 bp, Homo sapiens
ccctcatctatgaggaa

SEQ ID NO: 1176049 - DNA, 14 bp, Homo sapiens
ccctcatctgtccc

SEQ ID NO: 1176050 - DNA, 17 bp, Homo sapiens
ccctcatggcccctctg

SEQ ID NO: 1176051 - DNA, 15 bp, Homo sapiens
ccctcatggctctgg

SEQ ID NO: 1176052 - DNA, 15 bp, Homo sapiens
ccctcattcaggaaa

SEQ ID NO: 1176053 - DNA, 14 bp, Homo sapiens
ccctcattcatctt

SEQ ID NO: 1176054 - DNA, 12 bp, Homo sapiens
ccctcattcccc

SEQ ID NO: 1176055 - DNA, 18 bp, Homo sapiens
ccctccaaaagcacttac

SEQ ID NO: 1176056 - DNA, 16 bp, Homo sapiens
ccctccaaacctccag

SEQ ID NO: 1176057 - DNA, 19 bp, Homo sapiens
ccctccaaacctccagcct

SEQ ID NO: 1176058 - DNA, 17 bp, Homo sapiens
ccctccaaaggaagggg

SEQ ID NO: 1176059 - DNA, 20 bp, Homo sapiens
ccctccaaatggagaagctg

SEQ ID NO: 1176060 - DNA, 15 bp, Homo sapiens
ccctccaagcctggc

SEQ ID NO: 1176061 - DNA, 16 bp, Homo sapiens
ccctccaagcctggca

SEQ ID NO: 1176062 - DNA, 17 bp, Homo sapiens
ccctccacaccagtggc

SEQ ID NO: 1176063 - DNA, 16 bp, Homo sapiens
ccctccacagctgcag

SEQ ID NO: 1176064 - DNA, 11 bp, Homo sapiens
ccctccaccag

SEQ ID NO: 1176065 - DNA, 17 bp, Homo sapiens
ccctccaccagcctgct

SEQ ID NO: 1176066 - DNA, 20 bp, Homo sapiens
ccctccacccatccagtgga

SEQ ID NO: 1176067 - DNA, 12 bp, Homo sapiens
ccctccaccctg

SEQ ID NO: 1176068 - DNA, 14 bp, Homo sapiens
ccctccaccctgtc

SEQ ID NO: 1176069 - DNA, 15 bp, Homo sapiens
ccctccacctcaaga

SEQ ID NO: 1176070 - DNA, 18 bp, Homo sapiens
ccctccacctctcacggg

SEQ ID NO: 1176071 - DNA, 12 bp, Homo sapiens
ccctccaccttc

SEQ ID NO: 1176072 - DNA, 15 bp, Homo sapiens
ccctccaccttccat

SEQ ID NO: 1176073 - DNA, 21 bp, Homo sapiens
ccctccacgcctcctggccag

SEQ ID NO: 1176074 - DNA, 15 bp, Homo sapiens
ccctccactcactgc

SEQ ID NO: 1176075 - DNA, 17 bp, Homo sapiens
ccctccactcagctgtc

SEQ ID NO: 1176076 - DNA, 12 bp, Homo sapiens
ccctccactgtc

SEQ ID NO: 1176077 - DNA, 16 bp, Homo sapiens
ccctccagaccctgcc

SEQ ID NO: 1176078 - DNA, 11 bp, Homo sapiens
ccctccagagt

SEQ ID NO: 1176079 - DNA, 19 bp, Homo sapiens
ccctccaggagagagccag

SEQ ID NO: 1176080 - DNA, 20 bp, Homo sapiens
ccctccatccgtgctgcatg

SEQ ID NO: 1176081 - DNA, 23 bp, Homo sapiens
ccctccatggtcctgtctgtcct

SEQ ID NO: 1176082 - DNA, 15 bp, Homo sapiens
ccctccattgggcac

SEQ ID NO: 1176083 - DNA, 14 bp, Homo sapiens
ccctcccaacctca

SEQ ID NO: 1176084 - DNA, 23 bp, Homo sapiens
ccctcccaacctcaatgccctgc

SEQ ID NO: 1176085 - DNA, 16 bp, Homo sapiens
ccctcccaccagaacg

SEQ ID NO: 1176086 - DNA, 20 bp, Homo sapiens
ccctcccacccccagccccg

SEQ ID NO: 1176087 - DNA, 15 bp, Homo sapiens
ccctcccaccctgcg

SEQ ID NO: 1176088 - DNA, 16 bp, Homo sapiens
ccctcccagacaggcc

SEQ ID NO: 1176089 - DNA, 20 bp, Homo sapiens
ccctcccagacaggccctcc

SEQ ID NO: 1176090 - DNA, 21 bp, Homo sapiens
ccctcccagacaggccctccc

SEQ ID NO: 1176091 - DNA, 17 bp, Homo sapiens
ccctcccagctgcactt

SEQ ID NO: 1176092 - DNA, 18 bp, Homo sapiens
ccctcccaggggagccag

SEQ ID NO: 1176093 - DNA, 23 bp, Homo sapiens
ccctcccaggggagccagctgct

SEQ ID NO: 1176094 - DNA, 14 bp, Homo sapiens
ccctcccagtcctc

SEQ ID NO: 1176095 - DNA, 15 bp, Homo sapiens
ccctcccagtcctcc

SEQ ID NO: 1176096 - DNA, 22 bp, Homo sapiens
ccctcccagtctcatctcctga

SEQ ID NO: 1176097 - DNA, 14 bp, Homo sapiens
ccctcccatcctcc

SEQ ID NO: 1176098 - DNA, 15 bp, Homo sapiens
ccctcccattaggac

SEQ ID NO: 1176099 - DNA, 21 bp, Homo sapiens
ccctccccaaatggctgcttt

SEQ ID NO: 1176100 - DNA, 22 bp, Homo sapiens
ccctccccaaggatgaccacac

SEQ ID NO: 1176101 - DNA, 23 bp, Homo sapiens
ccctccccaaggatgaccacacc

SEQ ID NO: 1176102 - DNA, 16 bp, Homo sapiens
ccctccccagccagcc

SEQ ID NO: 1176103 - DNA, 16 bp, Homo sapiens
ccctcccccagctcct

SEQ ID NO: 1176104 - DNA, 13 bp, Homo sapiens
ccctccccccaga

SEQ ID NO: 1176105 - DNA, 16 bp, Homo sapiens
ccctccccctcaacct

SEQ ID NO: 1176106 - DNA, 13 bp, Homo sapiens
ccctcccccttct

SEQ ID NO: 1176107 - DNA, 17 bp, Homo sapiens
ccctcccccttctccca

SEQ ID NO: 1176108 - DNA, 13 bp, Homo sapiens
ccctcccccttgt

SEQ ID NO: 1176109 - DNA, 16 bp, Homo sapiens
ccctccccgcaccccc

SEQ ID NO: 1176110 - DNA, 15 bp, Homo sapiens
ccctccccgctgccc

SEQ ID NO: 1176111 - DNA, 19 bp, Homo sapiens
ccctccccggccctaccag

SEQ ID NO: 1176112 - DNA, 13 bp, Homo sapiens
ccctccccggcgg

SEQ ID NO: 1176113 - DNA, 13 bp, Homo sapiens
ccctccccgtccc

SEQ ID NO: 1176114 - DNA, 22 bp, Homo sapiens
ccctcccctcagcctgcccacc

SEQ ID NO: 1176115 - DNA, 14 bp, Homo sapiens
ccctcccctcgtgt

SEQ ID NO: 1176116 - DNA, 14 bp, Homo sapiens
ccctcccctctctt

SEQ ID NO: 1176117 - DNA, 12 bp, Homo sapiens
ccctcccctggg

SEQ ID NO: 1176118 - DNA, 22 bp, Homo sapiens
ccctccccttcgtgtttccccc

SEQ ID NO: 1176119 - DNA, 19 bp, Homo sapiens
ccctcccgtagtctcctgg

SEQ ID NO: 1176120 - DNA, 20 bp, Homo sapiens
ccctcccgtagtctcctggg

SEQ ID NO: 1176121 - DNA, 12 bp, Homo sapiens
ccctccctaccc

SEQ ID NO: 1176122 - DNA, 20 bp, Homo sapiens
ccctccctatatgcacccct

SEQ ID NO: 1176123 - DNA, 14 bp, Homo sapiens
ccctccctcccaca

SEQ ID NO: 1176124 - DNA, 12 bp, Homo sapiens
ccctccctccct

SEQ ID NO: 1176125 - DNA, 14 bp, Homo sapiens
ccctccctctgccc

SEQ ID NO: 1176126 - DNA, 17 bp, Homo sapiens
ccctctcagctccaggt

SEQ ID NO: 1176127 - DNA, 22 bp, Homo sapiens
ccctctcaggcatgcctgtgtg

SEQ ID NO: 1176128 - DNA, 15 bp, Homo sapiens
ccctctcatccccct

SEQ ID NO: 1176129 - DNA, 18 bp, Homo sapiens
ccctctcatgtccctcca

SEQ ID NO: 1176130 - DNA, 12 bp, Homo sapiens
ccctctccactc

SEQ ID NO: 1176131 - DNA, 13 bp, Homo sapiens
ccctctccactct

SEQ ID NO: 1176132 - DNA, 21 bp, Homo sapiens
ccctctcccagggatgctctt

SEQ ID NO: 1176133 - DNA, 14 bp, Homo sapiens
ccctctcccagtcc

SEQ ID NO: 1176134 - DNA, 18 bp, Homo sapiens
ccctctcccagtccattt

SEQ ID NO: 1176135 - DNA, 17 bp, Homo sapiens
ccctctccctgtgttct

SEQ ID NO: 1176136 - DNA, 13 bp, Homo sapiens
ccctctcctccca

SEQ ID NO: 1176137 - DNA, 17 bp, Homo sapiens
ccctctcctcccagctg

SEQ ID NO: 1176138 - DNA, 15 bp, Homo sapiens
ccctctcctccccct

SEQ ID NO: 1176139 - DNA, 15 bp, Homo sapiens
ccctctcctgcccag

SEQ ID NO: 1176140 - DNA, 21 bp, Homo sapiens
ccctctcggccaggcattggc

SEQ ID NO: 1176141 - DNA, 14 bp, Homo sapiens
ccctctctcttctg

SEQ ID NO: 1176142 - DNA, 23 bp, Homo sapiens
ccctctctcttctgctccaccct

SEQ ID NO: 1176143 - DNA, 13 bp, Homo sapiens
ccctctctgctcc

SEQ ID NO: 1176144 - DNA, 15 bp, Homo sapiens
ccctctctgctcctt

SEQ ID NO: 1176145 - DNA, 16 bp, Homo sapiens
ccctctctgctccttc

SEQ ID NO: 1176146 - DNA, 16 bp, Homo sapiens
ccctctctgctctgcg

SEQ ID NO: 1176147 - DNA, 21 bp, Homo sapiens
ccctctcttccgggagctggt

SEQ ID NO: 1176148 - DNA, 23 bp, Homo sapiens
ccctctcttgcacccgcctctcc

SEQ ID NO: 1176149 - DNA, 15 bp, Homo sapiens
ccctctctttctctg

SEQ ID NO: 1176150 - DNA, 21 bp, Homo sapiens
ccctctgaagagaccttggct

SEQ ID NO: 1176151 - DNA, 14 bp, Homo sapiens
ccctctgacctgca

SEQ ID NO: 1176152 - DNA, 16 bp, Homo sapiens
ccctctgacctgcact

SEQ ID NO: 1176153 - DNA, 20 bp, Homo sapiens
ccctctgagaattccaagga

SEQ ID NO: 1176154 - DNA, 15 bp, Homo sapiens
ccctctgagccgcca

SEQ ID NO: 1176155 - DNA, 11 bp, Homo sapiens
ccctctgattg

SEQ ID NO: 1176156 - DNA, 20 bp, Homo sapiens
ccctctgcagccggaggagg

SEQ ID NO: 1176157 - DNA, 15 bp, Homo sapiens
ccctctgcccagctt

SEQ ID NO: 1176158 - DNA, 18 bp, Homo sapiens
ccctctgcccagcttggg

SEQ ID NO: 1176159 - DNA, 23 bp, Homo sapiens
ccctctgcccagcttgggcccag

SEQ ID NO: 1176160 - DNA, 17 bp, Homo sapiens
ccctctgcccagggagt

SEQ ID NO: 1176161 - DNA, 20 bp, Homo sapiens
ccctctgccccaagcagcca

SEQ ID NO: 1176162 - DNA, 23 bp, Homo sapiens
ccctctgccccaagcagccagcc

SEQ ID NO: 1176163 - DNA, 14 bp, Homo sapiens
ccctctgcccctcc

SEQ ID NO: 1176164 - DNA, 15 bp, Homo sapiens
ccctctgcctcctca

SEQ ID NO: 1176165 - DNA, 20 bp, Homo sapiens
ccctctgcctcctccccagg

SEQ ID NO: 1176166 - DNA, 11 bp, Homo sapiens
ccctctgcctg

SEQ ID NO: 1176167 - DNA, 13 bp, Homo sapiens
ccctctgcctgca

SEQ ID NO: 1176168 - DNA, 16 bp, Homo sapiens
ccctctgcctgcactc

SEQ ID NO: 1176169 - DNA, 17 bp, Homo sapiens
ccctctgcctgcactcc

SEQ ID NO: 1176170 - DNA, 13 bp, Homo sapiens
ccctctgccttca

SEQ ID NO: 1176171 - DNA, 20 bp, Homo sapiens
ccctctgccttcaggcttct

SEQ ID NO: 1176172 - DNA, 21 bp, Homo sapiens
ccctctgcggccactgcgcca

SEQ ID NO: 1176173 - DNA, 14 bp, Homo sapiens
ccctctgctctgcc

SEQ ID NO: 1176174 - DNA, 21 bp, Homo sapiens
ccctctgctctgcctggagtg

SEQ ID NO: 1176175 - DNA, 14 bp, Homo sapiens
ccctctgctgctgt

SEQ ID NO: 1176176 - DNA, 15 bp, Homo sapiens
ccctctgctgctgtc

SEQ ID NO: 1176177 - DNA, 22 bp, Homo sapiens
ccctctggagtggccactaagc

SEQ ID NO: 1176178 - DNA, 23 bp, Homo sapiens
atggtatgattctattatatatt

SEQ ID NO: 1176179 - DNA, 16 bp, Homo sapiens
atggtatgctggccag

SEQ ID NO: 1176180 - DNA, 16 bp, Homo sapiens
atggtatttctttctc

SEQ ID NO: 1176181 - DNA, 17 bp, Homo sapiens
atggtcaagttcccaac

SEQ ID NO: 1176182 - DNA, 20 bp, Homo sapiens
atggtcaagttcccaactga

SEQ ID NO: 1176183 - DNA, 12 bp, Homo sapiens
atggtcagctcc

SEQ ID NO: 1176184 - DNA, 12 bp, Homo sapiens
atggtccagaaa

SEQ ID NO: 1176185 - DNA, 17 bp, Homo sapiens
atggtcccaggaagcag

SEQ ID NO: 1176186 - DNA, 13 bp, Homo sapiens
atggtcccatcca

SEQ ID NO: 1176187 - DNA, 14 bp, Homo sapiens
atggtcccatccag

SEQ ID NO: 1176188 - DNA, 15 bp, Homo sapiens
atggtcccatccagg

SEQ ID NO: 1176189 - DNA, 15 bp, Homo sapiens
atggtccggtgtcct

SEQ ID NO: 1176190 - DNA, 17 bp, Homo sapiens
atggtccgtgcccaggc

SEQ ID NO: 1176191 - DNA, 16 bp, Homo sapiens
atggtcgcccaggaga

SEQ ID NO: 1176192 - DNA, 15 bp, Homo sapiens
atggtcggatctcac

SEQ ID NO: 1176193 - DNA, 16 bp, Homo sapiens
atggtcggatctcaca

SEQ ID NO: 1176194 - DNA, 20 bp, Homo sapiens
atggtcggatctcacaggct

SEQ ID NO: 1176195 - DNA, 14 bp, Homo sapiens
atggtctcagaaac

SEQ ID NO: 1176196 - DNA, 15 bp, Homo sapiens
atggtctctctccct

SEQ ID NO: 1176197 - DNA, 20 bp, Homo sapiens
atggtctggcaatattctgt

SEQ ID NO: 1176198 - DNA, 12 bp, Homo sapiens
atggtcttgagc

SEQ ID NO: 1176199 - DNA, 22 bp, Homo sapiens
atggtcttgatcctccaatgtc

SEQ ID NO: 1176200 - DNA, 17 bp, Homo sapiens
atggtctttgctccaga

SEQ ID NO: 1176201 - DNA, 12 bp, Homo sapiens
atggtgaaaatg

SEQ ID NO: 1176202 - DNA, 19 bp, Homo sapiens
atggtgaaaccccgtctct

SEQ ID NO: 1176203 - DNA, 24 bp, Homo sapiens
atggtgaaaccccgtctctactaa

SEQ ID NO: 1176204 - DNA, 18 bp, Homo sapiens
atggtgaagtaacatgca

SEQ ID NO: 1176205 - DNA, 15 bp, Homo sapiens
atggtgacattgaaa

SEQ ID NO: 1176206 - DNA, 17 bp, Homo sapiens
atggtgaccaccccctg

SEQ ID NO: 1176207 - DNA, 23 bp, Homo sapiens
atggtgaccaccccctgttccct

SEQ ID NO: 1176208 - DNA, 18 bp, Homo sapiens
atggtgagatgcagctgg

SEQ ID NO: 1176209 - DNA, 12 bp, Homo sapiens
atggtgaggctg

SEQ ID NO: 1176210 - DNA, 14 bp, Homo sapiens
atggtgcctgagag

SEQ ID NO: 1176211 - DNA, 20 bp, Homo sapiens
atggtgcctgagaggcaggc

SEQ ID NO: 1176212 - DNA, 14 bp, Homo sapiens
atggtgcttccccc

SEQ ID NO: 1176213 - DNA, 15 bp, Homo sapiens
atggtggactaagca

SEQ ID NO: 1176214 - DNA, 13 bp, Homo sapiens
atggtggagggca

SEQ ID NO: 1176215 - DNA, 18 bp, Homo sapiens
atggtggagggcacttca

SEQ ID NO: 1176216 - DNA, 18 bp, Homo sapiens
atggtggagtgagagcct

SEQ ID NO: 1176217 - DNA, 15 bp, Homo sapiens
atggtggcacaggca

SEQ ID NO: 1176218 - DNA, 12 bp, Homo sapiens
atggtggcctca

SEQ ID NO: 1176219 - DNA, 17 bp, Homo sapiens
atggtggctcatgcctg

SEQ ID NO: 1176220 - DNA, 12 bp, Homo sapiens
atggtggctgtg

SEQ ID NO: 1176221 - DNA, 20 bp, Homo sapiens
atggtggctgtgtctctccc

SEQ ID NO: 1176222 - DNA, 16 bp, Homo sapiens
atggtggttattttaa

SEQ ID NO: 1176223 - DNA, 19 bp, Homo sapiens
atggtgtagaacactaatt

SEQ ID NO: 1176224 - DNA, 22 bp, Homo sapiens
atggtgtagaacactaattcat

SEQ ID NO: 1176225 - DNA, 14 bp, Homo sapiens
atggtgtatgtggt

SEQ ID NO: 1176226 - DNA, 15 bp, Homo sapiens
atggtgtcatggctg

SEQ ID NO: 1176227 - DNA, 22 bp, Homo sapiens
atggtgtcattctgcctgctcc

SEQ ID NO: 1176228 - DNA, 12 bp, Homo sapiens
atggtgtcccgg

SEQ ID NO: 1176229 - DNA, 21 bp, Homo sapiens
atggtgtcccggtaccttcca

SEQ ID NO: 1176230 - DNA, 12 bp, Homo sapiens
atggtgtctccc

SEQ ID NO: 1176231 - DNA, 14 bp, Homo sapiens
atggtgtctcccaa

SEQ ID NO: 1176232 - DNA, 18 bp, Homo sapiens
atggtgtgaaagtcagat

SEQ ID NO: 1176233 - DNA, 14 bp, Homo sapiens
atggtgtggccatc

SEQ ID NO: 1176234 - DNA, 14 bp, Homo sapiens
atggtgttaaagct

SEQ ID NO: 1176235 - DNA, 17 bp, Homo sapiens
atggtgttttgtcagac

SEQ ID NO: 1176236 - DNA, 18 bp, Homo sapiens
atggttaaaaaggccaaa

SEQ ID NO: 1176237 - DNA, 23 bp, Homo sapiens
atggttaaaaaggccaaagataa

SEQ ID NO: 1176238 - DNA, 13 bp, Homo sapiens
atggttaaatttt

SEQ ID NO: 1176239 - DNA, 16 bp, Homo sapiens
atggttaataaaactg

SEQ ID NO: 1176240 - DNA, 18 bp, Homo sapiens
atggttaataaaactgca

SEQ ID NO: 1176241 - DNA, 21 bp, Homo sapiens
atggttaataaaactgcacag

SEQ ID NO: 1176242 - DNA, 22 bp, Homo sapiens
atggttaatttttcctgcatgt

SEQ ID NO: 1176243 - DNA, 23 bp, Homo sapiens
atggttaatttttcctgcatgtt

SEQ ID NO: 1176244 - DNA, 15 bp, Homo sapiens
atggttacaatcatt

SEQ ID NO: 1176245 - DNA, 18 bp, Homo sapiens
atggttacttcttctctt

SEQ ID NO: 1176246 - DNA, 16 bp, Homo sapiens
atggttcaagattgtt

SEQ ID NO: 1176247 - DNA, 20 bp, Homo sapiens
atggttccatgcctgagggt

SEQ ID NO: 1176248 - DNA, 16 bp, Homo sapiens
atggttcccaataaaa

SEQ ID NO: 1176249 - DNA, 23 bp, Homo sapiens
atgtaattttgtgtaagaaatac

SEQ ID NO: 1176250 - DNA, 14 bp, Homo sapiens
atgtacaagatgaa

SEQ ID NO: 1176251 - DNA, 20 bp, Homo sapiens
atgtacaagttttgtataaa

SEQ ID NO: 1176252 - DNA, 22 bp, Homo sapiens
atgtacaagttttgtataaata

SEQ ID NO: 1176253 - DNA, 15 bp, Homo sapiens
atgtacaatacaatg

SEQ ID NO: 1176254 - DNA, 19 bp, Homo sapiens
atgtacaattatgtctctt

SEQ ID NO: 1176255 - DNA, 16 bp, Homo sapiens
atgtacagaacacaaa

SEQ ID NO: 1176256 - DNA, 13 bp, Homo sapiens
atgtacagtattt

SEQ ID NO: 1176257 - DNA, 12 bp, Homo sapiens
atgtacatttaa

SEQ ID NO: 1176258 - DNA, 15 bp, Homo sapiens
atgtaccccctttcc

SEQ ID NO: 1176259 - DNA, 20 bp, Homo sapiens
atgtaccgatgatactgttt

SEQ ID NO: 1176260 - DNA, 20 bp, Homo sapiens
atgtacctcagatctctctc

SEQ ID NO: 1176261 - DNA, 18 bp, Homo sapiens
atgtacctcccctgcctt

SEQ ID NO: 1176262 - DNA, 19 bp, Homo sapiens
atgtacctcccctgccttg

SEQ ID NO: 1176263 - DNA, 20 bp, Homo sapiens
atgtacctctagctgttctt

SEQ ID NO: 1176264 - DNA, 15 bp, Homo sapiens
atgtaccttgaccat

SEQ ID NO: 1176265 - DNA, 18 bp, Homo sapiens
atgtacggattttcagtt

SEQ ID NO: 1176266 - DNA, 15 bp, Homo sapiens
atgtactatgtctga

SEQ ID NO: 1176267 - DNA, 17 bp, Homo sapiens
atgtactatgtctgaac

SEQ ID NO: 1176268 - DNA, 20 bp, Homo sapiens
atgtactctacgccaaagtg

SEQ ID NO: 1176269 - DNA, 18 bp, Homo sapiens
atgtactgagccttgtaa

SEQ ID NO: 1176270 - DNA, 16 bp, Homo sapiens
atgtactgatttcagt

SEQ ID NO: 1176271 - DNA, 19 bp, Homo sapiens
atgtactgatttcagtaag

SEQ ID NO: 1176272 - DNA, 13 bp, Homo sapiens
atgtactgtacat

SEQ ID NO: 1176273 - DNA, 19 bp, Homo sapiens
atgtactgtacataaattc

SEQ ID NO: 1176274 - DNA, 16 bp, Homo sapiens
atgtactgtagttttt

SEQ ID NO: 1176275 - DNA, 19 bp, Homo sapiens
atgtactgtagtttttctt

SEQ ID NO: 1176276 - DNA, 14 bp, Homo sapiens
atgtacttaaatga

SEQ ID NO: 1176277 - DNA, 19 bp, Homo sapiens
atgtacttaagagtggcat

SEQ ID NO: 1176278 - DNA, 16 bp, Homo sapiens
atgtacttaatccttt

SEQ ID NO: 1176279 - DNA, 19 bp, Homo sapiens
atgtacttgaaggatggat

SEQ ID NO: 1176280 - DNA, 20 bp, Homo sapiens
atgtacttgtttgaatattt

SEQ ID NO: 1176281 - DNA, 22 bp, Homo sapiens
atgtacttgtttgaatatttgt

SEQ ID NO: 1176282 - DNA, 18 bp, Homo sapiens
atgtactttggcatcttt

SEQ ID NO: 1176283 - DNA, 15 bp, Homo sapiens
atgtactttttagta

SEQ ID NO: 1176284 - DNA, 14 bp, Homo sapiens
atgtagaaaatttg

SEQ ID NO: 1176285 - DNA, 16 bp, Homo sapiens
atgtagaataaatgaa

SEQ ID NO: 1176286 - DNA, 21 bp, Homo sapiens
atgtagatattgttttctgta

SEQ ID NO: 1176287 - DNA, 17 bp, Homo sapiens
atgtagatgtatgcaca

SEQ ID NO: 1176288 - DNA, 18 bp, Homo sapiens
atgtagatgtatgcacac

SEQ ID NO: 1176289 - DNA, 22 bp, Homo sapiens
atgtagatgtatgcacacacat

SEQ ID NO: 1176290 - DNA, 17 bp, Homo sapiens
atgtagatgtgcatttt

SEQ ID NO: 1176291 - DNA, 21 bp, Homo sapiens
atgtagcaaaatacatgacat

SEQ ID NO: 1176292 - DNA, 18 bp, Homo sapiens
atgtagcattatgcaatt

SEQ ID NO: 1176293 - DNA, 14 bp, Homo sapiens
atgtagccagctgt

SEQ ID NO: 1176294 - DNA, 20 bp, Homo sapiens
atgtagccagttaaggaaag

SEQ ID NO: 1176295 - DNA, 13 bp, Homo sapiens
atgtagcccatcc

SEQ ID NO: 1176296 - DNA, 20 bp, Homo sapiens
atgtagcccatccttccctt

SEQ ID NO: 1176297 - DNA, 21 bp, Homo sapiens
atgtagccccctggcctctgt

SEQ ID NO: 1176298 - DNA, 16 bp, Homo sapiens
atgtagccttcacaca

SEQ ID NO: 1176299 - DNA, 16 bp, Homo sapiens
atgtagcctttactgt

SEQ ID NO: 1176300 - DNA, 22 bp, Homo sapiens
atgtagcctttactgtttgata

SEQ ID NO: 1176301 - DNA, 14 bp, Homo sapiens
atgtagctatgggc

SEQ ID NO: 1176302 - DNA, 14 bp, Homo sapiens
atgtagctgaaaat

SEQ ID NO: 1176303 - DNA, 15 bp, Homo sapiens
atgtagctgaaaata

SEQ ID NO: 1176304 - DNA, 15 bp, Homo sapiens
atgtagctggtttcc

SEQ ID NO: 1176305 - DNA, 19 bp, Homo sapiens
atgtagcttcagtcattaa

SEQ ID NO: 1176306 - DNA, 20 bp, Homo sapiens
atgtagcttcagtcattaaa

SEQ ID NO: 1176307 - DNA, 17 bp, Homo sapiens
atgtagcttccacctca

SEQ ID NO: 1176308 - DNA, 20 bp, Homo sapiens
ccctgagtctggacctccat

SEQ ID NO: 1176309 - DNA, 16 bp, Homo sapiens
ccctgagtggtcactg

SEQ ID NO: 1176310 - DNA, 17 bp, Homo sapiens
ccctgagtggtcactgg

SEQ ID NO: 1176311 - DNA, 23 bp, Homo sapiens
ccctgagtggtcactggtcaggg

SEQ ID NO: 1176312 - DNA, 16 bp, Homo sapiens
ccctgagttgggcagc

SEQ ID NO: 1176313 - DNA, 17 bp, Homo sapiens
ccctgagttgggcagcc

SEQ ID NO: 1176314 - DNA, 19 bp, Homo sapiens
ccctgagttgggcagccag

SEQ ID NO: 1176315 - DNA, 17 bp, Homo sapiens
ccctgatagaagattgt

SEQ ID NO: 1176316 - DNA, 20 bp, Homo sapiens
ccctgatcccaccccctcct

SEQ ID NO: 1176317 - DNA, 13 bp, Homo sapiens
ccctgatggaccc

SEQ ID NO: 1176318 - DNA, 16 bp, Homo sapiens
ccctgatggcctttgg

SEQ ID NO: 1176319 - DNA, 18 bp, Homo sapiens
ccctgatggcctttggac

SEQ ID NO: 1176320 - DNA, 20 bp, Homo sapiens
ccctgatgtgtcctcaggga

SEQ ID NO: 1176321 - DNA, 13 bp, Homo sapiens
ccctgattcttga

SEQ ID NO: 1176322 - DNA, 23 bp, Homo sapiens
ccctgattgacctgctccgctgc

SEQ ID NO: 1176323 - DNA, 18 bp, Homo sapiens
ccctgcaaaaagaaaaaa

SEQ ID NO: 1176324 - DNA, 20 bp, Homo sapiens
ccctgcaaaaagaaaaaaag

SEQ ID NO: 1176325 - DNA, 18 bp, Homo sapiens
ccctgcaaaaggactctc

SEQ ID NO: 1176326 - DNA, 23 bp, Homo sapiens
ccctgcaaaatttgatgccagga

SEQ ID NO: 1176327 - DNA, 13 bp, Homo sapiens
ccctgcaaacaga

SEQ ID NO: 1176328 - DNA, 18 bp, Homo sapiens
ccctgcaaacagaacagg

SEQ ID NO: 1176329 - DNA, 15 bp, Homo sapiens
ccctgcaaagcccag

SEQ ID NO: 1176330 - DNA, 17 bp, Homo sapiens
ccctgcaaagcccagct

SEQ ID NO: 1176331 - DNA, 15 bp, Homo sapiens
ccctgcaaaggactg

SEQ ID NO: 1176332 - DNA, 19 bp, Homo sapiens
ccctgcaacttccgctgag

SEQ ID NO: 1176333 - DNA, 9 bp, Homo sapiens
ccctgcaat

SEQ ID NO: 1176334 - DNA, 21 bp, Homo sapiens
ccctgcaatcactttttggaa

SEQ ID NO: 1176335 - DNA, 20 bp, Homo sapiens
ccctgcacagtgacttctga

SEQ ID NO: 1176336 - DNA, 22 bp, Homo sapiens
ccctgcacagtgacttctgaga

SEQ ID NO: 1176337 - DNA, 13 bp, Homo sapiens
ccctgcacagttg

SEQ ID NO: 1176338 - DNA, 16 bp, Homo sapiens
ccctgcaccctggaaa

SEQ ID NO: 1176339 - DNA, 15 bp, Homo sapiens
ccctgcacctgctgc

SEQ ID NO: 1176340 - DNA, 14 bp, Homo sapiens
ccctgcacctggcc

SEQ ID NO: 1176341 - DNA, 15 bp, Homo sapiens
ccctgcacctggcct

SEQ ID NO: 1176342 - DNA, 17 bp, Homo sapiens
ccctgcacctggcctgg

SEQ ID NO: 1176343 - DNA, 21 bp, Homo sapiens
ccctgcacctggcctgggcca

SEQ ID NO: 1176344 - DNA, 22 bp, Homo sapiens
ccctgcactaaagccagcctga

SEQ ID NO: 1176345 - DNA, 17 bp, Homo sapiens
ccctgcactaggcaggt

SEQ ID NO: 1176346 - DNA, 13 bp, Homo sapiens
ccctgcactcccg

SEQ ID NO: 1176347 - DNA, 17 bp, Homo sapiens
ccctgcactccctcctg

SEQ ID NO: 1176348 - DNA, 17 bp, Homo sapiens
ccctgcacttcagacac

SEQ ID NO: 1176349 - DNA, 12 bp, Homo sapiens
ccctgcagacct

SEQ ID NO: 1176350 - DNA, 17 bp, Homo sapiens
ccctgcagacctcaagc

SEQ ID NO: 1176351 - DNA, 14 bp, Homo sapiens
ccctgcagagcaat

SEQ ID NO: 1176352 - DNA, 15 bp, Homo sapiens
ccctgcagagcaata

SEQ ID NO: 1176353 - DNA, 21 bp, Homo sapiens
ccctgcagagcaataacacta

SEQ ID NO: 1176354 - DNA, 15 bp, Homo sapiens
ccctgcagatgccac

SEQ ID NO: 1176355 - DNA, 22 bp, Homo sapiens
ccctgcagcccaaaacccaggg

SEQ ID NO: 1176356 - DNA, 23 bp, Homo sapiens
ccctgcagcccaaaacccagggc

SEQ ID NO: 1176357 - DNA, 18 bp, Homo sapiens
ccctgcagcctgggtctg

SEQ ID NO: 1176358 - DNA, 13 bp, Homo sapiens
ccctgcaggagca

SEQ ID NO: 1176359 - DNA, 21 bp, Homo sapiens
ccctgcaggctgcaggagggc

SEQ ID NO: 1176360 - DNA, 18 bp, Homo sapiens
ccctgcaggttgttcata

SEQ ID NO: 1176361 - DNA, 14 bp, Homo sapiens
ccctgcattttcct

SEQ ID NO: 1176362 - DNA, 16 bp, Homo sapiens
ccctgcattttcctct

SEQ ID NO: 1176363 - DNA, 19 bp, Homo sapiens
ccctgcattttcctcttgt

SEQ ID NO: 1176364 - DNA, 18 bp, Homo sapiens
ccctgccaagactcctca

SEQ ID NO: 1176365 - DNA, 19 bp, Homo sapiens
ccctgccaatgctccagct

SEQ ID NO: 1176366 - DNA, 20 bp, Homo sapiens
ccctgccacactcagtcccc

SEQ ID NO: 1176367 - DNA, 15 bp, Homo sapiens
ccctgccacagccag

SEQ ID NO: 1176368 - DNA, 20 bp, Homo sapiens
ccctgccacagccagaggag

SEQ ID NO: 1176369 - DNA, 15 bp, Homo sapiens
ccctgccaccaggcc

SEQ ID NO: 1176370 - DNA, 14 bp, Homo sapiens
ccctgccactcacc

SEQ ID NO: 1176371 - DNA, 21 bp, Homo sapiens
ccctgcttgcccgctcccaca

SEQ ID NO: 1176372 - DNA, 17 bp, Homo sapiens
ccctgctttgggctgcc

SEQ ID NO: 1176373 - DNA, 19 bp, Homo sapiens
ccctgctttgggctgccct

SEQ ID NO: 1176374 - DNA, 16 bp, Homo sapiens
ccctgctttttttctt

SEQ ID NO: 1176375 - DNA, 20 bp, Homo sapiens
ccctggaattcagcaccctg

SEQ ID NO: 1176376 - DNA, 17 bp, Homo sapiens
ccctggacaagcagagg

SEQ ID NO: 1176377 - DNA, 18 bp, Homo sapiens
ccctggacacccctgctc

SEQ ID NO: 1176378 - DNA, 19 bp, Homo sapiens
ccctggaccaccagcccca

SEQ ID NO: 1176379 - DNA, 20 bp, Homo sapiens
ccctggaccaccagccccag

SEQ ID NO: 1176380 - DNA, 13 bp, Homo sapiens
ccctggacctggg

SEQ ID NO: 1176381 - DNA, 13 bp, Homo sapiens
ccctggagcagga

SEQ ID NO: 1176382 - DNA, 13 bp, Homo sapiens
ccctggagccaga

SEQ ID NO: 1176383 - DNA, 20 bp, Homo sapiens
ccctggagccagactctggt

SEQ ID NO: 1176384 - DNA, 14 bp, Homo sapiens
ccctggagccaggg

SEQ ID NO: 1176385 - DNA, 14 bp, Homo sapiens
ccctggagccatcc

SEQ ID NO: 1176386 - DNA, 12 bp, Homo sapiens
ccctggagccct

SEQ ID NO: 1176387 - DNA, 19 bp, Homo sapiens
ccctggaggaattcagctc

SEQ ID NO: 1176388 - DNA, 23 bp, Homo sapiens
ccctggaggacagagggagacag

SEQ ID NO: 1176389 - DNA, 17 bp, Homo sapiens
ccctggaggctgacaca

SEQ ID NO: 1176390 - DNA, 13 bp, Homo sapiens
ccctggaggtggc

SEQ ID NO: 1176391 - DNA, 21 bp, Homo sapiens
ccctggatagacgagttgatt

SEQ ID NO: 1176392 - DNA, 23 bp, Homo sapiens
ccctggatcacgacgctgcagag

SEQ ID NO: 1176393 - DNA, 23 bp, Homo sapiens
ccctggatcagtcctttgatcag

SEQ ID NO: 1176394 - DNA, 20 bp, Homo sapiens
ccctggatctacctggaggg

SEQ ID NO: 1176395 - DNA, 19 bp, Homo sapiens
ccctggatgtgaagctcac

SEQ ID NO: 1176396 - DNA, 20 bp, Homo sapiens
ccctggatgtgtggggcatg

SEQ ID NO: 1176397 - DNA, 18 bp, Homo sapiens
ccctggcagacacaaccc

SEQ ID NO: 1176398 - DNA, 18 bp, Homo sapiens
ccctggcagcacagccca

SEQ ID NO: 1176399 - DNA, 22 bp, Homo sapiens
ccctggcagcacagcccagggc

SEQ ID NO: 1176400 - DNA, 23 bp, Homo sapiens
ccctggcagcacagcccagggcc

SEQ ID NO: 1176401 - DNA, 16 bp, Homo sapiens
ccctggcagcagcagg

SEQ ID NO: 1176402 - DNA, 18 bp, Homo sapiens
ccctggcagctgcccctc

SEQ ID NO: 1176403 - DNA, 20 bp, Homo sapiens
ccctggcagctgcccctcct

SEQ ID NO: 1176404 - DNA, 22 bp, Homo sapiens
ccctggcagctgcccctcctgg

SEQ ID NO: 1176405 - DNA, 13 bp, Homo sapiens
ccctggccaagct

SEQ ID NO: 1176406 - DNA, 20 bp, Homo sapiens
ccctggccaccttgtcctgg

SEQ ID NO: 1176407 - DNA, 22 bp, Homo sapiens
ccctggccactaaagcttcaga

SEQ ID NO: 1176408 - DNA, 23 bp, Homo sapiens
ccctggccactaaagcttcagac

SEQ ID NO: 1176409 - DNA, 13 bp, Homo sapiens
ccctggccactga

SEQ ID NO: 1176410 - DNA, 16 bp, Homo sapiens
ccctggccagctctga

SEQ ID NO: 1176411 - DNA, 15 bp, Homo sapiens
ccctggcccatctca

SEQ ID NO: 1176412 - DNA, 22 bp, Homo sapiens
ccctggcccatctcagcctcct

SEQ ID NO: 1176413 - DNA, 14 bp, Homo sapiens
ccctggcccctgtg

SEQ ID NO: 1176414 - DNA, 20 bp, Homo sapiens
ccctggccgagtccaagctg

SEQ ID NO: 1176415 - DNA, 13 bp, Homo sapiens
ccctggcctcccc

SEQ ID NO: 1176416 - DNA, 14 bp, Homo sapiens
ccctggcctcccct

SEQ ID NO: 1176417 - DNA, 19 bp, Homo sapiens
ccctggcctcccctgccac

SEQ ID NO: 1176418 - DNA, 11 bp, Homo sapiens
ccctggcctga

SEQ ID NO: 1176419 - DNA, 19 bp, Homo sapiens
ccctggcctgaactgagga

SEQ ID NO: 1176420 - DNA, 20 bp, Homo sapiens
ccctggcctgaactgaggag

SEQ ID NO: 1176421 - DNA, 21 bp, Homo sapiens
ccctggcctgaactgaggaga

SEQ ID NO: 1176422 - DNA, 14 bp, Homo sapiens
ccctggcctttttc

SEQ ID NO: 1176423 - DNA, 15 bp, Homo sapiens
ccctggctaacagtc

SEQ ID NO: 1176424 - DNA, 19 bp, Homo sapiens
ccctggctcccacaggccc

SEQ ID NO: 1176425 - DNA, 20 bp, Homo sapiens
ccctggctccctcctccagg

SEQ ID NO: 1176426 - DNA, 21 bp, Homo sapiens
ccctggctcctccgtctgacc

SEQ ID NO: 1176427 - DNA, 14 bp, Homo sapiens
ccctggctctgccc

SEQ ID NO: 1176428 - DNA, 17 bp, Homo sapiens
ccctggctctgcccctc

SEQ ID NO: 1176429 - DNA, 16 bp, Homo sapiens
ccctggctgccctggc

SEQ ID NO: 1176430 - DNA, 15 bp, Homo sapiens
ccctggctgctgccc

SEQ ID NO: 1176431 - DNA, 22 bp, Homo sapiens
ccctggctgctgcccccacccc

SEQ ID NO: 1176432 - DNA, 21 bp, Homo sapiens
ccctggctgtactgctcaggc

SEQ ID NO: 1176433 - DNA, 22 bp, Homo sapiens
ccctggctgttctgtggttcct

SEQ ID NO: 1176434 - DNA, 19 bp, Homo sapiens
ccctggcttttcactgctg

SEQ ID NO: 1176435 - DNA, 22 bp, Homo sapiens
ccctggcttttcactgctggct

SEQ ID NO: 1176436 - DNA, 16 bp, Homo sapiens
ccctgggaacaggccc

SEQ ID NO: 1176437 - DNA, 21 bp, Homo sapiens
ccctgggacacagacccagga

SEQ ID NO: 1176438 - DNA, 11 bp, Homo sapiens
ccctgggacct

SEQ ID NO: 1176439 - DNA, 15 bp, Homo sapiens
atgtcagacacagat

SEQ ID NO: 1176440 - DNA, 20 bp, Homo sapiens
atgtcagacacagattggcc

SEQ ID NO: 1176441 - DNA, 18 bp, Homo sapiens
atgtcagactttgctgca

SEQ ID NO: 1176442 - DNA, 15 bp, Homo sapiens
atgtcagagctatgt

SEQ ID NO: 1176443 - DNA, 18 bp, Homo sapiens
atgtcagaggaccccagg

SEQ ID NO: 1176444 - DNA, 22 bp, Homo sapiens
atgtcagaggaccccagggtgg

SEQ ID NO: 1176445 - DNA, 20 bp, Homo sapiens
atgtcagataagtgtaaata

SEQ ID NO: 1176446 - DNA, 23 bp, Homo sapiens
atgtcagatgtacatagagatct

SEQ ID NO: 1176447 - DNA, 15 bp, Homo sapiens
atgtcagcaaaaagc

SEQ ID NO: 1176448 - DNA, 13 bp, Homo sapiens
atgtcagcctttg

SEQ ID NO: 1176449 - DNA, 19 bp, Homo sapiens
atgtcaggaacagaaggat

SEQ ID NO: 1176450 - DNA, 12 bp, Homo sapiens
atgtcaggcctg

SEQ ID NO: 1176451 - DNA, 20 bp, Homo sapiens
atgtcagggccaggtgcaga

SEQ ID NO: 1176452 - DNA, 22 bp, Homo sapiens
atgtcagggctgagtgaatcaa

SEQ ID NO: 1176453 - DNA, 23 bp, Homo sapiens
atgtcaggggcggggagggtgac

SEQ ID NO: 1176454 - DNA, 18 bp, Homo sapiens
atgtcagtctgcttagaa

SEQ ID NO: 1176455 - DNA, 19 bp, Homo sapiens
atgtcagtctgcttagaaa

SEQ ID NO: 1176456 - DNA, 20 bp, Homo sapiens
atgtcagtctgcttagaaat

SEQ ID NO: 1176457 - DNA, 14 bp, Homo sapiens
atgtcagttctgat

SEQ ID NO: 1176458 - DNA, 14 bp, Homo sapiens
atgtcataaacgat

SEQ ID NO: 1176459 - DNA, 17 bp, Homo sapiens
atgtcatagccaaagcc

SEQ ID NO: 1176460 - DNA, 19 bp, Homo sapiens
atgtcatagccaaagccag

SEQ ID NO: 1176461 - DNA, 21 bp, Homo sapiens
atgtcatatcatttcactgtc

SEQ ID NO: 1176462 - DNA, 22 bp, Homo sapiens
atgtcatattttgccactgcct

SEQ ID NO: 1176463 - DNA, 18 bp, Homo sapiens
atgtcatggccttgaaac

SEQ ID NO: 1176464 - DNA, 17 bp, Homo sapiens
atgtcatgtacttcctg

SEQ ID NO: 1176465 - DNA, 19 bp, Homo sapiens
atgtcattatttattgtta

SEQ ID NO: 1176466 - DNA, 13 bp, Homo sapiens
atgtcattgtcta

SEQ ID NO: 1176467 - DNA, 14 bp, Homo sapiens
atgtcattgtctac

SEQ ID NO: 1176468 - DNA, 16 bp, Homo sapiens
atgtcatttcagaagt

SEQ ID NO: 1176469 - DNA, 21 bp, Homo sapiens
atgtcatttttaatgtatcta

SEQ ID NO: 1176470 - DNA, 16 bp, Homo sapiens
atgtccactgtgtata

SEQ ID NO: 1176471 - DNA, 23 bp, Homo sapiens
atgtccagaagaatattcaggac

SEQ ID NO: 1176472 - DNA, 19 bp, Homo sapiens
atgtccagccacccccagg

SEQ ID NO: 1176473 - DNA, 16 bp, Homo sapiens
atgtccagtcatcctg

SEQ ID NO: 1176474 - DNA, 19 bp, Homo sapiens
atgtccagtcatcctgccc

SEQ ID NO: 1176475 - DNA, 23 bp, Homo sapiens
atgtccagtcatcctgccctgca

SEQ ID NO: 1176476 - DNA, 21 bp, Homo sapiens
atgtccatacactttgttgca

SEQ ID NO: 1176477 - DNA, 14 bp, Homo sapiens
atgtccattctcat

SEQ ID NO: 1176478 - DNA, 22 bp, Homo sapiens
atgtcccaagagccataagggg

SEQ ID NO: 1176479 - DNA, 12 bp, Homo sapiens
atgtcccaccca

SEQ ID NO: 1176480 - DNA, 15 bp, Homo sapiens
atgtcccacccaccc

SEQ ID NO: 1176481 - DNA, 14 bp, Homo sapiens
atgtccccactccc

SEQ ID NO: 1176482 - DNA, 17 bp, Homo sapiens
atgtccccactcccgaa

SEQ ID NO: 1176483 - DNA, 16 bp, Homo sapiens
atgtcccctgtcccac

SEQ ID NO: 1176484 - DNA, 21 bp, Homo sapiens
atgtcccctgtcccaccaact

SEQ ID NO: 1176485 - DNA, 24 bp, Homo sapiens
atgtccctaccgagtctcttctcc

SEQ ID NO: 1176486 - DNA, 11 bp, Homo sapiens
atgtccctcca

SEQ ID NO: 1176487 - DNA, 13 bp, Homo sapiens
atgtccctccaac

SEQ ID NO: 1176488 - DNA, 15 bp, Homo sapiens
atgtccctgggccag

SEQ ID NO: 1176489 - DNA, 18 bp, Homo sapiens
atgtccctgggccagggt

SEQ ID NO: 1176490 - DNA, 21 bp, Homo sapiens
atgtccctgtccccaggccca

SEQ ID NO: 1176491 - DNA, 23 bp, Homo sapiens
atgtccctgtccccaggcccagc

SEQ ID NO: 1176492 - DNA, 19 bp, Homo sapiens
atgtgagaaagctaaaatg

SEQ ID NO: 1176493 - DNA, 13 bp, Homo sapiens
atgtgagaaatgt

SEQ ID NO: 1176494 - DNA, 15 bp, Homo sapiens
atgtgagaagccagc

SEQ ID NO: 1176495 - DNA, 15 bp, Homo sapiens
atgtgagatttcctt

SEQ ID NO: 1176496 - DNA, 21 bp, Homo sapiens
atgtgagccaccgtgcctggc

SEQ ID NO: 1176497 - DNA, 20 bp, Homo sapiens
atgtgagcctcgtgtcatct

SEQ ID NO: 1176498 - DNA, 21 bp, Homo sapiens
atgtgagctgtaaaaatgtta

SEQ ID NO: 1176499 - DNA, 14 bp, Homo sapiens
atgtgaggaggaaa

SEQ ID NO: 1176500 - DNA, 16 bp, Homo sapiens
atgtgaggaggaaaag

SEQ ID NO: 1176501 - DNA, 19 bp, Homo sapiens
atgtgaggaggaaaaggaa

SEQ ID NO: 1176502 - DNA, 18 bp, Homo sapiens
atgtgagtgccttttgca

SEQ ID NO: 1176503 - DNA, 20 bp, Homo sapiens
atgtgagtttggtctggact

SEQ ID NO: 1176504 - DNA, 22 bp, Homo sapiens
atgtgagtttggtctggactga

SEQ ID NO: 1176505 - DNA, 19 bp, Homo sapiens
atgtgatatataagtgtac

SEQ ID NO: 1176506 - DNA, 21 bp, Homo sapiens
atgtgatatataagtgtacat

SEQ ID NO: 1176507 - DNA, 22 bp, Homo sapiens
atgtgatatataagtgtacata

SEQ ID NO: 1176508 - DNA, 19 bp, Homo sapiens
atgtgatattctgttgctt

SEQ ID NO: 1176509 - DNA, 13 bp, Homo sapiens
atgtgatcactga

SEQ ID NO: 1176510 - DNA, 23 bp, Homo sapiens
atgtgatctgggcattttcctcc

SEQ ID NO: 1176511 - DNA, 17 bp, Homo sapiens
atgtgatgaatactgta

SEQ ID NO: 1176512 - DNA, 19 bp, Homo sapiens
atgtgatgaatactgtatt

SEQ ID NO: 1176513 - DNA, 14 bp, Homo sapiens
atgtgatggactgg

SEQ ID NO: 1176514 - DNA, 19 bp, Homo sapiens
atgtgatggatggcacaat

SEQ ID NO: 1176515 - DNA, 14 bp, Homo sapiens
atgtgatggttggt

SEQ ID NO: 1176516 - DNA, 15 bp, Homo sapiens
atgtgattaatgttt

SEQ ID NO: 1176517 - DNA, 18 bp, Homo sapiens
atgtgattaatgttttca

SEQ ID NO: 1176518 - DNA, 15 bp, Homo sapiens
atgtgattacaaggc

SEQ ID NO: 1176519 - DNA, 15 bp, Homo sapiens
atgtgattctaatgt

SEQ ID NO: 1176520 - DNA, 14 bp, Homo sapiens
atgtgatttttctg

SEQ ID NO: 1176521 - DNA, 23 bp, Homo sapiens
atgtgcaaaatctgttatagctt

SEQ ID NO: 1176522 - DNA, 19 bp, Homo sapiens
atgtgcaaattttgcattt

SEQ ID NO: 1176523 - DNA, 20 bp, Homo sapiens
atgtgcaagcgacgacagat

SEQ ID NO: 1176524 - DNA, 15 bp, Homo sapiens
atgtgcaagtttatc

SEQ ID NO: 1176525 - DNA, 17 bp, Homo sapiens
atgtgcaataatttgta

SEQ ID NO: 1176526 - DNA, 19 bp, Homo sapiens
atgtgcaataatttgtaca

SEQ ID NO: 1176527 - DNA, 13 bp, Homo sapiens
atgtgcaatagaa

SEQ ID NO: 1176528 - DNA, 15 bp, Homo sapiens
atgtgcactgtcact

SEQ ID NO: 1176529 - DNA, 19 bp, Homo sapiens
atgtgcagggatattgcct

SEQ ID NO: 1176530 - DNA, 23 bp, Homo sapiens
atgtgcagtgtagcccacacttg

SEQ ID NO: 1176531 - DNA, 23 bp, Homo sapiens
atgtgcatttcacctgtgacaaa

SEQ ID NO: 1176532 - DNA, 13 bp, Homo sapiens
atgtgccaaggtg

SEQ ID NO: 1176533 - DNA, 15 bp, Homo sapiens
atgtgccacattttc

SEQ ID NO: 1176534 - DNA, 11 bp, Homo sapiens
atgtgccacta

SEQ ID NO: 1176535 - DNA, 16 bp, Homo sapiens
atgtgccaggcttgcc

SEQ ID NO: 1176536 - DNA, 17 bp, Homo sapiens
atgtgccaggcttgcct

SEQ ID NO: 1176537 - DNA, 22 bp, Homo sapiens
atgtgccaggcttgcctgggct

SEQ ID NO: 1176538 - DNA, 21 bp, Homo sapiens
atgtgccagggcaatgatgaa

SEQ ID NO: 1176539 - DNA, 17 bp, Homo sapiens
atgtgccagttcctgta

SEQ ID NO: 1176540 - DNA, 14 bp, Homo sapiens
atgtgccatactaa

SEQ ID NO: 1176541 - DNA, 18 bp, Homo sapiens
atgtgccattttaaaaaa

SEQ ID NO: 1176542 - DNA, 16 bp, Homo sapiens
atgtgccctcctgagg

SEQ ID NO: 1176543 - DNA, 15 bp, Homo sapiens
atgtgcctaattttc

SEQ ID NO: 1176544 - DNA, 20 bp, Homo sapiens
atgtgccttgattgattaga

SEQ ID NO: 1176545 - DNA, 24 bp, Homo sapiens
atgtgccttgattgattagataaa

SEQ ID NO: 1176546 - DNA, 18 bp, Homo sapiens
atgtgccttgtccaggaa

SEQ ID NO: 1176547 - DNA, 16 bp, Homo sapiens
atgtgcggctgaactg

SEQ ID NO: 1176548 - DNA, 15 bp, Homo sapiens
atgtgcgtgtgtgca

SEQ ID NO: 1176549 - DNA, 18 bp, Homo sapiens
atgtgcgtgtgtgcaagt

SEQ ID NO: 1176550 - DNA, 15 bp, Homo sapiens
atgtgctagtggcaa

SEQ ID NO: 1176551 - DNA, 16 bp, Homo sapiens
atgtgctatacacaca

SEQ ID NO: 1176552 - DNA, 13 bp, Homo sapiens
atgtgctattaat

SEQ ID NO: 1176553 - DNA, 16 bp, Homo sapiens
atgtgctattaatatt

SEQ ID NO: 1176554 - DNA, 18 bp, Homo sapiens
atgtgctattaatatttg

SEQ ID NO: 1176555 - DNA, 19 bp, Homo sapiens
atgtgctcagaagaggaaa

SEQ ID NO: 1176556 - DNA, 16 bp, Homo sapiens
atgtgctcagccaaat

SEQ ID NO: 1176557 - DNA, 22 bp, Homo sapiens
atgtgctgatgtttacaatgat

SEQ ID NO: 1176558 - DNA, 21 bp, Homo sapiens
atgtgctgggaaatgcagaaa

SEQ ID NO: 1176559 - DNA, 22 bp, Homo sapiens
atgtgctgggaaatgcagaaat

SEQ ID NO: 1176560 - DNA, 17 bp, Homo sapiens
atgtgctggtgaacact

SEQ ID NO: 1176561 - DNA, 19 bp, Homo sapiens
atgtgctgtctccatgctg

SEQ ID NO: 1176562 - DNA, 14 bp, Homo sapiens
atgtgctttgattc

SEQ ID NO: 1176563 - DNA, 14 bp, Homo sapiens
atgtggaagagcat

SEQ ID NO: 1176564 - DNA, 12 bp, Homo sapiens
atgtggaagtat

SEQ ID NO: 1176565 - DNA, 19 bp, Homo sapiens
atgtggaagtatacctggc

SEQ ID NO: 1176566 - DNA, 19 bp, Homo sapiens
atgtggaccatattttgta

SEQ ID NO: 1176567 - DNA, 17 bp, Homo sapiens
atgtggacgtgcactga

SEQ ID NO: 1176568 - DNA, 14 bp, Homo sapiens
atgtggaggaagag

SEQ ID NO: 1176569 - DNA, 23 bp, Homo sapiens
ccctgtctgaaggacacttcctg

SEQ ID NO: 1176570 - DNA, 19 bp, Homo sapiens
ccctgtctgctaggcgctg

SEQ ID NO: 1176571 - DNA, 14 bp, Homo sapiens
ccctgtctggaaga

SEQ ID NO: 1176572 - DNA, 16 bp, Homo sapiens
ccctgtcttctgggca

SEQ ID NO: 1176573 - DNA, 22 bp, Homo sapiens
ccctgtcttctgggcacagtgg

SEQ ID NO: 1176574 - DNA, 18 bp, Homo sapiens
ccctgtgacatggtgcct

SEQ ID NO: 1176575 - DNA, 13 bp, Homo sapiens
ccctgtgaccctc

SEQ ID NO: 1176576 - DNA, 22 bp, Homo sapiens
ccctgtgcaacctcttggcctg

SEQ ID NO: 1176577 - DNA, 14 bp, Homo sapiens
ccctgtgcagacct

SEQ ID NO: 1176578 - DNA, 17 bp, Homo sapiens
ccctgtgcccccagcct

SEQ ID NO: 1176579 - DNA, 19 bp, Homo sapiens
ccctgtgcccccagcctca

SEQ ID NO: 1176580 - DNA, 22 bp, Homo sapiens
ccctgtgcccccagcctcagcc

SEQ ID NO: 1176581 - DNA, 13 bp, Homo sapiens
ccctgtgcctggg

SEQ ID NO: 1176582 - DNA, 18 bp, Homo sapiens
ccctgtgcctgggccctg

SEQ ID NO: 1176583 - DNA, 23 bp, Homo sapiens
ccctgtgcctgggccctgggctg

SEQ ID NO: 1176584 - DNA, 15 bp, Homo sapiens
ccctgtgctcccctg

SEQ ID NO: 1176585 - DNA, 22 bp, Homo sapiens
ccctgtgctcccctgccacact

SEQ ID NO: 1176586 - DNA, 22 bp, Homo sapiens
ccctgtgctccgtgcctccacc

SEQ ID NO: 1176587 - DNA, 13 bp, Homo sapiens
ccctgtgctggtg

SEQ ID NO: 1176588 - DNA, 21 bp, Homo sapiens
ccctgtgcttggaaacctttt

SEQ ID NO: 1176589 - DNA, 20 bp, Homo sapiens
ccctgtggaagcatggctgt

SEQ ID NO: 1176590 - DNA, 17 bp, Homo sapiens
ccctgtggagtccagct

SEQ ID NO: 1176591 - DNA, 13 bp, Homo sapiens
ccctgtggccaac

SEQ ID NO: 1176592 - DNA, 14 bp, Homo sapiens
ccctgtggccaact

SEQ ID NO: 1176593 - DNA, 14 bp, Homo sapiens
ccctgtggccctgg

SEQ ID NO: 1176594 - DNA, 18 bp, Homo sapiens
ccctgtggccctggccac

SEQ ID NO: 1176595 - DNA, 17 bp, Homo sapiens
ccctgtggccgccacct

SEQ ID NO: 1176596 - DNA, 23 bp, Homo sapiens
ccctgtgggaccgcctggccctc

SEQ ID NO: 1176597 - DNA, 20 bp, Homo sapiens
ccctgtggggatctcagggg

SEQ ID NO: 1176598 - DNA, 23 bp, Homo sapiens
ccctgtggggatctcaggggctg

SEQ ID NO: 1176599 - DNA, 14 bp, Homo sapiens
ccctgtggggcagg

SEQ ID NO: 1176600 - DNA, 20 bp, Homo sapiens
ccctgtggggcaggagtgcc

SEQ ID NO: 1176601 - DNA, 15 bp, Homo sapiens
ccctgtggggcctga

SEQ ID NO: 1176602 - DNA, 12 bp, Homo sapiens
ccctgtgggggt

SEQ ID NO: 1176603 - DNA, 22 bp, Homo sapiens
ccctgtgggggtggccatccct

SEQ ID NO: 1176604 - DNA, 24 bp, Homo sapiens
ccctgtgggggtggccatccctgg

SEQ ID NO: 1176605 - DNA, 17 bp, Homo sapiens
ccctgtggtctattgtc

SEQ ID NO: 1176606 - DNA, 19 bp, Homo sapiens
ccctgtgtctgtcacaggc

SEQ ID NO: 1176607 - DNA, 22 bp, Homo sapiens
ccctgtgtggatgctgagctgt

SEQ ID NO: 1176608 - DNA, 17 bp, Homo sapiens
ccctgtgttctgggctg

SEQ ID NO: 1176609 - DNA, 23 bp, Homo sapiens
ccctgtgttctgggctggggcca

SEQ ID NO: 1176610 - DNA, 20 bp, Homo sapiens
ccctgtgttgtcccatctgc

SEQ ID NO: 1176611 - DNA, 13 bp, Homo sapiens
ccctgtgttgtct

SEQ ID NO: 1176612 - DNA, 16 bp, Homo sapiens
ccctgtgttgtctcta

SEQ ID NO: 1176613 - DNA, 16 bp, Homo sapiens
cccttcggagccaaca

SEQ ID NO: 1176614 - DNA, 15 bp, Homo sapiens
cccttctccaaaggc

SEQ ID NO: 1176615 - DNA, 23 bp, Homo sapiens
cccttctccatccacatgggagc

SEQ ID NO: 1176616 - DNA, 16 bp, Homo sapiens
cccttctcccggccct

SEQ ID NO: 1176617 - DNA, 13 bp, Homo sapiens
cccttctccctgg

SEQ ID NO: 1176618 - DNA, 14 bp, Homo sapiens
cccttctccctgga

SEQ ID NO: 1176619 - DNA, 14 bp, Homo sapiens
cccttctctctcca

SEQ ID NO: 1176620 - DNA, 15 bp, Homo sapiens
cccttctctctccag

SEQ ID NO: 1176621 - DNA, 23 bp, Homo sapiens
cccttctctgctccaccacatcc

SEQ ID NO: 1176622 - DNA, 14 bp, Homo sapiens
cccttctgctcagc

SEQ ID NO: 1176623 - DNA, 19 bp, Homo sapiens
cccttcttccaaggagcag

SEQ ID NO: 1176624 - DNA, 17 bp, Homo sapiens
cccttcttcctcccctc

SEQ ID NO: 1176625 - DNA, 18 bp, Homo sapiens
cccttcttcctcccctca

SEQ ID NO: 1176626 - DNA, 22 bp, Homo sapiens
cccttcttgggtctgccctgcc

SEQ ID NO: 1176627 - DNA, 21 bp, Homo sapiens
cccttcttggtgcttacacat

SEQ ID NO: 1176628 - DNA, 14 bp, Homo sapiens
cccttctttcctct

SEQ ID NO: 1176629 - DNA, 18 bp, Homo sapiens
cccttgaaccccctccct

SEQ ID NO: 1176630 - DNA, 14 bp, Homo sapiens
cccttgaagcaata

SEQ ID NO: 1176631 - DNA, 19 bp, Homo sapiens
cccttgactttgctcctca

SEQ ID NO: 1176632 - DNA, 12 bp, Homo sapiens
cccttgagacct

SEQ ID NO: 1176633 - DNA, 17 bp, Homo sapiens
cccttgagggctgcagt

SEQ ID NO: 1176634 - DNA, 16 bp, Homo sapiens
cccttgaggggcccca

SEQ ID NO: 1176635 - DNA, 17 bp, Homo sapiens
cccttgaggggccccag

SEQ ID NO: 1176636 - DNA, 18 bp, Homo sapiens
cccttgaggggccccagc

SEQ ID NO: 1176637 - DNA, 15 bp, Homo sapiens
cccttgatgcacaga

SEQ ID NO: 1176638 - DNA, 19 bp, Homo sapiens
cccttgatgcacagagaag

SEQ ID NO: 1176639 - DNA, 21 bp, Homo sapiens
cccttgatttaaacacacaga

SEQ ID NO: 1176640 - DNA, 12 bp, Homo sapiens
cccttgcaagcc

SEQ ID NO: 1176641 - DNA, 16 bp, Homo sapiens
cccttgcagctagttt

SEQ ID NO: 1176642 - DNA, 19 bp, Homo sapiens
cccttgcagttcagcacca

SEQ ID NO: 1176643 - DNA, 23 bp, Homo sapiens
cccttgcagttcagcaccaccct

SEQ ID NO: 1176644 - DNA, 19 bp, Homo sapiens
cccttgcccagggctcagc

SEQ ID NO: 1176645 - DNA, 20 bp, Homo sapiens
cccttgcccagggctcagcc

SEQ ID NO: 1176646 - DNA, 18 bp, Homo sapiens
cccttgccccaggccagg

SEQ ID NO: 1176647 - DNA, 23 bp, Homo sapiens
cccttgccccaggccaggtagca

SEQ ID NO: 1176648 - DNA, 15 bp, Homo sapiens
cccttgccctgacct

SEQ ID NO: 1176649 - DNA, 19 bp, Homo sapiens
cccttgccctgacctccca

SEQ ID NO: 1176650 - DNA, 17 bp, Homo sapiens
cccttgcccttgccctg

SEQ ID NO: 1176651 - DNA, 18 bp, Homo sapiens
cccttgcccttgccctga

SEQ ID NO: 1176652 - DNA, 13 bp, Homo sapiens
cccttgctccctt

SEQ ID NO: 1176653 - DNA, 14 bp, Homo sapiens
cccttgctgtatgc

SEQ ID NO: 1176654 - DNA, 14 bp, Homo sapiens
cccttgcttagcct

SEQ ID NO: 1176655 - DNA, 18 bp, Homo sapiens
cccttgctttcctgggcc

SEQ ID NO: 1176656 - DNA, 11 bp, Homo sapiens
cccttgctttt

SEQ ID NO: 1176657 - DNA, 21 bp, Homo sapiens
cccttggaaatgtctgctggt

SEQ ID NO: 1176658 - DNA, 17 bp, Homo sapiens
cccttggagagagaggc

SEQ ID NO: 1176659 - DNA, 20 bp, Homo sapiens
cccttggcaccaccagggtg

SEQ ID NO: 1176660 - DNA, 12 bp, Homo sapiens
cccttggcctca

SEQ ID NO: 1176661 - DNA, 12 bp, Homo sapiens
cccttggcctgt

SEQ ID NO: 1176662 - DNA, 19 bp, Homo sapiens
cccttggcctgtctcatcc

SEQ ID NO: 1176663 - DNA, 18 bp, Homo sapiens
cccttggcttcctccgtc

SEQ ID NO: 1176664 - DNA, 16 bp, Homo sapiens
cccttggcttctgtga

SEQ ID NO: 1176665 - DNA, 19 bp, Homo sapiens
cccttgggaaggacacagc

SEQ ID NO: 1176666 - DNA, 20 bp, Homo sapiens
cccttgggaaggacacagca

SEQ ID NO: 1176667 - DNA, 19 bp, Homo sapiens
cccttgggacagccagagc

SEQ ID NO: 1176668 - DNA, 22 bp, Homo sapiens
cccttgggacagccagagctgg

SEQ ID NO: 1176669 - DNA, 20 bp, Homo sapiens
cccttgggcagttctcactc

SEQ ID NO: 1176670 - DNA, 22 bp, Homo sapiens
cccttgggcagttctcactcct

SEQ ID NO: 1176671 - DNA, 19 bp, Homo sapiens
cccttgggcatccacccag

SEQ ID NO: 1176672 - DNA, 15 bp, Homo sapiens
cccttgggccagaag

SEQ ID NO: 1176673 - DNA, 15 bp, Homo sapiens
cccttgggctggaag

SEQ ID NO: 1176674 - DNA, 19 bp, Homo sapiens
cccttggggcctggcttgc

SEQ ID NO: 1176675 - DNA, 17 bp, Homo sapiens
cccttggtagcagcctg

SEQ ID NO: 1176676 - DNA, 19 bp, Homo sapiens
cccttggtgtttcccttcc

SEQ ID NO: 1176677 - DNA, 16 bp, Homo sapiens
cccttgtcctgccagc

SEQ ID NO: 1176678 - DNA, 19 bp, Homo sapiens
cccttgtctccctggttgc

SEQ ID NO: 1176679 - DNA, 13 bp, Homo sapiens
cccttgtcttccc

SEQ ID NO: 1176680 - DNA, 15 bp, Homo sapiens
cccttgtcttccccc

SEQ ID NO: 1176681 - DNA, 10 bp, Homo sapiens
cccttgtggg

SEQ ID NO: 1176682 - DNA, 23 bp, Homo sapiens
cccttgtgggcaaaggcagggcc

SEQ ID NO: 1176683 - DNA, 21 bp, Homo sapiens
cccttgtgtgtgccctgggcc

SEQ ID NO: 1176684 - DNA, 22 bp, Homo sapiens
cccttgtgtgtgccctgggcca

SEQ ID NO: 1176685 - DNA, 13 bp, Homo sapiens
cccttgttctcta

SEQ ID NO: 1176686 - DNA, 16 bp, Homo sapiens
cccttgttgcactgcc

SEQ ID NO: 1176687 - DNA, 18 bp, Homo sapiens
cccttgtttacagtgagg

SEQ ID NO: 1176688 - DNA, 13 bp, Homo sapiens
ccctttaccctct

SEQ ID NO: 1176689 - DNA, 21 bp, Homo sapiens
ccctttagccaaacccttgtc

SEQ ID NO: 1176690 - DNA, 16 bp, Homo sapiens
ccctttagggctgttg

SEQ ID NO: 1176691 - DNA, 14 bp, Homo sapiens
ccctttagtgcttt

SEQ ID NO: 1176692 - DNA, 9 bp, Homo sapiens
ccctttcct

SEQ ID NO: 1176693 - DNA, 11 bp, Homo sapiens
ccctttcctaa

SEQ ID NO: 1176694 - DNA, 12 bp, Homo sapiens
ccctttcctaaa

SEQ ID NO: 1176695 - DNA, 14 bp, Homo sapiens
ccctttcctaggcc

SEQ ID NO: 1176696 - DNA, 13 bp, Homo sapiens
ccctttcctcccc

SEQ ID NO: 1176697 - DNA, 15 bp, Homo sapiens
ccctttcctgtccca

SEQ ID NO: 1176698 - DNA, 16 bp, Homo sapiens
ccctttccttcactgc

SEQ ID NO: 1176699 - DNA, 18 bp, Homo sapiens
ccctttccttccttccct

SEQ ID NO: 1176700 - DNA, 23 bp, Homo sapiens
atgttactattttctacaattaa

SEQ ID NO: 1176701 - DNA, 13 bp, Homo sapiens
atgttactgagat

SEQ ID NO: 1176702 - DNA, 15 bp, Homo sapiens
atgttactgagatgt

SEQ ID NO: 1176703 - DNA, 19 bp, Homo sapiens
atgttactgagatgtttta

SEQ ID NO: 1176704 - DNA, 19 bp, Homo sapiens
atgttactgatcatgcatt

SEQ ID NO: 1176705 - DNA, 21 bp, Homo sapiens
atgttactgatcatgcattgt

SEQ ID NO: 1176706 - DNA, 14 bp, Homo sapiens
atgttactgcctta

SEQ ID NO: 1176707 - DNA, 16 bp, Homo sapiens
atgttagaggttttaa

SEQ ID NO: 1176708 - DNA, 18 bp, Homo sapiens
atgttagcagacccagct

SEQ ID NO: 1176709 - DNA, 17 bp, Homo sapiens
atgttagcctgcaaaca

SEQ ID NO: 1176710 - DNA, 19 bp, Homo sapiens
atgttaggaaaatttcaca

SEQ ID NO: 1176711 - DNA, 16 bp, Homo sapiens
atgttaggagaactac

SEQ ID NO: 1176712 - DNA, 22 bp, Homo sapiens
atgttagggtataagttgctgt

SEQ ID NO: 1176713 - DNA, 22 bp, Homo sapiens
atgttagtcattgttatttata

SEQ ID NO: 1176714 - DNA, 20 bp, Homo sapiens
atgttagttaccttatagtt

SEQ ID NO: 1176715 - DNA, 13 bp, Homo sapiens
atgttatatattt

SEQ ID NO: 1176716 - DNA, 17 bp, Homo sapiens
atgttatatattttttg

SEQ ID NO: 1176717 - DNA, 20 bp, Homo sapiens
atgttatcaaccaactgcac

SEQ ID NO: 1176718 - DNA, 21 bp, Homo sapiens
atgttatcaaccaactgcaca

SEQ ID NO: 1176719 - DNA, 24 bp, Homo sapiens
atgttatgactatgtaaactactt

SEQ ID NO: 1176720 - DNA, 18 bp, Homo sapiens
atgttatgatattgttta

SEQ ID NO: 1176721 - DNA, 22 bp, Homo sapiens
atgttatgatattgtttaaaat

SEQ ID NO: 1176722 - DNA, 18 bp, Homo sapiens
atgttatgggatgtaaac

SEQ ID NO: 1176723 - DNA, 20 bp, Homo sapiens
atgttatgggatgtaaacaa

SEQ ID NO: 1176724 - DNA, 21 bp, Homo sapiens
atgttatgggatgtaaacaat

SEQ ID NO: 1176725 - DNA, 13 bp, Homo sapiens
atgttatgtttaa

SEQ ID NO: 1176726 - DNA, 19 bp, Homo sapiens
atgttatgtttaataagct

SEQ ID NO: 1176727 - DNA, 13 bp, Homo sapiens
atgttattactgt

SEQ ID NO: 1176728 - DNA, 13 bp, Homo sapiens
atgttattatctg

SEQ ID NO: 1176729 - DNA, 14 bp, Homo sapiens
atgttattatgcta

SEQ ID NO: 1176730 - DNA, 22 bp, Homo sapiens
atgttatttgttattttcagta

SEQ ID NO: 1176731 - DNA, 20 bp, Homo sapiens
atgttattttttaattatta

SEQ ID NO: 1176732 - DNA, 12 bp, Homo sapiens
atgttcaaagac

SEQ ID NO: 1176733 - DNA, 18 bp, Homo sapiens
atgttcaaagactgtgaa

SEQ ID NO: 1176734 - DNA, 14 bp, Homo sapiens
atgttcaactggag

SEQ ID NO: 1176735 - DNA, 12 bp, Homo sapiens
atgtttctggat

SEQ ID NO: 1176736 - DNA, 21 bp, Homo sapiens
atgtttctgggtcctgaagaa

SEQ ID NO: 1176737 - DNA, 18 bp, Homo sapiens
atgtttcttaaatgggct

SEQ ID NO: 1176738 - DNA, 13 bp, Homo sapiens
atgtttcttcatt

SEQ ID NO: 1176739 - DNA, 19 bp, Homo sapiens
atgtttcttcatttctctg

SEQ ID NO: 1176740 - DNA, 20 bp, Homo sapiens
atgtttcttcatttctctgc

SEQ ID NO: 1176741 - DNA, 19 bp, Homo sapiens
atgtttcttttgtatgtaa

SEQ ID NO: 1176742 - DNA, 21 bp, Homo sapiens
atgtttgaaaatgctcttaaa

SEQ ID NO: 1176743 - DNA, 20 bp, Homo sapiens
atgtttgaatttttctcttc

SEQ ID NO: 1176744 - DNA, 12 bp, Homo sapiens
atgtttgatgtc

SEQ ID NO: 1176745 - DNA, 12 bp, Homo sapiens
atgtttgattta

SEQ ID NO: 1176746 - DNA, 13 bp, Homo sapiens
atgtttgcagggg

SEQ ID NO: 1176747 - DNA, 15 bp, Homo sapiens
atgtttgccatgagt

SEQ ID NO: 1176748 - DNA, 14 bp, Homo sapiens
atgtttggatggtt

SEQ ID NO: 1176749 - DNA, 17 bp, Homo sapiens
atgtttggattgatatc

SEQ ID NO: 1176750 - DNA, 23 bp, Homo sapiens
atgtttgggcagaagggagaagg

SEQ ID NO: 1176751 - DNA, 19 bp, Homo sapiens
atgtttggggatcgatgtg

SEQ ID NO: 1176752 - DNA, 12 bp, Homo sapiens
atgtttggggtc

SEQ ID NO: 1176753 - DNA, 13 bp, Homo sapiens
atgtttggtaaga

SEQ ID NO: 1176754 - DNA, 19 bp, Homo sapiens
atgtttgtaaattaatact

SEQ ID NO: 1176755 - DNA, 19 bp, Homo sapiens
atgtttgtgatattaaatt

SEQ ID NO: 1176756 - DNA, 21 bp, Homo sapiens
atgtttgtgatattaaatttc

SEQ ID NO: 1176757 - DNA, 19 bp, Homo sapiens
atgtttgtgccttaaaagg

SEQ ID NO: 1176758 - DNA, 15 bp, Homo sapiens
atgtttgtgctctgt

SEQ ID NO: 1176759 - DNA, 13 bp, Homo sapiens
atgtttgtggcct

SEQ ID NO: 1176760 - DNA, 15 bp, Homo sapiens
atgtttgtggcctca

SEQ ID NO: 1176761 - DNA, 18 bp, Homo sapiens
atgtttgtggcctcagaa

SEQ ID NO: 1176762 - DNA, 20 bp, Homo sapiens
atgtttgttatttacactgg

SEQ ID NO: 1176763 - DNA, 23 bp, Homo sapiens
atgtttgttatttacactggtct

SEQ ID NO: 1176764 - DNA, 23 bp, Homo sapiens
atgtttgttggttgattgtttaa

SEQ ID NO: 1176765 - DNA, 13 bp, Homo sapiens
atgtttgtttcag

SEQ ID NO: 1176766 - DNA, 16 bp, Homo sapiens
atgtttgtttcagtgc

SEQ ID NO: 1176767 - DNA, 14 bp, Homo sapiens
atgttttaaacaca

SEQ ID NO: 1176768 - DNA, 21 bp, Homo sapiens
atgttttaaacatagaaagtt

SEQ ID NO: 1176769 - DNA, 15 bp, Homo sapiens
atgttttaaatgtac

SEQ ID NO: 1176770 - DNA, 20 bp, Homo sapiens
atgttttacgcaaggaagga

SEQ ID NO: 1176771 - DNA, 23 bp, Homo sapiens
atgttttagggagtggttcctgt

SEQ ID NO: 1176772 - DNA, 14 bp, Homo sapiens
atgttttataattt

SEQ ID NO: 1176773 - DNA, 15 bp, Homo sapiens
atgttttatttatca

SEQ ID NO: 1176774 - DNA, 23 bp, Homo sapiens
atgttttatttatcaaaatgtag

SEQ ID NO: 1176775 - DNA, 15 bp, Homo sapiens
atgttttcattatgt

SEQ ID NO: 1176776 - DNA, 20 bp, Homo sapiens
atgttttccattgtttgaaa

SEQ ID NO: 1176777 - DNA, 23 bp, Homo sapiens
atgttttcgaaaatcaaatggta

SEQ ID NO: 1176778 - DNA, 18 bp, Homo sapiens
atgttttctgaaaatata

SEQ ID NO: 1176779 - DNA, 16 bp, Homo sapiens
atgttttctttgcaaa

SEQ ID NO: 1176780 - DNA, 15 bp, Homo sapiens
atgttttgaatgtgg

SEQ ID NO: 1176781 - DNA, 17 bp, Homo sapiens
atgttttgaatgtggat

SEQ ID NO: 1176782 - DNA, 13 bp, Homo sapiens
atgttttgacaca

SEQ ID NO: 1176783 - DNA, 20 bp, Homo sapiens
atgttttgggatcaggagcc

SEQ ID NO: 1176784 - DNA, 15 bp, Homo sapiens
atgttttgtaaacat

SEQ ID NO: 1176785 - DNA, 17 bp, Homo sapiens
atgttttgtaaacattt

SEQ ID NO: 1176786 - DNA, 12 bp, Homo sapiens
atgttttgtaca

SEQ ID NO: 1176787 - DNA, 17 bp, Homo sapiens
atgttttgtacaattac

SEQ ID NO: 1176788 - DNA, 14 bp, Homo sapiens
atgttttgtgacta

SEQ ID NO: 1176789 - DNA, 18 bp, Homo sapiens
atgttttgtgggaacaga

SEQ ID NO: 1176790 - DNA, 14 bp, Homo sapiens
atgttttgtttctg

SEQ ID NO: 1176791 - DNA, 21 bp, Homo sapiens
atgttttgtttctgaaaattc

SEQ ID NO: 1176792 - DNA, 12 bp, Homo sapiens
atgtttttaatg

SEQ ID NO: 1176793 - DNA, 14 bp, Homo sapiens
atgtttttaatgac

SEQ ID NO: 1176794 - DNA, 16 bp, Homo sapiens
atgtttttaatgtata

SEQ ID NO: 1176795 - DNA, 19 bp, Homo sapiens
atgtttttaatgtatagta

SEQ ID NO: 1176796 - DNA, 19 bp, Homo sapiens
atgtttttacattatgcaa

SEQ ID NO: 1176797 - DNA, 14 bp, Homo sapiens
atgtttttccctcc

SEQ ID NO: 1176798 - DNA, 12 bp, Homo sapiens
atgtttttcctt

SEQ ID NO: 1176799 - DNA, 14 bp, Homo sapiens
atgtttttgaaggc

SEQ ID NO: 1176800 - DNA, 15 bp, Homo sapiens
atgtttttgaaggca

SEQ ID NO: 1176801 - DNA, 22 bp, Homo sapiens
atgttttttccttttcacattt

SEQ ID NO: 1176802 - DNA, 19 bp, Homo sapiens
atgttttttgccacagctt

SEQ ID NO: 1176803 - DNA, 21 bp, Homo sapiens
atgttttttgccacagctttt

SEQ ID NO: 1176804 - DNA, 19 bp, Homo sapiens
attaaaaaaaaaaaaaaac

SEQ ID NO: 1176805 - DNA, 21 bp, Homo sapiens
attaaaaaaaaatactctttc

SEQ ID NO: 1176806 - DNA, 23 bp, Homo sapiens
attaaaaaaaaatactctttcaa

SEQ ID NO: 1176807 - DNA, 23 bp, Homo sapiens
attaaaaaaaagaagagccttgt

SEQ ID NO: 1176808 - DNA, 20 bp, Homo sapiens
attaaaaaaatgtggtacat

SEQ ID NO: 1176809 - DNA, 16 bp, Homo sapiens
attaaaaaagagacat

SEQ ID NO: 1176810 - DNA, 22 bp, Homo sapiens
attaaaaaagagacatccaaat

SEQ ID NO: 1176811 - DNA, 18 bp, Homo sapiens
attaaaaaagcatacttc

SEQ ID NO: 1176812 - DNA, 19 bp, Homo sapiens
attaaaaaagcatacttct

SEQ ID NO: 1176813 - DNA, 13 bp, Homo sapiens
attaaaaactgag

SEQ ID NO: 1176814 - DNA, 14 bp, Homo sapiens
attaaaaactgagt

SEQ ID NO: 1176815 - DNA, 20 bp, Homo sapiens
attaaaaactgagtgactct

SEQ ID NO: 1176816 - DNA, 16 bp, Homo sapiens
attaaaaactgcttat

SEQ ID NO: 1176817 - DNA, 14 bp, Homo sapiens
attaaaaactttaa

SEQ ID NO: 1176818 - DNA, 11 bp, Homo sapiens
attaaaaataa

SEQ ID NO: 1176819 - DNA, 16 bp, Homo sapiens
attaaaaatataaaac

SEQ ID NO: 1176820 - DNA, 21 bp, Homo sapiens
attaaaaatatggaacttcta

SEQ ID NO: 1176821 - DNA, 15 bp, Homo sapiens
attaaaaatctcaaa

SEQ ID NO: 1176822 - DNA, 23 bp, Homo sapiens
attaaaaatctcaaatttctaaa

SEQ ID NO: 1176823 - DNA, 13 bp, Homo sapiens
attaaaaatgttc

SEQ ID NO: 1176824 - DNA, 13 bp, Homo sapiens
attaaaacaaaag

SEQ ID NO: 1176825 - DNA, 22 bp, Homo sapiens
attaaaacaaaagggtgtatag

SEQ ID NO: 1176826 - DNA, 14 bp, Homo sapiens
attaaaacaatatt

SEQ ID NO: 1176827 - DNA, 22 bp, Homo sapiens
attaaaacagctgcattagaaa

SEQ ID NO: 1176828 - DNA, 19 bp, Homo sapiens
attaaaacatatttcattt

SEQ ID NO: 1176829 - DNA, 21 bp, Homo sapiens
attaaaacatatttcatttta

SEQ ID NO: 1176830 - DNA, 17 bp, Homo sapiens
attaaaactgagtccat

SEQ ID NO: 1176831 - DNA, 23 bp, Homo sapiens
ccgagctcgtgtatcctggggct

SEQ ID NO: 1176832 - DNA, 15 bp, Homo sapiens
ccgagctgcctggcg

SEQ ID NO: 1176833 - DNA, 11 bp, Homo sapiens
ccgagctgggg

SEQ ID NO: 1176834 - DNA, 17 bp, Homo sapiens
ccgagctggtgcattac

SEQ ID NO: 1176835 - DNA, 20 bp, Homo sapiens
ccgagctggtgcattacaga

SEQ ID NO: 1176836 - DNA, 18 bp, Homo sapiens
ccgaggagttgtcgtttt

SEQ ID NO: 1176837 - DNA, 22 bp, Homo sapiens
ccgaggcctaccccgcagacac

SEQ ID NO: 1176838 - DNA, 13 bp, Homo sapiens
ccgaggctgcccc

SEQ ID NO: 1176839 - DNA, 17 bp, Homo sapiens
ccgaggctgccccaggc

SEQ ID NO: 1176840 - DNA, 19 bp, Homo sapiens
ccgaggctgccccaggccg

SEQ ID NO: 1176841 - DNA, 17 bp, Homo sapiens
ccgagggagctgctggc

SEQ ID NO: 1176842 - DNA, 18 bp, Homo sapiens
ccgagggagctgctggct

SEQ ID NO: 1176843 - DNA, 20 bp, Homo sapiens
ccgagggagctgctggctga

SEQ ID NO: 1176844 - DNA, 12 bp, Homo sapiens
ccgagggccagg

SEQ ID NO: 1176845 - DNA, 14 bp, Homo sapiens
ccgagggccaggca

SEQ ID NO: 1176846 - DNA, 17 bp, Homo sapiens
ccgagggctcagaagag

SEQ ID NO: 1176847 - DNA, 19 bp, Homo sapiens
ccgagggctcagaagagca

SEQ ID NO: 1176848 - DNA, 16 bp, Homo sapiens
ccgagggctgagcctg

SEQ ID NO: 1176849 - DNA, 22 bp, Homo sapiens
ccgagggctgagcctggtccca

SEQ ID NO: 1176850 - DNA, 14 bp, Homo sapiens
ccgagggctgagga

SEQ ID NO: 1176851 - DNA, 19 bp, Homo sapiens
ccgagggctgaggagcagc

SEQ ID NO: 1176852 - DNA, 21 bp, Homo sapiens
ccgagggtcctggctcctgag

SEQ ID NO: 1176853 - DNA, 18 bp, Homo sapiens
ccgagtagaaaatgtgac

SEQ ID NO: 1176854 - DNA, 21 bp, Homo sapiens
ccgagtagaaaatgtgaccct

SEQ ID NO: 1176855 - DNA, 20 bp, Homo sapiens
ccgagtagctgggactacag

SEQ ID NO: 1176856 - DNA, 20 bp, Homo sapiens
ccgagtagctgggattacag

SEQ ID NO: 1176857 - DNA, 13 bp, Homo sapiens
ccgccctgccccg

SEQ ID NO: 1176858 - DNA, 16 bp, Homo sapiens
ccgccctgcgggccac

SEQ ID NO: 1176859 - DNA, 18 bp, Homo sapiens
ccgccctgctcctccctg

SEQ ID NO: 1176860 - DNA, 15 bp, Homo sapiens
ccgccctgggctgga

SEQ ID NO: 1176861 - DNA, 17 bp, Homo sapiens
ccgccctgggctggact

SEQ ID NO: 1176862 - DNA, 18 bp, Homo sapiens
ccgccctgggctgtctgt

SEQ ID NO: 1176863 - DNA, 13 bp, Homo sapiens
ccgccgccaccct

SEQ ID NO: 1176864 - DNA, 14 bp, Homo sapiens
ccgccgccaggact

SEQ ID NO: 1176865 - DNA, 21 bp, Homo sapiens
ccgccgccctggacagatggc

SEQ ID NO: 1176866 - DNA, 15 bp, Homo sapiens
ccgccgcctcccacg

SEQ ID NO: 1176867 - DNA, 21 bp, Homo sapiens
ccgccggaccgcgtagagagc

SEQ ID NO: 1176868 - DNA, 17 bp, Homo sapiens
ccgccgtctgcaggggc

SEQ ID NO: 1176869 - DNA, 14 bp, Homo sapiens
ccgccgtgccggcg

SEQ ID NO: 1176870 - DNA, 15 bp, Homo sapiens
ccgcctagctgctgt

SEQ ID NO: 1176871 - DNA, 23 bp, Homo sapiens
ccgcctcaatgtggttgcaaggc

SEQ ID NO: 1176872 - DNA, 12 bp, Homo sapiens
ccgcctccactc

SEQ ID NO: 1176873 - DNA, 14 bp, Homo sapiens
ccgcctccactcta

SEQ ID NO: 1176874 - DNA, 23 bp, Homo sapiens
ccgcctccactctagttctagat

SEQ ID NO: 1176875 - DNA, 14 bp, Homo sapiens
ccgcctcccagcct

SEQ ID NO: 1176876 - DNA, 21 bp, Homo sapiens
ccgcctccctctcagaggcct

SEQ ID NO: 1176877 - DNA, 16 bp, Homo sapiens
ccgcctcgtgccagca

SEQ ID NO: 1176878 - DNA, 14 bp, Homo sapiens
ccgcctctgcccgc

SEQ ID NO: 1176879 - DNA, 11 bp, Homo sapiens
ccgcctctggc

SEQ ID NO: 1176880 - DNA, 16 bp, Homo sapiens
ccgcctctgtctggag

SEQ ID NO: 1176881 - DNA, 17 bp, Homo sapiens
ccgcctgacagaaacca

SEQ ID NO: 1176882 - DNA, 19 bp, Homo sapiens
ccgcctgagtcagtgctct

SEQ ID NO: 1176883 - DNA, 12 bp, Homo sapiens
ccgcctgcccag

SEQ ID NO: 1176884 - DNA, 15 bp, Homo sapiens
ccgcctgcccagact

SEQ ID NO: 1176885 - DNA, 20 bp, Homo sapiens
ccgcctgcccagactgatga

SEQ ID NO: 1176886 - DNA, 16 bp, Homo sapiens
ccgcctgccctgcctt

SEQ ID NO: 1176887 - DNA, 17 bp, Homo sapiens
ccgcctgccctgccttg

SEQ ID NO: 1176888 - DNA, 14 bp, Homo sapiens
ccgcctgcgcctcc

SEQ ID NO: 1176889 - DNA, 14 bp, Homo sapiens
ccgcctgctcccat

SEQ ID NO: 1176890 - DNA, 12 bp, Homo sapiens
ccgcctgctcct

SEQ ID NO: 1176891 - DNA, 18 bp, Homo sapiens
ccgcctgctcctcactgg

SEQ ID NO: 1176892 - DNA, 22 bp, Homo sapiens
ccgcctgctcctcactggagga

SEQ ID NO: 1176893 - DNA, 22 bp, Homo sapiens
ccgcctgcttcttctctccaca

SEQ ID NO: 1176894 - DNA, 15 bp, Homo sapiens
ccgcctggccaggag

SEQ ID NO: 1176895 - DNA, 21 bp, Homo sapiens
ccgcctggccaggagcaggca

SEQ ID NO: 1176896 - DNA, 12 bp, Homo sapiens
ccgcctggccct

SEQ ID NO: 1176897 - DNA, 13 bp, Homo sapiens
ccgcctggccctc

SEQ ID NO: 1176898 - DNA, 15 bp, Homo sapiens
ccgcctggccctccc

SEQ ID NO: 1176899 - DNA, 11 bp, Homo sapiens
ccgcctgggat

SEQ ID NO: 1176900 - DNA, 14 bp, Homo sapiens
ccgcctgtgggcgc

SEQ ID NO: 1176901 - DNA, 12 bp, Homo sapiens
ccgccttccctc

SEQ ID NO: 1176902 - DNA, 22 bp, Homo sapiens
ccgccttccctcactcttcctc

SEQ ID NO: 1176903 - DNA, 23 bp, Homo sapiens
ccgccttccctcactcttcctca

SEQ ID NO: 1176904 - DNA, 22 bp, Homo sapiens
ccgccttcgtgtgctgctgctg

SEQ ID NO: 1176905 - DNA, 16 bp, Homo sapiens
ccgccttctcccacat

SEQ ID NO: 1176906 - DNA, 19 bp, Homo sapiens
ccgccttctcccacatgag

SEQ ID NO: 1176907 - DNA, 15 bp, Homo sapiens
ccgccttctcccctc

SEQ ID NO: 1176908 - DNA, 23 bp, Homo sapiens
ccgccttctcccctctcccaggg

SEQ ID NO: 1176909 - DNA, 18 bp, Homo sapiens
ccgccttggcctcccaaa

SEQ ID NO: 1176910 - DNA, 15 bp, Homo sapiens
ccgcgaactgggttc

SEQ ID NO: 1176911 - DNA, 18 bp, Homo sapiens
ccgcgagactgagaggca

SEQ ID NO: 1176912 - DNA, 18 bp, Homo sapiens
ccgcgccacccgggcaag

SEQ ID NO: 1176913 - DNA, 14 bp, Homo sapiens
ccgcgccctccctc

SEQ ID NO: 1176914 - DNA, 13 bp, Homo sapiens
ccgcgccctccga

SEQ ID NO: 1176915 - DNA, 21 bp, Homo sapiens
ccgcgccctccgacctctctc

SEQ ID NO: 1176916 - DNA, 23 bp, Homo sapiens
ccgcgcctacccttcccgcctcc

SEQ ID NO: 1176917 - DNA, 16 bp, Homo sapiens
ccgcgcctccttcctt

SEQ ID NO: 1176918 - DNA, 19 bp, Homo sapiens
ccgcgcggagacctcctga

SEQ ID NO: 1176919 - DNA, 17 bp, Homo sapiens
ccgcgcgtccagctgcc

SEQ ID NO: 1176920 - DNA, 23 bp, Homo sapiens
ccgcgcgtccagctgcccttccg

SEQ ID NO: 1176921 - DNA, 19 bp, Homo sapiens
ccgcggcccagacccagcc

SEQ ID NO: 1176922 - DNA, 16 bp, Homo sapiens
ccgcggcctccccgag

SEQ ID NO: 1176923 - DNA, 17 bp, Homo sapiens
ccgcggcctgcaccgac

SEQ ID NO: 1176924 - DNA, 15 bp, Homo sapiens
ccgcgggctgactgg

SEQ ID NO: 1176925 - DNA, 18 bp, Homo sapiens
ccgcggggaagctggctt

SEQ ID NO: 1176926 - DNA, 19 bp, Homo sapiens
ccgcggggaagctggcttt

SEQ ID NO: 1176927 - DNA, 20 bp, Homo sapiens
ccgcggggacattgggaagg

SEQ ID NO: 1176928 - DNA, 17 bp, Homo sapiens
ccgcgggttccgcaggc

SEQ ID NO: 1176929 - DNA, 20 bp, Homo sapiens
ccgcggtaggtaagggccgc

SEQ ID NO: 1176930 - DNA, 21 bp, Homo sapiens
ccgcggttcatacgcatccca

SEQ ID NO: 1176931 - DNA, 13 bp, Homo sapiens
ccgcgtagagagc

SEQ ID NO: 1176932 - DNA, 21 bp, Homo sapiens
ccgcgtagagagccgggcccc

SEQ ID NO: 1176933 - DNA, 15 bp, Homo sapiens
ccgcgtccaaccccg

SEQ ID NO: 1176934 - DNA, 22 bp, Homo sapiens
ccgcgttcaagacttgagcgga

SEQ ID NO: 1176935 - DNA, 13 bp, Homo sapiens
ccgcgttgtaaaa

SEQ ID NO: 1176936 - DNA, 18 bp, Homo sapiens
ccgctaagttgctgatgg

SEQ ID NO: 1176937 - DNA, 15 bp, Homo sapiens
ccgctagaggcctga

SEQ ID NO: 1176938 - DNA, 16 bp, Homo sapiens
ccgctcacctagagcc

SEQ ID NO: 1176939 - DNA, 17 bp, Homo sapiens
ccgctcacctagagcca

SEQ ID NO: 1176940 - DNA, 12 bp, Homo sapiens
ccgctcagccct

SEQ ID NO: 1176941 - DNA, 13 bp, Homo sapiens
ccgctcagccctc

SEQ ID NO: 1176942 - DNA, 19 bp, Homo sapiens
ccgctcagccctccctgcc

SEQ ID NO: 1176943 - DNA, 13 bp, Homo sapiens
ccgctcagtattt

SEQ ID NO: 1176944 - DNA, 13 bp, Homo sapiens
ccgctccagcgtc

SEQ ID NO: 1176945 - DNA, 22 bp, Homo sapiens
ccgctcccaacccccctcctgc

SEQ ID NO: 1176946 - DNA, 15 bp, Homo sapiens
ccgctcccacagctt

SEQ ID NO: 1176947 - DNA, 22 bp, Homo sapiens
ccgctcccacagcttcctgagg

SEQ ID NO: 1176948 - DNA, 23 bp, Homo sapiens
ccgctcccacagcttcctgaggg

SEQ ID NO: 1176949 - DNA, 16 bp, Homo sapiens
ccgctcccaccgcccc

SEQ ID NO: 1176950 - DNA, 21 bp, Homo sapiens
ccgctcccaccgcccccaccc

SEQ ID NO: 1176951 - DNA, 15 bp, Homo sapiens
ccgctcccacctagt

SEQ ID NO: 1176952 - DNA, 17 bp, Homo sapiens
ccgctcccacctagtgc

SEQ ID NO: 1176953 - DNA, 15 bp, Homo sapiens
ccgctccccagccca

SEQ ID NO: 1176954 - DNA, 17 bp, Homo sapiens
ccgctcccgctcccagg

SEQ ID NO: 1176955 - DNA, 13 bp, Homo sapiens
ccgctcctccctg

SEQ ID NO: 1176956 - DNA, 23 bp, Homo sapiens
ccgctcctccctgctcctcatgg

SEQ ID NO: 1176957 - DNA, 17 bp, Homo sapiens
ccgctcctgcttcccct

SEQ ID NO: 1176958 - DNA, 15 bp, Homo sapiens
ccgctcctgtctgcc

SEQ ID NO: 1176959 - DNA, 19 bp, Homo sapiens
ccgctctacatcttctgcc

SEQ ID NO: 1176960 - DNA, 13 bp, Homo sapiens
ccgctctcttcct

SEQ ID NO: 1176961 - DNA, 17 bp, Homo sapiens
ccgctctcttcctgccc

SEQ ID NO: 1176962 - DNA, 16 bp, Homo sapiens
attaagaaaatcatat

SEQ ID NO: 1176963 - DNA, 13 bp, Homo sapiens
attaagaaagact

SEQ ID NO: 1176964 - DNA, 17 bp, Homo sapiens
attaagaaaggaagcat

SEQ ID NO: 1176965 - DNA, 19 bp, Homo sapiens
attaagaagagcagagctg

SEQ ID NO: 1176966 - DNA, 19 bp, Homo sapiens
attaagaaggcaaaaatgt

SEQ ID NO: 1176967 - DNA, 21 bp, Homo sapiens
attaagaatcttagataactt

SEQ ID NO: 1176968 - DNA, 21 bp, Homo sapiens
attaagacaaaaagccttgaa

SEQ ID NO: 1176969 - DNA, 13 bp, Homo sapiens
attaagacagtgt

SEQ ID NO: 1176970 - DNA, 15 bp, Homo sapiens
attaagacagtgtac

SEQ ID NO: 1176971 - DNA, 14 bp, Homo sapiens
attaagatacaaat

SEQ ID NO: 1176972 - DNA, 16 bp, Homo sapiens
attaagatcctaaact

SEQ ID NO: 1176973 - DNA, 20 bp, Homo sapiens
attaagatcctaaactctct

SEQ ID NO: 1176974 - DNA, 15 bp, Homo sapiens
attaagatggattct

SEQ ID NO: 1176975 - DNA, 16 bp, Homo sapiens
attaagatttccaagt

SEQ ID NO: 1176976 - DNA, 12 bp, Homo sapiens
attaagcacaca

SEQ ID NO: 1176977 - DNA, 17 bp, Homo sapiens
attaagcacacacatct

SEQ ID NO: 1176978 - DNA, 13 bp, Homo sapiens
attaagcacacta

SEQ ID NO: 1176979 - DNA, 21 bp, Homo sapiens
attaagcactttaagctcctt

SEQ ID NO: 1176980 - DNA, 14 bp, Homo sapiens
attacagtgtttat

SEQ ID NO: 1176981 - DNA, 14 bp, Homo sapiens
attacataaataaa

SEQ ID NO: 1176982 - DNA, 12 bp, Homo sapiens
attacatacaga

SEQ ID NO: 1176983 - DNA, 14 bp, Homo sapiens
attacatacagatt

SEQ ID NO: 1176984 - DNA, 16 bp, Homo sapiens
attacatagaacactt

SEQ ID NO: 1176985 - DNA, 13 bp, Homo sapiens
attacatatttga

SEQ ID NO: 1176986 - DNA, 15 bp, Homo sapiens
attacatatttgact

SEQ ID NO: 1176987 - DNA, 17 bp, Homo sapiens
attacatatttgactct

SEQ ID NO: 1176988 - DNA, 22 bp, Homo sapiens
attacatatttgactctttcaa

SEQ ID NO: 1176989 - DNA, 14 bp, Homo sapiens
attacatgactgtt

SEQ ID NO: 1176990 - DNA, 16 bp, Homo sapiens
attacatgtaaaacat

SEQ ID NO: 1176991 - DNA, 19 bp, Homo sapiens
attacatgtaaaacattat

SEQ ID NO: 1176992 - DNA, 17 bp, Homo sapiens
attacatgtttaaattg

SEQ ID NO: 1176993 - DNA, 20 bp, Homo sapiens
attacatgtttaaattgtaa

SEQ ID NO: 1176994 - DNA, 18 bp, Homo sapiens
attacatgttttttcatt

SEQ ID NO: 1176995 - DNA, 21 bp, Homo sapiens
attacattcctaactagaatt

SEQ ID NO: 1176996 - DNA, 18 bp, Homo sapiens
attacattttatatgtga

SEQ ID NO: 1176997 - DNA, 23 bp, Homo sapiens
attacattttattaagctttttg

SEQ ID NO: 1176998 - DNA, 15 bp, Homo sapiens
attacatttttaagc

SEQ ID NO: 1176999 - DNA, 20 bp, Homo sapiens
attaccaataggcaaattaa

SEQ ID NO: 1177000 - DNA, 17 bp, Homo sapiens
attaccaccctttcaca

SEQ ID NO: 1177001 - DNA, 19 bp, Homo sapiens
attaccacgccttgacctt

SEQ ID NO: 1177002 - DNA, 16 bp, Homo sapiens
attaccagacaaaaaa

SEQ ID NO: 1177003 - DNA, 18 bp, Homo sapiens
attaccagcaagaataaa

SEQ ID NO: 1177004 - DNA, 19 bp, Homo sapiens
attaccatagagtaatgat

SEQ ID NO: 1177005 - DNA, 20 bp, Homo sapiens
attaccatgagaagagggcc

SEQ ID NO: 1177006 - DNA, 13 bp, Homo sapiens
attaccatggaga

SEQ ID NO: 1177007 - DNA, 15 bp, Homo sapiens
attaccccatacccc

SEQ ID NO: 1177008 - DNA, 23 bp, Homo sapiens
attaccccataccccttattgct

SEQ ID NO: 1177009 - DNA, 22 bp, Homo sapiens
attaccccctcattgtttatta

SEQ ID NO: 1177010 - DNA, 21 bp, Homo sapiens
attaccccctccttcagacac

SEQ ID NO: 1177011 - DNA, 17 bp, Homo sapiens
attaccgcgttgtaaaa

SEQ ID NO: 1177012 - DNA, 12 bp, Homo sapiens
attacctcctga

SEQ ID NO: 1177013 - DNA, 15 bp, Homo sapiens
attacctgtggatat

SEQ ID NO: 1177014 - DNA, 16 bp, Homo sapiens
attacctgtggatatt

SEQ ID NO: 1177015 - DNA, 19 bp, Homo sapiens
attacctttaattttaatg

SEQ ID NO: 1177016 - DNA, 13 bp, Homo sapiens
attacgtgagcca

SEQ ID NO: 1177017 - DNA, 19 bp, Homo sapiens
attacgtgcatttaaactc

SEQ ID NO: 1177018 - DNA, 13 bp, Homo sapiens
attacgtgctctg

SEQ ID NO: 1177019 - DNA, 14 bp, Homo sapiens
attacgtgtatgtt

SEQ ID NO: 1177020 - DNA, 20 bp, Homo sapiens
attacgtttaaagtgcagtc

SEQ ID NO: 1177021 - DNA, 16 bp, Homo sapiens
attactaataaattga

SEQ ID NO: 1177022 - DNA, 22 bp, Homo sapiens
attactaattctatttctctat

SEQ ID NO: 1177023 - DNA, 12 bp, Homo sapiens
attactaatttt

SEQ ID NO: 1177024 - DNA, 20 bp, Homo sapiens
attactaattttacacatta

SEQ ID NO: 1177025 - DNA, 12 bp, Homo sapiens
attactactgta

SEQ ID NO: 1177026 - DNA, 13 bp, Homo sapiens
attactactgtac

SEQ ID NO: 1177027 - DNA, 14 bp, Homo sapiens
attactcaggtttg

SEQ ID NO: 1177028 - DNA, 17 bp, Homo sapiens
attactctacactgaaa

SEQ ID NO: 1177029 - DNA, 23 bp, Homo sapiens
attactctggtggattgttctag

SEQ ID NO: 1177030 - DNA, 21 bp, Homo sapiens
attactcttcctctaacattt

SEQ ID NO: 1177031 - DNA, 14 bp, Homo sapiens
attactctttttca

SEQ ID NO: 1177032 - DNA, 21 bp, Homo sapiens
attactgaataatatcaaata

SEQ ID NO: 1177033 - DNA, 19 bp, Homo sapiens
attactgatttagaagcaa

SEQ ID NO: 1177034 - DNA, 23 bp, Homo sapiens
attactgcagtacatacgtctgc

SEQ ID NO: 1177035 - DNA, 12 bp, Homo sapiens
attactgctaag

SEQ ID NO: 1177036 - DNA, 19 bp, Homo sapiens
attactgctaagtatttcc

SEQ ID NO: 1177037 - DNA, 23 bp, Homo sapiens
attactgctaagtatttcccagc

SEQ ID NO: 1177038 - DNA, 21 bp, Homo sapiens
attactgctttaatcagaaac

SEQ ID NO: 1177039 - DNA, 21 bp, Homo sapiens
attactggcctttttcattta

SEQ ID NO: 1177040 - DNA, 22 bp, Homo sapiens
attactggcctttttcatttat

SEQ ID NO: 1177041 - DNA, 15 bp, Homo sapiens
attactgggccttag

SEQ ID NO: 1177042 - DNA, 20 bp, Homo sapiens
attactgtatataaactcct

SEQ ID NO: 1177043 - DNA, 16 bp, Homo sapiens
attactgtcaataaac

SEQ ID NO: 1177044 - DNA, 17 bp, Homo sapiens
attactgtcaataaaca

SEQ ID NO: 1177045 - DNA, 18 bp, Homo sapiens
attactgtctctggcatt

SEQ ID NO: 1177046 - DNA, 17 bp, Homo sapiens
attactgtgtaaatata

SEQ ID NO: 1177047 - DNA, 15 bp, Homo sapiens
attactgttccagat

SEQ ID NO: 1177048 - DNA, 20 bp, Homo sapiens
attactgtttattacttcca

SEQ ID NO: 1177049 - DNA, 22 bp, Homo sapiens
attacttaggttattttgcttt

SEQ ID NO: 1177050 - DNA, 18 bp, Homo sapiens
attacttatttttgacag

SEQ ID NO: 1177051 - DNA, 15 bp, Homo sapiens
attacttccatgaat

SEQ ID NO: 1177052 - DNA, 16 bp, Homo sapiens
attacttctctataaa

SEQ ID NO: 1177053 - DNA, 16 bp, Homo sapiens
attacttctgtttggg

SEQ ID NO: 1177054 - DNA, 17 bp, Homo sapiens
attacttgctttcaatt

SEQ ID NO: 1177055 - DNA, 22 bp, Homo sapiens
attacttgctttcaattgacaa

SEQ ID NO: 1177056 - DNA, 14 bp, Homo sapiens
attactttaaaata

SEQ ID NO: 1177057 - DNA, 14 bp, Homo sapiens
attactttatgaac

SEQ ID NO: 1177058 - DNA, 14 bp, Homo sapiens
attactttctgccg

SEQ ID NO: 1177059 - DNA, 15 bp, Homo sapiens
attacttttgtaaat

SEQ ID NO: 1177060 - DNA, 21 bp, Homo sapiens
attacttttgtaaatattctt

SEQ ID NO: 1177061 - DNA, 22 bp, Homo sapiens
attactttttttgtagatgaac

SEQ ID NO: 1177062 - DNA, 13 bp, Homo sapiens
attagaaaatatt

SEQ ID NO: 1177063 - DNA, 17 bp, Homo sapiens
attagaaaatattctct

SEQ ID NO: 1177064 - DNA, 21 bp, Homo sapiens
attagaaaatattctctattt

SEQ ID NO: 1177065 - DNA, 13 bp, Homo sapiens
attagaaaatgtt

SEQ ID NO: 1177066 - DNA, 19 bp, Homo sapiens
attagaaaatgttatttaa

SEQ ID NO: 1177067 - DNA, 19 bp, Homo sapiens
attagaaaggacaacagtt

SEQ ID NO: 1177068 - DNA, 12 bp, Homo sapiens
attagaaatatt

SEQ ID NO: 1177069 - DNA, 13 bp, Homo sapiens
attagaaatcaac

SEQ ID NO: 1177070 - DNA, 22 bp, Homo sapiens
attagaaattacctgtggatat

SEQ ID NO: 1177071 - DNA, 17 bp, Homo sapiens
attagaaattggctgga

SEQ ID NO: 1177072 - DNA, 20 bp, Homo sapiens
attagaagtataaggtgctc

SEQ ID NO: 1177073 - DNA, 16 bp, Homo sapiens
attagaagtctttcag

SEQ ID NO: 1177074 - DNA, 15 bp, Homo sapiens
attagaatgtgattt

SEQ ID NO: 1177075 - DNA, 21 bp, Homo sapiens
attagaattaccatttgttaa

SEQ ID NO: 1177076 - DNA, 21 bp, Homo sapiens
attagaattagtgccagaatt

SEQ ID NO: 1177077 - DNA, 15 bp, Homo sapiens
attagacagaacacc

SEQ ID NO: 1177078 - DNA, 13 bp, Homo sapiens
attagacctttat

SEQ ID NO: 1177079 - DNA, 22 bp, Homo sapiens
attagactggaacttgaactga

SEQ ID NO: 1177080 - DNA, 20 bp, Homo sapiens
attagactggacagcttgtg

SEQ ID NO: 1177081 - DNA, 18 bp, Homo sapiens
attagactgtgattcaga

SEQ ID NO: 1177082 - DNA, 22 bp, Homo sapiens
attagagaaatgaattataact

SEQ ID NO: 1177083 - DNA, 13 bp, Homo sapiens
attagagcctgta

SEQ ID NO: 1177084 - DNA, 15 bp, Homo sapiens
attagagcttaaatt

SEQ ID NO: 1177085 - DNA, 12 bp, Homo sapiens
attagagggcct

SEQ ID NO: 1177086 - DNA, 19 bp, Homo sapiens
attagagtgcaaaagtgag

SEQ ID NO: 1177087 - DNA, 21 bp, Homo sapiens
attagagtggttattcattat

SEQ ID NO: 1177088 - DNA, 22 bp, Homo sapiens
attagagtggttattcattatt

SEQ ID NO: 1177089 - DNA, 16 bp, Homo sapiens
attagagtgtctttcc

SEQ ID NO: 1177090 - DNA, 23 bp, Homo sapiens
attagagtgtctttccacggagc

SEQ ID NO: 1177091 - DNA, 15 bp, Homo sapiens
attagataatatttt

SEQ ID NO: 1177092 - DNA, 14 bp, Homo sapiens
ccggcctcttccac

SEQ ID NO: 1177093 - DNA, 16 bp, Homo sapiens
ccggcctcttccaccc

SEQ ID NO: 1177094 - DNA, 18 bp, Homo sapiens
ccggcctcttccacccat

SEQ ID NO: 1177095 - DNA, 23 bp, Homo sapiens
ccggcgaggccggagagctggtg

SEQ ID NO: 1177096 - DNA, 12 bp, Homo sapiens
ccggcgcctgcc

SEQ ID NO: 1177097 - DNA, 15 bp, Homo sapiens
ccggcgcctgccctg

SEQ ID NO: 1177098 - DNA, 20 bp, Homo sapiens
ccggcggcagccccacttca

SEQ ID NO: 1177099 - DNA, 19 bp, Homo sapiens
ccggcggcccaagcccgac

SEQ ID NO: 1177100 - DNA, 13 bp, Homo sapiens
ccggcggctctga

SEQ ID NO: 1177101 - DNA, 15 bp, Homo sapiens
ccggcggctctgagc

SEQ ID NO: 1177102 - DNA, 16 bp, Homo sapiens
attatcgggaacagtg

SEQ ID NO: 1177103 - DNA, 17 bp, Homo sapiens
attatcgggaacagtgt

SEQ ID NO: 1177104 - DNA, 20 bp, Homo sapiens
attatcgggaacagtgtttc

SEQ ID NO: 1177105 - DNA, 19 bp, Homo sapiens
attatcgggagcagtgtct

SEQ ID NO: 1177106 - DNA, 19 bp, Homo sapiens
attatcgttttcttaaagt

SEQ ID NO: 1177107 - DNA, 14 bp, Homo sapiens
attatctaaatgaa

SEQ ID NO: 1177108 - DNA, 15 bp, Homo sapiens
attatctaaatgaat

SEQ ID NO: 1177109 - DNA, 14 bp, Homo sapiens
attatctaatttat

SEQ ID NO: 1177110 - DNA, 23 bp, Homo sapiens
attatctacctgttctgtagctt

SEQ ID NO: 1177111 - DNA, 19 bp, Homo sapiens
attatctatacatatcttt

SEQ ID NO: 1177112 - DNA, 17 bp, Homo sapiens
attatctatgcagcatg

SEQ ID NO: 1177113 - DNA, 18 bp, Homo sapiens
attatctatggaaatgtg

SEQ ID NO: 1177114 - DNA, 12 bp, Homo sapiens
attatctctttg

SEQ ID NO: 1177115 - DNA, 19 bp, Homo sapiens
attatctctttgatctact

SEQ ID NO: 1177116 - DNA, 13 bp, Homo sapiens
attatctgagttg

SEQ ID NO: 1177117 - DNA, 20 bp, Homo sapiens
attatcttcaccctcatcct

SEQ ID NO: 1177118 - DNA, 21 bp, Homo sapiens
attatcttcaccctcatcctt

SEQ ID NO: 1177119 - DNA, 12 bp, Homo sapiens
attatcttcagc

SEQ ID NO: 1177120 - DNA, 15 bp, Homo sapiens
attatcttgatacat

SEQ ID NO: 1177121 - DNA, 23 bp, Homo sapiens
attatcttgatacattcaaattt

SEQ ID NO: 1177122 - DNA, 18 bp, Homo sapiens
attatcttggaaagaaac

SEQ ID NO: 1177123 - DNA, 22 bp, Homo sapiens
attatcttgggatagttcccaa

SEQ ID NO: 1177124 - DNA, 13 bp, Homo sapiens
attatgaaaaaca

SEQ ID NO: 1177125 - DNA, 19 bp, Homo sapiens
attatgaaaaacatcccaa

SEQ ID NO: 1177126 - DNA, 23 bp, Homo sapiens
attatgaaaaacatcccaaactt

SEQ ID NO: 1177127 - DNA, 19 bp, Homo sapiens
attatgaaggaatttgatt

SEQ ID NO: 1177128 - DNA, 14 bp, Homo sapiens
attatgacagttat

SEQ ID NO: 1177129 - DNA, 15 bp, Homo sapiens
attatgacagttata

SEQ ID NO: 1177130 - DNA, 20 bp, Homo sapiens
attatgagaggcaatgattg

SEQ ID NO: 1177131 - DNA, 11 bp, Homo sapiens
attatgagcca

SEQ ID NO: 1177132 - DNA, 18 bp, Homo sapiens
attatgaggctattaaaa

SEQ ID NO: 1177133 - DNA, 15 bp, Homo sapiens
attatgcaaaagcag

SEQ ID NO: 1177134 - DNA, 18 bp, Homo sapiens
attatgcaaaagcagcta

SEQ ID NO: 1177135 - DNA, 16 bp, Homo sapiens
attatgcattatatca

SEQ ID NO: 1177136 - DNA, 22 bp, Homo sapiens
attatgccacttccttttaact

SEQ ID NO: 1177137 - DNA, 17 bp, Homo sapiens
attatgctttgaacttt

SEQ ID NO: 1177138 - DNA, 14 bp, Homo sapiens
attatggaaaactg

SEQ ID NO: 1177139 - DNA, 15 bp, Homo sapiens
attatggaaaactgt

SEQ ID NO: 1177140 - DNA, 16 bp, Homo sapiens
attatggaagatttta

SEQ ID NO: 1177141 - DNA, 16 bp, Homo sapiens
attatggcaagtgata

SEQ ID NO: 1177142 - DNA, 14 bp, Homo sapiens
attatggcatttct

SEQ ID NO: 1177143 - DNA, 15 bp, Homo sapiens
attatggcatttcta

SEQ ID NO: 1177144 - DNA, 15 bp, Homo sapiens
attatgtaaatatga

SEQ ID NO: 1177145 - DNA, 17 bp, Homo sapiens
attatgtaacatccaga

SEQ ID NO: 1177146 - DNA, 17 bp, Homo sapiens
attatgtaatatattgt

SEQ ID NO: 1177147 - DNA, 20 bp, Homo sapiens
attatgtaatatattgtaca

SEQ ID NO: 1177148 - DNA, 16 bp, Homo sapiens
attatgtatgtttaca

SEQ ID NO: 1177149 - DNA, 17 bp, Homo sapiens
attatgtatgtttacat

SEQ ID NO: 1177150 - DNA, 19 bp, Homo sapiens
attatgtgacattttacat

SEQ ID NO: 1177151 - DNA, 15 bp, Homo sapiens
attatgtgcaaaggt

SEQ ID NO: 1177152 - DNA, 20 bp, Homo sapiens
attatgtgcctaattttcta

SEQ ID NO: 1177153 - DNA, 14 bp, Homo sapiens
attatgtggaatcc

SEQ ID NO: 1177154 - DNA, 13 bp, Homo sapiens
attatgttcatgt

SEQ ID NO: 1177155 - DNA, 19 bp, Homo sapiens
attatgtttattacaattt

SEQ ID NO: 1177156 - DNA, 20 bp, Homo sapiens
attatgttttttaaaatatt

SEQ ID NO: 1177157 - DNA, 21 bp, Homo sapiens
attattaaggtaactactgct

SEQ ID NO: 1177158 - DNA, 22 bp, Homo sapiens
attattaaggtaactactgcta

SEQ ID NO: 1177159 - DNA, 13 bp, Homo sapiens
attattaattgtc

SEQ ID NO: 1177160 - DNA, 18 bp, Homo sapiens
attattactctacactga

SEQ ID NO: 1177161 - DNA, 12 bp, Homo sapiens
attattagaaat

SEQ ID NO: 1177162 - DNA, 20 bp, Homo sapiens
attattagaacattcacttt

SEQ ID NO: 1177163 - DNA, 17 bp, Homo sapiens
attattagaatcaaaca

SEQ ID NO: 1177164 - DNA, 23 bp, Homo sapiens
attattagaatcaaacattttga

SEQ ID NO: 1177165 - DNA, 22 bp, Homo sapiens
attattagccaggtaatgtgaa

SEQ ID NO: 1177166 - DNA, 15 bp, Homo sapiens
attattagtactgct

SEQ ID NO: 1177167 - DNA, 13 bp, Homo sapiens
attattataaaaa

SEQ ID NO: 1177168 - DNA, 17 bp, Homo sapiens
attattattattgctga

SEQ ID NO: 1177169 - DNA, 14 bp, Homo sapiens
attattattatttg

SEQ ID NO: 1177170 - DNA, 16 bp, Homo sapiens
attattattcttcata

SEQ ID NO: 1177171 - DNA, 15 bp, Homo sapiens
attattatttctgtt

SEQ ID NO: 1177172 - DNA, 20 bp, Homo sapiens
attattcaagaatgaaaaat

SEQ ID NO: 1177173 - DNA, 13 bp, Homo sapiens
attattcagtgtc

SEQ ID NO: 1177174 - DNA, 15 bp, Homo sapiens
attattcagtgtcac

SEQ ID NO: 1177175 - DNA, 14 bp, Homo sapiens
attattcatttaaa

SEQ ID NO: 1177176 - DNA, 17 bp, Homo sapiens
attattccaaagttatt

SEQ ID NO: 1177177 - DNA, 16 bp, Homo sapiens
attattcctcaaaaaa

SEQ ID NO: 1177178 - DNA, 21 bp, Homo sapiens
attattcctcagattgctgaa

SEQ ID NO: 1177179 - DNA, 16 bp, Homo sapiens
attattctgattccac

SEQ ID NO: 1177180 - DNA, 13 bp, Homo sapiens
attattctgcagc

SEQ ID NO: 1177181 - DNA, 12 bp, Homo sapiens
attattcttgta

SEQ ID NO: 1177182 - DNA, 13 bp, Homo sapiens
attattcttgtag

SEQ ID NO: 1177183 - DNA, 14 bp, Homo sapiens
attattctttgaaa

SEQ ID NO: 1177184 - DNA, 19 bp, Homo sapiens
attattctttgaaaacaga

SEQ ID NO: 1177185 - DNA, 14 bp, Homo sapiens
attattgacactga

SEQ ID NO: 1177186 - DNA, 16 bp, Homo sapiens
attattgagttcctcc

SEQ ID NO: 1177187 - DNA, 13 bp, Homo sapiens
attattgctgttg

SEQ ID NO: 1177188 - DNA, 17 bp, Homo sapiens
attattggttggtgtga

SEQ ID NO: 1177189 - DNA, 20 bp, Homo sapiens
attattggttggtgtgaaga

SEQ ID NO: 1177190 - DNA, 12 bp, Homo sapiens
attattgtaaac

SEQ ID NO: 1177191 - DNA, 18 bp, Homo sapiens
attattgtgacttcactg

SEQ ID NO: 1177192 - DNA, 19 bp, Homo sapiens
attattgtgacttcactgt

SEQ ID NO: 1177193 - DNA, 12 bp, Homo sapiens
attatttaaaca

SEQ ID NO: 1177194 - DNA, 19 bp, Homo sapiens
attatttaaactcgctcct

SEQ ID NO: 1177195 - DNA, 15 bp, Homo sapiens
attatttaaagaaag

SEQ ID NO: 1177196 - DNA, 12 bp, Homo sapiens
attatttaaata

SEQ ID NO: 1177197 - DNA, 14 bp, Homo sapiens
attatttaagacta

SEQ ID NO: 1177198 - DNA, 12 bp, Homo sapiens
attatttaatgt

SEQ ID NO: 1177199 - DNA, 13 bp, Homo sapiens
attatttaatgtt

SEQ ID NO: 1177200 - DNA, 19 bp, Homo sapiens
attatttacatcactttgt

SEQ ID NO: 1177201 - DNA, 16 bp, Homo sapiens
attatttatatatgta

SEQ ID NO: 1177202 - DNA, 21 bp, Homo sapiens
attatttattaaaaatgttct

SEQ ID NO: 1177203 - DNA, 22 bp, Homo sapiens
attatttattaaaaatgttctc

SEQ ID NO: 1177204 - DNA, 14 bp, Homo sapiens
attatttatttaat

SEQ ID NO: 1177205 - DNA, 15 bp, Homo sapiens
attatttatttattt

SEQ ID NO: 1177206 - DNA, 12 bp, Homo sapiens
attatttcagtg

SEQ ID NO: 1177207 - DNA, 16 bp, Homo sapiens
attatttctccatccc

SEQ ID NO: 1177208 - DNA, 14 bp, Homo sapiens
attatttcttctct

SEQ ID NO: 1177209 - DNA, 15 bp, Homo sapiens
attatttcttctctt

SEQ ID NO: 1177210 - DNA, 23 bp, Homo sapiens
attatttgaaaacatataaagca

SEQ ID NO: 1177211 - DNA, 14 bp, Homo sapiens
attatttgatatct

SEQ ID NO: 1177212 - DNA, 15 bp, Homo sapiens
attatttgatatctg

SEQ ID NO: 1177213 - DNA, 15 bp, Homo sapiens
attatttgattattt

SEQ ID NO: 1177214 - DNA, 13 bp, Homo sapiens
attatttgcatgt

SEQ ID NO: 1177215 - DNA, 12 bp, Homo sapiens
attatttgctaa

SEQ ID NO: 1177216 - DNA, 23 bp, Homo sapiens
attatttggagcctgccaagagg

SEQ ID NO: 1177217 - DNA, 18 bp, Homo sapiens
attatttgggggaactgg

SEQ ID NO: 1177218 - DNA, 17 bp, Homo sapiens
attatttgtaagatatt

SEQ ID NO: 1177219 - DNA, 11 bp, Homo sapiens
attatttgtat

SEQ ID NO: 1177220 - DNA, 13 bp, Homo sapiens
attatttgtgcat

SEQ ID NO: 1177221 - DNA, 15 bp, Homo sapiens
attatttgtgtaata

SEQ ID NO: 1177222 - DNA, 17 bp, Homo sapiens
attatttgtgtaataga

SEQ ID NO: 1177223 - DNA, 20 bp, Homo sapiens
attatttgtgtaatagaaaa

SEQ ID NO: 1177224 - DNA, 14 bp, Homo sapiens
attattttaaaata

SEQ ID NO: 1177225 - DNA, 15 bp, Homo sapiens
attattttaaaatat

SEQ ID NO: 1177226 - DNA, 14 bp, Homo sapiens
attcagcactgatt

SEQ ID NO: 1177227 - DNA, 17 bp, Homo sapiens
attcagcactgatttca

SEQ ID NO: 1177228 - DNA, 21 bp, Homo sapiens
attcagcactgatttcacaac

SEQ ID NO: 1177229 - DNA, 18 bp, Homo sapiens
attcagcagcaaattttc

SEQ ID NO: 1177230 - DNA, 23 bp, Homo sapiens
attcagcatctactctaaagaaa

SEQ ID NO: 1177231 - DNA, 21 bp, Homo sapiens
cctacagaaatactgctctga

SEQ ID NO: 1177232 - DNA, 16 bp, Homo sapiens
cctacagaagggcagt

SEQ ID NO: 1177233 - DNA, 15 bp, Homo sapiens
cctacagaggtctct

SEQ ID NO: 1177234 - DNA, 17 bp, Homo sapiens
cctacagaggtctctgc

SEQ ID NO: 1177235 - DNA, 23 bp, Homo sapiens
cctacagaggtctctgccggctc

SEQ ID NO: 1177236 - DNA, 17 bp, Homo sapiens
cctacagctttgatccc

SEQ ID NO: 1177237 - DNA, 12 bp, Homo sapiens
cctacaggctga

SEQ ID NO: 1177238 - DNA, 21 bp, Homo sapiens
cctacagtgactccctgggag

SEQ ID NO: 1177239 - DNA, 22 bp, Homo sapiens
cctacagttgaaaaacagctga

SEQ ID NO: 1177240 - DNA, 14 bp, Homo sapiens
cctacatgttattc

SEQ ID NO: 1177241 - DNA, 20 bp, Homo sapiens
cctacattccccagagtggg

SEQ ID NO: 1177242 - DNA, 18 bp, Homo sapiens
cctacattccctctcctg

SEQ ID NO: 1177243 - DNA, 23 bp, Homo sapiens
cctacattccctctcctgcccag

SEQ ID NO: 1177244 - DNA, 13 bp, Homo sapiens
cctacattcttta

SEQ ID NO: 1177245 - DNA, 19 bp, Homo sapiens
cctacattctttattctgc

SEQ ID NO: 1177246 - DNA, 20 bp, Homo sapiens
cctacattctttattctgcg

SEQ ID NO: 1177247 - DNA, 16 bp, Homo sapiens
cctaccaaaaattgcc

SEQ ID NO: 1177248 - DNA, 22 bp, Homo sapiens
cctaccaatgcatgcagccact

SEQ ID NO: 1177249 - DNA, 17 bp, Homo sapiens
cctaccactgtggcccc

SEQ ID NO: 1177250 - DNA, 20 bp, Homo sapiens
cctaccactgtggccccaag

SEQ ID NO: 1177251 - DNA, 22 bp, Homo sapiens
cctaccactgtggccccaagag

SEQ ID NO: 1177252 - DNA, 19 bp, Homo sapiens
cctaccagcaaacagctga

SEQ ID NO: 1177253 - DNA, 17 bp, Homo sapiens
cctaccagcgcccgctg

SEQ ID NO: 1177254 - DNA, 23 bp, Homo sapiens
cctaccagcgcccgctgggctga

SEQ ID NO: 1177255 - DNA, 16 bp, Homo sapiens
cctaccagctcctcca

SEQ ID NO: 1177256 - DNA, 16 bp, Homo sapiens
cctaccatcagggaca

SEQ ID NO: 1177257 - DNA, 22 bp, Homo sapiens
cctaccatcagggacaggatga

SEQ ID NO: 1177258 - DNA, 22 bp, Homo sapiens
cctacccaatgtctcccacacc

SEQ ID NO: 1177259 - DNA, 19 bp, Homo sapiens
cctacccagcgtggcccag

SEQ ID NO: 1177260 - DNA, 19 bp, Homo sapiens
cctacccatccccgcagtg

SEQ ID NO: 1177261 - DNA, 22 bp, Homo sapiens
cctaccccatggtgctaggaag

SEQ ID NO: 1177262 - DNA, 17 bp, Homo sapiens
cctaccccctcctctct

SEQ ID NO: 1177263 - DNA, 21 bp, Homo sapiens
cctaccccgcagacaccttgg

SEQ ID NO: 1177264 - DNA, 15 bp, Homo sapiens
cctacccctcttcca

SEQ ID NO: 1177265 - DNA, 20 bp, Homo sapiens
cctacccctcttccagcttc

SEQ ID NO: 1177266 - DNA, 15 bp, Homo sapiens
cctaccccttcctgt

SEQ ID NO: 1177267 - DNA, 13 bp, Homo sapiens
cctacccgcccgc

SEQ ID NO: 1177268 - DNA, 14 bp, Homo sapiens
cctaccctcccacc

SEQ ID NO: 1177269 - DNA, 15 bp, Homo sapiens
cctaccctccttcca

SEQ ID NO: 1177270 - DNA, 14 bp, Homo sapiens
cctaccctcgggcc

SEQ ID NO: 1177271 - DNA, 18 bp, Homo sapiens
cctaccctcgggcccacc

SEQ ID NO: 1177272 - DNA, 15 bp, Homo sapiens
cctaccctgcctccc

SEQ ID NO: 1177273 - DNA, 19 bp, Homo sapiens
cctaccgagtctcttctcc

SEQ ID NO: 1177274 - DNA, 17 bp, Homo sapiens
cctaccgtactccctgc

SEQ ID NO: 1177275 - DNA, 15 bp, Homo sapiens
cctacctcaagttct

SEQ ID NO: 1177276 - DNA, 22 bp, Homo sapiens
cctacctcaagttcttggacca

SEQ ID NO: 1177277 - DNA, 23 bp, Homo sapiens
cctacctcaagttcttggaccag

SEQ ID NO: 1177278 - DNA, 21 bp, Homo sapiens
cctacctcagcctagaccctc

SEQ ID NO: 1177279 - DNA, 15 bp, Homo sapiens
cctacctcaggcagg

SEQ ID NO: 1177280 - DNA, 13 bp, Homo sapiens
cctacctccaaag

SEQ ID NO: 1177281 - DNA, 16 bp, Homo sapiens
cctacctccctccctc

SEQ ID NO: 1177282 - DNA, 16 bp, Homo sapiens
cctacctccctcctca

SEQ ID NO: 1177283 - DNA, 17 bp, Homo sapiens
cctacctccctcctcag

SEQ ID NO: 1177284 - DNA, 18 bp, Homo sapiens
cctacctccctcctcagg

SEQ ID NO: 1177285 - DNA, 14 bp, Homo sapiens
cctacctgctgctg

SEQ ID NO: 1177286 - DNA, 20 bp, Homo sapiens
cctacctggggactcctcaa

SEQ ID NO: 1177287 - DNA, 12 bp, Homo sapiens
cctacctggtaa

SEQ ID NO: 1177288 - DNA, 20 bp, Homo sapiens
cctaccttttgtctcttggt

SEQ ID NO: 1177289 - DNA, 21 bp, Homo sapiens
cctacgctcatctctggaagg

SEQ ID NO: 1177290 - DNA, 16 bp, Homo sapiens
cctacgtccaaggtgg

SEQ ID NO: 1177291 - DNA, 16 bp, Homo sapiens
cctactagtcaccaga

SEQ ID NO: 1177292 - DNA, 19 bp, Homo sapiens
cctactatgtgctgggtgc

SEQ ID NO: 1177293 - DNA, 23 bp, Homo sapiens
cctactatgtgctgggtgcctcc

SEQ ID NO: 1177294 - DNA, 16 bp, Homo sapiens
cctactccaaaatgtt

SEQ ID NO: 1177295 - DNA, 15 bp, Homo sapiens
cctactcccctgggc

SEQ ID NO: 1177296 - DNA, 16 bp, Homo sapiens
cctactccctcttcca

SEQ ID NO: 1177297 - DNA, 18 bp, Homo sapiens
cctactccctcttccaaa

SEQ ID NO: 1177298 - DNA, 20 bp, Homo sapiens
cctactccctgcagatgcca

SEQ ID NO: 1177299 - DNA, 17 bp, Homo sapiens
cctactccgttcctggc

SEQ ID NO: 1177300 - DNA, 17 bp, Homo sapiens
cctactgaagtggctgg

SEQ ID NO: 1177301 - DNA, 22 bp, Homo sapiens
cctactgagcatttgcacctct

SEQ ID NO: 1177302 - DNA, 19 bp, Homo sapiens
cctactgcactttccccct

SEQ ID NO: 1177303 - DNA, 23 bp, Homo sapiens
cctactgccacccgcttcctgtt

SEQ ID NO: 1177304 - DNA, 16 bp, Homo sapiens
cctactgcccacattt

SEQ ID NO: 1177305 - DNA, 13 bp, Homo sapiens
cctactgtcctgg

SEQ ID NO: 1177306 - DNA, 15 bp, Homo sapiens
cctactgtggggaga

SEQ ID NO: 1177307 - DNA, 16 bp, Homo sapiens
cctactgtggggagag

SEQ ID NO: 1177308 - DNA, 14 bp, Homo sapiens
cctactgttactct

SEQ ID NO: 1177309 - DNA, 15 bp, Homo sapiens
cctacttaatgtaat

SEQ ID NO: 1177310 - DNA, 16 bp, Homo sapiens
cctacttagggaagaa

SEQ ID NO: 1177311 - DNA, 19 bp, Homo sapiens
cctacttagggaagaaaaa

SEQ ID NO: 1177312 - DNA, 18 bp, Homo sapiens
cctacttccaagaaaaat

SEQ ID NO: 1177313 - DNA, 21 bp, Homo sapiens
cctacttccccttcctaattc

SEQ ID NO: 1177314 - DNA, 13 bp, Homo sapiens
cctacttcctgtg

SEQ ID NO: 1177315 - DNA, 12 bp, Homo sapiens
cctacttctgac

SEQ ID NO: 1177316 - DNA, 22 bp, Homo sapiens
cctacttcttttgctcttagct

SEQ ID NO: 1177317 - DNA, 14 bp, Homo sapiens
cctactttgacttt

SEQ ID NO: 1177318 - DNA, 20 bp, Homo sapiens
cctactttgcttccgccact

SEQ ID NO: 1177319 - DNA, 20 bp, Homo sapiens
cctacttttgccacaaggtg

SEQ ID NO: 1177320 - DNA, 18 bp, Homo sapiens
cctagaaacccaagctcc

SEQ ID NO: 1177321 - DNA, 18 bp, Homo sapiens
cctagaaatatctttctc

SEQ ID NO: 1177322 - DNA, 21 bp, Homo sapiens
cctagaaattccccaccctga

SEQ ID NO: 1177323 - DNA, 21 bp, Homo sapiens
cctagaacactaactcaccag

SEQ ID NO: 1177324 - DNA, 18 bp, Homo sapiens
cctagaacatccctgggc

SEQ ID NO: 1177325 - DNA, 16 bp, Homo sapiens
cctagacaacctttct

SEQ ID NO: 1177326 - DNA, 17 bp, Homo sapiens
cctagacaacctttctg

SEQ ID NO: 1177327 - DNA, 23 bp, Homo sapiens
cctagaccagtttgcatgattct

SEQ ID NO: 1177328 - DNA, 13 bp, Homo sapiens
cctagaccctccc

SEQ ID NO: 1177329 - DNA, 16 bp, Homo sapiens
cctagaccctcctcct

SEQ ID NO: 1177330 - DNA, 21 bp, Homo sapiens
cctagactaattaaaatctgg

SEQ ID NO: 1177331 - DNA, 21 bp, Homo sapiens
cctagacttcccaacagcctt

SEQ ID NO: 1177332 - DNA, 21 bp, Homo sapiens
cctagagacagaagcaggctg

SEQ ID NO: 1177333 - DNA, 20 bp, Homo sapiens
cctagagcactctcacccca

SEQ ID NO: 1177334 - DNA, 13 bp, Homo sapiens
cctagagccagac

SEQ ID NO: 1177335 - DNA, 15 bp, Homo sapiens
cctagagccagacca

SEQ ID NO: 1177336 - DNA, 17 bp, Homo sapiens
cctagagggaggggcct

SEQ ID NO: 1177337 - DNA, 17 bp, Homo sapiens
cctagaggtgggcagct

SEQ ID NO: 1177338 - DNA, 21 bp, Homo sapiens
cctagagtgcagggattacag

SEQ ID NO: 1177339 - DNA, 11 bp, Homo sapiens
cctagagtgta

SEQ ID NO: 1177340 - DNA, 22 bp, Homo sapiens
cctagatccacgtgtggcctcc

SEQ ID NO: 1177341 - DNA, 23 bp, Homo sapiens
cctagatccacgtgtggcctccg

SEQ ID NO: 1177342 - DNA, 16 bp, Homo sapiens
cctagatgcacgtggg

SEQ ID NO: 1177343 - DNA, 22 bp, Homo sapiens
cctagcacaaggagtgcccgcc

SEQ ID NO: 1177344 - DNA, 13 bp, Homo sapiens
cctagcacagcag

SEQ ID NO: 1177345 - DNA, 16 bp, Homo sapiens
cctagcacagcagctt

SEQ ID NO: 1177346 - DNA, 17 bp, Homo sapiens
cctagcactttgggagg

SEQ ID NO: 1177347 - DNA, 15 bp, Homo sapiens
attccattgtgtgag

SEQ ID NO: 1177348 - DNA, 16 bp, Homo sapiens
attccatttctggaca

SEQ ID NO: 1177349 - DNA, 19 bp, Homo sapiens
attcccaagtatgccttaa

SEQ ID NO: 1177350 - DNA, 15 bp, Homo sapiens
attcccaccaaggtc

SEQ ID NO: 1177351 - DNA, 21 bp, Homo sapiens
attcccagaccttaagacact

SEQ ID NO: 1177352 - DNA, 16 bp, Homo sapiens
attcccagactctgcc

SEQ ID NO: 1177353 - DNA, 23 bp, Homo sapiens
attcccagagacaggaaaatcct

SEQ ID NO: 1177354 - DNA, 15 bp, Homo sapiens
attcccatctgtcac

SEQ ID NO: 1177355 - DNA, 15 bp, Homo sapiens
attcccatctttact

SEQ ID NO: 1177356 - DNA, 15 bp, Homo sapiens
attcccattttgcaa

SEQ ID NO: 1177357 - DNA, 20 bp, Homo sapiens
attcccattttgcaaaattt

SEQ ID NO: 1177358 - DNA, 13 bp, Homo sapiens
cctagcccagtgc

SEQ ID NO: 1177359 - DNA, 15 bp, Homo sapiens
cctagcccagtgctt

SEQ ID NO: 1177360 - DNA, 20 bp, Homo sapiens
cctagcccagtgcttctcca

SEQ ID NO: 1177361 - DNA, 17 bp, Homo sapiens
cctagccccaggtcttt

SEQ ID NO: 1177362 - DNA, 19 bp, Homo sapiens
cctagccccaggtcttttc

SEQ ID NO: 1177363 - DNA, 21 bp, Homo sapiens
cctagccccaggtcttttctt

SEQ ID NO: 1177364 - DNA, 18 bp, Homo sapiens
cctagcccctctctcaca

SEQ ID NO: 1177365 - DNA, 14 bp, Homo sapiens
cctagcccttccag

SEQ ID NO: 1177366 - DNA, 17 bp, Homo sapiens
cctagcccttccagcct

SEQ ID NO: 1177367 - DNA, 20 bp, Homo sapiens
cctagcccttccagcctggg

SEQ ID NO: 1177368 - DNA, 22 bp, Homo sapiens
cctagcccttccagcctgggac

SEQ ID NO: 1177369 - DNA, 15 bp, Homo sapiens
cctagcccttccctg

SEQ ID NO: 1177370 - DNA, 16 bp, Homo sapiens
cctagcccttccctga

SEQ ID NO: 1177371 - DNA, 17 bp, Homo sapiens
cctagcccttccctgag

SEQ ID NO: 1177372 - DNA, 19 bp, Homo sapiens
cctagcccttccctgagtg

SEQ ID NO: 1177373 - DNA, 16 bp, Homo sapiens
cctagccgacctcagc

SEQ ID NO: 1177374 - DNA, 18 bp, Homo sapiens
cctagccgacctcagcct

SEQ ID NO: 1177375 - DNA, 20 bp, Homo sapiens
cctagcctggatggcccctc

SEQ ID NO: 1177376 - DNA, 23 bp, Homo sapiens
cctagcctgtgcctctgggactg

SEQ ID NO: 1177377 - DNA, 22 bp, Homo sapiens
cctagccttatcctctgatctc

SEQ ID NO: 1177378 - DNA, 22 bp, Homo sapiens
cctagcgatctctcctggccta

SEQ ID NO: 1177379 - DNA, 18 bp, Homo sapiens
cctagcgctctcttccag

SEQ ID NO: 1177380 - DNA, 16 bp, Homo sapiens
cctagcggagcccagc

SEQ ID NO: 1177381 - DNA, 17 bp, Homo sapiens
cctagcggagcccagcc

SEQ ID NO: 1177382 - DNA, 18 bp, Homo sapiens
cctagcggagcccagcct

SEQ ID NO: 1177383 - DNA, 16 bp, Homo sapiens
cctagctctcccagtg

SEQ ID NO: 1177384 - DNA, 18 bp, Homo sapiens
cctagctctcccagtgaa

SEQ ID NO: 1177385 - DNA, 13 bp, Homo sapiens
cctagctgacccc

SEQ ID NO: 1177386 - DNA, 14 bp, Homo sapiens
cctagctgaccccg

SEQ ID NO: 1177387 - DNA, 14 bp, Homo sapiens
cctagctgacgcca

SEQ ID NO: 1177388 - DNA, 22 bp, Homo sapiens
cctagctgtgtgaatacctgct

SEQ ID NO: 1177389 - DNA, 20 bp, Homo sapiens
cctagcttgggaggcttccc

SEQ ID NO: 1177390 - DNA, 17 bp, Homo sapiens
cctagctttacgctcat

SEQ ID NO: 1177391 - DNA, 17 bp, Homo sapiens
cctagctttagaccctg

SEQ ID NO: 1177392 - DNA, 21 bp, Homo sapiens
cctagctttatatatggacat

SEQ ID NO: 1177393 - DNA, 20 bp, Homo sapiens
cctagcttttaaaaaatatt

SEQ ID NO: 1177394 - DNA, 16 bp, Homo sapiens
cctaggaattcccagc

SEQ ID NO: 1177395 - DNA, 17 bp, Homo sapiens
cctaggaattcccagcc

SEQ ID NO: 1177396 - DNA, 17 bp, Homo sapiens
cctaggaccactcagcc

SEQ ID NO: 1177397 - DNA, 18 bp, Homo sapiens
cctaggaccactcagccc

SEQ ID NO: 1177398 - DNA, 22 bp, Homo sapiens
cctaggacgccaacttctccca

SEQ ID NO: 1177399 - DNA, 21 bp, Homo sapiens
cctaggagagccaacctcggc

SEQ ID NO: 1177400 - DNA, 20 bp, Homo sapiens
cctaggagatatctgaggga

SEQ ID NO: 1177401 - DNA, 16 bp, Homo sapiens
cctaggaggctggcca

SEQ ID NO: 1177402 - DNA, 17 bp, Homo sapiens
cctaggaggctggccaa

SEQ ID NO: 1177403 - DNA, 16 bp, Homo sapiens
cctaggagtatatttc

SEQ ID NO: 1177404 - DNA, 21 bp, Homo sapiens
cctaggagtatatttccgcac

SEQ ID NO: 1177405 - DNA, 20 bp, Homo sapiens
cctaggagtgccccattctt

SEQ ID NO: 1177406 - DNA, 13 bp, Homo sapiens
cctaggagttgag

SEQ ID NO: 1177407 - DNA, 20 bp, Homo sapiens
cctaggagttgagtacagtg

SEQ ID NO: 1177408 - DNA, 21 bp, Homo sapiens
cctaggataaaaagccagggc

SEQ ID NO: 1177409 - DNA, 17 bp, Homo sapiens
cctaggatgctgcagca

SEQ ID NO: 1177410 - DNA, 17 bp, Homo sapiens
cctaggattccccctgc

SEQ ID NO: 1177411 - DNA, 19 bp, Homo sapiens
cctaggcattgcaggacct

SEQ ID NO: 1177412 - DNA, 23 bp, Homo sapiens
cctaggcatttgctgaatacaga

SEQ ID NO: 1177413 - DNA, 20 bp, Homo sapiens
cctaggccactcctccaaag

SEQ ID NO: 1177414 - DNA, 14 bp, Homo sapiens
cctaggcctcagcc

SEQ ID NO: 1177415 - DNA, 18 bp, Homo sapiens
cctaggcctcagccagag

SEQ ID NO: 1177416 - DNA, 24 bp, Homo sapiens
cctaggcgggatgggctcgctgaa

SEQ ID NO: 1177417 - DNA, 14 bp, Homo sapiens
cctaggcgggcggt

SEQ ID NO: 1177418 - DNA, 15 bp, Homo sapiens
cctaggctccacccc

SEQ ID NO: 1177419 - DNA, 17 bp, Homo sapiens
cctaggctccaccccat

SEQ ID NO: 1177420 - DNA, 11 bp, Homo sapiens
cctaggctgga

SEQ ID NO: 1177421 - DNA, 18 bp, Homo sapiens
cctaggctggaagccatg

SEQ ID NO: 1177422 - DNA, 13 bp, Homo sapiens
cctaggggaaggg

SEQ ID NO: 1177423 - DNA, 18 bp, Homo sapiens
cctaggggtcagggacca

SEQ ID NO: 1177424 - DNA, 14 bp, Homo sapiens
cctaggggtggcgc

SEQ ID NO: 1177425 - DNA, 23 bp, Homo sapiens
cctaggggtggcgctcagacccc

SEQ ID NO: 1177426 - DNA, 13 bp, Homo sapiens
cctagggtccctc

SEQ ID NO: 1177427 - DNA, 21 bp, Homo sapiens
cctagggtcttgggggtcagg

SEQ ID NO: 1177428 - DNA, 17 bp, Homo sapiens
cctaggtaacgagggca

SEQ ID NO: 1177429 - DNA, 20 bp, Homo sapiens
cctaggtcacgttggccctc

SEQ ID NO: 1177430 - DNA, 15 bp, Homo sapiens
cctaggtgcagctcc

SEQ ID NO: 1177431 - DNA, 16 bp, Homo sapiens
cctaggtgcagctcct

SEQ ID NO: 1177432 - DNA, 19 bp, Homo sapiens
cctaggtgcagctcctcag

SEQ ID NO: 1177433 - DNA, 22 bp, Homo sapiens
cctaggttccctgttcttcctc

SEQ ID NO: 1177434 - DNA, 22 bp, Homo sapiens
cctaggttggtttcccctgcac

SEQ ID NO: 1177435 - DNA, 20 bp, Homo sapiens
cctaggttttggagagtttg

SEQ ID NO: 1177436 - DNA, 20 bp, Homo sapiens
cctagtaaaaccttgttcta

SEQ ID NO: 1177437 - DNA, 16 bp, Homo sapiens
cctagtactctctgct

SEQ ID NO: 1177438 - DNA, 17 bp, Homo sapiens
cctagtactctctgctc

SEQ ID NO: 1177439 - DNA, 18 bp, Homo sapiens
cctagtactctctgctct

SEQ ID NO: 1177440 - DNA, 16 bp, Homo sapiens
cctagtccagtgacct

SEQ ID NO: 1177441 - DNA, 16 bp, Homo sapiens
cctagtcccctttcct

SEQ ID NO: 1177442 - DNA, 15 bp, Homo sapiens
cctagtcccttcccc

SEQ ID NO: 1177443 - DNA, 16 bp, Homo sapiens
cctagtcccttcccct

SEQ ID NO: 1177444 - DNA, 20 bp, Homo sapiens
cctagtcgggcagggcccct

SEQ ID NO: 1177445 - DNA, 17 bp, Homo sapiens
cctagtctgtaactctt

SEQ ID NO: 1177446 - DNA, 19 bp, Homo sapiens
cctagtgaaggcttctctc

SEQ ID NO: 1177447 - DNA, 22 bp, Homo sapiens
cctagtgaaggcttctctctgt

SEQ ID NO: 1177448 - DNA, 23 bp, Homo sapiens
cctagtgaaggcttctctctgtg

SEQ ID NO: 1177449 - DNA, 13 bp, Homo sapiens
cctagtgccccag

SEQ ID NO: 1177450 - DNA, 21 bp, Homo sapiens
cctagtgccccagactgagct

SEQ ID NO: 1177451 - DNA, 20 bp, Homo sapiens
cctagtgctattctgtgttg

SEQ ID NO: 1177452 - DNA, 18 bp, Homo sapiens
cctagtggatgactgttg

SEQ ID NO: 1177453 - DNA, 20 bp, Homo sapiens
cctagtggggtctccctctc

SEQ ID NO: 1177454 - DNA, 23 bp, Homo sapiens
cctagtggggtctccctctcctg

SEQ ID NO: 1177455 - DNA, 19 bp, Homo sapiens
cctagttaaagaaaggaaa

SEQ ID NO: 1177456 - DNA, 21 bp, Homo sapiens
cctagttcatccaatcctcac

SEQ ID NO: 1177457 - DNA, 17 bp, Homo sapiens
cctagttcctgtggcca

SEQ ID NO: 1177458 - DNA, 13 bp, Homo sapiens
cctagtttcctct

SEQ ID NO: 1177459 - DNA, 15 bp, Homo sapiens
cctagtttcctctcc

SEQ ID NO: 1177460 - DNA, 19 bp, Homo sapiens
cctagttttctcctcccag

SEQ ID NO: 1177461 - DNA, 20 bp, Homo sapiens
cctagttttctcctcccagg

SEQ ID NO: 1177462 - DNA, 18 bp, Homo sapiens
cctataaaattaaatgcc

SEQ ID NO: 1177463 - DNA, 16 bp, Homo sapiens
cctataagaagcctta

SEQ ID NO: 1177464 - DNA, 23 bp, Homo sapiens
cctataaggagagttcaagcctg

SEQ ID NO: 1177465 - DNA, 23 bp, Homo sapiens
cctataatacttgcaactaagga

SEQ ID NO: 1177466 - DNA, 18 bp, Homo sapiens
cctataatccttgataat

SEQ ID NO: 1177467 - DNA, 14 bp, Homo sapiens
cctataatctgtca

SEQ ID NO: 1177468 - DNA, 18 bp, Homo sapiens
cctcacccaaaagaatta

SEQ ID NO: 1177469 - DNA, 14 bp, Homo sapiens
cctcacccacaccc

SEQ ID NO: 1177470 - DNA, 15 bp, Homo sapiens
cctcacccacctctg

SEQ ID NO: 1177471 - DNA, 16 bp, Homo sapiens
cctcacccacctctgg

SEQ ID NO: 1177472 - DNA, 14 bp, Homo sapiens
cctcacccactctg

SEQ ID NO: 1177473 - DNA, 18 bp, Homo sapiens
cctcacccactctggtgg

SEQ ID NO: 1177474 - DNA, 23 bp, Homo sapiens
cctcacccactctggtggccact

SEQ ID NO: 1177475 - DNA, 14 bp, Homo sapiens
cctcacccagatca

SEQ ID NO: 1177476 - DNA, 13 bp, Homo sapiens
cctcaccccaatc

SEQ ID NO: 1177477 - DNA, 16 bp, Homo sapiens
cctcaccccagctccg

SEQ ID NO: 1177478 - DNA, 20 bp, Homo sapiens
cctcaccccccactcttagg

SEQ ID NO: 1177479 - DNA, 16 bp, Homo sapiens
cctcaccccctcccac

SEQ ID NO: 1177480 - DNA, 15 bp, Homo sapiens
cctcacccctgtagg

SEQ ID NO: 1177481 - DNA, 15 bp, Homo sapiens
cctcaccctgagccc

SEQ ID NO: 1177482 - DNA, 18 bp, Homo sapiens
cctcaccctgagcccctt

SEQ ID NO: 1177483 - DNA, 14 bp, Homo sapiens
cctcaccctgcctt

SEQ ID NO: 1177484 - DNA, 15 bp, Homo sapiens
cctcaccctgtggga

SEQ ID NO: 1177485 - DNA, 19 bp, Homo sapiens
cctcaccctgtgggaccgc

SEQ ID NO: 1177486 - DNA, 15 bp, Homo sapiens
cctcaccctttacct

SEQ ID NO: 1177487 - DNA, 15 bp, Homo sapiens
cctcacctcatgccc

SEQ ID NO: 1177488 - DNA, 21 bp, Homo sapiens
attcgtgttatgaatctgtgc

SEQ ID NO: 1177489 - DNA, 14 bp, Homo sapiens
attctaaagctcaa

SEQ ID NO: 1177490 - DNA, 18 bp, Homo sapiens
attctaaagttttgcaac

SEQ ID NO: 1177491 - DNA, 18 bp, Homo sapiens
attctaagaaatatctgt

SEQ ID NO: 1177492 - DNA, 21 bp, Homo sapiens
attctaagaaatatctgtgaa

SEQ ID NO: 1177493 - DNA, 23 bp, Homo sapiens
attctaagaaatatctgtgaaat

SEQ ID NO: 1177494 - DNA, 20 bp, Homo sapiens
attctaagccagttttcatt

SEQ ID NO: 1177495 - DNA, 18 bp, Homo sapiens
attctaagttatttactt

SEQ ID NO: 1177496 - DNA, 20 bp, Homo sapiens
attctaagttatttactttt

SEQ ID NO: 1177497 - DNA, 21 bp, Homo sapiens
attctaagttatttactttta

SEQ ID NO: 1177498 - DNA, 15 bp, Homo sapiens
attctacacctggac

SEQ ID NO: 1177499 - DNA, 15 bp, Homo sapiens
attctactcttgtca

SEQ ID NO: 1177500 - DNA, 17 bp, Homo sapiens
attctactcttgtcatt

SEQ ID NO: 1177501 - DNA, 22 bp, Homo sapiens
attctactcttgtcatttttaa

SEQ ID NO: 1177502 - DNA, 20 bp, Homo sapiens
attctactggaaaaaaatac

SEQ ID NO: 1177503 - DNA, 14 bp, Homo sapiens
attctacttcagct

SEQ ID NO: 1177504 - DNA, 16 bp, Homo sapiens
attctacttcagcttt

SEQ ID NO: 1177505 - DNA, 17 bp, Homo sapiens
attctacttcagctttg

SEQ ID NO: 1177506 - DNA, 17 bp, Homo sapiens
attctacttctctgttg

SEQ ID NO: 1177507 - DNA, 13 bp, Homo sapiens
attctactttgag

SEQ ID NO: 1177508 - DNA, 16 bp, Homo sapiens
attctagattaccatg

SEQ ID NO: 1177509 - DNA, 18 bp, Homo sapiens
attctagctgtatgattt

SEQ ID NO: 1177510 - DNA, 13 bp, Homo sapiens
attctaggcatcc

SEQ ID NO: 1177511 - DNA, 20 bp, Homo sapiens
attctaggcatcccagggga

SEQ ID NO: 1177512 - DNA, 23 bp, Homo sapiens
attctaggtggaggttgtgcatg

SEQ ID NO: 1177513 - DNA, 20 bp, Homo sapiens
attctagtacataattgatt

SEQ ID NO: 1177514 - DNA, 14 bp, Homo sapiens
attctagtgctgct

SEQ ID NO: 1177515 - DNA, 17 bp, Homo sapiens
attctagtgctgctgaa

SEQ ID NO: 1177516 - DNA, 14 bp, Homo sapiens
attctagtggctgt

SEQ ID NO: 1177517 - DNA, 17 bp, Homo sapiens
attctatatgaatttaa

SEQ ID NO: 1177518 - DNA, 19 bp, Homo sapiens
attctatccatctcctggt

SEQ ID NO: 1177519 - DNA, 17 bp, Homo sapiens
attctatctactgattt

SEQ ID NO: 1177520 - DNA, 14 bp, Homo sapiens
attctatgttaaat

SEQ ID NO: 1177521 - DNA, 21 bp, Homo sapiens
attctatgttaaatactgtgc

SEQ ID NO: 1177522 - DNA, 20 bp, Homo sapiens
attctattacattttcagtg

SEQ ID NO: 1177523 - DNA, 15 bp, Homo sapiens
attctattatatatt

SEQ ID NO: 1177524 - DNA, 14 bp, Homo sapiens
attctattgtttac

SEQ ID NO: 1177525 - DNA, 23 bp, Homo sapiens
attctatttcccctcttctgcta

SEQ ID NO: 1177526 - DNA, 14 bp, Homo sapiens
attctatttctcta

SEQ ID NO: 1177527 - DNA, 15 bp, Homo sapiens
attctatttctctat

SEQ ID NO: 1177528 - DNA, 15 bp, Homo sapiens
attctcaaacacagt

SEQ ID NO: 1177529 - DNA, 16 bp, Homo sapiens
attctcaaagatgcat

SEQ ID NO: 1177530 - DNA, 18 bp, Homo sapiens
attctcaaagatgcattt

SEQ ID NO: 1177531 - DNA, 13 bp, Homo sapiens
attctcaaagcag

SEQ ID NO: 1177532 - DNA, 22 bp, Homo sapiens
attctcaagacctgagtatttt

SEQ ID NO: 1177533 - DNA, 16 bp, Homo sapiens
attctcagatatttat

SEQ ID NO: 1177534 - DNA, 11 bp, Homo sapiens
attctcagggc

SEQ ID NO: 1177535 - DNA, 14 bp, Homo sapiens
attctcagggctgg

SEQ ID NO: 1177536 - DNA, 22 bp, Homo sapiens
attctcagggctggagcctggg

SEQ ID NO: 1177537 - DNA, 19 bp, Homo sapiens
attctcataggagactgcg

SEQ ID NO: 1177538 - DNA, 13 bp, Homo sapiens
attctcatctgca

SEQ ID NO: 1177539 - DNA, 20 bp, Homo sapiens
attctcatctgcacccttct

SEQ ID NO: 1177540 - DNA, 22 bp, Homo sapiens
attctcatctgcacccttcttt

SEQ ID NO: 1177541 - DNA, 12 bp, Homo sapiens
attctcattaaa

SEQ ID NO: 1177542 - DNA, 18 bp, Homo sapiens
attctcattatgttgata

SEQ ID NO: 1177543 - DNA, 13 bp, Homo sapiens
attctccacagca

SEQ ID NO: 1177544 - DNA, 23 bp, Homo sapiens
attctccagccatcaagagactg

SEQ ID NO: 1177545 - DNA, 12 bp, Homo sapiens
attctccctggg

SEQ ID NO: 1177546 - DNA, 14 bp, Homo sapiens
attctccctgggcc

SEQ ID NO: 1177547 - DNA, 16 bp, Homo sapiens
attctccctgggcctc

SEQ ID NO: 1177548 - DNA, 18 bp, Homo sapiens
attctcctgcctcagcct

SEQ ID NO: 1177549 - DNA, 21 bp, Homo sapiens
attctccttgtgttactaagt

SEQ ID NO: 1177550 - DNA, 20 bp, Homo sapiens
attctctatttgaattattt

SEQ ID NO: 1177551 - DNA, 20 bp, Homo sapiens
attctctcccatcctggggc

SEQ ID NO: 1177552 - DNA, 16 bp, Homo sapiens
attctctcctgtacct

SEQ ID NO: 1177553 - DNA, 10 bp, Homo sapiens
attctctctc

SEQ ID NO: 1177554 - DNA, 15 bp, Homo sapiens
attctctctcctgta

SEQ ID NO: 1177555 - DNA, 17 bp, Homo sapiens
attctctgagctgtgca

SEQ ID NO: 1177556 - DNA, 23 bp, Homo sapiens
attctctgcaatttgtttaaaga

SEQ ID NO: 1177557 - DNA, 19 bp, Homo sapiens
attctctgcccgggcccct

SEQ ID NO: 1177558 - DNA, 19 bp, Homo sapiens
attctctgtaagtgtagct

SEQ ID NO: 1177559 - DNA, 10 bp, Homo sapiens
attctctgtg

SEQ ID NO: 1177560 - DNA, 21 bp, Homo sapiens
attctctgtggttttttttga

SEQ ID NO: 1177561 - DNA, 22 bp, Homo sapiens
attctcttaaataaaaataata

SEQ ID NO: 1177562 - DNA, 22 bp, Homo sapiens
attctcttaatcactactgtat

SEQ ID NO: 1177563 - DNA, 15 bp, Homo sapiens
attctcttatccaac

SEQ ID NO: 1177564 - DNA, 13 bp, Homo sapiens
attctgaaaggaa

SEQ ID NO: 1177565 - DNA, 19 bp, Homo sapiens
attctgaaaggaaatacac

SEQ ID NO: 1177566 - DNA, 14 bp, Homo sapiens
attctgaaatactt

SEQ ID NO: 1177567 - DNA, 21 bp, Homo sapiens
attctgaaatacttttgagta

SEQ ID NO: 1177568 - DNA, 20 bp, Homo sapiens
attctgaaatttttttccta

SEQ ID NO: 1177569 - DNA, 15 bp, Homo sapiens
attctgaaggagccc

SEQ ID NO: 1177570 - DNA, 21 bp, Homo sapiens
attctgaatcaagcacactgt

SEQ ID NO: 1177571 - DNA, 10 bp, Homo sapiens
attctgaatg

SEQ ID NO: 1177572 - DNA, 13 bp, Homo sapiens
attctgaatgtac

SEQ ID NO: 1177573 - DNA, 23 bp, Homo sapiens
attctgaattaattaatttggag

SEQ ID NO: 1177574 - DNA, 17 bp, Homo sapiens
attctgaattgtccttt

SEQ ID NO: 1177575 - DNA, 22 bp, Homo sapiens
attctgacatgtaagaaaatgt

SEQ ID NO: 1177576 - DNA, 14 bp, Homo sapiens
attctgaccttaaa

SEQ ID NO: 1177577 - DNA, 18 bp, Homo sapiens
attctgaccttaaatgca

SEQ ID NO: 1177578 - DNA, 15 bp, Homo sapiens
attctgactgtccag

SEQ ID NO: 1177579 - DNA, 14 bp, Homo sapiens
attctgacttcctc

SEQ ID NO: 1177580 - DNA, 14 bp, Homo sapiens
attctgagccttga

SEQ ID NO: 1177581 - DNA, 23 bp, Homo sapiens
attctgagttttgtgtttgttgt

SEQ ID NO: 1177582 - DNA, 16 bp, Homo sapiens
attctgataatgctca

SEQ ID NO: 1177583 - DNA, 16 bp, Homo sapiens
attctgataggagggg

SEQ ID NO: 1177584 - DNA, 18 bp, Homo sapiens
attctgatgttactgaga

SEQ ID NO: 1177585 - DNA, 23 bp, Homo sapiens
attctgattattgagttccagtt

SEQ ID NO: 1177586 - DNA, 13 bp, Homo sapiens
attctgatttcag

SEQ ID NO: 1177587 - DNA, 22 bp, Homo sapiens
attctgatttcagtttttcatt

SEQ ID NO: 1177588 - DNA, 19 bp, Homo sapiens
attctgatttggaaaaaga

SEQ ID NO: 1177589 - DNA, 22 bp, Homo sapiens
attctgcaagcacatctgcatt

SEQ ID NO: 1177590 - DNA, 18 bp, Homo sapiens
attgaaaaaatagagcct

SEQ ID NO: 1177591 - DNA, 22 bp, Homo sapiens
attgaaaaaatagagcctgagg

SEQ ID NO: 1177592 - DNA, 17 bp, Homo sapiens
attgaaaagcacagagg

SEQ ID NO: 1177593 - DNA, 14 bp, Homo sapiens
attgaaaatcatat

SEQ ID NO: 1177594 - DNA, 13 bp, Homo sapiens
attgaaaatgcat

SEQ ID NO: 1177595 - DNA, 19 bp, Homo sapiens
attgaaaatgcattaggga

SEQ ID NO: 1177596 - DNA, 15 bp, Homo sapiens
attgaaagagaacca

SEQ ID NO: 1177597 - DNA, 23 bp, Homo sapiens
attgaaaggggacacctgtacat

SEQ ID NO: 1177598 - DNA, 18 bp, Homo sapiens
attgaaagtattcagaaa

SEQ ID NO: 1177599 - DNA, 16 bp, Homo sapiens
attgaaagttgctttt

SEQ ID NO: 1177600 - DNA, 22 bp, Homo sapiens
attgaaagttgcttttattgca

SEQ ID NO: 1177601 - DNA, 20 bp, Homo sapiens
attgaaatcagcatgacaaa

SEQ ID NO: 1177602 - DNA, 17 bp, Homo sapiens
attgaaatctaggaaaa

SEQ ID NO: 1177603 - DNA, 14 bp, Homo sapiens
attgaaatgtaagg

SEQ ID NO: 1177604 - DNA, 13 bp, Homo sapiens
attgaaatgtata

SEQ ID NO: 1177605 - DNA, 16 bp, Homo sapiens
attgaaattgtacata

SEQ ID NO: 1177606 - DNA, 20 bp, Homo sapiens
attgaacacaaactgtaaat

SEQ ID NO: 1177607 - DNA, 14 bp, Homo sapiens
attgaacagcaaag

SEQ ID NO: 1177608 - DNA, 16 bp, Homo sapiens
attgaacattctagaa

SEQ ID NO: 1177609 - DNA, 21 bp, Homo sapiens
attgaaccaagggatcctccc

SEQ ID NO: 1177610 - DNA, 14 bp, Homo sapiens
attgaacttttgta

SEQ ID NO: 1177611 - DNA, 19 bp, Homo sapiens
attgaacttttgtactgaa

SEQ ID NO: 1177612 - DNA, 20 bp, Homo sapiens
attgaacttttgtactgaat

SEQ ID NO: 1177613 - DNA, 10 bp, Homo sapiens
attgaagaat

SEQ ID NO: 1177614 - DNA, 15 bp, Homo sapiens
attgaagaatctgcc

SEQ ID NO: 1177615 - DNA, 13 bp, Homo sapiens
attgaagacaatt

SEQ ID NO: 1177616 - DNA, 18 bp, Homo sapiens
attgaagccgactctggc

SEQ ID NO: 1177617 - DNA, 15 bp, Homo sapiens
attgaagtaaacttt

SEQ ID NO: 1177618 - DNA, 22 bp, Homo sapiens
attgaagtaaactttttgttct

SEQ ID NO: 1177619 - DNA, 14 bp, Homo sapiens
attgaagtgtcttc

SEQ ID NO: 1177620 - DNA, 17 bp, Homo sapiens
attgaagtgtcttctgt

SEQ ID NO: 1177621 - DNA, 18 bp, Homo sapiens
attgaagtgtcttctgtt

SEQ ID NO: 1177622 - DNA, 17 bp, Homo sapiens
attgaagttgtttatca

SEQ ID NO: 1177623 - DNA, 22 bp, Homo sapiens
attgaagttgtttatcaacttc

SEQ ID NO: 1177624 - DNA, 15 bp, Homo sapiens
attgaatatatcaga

SEQ ID NO: 1177625 - DNA, 13 bp, Homo sapiens
attgaatcagtat

SEQ ID NO: 1177626 - DNA, 16 bp, Homo sapiens
attgaatctacaaaag

SEQ ID NO: 1177627 - DNA, 14 bp, Homo sapiens
attgaattcattat

SEQ ID NO: 1177628 - DNA, 15 bp, Homo sapiens
attgaattcattata

SEQ ID NO: 1177629 - DNA, 20 bp, Homo sapiens
attgaattcttggttgagga

SEQ ID NO: 1177630 - DNA, 14 bp, Homo sapiens
attgaatttttcct

SEQ ID NO: 1177631 - DNA, 17 bp, Homo sapiens
attgaatttttcctatg

SEQ ID NO: 1177632 - DNA, 13 bp, Homo sapiens
attgacaataaaa

SEQ ID NO: 1177633 - DNA, 20 bp, Homo sapiens
attgacaataatttcaggtt

SEQ ID NO: 1177634 - DNA, 17 bp, Homo sapiens
attgacacagaaaatgt

SEQ ID NO: 1177635 - DNA, 18 bp, Homo sapiens
attgacactgaacttaat

SEQ ID NO: 1177636 - DNA, 18 bp, Homo sapiens
attgacagatcaagctgt

SEQ ID NO: 1177637 - DNA, 21 bp, Homo sapiens
attgacagatcaagctgtgag

SEQ ID NO: 1177638 - DNA, 14 bp, Homo sapiens
attgacagctttgc

SEQ ID NO: 1177639 - DNA, 16 bp, Homo sapiens
attgacagctttgctg

SEQ ID NO: 1177640 - DNA, 19 bp, Homo sapiens
attgacagctttgctgctg

SEQ ID NO: 1177641 - DNA, 18 bp, Homo sapiens
attgacaggattattgga

SEQ ID NO: 1177642 - DNA, 22 bp, Homo sapiens
attgacattgaaatctaggaaa

SEQ ID NO: 1177643 - DNA, 14 bp, Homo sapiens
attgaccaagaact

SEQ ID NO: 1177644 - DNA, 16 bp, Homo sapiens
attgaccaagaactgc

SEQ ID NO: 1177645 - DNA, 20 bp, Homo sapiens
attgaccaagaactgcatgg

SEQ ID NO: 1177646 - DNA, 14 bp, Homo sapiens
attgaccatctgct

SEQ ID NO: 1177647 - DNA, 15 bp, Homo sapiens
attgaccatctgctt

SEQ ID NO: 1177648 - DNA, 17 bp, Homo sapiens
attgaccgcgactaatt

SEQ ID NO: 1177649 - DNA, 15 bp, Homo sapiens
attgacctcagctgc

SEQ ID NO: 1177650 - DNA, 12 bp, Homo sapiens
attgacctgctc

SEQ ID NO: 1177651 - DNA, 21 bp, Homo sapiens
attgacctgctccgctgctcc

SEQ ID NO: 1177652 - DNA, 20 bp, Homo sapiens
attgaccttctccctcactc

SEQ ID NO: 1177653 - DNA, 15 bp, Homo sapiens
attgacgtctagcta

SEQ ID NO: 1177654 - DNA, 21 bp, Homo sapiens
attgactcctttccaatagaa

SEQ ID NO: 1177655 - DNA, 23 bp, Homo sapiens
attgacttcttggtttggggaga

SEQ ID NO: 1177656 - DNA, 17 bp, Homo sapiens
attgactttatgttgta

SEQ ID NO: 1177657 - DNA, 16 bp, Homo sapiens
attgagaaagaaacta

SEQ ID NO: 1177658 - DNA, 17 bp, Homo sapiens
attgagaaagagcactt

SEQ ID NO: 1177659 - DNA, 18 bp, Homo sapiens
attgagaaagagcactta

SEQ ID NO: 1177660 - DNA, 12 bp, Homo sapiens
attgagaactga

SEQ ID NO: 1177661 - DNA, 16 bp, Homo sapiens
attgagaactgacaaa

SEQ ID NO: 1177662 - DNA, 22 bp, Homo sapiens
attgagaactgcatatgtttcg

SEQ ID NO: 1177663 - DNA, 17 bp, Homo sapiens
attgagaataagaattt

SEQ ID NO: 1177664 - DNA, 18 bp, Homo sapiens
attgagaataagaatttg

SEQ ID NO: 1177665 - DNA, 13 bp, Homo sapiens
attgagaatttta

SEQ ID NO: 1177666 - DNA, 21 bp, Homo sapiens
attgagaattttaaattataa

SEQ ID NO: 1177667 - DNA, 21 bp, Homo sapiens
attgagataatgatacttaac

SEQ ID NO: 1177668 - DNA, 20 bp, Homo sapiens
attgagatactatcattaac

SEQ ID NO: 1177669 - DNA, 21 bp, Homo sapiens
attgagcagaattcattcata

SEQ ID NO: 1177670 - DNA, 19 bp, Homo sapiens
attgagcatattttcttac

SEQ ID NO: 1177671 - DNA, 14 bp, Homo sapiens
attgagcttgcatg

SEQ ID NO: 1177672 - DNA, 12 bp, Homo sapiens
attgaggaagag

SEQ ID NO: 1177673 - DNA, 15 bp, Homo sapiens
attgaggaagagtct

SEQ ID NO: 1177674 - DNA, 19 bp, Homo sapiens
attgaggataaaaaggaag

SEQ ID NO: 1177675 - DNA, 22 bp, Homo sapiens
attgaggataaaaaggaaggag

SEQ ID NO: 1177676 - DNA, 18 bp, Homo sapiens
attgaggccaagaatatt

SEQ ID NO: 1177677 - DNA, 21 bp, Homo sapiens
attgaggcctgccctcaggga

SEQ ID NO: 1177678 - DNA, 14 bp, Homo sapiens
attgaggctgcagc

SEQ ID NO: 1177679 - DNA, 21 bp, Homo sapiens
attgagggccagtgatgatgt

SEQ ID NO: 1177680 - DNA, 15 bp, Homo sapiens
attgaggggccctgg

SEQ ID NO: 1177681 - DNA, 19 bp, Homo sapiens
attgaggggccctggccag

SEQ ID NO: 1177682 - DNA, 16 bp, Homo sapiens
attgaggtaagttttt

SEQ ID NO: 1177683 - DNA, 15 bp, Homo sapiens
attgaggtggggaat

SEQ ID NO: 1177684 - DNA, 14 bp, Homo sapiens
attgagtaagaaca

SEQ ID NO: 1177685 - DNA, 23 bp, Homo sapiens
attgagtacgtgctttgagaaaa

SEQ ID NO: 1177686 - DNA, 15 bp, Homo sapiens
attgagtcttaactg

SEQ ID NO: 1177687 - DNA, 17 bp, Homo sapiens
attgagttcttcctgta

SEQ ID NO: 1177688 - DNA, 19 bp, Homo sapiens
attgataaccttgaaaaaa

SEQ ID NO: 1177689 - DNA, 14 bp, Homo sapiens
attgataatcttca

SEQ ID NO: 1177690 - DNA, 15 bp, Homo sapiens
attgataatcttcag

SEQ ID NO: 1177691 - DNA, 20 bp, Homo sapiens
attgataatcttcaggtgaa

SEQ ID NO: 1177692 - DNA, 13 bp, Homo sapiens
attgatacttcag

SEQ ID NO: 1177693 - DNA, 16 bp, Homo sapiens
attgatattctaagaa

SEQ ID NO: 1177694 - DNA, 23 bp, Homo sapiens
attgatattctaagaaatatctg

SEQ ID NO: 1177695 - DNA, 16 bp, Homo sapiens
attgatcacacagtgt

SEQ ID NO: 1177696 - DNA, 23 bp, Homo sapiens
attgatcggagcctcctctctca

SEQ ID NO: 1177697 - DNA, 23 bp, Homo sapiens
attgatgataacacttaaaattg

SEQ ID NO: 1177698 - DNA, 16 bp, Homo sapiens
attgatgattttgtaa

SEQ ID NO: 1177699 - DNA, 18 bp, Homo sapiens
attgatgcaatataagca

SEQ ID NO: 1177700 - DNA, 15 bp, Homo sapiens
attgatggatgtctt

SEQ ID NO: 1177701 - DNA, 16 bp, Homo sapiens
attgatggatgtcttc

SEQ ID NO: 1177702 - DNA, 16 bp, Homo sapiens
attgatgtacagaaca

SEQ ID NO: 1177703 - DNA, 21 bp, Homo sapiens
attgatgtacagtctgtcatg

SEQ ID NO: 1177704 - DNA, 14 bp, Homo sapiens
attgattaaaatct

SEQ ID NO: 1177705 - DNA, 19 bp, Homo sapiens
attgattaaaatctcttga

SEQ ID NO: 1177706 - DNA, 22 bp, Homo sapiens
attgattaaaatctcttgatta

SEQ ID NO: 1177707 - DNA, 16 bp, Homo sapiens
attgattgatgtacag

SEQ ID NO: 1177708 - DNA, 14 bp, Homo sapiens
attgatttgaagaa

SEQ ID NO: 1177709 - DNA, 13 bp, Homo sapiens
attgatttgcatt

SEQ ID NO: 1177710 - DNA, 16 bp, Homo sapiens
attgatttgcattgaa

SEQ ID NO: 1177711 - DNA, 20 bp, Homo sapiens
attgatttgcattgaacaca

SEQ ID NO: 1177712 - DNA, 22 bp, Homo sapiens
attggaatgcagaggtctccaa

SEQ ID NO: 1177713 - DNA, 14 bp, Homo sapiens
attggaatttctgg

SEQ ID NO: 1177714 - DNA, 17 bp, Homo sapiens
attggacagatttcagt

SEQ ID NO: 1177715 - DNA, 17 bp, Homo sapiens
attggacattttcttca

SEQ ID NO: 1177716 - DNA, 15 bp, Homo sapiens
attggacccttccat

SEQ ID NO: 1177717 - DNA, 22 bp, Homo sapiens
attggagaatactttgcttcat

SEQ ID NO: 1177718 - DNA, 15 bp, Homo sapiens
attggagcacctggg

SEQ ID NO: 1177719 - DNA, 20 bp, Homo sapiens
attggataaagtttggtgtt

SEQ ID NO: 1177720 - DNA, 18 bp, Homo sapiens
attggattattcatttaa

SEQ ID NO: 1177721 - DNA, 19 bp, Homo sapiens
attggattattcatttaaa

SEQ ID NO: 1177722 - DNA, 22 bp, Homo sapiens
attggattattcatttaaaatg

SEQ ID NO: 1177723 - DNA, 14 bp, Homo sapiens
attggatttcctaa

SEQ ID NO: 1177724 - DNA, 16 bp, Homo sapiens
attggcaagtcacgtt

SEQ ID NO: 1177725 - DNA, 16 bp, Homo sapiens
attggcagccaaggaa

SEQ ID NO: 1177726 - DNA, 17 bp, Homo sapiens
attggcagctcaaagac

SEQ ID NO: 1177727 - DNA, 19 bp, Homo sapiens
attggcagtgactttgtat

SEQ ID NO: 1177728 - DNA, 15 bp, Homo sapiens
attggcatggaaatt

SEQ ID NO: 1177729 - DNA, 23 bp, Homo sapiens
attggcatggaaatttaaagcag

SEQ ID NO: 1177730 - DNA, 19 bp, Homo sapiens
attggccagtgagaagctg

SEQ ID NO: 1177731 - DNA, 20 bp, Homo sapiens
attggcccaagtcattgttt

SEQ ID NO: 1177732 - DNA, 18 bp, Homo sapiens
attggccgagctcctggg

SEQ ID NO: 1177733 - DNA, 12 bp, Homo sapiens
attggcctggag

SEQ ID NO: 1177734 - DNA, 12 bp, Homo sapiens
attggcctgtag

SEQ ID NO: 1177735 - DNA, 23 bp, Homo sapiens
attggcctgtagagttgctgaga

SEQ ID NO: 1177736 - DNA, 11 bp, Homo sapiens
attggcctgtt

SEQ ID NO: 1177737 - DNA, 19 bp, Homo sapiens
attggctagaggttcaaag

SEQ ID NO: 1177738 - DNA, 20 bp, Homo sapiens
attggctagaggttcaaaga

SEQ ID NO: 1177739 - DNA, 23 bp, Homo sapiens
attggctagaggttcaaagatat

SEQ ID NO: 1177740 - DNA, 19 bp, Homo sapiens
attggctatttaaagacaa

SEQ ID NO: 1177741 - DNA, 20 bp, Homo sapiens
attggctggattgccttgta

SEQ ID NO: 1177742 - DNA, 16 bp, Homo sapiens
attggcttaaagtgaa

SEQ ID NO: 1177743 - DNA, 20 bp, Homo sapiens
attgggaaggaaatatattt

SEQ ID NO: 1177744 - DNA, 15 bp, Homo sapiens
attgggaatgcaata

SEQ ID NO: 1177745 - DNA, 19 bp, Homo sapiens
attgggacgcacagtgcag

SEQ ID NO: 1177746 - DNA, 14 bp, Homo sapiens
attgggagaaatca

SEQ ID NO: 1177747 - DNA, 18 bp, Homo sapiens
attgggatatcattttaa

SEQ ID NO: 1177748 - DNA, 15 bp, Homo sapiens
attgggcttcttcgt

SEQ ID NO: 1177749 - DNA, 21 bp, Homo sapiens
cctccaataaagtgccttctg

SEQ ID NO: 1177750 - DNA, 22 bp, Homo sapiens
cctccaataaagtgccttctgg

SEQ ID NO: 1177751 - DNA, 23 bp, Homo sapiens
cctccaatcccaccaaccctcag

SEQ ID NO: 1177752 - DNA, 21 bp, Homo sapiens
cctccaattggtgcttcagcc

SEQ ID NO: 1177753 - DNA, 20 bp, Homo sapiens
cctccacaaagcaaaggcag

SEQ ID NO: 1177754 - DNA, 23 bp, Homo sapiens
cctccacagcgagggcagctgct

SEQ ID NO: 1177755 - DNA, 18 bp, Homo sapiens
cctccacagctgcagctg

SEQ ID NO: 1177756 - DNA, 17 bp, Homo sapiens
cctccacagtcccccac

SEQ ID NO: 1177757 - DNA, 22 bp, Homo sapiens
cctccacagtcccccacccacc

SEQ ID NO: 1177758 - DNA, 14 bp, Homo sapiens
cctccacagtgctg

SEQ ID NO: 1177759 - DNA, 18 bp, Homo sapiens
cctccacagtgctgcttc

SEQ ID NO: 1177760 - DNA, 15 bp, Homo sapiens
cctccacatcccagc

SEQ ID NO: 1177761 - DNA, 17 bp, Homo sapiens
cctccacatcccagcag

SEQ ID NO: 1177762 - DNA, 21 bp, Homo sapiens
cctccacatcccagcagccca

SEQ ID NO: 1177763 - DNA, 20 bp, Homo sapiens
cctccacatcctccacgttc

SEQ ID NO: 1177764 - DNA, 22 bp, Homo sapiens
cctccaccaaccccgcggccca

SEQ ID NO: 1177765 - DNA, 18 bp, Homo sapiens
cctccaccaccactggcc

SEQ ID NO: 1177766 - DNA, 14 bp, Homo sapiens
cctccaccagcctg

SEQ ID NO: 1177767 - DNA, 15 bp, Homo sapiens
cctccaccagcctgc

SEQ ID NO: 1177768 - DNA, 18 bp, Homo sapiens
cctccaccagcctgctga

SEQ ID NO: 1177769 - DNA, 22 bp, Homo sapiens
cctccaccagcctgctgacaga

SEQ ID NO: 1177770 - DNA, 11 bp, Homo sapiens
cctccacccag

SEQ ID NO: 1177771 - DNA, 12 bp, Homo sapiens
cctccacccagc

SEQ ID NO: 1177772 - DNA, 14 bp, Homo sapiens
cctccacccagccc

SEQ ID NO: 1177773 - DNA, 13 bp, Homo sapiens
cctccaccccagg

SEQ ID NO: 1177774 - DNA, 16 bp, Homo sapiens
cctccacccccatgtg

SEQ ID NO: 1177775 - DNA, 16 bp, Homo sapiens
cctccacccccgccac

SEQ ID NO: 1177776 - DNA, 21 bp, Homo sapiens
cctccacccgtcctccctcag

SEQ ID NO: 1177777 - DNA, 13 bp, Homo sapiens
cctccaccctgca

SEQ ID NO: 1177778 - DNA, 21 bp, Homo sapiens
cctccaccctgtcccccagct

SEQ ID NO: 1177779 - DNA, 24 bp, Homo sapiens
cctccaccctgtcccccagctctg

SEQ ID NO: 1177780 - DNA, 13 bp, Homo sapiens
cctccacctcaag

SEQ ID NO: 1177781 - DNA, 19 bp, Homo sapiens
cctccacctcaagaccccc

SEQ ID NO: 1177782 - DNA, 14 bp, Homo sapiens
cctccacctcttca

SEQ ID NO: 1177783 - DNA, 17 bp, Homo sapiens
cctccacgccactgcct

SEQ ID NO: 1177784 - DNA, 22 bp, Homo sapiens
cctccacggtccgcggcctgca

SEQ ID NO: 1177785 - DNA, 23 bp, Homo sapiens
cctccactcaccacaagctgagc

SEQ ID NO: 1177786 - DNA, 14 bp, Homo sapiens
cctccactcactcc

SEQ ID NO: 1177787 - DNA, 12 bp, Homo sapiens
cctccactcccc

SEQ ID NO: 1177788 - DNA, 14 bp, Homo sapiens
cctccactcctctc

SEQ ID NO: 1177789 - DNA, 20 bp, Homo sapiens
cctccacttcccgtctcaga

SEQ ID NO: 1177790 - DNA, 23 bp, Homo sapiens
cctccacttcccgtctcagaatc

SEQ ID NO: 1177791 - DNA, 21 bp, Homo sapiens
cctccagaagcctctggctag

SEQ ID NO: 1177792 - DNA, 14 bp, Homo sapiens
cctccagaagctgc

SEQ ID NO: 1177793 - DNA, 17 bp, Homo sapiens
cctccagaccaccagcc

SEQ ID NO: 1177794 - DNA, 18 bp, Homo sapiens
cctccagaccctgcctga

SEQ ID NO: 1177795 - DNA, 18 bp, Homo sapiens
cctccagagaagccccgc

SEQ ID NO: 1177796 - DNA, 12 bp, Homo sapiens
cctccagagcca

SEQ ID NO: 1177797 - DNA, 16 bp, Homo sapiens
cctccagagccagcct

SEQ ID NO: 1177798 - DNA, 20 bp, Homo sapiens
cctccagagccagcctggga

SEQ ID NO: 1177799 - DNA, 18 bp, Homo sapiens
cctccagaggtggaggtg

SEQ ID NO: 1177800 - DNA, 18 bp, Homo sapiens
cctccagcccctgtccca

SEQ ID NO: 1177801 - DNA, 12 bp, Homo sapiens
cctccagccctt

SEQ ID NO: 1177802 - DNA, 20 bp, Homo sapiens
cctccagcccttcagacgag

SEQ ID NO: 1177803 - DNA, 16 bp, Homo sapiens
cctccagcctccctgt

SEQ ID NO: 1177804 - DNA, 22 bp, Homo sapiens
cctccagcctccctgtctccag

SEQ ID NO: 1177805 - DNA, 18 bp, Homo sapiens
cctccagcctctcccggc

SEQ ID NO: 1177806 - DNA, 16 bp, Homo sapiens
cctccagcctgaacag

SEQ ID NO: 1177807 - DNA, 19 bp, Homo sapiens
cctccagcctttgctccct

SEQ ID NO: 1177808 - DNA, 19 bp, Homo sapiens
cctccagctgcaccagagc

SEQ ID NO: 1177809 - DNA, 22 bp, Homo sapiens
cctccaggaatgatctcttctt

SEQ ID NO: 1177810 - DNA, 13 bp, Homo sapiens
cctccaggaccag

SEQ ID NO: 1177811 - DNA, 16 bp, Homo sapiens
cctccaggagagagcc

SEQ ID NO: 1177812 - DNA, 18 bp, Homo sapiens
cctccaggagcttcttgt

SEQ ID NO: 1177813 - DNA, 23 bp, Homo sapiens
cctccaggagcttcttgtttcct

SEQ ID NO: 1177814 - DNA, 17 bp, Homo sapiens
cctccaggaggggcctg

SEQ ID NO: 1177815 - DNA, 13 bp, Homo sapiens
cctccaggcaaaa

SEQ ID NO: 1177816 - DNA, 19 bp, Homo sapiens
cctccaggcaggccaggct

SEQ ID NO: 1177817 - DNA, 12 bp, Homo sapiens
cctccaggcctg

SEQ ID NO: 1177818 - DNA, 13 bp, Homo sapiens
cctccaggcctgc

SEQ ID NO: 1177819 - DNA, 17 bp, Homo sapiens
cctccaggcctgttgct

SEQ ID NO: 1177820 - DNA, 21 bp, Homo sapiens
cctccagggaaaatgacttta

SEQ ID NO: 1177821 - DNA, 16 bp, Homo sapiens
cctccagggccacgtg

SEQ ID NO: 1177822 - DNA, 12 bp, Homo sapiens
cctccagggccc

SEQ ID NO: 1177823 - DNA, 14 bp, Homo sapiens
cctccagggcccag

SEQ ID NO: 1177824 - DNA, 16 bp, Homo sapiens
cctccaggggctcctg

SEQ ID NO: 1177825 - DNA, 19 bp, Homo sapiens
cctccaggggctcctgggt

SEQ ID NO: 1177826 - DNA, 20 bp, Homo sapiens
cctccaggggctcctgggtt

SEQ ID NO: 1177827 - DNA, 16 bp, Homo sapiens
cctccagtaccttgct

SEQ ID NO: 1177828 - DNA, 17 bp, Homo sapiens
cctccagtaccttgctt

SEQ ID NO: 1177829 - DNA, 20 bp, Homo sapiens
cctccagtacgtcccgctgc

SEQ ID NO: 1177830 - DNA, 16 bp, Homo sapiens
cctccagtcacactcc

SEQ ID NO: 1177831 - DNA, 20 bp, Homo sapiens
cctccagtcacactccccgc

SEQ ID NO: 1177832 - DNA, 16 bp, Homo sapiens
cctccagtcatggtac

SEQ ID NO: 1177833 - DNA, 21 bp, Homo sapiens
cctccccttttaccactccca

SEQ ID NO: 1177834 - DNA, 23 bp, Homo sapiens
cctccccttttatgcacttcaaa

SEQ ID NO: 1177835 - DNA, 21 bp, Homo sapiens
cctcccgaaaaatgtgtggtt

SEQ ID NO: 1177836 - DNA, 22 bp, Homo sapiens
cctcccgaaaaatgtgtggttc

SEQ ID NO: 1177837 - DNA, 17 bp, Homo sapiens
cctcccgacagcccatc

SEQ ID NO: 1177838 - DNA, 21 bp, Homo sapiens
cctcccgacagcccatcacct

SEQ ID NO: 1177839 - DNA, 19 bp, Homo sapiens
cctcccggcatgggaaagc

SEQ ID NO: 1177840 - DNA, 18 bp, Homo sapiens
cctcccggcctggcttca

SEQ ID NO: 1177841 - DNA, 21 bp, Homo sapiens
cctcccggctgcccccatcac

SEQ ID NO: 1177842 - DNA, 14 bp, Homo sapiens
cctcccgggccctc

SEQ ID NO: 1177843 - DNA, 19 bp, Homo sapiens
cctcccgggccctcccttg

SEQ ID NO: 1177844 - DNA, 17 bp, Homo sapiens
cctcccgtagtctcctg

SEQ ID NO: 1177845 - DNA, 21 bp, Homo sapiens
cctccctaagttgctgggatt

SEQ ID NO: 1177846 - DNA, 21 bp, Homo sapiens
cctccctagccagcacttgta

SEQ ID NO: 1177847 - DNA, 15 bp, Homo sapiens
cctccctagcccttc

SEQ ID NO: 1177848 - DNA, 11 bp, Homo sapiens
cctccctcagc

SEQ ID NO: 1177849 - DNA, 16 bp, Homo sapiens
cctccctcagcccctc

SEQ ID NO: 1177850 - DNA, 22 bp, Homo sapiens
cctccctcagccgtcagccatc

SEQ ID NO: 1177851 - DNA, 15 bp, Homo sapiens
cctccctcagggagc

SEQ ID NO: 1177852 - DNA, 15 bp, Homo sapiens
cctccctccaagcct

SEQ ID NO: 1177853 - DNA, 17 bp, Homo sapiens
cctccctccaagcctgg

SEQ ID NO: 1177854 - DNA, 13 bp, Homo sapiens
cctccctccaccc

SEQ ID NO: 1177855 - DNA, 20 bp, Homo sapiens
cctccctccaccccaggacg

SEQ ID NO: 1177856 - DNA, 14 bp, Homo sapiens
cctccctcccagcg

SEQ ID NO: 1177857 - DNA, 16 bp, Homo sapiens
cctccctccccagctc

SEQ ID NO: 1177858 - DNA, 17 bp, Homo sapiens
cctccctccccagctcc

SEQ ID NO: 1177859 - DNA, 18 bp, Homo sapiens
cctccctccccagctccg

SEQ ID NO: 1177860 - DNA, 16 bp, Homo sapiens
cctccctcccggctgc

SEQ ID NO: 1177861 - DNA, 14 bp, Homo sapiens
cctccctccctagc

SEQ ID NO: 1177862 - DNA, 12 bp, Homo sapiens
cctccctccctc

SEQ ID NO: 1177863 - DNA, 15 bp, Homo sapiens
cctccctccctctcc

SEQ ID NO: 1177864 - DNA, 12 bp, Homo sapiens
cctccctcctca

SEQ ID NO: 1177865 - DNA, 21 bp, Homo sapiens
cctccctcctgccgactcctg

SEQ ID NO: 1177866 - DNA, 13 bp, Homo sapiens
cctccctctaatt

SEQ ID NO: 1177867 - DNA, 12 bp, Homo sapiens
cctccctctact

SEQ ID NO: 1177868 - DNA, 22 bp, Homo sapiens
cctccctctcagaggcctgctg

SEQ ID NO: 1177869 - DNA, 14 bp, Homo sapiens
cctccctctccata

SEQ ID NO: 1177870 - DNA, 20 bp, Homo sapiens
cctccctctctcttctgctc

SEQ ID NO: 1177871 - DNA, 14 bp, Homo sapiens
cctccctctgacct

SEQ ID NO: 1177872 - DNA, 19 bp, Homo sapiens
cctccctctgacctgcagg

SEQ ID NO: 1177873 - DNA, 14 bp, Homo sapiens
cctccctctgccag

SEQ ID NO: 1177874 - DNA, 13 bp, Homo sapiens
cctccctctgccc

SEQ ID NO: 1177875 - DNA, 23 bp, Homo sapiens
cctccctctgccccaagcagcca

SEQ ID NO: 1177876 - DNA, 15 bp, Homo sapiens
cctccctctttccca

SEQ ID NO: 1177877 - DNA, 12 bp, Homo sapiens
cctccctgagcc

SEQ ID NO: 1177878 - DNA, 14 bp, Homo sapiens
cctccctgcagcca

SEQ ID NO: 1177879 - DNA, 22 bp, Homo sapiens
attgtgcagaaaagctcagagt

SEQ ID NO: 1177880 - DNA, 17 bp, Homo sapiens
attgtgccaatatgtat

SEQ ID NO: 1177881 - DNA, 15 bp, Homo sapiens
attgtgctcagagac

SEQ ID NO: 1177882 - DNA, 11 bp, Homo sapiens
attgtgctgcc

SEQ ID NO: 1177883 - DNA, 13 bp, Homo sapiens
attgtgctgccat

SEQ ID NO: 1177884 - DNA, 23 bp, Homo sapiens
attgtgctgggtcccagcctggt

SEQ ID NO: 1177885 - DNA, 15 bp, Homo sapiens
attgtggaaaaccag

SEQ ID NO: 1177886 - DNA, 18 bp, Homo sapiens
attgtggaagacagtgtg

SEQ ID NO: 1177887 - DNA, 23 bp, Homo sapiens
attgtggaataaatccttcgtcc

SEQ ID NO: 1177888 - DNA, 16 bp, Homo sapiens
attgtggattataaaa

SEQ ID NO: 1177889 - DNA, 18 bp, Homo sapiens
attgtggctatcctgatt

SEQ ID NO: 1177890 - DNA, 12 bp, Homo sapiens
attgtggctcct

SEQ ID NO: 1177891 - DNA, 19 bp, Homo sapiens
attgtgggcatgagctgct

SEQ ID NO: 1177892 - DNA, 13 bp, Homo sapiens
attgtggggtgca

SEQ ID NO: 1177893 - DNA, 16 bp, Homo sapiens
attgtgggtgttaatt

SEQ ID NO: 1177894 - DNA, 15 bp, Homo sapiens
attgtgtaaaaaatg

SEQ ID NO: 1177895 - DNA, 20 bp, Homo sapiens
attgtgtaaaaaatggaaaa

SEQ ID NO: 1177896 - DNA, 12 bp, Homo sapiens
attgtgtagacg

SEQ ID NO: 1177897 - DNA, 14 bp, Homo sapiens
attgtgtagacgat

SEQ ID NO: 1177898 - DNA, 16 bp, Homo sapiens
attgtgtagccttttt

SEQ ID NO: 1177899 - DNA, 18 bp, Homo sapiens
attgtgtagcctttttgt

SEQ ID NO: 1177900 - DNA, 22 bp, Homo sapiens
attgtgtagcctttttgtataa

SEQ ID NO: 1177901 - DNA, 17 bp, Homo sapiens
attgtgtatatatctta

SEQ ID NO: 1177902 - DNA, 12 bp, Homo sapiens
attgtgtatctg

SEQ ID NO: 1177903 - DNA, 21 bp, Homo sapiens
attgtgtatctgtgcttctaa

SEQ ID NO: 1177904 - DNA, 19 bp, Homo sapiens
attgtgtattgatgcaata

SEQ ID NO: 1177905 - DNA, 12 bp, Homo sapiens
attgtgtatttt

SEQ ID NO: 1177906 - DNA, 18 bp, Homo sapiens
attgtgtattttctttgg

SEQ ID NO: 1177907 - DNA, 23 bp, Homo sapiens
attgtgtattttctttgggggtg

SEQ ID NO: 1177908 - DNA, 20 bp, Homo sapiens
attgtgtcagaaacatgaaa

SEQ ID NO: 1177909 - DNA, 17 bp, Homo sapiens
attgtgtcagactgttt

SEQ ID NO: 1177910 - DNA, 20 bp, Homo sapiens
attgtgtgaaaaaagaaaat

SEQ ID NO: 1177911 - DNA, 17 bp, Homo sapiens
attgtgtgtctggtaac

SEQ ID NO: 1177912 - DNA, 16 bp, Homo sapiens
attgtgtgttatttaa

SEQ ID NO: 1177913 - DNA, 20 bp, Homo sapiens
attgtgttcccatttcagct

SEQ ID NO: 1177914 - DNA, 19 bp, Homo sapiens
attgtgttgaagaagggtt

SEQ ID NO: 1177915 - DNA, 18 bp, Homo sapiens
attgtgttgactttataa

SEQ ID NO: 1177916 - DNA, 19 bp, Homo sapiens
attgtgttgactttataaa

SEQ ID NO: 1177917 - DNA, 22 bp, Homo sapiens
attgtgtttctaccggagagag

SEQ ID NO: 1177918 - DNA, 17 bp, Homo sapiens
attgtgtttgttcataa

SEQ ID NO: 1177919 - DNA, 15 bp, Homo sapiens
attgttaaaataact

SEQ ID NO: 1177920 - DNA, 15 bp, Homo sapiens
attgttaaattacat

SEQ ID NO: 1177921 - DNA, 18 bp, Homo sapiens
attgttaagggcattttt

SEQ ID NO: 1177922 - DNA, 21 bp, Homo sapiens
attgttaagtctaaatatttc

SEQ ID NO: 1177923 - DNA, 15 bp, Homo sapiens
attgttaatgtgatg

SEQ ID NO: 1177924 - DNA, 17 bp, Homo sapiens
attgttacacattaagt

SEQ ID NO: 1177925 - DNA, 19 bp, Homo sapiens
attgttacgtagcctaagg

SEQ ID NO: 1177926 - DNA, 15 bp, Homo sapiens
attgttagatgtttg

SEQ ID NO: 1177927 - DNA, 23 bp, Homo sapiens
attgttaggagtggttctcattt

SEQ ID NO: 1177928 - DNA, 19 bp, Homo sapiens
attgttagggtcagccatt

SEQ ID NO: 1177929 - DNA, 12 bp, Homo sapiens
attgttagttta

SEQ ID NO: 1177930 - DNA, 19 bp, Homo sapiens
attgttataaaataacatg

SEQ ID NO: 1177931 - DNA, 12 bp, Homo sapiens
attgttatcaaa

SEQ ID NO: 1177932 - DNA, 17 bp, Homo sapiens
attgttatgaaaatcct

SEQ ID NO: 1177933 - DNA, 13 bp, Homo sapiens
attgttattaaat

SEQ ID NO: 1177934 - DNA, 13 bp, Homo sapiens
attgttcatttgt

SEQ ID NO: 1177935 - DNA, 16 bp, Homo sapiens
attgttccaagacatt

SEQ ID NO: 1177936 - DNA, 20 bp, Homo sapiens
attgttccaagacattgtca

SEQ ID NO: 1177937 - DNA, 22 bp, Homo sapiens
attgttccaggcatccatcttg

SEQ ID NO: 1177938 - DNA, 16 bp, Homo sapiens
attgttcccagtgaca

SEQ ID NO: 1177939 - DNA, 15 bp, Homo sapiens
attgttcccttcctc

SEQ ID NO: 1177940 - DNA, 16 bp, Homo sapiens
attgttcccttcctct

SEQ ID NO: 1177941 - DNA, 23 bp, Homo sapiens
attgttcccttcctcttcctgcc

SEQ ID NO: 1177942 - DNA, 22 bp, Homo sapiens
attgttcgtttcatcaggctct

SEQ ID NO: 1177943 - DNA, 22 bp, Homo sapiens
attgttctaatgcaacagaaaa

SEQ ID NO: 1177944 - DNA, 17 bp, Homo sapiens
attgttctagtactgta

SEQ ID NO: 1177945 - DNA, 18 bp, Homo sapiens
attgttcttattctggca

SEQ ID NO: 1177946 - DNA, 18 bp, Homo sapiens
attgttgaacatacttca

SEQ ID NO: 1177947 - DNA, 17 bp, Homo sapiens
attgttgacagttctga

SEQ ID NO: 1177948 - DNA, 22 bp, Homo sapiens
attgttgacagttctgaagaat

SEQ ID NO: 1177949 - DNA, 16 bp, Homo sapiens
attgttgagctattgc

SEQ ID NO: 1177950 - DNA, 20 bp, Homo sapiens
attgttgaggtggtctgaat

SEQ ID NO: 1177951 - DNA, 16 bp, Homo sapiens
attgttgcattgcttt

SEQ ID NO: 1177952 - DNA, 13 bp, Homo sapiens
attgttggagtat

SEQ ID NO: 1177953 - DNA, 16 bp, Homo sapiens
attgttggagtattta

SEQ ID NO: 1177954 - DNA, 15 bp, Homo sapiens
attgttgtccttttc

SEQ ID NO: 1177955 - DNA, 17 bp, Homo sapiens
attgttgtccttttcat

SEQ ID NO: 1177956 - DNA, 13 bp, Homo sapiens
attgttgtgtctg

SEQ ID NO: 1177957 - DNA, 17 bp, Homo sapiens
attgttgtttgtatgta

SEQ ID NO: 1177958 - DNA, 21 bp, Homo sapiens
attgttgtttgtatgtataat

SEQ ID NO: 1177959 - DNA, 17 bp, Homo sapiens
attgttgtttttttaat

SEQ ID NO: 1177960 - DNA, 13 bp, Homo sapiens
attgtttaaaatt

SEQ ID NO: 1177961 - DNA, 15 bp, Homo sapiens
attgtttaaaattca

SEQ ID NO: 1177962 - DNA, 16 bp, Homo sapiens
attgtttaaaattcag

SEQ ID NO: 1177963 - DNA, 21 bp, Homo sapiens
attgtttaccatagaaagatg

SEQ ID NO: 1177964 - DNA, 23 bp, Homo sapiens
attgtttatacacaactttgcaa

SEQ ID NO: 1177965 - DNA, 18 bp, Homo sapiens
attgtttatgccaaatgt

SEQ ID NO: 1177966 - DNA, 18 bp, Homo sapiens
attgtttatttatcagtg

SEQ ID NO: 1177967 - DNA, 22 bp, Homo sapiens
attgtttcaattgcatctccca

SEQ ID NO: 1177968 - DNA, 13 bp, Homo sapiens
attgtttcagaat

SEQ ID NO: 1177969 - DNA, 18 bp, Homo sapiens
attgtttcatatctggtc

SEQ ID NO: 1177970 - DNA, 18 bp, Homo sapiens
attgtttccaacttgtct

SEQ ID NO: 1177971 - DNA, 21 bp, Homo sapiens
attgtttccaacttgtctggg

SEQ ID NO: 1177972 - DNA, 16 bp, Homo sapiens
attgtttctagaacag

SEQ ID NO: 1177973 - DNA, 17 bp, Homo sapiens
attgtttctgcattcat

SEQ ID NO: 1177974 - DNA, 20 bp, Homo sapiens
attgtttgaaacaaagaagg

SEQ ID NO: 1177975 - DNA, 13 bp, Homo sapiens
attgtttgaaatg

SEQ ID NO: 1177976 - DNA, 20 bp, Homo sapiens
attgtttgctgttgggtttt

SEQ ID NO: 1177977 - DNA, 14 bp, Homo sapiens
attgttttacaata

SEQ ID NO: 1177978 - DNA, 18 bp, Homo sapiens
attgttttaccagctccc

SEQ ID NO: 1177979 - DNA, 19 bp, Homo sapiens
attgttttacctgttctga

SEQ ID NO: 1177980 - DNA, 21 bp, Homo sapiens
attgttttacctgttctgaaa

SEQ ID NO: 1177981 - DNA, 13 bp, Homo sapiens
attgttttatcat

SEQ ID NO: 1177982 - DNA, 19 bp, Homo sapiens
attgttttatctgaatttt

SEQ ID NO: 1177983 - DNA, 19 bp, Homo sapiens
attgttttattttggaatt

SEQ ID NO: 1177984 - DNA, 17 bp, Homo sapiens
attgttttcacttgtat

SEQ ID NO: 1177985 - DNA, 18 bp, Homo sapiens
attgttttcacttgtatt

SEQ ID NO: 1177986 - DNA, 19 bp, Homo sapiens
attgttttcacttgtattg

SEQ ID NO: 1177987 - DNA, 12 bp, Homo sapiens
attgttttctgt

SEQ ID NO: 1177988 - DNA, 17 bp, Homo sapiens
attgttttctgtaaata

SEQ ID NO: 1177989 - DNA, 17 bp, Homo sapiens
attgttttcttttacag

SEQ ID NO: 1177990 - DNA, 20 bp, Homo sapiens
attgttttcttttacagact

SEQ ID NO: 1177991 - DNA, 20 bp, Homo sapiens
attgttttgagctttccatg

SEQ ID NO: 1177992 - DNA, 15 bp, Homo sapiens
attgtttttaaacct

SEQ ID NO: 1177993 - DNA, 16 bp, Homo sapiens
attgtttttatttcta

SEQ ID NO: 1177994 - DNA, 19 bp, Homo sapiens
attgtttttgaatttaaat

SEQ ID NO: 1177995 - DNA, 23 bp, Homo sapiens
attgtttttgaatttaaataaag

SEQ ID NO: 1177996 - DNA, 15 bp, Homo sapiens
attgtttttgtatat

SEQ ID NO: 1177997 - DNA, 13 bp, Homo sapiens
attgttttttaaa

SEQ ID NO: 1177998 - DNA, 17 bp, Homo sapiens
attgttttttaaagcaa

SEQ ID NO: 1177999 - DNA, 13 bp, Homo sapiens
atttaaaaaataa

SEQ ID NO: 1178000 - DNA, 13 bp, Homo sapiens
atttaaaaaatta

SEQ ID NO: 1178001 - DNA, 18 bp, Homo sapiens
atttaaaaaattaaaaat

SEQ ID NO: 1178002 - DNA, 20 bp, Homo sapiens
atttaaaaaattaaaaatga

SEQ ID NO: 1178003 - DNA, 18 bp, Homo sapiens
atttaaaaacaaccaaca

SEQ ID NO: 1178004 - DNA, 14 bp, Homo sapiens
cctccctgcatctg

SEQ ID NO: 1178005 - DNA, 12 bp, Homo sapiens
cctccctgccca

SEQ ID NO: 1178006 - DNA, 22 bp, Homo sapiens
cctccctgcccaaactcccctt

SEQ ID NO: 1178007 - DNA, 13 bp, Homo sapiens
cctccctgccccc

SEQ ID NO: 1178008 - DNA, 13 bp, Homo sapiens
cctccctgcccct

SEQ ID NO: 1178009 - DNA, 21 bp, Homo sapiens
cctccctgcccctcccttcaa

SEQ ID NO: 1178010 - DNA, 24 bp, Homo sapiens
cctccctgcccctcccttcaacca

SEQ ID NO: 1178011 - DNA, 11 bp, Homo sapiens
cctccctgcct

SEQ ID NO: 1178012 - DNA, 14 bp, Homo sapiens
cctccctgcctcca

SEQ ID NO: 1178013 - DNA, 13 bp, Homo sapiens
cctccctgcctgc

SEQ ID NO: 1178014 - DNA, 14 bp, Homo sapiens
cctccctgcctgct

SEQ ID NO: 1178015 - DNA, 15 bp, Homo sapiens
cctccctgcctgctc

SEQ ID NO: 1178016 - DNA, 17 bp, Homo sapiens
cctccctgcctgctcct

SEQ ID NO: 1178017 - DNA, 23 bp, Homo sapiens
cctccctgctcagtgcttgggct

SEQ ID NO: 1178018 - DNA, 16 bp, Homo sapiens
cctccctgctcctcat

SEQ ID NO: 1178019 - DNA, 11 bp, Homo sapiens
cctccctgctt

SEQ ID NO: 1178020 - DNA, 12 bp, Homo sapiens
cctccctggcac

SEQ ID NO: 1178021 - DNA, 13 bp, Homo sapiens
cctccctggcaga

SEQ ID NO: 1178022 - DNA, 15 bp, Homo sapiens
cctccctggcctgtt

SEQ ID NO: 1178023 - DNA, 12 bp, Homo sapiens
cctccctggctc

SEQ ID NO: 1178024 - DNA, 15 bp, Homo sapiens
cctccctggctccca

SEQ ID NO: 1178025 - DNA, 20 bp, Homo sapiens
cctccctggctcccatgacc

SEQ ID NO: 1178026 - DNA, 16 bp, Homo sapiens
cctccctggctgccct

SEQ ID NO: 1178027 - DNA, 22 bp, Homo sapiens
cctccctggctgccctggccct

SEQ ID NO: 1178028 - DNA, 18 bp, Homo sapiens
cctccctgggctaagcag

SEQ ID NO: 1178029 - DNA, 20 bp, Homo sapiens
cctccctgggctaagcaggg

SEQ ID NO: 1178030 - DNA, 17 bp, Homo sapiens
cctccctgggggcccca

SEQ ID NO: 1178031 - DNA, 21 bp, Homo sapiens
cctccctgggggccccaggat

SEQ ID NO: 1178032 - DNA, 14 bp, Homo sapiens
cctccctgggttca

SEQ ID NO: 1178033 - DNA, 21 bp, Homo sapiens
cctccctggtttgcagctgtt

SEQ ID NO: 1178034 - DNA, 23 bp, Homo sapiens
cctccctgtcaaagctgtcactt

SEQ ID NO: 1178035 - DNA, 15 bp, Homo sapiens
cctccctgtcccagg

SEQ ID NO: 1178036 - DNA, 12 bp, Homo sapiens
cctccctgtcct

SEQ ID NO: 1178037 - DNA, 13 bp, Homo sapiens
cctccctgtctcc

SEQ ID NO: 1178038 - DNA, 17 bp, Homo sapiens
cctccctgtctccagct

SEQ ID NO: 1178039 - DNA, 18 bp, Homo sapiens
cctccctgtctccagggc

SEQ ID NO: 1178040 - DNA, 23 bp, Homo sapiens
cctccctgtgcccccagcctcag

SEQ ID NO: 1178041 - DNA, 13 bp, Homo sapiens
cctccctgttcac

SEQ ID NO: 1178042 - DNA, 22 bp, Homo sapiens
cctccctgttcacggtgacaca

SEQ ID NO: 1178043 - DNA, 11 bp, Homo sapiens
cctcccttccc

SEQ ID NO: 1178044 - DNA, 15 bp, Homo sapiens
cctcccttccgaccc

SEQ ID NO: 1178045 - DNA, 21 bp, Homo sapiens
cctcccttccgaccctctggg

SEQ ID NO: 1178046 - DNA, 19 bp, Homo sapiens
cctcccttccttgggcaga

SEQ ID NO: 1178047 - DNA, 20 bp, Homo sapiens
cctcccttccttgggcagaa

SEQ ID NO: 1178048 - DNA, 13 bp, Homo sapiens
cctcccttccttt

SEQ ID NO: 1178049 - DNA, 14 bp, Homo sapiens
cctcccttgcccca

SEQ ID NO: 1178050 - DNA, 19 bp, Homo sapiens
cctcccttgccccaggcca

SEQ ID NO: 1178051 - DNA, 21 bp, Homo sapiens
cctcccttgccccaggccagg

SEQ ID NO: 1178052 - DNA, 13 bp, Homo sapiens
cctcccttgcctt

SEQ ID NO: 1178053 - DNA, 21 bp, Homo sapiens
cctcccttgctcagtgcctcc

SEQ ID NO: 1178054 - DNA, 17 bp, Homo sapiens
cctcccttgtccttgaa

SEQ ID NO: 1178055 - DNA, 14 bp, Homo sapiens
cctccctttctggg

SEQ ID NO: 1178056 - DNA, 15 bp, Homo sapiens
cctccgacctctctc

SEQ ID NO: 1178057 - DNA, 20 bp, Homo sapiens
cctccgacctctctcggccc

SEQ ID NO: 1178058 - DNA, 17 bp, Homo sapiens
cctccgacgctgcctct

SEQ ID NO: 1178059 - DNA, 19 bp, Homo sapiens
cctccgacgctgcctctca

SEQ ID NO: 1178060 - DNA, 15 bp, Homo sapiens
cctccgactccagat

SEQ ID NO: 1178061 - DNA, 14 bp, Homo sapiens
cctccgagagggag

SEQ ID NO: 1178062 - DNA, 18 bp, Homo sapiens
cctccgaggctccccgcc

SEQ ID NO: 1178063 - DNA, 22 bp, Homo sapiens
cctccgagtgagtcagtgatga

SEQ ID NO: 1178064 - DNA, 14 bp, Homo sapiens
cctccgcagtgtct

SEQ ID NO: 1178065 - DNA, 14 bp, Homo sapiens
cctccgccagaccc

SEQ ID NO: 1178066 - DNA, 14 bp, Homo sapiens
cctccgccatccac

SEQ ID NO: 1178067 - DNA, 15 bp, Homo sapiens
cctccgccatccacc

SEQ ID NO: 1178068 - DNA, 14 bp, Homo sapiens
cctccgccatgggg

SEQ ID NO: 1178069 - DNA, 13 bp, Homo sapiens
cctccgccgtgcc

SEQ ID NO: 1178070 - DNA, 15 bp, Homo sapiens
cctccgcctgggatc

SEQ ID NO: 1178071 - DNA, 13 bp, Homo sapiens
cctccgcctgtgt

SEQ ID NO: 1178072 - DNA, 17 bp, Homo sapiens
cctccgccttcccagca

SEQ ID NO: 1178073 - DNA, 18 bp, Homo sapiens
cctccgcttatcctgcta

SEQ ID NO: 1178074 - DNA, 23 bp, Homo sapiens
cctccgcttatcctgctagcagg

SEQ ID NO: 1178075 - DNA, 13 bp, Homo sapiens
cctccggaggagc

SEQ ID NO: 1178076 - DNA, 17 bp, Homo sapiens
cctccggaggagcagcc

SEQ ID NO: 1178077 - DNA, 13 bp, Homo sapiens
cctccggctgcct

SEQ ID NO: 1178078 - DNA, 18 bp, Homo sapiens
atttataaaaatataaat

SEQ ID NO: 1178079 - DNA, 17 bp, Homo sapiens
atttataaacagacaat

SEQ ID NO: 1178080 - DNA, 21 bp, Homo sapiens
atttataaacagacaatatgt

SEQ ID NO: 1178081 - DNA, 12 bp, Homo sapiens
atttataaacta

SEQ ID NO: 1178082 - DNA, 18 bp, Homo sapiens
atttataaactaggtaaa

SEQ ID NO: 1178083 - DNA, 12 bp, Homo sapiens
atttataaagca

SEQ ID NO: 1178084 - DNA, 14 bp, Homo sapiens
atttataaagcaaa

SEQ ID NO: 1178085 - DNA, 21 bp, Homo sapiens
atttataaataacaaaatttt

SEQ ID NO: 1178086 - DNA, 14 bp, Homo sapiens
atttataaatgcta

SEQ ID NO: 1178087 - DNA, 14 bp, Homo sapiens
atttataactcatc

SEQ ID NO: 1178088 - DNA, 15 bp, Homo sapiens
atttataactcatca

SEQ ID NO: 1178089 - DNA, 17 bp, Homo sapiens
atttataactcatcata

SEQ ID NO: 1178090 - DNA, 18 bp, Homo sapiens
atttataactcatcataa

SEQ ID NO: 1178091 - DNA, 20 bp, Homo sapiens
atttataactcatcataaaa

SEQ ID NO: 1178092 - DNA, 14 bp, Homo sapiens
atttataagcagat

SEQ ID NO: 1178093 - DNA, 16 bp, Homo sapiens
atttataaggaaattt

SEQ ID NO: 1178094 - DNA, 14 bp, Homo sapiens
atttataatgttag

SEQ ID NO: 1178095 - DNA, 15 bp, Homo sapiens
atttataatttaaat

SEQ ID NO: 1178096 - DNA, 19 bp, Homo sapiens
atttataatttaaatgata

SEQ ID NO: 1178097 - DNA, 14 bp, Homo sapiens
atttatacaaatta

SEQ ID NO: 1178098 - DNA, 13 bp, Homo sapiens
atttatacaagat

SEQ ID NO: 1178099 - DNA, 15 bp, Homo sapiens
atttatacaagattg

SEQ ID NO: 1178100 - DNA, 20 bp, Homo sapiens
atttatacaccagcaattta

SEQ ID NO: 1178101 - DNA, 21 bp, Homo sapiens
atttatacaccagcaatttag

SEQ ID NO: 1178102 - DNA, 15 bp, Homo sapiens
atttatacagttgaa

SEQ ID NO: 1178103 - DNA, 20 bp, Homo sapiens
atttatactcttttttcatg

SEQ ID NO: 1178104 - DNA, 14 bp, Homo sapiens
atttataggccagg

SEQ ID NO: 1178105 - DNA, 12 bp, Homo sapiens
atttatagtttg

SEQ ID NO: 1178106 - DNA, 14 bp, Homo sapiens
atttatagtttgta

SEQ ID NO: 1178107 - DNA, 16 bp, Homo sapiens
atttatagtttgtaca

SEQ ID NO: 1178108 - DNA, 12 bp, Homo sapiens
atttatatactt

SEQ ID NO: 1178109 - DNA, 12 bp, Homo sapiens
atttatatatat

SEQ ID NO: 1178110 - DNA, 17 bp, Homo sapiens
atttatatatatatgta

SEQ ID NO: 1178111 - DNA, 14 bp, Homo sapiens
atttatatatggca

SEQ ID NO: 1178112 - DNA, 15 bp, Homo sapiens
atttatatatggcat

SEQ ID NO: 1178113 - DNA, 17 bp, Homo sapiens
atttatatatggcatat

SEQ ID NO: 1178114 - DNA, 19 bp, Homo sapiens
atttatatatggcatattt

SEQ ID NO: 1178115 - DNA, 15 bp, Homo sapiens
atttatatatgtatt

SEQ ID NO: 1178116 - DNA, 15 bp, Homo sapiens
atttatatcttgtta

SEQ ID NO: 1178117 - DNA, 19 bp, Homo sapiens
atttatatggggaatatat

SEQ ID NO: 1178118 - DNA, 15 bp, Homo sapiens
atttatatgtacatg

SEQ ID NO: 1178119 - DNA, 16 bp, Homo sapiens
atttatatgtacatga

SEQ ID NO: 1178120 - DNA, 17 bp, Homo sapiens
atttatattgtatattc

SEQ ID NO: 1178121 - DNA, 18 bp, Homo sapiens
atttatattgtatattct

SEQ ID NO: 1178122 - DNA, 19 bp, Homo sapiens
atttatattgtatattctg

SEQ ID NO: 1178123 - DNA, 14 bp, Homo sapiens
atttatatttggaa

SEQ ID NO: 1178124 - DNA, 13 bp, Homo sapiens
atttatatttttg

SEQ ID NO: 1178125 - DNA, 12 bp, Homo sapiens
atttatcaaaat

SEQ ID NO: 1178126 - DNA, 13 bp, Homo sapiens
atttatcaaaatg

SEQ ID NO: 1178127 - DNA, 18 bp, Homo sapiens
atttatcaaaatgtagct

SEQ ID NO: 1178128 - DNA, 21 bp, Homo sapiens
atttatcaaaccctagccttg

SEQ ID NO: 1178129 - DNA, 17 bp, Homo sapiens
atttatcagtgacagag

SEQ ID NO: 1178130 - DNA, 20 bp, Homo sapiens
atttatccacaggaaagtgt

SEQ ID NO: 1178131 - DNA, 21 bp, Homo sapiens
atttatccacaggaaagtgtt

SEQ ID NO: 1178132 - DNA, 17 bp, Homo sapiens
atttatcgcagaccttt

SEQ ID NO: 1178133 - DNA, 10 bp, Homo sapiens
atttatctat

SEQ ID NO: 1178134 - DNA, 11 bp, Homo sapiens
atttatctata

SEQ ID NO: 1178135 - DNA, 15 bp, Homo sapiens
atttatctataattt

SEQ ID NO: 1178136 - DNA, 14 bp, Homo sapiens
atttatctccctta

SEQ ID NO: 1178137 - DNA, 23 bp, Homo sapiens
atttatctcctcttcatggcatc

SEQ ID NO: 1178138 - DNA, 14 bp, Homo sapiens
atttatctctattt

SEQ ID NO: 1178139 - DNA, 14 bp, Homo sapiens
cctcgcacacaggg

SEQ ID NO: 1178140 - DNA, 21 bp, Homo sapiens
cctcgcacacagggctcacag

SEQ ID NO: 1178141 - DNA, 22 bp, Homo sapiens
cctcgcacacagggctcacagg

SEQ ID NO: 1178142 - DNA, 23 bp, Homo sapiens
cctcgcacacagggctcacaggg

SEQ ID NO: 1178143 - DNA, 12 bp, Homo sapiens
cctcgcacaggc

SEQ ID NO: 1178144 - DNA, 13 bp, Homo sapiens
cctcgcacaggcc

SEQ ID NO: 1178145 - DNA, 17 bp, Homo sapiens
cctcgcacaggccctag

SEQ ID NO: 1178146 - DNA, 20 bp, Homo sapiens
cctcgcacaggccctagctt

SEQ ID NO: 1178147 - DNA, 14 bp, Homo sapiens
cctcgccagcttgg

SEQ ID NO: 1178148 - DNA, 17 bp, Homo sapiens
cctcgccagcttggctc

SEQ ID NO: 1178149 - DNA, 17 bp, Homo sapiens
cctcgcccctccagtgt

SEQ ID NO: 1178150 - DNA, 12 bp, Homo sapiens
cctcgccctggg

SEQ ID NO: 1178151 - DNA, 13 bp, Homo sapiens
cctcgccctgggt

SEQ ID NO: 1178152 - DNA, 19 bp, Homo sapiens
cctcgccggatctgaggga

SEQ ID NO: 1178153 - DNA, 14 bp, Homo sapiens
cctcgcctccccac

SEQ ID NO: 1178154 - DNA, 13 bp, Homo sapiens
cctcgcctgcctt

SEQ ID NO: 1178155 - DNA, 15 bp, Homo sapiens
cctcgcctgtggagc

SEQ ID NO: 1178156 - DNA, 14 bp, Homo sapiens
cctcgctcccctct

SEQ ID NO: 1178157 - DNA, 16 bp, Homo sapiens
cctcgctcccctctgg

SEQ ID NO: 1178158 - DNA, 19 bp, Homo sapiens
cctcgctcccctctggaat

SEQ ID NO: 1178159 - DNA, 23 bp, Homo sapiens
cctcgctcctccttcccagggac

SEQ ID NO: 1178160 - DNA, 13 bp, Homo sapiens
cctcgctgccagc

SEQ ID NO: 1178161 - DNA, 15 bp, Homo sapiens
cctcgctgctgctac

SEQ ID NO: 1178162 - DNA, 12 bp, Homo sapiens
cctcgcttggac

SEQ ID NO: 1178163 - DNA, 23 bp, Homo sapiens
cctcggaaccgctcacctagagc

SEQ ID NO: 1178164 - DNA, 21 bp, Homo sapiens
cctcggagagcagcagcacca

SEQ ID NO: 1178165 - DNA, 23 bp, Homo sapiens
cctcggagcctcatccgaggcag

SEQ ID NO: 1178166 - DNA, 18 bp, Homo sapiens
cctcggagctggctgtgc

SEQ ID NO: 1178167 - DNA, 16 bp, Homo sapiens
cctcggagggatggag

SEQ ID NO: 1178168 - DNA, 15 bp, Homo sapiens
cctcggatcaccgag

SEQ ID NO: 1178169 - DNA, 17 bp, Homo sapiens
cctcggatcaccgagag

SEQ ID NO: 1178170 - DNA, 16 bp, Homo sapiens
cctcggcacacactgt

SEQ ID NO: 1178171 - DNA, 23 bp, Homo sapiens
cctcggcagaactctctgtcttc

SEQ ID NO: 1178172 - DNA, 20 bp, Homo sapiens
cctcggcttgtgggctggtg

SEQ ID NO: 1178173 - DNA, 13 bp, Homo sapiens
cctcgggcccacc

SEQ ID NO: 1178174 - DNA, 16 bp, Homo sapiens
cctcgggcccacctgg

SEQ ID NO: 1178175 - DNA, 21 bp, Homo sapiens
cctcgggcccacctggccacc

SEQ ID NO: 1178176 - DNA, 14 bp, Homo sapiens
cctcggggacacca

SEQ ID NO: 1178177 - DNA, 18 bp, Homo sapiens
cctcggggacaccagagc

SEQ ID NO: 1178178 - DNA, 16 bp, Homo sapiens
cctcggggagaggggg

SEQ ID NO: 1178179 - DNA, 18 bp, Homo sapiens
cctcggggatggggaggg

SEQ ID NO: 1178180 - DNA, 13 bp, Homo sapiens
cctcgggggcctg

SEQ ID NO: 1178181 - DNA, 15 bp, Homo sapiens
cctcgggggcctgtg

SEQ ID NO: 1178182 - DNA, 22 bp, Homo sapiens
cctcgggggctcttcccctaga

SEQ ID NO: 1178183 - DNA, 15 bp, Homo sapiens
cctcggtcagcgact

SEQ ID NO: 1178184 - DNA, 18 bp, Homo sapiens
cctcggtggctgcacaga

SEQ ID NO: 1178185 - DNA, 21 bp, Homo sapiens
cctcggtggctgcacagaagg

SEQ ID NO: 1178186 - DNA, 13 bp, Homo sapiens
cctcggtgggcca

SEQ ID NO: 1178187 - DNA, 18 bp, Homo sapiens
cctcggtgggccagagct

SEQ ID NO: 1178188 - DNA, 20 bp, Homo sapiens
cctcggtgggccagagctga

SEQ ID NO: 1178189 - DNA, 16 bp, Homo sapiens
cctcgtcccatccagc

SEQ ID NO: 1178190 - DNA, 16 bp, Homo sapiens
cctcgtccgtctgtct

SEQ ID NO: 1178191 - DNA, 14 bp, Homo sapiens
cctcgtcctgtccc

SEQ ID NO: 1178192 - DNA, 16 bp, Homo sapiens
cctcgtctccctggcc

SEQ ID NO: 1178193 - DNA, 18 bp, Homo sapiens
cctcgtctccctggccac

SEQ ID NO: 1178194 - DNA, 17 bp, Homo sapiens
cctcgtctccctggtgc

SEQ ID NO: 1178195 - DNA, 14 bp, Homo sapiens
cctcgtctggcaag

SEQ ID NO: 1178196 - DNA, 19 bp, Homo sapiens
cctcgtgcagagctggggc

SEQ ID NO: 1178197 - DNA, 14 bp, Homo sapiens
cctcgtggccagcc

SEQ ID NO: 1178198 - DNA, 17 bp, Homo sapiens
cctcgtggccagcccgg

SEQ ID NO: 1178199 - DNA, 18 bp, Homo sapiens
cctcgtggccagcccggc

SEQ ID NO: 1178200 - DNA, 13 bp, Homo sapiens
cctcgtgtcatct

SEQ ID NO: 1178201 - DNA, 21 bp, Homo sapiens
cctcgttcctttctcctgttt

SEQ ID NO: 1178202 - DNA, 17 bp, Homo sapiens
gaatctagaaaatcaga

SEQ ID NO: 1178203 - DNA, 18 bp, Homo sapiens
gaatctagggagggggaa

SEQ ID NO: 1178204 - DNA, 19 bp, Homo sapiens
gaatctataagtagtaaat

SEQ ID NO: 1178205 - DNA, 17 bp, Homo sapiens
gaatctatggctttaaa

SEQ ID NO: 1178206 - DNA, 15 bp, Homo sapiens
gaatctcaaaattag

SEQ ID NO: 1178207 - DNA, 16 bp, Homo sapiens
gaatctcaaataacta

SEQ ID NO: 1178208 - DNA, 17 bp, Homo sapiens
gaatctcccactccagc

SEQ ID NO: 1178209 - DNA, 14 bp, Homo sapiens
cccagctactcgat

SEQ ID NO: 1178210 - DNA, 19 bp, Homo sapiens
cccagctactctgtccagg

SEQ ID NO: 1178211 - DNA, 23 bp, Homo sapiens
cccagctactctgtccaggccac

SEQ ID NO: 1178212 - DNA, 24 bp, Homo sapiens
cccagctactctgtccaggccact

SEQ ID NO: 1178213 - DNA, 20 bp, Homo sapiens
cccagctactgtatgccccc

SEQ ID NO: 1178214 - DNA, 20 bp, Homo sapiens
cccagctacttgggagcctg

SEQ ID NO: 1178215 - DNA, 21 bp, Homo sapiens
cccagctacttgggagcctga

SEQ ID NO: 1178216 - DNA, 17 bp, Homo sapiens
cccagctacttgggagg

SEQ ID NO: 1178217 - DNA, 18 bp, Homo sapiens
cccagctaggaagagcag

SEQ ID NO: 1178218 - DNA, 23 bp, Homo sapiens
cccagctaggaagagcaggactc

SEQ ID NO: 1178219 - DNA, 11 bp, Homo sapiens
cccagctcaat

SEQ ID NO: 1178220 - DNA, 23 bp, Homo sapiens
cccagctcatgtaggtgagcctg

SEQ ID NO: 1178221 - DNA, 14 bp, Homo sapiens
cccagctccaggcc

SEQ ID NO: 1178222 - DNA, 18 bp, Homo sapiens
cccagctccaggggccct

SEQ ID NO: 1178223 - DNA, 15 bp, Homo sapiens
cccagctccccaaga

SEQ ID NO: 1178224 - DNA, 15 bp, Homo sapiens
cccagctccctagga

SEQ ID NO: 1178225 - DNA, 15 bp, Homo sapiens
cccagctccctgcac

SEQ ID NO: 1178226 - DNA, 23 bp, Homo sapiens
cccagctcccttgggaaggacac

SEQ ID NO: 1178227 - DNA, 17 bp, Homo sapiens
cccagctccgcctgctg

SEQ ID NO: 1178228 - DNA, 19 bp, Homo sapiens
cccagctccgcctgctggg

SEQ ID NO: 1178229 - DNA, 17 bp, Homo sapiens
cccagctccggcctgtc

SEQ ID NO: 1178230 - DNA, 14 bp, Homo sapiens
cccagctcctctga

SEQ ID NO: 1178231 - DNA, 15 bp, Homo sapiens
cccagctcctctgag

SEQ ID NO: 1178232 - DNA, 18 bp, Homo sapiens
cccagctcctctgagcca

SEQ ID NO: 1178233 - DNA, 13 bp, Homo sapiens
cccagctccttgg

SEQ ID NO: 1178234 - DNA, 14 bp, Homo sapiens
cccagctccttggc

SEQ ID NO: 1178235 - DNA, 20 bp, Homo sapiens
cccagctccttggctgcagc

SEQ ID NO: 1178236 - DNA, 22 bp, Homo sapiens
cccagctccttttgtccccagg

SEQ ID NO: 1178237 - DNA, 20 bp, Homo sapiens
cccagctctaagcagccagg

SEQ ID NO: 1178238 - DNA, 13 bp, Homo sapiens
cccagctctccca

SEQ ID NO: 1178239 - DNA, 14 bp, Homo sapiens
cccagctctccctc

SEQ ID NO: 1178240 - DNA, 15 bp, Homo sapiens
cccagctctccctct

SEQ ID NO: 1178241 - DNA, 18 bp, Homo sapiens
cccagctctccctctggc

SEQ ID NO: 1178242 - DNA, 23 bp, Homo sapiens
cccagctctccctctggccctgc

SEQ ID NO: 1178243 - DNA, 14 bp, Homo sapiens
cccagctctgaaac

SEQ ID NO: 1178244 - DNA, 22 bp, Homo sapiens
cccagctctgaaaccagtgtta

SEQ ID NO: 1178245 - DNA, 14 bp, Homo sapiens
cccagctctgaggc

SEQ ID NO: 1178246 - DNA, 13 bp, Homo sapiens
cccagctctggtg

SEQ ID NO: 1178247 - DNA, 15 bp, Homo sapiens
cccagctctggtgag

SEQ ID NO: 1178248 - DNA, 22 bp, Homo sapiens
cccagctctggtgagtcttggc

SEQ ID NO: 1178249 - DNA, 18 bp, Homo sapiens
cccagctcttgctctctt

SEQ ID NO: 1178250 - DNA, 15 bp, Homo sapiens
cccagctgacatgga

SEQ ID NO: 1178251 - DNA, 17 bp, Homo sapiens
cccagctgacatggaaa

SEQ ID NO: 1178252 - DNA, 11 bp, Homo sapiens
cccagctgcac

SEQ ID NO: 1178253 - DNA, 12 bp, Homo sapiens
cccagctgcacc

SEQ ID NO: 1178254 - DNA, 18 bp, Homo sapiens
cccagctgcacctgccag

SEQ ID NO: 1178255 - DNA, 13 bp, Homo sapiens
cccagctgccagg

SEQ ID NO: 1178256 - DNA, 14 bp, Homo sapiens
cccagctgccaggc

SEQ ID NO: 1178257 - DNA, 20 bp, Homo sapiens
cccagctgcgtttttttata

SEQ ID NO: 1178258 - DNA, 10 bp, Homo sapiens
cccagctgct

SEQ ID NO: 1178259 - DNA, 17 bp, Homo sapiens
cccagctgctcccctgg

SEQ ID NO: 1178260 - DNA, 11 bp, Homo sapiens
cccagctggcc

SEQ ID NO: 1178261 - DNA, 18 bp, Homo sapiens
cccagctgggaggcaaga

SEQ ID NO: 1178262 - DNA, 22 bp, Homo sapiens
cccagctgggaggcaagagggg

SEQ ID NO: 1178263 - DNA, 17 bp, Homo sapiens
cccagctgggctctgcc

SEQ ID NO: 1178264 - DNA, 19 bp, Homo sapiens
cccagctgggtcaggcagg

SEQ ID NO: 1178265 - DNA, 23 bp, Homo sapiens
cccagctggtcctgtggatggga

SEQ ID NO: 1178266 - DNA, 13 bp, Homo sapiens
cccagctgtagcc

SEQ ID NO: 1178267 - DNA, 14 bp, Homo sapiens
cccagctgtagcca

SEQ ID NO: 1178268 - DNA, 19 bp, Homo sapiens
cccagctgtagccatggct

SEQ ID NO: 1178269 - DNA, 20 bp, Homo sapiens
cccagctgtagccatggctc

SEQ ID NO: 1178270 - DNA, 21 bp, Homo sapiens
cccagctgtagccatggctca

SEQ ID NO: 1178271 - DNA, 23 bp, Homo sapiens
cccagctgtagccatggctcagg

SEQ ID NO: 1178272 - DNA, 11 bp, Homo sapiens
cccagctgttt

SEQ ID NO: 1178273 - DNA, 17 bp, Homo sapiens
cccagcttctctctccc

SEQ ID NO: 1178274 - DNA, 17 bp, Homo sapiens
cccagcttgctgagggg

SEQ ID NO: 1178275 - DNA, 22 bp, Homo sapiens
cccagcttgggcccagctgggc

SEQ ID NO: 1178276 - DNA, 23 bp, Homo sapiens
cccagcttgggcccagctgggct

SEQ ID NO: 1178277 - DNA, 19 bp, Homo sapiens
cccaggaaaggcaggattg

SEQ ID NO: 1178278 - DNA, 16 bp, Homo sapiens
cccaggaaaggcccag

SEQ ID NO: 1178279 - DNA, 13 bp, Homo sapiens
cccaggaagcagg

SEQ ID NO: 1178280 - DNA, 14 bp, Homo sapiens
cccaggaagcaggg

SEQ ID NO: 1178281 - DNA, 20 bp, Homo sapiens
cccaggaatagtggacatgg

SEQ ID NO: 1178282 - DNA, 22 bp, Homo sapiens
cccaggaatttgaagctgcagt

SEQ ID NO: 1178283 - DNA, 10 bp, Homo sapiens
cccaggacag

SEQ ID NO: 1178284 - DNA, 15 bp, Homo sapiens
cccaggaccaagcca

SEQ ID NO: 1178285 - DNA, 16 bp, Homo sapiens
cccaggaccagctggg

SEQ ID NO: 1178286 - DNA, 13 bp, Homo sapiens
cccaggacgccac

SEQ ID NO: 1178287 - DNA, 17 bp, Homo sapiens
cccaggacgcttctgaa

SEQ ID NO: 1178288 - DNA, 14 bp, Homo sapiens
cccaggagagccag

SEQ ID NO: 1178289 - DNA, 22 bp, Homo sapiens
cccaggagagccagccctccct

SEQ ID NO: 1178290 - DNA, 23 bp, Homo sapiens
cccaggagagcccccaccagcag

SEQ ID NO: 1178291 - DNA, 18 bp, Homo sapiens
cccaggagatgggtccag

SEQ ID NO: 1178292 - DNA, 14 bp, Homo sapiens
cccaggagctctgc

SEQ ID NO: 1178293 - DNA, 20 bp, Homo sapiens
cccaggagctgagtcacctc

SEQ ID NO: 1178294 - DNA, 21 bp, Homo sapiens
cccaggagctgagtcacctcc

SEQ ID NO: 1178295 - DNA, 23 bp, Homo sapiens
cccaggagctgagtcacctcctc

SEQ ID NO: 1178296 - DNA, 20 bp, Homo sapiens
cccaggaggaccgcctgccc

SEQ ID NO: 1178297 - DNA, 17 bp, Homo sapiens
cccaggatactggcaca

SEQ ID NO: 1178298 - DNA, 15 bp, Homo sapiens
cccaggattccccca

SEQ ID NO: 1178299 - DNA, 18 bp, Homo sapiens
cccaggattcccccagcc

SEQ ID NO: 1178300 - DNA, 19 bp, Homo sapiens
cccaggcaccaccaggagc

SEQ ID NO: 1178301 - DNA, 20 bp, Homo sapiens
cccaggcaccaccaggagca

SEQ ID NO: 1178302 - DNA, 17 bp, Homo sapiens
cccaggcactgggctcc

SEQ ID NO: 1178303 - DNA, 13 bp, Homo sapiens
cccaggcactgtt

SEQ ID NO: 1178304 - DNA, 14 bp, Homo sapiens
cccaggcagccacc

SEQ ID NO: 1178305 - DNA, 14 bp, Homo sapiens
cccaggcagcctca

SEQ ID NO: 1178306 - DNA, 13 bp, Homo sapiens
cccaggcagctat

SEQ ID NO: 1178307 - DNA, 23 bp, Homo sapiens
cccaggcagggccaacccttctc

SEQ ID NO: 1178308 - DNA, 20 bp, Homo sapiens
cccaggcaggtctgcaaggg

SEQ ID NO: 1178309 - DNA, 14 bp, Homo sapiens
cccaggcatctgtt

SEQ ID NO: 1178310 - DNA, 21 bp, Homo sapiens
cccaggcatctgttagcagag

SEQ ID NO: 1178311 - DNA, 22 bp, Homo sapiens
cccaggcatctgttagcagagt

SEQ ID NO: 1178312 - DNA, 14 bp, Homo sapiens
cccaggcatgcagc

SEQ ID NO: 1178313 - DNA, 21 bp, Homo sapiens
cccaggcatgcagctgcctgg

SEQ ID NO: 1178314 - DNA, 21 bp, Homo sapiens
cccaggcattgccaagggctt

SEQ ID NO: 1178315 - DNA, 13 bp, Homo sapiens
cccaggccagccc

SEQ ID NO: 1178316 - DNA, 18 bp, Homo sapiens
cccaggccagccccccca

SEQ ID NO: 1178317 - DNA, 12 bp, Homo sapiens
cccaggccaggt

SEQ ID NO: 1178318 - DNA, 21 bp, Homo sapiens
cccaggccatgtggcctgccc

SEQ ID NO: 1178319 - DNA, 22 bp, Homo sapiens
cccaggccatgtggcctgccca

SEQ ID NO: 1178320 - DNA, 13 bp, Homo sapiens
cccaggcccacca

SEQ ID NO: 1178321 - DNA, 23 bp, Homo sapiens
cccaggcccaccatcaccaccgc

SEQ ID NO: 1178322 - DNA, 18 bp, Homo sapiens
cccaggcccactgtgcct

SEQ ID NO: 1178323 - DNA, 16 bp, Homo sapiens
cccaggccccctgcat

SEQ ID NO: 1178324 - DNA, 17 bp, Homo sapiens
cccaggccctactaccc

SEQ ID NO: 1178325 - DNA, 16 bp, Homo sapiens
cccaggccctccatgg

SEQ ID NO: 1178326 - DNA, 20 bp, Homo sapiens
cccaggccctccatgggcta

SEQ ID NO: 1178327 - DNA, 18 bp, Homo sapiens
cccaggccctcccaccac

SEQ ID NO: 1178328 - DNA, 21 bp, Homo sapiens
cccaggccctcccaccacccc

SEQ ID NO: 1178329 - DNA, 15 bp, Homo sapiens
cccaggcccttggct

SEQ ID NO: 1178330 - DNA, 17 bp, Homo sapiens
gaatggtaaccgagcca

SEQ ID NO: 1178331 - DNA, 16 bp, Homo sapiens
gaattgcctgcagaga

SEQ ID NO: 1178332 - DNA, 16 bp, Homo sapiens
gaattggccatcttaa

SEQ ID NO: 1178333 - DNA, 14 bp, Homo sapiens
catggtgcctgaga

SEQ ID NO: 1178334 - DNA, 17 bp, Homo sapiens
catggtgcctgagaggc

SEQ ID NO: 1178335 - DNA, 13 bp, Homo sapiens
catggtgctagga

SEQ ID NO: 1178336 - DNA, 22 bp, Homo sapiens
catggtgctaggaagaggagtg

SEQ ID NO: 1178337 - DNA, 16 bp, Homo sapiens
catggtggacccagcg

SEQ ID NO: 1178338 - DNA, 18 bp, Homo sapiens
catggtggcgcaagcctg

SEQ ID NO: 1178339 - DNA, 20 bp, Homo sapiens
catggtggcgcaagcctgta

SEQ ID NO: 1178340 - DNA, 21 bp, Homo sapiens
catggtgggtccatgggcaga

SEQ ID NO: 1178341 - DNA, 12 bp, Homo sapiens
catggtgtatgt

SEQ ID NO: 1178342 - DNA, 15 bp, Homo sapiens
catggtgtggggggc

SEQ ID NO: 1178343 - DNA, 23 bp, Homo sapiens
catggtgtggggggctgggggag

SEQ ID NO: 1178344 - DNA, 15 bp, Homo sapiens
catggtgtgttacac

SEQ ID NO: 1178345 - DNA, 18 bp, Homo sapiens
catggttaccatgtcttt

SEQ ID NO: 1178346 - DNA, 19 bp, Homo sapiens
catggttaccatgtctttc

SEQ ID NO: 1178347 - DNA, 14 bp, Homo sapiens
catggttccttccc

SEQ ID NO: 1178348 - DNA, 20 bp, Homo sapiens
catggttccttccctgggaa

SEQ ID NO: 1178349 - DNA, 13 bp, Homo sapiens
catggttggggga

SEQ ID NO: 1178350 - DNA, 16 bp, Homo sapiens
catgtaaaagcggaaa

SEQ ID NO: 1178351 - DNA, 16 bp, Homo sapiens
catgtaaactatttgt

SEQ ID NO: 1178352 - DNA, 14 bp, Homo sapiens
catgtaaaggcctt

SEQ ID NO: 1178353 - DNA, 15 bp, Homo sapiens
catgtaaataagatg

SEQ ID NO: 1178354 - DNA, 18 bp, Homo sapiens
catgtaaatacaaatttt

SEQ ID NO: 1178355 - DNA, 21 bp, Homo sapiens
catgtaaatacaaattttgta

SEQ ID NO: 1178356 - DNA, 14 bp, Homo sapiens
catgtaaatgctca

SEQ ID NO: 1178357 - DNA, 13 bp, Homo sapiens
catgtaacattgg

SEQ ID NO: 1178358 - DNA, 22 bp, Homo sapiens
catgtaaccggcatgtttccag

SEQ ID NO: 1178359 - DNA, 17 bp, Homo sapiens
catgtaactatgtatca

SEQ ID NO: 1178360 - DNA, 19 bp, Homo sapiens
catgtaactatttcttcag

SEQ ID NO: 1178361 - DNA, 13 bp, Homo sapiens
catgtaactctcc

SEQ ID NO: 1178362 - DNA, 14 bp, Homo sapiens
catgtaactctcca

SEQ ID NO: 1178363 - DNA, 21 bp, Homo sapiens
catgtaactctccagccattg

SEQ ID NO: 1178364 - DNA, 15 bp, Homo sapiens
catgtaagaaaatgt

SEQ ID NO: 1178365 - DNA, 16 bp, Homo sapiens
catgtaataaattcaa

SEQ ID NO: 1178366 - DNA, 22 bp, Homo sapiens
catgtaataaattcaaaacctg

SEQ ID NO: 1178367 - DNA, 21 bp, Homo sapiens
catgtaataagcacttgcctg

SEQ ID NO: 1178368 - DNA, 23 bp, Homo sapiens
catgtaataagcacttgcctgga

SEQ ID NO: 1178369 - DNA, 14 bp, Homo sapiens
catgtaatcctcaa

SEQ ID NO: 1178370 - DNA, 21 bp, Homo sapiens
catgtaccatcaataaagtac

SEQ ID NO: 1178371 - DNA, 19 bp, Homo sapiens
catgtaccatttgcatggc

SEQ ID NO: 1178372 - DNA, 17 bp, Homo sapiens
catgtacctcccctgcc

SEQ ID NO: 1178373 - DNA, 22 bp, Homo sapiens
catgtactgagccttgtaattc

SEQ ID NO: 1178374 - DNA, 13 bp, Homo sapiens
catgtactgtagt

SEQ ID NO: 1178375 - DNA, 14 bp, Homo sapiens
catgtactgtagtt

SEQ ID NO: 1178376 - DNA, 22 bp, Homo sapiens
catgtactgtagtttttcttca

SEQ ID NO: 1178377 - DNA, 15 bp, Homo sapiens
catgtacttcctgtg

SEQ ID NO: 1178378 - DNA, 21 bp, Homo sapiens
catgtacttcctgtgtactct

SEQ ID NO: 1178379 - DNA, 13 bp, Homo sapiens
catgtacttgaag

SEQ ID NO: 1178380 - DNA, 15 bp, Homo sapiens
catgtacttgaagga

SEQ ID NO: 1178381 - DNA, 19 bp, Homo sapiens
catgtacttgaaggatgga

SEQ ID NO: 1178382 - DNA, 13 bp, Homo sapiens
catgtagagaaaa

SEQ ID NO: 1178383 - DNA, 14 bp, Homo sapiens
catgtagcaggact

SEQ ID NO: 1178384 - DNA, 20 bp, Homo sapiens
catgtagcaggactgaattg

SEQ ID NO: 1178385 - DNA, 18 bp, Homo sapiens
catgtaggtgagcctggg

SEQ ID NO: 1178386 - DNA, 21 bp, Homo sapiens
catgtaggtgagcctgggcag

SEQ ID NO: 1178387 - DNA, 23 bp, Homo sapiens
catgtaggtgagcctgggcagct

SEQ ID NO: 1178388 - DNA, 16 bp, Homo sapiens
catgtagtaacactaa

SEQ ID NO: 1178389 - DNA, 20 bp, Homo sapiens
catgtataaccaagtgtgct

SEQ ID NO: 1178390 - DNA, 21 bp, Homo sapiens
catgtatcccaactcctataa

SEQ ID NO: 1178391 - DNA, 16 bp, Homo sapiens
catgtattatcacatc

SEQ ID NO: 1178392 - DNA, 17 bp, Homo sapiens
catgtattggcctggag

SEQ ID NO: 1178393 - DNA, 15 bp, Homo sapiens
catgtatttcaggga

SEQ ID NO: 1178394 - DNA, 16 bp, Homo sapiens
catgtatttcagggac

SEQ ID NO: 1178395 - DNA, 18 bp, Homo sapiens
catgtatttcagggacct

SEQ ID NO: 1178396 - DNA, 20 bp, Homo sapiens
catgtatttcagggacctca

SEQ ID NO: 1178397 - DNA, 22 bp, Homo sapiens
catgtatttcagggacctcagg

SEQ ID NO: 1178398 - DNA, 23 bp, Homo sapiens
catgtatttcagggacctcaggg

SEQ ID NO: 1178399 - DNA, 12 bp, Homo sapiens
catgtattttat

SEQ ID NO: 1178400 - DNA, 20 bp, Homo sapiens
catgtcaccgtggaccttcc

SEQ ID NO: 1178401 - DNA, 14 bp, Homo sapiens
catgtcactgtggt

SEQ ID NO: 1178402 - DNA, 15 bp, Homo sapiens
catgtcactgtggtc

SEQ ID NO: 1178403 - DNA, 16 bp, Homo sapiens
catgtcagaggacccc

SEQ ID NO: 1178404 - DNA, 20 bp, Homo sapiens
catgtcagaggaccccaggg

SEQ ID NO: 1178405 - DNA, 21 bp, Homo sapiens
catgtcagataagtgtaaata

SEQ ID NO: 1178406 - DNA, 14 bp, Homo sapiens
catgtcagcaaaaa

SEQ ID NO: 1178407 - DNA, 16 bp, Homo sapiens
catgtcagcaaaaagc

SEQ ID NO: 1178408 - DNA, 17 bp, Homo sapiens
catgtccaaagaggctg

SEQ ID NO: 1178409 - DNA, 15 bp, Homo sapiens
catgtccaagttctt

SEQ ID NO: 1178410 - DNA, 19 bp, Homo sapiens
catgtccatacactttgtt

SEQ ID NO: 1178411 - DNA, 23 bp, Homo sapiens
catgtccatacactttgttgcaa

SEQ ID NO: 1178412 - DNA, 13 bp, Homo sapiens
catgtcccagatc

SEQ ID NO: 1178413 - DNA, 23 bp, Homo sapiens
catgtccctaccgagtctcttct

SEQ ID NO: 1178414 - DNA, 14 bp, Homo sapiens
catgtccctccagg

SEQ ID NO: 1178415 - DNA, 16 bp, Homo sapiens
catgtccctccaggga

SEQ ID NO: 1178416 - DNA, 20 bp, Homo sapiens
catgtcgcctctgcattcag

SEQ ID NO: 1178417 - DNA, 22 bp, Homo sapiens
catgtctataatcccagcactt

SEQ ID NO: 1178418 - DNA, 16 bp, Homo sapiens
catgtctattcagctt

SEQ ID NO: 1178419 - DNA, 17 bp, Homo sapiens
catgtctattcagcttc

SEQ ID NO: 1178420 - DNA, 14 bp, Homo sapiens
catgtctattgtcc

SEQ ID NO: 1178421 - DNA, 17 bp, Homo sapiens
catgtctctctgccaag

SEQ ID NO: 1178422 - DNA, 13 bp, Homo sapiens
catgtctctgctt

SEQ ID NO: 1178423 - DNA, 14 bp, Homo sapiens
catgtctctgcttc

SEQ ID NO: 1178424 - DNA, 16 bp, Homo sapiens
catgtctgcacctccg

SEQ ID NO: 1178425 - DNA, 17 bp, Homo sapiens
catgtctgcacctccgc

SEQ ID NO: 1178426 - DNA, 19 bp, Homo sapiens
catgtctgcacctccgctt

SEQ ID NO: 1178427 - DNA, 23 bp, Homo sapiens
catgtctgcatttcggtggctag

SEQ ID NO: 1178428 - DNA, 21 bp, Homo sapiens
catgtctgtaatcccagcaat

SEQ ID NO: 1178429 - DNA, 22 bp, Homo sapiens
catgtctgtatactcctgtcac

SEQ ID NO: 1178430 - DNA, 18 bp, Homo sapiens
catgtctgtcctcagagc

SEQ ID NO: 1178431 - DNA, 21 bp, Homo sapiens
catgtcttaaatgctcataaa

SEQ ID NO: 1178432 - DNA, 15 bp, Homo sapiens
catgtcttctgctgt

SEQ ID NO: 1178433 - DNA, 19 bp, Homo sapiens
catgtcttctgctgttctt

SEQ ID NO: 1178434 - DNA, 16 bp, Homo sapiens
catgtcttgtgcataa

SEQ ID NO: 1178435 - DNA, 17 bp, Homo sapiens
catgtcttgtgcataat

SEQ ID NO: 1178436 - DNA, 21 bp, Homo sapiens
catgtctttccacttctctgg

SEQ ID NO: 1178437 - DNA, 16 bp, Homo sapiens
catgtgaccactctgt

SEQ ID NO: 1178438 - DNA, 15 bp, Homo sapiens
catgtgaccattctg

SEQ ID NO: 1178439 - DNA, 19 bp, Homo sapiens
catgtgactagcgcctggc

SEQ ID NO: 1178440 - DNA, 18 bp, Homo sapiens
catgtgacttctcccctg

SEQ ID NO: 1178441 - DNA, 22 bp, Homo sapiens
catgtgagccaccgctgccagc

SEQ ID NO: 1178442 - DNA, 13 bp, Homo sapiens
catgtgagcctcg

SEQ ID NO: 1178443 - DNA, 22 bp, Homo sapiens
catgtgataactgattattact

SEQ ID NO: 1178444 - DNA, 23 bp, Homo sapiens
catgtgataactgattattactt

SEQ ID NO: 1178445 - DNA, 16 bp, Homo sapiens
catgtgatcacgcctg

SEQ ID NO: 1178446 - DNA, 20 bp, Homo sapiens
catgtgatggacactccagg

SEQ ID NO: 1178447 - DNA, 21 bp, Homo sapiens
catgtgatggacactccaggg

SEQ ID NO: 1178448 - DNA, 15 bp, Homo sapiens
catgtgatgtcatga

SEQ ID NO: 1178449 - DNA, 12 bp, Homo sapiens
catgtgattaat

SEQ ID NO: 1178450 - DNA, 16 bp, Homo sapiens
catgtgattaatgttt

SEQ ID NO: 1178451 - DNA, 20 bp, Homo sapiens
catgtgattaatgttttcat

SEQ ID NO: 1178452 - DNA, 22 bp, Homo sapiens
catgtgattcactgccttcctc

SEQ ID NO: 1178453 - DNA, 24 bp, Homo sapiens
catgtgccaagattctactcttgt

SEQ ID NO: 1178454 - DNA, 15 bp, Homo sapiens
catgtgccacacagt

SEQ ID NO: 1178455 - DNA, 19 bp, Homo sapiens
catgtgccatctgtacata

SEQ ID NO: 1178456 - DNA, 18 bp, Homo sapiens
catgtgccctcctgaggg

SEQ ID NO: 1178457 - DNA, 16 bp, Homo sapiens
catgtgcggctgaact

SEQ ID NO: 1178458 - DNA, 21 bp, Homo sapiens
catgtgcggctgaactgagaa

SEQ ID NO: 1178459 - DNA, 24 bp, Homo sapiens
catgtgcggctgaactgagaaggc

SEQ ID NO: 1178460 - DNA, 18 bp, Homo sapiens
catgtgctgccctacagc

SEQ ID NO: 1178461 - DNA, 19 bp, Homo sapiens
catgtgctgggaaatgcag

SEQ ID NO: 1178462 - DNA, 22 bp, Homo sapiens
catgtgctgtctccatgctgga

SEQ ID NO: 1178463 - DNA, 23 bp, Homo sapiens
catgtgctgtgaccatttataat

SEQ ID NO: 1178464 - DNA, 17 bp, Homo sapiens
catgtggaaagtgaatt

SEQ ID NO: 1178465 - DNA, 22 bp, Homo sapiens
catgtggaaagtgaatttgaat

SEQ ID NO: 1178466 - DNA, 17 bp, Homo sapiens
catgtggagacttcatc

SEQ ID NO: 1178467 - DNA, 22 bp, Homo sapiens
catgtggatatcagttaccaaa

SEQ ID NO: 1178468 - DNA, 20 bp, Homo sapiens
catgtggcaaaatatggttt

SEQ ID NO: 1178469 - DNA, 21 bp, Homo sapiens
catgtggcaaaatatggtttg

SEQ ID NO: 1178470 - DNA, 14 bp, Homo sapiens
catgtggcagccca

SEQ ID NO: 1178471 - DNA, 16 bp, Homo sapiens
catgtggcagcccatg

SEQ ID NO: 1178472 - DNA, 20 bp, Homo sapiens
catgtggccatggcctctgc

SEQ ID NO: 1178473 - DNA, 22 bp, Homo sapiens
catgtggccctccagtgtatga

SEQ ID NO: 1178474 - DNA, 16 bp, Homo sapiens
catgtggcctgcccag

SEQ ID NO: 1178475 - DNA, 19 bp, Homo sapiens
catgtggcctgcccagcct

SEQ ID NO: 1178476 - DNA, 20 bp, Homo sapiens
catgtggcctgcccagcctc

SEQ ID NO: 1178477 - DNA, 14 bp, Homo sapiens
catgtggcctgtgg

SEQ ID NO: 1178478 - DNA, 24 bp, Homo sapiens
catgtggcctttatctcaacggaa

SEQ ID NO: 1178479 - DNA, 11 bp, Homo sapiens
catgtggctga

SEQ ID NO: 1178480 - DNA, 15 bp, Homo sapiens
catgtggctgaagac

SEQ ID NO: 1178481 - DNA, 23 bp, Homo sapiens
catgtggcttctctgtctctgtg

SEQ ID NO: 1178482 - DNA, 21 bp, Homo sapiens
catgtggcttttttaaaaaag

SEQ ID NO: 1178483 - DNA, 15 bp, Homo sapiens
catgtgggcacggag

SEQ ID NO: 1178484 - DNA, 14 bp, Homo sapiens
catgtggggccagg

SEQ ID NO: 1178485 - DNA, 16 bp, Homo sapiens
catgtgggtgagccag

SEQ ID NO: 1178486 - DNA, 23 bp, Homo sapiens
catgtggtggcacaggccccctt

SEQ ID NO: 1178487 - DNA, 20 bp, Homo sapiens
catgtggtttatagagggcc

SEQ ID NO: 1178488 - DNA, 23 bp, Homo sapiens
catgtgtatgcgtgtccgtctgt

SEQ ID NO: 1178489 - DNA, 17 bp, Homo sapiens
catgtgtcccctcactc

SEQ ID NO: 1178490 - DNA, 15 bp, Homo sapiens
catgtgtcctggttc

SEQ ID NO: 1178491 - DNA, 14 bp, Homo sapiens
catgtgtgcatgtg

SEQ ID NO: 1178492 - DNA, 15 bp, Homo sapiens
catgtgtgcatgtga

SEQ ID NO: 1178493 - DNA, 18 bp, Homo sapiens
catgtgtgcatgtgagca

SEQ ID NO: 1178494 - DNA, 20 bp, Homo sapiens
catgtgtgcatgtgagcaca

SEQ ID NO: 1178495 - DNA, 13 bp, Homo sapiens
catgtgtgcctgt

SEQ ID NO: 1178496 - DNA, 19 bp, Homo sapiens
catgtgtgcgagtgtgtgc

SEQ ID NO: 1178497 - DNA, 21 bp, Homo sapiens
catgtgtggtacatggtgttt

SEQ ID NO: 1178498 - DNA, 15 bp, Homo sapiens
catgtgtgtgagttt

SEQ ID NO: 1178499 - DNA, 15 bp, Homo sapiens
catgtgtgtgctcag

SEQ ID NO: 1178500 - DNA, 18 bp, Homo sapiens
catgtgtgtgtctgtctt

SEQ ID NO: 1178501 - DNA, 20 bp, Homo sapiens
catgtgtgtgtctgtctttg

SEQ ID NO: 1178502 - DNA, 14 bp, Homo sapiens
catgtgttaaaata

SEQ ID NO: 1178503 - DNA, 21 bp, Homo sapiens
catgtgttggggagacatcaa

SEQ ID NO: 1178504 - DNA, 16 bp, Homo sapiens
catgtgttttcatcat

SEQ ID NO: 1178505 - DNA, 23 bp, Homo sapiens
catgtgttttcatcatttcagcc

SEQ ID NO: 1178506 - DNA, 13 bp, Homo sapiens
catgttaaatgac

SEQ ID NO: 1178507 - DNA, 15 bp, Homo sapiens
catgttaaatgactt

SEQ ID NO: 1178508 - DNA, 19 bp, Homo sapiens
catgttaagtcctccctga

SEQ ID NO: 1178509 - DNA, 17 bp, Homo sapiens
catgttactgaccagca

SEQ ID NO: 1178510 - DNA, 17 bp, Homo sapiens
catgttactgcttcatt

SEQ ID NO: 1178511 - DNA, 14 bp, Homo sapiens
catgttagccttag

SEQ ID NO: 1178512 - DNA, 19 bp, Homo sapiens
catgttaggaaaatttcac

SEQ ID NO: 1178513 - DNA, 21 bp, Homo sapiens
catgttagttaccttatagtt

SEQ ID NO: 1178514 - DNA, 20 bp, Homo sapiens
catgttatatattttttgta

SEQ ID NO: 1178515 - DNA, 12 bp, Homo sapiens
catgttatgttt

SEQ ID NO: 1178516 - DNA, 21 bp, Homo sapiens
catgttcattataatctcaaa

SEQ ID NO: 1178517 - DNA, 13 bp, Homo sapiens
catgttcctcaaa

SEQ ID NO: 1178518 - DNA, 21 bp, Homo sapiens
catgttcctcaaaagcaccct

SEQ ID NO: 1178519 - DNA, 20 bp, Homo sapiens
catgttctatttttgactgt

SEQ ID NO: 1178520 - DNA, 19 bp, Homo sapiens
catgttctcttcccaggcc

SEQ ID NO: 1178521 - DNA, 13 bp, Homo sapiens
catgttcttaatt

SEQ ID NO: 1178522 - DNA, 19 bp, Homo sapiens
catgttgagccaggcctgg

SEQ ID NO: 1178523 - DNA, 21 bp, Homo sapiens
catgttgatcatgtacttttt

SEQ ID NO: 1178524 - DNA, 17 bp, Homo sapiens
catgttgcatgcctatg

SEQ ID NO: 1178525 - DNA, 17 bp, Homo sapiens
catgttgcccctttctc

SEQ ID NO: 1178526 - DNA, 13 bp, Homo sapiens
catgttgctgaat

SEQ ID NO: 1178527 - DNA, 16 bp, Homo sapiens
catgttgctgaggagt

SEQ ID NO: 1178528 - DNA, 13 bp, Homo sapiens
catgttgctgcca

SEQ ID NO: 1178529 - DNA, 16 bp, Homo sapiens
catgttggaaatgtgt

SEQ ID NO: 1178530 - DNA, 18 bp, Homo sapiens
catgttggaaatgtgttt

SEQ ID NO: 1178531 - DNA, 17 bp, Homo sapiens
catgttggccaggctgg

SEQ ID NO: 1178532 - DNA, 13 bp, Homo sapiens
catgttggcctgt

SEQ ID NO: 1178533 - DNA, 16 bp, Homo sapiens
catgttggtcaggctg

SEQ ID NO: 1178534 - DNA, 22 bp, Homo sapiens
catgttggtcaggctggtctca

SEQ ID NO: 1178535 - DNA, 18 bp, Homo sapiens
ctgttcttccttcctaga

SEQ ID NO: 1178536 - DNA, 12 bp, Homo sapiens
ctgttcttgaag

SEQ ID NO: 1178537 - DNA, 16 bp, Homo sapiens
ctgttctttccaaagt

SEQ ID NO: 1178538 - DNA, 21 bp, Homo sapiens
ctgttctttccaaagtacact

SEQ ID NO: 1178539 - DNA, 15 bp, Homo sapiens
ctgttcttttttgta

SEQ ID NO: 1178540 - DNA, 21 bp, Homo sapiens
ctgttgaaaattattttaaac

SEQ ID NO: 1178541 - DNA, 22 bp, Homo sapiens
ctgttgaaaattattttaaaca

SEQ ID NO: 1178542 - DNA, 23 bp, Homo sapiens
ctgttgaaggtgccattttaaat

SEQ ID NO: 1178543 - DNA, 21 bp, Homo sapiens
ctgttgacacaggtctttcct

SEQ ID NO: 1178544 - DNA, 18 bp, Homo sapiens
ctgttgacatatttaatg

SEQ ID NO: 1178545 - DNA, 20 bp, Homo sapiens
ctgttgacatatttaatgtt

SEQ ID NO: 1178546 - DNA, 11 bp, Homo sapiens
ctgttgagaaa

SEQ ID NO: 1178547 - DNA, 13 bp, Homo sapiens
ctgttgagaaaac

SEQ ID NO: 1178548 - DNA, 19 bp, Homo sapiens
ctgttgagccccagtgctg

SEQ ID NO: 1178549 - DNA, 15 bp, Homo sapiens
ctgttgagctgtttt

SEQ ID NO: 1178550 - DNA, 16 bp, Homo sapiens
ctgttgaggtggctgt

SEQ ID NO: 1178551 - DNA, 14 bp, Homo sapiens
ctgttgataaaaac

SEQ ID NO: 1178552 - DNA, 23 bp, Homo sapiens
ctgttgatcccacttcactgtga

SEQ ID NO: 1178553 - DNA, 20 bp, Homo sapiens
ctgttgatctacccgtgcct

SEQ ID NO: 1178554 - DNA, 13 bp, Homo sapiens
ctgttgatgggaa

SEQ ID NO: 1178555 - DNA, 23 bp, Homo sapiens
ctgttgatgtatctgagttgcca

SEQ ID NO: 1178556 - DNA, 17 bp, Homo sapiens
ctgttgattatcttcag

SEQ ID NO: 1178557 - DNA, 18 bp, Homo sapiens
ctgttgattatcttcagc

SEQ ID NO: 1178558 - DNA, 23 bp, Homo sapiens
ctgttgattatcttcagcccagg

SEQ ID NO: 1178559 - DNA, 17 bp, Homo sapiens
ctgttgatttctttcca

SEQ ID NO: 1178560 - DNA, 19 bp, Homo sapiens
ctgttgcatttacttttaa

SEQ ID NO: 1178561 - DNA, 15 bp, Homo sapiens
ctgttgccatagccc

SEQ ID NO: 1178562 - DNA, 14 bp, Homo sapiens
ctgttgcctcatct

SEQ ID NO: 1178563 - DNA, 15 bp, Homo sapiens
ctgttgccttttaaa

SEQ ID NO: 1178564 - DNA, 16 bp, Homo sapiens
ctgttgcgctcccgca

SEQ ID NO: 1178565 - DNA, 14 bp, Homo sapiens
ctgttgctagggag

SEQ ID NO: 1178566 - DNA, 11 bp, Homo sapiens
ctgttgctcaa

SEQ ID NO: 1178567 - DNA, 21 bp, Homo sapiens
ctgttgctcaaatctattcag

SEQ ID NO: 1178568 - DNA, 14 bp, Homo sapiens
ctgttgctccagga

SEQ ID NO: 1178569 - DNA, 23 bp, Homo sapiens
ctgttgctccaggatgcattctg

SEQ ID NO: 1178570 - DNA, 15 bp, Homo sapiens
ctgttgctgaagtca

SEQ ID NO: 1178571 - DNA, 11 bp, Homo sapiens
ctgttgcttgt

SEQ ID NO: 1178572 - DNA, 22 bp, Homo sapiens
ctgttgctttaatatgagcttc

SEQ ID NO: 1178573 - DNA, 13 bp, Homo sapiens
ctgttggacagct

SEQ ID NO: 1178574 - DNA, 15 bp, Homo sapiens
ctgttggacagctgc

SEQ ID NO: 1178575 - DNA, 20 bp, Homo sapiens
ctgttggacccgctctggac

SEQ ID NO: 1178576 - DNA, 22 bp, Homo sapiens
ctgttggacccgctctggacca

SEQ ID NO: 1178577 - DNA, 14 bp, Homo sapiens
ctgttggcagctct

SEQ ID NO: 1178578 - DNA, 22 bp, Homo sapiens
ctgttggcaggcccactcccca

SEQ ID NO: 1178579 - DNA, 12 bp, Homo sapiens
ctgttggcctgt

SEQ ID NO: 1178580 - DNA, 14 bp, Homo sapiens
ctgttggcctgtgg

SEQ ID NO: 1178581 - DNA, 19 bp, Homo sapiens
ctgttggcctgtgggcctc

SEQ ID NO: 1178582 - DNA, 16 bp, Homo sapiens
ctgttgggctgaaccc

SEQ ID NO: 1178583 - DNA, 14 bp, Homo sapiens
ctgttggggagggg

SEQ ID NO: 1178584 - DNA, 19 bp, Homo sapiens
ctgttgggtttttgctgtt

SEQ ID NO: 1178585 - DNA, 16 bp, Homo sapiens
ctgttggtccactgtg

SEQ ID NO: 1178586 - DNA, 19 bp, Homo sapiens
ctgttggtcctctctctgt

SEQ ID NO: 1178587 - DNA, 23 bp, Homo sapiens
ctgttgtaaacaacgtgtatagt

SEQ ID NO: 1178588 - DNA, 21 bp, Homo sapiens
ctgttgtaagtaataatttgt

SEQ ID NO: 1178589 - DNA, 15 bp, Homo sapiens
ctgttgtagaagaca

SEQ ID NO: 1178590 - DNA, 22 bp, Homo sapiens
ctgttgtataaatttatttact

SEQ ID NO: 1178591 - DNA, 17 bp, Homo sapiens
ctgttgtccctctgcta

SEQ ID NO: 1178592 - DNA, 15 bp, Homo sapiens
ctgttgtcctcccct

SEQ ID NO: 1178593 - DNA, 20 bp, Homo sapiens
ctgttgtcctccccttgggc

SEQ ID NO: 1178594 - DNA, 13 bp, Homo sapiens
ctgttgttgttaa

SEQ ID NO: 1178595 - DNA, 22 bp, Homo sapiens
ctgtttaaagtcacatccctgt

SEQ ID NO: 1178596 - DNA, 15 bp, Homo sapiens
ctgtttaatgttctg

SEQ ID NO: 1178597 - DNA, 16 bp, Homo sapiens
ctgtttacctggcagt

SEQ ID NO: 1178598 - DNA, 15 bp, Homo sapiens
ctgtttactgctttt

SEQ ID NO: 1178599 - DNA, 17 bp, Homo sapiens
ctgtttagataatacac

SEQ ID NO: 1178600 - DNA, 18 bp, Homo sapiens
ctgtttagataatacacc

SEQ ID NO: 1178601 - DNA, 17 bp, Homo sapiens
ctgtttagcttcctcca

SEQ ID NO: 1178602 - DNA, 15 bp, Homo sapiens
ctgtttagttttaca

SEQ ID NO: 1178603 - DNA, 11 bp, Homo sapiens
ctgtttataat

SEQ ID NO: 1178604 - DNA, 18 bp, Homo sapiens
ctgtttataatctgaaga

SEQ ID NO: 1178605 - DNA, 12 bp, Homo sapiens
ctgtttatactt

SEQ ID NO: 1178606 - DNA, 13 bp, Homo sapiens
ctgtttatggcct

SEQ ID NO: 1178607 - DNA, 19 bp, Homo sapiens
ctgtttatggcctcagctg

SEQ ID NO: 1178608 - DNA, 14 bp, Homo sapiens
ctgtttattacttc

SEQ ID NO: 1178609 - DNA, 17 bp, Homo sapiens
ctgtttattcttccaga

SEQ ID NO: 1178610 - DNA, 18 bp, Homo sapiens
ctgtttattcttccagaa

SEQ ID NO: 1178611 - DNA, 19 bp, Homo sapiens
ctgtttattcttccagaat

SEQ ID NO: 1178612 - DNA, 23 bp, Homo sapiens
ctgtttattcttccagaatgctg

SEQ ID NO: 1178613 - DNA, 16 bp, Homo sapiens
ctgtttcaaagcacaa

SEQ ID NO: 1178614 - DNA, 13 bp, Homo sapiens
ctgtttcaaatgt

SEQ ID NO: 1178615 - DNA, 16 bp, Homo sapiens
ctgtttcagaggctca

SEQ ID NO: 1178616 - DNA, 16 bp, Homo sapiens
ctgtttcccaggccca

SEQ ID NO: 1178617 - DNA, 16 bp, Homo sapiens
ctgtttcctagctgtg

SEQ ID NO: 1178618 - DNA, 13 bp, Homo sapiens
ctgtttcctgggc

SEQ ID NO: 1178619 - DNA, 16 bp, Homo sapiens
ctgtttctaagaaaat

SEQ ID NO: 1178620 - DNA, 13 bp, Homo sapiens
ctgtttctcatga

SEQ ID NO: 1178621 - DNA, 13 bp, Homo sapiens
ctgtttctctgct

SEQ ID NO: 1178622 - DNA, 15 bp, Homo sapiens
ctgtttctctgctgt

SEQ ID NO: 1178623 - DNA, 15 bp, Homo sapiens
ctgtttctcttgagc

SEQ ID NO: 1178624 - DNA, 16 bp, Homo sapiens
ctgtttctcttgagct

SEQ ID NO: 1178625 - DNA, 22 bp, Homo sapiens
ctgtttctcttgagctggcctc

SEQ ID NO: 1178626 - DNA, 13 bp, Homo sapiens
ctgtttctctttg

SEQ ID NO: 1178627 - DNA, 17 bp, Homo sapiens
ctgtttctgcagccctt

SEQ ID NO: 1178628 - DNA, 15 bp, Homo sapiens
ctgtttcttgcactg

SEQ ID NO: 1178629 - DNA, 22 bp, Homo sapiens
ctgtttcttgcactgaatatat

SEQ ID NO: 1178630 - DNA, 16 bp, Homo sapiens
ctgtttcttgctctct

SEQ ID NO: 1178631 - DNA, 22 bp, Homo sapiens
ctgtttgaggatatattttcac

SEQ ID NO: 1178632 - DNA, 23 bp, Homo sapiens
ctgtttgaggatatattttcact

SEQ ID NO: 1178633 - DNA, 21 bp, Homo sapiens
ctgtttgatataccaaattaa

SEQ ID NO: 1178634 - DNA, 12 bp, Homo sapiens
ctgtttgatgta

SEQ ID NO: 1178635 - DNA, 12 bp, Homo sapiens
ctgtttgattct

SEQ ID NO: 1178636 - DNA, 13 bp, Homo sapiens
ctgtttgattctt

SEQ ID NO: 1178637 - DNA, 22 bp, Homo sapiens
ctgtttgcatttgatacatttt

SEQ ID NO: 1178638 - DNA, 22 bp, Homo sapiens
ctgtttgccacacccaggtgat

SEQ ID NO: 1178639 - DNA, 13 bp, Homo sapiens
ctgtttgctgtgc

SEQ ID NO: 1178640 - DNA, 11 bp, Homo sapiens
ctgtttggaaa

SEQ ID NO: 1178641 - DNA, 17 bp, Homo sapiens
ctgtttggaaaagacag

SEQ ID NO: 1178642 - DNA, 19 bp, Homo sapiens
ctgtttggatacagctgct

SEQ ID NO: 1178643 - DNA, 12 bp, Homo sapiens
cattgttccaca

SEQ ID NO: 1178644 - DNA, 14 bp, Homo sapiens
cattgttcccttcc

SEQ ID NO: 1178645 - DNA, 16 bp, Homo sapiens
cattgttcccttcctc

SEQ ID NO: 1178646 - DNA, 20 bp, Homo sapiens
cattgttcccttcctcttcc

SEQ ID NO: 1178647 - DNA, 19 bp, Homo sapiens
cattgttgtttttttaata

SEQ ID NO: 1178648 - DNA, 19 bp, Homo sapiens
cattgtttcaaaatagtca

SEQ ID NO: 1178649 - DNA, 19 bp, Homo sapiens
cattgtttgaaacaaagaa

SEQ ID NO: 1178650 - DNA, 20 bp, Homo sapiens
cattgtttgcttattgttcc

SEQ ID NO: 1178651 - DNA, 21 bp, Homo sapiens
cattgttttcttttacagact

SEQ ID NO: 1178652 - DNA, 14 bp, Homo sapiens
cattgtttttgtat

SEQ ID NO: 1178653 - DNA, 18 bp, Homo sapiens
catttaaaacagacactg

SEQ ID NO: 1178654 - DNA, 13 bp, Homo sapiens
catttaaaacatt

SEQ ID NO: 1178655 - DNA, 15 bp, Homo sapiens
catttaaaacatttg

SEQ ID NO: 1178656 - DNA, 21 bp, Homo sapiens
catttaaaagatacagttact

SEQ ID NO: 1178657 - DNA, 22 bp, Homo sapiens
catttaaaagcataaggccgga

SEQ ID NO: 1178658 - DNA, 14 bp, Homo sapiens
catttaaaatgatt

SEQ ID NO: 1178659 - DNA, 14 bp, Homo sapiens
catttaaaatggaa

SEQ ID NO: 1178660 - DNA, 20 bp, Homo sapiens
catttaaaattgctatgtta

SEQ ID NO: 1178661 - DNA, 23 bp, Homo sapiens
catttaaacccaatcagatgcct

SEQ ID NO: 1178662 - DNA, 14 bp, Homo sapiens
catttaaactaaat

SEQ ID NO: 1178663 - DNA, 17 bp, Homo sapiens
catttaaactaaattac

SEQ ID NO: 1178664 - DNA, 12 bp, Homo sapiens
catttaaactct

SEQ ID NO: 1178665 - DNA, 12 bp, Homo sapiens
catttaaacttt

SEQ ID NO: 1178666 - DNA, 15 bp, Homo sapiens
catttaaacttttta

SEQ ID NO: 1178667 - DNA, 17 bp, Homo sapiens
catttaaagctaaattt

SEQ ID NO: 1178668 - DNA, 22 bp, Homo sapiens
catttaaataaaactttccaaa

SEQ ID NO: 1178669 - DNA, 17 bp, Homo sapiens
catttaaatacagtctt

SEQ ID NO: 1178670 - DNA, 22 bp, Homo sapiens
catttaaatgtaacttattatt

SEQ ID NO: 1178671 - DNA, 21 bp, Homo sapiens
catttaaatgtgtacaatgta

SEQ ID NO: 1178672 - DNA, 15 bp, Homo sapiens
catttaaattccaca

SEQ ID NO: 1178673 - DNA, 12 bp, Homo sapiens
catttaaatttt

SEQ ID NO: 1178674 - DNA, 15 bp, Homo sapiens
catttaacattgttt

SEQ ID NO: 1178675 - DNA, 20 bp, Homo sapiens
catttaacattgtttttgta

SEQ ID NO: 1178676 - DNA, 19 bp, Homo sapiens
catttaacccccctgtaca

SEQ ID NO: 1178677 - DNA, 20 bp, Homo sapiens
catttaacccccctgtacac

SEQ ID NO: 1178678 - DNA, 21 bp, Homo sapiens
catttaacttacatttgtact

SEQ ID NO: 1178679 - DNA, 18 bp, Homo sapiens
catttaagaattgccagt

SEQ ID NO: 1178680 - DNA, 16 bp, Homo sapiens
catttaagagactctt

SEQ ID NO: 1178681 - DNA, 12 bp, Homo sapiens
catttaaggaga

SEQ ID NO: 1178682 - DNA, 16 bp, Homo sapiens
catttaaggagattgg

SEQ ID NO: 1178683 - DNA, 18 bp, Homo sapiens
catttaagggaaaaatat

SEQ ID NO: 1178684 - DNA, 20 bp, Homo sapiens
catttaagggaaagaaaatg

SEQ ID NO: 1178685 - DNA, 13 bp, Homo sapiens
catttaataaaac

SEQ ID NO: 1178686 - DNA, 12 bp, Homo sapiens
catttaataaag

SEQ ID NO: 1178687 - DNA, 20 bp, Homo sapiens
catttaataaagaaatattt

SEQ ID NO: 1178688 - DNA, 16 bp, Homo sapiens
catttaatcccaggaa

SEQ ID NO: 1178689 - DNA, 23 bp, Homo sapiens
catttaatttcaacctaaatact

SEQ ID NO: 1178690 - DNA, 14 bp, Homo sapiens
catttacaggaggg

SEQ ID NO: 1178691 - DNA, 20 bp, Homo sapiens
catttacaggagggcccgga

SEQ ID NO: 1178692 - DNA, 15 bp, Homo sapiens
catttacatagtgca

SEQ ID NO: 1178693 - DNA, 13 bp, Homo sapiens
catttaccaaatt

SEQ ID NO: 1178694 - DNA, 17 bp, Homo sapiens
catttaccaaattgctt

SEQ ID NO: 1178695 - DNA, 17 bp, Homo sapiens
catttactcttcttcat

SEQ ID NO: 1178696 - DNA, 22 bp, Homo sapiens
catttagaaaatagagctttta

SEQ ID NO: 1178697 - DNA, 12 bp, Homo sapiens
catttagaactt

SEQ ID NO: 1178698 - DNA, 21 bp, Homo sapiens
catttagaactttctgctttg

SEQ ID NO: 1178699 - DNA, 15 bp, Homo sapiens
catttagataatttg

SEQ ID NO: 1178700 - DNA, 21 bp, Homo sapiens
catttagcacaatttgagact

SEQ ID NO: 1178701 - DNA, 17 bp, Homo sapiens
catttagtcatgtgacc

SEQ ID NO: 1178702 - DNA, 13 bp, Homo sapiens
catttagtgtgaa

SEQ ID NO: 1178703 - DNA, 15 bp, Homo sapiens
catttagtgtgaata

SEQ ID NO: 1178704 - DNA, 20 bp, Homo sapiens
catttagttctttgttattt

SEQ ID NO: 1178705 - DNA, 23 bp, Homo sapiens
catttagtttgattattcagtgt

SEQ ID NO: 1178706 - DNA, 14 bp, Homo sapiens
catttataacccca

SEQ ID NO: 1178707 - DNA, 22 bp, Homo sapiens
catttataaccccagcctgacc

SEQ ID NO: 1178708 - DNA, 19 bp, Homo sapiens
catttatacctttgaaata

SEQ ID NO: 1178709 - DNA, 14 bp, Homo sapiens
catttatagaagaa

SEQ ID NO: 1178710 - DNA, 15 bp, Homo sapiens
catttatagaagaaa

SEQ ID NO: 1178711 - DNA, 15 bp, Homo sapiens
catttatatattgaa

SEQ ID NO: 1178712 - DNA, 22 bp, Homo sapiens
catttatatattgaattaatat

SEQ ID NO: 1178713 - DNA, 17 bp, Homo sapiens
catttatatttgtgtat

SEQ ID NO: 1178714 - DNA, 14 bp, Homo sapiens
catttatctataat

SEQ ID NO: 1178715 - DNA, 16 bp, Homo sapiens
catttatctataattt

SEQ ID NO: 1178716 - DNA, 21 bp, Homo sapiens
catttatctataatttaccta

SEQ ID NO: 1178717 - DNA, 22 bp, Homo sapiens
catttatctataatttacctaa

SEQ ID NO: 1178718 - DNA, 16 bp, Homo sapiens
catttatgttccttta

SEQ ID NO: 1178719 - DNA, 20 bp, Homo sapiens
catttattgtttgaaatgtc

SEQ ID NO: 1178720 - DNA, 18 bp, Homo sapiens
catttatttttagttaaa

SEQ ID NO: 1178721 - DNA, 19 bp, Homo sapiens
catttatttttagttaaaa

SEQ ID NO: 1178722 - DNA, 19 bp, Homo sapiens
catttattttttacattat

SEQ ID NO: 1178723 - DNA, 19 bp, Homo sapiens
catttattttttttaaaga

SEQ ID NO: 1178724 - DNA, 22 bp, Homo sapiens
catttattttttttaaagaaaa

SEQ ID NO: 1178725 - DNA, 23 bp, Homo sapiens
catttcaaaacaagatgtgtcat

SEQ ID NO: 1178726 - DNA, 16 bp, Homo sapiens
catttcaaaattaata

SEQ ID NO: 1178727 - DNA, 16 bp, Homo sapiens
catttcaaagctgagt

SEQ ID NO: 1178728 - DNA, 12 bp, Homo sapiens
catttcaatcat

SEQ ID NO: 1178729 - DNA, 19 bp, Homo sapiens
catttcaatgtcagccttt

SEQ ID NO: 1178730 - DNA, 22 bp, Homo sapiens
catttcaatgtcagcctttgtt

SEQ ID NO: 1178731 - DNA, 14 bp, Homo sapiens
catttcaatgtgta

SEQ ID NO: 1178732 - DNA, 18 bp, Homo sapiens
catttcaattcctggccc

SEQ ID NO: 1178733 - DNA, 13 bp, Homo sapiens
catttcacacagt

SEQ ID NO: 1178734 - DNA, 17 bp, Homo sapiens
catttcacgaactgttc

SEQ ID NO: 1178735 - DNA, 13 bp, Homo sapiens
catttcactgtct

SEQ ID NO: 1178736 - DNA, 23 bp, Homo sapiens
catttcagaaggtatcagttata

SEQ ID NO: 1178737 - DNA, 13 bp, Homo sapiens
catttcagaagtt

SEQ ID NO: 1178738 - DNA, 23 bp, Homo sapiens
catttcagaagttagtttgtata

SEQ ID NO: 1178739 - DNA, 18 bp, Homo sapiens
catttcagagggtaagta

SEQ ID NO: 1178740 - DNA, 12 bp, Homo sapiens
catttcagccaa

SEQ ID NO: 1178741 - DNA, 21 bp, Homo sapiens
catttcagcttgaacctgctt

SEQ ID NO: 1178742 - DNA, 23 bp, Homo sapiens
catttcaggccagtgtggtgtct

SEQ ID NO: 1178743 - DNA, 14 bp, Homo sapiens
catttcagtatcat

SEQ ID NO: 1178744 - DNA, 19 bp, Homo sapiens
catttcataaggcctgccc

SEQ ID NO: 1178745 - DNA, 22 bp, Homo sapiens
catttcataatttgtttccagc

SEQ ID NO: 1178746 - DNA, 15 bp, Homo sapiens
catttcatagtttca

SEQ ID NO: 1178747 - DNA, 17 bp, Homo sapiens
catttcatcattgtttc

SEQ ID NO: 1178748 - DNA, 18 bp, Homo sapiens
catttcatcattgtttct

SEQ ID NO: 1178749 - DNA, 20 bp, Homo sapiens
catttcatctatttctgaga

SEQ ID NO: 1178750 - DNA, 16 bp, Homo sapiens
catttcatctcattta

SEQ ID NO: 1178751 - DNA, 15 bp, Homo sapiens
catttcatctgggtg

SEQ ID NO: 1178752 - DNA, 15 bp, Homo sapiens
catttcatgaaaaag

SEQ ID NO: 1178753 - DNA, 21 bp, Homo sapiens
catttcattcaaatcagtgat

SEQ ID NO: 1178754 - DNA, 12 bp, Homo sapiens
catttcattcca

SEQ ID NO: 1178755 - DNA, 15 bp, Homo sapiens
catttcattccattg

SEQ ID NO: 1178756 - DNA, 18 bp, Homo sapiens
catttcattccattgcct

SEQ ID NO: 1178757 - DNA, 21 bp, Homo sapiens
catttcattccattgcctagc

SEQ ID NO: 1178758 - DNA, 15 bp, Homo sapiens
catttcattgtacaa

SEQ ID NO: 1178759 - DNA, 16 bp, Homo sapiens
catttcattgtatgat

SEQ ID NO: 1178760 - DNA, 23 bp, Homo sapiens
catttcattgtatgatgtgttgt

SEQ ID NO: 1178761 - DNA, 19 bp, Homo sapiens
catttccaaaccatcagct

SEQ ID NO: 1178762 - DNA, 21 bp, Homo sapiens
catttccaaaccatcagctgc

SEQ ID NO: 1178763 - DNA, 18 bp, Homo sapiens
catttccaaacttgaaaa

SEQ ID NO: 1178764 - DNA, 15 bp, Homo sapiens
catttccaaatgaac

SEQ ID NO: 1178765 - DNA, 13 bp, Homo sapiens
catttccaacagc

SEQ ID NO: 1178766 - DNA, 18 bp, Homo sapiens
catttccactgtatattt

SEQ ID NO: 1178767 - DNA, 12 bp, Homo sapiens
catttccagcct

SEQ ID NO: 1178768 - DNA, 16 bp, Homo sapiens
ctgtttgggcccctct

SEQ ID NO: 1178769 - DNA, 23 bp, Homo sapiens
ctgtttggtggggtggcacctgt

SEQ ID NO: 1178770 - DNA, 13 bp, Homo sapiens
ctgtttgtaaatt

SEQ ID NO: 1178771 - DNA, 16 bp, Homo sapiens
ctgtttgtaaattatt

SEQ ID NO: 1178772 - DNA, 19 bp, Homo sapiens
ctgtttgtaaattatttgc

SEQ ID NO: 1178773 - DNA, 21 bp, Homo sapiens
ctgtttgtaaattatttgcta

SEQ ID NO: 1178774 - DNA, 17 bp, Homo sapiens
ctgtttgtagtgaaata

SEQ ID NO: 1178775 - DNA, 19 bp, Homo sapiens
ctgtttgtgcaaacataat

SEQ ID NO: 1178776 - DNA, 14 bp, Homo sapiens
ctgtttgttaaaac

SEQ ID NO: 1178777 - DNA, 20 bp, Homo sapiens
ctgtttgttatctcttgtta

SEQ ID NO: 1178778 - DNA, 13 bp, Homo sapiens
ctgtttgttgact

SEQ ID NO: 1178779 - DNA, 15 bp, Homo sapiens
ctgtttgttgactta

SEQ ID NO: 1178780 - DNA, 14 bp, Homo sapiens
catttcctgctgaa

SEQ ID NO: 1178781 - DNA, 22 bp, Homo sapiens
catttcctgtacaatcatgaac

SEQ ID NO: 1178782 - DNA, 20 bp, Homo sapiens
catttcctgtgtttgtcctg

SEQ ID NO: 1178783 - DNA, 20 bp, Homo sapiens
catttcgggaagggcatgca

SEQ ID NO: 1178784 - DNA, 20 bp, Homo sapiens
catttctaacatatgtatta

SEQ ID NO: 1178785 - DNA, 19 bp, Homo sapiens
catttctaactctattaat

SEQ ID NO: 1178786 - DNA, 13 bp, Homo sapiens
catttctaattaa

SEQ ID NO: 1178787 - DNA, 18 bp, Homo sapiens
catttctactgtgactga

SEQ ID NO: 1178788 - DNA, 15 bp, Homo sapiens
catttctagactcaa

SEQ ID NO: 1178789 - DNA, 18 bp, Homo sapiens
catttctatttatttact

SEQ ID NO: 1178790 - DNA, 23 bp, Homo sapiens
catttctatttatttactgagct

SEQ ID NO: 1178791 - DNA, 22 bp, Homo sapiens
catttctatttcataatgaaaa

SEQ ID NO: 1178792 - DNA, 17 bp, Homo sapiens
catttctcaatcagtgc

SEQ ID NO: 1178793 - DNA, 13 bp, Homo sapiens
catttctcactga

SEQ ID NO: 1178794 - DNA, 15 bp, Homo sapiens
catttctcactgaaa

SEQ ID NO: 1178795 - DNA, 11 bp, Homo sapiens
catttctcagg

SEQ ID NO: 1178796 - DNA, 14 bp, Homo sapiens
catttctcatgctt

SEQ ID NO: 1178797 - DNA, 12 bp, Homo sapiens
catttctcatgt

SEQ ID NO: 1178798 - DNA, 15 bp, Homo sapiens
catttctctaagaga

SEQ ID NO: 1178799 - DNA, 13 bp, Homo sapiens
catttctctgctt

SEQ ID NO: 1178800 - DNA, 14 bp, Homo sapiens
catttctctgctta

SEQ ID NO: 1178801 - DNA, 19 bp, Homo sapiens
catttctcttctcagctct

SEQ ID NO: 1178802 - DNA, 14 bp, Homo sapiens
catttctctttaaa

SEQ ID NO: 1178803 - DNA, 15 bp, Homo sapiens
catttctgatgtctc

SEQ ID NO: 1178804 - DNA, 22 bp, Homo sapiens
catttctgccatgatgtttaca

SEQ ID NO: 1178805 - DNA, 17 bp, Homo sapiens
catttctgtatactgta

SEQ ID NO: 1178806 - DNA, 19 bp, Homo sapiens
catttctgtatactgtaaa

SEQ ID NO: 1178807 - DNA, 20 bp, Homo sapiens
catttctgtatactgtaaaa

SEQ ID NO: 1178808 - DNA, 16 bp, Homo sapiens
catttctgttctcatt

SEQ ID NO: 1178809 - DNA, 14 bp, Homo sapiens
catttcttaaatta

SEQ ID NO: 1178810 - DNA, 19 bp, Homo sapiens
catttcttctctctgttcc

SEQ ID NO: 1178811 - DNA, 20 bp, Homo sapiens
catttcttctctctgttccc

SEQ ID NO: 1178812 - DNA, 19 bp, Homo sapiens
catttcttggcattggaat

SEQ ID NO: 1178813 - DNA, 15 bp, Homo sapiens
catttcttgggccct

SEQ ID NO: 1178814 - DNA, 18 bp, Homo sapiens
catttcttgggccctcct

SEQ ID NO: 1178815 - DNA, 19 bp, Homo sapiens
catttctttcttccattcc

SEQ ID NO: 1178816 - DNA, 15 bp, Homo sapiens
catttctttcttgct

SEQ ID NO: 1178817 - DNA, 15 bp, Homo sapiens
catttctttgcttat

SEQ ID NO: 1178818 - DNA, 20 bp, Homo sapiens
catttctttgtctttttcct

SEQ ID NO: 1178819 - DNA, 21 bp, Homo sapiens
catttctttgtctttttccta

SEQ ID NO: 1178820 - DNA, 23 bp, Homo sapiens
catttctttgtctttttcctact

SEQ ID NO: 1178821 - DNA, 17 bp, Homo sapiens
catttgaaaattttgat

SEQ ID NO: 1178822 - DNA, 21 bp, Homo sapiens
catttgaaacccctgtaggcc

SEQ ID NO: 1178823 - DNA, 17 bp, Homo sapiens
catttgaacctggatcc

SEQ ID NO: 1178824 - DNA, 23 bp, Homo sapiens
catttgaacctggatccagcact

SEQ ID NO: 1178825 - DNA, 18 bp, Homo sapiens
catttgaagtgtacctgt

SEQ ID NO: 1178826 - DNA, 22 bp, Homo sapiens
catttgaatgagacctggaaca

SEQ ID NO: 1178827 - DNA, 17 bp, Homo sapiens
catttgacacaaagctt

SEQ ID NO: 1178828 - DNA, 21 bp, Homo sapiens
catttgacacaaagcttctaa

SEQ ID NO: 1178829 - DNA, 19 bp, Homo sapiens
catttgactgtctcacttt

SEQ ID NO: 1178830 - DNA, 14 bp, Homo sapiens
catttgagcccagg

SEQ ID NO: 1178831 - DNA, 18 bp, Homo sapiens
catttgaggaagctctcc

SEQ ID NO: 1178832 - DNA, 19 bp, Homo sapiens
catttgagggcccagccag

SEQ ID NO: 1178833 - DNA, 23 bp, Homo sapiens
catttgaggggccaggggcaggc

SEQ ID NO: 1178834 - DNA, 18 bp, Homo sapiens
catttgaggtctgttctt

SEQ ID NO: 1178835 - DNA, 16 bp, Homo sapiens
catttgatgtacatgt

SEQ ID NO: 1178836 - DNA, 14 bp, Homo sapiens
catttgattaacat

SEQ ID NO: 1178837 - DNA, 22 bp, Homo sapiens
catttgcaagggaaaagtctct

SEQ ID NO: 1178838 - DNA, 18 bp, Homo sapiens
catttgcaataacagctg

SEQ ID NO: 1178839 - DNA, 14 bp, Homo sapiens
catttgcacctctg

SEQ ID NO: 1178840 - DNA, 15 bp, Homo sapiens
catttgcacctctgt

SEQ ID NO: 1178841 - DNA, 20 bp, Homo sapiens
catttgcagggtcctcttct

SEQ ID NO: 1178842 - DNA, 22 bp, Homo sapiens
catttgcagggtcctcttctgg

SEQ ID NO: 1178843 - DNA, 14 bp, Homo sapiens
catttgcattgggc

SEQ ID NO: 1178844 - DNA, 17 bp, Homo sapiens
catttgcattgggcatt

SEQ ID NO: 1178845 - DNA, 13 bp, Homo sapiens
catttgccaagtg

SEQ ID NO: 1178846 - DNA, 14 bp, Homo sapiens
catttgccaagtga

SEQ ID NO: 1178847 - DNA, 20 bp, Homo sapiens
catttgccacttagtatttt

SEQ ID NO: 1178848 - DNA, 19 bp, Homo sapiens
catttgcctaattcctggc

SEQ ID NO: 1178849 - DNA, 16 bp, Homo sapiens
catttgccttgcagaa

SEQ ID NO: 1178850 - DNA, 22 bp, Homo sapiens
catttgccttgcagaactgcca

SEQ ID NO: 1178851 - DNA, 20 bp, Homo sapiens
catttgctaagtgtatgatg

SEQ ID NO: 1178852 - DNA, 19 bp, Homo sapiens
catttgctctttcatctct

SEQ ID NO: 1178853 - DNA, 17 bp, Homo sapiens
catttgctgatttctag

SEQ ID NO: 1178854 - DNA, 19 bp, Homo sapiens
catttgctgatttctagtg

SEQ ID NO: 1178855 - DNA, 15 bp, Homo sapiens
catttgctgttttaa

SEQ ID NO: 1178856 - DNA, 16 bp, Homo sapiens
catttgctttttcacc

SEQ ID NO: 1178857 - DNA, 16 bp, Homo sapiens
catttggaaccaaagt

SEQ ID NO: 1178858 - DNA, 17 bp, Homo sapiens
catttggaatacttttt

SEQ ID NO: 1178859 - DNA, 15 bp, Homo sapiens
catttggaatgaata

SEQ ID NO: 1178860 - DNA, 15 bp, Homo sapiens
catttggaggcaatc

SEQ ID NO: 1178861 - DNA, 16 bp, Homo sapiens
catttggccccagggg

SEQ ID NO: 1178862 - DNA, 17 bp, Homo sapiens
catttggccccagggga

SEQ ID NO: 1178863 - DNA, 16 bp, Homo sapiens
catttggcttgctgtt

SEQ ID NO: 1178864 - DNA, 20 bp, Homo sapiens
catttggcttgctgtttact

SEQ ID NO: 1178865 - DNA, 20 bp, Homo sapiens
catttgggagacatgtgaca

SEQ ID NO: 1178866 - DNA, 22 bp, Homo sapiens
catttgggctcagggttggcca

SEQ ID NO: 1178867 - DNA, 17 bp, Homo sapiens
catttggggtaatactt

SEQ ID NO: 1178868 - DNA, 20 bp, Homo sapiens
catttggtcaagattttgaa

SEQ ID NO: 1178869 - DNA, 22 bp, Homo sapiens
catttggtctgccagaatactg

SEQ ID NO: 1178870 - DNA, 21 bp, Homo sapiens
catttggtgagagtcaaagct

SEQ ID NO: 1178871 - DNA, 21 bp, Homo sapiens
catttggtggtactttattct

SEQ ID NO: 1178872 - DNA, 19 bp, Homo sapiens
catttggtgttcctggaag

SEQ ID NO: 1178873 - DNA, 20 bp, Homo sapiens
catttggtgttcctggaagc

SEQ ID NO: 1178874 - DNA, 22 bp, Homo sapiens
catttggtgttcctggaagcag

SEQ ID NO: 1178875 - DNA, 17 bp, Homo sapiens
catttggttaaatcatt

SEQ ID NO: 1178876 - DNA, 20 bp, Homo sapiens
catttggttcattaattcta

SEQ ID NO: 1178877 - DNA, 21 bp, Homo sapiens
catttggttcattaattctat

SEQ ID NO: 1178878 - DNA, 15 bp, Homo sapiens
catttgtaaaaatga

SEQ ID NO: 1178879 - DNA, 14 bp, Homo sapiens
catttgtaacttta

SEQ ID NO: 1178880 - DNA, 20 bp, Homo sapiens
catttgtaagtgtaaaaaat

SEQ ID NO: 1178881 - DNA, 16 bp, Homo sapiens
catttgtaataaagta

SEQ ID NO: 1178882 - DNA, 17 bp, Homo sapiens
catttgtaataaagtat

SEQ ID NO: 1178883 - DNA, 12 bp, Homo sapiens
catttgtacaag

SEQ ID NO: 1178884 - DNA, 15 bp, Homo sapiens
catttgtatattgtg

SEQ ID NO: 1178885 - DNA, 21 bp, Homo sapiens
catttgtattattttttaata

SEQ ID NO: 1178886 - DNA, 14 bp, Homo sapiens
catttgtcacagaa

SEQ ID NO: 1178887 - DNA, 21 bp, Homo sapiens
catttgtcagtatttttgccg

SEQ ID NO: 1178888 - DNA, 12 bp, Homo sapiens
catttgtcccag

SEQ ID NO: 1178889 - DNA, 21 bp, Homo sapiens
catttgtcccagactaaagga

SEQ ID NO: 1178890 - DNA, 16 bp, Homo sapiens
catttgtgaaatgatg

SEQ ID NO: 1178891 - DNA, 12 bp, Homo sapiens
catttgtgaggc

SEQ ID NO: 1178892 - DNA, 15 bp, Homo sapiens
catttgtgaggccca

SEQ ID NO: 1178893 - DNA, 22 bp, Homo sapiens
catttgtgccacacgcatgggc

SEQ ID NO: 1178894 - DNA, 16 bp, Homo sapiens
catttgtgccagagga

SEQ ID NO: 1178895 - DNA, 22 bp, Homo sapiens
cttaaattaaacaatttatttt

SEQ ID NO: 1178896 - DNA, 17 bp, Homo sapiens
cttaaattatgttttaa

SEQ ID NO: 1178897 - DNA, 19 bp, Homo sapiens
cttaaattcatttctagac

SEQ ID NO: 1178898 - DNA, 21 bp, Homo sapiens
cttaaattgcttttgttgtga

SEQ ID NO: 1178899 - DNA, 16 bp, Homo sapiens
cttaaattttaattta

SEQ ID NO: 1178900 - DNA, 20 bp, Homo sapiens
cttaaattttcttcctttga

SEQ ID NO: 1178901 - DNA, 22 bp, Homo sapiens
ctgtatttcactctttctccct

SEQ ID NO: 1178902 - DNA, 15 bp, Homo sapiens
ctgtatttcagtatt

SEQ ID NO: 1178903 - DNA, 16 bp, Homo sapiens
ctgtatttcagtattt

SEQ ID NO: 1178904 - DNA, 14 bp, Homo sapiens
ctgtatttcatgtg

SEQ ID NO: 1178905 - DNA, 19 bp, Homo sapiens
ctgtatttcatgtggctgt

SEQ ID NO: 1178906 - DNA, 15 bp, Homo sapiens
ctgtatttctttgta

SEQ ID NO: 1178907 - DNA, 17 bp, Homo sapiens
ctgtatttctttgtaga

SEQ ID NO: 1178908 - DNA, 22 bp, Homo sapiens
ctgtatttgaaataagaattca

SEQ ID NO: 1178909 - DNA, 16 bp, Homo sapiens
ctgtatttgctgttga

SEQ ID NO: 1178910 - DNA, 19 bp, Homo sapiens
ctgtattttaacactttgt

SEQ ID NO: 1178911 - DNA, 23 bp, Homo sapiens
ctgtattttaacactttgtatta

SEQ ID NO: 1178912 - DNA, 22 bp, Homo sapiens
ctgtattttatttagacaagag

SEQ ID NO: 1178913 - DNA, 23 bp, Homo sapiens
ctgtattttatttagacaagaga

SEQ ID NO: 1178914 - DNA, 20 bp, Homo sapiens
ctgtattttgtattgtttca

SEQ ID NO: 1178915 - DNA, 20 bp, Homo sapiens
ctgtattttgtttttgtctt

SEQ ID NO: 1178916 - DNA, 21 bp, Homo sapiens
ctgtatttttttttctaagag

SEQ ID NO: 1178917 - DNA, 16 bp, Homo sapiens
ctgtcaaaacactgtg

SEQ ID NO: 1178918 - DNA, 18 bp, Homo sapiens
ctgtcaaaacactgtgga

SEQ ID NO: 1178919 - DNA, 17 bp, Homo sapiens
ctgtcaaacaataaagg

SEQ ID NO: 1178920 - DNA, 13 bp, Homo sapiens
ctgtcaaatgaac

SEQ ID NO: 1178921 - DNA, 14 bp, Homo sapiens
ctgtcaaatgaact

SEQ ID NO: 1178922 - DNA, 23 bp, Homo sapiens
ctgtcaaatgaacttttacagaa

SEQ ID NO: 1178923 - DNA, 13 bp, Homo sapiens
ctgtcaaatgttt

SEQ ID NO: 1178924 - DNA, 19 bp, Homo sapiens
ctgtcaaatgtttccttaa

SEQ ID NO: 1178925 - DNA, 12 bp, Homo sapiens
ctgtcaagaaga

SEQ ID NO: 1178926 - DNA, 14 bp, Homo sapiens
ctgtcaagaagatg

SEQ ID NO: 1178927 - DNA, 19 bp, Homo sapiens
ctgtcaagagtagttatat

SEQ ID NO: 1178928 - DNA, 20 bp, Homo sapiens
ctgtcaagcatattggaaag

SEQ ID NO: 1178929 - DNA, 19 bp, Homo sapiens
ctgtcaaggccgagggcca

SEQ ID NO: 1178930 - DNA, 21 bp, Homo sapiens
ctgtcaaggccgagggccagg

SEQ ID NO: 1178931 - DNA, 14 bp, Homo sapiens
ctgtcaaggctcag

SEQ ID NO: 1178932 - DNA, 17 bp, Homo sapiens
ctgtcaaggctgcttag

SEQ ID NO: 1178933 - DNA, 20 bp, Homo sapiens
ctgtcaaggctgcttagaat

SEQ ID NO: 1178934 - DNA, 14 bp, Homo sapiens
ctgtcaagtacaag

SEQ ID NO: 1178935 - DNA, 20 bp, Homo sapiens
ctgtcaagttaacaaggaat

SEQ ID NO: 1178936 - DNA, 21 bp, Homo sapiens
ctgtcaagttaacaaggaatg

SEQ ID NO: 1178937 - DNA, 23 bp, Homo sapiens
ctgtcaataaatgacacccagac

SEQ ID NO: 1178938 - DNA, 19 bp, Homo sapiens
ctgtcaatttccctgactc

SEQ ID NO: 1178939 - DNA, 16 bp, Homo sapiens
ctgtcacaaccaagaa

SEQ ID NO: 1178940 - DNA, 12 bp, Homo sapiens
ctgtcacaataa

SEQ ID NO: 1178941 - DNA, 20 bp, Homo sapiens
ctgtcacaataaatggccag

SEQ ID NO: 1178942 - DNA, 15 bp, Homo sapiens
ctgtcacacactgga

SEQ ID NO: 1178943 - DNA, 16 bp, Homo sapiens
ctgtcacacactggac

SEQ ID NO: 1178944 - DNA, 22 bp, Homo sapiens
ctgtcacacactggaccccact

SEQ ID NO: 1178945 - DNA, 17 bp, Homo sapiens
ctgtcacactggtgctg

SEQ ID NO: 1178946 - DNA, 19 bp, Homo sapiens
ctgtcacactggtgctgag

SEQ ID NO: 1178947 - DNA, 15 bp, Homo sapiens
ctgtcacaggctggg

SEQ ID NO: 1178948 - DNA, 17 bp, Homo sapiens
ctgtcacaggctgggtc

SEQ ID NO: 1178949 - DNA, 18 bp, Homo sapiens
ctgtcacaggctgggtca

SEQ ID NO: 1178950 - DNA, 14 bp, Homo sapiens
ctgtcaccaagctc

SEQ ID NO: 1178951 - DNA, 16 bp, Homo sapiens
ctgtcaccaaggaaac

SEQ ID NO: 1178952 - DNA, 18 bp, Homo sapiens
ctgtcaccctccacctct

SEQ ID NO: 1178953 - DNA, 14 bp, Homo sapiens
ctgtcaccctgcag

SEQ ID NO: 1178954 - DNA, 17 bp, Homo sapiens
ctgtcacctgctcacag

SEQ ID NO: 1178955 - DNA, 19 bp, Homo sapiens
ctgtcacctgctcacaggg

SEQ ID NO: 1178956 - DNA, 15 bp, Homo sapiens
ctgtcacctgggagg

SEQ ID NO: 1178957 - DNA, 21 bp, Homo sapiens
ctgtcacgcggcagcttcagg

SEQ ID NO: 1178958 - DNA, 22 bp, Homo sapiens
ctgtcacgtggcttcatcagct

SEQ ID NO: 1178959 - DNA, 23 bp, Homo sapiens
ctgtcactcactgaggccatcag

SEQ ID NO: 1178960 - DNA, 21 bp, Homo sapiens
ctgtcactcattgctgagcct

SEQ ID NO: 1178961 - DNA, 24 bp, Homo sapiens
ctgtcactgctctggactgtgtgg

SEQ ID NO: 1178962 - DNA, 16 bp, Homo sapiens
ctgtcactggcagagc

SEQ ID NO: 1178963 - DNA, 20 bp, Homo sapiens
ctgtcactgtttctctgctg

SEQ ID NO: 1178964 - DNA, 23 bp, Homo sapiens
ctgtcacttcttcacctcttcca

SEQ ID NO: 1178965 - DNA, 22 bp, Homo sapiens
ctgtcagaagggggttgtggca

SEQ ID NO: 1178966 - DNA, 12 bp, Homo sapiens
ctgtcagaggct

SEQ ID NO: 1178967 - DNA, 13 bp, Homo sapiens
ctgtcagaggcta

SEQ ID NO: 1178968 - DNA, 15 bp, Homo sapiens
ctgtcagaggctaag

SEQ ID NO: 1178969 - DNA, 17 bp, Homo sapiens
ctgtcagatgagaacaa

SEQ ID NO: 1178970 - DNA, 22 bp, Homo sapiens
ctgtcagatgggaagacatgaa

SEQ ID NO: 1178971 - DNA, 21 bp, Homo sapiens
ctgtcagcaagactgaagatg

SEQ ID NO: 1178972 - DNA, 14 bp, Homo sapiens
ctgtcagcatctgg

SEQ ID NO: 1178973 - DNA, 16 bp, Homo sapiens
ctgtcagcatctggct

SEQ ID NO: 1178974 - DNA, 12 bp, Homo sapiens
ctgtcagccagc

SEQ ID NO: 1178975 - DNA, 23 bp, Homo sapiens
ctgtcagccagccgccctgggct

SEQ ID NO: 1178976 - DNA, 15 bp, Homo sapiens
ctgtcagcctgactc

SEQ ID NO: 1178977 - DNA, 12 bp, Homo sapiens
ctgtcagctgca

SEQ ID NO: 1178978 - DNA, 16 bp, Homo sapiens
catcttgctaccagta

SEQ ID NO: 1178979 - DNA, 14 bp, Homo sapiens
catcttgcttccct

SEQ ID NO: 1178980 - DNA, 16 bp, Homo sapiens
catcttggaactgcat

SEQ ID NO: 1178981 - DNA, 18 bp, Homo sapiens
catcttggggacatctct

SEQ ID NO: 1178982 - DNA, 20 bp, Homo sapiens
catcttggggacatctcttt

SEQ ID NO: 1178983 - DNA, 11 bp, Homo sapiens
catcttggggg

SEQ ID NO: 1178984 - DNA, 18 bp, Homo sapiens
catcttggtagttctgtg

SEQ ID NO: 1178985 - DNA, 23 bp, Homo sapiens
catcttggtagttctgtgcctcc

SEQ ID NO: 1178986 - DNA, 23 bp, Homo sapiens
catcttggttatttctgaaggta

SEQ ID NO: 1178987 - DNA, 17 bp, Homo sapiens
catcttgtatacacata

SEQ ID NO: 1178988 - DNA, 15 bp, Homo sapiens
catcttgtgagtgga

SEQ ID NO: 1178989 - DNA, 13 bp, Homo sapiens
catcttgtggggc

SEQ ID NO: 1178990 - DNA, 16 bp, Homo sapiens
catcttgtggggccag

SEQ ID NO: 1178991 - DNA, 20 bp, Homo sapiens
catcttgtggggccaggacc

SEQ ID NO: 1178992 - DNA, 19 bp, Homo sapiens
catctttaaacagtatttc

SEQ ID NO: 1178993 - DNA, 22 bp, Homo sapiens
catctttacaaaactacatgag

SEQ ID NO: 1178994 - DNA, 17 bp, Homo sapiens
catctttattgaacttg

SEQ ID NO: 1178995 - DNA, 23 bp, Homo sapiens
catctttcctcaagtatcttcta

SEQ ID NO: 1178996 - DNA, 15 bp, Homo sapiens
catctttgatccttc

SEQ ID NO: 1178997 - DNA, 17 bp, Homo sapiens
catctttgccttgggct

SEQ ID NO: 1178998 - DNA, 12 bp, Homo sapiens
catcttttattc

SEQ ID NO: 1178999 - DNA, 22 bp, Homo sapiens
catcttttctaatcacagtgtt

SEQ ID NO: 1179000 - DNA, 13 bp, Homo sapiens
catcttttgtatt

SEQ ID NO: 1179001 - DNA, 14 bp, Homo sapiens
catcttttgtatta

SEQ ID NO: 1179002 - DNA, 18 bp, Homo sapiens
catcttttgtattaagaa

SEQ ID NO: 1179003 - DNA, 19 bp, Homo sapiens
catcttttgtattaagaaa

SEQ ID NO: 1179004 - DNA, 16 bp, Homo sapiens
catcttttgtgagatg

SEQ ID NO: 1179005 - DNA, 22 bp, Homo sapiens
catctttttctagagttatctt

SEQ ID NO: 1179006 - DNA, 12 bp, Homo sapiens
catgaaaaagca

SEQ ID NO: 1179007 - DNA, 23 bp, Homo sapiens
catgaaaaagcagctaccaggtg

SEQ ID NO: 1179008 - DNA, 22 bp, Homo sapiens
catgaaaaatcatgggccagag

SEQ ID NO: 1179009 - DNA, 19 bp, Homo sapiens
catgaaaacacatttttct

SEQ ID NO: 1179010 - DNA, 22 bp, Homo sapiens
catgaaaaggattccttggtta

SEQ ID NO: 1179011 - DNA, 19 bp, Homo sapiens
catgaaaataccataggaa

SEQ ID NO: 1179012 - DNA, 14 bp, Homo sapiens
catgaaaattttaa

SEQ ID NO: 1179013 - DNA, 23 bp, Homo sapiens
catgaaagaacccaagacatcat

SEQ ID NO: 1179014 - DNA, 13 bp, Homo sapiens
catgaaataaaat

SEQ ID NO: 1179015 - DNA, 14 bp, Homo sapiens
catgaaataaaata

SEQ ID NO: 1179016 - DNA, 22 bp, Homo sapiens
catgaaatatagatcagttata

SEQ ID NO: 1179017 - DNA, 24 bp, Homo sapiens
catgaaattgtctagcagagcagg

SEQ ID NO: 1179018 - DNA, 18 bp, Homo sapiens
catgaacacactgtgtcc

SEQ ID NO: 1179019 - DNA, 20 bp, Homo sapiens
catgaacacactgtgtcctg

SEQ ID NO: 1179020 - DNA, 18 bp, Homo sapiens
catgaacacccttagaaa

SEQ ID NO: 1179021 - DNA, 22 bp, Homo sapiens
catgaacagaaaacattctgat

SEQ ID NO: 1179022 - DNA, 23 bp, Homo sapiens
catgaacagaaaacattctgatt

SEQ ID NO: 1179023 - DNA, 17 bp, Homo sapiens
catgaacagctctgaga

SEQ ID NO: 1179024 - DNA, 16 bp, Homo sapiens
catgaacatgttcctg

SEQ ID NO: 1179025 - DNA, 12 bp, Homo sapiens
catgaaccaaat

SEQ ID NO: 1179026 - DNA, 16 bp, Homo sapiens
catgaaccaaatggtt

SEQ ID NO: 1179027 - DNA, 23 bp, Homo sapiens
ctgtcccaatcttaccagatgct

SEQ ID NO: 1179028 - DNA, 14 bp, Homo sapiens
ctgtcccaccaact

SEQ ID NO: 1179029 - DNA, 14 bp, Homo sapiens
ctgtcccacccaca

SEQ ID NO: 1179030 - DNA, 16 bp, Homo sapiens
ctgtcccacccacaca

SEQ ID NO: 1179031 - DNA, 20 bp, Homo sapiens
ctgtcccacccacacagctg

SEQ ID NO: 1179032 - DNA, 22 bp, Homo sapiens
ctgtcccacccacacagctgcc

SEQ ID NO: 1179033 - DNA, 15 bp, Homo sapiens
ctgtcccaccgggag

SEQ ID NO: 1179034 - DNA, 21 bp, Homo sapiens
ctgtcccaccgggagcctccc

SEQ ID NO: 1179035 - DNA, 22 bp, Homo sapiens
ctgtcccaccgggagcctcccc

SEQ ID NO: 1179036 - DNA, 23 bp, Homo sapiens
ctgtcccacctcttctcttcctg

SEQ ID NO: 1179037 - DNA, 12 bp, Homo sapiens
ctgtcccacctg

SEQ ID NO: 1179038 - DNA, 14 bp, Homo sapiens
ctgtcccacctggc

SEQ ID NO: 1179039 - DNA, 15 bp, Homo sapiens
ctgtcccacctggct

SEQ ID NO: 1179040 - DNA, 11 bp, Homo sapiens
ctgtcccagag

SEQ ID NO: 1179041 - DNA, 12 bp, Homo sapiens
ctgtcccagagg

SEQ ID NO: 1179042 - DNA, 12 bp, Homo sapiens
ctgtcccaggac

SEQ ID NO: 1179043 - DNA, 13 bp, Homo sapiens
ctgtcccaggact

SEQ ID NO: 1179044 - DNA, 15 bp, Homo sapiens
ctgtcccaggactca

SEQ ID NO: 1179045 - DNA, 22 bp, Homo sapiens
ctgtcccaggactcaccctcca

SEQ ID NO: 1179046 - DNA, 13 bp, Homo sapiens
ctgtcccaggcat

SEQ ID NO: 1179047 - DNA, 23 bp, Homo sapiens
ctgtcccaggcatgcagctgcct

SEQ ID NO: 1179048 - DNA, 21 bp, Homo sapiens
ctgtcccaggccggcccagat

SEQ ID NO: 1179049 - DNA, 21 bp, Homo sapiens
ctgtcccatctggtcatttgg

SEQ ID NO: 1179050 - DNA, 18 bp, Homo sapiens
ctgtcccatggacactcc

SEQ ID NO: 1179051 - DNA, 13 bp, Homo sapiens
ctgtcccattccc

SEQ ID NO: 1179052 - DNA, 16 bp, Homo sapiens
ctgtcccattccctgg

SEQ ID NO: 1179053 - DNA, 15 bp, Homo sapiens
ctgtcccattctaga

SEQ ID NO: 1179054 - DNA, 17 bp, Homo sapiens
ctgtcccattctagatc

SEQ ID NO: 1179055 - DNA, 21 bp, Homo sapiens
ctgtcccattctagatcctgc

SEQ ID NO: 1179056 - DNA, 22 bp, Homo sapiens
ctgtcccattctagatcctgca

SEQ ID NO: 1179057 - DNA, 16 bp, Homo sapiens
ctgtccccaaacagga

SEQ ID NO: 1179058 - DNA, 18 bp, Homo sapiens
ctgtccccaccctccact

SEQ ID NO: 1179059 - DNA, 16 bp, Homo sapiens
ctgtccccacgagggg

SEQ ID NO: 1179060 - DNA, 12 bp, Homo sapiens
ctgtccccagac

SEQ ID NO: 1179061 - DNA, 18 bp, Homo sapiens
ctgtccccagaccaaccc

SEQ ID NO: 1179062 - DNA, 19 bp, Homo sapiens
ctgtccccagaccaaccct

SEQ ID NO: 1179063 - DNA, 22 bp, Homo sapiens
ctgtccccagaccaaccctggg

SEQ ID NO: 1179064 - DNA, 14 bp, Homo sapiens
ctgtccccagccct

SEQ ID NO: 1179065 - DNA, 17 bp, Homo sapiens
ctgtccccagccctgtc

SEQ ID NO: 1179066 - DNA, 13 bp, Homo sapiens
ctgtccccaggcc

SEQ ID NO: 1179067 - DNA, 16 bp, Homo sapiens
ctgtccccaggcctgg

SEQ ID NO: 1179068 - DNA, 19 bp, Homo sapiens
ctgtccccaggcctggctc

SEQ ID NO: 1179069 - DNA, 16 bp, Homo sapiens
ctgtccccagtcccca

SEQ ID NO: 1179070 - DNA, 21 bp, Homo sapiens
ctgtccccagtccccagccct

SEQ ID NO: 1179071 - DNA, 23 bp, Homo sapiens
ctgtccccagtccccagccctgg

SEQ ID NO: 1179072 - DNA, 18 bp, Homo sapiens
ctgtcccccactctctca

SEQ ID NO: 1179073 - DNA, 23 bp, Homo sapiens
ctgtccccctcccctcccagtcc

SEQ ID NO: 1179074 - DNA, 16 bp, Homo sapiens
ctgtccccgccttccc

SEQ ID NO: 1179075 - DNA, 13 bp, Homo sapiens
ctgtcccctctcc

SEQ ID NO: 1179076 - DNA, 15 bp, Homo sapiens
ctgtcccgccttcct

SEQ ID NO: 1179077 - DNA, 23 bp, Homo sapiens
ctgtccctcaaatgacccaaaga

SEQ ID NO: 1179078 - DNA, 12 bp, Homo sapiens
ctgtccctcact

SEQ ID NO: 1179079 - DNA, 15 bp, Homo sapiens
ctgtccctcatggag

SEQ ID NO: 1179080 - DNA, 15 bp, Homo sapiens
ctgtccctccccctt

SEQ ID NO: 1179081 - DNA, 17 bp, Homo sapiens
ctgtccctccgggacct

SEQ ID NO: 1179082 - DNA, 15 bp, Homo sapiens
ctgtccctgaaacct

SEQ ID NO: 1179083 - DNA, 16 bp, Homo sapiens
ctgtccctgccccgcc

SEQ ID NO: 1179084 - DNA, 18 bp, Homo sapiens
ctgtccctgccccgcccc

SEQ ID NO: 1179085 - DNA, 22 bp, Homo sapiens
ctgtccctgccccgccccccag

SEQ ID NO: 1179086 - DNA, 13 bp, Homo sapiens
ctgtccctgtagc

SEQ ID NO: 1179087 - DNA, 11 bp, Homo sapiens
ctgtccctgtc

SEQ ID NO: 1179088 - DNA, 12 bp, Homo sapiens
ctgtccctgtcc

SEQ ID NO: 1179089 - DNA, 17 bp, Homo sapiens
ctgtccctgtccctgcc

SEQ ID NO: 1179090 - DNA, 18 bp, Homo sapiens
ctgtccctgtccctgccc

SEQ ID NO: 1179091 - DNA, 13 bp, Homo sapiens
ctgtccctgtcct

SEQ ID NO: 1179092 - DNA, 16 bp, Homo sapiens
ctgtcccttccccttc

SEQ ID NO: 1179093 - DNA, 17 bp, Homo sapiens
ctgtcccttccccttca

SEQ ID NO: 1179094 - DNA, 23 bp, Homo sapiens
ctgtcccttccccttcaccgctc

SEQ ID NO: 1179095 - DNA, 19 bp, Homo sapiens
ctgtcccttcgagtccagg

SEQ ID NO: 1179096 - DNA, 16 bp, Homo sapiens
ctgtcccttctcttaa

SEQ ID NO: 1179097 - DNA, 21 bp, Homo sapiens
ctgtcccttctcttaatttaa

SEQ ID NO: 1179098 - DNA, 13 bp, Homo sapiens
ctgtcccttgcct

SEQ ID NO: 1179099 - DNA, 16 bp, Homo sapiens
ctgtccgcctctgccc

SEQ ID NO: 1179100 - DNA, 17 bp, Homo sapiens
catgagaccactgttat

SEQ ID NO: 1179101 - DNA, 14 bp, Homo sapiens
catgagactttctg

SEQ ID NO: 1179102 - DNA, 15 bp, Homo sapiens
catgagactttctgc

SEQ ID NO: 1179103 - DNA, 16 bp, Homo sapiens
catgagcaccccaagg

SEQ ID NO: 1179104 - DNA, 23 bp, Homo sapiens
catgagcctgctggaagcccagc

SEQ ID NO: 1179105 - DNA, 16 bp, Homo sapiens
catgagctatttccat

SEQ ID NO: 1179106 - DNA, 23 bp, Homo sapiens
catgagctatttccattccagaa

SEQ ID NO: 1179107 - DNA, 17 bp, Homo sapiens
catgagctccagacccc

SEQ ID NO: 1179108 - DNA, 14 bp, Homo sapiens
catgagctgctcat

SEQ ID NO: 1179109 - DNA, 19 bp, Homo sapiens
catgagctgctcattacag

SEQ ID NO: 1179110 - DNA, 19 bp, Homo sapiens
catgagctgctgtgcccag

SEQ ID NO: 1179111 - DNA, 21 bp, Homo sapiens
catgagctgctgtgcccagcc

SEQ ID NO: 1179112 - DNA, 15 bp, Homo sapiens
catgaggaaggaaca

SEQ ID NO: 1179113 - DNA, 21 bp, Homo sapiens
catgaggacatgatggagcgc

SEQ ID NO: 1179114 - DNA, 15 bp, Homo sapiens
catgaggaccagggt

SEQ ID NO: 1179115 - DNA, 20 bp, Homo sapiens
catgaggactctattcttta

SEQ ID NO: 1179116 - DNA, 12 bp, Homo sapiens
catgaggagggt

SEQ ID NO: 1179117 - DNA, 15 bp, Homo sapiens
catgaggagttgctg

SEQ ID NO: 1179118 - DNA, 18 bp, Homo sapiens
catgaggatttctttatg

SEQ ID NO: 1179119 - DNA, 16 bp, Homo sapiens
catgaggccactgctg

SEQ ID NO: 1179120 - DNA, 21 bp, Homo sapiens
catgaggccatctcaggagat

SEQ ID NO: 1179121 - DNA, 21 bp, Homo sapiens
catgaggcctcagtggacttt

SEQ ID NO: 1179122 - DNA, 19 bp, Homo sapiens
catgagggatcacagggcc

SEQ ID NO: 1179123 - DNA, 18 bp, Homo sapiens
catgaggggagaggagac

SEQ ID NO: 1179124 - DNA, 22 bp, Homo sapiens
catgaggtactggtcccttcct

SEQ ID NO: 1179125 - DNA, 17 bp, Homo sapiens
catgagtatctgtggga

SEQ ID NO: 1179126 - DNA, 20 bp, Homo sapiens
catgagtattcctagcaaat

SEQ ID NO: 1179127 - DNA, 21 bp, Homo sapiens
catgagtctgtaggagcaagg

SEQ ID NO: 1179128 - DNA, 18 bp, Homo sapiens
catgagttatcatgaatt

SEQ ID NO: 1179129 - DNA, 23 bp, Homo sapiens
catgagttatcatgaattttaaa

SEQ ID NO: 1179130 - DNA, 21 bp, Homo sapiens
catgagttggggtctggcagc

SEQ ID NO: 1179131 - DNA, 22 bp, Homo sapiens
catgagttttttctcttgggct

SEQ ID NO: 1179132 - DNA, 13 bp, Homo sapiens
catgataaatgat

SEQ ID NO: 1179133 - DNA, 18 bp, Homo sapiens
catgataatgaacagaac

SEQ ID NO: 1179134 - DNA, 20 bp, Homo sapiens
catgataccacctttactgt

SEQ ID NO: 1179135 - DNA, 21 bp, Homo sapiens
catgataccacctttactgtg

SEQ ID NO: 1179136 - DNA, 14 bp, Homo sapiens
catgatataacttt

SEQ ID NO: 1179137 - DNA, 18 bp, Homo sapiens
catgatataactttagaa

SEQ ID NO: 1179138 - DNA, 16 bp, Homo sapiens
catgatatcttcaagc

SEQ ID NO: 1179139 - DNA, 19 bp, Homo sapiens
catgatcaagatatatgtg

SEQ ID NO: 1179140 - DNA, 20 bp, Homo sapiens
catgatcaagatatatgtgt

SEQ ID NO: 1179141 - DNA, 20 bp, Homo sapiens
catgatcagacatacagctg

SEQ ID NO: 1179142 - DNA, 13 bp, Homo sapiens
catgatctccctg

SEQ ID NO: 1179143 - DNA, 16 bp, Homo sapiens
catgatctccctgccg

SEQ ID NO: 1179144 - DNA, 23 bp, Homo sapiens
catgatctgtatttaatggtttt

SEQ ID NO: 1179145 - DNA, 21 bp, Homo sapiens
catgatcttgtgacatattat

SEQ ID NO: 1179146 - DNA, 15 bp, Homo sapiens
catgatgatctgcct

SEQ ID NO: 1179147 - DNA, 12 bp, Homo sapiens
catgatgccctc

SEQ ID NO: 1179148 - DNA, 20 bp, Homo sapiens
catgatgccctcccctcagc

SEQ ID NO: 1179149 - DNA, 21 bp, Homo sapiens
catgatgccctcccctcagcg

SEQ ID NO: 1179150 - DNA, 18 bp, Homo sapiens
catgatggagcgcacctg

SEQ ID NO: 1179151 - DNA, 19 bp, Homo sapiens
catgatggagcgcacctgc

SEQ ID NO: 1179152 - DNA, 19 bp, Homo sapiens
catgatggagtcaggtttg

SEQ ID NO: 1179153 - DNA, 23 bp, Homo sapiens
catgatggagtcaggtttggggt

SEQ ID NO: 1179154 - DNA, 16 bp, Homo sapiens
ctgtccttcagatgga

SEQ ID NO: 1179155 - DNA, 21 bp, Homo sapiens
ctgtccttccccttccccgtc

SEQ ID NO: 1179156 - DNA, 12 bp, Homo sapiens
ctgtccttccct

SEQ ID NO: 1179157 - DNA, 20 bp, Homo sapiens
ctgtccttgaaggactaata

SEQ ID NO: 1179158 - DNA, 18 bp, Homo sapiens
ctgtccttgttcatggag

SEQ ID NO: 1179159 - DNA, 15 bp, Homo sapiens
ctgtcctttcttgca

SEQ ID NO: 1179160 - DNA, 22 bp, Homo sapiens
ctgtcctttgcaattgctcttc

SEQ ID NO: 1179161 - DNA, 23 bp, Homo sapiens
ctgtcctttgcaattgctcttct

SEQ ID NO: 1179162 - DNA, 19 bp, Homo sapiens
ctgtccttttaggaatatg

SEQ ID NO: 1179163 - DNA, 15 bp, Homo sapiens
ctgtcgattagactg

SEQ ID NO: 1179164 - DNA, 20 bp, Homo sapiens
ctgtcgccaccacttccaga

SEQ ID NO: 1179165 - DNA, 20 bp, Homo sapiens
ctgtcgcccacccagctggt

SEQ ID NO: 1179166 - DNA, 17 bp, Homo sapiens
ctgtcgctcaggctgga

SEQ ID NO: 1179167 - DNA, 16 bp, Homo sapiens
ctgtcgctctcagttc

SEQ ID NO: 1179168 - DNA, 14 bp, Homo sapiens
ctgtcggagaggct

SEQ ID NO: 1179169 - DNA, 17 bp, Homo sapiens
ctgtcgggaccacatct

SEQ ID NO: 1179170 - DNA, 19 bp, Homo sapiens
ctgtcgggaccacatctgt

SEQ ID NO: 1179171 - DNA, 16 bp, Homo sapiens
ctgtcggtggctgcct

SEQ ID NO: 1179172 - DNA, 17 bp, Homo sapiens
ctgtcggtggctgcctt

SEQ ID NO: 1179173 - DNA, 20 bp, Homo sapiens
ctgtcggtggctgcctttga

SEQ ID NO: 1179174 - DNA, 20 bp, Homo sapiens
ctgtcgtctgactctgggtt

SEQ ID NO: 1179175 - DNA, 21 bp, Homo sapiens
ctgtcgtgatggggcaagggc

SEQ ID NO: 1179176 - DNA, 12 bp, Homo sapiens
ctgtcgtgccag

SEQ ID NO: 1179177 - DNA, 15 bp, Homo sapiens
ctgtcgtgccagtcc

SEQ ID NO: 1179178 - DNA, 16 bp, Homo sapiens
ctgtcgtgccagtcct

SEQ ID NO: 1179179 - DNA, 17 bp, Homo sapiens
ctgtcgtgccagtcctg

SEQ ID NO: 1179180 - DNA, 19 bp, Homo sapiens
ctgtcgtgccagtcctggg

SEQ ID NO: 1179181 - DNA, 16 bp, Homo sapiens
ctgtcgtggagccatt

SEQ ID NO: 1179182 - DNA, 15 bp, Homo sapiens
ctgtcgttaaaaaca

SEQ ID NO: 1179183 - DNA, 13 bp, Homo sapiens
ctgtctaaaaaac

SEQ ID NO: 1179184 - DNA, 13 bp, Homo sapiens
ctgtctaaagcct

SEQ ID NO: 1179185 - DNA, 16 bp, Homo sapiens
ctgtctaaagccttaa

SEQ ID NO: 1179186 - DNA, 15 bp, Homo sapiens
ctgtctactgtggtg

SEQ ID NO: 1179187 - DNA, 13 bp, Homo sapiens
ctgtctagagagg

SEQ ID NO: 1179188 - DNA, 12 bp, Homo sapiens
ctgtctagagta

SEQ ID NO: 1179189 - DNA, 15 bp, Homo sapiens
ctgtctagccactcc

SEQ ID NO: 1179190 - DNA, 22 bp, Homo sapiens
ctgtctagccactccctcccag

SEQ ID NO: 1179191 - DNA, 23 bp, Homo sapiens
ctgtctagccactccctcccaga

SEQ ID NO: 1179192 - DNA, 20 bp, Homo sapiens
ctgtctaggaaggtgtgatg

SEQ ID NO: 1179193 - DNA, 15 bp, Homo sapiens
ctgtctaggactgca

SEQ ID NO: 1179194 - DNA, 19 bp, Homo sapiens
ctgtctaggactgcagtgt

SEQ ID NO: 1179195 - DNA, 21 bp, Homo sapiens
ctgtctaggactgcagtgtgg

SEQ ID NO: 1179196 - DNA, 17 bp, Homo sapiens
ctgtctaggttaaagct

SEQ ID NO: 1179197 - DNA, 14 bp, Homo sapiens
ctgtctagtgtctg

SEQ ID NO: 1179198 - DNA, 14 bp, Homo sapiens
ctgtctcaaaagga

SEQ ID NO: 1179199 - DNA, 21 bp, Homo sapiens
ctgtctcaagagggcactggt

SEQ ID NO: 1179200 - DNA, 17 bp, Homo sapiens
ctgtctcacctggactt

SEQ ID NO: 1179201 - DNA, 15 bp, Homo sapiens
ctgtctcacttttta

SEQ ID NO: 1179202 - DNA, 15 bp, Homo sapiens
ctgtctcatccatca

SEQ ID NO: 1179203 - DNA, 16 bp, Homo sapiens
ctgtctcatccatcat

SEQ ID NO: 1179204 - DNA, 21 bp, Homo sapiens
ctgtctcatccatcatcatgt

SEQ ID NO: 1179205 - DNA, 14 bp, Homo sapiens
ctgtctcatcccca

SEQ ID NO: 1179206 - DNA, 16 bp, Homo sapiens
ctgtctcatccccagg

SEQ ID NO: 1179207 - DNA, 19 bp, Homo sapiens
ctgtctcatccccaggggt

SEQ ID NO: 1179208 - DNA, 13 bp, Homo sapiens
ctgtctccagacc

SEQ ID NO: 1179209 - DNA, 15 bp, Homo sapiens
ctgtctccagacccc

SEQ ID NO: 1179210 - DNA, 13 bp, Homo sapiens
ctgtctccagctg

SEQ ID NO: 1179211 - DNA, 17 bp, Homo sapiens
ctgtctccagctgcctg

SEQ ID NO: 1179212 - DNA, 20 bp, Homo sapiens
ctgtctccagctgcctgggc

SEQ ID NO: 1179213 - DNA, 17 bp, Homo sapiens
ctgtctccagggccccc

SEQ ID NO: 1179214 - DNA, 17 bp, Homo sapiens
ctgtctccatgctggat

SEQ ID NO: 1179215 - DNA, 22 bp, Homo sapiens
ctgtctccatgctggatactgg

SEQ ID NO: 1179216 - DNA, 15 bp, Homo sapiens
ctgtctcccacttcc

SEQ ID NO: 1179217 - DNA, 16 bp, Homo sapiens
ctgtctcccacttccc

SEQ ID NO: 1179218 - DNA, 14 bp, Homo sapiens
ctgtctcccaggct

SEQ ID NO: 1179219 - DNA, 22 bp, Homo sapiens
ctgtctcccaggctggagtgca

SEQ ID NO: 1179220 - DNA, 21 bp, Homo sapiens
ctgtctcccttcttgggtagg

SEQ ID NO: 1179221 - DNA, 22 bp, Homo sapiens
catgcaggtggtgtcgggccct

SEQ ID NO: 1179222 - DNA, 12 bp, Homo sapiens
catgcatataat

SEQ ID NO: 1179223 - DNA, 14 bp, Homo sapiens
catgcatcttactg

SEQ ID NO: 1179224 - DNA, 17 bp, Homo sapiens
catgcatcttactgaag

SEQ ID NO: 1179225 - DNA, 21 bp, Homo sapiens
catgcatgttggggtttcctt

SEQ ID NO: 1179226 - DNA, 23 bp, Homo sapiens
catgcatgttggggtttccttta

SEQ ID NO: 1179227 - DNA, 14 bp, Homo sapiens
catgcattcataca

SEQ ID NO: 1179228 - DNA, 20 bp, Homo sapiens
catgcattgttgaggtggtc

SEQ ID NO: 1179229 - DNA, 22 bp, Homo sapiens
catgcattgttgaggtggtctg

SEQ ID NO: 1179230 - DNA, 20 bp, Homo sapiens
catgcattttgcagcagtga

SEQ ID NO: 1179231 - DNA, 12 bp, Homo sapiens
catgccaccctc

SEQ ID NO: 1179232 - DNA, 18 bp, Homo sapiens
catgccaccctcacacac

SEQ ID NO: 1179233 - DNA, 17 bp, Homo sapiens
catgccacgttccacag

SEQ ID NO: 1179234 - DNA, 19 bp, Homo sapiens
catgccacgttccacagtt

SEQ ID NO: 1179235 - DNA, 13 bp, Homo sapiens
catgccactgcca

SEQ ID NO: 1179236 - DNA, 15 bp, Homo sapiens
catgccactgccagg

SEQ ID NO: 1179237 - DNA, 18 bp, Homo sapiens
catgccagattctgcctc

SEQ ID NO: 1179238 - DNA, 19 bp, Homo sapiens
catgccagattctgcctct

SEQ ID NO: 1179239 - DNA, 14 bp, Homo sapiens
catgccagctggcc

SEQ ID NO: 1179240 - DNA, 19 bp, Homo sapiens
catgccagcttatctcagg

SEQ ID NO: 1179241 - DNA, 13 bp, Homo sapiens
catgccaggaacc

SEQ ID NO: 1179242 - DNA, 18 bp, Homo sapiens
catgccaggctgcgtccc

SEQ ID NO: 1179243 - DNA, 17 bp, Homo sapiens
catgccagtgacacttc

SEQ ID NO: 1179244 - DNA, 14 bp, Homo sapiens
catgccatctgttt

SEQ ID NO: 1179245 - DNA, 19 bp, Homo sapiens
catgccatggtctttgcta

SEQ ID NO: 1179246 - DNA, 15 bp, Homo sapiens
catgcccaccccctg

SEQ ID NO: 1179247 - DNA, 17 bp, Homo sapiens
catgcccaccccctgcc

SEQ ID NO: 1179248 - DNA, 21 bp, Homo sapiens
catgcccaccccctgccctgc

SEQ ID NO: 1179249 - DNA, 22 bp, Homo sapiens
catgcccaccccctgccctgca

SEQ ID NO: 1179250 - DNA, 13 bp, Homo sapiens
catgcccacctgc

SEQ ID NO: 1179251 - DNA, 14 bp, Homo sapiens
catgcccacctgcc

SEQ ID NO: 1179252 - DNA, 14 bp, Homo sapiens
catgcccagctctc

SEQ ID NO: 1179253 - DNA, 19 bp, Homo sapiens
catgccccacccccctcct

SEQ ID NO: 1179254 - DNA, 16 bp, Homo sapiens
catgccccagctctgg

SEQ ID NO: 1179255 - DNA, 15 bp, Homo sapiens
catgccccctccctt

SEQ ID NO: 1179256 - DNA, 11 bp, Homo sapiens
catgccccctg

SEQ ID NO: 1179257 - DNA, 16 bp, Homo sapiens
catgccccctgcagac

SEQ ID NO: 1179258 - DNA, 13 bp, Homo sapiens
catgcccccttcg

SEQ ID NO: 1179259 - DNA, 14 bp, Homo sapiens
catgcccccttcgc

SEQ ID NO: 1179260 - DNA, 14 bp, Homo sapiens
catgccccgatgtc

SEQ ID NO: 1179261 - DNA, 15 bp, Homo sapiens
catgcccctccccca

SEQ ID NO: 1179262 - DNA, 14 bp, Homo sapiens
catgccccttggct

SEQ ID NO: 1179263 - DNA, 12 bp, Homo sapiens
catgccctccca

SEQ ID NO: 1179264 - DNA, 13 bp, Homo sapiens
catgccctccctt

SEQ ID NO: 1179265 - DNA, 15 bp, Homo sapiens
catgccctcccttct

SEQ ID NO: 1179266 - DNA, 23 bp, Homo sapiens
catgccctcccttctccctggat

SEQ ID NO: 1179267 - DNA, 14 bp, Homo sapiens
catgccctcctctc

SEQ ID NO: 1179268 - DNA, 15 bp, Homo sapiens
catgccctcctctcc

SEQ ID NO: 1179269 - DNA, 12 bp, Homo sapiens
catgccctcctg

SEQ ID NO: 1179270 - DNA, 22 bp, Homo sapiens
catgccctgggatgcctcacca

SEQ ID NO: 1179271 - DNA, 23 bp, Homo sapiens
catgccctgtgcaacctcttggc

SEQ ID NO: 1179272 - DNA, 13 bp, Homo sapiens
catgccctgtgtg

SEQ ID NO: 1179273 - DNA, 18 bp, Homo sapiens
catgccgcagggagggct

SEQ ID NO: 1179274 - DNA, 19 bp, Homo sapiens
catgcctcagccctgaccc

SEQ ID NO: 1179275 - DNA, 14 bp, Homo sapiens
catgcctcatgcca

SEQ ID NO: 1179276 - DNA, 15 bp, Homo sapiens
catgcctcatgccac

SEQ ID NO: 1179277 - DNA, 12 bp, Homo sapiens
catgcctccctg

SEQ ID NO: 1179278 - DNA, 16 bp, Homo sapiens
catgcctctggaggcc

SEQ ID NO: 1179279 - DNA, 17 bp, Homo sapiens
catgcctctggaggcct

SEQ ID NO: 1179280 - DNA, 19 bp, Homo sapiens
catgcctctggaggcctct

SEQ ID NO: 1179281 - DNA, 21 bp, Homo sapiens
catgcctctggaggcctctgg

SEQ ID NO: 1179282 - DNA, 16 bp, Homo sapiens
catgcctgagggtgga

SEQ ID NO: 1179283 - DNA, 15 bp, Homo sapiens
ctgtcttgtttcagt

SEQ ID NO: 1179284 - DNA, 16 bp, Homo sapiens
ctgtctttaaaagaga

SEQ ID NO: 1179285 - DNA, 17 bp, Homo sapiens
ctgtctttaaaagagag

SEQ ID NO: 1179286 - DNA, 16 bp, Homo sapiens
ctgtctttaaggaaaa

SEQ ID NO: 1179287 - DNA, 15 bp, Homo sapiens
ctgtctttccactct

SEQ ID NO: 1179288 - DNA, 16 bp, Homo sapiens
ctgtctttccactctg

SEQ ID NO: 1179289 - DNA, 19 bp, Homo sapiens
ctgtctttccactctggat

SEQ ID NO: 1179290 - DNA, 21 bp, Homo sapiens
ctgtctttgtggactgtgggt

SEQ ID NO: 1179291 - DNA, 17 bp, Homo sapiens
ctgtcttttctcctccg

SEQ ID NO: 1179292 - DNA, 23 bp, Homo sapiens
ctgtgaaaatagtgtaagaactg

SEQ ID NO: 1179293 - DNA, 17 bp, Homo sapiens
ctgtgaaagaaaataat

SEQ ID NO: 1179294 - DNA, 19 bp, Homo sapiens
ctgtgaaatgagttggcca

SEQ ID NO: 1179295 - DNA, 15 bp, Homo sapiens
ctgtgaaatttcatg

SEQ ID NO: 1179296 - DNA, 23 bp, Homo sapiens
ctgtgaaatttcatgattggctt

SEQ ID NO: 1179297 - DNA, 19 bp, Homo sapiens
ctgtgaacagagagaccct

SEQ ID NO: 1179298 - DNA, 14 bp, Homo sapiens
ctgtgaacagcttg

SEQ ID NO: 1179299 - DNA, 21 bp, Homo sapiens
ctgtgaacagcttgctgtcac

SEQ ID NO: 1179300 - DNA, 19 bp, Homo sapiens
ctgtgaacttgactgggtg

SEQ ID NO: 1179301 - DNA, 18 bp, Homo sapiens
ctgtgaagcagtcagccc

SEQ ID NO: 1179302 - DNA, 19 bp, Homo sapiens
ctgtgaagcagtcagccct

SEQ ID NO: 1179303 - DNA, 14 bp, Homo sapiens
ctgtgaagcctctc

SEQ ID NO: 1179304 - DNA, 18 bp, Homo sapiens
ctgtgaagggtacagatt

SEQ ID NO: 1179305 - DNA, 21 bp, Homo sapiens
ctgtgaataaaaaccctgtat

SEQ ID NO: 1179306 - DNA, 15 bp, Homo sapiens
ctgtgaatacaatta

SEQ ID NO: 1179307 - DNA, 17 bp, Homo sapiens
ctgtgaatacaattaaa

SEQ ID NO: 1179308 - DNA, 21 bp, Homo sapiens
ctgtgaatacaattaaaggtc

SEQ ID NO: 1179309 - DNA, 15 bp, Homo sapiens
ctgtgaatacttgaa

SEQ ID NO: 1179310 - DNA, 22 bp, Homo sapiens
ctgtgaatatccagaaataaaa

SEQ ID NO: 1179311 - DNA, 17 bp, Homo sapiens
ctgtgaatcctggcaag

SEQ ID NO: 1179312 - DNA, 12 bp, Homo sapiens
ctgtgaatggag

SEQ ID NO: 1179313 - DNA, 16 bp, Homo sapiens
ctgtgaatggaggcag

SEQ ID NO: 1179314 - DNA, 17 bp, Homo sapiens
ctgtgaatggaggcaga

SEQ ID NO: 1179315 - DNA, 21 bp, Homo sapiens
ctgtgaatggaggcagagacc

SEQ ID NO: 1179316 - DNA, 23 bp, Homo sapiens
ctgtgaatggaggcagagacctc

SEQ ID NO: 1179317 - DNA, 21 bp, Homo sapiens
ctgtgaattgtttttgtacag

SEQ ID NO: 1179318 - DNA, 15 bp, Homo sapiens
ctgtgaatttcaaaa

SEQ ID NO: 1179319 - DNA, 23 bp, Homo sapiens
ctgtgacaaaggatgaagaacac

SEQ ID NO: 1179320 - DNA, 19 bp, Homo sapiens
ctgtgacaaccctggcctc

SEQ ID NO: 1179321 - DNA, 20 bp, Homo sapiens
ctgtgacaaccctggcctca

SEQ ID NO: 1179322 - DNA, 18 bp, Homo sapiens
ctgtgacaataagtttga

SEQ ID NO: 1179323 - DNA, 14 bp, Homo sapiens
ctgtgacagacttt

SEQ ID NO: 1179324 - DNA, 14 bp, Homo sapiens
ctgtgacagtgaaa

SEQ ID NO: 1179325 - DNA, 21 bp, Homo sapiens
ctgtgacatttatgtctcatg

SEQ ID NO: 1179326 - DNA, 17 bp, Homo sapiens
ctgtgaccaatgtcttg

SEQ ID NO: 1179327 - DNA, 17 bp, Homo sapiens
ctgtgaccaccttctgt

SEQ ID NO: 1179328 - DNA, 20 bp, Homo sapiens
ctgtgaccagcactgtctca

SEQ ID NO: 1179329 - DNA, 14 bp, Homo sapiens
ctgtgaccatttat

SEQ ID NO: 1179330 - DNA, 19 bp, Homo sapiens
ctgtgaccatttataatgt

SEQ ID NO: 1179331 - DNA, 17 bp, Homo sapiens
ctgtgaccccaccttga

SEQ ID NO: 1179332 - DNA, 13 bp, Homo sapiens
ctgtgacccccag

SEQ ID NO: 1179333 - DNA, 17 bp, Homo sapiens
ctgtgacccccagctcc

SEQ ID NO: 1179334 - DNA, 18 bp, Homo sapiens
ctgtgacccccagctccg

SEQ ID NO: 1179335 - DNA, 21 bp, Homo sapiens
ctgtgaccctctcactttggt

SEQ ID NO: 1179336 - DNA, 13 bp, Homo sapiens
ctgtgacctgtgg

SEQ ID NO: 1179337 - DNA, 14 bp, Homo sapiens
ctgtgacctgtggg

SEQ ID NO: 1179338 - DNA, 15 bp, Homo sapiens
ctgtgacctgtgggg

SEQ ID NO: 1179339 - DNA, 23 bp, Homo sapiens
ctgtgacgcagccggagggaggc

SEQ ID NO: 1179340 - DNA, 15 bp, Homo sapiens
ctgtgactaggcata

SEQ ID NO: 1179341 - DNA, 12 bp, Homo sapiens
ctgtgactctgg

SEQ ID NO: 1179342 - DNA, 14 bp, Homo sapiens
ctgtgactctgggc

SEQ ID NO: 1179343 - DNA, 15 bp, Homo sapiens
ctgtgactctgggca

SEQ ID NO: 1179344 - DNA, 19 bp, Homo sapiens
catgctgataatcattttg

SEQ ID NO: 1179345 - DNA, 22 bp, Homo sapiens
catgctgccaggaaacaaggga

SEQ ID NO: 1179346 - DNA, 19 bp, Homo sapiens
catgctgccattcttgatt

SEQ ID NO: 1179347 - DNA, 13 bp, Homo sapiens
catgctgcccagc

SEQ ID NO: 1179348 - DNA, 15 bp, Homo sapiens
catgctgcctggcac

SEQ ID NO: 1179349 - DNA, 15 bp, Homo sapiens
catgctgccttcagg

SEQ ID NO: 1179350 - DNA, 19 bp, Homo sapiens
catgctgctttttggcaca

SEQ ID NO: 1179351 - DNA, 23 bp, Homo sapiens
catgctggaacctgcaaaaaata

SEQ ID NO: 1179352 - DNA, 18 bp, Homo sapiens
catgctggatactggaca

SEQ ID NO: 1179353 - DNA, 16 bp, Homo sapiens
catgctggcggcgcag

SEQ ID NO: 1179354 - DNA, 21 bp, Homo sapiens
catgctggctcagtctgagct

SEQ ID NO: 1179355 - DNA, 19 bp, Homo sapiens
catgctgggatttccaact

SEQ ID NO: 1179356 - DNA, 21 bp, Homo sapiens
catgctgggccactggggact

SEQ ID NO: 1179357 - DNA, 23 bp, Homo sapiens
catgctggttacctgttccattg

SEQ ID NO: 1179358 - DNA, 20 bp, Homo sapiens
catgctgtccctgcactgtg

SEQ ID NO: 1179359 - DNA, 19 bp, Homo sapiens
catgctgtctggccctggg

SEQ ID NO: 1179360 - DNA, 13 bp, Homo sapiens
catgcttaaattt

SEQ ID NO: 1179361 - DNA, 14 bp, Homo sapiens
catgcttaaatttt

SEQ ID NO: 1179362 - DNA, 19 bp, Homo sapiens
catgcttagcttatctttc

SEQ ID NO: 1179363 - DNA, 15 bp, Homo sapiens
catgcttagtcactg

SEQ ID NO: 1179364 - DNA, 20 bp, Homo sapiens
catgcttatgttaaactctg

SEQ ID NO: 1179365 - DNA, 14 bp, Homo sapiens
catgcttcatcatt

SEQ ID NO: 1179366 - DNA, 23 bp, Homo sapiens
catgcttcatcattccctctcat

SEQ ID NO: 1179367 - DNA, 17 bp, Homo sapiens
catgcttcctttctctc

SEQ ID NO: 1179368 - DNA, 19 bp, Homo sapiens
catgcttcctttctctcct

SEQ ID NO: 1179369 - DNA, 21 bp, Homo sapiens
catgcttcctttctctcctgg

SEQ ID NO: 1179370 - DNA, 16 bp, Homo sapiens
catgcttcttccttac

SEQ ID NO: 1179371 - DNA, 14 bp, Homo sapiens
catgcttcttctca

SEQ ID NO: 1179372 - DNA, 17 bp, Homo sapiens
catgcttcttctcatgg

SEQ ID NO: 1179373 - DNA, 14 bp, Homo sapiens
catgcttgacatac

SEQ ID NO: 1179374 - DNA, 15 bp, Homo sapiens
catgcttgcaccgag

SEQ ID NO: 1179375 - DNA, 18 bp, Homo sapiens
catgcttgcctgaagctt

SEQ ID NO: 1179376 - DNA, 18 bp, Homo sapiens
catgcttgggctgaccca

SEQ ID NO: 1179377 - DNA, 17 bp, Homo sapiens
catgcttttctgccact

SEQ ID NO: 1179378 - DNA, 16 bp, Homo sapiens
catggaaaaacttcct

SEQ ID NO: 1179379 - DNA, 14 bp, Homo sapiens
catggaaaaatact

SEQ ID NO: 1179380 - DNA, 21 bp, Homo sapiens
catggaaaaatgccatcaaat

SEQ ID NO: 1179381 - DNA, 14 bp, Homo sapiens
catggaaaaatggt

SEQ ID NO: 1179382 - DNA, 16 bp, Homo sapiens
catggaaaaatggttg

SEQ ID NO: 1179383 - DNA, 23 bp, Homo sapiens
catggaaaaatggttgatggaaa

SEQ ID NO: 1179384 - DNA, 20 bp, Homo sapiens
catggaaaatgtcctgtggt

SEQ ID NO: 1179385 - DNA, 21 bp, Homo sapiens
catggaaaatgtcctgtggtg

SEQ ID NO: 1179386 - DNA, 17 bp, Homo sapiens
catggaaacctgaaaaa

SEQ ID NO: 1179387 - DNA, 14 bp, Homo sapiens
catggaaagactgg

SEQ ID NO: 1179388 - DNA, 20 bp, Homo sapiens
catggaaatagaatgaatag

SEQ ID NO: 1179389 - DNA, 21 bp, Homo sapiens
catggaaatcagccaagtttt

SEQ ID NO: 1179390 - DNA, 18 bp, Homo sapiens
catggaaatttaaagcag

SEQ ID NO: 1179391 - DNA, 19 bp, Homo sapiens
catggaaatttaaagcagg

SEQ ID NO: 1179392 - DNA, 19 bp, Homo sapiens
catggaacttttctgtaat

SEQ ID NO: 1179393 - DNA, 18 bp, Homo sapiens
catggaagagagagccat

SEQ ID NO: 1179394 - DNA, 21 bp, Homo sapiens
catggaaggggcttctggacc

SEQ ID NO: 1179395 - DNA, 14 bp, Homo sapiens
catggaaggtgcca

SEQ ID NO: 1179396 - DNA, 19 bp, Homo sapiens
catggaatcttgctgcagg

SEQ ID NO: 1179397 - DNA, 23 bp, Homo sapiens
catggaatcttgctgcaggccct

SEQ ID NO: 1179398 - DNA, 19 bp, Homo sapiens
catggaatggacatcctgt

SEQ ID NO: 1179399 - DNA, 16 bp, Homo sapiens
catggacaatataaac

SEQ ID NO: 1179400 - DNA, 20 bp, Homo sapiens
catggacaatataaactgaa

SEQ ID NO: 1179401 - DNA, 23 bp, Homo sapiens
catggacaccccttatccaggac

SEQ ID NO: 1179402 - DNA, 22 bp, Homo sapiens
catggacactacacccagcaat

SEQ ID NO: 1179403 - DNA, 12 bp, Homo sapiens
catggacactcc

SEQ ID NO: 1179404 - DNA, 18 bp, Homo sapiens
catggacactccagtgcc

SEQ ID NO: 1179405 - DNA, 15 bp, Homo sapiens
catggacaggctggc

SEQ ID NO: 1179406 - DNA, 14 bp, Homo sapiens
catggacagggcca

SEQ ID NO: 1179407 - DNA, 17 bp, Homo sapiens
catggacagggccaggg

SEQ ID NO: 1179408 - DNA, 19 bp, Homo sapiens
catggacagggccagggtt

SEQ ID NO: 1179409 - DNA, 13 bp, Homo sapiens
catggaccagcat

SEQ ID NO: 1179410 - DNA, 14 bp, Homo sapiens
ctgtgcatgacctg

SEQ ID NO: 1179411 - DNA, 15 bp, Homo sapiens
ctgtgcattagatat

SEQ ID NO: 1179412 - DNA, 22 bp, Homo sapiens
ctgtgccagaggaaggaaaagg

SEQ ID NO: 1179413 - DNA, 14 bp, Homo sapiens
ctgtgccaggaggc

SEQ ID NO: 1179414 - DNA, 14 bp, Homo sapiens
ctgtgccaggctga

SEQ ID NO: 1179415 - DNA, 12 bp, Homo sapiens
ctgtgccatgcc

SEQ ID NO: 1179416 - DNA, 15 bp, Homo sapiens
ctgtgccatgcccaa

SEQ ID NO: 1179417 - DNA, 22 bp, Homo sapiens
ctgtgccatgcccaaggcctag

SEQ ID NO: 1179418 - DNA, 16 bp, Homo sapiens
ctgtgccatgctgggc

SEQ ID NO: 1179419 - DNA, 15 bp, Homo sapiens
ctgtgccatggattt

SEQ ID NO: 1179420 - DNA, 23 bp, Homo sapiens
ctgtgcccaagtgggtccaagtg

SEQ ID NO: 1179421 - DNA, 22 bp, Homo sapiens
ctgtgcccacatcccaggcttc

SEQ ID NO: 1179422 - DNA, 19 bp, Homo sapiens
ctgtgcccacggtctgagc

SEQ ID NO: 1179423 - DNA, 12 bp, Homo sapiens
ctgtgcccagca

SEQ ID NO: 1179424 - DNA, 17 bp, Homo sapiens
ctgtgcccagcaggccc

SEQ ID NO: 1179425 - DNA, 18 bp, Homo sapiens
ctgtgcccagcaggccca

SEQ ID NO: 1179426 - DNA, 23 bp, Homo sapiens
ctgtgcccagcaggcccagcatg

SEQ ID NO: 1179427 - DNA, 19 bp, Homo sapiens
ctgtgccccagctgccagg

SEQ ID NO: 1179428 - DNA, 20 bp, Homo sapiens
ctgtgccccagctgccaggc

SEQ ID NO: 1179429 - DNA, 14 bp, Homo sapiens
ctgtgcccccagcc

SEQ ID NO: 1179430 - DNA, 20 bp, Homo sapiens
ctgtgcccccagcctcagcc

SEQ ID NO: 1179431 - DNA, 15 bp, Homo sapiens
ctgtgccccctctgg

SEQ ID NO: 1179432 - DNA, 20 bp, Homo sapiens
ctgtgccccgcgggctttgt

SEQ ID NO: 1179433 - DNA, 21 bp, Homo sapiens
ctgtgcccctgatgcagcctg

SEQ ID NO: 1179434 - DNA, 22 bp, Homo sapiens
ctgtgcccctgatgcagcctgt

SEQ ID NO: 1179435 - DNA, 17 bp, Homo sapiens
ctgtgcccgcatgtgtg

SEQ ID NO: 1179436 - DNA, 19 bp, Homo sapiens
ctgtgccctaaagtgtatt

SEQ ID NO: 1179437 - DNA, 13 bp, Homo sapiens
ctgtgccctcacc

SEQ ID NO: 1179438 - DNA, 14 bp, Homo sapiens
ctgtgccgcactct

SEQ ID NO: 1179439 - DNA, 20 bp, Homo sapiens
ctgtgccgcactctggcggt

SEQ ID NO: 1179440 - DNA, 23 bp, Homo sapiens
ctgtgccgcactctggcggtggc

SEQ ID NO: 1179441 - DNA, 18 bp, Homo sapiens
ctgtgcctaacaccagcg

SEQ ID NO: 1179442 - DNA, 14 bp, Homo sapiens
ctgtgcctcaggcc

SEQ ID NO: 1179443 - DNA, 20 bp, Homo sapiens
ctgtgcctcaggccagggct

SEQ ID NO: 1179444 - DNA, 15 bp, Homo sapiens
ctgtgcctctgcctg

SEQ ID NO: 1179445 - DNA, 14 bp, Homo sapiens
ctgtgcctctggga

SEQ ID NO: 1179446 - DNA, 15 bp, Homo sapiens
ctgtgcctgcactga

SEQ ID NO: 1179447 - DNA, 13 bp, Homo sapiens
ctgtgcctgctag

SEQ ID NO: 1179448 - DNA, 21 bp, Homo sapiens
ctgtgcctgctagagcaaccc

SEQ ID NO: 1179449 - DNA, 17 bp, Homo sapiens
ctgtgcctgctcagcag

SEQ ID NO: 1179450 - DNA, 15 bp, Homo sapiens
ctgtgcctggcccca

SEQ ID NO: 1179451 - DNA, 14 bp, Homo sapiens
ctgtgcctggcctc

SEQ ID NO: 1179452 - DNA, 17 bp, Homo sapiens
ctgtgcctgggccctgg

SEQ ID NO: 1179453 - DNA, 13 bp, Homo sapiens
ctgtgcctttcct

SEQ ID NO: 1179454 - DNA, 16 bp, Homo sapiens
ctgtgcctttcctatc

SEQ ID NO: 1179455 - DNA, 18 bp, Homo sapiens
ctgtgcctttcctatcac

SEQ ID NO: 1179456 - DNA, 14 bp, Homo sapiens
ctgtgcgtgaaaca

SEQ ID NO: 1179457 - DNA, 18 bp, Homo sapiens
ctgtgctaagtctttccc

SEQ ID NO: 1179458 - DNA, 15 bp, Homo sapiens
ctgtgctatgaattt

SEQ ID NO: 1179459 - DNA, 10 bp, Homo sapiens
ctgtgctccg

SEQ ID NO: 1179460 - DNA, 13 bp, Homo sapiens
ctgtgctgaggcc

SEQ ID NO: 1179461 - DNA, 20 bp, Homo sapiens
ctgtgctgcccgtcttcagc

SEQ ID NO: 1179462 - DNA, 22 bp, Homo sapiens
ctgtgctggactttaaaaaaac

SEQ ID NO: 1179463 - DNA, 13 bp, Homo sapiens
ctgtgctggccat

SEQ ID NO: 1179464 - DNA, 19 bp, Homo sapiens
ctgtgctggtgtcctgacc

SEQ ID NO: 1179465 - DNA, 20 bp, Homo sapiens
ctgtgctggtgtcctgacca

SEQ ID NO: 1179466 - DNA, 24 bp, Homo sapiens
catggcccccaataaaggcagctg

SEQ ID NO: 1179467 - DNA, 16 bp, Homo sapiens
catggccccccactcc

SEQ ID NO: 1179468 - DNA, 12 bp, Homo sapiens
catggccctggg

SEQ ID NO: 1179469 - DNA, 18 bp, Homo sapiens
catggccctgtcccaggc

SEQ ID NO: 1179470 - DNA, 16 bp, Homo sapiens
catggccgcttctaga

SEQ ID NO: 1179471 - DNA, 20 bp, Homo sapiens
catggcctattatattaaaa

SEQ ID NO: 1179472 - DNA, 16 bp, Homo sapiens
catggcctctgcaact

SEQ ID NO: 1179473 - DNA, 21 bp, Homo sapiens
catggcctcttcagatctcta

SEQ ID NO: 1179474 - DNA, 18 bp, Homo sapiens
catggcgccctgcctcct

SEQ ID NO: 1179475 - DNA, 22 bp, Homo sapiens
catggcgccctgcctcctggag

SEQ ID NO: 1179476 - DNA, 17 bp, Homo sapiens
catggcgtaatgggcct

SEQ ID NO: 1179477 - DNA, 20 bp, Homo sapiens
catggcgtggaggaggaggg

SEQ ID NO: 1179478 - DNA, 14 bp, Homo sapiens
catggcgtgtccct

SEQ ID NO: 1179479 - DNA, 19 bp, Homo sapiens
catggcgtgtccctctcgg

SEQ ID NO: 1179480 - DNA, 16 bp, Homo sapiens
catggctaactggcga

SEQ ID NO: 1179481 - DNA, 14 bp, Homo sapiens
catggctcagagct

SEQ ID NO: 1179482 - DNA, 17 bp, Homo sapiens
catggctcaggcaagcc

SEQ ID NO: 1179483 - DNA, 13 bp, Homo sapiens
catggctccagtc

SEQ ID NO: 1179484 - DNA, 15 bp, Homo sapiens
catggctccagtctg

SEQ ID NO: 1179485 - DNA, 18 bp, Homo sapiens
catggctgaagctggagc

SEQ ID NO: 1179486 - DNA, 19 bp, Homo sapiens
catggctgatcattaatta

SEQ ID NO: 1179487 - DNA, 12 bp, Homo sapiens
catggctgggaa

SEQ ID NO: 1179488 - DNA, 14 bp, Homo sapiens
catggctgtctgca

SEQ ID NO: 1179489 - DNA, 20 bp, Homo sapiens
catggctgtgtttgcagcct

SEQ ID NO: 1179490 - DNA, 17 bp, Homo sapiens
catggcttaatgtttat

SEQ ID NO: 1179491 - DNA, 19 bp, Homo sapiens
catggcttgttctctggaa

SEQ ID NO: 1179492 - DNA, 20 bp, Homo sapiens
catgggaaatgtcaacaagt

SEQ ID NO: 1179493 - DNA, 17 bp, Homo sapiens
catgggaacgcagcctc

SEQ ID NO: 1179494 - DNA, 21 bp, Homo sapiens
catgggaacgcagcctccagt

SEQ ID NO: 1179495 - DNA, 12 bp, Homo sapiens
catgggaagaac

SEQ ID NO: 1179496 - DNA, 22 bp, Homo sapiens
catgggaagatgtctcagagcc

SEQ ID NO: 1179497 - DNA, 23 bp, Homo sapiens
catgggaagatgtctcagagcct

SEQ ID NO: 1179498 - DNA, 13 bp, Homo sapiens
catgggagccagc

SEQ ID NO: 1179499 - DNA, 21 bp, Homo sapiens
catgggagctggttagaaatg

SEQ ID NO: 1179500 - DNA, 12 bp, Homo sapiens
catgggagggat

SEQ ID NO: 1179501 - DNA, 19 bp, Homo sapiens
catgggagggatcagcccc

SEQ ID NO: 1179502 - DNA, 14 bp, Homo sapiens
catgggagggggct

SEQ ID NO: 1179503 - DNA, 18 bp, Homo sapiens
catgggcattgcagcctt

SEQ ID NO: 1179504 - DNA, 17 bp, Homo sapiens
catgggcattgggttct

SEQ ID NO: 1179505 - DNA, 15 bp, Homo sapiens
catgggccaccgccc

SEQ ID NO: 1179506 - DNA, 19 bp, Homo sapiens
catgggcccgctgcctctt

SEQ ID NO: 1179507 - DNA, 21 bp, Homo sapiens
catgggcccgctgcctcttgg

SEQ ID NO: 1179508 - DNA, 23 bp, Homo sapiens
catgggcccgctgcctcttggct

SEQ ID NO: 1179509 - DNA, 15 bp, Homo sapiens
catgggcctctctgg

SEQ ID NO: 1179510 - DNA, 18 bp, Homo sapiens
catgggcctctctggggg

SEQ ID NO: 1179511 - DNA, 15 bp, Homo sapiens
catgggcctgctgcg

SEQ ID NO: 1179512 - DNA, 22 bp, Homo sapiens
catgggcctgctgcgtcagacc

SEQ ID NO: 1179513 - DNA, 13 bp, Homo sapiens
catgggcctggcc

SEQ ID NO: 1179514 - DNA, 24 bp, Homo sapiens
catgggcctggccacctctctcct

SEQ ID NO: 1179515 - DNA, 12 bp, Homo sapiens
catgggcctggg

SEQ ID NO: 1179516 - DNA, 14 bp, Homo sapiens
catgggcctgggcc

SEQ ID NO: 1179517 - DNA, 15 bp, Homo sapiens
catgggcctgggcct

SEQ ID NO: 1179518 - DNA, 17 bp, Homo sapiens
catgggcctgggcctgc

SEQ ID NO: 1179519 - DNA, 19 bp, Homo sapiens
catgggcctgggcctgctt

SEQ ID NO: 1179520 - DNA, 15 bp, Homo sapiens
catgggcgcaggccc

SEQ ID NO: 1179521 - DNA, 17 bp, Homo sapiens
catgggcgcaggcccag

SEQ ID NO: 1179522 - DNA, 23 bp, Homo sapiens
catgggctagtgtgagtggcagc

SEQ ID NO: 1179523 - DNA, 13 bp, Homo sapiens
catgggctcttca

SEQ ID NO: 1179524 - DNA, 14 bp, Homo sapiens
catgggctgagtgg

SEQ ID NO: 1179525 - DNA, 15 bp, Homo sapiens
catgggctgggggcc

SEQ ID NO: 1179526 - DNA, 13 bp, Homo sapiens
catgggctgtgtc

SEQ ID NO: 1179527 - DNA, 20 bp, Homo sapiens
catggggaaaccctggagcc

SEQ ID NO: 1179528 - DNA, 13 bp, Homo sapiens
catggggaaggca

SEQ ID NO: 1179529 - DNA, 14 bp, Homo sapiens
catggggaggagac

SEQ ID NO: 1179530 - DNA, 21 bp, Homo sapiens
catggggaggcagcagagcgg

SEQ ID NO: 1179531 - DNA, 23 bp, Homo sapiens
catggggagggattctggttcca

SEQ ID NO: 1179532 - DNA, 15 bp, Homo sapiens
catggggatctgggg

SEQ ID NO: 1179533 - DNA, 15 bp, Homo sapiens
catggggcaagccag

SEQ ID NO: 1179534 - DNA, 17 bp, Homo sapiens
catggggcaagccaggg

SEQ ID NO: 1179535 - DNA, 21 bp, Homo sapiens
catggggcaagccagggccca

SEQ ID NO: 1179536 - DNA, 23 bp, Homo sapiens
catggggcaagccagggcccaga

SEQ ID NO: 1179537 - DNA, 14 bp, Homo sapiens
catggggcccctgg

SEQ ID NO: 1179538 - DNA, 17 bp, Homo sapiens
ccagatgtttccagact

SEQ ID NO: 1179539 - DNA, 16 bp, Homo sapiens
ccagattcccagacct

SEQ ID NO: 1179540 - DNA, 15 bp, Homo sapiens
ccagattcccctgtg

SEQ ID NO: 1179541 - DNA, 18 bp, Homo sapiens
ccagattcccctgtgtca

SEQ ID NO: 1179542 - DNA, 14 bp, Homo sapiens
ccagattctgatgc

SEQ ID NO: 1179543 - DNA, 15 bp, Homo sapiens
ccagattctgatgca

SEQ ID NO: 1179544 - DNA, 18 bp, Homo sapiens
ccagattctgcctctctg

SEQ ID NO: 1179545 - DNA, 13 bp, Homo sapiens
ccagattcttcag

SEQ ID NO: 1179546 - DNA, 15 bp, Homo sapiens
ccagattgctctgcc

SEQ ID NO: 1179547 - DNA, 15 bp, Homo sapiens
ccagatttgtctttt

SEQ ID NO: 1179548 - DNA, 22 bp, Homo sapiens
ccagcaaaagagctattgccaa

SEQ ID NO: 1179549 - DNA, 14 bp, Homo sapiens
ccagcaaaatggaa

SEQ ID NO: 1179550 - DNA, 21 bp, Homo sapiens
ccagcaacacaagctggaagc

SEQ ID NO: 1179551 - DNA, 19 bp, Homo sapiens
ccagcaacatctcgagccc

SEQ ID NO: 1179552 - DNA, 20 bp, Homo sapiens
ccagcaacatctcgagcccc

SEQ ID NO: 1179553 - DNA, 22 bp, Homo sapiens
ccagcaacgcccctccaaacct

SEQ ID NO: 1179554 - DNA, 11 bp, Homo sapiens
ccagcaactga

SEQ ID NO: 1179555 - DNA, 23 bp, Homo sapiens
ccagcaacttcttctccatccct

SEQ ID NO: 1179556 - DNA, 16 bp, Homo sapiens
ccagcaagaaggcgag

SEQ ID NO: 1179557 - DNA, 21 bp, Homo sapiens
ccagcaagaataaaaaagaaa

SEQ ID NO: 1179558 - DNA, 14 bp, Homo sapiens
ccagcaagacctca

SEQ ID NO: 1179559 - DNA, 18 bp, Homo sapiens
ccagcaagagggaacaaa

SEQ ID NO: 1179560 - DNA, 14 bp, Homo sapiens
ccagcaagcagtct

SEQ ID NO: 1179561 - DNA, 14 bp, Homo sapiens
ccagcaaggcaggt

SEQ ID NO: 1179562 - DNA, 14 bp, Homo sapiens
ccagcaagtcccag

SEQ ID NO: 1179563 - DNA, 17 bp, Homo sapiens
ccagcaatatgtaaata

SEQ ID NO: 1179564 - DNA, 12 bp, Homo sapiens
ccagcaatgaca

SEQ ID NO: 1179565 - DNA, 22 bp, Homo sapiens
ccagcaatgacatctcaggggc

SEQ ID NO: 1179566 - DNA, 17 bp, Homo sapiens
ccagcaatgatgtccag

SEQ ID NO: 1179567 - DNA, 17 bp, Homo sapiens
ccagcacaccaagtggc

SEQ ID NO: 1179568 - DNA, 20 bp, Homo sapiens
ccagcacaccaagtggctgg

SEQ ID NO: 1179569 - DNA, 15 bp, Homo sapiens
ccagcacactattta

SEQ ID NO: 1179570 - DNA, 18 bp, Homo sapiens
ccagcacagagcgtcctt

SEQ ID NO: 1179571 - DNA, 21 bp, Homo sapiens
ccagcacagagcgtccttccc

SEQ ID NO: 1179572 - DNA, 19 bp, Homo sapiens
ccagcacagccacctccgc

SEQ ID NO: 1179573 - DNA, 20 bp, Homo sapiens
ccagcacagcttagatttca

SEQ ID NO: 1179574 - DNA, 13 bp, Homo sapiens
ccagcacaggggc

SEQ ID NO: 1179575 - DNA, 17 bp, Homo sapiens
ccagcacaggggcccca

SEQ ID NO: 1179576 - DNA, 22 bp, Homo sapiens
ccagcacatggccatagaggcc

SEQ ID NO: 1179577 - DNA, 20 bp, Homo sapiens
ccagcaccacctacacagga

SEQ ID NO: 1179578 - DNA, 12 bp, Homo sapiens
ccagcaccctct

SEQ ID NO: 1179579 - DNA, 17 bp, Homo sapiens
ccagcacctgcctcctc

SEQ ID NO: 1179580 - DNA, 20 bp, Homo sapiens
ccagcaccttcaagcgctcc

SEQ ID NO: 1179581 - DNA, 19 bp, Homo sapiens
ccagcaccttctttctgga

SEQ ID NO: 1179582 - DNA, 21 bp, Homo sapiens
ccagcacggtgactctgtcca

SEQ ID NO: 1179583 - DNA, 12 bp, Homo sapiens
ccagcactaacg

SEQ ID NO: 1179584 - DNA, 20 bp, Homo sapiens
ccagcactaaggccgtgtct

SEQ ID NO: 1179585 - DNA, 20 bp, Homo sapiens
ccagcactatgctttccttc

SEQ ID NO: 1179586 - DNA, 15 bp, Homo sapiens
ccagcactcagcctc

SEQ ID NO: 1179587 - DNA, 16 bp, Homo sapiens
ccagcactcagcctca

SEQ ID NO: 1179588 - DNA, 22 bp, Homo sapiens
ccagcactgcttgaggaaaaca

SEQ ID NO: 1179589 - DNA, 17 bp, Homo sapiens
ccagcacttccatggga

SEQ ID NO: 1179590 - DNA, 16 bp, Homo sapiens
ccagcacttgtccagc

SEQ ID NO: 1179591 - DNA, 20 bp, Homo sapiens
ccagcacttgtccagctgag

SEQ ID NO: 1179592 - DNA, 11 bp, Homo sapiens
ccagcactttg

SEQ ID NO: 1179593 - DNA, 13 bp, Homo sapiens
ccagcactttggg

SEQ ID NO: 1179594 - DNA, 23 bp, Homo sapiens
ccagcactttgggaggctgaggc

SEQ ID NO: 1179595 - DNA, 15 bp, Homo sapiens
ccagcagaagacaaa

SEQ ID NO: 1179596 - DNA, 19 bp, Homo sapiens
ccagcagaatggaggcagg

SEQ ID NO: 1179597 - DNA, 20 bp, Homo sapiens
ccagcagaatggaggcaggg

SEQ ID NO: 1179598 - DNA, 13 bp, Homo sapiens
ccagcagacagag

SEQ ID NO: 1179599 - DNA, 19 bp, Homo sapiens
ccagcagacagagccagga

SEQ ID NO: 1179600 - DNA, 20 bp, Homo sapiens
ccagcagacagagccaggag

SEQ ID NO: 1179601 - DNA, 18 bp, Homo sapiens
ccagcagagcccaccagc

SEQ ID NO: 1179602 - DNA, 18 bp, Homo sapiens
ccagcagaggcaggctgg

SEQ ID NO: 1179603 - DNA, 15 bp, Homo sapiens
ccagcagagggcgcc

SEQ ID NO: 1179604 - DNA, 16 bp, Homo sapiens
ccagcagagggcgcca

SEQ ID NO: 1179605 - DNA, 15 bp, Homo sapiens
ccagcagaggtgatt

SEQ ID NO: 1179606 - DNA, 16 bp, Homo sapiens
ccagcagcacaattct

SEQ ID NO: 1179607 - DNA, 20 bp, Homo sapiens
ccagcagcacaattctgtcc

SEQ ID NO: 1179608 - DNA, 18 bp, Homo sapiens
ccagcagcagcaggtgat

SEQ ID NO: 1179609 - DNA, 23 bp, Homo sapiens
ccagcagcagcccaagcttccct

SEQ ID NO: 1179610 - DNA, 16 bp, Homo sapiens
ccagcagcaggatggg

SEQ ID NO: 1179611 - DNA, 12 bp, Homo sapiens
ccagcagcatgg

SEQ ID NO: 1179612 - DNA, 18 bp, Homo sapiens
ccagcagccagctctcag

SEQ ID NO: 1179613 - DNA, 12 bp, Homo sapiens
ccagcagcccta

SEQ ID NO: 1179614 - DNA, 19 bp, Homo sapiens
ccagcagcctcgcacaggc

SEQ ID NO: 1179615 - DNA, 22 bp, Homo sapiens
ccagcagcctcgcacaggccct

SEQ ID NO: 1179616 - DNA, 11 bp, Homo sapiens
ccagcagcctg

SEQ ID NO: 1179617 - DNA, 18 bp, Homo sapiens
ccagcagcgcctttccca

SEQ ID NO: 1179618 - DNA, 14 bp, Homo sapiens
ccagcagctcaaga

SEQ ID NO: 1179619 - DNA, 11 bp, Homo sapiens
ccagcagctgc

SEQ ID NO: 1179620 - DNA, 18 bp, Homo sapiens
ccagcagctgcgggtctg

SEQ ID NO: 1179621 - DNA, 14 bp, Homo sapiens
ccagcagctgtcag

SEQ ID NO: 1179622 - DNA, 18 bp, Homo sapiens
ccagcaggaaggacccca

SEQ ID NO: 1179623 - DNA, 20 bp, Homo sapiens
ccagcaggaaggaccccaca

SEQ ID NO: 1179624 - DNA, 21 bp, Homo sapiens
ccagcaggagagactgagcag

SEQ ID NO: 1179625 - DNA, 12 bp, Homo sapiens
ccagcaggcaga

SEQ ID NO: 1179626 - DNA, 24 bp, Homo sapiens
ccagcaggcaggcactgtggccct

SEQ ID NO: 1179627 - DNA, 22 bp, Homo sapiens
ccagcaggccagggactcagcg

SEQ ID NO: 1179628 - DNA, 12 bp, Homo sapiens
ccagcaggccca

SEQ ID NO: 1179629 - DNA, 19 bp, Homo sapiens
ccagcaggcccagcatgca

SEQ ID NO: 1179630 - DNA, 16 bp, Homo sapiens
ccagcaggcctccctg

SEQ ID NO: 1179631 - DNA, 15 bp, Homo sapiens
ccagcaggctcctgg

SEQ ID NO: 1179632 - DNA, 22 bp, Homo sapiens
ccagcaggctcctggctgtgcc

SEQ ID NO: 1179633 - DNA, 21 bp, Homo sapiens
ccagcaggggggctgtgccaa

SEQ ID NO: 1179634 - DNA, 20 bp, Homo sapiens
ccagcagggtcttttcatct

SEQ ID NO: 1179635 - DNA, 23 bp, Homo sapiens
ccagcagggtcttttcatctggg

SEQ ID NO: 1179636 - DNA, 15 bp, Homo sapiens
ccagcaggtgctgac

SEQ ID NO: 1179637 - DNA, 15 bp, Homo sapiens
ccagcaggtggggag

SEQ ID NO: 1179638 - DNA, 23 bp, Homo sapiens
ccagcaggtgtggtggctcatgg

SEQ ID NO: 1179639 - DNA, 19 bp, Homo sapiens
ctttaattctctttcaaag

SEQ ID NO: 1179640 - DNA, 17 bp, Homo sapiens
ctttaattttaactgat

SEQ ID NO: 1179641 - DNA, 15 bp, Homo sapiens
ctttaattttcttgt

SEQ ID NO: 1179642 - DNA, 21 bp, Homo sapiens
ctttacaaaccattacctgta

SEQ ID NO: 1179643 - DNA, 19 bp, Homo sapiens
ctttacaatgttcatccca

SEQ ID NO: 1179644 - DNA, 13 bp, Homo sapiens
ctttacacacacg

SEQ ID NO: 1179645 - DNA, 23 bp, Homo sapiens
ctttacacattcggctccctgga

SEQ ID NO: 1179646 - DNA, 19 bp, Homo sapiens
ctttacaggaaaaaaaatt

SEQ ID NO: 1179647 - DNA, 17 bp, Homo sapiens
ctttacatatgctttaa

SEQ ID NO: 1179648 - DNA, 18 bp, Homo sapiens
ctttacatattcctttga

SEQ ID NO: 1179649 - DNA, 17 bp, Homo sapiens
ctttacatgaggactct

SEQ ID NO: 1179650 - DNA, 17 bp, Homo sapiens
ctttacatgcaatttat

SEQ ID NO: 1179651 - DNA, 20 bp, Homo sapiens
ctttacatgctgtgctcttt

SEQ ID NO: 1179652 - DNA, 19 bp, Homo sapiens
ctttaccataaagccttta

SEQ ID NO: 1179653 - DNA, 20 bp, Homo sapiens
ctttacccctcatccaaagt

SEQ ID NO: 1179654 - DNA, 17 bp, Homo sapiens
ctttaccctctttgctg

SEQ ID NO: 1179655 - DNA, 14 bp, Homo sapiens
ctttacctaagtgt

SEQ ID NO: 1179656 - DNA, 15 bp, Homo sapiens
ctttacctatggaag

SEQ ID NO: 1179657 - DNA, 16 bp, Homo sapiens
ctttacgcccatctca

SEQ ID NO: 1179658 - DNA, 18 bp, Homo sapiens
ctttacggacaccccctc

SEQ ID NO: 1179659 - DNA, 13 bp, Homo sapiens
ctttacgtactgt

SEQ ID NO: 1179660 - DNA, 15 bp, Homo sapiens
cttttactggttgca

SEQ ID NO: 1179661 - DNA, 22 bp, Homo sapiens
cttttactggttgcatggaaat

SEQ ID NO: 1179662 - DNA, 17 bp, Homo sapiens
cttttactttttttctg

SEQ ID NO: 1179663 - DNA, 23 bp, Homo sapiens
cttttagaaaagggagtttaaaa

SEQ ID NO: 1179664 - DNA, 15 bp, Homo sapiens
cttttagaaatactg

SEQ ID NO: 1179665 - DNA, 15 bp, Homo sapiens
cttttagaaatgcat

SEQ ID NO: 1179666 - DNA, 22 bp, Homo sapiens
cttttaggaatatgttcaatgc

SEQ ID NO: 1179667 - DNA, 16 bp, Homo sapiens
cttttaggccaaaaaa

SEQ ID NO: 1179668 - DNA, 18 bp, Homo sapiens
cttttagggtaagaagtt

SEQ ID NO: 1179669 - DNA, 18 bp, Homo sapiens
cttttagttgactcacag

SEQ ID NO: 1179670 - DNA, 19 bp, Homo sapiens
cttttagttgactcacagg

SEQ ID NO: 1179671 - DNA, 22 bp, Homo sapiens
ccagcttgggcccagctgggct

SEQ ID NO: 1179672 - DNA, 16 bp, Homo sapiens
ccagcttgtaggagct

SEQ ID NO: 1179673 - DNA, 21 bp, Homo sapiens
ccagctttaagggttgtgagc

SEQ ID NO: 1179674 - DNA, 18 bp, Homo sapiens
ccagctttccctgcctct

SEQ ID NO: 1179675 - DNA, 16 bp, Homo sapiens
ccagcttttcctccct

SEQ ID NO: 1179676 - DNA, 22 bp, Homo sapiens
ccaggaaacaagggaaggggcc

SEQ ID NO: 1179677 - DNA, 20 bp, Homo sapiens
ccaggaaacatgaagcataa

SEQ ID NO: 1179678 - DNA, 23 bp, Homo sapiens
ccaggaaactccacatctgcctt

SEQ ID NO: 1179679 - DNA, 23 bp, Homo sapiens
ccaggaaagagcagtcagagtcc

SEQ ID NO: 1179680 - DNA, 20 bp, Homo sapiens
ccaggaaagcgcctccaacc

SEQ ID NO: 1179681 - DNA, 22 bp, Homo sapiens
ccaggaacacccgactcctcaa

SEQ ID NO: 1179682 - DNA, 17 bp, Homo sapiens
ccaggaaccaaaaagag

SEQ ID NO: 1179683 - DNA, 14 bp, Homo sapiens
ccaggaacctcctc

SEQ ID NO: 1179684 - DNA, 17 bp, Homo sapiens
ccaggaacgctctcctc

SEQ ID NO: 1179685 - DNA, 18 bp, Homo sapiens
ccaggaactgcctgggcc

SEQ ID NO: 1179686 - DNA, 18 bp, Homo sapiens
ccaggaagatcccccaga

SEQ ID NO: 1179687 - DNA, 13 bp, Homo sapiens
ccaggaagcaggg

SEQ ID NO: 1179688 - DNA, 14 bp, Homo sapiens
ccaggaagccagag

SEQ ID NO: 1179689 - DNA, 17 bp, Homo sapiens
ccaggaagccagagccc

SEQ ID NO: 1179690 - DNA, 18 bp, Homo sapiens
ccaggaagccagagcccc

SEQ ID NO: 1179691 - DNA, 22 bp, Homo sapiens
ccaggaagccgtcctggcgcct

SEQ ID NO: 1179692 - DNA, 14 bp, Homo sapiens
ccaggaaggcagct

SEQ ID NO: 1179693 - DNA, 15 bp, Homo sapiens
ccaggaaggcagctg

SEQ ID NO: 1179694 - DNA, 20 bp, Homo sapiens
ccaggaagggaaagcgggca

SEQ ID NO: 1179695 - DNA, 23 bp, Homo sapiens
ccaggaagggaaagcgggcagcc

SEQ ID NO: 1179696 - DNA, 20 bp, Homo sapiens
ccaggaatgttaaagtcagt

SEQ ID NO: 1179697 - DNA, 12 bp, Homo sapiens
ccaggacagcag

SEQ ID NO: 1179698 - DNA, 13 bp, Homo sapiens
ccaggacagcagc

SEQ ID NO: 1179699 - DNA, 14 bp, Homo sapiens
ccaggacaggacca

SEQ ID NO: 1179700 - DNA, 13 bp, Homo sapiens
ccaggacaggatc

SEQ ID NO: 1179701 - DNA, 13 bp, Homo sapiens
ccaggacaggccc

SEQ ID NO: 1179702 - DNA, 17 bp, Homo sapiens
ccaggacatctctgccc

SEQ ID NO: 1179703 - DNA, 15 bp, Homo sapiens
ccaggaccagctggg

SEQ ID NO: 1179704 - DNA, 16 bp, Homo sapiens
ccaggaccagctgggg

SEQ ID NO: 1179705 - DNA, 15 bp, Homo sapiens
ccaggaccatcatcc

SEQ ID NO: 1179706 - DNA, 21 bp, Homo sapiens
ccaggacccagggtcccctcc

SEQ ID NO: 1179707 - DNA, 20 bp, Homo sapiens
ccaggacccccgaggggagg

SEQ ID NO: 1179708 - DNA, 19 bp, Homo sapiens
ccaggacccctcagctccc

SEQ ID NO: 1179709 - DNA, 17 bp, Homo sapiens
ccaggacccgccagccc

SEQ ID NO: 1179710 - DNA, 18 bp, Homo sapiens
ccaggacccgccagcccc

SEQ ID NO: 1179711 - DNA, 18 bp, Homo sapiens
ccaggacccgcctgctcc

SEQ ID NO: 1179712 - DNA, 22 bp, Homo sapiens
ccaggacccgcctgctcccatc

SEQ ID NO: 1179713 - DNA, 17 bp, Homo sapiens
ccaggacctggctgcca

SEQ ID NO: 1179714 - DNA, 18 bp, Homo sapiens
ccaggacctggctgccat

SEQ ID NO: 1179715 - DNA, 16 bp, Homo sapiens
ccaggacgccactcat

SEQ ID NO: 1179716 - DNA, 17 bp, Homo sapiens
ccaggacgcttctgaat

SEQ ID NO: 1179717 - DNA, 18 bp, Homo sapiens
ccaggacgcttctgaatg

SEQ ID NO: 1179718 - DNA, 22 bp, Homo sapiens
ccaggacgcttctgaatgctgc

SEQ ID NO: 1179719 - DNA, 23 bp, Homo sapiens
ccaggacgcttctgaatgctgct

SEQ ID NO: 1179720 - DNA, 20 bp, Homo sapiens
ccaggactatagcccaggtc

SEQ ID NO: 1179721 - DNA, 22 bp, Homo sapiens
ccaggactatagcccaggtcct

SEQ ID NO: 1179722 - DNA, 17 bp, Homo sapiens
ccaggactcaccctcca

SEQ ID NO: 1179723 - DNA, 17 bp, Homo sapiens
ccaggactccccaggcc

SEQ ID NO: 1179724 - DNA, 17 bp, Homo sapiens
ccaggactccctcctca

SEQ ID NO: 1179725 - DNA, 22 bp, Homo sapiens
ccaggactccctcctcacctct

SEQ ID NO: 1179726 - DNA, 15 bp, Homo sapiens
ccaggactctggcac

SEQ ID NO: 1179727 - DNA, 21 bp, Homo sapiens
ccaggactgagatgcaaatgt

SEQ ID NO: 1179728 - DNA, 15 bp, Homo sapiens
ccaggacttggggtc

SEQ ID NO: 1179729 - DNA, 18 bp, Homo sapiens
ccaggacttggggtcagg

SEQ ID NO: 1179730 - DNA, 19 bp, Homo sapiens
ccaggacttggggtcagga

SEQ ID NO: 1179731 - DNA, 20 bp, Homo sapiens
ccaggagaaagccgggggag

SEQ ID NO: 1179732 - DNA, 21 bp, Homo sapiens
ccaggagaaagccgggggagg

SEQ ID NO: 1179733 - DNA, 19 bp, Homo sapiens
ccaggagaaccactacatg

SEQ ID NO: 1179734 - DNA, 23 bp, Homo sapiens
ccaggagaaccactacatgcagc

SEQ ID NO: 1179735 - DNA, 14 bp, Homo sapiens
ccaggagaagctca

SEQ ID NO: 1179736 - DNA, 16 bp, Homo sapiens
ccaggagaagggctgg

SEQ ID NO: 1179737 - DNA, 23 bp, Homo sapiens
ccaggagaagggggctctgcccc

SEQ ID NO: 1179738 - DNA, 15 bp, Homo sapiens
ccaggagacatatat

SEQ ID NO: 1179739 - DNA, 14 bp, Homo sapiens
ccaggagagacaga

SEQ ID NO: 1179740 - DNA, 15 bp, Homo sapiens
ccaggagagagccag

SEQ ID NO: 1179741 - DNA, 17 bp, Homo sapiens
ccaggagagagccagga

SEQ ID NO: 1179742 - DNA, 23 bp, Homo sapiens
ccaggagagagccaggatgccca

SEQ ID NO: 1179743 - DNA, 17 bp, Homo sapiens
ccaggagagccagccct

SEQ ID NO: 1179744 - DNA, 19 bp, Homo sapiens
ccaggagagccagccctcc

SEQ ID NO: 1179745 - DNA, 19 bp, Homo sapiens
ccaggagagcccccaccag

SEQ ID NO: 1179746 - DNA, 14 bp, Homo sapiens
ccaggagagcctgg

SEQ ID NO: 1179747 - DNA, 22 bp, Homo sapiens
ccaggagattggatttgctgtg

SEQ ID NO: 1179748 - DNA, 13 bp, Homo sapiens
ccaggagcacctg

SEQ ID NO: 1179749 - DNA, 14 bp, Homo sapiens
ccaggagcacctgg

SEQ ID NO: 1179750 - DNA, 15 bp, Homo sapiens
ccaggagcagcagcc

SEQ ID NO: 1179751 - DNA, 16 bp, Homo sapiens
ccaggagcagcagcca

SEQ ID NO: 1179752 - DNA, 19 bp, Homo sapiens
ccaggagcatagaagccac

SEQ ID NO: 1179753 - DNA, 18 bp, Homo sapiens
ccaggagctctgcgccag

SEQ ID NO: 1179754 - DNA, 19 bp, Homo sapiens
ccaggagctctgcgccagg

SEQ ID NO: 1179755 - DNA, 21 bp, Homo sapiens
ccaggagctctgcgccaggca

SEQ ID NO: 1179756 - DNA, 22 bp, Homo sapiens
ccaggagctctgcgccaggcag

SEQ ID NO: 1179757 - DNA, 20 bp, Homo sapiens
ccaggagctgagtcacctcc

SEQ ID NO: 1179758 - DNA, 21 bp, Homo sapiens
ccaggagcttcttgtttcctt

SEQ ID NO: 1179759 - DNA, 22 bp, Homo sapiens
ccaggaggcggaccttgtagtg

SEQ ID NO: 1179760 - DNA, 15 bp, Homo sapiens
ccaggaggcggcagc

SEQ ID NO: 1179761 - DNA, 15 bp, Homo sapiens
ccaggaggctgaggt

SEQ ID NO: 1179762 - DNA, 21 bp, Homo sapiens
ccaggaggctttaagctccag

SEQ ID NO: 1179763 - DNA, 15 bp, Homo sapiens
ccaggagggaggcag

SEQ ID NO: 1179764 - DNA, 23 bp, Homo sapiens
ccaggagggcacagcaggggagc

SEQ ID NO: 1179765 - DNA, 13 bp, Homo sapiens
ccaggaggggcct

SEQ ID NO: 1179766 - DNA, 20 bp, Homo sapiens
ccaggaggggcctgggcagc

SEQ ID NO: 1179767 - DNA, 22 bp, Homo sapiens
ccaggaggtggctatggccacc

SEQ ID NO: 1179768 - DNA, 14 bp, Homo sapiens
ccaggagtctgtgc

SEQ ID NO: 1179769 - DNA, 17 bp, Homo sapiens
ccaggagtctgtgctct

SEQ ID NO: 1179770 - DNA, 21 bp, Homo sapiens
ccaggagtgtggccacgtggg

SEQ ID NO: 1179771 - DNA, 20 bp, Homo sapiens
ccaggagttcgaggctgcag

SEQ ID NO: 1179772 - DNA, 23 bp, Homo sapiens
ccaggagtttaagaccagcctgg

SEQ ID NO: 1179773 - DNA, 19 bp, Homo sapiens
ccaggagttttaagtccag

SEQ ID NO: 1179774 - DNA, 13 bp, Homo sapiens
ccaggataaagct

SEQ ID NO: 1179775 - DNA, 14 bp, Homo sapiens
ccaggataaggaga

SEQ ID NO: 1179776 - DNA, 23 bp, Homo sapiens
ccaggataaggagactgaggctt

SEQ ID NO: 1179777 - DNA, 20 bp, Homo sapiens
ccaggatactggcacagagg

SEQ ID NO: 1179778 - DNA, 14 bp, Homo sapiens
ccaggatcctgcag

SEQ ID NO: 1179779 - DNA, 15 bp, Homo sapiens
ccaggatcctgcagg

SEQ ID NO: 1179780 - DNA, 13 bp, Homo sapiens
ccaggatctgggt

SEQ ID NO: 1179781 - DNA, 15 bp, Homo sapiens
cttttgtatgtaaat

SEQ ID NO: 1179782 - DNA, 23 bp, Homo sapiens
cttttgtatgtaaatgtgcattc

SEQ ID NO: 1179783 - DNA, 14 bp, Homo sapiens
cttttgtattaaga

SEQ ID NO: 1179784 - DNA, 13 bp, Homo sapiens
cttttgtcctgca

SEQ ID NO: 1179785 - DNA, 21 bp, Homo sapiens
cttttgtcctgcatcatcttg

SEQ ID NO: 1179786 - DNA, 20 bp, Homo sapiens
cttttgtccttcctgtgccc

SEQ ID NO: 1179787 - DNA, 19 bp, Homo sapiens
cttttgtctacacaccctg

SEQ ID NO: 1179788 - DNA, 17 bp, Homo sapiens
cttttgtgaaatcagta

SEQ ID NO: 1179789 - DNA, 13 bp, Homo sapiens
cttttgtgaatta

SEQ ID NO: 1179790 - DNA, 18 bp, Homo sapiens
cttttgtgatgaacatat

SEQ ID NO: 1179791 - DNA, 13 bp, Homo sapiens
cttttgtgcatta

SEQ ID NO: 1179792 - DNA, 17 bp, Homo sapiens
cttttgtgggtttctct

SEQ ID NO: 1179793 - DNA, 19 bp, Homo sapiens
cttttgtgggtttctctgt

SEQ ID NO: 1179794 - DNA, 22 bp, Homo sapiens
cttttgtgggtttctctgtgct

SEQ ID NO: 1179795 - DNA, 16 bp, Homo sapiens
cttttgtggtgtcttc

SEQ ID NO: 1179796 - DNA, 14 bp, Homo sapiens
cttttgtgtacagt

SEQ ID NO: 1179797 - DNA, 20 bp, Homo sapiens
cttttgttaacagtatttct

SEQ ID NO: 1179798 - DNA, 13 bp, Homo sapiens
cttttgttcgcat

SEQ ID NO: 1179799 - DNA, 14 bp, Homo sapiens
cttttgttctctga

SEQ ID NO: 1179800 - DNA, 14 bp, Homo sapiens
cttttgttctcttc

SEQ ID NO: 1179801 - DNA, 13 bp, Homo sapiens
cttttgttctgag

SEQ ID NO: 1179802 - DNA, 17 bp, Homo sapiens
cttttgttctgaggggt

SEQ ID NO: 1179803 - DNA, 22 bp, Homo sapiens
ccaggcgcatgtctgcacctcc

SEQ ID NO: 1179804 - DNA, 23 bp, Homo sapiens
ccaggcgcatgtctgcacctccg

SEQ ID NO: 1179805 - DNA, 18 bp, Homo sapiens
ccaggcggccctggggag

SEQ ID NO: 1179806 - DNA, 17 bp, Homo sapiens
ccaggcgggagatggac

SEQ ID NO: 1179807 - DNA, 16 bp, Homo sapiens
ccaggcgggctcaagg

SEQ ID NO: 1179808 - DNA, 17 bp, Homo sapiens
ccaggcgggctcaagga

SEQ ID NO: 1179809 - DNA, 19 bp, Homo sapiens
ccaggcgttggtgccactt

SEQ ID NO: 1179810 - DNA, 19 bp, Homo sapiens
ccaggctatggttgccacc

SEQ ID NO: 1179811 - DNA, 13 bp, Homo sapiens
ccaggctccgccc

SEQ ID NO: 1179812 - DNA, 17 bp, Homo sapiens
ccaggctccgcccttag

SEQ ID NO: 1179813 - DNA, 20 bp, Homo sapiens
ccaggctcggaggaccctgg

SEQ ID NO: 1179814 - DNA, 22 bp, Homo sapiens
ccaggctcggaggaccctggaa

SEQ ID NO: 1179815 - DNA, 19 bp, Homo sapiens
ccaggctctggagccagag

SEQ ID NO: 1179816 - DNA, 19 bp, Homo sapiens
ccaggctctgggcacagtg

SEQ ID NO: 1179817 - DNA, 21 bp, Homo sapiens
ccaggctctgggcacagtgct

SEQ ID NO: 1179818 - DNA, 22 bp, Homo sapiens
ccaggctctttggggtcagcca

SEQ ID NO: 1179819 - DNA, 16 bp, Homo sapiens
ccaggctgaccacagc

SEQ ID NO: 1179820 - DNA, 19 bp, Homo sapiens
ccaggctgaccacagcaca

SEQ ID NO: 1179821 - DNA, 14 bp, Homo sapiens
ccaggctgagcctc

SEQ ID NO: 1179822 - DNA, 17 bp, Homo sapiens
ccaggctgagcctcagt

SEQ ID NO: 1179823 - DNA, 14 bp, Homo sapiens
ccaggctgccgtgg

SEQ ID NO: 1179824 - DNA, 15 bp, Homo sapiens
ccaggctgccgtggg

SEQ ID NO: 1179825 - DNA, 18 bp, Homo sapiens
ccaggctgccgtggggcc

SEQ ID NO: 1179826 - DNA, 13 bp, Homo sapiens
ccaggctgcctcg

SEQ ID NO: 1179827 - DNA, 15 bp, Homo sapiens
ccaggctgcctcgga

SEQ ID NO: 1179828 - DNA, 21 bp, Homo sapiens
ccaggctgcgtccctccgagc

SEQ ID NO: 1179829 - DNA, 21 bp, Homo sapiens
ccaggctgctaacctggaaag

SEQ ID NO: 1179830 - DNA, 12 bp, Homo sapiens
ccaggctggaga

SEQ ID NO: 1179831 - DNA, 17 bp, Homo sapiens
ccaggctggagtgcaat

SEQ ID NO: 1179832 - DNA, 19 bp, Homo sapiens
ccaggctggagtgcaatgg

SEQ ID NO: 1179833 - DNA, 19 bp, Homo sapiens
ccaggctggagtgtagtgg

SEQ ID NO: 1179834 - DNA, 13 bp, Homo sapiens
ccaggctggcgca

SEQ ID NO: 1179835 - DNA, 21 bp, Homo sapiens
ccaggctggcgcagccaaggc

SEQ ID NO: 1179836 - DNA, 13 bp, Homo sapiens
ccaggctgggcac

SEQ ID NO: 1179837 - DNA, 20 bp, Homo sapiens
ccaggctgggccgcaagggc

SEQ ID NO: 1179838 - DNA, 21 bp, Homo sapiens
ccaggctgggccgcaagggcc

SEQ ID NO: 1179839 - DNA, 20 bp, Homo sapiens
ccaggctgggctctgcctgt

SEQ ID NO: 1179840 - DNA, 23 bp, Homo sapiens
ccaggctgggctctgcctgtctg

SEQ ID NO: 1179841 - DNA, 23 bp, Homo sapiens
ccaggctgttctcgaactcctga

SEQ ID NO: 1179842 - DNA, 16 bp, Homo sapiens
ccaggcttcaccctga

SEQ ID NO: 1179843 - DNA, 21 bp, Homo sapiens
ccaggcttccgcgcccagcgc

SEQ ID NO: 1179844 - DNA, 13 bp, Homo sapiens
ccaggcttgcctg

SEQ ID NO: 1179845 - DNA, 13 bp, Homo sapiens
ccaggcttttgct

SEQ ID NO: 1179846 - DNA, 17 bp, Homo sapiens
ccagggaagagaaagtg

SEQ ID NO: 1179847 - DNA, 18 bp, Homo sapiens
ccagggaagctggccgag

SEQ ID NO: 1179848 - DNA, 10 bp, Homo sapiens
ccagggaagg

SEQ ID NO: 1179849 - DNA, 13 bp, Homo sapiens
ccagggaaggaaa

SEQ ID NO: 1179850 - DNA, 22 bp, Homo sapiens
ccagggaaggtggggccctgcc

SEQ ID NO: 1179851 - DNA, 22 bp, Homo sapiens
ccagggaagtgtgtgtgtgtcc

SEQ ID NO: 1179852 - DNA, 21 bp, Homo sapiens
ccagggaatccaagcctccac

SEQ ID NO: 1179853 - DNA, 11 bp, Homo sapiens
ccagggacaga

SEQ ID NO: 1179854 - DNA, 14 bp, Homo sapiens
ccagggacagaggc

SEQ ID NO: 1179855 - DNA, 17 bp, Homo sapiens
ccagggacagaggccaa

SEQ ID NO: 1179856 - DNA, 19 bp, Homo sapiens
ccagggacattgcagagtg

SEQ ID NO: 1179857 - DNA, 16 bp, Homo sapiens
ccagggacccaaagca

SEQ ID NO: 1179858 - DNA, 17 bp, Homo sapiens
ccagggacccaaagcag

SEQ ID NO: 1179859 - DNA, 23 bp, Homo sapiens
ccagggacccttgcctgcctcct

SEQ ID NO: 1179860 - DNA, 22 bp, Homo sapiens
ccagggactcagcgtcccctgc

SEQ ID NO: 1179861 - DNA, 14 bp, Homo sapiens
ccagggactgcagc

SEQ ID NO: 1179862 - DNA, 22 bp, Homo sapiens
ccagggactgcagctgcaccag

SEQ ID NO: 1179863 - DNA, 16 bp, Homo sapiens
ccagggagaatctgag

SEQ ID NO: 1179864 - DNA, 17 bp, Homo sapiens
ccagggagaggccatga

SEQ ID NO: 1179865 - DNA, 18 bp, Homo sapiens
ccagggagcaagacagag

SEQ ID NO: 1179866 - DNA, 12 bp, Homo sapiens
ccagggagcctt

SEQ ID NO: 1179867 - DNA, 13 bp, Homo sapiens
ccagggagccttt

SEQ ID NO: 1179868 - DNA, 17 bp, Homo sapiens
ccagggagctctgggga

SEQ ID NO: 1179869 - DNA, 23 bp, Homo sapiens
ccagggagctgatgccccttctc

SEQ ID NO: 1179870 - DNA, 16 bp, Homo sapiens
ccagggagcttcctgg

SEQ ID NO: 1179871 - DNA, 22 bp, Homo sapiens
ccagggagcttgaaagttttca

SEQ ID NO: 1179872 - DNA, 14 bp, Homo sapiens
ccagggaggcagag

SEQ ID NO: 1179873 - DNA, 14 bp, Homo sapiens
ccagggaggcagcg

SEQ ID NO: 1179874 - DNA, 21 bp, Homo sapiens
ccagggagtgagcagctactg

SEQ ID NO: 1179875 - DNA, 14 bp, Homo sapiens
ccagggatgctggg

SEQ ID NO: 1179876 - DNA, 17 bp, Homo sapiens
ccagggatgctgggctg

SEQ ID NO: 1179877 - DNA, 19 bp, Homo sapiens
ccagggatgctgggctggg

SEQ ID NO: 1179878 - DNA, 20 bp, Homo sapiens
ccagggatgctgggctgggc

SEQ ID NO: 1179879 - DNA, 23 bp, Homo sapiens
ccagggatgctgggctgggccct

SEQ ID NO: 1179880 - DNA, 17 bp, Homo sapiens
ccagggatgggggatgg

SEQ ID NO: 1179881 - DNA, 22 bp, Homo sapiens
ccagggcaagggttaaggcctg

SEQ ID NO: 1179882 - DNA, 14 bp, Homo sapiens
ccagggcaatgcca

SEQ ID NO: 1179883 - DNA, 14 bp, Homo sapiens
ccagggcagcaagg

SEQ ID NO: 1179884 - DNA, 22 bp, Homo sapiens
ccagggcagcaagggacctgct

SEQ ID NO: 1179885 - DNA, 14 bp, Homo sapiens
ccagggcagcagcc

SEQ ID NO: 1179886 - DNA, 18 bp, Homo sapiens
ccagggcagcggctccac

SEQ ID NO: 1179887 - DNA, 16 bp, Homo sapiens
ccagggcagggtctgg

SEQ ID NO: 1179888 - DNA, 17 bp, Homo sapiens
ccagggcagggtctggg

SEQ ID NO: 1179889 - DNA, 19 bp, Homo sapiens
ccagggcatcttgctggct

SEQ ID NO: 1179890 - DNA, 21 bp, Homo sapiens
ccagggcatcttgctggctac

SEQ ID NO: 1179891 - DNA, 18 bp, Homo sapiens
ccagggcatgtgtatgtg

SEQ ID NO: 1179892 - DNA, 21 bp, Homo sapiens
ccagggcatgtgtatgtgtct

SEQ ID NO: 1179893 - DNA, 19 bp, Homo sapiens
ccagggccacgctccagct

SEQ ID NO: 1179894 - DNA, 22 bp, Homo sapiens
ccagggccacgtgccaggcccg

SEQ ID NO: 1179895 - DNA, 17 bp, Homo sapiens
ccagggccagctaattt

SEQ ID NO: 1179896 - DNA, 23 bp, Homo sapiens
ccagggccagctaatttttgtat

SEQ ID NO: 1179897 - DNA, 14 bp, Homo sapiens
ccagggccagggcc

SEQ ID NO: 1179898 - DNA, 13 bp, Homo sapiens
ccagggcccagag

SEQ ID NO: 1179899 - DNA, 14 bp, Homo sapiens
ccagggcccagagc

SEQ ID NO: 1179900 - DNA, 15 bp, Homo sapiens
ccagggcccagagcc

SEQ ID NO: 1179901 - DNA, 16 bp, Homo sapiens
ccagggcccccaccga

SEQ ID NO: 1179902 - DNA, 12 bp, Homo sapiens
ccagggcccctc

SEQ ID NO: 1179903 - DNA, 15 bp, Homo sapiens
gaaaacttaataaaa

SEQ ID NO: 1179904 - DNA, 12 bp, Homo sapiens
gaaaacttcaaa

SEQ ID NO: 1179905 - DNA, 13 bp, Homo sapiens
gaaaacttcaaag

SEQ ID NO: 1179906 - DNA, 16 bp, Homo sapiens
gaaaacttcttttaaa

SEQ ID NO: 1179907 - DNA, 12 bp, Homo sapiens
gaaaactttaaa

SEQ ID NO: 1179908 - DNA, 15 bp, Homo sapiens
gaaaacttttgtaaa

SEQ ID NO: 1179909 - DNA, 19 bp, Homo sapiens
gaaaagaaaaaaaaagaaa

SEQ ID NO: 1179910 - DNA, 20 bp, Homo sapiens
gaaaagaaaaaaaaagaaaa

SEQ ID NO: 1179911 - DNA, 12 bp, Homo sapiens
gaaaagaaaaag

SEQ ID NO: 1179912 - DNA, 18 bp, Homo sapiens
gaaaagaaaaatgagcct

SEQ ID NO: 1179913 - DNA, 15 bp, Homo sapiens
gaaaagaaaacaaaa

SEQ ID NO: 1179914 - DNA, 16 bp, Homo sapiens
gaaaagaaaacaaaaa

SEQ ID NO: 1179915 - DNA, 14 bp, Homo sapiens
gaaaagaaaacatt

SEQ ID NO: 1179916 - DNA, 16 bp, Homo sapiens
gaaaagaaaacattta

SEQ ID NO: 1179917 - DNA, 23 bp, Homo sapiens
gaaaagaaacctggggtgaatac

SEQ ID NO: 1179918 - DNA, 15 bp, Homo sapiens
gaaaagaaagctaca

SEQ ID NO: 1179919 - DNA, 14 bp, Homo sapiens
gaaaagaagaaact

SEQ ID NO: 1179920 - DNA, 22 bp, Homo sapiens
gaaaagaatccctgcagcctgg

SEQ ID NO: 1179921 - DNA, 14 bp, Homo sapiens
gaaaagacatttta

SEQ ID NO: 1179922 - DNA, 22 bp, Homo sapiens
gaaaagaccctgagactccaga

SEQ ID NO: 1179923 - DNA, 19 bp, Homo sapiens
gaaaagacggatggcagga

SEQ ID NO: 1179924 - DNA, 18 bp, Homo sapiens
gaaaagactgtgggtggg

SEQ ID NO: 1179925 - DNA, 20 bp, Homo sapiens
gaaaagactgtgggtgggga

SEQ ID NO: 1179926 - DNA, 23 bp, Homo sapiens
gaaaagactgtgggtggggaggc

SEQ ID NO: 1179927 - DNA, 12 bp, Homo sapiens
gaaaagagaaac

SEQ ID NO: 1179928 - DNA, 13 bp, Homo sapiens
gaaaagagagaaa

SEQ ID NO: 1179929 - DNA, 15 bp, Homo sapiens
gaaaagagatatttt

SEQ ID NO: 1179930 - DNA, 22 bp, Homo sapiens
gaaaagataaagaccagaaatt

SEQ ID NO: 1179931 - DNA, 16 bp, Homo sapiens
gaaaagatacgacttt

SEQ ID NO: 1179932 - DNA, 16 bp, Homo sapiens
gaaaagatccccaaga

SEQ ID NO: 1179933 - DNA, 19 bp, Homo sapiens
gaaaagatgaatttgtcca

SEQ ID NO: 1179934 - DNA, 14 bp, Homo sapiens
gaaaagatgtagat

SEQ ID NO: 1179935 - DNA, 18 bp, Homo sapiens
gaaaagatgtagatttat

SEQ ID NO: 1179936 - DNA, 21 bp, Homo sapiens
gaaaagattttatttatggaa

SEQ ID NO: 1179937 - DNA, 23 bp, Homo sapiens
ccagtaacttttttgtgtatgta

SEQ ID NO: 1179938 - DNA, 12 bp, Homo sapiens
ccagtacctcca

SEQ ID NO: 1179939 - DNA, 16 bp, Homo sapiens
ccagtacctccaagca

SEQ ID NO: 1179940 - DNA, 18 bp, Homo sapiens
ccagtacctccaagcaag

SEQ ID NO: 1179941 - DNA, 14 bp, Homo sapiens
ccagtaccttgctt

SEQ ID NO: 1179942 - DNA, 23 bp, Homo sapiens
ccagtacgtcccgctgctgtgct

SEQ ID NO: 1179943 - DNA, 13 bp, Homo sapiens
ccagtacttgtca

SEQ ID NO: 1179944 - DNA, 16 bp, Homo sapiens
ccagtataagattttt

SEQ ID NO: 1179945 - DNA, 14 bp, Homo sapiens
ccagtatctatata

SEQ ID NO: 1179946 - DNA, 19 bp, Homo sapiens
ccagtattactgctgctgt

SEQ ID NO: 1179947 - DNA, 17 bp, Homo sapiens
ccagtattgaaaacttc

SEQ ID NO: 1179948 - DNA, 19 bp, Homo sapiens
ccagtattgaaaacttcaa

SEQ ID NO: 1179949 - DNA, 13 bp, Homo sapiens
ccagtattgctga

SEQ ID NO: 1179950 - DNA, 22 bp, Homo sapiens
ccagtatttttatacggaaaaa

SEQ ID NO: 1179951 - DNA, 19 bp, Homo sapiens
ccagtatttttgctgcttc

SEQ ID NO: 1179952 - DNA, 17 bp, Homo sapiens
ccagtcaaatctgggct

SEQ ID NO: 1179953 - DNA, 22 bp, Homo sapiens
ccagtcaaatctgggctcactc

SEQ ID NO: 1179954 - DNA, 16 bp, Homo sapiens
ccagtcaagaagaaaa

SEQ ID NO: 1179955 - DNA, 12 bp, Homo sapiens
ccagtcacattg

SEQ ID NO: 1179956 - DNA, 20 bp, Homo sapiens
ccagtcacctcgtctccctg

SEQ ID NO: 1179957 - DNA, 22 bp, Homo sapiens
ccagtcactccctctgccttca

SEQ ID NO: 1179958 - DNA, 15 bp, Homo sapiens
ccagtcactcctctc

SEQ ID NO: 1179959 - DNA, 14 bp, Homo sapiens
ccagtcactgctgc

SEQ ID NO: 1179960 - DNA, 14 bp, Homo sapiens
ccagtcaggcccag

SEQ ID NO: 1179961 - DNA, 17 bp, Homo sapiens
ccagtcaggctgcagag

SEQ ID NO: 1179962 - DNA, 21 bp, Homo sapiens
ccagtcaggctgcagaggcac

SEQ ID NO: 1179963 - DNA, 18 bp, Homo sapiens
ccagtcatggaatcttgc

SEQ ID NO: 1179964 - DNA, 20 bp, Homo sapiens
ccagtcatggaatcttgctg

SEQ ID NO: 1179965 - DNA, 22 bp, Homo sapiens
ccagtcatggtactaccccagc

SEQ ID NO: 1179966 - DNA, 18 bp, Homo sapiens
ccagtccaaatgtcctcc

SEQ ID NO: 1179967 - DNA, 19 bp, Homo sapiens
ccagtccaggctgccgtgg

SEQ ID NO: 1179968 - DNA, 15 bp, Homo sapiens
ccagtccatttccaa

SEQ ID NO: 1179969 - DNA, 14 bp, Homo sapiens
ccagtcccacactg

SEQ ID NO: 1179970 - DNA, 16 bp, Homo sapiens
ccagtccccacccctg

SEQ ID NO: 1179971 - DNA, 17 bp, Homo sapiens
ccagtccccacccctgc

SEQ ID NO: 1179972 - DNA, 19 bp, Homo sapiens
ccagtccccacccctgccc

SEQ ID NO: 1179973 - DNA, 22 bp, Homo sapiens
ccagtccccacccctgccccca

SEQ ID NO: 1179974 - DNA, 14 bp, Homo sapiens
ccagtcccctttgt

SEQ ID NO: 1179975 - DNA, 22 bp, Homo sapiens
ccagtccctgggggaagccctg

SEQ ID NO: 1179976 - DNA, 18 bp, Homo sapiens
ccagtcctcactgtcctg

SEQ ID NO: 1179977 - DNA, 16 bp, Homo sapiens
ccagtcctccagacca

SEQ ID NO: 1179978 - DNA, 21 bp, Homo sapiens
ccagtcctgcctggccaggca

SEQ ID NO: 1179979 - DNA, 22 bp, Homo sapiens
ccagtcctgcctggccaggcag

SEQ ID NO: 1179980 - DNA, 15 bp, Homo sapiens
ccagtcgagacctca

SEQ ID NO: 1179981 - DNA, 18 bp, Homo sapiens
ccagtcggccccatctct

SEQ ID NO: 1179982 - DNA, 20 bp, Homo sapiens
ccagtcgggagagccaggct

SEQ ID NO: 1179983 - DNA, 21 bp, Homo sapiens
ccagtcgggagagccaggctt

SEQ ID NO: 1179984 - DNA, 18 bp, Homo sapiens
ccagtcgttagaatatag

SEQ ID NO: 1179985 - DNA, 20 bp, Homo sapiens
ccagtctatttccactgaac

SEQ ID NO: 1179986 - DNA, 14 bp, Homo sapiens
ccagtctcagagac

SEQ ID NO: 1179987 - DNA, 20 bp, Homo sapiens
ccagtctcagagaccagcac

SEQ ID NO: 1179988 - DNA, 21 bp, Homo sapiens
ccagtctcagagaccagcact

SEQ ID NO: 1179989 - DNA, 16 bp, Homo sapiens
ccagtctcatctcctg

SEQ ID NO: 1179990 - DNA, 17 bp, Homo sapiens
ccagtctcatctcctga

SEQ ID NO: 1179991 - DNA, 14 bp, Homo sapiens
ccagtctcccaggc

SEQ ID NO: 1179992 - DNA, 19 bp, Homo sapiens
ccagtctgaagtgcctact

SEQ ID NO: 1179993 - DNA, 17 bp, Homo sapiens
ccagtctgaagtttcat

SEQ ID NO: 1179994 - DNA, 22 bp, Homo sapiens
ccagtctgctgccctccatccc

SEQ ID NO: 1179995 - DNA, 23 bp, Homo sapiens
ccagtctgctgccctccatcccg

SEQ ID NO: 1179996 - DNA, 16 bp, Homo sapiens
ccagtctgggctgccg

SEQ ID NO: 1179997 - DNA, 19 bp, Homo sapiens
ccagtctgggctgccgggt

SEQ ID NO: 1179998 - DNA, 16 bp, Homo sapiens
ccagtctgtctactgt

SEQ ID NO: 1179999 - DNA, 12 bp, Homo sapiens
ccagtctgtgga

SEQ ID NO: 1180000 - DNA, 16 bp, Homo sapiens
ccagtctgtggatcag

SEQ ID NO: 1180001 - DNA, 16 bp, Homo sapiens
ccagtctgttccccat

SEQ ID NO: 1180002 - DNA, 18 bp, Homo sapiens
ccagtcttccttgtctct

SEQ ID NO: 1180003 - DNA, 13 bp, Homo sapiens
ccagtcttgccta

SEQ ID NO: 1180004 - DNA, 16 bp, Homo sapiens
ccagtcttgcctaggc

SEQ ID NO: 1180005 - DNA, 18 bp, Homo sapiens
ccagtctttaaaggccca

SEQ ID NO: 1180006 - DNA, 18 bp, Homo sapiens
ccagtgaacattcccagc

SEQ ID NO: 1180007 - DNA, 15 bp, Homo sapiens
ccagtgaactcctgc

SEQ ID NO: 1180008 - DNA, 20 bp, Homo sapiens
ccagtgaacttacacttgga

SEQ ID NO: 1180009 - DNA, 21 bp, Homo sapiens
ccagtgaacttacacttggag

SEQ ID NO: 1180010 - DNA, 12 bp, Homo sapiens
ccagtgaagcct

SEQ ID NO: 1180011 - DNA, 14 bp, Homo sapiens
ccagtgaagggttt

SEQ ID NO: 1180012 - DNA, 17 bp, Homo sapiens
ccagtgaagtccttcag

SEQ ID NO: 1180013 - DNA, 19 bp, Homo sapiens
ccagtgacaaagactcctc

SEQ ID NO: 1180014 - DNA, 17 bp, Homo sapiens
ccagtgacagacaggct

SEQ ID NO: 1180015 - DNA, 19 bp, Homo sapiens
ccagtgacagacaggctct

SEQ ID NO: 1180016 - DNA, 17 bp, Homo sapiens
ccagtgacccctgacct

SEQ ID NO: 1180017 - DNA, 20 bp, Homo sapiens
ccagtgacctgctgggtaaa

SEQ ID NO: 1180018 - DNA, 18 bp, Homo sapiens
ccagtgacttgttctgag

SEQ ID NO: 1180019 - DNA, 12 bp, Homo sapiens
ccagtgactttt

SEQ ID NO: 1180020 - DNA, 19 bp, Homo sapiens
ccagtgagaagctgaggcc

SEQ ID NO: 1180021 - DNA, 20 bp, Homo sapiens
ccagtgagaagctgaggcct

SEQ ID NO: 1180022 - DNA, 21 bp, Homo sapiens
ccagtgagactgccccacgga

SEQ ID NO: 1180023 - DNA, 21 bp, Homo sapiens
ccagtgaggatgctgcagtga

SEQ ID NO: 1180024 - DNA, 12 bp, Homo sapiens
ccagtgatgatg

SEQ ID NO: 1180025 - DNA, 18 bp, Homo sapiens
gaaacgcacttacaagtg

SEQ ID NO: 1180026 - DNA, 18 bp, Homo sapiens
gaaacgctacctctctgt

SEQ ID NO: 1180027 - DNA, 16 bp, Homo sapiens
gaaacgggctccttcc

SEQ ID NO: 1180028 - DNA, 17 bp, Homo sapiens
gaaacggtatcctccct

SEQ ID NO: 1180029 - DNA, 22 bp, Homo sapiens
gaaacggtatcctccctgccca

SEQ ID NO: 1180030 - DNA, 21 bp, Homo sapiens
gaaacgtatgtgtgcaggagc

SEQ ID NO: 1180031 - DNA, 22 bp, Homo sapiens
gaaacgtggatacagagccacg

SEQ ID NO: 1180032 - DNA, 15 bp, Homo sapiens
gaaactaaaaatata

SEQ ID NO: 1180033 - DNA, 17 bp, Homo sapiens
gaaactaaacagaaaac

SEQ ID NO: 1180034 - DNA, 19 bp, Homo sapiens
gaaactaaacagaaaactc

SEQ ID NO: 1180035 - DNA, 12 bp, Homo sapiens
gaaactaacaga

SEQ ID NO: 1180036 - DNA, 23 bp, Homo sapiens
gaaactaagagacagttctctgt

SEQ ID NO: 1180037 - DNA, 17 bp, Homo sapiens
gaaactaggcttctgta

SEQ ID NO: 1180038 - DNA, 17 bp, Homo sapiens
gaaactatgtgtttttc

SEQ ID NO: 1180039 - DNA, 18 bp, Homo sapiens
gaaactatgtgtttttct

SEQ ID NO: 1180040 - DNA, 17 bp, Homo sapiens
gaaactcaccatgtaaa

SEQ ID NO: 1180041 - DNA, 23 bp, Homo sapiens
gaaactcacctgctggcccctca

SEQ ID NO: 1180042 - DNA, 19 bp, Homo sapiens
gaaactccacatctgcctt

SEQ ID NO: 1180043 - DNA, 13 bp, Homo sapiens
gaaactccatctc

SEQ ID NO: 1180044 - DNA, 18 bp, Homo sapiens
gaaactcccatgtatgga

SEQ ID NO: 1180045 - DNA, 15 bp, Homo sapiens
gaaactcctgtttct

SEQ ID NO: 1180046 - DNA, 17 bp, Homo sapiens
gaaactcctgtttctcc

SEQ ID NO: 1180047 - DNA, 19 bp, Homo sapiens
gaaactcctgtttctcctt

SEQ ID NO: 1180048 - DNA, 19 bp, Homo sapiens
gaaactccttttgctgtct

SEQ ID NO: 1180049 - DNA, 21 bp, Homo sapiens
gaaactccttttgctgtcttt

SEQ ID NO: 1180050 - DNA, 16 bp, Homo sapiens
gaaactcgggcttgag

SEQ ID NO: 1180051 - DNA, 13 bp, Homo sapiens
gaaactctggctc

SEQ ID NO: 1180052 - DNA, 18 bp, Homo sapiens
gaaactctggctcagcct

SEQ ID NO: 1180053 - DNA, 21 bp, Homo sapiens
gaaactctttcattcttctca

SEQ ID NO: 1180054 - DNA, 15 bp, Homo sapiens
gaaactgacagtatt

SEQ ID NO: 1180055 - DNA, 18 bp, Homo sapiens
gaaactgaggaattttct

SEQ ID NO: 1180056 - DNA, 15 bp, Homo sapiens
gaaactgcagggaaa

SEQ ID NO: 1180057 - DNA, 15 bp, Homo sapiens
gaaactgccaagggt

SEQ ID NO: 1180058 - DNA, 17 bp, Homo sapiens
gaaactgctaaattcta

SEQ ID NO: 1180059 - DNA, 17 bp, Homo sapiens
gaaactggattaaaaca

SEQ ID NO: 1180060 - DNA, 20 bp, Homo sapiens
gaaactggattaaaacaatt

SEQ ID NO: 1180061 - DNA, 17 bp, Homo sapiens
gaaactggattaaactt

SEQ ID NO: 1180062 - DNA, 16 bp, Homo sapiens
gaaactggcaaagcag

SEQ ID NO: 1180063 - DNA, 17 bp, Homo sapiens
gaaactggcactgaatt

SEQ ID NO: 1180064 - DNA, 11 bp, Homo sapiens
gaaactggctg

SEQ ID NO: 1180065 - DNA, 22 bp, Homo sapiens
gaaactgtacatactgcagtgt

SEQ ID NO: 1180066 - DNA, 20 bp, Homo sapiens
gaaactgttcccacctgctg

SEQ ID NO: 1180067 - DNA, 22 bp, Homo sapiens
gaaactgttcccacctgctgga

SEQ ID NO: 1180068 - DNA, 21 bp, Homo sapiens
gaaacttaaatgttattatct

SEQ ID NO: 1180069 - DNA, 22 bp, Homo sapiens
ccatattcagtgctgtggcctg

SEQ ID NO: 1180070 - DNA, 14 bp, Homo sapiens
ccatattggccagt

SEQ ID NO: 1180071 - DNA, 18 bp, Homo sapiens
ccatattgtaaaacaggt

SEQ ID NO: 1180072 - DNA, 21 bp, Homo sapiens
ccatattgtgcttcacagtag

SEQ ID NO: 1180073 - DNA, 20 bp, Homo sapiens
ccatattttattactgttta

SEQ ID NO: 1180074 - DNA, 15 bp, Homo sapiens
ccatcaaaaatattc

SEQ ID NO: 1180075 - DNA, 17 bp, Homo sapiens
ccatcaaaggaatataa

SEQ ID NO: 1180076 - DNA, 21 bp, Homo sapiens
ccatcaaaggaatataagaaa

SEQ ID NO: 1180077 - DNA, 20 bp, Homo sapiens
ccatcaactaaaacattata

SEQ ID NO: 1180078 - DNA, 20 bp, Homo sapiens
ccatcacagggttgggccca

SEQ ID NO: 1180079 - DNA, 16 bp, Homo sapiens
ccatcacatcccttca

SEQ ID NO: 1180080 - DNA, 20 bp, Homo sapiens
ccatcaccaccgcctctggc

SEQ ID NO: 1180081 - DNA, 13 bp, Homo sapiens
ccatcaccagaca

SEQ ID NO: 1180082 - DNA, 19 bp, Homo sapiens
ccatcaccctcacccactc

SEQ ID NO: 1180083 - DNA, 17 bp, Homo sapiens
ccatcaccgctgggtgg

SEQ ID NO: 1180084 - DNA, 18 bp, Homo sapiens
ccatcacctgaaacactg

SEQ ID NO: 1180085 - DNA, 17 bp, Homo sapiens
ccatcactcgcaggacc

SEQ ID NO: 1180086 - DNA, 21 bp, Homo sapiens
ccatcactcgcaggaccaagg

SEQ ID NO: 1180087 - DNA, 19 bp, Homo sapiens
ccatcactgcgccactgct

SEQ ID NO: 1180088 - DNA, 18 bp, Homo sapiens
ccatcactggagcaccag

SEQ ID NO: 1180089 - DNA, 20 bp, Homo sapiens
ccatcacttctccccgcagc

SEQ ID NO: 1180090 - DNA, 18 bp, Homo sapiens
ccatcagatgtgttcctc

SEQ ID NO: 1180091 - DNA, 22 bp, Homo sapiens
ccatcagcaggctccagttgaa

SEQ ID NO: 1180092 - DNA, 13 bp, Homo sapiens
ccatcagccattt

SEQ ID NO: 1180093 - DNA, 23 bp, Homo sapiens
ccatcagcgggtctcctcccagc

SEQ ID NO: 1180094 - DNA, 19 bp, Homo sapiens
ccatcagctgtaagaagag

SEQ ID NO: 1180095 - DNA, 21 bp, Homo sapiens
ccatcagggccctgccccagg

SEQ ID NO: 1180096 - DNA, 14 bp, Homo sapiens
ccatcagggtgggc

SEQ ID NO: 1180097 - DNA, 22 bp, Homo sapiens
ccatcagggtgggccactctcc

SEQ ID NO: 1180098 - DNA, 20 bp, Homo sapiens
ccatcagggttctcttagca

SEQ ID NO: 1180099 - DNA, 22 bp, Homo sapiens
ccatcaggtcccccccaggtgc

SEQ ID NO: 1180100 - DNA, 20 bp, Homo sapiens
ccatcagttcccccagtacc

SEQ ID NO: 1180101 - DNA, 15 bp, Homo sapiens
ccatcataggaaggg

SEQ ID NO: 1180102 - DNA, 16 bp, Homo sapiens
ccatcatcatgtgtgt

SEQ ID NO: 1180103 - DNA, 15 bp, Homo sapiens
ccatcatcccagctg

SEQ ID NO: 1180104 - DNA, 13 bp, Homo sapiens
ccatcatcctact

SEQ ID NO: 1180105 - DNA, 17 bp, Homo sapiens
ccatcatcctttgttct

SEQ ID NO: 1180106 - DNA, 20 bp, Homo sapiens
ccatcatgccttgataaata

SEQ ID NO: 1180107 - DNA, 18 bp, Homo sapiens
ccatcattccttctggcc

SEQ ID NO: 1180108 - DNA, 12 bp, Homo sapiens
ccatcatttctg

SEQ ID NO: 1180109 - DNA, 13 bp, Homo sapiens
ccatcatttctgt

SEQ ID NO: 1180110 - DNA, 18 bp, Homo sapiens
ccatccaaccactgtaca

SEQ ID NO: 1180111 - DNA, 16 bp, Homo sapiens
ccatccacgtggcctc

SEQ ID NO: 1180112 - DNA, 19 bp, Homo sapiens
ccatccactctaccctccc

SEQ ID NO: 1180113 - DNA, 13 bp, Homo sapiens
ccatccagccacg

SEQ ID NO: 1180114 - DNA, 12 bp, Homo sapiens
ccatccagccag

SEQ ID NO: 1180115 - DNA, 11 bp, Homo sapiens
ccatccagggt

SEQ ID NO: 1180116 - DNA, 13 bp, Homo sapiens
ccatccagggtct

SEQ ID NO: 1180117 - DNA, 21 bp, Homo sapiens
ccatccagggtctggcagagc

SEQ ID NO: 1180118 - DNA, 22 bp, Homo sapiens
ccatccagggtctggcagagcc

SEQ ID NO: 1180119 - DNA, 13 bp, Homo sapiens
ccatccaggtctt

SEQ ID NO: 1180120 - DNA, 18 bp, Homo sapiens
ccatccagtgacaaacca

SEQ ID NO: 1180121 - DNA, 11 bp, Homo sapiens
ccatccatccc

SEQ ID NO: 1180122 - DNA, 16 bp, Homo sapiens
ccatccatctgtccgt

SEQ ID NO: 1180123 - DNA, 14 bp, Homo sapiens
ccatccattctgga

SEQ ID NO: 1180124 - DNA, 13 bp, Homo sapiens
ccatcccagggtc

SEQ ID NO: 1180125 - DNA, 21 bp, Homo sapiens
ccatcccagggtcccaccccc

SEQ ID NO: 1180126 - DNA, 18 bp, Homo sapiens
ccatcccattttcatcct

SEQ ID NO: 1180127 - DNA, 14 bp, Homo sapiens
ccatccccaccagc

SEQ ID NO: 1180128 - DNA, 18 bp, Homo sapiens
ccatccccaccagctcgt

SEQ ID NO: 1180129 - DNA, 11 bp, Homo sapiens
ccatccccagg

SEQ ID NO: 1180130 - DNA, 19 bp, Homo sapiens
ccatccccaggtccccaaa

SEQ ID NO: 1180131 - DNA, 22 bp, Homo sapiens
ccatccccaggtccccaaactt

SEQ ID NO: 1180132 - DNA, 17 bp, Homo sapiens
ccatccccatcctccag

SEQ ID NO: 1180133 - DNA, 18 bp, Homo sapiens
ccatccccatcctccagc

SEQ ID NO: 1180134 - DNA, 22 bp, Homo sapiens
ccatccccatcggccctgtccc

SEQ ID NO: 1180135 - DNA, 12 bp, Homo sapiens
ccatccccctgc

SEQ ID NO: 1180136 - DNA, 17 bp, Homo sapiens
ccatcccccttcttcct

SEQ ID NO: 1180137 - DNA, 23 bp, Homo sapiens
ccatcccccttcttcctcccctc

SEQ ID NO: 1180138 - DNA, 14 bp, Homo sapiens
ccatcccctccctg

SEQ ID NO: 1180139 - DNA, 22 bp, Homo sapiens
ccatcccctccctgcctgctcc

SEQ ID NO: 1180140 - DNA, 14 bp, Homo sapiens
ccatcccctcctag

SEQ ID NO: 1180141 - DNA, 17 bp, Homo sapiens
ccatcccctcctagcac

SEQ ID NO: 1180142 - DNA, 16 bp, Homo sapiens
ccatcccctgtagagt

SEQ ID NO: 1180143 - DNA, 22 bp, Homo sapiens
ccatcccctgtagagtgggagc

SEQ ID NO: 1180144 - DNA, 14 bp, Homo sapiens
ccatccccttcccc

SEQ ID NO: 1180145 - DNA, 13 bp, Homo sapiens
ccatcccctttcc

SEQ ID NO: 1180146 - DNA, 14 bp, Homo sapiens
ccatcccctttcct

SEQ ID NO: 1180147 - DNA, 17 bp, Homo sapiens
gaaatacagttctgctc

SEQ ID NO: 1180148 - DNA, 14 bp, Homo sapiens
gaaatactcatgtg

SEQ ID NO: 1180149 - DNA, 13 bp, Homo sapiens
gaaatactgctct

SEQ ID NO: 1180150 - DNA, 15 bp, Homo sapiens
gaaatactgctctga

SEQ ID NO: 1180151 - DNA, 22 bp, Homo sapiens
gaaatactgctctgaatatttt

SEQ ID NO: 1180152 - DNA, 15 bp, Homo sapiens
gaaatacttgtgatt

SEQ ID NO: 1180153 - DNA, 21 bp, Homo sapiens
gaaatactttgcataaattaa

SEQ ID NO: 1180154 - DNA, 16 bp, Homo sapiens
gaaatagaattataac

SEQ ID NO: 1180155 - DNA, 21 bp, Homo sapiens
gaaatagacaaaaagtatatt

SEQ ID NO: 1180156 - DNA, 18 bp, Homo sapiens
gaaatagacagcatgaga

SEQ ID NO: 1180157 - DNA, 18 bp, Homo sapiens
gaaatagacagtatattt

SEQ ID NO: 1180158 - DNA, 19 bp, Homo sapiens
gaaatagccaaaaaggcaa

SEQ ID NO: 1180159 - DNA, 21 bp, Homo sapiens
gaaatagctttactgtttctc

SEQ ID NO: 1180160 - DNA, 20 bp, Homo sapiens
gaaataggagggaaaccttt

SEQ ID NO: 1180161 - DNA, 18 bp, Homo sapiens
gaaatagttcaaagccaa

SEQ ID NO: 1180162 - DNA, 13 bp, Homo sapiens
gaaatataattga

SEQ ID NO: 1180163 - DNA, 14 bp, Homo sapiens
gaaatatacagttt

SEQ ID NO: 1180164 - DNA, 20 bp, Homo sapiens
gaaatatacagtttgacttt

SEQ ID NO: 1180165 - DNA, 21 bp, Homo sapiens
gaaatatacttttacaagtaa

SEQ ID NO: 1180166 - DNA, 21 bp, Homo sapiens
gaaatataggatagacactgg

SEQ ID NO: 1180167 - DNA, 22 bp, Homo sapiens
gaaatataggatagacactgga

SEQ ID NO: 1180168 - DNA, 17 bp, Homo sapiens
gaaatatatttgtaaaa

SEQ ID NO: 1180169 - DNA, 23 bp, Homo sapiens
gaaatatcaaagtcattaaagac

SEQ ID NO: 1180170 - DNA, 21 bp, Homo sapiens
gaaatatcagttactcagccc

SEQ ID NO: 1180171 - DNA, 22 bp, Homo sapiens
gaaatatcatcacgtatgttat

SEQ ID NO: 1180172 - DNA, 18 bp, Homo sapiens
gaaatatctgaaaatgta

SEQ ID NO: 1180173 - DNA, 16 bp, Homo sapiens
gaaatatctgtgaaat

SEQ ID NO: 1180174 - DNA, 20 bp, Homo sapiens
gaaatatctgtgaaatatca

SEQ ID NO: 1180175 - DNA, 14 bp, Homo sapiens
gaaatatctttctc

SEQ ID NO: 1180176 - DNA, 14 bp, Homo sapiens
gaaatatgaaattc

SEQ ID NO: 1180177 - DNA, 14 bp, Homo sapiens
gaaatatgatttta

SEQ ID NO: 1180178 - DNA, 22 bp, Homo sapiens
gaaatatgattttatttgacaa

SEQ ID NO: 1180179 - DNA, 17 bp, Homo sapiens
gaaatatgcacaatagc

SEQ ID NO: 1180180 - DNA, 14 bp, Homo sapiens
gaaatatgcatact

SEQ ID NO: 1180181 - DNA, 13 bp, Homo sapiens
gaaatatgcatct

SEQ ID NO: 1180182 - DNA, 22 bp, Homo sapiens
gaaatatgtagtattaaaagtt

SEQ ID NO: 1180183 - DNA, 13 bp, Homo sapiens
gaaatattaaaat

SEQ ID NO: 1180184 - DNA, 19 bp, Homo sapiens
gaaatattaaaccctggat

SEQ ID NO: 1180185 - DNA, 15 bp, Homo sapiens
gaaatattccctaga

SEQ ID NO: 1180186 - DNA, 18 bp, Homo sapiens
gaaatattcttattactc

SEQ ID NO: 1180187 - DNA, 14 bp, Homo sapiens
gaaatattgctgta

SEQ ID NO: 1180188 - DNA, 15 bp, Homo sapiens
gaaatattgtgctta

SEQ ID NO: 1180189 - DNA, 13 bp, Homo sapiens
gaaatatttacct

SEQ ID NO: 1180190 - DNA, 19 bp, Homo sapiens
gaaatatttgtgacaaaaa

SEQ ID NO: 1180191 - DNA, 11 bp, Homo sapiens
gaaatcactgt

SEQ ID NO: 1180192 - DNA, 18 bp, Homo sapiens
gaaatcagcatgacaaaa

SEQ ID NO: 1180193 - DNA, 20 bp, Homo sapiens
gaaatcagcatgacaaaaat

SEQ ID NO: 1180194 - DNA, 20 bp, Homo sapiens
gaaatcagccaagttttata

SEQ ID NO: 1180195 - DNA, 19 bp, Homo sapiens
gaaatcaggtgttttaaga

SEQ ID NO: 1180196 - DNA, 23 bp, Homo sapiens
gaaatcaggtgttttaagactga

SEQ ID NO: 1180197 - DNA, 18 bp, Homo sapiens
gaaatcagtaatatttat

SEQ ID NO: 1180198 - DNA, 18 bp, Homo sapiens
gaaatcagtgaggtgaga

SEQ ID NO: 1180199 - DNA, 20 bp, Homo sapiens
gaaatcatcctgttttctct

SEQ ID NO: 1180200 - DNA, 15 bp, Homo sapiens
gaaatcattgtagaa

SEQ ID NO: 1180201 - DNA, 16 bp, Homo sapiens
gaaatcattgtagaaa

SEQ ID NO: 1180202 - DNA, 15 bp, Homo sapiens
ccatgcctcagccct

SEQ ID NO: 1180203 - DNA, 16 bp, Homo sapiens
ccatgcctcagccctg

SEQ ID NO: 1180204 - DNA, 16 bp, Homo sapiens
ccatgcctcatgccac

SEQ ID NO: 1180205 - DNA, 20 bp, Homo sapiens
ccatgcctcatgccacacct

SEQ ID NO: 1180206 - DNA, 13 bp, Homo sapiens
ccatgcctccctg

SEQ ID NO: 1180207 - DNA, 14 bp, Homo sapiens
ccatgcctccctgg

SEQ ID NO: 1180208 - DNA, 15 bp, Homo sapiens
ccatgcctccctggg

SEQ ID NO: 1180209 - DNA, 13 bp, Homo sapiens
ccatgcctctgga

SEQ ID NO: 1180210 - DNA, 22 bp, Homo sapiens
ccatgcctctggaggcctctgg

SEQ ID NO: 1180211 - DNA, 15 bp, Homo sapiens
ccatgcctgagggtg

SEQ ID NO: 1180212 - DNA, 21 bp, Homo sapiens
ccatgcgcagatgaggggcca

SEQ ID NO: 1180213 - DNA, 14 bp, Homo sapiens
ccatgcgccccctc

SEQ ID NO: 1180214 - DNA, 22 bp, Homo sapiens
ccatgcgccccctccgccctgc

SEQ ID NO: 1180215 - DNA, 13 bp, Homo sapiens
ccatgcgctcagg

SEQ ID NO: 1180216 - DNA, 15 bp, Homo sapiens
ccatgcgctcagggc

SEQ ID NO: 1180217 - DNA, 17 bp, Homo sapiens
ccatgcgtgccgcctgc

SEQ ID NO: 1180218 - DNA, 20 bp, Homo sapiens
ccatgcgtgccgcctgctcc

SEQ ID NO: 1180219 - DNA, 23 bp, Homo sapiens
ccatgcgtgccgcctgctcctca

SEQ ID NO: 1180220 - DNA, 17 bp, Homo sapiens
ccatgctcaacccccct

SEQ ID NO: 1180221 - DNA, 20 bp, Homo sapiens
ccatgctcaacccccctccc

SEQ ID NO: 1180222 - DNA, 23 bp, Homo sapiens
ccatgctcaacccccctcccaga

SEQ ID NO: 1180223 - DNA, 17 bp, Homo sapiens
ccatgctctgccccaag

SEQ ID NO: 1180224 - DNA, 16 bp, Homo sapiens
ccatgctgaaggctcc

SEQ ID NO: 1180225 - DNA, 19 bp, Homo sapiens
ccatgctgaggcctgggcc

SEQ ID NO: 1180226 - DNA, 19 bp, Homo sapiens
ccatgctgcaaaggagaag

SEQ ID NO: 1180227 - DNA, 15 bp, Homo sapiens
ccatgctgccttcag

SEQ ID NO: 1180228 - DNA, 17 bp, Homo sapiens
ccatgctgccttcaggg

SEQ ID NO: 1180229 - DNA, 21 bp, Homo sapiens
ccatgctgctttttggcacag

SEQ ID NO: 1180230 - DNA, 18 bp, Homo sapiens
ccatgctggatactggac

SEQ ID NO: 1180231 - DNA, 16 bp, Homo sapiens
ccatgctgggaagacg

SEQ ID NO: 1180232 - DNA, 12 bp, Homo sapiens
ccatgctgggcc

SEQ ID NO: 1180233 - DNA, 17 bp, Homo sapiens
ccatgctgggccactgg

SEQ ID NO: 1180234 - DNA, 20 bp, Homo sapiens
ccatgctgggccactgggga

SEQ ID NO: 1180235 - DNA, 19 bp, Homo sapiens
ccatgctgtccctgcactg

SEQ ID NO: 1180236 - DNA, 22 bp, Homo sapiens
ccatgctgtccctgcactgtgc

SEQ ID NO: 1180237 - DNA, 19 bp, Homo sapiens
ccatgctgtgcgcccaggg

SEQ ID NO: 1180238 - DNA, 19 bp, Homo sapiens
ccatgcttacgtgatcctc

SEQ ID NO: 1180239 - DNA, 16 bp, Homo sapiens
ccatgcttagtcactg

SEQ ID NO: 1180240 - DNA, 17 bp, Homo sapiens
ccatgcttagtcactgc

SEQ ID NO: 1180241 - DNA, 20 bp, Homo sapiens
ccatgcttagtcactgcctg

SEQ ID NO: 1180242 - DNA, 14 bp, Homo sapiens
ccatgcttgcctga

SEQ ID NO: 1180243 - DNA, 23 bp, Homo sapiens
ccatggaaataaaaagtatgttg

SEQ ID NO: 1180244 - DNA, 11 bp, Homo sapiens
ccatggaaggt

SEQ ID NO: 1180245 - DNA, 15 bp, Homo sapiens
ccatggaaggtgcca

SEQ ID NO: 1180246 - DNA, 23 bp, Homo sapiens
ccatggaaggtgccagaaggaag

SEQ ID NO: 1180247 - DNA, 13 bp, Homo sapiens
ccatggaattccc

SEQ ID NO: 1180248 - DNA, 18 bp, Homo sapiens
ccatggaattccctcctg

SEQ ID NO: 1180249 - DNA, 19 bp, Homo sapiens
ccatggaattccctcctga

SEQ ID NO: 1180250 - DNA, 22 bp, Homo sapiens
ccatggacactacacccagcaa

SEQ ID NO: 1180251 - DNA, 23 bp, Homo sapiens
ccatggacactacacccagcaat

SEQ ID NO: 1180252 - DNA, 16 bp, Homo sapiens
ccatggacaggctggc

SEQ ID NO: 1180253 - DNA, 19 bp, Homo sapiens
ccatggacaggctggctcc

SEQ ID NO: 1180254 - DNA, 15 bp, Homo sapiens
ccatggactctacac

SEQ ID NO: 1180255 - DNA, 22 bp, Homo sapiens
ccatggactctacactgtgaac

SEQ ID NO: 1180256 - DNA, 23 bp, Homo sapiens
ccatggacttcacataagctcag

SEQ ID NO: 1180257 - DNA, 17 bp, Homo sapiens
ccatggagacaagaagg

SEQ ID NO: 1180258 - DNA, 20 bp, Homo sapiens
ccatggagacgtggtgggac

SEQ ID NO: 1180259 - DNA, 18 bp, Homo sapiens
ccatggagatctgaaggg

SEQ ID NO: 1180260 - DNA, 14 bp, Homo sapiens
ccatggagccagct

SEQ ID NO: 1180261 - DNA, 21 bp, Homo sapiens
ccatggatttcgtttttcttg

SEQ ID NO: 1180262 - DNA, 19 bp, Homo sapiens
ccatggcaccagccccctg

SEQ ID NO: 1180263 - DNA, 22 bp, Homo sapiens
ccatggcaccagccccctggat

SEQ ID NO: 1180264 - DNA, 23 bp, Homo sapiens
ccatggcactaaaccacttctct

SEQ ID NO: 1180265 - DNA, 23 bp, Homo sapiens
ccatggcatgcgccaccatgccc

SEQ ID NO: 1180266 - DNA, 14 bp, Homo sapiens
ccatggccaccccg

SEQ ID NO: 1180267 - DNA, 13 bp, Homo sapiens
ccatggcccccca

SEQ ID NO: 1180268 - DNA, 18 bp, Homo sapiens
ccatttttgctaattatc

SEQ ID NO: 1180269 - DNA, 17 bp, Homo sapiens
ccattttttaaggaaac

SEQ ID NO: 1180270 - DNA, 14 bp, Homo sapiens
cccaaaacccaggg

SEQ ID NO: 1180271 - DNA, 13 bp, Homo sapiens
cccaaaagccatg

SEQ ID NO: 1180272 - DNA, 22 bp, Homo sapiens
cccaaaagccatgtatttcagg

SEQ ID NO: 1180273 - DNA, 19 bp, Homo sapiens
cccaaaatctgattagaag

SEQ ID NO: 1180274 - DNA, 16 bp, Homo sapiens
cccaaacacttctgct

SEQ ID NO: 1180275 - DNA, 17 bp, Homo sapiens
cccaaacacttctgctt

SEQ ID NO: 1180276 - DNA, 20 bp, Homo sapiens
cccaaacagctgtatttata

SEQ ID NO: 1180277 - DNA, 22 bp, Homo sapiens
cccaaacattaatcaccaaagt

SEQ ID NO: 1180278 - DNA, 20 bp, Homo sapiens
cccaaaccattactgagggg

SEQ ID NO: 1180279 - DNA, 19 bp, Homo sapiens
cccaaacccaagtgccttc

SEQ ID NO: 1180280 - DNA, 23 bp, Homo sapiens
cccaaacccagtctcctctccat

SEQ ID NO: 1180281 - DNA, 22 bp, Homo sapiens
cccaaacttatggacactgcct

SEQ ID NO: 1180282 - DNA, 23 bp, Homo sapiens
cccaaagattaggtcgttttcca

SEQ ID NO: 1180283 - DNA, 15 bp, Homo sapiens
cccaaagcacatgct

SEQ ID NO: 1180284 - DNA, 21 bp, Homo sapiens
cccaaagcacatgcttagctt

SEQ ID NO: 1180285 - DNA, 22 bp, Homo sapiens
cccaaagcagcaggcctctggt

SEQ ID NO: 1180286 - DNA, 14 bp, Homo sapiens
cccaaagcaggatg

SEQ ID NO: 1180287 - DNA, 14 bp, Homo sapiens
cccaaagccagaca

SEQ ID NO: 1180288 - DNA, 12 bp, Homo sapiens
cccaaagccctg

SEQ ID NO: 1180289 - DNA, 17 bp, Homo sapiens
cccaaagcctgtcccag

SEQ ID NO: 1180290 - DNA, 19 bp, Homo sapiens
cccaaagcggtccctgtcc

SEQ ID NO: 1180291 - DNA, 23 bp, Homo sapiens
cccaaaggatactgtaacacttt

SEQ ID NO: 1180292 - DNA, 15 bp, Homo sapiens
cccaaaggatgagaa

SEQ ID NO: 1180293 - DNA, 15 bp, Homo sapiens
cccaaaggcccaggg

SEQ ID NO: 1180294 - DNA, 16 bp, Homo sapiens
cccaaaggcccaggga

SEQ ID NO: 1180295 - DNA, 21 bp, Homo sapiens
cccaaaggcccagggaggcag

SEQ ID NO: 1180296 - DNA, 20 bp, Homo sapiens
cccaaagtgctgagattaca

SEQ ID NO: 1180297 - DNA, 14 bp, Homo sapiens
cccaaagtgctggg

SEQ ID NO: 1180298 - DNA, 21 bp, Homo sapiens
cccaaagtggtatagaaatgc

SEQ ID NO: 1180299 - DNA, 21 bp, Homo sapiens
cccaaataattgttgtgtgta

SEQ ID NO: 1180300 - DNA, 20 bp, Homo sapiens
cccaaatatgtattttccta

SEQ ID NO: 1180301 - DNA, 16 bp, Homo sapiens
cccaaatcaatacact

SEQ ID NO: 1180302 - DNA, 10 bp, Homo sapiens
cccaaatgat

SEQ ID NO: 1180303 - DNA, 21 bp, Homo sapiens
cccaaattataagggccctgc

SEQ ID NO: 1180304 - DNA, 16 bp, Homo sapiens
cccaaatttgattgat

SEQ ID NO: 1180305 - DNA, 21 bp, Homo sapiens
cccaacacctgcctctgaccc

SEQ ID NO: 1180306 - DNA, 12 bp, Homo sapiens
cccaacactgtg

SEQ ID NO: 1180307 - DNA, 21 bp, Homo sapiens
cccaacactgtgccctggtgg

SEQ ID NO: 1180308 - DNA, 22 bp, Homo sapiens
cccaacactgtgccctggtgga

SEQ ID NO: 1180309 - DNA, 15 bp, Homo sapiens
cccaacagccttagc

SEQ ID NO: 1180310 - DNA, 23 bp, Homo sapiens
cccaacagccttagctgccagtg

SEQ ID NO: 1180311 - DNA, 17 bp, Homo sapiens
cccaacaggaattttta

SEQ ID NO: 1180312 - DNA, 22 bp, Homo sapiens
cccaacaggtgctgaactgtgc

SEQ ID NO: 1180313 - DNA, 17 bp, Homo sapiens
cccaacagtttattttt

SEQ ID NO: 1180314 - DNA, 12 bp, Homo sapiens
cccaacatggga

SEQ ID NO: 1180315 - DNA, 15 bp, Homo sapiens
cccaaccaaggaagg

SEQ ID NO: 1180316 - DNA, 17 bp, Homo sapiens
cccaaccaaggaaggag

SEQ ID NO: 1180317 - DNA, 20 bp, Homo sapiens
cccaaccaaggaaggagccc

SEQ ID NO: 1180318 - DNA, 22 bp, Homo sapiens
cccaacccaatccctctccact

SEQ ID NO: 1180319 - DNA, 14 bp, Homo sapiens
cccaacccccaccc

SEQ ID NO: 1180320 - DNA, 13 bp, Homo sapiens
cccaacccccctc

SEQ ID NO: 1180321 - DNA, 19 bp, Homo sapiens
cccaacccccctcctgctc

SEQ ID NO: 1180322 - DNA, 21 bp, Homo sapiens
cccaacccccctcctgctcct

SEQ ID NO: 1180323 - DNA, 22 bp, Homo sapiens
cccaacccccctcctgctcctc

SEQ ID NO: 1180324 - DNA, 15 bp, Homo sapiens
cccaaccccctgcaa

SEQ ID NO: 1180325 - DNA, 17 bp, Homo sapiens
cccaaccccgtgtcctg

SEQ ID NO: 1180326 - DNA, 13 bp, Homo sapiens
cccaaccctgccc

SEQ ID NO: 1180327 - DNA, 20 bp, Homo sapiens
cccaaccctggcttggggtc

SEQ ID NO: 1180328 - DNA, 15 bp, Homo sapiens
cccaacccttcccca

SEQ ID NO: 1180329 - DNA, 13 bp, Homo sapiens
cccaacctcaatg

SEQ ID NO: 1180330 - DNA, 15 bp, Homo sapiens
cccaacctcagggct

SEQ ID NO: 1180331 - DNA, 16 bp, Homo sapiens
cccaacctcctgacct

SEQ ID NO: 1180332 - DNA, 13 bp, Homo sapiens
cccaacctgctct

SEQ ID NO: 1180333 - DNA, 20 bp, Homo sapiens
cccaacgagcctcctcaggg

SEQ ID NO: 1180334 - DNA, 21 bp, Homo sapiens
cccaacgagcctcctcagggg

SEQ ID NO: 1180335 - DNA, 22 bp, Homo sapiens
cccaacggccctgcagccagct

SEQ ID NO: 1180336 - DNA, 19 bp, Homo sapiens
gaaccacattgaagaatgt

SEQ ID NO: 1180337 - DNA, 14 bp, Homo sapiens
gaaccacgaggctg

SEQ ID NO: 1180338 - DNA, 17 bp, Homo sapiens
gaaccacgaggctgccc

SEQ ID NO: 1180339 - DNA, 18 bp, Homo sapiens
gaaccacgaggctgcccc

SEQ ID NO: 1180340 - DNA, 22 bp, Homo sapiens
gaaccactcccaccacaggcat

SEQ ID NO: 1180341 - DNA, 16 bp, Homo sapiens
gaaccactgcttctct

SEQ ID NO: 1180342 - DNA, 21 bp, Homo sapiens
gaaccactgcttctcttttga

SEQ ID NO: 1180343 - DNA, 14 bp, Homo sapiens
gaaccacttccctc

SEQ ID NO: 1180344 - DNA, 11 bp, Homo sapiens
gaaccagactc

SEQ ID NO: 1180345 - DNA, 17 bp, Homo sapiens
gaaccagactcttgcct

SEQ ID NO: 1180346 - DNA, 12 bp, Homo sapiens
gaaccagagcca

SEQ ID NO: 1180347 - DNA, 17 bp, Homo sapiens
gaaccagcaagtcccag

SEQ ID NO: 1180348 - DNA, 22 bp, Homo sapiens
gaaccagcccagcctgccccct

SEQ ID NO: 1180349 - DNA, 20 bp, Homo sapiens
gaaccagccccatcagaacc

SEQ ID NO: 1180350 - DNA, 16 bp, Homo sapiens
gaaccagccgtatttt

SEQ ID NO: 1180351 - DNA, 15 bp, Homo sapiens
gaaccagctcatctc

SEQ ID NO: 1180352 - DNA, 18 bp, Homo sapiens
gaaccagggagaccgagc

SEQ ID NO: 1180353 - DNA, 21 bp, Homo sapiens
gaaccagggcctccctgttca

SEQ ID NO: 1180354 - DNA, 17 bp, Homo sapiens
gaaccatgaagacagga

SEQ ID NO: 1180355 - DNA, 18 bp, Homo sapiens
gaaccatgaagacaggat

SEQ ID NO: 1180356 - DNA, 23 bp, Homo sapiens
gaaccatgtcagcaaaaagcaaa

SEQ ID NO: 1180357 - DNA, 20 bp, Homo sapiens
gaacccaaagagacagctct

SEQ ID NO: 1180358 - DNA, 13 bp, Homo sapiens
gaacccaacagtc

SEQ ID NO: 1180359 - DNA, 17 bp, Homo sapiens
gaacccaacagtccctt

SEQ ID NO: 1180360 - DNA, 15 bp, Homo sapiens
gaacccaagtgcctc

SEQ ID NO: 1180361 - DNA, 22 bp, Homo sapiens
gaacccacccggctggccggga

SEQ ID NO: 1180362 - DNA, 15 bp, Homo sapiens
gaacccaggacgctt

SEQ ID NO: 1180363 - DNA, 19 bp, Homo sapiens
gaacccaggacgcttctga

SEQ ID NO: 1180364 - DNA, 12 bp, Homo sapiens
gaacccagggct

SEQ ID NO: 1180365 - DNA, 17 bp, Homo sapiens
gaacccagggctctgcc

SEQ ID NO: 1180366 - DNA, 21 bp, Homo sapiens
gaacccagggctctgccccag

SEQ ID NO: 1180367 - DNA, 19 bp, Homo sapiens
gaaccccatgggcttggac

SEQ ID NO: 1180368 - DNA, 14 bp, Homo sapiens
gaaccccccaggcc

SEQ ID NO: 1180369 - DNA, 19 bp, Homo sapiens
gaaccccccaggccctaca

SEQ ID NO: 1180370 - DNA, 13 bp, Homo sapiens
gaaccccgcagcc

SEQ ID NO: 1180371 - DNA, 16 bp, Homo sapiens
gaaccccgcagcccgt

SEQ ID NO: 1180372 - DNA, 16 bp, Homo sapiens
gaaccccgggcccggg

SEQ ID NO: 1180373 - DNA, 23 bp, Homo sapiens
gaaccccgggcccgggcccccgc

SEQ ID NO: 1180374 - DNA, 13 bp, Homo sapiens
gaacccctggcca

SEQ ID NO: 1180375 - DNA, 18 bp, Homo sapiens
gaacccctggccagctct

SEQ ID NO: 1180376 - DNA, 10 bp, Homo sapiens
gaacccctgt

SEQ ID NO: 1180377 - DNA, 20 bp, Homo sapiens
gaacccgggagcggaggttg

SEQ ID NO: 1180378 - DNA, 18 bp, Homo sapiens
gaaccctcaggccaccct

SEQ ID NO: 1180379 - DNA, 22 bp, Homo sapiens
gaaccctcttgccatcctgatg

SEQ ID NO: 1180380 - DNA, 20 bp, Homo sapiens
gaaccctggggcctgactgc

SEQ ID NO: 1180381 - DNA, 14 bp, Homo sapiens
gaaccctgtgctgg

SEQ ID NO: 1180382 - DNA, 18 bp, Homo sapiens
gaacccttttggcccccg

SEQ ID NO: 1180383 - DNA, 19 bp, Homo sapiens
gaacccttttggcccccga

SEQ ID NO: 1180384 - DNA, 22 bp, Homo sapiens
gaaccgaacatatcatttgtga

SEQ ID NO: 1180385 - DNA, 15 bp, Homo sapiens
gaaccgactgaccct

SEQ ID NO: 1180386 - DNA, 16 bp, Homo sapiens
gaaccgactgaccctg

SEQ ID NO: 1180387 - DNA, 20 bp, Homo sapiens
gaaccgactgaccctgagga

SEQ ID NO: 1180388 - DNA, 17 bp, Homo sapiens
gaaccgagcaaagatca

SEQ ID NO: 1180389 - DNA, 22 bp, Homo sapiens
cccaccagaacgcaccccactg

SEQ ID NO: 1180390 - DNA, 14 bp, Homo sapiens
cccaccagcagcac

SEQ ID NO: 1180391 - DNA, 16 bp, Homo sapiens
cccaccagccagccct

SEQ ID NO: 1180392 - DNA, 12 bp, Homo sapiens
cccaccagctcg

SEQ ID NO: 1180393 - DNA, 14 bp, Homo sapiens
cccaccagcttcac

SEQ ID NO: 1180394 - DNA, 12 bp, Homo sapiens
cccaccaggagc

SEQ ID NO: 1180395 - DNA, 21 bp, Homo sapiens
cccaccaggggaaggaaggag

SEQ ID NO: 1180396 - DNA, 23 bp, Homo sapiens
cccaccaggggaaggaaggaggg

SEQ ID NO: 1180397 - DNA, 22 bp, Homo sapiens
cccaccatgcagcccctgggcc

SEQ ID NO: 1180398 - DNA, 13 bp, Homo sapiens
cccaccattcctg

SEQ ID NO: 1180399 - DNA, 18 bp, Homo sapiens
cccaccattcctgccttt

SEQ ID NO: 1180400 - DNA, 14 bp, Homo sapiens
cccacccaattggc

SEQ ID NO: 1180401 - DNA, 15 bp, Homo sapiens
cccacccacctcctg

SEQ ID NO: 1180402 - DNA, 14 bp, Homo sapiens
cccacccagctcca

SEQ ID NO: 1180403 - DNA, 13 bp, Homo sapiens
cccacccagctgg

SEQ ID NO: 1180404 - DNA, 17 bp, Homo sapiens
cccacccagctggtcct

SEQ ID NO: 1180405 - DNA, 12 bp, Homo sapiens
cccacccaggag

SEQ ID NO: 1180406 - DNA, 20 bp, Homo sapiens
cccacccatcttcctgctgc

SEQ ID NO: 1180407 - DNA, 22 bp, Homo sapiens
cccacccatcttcctgctgctg

SEQ ID NO: 1180408 - DNA, 23 bp, Homo sapiens
cccaccccagaaatcactgtgaa

SEQ ID NO: 1180409 - DNA, 14 bp, Homo sapiens
cccaccccagcaca

SEQ ID NO: 1180410 - DNA, 15 bp, Homo sapiens
cccaccccagcacag

SEQ ID NO: 1180411 - DNA, 17 bp, Homo sapiens
cccaccccagcacagcc

SEQ ID NO: 1180412 - DNA, 21 bp, Homo sapiens
cccacccccaacccccagagg

SEQ ID NO: 1180413 - DNA, 13 bp, Homo sapiens
cccacccccaagg

SEQ ID NO: 1180414 - DNA, 18 bp, Homo sapiens
cccacccccagccccgac

SEQ ID NO: 1180415 - DNA, 13 bp, Homo sapiens
cccacccccaggc

SEQ ID NO: 1180416 - DNA, 16 bp, Homo sapiens
cccacccccaggcctc

SEQ ID NO: 1180417 - DNA, 17 bp, Homo sapiens
cccacccccaggcctcc

SEQ ID NO: 1180418 - DNA, 12 bp, Homo sapiens
cccacccccatc

SEQ ID NO: 1180419 - DNA, 13 bp, Homo sapiens
cccaccccccagc

SEQ ID NO: 1180420 - DNA, 13 bp, Homo sapiens
cccacccccctca

SEQ ID NO: 1180421 - DNA, 20 bp, Homo sapiens
cccacccccctctctttctc

SEQ ID NO: 1180422 - DNA, 13 bp, Homo sapiens
cccacccccggga

SEQ ID NO: 1180423 - DNA, 21 bp, Homo sapiens
cccacccccgggatcctgccc

SEQ ID NO: 1180424 - DNA, 16 bp, Homo sapiens
cccaccccctgccctg

SEQ ID NO: 1180425 - DNA, 17 bp, Homo sapiens
cccaccccctgccctgc

SEQ ID NO: 1180426 - DNA, 15 bp, Homo sapiens
cccaccccctgggca

SEQ ID NO: 1180427 - DNA, 23 bp, Homo sapiens
cccacccccttcagtgcccacca

SEQ ID NO: 1180428 - DNA, 21 bp, Homo sapiens
cccaccccgccgttccctgcg

SEQ ID NO: 1180429 - DNA, 12 bp, Homo sapiens
cccacccctcac

SEQ ID NO: 1180430 - DNA, 15 bp, Homo sapiens
cccacccctccacgt

SEQ ID NO: 1180431 - DNA, 12 bp, Homo sapiens
cccacccctgcc

SEQ ID NO: 1180432 - DNA, 15 bp, Homo sapiens
cccacccctggaaga

SEQ ID NO: 1180433 - DNA, 13 bp, Homo sapiens
cccacccctgtgc

SEQ ID NO: 1180434 - DNA, 15 bp, Homo sapiens
cccacccctgtgctc

SEQ ID NO: 1180435 - DNA, 17 bp, Homo sapiens
cccaccccttccccact

SEQ ID NO: 1180436 - DNA, 17 bp, Homo sapiens
cccacccgagtacctcc

SEQ ID NO: 1180437 - DNA, 23 bp, Homo sapiens
cccacccgagtacctccagtcac

SEQ ID NO: 1180438 - DNA, 23 bp, Homo sapiens
cccacccgccgcctcccacggca

SEQ ID NO: 1180439 - DNA, 15 bp, Homo sapiens
cccacccggacaggt

SEQ ID NO: 1180440 - DNA, 17 bp, Homo sapiens
cccacccggccacagct

SEQ ID NO: 1180441 - DNA, 19 bp, Homo sapiens
cccacccggccacagctgc

SEQ ID NO: 1180442 - DNA, 20 bp, Homo sapiens
cccacccggccacagctgct

SEQ ID NO: 1180443 - DNA, 14 bp, Homo sapiens
cccaccctcagcac

SEQ ID NO: 1180444 - DNA, 17 bp, Homo sapiens
cccaccctcagcacccc

SEQ ID NO: 1180445 - DNA, 14 bp, Homo sapiens
cccaccctccactc

SEQ ID NO: 1180446 - DNA, 15 bp, Homo sapiens
cccaccctgcgggcc

SEQ ID NO: 1180447 - DNA, 18 bp, Homo sapiens
cccaccctgcgggccagg

SEQ ID NO: 1180448 - DNA, 21 bp, Homo sapiens
cccaccctgctcctcctgccc

SEQ ID NO: 1180449 - DNA, 22 bp, Homo sapiens
cccaccctgctcctcctgccct

SEQ ID NO: 1180450 - DNA, 14 bp, Homo sapiens
cccaccctgggacc

SEQ ID NO: 1180451 - DNA, 17 bp, Homo sapiens
cccacccttacttcctg

SEQ ID NO: 1180452 - DNA, 23 bp, Homo sapiens
cccacccttacttcctggcctct

SEQ ID NO: 1180453 - DNA, 15 bp, Homo sapiens
cccaccgatggagcc

SEQ ID NO: 1180454 - DNA, 15 bp, Homo sapiens
cccaccgcccccacc

SEQ ID NO: 1180455 - DNA, 22 bp, Homo sapiens
cccaccggatgctgtgcctggc

SEQ ID NO: 1180456 - DNA, 23 bp, Homo sapiens
cccaccgggagcctccccctcag

SEQ ID NO: 1180457 - DNA, 23 bp, Homo sapiens
cccaccgggctgggagctctgca

SEQ ID NO: 1180458 - DNA, 18 bp, Homo sapiens
cccaccggtccagctggc

SEQ ID NO: 1180459 - DNA, 21 bp, Homo sapiens
cccaccgtccgccctgctcct

SEQ ID NO: 1180460 - DNA, 18 bp, Homo sapiens
cccaccgtctcggccctg

SEQ ID NO: 1180461 - DNA, 20 bp, Homo sapiens
cccaccgtctcggccctgaa

SEQ ID NO: 1180462 - DNA, 20 bp, Homo sapiens
cccaccgtgggcagtgccac

SEQ ID NO: 1180463 - DNA, 21 bp, Homo sapiens
cccacctagaacactaactca

SEQ ID NO: 1180464 - DNA, 14 bp, Homo sapiens
cccacctagtgccc

SEQ ID NO: 1180465 - DNA, 20 bp, Homo sapiens
cccacctagtgccccagact

SEQ ID NO: 1180466 - DNA, 21 bp, Homo sapiens
cccacctccccacacacaggc

SEQ ID NO: 1180467 - DNA, 22 bp, Homo sapiens
cccacctcccgccctcacctgc

SEQ ID NO: 1180468 - DNA, 20 bp, Homo sapiens
gaagaaatatgaaattccag

SEQ ID NO: 1180469 - DNA, 18 bp, Homo sapiens
gaagaaatcacagaatca

SEQ ID NO: 1180470 - DNA, 22 bp, Homo sapiens
gaagaaattaatatattagtga

SEQ ID NO: 1180471 - DNA, 15 bp, Homo sapiens
gaagaaattcctgta

SEQ ID NO: 1180472 - DNA, 16 bp, Homo sapiens
gaagaacacagcatgt

SEQ ID NO: 1180473 - DNA, 23 bp, Homo sapiens
gaagaacacagcatgtgccaaga

SEQ ID NO: 1180474 - DNA, 21 bp, Homo sapiens
gaagaacagctgttcctgtgt

SEQ ID NO: 1180475 - DNA, 14 bp, Homo sapiens
gaagaacatcaaga

SEQ ID NO: 1180476 - DNA, 16 bp, Homo sapiens
gaagaacatccaagga

SEQ ID NO: 1180477 - DNA, 15 bp, Homo sapiens
gaagaacattattca

SEQ ID NO: 1180478 - DNA, 19 bp, Homo sapiens
gaagaaccagcccagcctg

SEQ ID NO: 1180479 - DNA, 19 bp, Homo sapiens
gaagaactcaccagggttt

SEQ ID NO: 1180480 - DNA, 13 bp, Homo sapiens
gaagaactgcact

SEQ ID NO: 1180481 - DNA, 13 bp, Homo sapiens
gaagaactgcagg

SEQ ID NO: 1180482 - DNA, 19 bp, Homo sapiens
gaagaactgcaggccctgg

SEQ ID NO: 1180483 - DNA, 20 bp, Homo sapiens
gaagaagaaccagcccagcc

SEQ ID NO: 1180484 - DNA, 16 bp, Homo sapiens
gaagaagacacctcta

SEQ ID NO: 1180485 - DNA, 17 bp, Homo sapiens
gaagaagagatgacaaa

SEQ ID NO: 1180486 - DNA, 12 bp, Homo sapiens
gaagaaggcagt

SEQ ID NO: 1180487 - DNA, 14 bp, Homo sapiens
gaagaagggagaag

SEQ ID NO: 1180488 - DNA, 21 bp, Homo sapiens
gaagaagtgggagcagcttct

SEQ ID NO: 1180489 - DNA, 16 bp, Homo sapiens
gaagaataaattctac

SEQ ID NO: 1180490 - DNA, 23 bp, Homo sapiens
gaagaatacttctcattttttaa

SEQ ID NO: 1180491 - DNA, 19 bp, Homo sapiens
gaagaatattcaggactta

SEQ ID NO: 1180492 - DNA, 15 bp, Homo sapiens
gaagaatctgcccct

SEQ ID NO: 1180493 - DNA, 23 bp, Homo sapiens
gaagaattatgtaatatattgta

SEQ ID NO: 1180494 - DNA, 22 bp, Homo sapiens
gaagaattattcagtgaatttg

SEQ ID NO: 1180495 - DNA, 12 bp, Homo sapiens
gaagaattccag

SEQ ID NO: 1180496 - DNA, 20 bp, Homo sapiens
gaagaattgaacccaggagg

SEQ ID NO: 1180497 - DNA, 23 bp, Homo sapiens
gaagaattgaacccaggaggtgg

SEQ ID NO: 1180498 - DNA, 22 bp, Homo sapiens
gaagaatttaatggactgtgaa

SEQ ID NO: 1180499 - DNA, 15 bp, Homo sapiens
gaagaattttcagac

SEQ ID NO: 1180500 - DNA, 17 bp, Homo sapiens
gaagaattttcagaccc

SEQ ID NO: 1180501 - DNA, 21 bp, Homo sapiens
gaagaattttcagaccccagc

SEQ ID NO: 1180502 - DNA, 21 bp, Homo sapiens
gaagacacagactgcgatttg

SEQ ID NO: 1180503 - DNA, 17 bp, Homo sapiens
gaagacacagcctcccc

SEQ ID NO: 1180504 - DNA, 20 bp, Homo sapiens
gaagacagagcaaagcgccc

SEQ ID NO: 1180505 - DNA, 20 bp, Homo sapiens
gaagacagcagcaagtgtgc

SEQ ID NO: 1180506 - DNA, 15 bp, Homo sapiens
gaagacaggacagtg

SEQ ID NO: 1180507 - DNA, 13 bp, Homo sapiens
gaagacataaaac

SEQ ID NO: 1180508 - DNA, 16 bp, Homo sapiens
gaagacataaaacttt

SEQ ID NO: 1180509 - DNA, 19 bp, Homo sapiens
gaagacattaagcagcctt

SEQ ID NO: 1180510 - DNA, 19 bp, Homo sapiens
gaagacattcaaaacgtga

SEQ ID NO: 1180511 - DNA, 13 bp, Homo sapiens
cccagactgggcc

SEQ ID NO: 1180512 - DNA, 20 bp, Homo sapiens
cccagactgggcccaggcag

SEQ ID NO: 1180513 - DNA, 13 bp, Homo sapiens
cccagagaacaat

SEQ ID NO: 1180514 - DNA, 21 bp, Homo sapiens
cccagagaagctggaagcctg

SEQ ID NO: 1180515 - DNA, 13 bp, Homo sapiens
cccagagacagga

SEQ ID NO: 1180516 - DNA, 14 bp, Homo sapiens
cccagagacaggaa

SEQ ID NO: 1180517 - DNA, 23 bp, Homo sapiens
cccagagacctgacccaacaccc

SEQ ID NO: 1180518 - DNA, 18 bp, Homo sapiens
cccagagagaccctgcaa

SEQ ID NO: 1180519 - DNA, 22 bp, Homo sapiens
cccagagagaccctgcaagacc

SEQ ID NO: 1180520 - DNA, 18 bp, Homo sapiens
cccagagagcaggcaggg

SEQ ID NO: 1180521 - DNA, 19 bp, Homo sapiens
cccagagagcaggcagggg

SEQ ID NO: 1180522 - DNA, 19 bp, Homo sapiens
cccagagaggaatcagact

SEQ ID NO: 1180523 - DNA, 16 bp, Homo sapiens
cccagagcacaggagc

SEQ ID NO: 1180524 - DNA, 14 bp, Homo sapiens
cccagagcaccccc

SEQ ID NO: 1180525 - DNA, 19 bp, Homo sapiens
cccagagcaccccctgctc

SEQ ID NO: 1180526 - DNA, 20 bp, Homo sapiens
cccagagcaccccctgctcc

SEQ ID NO: 1180527 - DNA, 16 bp, Homo sapiens
cccagagcaggaagca

SEQ ID NO: 1180528 - DNA, 21 bp, Homo sapiens
cccagagcaggaggcccctgg

SEQ ID NO: 1180529 - DNA, 18 bp, Homo sapiens
cccagagccacctggatc

SEQ ID NO: 1180530 - DNA, 13 bp, Homo sapiens
cccagagccaggg

SEQ ID NO: 1180531 - DNA, 14 bp, Homo sapiens
cccagagccagggc

SEQ ID NO: 1180532 - DNA, 15 bp, Homo sapiens
cccagagccagggct

SEQ ID NO: 1180533 - DNA, 22 bp, Homo sapiens
cccagagccagggctgtcctta

SEQ ID NO: 1180534 - DNA, 16 bp, Homo sapiens
cccagagcccagctct

SEQ ID NO: 1180535 - DNA, 18 bp, Homo sapiens
cccagagcccagctcttg

SEQ ID NO: 1180536 - DNA, 17 bp, Homo sapiens
cccagagccctggacct

SEQ ID NO: 1180537 - DNA, 22 bp, Homo sapiens
cccagagcccttgactgtacag

SEQ ID NO: 1180538 - DNA, 19 bp, Homo sapiens
cccagagctcatcccccct

SEQ ID NO: 1180539 - DNA, 12 bp, Homo sapiens
cccagagctggc

SEQ ID NO: 1180540 - DNA, 18 bp, Homo sapiens
cccagagctgtgccagca

SEQ ID NO: 1180541 - DNA, 21 bp, Homo sapiens
cccagagctgtttatggcctc

SEQ ID NO: 1180542 - DNA, 22 bp, Homo sapiens
cccagagctgtttatggcctca

SEQ ID NO: 1180543 - DNA, 23 bp, Homo sapiens
cccagagctgtttatggcctcag

SEQ ID NO: 1180544 - DNA, 23 bp, Homo sapiens
cccagagcttattggccactggg

SEQ ID NO: 1180545 - DNA, 22 bp, Homo sapiens
cccagaggaaggggccagaggc

SEQ ID NO: 1180546 - DNA, 22 bp, Homo sapiens
cccagaggacacaggcagcttc

SEQ ID NO: 1180547 - DNA, 16 bp, Homo sapiens
cccagaggattgctgc

SEQ ID NO: 1180548 - DNA, 15 bp, Homo sapiens
cccagaggccctgaa

SEQ ID NO: 1180549 - DNA, 19 bp, Homo sapiens
cccagaggccctgaagcct

SEQ ID NO: 1180550 - DNA, 19 bp, Homo sapiens
cccagaggtccagcccatc

SEQ ID NO: 1180551 - DNA, 12 bp, Homo sapiens
cccagaggtgga

SEQ ID NO: 1180552 - DNA, 17 bp, Homo sapiens
cccagaggtggcccttg

SEQ ID NO: 1180553 - DNA, 20 bp, Homo sapiens
cccagaggtgggatcctccc

SEQ ID NO: 1180554 - DNA, 21 bp, Homo sapiens
cccagaggtgggatcctccct

SEQ ID NO: 1180555 - DNA, 13 bp, Homo sapiens
cccagagtcagag

SEQ ID NO: 1180556 - DNA, 17 bp, Homo sapiens
cccagagtcagaggaga

SEQ ID NO: 1180557 - DNA, 20 bp, Homo sapiens
cccagagtgctgggattaca

SEQ ID NO: 1180558 - DNA, 19 bp, Homo sapiens
cccagagtggagtctgagt

SEQ ID NO: 1180559 - DNA, 21 bp, Homo sapiens
cccagagtgggagaggctggg

SEQ ID NO: 1180560 - DNA, 14 bp, Homo sapiens
cccagataccagcc

SEQ ID NO: 1180561 - DNA, 18 bp, Homo sapiens
cccagataccagcccctg

SEQ ID NO: 1180562 - DNA, 19 bp, Homo sapiens
cccagatacgggggctgtg

SEQ ID NO: 1180563 - DNA, 16 bp, Homo sapiens
cccagatcagctccta

SEQ ID NO: 1180564 - DNA, 14 bp, Homo sapiens
cccagatcaggaac

SEQ ID NO: 1180565 - DNA, 17 bp, Homo sapiens
cccagatcaggaaccag

SEQ ID NO: 1180566 - DNA, 20 bp, Homo sapiens
cccagatcaggaaccagggc

SEQ ID NO: 1180567 - DNA, 14 bp, Homo sapiens
cccagatctgcctg

SEQ ID NO: 1180568 - DNA, 16 bp, Homo sapiens
cccagatctgcctggg

SEQ ID NO: 1180569 - DNA, 19 bp, Homo sapiens
cccagatctgcctgggcct

SEQ ID NO: 1180570 - DNA, 20 bp, Homo sapiens
cccagatctggtcccttgca

SEQ ID NO: 1180571 - DNA, 13 bp, Homo sapiens
cccagatggcttc

SEQ ID NO: 1180572 - DNA, 15 bp, Homo sapiens
cccagatgtaaagaa

SEQ ID NO: 1180573 - DNA, 13 bp, Homo sapiens
cccagatgtgtcc

SEQ ID NO: 1180574 - DNA, 22 bp, Homo sapiens
cccagatgttttacgtctggga

SEQ ID NO: 1180575 - DNA, 14 bp, Homo sapiens
cccagattcccaga

SEQ ID NO: 1180576 - DNA, 16 bp, Homo sapiens
cccagattcccctgtg

SEQ ID NO: 1180577 - DNA, 17 bp, Homo sapiens
cccagattcccctgtgt

SEQ ID NO: 1180578 - DNA, 19 bp, Homo sapiens
cccagattcccctgtgtca

SEQ ID NO: 1180579 - DNA, 22 bp, Homo sapiens
cccagattctgaaacaggccct

SEQ ID NO: 1180580 - DNA, 21 bp, Homo sapiens
cccagattttgctgtatattt

SEQ ID NO: 1180581 - DNA, 17 bp, Homo sapiens
cccagcaaccctcctat

SEQ ID NO: 1180582 - DNA, 17 bp, Homo sapiens
cccagcaacgcccctcc

SEQ ID NO: 1180583 - DNA, 20 bp, Homo sapiens
cccagcaacgcccctccaaa

SEQ ID NO: 1180584 - DNA, 17 bp, Homo sapiens
cccagcaagcgggagcc

SEQ ID NO: 1180585 - DNA, 16 bp, Homo sapiens
cccagcacagatgagg

SEQ ID NO: 1180586 - DNA, 17 bp, Homo sapiens
cccagcacagccacctc

SEQ ID NO: 1180587 - DNA, 18 bp, Homo sapiens
cccagcacagccacctcc

SEQ ID NO: 1180588 - DNA, 19 bp, Homo sapiens
cccagcacatagcttgcct

SEQ ID NO: 1180589 - DNA, 23 bp, Homo sapiens
cccagcacatggccatagaggcc

SEQ ID NO: 1180590 - DNA, 19 bp, Homo sapiens
cccagcacatgtgctgccc

SEQ ID NO: 1180591 - DNA, 20 bp, Homo sapiens
cccagcactaaggccgtgtc

SEQ ID NO: 1180592 - DNA, 15 bp, Homo sapiens
cccagcactgcctcc

SEQ ID NO: 1180593 - DNA, 19 bp, Homo sapiens
cccagcactttgggaggcc

SEQ ID NO: 1180594 - DNA, 20 bp, Homo sapiens
cccagcactttgggaggcct

SEQ ID NO: 1180595 - DNA, 21 bp, Homo sapiens
cccagcagaatggaggcaggg

SEQ ID NO: 1180596 - DNA, 16 bp, Homo sapiens
cccagcagagcccacc

SEQ ID NO: 1180597 - DNA, 23 bp, Homo sapiens
cccagcagagcccaccagccagc

SEQ ID NO: 1180598 - DNA, 17 bp, Homo sapiens
cccagcagccctaagga

SEQ ID NO: 1180599 - DNA, 21 bp, Homo sapiens
cccagcaggagagactgagca

SEQ ID NO: 1180600 - DNA, 14 bp, Homo sapiens
cccagcaggcaggc

SEQ ID NO: 1180601 - DNA, 14 bp, Homo sapiens
cccagcaggcccag

SEQ ID NO: 1180602 - DNA, 13 bp, Homo sapiens
cccagcagggcct

SEQ ID NO: 1180603 - DNA, 14 bp, Homo sapiens
cccagcagtgtgga

SEQ ID NO: 1180604 - DNA, 14 bp, Homo sapiens
cccagcatccctgg

SEQ ID NO: 1180605 - DNA, 13 bp, Homo sapiens
cccagcatctccc

SEQ ID NO: 1180606 - DNA, 19 bp, Homo sapiens
cccagcatgcaccacgggc

SEQ ID NO: 1180607 - DNA, 17 bp, Homo sapiens
cccagcatgcaggtggt

SEQ ID NO: 1180608 - DNA, 19 bp, Homo sapiens
cccagcattccagcccctc

SEQ ID NO: 1180609 - DNA, 16 bp, Homo sapiens
cccagcattccagctc

SEQ ID NO: 1180610 - DNA, 21 bp, Homo sapiens
cccagcattccagctctgccc

SEQ ID NO: 1180611 - DNA, 22 bp, Homo sapiens
cccagcattccagctctgcccc

SEQ ID NO: 1180612 - DNA, 18 bp, Homo sapiens
cccagccaacgagattgc

SEQ ID NO: 1180613 - DNA, 22 bp, Homo sapiens
cccagccaccaccctcaggtgc

SEQ ID NO: 1180614 - DNA, 18 bp, Homo sapiens
cccagccactccaagccc

SEQ ID NO: 1180615 - DNA, 12 bp, Homo sapiens
cccagccactgc

SEQ ID NO: 1180616 - DNA, 22 bp, Homo sapiens
cccagccagagttcctgcggag

SEQ ID NO: 1180617 - DNA, 16 bp, Homo sapiens
cccagccagccacccc

SEQ ID NO: 1180618 - DNA, 13 bp, Homo sapiens
cccagccagccct

SEQ ID NO: 1180619 - DNA, 13 bp, Homo sapiens
cccagccagctgc

SEQ ID NO: 1180620 - DNA, 14 bp, Homo sapiens
cccagccagctgca

SEQ ID NO: 1180621 - DNA, 19 bp, Homo sapiens
cccagccagctgcagggca

SEQ ID NO: 1180622 - DNA, 20 bp, Homo sapiens
cccagccagctgcagggcac

SEQ ID NO: 1180623 - DNA, 18 bp, Homo sapiens
cccagccaggctatggtt

SEQ ID NO: 1180624 - DNA, 17 bp, Homo sapiens
cccagccatctgcccag

SEQ ID NO: 1180625 - DNA, 22 bp, Homo sapiens
cccagccatctgcccaggggtg

SEQ ID NO: 1180626 - DNA, 17 bp, Homo sapiens
cccagccatgccagctg

SEQ ID NO: 1180627 - DNA, 19 bp, Homo sapiens
cccagccatgccagctggc

SEQ ID NO: 1180628 - DNA, 13 bp, Homo sapiens
cccagccatgtgt

SEQ ID NO: 1180629 - DNA, 10 bp, Homo sapiens
cccagccatt

SEQ ID NO: 1180630 - DNA, 19 bp, Homo sapiens
cccagccattaccatggag

SEQ ID NO: 1180631 - DNA, 16 bp, Homo sapiens
cccagcccaaagctgt

SEQ ID NO: 1180632 - DNA, 16 bp, Homo sapiens
gaaggcttctctctgt

SEQ ID NO: 1180633 - DNA, 18 bp, Homo sapiens
gaagggaaagcgggcagc

SEQ ID NO: 1180634 - DNA, 23 bp, Homo sapiens
gaagggaaagcgggcagccccgt

SEQ ID NO: 1180635 - DNA, 23 bp, Homo sapiens
gaagggaagcgtatatacttaag

SEQ ID NO: 1180636 - DNA, 17 bp, Homo sapiens
gaagggaataaggtaca

SEQ ID NO: 1180637 - DNA, 22 bp, Homo sapiens
gaagggaataaggtacaagaag

SEQ ID NO: 1180638 - DNA, 20 bp, Homo sapiens
gaagggaatcctcctccagg

SEQ ID NO: 1180639 - DNA, 16 bp, Homo sapiens
gaagggagaagaaagg

SEQ ID NO: 1180640 - DNA, 13 bp, Homo sapiens
gaagggaggggaa

SEQ ID NO: 1180641 - DNA, 17 bp, Homo sapiens
gaagggaggggaagggg

SEQ ID NO: 1180642 - DNA, 19 bp, Homo sapiens
gaagggagtgaggggctgt

SEQ ID NO: 1180643 - DNA, 17 bp, Homo sapiens
gaagggccaccctgctg

SEQ ID NO: 1180644 - DNA, 21 bp, Homo sapiens
gaagggccaccctgctgcact

SEQ ID NO: 1180645 - DNA, 10 bp, Homo sapiens
gaagggccag

SEQ ID NO: 1180646 - DNA, 14 bp, Homo sapiens
gaagggccagtcct

SEQ ID NO: 1180647 - DNA, 20 bp, Homo sapiens
gaagggccagtcctgcctgg

SEQ ID NO: 1180648 - DNA, 14 bp, Homo sapiens
gaagggccagtctg

SEQ ID NO: 1180649 - DNA, 18 bp, Homo sapiens
gaagggccagtctgggct

SEQ ID NO: 1180650 - DNA, 20 bp, Homo sapiens
gaagggccagtctgggctgc

SEQ ID NO: 1180651 - DNA, 22 bp, Homo sapiens
gaagggcctgcccagttgcact

SEQ ID NO: 1180652 - DNA, 22 bp, Homo sapiens
gaagggctgcatgatgtttgcc

SEQ ID NO: 1180653 - DNA, 23 bp, Homo sapiens
gaagggctttgagggtggaagga

SEQ ID NO: 1180654 - DNA, 23 bp, Homo sapiens
gaaggggaggcagccggcaccca

SEQ ID NO: 1180655 - DNA, 13 bp, Homo sapiens
gaaggggatggag

SEQ ID NO: 1180656 - DNA, 20 bp, Homo sapiens
gaaggggatggaggccagag

SEQ ID NO: 1180657 - DNA, 11 bp, Homo sapiens
gaaggggcagc

SEQ ID NO: 1180658 - DNA, 13 bp, Homo sapiens
gaaggggcagccc

SEQ ID NO: 1180659 - DNA, 16 bp, Homo sapiens
gaaggggccagaggct

SEQ ID NO: 1180660 - DNA, 14 bp, Homo sapiens
gaaggggccccggg

SEQ ID NO: 1180661 - DNA, 23 bp, Homo sapiens
gaaggggccccggggctggcaag

SEQ ID NO: 1180662 - DNA, 23 bp, Homo sapiens
gaaggggccctggtccttccagg

SEQ ID NO: 1180663 - DNA, 14 bp, Homo sapiens
gaaggggcctccct

SEQ ID NO: 1180664 - DNA, 15 bp, Homo sapiens
gaagggggacactcc

SEQ ID NO: 1180665 - DNA, 12 bp, Homo sapiens
gaagggggagga

SEQ ID NO: 1180666 - DNA, 14 bp, Homo sapiens
gaagggggccatga

SEQ ID NO: 1180667 - DNA, 17 bp, Homo sapiens
gaagggggctctgcccc

SEQ ID NO: 1180668 - DNA, 22 bp, Homo sapiens
gaagggggtgcaaagactctga

SEQ ID NO: 1180669 - DNA, 17 bp, Homo sapiens
gaagggggttgtggcaa

SEQ ID NO: 1180670 - DNA, 13 bp, Homo sapiens
gaagggtaaagaa

SEQ ID NO: 1180671 - DNA, 15 bp, Homo sapiens
gaagggtgcatagct

SEQ ID NO: 1180672 - DNA, 15 bp, Homo sapiens
gaagggttctgccct

SEQ ID NO: 1180673 - DNA, 17 bp, Homo sapiens
gaagggttctgccctgc

SEQ ID NO: 1180674 - DNA, 13 bp, Homo sapiens
gaagggtttctct

SEQ ID NO: 1180675 - DNA, 15 bp, Homo sapiens
gaagggtttgtggct

SEQ ID NO: 1180676 - DNA, 15 bp, Homo sapiens
gaagggttttctttt

SEQ ID NO: 1180677 - DNA, 18 bp, Homo sapiens
gaagggtttttagagaat

SEQ ID NO: 1180678 - DNA, 13 bp, Homo sapiens
gaaggtaaataaa

SEQ ID NO: 1180679 - DNA, 20 bp, Homo sapiens
gaaggtatcagttatatgat

SEQ ID NO: 1180680 - DNA, 17 bp, Homo sapiens
gaaggtattggcctgtt

SEQ ID NO: 1180681 - DNA, 18 bp, Homo sapiens
gaaggtctccaagggagg

SEQ ID NO: 1180682 - DNA, 21 bp, Homo sapiens
gaaggtctttgttatgacagt

SEQ ID NO: 1180683 - DNA, 15 bp, Homo sapiens
gaaggtgacagcagt

SEQ ID NO: 1180684 - DNA, 24 bp, Homo sapiens
gaaggtgaccgcccagctctccca

SEQ ID NO: 1180685 - DNA, 20 bp, Homo sapiens
gaaggtggaagttgcagtga

SEQ ID NO: 1180686 - DNA, 20 bp, Homo sapiens
gaaggtggggccctgcccct

SEQ ID NO: 1180687 - DNA, 21 bp, Homo sapiens
gaaggtggggccctgccccta

SEQ ID NO: 1180688 - DNA, 20 bp, Homo sapiens
gaaggttaggatttaacagt

SEQ ID NO: 1180689 - DNA, 15 bp, Homo sapiens
gaaggttggcggggg

SEQ ID NO: 1180690 - DNA, 15 bp, Homo sapiens
gaaggttgtgatgaa

SEQ ID NO: 1180691 - DNA, 20 bp, Homo sapiens
gaaggtttacaatttacaaa

SEQ ID NO: 1180692 - DNA, 15 bp, Homo sapiens
gaaggtttgtatatt

SEQ ID NO: 1180693 - DNA, 20 bp, Homo sapiens
gaaggtttgtgtttttctgc

SEQ ID NO: 1180694 - DNA, 20 bp, Homo sapiens
gaaggttttttttttaagtg

SEQ ID NO: 1180695 - DNA, 20 bp, Homo sapiens
gaagtaaacagctgtgcatc

SEQ ID NO: 1180696 - DNA, 12 bp, Homo sapiens
gaagtaaagcct

SEQ ID NO: 1180697 - DNA, 20 bp, Homo sapiens
gaagtaaattaaacattttt

SEQ ID NO: 1180698 - DNA, 15 bp, Homo sapiens
gaagtaacagacaca

SEQ ID NO: 1180699 - DNA, 16 bp, Homo sapiens
gaagtaagcctcatca

SEQ ID NO: 1180700 - DNA, 15 bp, Homo sapiens
gaagtacaaacatga

SEQ ID NO: 1180701 - DNA, 18 bp, Homo sapiens
gaagtacaaacatgaaaa

SEQ ID NO: 1180702 - DNA, 14 bp, Homo sapiens
gaagtaccagacta

SEQ ID NO: 1180703 - DNA, 20 bp, Homo sapiens
gaagtacgtcccagcggcct

SEQ ID NO: 1180704 - DNA, 17 bp, Homo sapiens
gaagtaggaggaaacag

SEQ ID NO: 1180705 - DNA, 14 bp, Homo sapiens
gaagtaggtggctt

SEQ ID NO: 1180706 - DNA, 15 bp, Homo sapiens
gaagtagttctgttt

SEQ ID NO: 1180707 - DNA, 15 bp, Homo sapiens
gaagtataaggtgct

SEQ ID NO: 1180708 - DNA, 14 bp, Homo sapiens
gaagtatacctgat

SEQ ID NO: 1180709 - DNA, 15 bp, Homo sapiens
gaagtatgagtgctg

SEQ ID NO: 1180710 - DNA, 17 bp, Homo sapiens
gaagtatgagtgctgat

SEQ ID NO: 1180711 - DNA, 21 bp, Homo sapiens
gaagtatgtatattaaaaaag

SEQ ID NO: 1180712 - DNA, 17 bp, Homo sapiens
gaagtatttttagaata

SEQ ID NO: 1180713 - DNA, 19 bp, Homo sapiens
gaagtatttttagaataag

SEQ ID NO: 1180714 - DNA, 15 bp, Homo sapiens
gaagtcaaagcaagg

SEQ ID NO: 1180715 - DNA, 16 bp, Homo sapiens
gaagtcacctttctgg

SEQ ID NO: 1180716 - DNA, 19 bp, Homo sapiens
gaagtcacctttctgggct

SEQ ID NO: 1180717 - DNA, 20 bp, Homo sapiens
gaagtcacctttctgggctt

SEQ ID NO: 1180718 - DNA, 18 bp, Homo sapiens
gaagtcagccacactggg

SEQ ID NO: 1180719 - DNA, 22 bp, Homo sapiens
gaagtcagcccgaatgcctgtc

SEQ ID NO: 1180720 - DNA, 18 bp, Homo sapiens
gaagtcaggggagaagct

SEQ ID NO: 1180721 - DNA, 21 bp, Homo sapiens
gaagtcaggggagaagctgaa

SEQ ID NO: 1180722 - DNA, 23 bp, Homo sapiens
gaagtcagtgtagacctgagctg

SEQ ID NO: 1180723 - DNA, 18 bp, Homo sapiens
gaagtcataccaatgaaa

SEQ ID NO: 1180724 - DNA, 20 bp, Homo sapiens
gaagtcattgtcgctcagca

SEQ ID NO: 1180725 - DNA, 18 bp, Homo sapiens
gaagtcccttgccatcct

SEQ ID NO: 1180726 - DNA, 14 bp, Homo sapiens
gaagtcctgtcact

SEQ ID NO: 1180727 - DNA, 22 bp, Homo sapiens
gaagtccttcagtgagcccctc

SEQ ID NO: 1180728 - DNA, 23 bp, Homo sapiens
gaagtccttcagtgagcccctcc

SEQ ID NO: 1180729 - DNA, 18 bp, Homo sapiens
gaagtcgagcactctaat

SEQ ID NO: 1180730 - DNA, 17 bp, Homo sapiens
gaagtctcatgggaagc

SEQ ID NO: 1180731 - DNA, 18 bp, Homo sapiens
gaagtctctaggttctga

SEQ ID NO: 1180732 - DNA, 24 bp, Homo sapiens
gaagtctggctttgctctattaag

SEQ ID NO: 1180733 - DNA, 22 bp, Homo sapiens
gaagtcttatcttctgcagtga

SEQ ID NO: 1180734 - DNA, 19 bp, Homo sapiens
gaagtcttgaagttgggtg

SEQ ID NO: 1180735 - DNA, 18 bp, Homo sapiens
gaagtctttcagtggaat

SEQ ID NO: 1180736 - DNA, 18 bp, Homo sapiens
gaagtctttgccttctct

SEQ ID NO: 1180737 - DNA, 20 bp, Homo sapiens
gaagtctttttcattttgca

SEQ ID NO: 1180738 - DNA, 18 bp, Homo sapiens
gaagtgaatctgattgca

SEQ ID NO: 1180739 - DNA, 18 bp, Homo sapiens
gaagtgacaaggccccag

SEQ ID NO: 1180740 - DNA, 23 bp, Homo sapiens
gaagtgacaaggccccagagact

SEQ ID NO: 1180741 - DNA, 24 bp, Homo sapiens
gaagtgacaaggccccagagactc

SEQ ID NO: 1180742 - DNA, 17 bp, Homo sapiens
gaagtgagagctttgct

SEQ ID NO: 1180743 - DNA, 13 bp, Homo sapiens
gaagtgagcaagg

SEQ ID NO: 1180744 - DNA, 17 bp, Homo sapiens
gaagtgagcccccccct

SEQ ID NO: 1180745 - DNA, 20 bp, Homo sapiens
gaagtgaggcccaaggagct

SEQ ID NO: 1180746 - DNA, 16 bp, Homo sapiens
gaagtgagggaggaag

SEQ ID NO: 1180747 - DNA, 22 bp, Homo sapiens
gaagtgagggctcactcagcca

SEQ ID NO: 1180748 - DNA, 13 bp, Homo sapiens
gaagtgcagatga

SEQ ID NO: 1180749 - DNA, 22 bp, Homo sapiens
gaagtgcggggtaggggaagaa

SEQ ID NO: 1180750 - DNA, 15 bp, Homo sapiens
gaagtgcgtgaatgt

SEQ ID NO: 1180751 - DNA, 20 bp, Homo sapiens
gaagtgctggcaaccactaa

SEQ ID NO: 1180752 - DNA, 13 bp, Homo sapiens
gaagtgcttggaa

SEQ ID NO: 1180753 - DNA, 12 bp, Homo sapiens
cttagagtgtag

SEQ ID NO: 1180754 - DNA, 16 bp, Homo sapiens
cttagagtgtagctgt

SEQ ID NO: 1180755 - DNA, 19 bp, Homo sapiens
cttagagtttacagtttgt

SEQ ID NO: 1180756 - DNA, 22 bp, Homo sapiens
cttagataacttcttgaaaaag

SEQ ID NO: 1180757 - DNA, 21 bp, Homo sapiens
cttagataccttgaaaggcag

SEQ ID NO: 1180758 - DNA, 18 bp, Homo sapiens
cttagatattaaaatttg

SEQ ID NO: 1180759 - DNA, 19 bp, Homo sapiens
cttagatgagggtgactgt

SEQ ID NO: 1180760 - DNA, 16 bp, Homo sapiens
cttagatgtttcacac

SEQ ID NO: 1180761 - DNA, 14 bp, Homo sapiens
cttagattcttaat

SEQ ID NO: 1180762 - DNA, 15 bp, Homo sapiens
cttagattgtgttcc

SEQ ID NO: 1180763 - DNA, 14 bp, Homo sapiens
cttagatttcatag

SEQ ID NO: 1180764 - DNA, 21 bp, Homo sapiens
cttagatttcatagttcagaa

SEQ ID NO: 1180765 - DNA, 13 bp, Homo sapiens
cttagcaactgct

SEQ ID NO: 1180766 - DNA, 18 bp, Homo sapiens
cttagcaagacctgaaaa

SEQ ID NO: 1180767 - DNA, 12 bp, Homo sapiens
cttagcacagag

SEQ ID NO: 1180768 - DNA, 15 bp, Homo sapiens
cttagcaccttcagg

SEQ ID NO: 1180769 - DNA, 21 bp, Homo sapiens
cttagcatcagaggtttgctt

SEQ ID NO: 1180770 - DNA, 22 bp, Homo sapiens
cttagccaagccctaagcctgt

SEQ ID NO: 1180771 - DNA, 14 bp, Homo sapiens
cttagcccaagagg

SEQ ID NO: 1180772 - DNA, 21 bp, Homo sapiens
cttagcccaagaggtctgagc

SEQ ID NO: 1180773 - DNA, 22 bp, Homo sapiens
cttagcccaagaggtctgagcc

SEQ ID NO: 1180774 - DNA, 17 bp, Homo sapiens
cttagccgtccatggca

SEQ ID NO: 1180775 - DNA, 18 bp, Homo sapiens
cttagcctctcccacccg

SEQ ID NO: 1180776 - DNA, 11 bp, Homo sapiens
cttagcctgcc

SEQ ID NO: 1180777 - DNA, 14 bp, Homo sapiens
cttagcctgcctca

SEQ ID NO: 1180778 - DNA, 18 bp, Homo sapiens
cttagcctgcctcaccca

SEQ ID NO: 1180779 - DNA, 14 bp, Homo sapiens
cttagccttgtgcc

SEQ ID NO: 1180780 - DNA, 17 bp, Homo sapiens
cttagccttgtgccctg

SEQ ID NO: 1180781 - DNA, 16 bp, Homo sapiens
cttagcgtcaagacat

SEQ ID NO: 1180782 - DNA, 18 bp, Homo sapiens
cttagcgtcaagacattt

SEQ ID NO: 1180783 - DNA, 19 bp, Homo sapiens
cttagcgttctggactctg

SEQ ID NO: 1180784 - DNA, 22 bp, Homo sapiens
cttagcgttctggactctgccc

SEQ ID NO: 1180785 - DNA, 14 bp, Homo sapiens
cttagctactgtat

SEQ ID NO: 1180786 - DNA, 16 bp, Homo sapiens
cttagctatccttggc

SEQ ID NO: 1180787 - DNA, 22 bp, Homo sapiens
cttagctcattctccttgtgtt

SEQ ID NO: 1180788 - DNA, 23 bp, Homo sapiens
cttagctcattctccttgtgtta

SEQ ID NO: 1180789 - DNA, 19 bp, Homo sapiens
cttagctctcccaactctt

SEQ ID NO: 1180790 - DNA, 17 bp, Homo sapiens
cttagctcttaattgtt

SEQ ID NO: 1180791 - DNA, 16 bp, Homo sapiens
cttagctgccagtgct

SEQ ID NO: 1180792 - DNA, 14 bp, Homo sapiens
cttagctgccttga

SEQ ID NO: 1180793 - DNA, 18 bp, Homo sapiens
cttagctggatataatgt

SEQ ID NO: 1180794 - DNA, 15 bp, Homo sapiens
cttagcttagacctc

SEQ ID NO: 1180795 - DNA, 16 bp, Homo sapiens
cttagcttagacctca

SEQ ID NO: 1180796 - DNA, 18 bp, Homo sapiens
cttagcttagacctcagc

SEQ ID NO: 1180797 - DNA, 20 bp, Homo sapiens
cttagcttagacctcagcct

SEQ ID NO: 1180798 - DNA, 16 bp, Homo sapiens
cttagcttatctttct

SEQ ID NO: 1180799 - DNA, 17 bp, Homo sapiens
cttagcttatctttctt

SEQ ID NO: 1180800 - DNA, 21 bp, Homo sapiens
cttagcttatctttctttcca

SEQ ID NO: 1180801 - DNA, 16 bp, Homo sapiens
cttagctttctcaggg

SEQ ID NO: 1180802 - DNA, 18 bp, Homo sapiens
cttaggaaaatgcttctg

SEQ ID NO: 1180803 - DNA, 15 bp, Homo sapiens
cttaggaaaggagat

SEQ ID NO: 1180804 - DNA, 15 bp, Homo sapiens
cttaggagagaccga

SEQ ID NO: 1180805 - DNA, 22 bp, Homo sapiens
cttaggagatttaccacttttt

SEQ ID NO: 1180806 - DNA, 18 bp, Homo sapiens
cttaggagcaagaagaaa

SEQ ID NO: 1180807 - DNA, 20 bp, Homo sapiens
cttaggagcaagaagaaaat

SEQ ID NO: 1180808 - DNA, 22 bp, Homo sapiens
cttaggagcaagaagaaaatgt

SEQ ID NO: 1180809 - DNA, 22 bp, Homo sapiens
cttaggatggggctcccagctc

SEQ ID NO: 1180810 - DNA, 22 bp, Homo sapiens
cttaggattctgttccctgggc

SEQ ID NO: 1180811 - DNA, 17 bp, Homo sapiens
cttaggcatgtgctggt

SEQ ID NO: 1180812 - DNA, 18 bp, Homo sapiens
cttaggcatgtgctggta

SEQ ID NO: 1180813 - DNA, 19 bp, Homo sapiens
cttaggcctctctgcctgg

SEQ ID NO: 1180814 - DNA, 23 bp, Homo sapiens
cttaggctttgtatgacagtgaa

SEQ ID NO: 1180815 - DNA, 14 bp, Homo sapiens
cttagggaaagatg

SEQ ID NO: 1180816 - DNA, 17 bp, Homo sapiens
cttagggaagctggcct

SEQ ID NO: 1180817 - DNA, 21 bp, Homo sapiens
cttagggaaggatacaaaagc

SEQ ID NO: 1180818 - DNA, 19 bp, Homo sapiens
cttagggaagttgtctcct

SEQ ID NO: 1180819 - DNA, 20 bp, Homo sapiens
cttagggaagttgtctcctt

SEQ ID NO: 1180820 - DNA, 13 bp, Homo sapiens
cttagggagcccc

SEQ ID NO: 1180821 - DNA, 17 bp, Homo sapiens
cttagggcactgggctg

SEQ ID NO: 1180822 - DNA, 15 bp, Homo sapiens
cttagggccctggag

SEQ ID NO: 1180823 - DNA, 17 bp, Homo sapiens
cttagggccctggaggc

SEQ ID NO: 1180824 - DNA, 20 bp, Homo sapiens
cttagggtggctttaattgt

SEQ ID NO: 1180825 - DNA, 15 bp, Homo sapiens
cttaggtcagatgga

SEQ ID NO: 1180826 - DNA, 20 bp, Homo sapiens
cttaggtggctctgggaatg

SEQ ID NO: 1180827 - DNA, 17 bp, Homo sapiens
cttaggttggcaaaaag

SEQ ID NO: 1180828 - DNA, 19 bp, Homo sapiens
cttagtaaaataggtcccg

SEQ ID NO: 1180829 - DNA, 21 bp, Homo sapiens
cttagtagattaaaaattata

SEQ ID NO: 1180830 - DNA, 18 bp, Homo sapiens
cttagtagtttttacaaa

SEQ ID NO: 1180831 - DNA, 18 bp, Homo sapiens
cttagtatagtagaaaga

SEQ ID NO: 1180832 - DNA, 16 bp, Homo sapiens
cttagtattgacaact

SEQ ID NO: 1180833 - DNA, 18 bp, Homo sapiens
cttagtatttctcaggaa

SEQ ID NO: 1180834 - DNA, 13 bp, Homo sapiens
cttagtcactgcc

SEQ ID NO: 1180835 - DNA, 16 bp, Homo sapiens
cttagtcactgcctgc

SEQ ID NO: 1180836 - DNA, 17 bp, Homo sapiens
cttagtcccccaactct

SEQ ID NO: 1180837 - DNA, 23 bp, Homo sapiens
cttagtctcagtttgtgtgtctt

SEQ ID NO: 1180838 - DNA, 21 bp, Homo sapiens
cttagtcttctcatagcatta

SEQ ID NO: 1180839 - DNA, 17 bp, Homo sapiens
cttagtgaaattacttc

SEQ ID NO: 1180840 - DNA, 20 bp, Homo sapiens
cttagtgatcatttaaaaag

SEQ ID NO: 1180841 - DNA, 14 bp, Homo sapiens
cttagtgccaggag

SEQ ID NO: 1180842 - DNA, 20 bp, Homo sapiens
cttagtgccaggagggcaca

SEQ ID NO: 1180843 - DNA, 18 bp, Homo sapiens
cttagtgggccagggctg

SEQ ID NO: 1180844 - DNA, 13 bp, Homo sapiens
cttagttaaaaaa

SEQ ID NO: 1180845 - DNA, 19 bp, Homo sapiens
cttagttcatatatcaaga

SEQ ID NO: 1180846 - DNA, 16 bp, Homo sapiens
cttagttcttgaattg

SEQ ID NO: 1180847 - DNA, 23 bp, Homo sapiens
cttagttgacaacctagaatgtc

SEQ ID NO: 1180848 - DNA, 19 bp, Homo sapiens
cttagttggctggaaactg

SEQ ID NO: 1180849 - DNA, 19 bp, Homo sapiens
cttagttggctttgcccac

SEQ ID NO: 1180850 - DNA, 20 bp, Homo sapiens
cttataaagtggaagtatgt

SEQ ID NO: 1180851 - DNA, 21 bp, Homo sapiens
cttataacctagttaaagaaa

SEQ ID NO: 1180852 - DNA, 13 bp, Homo sapiens
cttataactgttt

SEQ ID NO: 1180853 - DNA, 16 bp, Homo sapiens
cttataactgttttag

SEQ ID NO: 1180854 - DNA, 17 bp, Homo sapiens
cttataactgttttaga

SEQ ID NO: 1180855 - DNA, 20 bp, Homo sapiens
cttataagtgaagtgatact

SEQ ID NO: 1180856 - DNA, 23 bp, Homo sapiens
cttataagttaaaacaaaggaac

SEQ ID NO: 1180857 - DNA, 15 bp, Homo sapiens
cttataatgggctct

SEQ ID NO: 1180858 - DNA, 17 bp, Homo sapiens
cttataatgtgtgttgt

SEQ ID NO: 1180859 - DNA, 14 bp, Homo sapiens
cttatacccatgaa

SEQ ID NO: 1180860 - DNA, 20 bp, Homo sapiens
cttatacgaaataattgttg

SEQ ID NO: 1180861 - DNA, 16 bp, Homo sapiens
cttatacgagtaatat

SEQ ID NO: 1180862 - DNA, 16 bp, Homo sapiens
cttatactgtacaata

SEQ ID NO: 1180863 - DNA, 14 bp, Homo sapiens
cttatagaataaaa

SEQ ID NO: 1180864 - DNA, 16 bp, Homo sapiens
cttatagaatatttat

SEQ ID NO: 1180865 - DNA, 17 bp, Homo sapiens
cttataggtaacgtgat

SEQ ID NO: 1180866 - DNA, 18 bp, Homo sapiens
cttatagttactgtgtaa

SEQ ID NO: 1180867 - DNA, 17 bp, Homo sapiens
cttatatatgcacttaa

SEQ ID NO: 1180868 - DNA, 22 bp, Homo sapiens
cttatatatgcacttaatttgt

SEQ ID NO: 1180869 - DNA, 21 bp, Homo sapiens
cttatattaatagtaatttgt

SEQ ID NO: 1180870 - DNA, 16 bp, Homo sapiens
cttatattgaagacaa

SEQ ID NO: 1180871 - DNA, 18 bp, Homo sapiens
cttatattgaagacaatt

SEQ ID NO: 1180872 - DNA, 14 bp, Homo sapiens
cttatattgtaaga

SEQ ID NO: 1180873 - DNA, 15 bp, Homo sapiens
cttatatttctgtgt

SEQ ID NO: 1180874 - DNA, 17 bp, Homo sapiens
catttttcaatagcaca

SEQ ID NO: 1180875 - DNA, 21 bp, Homo sapiens
catttttcaatatattgaact

SEQ ID NO: 1180876 - DNA, 16 bp, Homo sapiens
catttttccaggactc

SEQ ID NO: 1180877 - DNA, 19 bp, Homo sapiens
catttttccgtttgctttt

SEQ ID NO: 1180878 - DNA, 14 bp, Homo sapiens
catttttcctctgt

SEQ ID NO: 1180879 - DNA, 18 bp, Homo sapiens
catttttcctctgttcac

SEQ ID NO: 1180880 - DNA, 23 bp, Homo sapiens
catttttctataaatcagtattt

SEQ ID NO: 1180881 - DNA, 13 bp, Homo sapiens
catttttgctaat

SEQ ID NO: 1180882 - DNA, 16 bp, Homo sapiens
cttatcaaaggacacc

SEQ ID NO: 1180883 - DNA, 11 bp, Homo sapiens
cttatcaagtg

SEQ ID NO: 1180884 - DNA, 23 bp, Homo sapiens
cttatcacataagagagatgaga

SEQ ID NO: 1180885 - DNA, 22 bp, Homo sapiens
cttatcaccacagtaagttcct

SEQ ID NO: 1180886 - DNA, 22 bp, Homo sapiens
cttatcaccagctgcctcttct

SEQ ID NO: 1180887 - DNA, 18 bp, Homo sapiens
cttatcactgacacaaaa

SEQ ID NO: 1180888 - DNA, 15 bp, Homo sapiens
cttatcatttttgta

SEQ ID NO: 1180889 - DNA, 22 bp, Homo sapiens
cttatcatttttgtataaaaag

SEQ ID NO: 1180890 - DNA, 14 bp, Homo sapiens
cttatcccccccag

SEQ ID NO: 1180891 - DNA, 17 bp, Homo sapiens
cttatcccttctttttc

SEQ ID NO: 1180892 - DNA, 21 bp, Homo sapiens
cttatcctaaaacaaatagtt

SEQ ID NO: 1180893 - DNA, 20 bp, Homo sapiens
cttatcctctctctcttcta

SEQ ID NO: 1180894 - DNA, 13 bp, Homo sapiens
cttatcctctgat

SEQ ID NO: 1180895 - DNA, 15 bp, Homo sapiens
cttatcctctgatct

SEQ ID NO: 1180896 - DNA, 18 bp, Homo sapiens
cttatcgggctccagcca

SEQ ID NO: 1180897 - DNA, 18 bp, Homo sapiens
cttatctacttccaaact

SEQ ID NO: 1180898 - DNA, 17 bp, Homo sapiens
cttatctgtgcgtgaaa

SEQ ID NO: 1180899 - DNA, 21 bp, Homo sapiens
cttatctttctaaaactgcct

SEQ ID NO: 1180900 - DNA, 19 bp, Homo sapiens
cttatctttctttccattt

SEQ ID NO: 1180901 - DNA, 17 bp, Homo sapiens
cttatcttttggcttct

SEQ ID NO: 1180902 - DNA, 15 bp, Homo sapiens
cttatgaatatattt

SEQ ID NO: 1180903 - DNA, 18 bp, Homo sapiens
cttatgaatatttataac

SEQ ID NO: 1180904 - DNA, 18 bp, Homo sapiens
cttatgagcgtcactgcc

SEQ ID NO: 1180905 - DNA, 15 bp, Homo sapiens
cttatgaggagggga

SEQ ID NO: 1180906 - DNA, 22 bp, Homo sapiens
cttatgatacttgaggtaccag

SEQ ID NO: 1180907 - DNA, 21 bp, Homo sapiens
cttatgattaaacttccttct

SEQ ID NO: 1180908 - DNA, 23 bp, Homo sapiens
cttatgattcagattgttatcta

SEQ ID NO: 1180909 - DNA, 17 bp, Homo sapiens
cttatgcggttaatttt

SEQ ID NO: 1180910 - DNA, 15 bp, Homo sapiens
cttatgctaaattaa

SEQ ID NO: 1180911 - DNA, 15 bp, Homo sapiens
cttatgctacacaga

SEQ ID NO: 1180912 - DNA, 16 bp, Homo sapiens
cttatgctacacagac

SEQ ID NO: 1180913 - DNA, 21 bp, Homo sapiens
cttatgctagtttattggaag

SEQ ID NO: 1180914 - DNA, 14 bp, Homo sapiens
cttatgctgctgtg

SEQ ID NO: 1180915 - DNA, 17 bp, Homo sapiens
cttatggaattgatttg

SEQ ID NO: 1180916 - DNA, 19 bp, Homo sapiens
cttatggaattgatttgca

SEQ ID NO: 1180917 - DNA, 21 bp, Homo sapiens
cttatggaattgatttgcatt

SEQ ID NO: 1180918 - DNA, 17 bp, Homo sapiens
cttatggcacaaaaaat

SEQ ID NO: 1180919 - DNA, 20 bp, Homo sapiens
cttatgggtggctttcaagg

SEQ ID NO: 1180920 - DNA, 12 bp, Homo sapiens
cttatggtccag

SEQ ID NO: 1180921 - DNA, 17 bp, Homo sapiens
cttatgtgaaaaattaa

SEQ ID NO: 1180922 - DNA, 18 bp, Homo sapiens
cttatgtgaaaaattaac

SEQ ID NO: 1180923 - DNA, 13 bp, Homo sapiens
cttatgtgacatt

SEQ ID NO: 1180924 - DNA, 14 bp, Homo sapiens
cttatgttgaaaaa

SEQ ID NO: 1180925 - DNA, 17 bp, Homo sapiens
cttatgttgaaaaaatt

SEQ ID NO: 1180926 - DNA, 17 bp, Homo sapiens
cttattaaaaaatttgt

SEQ ID NO: 1180927 - DNA, 18 bp, Homo sapiens
cttattaaaaaatttgta

SEQ ID NO: 1180928 - DNA, 12 bp, Homo sapiens
cttattaattct

SEQ ID NO: 1180929 - DNA, 16 bp, Homo sapiens
cttattacattttatt

SEQ ID NO: 1180930 - DNA, 24 bp, Homo sapiens
cttattataaaatggacacaaatt

SEQ ID NO: 1180931 - DNA, 15 bp, Homo sapiens
cttattatagaattg

SEQ ID NO: 1180932 - DNA, 18 bp, Homo sapiens
cttattatattgtccagg

SEQ ID NO: 1180933 - DNA, 17 bp, Homo sapiens
cttattattaataatga

SEQ ID NO: 1180934 - DNA, 14 bp, Homo sapiens
cttattcattttct

SEQ ID NO: 1180935 - DNA, 16 bp, Homo sapiens
cttattcattttctct

SEQ ID NO: 1180936 - DNA, 18 bp, Homo sapiens
cttattcattttctctaa

SEQ ID NO: 1180937 - DNA, 15 bp, Homo sapiens
cttattccaagtgca

SEQ ID NO: 1180938 - DNA, 21 bp, Homo sapiens
cttattcccaaactacagaat

SEQ ID NO: 1180939 - DNA, 18 bp, Homo sapiens
cttattccgagcattcca

SEQ ID NO: 1180940 - DNA, 15 bp, Homo sapiens
cttattctcaaagca

SEQ ID NO: 1180941 - DNA, 22 bp, Homo sapiens
cttattgaaaaaaaaaatgttg

SEQ ID NO: 1180942 - DNA, 16 bp, Homo sapiens
cttattgatcccacat

SEQ ID NO: 1180943 - DNA, 20 bp, Homo sapiens
cttattgatcccacatttcc

SEQ ID NO: 1180944 - DNA, 16 bp, Homo sapiens
cttattgcctcccagg

SEQ ID NO: 1180945 - DNA, 16 bp, Homo sapiens
cttattgcgctgctac

SEQ ID NO: 1180946 - DNA, 12 bp, Homo sapiens
cttattgctgcc

SEQ ID NO: 1180947 - DNA, 17 bp, Homo sapiens
cttattgcttcatctgt

SEQ ID NO: 1180948 - DNA, 14 bp, Homo sapiens
cttattggaaatgt

SEQ ID NO: 1180949 - DNA, 13 bp, Homo sapiens
cttattggccact

SEQ ID NO: 1180950 - DNA, 16 bp, Homo sapiens
cttattggccactggg

SEQ ID NO: 1180951 - DNA, 20 bp, Homo sapiens
cttattgggatatcatttta

SEQ ID NO: 1180952 - DNA, 15 bp, Homo sapiens
cttattgtacctctc

SEQ ID NO: 1180953 - DNA, 12 bp, Homo sapiens
cttattgttcca

SEQ ID NO: 1180954 - DNA, 13 bp, Homo sapiens
cttattgttccaa

SEQ ID NO: 1180955 - DNA, 17 bp, Homo sapiens
cttattgttccaagaca

SEQ ID NO: 1180956 - DNA, 19 bp, Homo sapiens
cttattgttccaagacatt

SEQ ID NO: 1180957 - DNA, 22 bp, Homo sapiens
cttatttaaaaatatttcagat

SEQ ID NO: 1180958 - DNA, 18 bp, Homo sapiens
cttatttaaagctttcaa

SEQ ID NO: 1180959 - DNA, 15 bp, Homo sapiens
cttatttaactgatt

SEQ ID NO: 1180960 - DNA, 20 bp, Homo sapiens
cttatttaagtatggaatat

SEQ ID NO: 1180961 - DNA, 15 bp, Homo sapiens
cttatttaatctttt

SEQ ID NO: 1180962 - DNA, 15 bp, Homo sapiens
cttatttaatgaaag

SEQ ID NO: 1180963 - DNA, 13 bp, Homo sapiens
cttatttagagat

SEQ ID NO: 1180964 - DNA, 14 bp, Homo sapiens
cttatttatatctt

SEQ ID NO: 1180965 - DNA, 14 bp, Homo sapiens
cttatttatgaatt

SEQ ID NO: 1180966 - DNA, 19 bp, Homo sapiens
cttatttattgttgccttt

SEQ ID NO: 1180967 - DNA, 19 bp, Homo sapiens
cttatttctagaagcacat

SEQ ID NO: 1180968 - DNA, 17 bp, Homo sapiens
cttatttctatgacaaa

SEQ ID NO: 1180969 - DNA, 14 bp, Homo sapiens
cttatttctctctc

SEQ ID NO: 1180970 - DNA, 16 bp, Homo sapiens
cttatttctctctcct

SEQ ID NO: 1180971 - DNA, 20 bp, Homo sapiens
cttatttctctctcctggtg

SEQ ID NO: 1180972 - DNA, 17 bp, Homo sapiens
cttatttctgctctgga

SEQ ID NO: 1180973 - DNA, 15 bp, Homo sapiens
cttatttgcttcatt

SEQ ID NO: 1180974 - DNA, 13 bp, Homo sapiens
cttatttggaaat

SEQ ID NO: 1180975 - DNA, 22 bp, Homo sapiens
cttatttgtctgtaaaaaatgg

SEQ ID NO: 1180976 - DNA, 13 bp, Homo sapiens
cttattttagtat

SEQ ID NO: 1180977 - DNA, 12 bp, Homo sapiens
cttattttcaag

SEQ ID NO: 1180978 - DNA, 14 bp, Homo sapiens
cttattttcaagaa

SEQ ID NO: 1180979 - DNA, 15 bp, Homo sapiens
cttattttcaagaaa

SEQ ID NO: 1180980 - DNA, 18 bp, Homo sapiens
cttattttcaagaaactg

SEQ ID NO: 1180981 - DNA, 23 bp, Homo sapiens
cttattttgcattccagaatctt

SEQ ID NO: 1180982 - DNA, 14 bp, Homo sapiens
cttattttgtctta

SEQ ID NO: 1180983 - DNA, 19 bp, Homo sapiens
cttattttgtcttattctt

SEQ ID NO: 1180984 - DNA, 21 bp, Homo sapiens
cttatttttagccataatttt

SEQ ID NO: 1180985 - DNA, 16 bp, Homo sapiens
cttatttttataatta

SEQ ID NO: 1180986 - DNA, 19 bp, Homo sapiens
cttatttttgtatgccttt

SEQ ID NO: 1180987 - DNA, 14 bp, Homo sapiens
cttattttttccca

SEQ ID NO: 1180988 - DNA, 14 bp, Homo sapiens
cttcaaaaataatg

SEQ ID NO: 1180989 - DNA, 21 bp, Homo sapiens
cttcaaaagtttgtttgctta

SEQ ID NO: 1180990 - DNA, 20 bp, Homo sapiens
cttcaaaatgttctatttaa

SEQ ID NO: 1180991 - DNA, 22 bp, Homo sapiens
cttcaaacagaactgcagtcag

SEQ ID NO: 1180992 - DNA, 17 bp, Homo sapiens
cttcaaagattatctga

SEQ ID NO: 1180993 - DNA, 21 bp, Homo sapiens
cttcaaagattatctgattcc

SEQ ID NO: 1180994 - DNA, 19 bp, Homo sapiens
cttcaaagctgaatatttt

SEQ ID NO: 1180995 - DNA, 13 bp, Homo sapiens
cttcaaagtctca

SEQ ID NO: 1180996 - DNA, 14 bp, Homo sapiens
cttcagccctggcc

SEQ ID NO: 1180997 - DNA, 15 bp, Homo sapiens
cttcagccctggcca

SEQ ID NO: 1180998 - DNA, 20 bp, Homo sapiens
cttcagcctagccgacctca

SEQ ID NO: 1180999 - DNA, 23 bp, Homo sapiens
cttcagcctagccgacctcagcc

SEQ ID NO: 1181000 - DNA, 21 bp, Homo sapiens
cttcagctagcttttaggaaa

SEQ ID NO: 1181001 - DNA, 15 bp, Homo sapiens
cttcagctccaggga

SEQ ID NO: 1181002 - DNA, 12 bp, Homo sapiens
cttcagctcctg

SEQ ID NO: 1181003 - DNA, 16 bp, Homo sapiens
cttcagctcctgagta

SEQ ID NO: 1181004 - DNA, 15 bp, Homo sapiens
cttcagctgactttt

SEQ ID NO: 1181005 - DNA, 19 bp, Homo sapiens
cttcagctgtacttcgtct

SEQ ID NO: 1181006 - DNA, 16 bp, Homo sapiens
cttcaggaggccctgg

SEQ ID NO: 1181007 - DNA, 23 bp, Homo sapiens
cttcagggagggttagcctgcac

SEQ ID NO: 1181008 - DNA, 17 bp, Homo sapiens
cttcagggcagggctct

SEQ ID NO: 1181009 - DNA, 18 bp, Homo sapiens
cttcagggcagggctctg

SEQ ID NO: 1181010 - DNA, 15 bp, Homo sapiens
cttcagggctgagtt

SEQ ID NO: 1181011 - DNA, 16 bp, Homo sapiens
cttcagggctgctggg

SEQ ID NO: 1181012 - DNA, 18 bp, Homo sapiens
cttcaggggaagagaaga

SEQ ID NO: 1181013 - DNA, 12 bp, Homo sapiens
ccaaaggaaggg

SEQ ID NO: 1181014 - DNA, 18 bp, Homo sapiens
ccaaaggaagtctaggag

SEQ ID NO: 1181015 - DNA, 15 bp, Homo sapiens
ccaaaggacgcctgc

SEQ ID NO: 1181016 - DNA, 15 bp, Homo sapiens
ccaaaggaggctggc

SEQ ID NO: 1181017 - DNA, 16 bp, Homo sapiens
ccaaaggaggctggca

SEQ ID NO: 1181018 - DNA, 18 bp, Homo sapiens
ccaaaggaggctggcagg

SEQ ID NO: 1181019 - DNA, 13 bp, Homo sapiens
ccaaaggccagcg

SEQ ID NO: 1181020 - DNA, 15 bp, Homo sapiens
ccaaaggccagcggt

SEQ ID NO: 1181021 - DNA, 15 bp, Homo sapiens
ccaaaggcccaggga

SEQ ID NO: 1181022 - DNA, 12 bp, Homo sapiens
ccaaaggctggt

SEQ ID NO: 1181023 - DNA, 15 bp, Homo sapiens
ccaaaggctggtggc

SEQ ID NO: 1181024 - DNA, 22 bp, Homo sapiens
ccaaagggaagtgaggcccaag

SEQ ID NO: 1181025 - DNA, 17 bp, Homo sapiens
ccaaaggggacaggcct

SEQ ID NO: 1181026 - DNA, 18 bp, Homo sapiens
ccaaaggggacaggcctc

SEQ ID NO: 1181027 - DNA, 19 bp, Homo sapiens
ccaaaggggacaggcctca

SEQ ID NO: 1181028 - DNA, 16 bp, Homo sapiens
ccaaaggggagccaga

SEQ ID NO: 1181029 - DNA, 14 bp, Homo sapiens
ccaaaggggctgct

SEQ ID NO: 1181030 - DNA, 19 bp, Homo sapiens
ccaaaggggctgctggggc

SEQ ID NO: 1181031 - DNA, 14 bp, Homo sapiens
ccaaaggtcaatgt

SEQ ID NO: 1181032 - DNA, 22 bp, Homo sapiens
ccaaaggtgaaggaatatatgg

SEQ ID NO: 1181033 - DNA, 11 bp, Homo sapiens
ccaaaggttcc

SEQ ID NO: 1181034 - DNA, 22 bp, Homo sapiens
ccaaagtacactgtttcaaact

SEQ ID NO: 1181035 - DNA, 12 bp, Homo sapiens
ccaaagtacctt

SEQ ID NO: 1181036 - DNA, 21 bp, Homo sapiens
ccaaagtagtcctggcagctg

SEQ ID NO: 1181037 - DNA, 20 bp, Homo sapiens
ccaaagtattaatgtacaga

SEQ ID NO: 1181038 - DNA, 13 bp, Homo sapiens
ccaaagtattttt

SEQ ID NO: 1181039 - DNA, 21 bp, Homo sapiens
ccaaagtcccttcctgcttcc

SEQ ID NO: 1181040 - DNA, 14 bp, Homo sapiens
ccaaagtcctctgc

SEQ ID NO: 1181041 - DNA, 14 bp, Homo sapiens
ccaaagtctaaact

SEQ ID NO: 1181042 - DNA, 15 bp, Homo sapiens
ccaaagtctgccgcc

SEQ ID NO: 1181043 - DNA, 19 bp, Homo sapiens
ccaaagtgcagcccttcct

SEQ ID NO: 1181044 - DNA, 23 bp, Homo sapiens
ccaaagtgcagcccttcctcctg

SEQ ID NO: 1181045 - DNA, 15 bp, Homo sapiens
ccaaagtggagctgg

SEQ ID NO: 1181046 - DNA, 15 bp, Homo sapiens
ccaaataacttcagt

SEQ ID NO: 1181047 - DNA, 14 bp, Homo sapiens
ccaaatagccccag

SEQ ID NO: 1181048 - DNA, 20 bp, Homo sapiens
ccaaatagccccagactggg

SEQ ID NO: 1181049 - DNA, 16 bp, Homo sapiens
ccaaatataagacatt

SEQ ID NO: 1181050 - DNA, 20 bp, Homo sapiens
ccaaatataagacatttgtt

SEQ ID NO: 1181051 - DNA, 18 bp, Homo sapiens
ccaaatatgtattttcct

SEQ ID NO: 1181052 - DNA, 23 bp, Homo sapiens
ccaaatattattcaagtgcctct

SEQ ID NO: 1181053 - DNA, 18 bp, Homo sapiens
ccaaatcatcctgaatct

SEQ ID NO: 1181054 - DNA, 20 bp, Homo sapiens
ccaaatccctttcatgtctt

SEQ ID NO: 1181055 - DNA, 20 bp, Homo sapiens
ccaaatccgctctcttcctg

SEQ ID NO: 1181056 - DNA, 14 bp, Homo sapiens
ccaaatctggaagc

SEQ ID NO: 1181057 - DNA, 13 bp, Homo sapiens
ccaaatctgtcct

SEQ ID NO: 1181058 - DNA, 16 bp, Homo sapiens
ccaaatgcaaaattag

SEQ ID NO: 1181059 - DNA, 17 bp, Homo sapiens
ccaaatgcaaaattagt

SEQ ID NO: 1181060 - DNA, 15 bp, Homo sapiens
ccaaatgcaatttga

SEQ ID NO: 1181061 - DNA, 23 bp, Homo sapiens
ccaaatgcagggaggggaggcag

SEQ ID NO: 1181062 - DNA, 23 bp, Homo sapiens
ccaaatgcagttcattgcagaca

SEQ ID NO: 1181063 - DNA, 22 bp, Homo sapiens
ccaaatgcatggtgcagttgac

SEQ ID NO: 1181064 - DNA, 14 bp, Homo sapiens
ccaaatgcccaagg

SEQ ID NO: 1181065 - DNA, 15 bp, Homo sapiens
ccaaatgcctgttgt

SEQ ID NO: 1181066 - DNA, 19 bp, Homo sapiens
ccaaatggagaagctgcag

SEQ ID NO: 1181067 - DNA, 18 bp, Homo sapiens
ccaaatggccattttaaa

SEQ ID NO: 1181068 - DNA, 19 bp, Homo sapiens
ccaaatggccattttaaaa

SEQ ID NO: 1181069 - DNA, 13 bp, Homo sapiens
ccaaatggctgct

SEQ ID NO: 1181070 - DNA, 20 bp, Homo sapiens
ccaaatggctgctttgacaa

SEQ ID NO: 1181071 - DNA, 18 bp, Homo sapiens
ccaaatgtaattgaataa

SEQ ID NO: 1181072 - DNA, 13 bp, Homo sapiens
ccaaatgtccctc

SEQ ID NO: 1181073 - DNA, 21 bp, Homo sapiens
ccaaatgtgatcaactgttca

SEQ ID NO: 1181074 - DNA, 14 bp, Homo sapiens
ccaaatgtgtcaga

SEQ ID NO: 1181075 - DNA, 18 bp, Homo sapiens
ccaaattataagggccct

SEQ ID NO: 1181076 - DNA, 19 bp, Homo sapiens
ccaaattataagggccctg

SEQ ID NO: 1181077 - DNA, 14 bp, Homo sapiens
ccaaattatgtgaa

SEQ ID NO: 1181078 - DNA, 13 bp, Homo sapiens
ccaaattattaat

SEQ ID NO: 1181079 - DNA, 11 bp, Homo sapiens
ccaaattattt

SEQ ID NO: 1181080 - DNA, 14 bp, Homo sapiens
ccaaattatttgtg

SEQ ID NO: 1181081 - DNA, 17 bp, Homo sapiens
ccaaattatttgtgtaa

SEQ ID NO: 1181082 - DNA, 13 bp, Homo sapiens
ccaaattcagttt

SEQ ID NO: 1181083 - DNA, 18 bp, Homo sapiens
ccaaattcagtttcataa

SEQ ID NO: 1181084 - DNA, 19 bp, Homo sapiens
ccaaattgcttctaggagt

SEQ ID NO: 1181085 - DNA, 16 bp, Homo sapiens
ccaaattgtgtatata

SEQ ID NO: 1181086 - DNA, 20 bp, Homo sapiens
ccaaatttgattgatttgaa

SEQ ID NO: 1181087 - DNA, 22 bp, Homo sapiens
ccaaatttggctcacttgcctt

SEQ ID NO: 1181088 - DNA, 21 bp, Homo sapiens
ccaaattttggccaaagtgtt

SEQ ID NO: 1181089 - DNA, 16 bp, Homo sapiens
ccaacaaaccatccag

SEQ ID NO: 1181090 - DNA, 22 bp, Homo sapiens
ccaacaactcagaatgggggct

SEQ ID NO: 1181091 - DNA, 17 bp, Homo sapiens
ccaacaagcctcaaagt

SEQ ID NO: 1181092 - DNA, 21 bp, Homo sapiens
ccaacaataaacaggaatttt

SEQ ID NO: 1181093 - DNA, 23 bp, Homo sapiens
ccaacaataaaccaaacccagcc

SEQ ID NO: 1181094 - DNA, 18 bp, Homo sapiens
ccaacaatggggtgggcc

SEQ ID NO: 1181095 - DNA, 15 bp, Homo sapiens
ccaacaattggaggg

SEQ ID NO: 1181096 - DNA, 16 bp, Homo sapiens
ccaacaccaagcacag

SEQ ID NO: 1181097 - DNA, 17 bp, Homo sapiens
ccaacaccaagcacagc

SEQ ID NO: 1181098 - DNA, 23 bp, Homo sapiens
ccaacaccaagcacagcagcctg

SEQ ID NO: 1181099 - DNA, 16 bp, Homo sapiens
ccaacaccacagacac

SEQ ID NO: 1181100 - DNA, 12 bp, Homo sapiens
ccaacaccaggg

SEQ ID NO: 1181101 - DNA, 13 bp, Homo sapiens
ccaacaccaggga

SEQ ID NO: 1181102 - DNA, 19 bp, Homo sapiens
ccaacaccttcttggcttc

SEQ ID NO: 1181103 - DNA, 16 bp, Homo sapiens
ccaacagaagcagact

SEQ ID NO: 1181104 - DNA, 22 bp, Homo sapiens
ccaacagaagcagacttttcag

SEQ ID NO: 1181105 - DNA, 23 bp, Homo sapiens
ccaacagaagcagacttttcaga

SEQ ID NO: 1181106 - DNA, 17 bp, Homo sapiens
ccaacagatgcttttct

SEQ ID NO: 1181107 - DNA, 16 bp, Homo sapiens
ccaacagcacctcccc

SEQ ID NO: 1181108 - DNA, 14 bp, Homo sapiens
ccaacagcagtgat

SEQ ID NO: 1181109 - DNA, 16 bp, Homo sapiens
ccaacagcccccccct

SEQ ID NO: 1181110 - DNA, 17 bp, Homo sapiens
ccaacagctcagagatg

SEQ ID NO: 1181111 - DNA, 23 bp, Homo sapiens
ccaacagggtagatttctcttgg

SEQ ID NO: 1181112 - DNA, 23 bp, Homo sapiens
ccaacaggtggcaggaccaggac

SEQ ID NO: 1181113 - DNA, 17 bp, Homo sapiens
ccaacaggtttatctga

SEQ ID NO: 1181114 - DNA, 20 bp, Homo sapiens
ccaacagtgagtctgtcagc

SEQ ID NO: 1181115 - DNA, 17 bp, Homo sapiens
ccaacagttgtatgttt

SEQ ID NO: 1181116 - DNA, 13 bp, Homo sapiens
ccaacagtttatt

SEQ ID NO: 1181117 - DNA, 15 bp, Homo sapiens
ccaacataaaaatga

SEQ ID NO: 1181118 - DNA, 15 bp, Homo sapiens
ccaagaatacttgaa

SEQ ID NO: 1181119 - DNA, 16 bp, Homo sapiens
ccaagacaaatcaaca

SEQ ID NO: 1181120 - DNA, 18 bp, Homo sapiens
ccaagacaaatcaacaga

SEQ ID NO: 1181121 - DNA, 14 bp, Homo sapiens
ccaagacacatgct

SEQ ID NO: 1181122 - DNA, 16 bp, Homo sapiens
ccaagacacttcccct

SEQ ID NO: 1181123 - DNA, 23 bp, Homo sapiens
ccaagacagatgccccagagctg

SEQ ID NO: 1181124 - DNA, 16 bp, Homo sapiens
ccaagacagtgagaca

SEQ ID NO: 1181125 - DNA, 17 bp, Homo sapiens
ccaagaccaccagggtc

SEQ ID NO: 1181126 - DNA, 22 bp, Homo sapiens
ccaagaccaccagggtcccagg

SEQ ID NO: 1181127 - DNA, 15 bp, Homo sapiens
ccaagaccccctggg

SEQ ID NO: 1181128 - DNA, 16 bp, Homo sapiens
ccaagactcctcaggc

SEQ ID NO: 1181129 - DNA, 13 bp, Homo sapiens
ccaagactgaaga

SEQ ID NO: 1181130 - DNA, 19 bp, Homo sapiens
ccaagacttcattgtccct

SEQ ID NO: 1181131 - DNA, 18 bp, Homo sapiens
ccaagacttggcaacaga

SEQ ID NO: 1181132 - DNA, 20 bp, Homo sapiens
ccaagacttggcaacagaag

SEQ ID NO: 1181133 - DNA, 17 bp, Homo sapiens
ccaagagaactaaagct

SEQ ID NO: 1181134 - DNA, 11 bp, Homo sapiens
ccaagagacat

SEQ ID NO: 1181135 - DNA, 12 bp, Homo sapiens
ccaagagacatg

SEQ ID NO: 1181136 - DNA, 13 bp, Homo sapiens
ccaagagaggaag

SEQ ID NO: 1181137 - DNA, 18 bp, Homo sapiens
ccaagagaggaaggaccc

SEQ ID NO: 1181138 - DNA, 21 bp, Homo sapiens
ccaagagaggaaggacccctc

SEQ ID NO: 1181139 - DNA, 12 bp, Homo sapiens
ccaagagatgaa

SEQ ID NO: 1181140 - DNA, 18 bp, Homo sapiens
ccaagagcaattgcagca

SEQ ID NO: 1181141 - DNA, 18 bp, Homo sapiens
ccaagagcaatttacctg

SEQ ID NO: 1181142 - DNA, 19 bp, Homo sapiens
ccaagagcagaggcagcga

SEQ ID NO: 1181143 - DNA, 22 bp, Homo sapiens
cttccagcccagacccccagtg

SEQ ID NO: 1181144 - DNA, 12 bp, Homo sapiens
cttccagctgct

SEQ ID NO: 1181145 - DNA, 21 bp, Homo sapiens
cttccagctgctgtcttctgg

SEQ ID NO: 1181146 - DNA, 13 bp, Homo sapiens
cttccaggaaact

SEQ ID NO: 1181147 - DNA, 22 bp, Homo sapiens
cttccaggaaactccacatctg

SEQ ID NO: 1181148 - DNA, 18 bp, Homo sapiens
cttccaggaatgctgggc

SEQ ID NO: 1181149 - DNA, 20 bp, Homo sapiens
cttccaggaatgctgggccc

SEQ ID NO: 1181150 - DNA, 21 bp, Homo sapiens
cttccaggagccaccttgcca

SEQ ID NO: 1181151 - DNA, 19 bp, Homo sapiens
cttccaggcccccaccact

SEQ ID NO: 1181152 - DNA, 15 bp, Homo sapiens
cttccaggctcttcc

SEQ ID NO: 1181153 - DNA, 21 bp, Homo sapiens
cttccaggctcttcctggacc

SEQ ID NO: 1181154 - DNA, 22 bp, Homo sapiens
cttccaggctcttcctggacct

SEQ ID NO: 1181155 - DNA, 23 bp, Homo sapiens
cttccaggctcttcctggacctg

SEQ ID NO: 1181156 - DNA, 22 bp, Homo sapiens
cttccagggcagcggctccact

SEQ ID NO: 1181157 - DNA, 16 bp, Homo sapiens
cttccaggggaacctg

SEQ ID NO: 1181158 - DNA, 13 bp, Homo sapiens
cttccagggggaa

SEQ ID NO: 1181159 - DNA, 18 bp, Homo sapiens
cttccaggtatctccagg

SEQ ID NO: 1181160 - DNA, 19 bp, Homo sapiens
cttccaggtatctccagga

SEQ ID NO: 1181161 - DNA, 14 bp, Homo sapiens
cttccaggtcagga

SEQ ID NO: 1181162 - DNA, 23 bp, Homo sapiens
cttccaggtcaggatgcacattt

SEQ ID NO: 1181163 - DNA, 23 bp, Homo sapiens
cttccaggtccaaacccttcaac

SEQ ID NO: 1181164 - DNA, 22 bp, Homo sapiens
cttccaggtgggtgtgggacac

SEQ ID NO: 1181165 - DNA, 19 bp, Homo sapiens
cttccagtctggagagctg

SEQ ID NO: 1181166 - DNA, 20 bp, Homo sapiens
cttccagtcttcctgacact

SEQ ID NO: 1181167 - DNA, 22 bp, Homo sapiens
cttccagtcttcctgacacttt

SEQ ID NO: 1181168 - DNA, 14 bp, Homo sapiens
cttccagtgaacat

SEQ ID NO: 1181169 - DNA, 21 bp, Homo sapiens
cttccagtgaacattcccagc

SEQ ID NO: 1181170 - DNA, 19 bp, Homo sapiens
cttccagtgtccttagaac

SEQ ID NO: 1181171 - DNA, 12 bp, Homo sapiens
cttccagtgttg

SEQ ID NO: 1181172 - DNA, 22 bp, Homo sapiens
cttccataatgctactgtctca

SEQ ID NO: 1181173 - DNA, 14 bp, Homo sapiens
cttccatacagctc

SEQ ID NO: 1181174 - DNA, 16 bp, Homo sapiens
cttccatacagctcta

SEQ ID NO: 1181175 - DNA, 15 bp, Homo sapiens
cttccatatccctgc

SEQ ID NO: 1181176 - DNA, 22 bp, Homo sapiens
cttccatcagcgggtctcctcc

SEQ ID NO: 1181177 - DNA, 19 bp, Homo sapiens
cttccatcatcactgtaaa

SEQ ID NO: 1181178 - DNA, 23 bp, Homo sapiens
cttccatcatcactgtaaagaca

SEQ ID NO: 1181179 - DNA, 12 bp, Homo sapiens
cttccatcccta

SEQ ID NO: 1181180 - DNA, 14 bp, Homo sapiens
cttccatccctacc

SEQ ID NO: 1181181 - DNA, 16 bp, Homo sapiens
cttccatccctacccc

SEQ ID NO: 1181182 - DNA, 19 bp, Homo sapiens
cttccatcttgtggggcca

SEQ ID NO: 1181183 - DNA, 22 bp, Homo sapiens
cttccatcttgtggggccagga

SEQ ID NO: 1181184 - DNA, 20 bp, Homo sapiens
cttccatgaattttaaaatc

SEQ ID NO: 1181185 - DNA, 19 bp, Homo sapiens
cttccatgacctcccctcc

SEQ ID NO: 1181186 - DNA, 22 bp, Homo sapiens
cttccatgacctcccctcccca

SEQ ID NO: 1181187 - DNA, 14 bp, Homo sapiens
cttccatgatttta

SEQ ID NO: 1181188 - DNA, 14 bp, Homo sapiens
cttccatgctgtgc

SEQ ID NO: 1181189 - DNA, 17 bp, Homo sapiens
cttccatggcttcctga

SEQ ID NO: 1181190 - DNA, 19 bp, Homo sapiens
cttccatggcttcctgaga

SEQ ID NO: 1181191 - DNA, 22 bp, Homo sapiens
cttccatggtactgtagcaggg

SEQ ID NO: 1181192 - DNA, 19 bp, Homo sapiens
cttccatgtcgcctctgca

SEQ ID NO: 1181193 - DNA, 12 bp, Homo sapiens
cttccatgtgga

SEQ ID NO: 1181194 - DNA, 15 bp, Homo sapiens
cttccatgtggagaa

SEQ ID NO: 1181195 - DNA, 13 bp, Homo sapiens
cttccattattga

SEQ ID NO: 1181196 - DNA, 17 bp, Homo sapiens
cttccattccttcatgt

SEQ ID NO: 1181197 - DNA, 21 bp, Homo sapiens
cttccattggttcttcctttc

SEQ ID NO: 1181198 - DNA, 19 bp, Homo sapiens
cttccatttgacaaagtgc

SEQ ID NO: 1181199 - DNA, 13 bp, Homo sapiens
cttccatttgcaa

SEQ ID NO: 1181200 - DNA, 22 bp, Homo sapiens
cttccattttcccccactactg

SEQ ID NO: 1181201 - DNA, 19 bp, Homo sapiens
cttcccaacagccttagct

SEQ ID NO: 1181202 - DNA, 22 bp, Homo sapiens
cttcccaacagccttagctgcc

SEQ ID NO: 1181203 - DNA, 22 bp, Homo sapiens
cttcccaaggttactcagcagc

SEQ ID NO: 1181204 - DNA, 20 bp, Homo sapiens
cttcccaagtagctgcaaca

SEQ ID NO: 1181205 - DNA, 23 bp, Homo sapiens
cttcccaagtagctgggattaca

SEQ ID NO: 1181206 - DNA, 20 bp, Homo sapiens
cttcccacaaaagacagacc

SEQ ID NO: 1181207 - DNA, 17 bp, Homo sapiens
cttcccacacggcagcc

SEQ ID NO: 1181208 - DNA, 18 bp, Homo sapiens
cttcccacacggcagccc

SEQ ID NO: 1181209 - DNA, 23 bp, Homo sapiens
cttcccacatacattaaacacac

SEQ ID NO: 1181210 - DNA, 15 bp, Homo sapiens
cttcccactggaggt

SEQ ID NO: 1181211 - DNA, 12 bp, Homo sapiens
cttcccacttgc

SEQ ID NO: 1181212 - DNA, 15 bp, Homo sapiens
cttcccagccagccc

SEQ ID NO: 1181213 - DNA, 18 bp, Homo sapiens
cttcccagccctcatccc

SEQ ID NO: 1181214 - DNA, 21 bp, Homo sapiens
cttcccagcggttcctgtgca

SEQ ID NO: 1181215 - DNA, 15 bp, Homo sapiens
cttcccagctctccc

SEQ ID NO: 1181216 - DNA, 11 bp, Homo sapiens
cttcccaggcc

SEQ ID NO: 1181217 - DNA, 12 bp, Homo sapiens
cttcccaggcct

SEQ ID NO: 1181218 - DNA, 13 bp, Homo sapiens
cttcccaggcctt

SEQ ID NO: 1181219 - DNA, 13 bp, Homo sapiens
cttcccagggacc

SEQ ID NO: 1181220 - DNA, 21 bp, Homo sapiens
cttcccagtgaatccctggga

SEQ ID NO: 1181221 - DNA, 23 bp, Homo sapiens
cttcccagtgaatccctgggagc

SEQ ID NO: 1181222 - DNA, 14 bp, Homo sapiens
cttcccagtgggct

SEQ ID NO: 1181223 - DNA, 22 bp, Homo sapiens
cttcccagttcaggagtcccaa

SEQ ID NO: 1181224 - DNA, 23 bp, Homo sapiens
cttcccataaaatgtaagaaaag

SEQ ID NO: 1181225 - DNA, 19 bp, Homo sapiens
cttcccatcctaccctcgg

SEQ ID NO: 1181226 - DNA, 18 bp, Homo sapiens
cttcccatgactgcaccc

SEQ ID NO: 1181227 - DNA, 21 bp, Homo sapiens
cttcccatgactgcacccagc

SEQ ID NO: 1181228 - DNA, 24 bp, Homo sapiens
cttcccattgagtaatcatactca

SEQ ID NO: 1181229 - DNA, 15 bp, Homo sapiens
cttcccattgtggct

SEQ ID NO: 1181230 - DNA, 22 bp, Homo sapiens
cttcccatttctctacactaag

SEQ ID NO: 1181231 - DNA, 19 bp, Homo sapiens
cttccccaacttccctagt

SEQ ID NO: 1181232 - DNA, 20 bp, Homo sapiens
cttccccaagggccaaaccc

SEQ ID NO: 1181233 - DNA, 18 bp, Homo sapiens
cttccccactgcacacac

SEQ ID NO: 1181234 - DNA, 14 bp, Homo sapiens
cttccccactgcct

SEQ ID NO: 1181235 - DNA, 16 bp, Homo sapiens
cttccccactgcctgc

SEQ ID NO: 1181236 - DNA, 20 bp, Homo sapiens
cttccccactgcctgcccac

SEQ ID NO: 1181237 - DNA, 19 bp, Homo sapiens
cttccccagaaaggagact

SEQ ID NO: 1181238 - DNA, 17 bp, Homo sapiens
cttccccagactcagct

SEQ ID NO: 1181239 - DNA, 17 bp, Homo sapiens
cttcctcacactgctgt

SEQ ID NO: 1181240 - DNA, 18 bp, Homo sapiens
cttcctcacactgctgtc

SEQ ID NO: 1181241 - DNA, 15 bp, Homo sapiens
cttcctcagcctcca

SEQ ID NO: 1181242 - DNA, 18 bp, Homo sapiens
cttcctcagcctccaaag

SEQ ID NO: 1181243 - DNA, 14 bp, Homo sapiens
cttcctcagggccc

SEQ ID NO: 1181244 - DNA, 19 bp, Homo sapiens
cttcctcagggcccctggg

SEQ ID NO: 1181245 - DNA, 14 bp, Homo sapiens
cttcctcatcccct

SEQ ID NO: 1181246 - DNA, 14 bp, Homo sapiens
cttcctcatcctgc

SEQ ID NO: 1181247 - DNA, 13 bp, Homo sapiens
cttcctccacaag

SEQ ID NO: 1181248 - DNA, 15 bp, Homo sapiens
cttcctccacatcct

SEQ ID NO: 1181249 - DNA, 11 bp, Homo sapiens
cttcctccaga

SEQ ID NO: 1181250 - DNA, 13 bp, Homo sapiens
cttcctccagagg

SEQ ID NO: 1181251 - DNA, 15 bp, Homo sapiens
cttcctccagctgca

SEQ ID NO: 1181252 - DNA, 22 bp, Homo sapiens
cttcctccagctgcaccagagc

SEQ ID NO: 1181253 - DNA, 16 bp, Homo sapiens
cttcctccccacactc

SEQ ID NO: 1181254 - DNA, 18 bp, Homo sapiens
cttcctccccacactcca

SEQ ID NO: 1181255 - DNA, 19 bp, Homo sapiens
cttcctccccacactccac

SEQ ID NO: 1181256 - DNA, 23 bp, Homo sapiens
cttcctccccacactccactctg

SEQ ID NO: 1181257 - DNA, 22 bp, Homo sapiens
cttcctccccgcctcctcccac

SEQ ID NO: 1181258 - DNA, 14 bp, Homo sapiens
cttcctccctgggg

SEQ ID NO: 1181259 - DNA, 20 bp, Homo sapiens
cttcctccgaggccagtacc

SEQ ID NO: 1181260 - DNA, 16 bp, Homo sapiens
cttcctccgtccaccc

SEQ ID NO: 1181261 - DNA, 20 bp, Homo sapiens
cttcctccgtccacccaggc

SEQ ID NO: 1181262 - DNA, 14 bp, Homo sapiens
cttcctcctacctg

SEQ ID NO: 1181263 - DNA, 13 bp, Homo sapiens
cttcctcctcagg

SEQ ID NO: 1181264 - DNA, 12 bp, Homo sapiens
cttcctcctcca

SEQ ID NO: 1181265 - DNA, 20 bp, Homo sapiens
cttcctcctccatcacctga

SEQ ID NO: 1181266 - DNA, 16 bp, Homo sapiens
cttcctcctccccact

SEQ ID NO: 1181267 - DNA, 21 bp, Homo sapiens
cttcctcctccctcctgccga

SEQ ID NO: 1181268 - DNA, 11 bp, Homo sapiens
cttcctcctga

SEQ ID NO: 1181269 - DNA, 20 bp, Homo sapiens
cttcctcctgaagcctctgc

SEQ ID NO: 1181270 - DNA, 12 bp, Homo sapiens
cttcctcctgat

SEQ ID NO: 1181271 - DNA, 13 bp, Homo sapiens
cttcctcctggaa

SEQ ID NO: 1181272 - DNA, 14 bp, Homo sapiens
cttcctcctggaaa

SEQ ID NO: 1181273 - DNA, 16 bp, Homo sapiens
ccaaggccgaagctct

SEQ ID NO: 1181274 - DNA, 18 bp, Homo sapiens
ccaaggccgaagctctgg

SEQ ID NO: 1181275 - DNA, 14 bp, Homo sapiens
ccaaggccttctcc

SEQ ID NO: 1181276 - DNA, 18 bp, Homo sapiens
ccaaggctctcccctctc

SEQ ID NO: 1181277 - DNA, 16 bp, Homo sapiens
ccaaggctctgagcaa

SEQ ID NO: 1181278 - DNA, 21 bp, Homo sapiens
ccaaggctttaaagctgagag

SEQ ID NO: 1181279 - DNA, 17 bp, Homo sapiens
ccaagggaacctgtgtc

SEQ ID NO: 1181280 - DNA, 16 bp, Homo sapiens
ccaagggaatattgcc

SEQ ID NO: 1181281 - DNA, 22 bp, Homo sapiens
ccaagggacagcaagtgagcag

SEQ ID NO: 1181282 - DNA, 20 bp, Homo sapiens
ccaagggacaggagaagaga

SEQ ID NO: 1181283 - DNA, 18 bp, Homo sapiens
ccaagggacaggtgggcc

SEQ ID NO: 1181284 - DNA, 17 bp, Homo sapiens
ccaagggagggaagggc

SEQ ID NO: 1181285 - DNA, 20 bp, Homo sapiens
ccaagggagggaagggccac

SEQ ID NO: 1181286 - DNA, 21 bp, Homo sapiens
ccaagggagggaagggccacc

SEQ ID NO: 1181287 - DNA, 24 bp, Homo sapiens
ccaagggagggaagggccaccctg

SEQ ID NO: 1181288 - DNA, 21 bp, Homo sapiens
ccaagggatctggtcctaccc

SEQ ID NO: 1181289 - DNA, 17 bp, Homo sapiens
ccaagggatggcaccac

SEQ ID NO: 1181290 - DNA, 13 bp, Homo sapiens
ccaagggccaaac

SEQ ID NO: 1181291 - DNA, 14 bp, Homo sapiens
ccaagggccaaacc

SEQ ID NO: 1181292 - DNA, 20 bp, Homo sapiens
ccaagggccaaacccacttc

SEQ ID NO: 1181293 - DNA, 11 bp, Homo sapiens
ccaagggcccc

SEQ ID NO: 1181294 - DNA, 14 bp, Homo sapiens
ccaagggcttctgc

SEQ ID NO: 1181295 - DNA, 17 bp, Homo sapiens
ccaagggcttctgcacc

SEQ ID NO: 1181296 - DNA, 19 bp, Homo sapiens
ccaagggcttctgcaccct

SEQ ID NO: 1181297 - DNA, 22 bp, Homo sapiens
ccaagggcttctgcaccctcca

SEQ ID NO: 1181298 - DNA, 20 bp, Homo sapiens
ccaaggggagtcaccttccc

SEQ ID NO: 1181299 - DNA, 21 bp, Homo sapiens
ccaaggggagtcaccttccct

SEQ ID NO: 1181300 - DNA, 22 bp, Homo sapiens
ccaaggggagtcaccttccctt

SEQ ID NO: 1181301 - DNA, 14 bp, Homo sapiens
ccaaggggcagtct

SEQ ID NO: 1181302 - DNA, 16 bp, Homo sapiens
ccaaggggcagtcttg

SEQ ID NO: 1181303 - DNA, 14 bp, Homo sapiens
ccaaggggctgcgc

SEQ ID NO: 1181304 - DNA, 19 bp, Homo sapiens
ccaaggggcttcgttttca

SEQ ID NO: 1181305 - DNA, 16 bp, Homo sapiens
ccaagggggcggggac

SEQ ID NO: 1181306 - DNA, 16 bp, Homo sapiens
ccaagggggtgactgg

SEQ ID NO: 1181307 - DNA, 17 bp, Homo sapiens
ccaagggggtgactgga

SEQ ID NO: 1181308 - DNA, 19 bp, Homo sapiens
ccaagggggtgactggaag

SEQ ID NO: 1181309 - DNA, 22 bp, Homo sapiens
ccaaggggtctgtatatacatt

SEQ ID NO: 1181310 - DNA, 20 bp, Homo sapiens
ccaagggttcagagactcag

SEQ ID NO: 1181311 - DNA, 14 bp, Homo sapiens
ccaaggtcctctca

SEQ ID NO: 1181312 - DNA, 15 bp, Homo sapiens
ccaaggtcctgctca

SEQ ID NO: 1181313 - DNA, 17 bp, Homo sapiens
ccaaggtcttcagccat

SEQ ID NO: 1181314 - DNA, 19 bp, Homo sapiens
ccaaggtcttcagccatca

SEQ ID NO: 1181315 - DNA, 15 bp, Homo sapiens
ccaaggtgatgttgt

SEQ ID NO: 1181316 - DNA, 10 bp, Homo sapiens
ccaaggtgca

SEQ ID NO: 1181317 - DNA, 16 bp, Homo sapiens
ccaaggtgcatataga

SEQ ID NO: 1181318 - DNA, 14 bp, Homo sapiens
ccaaggtggaggga

SEQ ID NO: 1181319 - DNA, 16 bp, Homo sapiens
ccaaggtggagggaag

SEQ ID NO: 1181320 - DNA, 21 bp, Homo sapiens
ccaaggttactcagcagcaga

SEQ ID NO: 1181321 - DNA, 22 bp, Homo sapiens
ccaaggttactcagcagcagag

SEQ ID NO: 1181322 - DNA, 16 bp, Homo sapiens
ccaaggttccagaggc

SEQ ID NO: 1181323 - DNA, 20 bp, Homo sapiens
ccaaggttccagaggcccta

SEQ ID NO: 1181324 - DNA, 13 bp, Homo sapiens
ccaagtaaaatgt

SEQ ID NO: 1181325 - DNA, 18 bp, Homo sapiens
ccaagtaaacagggtacc

SEQ ID NO: 1181326 - DNA, 15 bp, Homo sapiens
ccaagtagcctctcc

SEQ ID NO: 1181327 - DNA, 14 bp, Homo sapiens
ccaagtatttatta

SEQ ID NO: 1181328 - DNA, 20 bp, Homo sapiens
ccaagtcaacactcttcttg

SEQ ID NO: 1181329 - DNA, 23 bp, Homo sapiens
ccaagtcaacactcttcttgagc

SEQ ID NO: 1181330 - DNA, 20 bp, Homo sapiens
ccaagtcaagtgaaaaagga

SEQ ID NO: 1181331 - DNA, 20 bp, Homo sapiens
ccaagtcagctttgccttcc

SEQ ID NO: 1181332 - DNA, 15 bp, Homo sapiens
ccaagtcaggccagg

SEQ ID NO: 1181333 - DNA, 22 bp, Homo sapiens
ccaagtccaacctgcctgtgca

SEQ ID NO: 1181334 - DNA, 17 bp, Homo sapiens
ccaagtccactgtcctc

SEQ ID NO: 1181335 - DNA, 15 bp, Homo sapiens
ccaagtccctgtttt

SEQ ID NO: 1181336 - DNA, 23 bp, Homo sapiens
ccaagtccctgttttctgagccc

SEQ ID NO: 1181337 - DNA, 21 bp, Homo sapiens
ccaagtccgcagaagccctga

SEQ ID NO: 1181338 - DNA, 22 bp, Homo sapiens
ccaagtctaaaaagacctggcc

SEQ ID NO: 1181339 - DNA, 12 bp, Homo sapiens
ccaagtctctct

SEQ ID NO: 1181340 - DNA, 15 bp, Homo sapiens
ccaagtctctctgtg

SEQ ID NO: 1181341 - DNA, 19 bp, Homo sapiens
ccaagtctctctgtgaata

SEQ ID NO: 1181342 - DNA, 17 bp, Homo sapiens
ccaagtgaccagggaag

SEQ ID NO: 1181343 - DNA, 22 bp, Homo sapiens
ccaagtgatccttccacctcag

SEQ ID NO: 1181344 - DNA, 16 bp, Homo sapiens
ccaagtgcactttcta

SEQ ID NO: 1181345 - DNA, 14 bp, Homo sapiens
ccaagtgccagagg

SEQ ID NO: 1181346 - DNA, 15 bp, Homo sapiens
ccaagtgccagaggt

SEQ ID NO: 1181347 - DNA, 17 bp, Homo sapiens
ccaagtgccagaggtgg

SEQ ID NO: 1181348 - DNA, 18 bp, Homo sapiens
ccaagtgccagaggtggg

SEQ ID NO: 1181349 - DNA, 21 bp, Homo sapiens
ccaagtgccagaggtgggcag

SEQ ID NO: 1181350 - DNA, 16 bp, Homo sapiens
ccaagtgccagtcttg

SEQ ID NO: 1181351 - DNA, 12 bp, Homo sapiens
ccaagtgcctca

SEQ ID NO: 1181352 - DNA, 13 bp, Homo sapiens
ccaagtgcctgct

SEQ ID NO: 1181353 - DNA, 19 bp, Homo sapiens
ccaagtggacttggagctg

SEQ ID NO: 1181354 - DNA, 19 bp, Homo sapiens
ccaagtggctgggtgccct

SEQ ID NO: 1181355 - DNA, 12 bp, Homo sapiens
ccaagtgggcag

SEQ ID NO: 1181356 - DNA, 20 bp, Homo sapiens
ccaagtgggcagtcaccacc

SEQ ID NO: 1181357 - DNA, 16 bp, Homo sapiens
ccaagtgggggcagag

SEQ ID NO: 1181358 - DNA, 11 bp, Homo sapiens
ccaagtgtctt

SEQ ID NO: 1181359 - DNA, 17 bp, Homo sapiens
ccaagtgtgtgtgcgtg

SEQ ID NO: 1181360 - DNA, 15 bp, Homo sapiens
ccaagttataaatca

SEQ ID NO: 1181361 - DNA, 19 bp, Homo sapiens
ccacaacaccagccccact

SEQ ID NO: 1181362 - DNA, 17 bp, Homo sapiens
ccacaacagcctggggt

SEQ ID NO: 1181363 - DNA, 17 bp, Homo sapiens
ccacaaccttcggctcc

SEQ ID NO: 1181364 - DNA, 13 bp, Homo sapiens
ccacaactgctgt

SEQ ID NO: 1181365 - DNA, 14 bp, Homo sapiens
ccacaactgctgtg

SEQ ID NO: 1181366 - DNA, 21 bp, Homo sapiens
ccacaacttgtcacccaaagc

SEQ ID NO: 1181367 - DNA, 16 bp, Homo sapiens
ccacaagattcccaga

SEQ ID NO: 1181368 - DNA, 17 bp, Homo sapiens
ccacaagattcccagag

SEQ ID NO: 1181369 - DNA, 19 bp, Homo sapiens
ccacaagattcccagagac

SEQ ID NO: 1181370 - DNA, 21 bp, Homo sapiens
ccacaagattcccagagacag

SEQ ID NO: 1181371 - DNA, 13 bp, Homo sapiens
ccacaagctgagc

SEQ ID NO: 1181372 - DNA, 14 bp, Homo sapiens
ccacaagctgagca

SEQ ID NO: 1181373 - DNA, 14 bp, Homo sapiens
ccacaagctgcact

SEQ ID NO: 1181374 - DNA, 20 bp, Homo sapiens
ccacaagctgcactgtgaac

SEQ ID NO: 1181375 - DNA, 19 bp, Homo sapiens
ccacaaggaaccctcaggc

SEQ ID NO: 1181376 - DNA, 13 bp, Homo sapiens
ccacaaggctggc

SEQ ID NO: 1181377 - DNA, 16 bp, Homo sapiens
ccacaaggctggccag

SEQ ID NO: 1181378 - DNA, 18 bp, Homo sapiens
ccacaaggtccactccct

SEQ ID NO: 1181379 - DNA, 17 bp, Homo sapiens
ccacaagtccagctggg

SEQ ID NO: 1181380 - DNA, 19 bp, Homo sapiens
ccacaagtgaatctttctc

SEQ ID NO: 1181381 - DNA, 15 bp, Homo sapiens
ccacaagtggtggta

SEQ ID NO: 1181382 - DNA, 22 bp, Homo sapiens
ccacaagtggtggtaaccctgg

SEQ ID NO: 1181383 - DNA, 13 bp, Homo sapiens
ccacaagtgtcta

SEQ ID NO: 1181384 - DNA, 15 bp, Homo sapiens
ccacaagttaaataa

SEQ ID NO: 1181385 - DNA, 23 bp, Homo sapiens
ccacaattcttctgtcaagctta

SEQ ID NO: 1181386 - DNA, 16 bp, Homo sapiens
ccacacacacccacac

SEQ ID NO: 1181387 - DNA, 19 bp, Homo sapiens
ccacacacaggccttctgt

SEQ ID NO: 1181388 - DNA, 23 bp, Homo sapiens
ccacacacaggccttctgtgggg

SEQ ID NO: 1181389 - DNA, 18 bp, Homo sapiens
ccacacacgcaggaactc

SEQ ID NO: 1181390 - DNA, 15 bp, Homo sapiens
ccacacactcgcccg

SEQ ID NO: 1181391 - DNA, 14 bp, Homo sapiens
ccacacagcctcta

SEQ ID NO: 1181392 - DNA, 13 bp, Homo sapiens
ccacacagctgcc

SEQ ID NO: 1181393 - DNA, 19 bp, Homo sapiens
ccacacagctgccctagct

SEQ ID NO: 1181394 - DNA, 12 bp, Homo sapiens
ccacacagggca

SEQ ID NO: 1181395 - DNA, 17 bp, Homo sapiens
ccacacagtcacccctc

SEQ ID NO: 1181396 - DNA, 21 bp, Homo sapiens
ccacacattccagccaggccc

SEQ ID NO: 1181397 - DNA, 22 bp, Homo sapiens
ccacacattccagccaggccca

SEQ ID NO: 1181398 - DNA, 23 bp, Homo sapiens
ccacacattccagccaggcccag

SEQ ID NO: 1181399 - DNA, 14 bp, Homo sapiens
ccacaccaacactg

SEQ ID NO: 1181400 - DNA, 23 bp, Homo sapiens
ccacaccaatcagagagcctaga

SEQ ID NO: 1181401 - DNA, 20 bp, Homo sapiens
ccacaccactaaccatcccc

SEQ ID NO: 1181402 - DNA, 15 bp, Homo sapiens
ccacaccagtggcct

SEQ ID NO: 1181403 - DNA, 19 bp, Homo sapiens
cttcgctgctctagctggc

SEQ ID NO: 1181404 - DNA, 21 bp, Homo sapiens
cttcgctgctctagctggcag

SEQ ID NO: 1181405 - DNA, 17 bp, Homo sapiens
cttcgcttcttgcctct

SEQ ID NO: 1181406 - DNA, 17 bp, Homo sapiens
cttcggacagacatatg

SEQ ID NO: 1181407 - DNA, 22 bp, Homo sapiens
cttcggagggcccctgcgtggg

SEQ ID NO: 1181408 - DNA, 13 bp, Homo sapiens
cttcggagggccg

SEQ ID NO: 1181409 - DNA, 18 bp, Homo sapiens
cttcggagggccgcaggg

SEQ ID NO: 1181410 - DNA, 14 bp, Homo sapiens
cttcggcagggagg

SEQ ID NO: 1181411 - DNA, 21 bp, Homo sapiens
cttcgggaggtcgaggcagga

SEQ ID NO: 1181412 - DNA, 16 bp, Homo sapiens
cttcggggaagataca

SEQ ID NO: 1181413 - DNA, 14 bp, Homo sapiens
cttcggggcctcct

SEQ ID NO: 1181414 - DNA, 23 bp, Homo sapiens
cttcggtgtgcagatcatccgtc

SEQ ID NO: 1181415 - DNA, 14 bp, Homo sapiens
cttcggtttctgag

SEQ ID NO: 1181416 - DNA, 15 bp, Homo sapiens
cttcggtttctgagc

SEQ ID NO: 1181417 - DNA, 16 bp, Homo sapiens
cttcggtttctgagca

SEQ ID NO: 1181418 - DNA, 23 bp, Homo sapiens
cttcgtatcccgagtctgggaca

SEQ ID NO: 1181419 - DNA, 19 bp, Homo sapiens
cttcgtcctgatccctcca

SEQ ID NO: 1181420 - DNA, 14 bp, Homo sapiens
cttcgtccttttgg

SEQ ID NO: 1181421 - DNA, 18 bp, Homo sapiens
cttcgtccttttggttta

SEQ ID NO: 1181422 - DNA, 21 bp, Homo sapiens
cttcgtcttgtgtttgctgca

SEQ ID NO: 1181423 - DNA, 21 bp, Homo sapiens
cttcgtctttcccatggggag

SEQ ID NO: 1181424 - DNA, 15 bp, Homo sapiens
cttcgtgctggagga

SEQ ID NO: 1181425 - DNA, 16 bp, Homo sapiens
cttcgtgctggaggaa

SEQ ID NO: 1181426 - DNA, 16 bp, Homo sapiens
cttcgtgtctctccca

SEQ ID NO: 1181427 - DNA, 13 bp, Homo sapiens
cttcgtgtgctgc

SEQ ID NO: 1181428 - DNA, 15 bp, Homo sapiens
cttcgtgtgctgctg

SEQ ID NO: 1181429 - DNA, 20 bp, Homo sapiens
cttcgttaactgtgtatgta

SEQ ID NO: 1181430 - DNA, 23 bp, Homo sapiens
cttcgttaatagattatttcata

SEQ ID NO: 1181431 - DNA, 15 bp, Homo sapiens
cttcgtttattttca

SEQ ID NO: 1181432 - DNA, 13 bp, Homo sapiens
cttctaaaaactt

SEQ ID NO: 1181433 - DNA, 19 bp, Homo sapiens
cttctaaacccaatccaaa

SEQ ID NO: 1181434 - DNA, 22 bp, Homo sapiens
cttctaaacttccccatcttct

SEQ ID NO: 1181435 - DNA, 23 bp, Homo sapiens
cttctaaagcactggtttcaaga

SEQ ID NO: 1181436 - DNA, 23 bp, Homo sapiens
cttctaaatggcaaaggaaggtg

SEQ ID NO: 1181437 - DNA, 16 bp, Homo sapiens
cttctaagaggataca

SEQ ID NO: 1181438 - DNA, 15 bp, Homo sapiens
cttctaagatgccag

SEQ ID NO: 1181439 - DNA, 17 bp, Homo sapiens
cttctaagtaaatacaa

SEQ ID NO: 1181440 - DNA, 20 bp, Homo sapiens
cttctaatatatttttatat

SEQ ID NO: 1181441 - DNA, 14 bp, Homo sapiens
cttctaatttatat

SEQ ID NO: 1181442 - DNA, 18 bp, Homo sapiens
cttctaatttatattatc

SEQ ID NO: 1181443 - DNA, 19 bp, Homo sapiens
cttctacagaacctgaggg

SEQ ID NO: 1181444 - DNA, 18 bp, Homo sapiens
cttctaccccaaggccag

SEQ ID NO: 1181445 - DNA, 19 bp, Homo sapiens
cttctacctgccctcaagg

SEQ ID NO: 1181446 - DNA, 17 bp, Homo sapiens
cttctacttgtaaaatg

SEQ ID NO: 1181447 - DNA, 19 bp, Homo sapiens
cttctacttgtaaaatgct

SEQ ID NO: 1181448 - DNA, 16 bp, Homo sapiens
cttctactttcatctt

SEQ ID NO: 1181449 - DNA, 21 bp, Homo sapiens
cttctacttttaagttgctga

SEQ ID NO: 1181450 - DNA, 17 bp, Homo sapiens
cttctagaaactctggc

SEQ ID NO: 1181451 - DNA, 20 bp, Homo sapiens
cttctagaaactctggctca

SEQ ID NO: 1181452 - DNA, 14 bp, Homo sapiens
cttctagagcctcg

SEQ ID NO: 1181453 - DNA, 21 bp, Homo sapiens
cttctagatcttagttctaga

SEQ ID NO: 1181454 - DNA, 13 bp, Homo sapiens
cttctagcagaga

SEQ ID NO: 1181455 - DNA, 20 bp, Homo sapiens
cttctaggagtcaactggct

SEQ ID NO: 1181456 - DNA, 23 bp, Homo sapiens
cttctaggagtcaactggctggc

SEQ ID NO: 1181457 - DNA, 22 bp, Homo sapiens
cttctaggatagctaactgtaa

SEQ ID NO: 1181458 - DNA, 17 bp, Homo sapiens
cttctaggggtagctgg

SEQ ID NO: 1181459 - DNA, 19 bp, Homo sapiens
cttctagggttattgcatt

SEQ ID NO: 1181460 - DNA, 16 bp, Homo sapiens
cttctaggttctaaaa

SEQ ID NO: 1181461 - DNA, 16 bp, Homo sapiens
cttctagtgagcctgg

SEQ ID NO: 1181462 - DNA, 17 bp, Homo sapiens
cttctagtgagcctggg

SEQ ID NO: 1181463 - DNA, 20 bp, Homo sapiens
cttctagtgagcctgggcca

SEQ ID NO: 1181464 - DNA, 23 bp, Homo sapiens
cttctagtgagcctgggccagga

SEQ ID NO: 1181465 - DNA, 18 bp, Homo sapiens
cttctagtgcttttcagt

SEQ ID NO: 1181466 - DNA, 15 bp, Homo sapiens
cttctagtttcccac

SEQ ID NO: 1181467 - DNA, 17 bp, Homo sapiens
cttctataattttgcct

SEQ ID NO: 1181468 - DNA, 19 bp, Homo sapiens
cttctataattttgccttt

SEQ ID NO: 1181469 - DNA, 15 bp, Homo sapiens
cttctatattttaat

SEQ ID NO: 1181470 - DNA, 19 bp, Homo sapiens
cttctatattttaatagaa

SEQ ID NO: 1181471 - DNA, 20 bp, Homo sapiens
cttctatattttaatagaaa

SEQ ID NO: 1181472 - DNA, 23 bp, Homo sapiens
cttctatggactggttgttgcca

SEQ ID NO: 1181473 - DNA, 17 bp, Homo sapiens
cttctatgttggtttca

SEQ ID NO: 1181474 - DNA, 20 bp, Homo sapiens
cttctatgttggtttcagtg

SEQ ID NO: 1181475 - DNA, 19 bp, Homo sapiens
cttctattaatcaagagaa

SEQ ID NO: 1181476 - DNA, 19 bp, Homo sapiens
cttctattatagccacatc

SEQ ID NO: 1181477 - DNA, 21 bp, Homo sapiens
cttctattctagcctgcattg

SEQ ID NO: 1181478 - DNA, 16 bp, Homo sapiens
cttctatttaatgctt

SEQ ID NO: 1181479 - DNA, 13 bp, Homo sapiens
cttctattttatt

SEQ ID NO: 1181480 - DNA, 16 bp, Homo sapiens
cttctattttgtaaac

SEQ ID NO: 1181481 - DNA, 12 bp, Homo sapiens
cttctcaagact

SEQ ID NO: 1181482 - DNA, 19 bp, Homo sapiens
cttctgcaattgcttagga

SEQ ID NO: 1181483 - DNA, 21 bp, Homo sapiens
cttctgcaccctccaccctgt

SEQ ID NO: 1181484 - DNA, 14 bp, Homo sapiens
cttctgcagcctcg

SEQ ID NO: 1181485 - DNA, 19 bp, Homo sapiens
cttctgccaacgcctcctg

SEQ ID NO: 1181486 - DNA, 20 bp, Homo sapiens
cttctgccaacgcctcctgt

SEQ ID NO: 1181487 - DNA, 20 bp, Homo sapiens
cttctgccacttctgcgggc

SEQ ID NO: 1181488 - DNA, 20 bp, Homo sapiens
cttctgccatttctgagatc

SEQ ID NO: 1181489 - DNA, 18 bp, Homo sapiens
cttctgccctccctggag

SEQ ID NO: 1181490 - DNA, 11 bp, Homo sapiens
cttctgccctt

SEQ ID NO: 1181491 - DNA, 14 bp, Homo sapiens
cttctgcctgttat

SEQ ID NO: 1181492 - DNA, 20 bp, Homo sapiens
cttctgcgggctccctcctc

SEQ ID NO: 1181493 - DNA, 22 bp, Homo sapiens
cttctgcgtccaccaggcctca

SEQ ID NO: 1181494 - DNA, 24 bp, Homo sapiens
cttctgcgtccaccaggcctcact

SEQ ID NO: 1181495 - DNA, 19 bp, Homo sapiens
cttctgctactggcaaaag

SEQ ID NO: 1181496 - DNA, 20 bp, Homo sapiens
cttctgctactggcaaaagg

SEQ ID NO: 1181497 - DNA, 15 bp, Homo sapiens
cttctgctcagctct

SEQ ID NO: 1181498 - DNA, 18 bp, Homo sapiens
cttctgctcagctctggg

SEQ ID NO: 1181499 - DNA, 13 bp, Homo sapiens
cttctgctcatta

SEQ ID NO: 1181500 - DNA, 12 bp, Homo sapiens
cttctgctccac

SEQ ID NO: 1181501 - DNA, 17 bp, Homo sapiens
cttctgctccacccttg

SEQ ID NO: 1181502 - DNA, 14 bp, Homo sapiens
cttctgctccagcc

SEQ ID NO: 1181503 - DNA, 16 bp, Homo sapiens
cttctgctccagcccc

SEQ ID NO: 1181504 - DNA, 14 bp, Homo sapiens
cttctgctcccacc

SEQ ID NO: 1181505 - DNA, 19 bp, Homo sapiens
cttctgctcccaccccaga

SEQ ID NO: 1181506 - DNA, 12 bp, Homo sapiens
cttctgctcctt

SEQ ID NO: 1181507 - DNA, 19 bp, Homo sapiens
cttctgctgcctaggttct

SEQ ID NO: 1181508 - DNA, 14 bp, Homo sapiens
cttctgctggagga

SEQ ID NO: 1181509 - DNA, 19 bp, Homo sapiens
cttctgctggataaaatga

SEQ ID NO: 1181510 - DNA, 14 bp, Homo sapiens
cttctgctgttctt

SEQ ID NO: 1181511 - DNA, 17 bp, Homo sapiens
cttctgctgttcttcac

SEQ ID NO: 1181512 - DNA, 16 bp, Homo sapiens
cttctgcttttctgcc

SEQ ID NO: 1181513 - DNA, 17 bp, Homo sapiens
cttctgcttttctgccc

SEQ ID NO: 1181514 - DNA, 22 bp, Homo sapiens
cttctgcttttctgccctggct

SEQ ID NO: 1181515 - DNA, 17 bp, Homo sapiens
cttctggaaactaccag

SEQ ID NO: 1181516 - DNA, 15 bp, Homo sapiens
cttctggacactgag

SEQ ID NO: 1181517 - DNA, 17 bp, Homo sapiens
cttctggagctgggaga

SEQ ID NO: 1181518 - DNA, 14 bp, Homo sapiens
cttctggagtttct

SEQ ID NO: 1181519 - DNA, 15 bp, Homo sapiens
cttctggagtttctc

SEQ ID NO: 1181520 - DNA, 17 bp, Homo sapiens
cttctggcacttggaga

SEQ ID NO: 1181521 - DNA, 14 bp, Homo sapiens
cttctggcctccca

SEQ ID NO: 1181522 - DNA, 16 bp, Homo sapiens
cttctggctcacagga

SEQ ID NO: 1181523 - DNA, 17 bp, Homo sapiens
cttctgggagcaggaac

SEQ ID NO: 1181524 - DNA, 14 bp, Homo sapiens
cttctgggcagagc

SEQ ID NO: 1181525 - DNA, 18 bp, Homo sapiens
cttctgggcagagcctgt

SEQ ID NO: 1181526 - DNA, 21 bp, Homo sapiens
cttctgggctactgccactgt

SEQ ID NO: 1181527 - DNA, 20 bp, Homo sapiens
cttctgggcttcattctgga

SEQ ID NO: 1181528 - DNA, 23 bp, Homo sapiens
cttctgggcttcattctggaaac

SEQ ID NO: 1181529 - DNA, 15 bp, Homo sapiens
cttctggggcaggct

SEQ ID NO: 1181530 - DNA, 16 bp, Homo sapiens
cttctggggcaggctg

SEQ ID NO: 1181531 - DNA, 19 bp, Homo sapiens
cttctggggcaggctgggc

SEQ ID NO: 1181532 - DNA, 23 bp, Homo sapiens
ccacagttgccaccacctctgtg

SEQ ID NO: 1181533 - DNA, 21 bp, Homo sapiens
ccacagtttacctcaggtgtg

SEQ ID NO: 1181534 - DNA, 13 bp, Homo sapiens
ccacagttttaat

SEQ ID NO: 1181535 - DNA, 14 bp, Homo sapiens
ccacataaatgctc

SEQ ID NO: 1181536 - DNA, 13 bp, Homo sapiens
ccacataagtcca

SEQ ID NO: 1181537 - DNA, 20 bp, Homo sapiens
ccacatagcatgcttccttt

SEQ ID NO: 1181538 - DNA, 23 bp, Homo sapiens
ccacatagcatgcttcctttctc

SEQ ID NO: 1181539 - DNA, 16 bp, Homo sapiens
ccacataggaaaatgc

SEQ ID NO: 1181540 - DNA, 19 bp, Homo sapiens
ccacatagtgatggttccc

SEQ ID NO: 1181541 - DNA, 21 bp, Homo sapiens
ccacatagtgatggttcccct

SEQ ID NO: 1181542 - DNA, 23 bp, Homo sapiens
ccacatagtgatggttcccctgt

SEQ ID NO: 1181543 - DNA, 19 bp, Homo sapiens
ccacatattaaaagggggc

SEQ ID NO: 1181544 - DNA, 18 bp, Homo sapiens
ccacatcagccccacagg

SEQ ID NO: 1181545 - DNA, 19 bp, Homo sapiens
ccacatcatggaccaaatg

SEQ ID NO: 1181546 - DNA, 19 bp, Homo sapiens
ccacatcccagcagcccaa

SEQ ID NO: 1181547 - DNA, 15 bp, Homo sapiens
ccacatcccaggctt

SEQ ID NO: 1181548 - DNA, 16 bp, Homo sapiens
ccacatcccatcgtct

SEQ ID NO: 1181549 - DNA, 14 bp, Homo sapiens
ccacatccccagag

SEQ ID NO: 1181550 - DNA, 17 bp, Homo sapiens
ccacatccccagagccc

SEQ ID NO: 1181551 - DNA, 13 bp, Homo sapiens
ccacatcctccac

SEQ ID NO: 1181552 - DNA, 20 bp, Homo sapiens
ccacatcctccgtccagccg

SEQ ID NO: 1181553 - DNA, 22 bp, Homo sapiens
ccacatctaagcctgaaggggc

SEQ ID NO: 1181554 - DNA, 23 bp, Homo sapiens
ccacatctaagcctgaaggggcg

SEQ ID NO: 1181555 - DNA, 16 bp, Homo sapiens
ccacatctgccagacc

SEQ ID NO: 1181556 - DNA, 14 bp, Homo sapiens
ccacatctgcctcc

SEQ ID NO: 1181557 - DNA, 18 bp, Homo sapiens
ccacatctgcctcctctc

SEQ ID NO: 1181558 - DNA, 13 bp, Homo sapiens
ccacatctgcctt

SEQ ID NO: 1181559 - DNA, 13 bp, Homo sapiens
ccacatctgtcct

SEQ ID NO: 1181560 - DNA, 14 bp, Homo sapiens
ccacatgaaaccta

SEQ ID NO: 1181561 - DNA, 13 bp, Homo sapiens
ccacatgaggcca

SEQ ID NO: 1181562 - DNA, 15 bp, Homo sapiens
ccacatggagccccc

SEQ ID NO: 1181563 - DNA, 14 bp, Homo sapiens
ccacatgggacctg

SEQ ID NO: 1181564 - DNA, 12 bp, Homo sapiens
ccacatgggctg

SEQ ID NO: 1181565 - DNA, 13 bp, Homo sapiens
ccacatgggctgg

SEQ ID NO: 1181566 - DNA, 20 bp, Homo sapiens
ccacatgggctgggggccag

SEQ ID NO: 1181567 - DNA, 17 bp, Homo sapiens
ccacatggtgtggccat

SEQ ID NO: 1181568 - DNA, 16 bp, Homo sapiens
ccacattaaagaagac

SEQ ID NO: 1181569 - DNA, 16 bp, Homo sapiens
ccacattgaagaatgt

SEQ ID NO: 1181570 - DNA, 16 bp, Homo sapiens
ccacattgacagtggt

SEQ ID NO: 1181571 - DNA, 17 bp, Homo sapiens
ccacatttgggctcagg

SEQ ID NO: 1181572 - DNA, 16 bp, Homo sapiens
ccacatttgtcacaga

SEQ ID NO: 1181573 - DNA, 15 bp, Homo sapiens
ccaccaaactgcaca

SEQ ID NO: 1181574 - DNA, 14 bp, Homo sapiens
ccaccaaagctgcc

SEQ ID NO: 1181575 - DNA, 19 bp, Homo sapiens
ccaccaacataaaacaaaa

SEQ ID NO: 1181576 - DNA, 21 bp, Homo sapiens
ccaccaacccatcagaaggag

SEQ ID NO: 1181577 - DNA, 20 bp, Homo sapiens
ccaccaactctgcactccat

SEQ ID NO: 1181578 - DNA, 17 bp, Homo sapiens
ccaccaagacttgtttt

SEQ ID NO: 1181579 - DNA, 11 bp, Homo sapiens
ccaccaaggtc

SEQ ID NO: 1181580 - DNA, 22 bp, Homo sapiens
ccaccaagtctaaaaagacctg

SEQ ID NO: 1181581 - DNA, 23 bp, Homo sapiens
ccaccaagtctaaaaagacctgg

SEQ ID NO: 1181582 - DNA, 12 bp, Homo sapiens
ccaccacacagt

SEQ ID NO: 1181583 - DNA, 14 bp, Homo sapiens
ccaccacacagtca

SEQ ID NO: 1181584 - DNA, 14 bp, Homo sapiens
ccaccacagccagc

SEQ ID NO: 1181585 - DNA, 15 bp, Homo sapiens
ccaccacagccagca

SEQ ID NO: 1181586 - DNA, 21 bp, Homo sapiens
ccaccacagccagcacctggc

SEQ ID NO: 1181587 - DNA, 11 bp, Homo sapiens
ccaccacccaa

SEQ ID NO: 1181588 - DNA, 14 bp, Homo sapiens
ccaccacctctgtg

SEQ ID NO: 1181589 - DNA, 15 bp, Homo sapiens
ccaccacctttggct

SEQ ID NO: 1181590 - DNA, 19 bp, Homo sapiens
ccaccacgatgtggccctg

SEQ ID NO: 1181591 - DNA, 21 bp, Homo sapiens
ccaccacgatgtggccctggc

SEQ ID NO: 1181592 - DNA, 13 bp, Homo sapiens
ccaccacgcagcc

SEQ ID NO: 1181593 - DNA, 18 bp, Homo sapiens
ccaccacgcatgctcagt

SEQ ID NO: 1181594 - DNA, 16 bp, Homo sapiens
ccaccacgcccagcta

SEQ ID NO: 1181595 - DNA, 13 bp, Homo sapiens
ccaccacgcctgg

SEQ ID NO: 1181596 - DNA, 14 bp, Homo sapiens
ccaccacgtctgcc

SEQ ID NO: 1181597 - DNA, 15 bp, Homo sapiens
ccaccacgtctgcca

SEQ ID NO: 1181598 - DNA, 17 bp, Homo sapiens
ccaccacgtctgccagg

SEQ ID NO: 1181599 - DNA, 20 bp, Homo sapiens
ccaccacgtctgccaggccc

SEQ ID NO: 1181600 - DNA, 22 bp, Homo sapiens
ccaccacgtctggctccctgcc

SEQ ID NO: 1181601 - DNA, 14 bp, Homo sapiens
ccaccactcaggcc

SEQ ID NO: 1181602 - DNA, 16 bp, Homo sapiens
ccaccactcaggccac

SEQ ID NO: 1181603 - DNA, 18 bp, Homo sapiens
ccaccactgcctgactgc

SEQ ID NO: 1181604 - DNA, 20 bp, Homo sapiens
ccaccacttccagagccaga

SEQ ID NO: 1181605 - DNA, 17 bp, Homo sapiens
ccacccctgccactcac

SEQ ID NO: 1181606 - DNA, 12 bp, Homo sapiens
ccacccctgtgc

SEQ ID NO: 1181607 - DNA, 15 bp, Homo sapiens
ccacccctgtgctcc

SEQ ID NO: 1181608 - DNA, 13 bp, Homo sapiens
ccaccccttcctc

SEQ ID NO: 1181609 - DNA, 21 bp, Homo sapiens
ccaccccttggcccctcacat

SEQ ID NO: 1181610 - DNA, 15 bp, Homo sapiens
ccacccgacttcttt

SEQ ID NO: 1181611 - DNA, 12 bp, Homo sapiens
ccacccgcccga

SEQ ID NO: 1181612 - DNA, 21 bp, Homo sapiens
ccacccggccacagctgctgg

SEQ ID NO: 1181613 - DNA, 14 bp, Homo sapiens
ccacccgggctgcc

SEQ ID NO: 1181614 - DNA, 19 bp, Homo sapiens
ccacccgtaggcagcctct

SEQ ID NO: 1181615 - DNA, 20 bp, Homo sapiens
ccacccgtaggcagcctctc

SEQ ID NO: 1181616 - DNA, 23 bp, Homo sapiens
ccacccgtcctccctcagcctcc

SEQ ID NO: 1181617 - DNA, 15 bp, Homo sapiens
ccacccgtcttcaat

SEQ ID NO: 1181618 - DNA, 21 bp, Homo sapiens
ccacccgtggggtgctgccct

SEQ ID NO: 1181619 - DNA, 17 bp, Homo sapiens
ccaccctaagggcagcc

SEQ ID NO: 1181620 - DNA, 19 bp, Homo sapiens
ccaccctaagggcagccct

SEQ ID NO: 1181621 - DNA, 12 bp, Homo sapiens
ccaccctacctg

SEQ ID NO: 1181622 - DNA, 23 bp, Homo sapiens
ccaccctacgctcatctctggaa

SEQ ID NO: 1181623 - DNA, 23 bp, Homo sapiens
ccaccctcacacacacagctggg

SEQ ID NO: 1181624 - DNA, 19 bp, Homo sapiens
ccaccctcactggctctcc

SEQ ID NO: 1181625 - DNA, 21 bp, Homo sapiens
ccaccctcactggctctcctg

SEQ ID NO: 1181626 - DNA, 19 bp, Homo sapiens
ccaccctcagcaccccttc

SEQ ID NO: 1181627 - DNA, 18 bp, Homo sapiens
ccaccctcaggtgcctcc

SEQ ID NO: 1181628 - DNA, 18 bp, Homo sapiens
ccaccctccacgaggtgt

SEQ ID NO: 1181629 - DNA, 12 bp, Homo sapiens
ccaccctcctct

SEQ ID NO: 1181630 - DNA, 14 bp, Homo sapiens
ccaccctcctctag

SEQ ID NO: 1181631 - DNA, 16 bp, Homo sapiens
ccaccctcctcttgga

SEQ ID NO: 1181632 - DNA, 14 bp, Homo sapiens
ccaccctctgggga

SEQ ID NO: 1181633 - DNA, 17 bp, Homo sapiens
ccaccctctggggacag

SEQ ID NO: 1181634 - DNA, 12 bp, Homo sapiens
ccaccctctggt

SEQ ID NO: 1181635 - DNA, 13 bp, Homo sapiens
ccaccctgagccg

SEQ ID NO: 1181636 - DNA, 22 bp, Homo sapiens
ccaccctgagccggccccaggc

SEQ ID NO: 1181637 - DNA, 11 bp, Homo sapiens
ccaccctgcat

SEQ ID NO: 1181638 - DNA, 18 bp, Homo sapiens
ccaccctgcattttcctc

SEQ ID NO: 1181639 - DNA, 24 bp, Homo sapiens
ccaccctgcattttcctcttgtcc

SEQ ID NO: 1181640 - DNA, 21 bp, Homo sapiens
ccaccctgccaagactcctca

SEQ ID NO: 1181641 - DNA, 19 bp, Homo sapiens
ccaccctgcgggccagggt

SEQ ID NO: 1181642 - DNA, 20 bp, Homo sapiens
ccaccctgcgggccagggtc

SEQ ID NO: 1181643 - DNA, 10 bp, Homo sapiens
ccaccctgct

SEQ ID NO: 1181644 - DNA, 13 bp, Homo sapiens
ccaccctgctcat

SEQ ID NO: 1181645 - DNA, 13 bp, Homo sapiens
ccaccctgctcct

SEQ ID NO: 1181646 - DNA, 12 bp, Homo sapiens
ccaccctggccc

SEQ ID NO: 1181647 - DNA, 12 bp, Homo sapiens
ccaccctgggac

SEQ ID NO: 1181648 - DNA, 20 bp, Homo sapiens
ccaccctgggccctgggctg

SEQ ID NO: 1181649 - DNA, 22 bp, Homo sapiens
ccaccctgggccctgggctgga

SEQ ID NO: 1181650 - DNA, 22 bp, Homo sapiens
ccaccctgtcccccagctctgg

SEQ ID NO: 1181651 - DNA, 12 bp, Homo sapiens
ccacccttggcc

SEQ ID NO: 1181652 - DNA, 15 bp, Homo sapiens
ccacccttggcctgt

SEQ ID NO: 1181653 - DNA, 22 bp, Homo sapiens
ccacccttggcctgtccacctg

SEQ ID NO: 1181654 - DNA, 17 bp, Homo sapiens
ccacccttggcctgtct

SEQ ID NO: 1181655 - DNA, 23 bp, Homo sapiens
ccaccctttggggggggcccgcc

SEQ ID NO: 1181656 - DNA, 17 bp, Homo sapiens
ccaccgaccaactgccc

SEQ ID NO: 1181657 - DNA, 18 bp, Homo sapiens
ccaccgaccaactgccct

SEQ ID NO: 1181658 - DNA, 14 bp, Homo sapiens
ccaccgactgccca

SEQ ID NO: 1181659 - DNA, 15 bp, Homo sapiens
ccaccgactgcccag

SEQ ID NO: 1181660 - DNA, 17 bp, Homo sapiens
ccaccgatggagccccc

SEQ ID NO: 1181661 - DNA, 21 bp, Homo sapiens
ccaccgatggagcccccagat

SEQ ID NO: 1181662 - DNA, 14 bp, Homo sapiens
ccaccgcagctact

SEQ ID NO: 1181663 - DNA, 22 bp, Homo sapiens
ccaccgcatatgcatgccaggc

SEQ ID NO: 1181664 - DNA, 20 bp, Homo sapiens
cttgaaagcagttaaactga

SEQ ID NO: 1181665 - DNA, 20 bp, Homo sapiens
cttgaaagcatccatgtgtg

SEQ ID NO: 1181666 - DNA, 15 bp, Homo sapiens
cttgaaagttttcta

SEQ ID NO: 1181667 - DNA, 17 bp, Homo sapiens
cttgaaataccagtgaa

SEQ ID NO: 1181668 - DNA, 18 bp, Homo sapiens
cttgaaatattcagaaat

SEQ ID NO: 1181669 - DNA, 15 bp, Homo sapiens
cttgaaatgagtaaa

SEQ ID NO: 1181670 - DNA, 22 bp, Homo sapiens
cttgaaattactgtgtaaatat

SEQ ID NO: 1181671 - DNA, 16 bp, Homo sapiens
cttgaacatacttggt

SEQ ID NO: 1181672 - DNA, 15 bp, Homo sapiens
cttgaacccaggaga

SEQ ID NO: 1181673 - DNA, 18 bp, Homo sapiens
cttgaaccccctccctgt

SEQ ID NO: 1181674 - DNA, 19 bp, Homo sapiens
cttgaaccccctccctgtc

SEQ ID NO: 1181675 - DNA, 18 bp, Homo sapiens
cttgaacctatgaagcaa

SEQ ID NO: 1181676 - DNA, 14 bp, Homo sapiens
cttgaacctgcttc

SEQ ID NO: 1181677 - DNA, 16 bp, Homo sapiens
cttgaacctgcttcct

SEQ ID NO: 1181678 - DNA, 17 bp, Homo sapiens
cttgaacctgcttcctg

SEQ ID NO: 1181679 - DNA, 16 bp, Homo sapiens
cttgaacctgggaagt

SEQ ID NO: 1181680 - DNA, 19 bp, Homo sapiens
cttgaacctgggaggcaga

SEQ ID NO: 1181681 - DNA, 14 bp, Homo sapiens
cttgaactcctggc

SEQ ID NO: 1181682 - DNA, 15 bp, Homo sapiens
cttgaactcctggcc

SEQ ID NO: 1181683 - DNA, 19 bp, Homo sapiens
cttgaactctgttccccca

SEQ ID NO: 1181684 - DNA, 16 bp, Homo sapiens
cttgaactgaggccct

SEQ ID NO: 1181685 - DNA, 17 bp, Homo sapiens
cttgaactttgacctct

SEQ ID NO: 1181686 - DNA, 20 bp, Homo sapiens
cttgaagaaaatgactttat

SEQ ID NO: 1181687 - DNA, 12 bp, Homo sapiens
cttgaagaactg

SEQ ID NO: 1181688 - DNA, 20 bp, Homo sapiens
cttgaagaactgcaggccct

SEQ ID NO: 1181689 - DNA, 22 bp, Homo sapiens
cttgaagaactgcaggccctgg

SEQ ID NO: 1181690 - DNA, 16 bp, Homo sapiens
cttgaagacagagcaa

SEQ ID NO: 1181691 - DNA, 23 bp, Homo sapiens
cttgaagaggggaggggcctagg

SEQ ID NO: 1181692 - DNA, 18 bp, Homo sapiens
cttgaagcacagagggct

SEQ ID NO: 1181693 - DNA, 19 bp, Homo sapiens
cttgaagcatttcaaagcc

SEQ ID NO: 1181694 - DNA, 24 bp, Homo sapiens
cttgaagcatttcaaagccctgcc

SEQ ID NO: 1181695 - DNA, 12 bp, Homo sapiens
cttgaagccaaa

SEQ ID NO: 1181696 - DNA, 19 bp, Homo sapiens
cttgaagccaaagaaaaat

SEQ ID NO: 1181697 - DNA, 18 bp, Homo sapiens
cttgaagccactgaagct

SEQ ID NO: 1181698 - DNA, 19 bp, Homo sapiens
cttgaagccactgaagctg

SEQ ID NO: 1181699 - DNA, 16 bp, Homo sapiens
cttgaagggtaaagaa

SEQ ID NO: 1181700 - DNA, 20 bp, Homo sapiens
cttgaagtcagccacactgg

SEQ ID NO: 1181701 - DNA, 22 bp, Homo sapiens
cttgaagtcagccacactgggc

SEQ ID NO: 1181702 - DNA, 23 bp, Homo sapiens
cttgaagttgggtgtttccagaa

SEQ ID NO: 1181703 - DNA, 20 bp, Homo sapiens
cttgaatataaaaaatcatg

SEQ ID NO: 1181704 - DNA, 14 bp, Homo sapiens
cttgaatatgtagc

SEQ ID NO: 1181705 - DNA, 16 bp, Homo sapiens
cttgaatcctatgtat

SEQ ID NO: 1181706 - DNA, 13 bp, Homo sapiens
cttgaatcttctc

SEQ ID NO: 1181707 - DNA, 20 bp, Homo sapiens
cttgaatctttttatcccat

SEQ ID NO: 1181708 - DNA, 19 bp, Homo sapiens
cttgaatgtggtctcagga

SEQ ID NO: 1181709 - DNA, 21 bp, Homo sapiens
cttgaatgtggtctcaggata

SEQ ID NO: 1181710 - DNA, 17 bp, Homo sapiens
cttgaattgtaactgtt

SEQ ID NO: 1181711 - DNA, 13 bp, Homo sapiens
cttgaattgtgta

SEQ ID NO: 1181712 - DNA, 16 bp, Homo sapiens
cttgaattgttatgaa

SEQ ID NO: 1181713 - DNA, 13 bp, Homo sapiens
cttgaatttcaaa

SEQ ID NO: 1181714 - DNA, 13 bp, Homo sapiens
cttgaatttctag

SEQ ID NO: 1181715 - DNA, 21 bp, Homo sapiens
cttgaatttctagacagtatt

SEQ ID NO: 1181716 - DNA, 12 bp, Homo sapiens
cttgaatttctg

SEQ ID NO: 1181717 - DNA, 19 bp, Homo sapiens
cttgacaaaacctaacttg

SEQ ID NO: 1181718 - DNA, 15 bp, Homo sapiens
cttgacaacagactg

SEQ ID NO: 1181719 - DNA, 22 bp, Homo sapiens
cttgacaagttgcgacggagag

SEQ ID NO: 1181720 - DNA, 20 bp, Homo sapiens
cttgacacatagtttttcag

SEQ ID NO: 1181721 - DNA, 14 bp, Homo sapiens
cttgacatacctac

SEQ ID NO: 1181722 - DNA, 12 bp, Homo sapiens
cttgacattcct

SEQ ID NO: 1181723 - DNA, 13 bp, Homo sapiens
cttgacattcctt

SEQ ID NO: 1181724 - DNA, 13 bp, Homo sapiens
cttgaccaggctg

SEQ ID NO: 1181725 - DNA, 16 bp, Homo sapiens
cttgacccatctcccc

SEQ ID NO: 1181726 - DNA, 16 bp, Homo sapiens
cttgaccctgcaccct

SEQ ID NO: 1181727 - DNA, 16 bp, Homo sapiens
cttgcactgaatatat

SEQ ID NO: 1181728 - DNA, 22 bp, Homo sapiens
cttgcacttgttatattataat

SEQ ID NO: 1181729 - DNA, 13 bp, Homo sapiens
cttgcagaactgc

SEQ ID NO: 1181730 - DNA, 17 bp, Homo sapiens
cttgcagaactgccatt

SEQ ID NO: 1181731 - DNA, 14 bp, Homo sapiens
cttgcagaggagcc

SEQ ID NO: 1181732 - DNA, 19 bp, Homo sapiens
cttgcagaggagcccagtg

SEQ ID NO: 1181733 - DNA, 20 bp, Homo sapiens
cttgcagaggagcccagtgg

SEQ ID NO: 1181734 - DNA, 21 bp, Homo sapiens
cttgcagaggagcccagtggg

SEQ ID NO: 1181735 - DNA, 19 bp, Homo sapiens
cttgcagcactcacacagg

SEQ ID NO: 1181736 - DNA, 22 bp, Homo sapiens
cttgcagcactcacacaggacc

SEQ ID NO: 1181737 - DNA, 14 bp, Homo sapiens
cttgcagcagggct

SEQ ID NO: 1181738 - DNA, 18 bp, Homo sapiens
cttgcagcagggctgggc

SEQ ID NO: 1181739 - DNA, 19 bp, Homo sapiens
cttgcagcagggctgggcc

SEQ ID NO: 1181740 - DNA, 20 bp, Homo sapiens
cttgcagcagggctgggcct

SEQ ID NO: 1181741 - DNA, 23 bp, Homo sapiens
cttgcaggaaggactatgaaaag

SEQ ID NO: 1181742 - DNA, 15 bp, Homo sapiens
cttgcatccaactcc

SEQ ID NO: 1181743 - DNA, 19 bp, Homo sapiens
cttgcatccaactccagga

SEQ ID NO: 1181744 - DNA, 16 bp, Homo sapiens
cttgcatccattgttg

SEQ ID NO: 1181745 - DNA, 18 bp, Homo sapiens
cttgcatccattgttgtg

SEQ ID NO: 1181746 - DNA, 15 bp, Homo sapiens
cttgcatcctatttg

SEQ ID NO: 1181747 - DNA, 15 bp, Homo sapiens
cttgcatctaatgaa

SEQ ID NO: 1181748 - DNA, 18 bp, Homo sapiens
cttgcatctaatgaaaaa

SEQ ID NO: 1181749 - DNA, 22 bp, Homo sapiens
cttgcatctaatgaaaaacaaa

SEQ ID NO: 1181750 - DNA, 16 bp, Homo sapiens
cttgcatgtacttgaa

SEQ ID NO: 1181751 - DNA, 19 bp, Homo sapiens
cttgcatgtacttgaagga

SEQ ID NO: 1181752 - DNA, 12 bp, Homo sapiens
cttgcattccca

SEQ ID NO: 1181753 - DNA, 12 bp, Homo sapiens
cttgcatttttg

SEQ ID NO: 1181754 - DNA, 13 bp, Homo sapiens
cttgcatttttgc

SEQ ID NO: 1181755 - DNA, 14 bp, Homo sapiens
cttgcatttttgca

SEQ ID NO: 1181756 - DNA, 20 bp, Homo sapiens
cttgcatttttgcaggagca

SEQ ID NO: 1181757 - DNA, 20 bp, Homo sapiens
cttgccaaagtacagaattt

SEQ ID NO: 1181758 - DNA, 21 bp, Homo sapiens
cttgccaaagtacagaatttg

SEQ ID NO: 1181759 - DNA, 17 bp, Homo sapiens
cttgccaaggcagaggc

SEQ ID NO: 1181760 - DNA, 20 bp, Homo sapiens
cttgccaaggcagaggcctg

SEQ ID NO: 1181761 - DNA, 22 bp, Homo sapiens
cttgccaatgaggtctgaaatg

SEQ ID NO: 1181762 - DNA, 22 bp, Homo sapiens
cttgccacatggtgtctcccaa

SEQ ID NO: 1181763 - DNA, 23 bp, Homo sapiens
cttgccacatggtgtctcccaac

SEQ ID NO: 1181764 - DNA, 19 bp, Homo sapiens
cttgccacccattcttccc

SEQ ID NO: 1181765 - DNA, 14 bp, Homo sapiens
cttgccaccctctg

SEQ ID NO: 1181766 - DNA, 16 bp, Homo sapiens
cttgccaccctctggg

SEQ ID NO: 1181767 - DNA, 18 bp, Homo sapiens
cttgccaccctctgggag

SEQ ID NO: 1181768 - DNA, 15 bp, Homo sapiens
cttgccactttgcac

SEQ ID NO: 1181769 - DNA, 17 bp, Homo sapiens
cttgccactttgcacga

SEQ ID NO: 1181770 - DNA, 23 bp, Homo sapiens
cttgccagcctcaggcttgaggg

SEQ ID NO: 1181771 - DNA, 13 bp, Homo sapiens
cttgccagcctcc

SEQ ID NO: 1181772 - DNA, 15 bp, Homo sapiens
cttgccagcctcctt

SEQ ID NO: 1181773 - DNA, 14 bp, Homo sapiens
cttgccatcactgg

SEQ ID NO: 1181774 - DNA, 16 bp, Homo sapiens
cttgccatcctgatgg

SEQ ID NO: 1181775 - DNA, 17 bp, Homo sapiens
cttgccatcctgatgga

SEQ ID NO: 1181776 - DNA, 16 bp, Homo sapiens
cttgccattgccagga

SEQ ID NO: 1181777 - DNA, 20 bp, Homo sapiens
cttgccattgccaggagatg

SEQ ID NO: 1181778 - DNA, 21 bp, Homo sapiens
cttgccattgccaggagatgg

SEQ ID NO: 1181779 - DNA, 16 bp, Homo sapiens
cttgcccaattttaat

SEQ ID NO: 1181780 - DNA, 18 bp, Homo sapiens
cttgcccactggccgctg

SEQ ID NO: 1181781 - DNA, 14 bp, Homo sapiens
cttgcccagcagct

SEQ ID NO: 1181782 - DNA, 19 bp, Homo sapiens
cttgcccagggctcagcct

SEQ ID NO: 1181783 - DNA, 20 bp, Homo sapiens
cttgcccagggctcagcctg

SEQ ID NO: 1181784 - DNA, 20 bp, Homo sapiens
cttgcccaggtcaccaagca

SEQ ID NO: 1181785 - DNA, 13 bp, Homo sapiens
cttgcccatcagc

SEQ ID NO: 1181786 - DNA, 18 bp, Homo sapiens
cttgcccatcctgactga

SEQ ID NO: 1181787 - DNA, 22 bp, Homo sapiens
cttgccccactcctctccacca

SEQ ID NO: 1181788 - DNA, 14 bp, Homo sapiens
cttgccccaggcca

SEQ ID NO: 1181789 - DNA, 17 bp, Homo sapiens
cttgccccaggccaggt

SEQ ID NO: 1181790 - DNA, 12 bp, Homo sapiens
cttgccccagtt

SEQ ID NO: 1181791 - DNA, 14 bp, Homo sapiens
cttgccccagtttg

SEQ ID NO: 1181792 - DNA, 14 bp, Homo sapiens
cttgcccccatccc

SEQ ID NO: 1181793 - DNA, 22 bp, Homo sapiens
cttgccccctttgaccttcccc

SEQ ID NO: 1181794 - DNA, 12 bp, Homo sapiens
ccacctgtctca

SEQ ID NO: 1181795 - DNA, 20 bp, Homo sapiens
ccacctgtctcagcctccca

SEQ ID NO: 1181796 - DNA, 18 bp, Homo sapiens
ccacctgtgccctcacca

SEQ ID NO: 1181797 - DNA, 17 bp, Homo sapiens
ccacctgtgctgctgca

SEQ ID NO: 1181798 - DNA, 16 bp, Homo sapiens
ccacctgttttctgaa

SEQ ID NO: 1181799 - DNA, 15 bp, Homo sapiens
ccaccttaaattaaa

SEQ ID NO: 1181800 - DNA, 22 bp, Homo sapiens
ccaccttaaattaaacaattta

SEQ ID NO: 1181801 - DNA, 16 bp, Homo sapiens
ccaccttcccacccct

SEQ ID NO: 1181802 - DNA, 14 bp, Homo sapiens
ccaccttcccagct

SEQ ID NO: 1181803 - DNA, 15 bp, Homo sapiens
ccaccttcccagctc

SEQ ID NO: 1181804 - DNA, 16 bp, Homo sapiens
ccaccttcccagctct

SEQ ID NO: 1181805 - DNA, 21 bp, Homo sapiens
ccaccttcccagctctccctc

SEQ ID NO: 1181806 - DNA, 15 bp, Homo sapiens
ccaccttccccagac

SEQ ID NO: 1181807 - DNA, 12 bp, Homo sapiens
ccaccttccctt

SEQ ID NO: 1181808 - DNA, 22 bp, Homo sapiens
ccaccttcgggcagtcctgtgt

SEQ ID NO: 1181809 - DNA, 20 bp, Homo sapiens
ccaccttctgtccccagccc

SEQ ID NO: 1181810 - DNA, 20 bp, Homo sapiens
ccaccttgacgtttcttctt

SEQ ID NO: 1181811 - DNA, 13 bp, Homo sapiens
ccaccttgctctt

SEQ ID NO: 1181812 - DNA, 22 bp, Homo sapiens
ccaccttggactcctcccacaa

SEQ ID NO: 1181813 - DNA, 13 bp, Homo sapiens
ccaccttgttaca

SEQ ID NO: 1181814 - DNA, 17 bp, Homo sapiens
ccacctttattaaaatc

SEQ ID NO: 1181815 - DNA, 16 bp, Homo sapiens
ccacctttcaccctca

SEQ ID NO: 1181816 - DNA, 20 bp, Homo sapiens
ccacctttgggatcagcctc

SEQ ID NO: 1181817 - DNA, 21 bp, Homo sapiens
ccacctttgggatcagcctcc

SEQ ID NO: 1181818 - DNA, 21 bp, Homo sapiens
ccacgacccctgcctcgaggg

SEQ ID NO: 1181819 - DNA, 14 bp, Homo sapiens
ccacgactgtctcc

SEQ ID NO: 1181820 - DNA, 13 bp, Homo sapiens
ccacgaggagcag

SEQ ID NO: 1181821 - DNA, 16 bp, Homo sapiens
ccacgaggagcagcag

SEQ ID NO: 1181822 - DNA, 19 bp, Homo sapiens
ccacgagggctggctggcc

SEQ ID NO: 1181823 - DNA, 16 bp, Homo sapiens
ccacgagggtcaggac

SEQ ID NO: 1181824 - DNA, 22 bp, Homo sapiens
ccacgagggtctcccctcctgc

SEQ ID NO: 1181825 - DNA, 16 bp, Homo sapiens
ccacgagtcacctgca

SEQ ID NO: 1181826 - DNA, 18 bp, Homo sapiens
ccacgagtcacctgcaag

SEQ ID NO: 1181827 - DNA, 14 bp, Homo sapiens
ccacgatcccctcc

SEQ ID NO: 1181828 - DNA, 20 bp, Homo sapiens
ccacgatgtggccctggcct

SEQ ID NO: 1181829 - DNA, 15 bp, Homo sapiens
ccacgattggagaat

SEQ ID NO: 1181830 - DNA, 14 bp, Homo sapiens
ccacgatttgtctt

SEQ ID NO: 1181831 - DNA, 20 bp, Homo sapiens
ccacgattttctccagctca

SEQ ID NO: 1181832 - DNA, 21 bp, Homo sapiens
ccacgcacctccacgccactg

SEQ ID NO: 1181833 - DNA, 16 bp, Homo sapiens
ccacgcacttcctctc

SEQ ID NO: 1181834 - DNA, 15 bp, Homo sapiens
ccacgcagaggacgc

SEQ ID NO: 1181835 - DNA, 12 bp, Homo sapiens
ccacgcaggcca

SEQ ID NO: 1181836 - DNA, 20 bp, Homo sapiens
ccacgcaggccacccgggct

SEQ ID NO: 1181837 - DNA, 19 bp, Homo sapiens
ccacgcaggggccctgagc

SEQ ID NO: 1181838 - DNA, 15 bp, Homo sapiens
ccacgcccgtcctgc

SEQ ID NO: 1181839 - DNA, 19 bp, Homo sapiens
ccacgcccgtcctgcctgt

SEQ ID NO: 1181840 - DNA, 16 bp, Homo sapiens
ccacgccctctcctcc

SEQ ID NO: 1181841 - DNA, 20 bp, Homo sapiens
ccacgccctctcctccccct

SEQ ID NO: 1181842 - DNA, 15 bp, Homo sapiens
ccacgccgccctcca

SEQ ID NO: 1181843 - DNA, 16 bp, Homo sapiens
ccacgccgccctccat

SEQ ID NO: 1181844 - DNA, 22 bp, Homo sapiens
ccacgccggcctctgctgcccc

SEQ ID NO: 1181845 - DNA, 16 bp, Homo sapiens
ccacgcctcctggcca

SEQ ID NO: 1181846 - DNA, 18 bp, Homo sapiens
ccacgcctcttgaccagg

SEQ ID NO: 1181847 - DNA, 21 bp, Homo sapiens
ccacgcctcttgaccaggctg

SEQ ID NO: 1181848 - DNA, 17 bp, Homo sapiens
ccacgcctgtaatccca

SEQ ID NO: 1181849 - DNA, 15 bp, Homo sapiens
ccactcttctctcct

SEQ ID NO: 1181850 - DNA, 20 bp, Homo sapiens
ccactcttctctcctttctc

SEQ ID NO: 1181851 - DNA, 22 bp, Homo sapiens
ccactcttctctcctttctccc

SEQ ID NO: 1181852 - DNA, 19 bp, Homo sapiens
ccactgaaaaaatatatgt

SEQ ID NO: 1181853 - DNA, 23 bp, Homo sapiens
ccactgaaaacatttcaaagctg

SEQ ID NO: 1181854 - DNA, 20 bp, Homo sapiens
ccactgaaaagctttcctga

SEQ ID NO: 1181855 - DNA, 14 bp, Homo sapiens
ccactgaaatctgt

SEQ ID NO: 1181856 - DNA, 17 bp, Homo sapiens
ccactgaaatgaccaag

SEQ ID NO: 1181857 - DNA, 14 bp, Homo sapiens
ccactgaacaaaac

SEQ ID NO: 1181858 - DNA, 15 bp, Homo sapiens
ccactgacagcctcc

SEQ ID NO: 1181859 - DNA, 17 bp, Homo sapiens
ccactgacagcctccca

SEQ ID NO: 1181860 - DNA, 16 bp, Homo sapiens
ccactgacccacctgc

SEQ ID NO: 1181861 - DNA, 12 bp, Homo sapiens
ccactgagctcc

SEQ ID NO: 1181862 - DNA, 20 bp, Homo sapiens
ccactgcaaataaagccttt

SEQ ID NO: 1181863 - DNA, 17 bp, Homo sapiens
ccactgcaacttgtgaa

SEQ ID NO: 1181864 - DNA, 16 bp, Homo sapiens
ccactgcacaccagcc

SEQ ID NO: 1181865 - DNA, 18 bp, Homo sapiens
ccactgcacctgcccagc

SEQ ID NO: 1181866 - DNA, 11 bp, Homo sapiens
ccactgcactc

SEQ ID NO: 1181867 - DNA, 18 bp, Homo sapiens
ccactgcactccagcctg

SEQ ID NO: 1181868 - DNA, 20 bp, Homo sapiens
ccactgcactccagcctggg

SEQ ID NO: 1181869 - DNA, 23 bp, Homo sapiens
ccactgcactccagcctgggtga

SEQ ID NO: 1181870 - DNA, 22 bp, Homo sapiens
ccactgccagatgctgcaagcg

SEQ ID NO: 1181871 - DNA, 15 bp, Homo sapiens
ccactgccagcagca

SEQ ID NO: 1181872 - DNA, 17 bp, Homo sapiens
ccactgccagcagcagc

SEQ ID NO: 1181873 - DNA, 20 bp, Homo sapiens
ccactgccagcagcagcagg

SEQ ID NO: 1181874 - DNA, 12 bp, Homo sapiens
ccactgccaggc

SEQ ID NO: 1181875 - DNA, 13 bp, Homo sapiens
ccactgccaggca

SEQ ID NO: 1181876 - DNA, 15 bp, Homo sapiens
ccactgccaggcacc

SEQ ID NO: 1181877 - DNA, 16 bp, Homo sapiens
ccactgccaggcacct

SEQ ID NO: 1181878 - DNA, 18 bp, Homo sapiens
ccactgccaggcacctgg

SEQ ID NO: 1181879 - DNA, 19 bp, Homo sapiens
ccactgccaggcacctggc

SEQ ID NO: 1181880 - DNA, 11 bp, Homo sapiens
ccactgccatg

SEQ ID NO: 1181881 - DNA, 15 bp, Homo sapiens
ccactgcccaccccc

SEQ ID NO: 1181882 - DNA, 19 bp, Homo sapiens
ccactgccccccgaggctg

SEQ ID NO: 1181883 - DNA, 21 bp, Homo sapiens
ccactgccccccgaggctgct

SEQ ID NO: 1181884 - DNA, 17 bp, Homo sapiens
ccactgccccctgctgc

SEQ ID NO: 1181885 - DNA, 20 bp, Homo sapiens
ccactgccccctgctgccat

SEQ ID NO: 1181886 - DNA, 16 bp, Homo sapiens
ccactgccccgtgtga

SEQ ID NO: 1181887 - DNA, 16 bp, Homo sapiens
ccactgcccgagctgg

SEQ ID NO: 1181888 - DNA, 18 bp, Homo sapiens
ccactgcccgagctggtg

SEQ ID NO: 1181889 - DNA, 22 bp, Homo sapiens
ccactgcccgagctggtgcatt

SEQ ID NO: 1181890 - DNA, 19 bp, Homo sapiens
ccactgccctgcctgccca

SEQ ID NO: 1181891 - DNA, 13 bp, Homo sapiens
ccactgccctggc

SEQ ID NO: 1181892 - DNA, 18 bp, Homo sapiens
ccactgccctggcagcag

SEQ ID NO: 1181893 - DNA, 22 bp, Homo sapiens
ccactgccgcctactggacgct

SEQ ID NO: 1181894 - DNA, 18 bp, Homo sapiens
ccactgcctcctgcctgg

SEQ ID NO: 1181895 - DNA, 15 bp, Homo sapiens
ccactgcctctccct

SEQ ID NO: 1181896 - DNA, 16 bp, Homo sapiens
ccactgcctcttcctc

SEQ ID NO: 1181897 - DNA, 14 bp, Homo sapiens
ccactgcctgccca

SEQ ID NO: 1181898 - DNA, 18 bp, Homo sapiens
ccactgccttcgcttctt

SEQ ID NO: 1181899 - DNA, 18 bp, Homo sapiens
ccactgcgcccagcctga

SEQ ID NO: 1181900 - DNA, 22 bp, Homo sapiens
ccactgctatgccatttcttct

SEQ ID NO: 1181901 - DNA, 20 bp, Homo sapiens
ccactgctccctaagccagc

SEQ ID NO: 1181902 - DNA, 21 bp, Homo sapiens
ccactgctcgtggactgtgct

SEQ ID NO: 1181903 - DNA, 14 bp, Homo sapiens
ccactgctgaggag

SEQ ID NO: 1181904 - DNA, 17 bp, Homo sapiens
ccactgctgaggagtct

SEQ ID NO: 1181905 - DNA, 20 bp, Homo sapiens
ccactgctgatattttctct

SEQ ID NO: 1181906 - DNA, 14 bp, Homo sapiens
ccactgcttctctt

SEQ ID NO: 1181907 - DNA, 17 bp, Homo sapiens
ccactggacaacactga

SEQ ID NO: 1181908 - DNA, 20 bp, Homo sapiens
ccactggacttgagcttggc

SEQ ID NO: 1181909 - DNA, 11 bp, Homo sapiens
ccactggccac

SEQ ID NO: 1181910 - DNA, 17 bp, Homo sapiens
ccactggccaccaggct

SEQ ID NO: 1181911 - DNA, 19 bp, Homo sapiens
ccactggccaccaggctgg

SEQ ID NO: 1181912 - DNA, 16 bp, Homo sapiens
ccactggccgctgagc

SEQ ID NO: 1181913 - DNA, 23 bp, Homo sapiens
ccactgggaccaaccctggggaa

SEQ ID NO: 1181914 - DNA, 21 bp, Homo sapiens
ccactgggactcccagcagag

SEQ ID NO: 1181915 - DNA, 11 bp, Homo sapiens
ccactgggagg

SEQ ID NO: 1181916 - DNA, 15 bp, Homo sapiens
ccactgggcacctgc

SEQ ID NO: 1181917 - DNA, 19 bp, Homo sapiens
ccactgggcacctgcgcac

SEQ ID NO: 1181918 - DNA, 22 bp, Homo sapiens
ccactgggcacctgcgcacagg

SEQ ID NO: 1181919 - DNA, 24 bp, Homo sapiens
ccactgggccagccctgcagccca

SEQ ID NO: 1181920 - DNA, 12 bp, Homo sapiens
ccactgggcccc

SEQ ID NO: 1181921 - DNA, 15 bp, Homo sapiens
ccactgggcccctgt

SEQ ID NO: 1181922 - DNA, 20 bp, Homo sapiens
ccactgggcccctgtcccca

SEQ ID NO: 1181923 - DNA, 21 bp, Homo sapiens
ccactgggctctggacctcag

SEQ ID NO: 1181924 - DNA, 15 bp, Homo sapiens
cttgcttctcccatt

SEQ ID NO: 1181925 - DNA, 18 bp, Homo sapiens
cttgcttctcccatttcc

SEQ ID NO: 1181926 - DNA, 22 bp, Homo sapiens
cttgcttctcccatttcctgat

SEQ ID NO: 1181927 - DNA, 14 bp, Homo sapiens
cttgcttctcttct

SEQ ID NO: 1181928 - DNA, 19 bp, Homo sapiens
cttgcttctttctagaaag

SEQ ID NO: 1181929 - DNA, 15 bp, Homo sapiens
cttgctttcaattga

SEQ ID NO: 1181930 - DNA, 19 bp, Homo sapiens
cttgctttcaattgacaaa

SEQ ID NO: 1181931 - DNA, 14 bp, Homo sapiens
cttgctttcctgca

SEQ ID NO: 1181932 - DNA, 18 bp, Homo sapiens
cttgctttcctgggcctt

SEQ ID NO: 1181933 - DNA, 21 bp, Homo sapiens
cttgctttctatgctgtttgt

SEQ ID NO: 1181934 - DNA, 11 bp, Homo sapiens
cttgctttctt

SEQ ID NO: 1181935 - DNA, 13 bp, Homo sapiens
cttgctttgggct

SEQ ID NO: 1181936 - DNA, 17 bp, Homo sapiens
cttgctttgggctttgc

SEQ ID NO: 1181937 - DNA, 22 bp, Homo sapiens
cttgctttggggggtgtgctga

SEQ ID NO: 1181938 - DNA, 17 bp, Homo sapiens
cttgcttttccctcttt

SEQ ID NO: 1181939 - DNA, 12 bp, Homo sapiens
cttgctttttgc

SEQ ID NO: 1181940 - DNA, 20 bp, Homo sapiens
cttggaaaaatccagaaaga

SEQ ID NO: 1181941 - DNA, 17 bp, Homo sapiens
cttggaaaacaaaagtt

SEQ ID NO: 1181942 - DNA, 23 bp, Homo sapiens
cttggaaaacaaaagttttaatt

SEQ ID NO: 1181943 - DNA, 18 bp, Homo sapiens
cttggaaatgtctgctgg

SEQ ID NO: 1181944 - DNA, 16 bp, Homo sapiens
cttggaacaccttggg

SEQ ID NO: 1181945 - DNA, 15 bp, Homo sapiens
cttggaaccagcccc

SEQ ID NO: 1181946 - DNA, 21 bp, Homo sapiens
cttggaagattctatttaatt

SEQ ID NO: 1181947 - DNA, 14 bp, Homo sapiens
cttggaagccaggt

SEQ ID NO: 1181948 - DNA, 15 bp, Homo sapiens
cttggaagccaggta

SEQ ID NO: 1181949 - DNA, 18 bp, Homo sapiens
cttggaattacaagccct

SEQ ID NO: 1181950 - DNA, 22 bp, Homo sapiens
cttggaatttgtaacctcagct

SEQ ID NO: 1181951 - DNA, 14 bp, Homo sapiens
cttggacaaatcac

SEQ ID NO: 1181952 - DNA, 16 bp, Homo sapiens
cttggacaacagctct

SEQ ID NO: 1181953 - DNA, 17 bp, Homo sapiens
cttggacaacagctctc

SEQ ID NO: 1181954 - DNA, 23 bp, Homo sapiens
cttggaccactcctgtccctgta

SEQ ID NO: 1181955 - DNA, 19 bp, Homo sapiens
cttggaccatgccagattc

SEQ ID NO: 1181956 - DNA, 13 bp, Homo sapiens
cttggacctccag

SEQ ID NO: 1181957 - DNA, 18 bp, Homo sapiens
cttggacctccaggggct

SEQ ID NO: 1181958 - DNA, 17 bp, Homo sapiens
cttggacctctgctctg

SEQ ID NO: 1181959 - DNA, 19 bp, Homo sapiens
cttggacctctgctctgag

SEQ ID NO: 1181960 - DNA, 18 bp, Homo sapiens
cttggactctagtccttg

SEQ ID NO: 1181961 - DNA, 22 bp, Homo sapiens
cttggacttttttttttctttt

SEQ ID NO: 1181962 - DNA, 17 bp, Homo sapiens
cttggagaagtctcagc

SEQ ID NO: 1181963 - DNA, 18 bp, Homo sapiens
cttggagaagtctcagct

SEQ ID NO: 1181964 - DNA, 15 bp, Homo sapiens
cttggagaccctgca

SEQ ID NO: 1181965 - DNA, 15 bp, Homo sapiens
cttggagagaatcat

SEQ ID NO: 1181966 - DNA, 13 bp, Homo sapiens
cttggagagagag

SEQ ID NO: 1181967 - DNA, 13 bp, Homo sapiens
cttggagagcaaa

SEQ ID NO: 1181968 - DNA, 19 bp, Homo sapiens
cttggagagcaaaggccca

SEQ ID NO: 1181969 - DNA, 20 bp, Homo sapiens
cttggagagcaaaggcccat

SEQ ID NO: 1181970 - DNA, 20 bp, Homo sapiens
cttggagagcagctggctct

SEQ ID NO: 1181971 - DNA, 19 bp, Homo sapiens
cttgggcgtctcccccaga

SEQ ID NO: 1181972 - DNA, 18 bp, Homo sapiens
cttgggctactggcagct

SEQ ID NO: 1181973 - DNA, 20 bp, Homo sapiens
cttgggctactggcagctcc

SEQ ID NO: 1181974 - DNA, 21 bp, Homo sapiens
cttgggctatttggactcagg

SEQ ID NO: 1181975 - DNA, 15 bp, Homo sapiens
cttgggctcctggct

SEQ ID NO: 1181976 - DNA, 16 bp, Homo sapiens
cttgggctcctggctg

SEQ ID NO: 1181977 - DNA, 20 bp, Homo sapiens
cttgggctcctggctgccag

SEQ ID NO: 1181978 - DNA, 21 bp, Homo sapiens
cttgggctcctggctgccagg

SEQ ID NO: 1181979 - DNA, 23 bp, Homo sapiens
cttgggctcctggctgccaggcg

SEQ ID NO: 1181980 - DNA, 22 bp, Homo sapiens
cttgggctggtcagagtggcgt

SEQ ID NO: 1181981 - DNA, 15 bp, Homo sapiens
cttgggcttcttcct

SEQ ID NO: 1181982 - DNA, 18 bp, Homo sapiens
cttggggaacaagggtgg

SEQ ID NO: 1181983 - DNA, 17 bp, Homo sapiens
cttggggaccctgccta

SEQ ID NO: 1181984 - DNA, 19 bp, Homo sapiens
cttggggccaccaaagctg

SEQ ID NO: 1181985 - DNA, 14 bp, Homo sapiens
cttggggcctggct

SEQ ID NO: 1181986 - DNA, 15 bp, Homo sapiens
cttggggcctggctt

SEQ ID NO: 1181987 - DNA, 14 bp, Homo sapiens
cttggggccttccc

SEQ ID NO: 1181988 - DNA, 19 bp, Homo sapiens
cttggggctcgccccaccc

SEQ ID NO: 1181989 - DNA, 20 bp, Homo sapiens
cttggggctcgccccaccca

SEQ ID NO: 1181990 - DNA, 22 bp, Homo sapiens
cttggggctcgccccacccagg

SEQ ID NO: 1181991 - DNA, 20 bp, Homo sapiens
cttgggggaggccaccccaa

SEQ ID NO: 1181992 - DNA, 22 bp, Homo sapiens
cttggggggctgaggtgggagg

SEQ ID NO: 1181993 - DNA, 15 bp, Homo sapiens
cttgggggggctgcc

SEQ ID NO: 1181994 - DNA, 22 bp, Homo sapiens
cttgggggggtggccgctgagt

SEQ ID NO: 1181995 - DNA, 22 bp, Homo sapiens
cttgggggttttcaatgtgaaa

SEQ ID NO: 1181996 - DNA, 20 bp, Homo sapiens
cttggggtgggggccaggcc

SEQ ID NO: 1181997 - DNA, 23 bp, Homo sapiens
cttgggtcaggttcttgcctttc

SEQ ID NO: 1181998 - DNA, 23 bp, Homo sapiens
cttgggtgtattctctgtaagtg

SEQ ID NO: 1181999 - DNA, 19 bp, Homo sapiens
cttgggttccaaccaggca

SEQ ID NO: 1182000 - DNA, 14 bp, Homo sapiens
cttgggttgatctc

SEQ ID NO: 1182001 - DNA, 14 bp, Homo sapiens
cttggtagttctgt

SEQ ID NO: 1182002 - DNA, 17 bp, Homo sapiens
cttggtatgtgccaggc

SEQ ID NO: 1182003 - DNA, 22 bp, Homo sapiens
cttggtcaaactttttccagca

SEQ ID NO: 1182004 - DNA, 15 bp, Homo sapiens
cttggtccctctcag

SEQ ID NO: 1182005 - DNA, 18 bp, Homo sapiens
cttggtccctggaagctt

SEQ ID NO: 1182006 - DNA, 15 bp, Homo sapiens
cttggtctatgtgct

SEQ ID NO: 1182007 - DNA, 20 bp, Homo sapiens
cttggtctgatttcaggata

SEQ ID NO: 1182008 - DNA, 15 bp, Homo sapiens
cttggtcttatttat

SEQ ID NO: 1182009 - DNA, 19 bp, Homo sapiens
cttggtgaaataataaaat

SEQ ID NO: 1182010 - DNA, 16 bp, Homo sapiens
cttggtgctctgtgtt

SEQ ID NO: 1182011 - DNA, 17 bp, Homo sapiens
cttggtggcttttcctt

SEQ ID NO: 1182012 - DNA, 13 bp, Homo sapiens
cttggtggggagc

SEQ ID NO: 1182013 - DNA, 18 bp, Homo sapiens
cttggtgggtgtggccag

SEQ ID NO: 1182014 - DNA, 21 bp, Homo sapiens
cttggtgggtgtggccagcac

SEQ ID NO: 1182015 - DNA, 15 bp, Homo sapiens
cttggtgtccacctg

SEQ ID NO: 1182016 - DNA, 17 bp, Homo sapiens
cttggtgtccacctggc

SEQ ID NO: 1182017 - DNA, 15 bp, Homo sapiens
cttggtgtgaagact

SEQ ID NO: 1182018 - DNA, 19 bp, Homo sapiens
cttggtgtgaccctctgaa

SEQ ID NO: 1182019 - DNA, 15 bp, Homo sapiens
cttggtgtgattgca

SEQ ID NO: 1182020 - DNA, 18 bp, Homo sapiens
cttggtgtgattgcacag

SEQ ID NO: 1182021 - DNA, 17 bp, Homo sapiens
cttggtgtgtaggttcc

SEQ ID NO: 1182022 - DNA, 18 bp, Homo sapiens
cttggtgtttcccttcct

SEQ ID NO: 1182023 - DNA, 21 bp, Homo sapiens
cttggttagacgccttccagg

SEQ ID NO: 1182024 - DNA, 19 bp, Homo sapiens
cttggttagtggctgcctc

SEQ ID NO: 1182025 - DNA, 23 bp, Homo sapiens
cttggttcaataaagcactgagc

SEQ ID NO: 1182026 - DNA, 16 bp, Homo sapiens
cttggttcataaatga

SEQ ID NO: 1182027 - DNA, 12 bp, Homo sapiens
cttggttcctgt

SEQ ID NO: 1182028 - DNA, 20 bp, Homo sapiens
cttggttcttttttcagtta

SEQ ID NO: 1182029 - DNA, 23 bp, Homo sapiens
cttggttcttttttcagttattt

SEQ ID NO: 1182030 - DNA, 16 bp, Homo sapiens
cttggttggctggcag

SEQ ID NO: 1182031 - DNA, 22 bp, Homo sapiens
cttggttggctggcagctgaga

SEQ ID NO: 1182032 - DNA, 19 bp, Homo sapiens
cttggttggtagggtggga

SEQ ID NO: 1182033 - DNA, 14 bp, Homo sapiens
cttggtttcagcca

SEQ ID NO: 1182034 - DNA, 23 bp, Homo sapiens
cttggtttctctctacagtgcca

SEQ ID NO: 1182035 - DNA, 15 bp, Homo sapiens
cttggtttctggata

SEQ ID NO: 1182036 - DNA, 17 bp, Homo sapiens
cttggtttggggagaaa

SEQ ID NO: 1182037 - DNA, 15 bp, Homo sapiens
cttggtttgtaaatt

SEQ ID NO: 1182038 - DNA, 15 bp, Homo sapiens
cttggttttctctct

SEQ ID NO: 1182039 - DNA, 16 bp, Homo sapiens
cttggttttctctctg

SEQ ID NO: 1182040 - DNA, 14 bp, Homo sapiens
cttgtaaaaaaagc

SEQ ID NO: 1182041 - DNA, 15 bp, Homo sapiens
cttgtaaaaaaagca

SEQ ID NO: 1182042 - DNA, 16 bp, Homo sapiens
cttgtaaaaaaagcaa

SEQ ID NO: 1182043 - DNA, 17 bp, Homo sapiens
cttgtaaaaaggggagg

SEQ ID NO: 1182044 - DNA, 15 bp, Homo sapiens
cttgtaaaatgcttt

SEQ ID NO: 1182045 - DNA, 14 bp, Homo sapiens
cttgtaaagactgg

SEQ ID NO: 1182046 - DNA, 15 bp, Homo sapiens
cttgtaaagactggt

SEQ ID NO: 1182047 - DNA, 23 bp, Homo sapiens
cttgtaaagactggttttctgcc

SEQ ID NO: 1182048 - DNA, 16 bp, Homo sapiens
cttgtaaaggatatta

SEQ ID NO: 1182049 - DNA, 12 bp, Homo sapiens
cttgtaaataca

SEQ ID NO: 1182050 - DNA, 13 bp, Homo sapiens
cttgtaaatgttt

SEQ ID NO: 1182051 - DNA, 17 bp, Homo sapiens
cttgtaacaagaaaaca

SEQ ID NO: 1182052 - DNA, 22 bp, Homo sapiens
cttgtaactaaaataattttgt

SEQ ID NO: 1182053 - DNA, 22 bp, Homo sapiens
cttgtaatacctgattgatcac

SEQ ID NO: 1182054 - DNA, 14 bp, Homo sapiens
ccagaaaggagact

SEQ ID NO: 1182055 - DNA, 17 bp, Homo sapiens
ccagaaaggatatttaa

SEQ ID NO: 1182056 - DNA, 15 bp, Homo sapiens
ccagaaagtaaaggt

SEQ ID NO: 1182057 - DNA, 15 bp, Homo sapiens
ccagaaatcactgtg

SEQ ID NO: 1182058 - DNA, 18 bp, Homo sapiens
ccagaaatcactgtgaaa

SEQ ID NO: 1182059 - DNA, 22 bp, Homo sapiens
ccagaaatgtctaaatgctgaa

SEQ ID NO: 1182060 - DNA, 13 bp, Homo sapiens
ccagaaattagaa

SEQ ID NO: 1182061 - DNA, 10 bp, Homo sapiens
ccagaaattc

SEQ ID NO: 1182062 - DNA, 17 bp, Homo sapiens
ccagaacaaaaagaaat

SEQ ID NO: 1182063 - DNA, 17 bp, Homo sapiens
ccagaacagccctcggc

SEQ ID NO: 1182064 - DNA, 14 bp, Homo sapiens
ccagaaccacagat

SEQ ID NO: 1182065 - DNA, 16 bp, Homo sapiens
ccagaacgcaccccac

SEQ ID NO: 1182066 - DNA, 18 bp, Homo sapiens
ccagaacgcaccccactg

SEQ ID NO: 1182067 - DNA, 16 bp, Homo sapiens
ccagaacgtggtttgc

SEQ ID NO: 1182068 - DNA, 21 bp, Homo sapiens
ccagaacgtggtttgcctgag

SEQ ID NO: 1182069 - DNA, 19 bp, Homo sapiens
ccagaactattctgggggc

SEQ ID NO: 1182070 - DNA, 14 bp, Homo sapiens
ccagaactgccccc

SEQ ID NO: 1182071 - DNA, 17 bp, Homo sapiens
ccagaactgcccccact

SEQ ID NO: 1182072 - DNA, 19 bp, Homo sapiens
ccagaactgcccccactgt

SEQ ID NO: 1182073 - DNA, 16 bp, Homo sapiens
ccagaactggctgggc

SEQ ID NO: 1182074 - DNA, 17 bp, Homo sapiens
ccagaactggctgggcc

SEQ ID NO: 1182075 - DNA, 22 bp, Homo sapiens
ccagaactggctgggcccctgg

SEQ ID NO: 1182076 - DNA, 18 bp, Homo sapiens
ccagaagaagagaagctg

SEQ ID NO: 1182077 - DNA, 20 bp, Homo sapiens
ccagaagaagagaagctgct

SEQ ID NO: 1182078 - DNA, 17 bp, Homo sapiens
ccagaagaatattcagg

SEQ ID NO: 1182079 - DNA, 18 bp, Homo sapiens
ccagaagaatattcagga

SEQ ID NO: 1182080 - DNA, 15 bp, Homo sapiens
ccagaagagaattca

SEQ ID NO: 1182081 - DNA, 18 bp, Homo sapiens
ccagaagatgccagcttc

SEQ ID NO: 1182082 - DNA, 19 bp, Homo sapiens
ccagaagatgccagcttct

SEQ ID NO: 1182083 - DNA, 14 bp, Homo sapiens
ccagaagccttgga

SEQ ID NO: 1182084 - DNA, 21 bp, Homo sapiens
ccagaaggaatcttctcatct

SEQ ID NO: 1182085 - DNA, 18 bp, Homo sapiens
ccagaaggagggcagagc

SEQ ID NO: 1182086 - DNA, 21 bp, Homo sapiens
ccagaaggagggcagagccat

SEQ ID NO: 1182087 - DNA, 17 bp, Homo sapiens
ccagaaggcagcaaaga

SEQ ID NO: 1182088 - DNA, 22 bp, Homo sapiens
ccagaaggcagcaaagaggggc

SEQ ID NO: 1182089 - DNA, 14 bp, Homo sapiens
ccagaaggggagct

SEQ ID NO: 1182090 - DNA, 15 bp, Homo sapiens
ccagaagggggccat

SEQ ID NO: 1182091 - DNA, 13 bp, Homo sapiens
ccagaaggtcacg

SEQ ID NO: 1182092 - DNA, 20 bp, Homo sapiens
ccagaagtttgtcaagtcaa

SEQ ID NO: 1182093 - DNA, 16 bp, Homo sapiens
ccagagccagcctggg

SEQ ID NO: 1182094 - DNA, 18 bp, Homo sapiens
ccagagccagggctgtcc

SEQ ID NO: 1182095 - DNA, 19 bp, Homo sapiens
ccagagccagggctgtcct

SEQ ID NO: 1182096 - DNA, 20 bp, Homo sapiens
ccagagccagggctgtcctt

SEQ ID NO: 1182097 - DNA, 21 bp, Homo sapiens
ccagagccagggctgtcctta

SEQ ID NO: 1182098 - DNA, 16 bp, Homo sapiens
ccagagccatgccagg

SEQ ID NO: 1182099 - DNA, 13 bp, Homo sapiens
ccagagccatgga

SEQ ID NO: 1182100 - DNA, 21 bp, Homo sapiens
ccagagccatggactctacac

SEQ ID NO: 1182101 - DNA, 15 bp, Homo sapiens
ccagagcccaaggtc

SEQ ID NO: 1182102 - DNA, 12 bp, Homo sapiens
ccagagcccagc

SEQ ID NO: 1182103 - DNA, 15 bp, Homo sapiens
ccagagcccagctct

SEQ ID NO: 1182104 - DNA, 19 bp, Homo sapiens
ccagagcccagctcttgct

SEQ ID NO: 1182105 - DNA, 21 bp, Homo sapiens
ccagagcccagctcttgctct

SEQ ID NO: 1182106 - DNA, 18 bp, Homo sapiens
ccagagccccacacggag

SEQ ID NO: 1182107 - DNA, 19 bp, Homo sapiens
ccagagccccacacggagg

SEQ ID NO: 1182108 - DNA, 13 bp, Homo sapiens
ccagagccccttt

SEQ ID NO: 1182109 - DNA, 22 bp, Homo sapiens
ccagagcccttgactgtacaga

SEQ ID NO: 1182110 - DNA, 14 bp, Homo sapiens
ccagagccgggagg

SEQ ID NO: 1182111 - DNA, 19 bp, Homo sapiens
ccagagcctctgctggaag

SEQ ID NO: 1182112 - DNA, 21 bp, Homo sapiens
ccagagcctctgctggaaggg

SEQ ID NO: 1182113 - DNA, 14 bp, Homo sapiens
ccagagcctctggc

SEQ ID NO: 1182114 - DNA, 17 bp, Homo sapiens
ccagagcggtatctctg

SEQ ID NO: 1182115 - DNA, 19 bp, Homo sapiens
ccagagcggtatctctggc

SEQ ID NO: 1182116 - DNA, 15 bp, Homo sapiens
ccagagctagggctg

SEQ ID NO: 1182117 - DNA, 17 bp, Homo sapiens
ccagagctagggctgct

SEQ ID NO: 1182118 - DNA, 22 bp, Homo sapiens
ccagagctagggctgctgcttc

SEQ ID NO: 1182119 - DNA, 23 bp, Homo sapiens
ccagagctagggctgctgcttct

SEQ ID NO: 1182120 - DNA, 14 bp, Homo sapiens
ccagagctcatccc

SEQ ID NO: 1182121 - DNA, 17 bp, Homo sapiens
ccagagctcatcccccc

SEQ ID NO: 1182122 - DNA, 15 bp, Homo sapiens
ccagagctgccgact

SEQ ID NO: 1182123 - DNA, 23 bp, Homo sapiens
ccagagctggaaggcagggcaga

SEQ ID NO: 1182124 - DNA, 14 bp, Homo sapiens
ccagagctgggagg

SEQ ID NO: 1182125 - DNA, 14 bp, Homo sapiens
ccagagctgtgcct

SEQ ID NO: 1182126 - DNA, 20 bp, Homo sapiens
ccagagctgtgcctgctcag

SEQ ID NO: 1182127 - DNA, 22 bp, Homo sapiens
ccagagctgtgcctgctcagca

SEQ ID NO: 1182128 - DNA, 20 bp, Homo sapiens
ccagagctgtttatggcctc

SEQ ID NO: 1182129 - DNA, 21 bp, Homo sapiens
ccagagctgtttatggcctca

SEQ ID NO: 1182130 - DNA, 23 bp, Homo sapiens
ccagagctgtttatggcctcagc

SEQ ID NO: 1182131 - DNA, 15 bp, Homo sapiens
ccagagctgtttgga

SEQ ID NO: 1182132 - DNA, 19 bp, Homo sapiens
ccagagctgtttggataca

SEQ ID NO: 1182133 - DNA, 22 bp, Homo sapiens
ccagaggaactgtccagagagc

SEQ ID NO: 1182134 - DNA, 23 bp, Homo sapiens
ccagaggaactgtccagagagca

SEQ ID NO: 1182135 - DNA, 18 bp, Homo sapiens
ccagaggaaggaaaagga

SEQ ID NO: 1182136 - DNA, 23 bp, Homo sapiens
ccagaggaatcctggcagcccag

SEQ ID NO: 1182137 - DNA, 23 bp, Homo sapiens
ccagaggaattgattgtcagcca

SEQ ID NO: 1182138 - DNA, 16 bp, Homo sapiens
ccagaggactctgctt

SEQ ID NO: 1182139 - DNA, 18 bp, Homo sapiens
ccagaggactctgcttaa

SEQ ID NO: 1182140 - DNA, 21 bp, Homo sapiens
ccagaggagggcagagggaga

SEQ ID NO: 1182141 - DNA, 21 bp, Homo sapiens
ccagaggattgctgccccatc

SEQ ID NO: 1182142 - DNA, 12 bp, Homo sapiens
ccagaggcagcc

SEQ ID NO: 1182143 - DNA, 14 bp, Homo sapiens
ccagaggcccccag

SEQ ID NO: 1182144 - DNA, 18 bp, Homo sapiens
ccagaggcccccagccca

SEQ ID NO: 1182145 - DNA, 15 bp, Homo sapiens
ccagaggccctgaag

SEQ ID NO: 1182146 - DNA, 20 bp, Homo sapiens
ccagaggccctgaagcctcc

SEQ ID NO: 1182147 - DNA, 12 bp, Homo sapiens
ccagaggctccc

SEQ ID NO: 1182148 - DNA, 22 bp, Homo sapiens
ccagaggctcccaatcagcttt

SEQ ID NO: 1182149 - DNA, 14 bp, Homo sapiens
ccagaggctgggag

SEQ ID NO: 1182150 - DNA, 15 bp, Homo sapiens
ccagaggctgggagt

SEQ ID NO: 1182151 - DNA, 18 bp, Homo sapiens
ccagagggcatgctgaat

SEQ ID NO: 1182152 - DNA, 12 bp, Homo sapiens
ccagagggccag

SEQ ID NO: 1182153 - DNA, 13 bp, Homo sapiens
ccagagggccagc

SEQ ID NO: 1182154 - DNA, 16 bp, Homo sapiens
ccagagggccagcagg

SEQ ID NO: 1182155 - DNA, 18 bp, Homo sapiens
ccagagggtgtggctttc

SEQ ID NO: 1182156 - DNA, 12 bp, Homo sapiens
ccagaggtgctt

SEQ ID NO: 1182157 - DNA, 11 bp, Homo sapiens
ccagaggtggc

SEQ ID NO: 1182158 - DNA, 15 bp, Homo sapiens
ccagaggtgggcagg

SEQ ID NO: 1182159 - DNA, 21 bp, Homo sapiens
ccagagtagagccaggtgctt

SEQ ID NO: 1182160 - DNA, 17 bp, Homo sapiens
ccagagtcacccagttg

SEQ ID NO: 1182161 - DNA, 17 bp, Homo sapiens
ccagagtcagaggagaa

SEQ ID NO: 1182162 - DNA, 16 bp, Homo sapiens
ccagagtcctttccaa

SEQ ID NO: 1182163 - DNA, 17 bp, Homo sapiens
ccagagtctgagccccc

SEQ ID NO: 1182164 - DNA, 22 bp, Homo sapiens
ccagagtgaaagggctatggca

SEQ ID NO: 1182165 - DNA, 19 bp, Homo sapiens
ccagagtgctgaggccagg

SEQ ID NO: 1182166 - DNA, 13 bp, Homo sapiens
ccagagtgctgtc

SEQ ID NO: 1182167 - DNA, 14 bp, Homo sapiens
ccagagtgctgtcg

SEQ ID NO: 1182168 - DNA, 19 bp, Homo sapiens
ccagagtggagtctgagtc

SEQ ID NO: 1182169 - DNA, 20 bp, Homo sapiens
ccagagtggagtctgagtct

SEQ ID NO: 1182170 - DNA, 21 bp, Homo sapiens
ccagagtggagtctgagtctg

SEQ ID NO: 1182171 - DNA, 17 bp, Homo sapiens
ccagagtggcctggcca

SEQ ID NO: 1182172 - DNA, 19 bp, Homo sapiens
ccagagtggcctggccagg

SEQ ID NO: 1182173 - DNA, 23 bp, Homo sapiens
ccagagtggcctggccaggagct

SEQ ID NO: 1182174 - DNA, 14 bp, Homo sapiens
ccagagtgggagag

SEQ ID NO: 1182175 - DNA, 20 bp, Homo sapiens
ccagagtgggagaggctggg

SEQ ID NO: 1182176 - DNA, 21 bp, Homo sapiens
ccagagtgggagaggctggga

SEQ ID NO: 1182177 - DNA, 17 bp, Homo sapiens
ccagagtgtagggggcc

SEQ ID NO: 1182178 - DNA, 15 bp, Homo sapiens
ccagagttaaagcat

SEQ ID NO: 1182179 - DNA, 21 bp, Homo sapiens
ccagagttgctgggagctgaa

SEQ ID NO: 1182180 - DNA, 17 bp, Homo sapiens
ccagataaatagaacta

SEQ ID NO: 1182181 - DNA, 18 bp, Homo sapiens
ccagataactctctttcc

SEQ ID NO: 1182182 - DNA, 13 bp, Homo sapiens
ccagataccagcc

SEQ ID NO: 1182183 - DNA, 20 bp, Homo sapiens
ccagataccagcccctgtat

SEQ ID NO: 1182184 - DNA, 18 bp, Homo sapiens
ctgggtactgaaagcctt

SEQ ID NO: 1182185 - DNA, 15 bp, Homo sapiens
ctgggtagctgtaag

SEQ ID NO: 1182186 - DNA, 15 bp, Homo sapiens
ctgggtaggaaagag

SEQ ID NO: 1182187 - DNA, 17 bp, Homo sapiens
ctgggtaggaaagagga

SEQ ID NO: 1182188 - DNA, 16 bp, Homo sapiens
ctgggtatcccctgcc

SEQ ID NO: 1182189 - DNA, 17 bp, Homo sapiens
ctgggtatcccctgcct

SEQ ID NO: 1182190 - DNA, 21 bp, Homo sapiens
ctgggtatcccctgcctcctg

SEQ ID NO: 1182191 - DNA, 20 bp, Homo sapiens
ctgggtcaaaagagccctgg

SEQ ID NO: 1182192 - DNA, 17 bp, Homo sapiens
ctgggtcagaaccagag

SEQ ID NO: 1182193 - DNA, 14 bp, Homo sapiens
ctgggtcagggcca

SEQ ID NO: 1182194 - DNA, 20 bp, Homo sapiens
ctgggtccaggcctggccat

SEQ ID NO: 1182195 - DNA, 21 bp, Homo sapiens
ctgggtccctcggagctgcca

SEQ ID NO: 1182196 - DNA, 22 bp, Homo sapiens
ctgggtccctcggagctgccag

SEQ ID NO: 1182197 - DNA, 16 bp, Homo sapiens
ctgggtccctgctccc

SEQ ID NO: 1182198 - DNA, 21 bp, Homo sapiens
ctgggtcctaattaccagtct

SEQ ID NO: 1182199 - DNA, 18 bp, Homo sapiens
ctgggtcctgttccctac

SEQ ID NO: 1182200 - DNA, 23 bp, Homo sapiens
ctgggtccttgcacccctcactc

SEQ ID NO: 1182201 - DNA, 16 bp, Homo sapiens
ctgggtcggccctgcc

SEQ ID NO: 1182202 - DNA, 14 bp, Homo sapiens
catcgtccagccct

SEQ ID NO: 1182203 - DNA, 15 bp, Homo sapiens
catcgtgacccttca

SEQ ID NO: 1182204 - DNA, 18 bp, Homo sapiens
catcgtgacccttcaggg

SEQ ID NO: 1182205 - DNA, 19 bp, Homo sapiens
catcgtgatcactgagcca

SEQ ID NO: 1182206 - DNA, 16 bp, Homo sapiens
catcgtggtgggggag

SEQ ID NO: 1182207 - DNA, 22 bp, Homo sapiens
catctaaacacaacaataactt

SEQ ID NO: 1182208 - DNA, 18 bp, Homo sapiens
catctaaagctttatctt

SEQ ID NO: 1182209 - DNA, 23 bp, Homo sapiens
catctaaagctttatctttgtgt

SEQ ID NO: 1182210 - DNA, 15 bp, Homo sapiens
catctaaattctgat

SEQ ID NO: 1182211 - DNA, 22 bp, Homo sapiens
catctaactgatgagtaaactg

SEQ ID NO: 1182212 - DNA, 15 bp, Homo sapiens
catctaatgaaaaac

SEQ ID NO: 1182213 - DNA, 17 bp, Homo sapiens
catctaatgcttgttta

SEQ ID NO: 1182214 - DNA, 21 bp, Homo sapiens
catctaatgtctcttcctctg

SEQ ID NO: 1182215 - DNA, 22 bp, Homo sapiens
catctacttttttatccacctc

SEQ ID NO: 1182216 - DNA, 14 bp, Homo sapiens
catctagcaaatgt

SEQ ID NO: 1182217 - DNA, 18 bp, Homo sapiens
catctagcagctggccta

SEQ ID NO: 1182218 - DNA, 17 bp, Homo sapiens
catctagccagcccctc

SEQ ID NO: 1182219 - DNA, 21 bp, Homo sapiens
catctagccagcccctcttcc

SEQ ID NO: 1182220 - DNA, 18 bp, Homo sapiens
catctagtacttgaaaaa

SEQ ID NO: 1182221 - DNA, 14 bp, Homo sapiens
catctataaagaag

SEQ ID NO: 1182222 - DNA, 14 bp, Homo sapiens
catctatcgagttt

SEQ ID NO: 1182223 - DNA, 20 bp, Homo sapiens
catctatcgagtttgcaatg

SEQ ID NO: 1182224 - DNA, 14 bp, Homo sapiens
catctatttctgag

SEQ ID NO: 1182225 - DNA, 18 bp, Homo sapiens
catctcaaaacagagggc

SEQ ID NO: 1182226 - DNA, 20 bp, Homo sapiens
catctcagacctttactgat

SEQ ID NO: 1182227 - DNA, 16 bp, Homo sapiens
catctcagcctcctga

SEQ ID NO: 1182228 - DNA, 17 bp, Homo sapiens
catctcagcctcctgag

SEQ ID NO: 1182229 - DNA, 21 bp, Homo sapiens
catctcagcctcctgagcctg

SEQ ID NO: 1182230 - DNA, 23 bp, Homo sapiens
catctcagcctcctgagcctgtg

SEQ ID NO: 1182231 - DNA, 22 bp, Homo sapiens
catctcaggaaaatctgtgatt

SEQ ID NO: 1182232 - DNA, 17 bp, Homo sapiens
catctcaggagatggag

SEQ ID NO: 1182233 - DNA, 22 bp, Homo sapiens
catctcaggagatggagggctt

SEQ ID NO: 1182234 - DNA, 23 bp, Homo sapiens
catctcaggagatggagggcttg

SEQ ID NO: 1182235 - DNA, 12 bp, Homo sapiens
catctcaggggc

SEQ ID NO: 1182236 - DNA, 19 bp, Homo sapiens
catctcaggggccagagga

SEQ ID NO: 1182237 - DNA, 14 bp, Homo sapiens
catctcaggtgcca

SEQ ID NO: 1182238 - DNA, 15 bp, Homo sapiens
catctcaggtgccac

SEQ ID NO: 1182239 - DNA, 16 bp, Homo sapiens
catctcaggtgccact

SEQ ID NO: 1182240 - DNA, 21 bp, Homo sapiens
catctcaggtgccactccctg

SEQ ID NO: 1182241 - DNA, 21 bp, Homo sapiens
catctcagtgaagaatacttc

SEQ ID NO: 1182242 - DNA, 18 bp, Homo sapiens
catctcatcatgtctatt

SEQ ID NO: 1182243 - DNA, 19 bp, Homo sapiens
catctcatgaggggagagg

SEQ ID NO: 1182244 - DNA, 22 bp, Homo sapiens
catctcatgcccctggctggga

SEQ ID NO: 1182245 - DNA, 18 bp, Homo sapiens
catctcatttaagggaaa

SEQ ID NO: 1182246 - DNA, 20 bp, Homo sapiens
catctcatttaagggaaaaa

SEQ ID NO: 1182247 - DNA, 22 bp, Homo sapiens
catctcatttaagggaaaaata

SEQ ID NO: 1182248 - DNA, 23 bp, Homo sapiens
catctcatttaagggaaaaatat

SEQ ID NO: 1182249 - DNA, 20 bp, Homo sapiens
catctccagaaaaatgaaaa

SEQ ID NO: 1182250 - DNA, 12 bp, Homo sapiens
catctccaggga

SEQ ID NO: 1182251 - DNA, 17 bp, Homo sapiens
catctccagggagtccc

SEQ ID NO: 1182252 - DNA, 16 bp, Homo sapiens
catctccatcagctgt

SEQ ID NO: 1182253 - DNA, 17 bp, Homo sapiens
catctcccagataatgt

SEQ ID NO: 1182254 - DNA, 16 bp, Homo sapiens
catctccccaggcctc

SEQ ID NO: 1182255 - DNA, 19 bp, Homo sapiens
catctcctataatctgtca

SEQ ID NO: 1182256 - DNA, 21 bp, Homo sapiens
catctcctgaccctcccactc

SEQ ID NO: 1182257 - DNA, 14 bp, Homo sapiens
catctcctgagtat

SEQ ID NO: 1182258 - DNA, 15 bp, Homo sapiens
catctcctgtgcatg

SEQ ID NO: 1182259 - DNA, 19 bp, Homo sapiens
catctccttacctctggaa

SEQ ID NO: 1182260 - DNA, 20 bp, Homo sapiens
catctccttacctctggaac

SEQ ID NO: 1182261 - DNA, 15 bp, Homo sapiens
catctcgagccccct

SEQ ID NO: 1182262 - DNA, 19 bp, Homo sapiens
catctcgagccccctggat

SEQ ID NO: 1182263 - DNA, 20 bp, Homo sapiens
catctcggagcatcccggag

SEQ ID NO: 1182264 - DNA, 23 bp, Homo sapiens
catctcggatcatatggagctca

SEQ ID NO: 1182265 - DNA, 15 bp, Homo sapiens
catctctaccatcat

SEQ ID NO: 1182266 - DNA, 22 bp, Homo sapiens
catctctagtgtagctgccaca

SEQ ID NO: 1182267 - DNA, 17 bp, Homo sapiens
catctctcatcctccag

SEQ ID NO: 1182268 - DNA, 13 bp, Homo sapiens
catctctcccact

SEQ ID NO: 1182269 - DNA, 12 bp, Homo sapiens
catctctcccca

SEQ ID NO: 1182270 - DNA, 15 bp, Homo sapiens
catctctccctcccc

SEQ ID NO: 1182271 - DNA, 17 bp, Homo sapiens
catctctctacctccac

SEQ ID NO: 1182272 - DNA, 21 bp, Homo sapiens
catctctctactcctacctca

SEQ ID NO: 1182273 - DNA, 12 bp, Homo sapiens
catctctctggc

SEQ ID NO: 1182274 - DNA, 14 bp, Homo sapiens
catctctctggctt

SEQ ID NO: 1182275 - DNA, 13 bp, Homo sapiens
catctctctgggg

SEQ ID NO: 1182276 - DNA, 14 bp, Homo sapiens
catctctctggggc

SEQ ID NO: 1182277 - DNA, 18 bp, Homo sapiens
catctctgaaaattctgg

SEQ ID NO: 1182278 - DNA, 11 bp, Homo sapiens
catctctgcac

SEQ ID NO: 1182279 - DNA, 12 bp, Homo sapiens
catctctggaag

SEQ ID NO: 1182280 - DNA, 22 bp, Homo sapiens
catctctggaaggggcagccct

SEQ ID NO: 1182281 - DNA, 13 bp, Homo sapiens
catctctggagcc

SEQ ID NO: 1182282 - DNA, 14 bp, Homo sapiens
catctctggagcca

SEQ ID NO: 1182283 - DNA, 18 bp, Homo sapiens
catctctgtactttgctt

SEQ ID NO: 1182284 - DNA, 20 bp, Homo sapiens
catctctgtaggatcgtaaa

SEQ ID NO: 1182285 - DNA, 21 bp, Homo sapiens
catctctgtcccattccctgg

SEQ ID NO: 1182286 - DNA, 23 bp, Homo sapiens
catctctgtcccattccctggga

SEQ ID NO: 1182287 - DNA, 12 bp, Homo sapiens
catctctgtctg

SEQ ID NO: 1182288 - DNA, 17 bp, Homo sapiens
catctcttaaattttgt

SEQ ID NO: 1182289 - DNA, 23 bp, Homo sapiens
catctcttacgcccaacccttcc

SEQ ID NO: 1182290 - DNA, 13 bp, Homo sapiens
catctcttcaggt

SEQ ID NO: 1182291 - DNA, 14 bp, Homo sapiens
catctcttcaggtt

SEQ ID NO: 1182292 - DNA, 18 bp, Homo sapiens
catctcttccccagagag

SEQ ID NO: 1182293 - DNA, 22 bp, Homo sapiens
catctcttgaaacctgttaaaa

SEQ ID NO: 1182294 - DNA, 15 bp, Homo sapiens
catctctttgaattt

SEQ ID NO: 1182295 - DNA, 22 bp, Homo sapiens
catctgaaacccacagatgtct

SEQ ID NO: 1182296 - DNA, 15 bp, Homo sapiens
catctgaagagcaga

SEQ ID NO: 1182297 - DNA, 14 bp, Homo sapiens
catctgacacaaaa

SEQ ID NO: 1182298 - DNA, 15 bp, Homo sapiens
catctgacacaaaaa

SEQ ID NO: 1182299 - DNA, 16 bp, Homo sapiens
catctgacagcaggcc

SEQ ID NO: 1182300 - DNA, 15 bp, Homo sapiens
catctgaccgttttc

SEQ ID NO: 1182301 - DNA, 19 bp, Homo sapiens
catctgaccttcaccttgg

SEQ ID NO: 1182302 - DNA, 15 bp, Homo sapiens
catctgagctggggg

SEQ ID NO: 1182303 - DNA, 17 bp, Homo sapiens
catctgagtccagctcc

SEQ ID NO: 1182304 - DNA, 23 bp, Homo sapiens
catctgcaaaaggcctcttgtaa

SEQ ID NO: 1182305 - DNA, 20 bp, Homo sapiens
ctggtcatccttggtgctct

SEQ ID NO: 1182306 - DNA, 22 bp, Homo sapiens
ctggtccaaaagattgctgaaa

SEQ ID NO: 1182307 - DNA, 17 bp, Homo sapiens
ctggtccagggaagctg

SEQ ID NO: 1182308 - DNA, 13 bp, Homo sapiens
ctggtccagggct

SEQ ID NO: 1182309 - DNA, 16 bp, Homo sapiens
ctggtccatgcagggg

SEQ ID NO: 1182310 - DNA, 14 bp, Homo sapiens
ctggtcccacgagg

SEQ ID NO: 1182311 - DNA, 17 bp, Homo sapiens
ctggtccccactgctga

SEQ ID NO: 1182312 - DNA, 21 bp, Homo sapiens
ctggtccccactgctgagctg

SEQ ID NO: 1182313 - DNA, 12 bp, Homo sapiens
ctggtcccctcc

SEQ ID NO: 1182314 - DNA, 12 bp, Homo sapiens
ctggtccctctt

SEQ ID NO: 1182315 - DNA, 15 bp, Homo sapiens
ctggtccctcttctc

SEQ ID NO: 1182316 - DNA, 19 bp, Homo sapiens
ctggtccctcttctctcct

SEQ ID NO: 1182317 - DNA, 23 bp, Homo sapiens
ctggtccctgttttcccacgagg

SEQ ID NO: 1182318 - DNA, 15 bp, Homo sapiens
ctggtccgtgggacg

SEQ ID NO: 1182319 - DNA, 13 bp, Homo sapiens
ctggtcctaccca

SEQ ID NO: 1182320 - DNA, 16 bp, Homo sapiens
ctggtcctacccatcc

SEQ ID NO: 1182321 - DNA, 24 bp, Homo sapiens
ctggtcctaggtcctctgaggcac

SEQ ID NO: 1182322 - DNA, 17 bp, Homo sapiens
ctggtcctcggagctgg

SEQ ID NO: 1182323 - DNA, 11 bp, Homo sapiens
ctggtcctgga

SEQ ID NO: 1182324 - DNA, 13 bp, Homo sapiens
ctggtcctggaca

SEQ ID NO: 1182325 - DNA, 16 bp, Homo sapiens
ctggtcctggacacct

SEQ ID NO: 1182326 - DNA, 18 bp, Homo sapiens
ctggtcctggacacctcc

SEQ ID NO: 1182327 - DNA, 20 bp, Homo sapiens
ctggtcctggacacctccca

SEQ ID NO: 1182328 - DNA, 23 bp, Homo sapiens
ctggtcctggacacctcccaggg

SEQ ID NO: 1182329 - DNA, 19 bp, Homo sapiens
ctggtcctggccgtcccta

SEQ ID NO: 1182330 - DNA, 15 bp, Homo sapiens
cagttagcagggatg

SEQ ID NO: 1182331 - DNA, 19 bp, Homo sapiens
cagttagggttttgcaata

SEQ ID NO: 1182332 - DNA, 22 bp, Homo sapiens
cagttaggtgctgaatgaagct

SEQ ID NO: 1182333 - DNA, 20 bp, Homo sapiens
cagttatacagttataaaat

SEQ ID NO: 1182334 - DNA, 16 bp, Homo sapiens
cagttatatgatattc

SEQ ID NO: 1182335 - DNA, 20 bp, Homo sapiens
cagttatatgatattcttta

SEQ ID NO: 1182336 - DNA, 12 bp, Homo sapiens
cagttatatttt

SEQ ID NO: 1182337 - DNA, 15 bp, Homo sapiens
cagttatattttgca

SEQ ID NO: 1182338 - DNA, 22 bp, Homo sapiens
cagttatatttttgtgttttct

SEQ ID NO: 1182339 - DNA, 16 bp, Homo sapiens
cagttatctaagttaa

SEQ ID NO: 1182340 - DNA, 15 bp, Homo sapiens
cagttatcttagctg

SEQ ID NO: 1182341 - DNA, 20 bp, Homo sapiens
cagttatcttagctggatat

SEQ ID NO: 1182342 - DNA, 22 bp, Homo sapiens
cagttatgatttttttttcata

SEQ ID NO: 1182343 - DNA, 14 bp, Homo sapiens
cagttatgtagttt

SEQ ID NO: 1182344 - DNA, 15 bp, Homo sapiens
cagttcaaagtgtat

SEQ ID NO: 1182345 - DNA, 18 bp, Homo sapiens
cagttcaaagtgtatatt

SEQ ID NO: 1182346 - DNA, 20 bp, Homo sapiens
cagttcaaagtgtatattta

SEQ ID NO: 1182347 - DNA, 23 bp, Homo sapiens
cagttcaacctggtggcaccaga

SEQ ID NO: 1182348 - DNA, 15 bp, Homo sapiens
ctggctcctgagggg

SEQ ID NO: 1182349 - DNA, 13 bp, Homo sapiens
ctggctcctgatc

SEQ ID NO: 1182350 - DNA, 15 bp, Homo sapiens
ctggctccttcactg

SEQ ID NO: 1182351 - DNA, 18 bp, Homo sapiens
ctggctccttgcagcagg

SEQ ID NO: 1182352 - DNA, 20 bp, Homo sapiens
ctggctccttgcagcagggc

SEQ ID NO: 1182353 - DNA, 20 bp, Homo sapiens
ctggctcggacccaccccaa

SEQ ID NO: 1182354 - DNA, 22 bp, Homo sapiens
ctggctcggacccaccccaact

SEQ ID NO: 1182355 - DNA, 19 bp, Homo sapiens
ctggctctaattcacagtg

SEQ ID NO: 1182356 - DNA, 20 bp, Homo sapiens
ctggctctaattcacagtgc

SEQ ID NO: 1182357 - DNA, 21 bp, Homo sapiens
ctggctctaccttcctgtccc

SEQ ID NO: 1182358 - DNA, 22 bp, Homo sapiens
ctggctctaccttcctgtccct

SEQ ID NO: 1182359 - DNA, 13 bp, Homo sapiens
ctggctctccaag

SEQ ID NO: 1182360 - DNA, 14 bp, Homo sapiens
ctggctctccaagt

SEQ ID NO: 1182361 - DNA, 15 bp, Homo sapiens
ctggctctccaagtg

SEQ ID NO: 1182362 - DNA, 22 bp, Homo sapiens
ctggctctccaagtgccagagg

SEQ ID NO: 1182363 - DNA, 23 bp, Homo sapiens
ctggctctccaagtgccagaggt

SEQ ID NO: 1182364 - DNA, 14 bp, Homo sapiens
ctggctctccacct

SEQ ID NO: 1182365 - DNA, 15 bp, Homo sapiens
ctggctctctccagg

SEQ ID NO: 1182366 - DNA, 13 bp, Homo sapiens
ctggctctgagaa

SEQ ID NO: 1182367 - DNA, 18 bp, Homo sapiens
ctggctctgcaatgggca

SEQ ID NO: 1182368 - DNA, 12 bp, Homo sapiens
ctggctctgccc

SEQ ID NO: 1182369 - DNA, 21 bp, Homo sapiens
ctggctctgccccctccccca

SEQ ID NO: 1182370 - DNA, 14 bp, Homo sapiens
ctggctctgcccct

SEQ ID NO: 1182371 - DNA, 18 bp, Homo sapiens
ctggctctgcccctcagg

SEQ ID NO: 1182372 - DNA, 12 bp, Homo sapiens
ctggctctgggc

SEQ ID NO: 1182373 - DNA, 18 bp, Homo sapiens
ctggctctgttcggcctt

SEQ ID NO: 1182374 - DNA, 16 bp, Homo sapiens
ctggctgaaccctgtg

SEQ ID NO: 1182375 - DNA, 17 bp, Homo sapiens
ctggctgaaccctgtgc

SEQ ID NO: 1182376 - DNA, 21 bp, Homo sapiens
ctggctgaaccctgtgctggt

SEQ ID NO: 1182377 - DNA, 19 bp, Homo sapiens
ctggctgaccccaaagagc

SEQ ID NO: 1182378 - DNA, 16 bp, Homo sapiens
ctggctgacctgggcc

SEQ ID NO: 1182379 - DNA, 18 bp, Homo sapiens
ctggctgagcctggctgg

SEQ ID NO: 1182380 - DNA, 22 bp, Homo sapiens
ctggctgaggatttcaagcctg

SEQ ID NO: 1182381 - DNA, 19 bp, Homo sapiens
ctggctgaggttcctctgc

SEQ ID NO: 1182382 - DNA, 23 bp, Homo sapiens
ctggctgaggttcctctgcctgc

SEQ ID NO: 1182383 - DNA, 22 bp, Homo sapiens
ctggctgagtggaatgcaggga

SEQ ID NO: 1182384 - DNA, 24 bp, Homo sapiens
ctggctgagtggaatgcagggaag

SEQ ID NO: 1182385 - DNA, 12 bp, Homo sapiens
ctggctgatgat

SEQ ID NO: 1182386 - DNA, 13 bp, Homo sapiens
ctggctgcacagg

SEQ ID NO: 1182387 - DNA, 16 bp, Homo sapiens
ctggctgcacaggctg

SEQ ID NO: 1182388 - DNA, 14 bp, Homo sapiens
ctggctgccaggcg

SEQ ID NO: 1182389 - DNA, 22 bp, Homo sapiens
ctggctgccaggcgttggtgcc

SEQ ID NO: 1182390 - DNA, 12 bp, Homo sapiens
ctggctgcccag

SEQ ID NO: 1182391 - DNA, 20 bp, Homo sapiens
ctggctgccccaacctgctg

SEQ ID NO: 1182392 - DNA, 14 bp, Homo sapiens
ctggctgccctggc

SEQ ID NO: 1182393 - DNA, 23 bp, Homo sapiens
ctggctgccctggccctgaggtg

SEQ ID NO: 1182394 - DNA, 15 bp, Homo sapiens
ctggctgctgccccc

SEQ ID NO: 1182395 - DNA, 19 bp, Homo sapiens
ctggctggaacactttcag

SEQ ID NO: 1182396 - DNA, 14 bp, Homo sapiens
ctggctggagagct

SEQ ID NO: 1182397 - DNA, 18 bp, Homo sapiens
ctggctggagagctgcta

SEQ ID NO: 1182398 - DNA, 18 bp, Homo sapiens
ctggctggagcctagaac

SEQ ID NO: 1182399 - DNA, 20 bp, Homo sapiens
ctggctggaggagcagcagc

SEQ ID NO: 1182400 - DNA, 21 bp, Homo sapiens
ctggctggaggagcagcagct

SEQ ID NO: 1182401 - DNA, 14 bp, Homo sapiens
ctggctggcctgag

SEQ ID NO: 1182402 - DNA, 17 bp, Homo sapiens
ctggctggctgcagtga

SEQ ID NO: 1182403 - DNA, 16 bp, Homo sapiens
ctggctgggacgtggc

SEQ ID NO: 1182404 - DNA, 19 bp, Homo sapiens
ctggctgggacgtggctca

SEQ ID NO: 1182405 - DNA, 21 bp, Homo sapiens
ctggctgggacgtggctcagc

SEQ ID NO: 1182406 - DNA, 21 bp, Homo sapiens
ctggctgggagtccttacctc

SEQ ID NO: 1182407 - DNA, 11 bp, Homo sapiens
ctggctgggcc

SEQ ID NO: 1182408 - DNA, 13 bp, Homo sapiens
ctggctgggcccc

SEQ ID NO: 1182409 - DNA, 17 bp, Homo sapiens
ctggctgggcccctggg

SEQ ID NO: 1182410 - DNA, 21 bp, Homo sapiens
ctggctgggcccctggggaca

SEQ ID NO: 1182411 - DNA, 23 bp, Homo sapiens
ctggctgggcccctggggacaga

SEQ ID NO: 1182412 - DNA, 22 bp, Homo sapiens
ctggctggggcagaggggcagc

SEQ ID NO: 1182413 - DNA, 23 bp, Homo sapiens
ctggctggggcagaggggcagcc

SEQ ID NO: 1182414 - DNA, 17 bp, Homo sapiens
ctggctgggttcaggtc

SEQ ID NO: 1182415 - DNA, 18 bp, Homo sapiens
ctggctgtactgctcagg

SEQ ID NO: 1182416 - DNA, 21 bp, Homo sapiens
ctggctgtactgctcaggctg

SEQ ID NO: 1182417 - DNA, 18 bp, Homo sapiens
ctggctgtctagaatgtg

SEQ ID NO: 1182418 - DNA, 15 bp, Homo sapiens
ctggctgtctgcctg

SEQ ID NO: 1182419 - DNA, 20 bp, Homo sapiens
ctggctgtctgcctgtattt

SEQ ID NO: 1182420 - DNA, 22 bp, Homo sapiens
ctggctgtgaagacccaggaga

SEQ ID NO: 1182421 - DNA, 21 bp, Homo sapiens
ctggctgtgcccagcaggccc

SEQ ID NO: 1182422 - DNA, 22 bp, Homo sapiens
ctggctgtgcccagcaggccca

SEQ ID NO: 1182423 - DNA, 18 bp, Homo sapiens
ctggctgtggaggcctga

SEQ ID NO: 1182424 - DNA, 20 bp, Homo sapiens
ctggctgtggaggcctgatg

SEQ ID NO: 1182425 - DNA, 23 bp, Homo sapiens
ctggctgtggaggcctgatgctg

SEQ ID NO: 1182426 - DNA, 16 bp, Homo sapiens
ctggctgtggtcagca

SEQ ID NO: 1182427 - DNA, 19 bp, Homo sapiens
ctggctgtgtaaccttggg

SEQ ID NO: 1182428 - DNA, 15 bp, Homo sapiens
ctggctgtgtggcca

SEQ ID NO: 1182429 - DNA, 15 bp, Homo sapiens
ctggctgtgttgccc

SEQ ID NO: 1182430 - DNA, 16 bp, Homo sapiens
ctggctgttcccctgc

SEQ ID NO: 1182431 - DNA, 12 bp, Homo sapiens
ctggctgtttga

SEQ ID NO: 1182432 - DNA, 12 bp, Homo sapiens
ctggcttattta

SEQ ID NO: 1182433 - DNA, 21 bp, Homo sapiens
ctggcttcagcccccaccagg

SEQ ID NO: 1182434 - DNA, 14 bp, Homo sapiens
ctggcttccaggta

SEQ ID NO: 1182435 - DNA, 18 bp, Homo sapiens
ctggcttctgaagagcct

SEQ ID NO: 1182436 - DNA, 20 bp, Homo sapiens
ctggcttctggagcccttgg

SEQ ID NO: 1182437 - DNA, 13 bp, Homo sapiens
ctggcttctgtga

SEQ ID NO: 1182438 - DNA, 16 bp, Homo sapiens
ctggcttgaaggactg

SEQ ID NO: 1182439 - DNA, 18 bp, Homo sapiens
ctggcttgccccaggact

SEQ ID NO: 1182440 - DNA, 13 bp, Homo sapiens
ctggcttgctcca

SEQ ID NO: 1182441 - DNA, 15 bp, Homo sapiens
ctggcttgctccagg

SEQ ID NO: 1182442 - DNA, 19 bp, Homo sapiens
ctggcttgctccagggtct

SEQ ID NO: 1182443 - DNA, 14 bp, Homo sapiens
ctggcttgcttgcc

SEQ ID NO: 1182444 - DNA, 20 bp, Homo sapiens
ctggcttgtaactccaccaa

SEQ ID NO: 1182445 - DNA, 16 bp, Homo sapiens
ctggcttgtttgattt

SEQ ID NO: 1182446 - DNA, 15 bp, Homo sapiens
ctggctttcagagta

SEQ ID NO: 1182447 - DNA, 19 bp, Homo sapiens
ctggctttgaaacctcagg

SEQ ID NO: 1182448 - DNA, 15 bp, Homo sapiens
ctggctttgctctat

SEQ ID NO: 1182449 - DNA, 23 bp, Homo sapiens
ctggcttttattaatgcactttc

SEQ ID NO: 1182450 - DNA, 16 bp, Homo sapiens
ctggcttttcacccca

SEQ ID NO: 1182451 - DNA, 17 bp, Homo sapiens
ctggcttttcaccccag

SEQ ID NO: 1182452 - DNA, 21 bp, Homo sapiens
ctggcttttcaccccagagga

SEQ ID NO: 1182453 - DNA, 19 bp, Homo sapiens
ctggcttttgcctgtaaga

SEQ ID NO: 1182454 - DNA, 14 bp, Homo sapiens
ctggcttttggaag

SEQ ID NO: 1182455 - DNA, 17 bp, Homo sapiens
ctggctttttaaaatat

SEQ ID NO: 1182456 - DNA, 22 bp, Homo sapiens
cagtttcttgcttggaagccag

SEQ ID NO: 1182457 - DNA, 22 bp, Homo sapiens
cagtttcttgtgtagatttgaa

SEQ ID NO: 1182458 - DNA, 23 bp, Homo sapiens
cagtttcttgtgtagatttgaaa

SEQ ID NO: 1182459 - DNA, 13 bp, Homo sapiens
cagtttgaacaaa

SEQ ID NO: 1182460 - DNA, 20 bp, Homo sapiens
cagtttgactttttggaatt

SEQ ID NO: 1182461 - DNA, 18 bp, Homo sapiens
cagtttgagacaggagac

SEQ ID NO: 1182462 - DNA, 21 bp, Homo sapiens
cagtttgcagaaaagcacctg

SEQ ID NO: 1182463 - DNA, 22 bp, Homo sapiens
cagtttgcagaaaagcacctgc

SEQ ID NO: 1182464 - DNA, 23 bp, Homo sapiens
cagtttgcagaaaagcacctgcc

SEQ ID NO: 1182465 - DNA, 15 bp, Homo sapiens
cagtttgcatgattc

SEQ ID NO: 1182466 - DNA, 22 bp, Homo sapiens
cagtttggagagtcagatcttt

SEQ ID NO: 1182467 - DNA, 16 bp, Homo sapiens
cagtttggccctggag

SEQ ID NO: 1182468 - DNA, 17 bp, Homo sapiens
cagtttggccctggagc

SEQ ID NO: 1182469 - DNA, 20 bp, Homo sapiens
cataatctggactcctctgt

SEQ ID NO: 1182470 - DNA, 13 bp, Homo sapiens
cataatcttctgc

SEQ ID NO: 1182471 - DNA, 21 bp, Homo sapiens
cataatcttctgccttctcat

SEQ ID NO: 1182472 - DNA, 18 bp, Homo sapiens
cataatgctaatttaaag

SEQ ID NO: 1182473 - DNA, 15 bp, Homo sapiens
cataatgctactgtc

SEQ ID NO: 1182474 - DNA, 22 bp, Homo sapiens
cataatgggccactgaaatctg

SEQ ID NO: 1182475 - DNA, 22 bp, Homo sapiens
cataatggggtcctggccatcc

SEQ ID NO: 1182476 - DNA, 23 bp, Homo sapiens
cataatggttgtgaaatgtaaca

SEQ ID NO: 1182477 - DNA, 13 bp, Homo sapiens
cataatgttaagc

SEQ ID NO: 1182478 - DNA, 22 bp, Homo sapiens
cataatgtttctggatttcata

SEQ ID NO: 1182479 - DNA, 18 bp, Homo sapiens
cataattacattcctaac

SEQ ID NO: 1182480 - DNA, 13 bp, Homo sapiens
cataattatgaaa

SEQ ID NO: 1182481 - DNA, 16 bp, Homo sapiens
cataattatgaaaact

SEQ ID NO: 1182482 - DNA, 13 bp, Homo sapiens
cataattctgaaa

SEQ ID NO: 1182483 - DNA, 18 bp, Homo sapiens
cataattcttgtatatta

SEQ ID NO: 1182484 - DNA, 12 bp, Homo sapiens
cataattctttt

SEQ ID NO: 1182485 - DNA, 14 bp, Homo sapiens
cataattgattaaa

SEQ ID NO: 1182486 - DNA, 15 bp, Homo sapiens
cataattgattaaaa

SEQ ID NO: 1182487 - DNA, 21 bp, Homo sapiens
cataattgtgattagacagaa

SEQ ID NO: 1182488 - DNA, 23 bp, Homo sapiens
cataattgtggattataaaaaat

SEQ ID NO: 1182489 - DNA, 20 bp, Homo sapiens
cataatttaaaaatatattt

SEQ ID NO: 1182490 - DNA, 22 bp, Homo sapiens
cataatttaaaaatctccatta

SEQ ID NO: 1182491 - DNA, 19 bp, Homo sapiens
cataatttagttgtttcta

SEQ ID NO: 1182492 - DNA, 15 bp, Homo sapiens
cataatttggaggga

SEQ ID NO: 1182493 - DNA, 17 bp, Homo sapiens
cataatttggggccctg

SEQ ID NO: 1182494 - DNA, 18 bp, Homo sapiens
cataatttgtttaaaatt

SEQ ID NO: 1182495 - DNA, 18 bp, Homo sapiens
cataatttgtttccagca

SEQ ID NO: 1182496 - DNA, 12 bp, Homo sapiens
cataattttgca

SEQ ID NO: 1182497 - DNA, 20 bp, Homo sapiens
cataattttgcatactgaaa

SEQ ID NO: 1182498 - DNA, 12 bp, Homo sapiens
cataatttttaa

SEQ ID NO: 1182499 - DNA, 21 bp, Homo sapiens
cataattttttttaaagaaga

SEQ ID NO: 1182500 - DNA, 23 bp, Homo sapiens
catacaaaatatttaagtgaagg

SEQ ID NO: 1182501 - DNA, 16 bp, Homo sapiens
catacaaactctcacc

SEQ ID NO: 1182502 - DNA, 13 bp, Homo sapiens
catacaaatttat

SEQ ID NO: 1182503 - DNA, 15 bp, Homo sapiens
catacaacacaaaga

SEQ ID NO: 1182504 - DNA, 22 bp, Homo sapiens
catacaacagaaaccagaaaag

SEQ ID NO: 1182505 - DNA, 16 bp, Homo sapiens
catacaagaaaatgta

SEQ ID NO: 1182506 - DNA, 12 bp, Homo sapiens
catacaataaaa

SEQ ID NO: 1182507 - DNA, 14 bp, Homo sapiens
catacaataaaaga

SEQ ID NO: 1182508 - DNA, 22 bp, Homo sapiens
catacaataaaagagctttatc

SEQ ID NO: 1182509 - DNA, 14 bp, Homo sapiens
catacaatgaaaag

SEQ ID NO: 1182510 - DNA, 16 bp, Homo sapiens
catacaatgaccacat

SEQ ID NO: 1182511 - DNA, 17 bp, Homo sapiens
catacaatgtatgtaca

SEQ ID NO: 1182512 - DNA, 13 bp, Homo sapiens
catacacacacaa

SEQ ID NO: 1182513 - DNA, 17 bp, Homo sapiens
catacacacacaaacca

SEQ ID NO: 1182514 - DNA, 14 bp, Homo sapiens
catacaccagcatt

SEQ ID NO: 1182515 - DNA, 18 bp, Homo sapiens
catacaccagcattcctt

SEQ ID NO: 1182516 - DNA, 20 bp, Homo sapiens
catacaccttgctaacctaa

SEQ ID NO: 1182517 - DNA, 17 bp, Homo sapiens
catacactgtgaactca

SEQ ID NO: 1182518 - DNA, 21 bp, Homo sapiens
catacagaaagaagcagttct

SEQ ID NO: 1182519 - DNA, 18 bp, Homo sapiens
catacagaggatgccttt

SEQ ID NO: 1182520 - DNA, 12 bp, Homo sapiens
catacagctcta

SEQ ID NO: 1182521 - DNA, 14 bp, Homo sapiens
catacagctgccta

SEQ ID NO: 1182522 - DNA, 17 bp, Homo sapiens
catacagctgcctacct

SEQ ID NO: 1182523 - DNA, 11 bp, Homo sapiens
catacagtttt

SEQ ID NO: 1182524 - DNA, 12 bp, Homo sapiens
catacagttttc

SEQ ID NO: 1182525 - DNA, 15 bp, Homo sapiens
catacagttttcatt

SEQ ID NO: 1182526 - DNA, 18 bp, Homo sapiens
catacataaaagaaataa

SEQ ID NO: 1182527 - DNA, 20 bp, Homo sapiens
catacataaaagaaataaac

SEQ ID NO: 1182528 - DNA, 21 bp, Homo sapiens
catacatacacacacacacat

SEQ ID NO: 1182529 - DNA, 17 bp, Homo sapiens
catacatacacatacat

SEQ ID NO: 1182530 - DNA, 18 bp, Homo sapiens
catacatacacatacata

SEQ ID NO: 1182531 - DNA, 19 bp, Homo sapiens
catacatatatatatttgt

SEQ ID NO: 1182532 - DNA, 15 bp, Homo sapiens
catacatgctacttt

SEQ ID NO: 1182533 - DNA, 22 bp, Homo sapiens
catacatgtatctggtttgtca

SEQ ID NO: 1182534 - DNA, 17 bp, Homo sapiens
catacattaaggagcag

SEQ ID NO: 1182535 - DNA, 23 bp, Homo sapiens
catacattaaggagcagggtcct

SEQ ID NO: 1182536 - DNA, 21 bp, Homo sapiens
catacattgtataggccatct

SEQ ID NO: 1182537 - DNA, 23 bp, Homo sapiens
catacatttataatgtttgctat

SEQ ID NO: 1182538 - DNA, 21 bp, Homo sapiens
cataccatgtggatgcagcac

SEQ ID NO: 1182539 - DNA, 20 bp, Homo sapiens
cataccattattatgtaaat

SEQ ID NO: 1182540 - DNA, 18 bp, Homo sapiens
catacccaaaccaggtgg

SEQ ID NO: 1182541 - DNA, 22 bp, Homo sapiens
catacccacacattccagggct

SEQ ID NO: 1182542 - DNA, 16 bp, Homo sapiens
cataccccttattgct

SEQ ID NO: 1182543 - DNA, 19 bp, Homo sapiens
cataccccttattgctgcc

SEQ ID NO: 1182544 - DNA, 21 bp, Homo sapiens
cataccccttattgctgccaa

SEQ ID NO: 1182545 - DNA, 20 bp, Homo sapiens
cataccgaccatcgtccagc

SEQ ID NO: 1182546 - DNA, 19 bp, Homo sapiens
cataccgcctcgtgccagc

SEQ ID NO: 1182547 - DNA, 20 bp, Homo sapiens
cataccgcctcgtgccagca

SEQ ID NO: 1182548 - DNA, 21 bp, Homo sapiens
cataccgcctcgtgccagcag

SEQ ID NO: 1182549 - DNA, 22 bp, Homo sapiens
cataccgcctcgtgccagcagc

SEQ ID NO: 1182550 - DNA, 23 bp, Homo sapiens
cataccgcctcgtgccagcagcc

SEQ ID NO: 1182551 - DNA, 14 bp, Homo sapiens
catacctaccagta

SEQ ID NO: 1182552 - DNA, 17 bp, Homo sapiens
catacctaccagtatta

SEQ ID NO: 1182553 - DNA, 21 bp, Homo sapiens
catacctcctatgggttgtca

SEQ ID NO: 1182554 - DNA, 18 bp, Homo sapiens
cataccttccttccctgg

SEQ ID NO: 1182555 - DNA, 14 bp, Homo sapiens
cataccttgtgcat

SEQ ID NO: 1182556 - DNA, 21 bp, Homo sapiens
catacgcaaaaacttccttta

SEQ ID NO: 1182557 - DNA, 16 bp, Homo sapiens
catacgcatcccatct

SEQ ID NO: 1182558 - DNA, 19 bp, Homo sapiens
catacggtcaggtttaaca

SEQ ID NO: 1182559 - DNA, 17 bp, Homo sapiens
catacgtacacatttta

SEQ ID NO: 1182560 - DNA, 13 bp, Homo sapiens
catactacccttt

SEQ ID NO: 1182561 - DNA, 18 bp, Homo sapiens
catactactgaaacagat

SEQ ID NO: 1182562 - DNA, 19 bp, Homo sapiens
catactatttagattttct

SEQ ID NO: 1182563 - DNA, 14 bp, Homo sapiens
catactcaaggtga

SEQ ID NO: 1182564 - DNA, 20 bp, Homo sapiens
catactcagcctgctgccca

SEQ ID NO: 1182565 - DNA, 22 bp, Homo sapiens
catactcctctccttcaaagaa

SEQ ID NO: 1182566 - DNA, 20 bp, Homo sapiens
catactccttttggctgggg

SEQ ID NO: 1182567 - DNA, 11 bp, Homo sapiens
catactctgct

SEQ ID NO: 1182568 - DNA, 19 bp, Homo sapiens
catactgacttcagtggga

SEQ ID NO: 1182569 - DNA, 16 bp, Homo sapiens
catactgagcctgcca

SEQ ID NO: 1182570 - DNA, 19 bp, Homo sapiens
catactgagggaccaactg

SEQ ID NO: 1182571 - DNA, 20 bp, Homo sapiens
catactgagggaccaactgg

SEQ ID NO: 1182572 - DNA, 13 bp, Homo sapiens
catactggcagga

SEQ ID NO: 1182573 - DNA, 17 bp, Homo sapiens
catactggcctctgtga

SEQ ID NO: 1182574 - DNA, 18 bp, Homo sapiens
catactgtatttttacta

SEQ ID NO: 1182575 - DNA, 13 bp, Homo sapiens
catactgtctctg

SEQ ID NO: 1182576 - DNA, 14 bp, Homo sapiens
catactgtctctgg

SEQ ID NO: 1182577 - DNA, 11 bp, Homo sapiens
catactgtgta

SEQ ID NO: 1182578 - DNA, 13 bp, Homo sapiens
catactgtgtatg

SEQ ID NO: 1182579 - DNA, 14 bp, Homo sapiens
catactgtgtatgt

SEQ ID NO: 1182580 - DNA, 19 bp, Homo sapiens
catactgtgtatgttttat

SEQ ID NO: 1182581 - DNA, 12 bp, Homo sapiens
catactgttgat

SEQ ID NO: 1182582 - DNA, 17 bp, Homo sapiens
catactgttgatacaaa

SEQ ID NO: 1182583 - DNA, 19 bp, Homo sapiens
catactgttgatacaaacc

SEQ ID NO: 1182584 - DNA, 21 bp, Homo sapiens
catactgttgatacaaaccac

SEQ ID NO: 1182585 - DNA, 14 bp, Homo sapiens
catacttacatttc

SEQ ID NO: 1182586 - DNA, 16 bp, Homo sapiens
ctgggatgtagaactt

SEQ ID NO: 1182587 - DNA, 15 bp, Homo sapiens
ctgggatgtcacagt

SEQ ID NO: 1182588 - DNA, 22 bp, Homo sapiens
ctgggattacaggcatgagcca

SEQ ID NO: 1182589 - DNA, 24 bp, Homo sapiens
ctgggattacaggcatgagccact

SEQ ID NO: 1182590 - DNA, 23 bp, Homo sapiens
ctgggattacaggcatgtgccac

SEQ ID NO: 1182591 - DNA, 15 bp, Homo sapiens
catcaaccaggaaga

SEQ ID NO: 1182592 - DNA, 10 bp, Homo sapiens
catcaactga

SEQ ID NO: 1182593 - DNA, 19 bp, Homo sapiens
ctgggccgcaagggcctgg

SEQ ID NO: 1182594 - DNA, 16 bp, Homo sapiens
ctgggccgctgccacg

SEQ ID NO: 1182595 - DNA, 16 bp, Homo sapiens
ctgggccgggcctggg

SEQ ID NO: 1182596 - DNA, 22 bp, Homo sapiens
ctgggccgggctgtagatcagg

SEQ ID NO: 1182597 - DNA, 18 bp, Homo sapiens
ctgggccgtggcacagct

SEQ ID NO: 1182598 - DNA, 18 bp, Homo sapiens
ctgggcctcccctgggca

SEQ ID NO: 1182599 - DNA, 19 bp, Homo sapiens
ctgggcctccttcttccac

SEQ ID NO: 1182600 - DNA, 23 bp, Homo sapiens
ctgggcctccttcttccacttct

SEQ ID NO: 1182601 - DNA, 20 bp, Homo sapiens
ctgggcctgaccaaacagcc

SEQ ID NO: 1182602 - DNA, 16 bp, Homo sapiens
ctgggcctgcccctgt

SEQ ID NO: 1182603 - DNA, 19 bp, Homo sapiens
ctgggcctgcttttccagg

SEQ ID NO: 1182604 - DNA, 23 bp, Homo sapiens
ctgggcctgcttttccaggatcc

SEQ ID NO: 1182605 - DNA, 19 bp, Homo sapiens
ctgggcctgtgcagcagcc

SEQ ID NO: 1182606 - DNA, 16 bp, Homo sapiens
ctgggccttggctggg

SEQ ID NO: 1182607 - DNA, 19 bp, Homo sapiens
ctgggcctttccagagaac

SEQ ID NO: 1182608 - DNA, 13 bp, Homo sapiens
ctgggcctttcct

SEQ ID NO: 1182609 - DNA, 21 bp, Homo sapiens
ctgggcctttcctgtgccaac

SEQ ID NO: 1182610 - DNA, 23 bp, Homo sapiens
ctgggcctttgcaagatgcttgg

SEQ ID NO: 1182611 - DNA, 18 bp, Homo sapiens
ctgggcgccctggaagcc

SEQ ID NO: 1182612 - DNA, 22 bp, Homo sapiens
ctgggcgcggtggctcacgcct

SEQ ID NO: 1182613 - DNA, 20 bp, Homo sapiens
ctgggcggcccgtggacacc

SEQ ID NO: 1182614 - DNA, 17 bp, Homo sapiens
ctgggcggctgtgcttc

SEQ ID NO: 1182615 - DNA, 18 bp, Homo sapiens
ctgggcgtccagctcagc

SEQ ID NO: 1182616 - DNA, 20 bp, Homo sapiens
ctgggcgtccagctcagccc

SEQ ID NO: 1182617 - DNA, 14 bp, Homo sapiens
ctgggcgtctgact

SEQ ID NO: 1182618 - DNA, 19 bp, Homo sapiens
ctgggctactgccactgtg

SEQ ID NO: 1182619 - DNA, 23 bp, Homo sapiens
ctgggctagaaagaccactggca

SEQ ID NO: 1182620 - DNA, 22 bp, Homo sapiens
ctgggctagggagaatgcagag

SEQ ID NO: 1182621 - DNA, 23 bp, Homo sapiens
ctgggctagggagaatgcagaga

SEQ ID NO: 1182622 - DNA, 14 bp, Homo sapiens
ctgggctatggaca

SEQ ID NO: 1182623 - DNA, 15 bp, Homo sapiens
ctgggctatggacac

SEQ ID NO: 1182624 - DNA, 22 bp, Homo sapiens
ctgggctcactgtgctggggca

SEQ ID NO: 1182625 - DNA, 12 bp, Homo sapiens
ctgggctcagcc

SEQ ID NO: 1182626 - DNA, 18 bp, Homo sapiens
ctgggctcagggctggag

SEQ ID NO: 1182627 - DNA, 14 bp, Homo sapiens
ctgggctccctctt

SEQ ID NO: 1182628 - DNA, 17 bp, Homo sapiens
ctgggctcctggaacca

SEQ ID NO: 1182629 - DNA, 16 bp, Homo sapiens
ctgggctctccacctc

SEQ ID NO: 1182630 - DNA, 17 bp, Homo sapiens
ctgggctctgccaccct

SEQ ID NO: 1182631 - DNA, 20 bp, Homo sapiens
ctgggctctgccaccctacc

SEQ ID NO: 1182632 - DNA, 17 bp, Homo sapiens
ctgggctctgccccagc

SEQ ID NO: 1182633 - DNA, 23 bp, Homo sapiens
ctgggctctgccccagctctggc

SEQ ID NO: 1182634 - DNA, 13 bp, Homo sapiens
ctgggctctggaa

SEQ ID NO: 1182635 - DNA, 21 bp, Homo sapiens
ctgggctctggacctcaggag

SEQ ID NO: 1182636 - DNA, 15 bp, Homo sapiens
ctgggctgagcccct

SEQ ID NO: 1182637 - DNA, 16 bp, Homo sapiens
ctgggctgagcccctg

SEQ ID NO: 1182638 - DNA, 17 bp, Homo sapiens
ctgggctgagcccctgg

SEQ ID NO: 1182639 - DNA, 16 bp, Homo sapiens
ctgggctgagtgacac

SEQ ID NO: 1182640 - DNA, 20 bp, Homo sapiens
ctgggctgccatgtgaagag

SEQ ID NO: 1182641 - DNA, 13 bp, Homo sapiens
ctgggctggcgct

SEQ ID NO: 1182642 - DNA, 12 bp, Homo sapiens
ctgggctgggaa

SEQ ID NO: 1182643 - DNA, 14 bp, Homo sapiens
ctgggctgggccct

SEQ ID NO: 1182644 - DNA, 15 bp, Homo sapiens
ctgggctgggctgag

SEQ ID NO: 1182645 - DNA, 16 bp, Homo sapiens
ctgggctgggctgagc

SEQ ID NO: 1182646 - DNA, 21 bp, Homo sapiens
ctgggctggggccacctttgt

SEQ ID NO: 1182647 - DNA, 15 bp, Homo sapiens
ctgggctgggtgctg

SEQ ID NO: 1182648 - DNA, 13 bp, Homo sapiens
ctgggctgtgcta

SEQ ID NO: 1182649 - DNA, 15 bp, Homo sapiens
ctgggctgtgggcaa

SEQ ID NO: 1182650 - DNA, 15 bp, Homo sapiens
ctgggctgttggcac

SEQ ID NO: 1182651 - DNA, 12 bp, Homo sapiens
ctgggctgttgt

SEQ ID NO: 1182652 - DNA, 16 bp, Homo sapiens
ctgggcttcattctgg

SEQ ID NO: 1182653 - DNA, 18 bp, Homo sapiens
ctgggcttgagctgcaga

SEQ ID NO: 1182654 - DNA, 19 bp, Homo sapiens
ctgggcttgagctgcagaa

SEQ ID NO: 1182655 - DNA, 14 bp, Homo sapiens
ctgggcttggcctg

SEQ ID NO: 1182656 - DNA, 15 bp, Homo sapiens
ctgggcttggcctgg

SEQ ID NO: 1182657 - DNA, 14 bp, Homo sapiens
ctgggcttggctct

SEQ ID NO: 1182658 - DNA, 14 bp, Homo sapiens
ctgggctttctcct

SEQ ID NO: 1182659 - DNA, 17 bp, Homo sapiens
ctgggctttctcctgga

SEQ ID NO: 1182660 - DNA, 18 bp, Homo sapiens
ctgggctttctcctggag

SEQ ID NO: 1182661 - DNA, 23 bp, Homo sapiens
ctgggctttttttttctctttct

SEQ ID NO: 1182662 - DNA, 18 bp, Homo sapiens
ctggggaaaaaaaagaga

SEQ ID NO: 1182663 - DNA, 19 bp, Homo sapiens
ctggggaaagacgccttca

SEQ ID NO: 1182664 - DNA, 22 bp, Homo sapiens
ctggggaagggttttcttttct

SEQ ID NO: 1182665 - DNA, 19 bp, Homo sapiens
ctggggaagtacgtcccag

SEQ ID NO: 1182666 - DNA, 21 bp, Homo sapiens
ctggggaagtacgtcccagcg

SEQ ID NO: 1182667 - DNA, 24 bp, Homo sapiens
ctggggaagtacgtcccagcggcc

SEQ ID NO: 1182668 - DNA, 18 bp, Homo sapiens
ctggggaagtcaggggag

SEQ ID NO: 1182669 - DNA, 17 bp, Homo sapiens
ctggggaatgctcccag

SEQ ID NO: 1182670 - DNA, 18 bp, Homo sapiens
ctggggacagagccaccc

SEQ ID NO: 1182671 - DNA, 23 bp, Homo sapiens
ctggggacagagccaccccatga

SEQ ID NO: 1182672 - DNA, 13 bp, Homo sapiens
ctggggacagagg

SEQ ID NO: 1182673 - DNA, 14 bp, Homo sapiens
ctggggacagcttc

SEQ ID NO: 1182674 - DNA, 22 bp, Homo sapiens
ctggggacccacccagcccctc

SEQ ID NO: 1182675 - DNA, 21 bp, Homo sapiens
ctggggaccctccagaggtgg

SEQ ID NO: 1182676 - DNA, 15 bp, Homo sapiens
ctggggactcaggga

SEQ ID NO: 1182677 - DNA, 12 bp, Homo sapiens
ctggggactcct

SEQ ID NO: 1182678 - DNA, 21 bp, Homo sapiens
ctggggactttatttatttct

SEQ ID NO: 1182679 - DNA, 23 bp, Homo sapiens
ctggggactttatttatttctag

SEQ ID NO: 1182680 - DNA, 15 bp, Homo sapiens
ctggggagcccgtct

SEQ ID NO: 1182681 - DNA, 18 bp, Homo sapiens
ctggggagccctcaggct

SEQ ID NO: 1182682 - DNA, 21 bp, Homo sapiens
ctggggagccctcaggctccc

SEQ ID NO: 1182683 - DNA, 12 bp, Homo sapiens
ctggggagctcc

SEQ ID NO: 1182684 - DNA, 13 bp, Homo sapiens
ctggggagctcct

SEQ ID NO: 1182685 - DNA, 21 bp, Homo sapiens
ctggggagctcctggccagga

SEQ ID NO: 1182686 - DNA, 16 bp, Homo sapiens
ctggggagctcctggg

SEQ ID NO: 1182687 - DNA, 15 bp, Homo sapiens
ctggggaggaccagg

SEQ ID NO: 1182688 - DNA, 16 bp, Homo sapiens
ctggggaggaccaggg

SEQ ID NO: 1182689 - DNA, 14 bp, Homo sapiens
ctggggaggaggag

SEQ ID NO: 1182690 - DNA, 17 bp, Homo sapiens
ctggggaggtgctgggg

SEQ ID NO: 1182691 - DNA, 22 bp, Homo sapiens
ctggggaggtgggaggccaggc

SEQ ID NO: 1182692 - DNA, 22 bp, Homo sapiens
ctggggatccccgcctggccag

SEQ ID NO: 1182693 - DNA, 23 bp, Homo sapiens
ctggggatccccgcctggccagg

SEQ ID NO: 1182694 - DNA, 23 bp, Homo sapiens
ctggggatcttcccacaggaggg

SEQ ID NO: 1182695 - DNA, 15 bp, Homo sapiens
ctggggatggtggca

SEQ ID NO: 1182696 - DNA, 19 bp, Homo sapiens
ctggggatgtcatagccaa

SEQ ID NO: 1182697 - DNA, 20 bp, Homo sapiens
ctggggatgtcatagccaaa

SEQ ID NO: 1182698 - DNA, 15 bp, Homo sapiens
ctggggatgtgggag

SEQ ID NO: 1182699 - DNA, 16 bp, Homo sapiens
ctggggcaagtccctg

SEQ ID NO: 1182700 - DNA, 17 bp, Homo sapiens
ctggggcacagtccagg

SEQ ID NO: 1182701 - DNA, 21 bp, Homo sapiens
ctggggcacagtccaggaaca

SEQ ID NO: 1182702 - DNA, 23 bp, Homo sapiens
ctggggcagagaagttccttagg

SEQ ID NO: 1182703 - DNA, 15 bp, Homo sapiens
ctggggcagaggggc

SEQ ID NO: 1182704 - DNA, 20 bp, Homo sapiens
ctggggcagaggggcagccg

SEQ ID NO: 1182705 - DNA, 21 bp, Homo sapiens
ctggggcagaggggcagccgc

SEQ ID NO: 1182706 - DNA, 13 bp, Homo sapiens
ctggggcagatcc

SEQ ID NO: 1182707 - DNA, 22 bp, Homo sapiens
ctggggcagcaccctataaatc

SEQ ID NO: 1182708 - DNA, 14 bp, Homo sapiens
ctggggcagcactc

SEQ ID NO: 1182709 - DNA, 19 bp, Homo sapiens
ctggggcagcactccccag

SEQ ID NO: 1182710 - DNA, 21 bp, Homo sapiens
ctggggcagcactccccagag

SEQ ID NO: 1182711 - DNA, 11 bp, Homo sapiens
ctggggcaggc

SEQ ID NO: 1182712 - DNA, 15 bp, Homo sapiens
catcccctctcagga

SEQ ID NO: 1182713 - DNA, 17 bp, Homo sapiens
catcccctctcaggaga

SEQ ID NO: 1182714 - DNA, 19 bp, Homo sapiens
catccccttcccccatccc

SEQ ID NO: 1182715 - DNA, 12 bp, Homo sapiens
catcccctttcc

SEQ ID NO: 1182716 - DNA, 13 bp, Homo sapiens
catcccctttcct

SEQ ID NO: 1182717 - DNA, 16 bp, Homo sapiens
catcccctttcctccc

SEQ ID NO: 1182718 - DNA, 19 bp, Homo sapiens
catcccctttcctccccac

SEQ ID NO: 1182719 - DNA, 21 bp, Homo sapiens
catcccctttcctccccacct

SEQ ID NO: 1182720 - DNA, 23 bp, Homo sapiens
catcccgacatggacccggagct

SEQ ID NO: 1182721 - DNA, 23 bp, Homo sapiens
catcccgcttagcgctctggaca

SEQ ID NO: 1182722 - DNA, 20 bp, Homo sapiens
ctgctggggaagggttttct

SEQ ID NO: 1182723 - DNA, 14 bp, Homo sapiens
ctgctggggatccc

SEQ ID NO: 1182724 - DNA, 19 bp, Homo sapiens
ctgctggggcatgtgtgcc

SEQ ID NO: 1182725 - DNA, 17 bp, Homo sapiens
ctgctggggcctcagac

SEQ ID NO: 1182726 - DNA, 18 bp, Homo sapiens
ctgctgggggcaactggc

SEQ ID NO: 1182727 - DNA, 20 bp, Homo sapiens
ctgctgggggcaactggcca

SEQ ID NO: 1182728 - DNA, 17 bp, Homo sapiens
ctgctggtcagcactcc

SEQ ID NO: 1182729 - DNA, 20 bp, Homo sapiens
ctgctgtaactgctgagcca

SEQ ID NO: 1182730 - DNA, 12 bp, Homo sapiens
ctgctgtattta

SEQ ID NO: 1182731 - DNA, 17 bp, Homo sapiens
ctgctgtcaataaatga

SEQ ID NO: 1182732 - DNA, 17 bp, Homo sapiens
ctgctgtccctccccct

SEQ ID NO: 1182733 - DNA, 15 bp, Homo sapiens
ctgctgtccctgtca

SEQ ID NO: 1182734 - DNA, 16 bp, Homo sapiens
ctgctgtccctgtcag

SEQ ID NO: 1182735 - DNA, 17 bp, Homo sapiens
ctgctgtcctctccccc

SEQ ID NO: 1182736 - DNA, 20 bp, Homo sapiens
ctgctgtctaacctgtgacc

SEQ ID NO: 1182737 - DNA, 11 bp, Homo sapiens
ctgctgtctct

SEQ ID NO: 1182738 - DNA, 14 bp, Homo sapiens
ctgctgtcttccaa

SEQ ID NO: 1182739 - DNA, 13 bp, Homo sapiens
ctgctgtgaattt

SEQ ID NO: 1182740 - DNA, 14 bp, Homo sapiens
ctgctgtgaatttt

SEQ ID NO: 1182741 - DNA, 23 bp, Homo sapiens
ctgctgtgatgccgtcctgctgg

SEQ ID NO: 1182742 - DNA, 16 bp, Homo sapiens
ctgctgtgattccact

SEQ ID NO: 1182743 - DNA, 13 bp, Homo sapiens
ctgctgtgcccag

SEQ ID NO: 1182744 - DNA, 14 bp, Homo sapiens
ctgctgtgcccagc

SEQ ID NO: 1182745 - DNA, 19 bp, Homo sapiens
ctgctgtgcctcgcatcct

SEQ ID NO: 1182746 - DNA, 13 bp, Homo sapiens
ctgctgtgcctgc

SEQ ID NO: 1182747 - DNA, 14 bp, Homo sapiens
ctgctgtgcctgcg

SEQ ID NO: 1182748 - DNA, 15 bp, Homo sapiens
ctgctgtgctgctca

SEQ ID NO: 1182749 - DNA, 17 bp, Homo sapiens
ctgctgtggccccctgt

SEQ ID NO: 1182750 - DNA, 12 bp, Homo sapiens
ctgctgtgtcct

SEQ ID NO: 1182751 - DNA, 21 bp, Homo sapiens
ctgctgtgtccttcctccaca

SEQ ID NO: 1182752 - DNA, 15 bp, Homo sapiens
ctgctgttctcagga

SEQ ID NO: 1182753 - DNA, 20 bp, Homo sapiens
ctgctgttctcaggacagca

SEQ ID NO: 1182754 - DNA, 22 bp, Homo sapiens
ctgctgttctcaggacagcatc

SEQ ID NO: 1182755 - DNA, 22 bp, Homo sapiens
ctgctgttcttcacttctggga

SEQ ID NO: 1182756 - DNA, 18 bp, Homo sapiens
ctgctgttgccatagccc

SEQ ID NO: 1182757 - DNA, 21 bp, Homo sapiens
ctgctgttggtcctctctctg

SEQ ID NO: 1182758 - DNA, 12 bp, Homo sapiens
ctgctgtttaag

SEQ ID NO: 1182759 - DNA, 13 bp, Homo sapiens
ctgcttaaacaaa

SEQ ID NO: 1182760 - DNA, 15 bp, Homo sapiens
ctgcttaaagcttcc

SEQ ID NO: 1182761 - DNA, 13 bp, Homo sapiens
ctgcttaacttca

SEQ ID NO: 1182762 - DNA, 17 bp, Homo sapiens
ctgcttaacttcacata

SEQ ID NO: 1182763 - DNA, 22 bp, Homo sapiens
ctgcttaatcctaccccctctt

SEQ ID NO: 1182764 - DNA, 18 bp, Homo sapiens
ctgcttacaattccctgc

SEQ ID NO: 1182765 - DNA, 15 bp, Homo sapiens
ctgcttacccttcac

SEQ ID NO: 1182766 - DNA, 23 bp, Homo sapiens
ctgcttagaaataacagaagaaa

SEQ ID NO: 1182767 - DNA, 12 bp, Homo sapiens
ctgcttagcttg

SEQ ID NO: 1182768 - DNA, 16 bp, Homo sapiens
ctgcttaggagagacc

SEQ ID NO: 1182769 - DNA, 18 bp, Homo sapiens
ctgcttaggagagaccga

SEQ ID NO: 1182770 - DNA, 21 bp, Homo sapiens
ctgcttcagtgtatggaaata

SEQ ID NO: 1182771 - DNA, 21 bp, Homo sapiens
ctgcttcatgctcagccctga

SEQ ID NO: 1182772 - DNA, 13 bp, Homo sapiens
ctgcttcatgtga

SEQ ID NO: 1182773 - DNA, 17 bp, Homo sapiens
ctgcttccaggctgggc

SEQ ID NO: 1182774 - DNA, 22 bp, Homo sapiens
ctgcttccatggcttcctgaga

SEQ ID NO: 1182775 - DNA, 17 bp, Homo sapiens
ctgcttcccagaggagc

SEQ ID NO: 1182776 - DNA, 13 bp, Homo sapiens
ctgcttcccatcc

SEQ ID NO: 1182777 - DNA, 19 bp, Homo sapiens
ctgcttcccctccctaccc

SEQ ID NO: 1182778 - DNA, 23 bp, Homo sapiens
ctgcttccctctgcctgtccctc

SEQ ID NO: 1182779 - DNA, 14 bp, Homo sapiens
ctgcttcctcctgg

SEQ ID NO: 1182780 - DNA, 12 bp, Homo sapiens
ctgcttccttca

SEQ ID NO: 1182781 - DNA, 13 bp, Homo sapiens
ctgcttccttcag

SEQ ID NO: 1182782 - DNA, 15 bp, Homo sapiens
ctgcttccttcagtt

SEQ ID NO: 1182783 - DNA, 16 bp, Homo sapiens
ctgcttctaagatgcc

SEQ ID NO: 1182784 - DNA, 13 bp, Homo sapiens
ctgcttctccaag

SEQ ID NO: 1182785 - DNA, 16 bp, Homo sapiens
ctgcttctccaaggaa

SEQ ID NO: 1182786 - DNA, 12 bp, Homo sapiens
ctgcttctcccc

SEQ ID NO: 1182787 - DNA, 19 bp, Homo sapiens
caggtcccagcgagccaca

SEQ ID NO: 1182788 - DNA, 20 bp, Homo sapiens
caggtcccagcgagccacag

SEQ ID NO: 1182789 - DNA, 15 bp, Homo sapiens
caggtccccaaactt

SEQ ID NO: 1182790 - DNA, 18 bp, Homo sapiens
caggtccccatggcttgt

SEQ ID NO: 1182791 - DNA, 16 bp, Homo sapiens
caggtcccccccaggt

SEQ ID NO: 1182792 - DNA, 15 bp, Homo sapiens
caggtcccccgactg

SEQ ID NO: 1182793 - DNA, 20 bp, Homo sapiens
caggtcccccgactgcctgt

SEQ ID NO: 1182794 - DNA, 23 bp, Homo sapiens
caggtcccccgactgcctgtctc

SEQ ID NO: 1182795 - DNA, 15 bp, Homo sapiens
caggtcctcagagaa

SEQ ID NO: 1182796 - DNA, 21 bp, Homo sapiens
caggtcctctgatacccagag

SEQ ID NO: 1182797 - DNA, 12 bp, Homo sapiens
caggtcctgccc

SEQ ID NO: 1182798 - DNA, 19 bp, Homo sapiens
caggtcgtagcatttggag

SEQ ID NO: 1182799 - DNA, 20 bp, Homo sapiens
caggtctcaaggttctcatt

SEQ ID NO: 1182800 - DNA, 20 bp, Homo sapiens
caggtctcccacgtgggaga

SEQ ID NO: 1182801 - DNA, 13 bp, Homo sapiens
caggtctcctctt

SEQ ID NO: 1182802 - DNA, 15 bp, Homo sapiens
caggtctgcaagggc

SEQ ID NO: 1182803 - DNA, 13 bp, Homo sapiens
caggtctgggcaa

SEQ ID NO: 1182804 - DNA, 22 bp, Homo sapiens
caggtctgggcaagtagcagga

SEQ ID NO: 1182805 - DNA, 13 bp, Homo sapiens
caggtctgtaact

SEQ ID NO: 1182806 - DNA, 19 bp, Homo sapiens
caggtctgtaactgcccag

SEQ ID NO: 1182807 - DNA, 22 bp, Homo sapiens
caggtctgtaactgcccagccc

SEQ ID NO: 1182808 - DNA, 13 bp, Homo sapiens
caggtgaataaag

SEQ ID NO: 1182809 - DNA, 13 bp, Homo sapiens
caggtgacaagcg

SEQ ID NO: 1182810 - DNA, 18 bp, Homo sapiens
caggtgaccttctgggaa

SEQ ID NO: 1182811 - DNA, 20 bp, Homo sapiens
caggtgacttctagcagaga

SEQ ID NO: 1182812 - DNA, 22 bp, Homo sapiens
caggtgacttctagcagagacc

SEQ ID NO: 1182813 - DNA, 13 bp, Homo sapiens
caggtgagaaact

SEQ ID NO: 1182814 - DNA, 22 bp, Homo sapiens
caggtgagaaactgtttgaaaa

SEQ ID NO: 1182815 - DNA, 16 bp, Homo sapiens
caggtgagaacatcca

SEQ ID NO: 1182816 - DNA, 13 bp, Homo sapiens
caggtgagaagca

SEQ ID NO: 1182817 - DNA, 14 bp, Homo sapiens
caggtgaggcccaa

SEQ ID NO: 1182818 - DNA, 20 bp, Homo sapiens
caggtgaggcccaagagccc

SEQ ID NO: 1182819 - DNA, 14 bp, Homo sapiens
caggtgaggggcag

SEQ ID NO: 1182820 - DNA, 16 bp, Homo sapiens
caggtgatctgcccgc

SEQ ID NO: 1182821 - DNA, 17 bp, Homo sapiens
caggtgatttcctctaa

SEQ ID NO: 1182822 - DNA, 15 bp, Homo sapiens
caggtgcacacatca

SEQ ID NO: 1182823 - DNA, 13 bp, Homo sapiens
caggtgcagacct

SEQ ID NO: 1182824 - DNA, 21 bp, Homo sapiens
caggtgcagaccttgggggaa

SEQ ID NO: 1182825 - DNA, 19 bp, Homo sapiens
caggtgcagccccagggcc

SEQ ID NO: 1182826 - DNA, 22 bp, Homo sapiens
caggtgcagccccagggcctgc

SEQ ID NO: 1182827 - DNA, 23 bp, Homo sapiens
caggtgcagccccagggcctgcg

SEQ ID NO: 1182828 - DNA, 15 bp, Homo sapiens
caggtgcagtggctc

SEQ ID NO: 1182829 - DNA, 19 bp, Homo sapiens
caggtgccactccctgagc

SEQ ID NO: 1182830 - DNA, 20 bp, Homo sapiens
caggtgccactccctgagct

SEQ ID NO: 1182831 - DNA, 16 bp, Homo sapiens
caggtgccactgaccg

SEQ ID NO: 1182832 - DNA, 15 bp, Homo sapiens
caggtgcctccaggt

SEQ ID NO: 1182833 - DNA, 17 bp, Homo sapiens
caggtgcctccaggtgt

SEQ ID NO: 1182834 - DNA, 15 bp, Homo sapiens
caggtgcctggacat

SEQ ID NO: 1182835 - DNA, 21 bp, Homo sapiens
caggtgccttacatcttttct

SEQ ID NO: 1182836 - DNA, 21 bp, Homo sapiens
caggtgcctttcaaatttaga

SEQ ID NO: 1182837 - DNA, 20 bp, Homo sapiens
caggtgcggcctggggggaa

SEQ ID NO: 1182838 - DNA, 20 bp, Homo sapiens
caggtgctaatttgttttgg

SEQ ID NO: 1182839 - DNA, 20 bp, Homo sapiens
caggtgctatgtcccaagag

SEQ ID NO: 1182840 - DNA, 13 bp, Homo sapiens
caggtgctgggct

SEQ ID NO: 1182841 - DNA, 14 bp, Homo sapiens
caggtgctgggctg

SEQ ID NO: 1182842 - DNA, 18 bp, Homo sapiens
caggtgcttctcaccacg

SEQ ID NO: 1182843 - DNA, 16 bp, Homo sapiens
caggtggaaggcagac

SEQ ID NO: 1182844 - DNA, 17 bp, Homo sapiens
caggtggagagcactag

SEQ ID NO: 1182845 - DNA, 17 bp, Homo sapiens
ctgcttttcattagcag

SEQ ID NO: 1182846 - DNA, 18 bp, Homo sapiens
ctgcttttcattagcagt

SEQ ID NO: 1182847 - DNA, 19 bp, Homo sapiens
ctgcttttccaggatcctg

SEQ ID NO: 1182848 - DNA, 21 bp, Homo sapiens
ctgcttttccaggatcctgca

SEQ ID NO: 1182849 - DNA, 14 bp, Homo sapiens
ctgcttttctgccc

SEQ ID NO: 1182850 - DNA, 15 bp, Homo sapiens
ctgcttttctgccct

SEQ ID NO: 1182851 - DNA, 22 bp, Homo sapiens
ctgcttttctgccctggctgct

SEQ ID NO: 1182852 - DNA, 18 bp, Homo sapiens
ctgcttttctgtcctggg

SEQ ID NO: 1182853 - DNA, 14 bp, Homo sapiens
ctgcttttcttaag

SEQ ID NO: 1182854 - DNA, 21 bp, Homo sapiens
ctgcttttcttaagtgcccac

SEQ ID NO: 1182855 - DNA, 18 bp, Homo sapiens
ctgcttttgatgatgtct

SEQ ID NO: 1182856 - DNA, 15 bp, Homo sapiens
ctgctttttttctta

SEQ ID NO: 1182857 - DNA, 23 bp, Homo sapiens
ctgctttttttcttaaaagtact

SEQ ID NO: 1182858 - DNA, 19 bp, Homo sapiens
ctgcttttttttttccagc

SEQ ID NO: 1182859 - DNA, 17 bp, Homo sapiens
ctggaaaacagaacact

SEQ ID NO: 1182860 - DNA, 19 bp, Homo sapiens
ctggaaaacagaacactta

SEQ ID NO: 1182861 - DNA, 16 bp, Homo sapiens
ctggaaaacagacggg

SEQ ID NO: 1182862 - DNA, 15 bp, Homo sapiens
ctggaaaactcagga

SEQ ID NO: 1182863 - DNA, 17 bp, Homo sapiens
ctggaaaactcaggatt

SEQ ID NO: 1182864 - DNA, 22 bp, Homo sapiens
ctggaaaagaagaaactttgcc

SEQ ID NO: 1182865 - DNA, 18 bp, Homo sapiens
ctggaaaatgtgacccag

SEQ ID NO: 1182866 - DNA, 14 bp, Homo sapiens
ctggaaacagcatg

SEQ ID NO: 1182867 - DNA, 19 bp, Homo sapiens
ctggaaacagcatgaataa

SEQ ID NO: 1182868 - DNA, 23 bp, Homo sapiens
ctggaaacagcatgaataaaaca

SEQ ID NO: 1182869 - DNA, 22 bp, Homo sapiens
ctggaaaccaagtcaggccagg

SEQ ID NO: 1182870 - DNA, 23 bp, Homo sapiens
ctggaaaccaagtcaggccaggt

SEQ ID NO: 1182871 - DNA, 15 bp, Homo sapiens
ctggaaactaccagg

SEQ ID NO: 1182872 - DNA, 21 bp, Homo sapiens
ctggaaacttttgttagggct

SEQ ID NO: 1182873 - DNA, 19 bp, Homo sapiens
ctggaaagcagagcctcct

SEQ ID NO: 1182874 - DNA, 21 bp, Homo sapiens
ctggaaagcagagcctcctgg

SEQ ID NO: 1182875 - DNA, 22 bp, Homo sapiens
ctggaaagcagagcctcctggg

SEQ ID NO: 1182876 - DNA, 23 bp, Homo sapiens
ctggaaagcagagcctcctggga

SEQ ID NO: 1182877 - DNA, 13 bp, Homo sapiens
ctggaaaggctca

SEQ ID NO: 1182878 - DNA, 17 bp, Homo sapiens
ctggaaaggctcagtct

SEQ ID NO: 1182879 - DNA, 22 bp, Homo sapiens
ctggaaaggctcagtctcagga

SEQ ID NO: 1182880 - DNA, 19 bp, Homo sapiens
ctggaaaggggagagcctg

SEQ ID NO: 1182881 - DNA, 21 bp, Homo sapiens
ctggaaaggggagagcctgct

SEQ ID NO: 1182882 - DNA, 23 bp, Homo sapiens
ctggaaaggggggagctggggaa

SEQ ID NO: 1182883 - DNA, 21 bp, Homo sapiens
ctggaaatctgttttgtatat

SEQ ID NO: 1182884 - DNA, 20 bp, Homo sapiens
ctggaaatgtagcacttacg

SEQ ID NO: 1182885 - DNA, 13 bp, Homo sapiens
ctggaaattccag

SEQ ID NO: 1182886 - DNA, 16 bp, Homo sapiens
ctggaaattccaggaa

SEQ ID NO: 1182887 - DNA, 12 bp, Homo sapiens
ctggaaattttg

SEQ ID NO: 1182888 - DNA, 23 bp, Homo sapiens
ctggaacaaatcgtttctcagaa

SEQ ID NO: 1182889 - DNA, 19 bp, Homo sapiens
ctggaacaaattatttttg

SEQ ID NO: 1182890 - DNA, 17 bp, Homo sapiens
ctggaacaacttgtagc

SEQ ID NO: 1182891 - DNA, 13 bp, Homo sapiens
ctggaacaatatt

SEQ ID NO: 1182892 - DNA, 16 bp, Homo sapiens
ctggaacatttgatat

SEQ ID NO: 1182893 - DNA, 20 bp, Homo sapiens
ctggaaccacattgaagaat

SEQ ID NO: 1182894 - DNA, 14 bp, Homo sapiens
ctggaaccagggag

SEQ ID NO: 1182895 - DNA, 17 bp, Homo sapiens
ctggaaccagggaggag

SEQ ID NO: 1182896 - DNA, 23 bp, Homo sapiens
ctggaaccagggaggagaggaaa

SEQ ID NO: 1182897 - DNA, 20 bp, Homo sapiens
ctggaacccacagacctcac

SEQ ID NO: 1182898 - DNA, 16 bp, Homo sapiens
ctggaacctgcaaaaa

SEQ ID NO: 1182899 - DNA, 16 bp, Homo sapiens
ctggaaccttgctgtc

SEQ ID NO: 1182900 - DNA, 19 bp, Homo sapiens
ctggaaccttgctgtcctg

SEQ ID NO: 1182901 - DNA, 14 bp, Homo sapiens
ctggaactgcatca

SEQ ID NO: 1182902 - DNA, 16 bp, Homo sapiens
ctggaacttgaactga

SEQ ID NO: 1182903 - DNA, 19 bp, Homo sapiens
ctggaacttgaactgattc

SEQ ID NO: 1182904 - DNA, 19 bp, Homo sapiens
ctggaactttagtgaaaca

SEQ ID NO: 1182905 - DNA, 19 bp, Homo sapiens
ctggaagaaactaaaaata

SEQ ID NO: 1182906 - DNA, 15 bp, Homo sapiens
ctggaagaacatcaa

SEQ ID NO: 1182907 - DNA, 15 bp, Homo sapiens
ctggaagacacttca

SEQ ID NO: 1182908 - DNA, 12 bp, Homo sapiens
ctggaagactgc

SEQ ID NO: 1182909 - DNA, 18 bp, Homo sapiens
ctggaagactgctcccgg

SEQ ID NO: 1182910 - DNA, 12 bp, Homo sapiens
ctggaagagagg

SEQ ID NO: 1182911 - DNA, 22 bp, Homo sapiens
ctggaagagcccagtctgttga

SEQ ID NO: 1182912 - DNA, 17 bp, Homo sapiens
ctggaagaggccttccc

SEQ ID NO: 1182913 - DNA, 17 bp, Homo sapiens
caggtttgaattaggct

SEQ ID NO: 1182914 - DNA, 19 bp, Homo sapiens
caggtttgagaaaaaggaa

SEQ ID NO: 1182915 - DNA, 15 bp, Homo sapiens
caggtttgccagtga

SEQ ID NO: 1182916 - DNA, 21 bp, Homo sapiens
caggtttgccagtgaagactt

SEQ ID NO: 1182917 - DNA, 21 bp, Homo sapiens
caggtttggggagggggaaga

SEQ ID NO: 1182918 - DNA, 18 bp, Homo sapiens
caggttttcttttaagaa

SEQ ID NO: 1182919 - DNA, 20 bp, Homo sapiens
caggttttgttttttttcag

SEQ ID NO: 1182920 - DNA, 18 bp, Homo sapiens
caggtttttaagttgtct

SEQ ID NO: 1182921 - DNA, 18 bp, Homo sapiens
cagtaaaaacttgtacta

SEQ ID NO: 1182922 - DNA, 15 bp, Homo sapiens
cagtaaaacacattt

SEQ ID NO: 1182923 - DNA, 18 bp, Homo sapiens
cagtaaaagccttattct

SEQ ID NO: 1182924 - DNA, 19 bp, Homo sapiens
cagtaaagtacctttatgt

SEQ ID NO: 1182925 - DNA, 17 bp, Homo sapiens
cagtaaataactggaaa

SEQ ID NO: 1182926 - DNA, 22 bp, Homo sapiens
cagtaaataactggaaaacaga

SEQ ID NO: 1182927 - DNA, 20 bp, Homo sapiens
cagtaaatacttgcagttgt

SEQ ID NO: 1182928 - DNA, 12 bp, Homo sapiens
cagtaaatcttt

SEQ ID NO: 1182929 - DNA, 19 bp, Homo sapiens
cagtaaatgggggtgcatt

SEQ ID NO: 1182930 - DNA, 22 bp, Homo sapiens
cagtaaatgggggtgcatttga

SEQ ID NO: 1182931 - DNA, 20 bp, Homo sapiens
cagtaacatttctgttctca

SEQ ID NO: 1182932 - DNA, 22 bp, Homo sapiens
cagtaaccaaaacagcatagta

SEQ ID NO: 1182933 - DNA, 21 bp, Homo sapiens
cagtaacgcgtcttcctgagt

SEQ ID NO: 1182934 - DNA, 16 bp, Homo sapiens
cagtaacgtgctgctc

SEQ ID NO: 1182935 - DNA, 18 bp, Homo sapiens
cagtaactttatgtgtaa

SEQ ID NO: 1182936 - DNA, 18 bp, Homo sapiens
cagtaacttttttgtgta

SEQ ID NO: 1182937 - DNA, 19 bp, Homo sapiens
cagtaacttttttgtgtat

SEQ ID NO: 1182938 - DNA, 21 bp, Homo sapiens
cagtaacttttttgtgtatgt

SEQ ID NO: 1182939 - DNA, 19 bp, Homo sapiens
cagtaagctgctctattgt

SEQ ID NO: 1182940 - DNA, 13 bp, Homo sapiens
cagtaaggcaggg

SEQ ID NO: 1182941 - DNA, 14 bp, Homo sapiens
cagtaagtcttttt

SEQ ID NO: 1182942 - DNA, 13 bp, Homo sapiens
cagtaataactct

SEQ ID NO: 1182943 - DNA, 14 bp, Homo sapiens
cagtaatatgttta

SEQ ID NO: 1182944 - DNA, 13 bp, Homo sapiens
cagtaatatttat

SEQ ID NO: 1182945 - DNA, 20 bp, Homo sapiens
cagtaatcccatttcccaaa

SEQ ID NO: 1182946 - DNA, 16 bp, Homo sapiens
cagtaatcctggggga

SEQ ID NO: 1182947 - DNA, 20 bp, Homo sapiens
cagtaatgctgcaggaaaag

SEQ ID NO: 1182948 - DNA, 14 bp, Homo sapiens
cagtaattgtgaca

SEQ ID NO: 1182949 - DNA, 11 bp, Homo sapiens
cagtaatttat

SEQ ID NO: 1182950 - DNA, 20 bp, Homo sapiens
cagtacaacccataatcatg

SEQ ID NO: 1182951 - DNA, 21 bp, Homo sapiens
cagtacaacccataatcatgt

SEQ ID NO: 1182952 - DNA, 22 bp, Homo sapiens
cagtacaacccataatcatgta

SEQ ID NO: 1182953 - DNA, 16 bp, Homo sapiens
cagtacaggggtgctg

SEQ ID NO: 1182954 - DNA, 22 bp, Homo sapiens
cagtacatttaaattttttggc

SEQ ID NO: 1182955 - DNA, 23 bp, Homo sapiens
cagtaccccatggagctgggcta

SEQ ID NO: 1182956 - DNA, 14 bp, Homo sapiens
cagtaccctctcag

SEQ ID NO: 1182957 - DNA, 16 bp, Homo sapiens
cagtacctgattgtat

SEQ ID NO: 1182958 - DNA, 20 bp, Homo sapiens
cagtacctgattgtattttt

SEQ ID NO: 1182959 - DNA, 18 bp, Homo sapiens
cagtacctgggaaaggac

SEQ ID NO: 1182960 - DNA, 13 bp, Homo sapiens
cagtaccttgctt

SEQ ID NO: 1182961 - DNA, 18 bp, Homo sapiens
cagtacgtcccgctgctg

SEQ ID NO: 1182962 - DNA, 16 bp, Homo sapiens
cagtactttattgtac

SEQ ID NO: 1182963 - DNA, 16 bp, Homo sapiens
cagtactttggaggcc

SEQ ID NO: 1182964 - DNA, 20 bp, Homo sapiens
cagtactttggaggccccta

SEQ ID NO: 1182965 - DNA, 18 bp, Homo sapiens
cagtactttgtgcattct

SEQ ID NO: 1182966 - DNA, 14 bp, Homo sapiens
cagtccacagctga

SEQ ID NO: 1182967 - DNA, 21 bp, Homo sapiens
cagtccacaggggccaccacc

SEQ ID NO: 1182968 - DNA, 15 bp, Homo sapiens
cagtccactcctgac

SEQ ID NO: 1182969 - DNA, 16 bp, Homo sapiens
cagtccagacccaagt

SEQ ID NO: 1182970 - DNA, 11 bp, Homo sapiens
cagtccagagc

SEQ ID NO: 1182971 - DNA, 15 bp, Homo sapiens
cagtccagagctttt

SEQ ID NO: 1182972 - DNA, 15 bp, Homo sapiens
cagtccaggaacaag

SEQ ID NO: 1182973 - DNA, 15 bp, Homo sapiens
cagtccatttcctaa

SEQ ID NO: 1182974 - DNA, 13 bp, Homo sapiens
cagtcccacactg

SEQ ID NO: 1182975 - DNA, 15 bp, Homo sapiens
cagtcccacactgtg

SEQ ID NO: 1182976 - DNA, 18 bp, Homo sapiens
cagtcccacactgtgcag

SEQ ID NO: 1182977 - DNA, 19 bp, Homo sapiens
cagtcccacactgtggcca

SEQ ID NO: 1182978 - DNA, 21 bp, Homo sapiens
cagtcccagacaattccattc

SEQ ID NO: 1182979 - DNA, 22 bp, Homo sapiens
cagtcccagacaattccattca

SEQ ID NO: 1182980 - DNA, 22 bp, Homo sapiens
cagtcccagggaaggtggggcc

SEQ ID NO: 1182981 - DNA, 21 bp, Homo sapiens
cagtcccattcctccactctg

SEQ ID NO: 1182982 - DNA, 15 bp, Homo sapiens
cagtccccacccctg

SEQ ID NO: 1182983 - DNA, 19 bp, Homo sapiens
cagtccccacccctgcccc

SEQ ID NO: 1182984 - DNA, 20 bp, Homo sapiens
cagtccccacccctgccccc

SEQ ID NO: 1182985 - DNA, 12 bp, Homo sapiens
cagtccccagcc

SEQ ID NO: 1182986 - DNA, 13 bp, Homo sapiens
cagtccccagccc

SEQ ID NO: 1182987 - DNA, 16 bp, Homo sapiens
cagtccccagccctgg

SEQ ID NO: 1182988 - DNA, 19 bp, Homo sapiens
cagtccccagcccttctgc

SEQ ID NO: 1182989 - DNA, 13 bp, Homo sapiens
cagtcccccaccc

SEQ ID NO: 1182990 - DNA, 15 bp, Homo sapiens
cagtcccccacccac

SEQ ID NO: 1182991 - DNA, 18 bp, Homo sapiens
cagtcccccacccacctc

SEQ ID NO: 1182992 - DNA, 12 bp, Homo sapiens
cagtccccgagg

SEQ ID NO: 1182993 - DNA, 20 bp, Homo sapiens
cagtccccgaggagctgggc

SEQ ID NO: 1182994 - DNA, 18 bp, Homo sapiens
cagtccccgtgccccgcc

SEQ ID NO: 1182995 - DNA, 14 bp, Homo sapiens
cagtcccctcccat

SEQ ID NO: 1182996 - DNA, 19 bp, Homo sapiens
cagtcccctcccatctggg

SEQ ID NO: 1182997 - DNA, 22 bp, Homo sapiens
cagtcccctcccatctgggagt

SEQ ID NO: 1182998 - DNA, 14 bp, Homo sapiens
cagtcccctctctc

SEQ ID NO: 1182999 - DNA, 20 bp, Homo sapiens
cagtcccctctctctgggtc

SEQ ID NO: 1183000 - DNA, 23 bp, Homo sapiens
cagtcccgggagaaaagacggat

SEQ ID NO: 1183001 - DNA, 19 bp, Homo sapiens
cagtccgtcaaaacagatt

SEQ ID NO: 1183002 - DNA, 15 bp, Homo sapiens
cagtcctaagaaaga

SEQ ID NO: 1183003 - DNA, 21 bp, Homo sapiens
cagtcctactcaagcgggtgg

SEQ ID NO: 1183004 - DNA, 19 bp, Homo sapiens
cagtcctatgtacagagct

SEQ ID NO: 1183005 - DNA, 15 bp, Homo sapiens
cagtcctatttttca

SEQ ID NO: 1183006 - DNA, 11 bp, Homo sapiens
cagtcctccat

SEQ ID NO: 1183007 - DNA, 13 bp, Homo sapiens
cagtcctccatcc

SEQ ID NO: 1183008 - DNA, 14 bp, Homo sapiens
cagtcctccatcca

SEQ ID NO: 1183009 - DNA, 18 bp, Homo sapiens
cagtcctccggggtgggt

SEQ ID NO: 1183010 - DNA, 22 bp, Homo sapiens
cagtcctgatcagagccgtggt

SEQ ID NO: 1183011 - DNA, 17 bp, Homo sapiens
cagtcctgcctcagcct

SEQ ID NO: 1183012 - DNA, 15 bp, Homo sapiens
cagtcctgctccaga

SEQ ID NO: 1183013 - DNA, 14 bp, Homo sapiens
cagtcctggtcctg

SEQ ID NO: 1183014 - DNA, 18 bp, Homo sapiens
cagtcctggtccttccac

SEQ ID NO: 1183015 - DNA, 17 bp, Homo sapiens
cagtccttactccccca

SEQ ID NO: 1183016 - DNA, 19 bp, Homo sapiens
cagtccttattatcccagc

SEQ ID NO: 1183017 - DNA, 15 bp, Homo sapiens
cagtccttgctttgg

SEQ ID NO: 1183018 - DNA, 13 bp, Homo sapiens
cagtcctttccca

SEQ ID NO: 1183019 - DNA, 22 bp, Homo sapiens
cagtcctttcccaccattcctg

SEQ ID NO: 1183020 - DNA, 15 bp, Homo sapiens
cagtcgggagagcca

SEQ ID NO: 1183021 - DNA, 18 bp, Homo sapiens
cagtcgggagagccaggc

SEQ ID NO: 1183022 - DNA, 14 bp, Homo sapiens
cagtcgggggctgg

SEQ ID NO: 1183023 - DNA, 17 bp, Homo sapiens
cagtcgggggctggcct

SEQ ID NO: 1183024 - DNA, 21 bp, Homo sapiens
cagtcgtggctttggcagtgt

SEQ ID NO: 1183025 - DNA, 15 bp, Homo sapiens
cagtcgttagaatat

SEQ ID NO: 1183026 - DNA, 16 bp, Homo sapiens
cagtcgttcccagtgt

SEQ ID NO: 1183027 - DNA, 22 bp, Homo sapiens
cagtctaaagctggtttaatgt

SEQ ID NO: 1183028 - DNA, 18 bp, Homo sapiens
cagtctaacagtttgcct

SEQ ID NO: 1183029 - DNA, 17 bp, Homo sapiens
cagtctaccctgtcctt

SEQ ID NO: 1183030 - DNA, 21 bp, Homo sapiens
cagtctaccctgtcctttgca

SEQ ID NO: 1183031 - DNA, 13 bp, Homo sapiens
cagtctatttcca

SEQ ID NO: 1183032 - DNA, 15 bp, Homo sapiens
cagtctatttccatt

SEQ ID NO: 1183033 - DNA, 18 bp, Homo sapiens
cagtctatttccattctt

SEQ ID NO: 1183034 - DNA, 19 bp, Homo sapiens
cagtctcactgtgggaagg

SEQ ID NO: 1183035 - DNA, 21 bp, Homo sapiens
cagtctcagaatgtcattttg

SEQ ID NO: 1183036 - DNA, 13 bp, Homo sapiens
cagtctcaggagc

SEQ ID NO: 1183037 - DNA, 15 bp, Homo sapiens
cagtctcatctcctg

SEQ ID NO: 1183038 - DNA, 15 bp, Homo sapiens
cagtctccagggacc

SEQ ID NO: 1183039 - DNA, 20 bp, Homo sapiens
cagtctcccaggccccctgc

SEQ ID NO: 1183040 - DNA, 14 bp, Homo sapiens
cagtctccctgatg

SEQ ID NO: 1183041 - DNA, 16 bp, Homo sapiens
cagtctccctgatgga

SEQ ID NO: 1183042 - DNA, 11 bp, Homo sapiens
cagtctccctt

SEQ ID NO: 1183043 - DNA, 22 bp, Homo sapiens
cagtctccctttcccttcttgg

SEQ ID NO: 1183044 - DNA, 20 bp, Homo sapiens
ctggactgtcatagaaatta

SEQ ID NO: 1183045 - DNA, 19 bp, Homo sapiens
ctggactgttccaggccct

SEQ ID NO: 1183046 - DNA, 20 bp, Homo sapiens
ctggactgttccaggccctc

SEQ ID NO: 1183047 - DNA, 22 bp, Homo sapiens
ctggactgttccaggccctcca

SEQ ID NO: 1183048 - DNA, 23 bp, Homo sapiens
ctggactgttccaggccctccag

SEQ ID NO: 1183049 - DNA, 19 bp, Homo sapiens
ctggacttaaagaaaaaaa

SEQ ID NO: 1183050 - DNA, 23 bp, Homo sapiens
ctggacttaagcatctggctcta

SEQ ID NO: 1183051 - DNA, 13 bp, Homo sapiens
ctggacttacaaa

SEQ ID NO: 1183052 - DNA, 16 bp, Homo sapiens
ctggacttacaaaatg

SEQ ID NO: 1183053 - DNA, 19 bp, Homo sapiens
ctggacttctacctgccct

SEQ ID NO: 1183054 - DNA, 20 bp, Homo sapiens
ctggacttctacctgccctc

SEQ ID NO: 1183055 - DNA, 23 bp, Homo sapiens
ctggacttctacctgccctcaag

SEQ ID NO: 1183056 - DNA, 18 bp, Homo sapiens
ctggacttgagcttggca

SEQ ID NO: 1183057 - DNA, 13 bp, Homo sapiens
ctggactttcctg

SEQ ID NO: 1183058 - DNA, 15 bp, Homo sapiens
ctggactttcctgca

SEQ ID NO: 1183059 - DNA, 18 bp, Homo sapiens
ctggactttcctgttgtc

SEQ ID NO: 1183060 - DNA, 18 bp, Homo sapiens
ctggactttctctaataa

SEQ ID NO: 1183061 - DNA, 21 bp, Homo sapiens
ctggactttctctaataataa

SEQ ID NO: 1183062 - DNA, 15 bp, Homo sapiens
ctggagaactagaga

SEQ ID NO: 1183063 - DNA, 18 bp, Homo sapiens
ctggagaagaatatcaaa

SEQ ID NO: 1183064 - DNA, 19 bp, Homo sapiens
ctggagaagaccctccccg

SEQ ID NO: 1183065 - DNA, 15 bp, Homo sapiens
ctggagaagcaccag

SEQ ID NO: 1183066 - DNA, 14 bp, Homo sapiens
ctggagaagcagtg

SEQ ID NO: 1183067 - DNA, 19 bp, Homo sapiens
ctggagaagctcacccaat

SEQ ID NO: 1183068 - DNA, 15 bp, Homo sapiens
ctggagaagctccca

SEQ ID NO: 1183069 - DNA, 19 bp, Homo sapiens
ctggagaagctcccaggaa

SEQ ID NO: 1183070 - DNA, 17 bp, Homo sapiens
ctggagacaaggtgcta

SEQ ID NO: 1183071 - DNA, 18 bp, Homo sapiens
ctggagaccagggagcct

SEQ ID NO: 1183072 - DNA, 21 bp, Homo sapiens
ctggagaccgcttcacccctg

SEQ ID NO: 1183073 - DNA, 22 bp, Homo sapiens
ctggagaccgcttcacccctgc

SEQ ID NO: 1183074 - DNA, 21 bp, Homo sapiens
ctggagacgtggaacctctgt

SEQ ID NO: 1183075 - DNA, 22 bp, Homo sapiens
ctggagacgtggaacctctgtc

SEQ ID NO: 1183076 - DNA, 14 bp, Homo sapiens
ctggagacttcctc

SEQ ID NO: 1183077 - DNA, 20 bp, Homo sapiens
ctggagagcacagcatgcct

SEQ ID NO: 1183078 - DNA, 20 bp, Homo sapiens
ctggagaggacggccctgcc

SEQ ID NO: 1183079 - DNA, 23 bp, Homo sapiens
ctggagaggagggatgctgcctg

SEQ ID NO: 1183080 - DNA, 15 bp, Homo sapiens
ctggagaggcctggg

SEQ ID NO: 1183081 - DNA, 17 bp, Homo sapiens
ctggagaggcctggggt

SEQ ID NO: 1183082 - DNA, 18 bp, Homo sapiens
ctggagataacagcctct

SEQ ID NO: 1183083 - DNA, 19 bp, Homo sapiens
ctggagataacagcctctt

SEQ ID NO: 1183084 - DNA, 17 bp, Homo sapiens
ctggagatagctggggc

SEQ ID NO: 1183085 - DNA, 18 bp, Homo sapiens
ctggagatagctggggct

SEQ ID NO: 1183086 - DNA, 19 bp, Homo sapiens
ctggagatagctggggctt

SEQ ID NO: 1183087 - DNA, 14 bp, Homo sapiens
ctggagatcctcct

SEQ ID NO: 1183088 - DNA, 15 bp, Homo sapiens
ctggagtttctctaa

SEQ ID NO: 1183089 - DNA, 14 bp, Homo sapiens
ctggatactggaca

SEQ ID NO: 1183090 - DNA, 22 bp, Homo sapiens
ctggatagacttgggatgggga

SEQ ID NO: 1183091 - DNA, 18 bp, Homo sapiens
ctggatagttaagggctt

SEQ ID NO: 1183092 - DNA, 16 bp, Homo sapiens
ctggatataatgtatt

SEQ ID NO: 1183093 - DNA, 20 bp, Homo sapiens
ctggatatgttgttaaacac

SEQ ID NO: 1183094 - DNA, 21 bp, Homo sapiens
ctggatattttcaaattgtat

SEQ ID NO: 1183095 - DNA, 14 bp, Homo sapiens
ctggatcacagctg

SEQ ID NO: 1183096 - DNA, 16 bp, Homo sapiens
ctggatcacagctgct

SEQ ID NO: 1183097 - DNA, 22 bp, Homo sapiens
ctggatcacagctgctttctgt

SEQ ID NO: 1183098 - DNA, 20 bp, Homo sapiens
ctggatcacgacgctgcaga

SEQ ID NO: 1183099 - DNA, 21 bp, Homo sapiens
ctggatcacgacgctgcagag

SEQ ID NO: 1183100 - DNA, 13 bp, Homo sapiens
ctggatcagggaa

SEQ ID NO: 1183101 - DNA, 17 bp, Homo sapiens
ctggatccagcactggt

SEQ ID NO: 1183102 - DNA, 22 bp, Homo sapiens
ctggatcccgaggtatggcaga

SEQ ID NO: 1183103 - DNA, 21 bp, Homo sapiens
ctggatccctgcccttctcaa

SEQ ID NO: 1183104 - DNA, 23 bp, Homo sapiens
ctggatcctagccttatcctctg

SEQ ID NO: 1183105 - DNA, 15 bp, Homo sapiens
ctggatctacctgga

SEQ ID NO: 1183106 - DNA, 16 bp, Homo sapiens
ctggatctacctggag

SEQ ID NO: 1183107 - DNA, 18 bp, Homo sapiens
ctggatctacctggaggg

SEQ ID NO: 1183108 - DNA, 16 bp, Homo sapiens
ctggatctatccctgc

SEQ ID NO: 1183109 - DNA, 23 bp, Homo sapiens
ctggatctatccctgcggcctcc

SEQ ID NO: 1183110 - DNA, 15 bp, Homo sapiens
ctggatctccccact

SEQ ID NO: 1183111 - DNA, 15 bp, Homo sapiens
ctggatctcctgctg

SEQ ID NO: 1183112 - DNA, 19 bp, Homo sapiens
ctggatctgaccctcccag

SEQ ID NO: 1183113 - DNA, 21 bp, Homo sapiens
ctggatctgaccctcccagtc

SEQ ID NO: 1183114 - DNA, 21 bp, Homo sapiens
ctggatctgggaccctttcct

SEQ ID NO: 1183115 - DNA, 22 bp, Homo sapiens
ctggatgaaataactccttctt

SEQ ID NO: 1183116 - DNA, 13 bp, Homo sapiens
ctggatgaagatt

SEQ ID NO: 1183117 - DNA, 13 bp, Homo sapiens
ctggatgagactt

SEQ ID NO: 1183118 - DNA, 22 bp, Homo sapiens
ctggatgagtagcgctatagtt

SEQ ID NO: 1183119 - DNA, 14 bp, Homo sapiens
ctggatgatactaa

SEQ ID NO: 1183120 - DNA, 16 bp, Homo sapiens
ctggatgatggattcc

SEQ ID NO: 1183121 - DNA, 15 bp, Homo sapiens
ctggatgcccaggaa

SEQ ID NO: 1183122 - DNA, 16 bp, Homo sapiens
ctggatgccttccccc

SEQ ID NO: 1183123 - DNA, 11 bp, Homo sapiens
ctggatggaca

SEQ ID NO: 1183124 - DNA, 13 bp, Homo sapiens
ctggatggacaga

SEQ ID NO: 1183125 - DNA, 21 bp, Homo sapiens
ctggatggaggaaaaccaagc

SEQ ID NO: 1183126 - DNA, 15 bp, Homo sapiens
ctggatggcaccaga

SEQ ID NO: 1183127 - DNA, 13 bp, Homo sapiens
ctggatgggaaag

SEQ ID NO: 1183128 - DNA, 23 bp, Homo sapiens
ctggatgggactccatagctcct

SEQ ID NO: 1183129 - DNA, 21 bp, Homo sapiens
ctggatgggaggagagccact

SEQ ID NO: 1183130 - DNA, 22 bp, Homo sapiens
ctggatgggaggagagccactg

SEQ ID NO: 1183131 - DNA, 20 bp, Homo sapiens
ctggatgtcccctgtcccac

SEQ ID NO: 1183132 - DNA, 23 bp, Homo sapiens
ctggatgtgaagctcacactgat

SEQ ID NO: 1183133 - DNA, 16 bp, Homo sapiens
ctggattaggagggtg

SEQ ID NO: 1183134 - DNA, 16 bp, Homo sapiens
ctggattcatttcctg

SEQ ID NO: 1183135 - DNA, 18 bp, Homo sapiens
ctggattcatttcctgcc

SEQ ID NO: 1183136 - DNA, 19 bp, Homo sapiens
ctggattctgggaggcaag

SEQ ID NO: 1183137 - DNA, 12 bp, Homo sapiens
ctggattttgaa

SEQ ID NO: 1183138 - DNA, 13 bp, Homo sapiens
ctggattttgaac

SEQ ID NO: 1183139 - DNA, 15 bp, Homo sapiens
ctggattttgaatta

SEQ ID NO: 1183140 - DNA, 21 bp, Homo sapiens
ctggattttttatgtacaacc

SEQ ID NO: 1183141 - DNA, 23 bp, Homo sapiens
ctggattttttatgtacaaccct

SEQ ID NO: 1183142 - DNA, 18 bp, Homo sapiens
ctggcaaaccctcccaga

SEQ ID NO: 1183143 - DNA, 20 bp, Homo sapiens
ctggcaaaccctcccagaaa

SEQ ID NO: 1183144 - DNA, 19 bp, Homo sapiens
ctggcaaagcagaatgtga

SEQ ID NO: 1183145 - DNA, 16 bp, Homo sapiens
ctggcaacacagaggc

SEQ ID NO: 1183146 - DNA, 17 bp, Homo sapiens
ctggcaagcagggaaag

SEQ ID NO: 1183147 - DNA, 19 bp, Homo sapiens
ctggcaaggactttgtaca

SEQ ID NO: 1183148 - DNA, 13 bp, Homo sapiens
ctggcaataaact

SEQ ID NO: 1183149 - DNA, 14 bp, Homo sapiens
ctggcaataaactc

SEQ ID NO: 1183150 - DNA, 20 bp, Homo sapiens
ctggcaatagtgtgttctga

SEQ ID NO: 1183151 - DNA, 15 bp, Homo sapiens
ctggcaatcccacca

SEQ ID NO: 1183152 - DNA, 21 bp, Homo sapiens
ctggcaatgaaaaattctcag

SEQ ID NO: 1183153 - DNA, 19 bp, Homo sapiens
ctggcaatgtttatttcat

SEQ ID NO: 1183154 - DNA, 15 bp, Homo sapiens
ctggcaattgtctat

SEQ ID NO: 1183155 - DNA, 17 bp, Homo sapiens
ctggcacacacccctcc

SEQ ID NO: 1183156 - DNA, 13 bp, Homo sapiens
ctggcacactccc

SEQ ID NO: 1183157 - DNA, 16 bp, Homo sapiens
ctggcacagaaacctc

SEQ ID NO: 1183158 - DNA, 16 bp, Homo sapiens
ctggcacagaccaggc

SEQ ID NO: 1183159 - DNA, 12 bp, Homo sapiens
ctggcacagagg

SEQ ID NO: 1183160 - DNA, 15 bp, Homo sapiens
ctggcacagtgatgc

SEQ ID NO: 1183161 - DNA, 16 bp, Homo sapiens
ctggcacagtgatgcc

SEQ ID NO: 1183162 - DNA, 18 bp, Homo sapiens
ctggcacattcattttct

SEQ ID NO: 1183163 - DNA, 14 bp, Homo sapiens
ctggcaccatggtg

SEQ ID NO: 1183164 - DNA, 17 bp, Homo sapiens
ctggcacccaccgtctc

SEQ ID NO: 1183165 - DNA, 23 bp, Homo sapiens
ctggcactataatgtaagctcta

SEQ ID NO: 1183166 - DNA, 13 bp, Homo sapiens
ctggcactgaacc

SEQ ID NO: 1183167 - DNA, 19 bp, Homo sapiens
ctggcactgagcctgcttg

SEQ ID NO: 1183168 - DNA, 19 bp, Homo sapiens
ctggcacttagcccaagag

SEQ ID NO: 1183169 - DNA, 23 bp, Homo sapiens
ctggcacttagcccaagaggtct

SEQ ID NO: 1183170 - DNA, 14 bp, Homo sapiens
ctggcacttggaga

SEQ ID NO: 1183171 - DNA, 18 bp, Homo sapiens
ctggcagaaacaggaggc

SEQ ID NO: 1183172 - DNA, 17 bp, Homo sapiens
ctggcagaactgagctc

SEQ ID NO: 1183173 - DNA, 18 bp, Homo sapiens
ctggcagaactgagctcc

SEQ ID NO: 1183174 - DNA, 21 bp, Homo sapiens
cagtgatctccatatgttaca

SEQ ID NO: 1183175 - DNA, 16 bp, Homo sapiens
cagtgatgacttgctg

SEQ ID NO: 1183176 - DNA, 21 bp, Homo sapiens
cagtgatgacttgctgtccag

SEQ ID NO: 1183177 - DNA, 22 bp, Homo sapiens
cagtgatgacttgctgtccagg

SEQ ID NO: 1183178 - DNA, 18 bp, Homo sapiens
cagtgatgatgttttgat

SEQ ID NO: 1183179 - DNA, 19 bp, Homo sapiens
cagtgatgatgttttgata

SEQ ID NO: 1183180 - DNA, 13 bp, Homo sapiens
cagtgatgccggg

SEQ ID NO: 1183181 - DNA, 14 bp, Homo sapiens
cagtgatgccgggc

SEQ ID NO: 1183182 - DNA, 23 bp, Homo sapiens
cagtgatggcgcgggaggcacca

SEQ ID NO: 1183183 - DNA, 23 bp, Homo sapiens
cagtgatgtaccatgaaacaaag

SEQ ID NO: 1183184 - DNA, 14 bp, Homo sapiens
cagtgattagcact

SEQ ID NO: 1183185 - DNA, 22 bp, Homo sapiens
cagtgatttttttcttgtaatt

SEQ ID NO: 1183186 - DNA, 18 bp, Homo sapiens
cagtgcaaaccacttctc

SEQ ID NO: 1183187 - DNA, 17 bp, Homo sapiens
cagtgcaaattgtatct

SEQ ID NO: 1183188 - DNA, 19 bp, Homo sapiens
cagtgcaatgcttgtagaa

SEQ ID NO: 1183189 - DNA, 22 bp, Homo sapiens
cagtgcaatggtataaatttca

SEQ ID NO: 1183190 - DNA, 13 bp, Homo sapiens
cagtgcactccgg

SEQ ID NO: 1183191 - DNA, 14 bp, Homo sapiens
cagtgcactgaaag

SEQ ID NO: 1183192 - DNA, 16 bp, Homo sapiens
cagtgcagagccttct

SEQ ID NO: 1183193 - DNA, 19 bp, Homo sapiens
cagtgcagagccttctcag

SEQ ID NO: 1183194 - DNA, 13 bp, Homo sapiens
cagtgcagccact

SEQ ID NO: 1183195 - DNA, 16 bp, Homo sapiens
cagtgcagccactggc

SEQ ID NO: 1183196 - DNA, 15 bp, Homo sapiens
cagtgcagtttctaa

SEQ ID NO: 1183197 - DNA, 18 bp, Homo sapiens
cagtgcagtttcttttca

SEQ ID NO: 1183198 - DNA, 15 bp, Homo sapiens
cagtgcatgacgttt

SEQ ID NO: 1183199 - DNA, 13 bp, Homo sapiens
cagtgcatgcatg

SEQ ID NO: 1183200 - DNA, 19 bp, Homo sapiens
cagtgcattttgtttctgt

SEQ ID NO: 1183201 - DNA, 16 bp, Homo sapiens
cagtgccacagcctgc

SEQ ID NO: 1183202 - DNA, 19 bp, Homo sapiens
cagtgccacagcctgctgg

SEQ ID NO: 1183203 - DNA, 20 bp, Homo sapiens
cagtgccacctatgcctgtg

SEQ ID NO: 1183204 - DNA, 23 bp, Homo sapiens
cagtgccacctatgcctgtggtg

SEQ ID NO: 1183205 - DNA, 14 bp, Homo sapiens
cagtgccactgccc

SEQ ID NO: 1183206 - DNA, 17 bp, Homo sapiens
cagtgccactgcccccc

SEQ ID NO: 1183207 - DNA, 13 bp, Homo sapiens
cagtgccagctcc

SEQ ID NO: 1183208 - DNA, 23 bp, Homo sapiens
cagtgccagctccagtgccgctc

SEQ ID NO: 1183209 - DNA, 12 bp, Homo sapiens
cagtgccagggt

SEQ ID NO: 1183210 - DNA, 22 bp, Homo sapiens
cagtggtggcaacattcattgc

SEQ ID NO: 1183211 - DNA, 18 bp, Homo sapiens
cagtggtggttttctgtt

SEQ ID NO: 1183212 - DNA, 21 bp, Homo sapiens
cagtggtgtgctctgggctca

SEQ ID NO: 1183213 - DNA, 14 bp, Homo sapiens
cagtggttgctgtt

SEQ ID NO: 1183214 - DNA, 20 bp, Homo sapiens
cagtggttttatactgaagg

SEQ ID NO: 1183215 - DNA, 17 bp, Homo sapiens
cagtgtacaaaactgta

SEQ ID NO: 1183216 - DNA, 20 bp, Homo sapiens
cagtgtacaaaactgtaaat

SEQ ID NO: 1183217 - DNA, 22 bp, Homo sapiens
cagtgtacacgtctggaccccg

SEQ ID NO: 1183218 - DNA, 16 bp, Homo sapiens
cagtgtacatggaata

SEQ ID NO: 1183219 - DNA, 20 bp, Homo sapiens
cagtgtagattttatagtgt

SEQ ID NO: 1183220 - DNA, 18 bp, Homo sapiens
cagtgtagcatcttcctc

SEQ ID NO: 1183221 - DNA, 19 bp, Homo sapiens
cagtgtagcgggaggaagc

SEQ ID NO: 1183222 - DNA, 17 bp, Homo sapiens
cagtgtatggaaataaa

SEQ ID NO: 1183223 - DNA, 18 bp, Homo sapiens
cagtgtatggggctgcag

SEQ ID NO: 1183224 - DNA, 19 bp, Homo sapiens
cagtgtattgtttattata

SEQ ID NO: 1183225 - DNA, 15 bp, Homo sapiens
cagtgtatttgtatt

SEQ ID NO: 1183226 - DNA, 23 bp, Homo sapiens
cagtgtatttgtatttttttgca

SEQ ID NO: 1183227 - DNA, 12 bp, Homo sapiens
cagtgtattttg

SEQ ID NO: 1183228 - DNA, 20 bp, Homo sapiens
cagtgtcaagttgtgcttgt

SEQ ID NO: 1183229 - DNA, 15 bp, Homo sapiens
cagtgtcagcgggtg

SEQ ID NO: 1183230 - DNA, 19 bp, Homo sapiens
cagtgtcagggtccaggag

SEQ ID NO: 1183231 - DNA, 20 bp, Homo sapiens
cagtgtcatttatgaaaaga

SEQ ID NO: 1183232 - DNA, 21 bp, Homo sapiens
cagtgtcattttattttttcc

SEQ ID NO: 1183233 - DNA, 15 bp, Homo sapiens
cagtgtccagcttcc

SEQ ID NO: 1183234 - DNA, 13 bp, Homo sapiens
cagtgtcccaggc

SEQ ID NO: 1183235 - DNA, 15 bp, Homo sapiens
cagtgtcccaggcag

SEQ ID NO: 1183236 - DNA, 15 bp, Homo sapiens
cagtgtcccctccac

SEQ ID NO: 1183237 - DNA, 17 bp, Homo sapiens
cagtgtcccctccactg

SEQ ID NO: 1183238 - DNA, 19 bp, Homo sapiens
cagtgtcccctccactgtc

SEQ ID NO: 1183239 - DNA, 20 bp, Homo sapiens
cagtgtcccctccactgtca

SEQ ID NO: 1183240 - DNA, 18 bp, Homo sapiens
cagtgtcctcttgctcaa

SEQ ID NO: 1183241 - DNA, 19 bp, Homo sapiens
cagtgtcctcttgctcaaa

SEQ ID NO: 1183242 - DNA, 18 bp, Homo sapiens
cagtgtcctgtgctttct

SEQ ID NO: 1183243 - DNA, 16 bp, Homo sapiens
cagtgtccttagaaca

SEQ ID NO: 1183244 - DNA, 20 bp, Homo sapiens
cagtgtctcacagccctgct

SEQ ID NO: 1183245 - DNA, 19 bp, Homo sapiens
cagtgtctgtaaaagagcc

SEQ ID NO: 1183246 - DNA, 22 bp, Homo sapiens
cagtgtctgtatcggagacagt

SEQ ID NO: 1183247 - DNA, 17 bp, Homo sapiens
cagtgtctgtgccatgg

SEQ ID NO: 1183248 - DNA, 16 bp, Homo sapiens
cagtgtcttccataat

SEQ ID NO: 1183249 - DNA, 17 bp, Homo sapiens
cagtgtcttccataatg

SEQ ID NO: 1183250 - DNA, 22 bp, Homo sapiens
cagtgtcttccataatgtataa

SEQ ID NO: 1183251 - DNA, 20 bp, Homo sapiens
cagtgtctttctagccataa

SEQ ID NO: 1183252 - DNA, 21 bp, Homo sapiens
cagtgtctttttttgtatagt

SEQ ID NO: 1183253 - DNA, 22 bp, Homo sapiens
cagtgtgcacgagtgggaagga

SEQ ID NO: 1183254 - DNA, 19 bp, Homo sapiens
cagtgtgcacgcctgcagg

SEQ ID NO: 1183255 - DNA, 19 bp, Homo sapiens
cagtgtgcactaaggggcc

SEQ ID NO: 1183256 - DNA, 13 bp, Homo sapiens
cagtgtgcatggg

SEQ ID NO: 1183257 - DNA, 17 bp, Homo sapiens
cagtgtgcccaaaagcc

SEQ ID NO: 1183258 - DNA, 20 bp, Homo sapiens
cagtgtgcccaaaagccatg

SEQ ID NO: 1183259 - DNA, 23 bp, Homo sapiens
cagtgtggagttcaccttggaag

SEQ ID NO: 1183260 - DNA, 22 bp, Homo sapiens
cagtgtggggataaagacagag

SEQ ID NO: 1183261 - DNA, 20 bp, Homo sapiens
cagtgtggttatgttcccag

SEQ ID NO: 1183262 - DNA, 13 bp, Homo sapiens
cagtgtgtaaata

SEQ ID NO: 1183263 - DNA, 14 bp, Homo sapiens
cagtgtgtgactta

SEQ ID NO: 1183264 - DNA, 15 bp, Homo sapiens
cagtgtgtgggggag

SEQ ID NO: 1183265 - DNA, 14 bp, Homo sapiens
cagtgttaaaaaat

SEQ ID NO: 1183266 - DNA, 14 bp, Homo sapiens
cagtgttaaattca

SEQ ID NO: 1183267 - DNA, 16 bp, Homo sapiens
cagtgttaatgctgaa

SEQ ID NO: 1183268 - DNA, 18 bp, Homo sapiens
cagtgttacctgtgtgct

SEQ ID NO: 1183269 - DNA, 19 bp, Homo sapiens
cagtgttacctgtgtgctt

SEQ ID NO: 1183270 - DNA, 21 bp, Homo sapiens
cagtgttacctgttagctccc

SEQ ID NO: 1183271 - DNA, 23 bp, Homo sapiens
cagtgttacttgcaggtactttg

SEQ ID NO: 1183272 - DNA, 15 bp, Homo sapiens
cagtgttagagaaat

SEQ ID NO: 1183273 - DNA, 19 bp, Homo sapiens
cagtgttagggaagggcct

SEQ ID NO: 1183274 - DNA, 19 bp, Homo sapiens
cagtgttccccatctgggt

SEQ ID NO: 1183275 - DNA, 16 bp, Homo sapiens
cagtgttcctgaagct

SEQ ID NO: 1183276 - DNA, 19 bp, Homo sapiens
cagtgttcctgaagctgct

SEQ ID NO: 1183277 - DNA, 22 bp, Homo sapiens
cagtgttggctgtgtgacagaa

SEQ ID NO: 1183278 - DNA, 18 bp, Homo sapiens
cagtgttggggatgcctt

SEQ ID NO: 1183279 - DNA, 20 bp, Homo sapiens
cagtgttgtggatttaacag

SEQ ID NO: 1183280 - DNA, 23 bp, Homo sapiens
cagtgtttatgtgctattaatat

SEQ ID NO: 1183281 - DNA, 12 bp, Homo sapiens
cagtgtttcaat

SEQ ID NO: 1183282 - DNA, 21 bp, Homo sapiens
cagtgtttcaattctgtaatt

SEQ ID NO: 1183283 - DNA, 17 bp, Homo sapiens
cagtgtttcccataatt

SEQ ID NO: 1183284 - DNA, 21 bp, Homo sapiens
cagtgtttcccataattttct

SEQ ID NO: 1183285 - DNA, 20 bp, Homo sapiens
cagtgttttaaactctccta

SEQ ID NO: 1183286 - DNA, 13 bp, Homo sapiens
cagtgttttcaga

SEQ ID NO: 1183287 - DNA, 23 bp, Homo sapiens
cagtgttttcagaagaaataaat

SEQ ID NO: 1183288 - DNA, 18 bp, Homo sapiens
cagtgtttttattgctcg

SEQ ID NO: 1183289 - DNA, 14 bp, Homo sapiens
cagttaaaatgtga

SEQ ID NO: 1183290 - DNA, 12 bp, Homo sapiens
cagttaaagatt

SEQ ID NO: 1183291 - DNA, 13 bp, Homo sapiens
cagttaaagccac

SEQ ID NO: 1183292 - DNA, 15 bp, Homo sapiens
cagttaacaggatat

SEQ ID NO: 1183293 - DNA, 24 bp, Homo sapiens
cagttaactattgcatttatatgt

SEQ ID NO: 1183294 - DNA, 20 bp, Homo sapiens
cagttaactttcagaagaga

SEQ ID NO: 1183295 - DNA, 16 bp, Homo sapiens
cagttaagaaatttca

SEQ ID NO: 1183296 - DNA, 14 bp, Homo sapiens
cagttaagaagccc

SEQ ID NO: 1183297 - DNA, 16 bp, Homo sapiens
cagttaattcaatgtg

SEQ ID NO: 1183298 - DNA, 20 bp, Homo sapiens
cagttaattccctgctaaat

SEQ ID NO: 1183299 - DNA, 21 bp, Homo sapiens
cagttaccaaacattacaaaa

SEQ ID NO: 1183300 - DNA, 22 bp, Homo sapiens
cagttaccacagcaactgacct

SEQ ID NO: 1183301 - DNA, 13 bp, Homo sapiens
cagttactcagcc

SEQ ID NO: 1183302 - DNA, 19 bp, Homo sapiens
cagttactcaggaggctga

SEQ ID NO: 1183303 - DNA, 15 bp, Homo sapiens
cagttactctgaagg

SEQ ID NO: 1183304 - DNA, 19 bp, Homo sapiens
ctggccccaggccccagac

SEQ ID NO: 1183305 - DNA, 11 bp, Homo sapiens
ctggcccccag

SEQ ID NO: 1183306 - DNA, 19 bp, Homo sapiens
ctggcccccagccctgggg

SEQ ID NO: 1183307 - DNA, 12 bp, Homo sapiens
ctggccccgccg

SEQ ID NO: 1183308 - DNA, 16 bp, Homo sapiens
ctggccccgcctgcct

SEQ ID NO: 1183309 - DNA, 17 bp, Homo sapiens
ctggccccgcctgcctg

SEQ ID NO: 1183310 - DNA, 18 bp, Homo sapiens
ctggccccgcctgcctgc

SEQ ID NO: 1183311 - DNA, 19 bp, Homo sapiens
ctggccccggatcagagca

SEQ ID NO: 1183312 - DNA, 20 bp, Homo sapiens
ctggccccggatcagagcag

SEQ ID NO: 1183313 - DNA, 23 bp, Homo sapiens
ctggccccggatcagagcaggac

SEQ ID NO: 1183314 - DNA, 19 bp, Homo sapiens
ctggccccgggctctggcc

SEQ ID NO: 1183315 - DNA, 20 bp, Homo sapiens
ctggcccctagaatcagcct

SEQ ID NO: 1183316 - DNA, 12 bp, Homo sapiens
ctggcccctcac

SEQ ID NO: 1183317 - DNA, 20 bp, Homo sapiens
ctggcccctccagaccctgc

SEQ ID NO: 1183318 - DNA, 19 bp, Homo sapiens
ctggcccgcccctcgctgc

SEQ ID NO: 1183319 - DNA, 21 bp, Homo sapiens
ctggcccgcccctcgctgctg

SEQ ID NO: 1183320 - DNA, 23 bp, Homo sapiens
ctggcccgcccctcgctgctgct

SEQ ID NO: 1183321 - DNA, 16 bp, Homo sapiens
ctggcccgccctcacc

SEQ ID NO: 1183322 - DNA, 19 bp, Homo sapiens
ctggcccgtgacagactcc

SEQ ID NO: 1183323 - DNA, 12 bp, Homo sapiens
ctggccctccct

SEQ ID NO: 1183324 - DNA, 13 bp, Homo sapiens
ctggccctccctc

SEQ ID NO: 1183325 - DNA, 16 bp, Homo sapiens
ctggccctccctccct

SEQ ID NO: 1183326 - DNA, 23 bp, Homo sapiens
ctggccctcggtggctgcacaga

SEQ ID NO: 1183327 - DNA, 13 bp, Homo sapiens
ctggccctgaggt

SEQ ID NO: 1183328 - DNA, 21 bp, Homo sapiens
ctggccctgcttcctgcttgc

SEQ ID NO: 1183329 - DNA, 23 bp, Homo sapiens
ctggccctgcttcctgcttgcca

SEQ ID NO: 1183330 - DNA, 12 bp, Homo sapiens
ctggccctggct

SEQ ID NO: 1183331 - DNA, 19 bp, Homo sapiens
ctgattggaatttctggcc

SEQ ID NO: 1183332 - DNA, 16 bp, Homo sapiens
ctgattggcatgtctg

SEQ ID NO: 1183333 - DNA, 19 bp, Homo sapiens
ctgattgggaggtgcgtgt

SEQ ID NO: 1183334 - DNA, 17 bp, Homo sapiens
ctgattggtgcaaccct

SEQ ID NO: 1183335 - DNA, 17 bp, Homo sapiens
ctgattgttgtcaggcc

SEQ ID NO: 1183336 - DNA, 17 bp, Homo sapiens
ctgattgtttcattgcg

SEQ ID NO: 1183337 - DNA, 12 bp, Homo sapiens
ctgatttaatgt

SEQ ID NO: 1183338 - DNA, 14 bp, Homo sapiens
ctgatttaatgttt

SEQ ID NO: 1183339 - DNA, 15 bp, Homo sapiens
ctgatttaatgtttt

SEQ ID NO: 1183340 - DNA, 18 bp, Homo sapiens
ctgatttaatgttttctg

SEQ ID NO: 1183341 - DNA, 15 bp, Homo sapiens
ctgatttagaagcaa

SEQ ID NO: 1183342 - DNA, 13 bp, Homo sapiens
ctgatttcacaac

SEQ ID NO: 1183343 - DNA, 15 bp, Homo sapiens
ctgatttcagttttt

SEQ ID NO: 1183344 - DNA, 16 bp, Homo sapiens
ctgatttcagtttttc

SEQ ID NO: 1183345 - DNA, 18 bp, Homo sapiens
ctgatttcagtttttcat

SEQ ID NO: 1183346 - DNA, 16 bp, Homo sapiens
ctgatttcataattca

SEQ ID NO: 1183347 - DNA, 17 bp, Homo sapiens
ctgatttcataattcag

SEQ ID NO: 1183348 - DNA, 20 bp, Homo sapiens
ctgatttcattacatttctg

SEQ ID NO: 1183349 - DNA, 13 bp, Homo sapiens
ctgatttccaggc

SEQ ID NO: 1183350 - DNA, 18 bp, Homo sapiens
ctgatttccaggcccctg

SEQ ID NO: 1183351 - DNA, 18 bp, Homo sapiens
ctgatttctagtgtatac

SEQ ID NO: 1183352 - DNA, 23 bp, Homo sapiens
ctgatttctagtgtatactctgt

SEQ ID NO: 1183353 - DNA, 13 bp, Homo sapiens
ctgatttcttcag

SEQ ID NO: 1183354 - DNA, 23 bp, Homo sapiens
ctgatttgatgatacatttcatt

SEQ ID NO: 1183355 - DNA, 11 bp, Homo sapiens
ctgatttgcaa

SEQ ID NO: 1183356 - DNA, 22 bp, Homo sapiens
ctgatttggagtgagccagaaa

SEQ ID NO: 1183357 - DNA, 20 bp, Homo sapiens
ctgatttgggctgaatgtat

SEQ ID NO: 1183358 - DNA, 23 bp, Homo sapiens
ctgatttgggctgaatgtatgta

SEQ ID NO: 1183359 - DNA, 14 bp, Homo sapiens
ctgatttggtactt

SEQ ID NO: 1183360 - DNA, 23 bp, Homo sapiens
ctgatttggtacttttgagtgtg

SEQ ID NO: 1183361 - DNA, 13 bp, Homo sapiens
ctgattttaaaat

SEQ ID NO: 1183362 - DNA, 23 bp, Homo sapiens
ctgattttaaaggcagagaagtt

SEQ ID NO: 1183363 - DNA, 12 bp, Homo sapiens
ctgattttaaca

SEQ ID NO: 1183364 - DNA, 22 bp, Homo sapiens
ctgattttaacaataactactg

SEQ ID NO: 1183365 - DNA, 12 bp, Homo sapiens
ctgattttgtat

SEQ ID NO: 1183366 - DNA, 21 bp, Homo sapiens
ctgcaaaaaaagcctccaagg

SEQ ID NO: 1183367 - DNA, 17 bp, Homo sapiens
ctgcaaaaatatttata

SEQ ID NO: 1183368 - DNA, 15 bp, Homo sapiens
ctgcaaaaggcctct

SEQ ID NO: 1183369 - DNA, 21 bp, Homo sapiens
ctgcaaaaggcctcttgtaaa

SEQ ID NO: 1183370 - DNA, 15 bp, Homo sapiens
ctgcaaaattaaatc

SEQ ID NO: 1183371 - DNA, 23 bp, Homo sapiens
ctgcaaacatggggttggctggg

SEQ ID NO: 1183372 - DNA, 16 bp, Homo sapiens
ctgcaaaccttcctgg

SEQ ID NO: 1183373 - DNA, 16 bp, Homo sapiens
ctgcaaactcactgct

SEQ ID NO: 1183374 - DNA, 13 bp, Homo sapiens
ctgcaaagagaaa

SEQ ID NO: 1183375 - DNA, 15 bp, Homo sapiens
ctgcaaagcccagct

SEQ ID NO: 1183376 - DNA, 15 bp, Homo sapiens
ctgcaaaggaaatac

SEQ ID NO: 1183377 - DNA, 17 bp, Homo sapiens
ctgcaaaggcctgggct

SEQ ID NO: 1183378 - DNA, 21 bp, Homo sapiens
ctgcaaaggcctgggctggcc

SEQ ID NO: 1183379 - DNA, 15 bp, Homo sapiens
ctgcaaataaagcct

SEQ ID NO: 1183380 - DNA, 16 bp, Homo sapiens
ctgcaaataaagcctt

SEQ ID NO: 1183381 - DNA, 20 bp, Homo sapiens
ctgcaaatagaaaacaggaa

SEQ ID NO: 1183382 - DNA, 18 bp, Homo sapiens
ctgcaaatcaggcttttg

SEQ ID NO: 1183383 - DNA, 15 bp, Homo sapiens
ctgcaaatctagtgc

SEQ ID NO: 1183384 - DNA, 18 bp, Homo sapiens
ctgcaaatggcagtttta

SEQ ID NO: 1183385 - DNA, 12 bp, Homo sapiens
ctgcaacaaaat

SEQ ID NO: 1183386 - DNA, 17 bp, Homo sapiens
ctgcaaccttcacctcc

SEQ ID NO: 1183387 - DNA, 23 bp, Homo sapiens
ctgcaactcaaggactttgcagc

SEQ ID NO: 1183388 - DNA, 13 bp, Homo sapiens
ctgcaactgcaag

SEQ ID NO: 1183389 - DNA, 16 bp, Homo sapiens
ctgcaacttccgctga

SEQ ID NO: 1183390 - DNA, 21 bp, Homo sapiens
ctgcaagaaaatgatgtgtac

SEQ ID NO: 1183391 - DNA, 22 bp, Homo sapiens
ctgcaagaccacggagggagcg

SEQ ID NO: 1183392 - DNA, 19 bp, Homo sapiens
ctgcaagagccttggtgtc

SEQ ID NO: 1183393 - DNA, 21 bp, Homo sapiens
ctgcaagagccttggtgtcca

SEQ ID NO: 1183394 - DNA, 23 bp, Homo sapiens
ctgcaagatggacacgagccaca

SEQ ID NO: 1183395 - DNA, 17 bp, Homo sapiens
ctgcaagcacagccctt

SEQ ID NO: 1183396 - DNA, 17 bp, Homo sapiens
ctgcaagcatttttcca

SEQ ID NO: 1183397 - DNA, 13 bp, Homo sapiens
ctgcaagccccag

SEQ ID NO: 1183398 - DNA, 18 bp, Homo sapiens
ctgcaagccccagggcct

SEQ ID NO: 1183399 - DNA, 21 bp, Homo sapiens
ctgcaagccccagggcctggg

SEQ ID NO: 1183400 - DNA, 14 bp, Homo sapiens
ctgcaagggcccag

SEQ ID NO: 1183401 - DNA, 17 bp, Homo sapiens
ctgcaaggtactctggt

SEQ ID NO: 1183402 - DNA, 17 bp, Homo sapiens
ctgcaaggtctttggtt

SEQ ID NO: 1183403 - DNA, 12 bp, Homo sapiens
ctgcaaggtggc

SEQ ID NO: 1183404 - DNA, 18 bp, Homo sapiens
ctgcaaggtggcctctgc

SEQ ID NO: 1183405 - DNA, 22 bp, Homo sapiens
ctgcaaggtggcctctgcctgg

SEQ ID NO: 1183406 - DNA, 23 bp, Homo sapiens
ctgcaaggtggcctctgcctggg

SEQ ID NO: 1183407 - DNA, 22 bp, Homo sapiens
ctgcaaggtttaggctggtggc

SEQ ID NO: 1183408 - DNA, 16 bp, Homo sapiens
ctgcaagtctgtggcc

SEQ ID NO: 1183409 - DNA, 18 bp, Homo sapiens
ctgcaatagagactgtag

SEQ ID NO: 1183410 - DNA, 15 bp, Homo sapiens
ctgcaatgcctagac

SEQ ID NO: 1183411 - DNA, 16 bp, Homo sapiens
ctgcaatgcctagact

SEQ ID NO: 1183412 - DNA, 15 bp, Homo sapiens
ctgcaatttctacta

SEQ ID NO: 1183413 - DNA, 16 bp, Homo sapiens
ctgcacaaaagcagat

SEQ ID NO: 1183414 - DNA, 17 bp, Homo sapiens
ctgcacaaaagcagata

SEQ ID NO: 1183415 - DNA, 13 bp, Homo sapiens
ctgcacaaagccc

SEQ ID NO: 1183416 - DNA, 21 bp, Homo sapiens
ctgcacaacagccctgcctga

SEQ ID NO: 1183417 - DNA, 23 bp, Homo sapiens
ctgcacaacagccctgcctgaga

SEQ ID NO: 1183418 - DNA, 18 bp, Homo sapiens
ctgcacaataaaaatgtt

SEQ ID NO: 1183419 - DNA, 16 bp, Homo sapiens
ctgcacacacagctcc

SEQ ID NO: 1183420 - DNA, 15 bp, Homo sapiens
ctgcacacacctcag

SEQ ID NO: 1183421 - DNA, 20 bp, Homo sapiens
ctgcacacacctcagaggct

SEQ ID NO: 1183422 - DNA, 14 bp, Homo sapiens
ctgcacacacctgg

SEQ ID NO: 1183423 - DNA, 22 bp, Homo sapiens
ctgcacacagaatgctcagggt

SEQ ID NO: 1183424 - DNA, 21 bp, Homo sapiens
ctgcacacagacggcctaggg

SEQ ID NO: 1183425 - DNA, 13 bp, Homo sapiens
ctgcacacagcac

SEQ ID NO: 1183426 - DNA, 12 bp, Homo sapiens
ctgcacacagga

SEQ ID NO: 1183427 - DNA, 15 bp, Homo sapiens
ctgcacacagtgact

SEQ ID NO: 1183428 - DNA, 18 bp, Homo sapiens
ctgcacaccctccagaga

SEQ ID NO: 1183429 - DNA, 16 bp, Homo sapiens
ctgcacagacctggag

SEQ ID NO: 1183430 - DNA, 22 bp, Homo sapiens
ctgcacagagggtcccattgtg

SEQ ID NO: 1183431 - DNA, 13 bp, Homo sapiens
ctgcacagatgga

SEQ ID NO: 1183432 - DNA, 20 bp, Homo sapiens
ctgcacagatggatttgcct

SEQ ID NO: 1183433 - DNA, 13 bp, Homo sapiens
ctgcacagcagga

SEQ ID NO: 1183434 - DNA, 13 bp, Homo sapiens
ctgcacagcggcc

SEQ ID NO: 1183435 - DNA, 19 bp, Homo sapiens
ctgcacagcggcccctgca

SEQ ID NO: 1183436 - DNA, 20 bp, Homo sapiens
ctgcacagtgacttctgaga

SEQ ID NO: 1183437 - DNA, 21 bp, Homo sapiens
ctgcacagtgacttctgagat

SEQ ID NO: 1183438 - DNA, 14 bp, Homo sapiens
ctgcacagtgctgt

SEQ ID NO: 1183439 - DNA, 17 bp, Homo sapiens
ctgcacagtggcacaaa

SEQ ID NO: 1183440 - DNA, 21 bp, Homo sapiens
ctgcacagtttagaacagagg

SEQ ID NO: 1183441 - DNA, 23 bp, Homo sapiens
ctgcacatgaaagttttgcaaag

SEQ ID NO: 1183442 - DNA, 20 bp, Homo sapiens
ctgcacatgtgccacacagt

SEQ ID NO: 1183443 - DNA, 16 bp, Homo sapiens
cagcttttgttctaga

SEQ ID NO: 1183444 - DNA, 16 bp, Homo sapiens
cagctttttattccct

SEQ ID NO: 1183445 - DNA, 18 bp, Homo sapiens
cagctttttattccctgc

SEQ ID NO: 1183446 - DNA, 20 bp, Homo sapiens
caggaaaaaaaattctgttg

SEQ ID NO: 1183447 - DNA, 16 bp, Homo sapiens
caggaaaaaaactttt

SEQ ID NO: 1183448 - DNA, 18 bp, Homo sapiens
caggaaaaaaacttttat

SEQ ID NO: 1183449 - DNA, 17 bp, Homo sapiens
caggaaaaaccaacagg

SEQ ID NO: 1183450 - DNA, 15 bp, Homo sapiens
caggaaaaatgaaaa

SEQ ID NO: 1183451 - DNA, 19 bp, Homo sapiens
caggaaaaatgaggaatcc

SEQ ID NO: 1183452 - DNA, 22 bp, Homo sapiens
caggaaaatgtatccagaggaa

SEQ ID NO: 1183453 - DNA, 21 bp, Homo sapiens
ctgcagccatcccgcttagcc

SEQ ID NO: 1183454 - DNA, 21 bp, Homo sapiens
ctgcagcccaaaacccagggc

SEQ ID NO: 1183455 - DNA, 22 bp, Homo sapiens
ctgcagcccaaaacccagggca

SEQ ID NO: 1183456 - DNA, 16 bp, Homo sapiens
ctgcagcccaccagac

SEQ ID NO: 1183457 - DNA, 14 bp, Homo sapiens
ctgcagcccagcct

SEQ ID NO: 1183458 - DNA, 24 bp, Homo sapiens
ctgcagcccggcgccaccatcctg

SEQ ID NO: 1183459 - DNA, 13 bp, Homo sapiens
ctgcagcccttgg

SEQ ID NO: 1183460 - DNA, 14 bp, Homo sapiens
ctgcagcccttggg

SEQ ID NO: 1183461 - DNA, 16 bp, Homo sapiens
ctgcagcccttgggca

SEQ ID NO: 1183462 - DNA, 19 bp, Homo sapiens
ctgcagcccttgggcagtt

SEQ ID NO: 1183463 - DNA, 16 bp, Homo sapiens
ctgcagccggaggagg

SEQ ID NO: 1183464 - DNA, 23 bp, Homo sapiens
ctgcagcctcaacctcctgggtt

SEQ ID NO: 1183465 - DNA, 23 bp, Homo sapiens
ctgcagcctcatactcctgggct

SEQ ID NO: 1183466 - DNA, 13 bp, Homo sapiens
ctgcagcctcctc

SEQ ID NO: 1183467 - DNA, 17 bp, Homo sapiens
ctgcagcctcctcctga

SEQ ID NO: 1183468 - DNA, 14 bp, Homo sapiens
ctgcagcctcggcc

SEQ ID NO: 1183469 - DNA, 18 bp, Homo sapiens
ctgcagcctctctggctg

SEQ ID NO: 1183470 - DNA, 23 bp, Homo sapiens
ctgcagcctctctggctggtctt

SEQ ID NO: 1183471 - DNA, 17 bp, Homo sapiens
ctgcagcctctgcctct

SEQ ID NO: 1183472 - DNA, 15 bp, Homo sapiens
ctgcagcctgcagga

SEQ ID NO: 1183473 - DNA, 19 bp, Homo sapiens
ctgcagcctgcaggacctc

SEQ ID NO: 1183474 - DNA, 13 bp, Homo sapiens
ctgcagcctgctg

SEQ ID NO: 1183475 - DNA, 12 bp, Homo sapiens
ctgcagcctggg

SEQ ID NO: 1183476 - DNA, 15 bp, Homo sapiens
ctgcagcctgggtct

SEQ ID NO: 1183477 - DNA, 20 bp, Homo sapiens
ctgcagcctggtagaattgg

SEQ ID NO: 1183478 - DNA, 20 bp, Homo sapiens
ctgcagcctttgcctccccg

SEQ ID NO: 1183479 - DNA, 22 bp, Homo sapiens
ctgcagctatgcgcaatgtggc

SEQ ID NO: 1183480 - DNA, 21 bp, Homo sapiens
ctgcagctgacctctgttgtc

SEQ ID NO: 1183481 - DNA, 19 bp, Homo sapiens
ctgcagctgcaccagcagg

SEQ ID NO: 1183482 - DNA, 12 bp, Homo sapiens
ctgcagctgccg

SEQ ID NO: 1183483 - DNA, 16 bp, Homo sapiens
ctgcagctggacagag

SEQ ID NO: 1183484 - DNA, 17 bp, Homo sapiens
ctgcagctggacagagg

SEQ ID NO: 1183485 - DNA, 19 bp, Homo sapiens
ctgcagctggacagagggg

SEQ ID NO: 1183486 - DNA, 15 bp, Homo sapiens
ctgcagctgggcccc

SEQ ID NO: 1183487 - DNA, 16 bp, Homo sapiens
ctgcagctgggcccca

SEQ ID NO: 1183488 - DNA, 22 bp, Homo sapiens
ctgcagctgggccccatgctct

SEQ ID NO: 1183489 - DNA, 11 bp, Homo sapiens
ctgcagctgtg

SEQ ID NO: 1183490 - DNA, 14 bp, Homo sapiens
ctgcagctttacat

SEQ ID NO: 1183491 - DNA, 23 bp, Homo sapiens
ctgcaggaaacatttctgacacc

SEQ ID NO: 1183492 - DNA, 18 bp, Homo sapiens
ctgcaggaaatagtcact

SEQ ID NO: 1183493 - DNA, 19 bp, Homo sapiens
ctgcaggaacgagcactgg

SEQ ID NO: 1183494 - DNA, 15 bp, Homo sapiens
ctgcaggacagtcaa

SEQ ID NO: 1183495 - DNA, 20 bp, Homo sapiens
ctgcaggaccctgtcctgca

SEQ ID NO: 1183496 - DNA, 18 bp, Homo sapiens
ctgcaggagagagcagca

SEQ ID NO: 1183497 - DNA, 20 bp, Homo sapiens
ctgcaggagagagcagcact

SEQ ID NO: 1183498 - DNA, 22 bp, Homo sapiens
ctgcaggagagagcagcactcc

SEQ ID NO: 1183499 - DNA, 18 bp, Homo sapiens
ctgcaggagcagggcggc

SEQ ID NO: 1183500 - DNA, 16 bp, Homo sapiens
ctgcaggagttaaaaa

SEQ ID NO: 1183501 - DNA, 19 bp, Homo sapiens
ctgcaggatgattgtacag

SEQ ID NO: 1183502 - DNA, 20 bp, Homo sapiens
ctgcaggatgattgtacaga

SEQ ID NO: 1183503 - DNA, 23 bp, Homo sapiens
ctgcaggcacagaggaggtcagc

SEQ ID NO: 1183504 - DNA, 12 bp, Homo sapiens
ctgcaggcagac

SEQ ID NO: 1183505 - DNA, 14 bp, Homo sapiens
ctgcaggcagagct

SEQ ID NO: 1183506 - DNA, 22 bp, Homo sapiens
ctgcaggcaggaacaaacaggg

SEQ ID NO: 1183507 - DNA, 13 bp, Homo sapiens
ctgcaggcaggcg

SEQ ID NO: 1183508 - DNA, 22 bp, Homo sapiens
ctgcaggccaagagcagaggca

SEQ ID NO: 1183509 - DNA, 15 bp, Homo sapiens
ctgcaggccactgtg

SEQ ID NO: 1183510 - DNA, 23 bp, Homo sapiens
ctgcaggccaggccagctgcctc

SEQ ID NO: 1183511 - DNA, 23 bp, Homo sapiens
ctgcaggccccgcttgtccagcg

SEQ ID NO: 1183512 - DNA, 15 bp, Homo sapiens
ctgcaggccctccct

SEQ ID NO: 1183513 - DNA, 18 bp, Homo sapiens
ctgcaggccctccctcta

SEQ ID NO: 1183514 - DNA, 20 bp, Homo sapiens
ctgcaggccctccctctact

SEQ ID NO: 1183515 - DNA, 16 bp, Homo sapiens
ctgcaggccctggcct

SEQ ID NO: 1183516 - DNA, 22 bp, Homo sapiens
ctgcaggcctaggtgcagctcc

SEQ ID NO: 1183517 - DNA, 15 bp, Homo sapiens
ctgcaggctcccgag

SEQ ID NO: 1183518 - DNA, 19 bp, Homo sapiens
ctgcaggctggggaggtgc

SEQ ID NO: 1183519 - DNA, 22 bp, Homo sapiens
ctgcagggaaaattatttgcat

SEQ ID NO: 1183520 - DNA, 20 bp, Homo sapiens
ctgcagggagcaactctcca

SEQ ID NO: 1183521 - DNA, 18 bp, Homo sapiens
ctgcagggcacggggacc

SEQ ID NO: 1183522 - DNA, 23 bp, Homo sapiens
ctgcagggcacggggacctggat

SEQ ID NO: 1183523 - DNA, 23 bp, Homo sapiens
ctgcagggcgcccctgggagaca

SEQ ID NO: 1183524 - DNA, 19 bp, Homo sapiens
ctgcagggctcccatgggc

SEQ ID NO: 1183525 - DNA, 14 bp, Homo sapiens
ctgcaggggcctgg

SEQ ID NO: 1183526 - DNA, 18 bp, Homo sapiens
ctgcagggggaggaggac

SEQ ID NO: 1183527 - DNA, 19 bp, Homo sapiens
ctgcagggggaggaggact

SEQ ID NO: 1183528 - DNA, 23 bp, Homo sapiens
ctgcaggggttgagagctttctg

SEQ ID NO: 1183529 - DNA, 18 bp, Homo sapiens
ctgcagggtgacgcctga

SEQ ID NO: 1183530 - DNA, 22 bp, Homo sapiens
ctgcagggtgacgcctgagaca

SEQ ID NO: 1183531 - DNA, 16 bp, Homo sapiens
ctgcaggtacttcctc

SEQ ID NO: 1183532 - DNA, 19 bp, Homo sapiens
ctgcaggtacttcctcctg

SEQ ID NO: 1183533 - DNA, 21 bp, Homo sapiens
ctgcaggtcagttgtaataaa

SEQ ID NO: 1183534 - DNA, 21 bp, Homo sapiens
ctgcaggtcagtttggaatga

SEQ ID NO: 1183535 - DNA, 21 bp, Homo sapiens
ctgcaggttgaagccatgtct

SEQ ID NO: 1183536 - DNA, 23 bp, Homo sapiens
ctgcaggtttgtaatgcaaaagg

SEQ ID NO: 1183537 - DNA, 19 bp, Homo sapiens
ctgcagtacatacgtctgc

SEQ ID NO: 1183538 - DNA, 20 bp, Homo sapiens
ctgcagtaggggacccagag

SEQ ID NO: 1183539 - DNA, 18 bp, Homo sapiens
ctgcagtcacattgatgt

SEQ ID NO: 1183540 - DNA, 12 bp, Homo sapiens
ctgcagtcagat

SEQ ID NO: 1183541 - DNA, 23 bp, Homo sapiens
ctgcagtcatctcccctcctggc

SEQ ID NO: 1183542 - DNA, 21 bp, Homo sapiens
ctgcagtcccacactgtgcag

SEQ ID NO: 1183543 - DNA, 21 bp, Homo sapiens
ctgcagtcctccggggtgggt

SEQ ID NO: 1183544 - DNA, 22 bp, Homo sapiens
ctgcagtcggcatgccaggacc

SEQ ID NO: 1183545 - DNA, 18 bp, Homo sapiens
ctgcagtgaatttgaata

SEQ ID NO: 1183546 - DNA, 19 bp, Homo sapiens
ctgcagtgaatttgaataa

SEQ ID NO: 1183547 - DNA, 17 bp, Homo sapiens
ctgcagtgaggggccct

SEQ ID NO: 1183548 - DNA, 22 bp, Homo sapiens
ctgcagtgatggcgcgggaggc

SEQ ID NO: 1183549 - DNA, 17 bp, Homo sapiens
ctgcagtggtgtgaaac

SEQ ID NO: 1183550 - DNA, 14 bp, Homo sapiens
ctgcagttcctgag

SEQ ID NO: 1183551 - DNA, 18 bp, Homo sapiens
ctgcagttctactcaggc

SEQ ID NO: 1183552 - DNA, 14 bp, Homo sapiens
ctgcagtttcctgg

SEQ ID NO: 1183553 - DNA, 23 bp, Homo sapiens
ctgcagtttcttgtgtagatttg

SEQ ID NO: 1183554 - DNA, 18 bp, Homo sapiens
ctgcagtttggccctgga

SEQ ID NO: 1183555 - DNA, 21 bp, Homo sapiens
ctgcagtttggccctggagcc

SEQ ID NO: 1183556 - DNA, 22 bp, Homo sapiens
ctgcagtttggccctggagcca

SEQ ID NO: 1183557 - DNA, 23 bp, Homo sapiens
ctgcagtttggccctggagccag

SEQ ID NO: 1183558 - DNA, 15 bp, Homo sapiens
ctgcagttttgctat

SEQ ID NO: 1183559 - DNA, 14 bp, Homo sapiens
ctgcagtttttcag

SEQ ID NO: 1183560 - DNA, 20 bp, Homo sapiens
ctgcataagtgaaaatctta

SEQ ID NO: 1183561 - DNA, 15 bp, Homo sapiens
ctgcataatgtttct

SEQ ID NO: 1183562 - DNA, 15 bp, Homo sapiens
ctgcatatttctgta

SEQ ID NO: 1183563 - DNA, 19 bp, Homo sapiens
ctgcatatttctgtatatt

SEQ ID NO: 1183564 - DNA, 12 bp, Homo sapiens
ctgcatcatctt

SEQ ID NO: 1183565 - DNA, 16 bp, Homo sapiens
ctgcatcccagcacct

SEQ ID NO: 1183566 - DNA, 20 bp, Homo sapiens
ctgcatcccagcacctgcct

SEQ ID NO: 1183567 - DNA, 23 bp, Homo sapiens
ctgcatcccagcacctgcctcct

SEQ ID NO: 1183568 - DNA, 12 bp, Homo sapiens
ctgcatcccctt

SEQ ID NO: 1183569 - DNA, 19 bp, Homo sapiens
ctgcatccgtagttccctg

SEQ ID NO: 1183570 - DNA, 20 bp, Homo sapiens
ctgcatccgtagttccctga

SEQ ID NO: 1183571 - DNA, 14 bp, Homo sapiens
ctgcatcctgaggc

SEQ ID NO: 1183572 - DNA, 21 bp, Homo sapiens
ctgcatcctgaggccagtggc

SEQ ID NO: 1183573 - DNA, 13 bp, Homo sapiens
ctgccaggcggcc

SEQ ID NO: 1183574 - DNA, 14 bp, Homo sapiens
ctgccaggcggccc

SEQ ID NO: 1183575 - DNA, 22 bp, Homo sapiens
ctgccaggcggccctggggagg

SEQ ID NO: 1183576 - DNA, 12 bp, Homo sapiens
caggagggcagg

SEQ ID NO: 1183577 - DNA, 13 bp, Homo sapiens
caggagggcaggc

SEQ ID NO: 1183578 - DNA, 18 bp, Homo sapiens
caggagggccagcgctgt

SEQ ID NO: 1183579 - DNA, 19 bp, Homo sapiens
caggagggctaattagaaa

SEQ ID NO: 1183580 - DNA, 20 bp, Homo sapiens
caggaggggaaaaaattaac

SEQ ID NO: 1183581 - DNA, 21 bp, Homo sapiens
caggaggggcctgggcagccc

SEQ ID NO: 1183582 - DNA, 16 bp, Homo sapiens
caggagggtgacgccc

SEQ ID NO: 1183583 - DNA, 18 bp, Homo sapiens
caggagggtgacgcccag

SEQ ID NO: 1183584 - DNA, 19 bp, Homo sapiens
caggaggtcatctgacctt

SEQ ID NO: 1183585 - DNA, 14 bp, Homo sapiens
caggaggtggagaa

SEQ ID NO: 1183586 - DNA, 20 bp, Homo sapiens
caggaggtggaggctgcagt

SEQ ID NO: 1183587 - DNA, 20 bp, Homo sapiens
caggaggtggaggttgcagt

SEQ ID NO: 1183588 - DNA, 23 bp, Homo sapiens
caggaggttctgggcctctgaac

SEQ ID NO: 1183589 - DNA, 15 bp, Homo sapiens
caggagtcccaagga

SEQ ID NO: 1183590 - DNA, 21 bp, Homo sapiens
caggagtcccaaggaaagccc

SEQ ID NO: 1183591 - DNA, 13 bp, Homo sapiens
caggagtccctgg

SEQ ID NO: 1183592 - DNA, 15 bp, Homo sapiens
caggagtccctggta

SEQ ID NO: 1183593 - DNA, 16 bp, Homo sapiens
caggagtctctgccac

SEQ ID NO: 1183594 - DNA, 17 bp, Homo sapiens
caggagtctctgccacc

SEQ ID NO: 1183595 - DNA, 21 bp, Homo sapiens
caggagtctctgccacccact

SEQ ID NO: 1183596 - DNA, 23 bp, Homo sapiens
caggagtctctgccacccactca

SEQ ID NO: 1183597 - DNA, 13 bp, Homo sapiens
caggagtctgcca

SEQ ID NO: 1183598 - DNA, 20 bp, Homo sapiens
caggagtctgccacttgtca

SEQ ID NO: 1183599 - DNA, 14 bp, Homo sapiens
caggagtctgtgct

SEQ ID NO: 1183600 - DNA, 22 bp, Homo sapiens
caggagtcttcagacccagaga

SEQ ID NO: 1183601 - DNA, 22 bp, Homo sapiens
caggagtgccaggaccagcctg

SEQ ID NO: 1183602 - DNA, 21 bp, Homo sapiens
caggagtggcagctgtcccct

SEQ ID NO: 1183603 - DNA, 24 bp, Homo sapiens
caggagtggtgcagacagaagtct

SEQ ID NO: 1183604 - DNA, 19 bp, Homo sapiens
caggagtgtcctcttccct

SEQ ID NO: 1183605 - DNA, 14 bp, Homo sapiens
caggagtgtcctgc

SEQ ID NO: 1183606 - DNA, 18 bp, Homo sapiens
caggagttcgaggctgca

SEQ ID NO: 1183607 - DNA, 22 bp, Homo sapiens
caggagttggaatgttgtagtt

SEQ ID NO: 1183608 - DNA, 24 bp, Homo sapiens
caggagttgtgagccctctagggc

SEQ ID NO: 1183609 - DNA, 21 bp, Homo sapiens
caggagtttaagaccagcctg

SEQ ID NO: 1183610 - DNA, 21 bp, Homo sapiens
caggagtttgagacaagccct

SEQ ID NO: 1183611 - DNA, 24 bp, Homo sapiens
caggagtttgagacaagccctggc

SEQ ID NO: 1183612 - DNA, 22 bp, Homo sapiens
caggagtttgagaccaacctgg

SEQ ID NO: 1183613 - DNA, 18 bp, Homo sapiens
caggagtttgaggctgca

SEQ ID NO: 1183614 - DNA, 21 bp, Homo sapiens
caggagtttgaggctgcagcg

SEQ ID NO: 1183615 - DNA, 17 bp, Homo sapiens
caggagttttactgcct

SEQ ID NO: 1183616 - DNA, 19 bp, Homo sapiens
caggagttttactgcctgt

SEQ ID NO: 1183617 - DNA, 22 bp, Homo sapiens
caggagttttactgcctgtagc

SEQ ID NO: 1183618 - DNA, 14 bp, Homo sapiens
caggataaggagac

SEQ ID NO: 1183619 - DNA, 16 bp, Homo sapiens
caggataaggagactg

SEQ ID NO: 1183620 - DNA, 17 bp, Homo sapiens
caggataaggagactga

SEQ ID NO: 1183621 - DNA, 20 bp, Homo sapiens
caggatactctgtcagatgg

SEQ ID NO: 1183622 - DNA, 16 bp, Homo sapiens
caggataggactccat

SEQ ID NO: 1183623 - DNA, 13 bp, Homo sapiens
caggatattagtt

SEQ ID NO: 1183624 - DNA, 22 bp, Homo sapiens
caggatattggttcttcccctc

SEQ ID NO: 1183625 - DNA, 14 bp, Homo sapiens
caggatcaggggtt

SEQ ID NO: 1183626 - DNA, 17 bp, Homo sapiens
caggatcagttaactat

SEQ ID NO: 1183627 - DNA, 15 bp, Homo sapiens
caggatccagtgaca

SEQ ID NO: 1183628 - DNA, 15 bp, Homo sapiens
caggatccccctctt

SEQ ID NO: 1183629 - DNA, 16 bp, Homo sapiens
caggatccgctgccac

SEQ ID NO: 1183630 - DNA, 20 bp, Homo sapiens
caggatctcaagccagcccc

SEQ ID NO: 1183631 - DNA, 13 bp, Homo sapiens
caggatctgggtt

SEQ ID NO: 1183632 - DNA, 15 bp, Homo sapiens
caggatgaacccagg

SEQ ID NO: 1183633 - DNA, 21 bp, Homo sapiens
caggatgaccacgcacctcca

SEQ ID NO: 1183634 - DNA, 17 bp, Homo sapiens
caggatgcacatttctg

SEQ ID NO: 1183635 - DNA, 17 bp, Homo sapiens
caggatgcccagatgaa

SEQ ID NO: 1183636 - DNA, 22 bp, Homo sapiens
caggatgcccagatgaactgac

SEQ ID NO: 1183637 - DNA, 19 bp, Homo sapiens
caggatgctaaagatgatg

SEQ ID NO: 1183638 - DNA, 13 bp, Homo sapiens
caggatgctggcc

SEQ ID NO: 1183639 - DNA, 20 bp, Homo sapiens
caggatggatgcatcacact

SEQ ID NO: 1183640 - DNA, 23 bp, Homo sapiens
caggatggccgggcgcggtggct

SEQ ID NO: 1183641 - DNA, 17 bp, Homo sapiens
caggatggcctttcctt

SEQ ID NO: 1183642 - DNA, 18 bp, Homo sapiens
caggatggcctttccttc

SEQ ID NO: 1183643 - DNA, 20 bp, Homo sapiens
caggatggcctttccttccc

SEQ ID NO: 1183644 - DNA, 21 bp, Homo sapiens
caggatggcctttccttccct

SEQ ID NO: 1183645 - DNA, 23 bp, Homo sapiens
caggatgggctgagctagcctcc

SEQ ID NO: 1183646 - DNA, 22 bp, Homo sapiens
caggatgtagttctgccaggca

SEQ ID NO: 1183647 - DNA, 19 bp, Homo sapiens
caggcaaaaaagggacagc

SEQ ID NO: 1183648 - DNA, 23 bp, Homo sapiens
caggcaaaggaggggaaacaatg

SEQ ID NO: 1183649 - DNA, 11 bp, Homo sapiens
caggcaaatca

SEQ ID NO: 1183650 - DNA, 12 bp, Homo sapiens
caggcaaattca

SEQ ID NO: 1183651 - DNA, 22 bp, Homo sapiens
caggcaacgcacaaaacagaaa

SEQ ID NO: 1183652 - DNA, 18 bp, Homo sapiens
caggcaactgaggcagac

SEQ ID NO: 1183653 - DNA, 13 bp, Homo sapiens
caggcaagcccct

SEQ ID NO: 1183654 - DNA, 16 bp, Homo sapiens
caggcaagcccctcag

SEQ ID NO: 1183655 - DNA, 19 bp, Homo sapiens
caggcaagcccctcagccc

SEQ ID NO: 1183656 - DNA, 14 bp, Homo sapiens
caggcaatgctgta

SEQ ID NO: 1183657 - DNA, 19 bp, Homo sapiens
caggcacacaaggggccct

SEQ ID NO: 1183658 - DNA, 12 bp, Homo sapiens
caggcacacagc

SEQ ID NO: 1183659 - DNA, 21 bp, Homo sapiens
caggcacacagcagcccccca

SEQ ID NO: 1183660 - DNA, 23 bp, Homo sapiens
caggcacacagctactctcccca

SEQ ID NO: 1183661 - DNA, 14 bp, Homo sapiens
caggcacagaggag

SEQ ID NO: 1183662 - DNA, 20 bp, Homo sapiens
caggcacagaggaggtcagc

SEQ ID NO: 1183663 - DNA, 21 bp, Homo sapiens
caggcacagaggaggtcagca

SEQ ID NO: 1183664 - DNA, 15 bp, Homo sapiens
caggcacagctgagt

SEQ ID NO: 1183665 - DNA, 13 bp, Homo sapiens
caggcacaggatg

SEQ ID NO: 1183666 - DNA, 20 bp, Homo sapiens
caggcacaggatgctgtgtt

SEQ ID NO: 1183667 - DNA, 16 bp, Homo sapiens
caggcaccaaaagaag

SEQ ID NO: 1183668 - DNA, 14 bp, Homo sapiens
caggcaccaccagg

SEQ ID NO: 1183669 - DNA, 15 bp, Homo sapiens
caggcaccaccagga

SEQ ID NO: 1183670 - DNA, 16 bp, Homo sapiens
caggcaccaccaggag

SEQ ID NO: 1183671 - DNA, 19 bp, Homo sapiens
caggcaccaccaggagcag

SEQ ID NO: 1183672 - DNA, 15 bp, Homo sapiens
caggcaccccctgga

SEQ ID NO: 1183673 - DNA, 16 bp, Homo sapiens
caggcacccctcccag

SEQ ID NO: 1183674 - DNA, 13 bp, Homo sapiens
caggcaccctcag

SEQ ID NO: 1183675 - DNA, 14 bp, Homo sapiens
caggcaccctcagg

SEQ ID NO: 1183676 - DNA, 16 bp, Homo sapiens
caggcaccctcaggga

SEQ ID NO: 1183677 - DNA, 20 bp, Homo sapiens
caggcaccctcagggagcct

SEQ ID NO: 1183678 - DNA, 21 bp, Homo sapiens
caggcaccgccacgtcccagc

SEQ ID NO: 1183679 - DNA, 24 bp, Homo sapiens
caggcaccgccacgtcccagcatc

SEQ ID NO: 1183680 - DNA, 23 bp, Homo sapiens
caggcaccgggctggctgcttgc

SEQ ID NO: 1183681 - DNA, 14 bp, Homo sapiens
caggcacctcttcc

SEQ ID NO: 1183682 - DNA, 15 bp, Homo sapiens
caggcacctcttcct

SEQ ID NO: 1183683 - DNA, 12 bp, Homo sapiens
caggcacctggc

SEQ ID NO: 1183684 - DNA, 22 bp, Homo sapiens
caggcacctggcctgctgggaa

SEQ ID NO: 1183685 - DNA, 16 bp, Homo sapiens
caggcacgaacccacc

SEQ ID NO: 1183686 - DNA, 17 bp, Homo sapiens
caggcacgaacccacct

SEQ ID NO: 1183687 - DNA, 20 bp, Homo sapiens
caggcacgaacccacctgct

SEQ ID NO: 1183688 - DNA, 17 bp, Homo sapiens
caggcacgggtggtccc

SEQ ID NO: 1183689 - DNA, 18 bp, Homo sapiens
caggcacgggtggtcccc

SEQ ID NO: 1183690 - DNA, 20 bp, Homo sapiens
caggcacgggtggtccccgt

SEQ ID NO: 1183691 - DNA, 22 bp, Homo sapiens
caggcactgaacaggctggggc

SEQ ID NO: 1183692 - DNA, 22 bp, Homo sapiens
caggcactgagataccagcgag

SEQ ID NO: 1183693 - DNA, 23 bp, Homo sapiens
caggcactgagataccagcgagg

SEQ ID NO: 1183694 - DNA, 19 bp, Homo sapiens
caggcactgcccttttcag

SEQ ID NO: 1183695 - DNA, 16 bp, Homo sapiens
caggcactgccttctc

SEQ ID NO: 1183696 - DNA, 14 bp, Homo sapiens
caggcactggtggc

SEQ ID NO: 1183697 - DNA, 20 bp, Homo sapiens
caggcagaatggctgcacgt

SEQ ID NO: 1183698 - DNA, 11 bp, Homo sapiens
caggcagacac

SEQ ID NO: 1183699 - DNA, 23 bp, Homo sapiens
ctgccaggcggccctggggaggg

SEQ ID NO: 1183700 - DNA, 14 bp, Homo sapiens
ctgccaggcgttgg

SEQ ID NO: 1183701 - DNA, 13 bp, Homo sapiens
ctgccaggctgtt

SEQ ID NO: 1183702 - DNA, 12 bp, Homo sapiens
ctgccagggagc

SEQ ID NO: 1183703 - DNA, 13 bp, Homo sapiens
ctgccagggagct

SEQ ID NO: 1183704 - DNA, 11 bp, Homo sapiens
ctgccagggca

SEQ ID NO: 1183705 - DNA, 16 bp, Homo sapiens
ctgccagggcagggcc

SEQ ID NO: 1183706 - DNA, 20 bp, Homo sapiens
ctgccaggggtaacctggcc

SEQ ID NO: 1183707 - DNA, 22 bp, Homo sapiens
ctgccagtccccctgccccagg

SEQ ID NO: 1183708 - DNA, 21 bp, Homo sapiens
ctgccagtcgggagagccagg

SEQ ID NO: 1183709 - DNA, 19 bp, Homo sapiens
ctgccagtgaagtccttca

SEQ ID NO: 1183710 - DNA, 19 bp, Homo sapiens
ctgccagtgcagccactgg

SEQ ID NO: 1183711 - DNA, 14 bp, Homo sapiens
ctgccagtgccagg

SEQ ID NO: 1183712 - DNA, 15 bp, Homo sapiens
ctgccagtgccaggg

SEQ ID NO: 1183713 - DNA, 19 bp, Homo sapiens
ctgccagtgccagggtggg

SEQ ID NO: 1183714 - DNA, 20 bp, Homo sapiens
ctgccagtgccttacctcct

SEQ ID NO: 1183715 - DNA, 21 bp, Homo sapiens
ctgccagtgccttacctcctg

SEQ ID NO: 1183716 - DNA, 23 bp, Homo sapiens
ctgccagtgccttacctcctgcc

SEQ ID NO: 1183717 - DNA, 17 bp, Homo sapiens
ctgccagtgctggtcac

SEQ ID NO: 1183718 - DNA, 20 bp, Homo sapiens
ctgccataaaacattaagaa

SEQ ID NO: 1183719 - DNA, 22 bp, Homo sapiens
ctgccatagggtctgcagcctg

SEQ ID NO: 1183720 - DNA, 19 bp, Homo sapiens
ctgccatcaccgctgggtg

SEQ ID NO: 1183721 - DNA, 20 bp, Homo sapiens
ctgccatcaccgctgggtgg

SEQ ID NO: 1183722 - DNA, 16 bp, Homo sapiens
ctgccatccccctctc

SEQ ID NO: 1183723 - DNA, 15 bp, Homo sapiens
ctgccatcctcccaa

SEQ ID NO: 1183724 - DNA, 15 bp, Homo sapiens
ctgccatccttgctg

SEQ ID NO: 1183725 - DNA, 20 bp, Homo sapiens
ctgccatccttgctgcagct

SEQ ID NO: 1183726 - DNA, 17 bp, Homo sapiens
ctgccatcttctccccg

SEQ ID NO: 1183727 - DNA, 21 bp, Homo sapiens
ctgccatcttctccccgaggc

SEQ ID NO: 1183728 - DNA, 17 bp, Homo sapiens
ctgccatgacagaggct

SEQ ID NO: 1183729 - DNA, 15 bp, Homo sapiens
ctgccatgatagctg

SEQ ID NO: 1183730 - DNA, 15 bp, Homo sapiens
ctgccatgccactgc

SEQ ID NO: 1183731 - DNA, 16 bp, Homo sapiens
ctgccatgccactgcc

SEQ ID NO: 1183732 - DNA, 20 bp, Homo sapiens
ctgccatgccactgccaggc

SEQ ID NO: 1183733 - DNA, 15 bp, Homo sapiens
ctgccatgccagctt

SEQ ID NO: 1183734 - DNA, 23 bp, Homo sapiens
ctgccatggaattccctcctgag

SEQ ID NO: 1183735 - DNA, 22 bp, Homo sapiens
ctgccatggcgtgtccctctcg

SEQ ID NO: 1183736 - DNA, 22 bp, Homo sapiens
ctgccatgtaaggttgtgcagg

SEQ ID NO: 1183737 - DNA, 20 bp, Homo sapiens
ctgccatgtacctcccctgc

SEQ ID NO: 1183738 - DNA, 19 bp, Homo sapiens
ctgccatgtactagtttta

SEQ ID NO: 1183739 - DNA, 23 bp, Homo sapiens
ctgccatgtttagtgaatgactt

SEQ ID NO: 1183740 - DNA, 23 bp, Homo sapiens
ctgccattaaatccgcaaacagc

SEQ ID NO: 1183741 - DNA, 15 bp, Homo sapiens
ctgccattattttct

SEQ ID NO: 1183742 - DNA, 20 bp, Homo sapiens
ctgccattattttctgtcag

SEQ ID NO: 1183743 - DNA, 15 bp, Homo sapiens
ctgccattggcctct

SEQ ID NO: 1183744 - DNA, 13 bp, Homo sapiens
ctgccatttaaaa

SEQ ID NO: 1183745 - DNA, 21 bp, Homo sapiens
ctgccatttgcaccctccgcc

SEQ ID NO: 1183746 - DNA, 21 bp, Homo sapiens
ctgcccaaacagctgtattta

SEQ ID NO: 1183747 - DNA, 14 bp, Homo sapiens
ctgcccaaaccctt

SEQ ID NO: 1183748 - DNA, 19 bp, Homo sapiens
ctgcccaaactccccttcc

SEQ ID NO: 1183749 - DNA, 19 bp, Homo sapiens
ctgcccaaattatgtgaaa

SEQ ID NO: 1183750 - DNA, 17 bp, Homo sapiens
ctgcccaacctgctctc

SEQ ID NO: 1183751 - DNA, 21 bp, Homo sapiens
ctgcccaagcagcctggagac

SEQ ID NO: 1183752 - DNA, 11 bp, Homo sapiens
ctgcccaagtg

SEQ ID NO: 1183753 - DNA, 17 bp, Homo sapiens
ctgcccaagtgaccagg

SEQ ID NO: 1183754 - DNA, 23 bp, Homo sapiens
ctgcccaagtgaccagggaagtg

SEQ ID NO: 1183755 - DNA, 19 bp, Homo sapiens
ctgcccacatgggacctgg

SEQ ID NO: 1183756 - DNA, 17 bp, Homo sapiens
ctgcccacatttgggct

SEQ ID NO: 1183757 - DNA, 19 bp, Homo sapiens
ctgcccacatttgggctca

SEQ ID NO: 1183758 - DNA, 23 bp, Homo sapiens
ctgcccacatttgggctcagggt

SEQ ID NO: 1183759 - DNA, 13 bp, Homo sapiens
ctgcccaccaaag

SEQ ID NO: 1183760 - DNA, 15 bp, Homo sapiens
ctgcccacccccggg

SEQ ID NO: 1183761 - DNA, 16 bp, Homo sapiens
ctgcccacccccggga

SEQ ID NO: 1183762 - DNA, 21 bp, Homo sapiens
ctgcccacccccgggatcctg

SEQ ID NO: 1183763 - DNA, 15 bp, Homo sapiens
ctgcccaccccctca

SEQ ID NO: 1183764 - DNA, 12 bp, Homo sapiens
ctgcccaccctc

SEQ ID NO: 1183765 - DNA, 19 bp, Homo sapiens
ctgcccaccctccctccac

SEQ ID NO: 1183766 - DNA, 17 bp, Homo sapiens
ctgcccacctctccctg

SEQ ID NO: 1183767 - DNA, 19 bp, Homo sapiens
ctgcccacctctccctgca

SEQ ID NO: 1183768 - DNA, 14 bp, Homo sapiens
ctgcccacctgggg

SEQ ID NO: 1183769 - DNA, 16 bp, Homo sapiens
ctgcccacctggggtc

SEQ ID NO: 1183770 - DNA, 18 bp, Homo sapiens
ctgcccacgcagaggacg

SEQ ID NO: 1183771 - DNA, 17 bp, Homo sapiens
ctgcccactcgggtctg

SEQ ID NO: 1183772 - DNA, 16 bp, Homo sapiens
ctgcccactgctgcag

SEQ ID NO: 1183773 - DNA, 22 bp, Homo sapiens
ctgcccagactgatgagcacat

SEQ ID NO: 1183774 - DNA, 19 bp, Homo sapiens
ctgcccagatgccctttgg

SEQ ID NO: 1183775 - DNA, 18 bp, Homo sapiens
ctgcccagccacccctca

SEQ ID NO: 1183776 - DNA, 13 bp, Homo sapiens
ctgcccagccact

SEQ ID NO: 1183777 - DNA, 17 bp, Homo sapiens
ctgcccagccactccaa

SEQ ID NO: 1183778 - DNA, 20 bp, Homo sapiens
ctgcccagccccgctcaggc

SEQ ID NO: 1183779 - DNA, 21 bp, Homo sapiens
ctgcccagccccgctcaggcc

SEQ ID NO: 1183780 - DNA, 23 bp, Homo sapiens
ctgcccagccccgctcaggccta

SEQ ID NO: 1183781 - DNA, 12 bp, Homo sapiens
ctgcccagctct

SEQ ID NO: 1183782 - DNA, 16 bp, Homo sapiens
ctgcccagcttgggcc

SEQ ID NO: 1183783 - DNA, 19 bp, Homo sapiens
ctgcccagcttgggcccag

SEQ ID NO: 1183784 - DNA, 20 bp, Homo sapiens
ctgcccagcttgggcccagc

SEQ ID NO: 1183785 - DNA, 22 bp, Homo sapiens
ctgcccagcttgggcccagctg

SEQ ID NO: 1183786 - DNA, 19 bp, Homo sapiens
ctgcccaggagagccagcc

SEQ ID NO: 1183787 - DNA, 21 bp, Homo sapiens
ctgcccaggagagccagccct

SEQ ID NO: 1183788 - DNA, 23 bp, Homo sapiens
ctgcccaggagagccagccctcc

SEQ ID NO: 1183789 - DNA, 17 bp, Homo sapiens
ctgcccaggcctgcctg

SEQ ID NO: 1183790 - DNA, 18 bp, Homo sapiens
ctgcccaggcctgcctgt

SEQ ID NO: 1183791 - DNA, 18 bp, Homo sapiens
ctgcccaggctgtgcagc

SEQ ID NO: 1183792 - DNA, 12 bp, Homo sapiens
ctgcccagggag

SEQ ID NO: 1183793 - DNA, 13 bp, Homo sapiens
ctgcccaggggtg

SEQ ID NO: 1183794 - DNA, 16 bp, Homo sapiens
ctgcccaggggtgccc

SEQ ID NO: 1183795 - DNA, 22 bp, Homo sapiens
ctgcccaggggtgccccctcct

SEQ ID NO: 1183796 - DNA, 16 bp, Homo sapiens
ctgcccaggtggcctc

SEQ ID NO: 1183797 - DNA, 21 bp, Homo sapiens
ctgcccaggtggcctcctggc

SEQ ID NO: 1183798 - DNA, 20 bp, Homo sapiens
ctgcccagtgttgtttgtaa

SEQ ID NO: 1183799 - DNA, 21 bp, Homo sapiens
ctgcccagtgttgtttgtaaa

SEQ ID NO: 1183800 - DNA, 13 bp, Homo sapiens
ctgcccagttgca

SEQ ID NO: 1183801 - DNA, 22 bp, Homo sapiens
ctgcccatcagtgacagactgg

SEQ ID NO: 1183802 - DNA, 22 bp, Homo sapiens
ctgcccatgtcgcgctcagcat

SEQ ID NO: 1183803 - DNA, 12 bp, Homo sapiens
ctgccccaactc

SEQ ID NO: 1183804 - DNA, 14 bp, Homo sapiens
ctgccccaactcct

SEQ ID NO: 1183805 - DNA, 12 bp, Homo sapiens
ctgccccaagca

SEQ ID NO: 1183806 - DNA, 16 bp, Homo sapiens
ctgccccaagcagcca

SEQ ID NO: 1183807 - DNA, 21 bp, Homo sapiens
ctgccccaagcagccagccag

SEQ ID NO: 1183808 - DNA, 20 bp, Homo sapiens
ctgccccaaggccccaggga

SEQ ID NO: 1183809 - DNA, 21 bp, Homo sapiens
ctgccccaatcgggtccagag

SEQ ID NO: 1183810 - DNA, 20 bp, Homo sapiens
ctgccccacacctcctctca

SEQ ID NO: 1183811 - DNA, 17 bp, Homo sapiens
ctgccccacacggactc

SEQ ID NO: 1183812 - DNA, 21 bp, Homo sapiens
ctgccccacacggactcccgg

SEQ ID NO: 1183813 - DNA, 21 bp, Homo sapiens
ctgccccaccacgcatgctca

SEQ ID NO: 1183814 - DNA, 14 bp, Homo sapiens
ctgccccacctgcc

SEQ ID NO: 1183815 - DNA, 21 bp, Homo sapiens
ctgccctctgctgctgcccgg

SEQ ID NO: 1183816 - DNA, 13 bp, Homo sapiens
ctgccctgagggg

SEQ ID NO: 1183817 - DNA, 14 bp, Homo sapiens
ctgccctgaggggc

SEQ ID NO: 1183818 - DNA, 17 bp, Homo sapiens
ctgccctgcacgtcatg

SEQ ID NO: 1183819 - DNA, 12 bp, Homo sapiens
ctgccctgccca

SEQ ID NO: 1183820 - DNA, 13 bp, Homo sapiens
ctgccctgcccat

SEQ ID NO: 1183821 - DNA, 17 bp, Homo sapiens
ctgccctgccccaagtt

SEQ ID NO: 1183822 - DNA, 11 bp, Homo sapiens
ctgccctgcct

SEQ ID NO: 1183823 - DNA, 15 bp, Homo sapiens
ctgccctgcctccct

SEQ ID NO: 1183824 - DNA, 21 bp, Homo sapiens
ctgccctgcctccctttctgg

SEQ ID NO: 1183825 - DNA, 12 bp, Homo sapiens
ctgccctgcctg

SEQ ID NO: 1183826 - DNA, 12 bp, Homo sapiens
ctgatcagtgta

SEQ ID NO: 1183827 - DNA, 15 bp, Homo sapiens
ctgatcatgcattgt

SEQ ID NO: 1183828 - DNA, 17 bp, Homo sapiens
ctgatcattagagaaat

SEQ ID NO: 1183829 - DNA, 14 bp, Homo sapiens
ctgatcccaccccc

SEQ ID NO: 1183830 - DNA, 18 bp, Homo sapiens
ctgatcccaccccctcct

SEQ ID NO: 1183831 - DNA, 20 bp, Homo sapiens
ctgatcccaccccctcctcc

SEQ ID NO: 1183832 - DNA, 23 bp, Homo sapiens
ctgatcccaccccctcctccccc

SEQ ID NO: 1183833 - DNA, 13 bp, Homo sapiens
ctgatcccagacc

SEQ ID NO: 1183834 - DNA, 18 bp, Homo sapiens
ctgatcccagacccattc

SEQ ID NO: 1183835 - DNA, 23 bp, Homo sapiens
ctgatccccaagacatgtggagg

SEQ ID NO: 1183836 - DNA, 20 bp, Homo sapiens
ctgatccctgaacccctggc

SEQ ID NO: 1183837 - DNA, 21 bp, Homo sapiens
ctgatccggctgctcctccag

SEQ ID NO: 1183838 - DNA, 20 bp, Homo sapiens
ctgatcgccaacctttcccc

SEQ ID NO: 1183839 - DNA, 16 bp, Homo sapiens
ctgatcgtagaaaatt

SEQ ID NO: 1183840 - DNA, 22 bp, Homo sapiens
ctgatcgtagaaaatttgcttt

SEQ ID NO: 1183841 - DNA, 15 bp, Homo sapiens
ctgatcgtctcggcc

SEQ ID NO: 1183842 - DNA, 15 bp, Homo sapiens
ctgatcgtgctaaat

SEQ ID NO: 1183843 - DNA, 21 bp, Homo sapiens
ctgatctccataaacatgaaa

SEQ ID NO: 1183844 - DNA, 13 bp, Homo sapiens
ctgatctccatgg

SEQ ID NO: 1183845 - DNA, 20 bp, Homo sapiens
ctgatctccatggcttcctc

SEQ ID NO: 1183846 - DNA, 17 bp, Homo sapiens
ctgatctctcagcccca

SEQ ID NO: 1183847 - DNA, 21 bp, Homo sapiens
ctgatctctgacctctgctga

SEQ ID NO: 1183848 - DNA, 13 bp, Homo sapiens
ctgatctcttcct

SEQ ID NO: 1183849 - DNA, 21 bp, Homo sapiens
ctgatctcttcctgttttgta

SEQ ID NO: 1183850 - DNA, 16 bp, Homo sapiens
ctgatctgtactttgt

SEQ ID NO: 1183851 - DNA, 18 bp, Homo sapiens
ctgatctgtactttgtgt

SEQ ID NO: 1183852 - DNA, 13 bp, Homo sapiens
ctgatcttttaaa

SEQ ID NO: 1183853 - DNA, 17 bp, Homo sapiens
ctgatcttttaaaatca

SEQ ID NO: 1183854 - DNA, 18 bp, Homo sapiens
ctgatctttttatacaca

SEQ ID NO: 1183855 - DNA, 16 bp, Homo sapiens
ctgatgaaatctgcta

SEQ ID NO: 1183856 - DNA, 20 bp, Homo sapiens
ctgatgaaatctgctagaaa

SEQ ID NO: 1183857 - DNA, 16 bp, Homo sapiens
ctgatgacgcctgtct

SEQ ID NO: 1183858 - DNA, 15 bp, Homo sapiens
ctgatgagactccac

SEQ ID NO: 1183859 - DNA, 18 bp, Homo sapiens
ctgatgagactccactca

SEQ ID NO: 1183860 - DNA, 12 bp, Homo sapiens
ctgatgagcaca

SEQ ID NO: 1183861 - DNA, 20 bp, Homo sapiens
ctgatgagtttcactgtact

SEQ ID NO: 1183862 - DNA, 14 bp, Homo sapiens
ctgatgatccagaa

SEQ ID NO: 1183863 - DNA, 21 bp, Homo sapiens
ctgatgatgtctcttgtagaa

SEQ ID NO: 1183864 - DNA, 22 bp, Homo sapiens
ctgatgatgtctcttgtagaag

SEQ ID NO: 1183865 - DNA, 18 bp, Homo sapiens
ctgatgatgtcttctggt

SEQ ID NO: 1183866 - DNA, 20 bp, Homo sapiens
ctgatgatttgtttttgtat

SEQ ID NO: 1183867 - DNA, 12 bp, Homo sapiens
ctgatgcagaaa

SEQ ID NO: 1183868 - DNA, 13 bp, Homo sapiens
ctgatgcagaaat

SEQ ID NO: 1183869 - DNA, 14 bp, Homo sapiens
ctgatgcagcctgt

SEQ ID NO: 1183870 - DNA, 15 bp, Homo sapiens
ctgatgcagcctgtg

SEQ ID NO: 1183871 - DNA, 16 bp, Homo sapiens
ctgatgcagcctgtgg

SEQ ID NO: 1183872 - DNA, 21 bp, Homo sapiens
ctgatgccccttctccccttc

SEQ ID NO: 1183873 - DNA, 23 bp, Homo sapiens
ctgatgccccttctccccttcct

SEQ ID NO: 1183874 - DNA, 22 bp, Homo sapiens
ctgatgccctcttctccttgcc

SEQ ID NO: 1183875 - DNA, 13 bp, Homo sapiens
ctgatgccttttg

SEQ ID NO: 1183876 - DNA, 16 bp, Homo sapiens
ctgatgcgctgggatc

SEQ ID NO: 1183877 - DNA, 14 bp, Homo sapiens
ctgatgctccctcc

SEQ ID NO: 1183878 - DNA, 22 bp, Homo sapiens
ctgatgctccctcccctgccct

SEQ ID NO: 1183879 - DNA, 12 bp, Homo sapiens
ctgatgctgaca

SEQ ID NO: 1183880 - DNA, 18 bp, Homo sapiens
ctgatgctgaggatgatt

SEQ ID NO: 1183881 - DNA, 12 bp, Homo sapiens
ctgatgctgccc

SEQ ID NO: 1183882 - DNA, 19 bp, Homo sapiens
ctgatgctgccccgttccc

SEQ ID NO: 1183883 - DNA, 16 bp, Homo sapiens
ctgatgctgggaccct

SEQ ID NO: 1183884 - DNA, 16 bp, Homo sapiens
ctgatggaaaatacca

SEQ ID NO: 1183885 - DNA, 21 bp, Homo sapiens
ctgatggaaaataccagtgtt

SEQ ID NO: 1183886 - DNA, 20 bp, Homo sapiens
ctgatggaagtaaagcctca

SEQ ID NO: 1183887 - DNA, 21 bp, Homo sapiens
ctgatggaccgggtgggcctg

SEQ ID NO: 1183888 - DNA, 14 bp, Homo sapiens
ctgatggaggaaaa

SEQ ID NO: 1183889 - DNA, 16 bp, Homo sapiens
ctgatggaggaaaaag

SEQ ID NO: 1183890 - DNA, 19 bp, Homo sapiens
ctgatggagtgtgcagaca

SEQ ID NO: 1183891 - DNA, 21 bp, Homo sapiens
ctgatggagtgtgcagacagc

SEQ ID NO: 1183892 - DNA, 22 bp, Homo sapiens
ctgatggcacttagctatcaga

SEQ ID NO: 1183893 - DNA, 19 bp, Homo sapiens
ctgatggccaaaataccaa

SEQ ID NO: 1183894 - DNA, 13 bp, Homo sapiens
ctgatggccaaga

SEQ ID NO: 1183895 - DNA, 11 bp, Homo sapiens
ctgatggcctg

SEQ ID NO: 1183896 - DNA, 14 bp, Homo sapiens
ctgatggcctggct

SEQ ID NO: 1183897 - DNA, 19 bp, Homo sapiens
ctgatggccttaatttcct

SEQ ID NO: 1183898 - DNA, 14 bp, Homo sapiens
ctgatggcctttgg

SEQ ID NO: 1183899 - DNA, 18 bp, Homo sapiens
ctgatggcctttggaccc

SEQ ID NO: 1183900 - DNA, 21 bp, Homo sapiens
ctgatggcctttggacccagg

SEQ ID NO: 1183901 - DNA, 14 bp, Homo sapiens
ctgatggctcaaga

SEQ ID NO: 1183902 - DNA, 21 bp, Homo sapiens
ctgatggctcaagacaaggct

SEQ ID NO: 1183903 - DNA, 18 bp, Homo sapiens
ctgatggctgctagattt

SEQ ID NO: 1183904 - DNA, 18 bp, Homo sapiens
ctgatggcttgacatgtg

SEQ ID NO: 1183905 - DNA, 18 bp, Homo sapiens
ctgatgggaaggagggga

SEQ ID NO: 1183906 - DNA, 16 bp, Homo sapiens
ctgatgggctggggca

SEQ ID NO: 1183907 - DNA, 18 bp, Homo sapiens
ctgatgggctggggcagg

SEQ ID NO: 1183908 - DNA, 17 bp, Homo sapiens
ctgatggggtcgctctt

SEQ ID NO: 1183909 - DNA, 14 bp, Homo sapiens
ctgatggtcagctc

SEQ ID NO: 1183910 - DNA, 16 bp, Homo sapiens
ctgatggtcagctccc

SEQ ID NO: 1183911 - DNA, 19 bp, Homo sapiens
ctgatggtgctgctcaggc

SEQ ID NO: 1183912 - DNA, 21 bp, Homo sapiens
ctgatggtttctttttttccc

SEQ ID NO: 1183913 - DNA, 22 bp, Homo sapiens
ctgatgtcaatttctgtgttgc

SEQ ID NO: 1183914 - DNA, 13 bp, Homo sapiens
ctgatgtcccagt

SEQ ID NO: 1183915 - DNA, 17 bp, Homo sapiens
ctgatgtcccagtgctc

SEQ ID NO: 1183916 - DNA, 13 bp, Homo sapiens
ctgatgtggactg

SEQ ID NO: 1183917 - DNA, 13 bp, Homo sapiens
ctgatgtgtccct

SEQ ID NO: 1183918 - DNA, 18 bp, Homo sapiens
ctgatgtgtcccttgatg

SEQ ID NO: 1183919 - DNA, 16 bp, Homo sapiens
ctgatgttactagcct

SEQ ID NO: 1183920 - DNA, 16 bp, Homo sapiens
ctgatgttactgagat

SEQ ID NO: 1183921 - DNA, 20 bp, Homo sapiens
ctgatgttactgagatgttt

SEQ ID NO: 1183922 - DNA, 15 bp, Homo sapiens
ctgatgttggaagag

SEQ ID NO: 1183923 - DNA, 12 bp, Homo sapiens
ctgatgttgtgt

SEQ ID NO: 1183924 - DNA, 14 bp, Homo sapiens
ctgatgtttataaa

SEQ ID NO: 1183925 - DNA, 18 bp, Homo sapiens
ctgatgtttataaactga

SEQ ID NO: 1183926 - DNA, 21 bp, Homo sapiens
ctgattaaaaagggagaaaga

SEQ ID NO: 1183927 - DNA, 17 bp, Homo sapiens
ctgattaaatatttgaa

SEQ ID NO: 1183928 - DNA, 14 bp, Homo sapiens
ctgattactgtcaa

SEQ ID NO: 1183929 - DNA, 20 bp, Homo sapiens
ctgattactgtcaataaaca

SEQ ID NO: 1183930 - DNA, 20 bp, Homo sapiens
ctgattagagtgcaaaagtg

SEQ ID NO: 1183931 - DNA, 22 bp, Homo sapiens
ctgattagagtggttattcatt

SEQ ID NO: 1183932 - DNA, 14 bp, Homo sapiens
ctgagtaccttcta

SEQ ID NO: 1183933 - DNA, 18 bp, Homo sapiens
ctgagtacgttgtgcatt

SEQ ID NO: 1183934 - DNA, 19 bp, Homo sapiens
ctgagtacgttgtgcattt

SEQ ID NO: 1183935 - DNA, 20 bp, Homo sapiens
ctgagtacgttgtgcatttg

SEQ ID NO: 1183936 - DNA, 17 bp, Homo sapiens
ctgagtactggaataaa

SEQ ID NO: 1183937 - DNA, 19 bp, Homo sapiens
ctgagtagctctcctgact

SEQ ID NO: 1183938 - DNA, 13 bp, Homo sapiens
ctgagtagctggg

SEQ ID NO: 1183939 - DNA, 14 bp, Homo sapiens
ctgagtagctgggc

SEQ ID NO: 1183940 - DNA, 15 bp, Homo sapiens
ctgagtagctgggcc

SEQ ID NO: 1183941 - DNA, 16 bp, Homo sapiens
ctgagtagctgggcct

SEQ ID NO: 1183942 - DNA, 21 bp, Homo sapiens
ctgagtagctgggcctgtgca

SEQ ID NO: 1183943 - DNA, 22 bp, Homo sapiens
ctgagtagctgggcctgtgcac

SEQ ID NO: 1183944 - DNA, 14 bp, Homo sapiens
ctgagtaggtctgg

SEQ ID NO: 1183945 - DNA, 21 bp, Homo sapiens
ctgagtaggtctgggatggac

SEQ ID NO: 1183946 - DNA, 20 bp, Homo sapiens
ctgagtatgtaacttgcaat

SEQ ID NO: 1183947 - DNA, 15 bp, Homo sapiens
ctgagtattttttat

SEQ ID NO: 1183948 - DNA, 16 bp, Homo sapiens
ctgagtcaactggagc

SEQ ID NO: 1183949 - DNA, 16 bp, Homo sapiens
ctgagtcacaggtgtg

SEQ ID NO: 1183950 - DNA, 15 bp, Homo sapiens
ctgagtcaccaggaa

SEQ ID NO: 1183951 - DNA, 17 bp, Homo sapiens
ctgagtcaccaggaatg

SEQ ID NO: 1183952 - DNA, 20 bp, Homo sapiens
ctgagtcacccatgaagaca

SEQ ID NO: 1183953 - DNA, 14 bp, Homo sapiens
ctgagtcacctcct

SEQ ID NO: 1183954 - DNA, 15 bp, Homo sapiens
ctgagtcacctcctc

SEQ ID NO: 1183955 - DNA, 15 bp, Homo sapiens
ctgagtcagtgctct

SEQ ID NO: 1183956 - DNA, 22 bp, Homo sapiens
ctgagtcatctgttagggcctt

SEQ ID NO: 1183957 - DNA, 21 bp, Homo sapiens
ctgagtcatcttgtgagtgga

SEQ ID NO: 1183958 - DNA, 18 bp, Homo sapiens
ctgagtcatgatctccct

SEQ ID NO: 1183959 - DNA, 15 bp, Homo sapiens
ctgagtccagagctt

SEQ ID NO: 1183960 - DNA, 13 bp, Homo sapiens
ctgagtccagctc

SEQ ID NO: 1183961 - DNA, 19 bp, Homo sapiens
ctgagtccatgaaaatacc

SEQ ID NO: 1183962 - DNA, 14 bp, Homo sapiens
ctgagtccgcctgc

SEQ ID NO: 1183963 - DNA, 20 bp, Homo sapiens
ctgagtcctgtctctgcctg

SEQ ID NO: 1183964 - DNA, 14 bp, Homo sapiens
ctgagtcggcccca

SEQ ID NO: 1183965 - DNA, 17 bp, Homo sapiens
ctgagtcgtacagaaag

SEQ ID NO: 1183966 - DNA, 18 bp, Homo sapiens
ctgagtcgtacagaaagc

SEQ ID NO: 1183967 - DNA, 14 bp, Homo sapiens
ctgagtctatgttc

SEQ ID NO: 1183968 - DNA, 23 bp, Homo sapiens
ctgagtctatgttcaaagactgt

SEQ ID NO: 1183969 - DNA, 15 bp, Homo sapiens
ctgagtctcctgtgc

SEQ ID NO: 1183970 - DNA, 16 bp, Homo sapiens
ctgagtctcctgtgcc

SEQ ID NO: 1183971 - DNA, 17 bp, Homo sapiens
ctgagtctggacctcca

SEQ ID NO: 1183972 - DNA, 14 bp, Homo sapiens
ctgagtgaaaaatc

SEQ ID NO: 1183973 - DNA, 13 bp, Homo sapiens
ctgagtgaacctg

SEQ ID NO: 1183974 - DNA, 18 bp, Homo sapiens
ctgagtgaacctgtataa

SEQ ID NO: 1183975 - DNA, 20 bp, Homo sapiens
ctgagtgacacaagcacttt

SEQ ID NO: 1183976 - DNA, 18 bp, Homo sapiens
ctgagtgaccgggggctg

SEQ ID NO: 1183977 - DNA, 22 bp, Homo sapiens
ctgagtgactgtaggcagggaa

SEQ ID NO: 1183978 - DNA, 12 bp, Homo sapiens
ctgagtgagagg

SEQ ID NO: 1183979 - DNA, 19 bp, Homo sapiens
ctgagtgagtgtgtgtgct

SEQ ID NO: 1183980 - DNA, 20 bp, Homo sapiens
ctgagtgagttattgggagt

SEQ ID NO: 1183981 - DNA, 16 bp, Homo sapiens
ctgagtgagttttact

SEQ ID NO: 1183982 - DNA, 12 bp, Homo sapiens
ctgagtgcagcc

SEQ ID NO: 1183983 - DNA, 16 bp, Homo sapiens
ctgagtgcagccaaag

SEQ ID NO: 1183984 - DNA, 22 bp, Homo sapiens
ctgagtgcagccaaaggggagc

SEQ ID NO: 1183985 - DNA, 23 bp, Homo sapiens
ctgagtgccccacttctggccac

SEQ ID NO: 1183986 - DNA, 23 bp, Homo sapiens
ctgagtggaatgcagggaagagg

SEQ ID NO: 1183987 - DNA, 11 bp, Homo sapiens
ctgagtggagg

SEQ ID NO: 1183988 - DNA, 13 bp, Homo sapiens
ctgagtggcaggg

SEQ ID NO: 1183989 - DNA, 21 bp, Homo sapiens
ctgagtggccagccagtgcca

SEQ ID NO: 1183990 - DNA, 14 bp, Homo sapiens
ctgagtggggagca

SEQ ID NO: 1183991 - DNA, 14 bp, Homo sapiens
ctgagtggtcactg

SEQ ID NO: 1183992 - DNA, 21 bp, Homo sapiens
ctgagtggtcactggtcaggg

SEQ ID NO: 1183993 - DNA, 17 bp, Homo sapiens
ctgagtggtgttttttt

SEQ ID NO: 1183994 - DNA, 12 bp, Homo sapiens
ctgagtgtggga

SEQ ID NO: 1183995 - DNA, 18 bp, Homo sapiens
ctgagttacttgtctgag

SEQ ID NO: 1183996 - DNA, 22 bp, Homo sapiens
ctgagttacttgtctgaggcct

SEQ ID NO: 1183997 - DNA, 17 bp, Homo sapiens
ctgagttatcaggtgca

SEQ ID NO: 1183998 - DNA, 13 bp, Homo sapiens
ctgagttatgatg

SEQ ID NO: 1183999 - DNA, 15 bp, Homo sapiens
ctgagttatgatgta

SEQ ID NO: 1184000 - DNA, 22 bp, Homo sapiens
ctgagttctgggtttctagagg

SEQ ID NO: 1184001 - DNA, 15 bp, Homo sapiens
ctgagttgcttttca

SEQ ID NO: 1184002 - DNA, 16 bp, Homo sapiens
ctgagttgcttttcag

SEQ ID NO: 1184003 - DNA, 16 bp, Homo sapiens
ctgagttgggcagcca

SEQ ID NO: 1184004 - DNA, 17 bp, Homo sapiens
ctgagttgggcagccag

SEQ ID NO: 1184005 - DNA, 13 bp, Homo sapiens
ctgagttgttcta

SEQ ID NO: 1184006 - DNA, 16 bp, Homo sapiens
ctgagttgttctaaca

SEQ ID NO: 1184007 - DNA, 23 bp, Homo sapiens
ctgagtttaccatttgtaataaa

SEQ ID NO: 1184008 - DNA, 18 bp, Homo sapiens
ctgagtttatattctgaa

SEQ ID NO: 1184009 - DNA, 20 bp, Homo sapiens
ctgagtttatattctgaaag

SEQ ID NO: 1184010 - DNA, 22 bp, Homo sapiens
ctgagtttatattctgaaagga

SEQ ID NO: 1184011 - DNA, 18 bp, Homo sapiens
ctgagtttcattctcctg

SEQ ID NO: 1184012 - DNA, 16 bp, Homo sapiens
ctgagtttccagcctg

SEQ ID NO: 1184013 - DNA, 15 bp, Homo sapiens
ctgagtttcccttcc

SEQ ID NO: 1184014 - DNA, 12 bp, Homo sapiens
ctgagtttccta

SEQ ID NO: 1184015 - DNA, 15 bp, Homo sapiens
ctgagttttgttttg

SEQ ID NO: 1184016 - DNA, 13 bp, Homo sapiens
ctgataaaattgt

SEQ ID NO: 1184017 - DNA, 13 bp, Homo sapiens
ctgataaagatga

SEQ ID NO: 1184018 - DNA, 21 bp, Homo sapiens
ctgataaagatgagtgagcat

SEQ ID NO: 1184019 - DNA, 18 bp, Homo sapiens
ctgataaagcacagctgt

SEQ ID NO: 1184020 - DNA, 18 bp, Homo sapiens
ctgataagaacccagggt

SEQ ID NO: 1184021 - DNA, 15 bp, Homo sapiens
ctgataagactgttt

SEQ ID NO: 1184022 - DNA, 14 bp, Homo sapiens
ctgataatcatttt

SEQ ID NO: 1184023 - DNA, 20 bp, Homo sapiens
ctgataatgatttgctcttt

SEQ ID NO: 1184024 - DNA, 14 bp, Homo sapiens
ctgataattgtgta

SEQ ID NO: 1184025 - DNA, 15 bp, Homo sapiens
ctgataattttaaat

SEQ ID NO: 1184026 - DNA, 13 bp, Homo sapiens
ctgataattttac

SEQ ID NO: 1184027 - DNA, 12 bp, Homo sapiens
ctgatacacagt

SEQ ID NO: 1184028 - DNA, 19 bp, Homo sapiens
ctgatacacagtaattgtg

SEQ ID NO: 1184029 - DNA, 20 bp, Homo sapiens
ctgatacacagtaattgtga

SEQ ID NO: 1184030 - DNA, 23 bp, Homo sapiens
ctgatacacagtaattgtgacaa

SEQ ID NO: 1184031 - DNA, 15 bp, Homo sapiens
ctgatacatttacat

SEQ ID NO: 1184032 - DNA, 16 bp, Homo sapiens
ctcttttattctgtta

SEQ ID NO: 1184033 - DNA, 14 bp, Homo sapiens
ctcttttccactcc

SEQ ID NO: 1184034 - DNA, 19 bp, Homo sapiens
ctcttttccactccaagat

SEQ ID NO: 1184035 - DNA, 18 bp, Homo sapiens
ctcttttcccctttcctg

SEQ ID NO: 1184036 - DNA, 20 bp, Homo sapiens
ctcttttcccctttcctgtc

SEQ ID NO: 1184037 - DNA, 16 bp, Homo sapiens
ctcttttccctctcta

SEQ ID NO: 1184038 - DNA, 17 bp, Homo sapiens
ctcttttccctctctag

SEQ ID NO: 1184039 - DNA, 18 bp, Homo sapiens
ctcttttcctctctgtct

SEQ ID NO: 1184040 - DNA, 17 bp, Homo sapiens
ctcttttcctggcagct

SEQ ID NO: 1184041 - DNA, 18 bp, Homo sapiens
ctcttttcctggcagctg

SEQ ID NO: 1184042 - DNA, 20 bp, Homo sapiens
ctcttttcctggcagctgct

SEQ ID NO: 1184043 - DNA, 21 bp, Homo sapiens
ctcttttcctggcagctgctg

SEQ ID NO: 1184044 - DNA, 15 bp, Homo sapiens
ctcttttctgcatca

SEQ ID NO: 1184045 - DNA, 20 bp, Homo sapiens
ctcttttcttactcctcctc

SEQ ID NO: 1184046 - DNA, 14 bp, Homo sapiens
ctcttttgaaagta

SEQ ID NO: 1184047 - DNA, 12 bp, Homo sapiens
ctcttttgctta

SEQ ID NO: 1184048 - DNA, 21 bp, Homo sapiens
ctcttttgcttgccaaagtac

SEQ ID NO: 1184049 - DNA, 15 bp, Homo sapiens
ctcttttggccttgt

SEQ ID NO: 1184050 - DNA, 17 bp, Homo sapiens
ctcttttgggtaaaatc

SEQ ID NO: 1184051 - DNA, 22 bp, Homo sapiens
ctctttttagggccaggcaggt

SEQ ID NO: 1184052 - DNA, 19 bp, Homo sapiens
ctctttttccttcttcagc

SEQ ID NO: 1184053 - DNA, 18 bp, Homo sapiens
ctctttttctaaagtgtt

SEQ ID NO: 1184054 - DNA, 22 bp, Homo sapiens
ctctttttctgtgataactctg

SEQ ID NO: 1184055 - DNA, 14 bp, Homo sapiens
ctctttttgttttt

SEQ ID NO: 1184056 - DNA, 16 bp, Homo sapiens
ctcttttttattctgt

SEQ ID NO: 1184057 - DNA, 19 bp, Homo sapiens
ctcttttttattctgtttt

SEQ ID NO: 1184058 - DNA, 21 bp, Homo sapiens
ctcttttttattctgttttct

SEQ ID NO: 1184059 - DNA, 21 bp, Homo sapiens
ctcttttttgtttgtttcttt

SEQ ID NO: 1184060 - DNA, 22 bp, Homo sapiens
ctctttttttttttttttttgg

SEQ ID NO: 1184061 - DNA, 14 bp, Homo sapiens
ctgaaaaaaagttt

SEQ ID NO: 1184062 - DNA, 18 bp, Homo sapiens
ctgaaaaaaagtttacaa

SEQ ID NO: 1184063 - DNA, 21 bp, Homo sapiens
ctgaaaaaacacctagcttta

SEQ ID NO: 1184064 - DNA, 15 bp, Homo sapiens
ctgaaaaaatatatg

SEQ ID NO: 1184065 - DNA, 15 bp, Homo sapiens
ctgaaaaagtagatt

SEQ ID NO: 1184066 - DNA, 17 bp, Homo sapiens
ctgaaaaatcacatcct

SEQ ID NO: 1184067 - DNA, 21 bp, Homo sapiens
ctgaaaaatcacatcctggcc

SEQ ID NO: 1184068 - DNA, 23 bp, Homo sapiens
ctgaaaaatcacatcctggcctg

SEQ ID NO: 1184069 - DNA, 22 bp, Homo sapiens
ctgaaaaatctaagtgatataa

SEQ ID NO: 1184070 - DNA, 13 bp, Homo sapiens
ctgaaaaatggga

SEQ ID NO: 1184071 - DNA, 17 bp, Homo sapiens
ctgaaaacactgtgcac

SEQ ID NO: 1184072 - DNA, 18 bp, Homo sapiens
ctgaaaacctaccagcca

SEQ ID NO: 1184073 - DNA, 14 bp, Homo sapiens
ctgaaaacctctcc

SEQ ID NO: 1184074 - DNA, 15 bp, Homo sapiens
ctgaaaacgaagggg

SEQ ID NO: 1184075 - DNA, 12 bp, Homo sapiens
ctgaaaactaat

SEQ ID NO: 1184076 - DNA, 19 bp, Homo sapiens
ctgaaaactaatgtactgt

SEQ ID NO: 1184077 - DNA, 21 bp, Homo sapiens
ctgaaaactaatgtactgtac

SEQ ID NO: 1184078 - DNA, 18 bp, Homo sapiens
ctgaaaagaaggaaagat

SEQ ID NO: 1184079 - DNA, 17 bp, Homo sapiens
ctgaaaagggcactccc

SEQ ID NO: 1184080 - DNA, 19 bp, Homo sapiens
ctgaaaagggcactcccaa

SEQ ID NO: 1184081 - DNA, 15 bp, Homo sapiens
ctgaaaatataacca

SEQ ID NO: 1184082 - DNA, 20 bp, Homo sapiens
ctgaaaatattgttttacaa

SEQ ID NO: 1184083 - DNA, 22 bp, Homo sapiens
ctgaaaatattgttttacaata

SEQ ID NO: 1184084 - DNA, 24 bp, Homo sapiens
ctgaaaatattgttttacaatagt

SEQ ID NO: 1184085 - DNA, 16 bp, Homo sapiens
ctgaaaatctaatatt

SEQ ID NO: 1184086 - DNA, 17 bp, Homo sapiens
ctgaaaatctaatatta

SEQ ID NO: 1184087 - DNA, 18 bp, Homo sapiens
ctgaaaatggtattttcc

SEQ ID NO: 1184088 - DNA, 13 bp, Homo sapiens
ctgaaaatgtgct

SEQ ID NO: 1184089 - DNA, 22 bp, Homo sapiens
ctgaaaatgtttttctgccagg

SEQ ID NO: 1184090 - DNA, 17 bp, Homo sapiens
ctgaaaattatttaaac

SEQ ID NO: 1184091 - DNA, 15 bp, Homo sapiens
ctgaaaatttaacag

SEQ ID NO: 1184092 - DNA, 16 bp, Homo sapiens
ctgaaacaaaatgttt

SEQ ID NO: 1184093 - DNA, 19 bp, Homo sapiens
ctgaaacacgaaacttgtt

SEQ ID NO: 1184094 - DNA, 15 bp, Homo sapiens
ctgaaacactgcttc

SEQ ID NO: 1184095 - DNA, 16 bp, Homo sapiens
ctgaaacactgcttct

SEQ ID NO: 1184096 - DNA, 17 bp, Homo sapiens
ctgaaacagatttcata

SEQ ID NO: 1184097 - DNA, 20 bp, Homo sapiens
ctgaaacaggccctctgtgg

SEQ ID NO: 1184098 - DNA, 15 bp, Homo sapiens
cagctcccagggtgg

SEQ ID NO: 1184099 - DNA, 16 bp, Homo sapiens
cagctcccagggtgga

SEQ ID NO: 1184100 - DNA, 17 bp, Homo sapiens
cagctccccaactccct

SEQ ID NO: 1184101 - DNA, 17 bp, Homo sapiens
cagctccccccgcccac

SEQ ID NO: 1184102 - DNA, 22 bp, Homo sapiens
cagctcccccgacggtgggcat

SEQ ID NO: 1184103 - DNA, 20 bp, Homo sapiens
cagctccccggcactgcagt

SEQ ID NO: 1184104 - DNA, 14 bp, Homo sapiens
cagctccctagact

SEQ ID NO: 1184105 - DNA, 16 bp, Homo sapiens
cagctccctagactgc

SEQ ID NO: 1184106 - DNA, 23 bp, Homo sapiens
cagctccctagactgcatcccgt

SEQ ID NO: 1184107 - DNA, 18 bp, Homo sapiens
cagctccctaggagacca

SEQ ID NO: 1184108 - DNA, 13 bp, Homo sapiens
cagctccctgcac

SEQ ID NO: 1184109 - DNA, 13 bp, Homo sapiens
cagctcccttccc

SEQ ID NO: 1184110 - DNA, 14 bp, Homo sapiens
cagctcccttctct

SEQ ID NO: 1184111 - DNA, 15 bp, Homo sapiens
cagctcccttctctg

SEQ ID NO: 1184112 - DNA, 22 bp, Homo sapiens
cagctcccttgggaaggacaca

SEQ ID NO: 1184113 - DNA, 19 bp, Homo sapiens
cagctcctaacccttatca

SEQ ID NO: 1184114 - DNA, 11 bp, Homo sapiens
cagctcctcac

SEQ ID NO: 1184115 - DNA, 13 bp, Homo sapiens
cagctcctcagcg

SEQ ID NO: 1184116 - DNA, 18 bp, Homo sapiens
cagctcctcagcggctcc

SEQ ID NO: 1184117 - DNA, 15 bp, Homo sapiens
cagctcctccagccc

SEQ ID NO: 1184118 - DNA, 21 bp, Homo sapiens
cagctcctcccttgttctcta

SEQ ID NO: 1184119 - DNA, 14 bp, Homo sapiens
cagctcctctaggg

SEQ ID NO: 1184120 - DNA, 23 bp, Homo sapiens
cagctcctctaggggcagcctcc

SEQ ID NO: 1184121 - DNA, 19 bp, Homo sapiens
cagctcctgagtagctggg

SEQ ID NO: 1184122 - DNA, 23 bp, Homo sapiens
cagctcctgagtagctgggcctg

SEQ ID NO: 1184123 - DNA, 13 bp, Homo sapiens
cagctccttcctg

SEQ ID NO: 1184124 - DNA, 16 bp, Homo sapiens
cagctccttcctggag

SEQ ID NO: 1184125 - DNA, 19 bp, Homo sapiens
cagctcctttctcctgtga

SEQ ID NO: 1184126 - DNA, 13 bp, Homo sapiens
cagctcgaggccc

SEQ ID NO: 1184127 - DNA, 15 bp, Homo sapiens
cagctcgtgggctgg

SEQ ID NO: 1184128 - DNA, 18 bp, Homo sapiens
cagctcgtgtgtcctcat

SEQ ID NO: 1184129 - DNA, 21 bp, Homo sapiens
cagctcgtttttcagcacccc

SEQ ID NO: 1184130 - DNA, 18 bp, Homo sapiens
cagctctaagcagccagg

SEQ ID NO: 1184131 - DNA, 22 bp, Homo sapiens
cagctctaagcagccaggaggg

SEQ ID NO: 1184132 - DNA, 17 bp, Homo sapiens
cagctctagacaaccct

SEQ ID NO: 1184133 - DNA, 20 bp, Homo sapiens
cagctctagacactgccaca

SEQ ID NO: 1184134 - DNA, 17 bp, Homo sapiens
cagctctagctttgcag

SEQ ID NO: 1184135 - DNA, 14 bp, Homo sapiens
cagctctcccacat

SEQ ID NO: 1184136 - DNA, 12 bp, Homo sapiens
cagctctccctc

SEQ ID NO: 1184137 - DNA, 15 bp, Homo sapiens
cagctctccctctgg

SEQ ID NO: 1184138 - DNA, 18 bp, Homo sapiens
cagctctccctctggccc

SEQ ID NO: 1184139 - DNA, 20 bp, Homo sapiens
cagctctccctctggccctg

SEQ ID NO: 1184140 - DNA, 14 bp, Homo sapiens
cagctctcctggct

SEQ ID NO: 1184141 - DNA, 17 bp, Homo sapiens
cagctctcctggctccc

SEQ ID NO: 1184142 - DNA, 14 bp, Homo sapiens
cagctctcgttctc

SEQ ID NO: 1184143 - DNA, 21 bp, Homo sapiens
cagctctcgttctccttcccc

SEQ ID NO: 1184144 - DNA, 23 bp, Homo sapiens
cagctctctctacccggcccaga

SEQ ID NO: 1184145 - DNA, 15 bp, Homo sapiens
cagctctctgacgct

SEQ ID NO: 1184146 - DNA, 11 bp, Homo sapiens
cagctctctgc

SEQ ID NO: 1184147 - DNA, 17 bp, Homo sapiens
cagctctctgccctgtg

SEQ ID NO: 1184148 - DNA, 16 bp, Homo sapiens
cagctctgaaagagaa

SEQ ID NO: 1184149 - DNA, 14 bp, Homo sapiens
cagctctgacatcc

SEQ ID NO: 1184150 - DNA, 16 bp, Homo sapiens
cagctctgacatccct

SEQ ID NO: 1184151 - DNA, 18 bp, Homo sapiens
cagctctgacatcccttc

SEQ ID NO: 1184152 - DNA, 19 bp, Homo sapiens
cagctctgacatcccttcc

SEQ ID NO: 1184153 - DNA, 22 bp, Homo sapiens
cagctctgacatcccttcctgg

SEQ ID NO: 1184154 - DNA, 21 bp, Homo sapiens
cagctctgacattctgattcg

SEQ ID NO: 1184155 - DNA, 22 bp, Homo sapiens
cagctctgagacccttttctca

SEQ ID NO: 1184156 - DNA, 16 bp, Homo sapiens
cagctctgaggggagg

SEQ ID NO: 1184157 - DNA, 12 bp, Homo sapiens
cagctctgcccc

SEQ ID NO: 1184158 - DNA, 14 bp, Homo sapiens
cagctctgcccccg

SEQ ID NO: 1184159 - DNA, 15 bp, Homo sapiens
cagctctgcccccgc

SEQ ID NO: 1184160 - DNA, 23 bp, Homo sapiens
cagctctgcccccgcgggttcta

SEQ ID NO: 1184161 - DNA, 17 bp, Homo sapiens
cagctctgggaactgaa

SEQ ID NO: 1184162 - DNA, 14 bp, Homo sapiens
cagctctgggagag

SEQ ID NO: 1184163 - DNA, 19 bp, Homo sapiens
cagctctgggccattctcc

SEQ ID NO: 1184164 - DNA, 13 bp, Homo sapiens
cagctctgggcct

SEQ ID NO: 1184165 - DNA, 15 bp, Homo sapiens
cagctctgtggcctg

SEQ ID NO: 1184166 - DNA, 16 bp, Homo sapiens
cagctctgtggcctgt

SEQ ID NO: 1184167 - DNA, 17 bp, Homo sapiens
cagctctgtggcctgtg

SEQ ID NO: 1184168 - DNA, 11 bp, Homo sapiens
cagctcttcca

SEQ ID NO: 1184169 - DNA, 18 bp, Homo sapiens
cagctcttccagggcagc

SEQ ID NO: 1184170 - DNA, 23 bp, Homo sapiens
cagctcttccagggcagcggctc

SEQ ID NO: 1184171 - DNA, 12 bp, Homo sapiens
cagctcttctgg

SEQ ID NO: 1184172 - DNA, 23 bp, Homo sapiens
cagctcttctggagtttctctaa

SEQ ID NO: 1184173 - DNA, 15 bp, Homo sapiens
cagctcttctgggca

SEQ ID NO: 1184174 - DNA, 17 bp, Homo sapiens
cagctcttctgggcaga

SEQ ID NO: 1184175 - DNA, 18 bp, Homo sapiens
cagctcttctgggcagag

SEQ ID NO: 1184176 - DNA, 22 bp, Homo sapiens
cagctcttctgggcagagcctg

SEQ ID NO: 1184177 - DNA, 20 bp, Homo sapiens
cagctcttgatttgggtgga

SEQ ID NO: 1184178 - DNA, 19 bp, Homo sapiens
cagctcttgcccttccctg

SEQ ID NO: 1184179 - DNA, 18 bp, Homo sapiens
cagctcttggctccactg

SEQ ID NO: 1184180 - DNA, 15 bp, Homo sapiens
cagctctttccaaat

SEQ ID NO: 1184181 - DNA, 22 bp, Homo sapiens
cagctctttgaaatagtctgtg

SEQ ID NO: 1184182 - DNA, 22 bp, Homo sapiens
cagctgaaacattccgaagagg

SEQ ID NO: 1184183 - DNA, 21 bp, Homo sapiens
cagctgaaattgggtggagga

SEQ ID NO: 1184184 - DNA, 15 bp, Homo sapiens
cagctgaacagccaa

SEQ ID NO: 1184185 - DNA, 15 bp, Homo sapiens
cagctgaaccctgct

SEQ ID NO: 1184186 - DNA, 20 bp, Homo sapiens
cagctgaagaaaaaatcaga

SEQ ID NO: 1184187 - DNA, 19 bp, Homo sapiens
cagctgaagtctctttttc

SEQ ID NO: 1184188 - DNA, 23 bp, Homo sapiens
cagctgaatgcctcctgtgggga

SEQ ID NO: 1184189 - DNA, 13 bp, Homo sapiens
cagctgacctctg

SEQ ID NO: 1184190 - DNA, 17 bp, Homo sapiens
cagctgacctctgttgt

SEQ ID NO: 1184191 - DNA, 18 bp, Homo sapiens
cagctgacctctgttgtc

SEQ ID NO: 1184192 - DNA, 22 bp, Homo sapiens
cagctgactgttggctctctga

SEQ ID NO: 1184193 - DNA, 21 bp, Homo sapiens
cagctgacttggttctgaagc

SEQ ID NO: 1184194 - DNA, 16 bp, Homo sapiens
cagctgagaccagggt

SEQ ID NO: 1184195 - DNA, 14 bp, Homo sapiens
cagctgagaggctg

SEQ ID NO: 1184196 - DNA, 22 bp, Homo sapiens
cagctgagcacttagcaggcac

SEQ ID NO: 1184197 - DNA, 14 bp, Homo sapiens
cagctgagcgccag

SEQ ID NO: 1184198 - DNA, 16 bp, Homo sapiens
cagctgagcgccagga

SEQ ID NO: 1184199 - DNA, 18 bp, Homo sapiens
cagctgagcgccaggatg

SEQ ID NO: 1184200 - DNA, 23 bp, Homo sapiens
cagctgaggctgggggagagccg

SEQ ID NO: 1184201 - DNA, 18 bp, Homo sapiens
cagctgagttatgatgta

SEQ ID NO: 1184202 - DNA, 17 bp, Homo sapiens
cagctgatccataggac

SEQ ID NO: 1184203 - DNA, 20 bp, Homo sapiens
cagctgatccataggactac

SEQ ID NO: 1184204 - DNA, 20 bp, Homo sapiens
cagctgatgttggaagagaa

SEQ ID NO: 1184205 - DNA, 20 bp, Homo sapiens
cagctgattttaacaataac

SEQ ID NO: 1184206 - DNA, 18 bp, Homo sapiens
cagctgcaattccctgga

SEQ ID NO: 1184207 - DNA, 14 bp, Homo sapiens
cagctgcacattcc

SEQ ID NO: 1184208 - DNA, 20 bp, Homo sapiens
cagctgcacattcctggccc

SEQ ID NO: 1184209 - DNA, 21 bp, Homo sapiens
cagctgcacattcctggcccc

SEQ ID NO: 1184210 - DNA, 19 bp, Homo sapiens
cagctgcaccccagcgtca

SEQ ID NO: 1184211 - DNA, 13 bp, Homo sapiens
cagctgcagacca

SEQ ID NO: 1184212 - DNA, 14 bp, Homo sapiens
cagctgcagaccat

SEQ ID NO: 1184213 - DNA, 15 bp, Homo sapiens
cagctgcagctgatc

SEQ ID NO: 1184214 - DNA, 15 bp, Homo sapiens
cagctgcagctgggc

SEQ ID NO: 1184215 - DNA, 18 bp, Homo sapiens
cagctgcagctgggcccc

SEQ ID NO: 1184216 - DNA, 19 bp, Homo sapiens
cagctgcagctgggcccca

SEQ ID NO: 1184217 - DNA, 11 bp, Homo sapiens
cagctgcaggg

SEQ ID NO: 1184218 - DNA, 17 bp, Homo sapiens
cagctgcagggcacggg

SEQ ID NO: 1184219 - DNA, 19 bp, Homo sapiens
cagctgcatggagcctgga

SEQ ID NO: 1184220 - DNA, 20 bp, Homo sapiens
ctgagcaccgtgtcaagctg

SEQ ID NO: 1184221 - DNA, 23 bp, Homo sapiens
ctgagcaccgtgtcaagctgctc

SEQ ID NO: 1184222 - DNA, 13 bp, Homo sapiens
ctgagcacctgct

SEQ ID NO: 1184223 - DNA, 15 bp, Homo sapiens
ctgagcacttagcag

SEQ ID NO: 1184224 - DNA, 20 bp, Homo sapiens
ctgagcacttagcaggcacc

SEQ ID NO: 1184225 - DNA, 16 bp, Homo sapiens
ctgagcagaatactgg

SEQ ID NO: 1184226 - DNA, 13 bp, Homo sapiens
ctgagcagccgcc

SEQ ID NO: 1184227 - DNA, 14 bp, Homo sapiens
ctgagcagccgcca

SEQ ID NO: 1184228 - DNA, 15 bp, Homo sapiens
ctgagcagccgccag

SEQ ID NO: 1184229 - DNA, 18 bp, Homo sapiens
ctgagcagccgccagctg

SEQ ID NO: 1184230 - DNA, 20 bp, Homo sapiens
ctgagcaggacagccagcag

SEQ ID NO: 1184231 - DNA, 13 bp, Homo sapiens
ctgagcaggggca

SEQ ID NO: 1184232 - DNA, 18 bp, Homo sapiens
ctgagcaggggcaggcgc

SEQ ID NO: 1184233 - DNA, 20 bp, Homo sapiens
ctgagcaggggcaggcgcag

SEQ ID NO: 1184234 - DNA, 14 bp, Homo sapiens
ctgagcatcaagaa

SEQ ID NO: 1184235 - DNA, 22 bp, Homo sapiens
ctgagcattcaggcagcactga

SEQ ID NO: 1184236 - DNA, 22 bp, Homo sapiens
ctgagcattcgctgtacccttt

SEQ ID NO: 1184237 - DNA, 19 bp, Homo sapiens
ctgagccaagggagggaag

SEQ ID NO: 1184238 - DNA, 20 bp, Homo sapiens
ctgagcccaaccaggccctg

SEQ ID NO: 1184239 - DNA, 22 bp, Homo sapiens
ctgagcccaaccaggccctgcc

SEQ ID NO: 1184240 - DNA, 11 bp, Homo sapiens
ctgagcccagg

SEQ ID NO: 1184241 - DNA, 13 bp, Homo sapiens
ctgagcccaggag

SEQ ID NO: 1184242 - DNA, 13 bp, Homo sapiens
ctgagcccaggcc

SEQ ID NO: 1184243 - DNA, 19 bp, Homo sapiens
ctgagcccaggccgttccc

SEQ ID NO: 1184244 - DNA, 16 bp, Homo sapiens
ctgagcccatgttctg

SEQ ID NO: 1184245 - DNA, 17 bp, Homo sapiens
ctgagccccacctctcc

SEQ ID NO: 1184246 - DNA, 20 bp, Homo sapiens
ctgagccccagggtgcccag

SEQ ID NO: 1184247 - DNA, 14 bp, Homo sapiens
ctgagcccccaccg

SEQ ID NO: 1184248 - DNA, 21 bp, Homo sapiens
ctgagcccccccaacactgtg

SEQ ID NO: 1184249 - DNA, 14 bp, Homo sapiens
ctgagcccccggct

SEQ ID NO: 1184250 - DNA, 16 bp, Homo sapiens
ctgagcccccggctag

SEQ ID NO: 1184251 - DNA, 22 bp, Homo sapiens
ctgagcccccggctagtaccct

SEQ ID NO: 1184252 - DNA, 18 bp, Homo sapiens
ctgagccccgccctcttc

SEQ ID NO: 1184253 - DNA, 23 bp, Homo sapiens
ctgagccccgccctcttcctgac

SEQ ID NO: 1184254 - DNA, 13 bp, Homo sapiens
ctgagcccctacc

SEQ ID NO: 1184255 - DNA, 12 bp, Homo sapiens
ctgagcccctgg

SEQ ID NO: 1184256 - DNA, 14 bp, Homo sapiens
ctgagcccctggtc

SEQ ID NO: 1184257 - DNA, 19 bp, Homo sapiens
ctgagcccctggtcttctc

SEQ ID NO: 1184258 - DNA, 12 bp, Homo sapiens
ctgagcccctgt

SEQ ID NO: 1184259 - DNA, 15 bp, Homo sapiens
ctgagcccctgtcta

SEQ ID NO: 1184260 - DNA, 16 bp, Homo sapiens
ctgagcccctgtctag

SEQ ID NO: 1184261 - DNA, 23 bp, Homo sapiens
ctgagcccctgtctagagaggga

SEQ ID NO: 1184262 - DNA, 16 bp, Homo sapiens
ctgagccccttccttg

SEQ ID NO: 1184263 - DNA, 17 bp, Homo sapiens
ctgagcccggccctccc

SEQ ID NO: 1184264 - DNA, 18 bp, Homo sapiens
ctgagcccgggctgcctg

SEQ ID NO: 1184265 - DNA, 20 bp, Homo sapiens
ctgagcccgggctgcctggg

SEQ ID NO: 1184266 - DNA, 19 bp, Homo sapiens
ctgagcccggtaagagcaa

SEQ ID NO: 1184267 - DNA, 20 bp, Homo sapiens
ctgagccctactccctgcag

SEQ ID NO: 1184268 - DNA, 22 bp, Homo sapiens
ctgagccctactccctgcagat

SEQ ID NO: 1184269 - DNA, 23 bp, Homo sapiens
ctgagccctactccctgcagatg

SEQ ID NO: 1184270 - DNA, 15 bp, Homo sapiens
ctgagccctggcagg

SEQ ID NO: 1184271 - DNA, 19 bp, Homo sapiens
ctgagccctgtacccaccc

SEQ ID NO: 1184272 - DNA, 18 bp, Homo sapiens
ctgagccggccccaggct

SEQ ID NO: 1184273 - DNA, 16 bp, Homo sapiens
ctgagcctcagtctcc

SEQ ID NO: 1184274 - DNA, 22 bp, Homo sapiens
ctgagcctcagtctccctccct

SEQ ID NO: 1184275 - DNA, 13 bp, Homo sapiens
ctgagcctctcac

SEQ ID NO: 1184276 - DNA, 22 bp, Homo sapiens
ctgagcctctcacctgtactct

SEQ ID NO: 1184277 - DNA, 17 bp, Homo sapiens
ctgagcctgcattctgc

SEQ ID NO: 1184278 - DNA, 14 bp, Homo sapiens
ctgagcctggctgg

SEQ ID NO: 1184279 - DNA, 17 bp, Homo sapiens
ctgagcctggctggaga

SEQ ID NO: 1184280 - DNA, 22 bp, Homo sapiens
ctgagcctgtgggtccccactc

SEQ ID NO: 1184281 - DNA, 21 bp, Homo sapiens
ctgagccttgtaattctaaat

SEQ ID NO: 1184282 - DNA, 19 bp, Homo sapiens
ctgagcggcaccctggtct

SEQ ID NO: 1184283 - DNA, 22 bp, Homo sapiens
ctgagcggcaccctggtctgtg

SEQ ID NO: 1184284 - DNA, 18 bp, Homo sapiens
ctgagcgggaggcagagt

SEQ ID NO: 1184285 - DNA, 16 bp, Homo sapiens
ctgagcgtggaagggg

SEQ ID NO: 1184286 - DNA, 18 bp, Homo sapiens
ctgagcgtggaaggggga

SEQ ID NO: 1184287 - DNA, 19 bp, Homo sapiens
ctgagcgtggaagggggag

SEQ ID NO: 1184288 - DNA, 22 bp, Homo sapiens
ctgagcgtggaagggggaggag

SEQ ID NO: 1184289 - DNA, 16 bp, Homo sapiens
ctgagctagcctccag

SEQ ID NO: 1184290 - DNA, 24 bp, Homo sapiens
ctgagctattttcctctggccgca

SEQ ID NO: 1184291 - DNA, 13 bp, Homo sapiens
ctgagctccacct

SEQ ID NO: 1184292 - DNA, 17 bp, Homo sapiens
ctgagctccacctctgg

SEQ ID NO: 1184293 - DNA, 22 bp, Homo sapiens
ctgagctccacctctggtggct

SEQ ID NO: 1184294 - DNA, 19 bp, Homo sapiens
ctgagctcccacctccctt

SEQ ID NO: 1184295 - DNA, 22 bp, Homo sapiens
ctgagctcccacctcccttccc

SEQ ID NO: 1184296 - DNA, 23 bp, Homo sapiens
ctgagctccccagatctcccact

SEQ ID NO: 1184297 - DNA, 14 bp, Homo sapiens
ctgagctcctctgg

SEQ ID NO: 1184298 - DNA, 15 bp, Homo sapiens
ctgagctcctctggg

SEQ ID NO: 1184299 - DNA, 16 bp, Homo sapiens
ctgagctcctctgggc

SEQ ID NO: 1184300 - DNA, 17 bp, Homo sapiens
ctgagctcctctgggca

SEQ ID NO: 1184301 - DNA, 20 bp, Homo sapiens
ctgagctcggtggacccagg

SEQ ID NO: 1184302 - DNA, 13 bp, Homo sapiens
ctgagctctccag

SEQ ID NO: 1184303 - DNA, 22 bp, Homo sapiens
ctgagctctccaggccaggtgg

SEQ ID NO: 1184304 - DNA, 12 bp, Homo sapiens
ctgagctgaggc

SEQ ID NO: 1184305 - DNA, 13 bp, Homo sapiens
ctgagctgaggca

SEQ ID NO: 1184306 - DNA, 15 bp, Homo sapiens
ctgagctgaggcagc

SEQ ID NO: 1184307 - DNA, 16 bp, Homo sapiens
ctgagctgagtggcca

SEQ ID NO: 1184308 - DNA, 13 bp, Homo sapiens
ctgagctgctcac

SEQ ID NO: 1184309 - DNA, 15 bp, Homo sapiens
ctgagctgctcaccg

SEQ ID NO: 1184310 - DNA, 20 bp, Homo sapiens
ctctgcatcccagcacctgc

SEQ ID NO: 1184311 - DNA, 17 bp, Homo sapiens
ctctgcatctactccca

SEQ ID NO: 1184312 - DNA, 14 bp, Homo sapiens
ctctgcattctagt

SEQ ID NO: 1184313 - DNA, 21 bp, Homo sapiens
ctctgccaatgtgggctgccc

SEQ ID NO: 1184314 - DNA, 10 bp, Homo sapiens
ctctgccacc

SEQ ID NO: 1184315 - DNA, 12 bp, Homo sapiens
ctctgccaccca

SEQ ID NO: 1184316 - DNA, 19 bp, Homo sapiens
ctctgccacccactcagga

SEQ ID NO: 1184317 - DNA, 18 bp, Homo sapiens
ctctgccaccctacctgt

SEQ ID NO: 1184318 - DNA, 13 bp, Homo sapiens
ctctgccacctcc

SEQ ID NO: 1184319 - DNA, 14 bp, Homo sapiens
ctctgccacctccc

SEQ ID NO: 1184320 - DNA, 18 bp, Homo sapiens
ctctgccacctcccctat

SEQ ID NO: 1184321 - DNA, 14 bp, Homo sapiens
ctctgccagccaca

SEQ ID NO: 1184322 - DNA, 12 bp, Homo sapiens
ctctgcccacct

SEQ ID NO: 1184323 - DNA, 13 bp, Homo sapiens
ctctgcccagctt

SEQ ID NO: 1184324 - DNA, 19 bp, Homo sapiens
ctctgccccaagcagccag

SEQ ID NO: 1184325 - DNA, 16 bp, Homo sapiens
ctctgccccaagcccc

SEQ ID NO: 1184326 - DNA, 16 bp, Homo sapiens
ctctgccccaccttgc

SEQ ID NO: 1184327 - DNA, 20 bp, Homo sapiens
ctctgccccaccttgccagg

SEQ ID NO: 1184328 - DNA, 15 bp, Homo sapiens
ctctgccccacgctg

SEQ ID NO: 1184329 - DNA, 17 bp, Homo sapiens
ctctgccccagctctgg

SEQ ID NO: 1184330 - DNA, 16 bp, Homo sapiens
ctctgccccaggccct

SEQ ID NO: 1184331 - DNA, 22 bp, Homo sapiens
ctctgccccatcctccagcagg

SEQ ID NO: 1184332 - DNA, 23 bp, Homo sapiens
ctctgcccccgcgggttctagac

SEQ ID NO: 1184333 - DNA, 16 bp, Homo sapiens
ctctgcccctcagggg

SEQ ID NO: 1184334 - DNA, 16 bp, Homo sapiens
ctctgcccctggacct

SEQ ID NO: 1184335 - DNA, 20 bp, Homo sapiens
ctctgccccttgggcatcca

SEQ ID NO: 1184336 - DNA, 21 bp, Homo sapiens
ctctgccccttgggcatccac

SEQ ID NO: 1184337 - DNA, 16 bp, Homo sapiens
ctctgcccgcagagcc

SEQ ID NO: 1184338 - DNA, 21 bp, Homo sapiens
ctctgcccgggccccttgctg

SEQ ID NO: 1184339 - DNA, 16 bp, Homo sapiens
ctctgccctctccctg

SEQ ID NO: 1184340 - DNA, 15 bp, Homo sapiens
ctctgccctctgctg

SEQ ID NO: 1184341 - DNA, 17 bp, Homo sapiens
ctctgccctctgctgct

SEQ ID NO: 1184342 - DNA, 12 bp, Homo sapiens
ctctgcccttcc

SEQ ID NO: 1184343 - DNA, 14 bp, Homo sapiens
ctctgcccttcccc

SEQ ID NO: 1184344 - DNA, 15 bp, Homo sapiens
ctctgccgctacctc

SEQ ID NO: 1184345 - DNA, 20 bp, Homo sapiens
ctctgccggctctttccttg

SEQ ID NO: 1184346 - DNA, 22 bp, Homo sapiens
ctctgccggctctttccttgct

SEQ ID NO: 1184347 - DNA, 18 bp, Homo sapiens
ctctgccggtcgggcagc

SEQ ID NO: 1184348 - DNA, 24 bp, Homo sapiens
ctctgccggtcgggcagccagcag

SEQ ID NO: 1184349 - DNA, 19 bp, Homo sapiens
ctctgccgtctctcctgct

SEQ ID NO: 1184350 - DNA, 16 bp, Homo sapiens
ctctgcctacagccag

SEQ ID NO: 1184351 - DNA, 22 bp, Homo sapiens
ctctgcctcagacgttgcctga

SEQ ID NO: 1184352 - DNA, 14 bp, Homo sapiens
ctctgcctccctca

SEQ ID NO: 1184353 - DNA, 22 bp, Homo sapiens
ctctgcctcctggtttcctttc

SEQ ID NO: 1184354 - DNA, 14 bp, Homo sapiens
ctctgcctctccca

SEQ ID NO: 1184355 - DNA, 11 bp, Homo sapiens
ctctgcctctg

SEQ ID NO: 1184356 - DNA, 20 bp, Homo sapiens
ctctgcctctgggcagcctg

SEQ ID NO: 1184357 - DNA, 18 bp, Homo sapiens
ctctgcctgcactccctg

SEQ ID NO: 1184358 - DNA, 21 bp, Homo sapiens
ctctgcctgcactccctggcc

SEQ ID NO: 1184359 - DNA, 12 bp, Homo sapiens
ctctgcctgccc

SEQ ID NO: 1184360 - DNA, 15 bp, Homo sapiens
ctctgcctgccccgc

SEQ ID NO: 1184361 - DNA, 11 bp, Homo sapiens
ctctgcctgga

SEQ ID NO: 1184362 - DNA, 14 bp, Homo sapiens
ctctgcctggagtg

SEQ ID NO: 1184363 - DNA, 22 bp, Homo sapiens
ctctgcctgggatgggctccca

SEQ ID NO: 1184364 - DNA, 18 bp, Homo sapiens
ctctgcctgggctctgga

SEQ ID NO: 1184365 - DNA, 20 bp, Homo sapiens
ctctgcctgggctctggaag

SEQ ID NO: 1184366 - DNA, 19 bp, Homo sapiens
ctctgcctgtccctctcag

SEQ ID NO: 1184367 - DNA, 21 bp, Homo sapiens
ctctgcctgtccctctcaggc

SEQ ID NO: 1184368 - DNA, 18 bp, Homo sapiens
ctctgccttcaggcttct

SEQ ID NO: 1184369 - DNA, 14 bp, Homo sapiens
ctctgcctttatga

SEQ ID NO: 1184370 - DNA, 23 bp, Homo sapiens
ctctgcctttatgatgctaagct

SEQ ID NO: 1184371 - DNA, 15 bp, Homo sapiens
ctctgcgccaggcag

SEQ ID NO: 1184372 - DNA, 22 bp, Homo sapiens
ctctgcgccaggcagagctgag

SEQ ID NO: 1184373 - DNA, 16 bp, Homo sapiens
ctctgcggccactgcg

SEQ ID NO: 1184374 - DNA, 19 bp, Homo sapiens
ctctgcggccactgcgcca

SEQ ID NO: 1184375 - DNA, 16 bp, Homo sapiens
ctctgcgggaggctgg

SEQ ID NO: 1184376 - DNA, 18 bp, Homo sapiens
ctctgcgggaggctgggg

SEQ ID NO: 1184377 - DNA, 23 bp, Homo sapiens
ctctgcgggaggctggggcccca

SEQ ID NO: 1184378 - DNA, 19 bp, Homo sapiens
ctctgcgtcggtcctggtg

SEQ ID NO: 1184379 - DNA, 16 bp, Homo sapiens
ctctgctaatcatgtg

SEQ ID NO: 1184380 - DNA, 15 bp, Homo sapiens
ctctgctatgcattt

SEQ ID NO: 1184381 - DNA, 14 bp, Homo sapiens
ctctgctcaggcct

SEQ ID NO: 1184382 - DNA, 16 bp, Homo sapiens
ctctgctcaggcctcc

SEQ ID NO: 1184383 - DNA, 18 bp, Homo sapiens
ctctgctccaccacatcc

SEQ ID NO: 1184384 - DNA, 15 bp, Homo sapiens
ctctgctccagactc

SEQ ID NO: 1184385 - DNA, 21 bp, Homo sapiens
ctctgctccagcaactgccct

SEQ ID NO: 1184386 - DNA, 14 bp, Homo sapiens
ctctgctcctacat

SEQ ID NO: 1184387 - DNA, 20 bp, Homo sapiens
ctctgctcctacatccagct

SEQ ID NO: 1184388 - DNA, 23 bp, Homo sapiens
ctctgctcctacatccagctcct

SEQ ID NO: 1184389 - DNA, 14 bp, Homo sapiens
ctctgctcctggag

SEQ ID NO: 1184390 - DNA, 22 bp, Homo sapiens
ctctgctcctggagcctttgaa

SEQ ID NO: 1184391 - DNA, 20 bp, Homo sapiens
ctctgctcgccctcctttct

SEQ ID NO: 1184392 - DNA, 12 bp, Homo sapiens
ctctgctctagc

SEQ ID NO: 1184393 - DNA, 13 bp, Homo sapiens
ctctgctctagcc

SEQ ID NO: 1184394 - DNA, 17 bp, Homo sapiens
ctctgctctgcctggag

SEQ ID NO: 1184395 - DNA, 16 bp, Homo sapiens
ctctgctcttgtttca

SEQ ID NO: 1184396 - DNA, 14 bp, Homo sapiens
ctctgctgaaggtt

SEQ ID NO: 1184397 - DNA, 16 bp, Homo sapiens
ctctgctgacctgctg

SEQ ID NO: 1184398 - DNA, 18 bp, Homo sapiens
ctctgctgagctgggccc

SEQ ID NO: 1184399 - DNA, 14 bp, Homo sapiens
ctctgctgagtgct

SEQ ID NO: 1184400 - DNA, 16 bp, Homo sapiens
ctctgctgagtgctgg

SEQ ID NO: 1184401 - DNA, 21 bp, Homo sapiens
ctctgctgagtgctgggcact

SEQ ID NO: 1184402 - DNA, 23 bp, Homo sapiens
ctctgctgagtgctgggcactgc

SEQ ID NO: 1184403 - DNA, 14 bp, Homo sapiens
ctctgctgccccct

SEQ ID NO: 1184404 - DNA, 17 bp, Homo sapiens
cagcagccagctctcag

SEQ ID NO: 1184405 - DNA, 18 bp, Homo sapiens
cagcagccagctctcagc

SEQ ID NO: 1184406 - DNA, 15 bp, Homo sapiens
cagcagccagtctca

SEQ ID NO: 1184407 - DNA, 20 bp, Homo sapiens
cagcagccagtctcagagac

SEQ ID NO: 1184408 - DNA, 21 bp, Homo sapiens
cagcagccagtctcagagacc

SEQ ID NO: 1184409 - DNA, 24 bp, Homo sapiens
cagcagccagtctcagagaccagc

SEQ ID NO: 1184410 - DNA, 12 bp, Homo sapiens
cagcagcccagc

SEQ ID NO: 1184411 - DNA, 15 bp, Homo sapiens
cagcagccccccagc

SEQ ID NO: 1184412 - DNA, 20 bp, Homo sapiens
cagcagccctaaggatctct

SEQ ID NO: 1184413 - DNA, 24 bp, Homo sapiens
cagcagccctaaggatctctcagg

SEQ ID NO: 1184414 - DNA, 11 bp, Homo sapiens
cagcagccctc

SEQ ID NO: 1184415 - DNA, 12 bp, Homo sapiens
cagcagccctcc

SEQ ID NO: 1184416 - DNA, 14 bp, Homo sapiens
cagcagccctcctc

SEQ ID NO: 1184417 - DNA, 17 bp, Homo sapiens
cagcagccctcctcacc

SEQ ID NO: 1184418 - DNA, 18 bp, Homo sapiens
cagcagccctcctcaccc

SEQ ID NO: 1184419 - DNA, 21 bp, Homo sapiens
cagcagccggaatagagcctc

SEQ ID NO: 1184420 - DNA, 17 bp, Homo sapiens
cagcagcctcgcacagg

SEQ ID NO: 1184421 - DNA, 16 bp, Homo sapiens
cagcagcctctgaagt

SEQ ID NO: 1184422 - DNA, 18 bp, Homo sapiens
cagcagcctctgaagttg

SEQ ID NO: 1184423 - DNA, 23 bp, Homo sapiens
cagcagcctctgaagttggacag

SEQ ID NO: 1184424 - DNA, 22 bp, Homo sapiens
cagcagcctggaccctgtggat

SEQ ID NO: 1184425 - DNA, 15 bp, Homo sapiens
cagcagcctgtatgt

SEQ ID NO: 1184426 - DNA, 21 bp, Homo sapiens
cagcagcctgtgagggagtgc

SEQ ID NO: 1184427 - DNA, 15 bp, Homo sapiens
cagcagcgctcggcc

SEQ ID NO: 1184428 - DNA, 19 bp, Homo sapiens
cagcagcgctcggcccgga

SEQ ID NO: 1184429 - DNA, 17 bp, Homo sapiens
cagcagcggtaccccag

SEQ ID NO: 1184430 - DNA, 18 bp, Homo sapiens
cagcagctgaacagccaa

SEQ ID NO: 1184431 - DNA, 13 bp, Homo sapiens
cagcagctgcacc

SEQ ID NO: 1184432 - DNA, 15 bp, Homo sapiens
cagcagctgcacccc

SEQ ID NO: 1184433 - DNA, 11 bp, Homo sapiens
cagcagctgcg

SEQ ID NO: 1184434 - DNA, 23 bp, Homo sapiens
cagcagctgcgggtctgaaggaa

SEQ ID NO: 1184435 - DNA, 14 bp, Homo sapiens
cagcagctgggacc

SEQ ID NO: 1184436 - DNA, 15 bp, Homo sapiens
cagcagcttataatg

SEQ ID NO: 1184437 - DNA, 12 bp, Homo sapiens
cagcagcttcac

SEQ ID NO: 1184438 - DNA, 16 bp, Homo sapiens
cagcagcttcaccaga

SEQ ID NO: 1184439 - DNA, 16 bp, Homo sapiens
cagcaggaaggacccc

SEQ ID NO: 1184440 - DNA, 20 bp, Homo sapiens
cagcaggcacggcccgcagc

SEQ ID NO: 1184441 - DNA, 13 bp, Homo sapiens
cagcaggcagcgc

SEQ ID NO: 1184442 - DNA, 13 bp, Homo sapiens
cagcaggcaggca

SEQ ID NO: 1184443 - DNA, 16 bp, Homo sapiens
cagcaggcaggcactg

SEQ ID NO: 1184444 - DNA, 15 bp, Homo sapiens
ctctgtcagccagcc

SEQ ID NO: 1184445 - DNA, 23 bp, Homo sapiens
ctctgtcagccagccgccctggg

SEQ ID NO: 1184446 - DNA, 14 bp, Homo sapiens
ctctgtcagtcaca

SEQ ID NO: 1184447 - DNA, 19 bp, Homo sapiens
ctctgtcagtcacagccac

SEQ ID NO: 1184448 - DNA, 18 bp, Homo sapiens
ctctgtcatcactccctg

SEQ ID NO: 1184449 - DNA, 22 bp, Homo sapiens
ctctgtcatcactccctggatg

SEQ ID NO: 1184450 - DNA, 19 bp, Homo sapiens
ctctgtccaggcactgaga

SEQ ID NO: 1184451 - DNA, 13 bp, Homo sapiens
ctctgtccaggcc

SEQ ID NO: 1184452 - DNA, 24 bp, Homo sapiens
ctctgtccaggccactgtggccag

SEQ ID NO: 1184453 - DNA, 21 bp, Homo sapiens
ctctgtccatttatccacagg

SEQ ID NO: 1184454 - DNA, 17 bp, Homo sapiens
ctctgtcccattccctg

SEQ ID NO: 1184455 - DNA, 19 bp, Homo sapiens
ctctgtcccattccctggg

SEQ ID NO: 1184456 - DNA, 13 bp, Homo sapiens
ctctgtccccagg

SEQ ID NO: 1184457 - DNA, 15 bp, Homo sapiens
ctctgtcccttgctg

SEQ ID NO: 1184458 - DNA, 13 bp, Homo sapiens
ctctgtcctactt

SEQ ID NO: 1184459 - DNA, 16 bp, Homo sapiens
ctctgtcctcccatcc

SEQ ID NO: 1184460 - DNA, 21 bp, Homo sapiens
ctctgtcctcccatcccctca

SEQ ID NO: 1184461 - DNA, 16 bp, Homo sapiens
ctctgtctacctggtc

SEQ ID NO: 1184462 - DNA, 21 bp, Homo sapiens
ctctgtctaggactgcagtgt

SEQ ID NO: 1184463 - DNA, 14 bp, Homo sapiens
ctctgtctcatcca

SEQ ID NO: 1184464 - DNA, 17 bp, Homo sapiens
ctctgtctcatcctcct

SEQ ID NO: 1184465 - DNA, 18 bp, Homo sapiens
ctctgtctcatcctcctg

SEQ ID NO: 1184466 - DNA, 22 bp, Homo sapiens
ctctgtctcatcctcctggaac

SEQ ID NO: 1184467 - DNA, 11 bp, Homo sapiens
ctctgtctccc

SEQ ID NO: 1184468 - DNA, 20 bp, Homo sapiens
ctctgtctctcctagcccct

SEQ ID NO: 1184469 - DNA, 14 bp, Homo sapiens
ctctgtctctgtgg

SEQ ID NO: 1184470 - DNA, 13 bp, Homo sapiens
ctctgtcttctct

SEQ ID NO: 1184471 - DNA, 17 bp, Homo sapiens
ctctgtcttctctatcc

SEQ ID NO: 1184472 - DNA, 21 bp, Homo sapiens
ctctgtcttctctatcctctc

SEQ ID NO: 1184473 - DNA, 22 bp, Homo sapiens
ctctgtgaatacaattaaaggt

SEQ ID NO: 1184474 - DNA, 16 bp, Homo sapiens
ctctgtgaccaactgt

SEQ ID NO: 1184475 - DNA, 17 bp, Homo sapiens
ctctgtgattacataga

SEQ ID NO: 1184476 - DNA, 18 bp, Homo sapiens
ctctgtgcacagtggctt

SEQ ID NO: 1184477 - DNA, 20 bp, Homo sapiens
ctctgtgcacagtggcttct

SEQ ID NO: 1184478 - DNA, 22 bp, Homo sapiens
ctctgtgcacagtggcttcttt

SEQ ID NO: 1184479 - DNA, 20 bp, Homo sapiens
ctctgtgcacttatttatga

SEQ ID NO: 1184480 - DNA, 16 bp, Homo sapiens
ctctgtgccttctttt

SEQ ID NO: 1184481 - DNA, 10 bp, Homo sapiens
ctctgtgctc

SEQ ID NO: 1184482 - DNA, 22 bp, Homo sapiens
ctctgtgcttttaaatgcataa

SEQ ID NO: 1184483 - DNA, 19 bp, Homo sapiens
ctctgtggaaaagccatct

SEQ ID NO: 1184484 - DNA, 14 bp, Homo sapiens
ctctgtggcctgtg

SEQ ID NO: 1184485 - DNA, 15 bp, Homo sapiens
ctctgtggcctgtgt

SEQ ID NO: 1184486 - DNA, 17 bp, Homo sapiens
ctctgtggcctgtgtcc

SEQ ID NO: 1184487 - DNA, 19 bp, Homo sapiens
ctctgtggcctgtgtccag

SEQ ID NO: 1184488 - DNA, 17 bp, Homo sapiens
ctctgtgggctggcagt

SEQ ID NO: 1184489 - DNA, 17 bp, Homo sapiens
ctctgtgggtctctgga

SEQ ID NO: 1184490 - DNA, 18 bp, Homo sapiens
ctctgtgggtctctggaa

SEQ ID NO: 1184491 - DNA, 22 bp, Homo sapiens
ctctgtgtagccgccctgagag

SEQ ID NO: 1184492 - DNA, 15 bp, Homo sapiens
ctctgtgtatttata

SEQ ID NO: 1184493 - DNA, 18 bp, Homo sapiens
ctctgtgtatttatataa

SEQ ID NO: 1184494 - DNA, 15 bp, Homo sapiens
ctctgttacccaggc

SEQ ID NO: 1184495 - DNA, 19 bp, Homo sapiens
ctctgttacccaggctgga

SEQ ID NO: 1184496 - DNA, 18 bp, Homo sapiens
ctctgttaggtccatttt

SEQ ID NO: 1184497 - DNA, 18 bp, Homo sapiens
ctctgttcaaagctgcct

SEQ ID NO: 1184498 - DNA, 22 bp, Homo sapiens
ctctgttcaaagctgcctgtcc

SEQ ID NO: 1184499 - DNA, 19 bp, Homo sapiens
ctctgttcagatgtgcatt

SEQ ID NO: 1184500 - DNA, 20 bp, Homo sapiens
ctctgttcagatgtgcattt

SEQ ID NO: 1184501 - DNA, 13 bp, Homo sapiens
ctctgttcatttc

SEQ ID NO: 1184502 - DNA, 14 bp, Homo sapiens
ctctgttcccttcc

SEQ ID NO: 1184503 - DNA, 15 bp, Homo sapiens
ctctgttcctcaatg

SEQ ID NO: 1184504 - DNA, 14 bp, Homo sapiens
ctctgttccttttg

SEQ ID NO: 1184505 - DNA, 14 bp, Homo sapiens
ctctgttctctccc

SEQ ID NO: 1184506 - DNA, 24 bp, Homo sapiens
ctctgttctctcccctcacatcct

SEQ ID NO: 1184507 - DNA, 20 bp, Homo sapiens
ctctgttctgcacacagcac

SEQ ID NO: 1184508 - DNA, 16 bp, Homo sapiens
ctctgttgatctaccc

SEQ ID NO: 1184509 - DNA, 19 bp, Homo sapiens
ctctgttgcccaggctgga

SEQ ID NO: 1184510 - DNA, 22 bp, Homo sapiens
ctctgttgcccaggctggagtg

SEQ ID NO: 1184511 - DNA, 14 bp, Homo sapiens
ctctgttgtaagaa

SEQ ID NO: 1184512 - DNA, 22 bp, Homo sapiens
ctctgttgtcaaactgaaattc

SEQ ID NO: 1184513 - DNA, 21 bp, Homo sapiens
ctctgttgtcctccccttggg

SEQ ID NO: 1184514 - DNA, 14 bp, Homo sapiens
ctctgtttcctgaa

SEQ ID NO: 1184515 - DNA, 17 bp, Homo sapiens
ctctgtttcctgaaata

SEQ ID NO: 1184516 - DNA, 18 bp, Homo sapiens
ctctgtttcctgaaatat

SEQ ID NO: 1184517 - DNA, 14 bp, Homo sapiens
ctctgtttctcttt

SEQ ID NO: 1184518 - DNA, 23 bp, Homo sapiens
ctctgtttgatgctatttatgca

SEQ ID NO: 1184519 - DNA, 16 bp, Homo sapiens
ctctgtttgtgggact

SEQ ID NO: 1184520 - DNA, 19 bp, Homo sapiens
ctcttaaaaaataaaaact

SEQ ID NO: 1184521 - DNA, 17 bp, Homo sapiens
ctcttaaaaagacactt

SEQ ID NO: 1184522 - DNA, 24 bp, Homo sapiens
ctcttaaaacccaagtgccttagc

SEQ ID NO: 1184523 - DNA, 17 bp, Homo sapiens
ctcttaagcagcatgga

SEQ ID NO: 1184524 - DNA, 22 bp, Homo sapiens
ctcttaagcagcatggaaaaat

SEQ ID NO: 1184525 - DNA, 16 bp, Homo sapiens
ctcttaatattgagaa

SEQ ID NO: 1184526 - DNA, 22 bp, Homo sapiens
cagcatggcatccaagactctt

SEQ ID NO: 1184527 - DNA, 17 bp, Homo sapiens
cagcatggtccctgcct

SEQ ID NO: 1184528 - DNA, 18 bp, Homo sapiens
cagcatggtccctgcctt

SEQ ID NO: 1184529 - DNA, 13 bp, Homo sapiens
cagcatgtgcctt

SEQ ID NO: 1184530 - DNA, 22 bp, Homo sapiens
cagcatgtgtatttccagtgca

SEQ ID NO: 1184531 - DNA, 23 bp, Homo sapiens
cagcatgtgttaatcttaatgta

SEQ ID NO: 1184532 - DNA, 21 bp, Homo sapiens
cagcattaggcttttaagaaa

SEQ ID NO: 1184533 - DNA, 15 bp, Homo sapiens
cagcattcagcacac

SEQ ID NO: 1184534 - DNA, 14 bp, Homo sapiens
cagcattccagctc

SEQ ID NO: 1184535 - DNA, 13 bp, Homo sapiens
cagcattccctac

SEQ ID NO: 1184536 - DNA, 15 bp, Homo sapiens
cagcattctcactcc

SEQ ID NO: 1184537 - DNA, 13 bp, Homo sapiens
cagcattctggag

SEQ ID NO: 1184538 - DNA, 18 bp, Homo sapiens
cagcattgatctcctgga

SEQ ID NO: 1184539 - DNA, 15 bp, Homo sapiens
cagcattgctggttc

SEQ ID NO: 1184540 - DNA, 14 bp, Homo sapiens
cagcattgtctttg

SEQ ID NO: 1184541 - DNA, 17 bp, Homo sapiens
cagcattgtctttgctg

SEQ ID NO: 1184542 - DNA, 17 bp, Homo sapiens
cagcattgtttcaaaat

SEQ ID NO: 1184543 - DNA, 20 bp, Homo sapiens
cagcatttccacaccaagca

SEQ ID NO: 1184544 - DNA, 21 bp, Homo sapiens
cagcatttccacaccaagcag

SEQ ID NO: 1184545 - DNA, 16 bp, Homo sapiens
cagcatttgatctgtt

SEQ ID NO: 1184546 - DNA, 16 bp, Homo sapiens
cagccaaacccatgag

SEQ ID NO: 1184547 - DNA, 19 bp, Homo sapiens
cagccaaacccatgaggca

SEQ ID NO: 1184548 - DNA, 22 bp, Homo sapiens
cagccaaagaaatgggcctgcc

SEQ ID NO: 1184549 - DNA, 16 bp, Homo sapiens
cagccaaagcctcctc

SEQ ID NO: 1184550 - DNA, 15 bp, Homo sapiens
cagccaaaggggagc

SEQ ID NO: 1184551 - DNA, 18 bp, Homo sapiens
cagccaaaggggagccag

SEQ ID NO: 1184552 - DNA, 19 bp, Homo sapiens
cagccaacacgcacctgcc

SEQ ID NO: 1184553 - DNA, 22 bp, Homo sapiens
cagccaacacgcacctgcctca

SEQ ID NO: 1184554 - DNA, 18 bp, Homo sapiens
cagccaacaggtggcagg

SEQ ID NO: 1184555 - DNA, 12 bp, Homo sapiens
cagccaacccct

SEQ ID NO: 1184556 - DNA, 18 bp, Homo sapiens
cagccaacccctgtggag

SEQ ID NO: 1184557 - DNA, 19 bp, Homo sapiens
cagccaacgagacacattg

SEQ ID NO: 1184558 - DNA, 20 bp, Homo sapiens
cagccaacgagattgctgga

SEQ ID NO: 1184559 - DNA, 21 bp, Homo sapiens
cagccaacgagtaatttattg

SEQ ID NO: 1184560 - DNA, 14 bp, Homo sapiens
cagccaactagccc

SEQ ID NO: 1184561 - DNA, 19 bp, Homo sapiens
cagccaactagcccctggg

SEQ ID NO: 1184562 - DNA, 16 bp, Homo sapiens
cagccaagattttcct

SEQ ID NO: 1184563 - DNA, 18 bp, Homo sapiens
cagccaaggaatgtgtcc

SEQ ID NO: 1184564 - DNA, 19 bp, Homo sapiens
cagccaaggaatgtgtcca

SEQ ID NO: 1184565 - DNA, 16 bp, Homo sapiens
cagccaaggccgccag

SEQ ID NO: 1184566 - DNA, 16 bp, Homo sapiens
cagccaaggggctgcg

SEQ ID NO: 1184567 - DNA, 18 bp, Homo sapiens
cagccaaggggctgcgct

SEQ ID NO: 1184568 - DNA, 22 bp, Homo sapiens
cagccaagggtcctcacccctc

SEQ ID NO: 1184569 - DNA, 23 bp, Homo sapiens
cagccaaggttttataaggctga

SEQ ID NO: 1184570 - DNA, 22 bp, Homo sapiens
ctcttcaggttcttagtgtcac

SEQ ID NO: 1184571 - DNA, 17 bp, Homo sapiens
ctcttcagttaattctt

SEQ ID NO: 1184572 - DNA, 19 bp, Homo sapiens
ctcttcatactttttttca

SEQ ID NO: 1184573 - DNA, 21 bp, Homo sapiens
ctcttcatgcttgacatacct

SEQ ID NO: 1184574 - DNA, 19 bp, Homo sapiens
ctcttcatggcatcttcaa

SEQ ID NO: 1184575 - DNA, 23 bp, Homo sapiens
ctcttcatggcatcttcaatatg

SEQ ID NO: 1184576 - DNA, 14 bp, Homo sapiens
ctcttcatttctgg

SEQ ID NO: 1184577 - DNA, 11 bp, Homo sapiens
ctcttccaaat

SEQ ID NO: 1184578 - DNA, 16 bp, Homo sapiens
ctcttccactccttct

SEQ ID NO: 1184579 - DNA, 17 bp, Homo sapiens
ctcttccactccttctc

SEQ ID NO: 1184580 - DNA, 20 bp, Homo sapiens
ctcttccagggcagcggctc

SEQ ID NO: 1184581 - DNA, 22 bp, Homo sapiens
ctcttccagggcagcggctcca

SEQ ID NO: 1184582 - DNA, 19 bp, Homo sapiens
ctcttccagtcttcctgac

SEQ ID NO: 1184583 - DNA, 22 bp, Homo sapiens
ctcttccagtgaacattcccag

SEQ ID NO: 1184584 - DNA, 15 bp, Homo sapiens
ctcttcccaggcctt

SEQ ID NO: 1184585 - DNA, 16 bp, Homo sapiens
ctcttcccatgactgc

SEQ ID NO: 1184586 - DNA, 14 bp, Homo sapiens
ctcttccccagaga

SEQ ID NO: 1184587 - DNA, 15 bp, Homo sapiens
ctcttccccagagag

SEQ ID NO: 1184588 - DNA, 15 bp, Homo sapiens
ctcttcccccaagat

SEQ ID NO: 1184589 - DNA, 22 bp, Homo sapiens
ctcttcccctagacctccccct

SEQ ID NO: 1184590 - DNA, 16 bp, Homo sapiens
ctcttccccttcctgt

SEQ ID NO: 1184591 - DNA, 22 bp, Homo sapiens
ctcttccccttcctgtttcaga

SEQ ID NO: 1184592 - DNA, 18 bp, Homo sapiens
ctcttccccttgcccttg

SEQ ID NO: 1184593 - DNA, 23 bp, Homo sapiens
ctcttccccttgcccttgccctg

SEQ ID NO: 1184594 - DNA, 14 bp, Homo sapiens
ctcttccctctgat

SEQ ID NO: 1184595 - DNA, 21 bp, Homo sapiens
ctcttccctgaacgttttctt

SEQ ID NO: 1184596 - DNA, 22 bp, Homo sapiens
ctcttccctgcgcctgtgatgc

SEQ ID NO: 1184597 - DNA, 14 bp, Homo sapiens
ctcttcccttcctc

SEQ ID NO: 1184598 - DNA, 15 bp, Homo sapiens
ctcttccgagctgct

SEQ ID NO: 1184599 - DNA, 17 bp, Homo sapiens
ctcttccgcagcccctt

SEQ ID NO: 1184600 - DNA, 19 bp, Homo sapiens
ctcttccgtgcatcccaga

SEQ ID NO: 1184601 - DNA, 20 bp, Homo sapiens
ctcttcctaccctccttcca

SEQ ID NO: 1184602 - DNA, 19 bp, Homo sapiens
ctcttcctaccctgcctcc

SEQ ID NO: 1184603 - DNA, 16 bp, Homo sapiens
ctcttcctatttttgt

SEQ ID NO: 1184604 - DNA, 16 bp, Homo sapiens
ctcttcctcatcctgc

SEQ ID NO: 1184605 - DNA, 22 bp, Homo sapiens
ctcttcctcatcctgcttctct

SEQ ID NO: 1184606 - DNA, 15 bp, Homo sapiens
ctcttcctccctggg

SEQ ID NO: 1184607 - DNA, 16 bp, Homo sapiens
ctcttcctctgaggct

SEQ ID NO: 1184608 - DNA, 17 bp, Homo sapiens
ctcttcctctgaggctg

SEQ ID NO: 1184609 - DNA, 22 bp, Homo sapiens
ctcttcctctgaggctggatcc

SEQ ID NO: 1184610 - DNA, 12 bp, Homo sapiens
ctcttcctctgg

SEQ ID NO: 1184611 - DNA, 12 bp, Homo sapiens
ctcttcctctgt

SEQ ID NO: 1184612 - DNA, 15 bp, Homo sapiens
ctcttcctctgttct

SEQ ID NO: 1184613 - DNA, 14 bp, Homo sapiens
ctcttcctcttgac

SEQ ID NO: 1184614 - DNA, 19 bp, Homo sapiens
ctcttcctcttgaccctgc

SEQ ID NO: 1184615 - DNA, 23 bp, Homo sapiens
ctcttcctcttgaccctgcaccc

SEQ ID NO: 1184616 - DNA, 13 bp, Homo sapiens
ctcttcctgcccc

SEQ ID NO: 1184617 - DNA, 16 bp, Homo sapiens
ctcttcctgcccctct

SEQ ID NO: 1184618 - DNA, 18 bp, Homo sapiens
ctcttcctgcccctcttt

SEQ ID NO: 1184619 - DNA, 23 bp, Homo sapiens
ctcttcctgcccctctttctctt

SEQ ID NO: 1184620 - DNA, 13 bp, Homo sapiens
ctcttcctggacc

SEQ ID NO: 1184621 - DNA, 15 bp, Homo sapiens
ctcttcctggacctg

SEQ ID NO: 1184622 - DNA, 17 bp, Homo sapiens
ctcttcctgtgatccac

SEQ ID NO: 1184623 - DNA, 12 bp, Homo sapiens
ctcttccttccc

SEQ ID NO: 1184624 - DNA, 13 bp, Homo sapiens
ctcttccttcccc

SEQ ID NO: 1184625 - DNA, 13 bp, Homo sapiens
ctcttccttgaat

SEQ ID NO: 1184626 - DNA, 16 bp, Homo sapiens
ctcttcggccctcaga

SEQ ID NO: 1184627 - DNA, 17 bp, Homo sapiens
ctcttcggtttctgagc

SEQ ID NO: 1184628 - DNA, 13 bp, Homo sapiens
ctcttctacttgt

SEQ ID NO: 1184629 - DNA, 15 bp, Homo sapiens
ctcttctcaagtgcc

SEQ ID NO: 1184630 - DNA, 18 bp, Homo sapiens
ctcttctcagctcttcca

SEQ ID NO: 1184631 - DNA, 12 bp, Homo sapiens
ctcttctccact

SEQ ID NO: 1184632 - DNA, 13 bp, Homo sapiens
ctcttctcccaga

SEQ ID NO: 1184633 - DNA, 21 bp, Homo sapiens
ctcttctcccagaatcccagc

SEQ ID NO: 1184634 - DNA, 15 bp, Homo sapiens
ctcttctcctttcac

SEQ ID NO: 1184635 - DNA, 14 bp, Homo sapiens
ctcttctctccagc

SEQ ID NO: 1184636 - DNA, 19 bp, Homo sapiens
ctcttctctccagctgact

SEQ ID NO: 1184637 - DNA, 12 bp, Homo sapiens
ctcttctctcct

SEQ ID NO: 1184638 - DNA, 14 bp, Homo sapiens
ctcttctctcctca

SEQ ID NO: 1184639 - DNA, 15 bp, Homo sapiens
ctcttctctcctcag

SEQ ID NO: 1184640 - DNA, 15 bp, Homo sapiens
ctcttctcttcctgt

SEQ ID NO: 1184641 - DNA, 17 bp, Homo sapiens
ctcttctgacgtgcctt

SEQ ID NO: 1184642 - DNA, 20 bp, Homo sapiens
ctcttctgacgtgccttttg

SEQ ID NO: 1184643 - DNA, 18 bp, Homo sapiens
ctcttctgagctatttca

SEQ ID NO: 1184644 - DNA, 11 bp, Homo sapiens
ctcttctgcta

SEQ ID NO: 1184645 - DNA, 21 bp, Homo sapiens
ctcttctgctccacccttggc

SEQ ID NO: 1184646 - DNA, 13 bp, Homo sapiens
ctcttctgctcct

SEQ ID NO: 1184647 - DNA, 13 bp, Homo sapiens
ctcttctggagtt

SEQ ID NO: 1184648 - DNA, 19 bp, Homo sapiens
ctctcactgtgttactgct

SEQ ID NO: 1184649 - DNA, 20 bp, Homo sapiens
ctctcactgtgttactgctt

SEQ ID NO: 1184650 - DNA, 17 bp, Homo sapiens
cagatataactgtcttg

SEQ ID NO: 1184651 - DNA, 20 bp, Homo sapiens
cagatataactgtcttgttt

SEQ ID NO: 1184652 - DNA, 16 bp, Homo sapiens
cagatatcaaaattct

SEQ ID NO: 1184653 - DNA, 17 bp, Homo sapiens
cagatatcaaaattcta

SEQ ID NO: 1184654 - DNA, 17 bp, Homo sapiens
cagatatccacataaat

SEQ ID NO: 1184655 - DNA, 19 bp, Homo sapiens
cagatatccacataaatgc

SEQ ID NO: 1184656 - DNA, 16 bp, Homo sapiens
cagatatctgcatgtg

SEQ ID NO: 1184657 - DNA, 21 bp, Homo sapiens
cagatatgtttttatttaaaa

SEQ ID NO: 1184658 - DNA, 18 bp, Homo sapiens
cagatattgttataaata

SEQ ID NO: 1184659 - DNA, 15 bp, Homo sapiens
cagatatttagctct

SEQ ID NO: 1184660 - DNA, 11 bp, Homo sapiens
cagatatttat

SEQ ID NO: 1184661 - DNA, 12 bp, Homo sapiens
cagatatttata

SEQ ID NO: 1184662 - DNA, 14 bp, Homo sapiens
cagatatttatatt

SEQ ID NO: 1184663 - DNA, 20 bp, Homo sapiens
cagatatttatatttttatt

SEQ ID NO: 1184664 - DNA, 22 bp, Homo sapiens
cagatatttatatttttatttt

SEQ ID NO: 1184665 - DNA, 12 bp, Homo sapiens
cagatatttctt

SEQ ID NO: 1184666 - DNA, 12 bp, Homo sapiens
cagatattttat

SEQ ID NO: 1184667 - DNA, 13 bp, Homo sapiens
cagatattttatc

SEQ ID NO: 1184668 - DNA, 15 bp, Homo sapiens
cagatattttttcag

SEQ ID NO: 1184669 - DNA, 13 bp, Homo sapiens
cagatcaaattct

SEQ ID NO: 1184670 - DNA, 19 bp, Homo sapiens
cagatcaagagttttggag

SEQ ID NO: 1184671 - DNA, 13 bp, Homo sapiens
cagatcactcctg

SEQ ID NO: 1184672 - DNA, 15 bp, Homo sapiens
cagatcactcctgga

SEQ ID NO: 1184673 - DNA, 23 bp, Homo sapiens
cagatcagaacatgaaatgccct

SEQ ID NO: 1184674 - DNA, 20 bp, Homo sapiens
cagatcagctcctaaccctt

SEQ ID NO: 1184675 - DNA, 12 bp, Homo sapiens
cagatcaggaac

SEQ ID NO: 1184676 - DNA, 19 bp, Homo sapiens
cagatcaggaaccagggcc

SEQ ID NO: 1184677 - DNA, 14 bp, Homo sapiens
cagatcaggccttc

SEQ ID NO: 1184678 - DNA, 20 bp, Homo sapiens
cagatcataggaagtggctg

SEQ ID NO: 1184679 - DNA, 21 bp, Homo sapiens
cagatcataggaagtggctgg

SEQ ID NO: 1184680 - DNA, 23 bp, Homo sapiens
cagatcatccgtctgtgtggggt

SEQ ID NO: 1184681 - DNA, 15 bp, Homo sapiens
cagatcatctgggga

SEQ ID NO: 1184682 - DNA, 20 bp, Homo sapiens
cagatcatctggggacctgg

SEQ ID NO: 1184683 - DNA, 18 bp, Homo sapiens
cagatcatcttggaactg

SEQ ID NO: 1184684 - DNA, 19 bp, Homo sapiens
cagatcatgggtcaagaga

SEQ ID NO: 1184685 - DNA, 22 bp, Homo sapiens
cagatcccagcttcggcatttg

SEQ ID NO: 1184686 - DNA, 13 bp, Homo sapiens
cagatcctctgga

SEQ ID NO: 1184687 - DNA, 17 bp, Homo sapiens
cagatcctttgaaaaga

SEQ ID NO: 1184688 - DNA, 23 bp, Homo sapiens
cagatcgaaattggactgtcttt

SEQ ID NO: 1184689 - DNA, 17 bp, Homo sapiens
cagatcggccacagggc

SEQ ID NO: 1184690 - DNA, 18 bp, Homo sapiens
cagatcgttcattgcctt

SEQ ID NO: 1184691 - DNA, 20 bp, Homo sapiens
cagatctctaacttcaccat

SEQ ID NO: 1184692 - DNA, 17 bp, Homo sapiens
cagatctgcaccaccat

SEQ ID NO: 1184693 - DNA, 19 bp, Homo sapiens
cagatctgcctgggcctgt

SEQ ID NO: 1184694 - DNA, 16 bp, Homo sapiens
cagatctgtctccaag

SEQ ID NO: 1184695 - DNA, 13 bp, Homo sapiens
cagatctgtgccc

SEQ ID NO: 1184696 - DNA, 18 bp, Homo sapiens
cagatctgtgccccatgc

SEQ ID NO: 1184697 - DNA, 21 bp, Homo sapiens
cagatctgtgccccatgcctg

SEQ ID NO: 1184698 - DNA, 18 bp, Homo sapiens
cagatctgtgcctgggat

SEQ ID NO: 1184699 - DNA, 12 bp, Homo sapiens
cagatctgtttt

SEQ ID NO: 1184700 - DNA, 13 bp, Homo sapiens
cagatctgttttg

SEQ ID NO: 1184701 - DNA, 18 bp, Homo sapiens
cagatcttaatataaatt

SEQ ID NO: 1184702 - DNA, 14 bp, Homo sapiens
cagatcttgacagt

SEQ ID NO: 1184703 - DNA, 13 bp, Homo sapiens
cagatctttctct

SEQ ID NO: 1184704 - DNA, 16 bp, Homo sapiens
cagatctttctcttcc

SEQ ID NO: 1184705 - DNA, 20 bp, Homo sapiens
cagatctttctcttccctga

SEQ ID NO: 1184706 - DNA, 13 bp, Homo sapiens
cagatcttttctt

SEQ ID NO: 1184707 - DNA, 15 bp, Homo sapiens
cagatcttttcttta

SEQ ID NO: 1184708 - DNA, 18 bp, Homo sapiens
cagatgaaaaggagcctg

SEQ ID NO: 1184709 - DNA, 22 bp, Homo sapiens
cagatgaactctttctggcctg

SEQ ID NO: 1184710 - DNA, 19 bp, Homo sapiens
cagatgaactgactgaagg

SEQ ID NO: 1184711 - DNA, 22 bp, Homo sapiens
cagatgacacgcgctctccacc

SEQ ID NO: 1184712 - DNA, 21 bp, Homo sapiens
cagatgaccccagaaactgaa

SEQ ID NO: 1184713 - DNA, 23 bp, Homo sapiens
cagatgactatgcagaggcctgg

SEQ ID NO: 1184714 - DNA, 17 bp, Homo sapiens
cagatgagaacaaagct

SEQ ID NO: 1184715 - DNA, 19 bp, Homo sapiens
cagatgagaacaaagctgt

SEQ ID NO: 1184716 - DNA, 18 bp, Homo sapiens
cagatgaggcaaacagca

SEQ ID NO: 1184717 - DNA, 16 bp, Homo sapiens
cagatgaggggccact

SEQ ID NO: 1184718 - DNA, 19 bp, Homo sapiens
cagatgaggggccactgac

SEQ ID NO: 1184719 - DNA, 15 bp, Homo sapiens
cagatgataaaagga

SEQ ID NO: 1184720 - DNA, 18 bp, Homo sapiens
cagatgatcaactcttcg

SEQ ID NO: 1184721 - DNA, 13 bp, Homo sapiens
cagatgatggcca

SEQ ID NO: 1184722 - DNA, 19 bp, Homo sapiens
cagatgatggccatttcta

SEQ ID NO: 1184723 - DNA, 22 bp, Homo sapiens
cagatgcaagttattttatttg

SEQ ID NO: 1184724 - DNA, 16 bp, Homo sapiens
cagatgccaccctagc

SEQ ID NO: 1184725 - DNA, 18 bp, Homo sapiens
cagatgccaccctagcca

SEQ ID NO: 1184726 - DNA, 15 bp, Homo sapiens
cagatgccagtgaag

SEQ ID NO: 1184727 - DNA, 22 bp, Homo sapiens
cagatgcccagagggcccaggc

SEQ ID NO: 1184728 - DNA, 13 bp, Homo sapiens
cagatgccccaga

SEQ ID NO: 1184729 - DNA, 16 bp, Homo sapiens
cagatgccccagagct

SEQ ID NO: 1184730 - DNA, 22 bp, Homo sapiens
cagatgccctttggaaagccat

SEQ ID NO: 1184731 - DNA, 14 bp, Homo sapiens
cagatgccttctag

SEQ ID NO: 1184732 - DNA, 20 bp, Homo sapiens
cagatgcggggacaggctgg

SEQ ID NO: 1184733 - DNA, 16 bp, Homo sapiens
cagatgctaggaagct

SEQ ID NO: 1184734 - DNA, 13 bp, Homo sapiens
cagatgctcttgg

SEQ ID NO: 1184735 - DNA, 14 bp, Homo sapiens
cagatgctgagcca

SEQ ID NO: 1184736 - DNA, 15 bp, Homo sapiens
cagatgctgctgaag

SEQ ID NO: 1184737 - DNA, 21 bp, Homo sapiens
cagatgctgtcactggcagag

SEQ ID NO: 1184738 - DNA, 23 bp, Homo sapiens
cagatgctgtcactggcagagca

SEQ ID NO: 1184739 - DNA, 14 bp, Homo sapiens
cagatgcttttctg

SEQ ID NO: 1184740 - DNA, 20 bp, Homo sapiens
cagatgcttttgtgagaaag

SEQ ID NO: 1184741 - DNA, 23 bp, Homo sapiens
cagatgcttttgtgagaaaggga

SEQ ID NO: 1184742 - DNA, 21 bp, Homo sapiens
cagatggaaaattcatttttt

SEQ ID NO: 1184743 - DNA, 14 bp, Homo sapiens
cagatggaaagaaa

SEQ ID NO: 1184744 - DNA, 15 bp, Homo sapiens
cagatggacgcaggc

SEQ ID NO: 1184745 - DNA, 19 bp, Homo sapiens
cagatggacgcaggccctg

SEQ ID NO: 1184746 - DNA, 23 bp, Homo sapiens
cagatggaggttctcagagccaa

SEQ ID NO: 1184747 - DNA, 21 bp, Homo sapiens
cagatggatttgcctgtgcca

SEQ ID NO: 1184748 - DNA, 16 bp, Homo sapiens
cagatggcccaaggga

SEQ ID NO: 1184749 - DNA, 20 bp, Homo sapiens
cagatggcccaagggatggc

SEQ ID NO: 1184750 - DNA, 17 bp, Homo sapiens
cagatggcccctccact

SEQ ID NO: 1184751 - DNA, 20 bp, Homo sapiens
cagatggcttcggagggccg

SEQ ID NO: 1184752 - DNA, 19 bp, Homo sapiens
cagatggctttcagggcag

SEQ ID NO: 1184753 - DNA, 20 bp, Homo sapiens
cagatgggaacagtaaagaa

SEQ ID NO: 1184754 - DNA, 19 bp, Homo sapiens
cagatggggtctgtgactg

SEQ ID NO: 1184755 - DNA, 21 bp, Homo sapiens
cagatggggtctgtgactgga

SEQ ID NO: 1184756 - DNA, 21 bp, Homo sapiens
cagatgggtctgatattaatc

SEQ ID NO: 1184757 - DNA, 23 bp, Homo sapiens
cagatgggtctgatattaatcaa

SEQ ID NO: 1184758 - DNA, 20 bp, Homo sapiens
cagatggtgtgtccagcact

SEQ ID NO: 1184759 - DNA, 12 bp, Homo sapiens
cagatgtaaaga

SEQ ID NO: 1184760 - DNA, 15 bp, Homo sapiens
cagatgtaatgtttt

SEQ ID NO: 1184761 - DNA, 15 bp, Homo sapiens
cagatgtacatagag

SEQ ID NO: 1184762 - DNA, 23 bp, Homo sapiens
cagatgtaggggaagagatgttt

SEQ ID NO: 1184763 - DNA, 19 bp, Homo sapiens
cagatgtattgactgtacc

SEQ ID NO: 1184764 - DNA, 23 bp, Homo sapiens
cagatgtcccttgatgcacagag

SEQ ID NO: 1184765 - DNA, 15 bp, Homo sapiens
cagatgtctctgggg

SEQ ID NO: 1184766 - DNA, 14 bp, Homo sapiens
cagatgtcttccct

SEQ ID NO: 1184767 - DNA, 20 bp, Homo sapiens
cagatgtcttccctgggctg

SEQ ID NO: 1184768 - DNA, 22 bp, Homo sapiens
cagatgtcttctgcctgttata

SEQ ID NO: 1184769 - DNA, 16 bp, Homo sapiens
cagatgtgactgtata

SEQ ID NO: 1184770 - DNA, 16 bp, Homo sapiens
cagatgtgagccaccg

SEQ ID NO: 1184771 - DNA, 18 bp, Homo sapiens
cagcacaccaagtggctg

SEQ ID NO: 1184772 - DNA, 14 bp, Homo sapiens
cagcacaccagccg

SEQ ID NO: 1184773 - DNA, 20 bp, Homo sapiens
cagcacaccagccgctgcag

SEQ ID NO: 1184774 - DNA, 14 bp, Homo sapiens
cagcacactctcct

SEQ ID NO: 1184775 - DNA, 15 bp, Homo sapiens
cagcacagaatgagt

SEQ ID NO: 1184776 - DNA, 13 bp, Homo sapiens
cagcacagccaac

SEQ ID NO: 1184777 - DNA, 14 bp, Homo sapiens
cagcacagccacct

SEQ ID NO: 1184778 - DNA, 16 bp, Homo sapiens
cagcacagccacctcc

SEQ ID NO: 1184779 - DNA, 22 bp, Homo sapiens
cagcacagcttagatttcatag

SEQ ID NO: 1184780 - DNA, 14 bp, Homo sapiens
cagcacaggggccc

SEQ ID NO: 1184781 - DNA, 18 bp, Homo sapiens
cagcacaggggccccaga

SEQ ID NO: 1184782 - DNA, 16 bp, Homo sapiens
cagcacatgcgggctc

SEQ ID NO: 1184783 - DNA, 14 bp, Homo sapiens
cagcacatggccat

SEQ ID NO: 1184784 - DNA, 17 bp, Homo sapiens
cagcacatggccataga

SEQ ID NO: 1184785 - DNA, 21 bp, Homo sapiens
cagcacatggccatagaggcc

SEQ ID NO: 1184786 - DNA, 22 bp, Homo sapiens
cagcacatggccatagaggccc

SEQ ID NO: 1184787 - DNA, 15 bp, Homo sapiens
cagcacattcgggac

SEQ ID NO: 1184788 - DNA, 19 bp, Homo sapiens
cagcacatttccgctgtcc

SEQ ID NO: 1184789 - DNA, 16 bp, Homo sapiens
cagcaccaaccacagc

SEQ ID NO: 1184790 - DNA, 17 bp, Homo sapiens
cagcaccaaccacagca

SEQ ID NO: 1184791 - DNA, 15 bp, Homo sapiens
cagcaccacactggg

SEQ ID NO: 1184792 - DNA, 23 bp, Homo sapiens
cagcaccacactgggtgcgtctc

SEQ ID NO: 1184793 - DNA, 22 bp, Homo sapiens
cagcaccacctacacaggagtc

SEQ ID NO: 1184794 - DNA, 16 bp, Homo sapiens
cagcaccactgctgag

SEQ ID NO: 1184795 - DNA, 19 bp, Homo sapiens
ctcctcacccacctctggg

SEQ ID NO: 1184796 - DNA, 15 bp, Homo sapiens
ctcctcacccccagc

SEQ ID NO: 1184797 - DNA, 21 bp, Homo sapiens
ctcctcacccccagctttgct

SEQ ID NO: 1184798 - DNA, 18 bp, Homo sapiens
ctcctcaccccgtctggg

SEQ ID NO: 1184799 - DNA, 17 bp, Homo sapiens
ctcctcacccctgtagg

SEQ ID NO: 1184800 - DNA, 18 bp, Homo sapiens
ctcctcacccctgtaggg

SEQ ID NO: 1184801 - DNA, 18 bp, Homo sapiens
ctcctcacctctggactg

SEQ ID NO: 1184802 - DNA, 21 bp, Homo sapiens
ctcctcacctctggactggct

SEQ ID NO: 1184803 - DNA, 13 bp, Homo sapiens
ctcctcactctgt

SEQ ID NO: 1184804 - DNA, 17 bp, Homo sapiens
ctcctcactctgtccct

SEQ ID NO: 1184805 - DNA, 14 bp, Homo sapiens
ctcctcactgtatc

SEQ ID NO: 1184806 - DNA, 16 bp, Homo sapiens
ctcctcagatggggca

SEQ ID NO: 1184807 - DNA, 13 bp, Homo sapiens
ctcctcagccccc

SEQ ID NO: 1184808 - DNA, 20 bp, Homo sapiens
ctcctcagcccccaggccag

SEQ ID NO: 1184809 - DNA, 23 bp, Homo sapiens
ctcctcagcccccaggccaggtg

SEQ ID NO: 1184810 - DNA, 15 bp, Homo sapiens
ctcctcagcctctgc

SEQ ID NO: 1184811 - DNA, 16 bp, Homo sapiens
ctcctcagcctctgca

SEQ ID NO: 1184812 - DNA, 19 bp, Homo sapiens
ctcctcagcctctgcaact

SEQ ID NO: 1184813 - DNA, 19 bp, Homo sapiens
ctcctcagctgcatggagc

SEQ ID NO: 1184814 - DNA, 22 bp, Homo sapiens
ctcctcagctgcatggagcctg

SEQ ID NO: 1184815 - DNA, 13 bp, Homo sapiens
ctcctcaggacaa

SEQ ID NO: 1184816 - DNA, 14 bp, Homo sapiens
ctcctcaggaccct

SEQ ID NO: 1184817 - DNA, 17 bp, Homo sapiens
ctcctcaggaccctcag

SEQ ID NO: 1184818 - DNA, 21 bp, Homo sapiens
ctcctcaggaccctcagccct

SEQ ID NO: 1184819 - DNA, 22 bp, Homo sapiens
ctcctcaggaccctcagccctg

SEQ ID NO: 1184820 - DNA, 18 bp, Homo sapiens
ctcctcaggcacacagct

SEQ ID NO: 1184821 - DNA, 23 bp, Homo sapiens
ctcctcaggcacacagctactct

SEQ ID NO: 1184822 - DNA, 20 bp, Homo sapiens
ctcctcaggcccagctgctc

SEQ ID NO: 1184823 - DNA, 13 bp, Homo sapiens
ctcctcagggtgg

SEQ ID NO: 1184824 - DNA, 21 bp, Homo sapiens
ctcctcagtgaaggtggtggg

SEQ ID NO: 1184825 - DNA, 14 bp, Homo sapiens
ctcctcagtttctc

SEQ ID NO: 1184826 - DNA, 18 bp, Homo sapiens
ctcctcatagcatgatat

SEQ ID NO: 1184827 - DNA, 12 bp, Homo sapiens
ctcctcatcccg

SEQ ID NO: 1184828 - DNA, 14 bp, Homo sapiens
ctcctcatgggaag

SEQ ID NO: 1184829 - DNA, 15 bp, Homo sapiens
ctcctccaaaggaag

SEQ ID NO: 1184830 - DNA, 21 bp, Homo sapiens
ctcctccaagacactgtggac

SEQ ID NO: 1184831 - DNA, 16 bp, Homo sapiens
ctcctccaatgtcctg

SEQ ID NO: 1184832 - DNA, 15 bp, Homo sapiens
ctcctccacagtgct

SEQ ID NO: 1184833 - DNA, 15 bp, Homo sapiens
ctcctccactccacc

SEQ ID NO: 1184834 - DNA, 12 bp, Homo sapiens
ctcctccagccc

SEQ ID NO: 1184835 - DNA, 15 bp, Homo sapiens
ctcctccagcccctg

SEQ ID NO: 1184836 - DNA, 23 bp, Homo sapiens
ctcctccagcccttcagacgaga

SEQ ID NO: 1184837 - DNA, 14 bp, Homo sapiens
ctcctccagggcca

SEQ ID NO: 1184838 - DNA, 22 bp, Homo sapiens
ctcctccagggccacgtgccag

SEQ ID NO: 1184839 - DNA, 13 bp, Homo sapiens
ctcctccagggtg

SEQ ID NO: 1184840 - DNA, 21 bp, Homo sapiens
ctcctccagggtggcagcaac

SEQ ID NO: 1184841 - DNA, 17 bp, Homo sapiens
ctcctccagtgtgggct

SEQ ID NO: 1184842 - DNA, 23 bp, Homo sapiens
ctcctccagtgtgggcttgacca

SEQ ID NO: 1184843 - DNA, 15 bp, Homo sapiens
ctcctccatgggaga

SEQ ID NO: 1184844 - DNA, 14 bp, Homo sapiens
ctcctcccacaatc

SEQ ID NO: 1184845 - DNA, 20 bp, Homo sapiens
ctcctcccacaatctgggac

SEQ ID NO: 1184846 - DNA, 22 bp, Homo sapiens
ctcctcccacccggctgcagag

SEQ ID NO: 1184847 - DNA, 13 bp, Homo sapiens
ctcctcccagctg

SEQ ID NO: 1184848 - DNA, 14 bp, Homo sapiens
ctcctcccagctgc

SEQ ID NO: 1184849 - DNA, 15 bp, Homo sapiens
ctcctcccagctgct

SEQ ID NO: 1184850 - DNA, 17 bp, Homo sapiens
ctcctcccagctgcttt

SEQ ID NO: 1184851 - DNA, 14 bp, Homo sapiens
ctcctcccagcttg

SEQ ID NO: 1184852 - DNA, 23 bp, Homo sapiens
ctcctcccaggcgccccttcccc

SEQ ID NO: 1184853 - DNA, 13 bp, Homo sapiens
ctcctcccatcca

SEQ ID NO: 1184854 - DNA, 14 bp, Homo sapiens
ctcctcccatccag

SEQ ID NO: 1184855 - DNA, 14 bp, Homo sapiens
ctcctcccatgtca

SEQ ID NO: 1184856 - DNA, 19 bp, Homo sapiens
ctcctcccatgtcactgca

SEQ ID NO: 1184857 - DNA, 14 bp, Homo sapiens
ctcctccccaaatc

SEQ ID NO: 1184858 - DNA, 15 bp, Homo sapiens
ctcctccccacctgt

SEQ ID NO: 1184859 - DNA, 20 bp, Homo sapiens
ctcctcccccggctgggcct

SEQ ID NO: 1184860 - DNA, 18 bp, Homo sapiens
ctcctccccctttggggt

SEQ ID NO: 1184861 - DNA, 19 bp, Homo sapiens
ctcctccccttttttttct

SEQ ID NO: 1184862 - DNA, 22 bp, Homo sapiens
ctcctccctaatgctcaccttt

SEQ ID NO: 1184863 - DNA, 15 bp, Homo sapiens
ctcctccctcattca

SEQ ID NO: 1184864 - DNA, 11 bp, Homo sapiens
ctcctccctcc

SEQ ID NO: 1184865 - DNA, 14 bp, Homo sapiens
ctcctccctccaag

SEQ ID NO: 1184866 - DNA, 20 bp, Homo sapiens
ctcctccctccaagcctggc

SEQ ID NO: 1184867 - DNA, 20 bp, Homo sapiens
ctcctccctcccagctgcac

SEQ ID NO: 1184868 - DNA, 13 bp, Homo sapiens
ctcctccctgcat

SEQ ID NO: 1184869 - DNA, 23 bp, Homo sapiens
ctcctccctgcatctgaccagca

SEQ ID NO: 1184870 - DNA, 13 bp, Homo sapiens
ctcctccctgccc

SEQ ID NO: 1184871 - DNA, 14 bp, Homo sapiens
ctcctccctgctcc

SEQ ID NO: 1184872 - DNA, 18 bp, Homo sapiens
ctcctccctgctcctcat

SEQ ID NO: 1184873 - DNA, 13 bp, Homo sapiens
ctcctccctggct

SEQ ID NO: 1184874 - DNA, 19 bp, Homo sapiens
ctcctccctggctgccctg

SEQ ID NO: 1184875 - DNA, 20 bp, Homo sapiens
ctcctccctggctgccctgg

SEQ ID NO: 1184876 - DNA, 14 bp, Homo sapiens
ctcctccctgtgcc

SEQ ID NO: 1184877 - DNA, 17 bp, Homo sapiens
ctcctccctgtgccccc

SEQ ID NO: 1184878 - DNA, 13 bp, Homo sapiens
ctcctcccttcct

SEQ ID NO: 1184879 - DNA, 21 bp, Homo sapiens
ctcctcccttccttttccctg

SEQ ID NO: 1184880 - DNA, 12 bp, Homo sapiens
ctcctccgcctg

SEQ ID NO: 1184881 - DNA, 21 bp, Homo sapiens
ctcctccgtctgaccctctgc

SEQ ID NO: 1184882 - DNA, 21 bp, Homo sapiens
ctcctcctaggaaaccagctc

SEQ ID NO: 1184883 - DNA, 16 bp, Homo sapiens
cagaacctcttcccca

SEQ ID NO: 1184884 - DNA, 18 bp, Homo sapiens
cagaacctgagctatttt

SEQ ID NO: 1184885 - DNA, 14 bp, Homo sapiens
cagaacctgagggc

SEQ ID NO: 1184886 - DNA, 18 bp, Homo sapiens
cagaacctgcacacagga

SEQ ID NO: 1184887 - DNA, 19 bp, Homo sapiens
cagaacctgcacacaggac

SEQ ID NO: 1184888 - DNA, 23 bp, Homo sapiens
cagaacctgttattttatgtctg

SEQ ID NO: 1184889 - DNA, 17 bp, Homo sapiens
cagaaccttcaacccag

SEQ ID NO: 1184890 - DNA, 17 bp, Homo sapiens
cagaacgcaccccactg

SEQ ID NO: 1184891 - DNA, 22 bp, Homo sapiens
cagaacgcaccccactgggaga

SEQ ID NO: 1184892 - DNA, 21 bp, Homo sapiens
cagaacggagccccaggcctc

SEQ ID NO: 1184893 - DNA, 19 bp, Homo sapiens
cagaacgtatttagccatt

SEQ ID NO: 1184894 - DNA, 18 bp, Homo sapiens
cagaacgtggctctgctg

SEQ ID NO: 1184895 - DNA, 16 bp, Homo sapiens
cagaactaccaggtgg

SEQ ID NO: 1184896 - DNA, 18 bp, Homo sapiens
cagaactatttaaaataa

SEQ ID NO: 1184897 - DNA, 15 bp, Homo sapiens
cagaactcactgggg

SEQ ID NO: 1184898 - DNA, 18 bp, Homo sapiens
cagaactcactggggcct

SEQ ID NO: 1184899 - DNA, 14 bp, Homo sapiens
cagaactcccttca

SEQ ID NO: 1184900 - DNA, 13 bp, Homo sapiens
cagaactcgatgc

SEQ ID NO: 1184901 - DNA, 16 bp, Homo sapiens
cagaactcgatgcact

SEQ ID NO: 1184902 - DNA, 21 bp, Homo sapiens
cagaactcgatgcactgacct

SEQ ID NO: 1184903 - DNA, 23 bp, Homo sapiens
cagaactcgatgcactgacctgc

SEQ ID NO: 1184904 - DNA, 20 bp, Homo sapiens
cagaactgagctcctctggg

SEQ ID NO: 1184905 - DNA, 23 bp, Homo sapiens
cagaactgagctcctctgggcag

SEQ ID NO: 1184906 - DNA, 12 bp, Homo sapiens
cagaactgccat

SEQ ID NO: 1184907 - DNA, 14 bp, Homo sapiens
cagaactgccatta

SEQ ID NO: 1184908 - DNA, 20 bp, Homo sapiens
cagaactgccattattttct

SEQ ID NO: 1184909 - DNA, 14 bp, Homo sapiens
cagaactgccccca

SEQ ID NO: 1184910 - DNA, 18 bp, Homo sapiens
cagaactgcccccactgt

SEQ ID NO: 1184911 - DNA, 13 bp, Homo sapiens
cagaactgccctt

SEQ ID NO: 1184912 - DNA, 22 bp, Homo sapiens
cagaactgcccttgctgcccgc

SEQ ID NO: 1184913 - DNA, 15 bp, Homo sapiens
cagaactggctgggc

SEQ ID NO: 1184914 - DNA, 18 bp, Homo sapiens
cagaactggctgggcccc

SEQ ID NO: 1184915 - DNA, 22 bp, Homo sapiens
cagaactggctgggcccctggg

SEQ ID NO: 1184916 - DNA, 19 bp, Homo sapiens
cagaactgtcccatcccca

SEQ ID NO: 1184917 - DNA, 18 bp, Homo sapiens
ctcctggcagggccacct

SEQ ID NO: 1184918 - DNA, 22 bp, Homo sapiens
ctcctggcagggccacctgcag

SEQ ID NO: 1184919 - DNA, 23 bp, Homo sapiens
ctcctggcagggccacctgcagg

SEQ ID NO: 1184920 - DNA, 18 bp, Homo sapiens
ctcctggcccactgcatc

SEQ ID NO: 1184921 - DNA, 19 bp, Homo sapiens
ctcctggcccactgcatcg

SEQ ID NO: 1184922 - DNA, 15 bp, Homo sapiens
ctcctggcccgccct

SEQ ID NO: 1184923 - DNA, 20 bp, Homo sapiens
ctcctggcccgccctcacct

SEQ ID NO: 1184924 - DNA, 13 bp, Homo sapiens
ctcctggcctatc

SEQ ID NO: 1184925 - DNA, 23 bp, Homo sapiens
ctcctggcctatccgctgccagc

SEQ ID NO: 1184926 - DNA, 12 bp, Homo sapiens
ctcctggccttc

SEQ ID NO: 1184927 - DNA, 17 bp, Homo sapiens
ctcctggctccgcaggg

SEQ ID NO: 1184928 - DNA, 20 bp, Homo sapiens
ctcctggctccgcaggggtt

SEQ ID NO: 1184929 - DNA, 13 bp, Homo sapiens
ctcctggctcggg

SEQ ID NO: 1184930 - DNA, 15 bp, Homo sapiens
ctcctggctgccagg

SEQ ID NO: 1184931 - DNA, 18 bp, Homo sapiens
ctcctggctgtctgaggc

SEQ ID NO: 1184932 - DNA, 12 bp, Homo sapiens
ctcctggctgtg

SEQ ID NO: 1184933 - DNA, 23 bp, Homo sapiens
ctcctggctgtgcccagcaggcc

SEQ ID NO: 1184934 - DNA, 22 bp, Homo sapiens
ctcctgggaaacctgcctttgt

SEQ ID NO: 1184935 - DNA, 18 bp, Homo sapiens
ctcctgggacccttggct

SEQ ID NO: 1184936 - DNA, 19 bp, Homo sapiens
ctcctgggagcccccacca

SEQ ID NO: 1184937 - DNA, 20 bp, Homo sapiens
ctcctgggagcccccaccac

SEQ ID NO: 1184938 - DNA, 16 bp, Homo sapiens
ctcctgggcagccgtt

SEQ ID NO: 1184939 - DNA, 19 bp, Homo sapiens
ctcctgggctcaagcaatc

SEQ ID NO: 1184940 - DNA, 19 bp, Homo sapiens
ctcctgggctcaagtgatc

SEQ ID NO: 1184941 - DNA, 15 bp, Homo sapiens
ctcctgggctctgaa

SEQ ID NO: 1184942 - DNA, 21 bp, Homo sapiens
ctcctggggagaaagaggggc

SEQ ID NO: 1184943 - DNA, 13 bp, Homo sapiens
ctcctggggagct

SEQ ID NO: 1184944 - DNA, 16 bp, Homo sapiens
ctcctggggagctcct

SEQ ID NO: 1184945 - DNA, 18 bp, Homo sapiens
ctcctggggagctcctgg

SEQ ID NO: 1184946 - DNA, 19 bp, Homo sapiens
ctcctggggagctcctggg

SEQ ID NO: 1184947 - DNA, 23 bp, Homo sapiens
ctcctggggagctcctgggaccc

SEQ ID NO: 1184948 - DNA, 14 bp, Homo sapiens
ctcctgggggctgg

SEQ ID NO: 1184949 - DNA, 17 bp, Homo sapiens
ctcctgggggtggcagg

SEQ ID NO: 1184950 - DNA, 20 bp, Homo sapiens
ctcctgggggtggcaggcac

SEQ ID NO: 1184951 - DNA, 24 bp, Homo sapiens
ctcctgggggtggcaggcacacag

SEQ ID NO: 1184952 - DNA, 21 bp, Homo sapiens
ctcctgggtgtgtttggcttg

SEQ ID NO: 1184953 - DNA, 16 bp, Homo sapiens
ctcctgggttgagctg

SEQ ID NO: 1184954 - DNA, 22 bp, Homo sapiens
ctcctgggttttgtattctctg

SEQ ID NO: 1184955 - DNA, 14 bp, Homo sapiens
ctcctggtcctgga

SEQ ID NO: 1184956 - DNA, 15 bp, Homo sapiens
ctcctggtcctggac

SEQ ID NO: 1184957 - DNA, 17 bp, Homo sapiens
ctcctggtcctggacac

SEQ ID NO: 1184958 - DNA, 21 bp, Homo sapiens
ctcctggtcctggacacctcc

SEQ ID NO: 1184959 - DNA, 24 bp, Homo sapiens
ctcctggtgtgggtaaagggacag

SEQ ID NO: 1184960 - DNA, 13 bp, Homo sapiens
ctcctggtttcct

SEQ ID NO: 1184961 - DNA, 16 bp, Homo sapiens
ctcctggtttcctttc

SEQ ID NO: 1184962 - DNA, 16 bp, Homo sapiens
ctcctgtacctcagtg

SEQ ID NO: 1184963 - DNA, 16 bp, Homo sapiens
ctcctgtacctcttga

SEQ ID NO: 1184964 - DNA, 20 bp, Homo sapiens
ctcctgtacttgtcctcagc

SEQ ID NO: 1184965 - DNA, 22 bp, Homo sapiens
ctcctgtccctgtagctcagtc

SEQ ID NO: 1184966 - DNA, 10 bp, Homo sapiens
ctcctgtcct

SEQ ID NO: 1184967 - DNA, 12 bp, Homo sapiens
ctcctgtcctcc

SEQ ID NO: 1184968 - DNA, 20 bp, Homo sapiens
ctcctgtcctcccatcccct

SEQ ID NO: 1184969 - DNA, 13 bp, Homo sapiens
ctcctgtctgcca

SEQ ID NO: 1184970 - DNA, 17 bp, Homo sapiens
ctcctgtctgccagcca

SEQ ID NO: 1184971 - DNA, 14 bp, Homo sapiens
ctcctgtctgccct

SEQ ID NO: 1184972 - DNA, 17 bp, Homo sapiens
ctcctgtctggctcgga

SEQ ID NO: 1184973 - DNA, 16 bp, Homo sapiens
ctcctgtgaatggagg

SEQ ID NO: 1184974 - DNA, 20 bp, Homo sapiens
ctcctgtgaatggaggcaga

SEQ ID NO: 1184975 - DNA, 17 bp, Homo sapiens
ctcctgtgccccagctg

SEQ ID NO: 1184976 - DNA, 17 bp, Homo sapiens
ctcctgtgcctggcccc

SEQ ID NO: 1184977 - DNA, 22 bp, Homo sapiens
ctcctgtgcctggccccagcct

SEQ ID NO: 1184978 - DNA, 13 bp, Homo sapiens
ctcctgttctgaa

SEQ ID NO: 1184979 - DNA, 17 bp, Homo sapiens
ctccttaaaaactggcc

SEQ ID NO: 1184980 - DNA, 23 bp, Homo sapiens
ctccttaatttaattgctttgaa

SEQ ID NO: 1184981 - DNA, 16 bp, Homo sapiens
ctccttacctctggaa

SEQ ID NO: 1184982 - DNA, 14 bp, Homo sapiens
ctccttactctgag

SEQ ID NO: 1184983 - DNA, 18 bp, Homo sapiens
ctccttactctgagccca

SEQ ID NO: 1184984 - DNA, 23 bp, Homo sapiens
ctccttactctgagcccaggccg

SEQ ID NO: 1184985 - DNA, 19 bp, Homo sapiens
ctccttagacctgagggac

SEQ ID NO: 1184986 - DNA, 15 bp, Homo sapiens
ctccttattttgtat

SEQ ID NO: 1184987 - DNA, 16 bp, Homo sapiens
ctccttattttgtatt

SEQ ID NO: 1184988 - DNA, 21 bp, Homo sapiens
ctccttcaacaattctaaaat

SEQ ID NO: 1184989 - DNA, 15 bp, Homo sapiens
ctccttcactgttcc

SEQ ID NO: 1184990 - DNA, 22 bp, Homo sapiens
ctccttcactgttccctctggc

SEQ ID NO: 1184991 - DNA, 15 bp, Homo sapiens
ctccttcactgtttc

SEQ ID NO: 1184992 - DNA, 14 bp, Homo sapiens
ctccttccagtgtc

SEQ ID NO: 1184993 - DNA, 17 bp, Homo sapiens
ctccttccattcagatg

SEQ ID NO: 1184994 - DNA, 16 bp, Homo sapiens
ctccttcccagcaaca

SEQ ID NO: 1184995 - DNA, 22 bp, Homo sapiens
ctccttcccagcaacactccgg

SEQ ID NO: 1184996 - DNA, 17 bp, Homo sapiens
ctccttcccaggacccc

SEQ ID NO: 1184997 - DNA, 17 bp, Homo sapiens
ctccttcccagggacca

SEQ ID NO: 1184998 - DNA, 23 bp, Homo sapiens
ctccttcccagggaccagcacct

SEQ ID NO: 1184999 - DNA, 17 bp, Homo sapiens
ctccttcccatcgctgt

SEQ ID NO: 1185000 - DNA, 17 bp, Homo sapiens
ctccttcccatgcctgt

SEQ ID NO: 1185001 - DNA, 20 bp, Homo sapiens
ctccttcccatttctctaca

SEQ ID NO: 1185002 - DNA, 22 bp, Homo sapiens
ctccttcccatttctctacact

SEQ ID NO: 1185003 - DNA, 20 bp, Homo sapiens
ctccttccccccatctctga

SEQ ID NO: 1185004 - DNA, 21 bp, Homo sapiens
ctccttccccccatctctgag

SEQ ID NO: 1185005 - DNA, 22 bp, Homo sapiens
ctccttccccccatctctgagt

SEQ ID NO: 1185006 - DNA, 16 bp, Homo sapiens
ctccttcccctgcacc

SEQ ID NO: 1185007 - DNA, 22 bp, Homo sapiens
ctccttcccgccgcccgacccc

SEQ ID NO: 1185008 - DNA, 13 bp, Homo sapiens
ctccttcctggag

SEQ ID NO: 1185009 - DNA, 14 bp, Homo sapiens
ctccttcctggcct

SEQ ID NO: 1185010 - DNA, 15 bp, Homo sapiens
ctccttcctgggacc

SEQ ID NO: 1185011 - DNA, 19 bp, Homo sapiens
ctccttcctgtttgttttg

SEQ ID NO: 1185012 - DNA, 14 bp, Homo sapiens
ctccttcgtgtctc

SEQ ID NO: 1185013 - DNA, 15 bp, Homo sapiens
ctccttcgtgtctct

SEQ ID NO: 1185014 - DNA, 15 bp, Homo sapiens
ctccttctattttcc

SEQ ID NO: 1185015 - DNA, 14 bp, Homo sapiens
ctccttctccccaa

SEQ ID NO: 1185016 - DNA, 19 bp, Homo sapiens
cagacactaacgaaatatc

SEQ ID NO: 1185017 - DNA, 16 bp, Homo sapiens
cagacactaactttgt

SEQ ID NO: 1185018 - DNA, 19 bp, Homo sapiens
cagacactacatatctaaa

SEQ ID NO: 1185019 - DNA, 21 bp, Homo sapiens
cagacacttttttgagtggat

SEQ ID NO: 1185020 - DNA, 14 bp, Homo sapiens
cagacagaaactgg

SEQ ID NO: 1185021 - DNA, 15 bp, Homo sapiens
cagacagaacttgaa

SEQ ID NO: 1185022 - DNA, 23 bp, Homo sapiens
cagacagaacttgaatgtgtcag

SEQ ID NO: 1185023 - DNA, 13 bp, Homo sapiens
cagacagaagtct

SEQ ID NO: 1185024 - DNA, 13 bp, Homo sapiens
cagacagagactt

SEQ ID NO: 1185025 - DNA, 14 bp, Homo sapiens
cagacagagacttt

SEQ ID NO: 1185026 - DNA, 21 bp, Homo sapiens
cagacagcaacggggaggcca

SEQ ID NO: 1185027 - DNA, 19 bp, Homo sapiens
cagacagcagctcaggcac

SEQ ID NO: 1185028 - DNA, 17 bp, Homo sapiens
cagacagcaggcagcgc

SEQ ID NO: 1185029 - DNA, 19 bp, Homo sapiens
cagacagcaggcagcgcca

SEQ ID NO: 1185030 - DNA, 15 bp, Homo sapiens
cagacagccccaagc

SEQ ID NO: 1185031 - DNA, 19 bp, Homo sapiens
cagacagccccaagcttct

SEQ ID NO: 1185032 - DNA, 21 bp, Homo sapiens
cagacaggagaaatgcatcca

SEQ ID NO: 1185033 - DNA, 20 bp, Homo sapiens
cagacaggccccgtgaggca

SEQ ID NO: 1185034 - DNA, 20 bp, Homo sapiens
cagacaggctcttagcagct

SEQ ID NO: 1185035 - DNA, 18 bp, Homo sapiens
cagacaggctggcattct

SEQ ID NO: 1185036 - DNA, 20 bp, Homo sapiens
cagacagggtctgaaggact

SEQ ID NO: 1185037 - DNA, 23 bp, Homo sapiens
cagacagtctgttatgcactgtg

SEQ ID NO: 1185038 - DNA, 21 bp, Homo sapiens
cagactctgcctcctggtttc

SEQ ID NO: 1185039 - DNA, 19 bp, Homo sapiens
cagactcttacgtggagag

SEQ ID NO: 1185040 - DNA, 13 bp, Homo sapiens
cagactcttgcct

SEQ ID NO: 1185041 - DNA, 22 bp, Homo sapiens
cagactctttttttgagtgaca

SEQ ID NO: 1185042 - DNA, 19 bp, Homo sapiens
cagactgaactcgcaggga

SEQ ID NO: 1185043 - DNA, 20 bp, Homo sapiens
cagactgacaaatgtgtatc

SEQ ID NO: 1185044 - DNA, 19 bp, Homo sapiens
cagactgagctctccaggc

SEQ ID NO: 1185045 - DNA, 20 bp, Homo sapiens
cagactgagctctccaggcc

SEQ ID NO: 1185046 - DNA, 16 bp, Homo sapiens
cagactgatgagcaca

SEQ ID NO: 1185047 - DNA, 22 bp, Homo sapiens
cagactgatggcgattccctct

SEQ ID NO: 1185048 - DNA, 21 bp, Homo sapiens
cagactgcagacattctcaaa

SEQ ID NO: 1185049 - DNA, 15 bp, Homo sapiens
cagactgccccagcc

SEQ ID NO: 1185050 - DNA, 17 bp, Homo sapiens
cagactgccccagccaa

SEQ ID NO: 1185051 - DNA, 22 bp, Homo sapiens
cagactgccccagccaacgaga

SEQ ID NO: 1185052 - DNA, 18 bp, Homo sapiens
cagactgcgatttgtccc

SEQ ID NO: 1185053 - DNA, 13 bp, Homo sapiens
cagactgctggga

SEQ ID NO: 1185054 - DNA, 16 bp, Homo sapiens
cagactgctgggactg

SEQ ID NO: 1185055 - DNA, 23 bp, Homo sapiens
cagactgctgggactggccaggt

SEQ ID NO: 1185056 - DNA, 20 bp, Homo sapiens
cagactgcttccaattttct

SEQ ID NO: 1185057 - DNA, 15 bp, Homo sapiens
cagactgcttggcca

SEQ ID NO: 1185058 - DNA, 17 bp, Homo sapiens
cagactggaagacactt

SEQ ID NO: 1185059 - DNA, 16 bp, Homo sapiens
cagactggctggctgc

SEQ ID NO: 1185060 - DNA, 18 bp, Homo sapiens
cagactgggaacccctcc

SEQ ID NO: 1185061 - DNA, 12 bp, Homo sapiens
cagactgggccc

SEQ ID NO: 1185062 - DNA, 23 bp, Homo sapiens
cagactgtaagatgttgttttag

SEQ ID NO: 1185063 - DNA, 16 bp, Homo sapiens
cagactgttaattata

SEQ ID NO: 1185064 - DNA, 14 bp, Homo sapiens
cagactgttttact

SEQ ID NO: 1185065 - DNA, 22 bp, Homo sapiens
cagacttccaaatcctggaagg

SEQ ID NO: 1185066 - DNA, 15 bp, Homo sapiens
cagacttcccagcta

SEQ ID NO: 1185067 - DNA, 23 bp, Homo sapiens
cagacttctattttttaaagact

SEQ ID NO: 1185068 - DNA, 13 bp, Homo sapiens
cagacttctccag

SEQ ID NO: 1185069 - DNA, 14 bp, Homo sapiens
cagacttctccaga

SEQ ID NO: 1185070 - DNA, 15 bp, Homo sapiens
cagacttctggaagg

SEQ ID NO: 1185071 - DNA, 19 bp, Homo sapiens
cagacttctggaaggctgg

SEQ ID NO: 1185072 - DNA, 22 bp, Homo sapiens
cagacttctggaaggctggctg

SEQ ID NO: 1185073 - DNA, 17 bp, Homo sapiens
cagacttgcccaggtca

SEQ ID NO: 1185074 - DNA, 15 bp, Homo sapiens
cagactttcacacca

SEQ ID NO: 1185075 - DNA, 17 bp, Homo sapiens
cagactttcccaaatgt

SEQ ID NO: 1185076 - DNA, 19 bp, Homo sapiens
cagactttgagcctgcatc

SEQ ID NO: 1185077 - DNA, 21 bp, Homo sapiens
cagactttgtgttcatttcat

SEQ ID NO: 1185078 - DNA, 22 bp, Homo sapiens
cagactttgtgttcatttcatt

SEQ ID NO: 1185079 - DNA, 15 bp, Homo sapiens
cagacttttcagaag

SEQ ID NO: 1185080 - DNA, 13 bp, Homo sapiens
cagacttttgctt

SEQ ID NO: 1185081 - DNA, 17 bp, Homo sapiens
cagagaaaatgaatttg

SEQ ID NO: 1185082 - DNA, 13 bp, Homo sapiens
cagagaaagaaaa

SEQ ID NO: 1185083 - DNA, 15 bp, Homo sapiens
cagagaaagaagaga

SEQ ID NO: 1185084 - DNA, 19 bp, Homo sapiens
cagagaaagaagagacagg

SEQ ID NO: 1185085 - DNA, 20 bp, Homo sapiens
cagagaaagaagagacagga

SEQ ID NO: 1185086 - DNA, 15 bp, Homo sapiens
cagagaaattctgtg

SEQ ID NO: 1185087 - DNA, 16 bp, Homo sapiens
cagagaaattctgtgg

SEQ ID NO: 1185088 - DNA, 18 bp, Homo sapiens
cagagaacaatcactatt

SEQ ID NO: 1185089 - DNA, 20 bp, Homo sapiens
cagagaacaatcactattct

SEQ ID NO: 1185090 - DNA, 14 bp, Homo sapiens
cagagaactgcaga

SEQ ID NO: 1185091 - DNA, 19 bp, Homo sapiens
cagagaagaccttctagtg

SEQ ID NO: 1185092 - DNA, 15 bp, Homo sapiens
cagagaaggcctctt

SEQ ID NO: 1185093 - DNA, 19 bp, Homo sapiens
cagagaaggcctcttgtgc

SEQ ID NO: 1185094 - DNA, 12 bp, Homo sapiens
cagagaaggcta

SEQ ID NO: 1185095 - DNA, 11 bp, Homo sapiens
cagagaagttc

SEQ ID NO: 1185096 - DNA, 20 bp, Homo sapiens
cagagaagttctcaaagtta

SEQ ID NO: 1185097 - DNA, 23 bp, Homo sapiens
cagagaagttctcaaagttaatt

SEQ ID NO: 1185098 - DNA, 21 bp, Homo sapiens
cagagaagtttgtagccaggt

SEQ ID NO: 1185099 - DNA, 14 bp, Homo sapiens
cagagaatctcttg

SEQ ID NO: 1185100 - DNA, 13 bp, Homo sapiens
cagagaatcttaa

SEQ ID NO: 1185101 - DNA, 14 bp, Homo sapiens
cagagaatggctgg

SEQ ID NO: 1185102 - DNA, 19 bp, Homo sapiens
cagagaatggctgggtcag

SEQ ID NO: 1185103 - DNA, 16 bp, Homo sapiens
cagagacacctgcacc

SEQ ID NO: 1185104 - DNA, 20 bp, Homo sapiens
cagagacacctgcacctccc

SEQ ID NO: 1185105 - DNA, 22 bp, Homo sapiens
cagagacacctgcacctccccc

SEQ ID NO: 1185106 - DNA, 20 bp, Homo sapiens
cagagacagatacctccaac

SEQ ID NO: 1185107 - DNA, 14 bp, Homo sapiens
cagagacagctgat

SEQ ID NO: 1185108 - DNA, 21 bp, Homo sapiens
cagagacagctgatacttcat

SEQ ID NO: 1185109 - DNA, 22 bp, Homo sapiens
cagagacaggaagtcttcaggg

SEQ ID NO: 1185110 - DNA, 19 bp, Homo sapiens
cagagacaggcccaagaga

SEQ ID NO: 1185111 - DNA, 21 bp, Homo sapiens
cagagaccagcactcagcctc

SEQ ID NO: 1185112 - DNA, 12 bp, Homo sapiens
cagagaccaggg

SEQ ID NO: 1185113 - DNA, 15 bp, Homo sapiens
cagagaccccttcct

SEQ ID NO: 1185114 - DNA, 21 bp, Homo sapiens
cagagaccccttcctttcctc

SEQ ID NO: 1185115 - DNA, 15 bp, Homo sapiens
cagagacgcaggaat

SEQ ID NO: 1185116 - DNA, 17 bp, Homo sapiens
cagagacgcaggaatgg

SEQ ID NO: 1185117 - DNA, 18 bp, Homo sapiens
cagagacgcaggaatgga

SEQ ID NO: 1185118 - DNA, 10 bp, Homo sapiens
cagagactca

SEQ ID NO: 1185119 - DNA, 20 bp, Homo sapiens
cagagactcagggccccagc

SEQ ID NO: 1185120 - DNA, 21 bp, Homo sapiens
cagagactcagggccccagca

SEQ ID NO: 1185121 - DNA, 17 bp, Homo sapiens
cagagactcatttcaca

SEQ ID NO: 1185122 - DNA, 16 bp, Homo sapiens
cagagactctatttta

SEQ ID NO: 1185123 - DNA, 19 bp, Homo sapiens
cagagactgcccttctcac

SEQ ID NO: 1185124 - DNA, 14 bp, Homo sapiens
cagagactttgtag

SEQ ID NO: 1185125 - DNA, 11 bp, Homo sapiens
cagagagacag

SEQ ID NO: 1185126 - DNA, 23 bp, Homo sapiens
cagagagacctcatcctgctctt

SEQ ID NO: 1185127 - DNA, 24 bp, Homo sapiens
cagagagagaagtgcccctgctgc

SEQ ID NO: 1185128 - DNA, 13 bp, Homo sapiens
cagagagaggagg

SEQ ID NO: 1185129 - DNA, 19 bp, Homo sapiens
cagagagcagctccctttc

SEQ ID NO: 1185130 - DNA, 18 bp, Homo sapiens
cagagagcaggcaggggc

SEQ ID NO: 1185131 - DNA, 21 bp, Homo sapiens
cagagagcaggggagcttggg

SEQ ID NO: 1185132 - DNA, 23 bp, Homo sapiens
cagagagcaggggagcttgggac

SEQ ID NO: 1185133 - DNA, 20 bp, Homo sapiens
cagagagcctggtgctgctg

SEQ ID NO: 1185134 - DNA, 12 bp, Homo sapiens
cagagagctggt

SEQ ID NO: 1185135 - DNA, 11 bp, Homo sapiens
cagagaggaag

SEQ ID NO: 1185136 - DNA, 17 bp, Homo sapiens
cagagaggagaaacaca

SEQ ID NO: 1185137 - DNA, 22 bp, Homo sapiens
cagagaggagaaacacatcttc

SEQ ID NO: 1185138 - DNA, 15 bp, Homo sapiens
cagagaggagcacct

SEQ ID NO: 1185139 - DNA, 20 bp, Homo sapiens
cagagaggagcacctgaacc

SEQ ID NO: 1185140 - DNA, 21 bp, Homo sapiens
cagagaggagcacctgaaccc

SEQ ID NO: 1185141 - DNA, 19 bp, Homo sapiens
cagagaggatacatttaat

SEQ ID NO: 1185142 - DNA, 18 bp, Homo sapiens
cagagaggcactcagtga

SEQ ID NO: 1185143 - DNA, 20 bp, Homo sapiens
cagagaggcactcagtgagc

SEQ ID NO: 1185144 - DNA, 20 bp, Homo sapiens
cagagaggccttttggaatg

SEQ ID NO: 1185145 - DNA, 23 bp, Homo sapiens
ctcggaaccgctcacctagagcc

SEQ ID NO: 1185146 - DNA, 19 bp, Homo sapiens
ctcggaagccgtctgactc

SEQ ID NO: 1185147 - DNA, 23 bp, Homo sapiens
ctcggacccaccaaactgcacac

SEQ ID NO: 1185148 - DNA, 20 bp, Homo sapiens
ctcggagagcagcagcacca

SEQ ID NO: 1185149 - DNA, 18 bp, Homo sapiens
ctcggagcatcccggagg

SEQ ID NO: 1185150 - DNA, 13 bp, Homo sapiens
ctcggagcctcat

SEQ ID NO: 1185151 - DNA, 12 bp, Homo sapiens
ctcggagcctgt

SEQ ID NO: 1185152 - DNA, 23 bp, Homo sapiens
ctcggagctggctgtgcctgctt

SEQ ID NO: 1185153 - DNA, 17 bp, Homo sapiens
ctcggaggaagccccca

SEQ ID NO: 1185154 - DNA, 20 bp, Homo sapiens
ctcggatcaccgagagtagc

SEQ ID NO: 1185155 - DNA, 17 bp, Homo sapiens
ctcggatcatatggagc

SEQ ID NO: 1185156 - DNA, 18 bp, Homo sapiens
ctcggatcatatggagct

SEQ ID NO: 1185157 - DNA, 17 bp, Homo sapiens
ctcggatgacaccctgg

SEQ ID NO: 1185158 - DNA, 19 bp, Homo sapiens
ctcggatgacaccctggcc

SEQ ID NO: 1185159 - DNA, 21 bp, Homo sapiens
ctccgcccccagcctatgagc

SEQ ID NO: 1185160 - DNA, 13 bp, Homo sapiens
ctccgcccctgcc

SEQ ID NO: 1185161 - DNA, 15 bp, Homo sapiens
ctccgccctgccact

SEQ ID NO: 1185162 - DNA, 16 bp, Homo sapiens
ctccgcctggcctggc

SEQ ID NO: 1185163 - DNA, 13 bp, Homo sapiens
ctccgcctgggat

SEQ ID NO: 1185164 - DNA, 14 bp, Homo sapiens
ctccgcctgggatc

SEQ ID NO: 1185165 - DNA, 15 bp, Homo sapiens
ctccgcctgtgtcca

SEQ ID NO: 1185166 - DNA, 17 bp, Homo sapiens
ctccgccttaccaggag

SEQ ID NO: 1185167 - DNA, 18 bp, Homo sapiens
ctccgccttcactccggt

SEQ ID NO: 1185168 - DNA, 13 bp, Homo sapiens
ctccgccttccgg

SEQ ID NO: 1185169 - DNA, 15 bp, Homo sapiens
ctccgcgccgatgcc

SEQ ID NO: 1185170 - DNA, 16 bp, Homo sapiens
ctccgcgggagacccc

SEQ ID NO: 1185171 - DNA, 12 bp, Homo sapiens
ctccgctcccac

SEQ ID NO: 1185172 - DNA, 13 bp, Homo sapiens
ctccgctgctcct

SEQ ID NO: 1185173 - DNA, 15 bp, Homo sapiens
ctccgcttatcctgc

SEQ ID NO: 1185174 - DNA, 17 bp, Homo sapiens
ctccgcttatcctgcta

SEQ ID NO: 1185175 - DNA, 16 bp, Homo sapiens
ctccggacatccagcg

SEQ ID NO: 1185176 - DNA, 12 bp, Homo sapiens
ctccggaggact

SEQ ID NO: 1185177 - DNA, 17 bp, Homo sapiens
ctccggaggactgagcc

SEQ ID NO: 1185178 - DNA, 20 bp, Homo sapiens
ctccggaggactgagccccc

SEQ ID NO: 1185179 - DNA, 15 bp, Homo sapiens
ctccggaggagcagc

SEQ ID NO: 1185180 - DNA, 18 bp, Homo sapiens
ctccggaggagcagcctc

SEQ ID NO: 1185181 - DNA, 14 bp, Homo sapiens
ctccggaggggacc

SEQ ID NO: 1185182 - DNA, 19 bp, Homo sapiens
ctccggagggggtcctcct

SEQ ID NO: 1185183 - DNA, 20 bp, Homo sapiens
ctccggagggggtcctcctc

SEQ ID NO: 1185184 - DNA, 21 bp, Homo sapiens
ctccggccctcctaccctgcg

SEQ ID NO: 1185185 - DNA, 14 bp, Homo sapiens
ctccggcctcccct

SEQ ID NO: 1185186 - DNA, 20 bp, Homo sapiens
ctccggcgtcttgcccagca

SEQ ID NO: 1185187 - DNA, 18 bp, Homo sapiens
ctccggctgcctagccct

SEQ ID NO: 1185188 - DNA, 20 bp, Homo sapiens
ctccgggaccattgacctca

SEQ ID NO: 1185189 - DNA, 15 bp, Homo sapiens
ctccgggacctggtg

SEQ ID NO: 1185190 - DNA, 12 bp, Homo sapiens
ctccgggcaggg

SEQ ID NO: 1185191 - DNA, 14 bp, Homo sapiens
ctccgggcagggga

SEQ ID NO: 1185192 - DNA, 21 bp, Homo sapiens
ctccgggcaggggagccaggg

SEQ ID NO: 1185193 - DNA, 13 bp, Homo sapiens
ctccggggtctgt

SEQ ID NO: 1185194 - DNA, 15 bp, Homo sapiens
ctccggggtctgtgc

SEQ ID NO: 1185195 - DNA, 22 bp, Homo sapiens
ctccggggtctgtgctgtgcct

SEQ ID NO: 1185196 - DNA, 17 bp, Homo sapiens
ctccggggtggccacag

SEQ ID NO: 1185197 - DNA, 18 bp, Homo sapiens
ctccgggtcactgctgta

SEQ ID NO: 1185198 - DNA, 14 bp, Homo sapiens
ctccgggtcctcct

SEQ ID NO: 1185199 - DNA, 15 bp, Homo sapiens
ctccgggtgtggcct

SEQ ID NO: 1185200 - DNA, 16 bp, Homo sapiens
ctccgggtgtggcctc

SEQ ID NO: 1185201 - DNA, 21 bp, Homo sapiens
ctccgggtgtggcctcagccc

SEQ ID NO: 1185202 - DNA, 13 bp, Homo sapiens
ctccggtgtgcct

SEQ ID NO: 1185203 - DNA, 19 bp, Homo sapiens
ctccggtttgggctgtctt

SEQ ID NO: 1185204 - DNA, 17 bp, Homo sapiens
ctccgtagggtctttct

SEQ ID NO: 1185205 - DNA, 18 bp, Homo sapiens
ctccgtcatccatgccct

SEQ ID NO: 1185206 - DNA, 15 bp, Homo sapiens
ctccgtccacccagg

SEQ ID NO: 1185207 - DNA, 23 bp, Homo sapiens
ctccgtccatatcagaactgtgc

SEQ ID NO: 1185208 - DNA, 20 bp, Homo sapiens
ctccgtcctgtcactgatgg

SEQ ID NO: 1185209 - DNA, 12 bp, Homo sapiens
ctccgtctctgt

SEQ ID NO: 1185210 - DNA, 13 bp, Homo sapiens
ctccgtctctgtc

SEQ ID NO: 1185211 - DNA, 15 bp, Homo sapiens
ctccgtgatccatcc

SEQ ID NO: 1185212 - DNA, 15 bp, Homo sapiens
ctccgtgcctccacc

SEQ ID NO: 1185213 - DNA, 22 bp, Homo sapiens
ctccgtgcctccaccaccactg

SEQ ID NO: 1185214 - DNA, 13 bp, Homo sapiens
ctccgtggaacat

SEQ ID NO: 1185215 - DNA, 17 bp, Homo sapiens
ctccgtggactgcagtc

SEQ ID NO: 1185216 - DNA, 22 bp, Homo sapiens
ctccgtgtctcgcgcgactgag

SEQ ID NO: 1185217 - DNA, 23 bp, Homo sapiens
ctccgtgtggactgtgcctcagg

SEQ ID NO: 1185218 - DNA, 17 bp, Homo sapiens
ctccgttagctcctgtg

SEQ ID NO: 1185219 - DNA, 22 bp, Homo sapiens
ctccgttagctcctgtggcccc

SEQ ID NO: 1185220 - DNA, 12 bp, Homo sapiens
ctccgttcctgg

SEQ ID NO: 1185221 - DNA, 21 bp, Homo sapiens
ctccgttcctggcatttgctg

SEQ ID NO: 1185222 - DNA, 20 bp, Homo sapiens
ctccgtttatgggccttgct

SEQ ID NO: 1185223 - DNA, 21 bp, Homo sapiens
ctccgtttatgggccttgctt

SEQ ID NO: 1185224 - DNA, 15 bp, Homo sapiens
ctcctaagtcccttc

SEQ ID NO: 1185225 - DNA, 18 bp, Homo sapiens
ctcctaagtcccttccta

SEQ ID NO: 1185226 - DNA, 20 bp, Homo sapiens
ctcctaagtcccttcctatt

SEQ ID NO: 1185227 - DNA, 15 bp, Homo sapiens
ctcctaattttaaat

SEQ ID NO: 1185228 - DNA, 21 bp, Homo sapiens
ctcctaattttaaataatttc

SEQ ID NO: 1185229 - DNA, 20 bp, Homo sapiens
ctcctacaagatttagaaaa

SEQ ID NO: 1185230 - DNA, 14 bp, Homo sapiens
ctcctacatccagc

SEQ ID NO: 1185231 - DNA, 19 bp, Homo sapiens
ctcctacatccagctcctc

SEQ ID NO: 1185232 - DNA, 21 bp, Homo sapiens
ctcctaccagcaaacagctga

SEQ ID NO: 1185233 - DNA, 15 bp, Homo sapiens
ctcctaccccttcct

SEQ ID NO: 1185234 - DNA, 16 bp, Homo sapiens
ctcctaccccttcctg

SEQ ID NO: 1185235 - DNA, 16 bp, Homo sapiens
ctcctaccctcccacc

SEQ ID NO: 1185236 - DNA, 22 bp, Homo sapiens
ctcctaccctcccaccagaacg

SEQ ID NO: 1185237 - DNA, 15 bp, Homo sapiens
ctcctacctcagcct

SEQ ID NO: 1185238 - DNA, 16 bp, Homo sapiens
ctcctacctgctgctg

SEQ ID NO: 1185239 - DNA, 20 bp, Homo sapiens
ctcctacctggggactcctc

SEQ ID NO: 1185240 - DNA, 18 bp, Homo sapiens
ctcctactctgtgtaaat

SEQ ID NO: 1185241 - DNA, 15 bp, Homo sapiens
cccaggagcaacagc

SEQ ID NO: 1185242 - DNA, 13 bp, Homo sapiens
cccaggagctctg

SEQ ID NO: 1185243 - DNA, 20 bp, Homo sapiens
cccaggagctctgcgccagg

SEQ ID NO: 1185244 - DNA, 18 bp, Homo sapiens
cccaggagggagggggct

SEQ ID NO: 1185245 - DNA, 23 bp, Homo sapiens
cccaggaggtggaggttgcagtg

SEQ ID NO: 1185246 - DNA, 24 bp, Homo sapiens
cccaggagttcgaggctgcagtca

SEQ ID NO: 1185247 - DNA, 20 bp, Homo sapiens
cccaggagtttgagacaagc

SEQ ID NO: 1185248 - DNA, 22 bp, Homo sapiens
cccaggagtttgaggctgcagc

SEQ ID NO: 1185249 - DNA, 23 bp, Homo sapiens
cccaggagtttgaggctgcagcg

SEQ ID NO: 1185250 - DNA, 18 bp, Homo sapiens
cccaggatatttctgaga

SEQ ID NO: 1185251 - DNA, 17 bp, Homo sapiens
cccaggattcccccagc

SEQ ID NO: 1185252 - DNA, 14 bp, Homo sapiens
cccaggcaccacca

SEQ ID NO: 1185253 - DNA, 10 bp, Homo sapiens
cccaggcagc

SEQ ID NO: 1185254 - DNA, 22 bp, Homo sapiens
cccaggcagcacagtgtgtgaa

SEQ ID NO: 1185255 - DNA, 11 bp, Homo sapiens
cccaggcagcc

SEQ ID NO: 1185256 - DNA, 15 bp, Homo sapiens
cccaggcagccacca

SEQ ID NO: 1185257 - DNA, 22 bp, Homo sapiens
cccaggcagcctcaaggccctc

SEQ ID NO: 1185258 - DNA, 20 bp, Homo sapiens
cccaggcagctatttcagcc

SEQ ID NO: 1185259 - DNA, 14 bp, Homo sapiens
cccaggcaggccac

SEQ ID NO: 1185260 - DNA, 14 bp, Homo sapiens
cccaggcaggtctg

SEQ ID NO: 1185261 - DNA, 15 bp, Homo sapiens
cccaggcatctcctt

SEQ ID NO: 1185262 - DNA, 12 bp, Homo sapiens
cccaggcatgca

SEQ ID NO: 1185263 - DNA, 20 bp, Homo sapiens
cccaggcatgcagctgcctg

SEQ ID NO: 1185264 - DNA, 12 bp, Homo sapiens
cccaggccaccc

SEQ ID NO: 1185265 - DNA, 16 bp, Homo sapiens
cccaggccagcccccc

SEQ ID NO: 1185266 - DNA, 21 bp, Homo sapiens
cccaggccagcccccccaccc

SEQ ID NO: 1185267 - DNA, 23 bp, Homo sapiens
cccaggccagcccccccacccac

SEQ ID NO: 1185268 - DNA, 17 bp, Homo sapiens
cccaggccaggccacca

SEQ ID NO: 1185269 - DNA, 13 bp, Homo sapiens
cccaggccaggta

SEQ ID NO: 1185270 - DNA, 15 bp, Homo sapiens
cccaggccaggtagc

SEQ ID NO: 1185271 - DNA, 19 bp, Homo sapiens
cccaggccatgtggcctgc

SEQ ID NO: 1185272 - DNA, 20 bp, Homo sapiens
cccaggcccaccatcaccac

SEQ ID NO: 1185273 - DNA, 11 bp, Homo sapiens
cccaggcccag

SEQ ID NO: 1185274 - DNA, 14 bp, Homo sapiens
cccaggcccagccc

SEQ ID NO: 1185275 - DNA, 17 bp, Homo sapiens
cccaggcccagccctcc

SEQ ID NO: 1185276 - DNA, 18 bp, Homo sapiens
cccaggcccagccctcct

SEQ ID NO: 1185277 - DNA, 11 bp, Homo sapiens
cccaggccccc

SEQ ID NO: 1185278 - DNA, 16 bp, Homo sapiens
cccaggcccccggctt

SEQ ID NO: 1185279 - DNA, 21 bp, Homo sapiens
cccaggcccccggctttcctc

SEQ ID NO: 1185280 - DNA, 12 bp, Homo sapiens
cccaggccccct

SEQ ID NO: 1185281 - DNA, 15 bp, Homo sapiens
cccaggccccctgca

SEQ ID NO: 1185282 - DNA, 22 bp, Homo sapiens
cccaggcccgcgggcacagcca

SEQ ID NO: 1185283 - DNA, 12 bp, Homo sapiens
cccaggccctcc

SEQ ID NO: 1185284 - DNA, 18 bp, Homo sapiens
cccaggccctccatgggc

SEQ ID NO: 1185285 - DNA, 15 bp, Homo sapiens
cccaggccctcccac

SEQ ID NO: 1185286 - DNA, 16 bp, Homo sapiens
cccaggccctcccacc

SEQ ID NO: 1185287 - DNA, 17 bp, Homo sapiens
cccaggccctcccacca

SEQ ID NO: 1185288 - DNA, 19 bp, Homo sapiens
cccaggccctcccaccacc

SEQ ID NO: 1185289 - DNA, 14 bp, Homo sapiens
cccaggccctccct

SEQ ID NO: 1185290 - DNA, 18 bp, Homo sapiens
cccaggcccttggctgca

SEQ ID NO: 1185291 - DNA, 16 bp, Homo sapiens
cccaggccggagccca

SEQ ID NO: 1185292 - DNA, 15 bp, Homo sapiens
cccaggccggcccag

SEQ ID NO: 1185293 - DNA, 13 bp, Homo sapiens
cccaggcctccag

SEQ ID NO: 1185294 - DNA, 22 bp, Homo sapiens
cccaggcctccagcctctcccg

SEQ ID NO: 1185295 - DNA, 15 bp, Homo sapiens
cccaggcctgcctgt

SEQ ID NO: 1185296 - DNA, 13 bp, Homo sapiens
cccaggcctggag

SEQ ID NO: 1185297 - DNA, 14 bp, Homo sapiens
cccaggcctggagc

SEQ ID NO: 1185298 - DNA, 12 bp, Homo sapiens
cccaggcctggc

SEQ ID NO: 1185299 - DNA, 13 bp, Homo sapiens
cccaggcctggcc

SEQ ID NO: 1185300 - DNA, 15 bp, Homo sapiens
cccaggcctggcctc

SEQ ID NO: 1185301 - DNA, 13 bp, Homo sapiens
cccaggcctggct

SEQ ID NO: 1185302 - DNA, 23 bp, Homo sapiens
cccaggcctgggatgcagtgatg

SEQ ID NO: 1185303 - DNA, 14 bp, Homo sapiens
cccaggcctgtcca

SEQ ID NO: 1185304 - DNA, 10 bp, Homo sapiens
cccaggcctt

SEQ ID NO: 1185305 - DNA, 18 bp, Homo sapiens
cccaggccttgctgactc

SEQ ID NO: 1185306 - DNA, 12 bp, Homo sapiens
cccaggcctttg

SEQ ID NO: 1185307 - DNA, 18 bp, Homo sapiens
cccaggcctttggagggg

SEQ ID NO: 1185308 - DNA, 20 bp, Homo sapiens
cccaggctctggagccagag

SEQ ID NO: 1185309 - DNA, 18 bp, Homo sapiens
cccaggctgagcctcagt

SEQ ID NO: 1185310 - DNA, 13 bp, Homo sapiens
cccaggctgcact

SEQ ID NO: 1185311 - DNA, 14 bp, Homo sapiens
cccaggctgcactg

SEQ ID NO: 1185312 - DNA, 15 bp, Homo sapiens
cccaggctgcactgc

SEQ ID NO: 1185313 - DNA, 16 bp, Homo sapiens
cccaggctgcactgca

SEQ ID NO: 1185314 - DNA, 21 bp, Homo sapiens
cccaggctgctggagtgcagt

SEQ ID NO: 1185315 - DNA, 14 bp, Homo sapiens
cccaggctggaatg

SEQ ID NO: 1185316 - DNA, 14 bp, Homo sapiens
cccaggctgggaac

SEQ ID NO: 1185317 - DNA, 16 bp, Homo sapiens
cccaggctggtctcaa

SEQ ID NO: 1185318 - DNA, 12 bp, Homo sapiens
cccaggctgtca

SEQ ID NO: 1185319 - DNA, 22 bp, Homo sapiens
cccaggctgtgcagcgcagctg

SEQ ID NO: 1185320 - DNA, 16 bp, Homo sapiens
cccaggcttttgctag

SEQ ID NO: 1185321 - DNA, 21 bp, Homo sapiens
cccagggacagaaaccaaggc

SEQ ID NO: 1185322 - DNA, 14 bp, Homo sapiens
cccagggacagagg

SEQ ID NO: 1185323 - DNA, 15 bp, Homo sapiens
cccagggacagaggc

SEQ ID NO: 1185324 - DNA, 15 bp, Homo sapiens
cccagggagctctgg

SEQ ID NO: 1185325 - DNA, 15 bp, Homo sapiens
cccagggaggcagcg

SEQ ID NO: 1185326 - DNA, 17 bp, Homo sapiens
cccagggaggcagcgtg

SEQ ID NO: 1185327 - DNA, 14 bp, Homo sapiens
cactgagcacagtc

SEQ ID NO: 1185328 - DNA, 11 bp, Homo sapiens
cactgagcccc

SEQ ID NO: 1185329 - DNA, 16 bp, Homo sapiens
cactgagcccccccaa

SEQ ID NO: 1185330 - DNA, 17 bp, Homo sapiens
cactgagctccatgtgc

SEQ ID NO: 1185331 - DNA, 15 bp, Homo sapiens
cactgagctccccag

SEQ ID NO: 1185332 - DNA, 18 bp, Homo sapiens
cactgaggccatcagggc

SEQ ID NO: 1185333 - DNA, 20 bp, Homo sapiens
cactgaggccatcagggccc

SEQ ID NO: 1185334 - DNA, 20 bp, Homo sapiens
cactgaggcttaggcctctc

SEQ ID NO: 1185335 - DNA, 14 bp, Homo sapiens
cactgagggatctg

SEQ ID NO: 1185336 - DNA, 10 bp, Homo sapiens
cactgagggc

SEQ ID NO: 1185337 - DNA, 14 bp, Homo sapiens
cactgagggcagtc

SEQ ID NO: 1185338 - DNA, 14 bp, Homo sapiens
cactgagggccaca

SEQ ID NO: 1185339 - DNA, 20 bp, Homo sapiens
ctcagcaccccttccatgtg

SEQ ID NO: 1185340 - DNA, 15 bp, Homo sapiens
ctcagcagaggcagt

SEQ ID NO: 1185341 - DNA, 16 bp, Homo sapiens
ctcagcagaggcagtg

SEQ ID NO: 1185342 - DNA, 18 bp, Homo sapiens
ctcagcagcagagagccc

SEQ ID NO: 1185343 - DNA, 21 bp, Homo sapiens
ctcagcagccagtctcagaga

SEQ ID NO: 1185344 - DNA, 23 bp, Homo sapiens
ctcagcagccagtctcagagacc

SEQ ID NO: 1185345 - DNA, 24 bp, Homo sapiens
ctcagcagccagtctcagagacca

SEQ ID NO: 1185346 - DNA, 18 bp, Homo sapiens
ctcagcagccctcctcac

SEQ ID NO: 1185347 - DNA, 23 bp, Homo sapiens
ctcagcagccgccttaagctgat

SEQ ID NO: 1185348 - DNA, 20 bp, Homo sapiens
ctcagcatagggtcactttg

SEQ ID NO: 1185349 - DNA, 23 bp, Homo sapiens
ctcagcatatttgtatagttgct

SEQ ID NO: 1185350 - DNA, 20 bp, Homo sapiens
ctcagcatttgattaacatt

SEQ ID NO: 1185351 - DNA, 18 bp, Homo sapiens
ctcagccaagacaaggag

SEQ ID NO: 1185352 - DNA, 16 bp, Homo sapiens
ctcagccaccctgagt

SEQ ID NO: 1185353 - DNA, 11 bp, Homo sapiens
ctcagccagca

SEQ ID NO: 1185354 - DNA, 17 bp, Homo sapiens
ctcagccagtggcacag

SEQ ID NO: 1185355 - DNA, 22 bp, Homo sapiens
ctcagccagtggcacaggagac

SEQ ID NO: 1185356 - DNA, 19 bp, Homo sapiens
ctcagccataggtgcagtt

SEQ ID NO: 1185357 - DNA, 19 bp, Homo sapiens
ctcagccatgggaacctca

SEQ ID NO: 1185358 - DNA, 20 bp, Homo sapiens
ctcagccatgggaacctcat

SEQ ID NO: 1185359 - DNA, 20 bp, Homo sapiens
ctcagcccaacttcttaccc

SEQ ID NO: 1185360 - DNA, 21 bp, Homo sapiens
ctcagcccaacttcttacccg

SEQ ID NO: 1185361 - DNA, 11 bp, Homo sapiens
ctcagcccacc

SEQ ID NO: 1185362 - DNA, 19 bp, Homo sapiens
ctcagcccacccccctcat

SEQ ID NO: 1185363 - DNA, 12 bp, Homo sapiens
ctcagcccagct

SEQ ID NO: 1185364 - DNA, 14 bp, Homo sapiens
ctcagcccccagga

SEQ ID NO: 1185365 - DNA, 21 bp, Homo sapiens
ctcagcccccaggatctgggt

SEQ ID NO: 1185366 - DNA, 17 bp, Homo sapiens
ctcagcccccaggccag

SEQ ID NO: 1185367 - DNA, 19 bp, Homo sapiens
ctcagcccctacccctgcc

SEQ ID NO: 1185368 - DNA, 22 bp, Homo sapiens
ctcagcccctacccctgccctg

SEQ ID NO: 1185369 - DNA, 23 bp, Homo sapiens
ctcagcccctacccctgccctgc

SEQ ID NO: 1185370 - DNA, 15 bp, Homo sapiens
ctcagcccctaggag

SEQ ID NO: 1185371 - DNA, 23 bp, Homo sapiens
ctcagcccctaggagtatatttc

SEQ ID NO: 1185372 - DNA, 19 bp, Homo sapiens
ctcagcccctcttgccccc

SEQ ID NO: 1185373 - DNA, 13 bp, Homo sapiens
ctcagccctcaga

SEQ ID NO: 1185374 - DNA, 16 bp, Homo sapiens
ctcagccctcagaaca

SEQ ID NO: 1185375 - DNA, 13 bp, Homo sapiens
ctcagccctcagt

SEQ ID NO: 1185376 - DNA, 20 bp, Homo sapiens
ctcagccctccctgcccctc

SEQ ID NO: 1185377 - DNA, 13 bp, Homo sapiens
ctcagccctgacc

SEQ ID NO: 1185378 - DNA, 17 bp, Homo sapiens
ctcagccctgaccctgt

SEQ ID NO: 1185379 - DNA, 13 bp, Homo sapiens
ctcagccctgact

SEQ ID NO: 1185380 - DNA, 13 bp, Homo sapiens
ctcagccctgagg

SEQ ID NO: 1185381 - DNA, 11 bp, Homo sapiens
ctcagccctgg

SEQ ID NO: 1185382 - DNA, 13 bp, Homo sapiens
ctcagccctggcc

SEQ ID NO: 1185383 - DNA, 15 bp, Homo sapiens
ctcagccctggcctt

SEQ ID NO: 1185384 - DNA, 13 bp, Homo sapiens
ctcagccctgggc

SEQ ID NO: 1185385 - DNA, 14 bp, Homo sapiens
ctcagccctgggcc

SEQ ID NO: 1185386 - DNA, 14 bp, Homo sapiens
ctcagcccttgccc

SEQ ID NO: 1185387 - DNA, 15 bp, Homo sapiens
ctcagccgtcagcca

SEQ ID NO: 1185388 - DNA, 15 bp, Homo sapiens
ctcagcctcattcag

SEQ ID NO: 1185389 - DNA, 19 bp, Homo sapiens
ctcagcctcattcagcatg

SEQ ID NO: 1185390 - DNA, 12 bp, Homo sapiens
ctcagcctccca

SEQ ID NO: 1185391 - DNA, 22 bp, Homo sapiens
ctcagcctcccaaagtgctggg

SEQ ID NO: 1185392 - DNA, 14 bp, Homo sapiens
ctcagcctcccaca

SEQ ID NO: 1185393 - DNA, 19 bp, Homo sapiens
ctcagcctccccttcttcc

SEQ ID NO: 1185394 - DNA, 15 bp, Homo sapiens
ctcagcctcctgagc

SEQ ID NO: 1185395 - DNA, 22 bp, Homo sapiens
ctcagcctcctgagtagctgga

SEQ ID NO: 1185396 - DNA, 15 bp, Homo sapiens
ctcagcctcctgggt

SEQ ID NO: 1185397 - DNA, 22 bp, Homo sapiens
ctcagcctctgcaactgcaaga

SEQ ID NO: 1185398 - DNA, 14 bp, Homo sapiens
ctcagcctctgcca

SEQ ID NO: 1185399 - DNA, 16 bp, Homo sapiens
ctcagcctgcccacct

SEQ ID NO: 1185400 - DNA, 18 bp, Homo sapiens
ctcagcctgcccacctct

SEQ ID NO: 1185401 - DNA, 10 bp, Homo sapiens
ctcagcctgg

SEQ ID NO: 1185402 - DNA, 21 bp, Homo sapiens
ctcagcctggagaggcctggg

SEQ ID NO: 1185403 - DNA, 20 bp, Homo sapiens
ctcagcctggtgggcctcct

SEQ ID NO: 1185404 - DNA, 19 bp, Homo sapiens
ctcagccttcagacagaga

SEQ ID NO: 1185405 - DNA, 22 bp, Homo sapiens
ctcagccttccccttgcccagg

SEQ ID NO: 1185406 - DNA, 16 bp, Homo sapiens
ctcagccttgcacacc

SEQ ID NO: 1185407 - DNA, 11 bp, Homo sapiens
ctcagccttgg

SEQ ID NO: 1185408 - DNA, 22 bp, Homo sapiens
ctcagcgcaggctgcagagccc

SEQ ID NO: 1185409 - DNA, 13 bp, Homo sapiens
ctcagcggagggg

SEQ ID NO: 1185410 - DNA, 21 bp, Homo sapiens
ctcagctacccactatccttc

SEQ ID NO: 1185411 - DNA, 12 bp, Homo sapiens
ctcagctagaag

SEQ ID NO: 1185412 - DNA, 23 bp, Homo sapiens
ctcagctccagaataccttcttc

SEQ ID NO: 1185413 - DNA, 19 bp, Homo sapiens
ctcagctccaggtggctct

SEQ ID NO: 1185414 - DNA, 15 bp, Homo sapiens
ctcagctcccaaggc

SEQ ID NO: 1185415 - DNA, 15 bp, Homo sapiens
ctcagctctctggga

SEQ ID NO: 1185416 - DNA, 16 bp, Homo sapiens
ctcagctctgggagag

SEQ ID NO: 1185417 - DNA, 14 bp, Homo sapiens
ctcagctctgggcc

SEQ ID NO: 1185418 - DNA, 23 bp, Homo sapiens
ctcagctctgggccattctccac

SEQ ID NO: 1185419 - DNA, 19 bp, Homo sapiens
ctcagctctggtccaggcc

SEQ ID NO: 1185420 - DNA, 18 bp, Homo sapiens
ctcagctcttccatgatg

SEQ ID NO: 1185421 - DNA, 15 bp, Homo sapiens
ctcagctgcacattc

SEQ ID NO: 1185422 - DNA, 17 bp, Homo sapiens
ctcagctgcacattcct

SEQ ID NO: 1185423 - DNA, 20 bp, Homo sapiens
ctcagctgcacattcctggc

SEQ ID NO: 1185424 - DNA, 19 bp, Homo sapiens
ctcagctgcatggagcctg

SEQ ID NO: 1185425 - DNA, 20 bp, Homo sapiens
ctcagctgcatggagcctgg

SEQ ID NO: 1185426 - DNA, 16 bp, Homo sapiens
ctcagctgccaagcac

SEQ ID NO: 1185427 - DNA, 12 bp, Homo sapiens
ctcagctgctcc

SEQ ID NO: 1185428 - DNA, 13 bp, Homo sapiens
ctcagctgctccc

SEQ ID NO: 1185429 - DNA, 17 bp, Homo sapiens
ctcagctggctgagaca

SEQ ID NO: 1185430 - DNA, 19 bp, Homo sapiens
ctcagctgtcacctgctca

SEQ ID NO: 1185431 - DNA, 16 bp, Homo sapiens
ctcagctgtcctgcag

SEQ ID NO: 1185432 - DNA, 17 bp, Homo sapiens
ctcagctgtcctgcagc

SEQ ID NO: 1185433 - DNA, 18 bp, Homo sapiens
ctcagctgtcctgcagca

SEQ ID NO: 1185434 - DNA, 20 bp, Homo sapiens
ctcagcttatctcttttata

SEQ ID NO: 1185435 - DNA, 19 bp, Homo sapiens
ctcagcttcggggccggtg

SEQ ID NO: 1185436 - DNA, 20 bp, Homo sapiens
ctcagcttcttcacaggcac

SEQ ID NO: 1185437 - DNA, 20 bp, Homo sapiens
ctcagcttgggcttcttcct

SEQ ID NO: 1185438 - DNA, 12 bp, Homo sapiens
ctcagctttgag

SEQ ID NO: 1185439 - DNA, 22 bp, Homo sapiens
ctcagctttgagaagccttcag

SEQ ID NO: 1185440 - DNA, 17 bp, Homo sapiens
ctcaggaaaacgggacc

SEQ ID NO: 1185441 - DNA, 23 bp, Homo sapiens
ctcaggaaacgagactttccatt

SEQ ID NO: 1185442 - DNA, 13 bp, Homo sapiens
ctcaggaactttt

SEQ ID NO: 1185443 - DNA, 14 bp, Homo sapiens
ctcaggaagaagag

SEQ ID NO: 1185444 - DNA, 14 bp, Homo sapiens
ctcaggaagagcta

SEQ ID NO: 1185445 - DNA, 14 bp, Homo sapiens
ctcaggaaggacat

SEQ ID NO: 1185446 - DNA, 14 bp, Homo sapiens
ctcaggaagtccag

SEQ ID NO: 1185447 - DNA, 21 bp, Homo sapiens
ctcaggacagcatcccttccc

SEQ ID NO: 1185448 - DNA, 20 bp, Homo sapiens
ctcaggacctctgtaggcag

SEQ ID NO: 1185449 - DNA, 18 bp, Homo sapiens
cactgcttctcggccagc

SEQ ID NO: 1185450 - DNA, 20 bp, Homo sapiens
cactgcttgaactaggctga

SEQ ID NO: 1185451 - DNA, 15 bp, Homo sapiens
cactgcttgaggaaa

SEQ ID NO: 1185452 - DNA, 18 bp, Homo sapiens
cactgcttgatgaagcaa

SEQ ID NO: 1185453 - DNA, 16 bp, Homo sapiens
cactggaaaggggaga

SEQ ID NO: 1185454 - DNA, 24 bp, Homo sapiens
cactggaaaggggagagcctgctg

SEQ ID NO: 1185455 - DNA, 11 bp, Homo sapiens
cactggaatat

SEQ ID NO: 1185456 - DNA, 16 bp, Homo sapiens
cactggaccactgggc

SEQ ID NO: 1185457 - DNA, 15 bp, Homo sapiens
cactggaccccactg

SEQ ID NO: 1185458 - DNA, 16 bp, Homo sapiens
cactggaccccactgg

SEQ ID NO: 1185459 - DNA, 17 bp, Homo sapiens
cactggaccccactggc

SEQ ID NO: 1185460 - DNA, 22 bp, Homo sapiens
cactggaccccactggctgaga

SEQ ID NO: 1185461 - DNA, 16 bp, Homo sapiens
cactggacctgggggt

SEQ ID NO: 1185462 - DNA, 15 bp, Homo sapiens
cactggactccggcc

SEQ ID NO: 1185463 - DNA, 16 bp, Homo sapiens
cactggactccggccc

SEQ ID NO: 1185464 - DNA, 16 bp, Homo sapiens
cactggactgcatggg

SEQ ID NO: 1185465 - DNA, 23 bp, Homo sapiens
cactggagaagaatatcaaataa

SEQ ID NO: 1185466 - DNA, 16 bp, Homo sapiens
ctcaggcaagcccctc

SEQ ID NO: 1185467 - DNA, 22 bp, Homo sapiens
ctcaggcaagcccctcagccct

SEQ ID NO: 1185468 - DNA, 15 bp, Homo sapiens
ctcaggcacacagct

SEQ ID NO: 1185469 - DNA, 13 bp, Homo sapiens
ctcaggcactctc

SEQ ID NO: 1185470 - DNA, 17 bp, Homo sapiens
ctcaggcagcaccacac

SEQ ID NO: 1185471 - DNA, 21 bp, Homo sapiens
ctcaggcagcaccacactggg

SEQ ID NO: 1185472 - DNA, 13 bp, Homo sapiens
ctcaggcagctcg

SEQ ID NO: 1185473 - DNA, 18 bp, Homo sapiens
ctcaggcaggtgggatgg

SEQ ID NO: 1185474 - DNA, 17 bp, Homo sapiens
ctcaggcatgcctgtgt

SEQ ID NO: 1185475 - DNA, 19 bp, Homo sapiens
ctcaggccaacaagccaac

SEQ ID NO: 1185476 - DNA, 20 bp, Homo sapiens
ctcaggccaagaaacgtctt

SEQ ID NO: 1185477 - DNA, 18 bp, Homo sapiens
ctcaggccaccctccacg

SEQ ID NO: 1185478 - DNA, 14 bp, Homo sapiens
ctcaggccagggct

SEQ ID NO: 1185479 - DNA, 15 bp, Homo sapiens
ctcaggccagggctc

SEQ ID NO: 1185480 - DNA, 16 bp, Homo sapiens
ctcaggccagggctca

SEQ ID NO: 1185481 - DNA, 15 bp, Homo sapiens
ctcaggccaggtgca

SEQ ID NO: 1185482 - DNA, 18 bp, Homo sapiens
ctcaggccaggtgcagtg

SEQ ID NO: 1185483 - DNA, 18 bp, Homo sapiens
ctcaggccattccccaac

SEQ ID NO: 1185484 - DNA, 19 bp, Homo sapiens
ctcaggcctaggaggcccc

SEQ ID NO: 1185485 - DNA, 18 bp, Homo sapiens
ctcaggcctccctagcac

SEQ ID NO: 1185486 - DNA, 21 bp, Homo sapiens
ctcaggcgatccacctgtctc

SEQ ID NO: 1185487 - DNA, 14 bp, Homo sapiens
ctcaggctccccag

SEQ ID NO: 1185488 - DNA, 12 bp, Homo sapiens
ctcaggctcttg

SEQ ID NO: 1185489 - DNA, 13 bp, Homo sapiens
ctcaggctgcagc

SEQ ID NO: 1185490 - DNA, 17 bp, Homo sapiens
ctcaggctgcagctgga

SEQ ID NO: 1185491 - DNA, 19 bp, Homo sapiens
ctcaggctggagtgcagtg

SEQ ID NO: 1185492 - DNA, 20 bp, Homo sapiens
ctcaggctggagtgcagtga

SEQ ID NO: 1185493 - DNA, 16 bp, Homo sapiens
ctcagggacagagcca

SEQ ID NO: 1185494 - DNA, 20 bp, Homo sapiens
ctcagggaccggtgctgcag

SEQ ID NO: 1185495 - DNA, 23 bp, Homo sapiens
ctcagggaccggtgctgcaggag

SEQ ID NO: 1185496 - DNA, 19 bp, Homo sapiens
ctcagggactgcaccctga

SEQ ID NO: 1185497 - DNA, 21 bp, Homo sapiens
ctcagggagcagggaaggcct

SEQ ID NO: 1185498 - DNA, 17 bp, Homo sapiens
ctcagggagggaagggg

SEQ ID NO: 1185499 - DNA, 22 bp, Homo sapiens
ctcagggagggaaggggatgga

SEQ ID NO: 1185500 - DNA, 14 bp, Homo sapiens
ctcagggcacgcag

SEQ ID NO: 1185501 - DNA, 16 bp, Homo sapiens
ctcagggcacgcagga

SEQ ID NO: 1185502 - DNA, 16 bp, Homo sapiens
ctcagggcagctgcct

SEQ ID NO: 1185503 - DNA, 20 bp, Homo sapiens
ctcagggccatgcctgcccc

SEQ ID NO: 1185504 - DNA, 17 bp, Homo sapiens
ctcagggccatgctgag

SEQ ID NO: 1185505 - DNA, 19 bp, Homo sapiens
ctcagggccatgctgaggc

SEQ ID NO: 1185506 - DNA, 12 bp, Homo sapiens
ctcagggcccca

SEQ ID NO: 1185507 - DNA, 15 bp, Homo sapiens
ctcagggcctggtcg

SEQ ID NO: 1185508 - DNA, 15 bp, Homo sapiens
ctcagggctcctccc

SEQ ID NO: 1185509 - DNA, 14 bp, Homo sapiens
ctcagggctcctgg

SEQ ID NO: 1185510 - DNA, 17 bp, Homo sapiens
ctcagggctcctgggtt

SEQ ID NO: 1185511 - DNA, 11 bp, Homo sapiens
ctcagggctgg

SEQ ID NO: 1185512 - DNA, 14 bp, Homo sapiens
ctcagggctggagc

SEQ ID NO: 1185513 - DNA, 16 bp, Homo sapiens
ctcagggctgtcccag

SEQ ID NO: 1185514 - DNA, 17 bp, Homo sapiens
ctcagggctgtcccagc

SEQ ID NO: 1185515 - DNA, 19 bp, Homo sapiens
ctcagggctgtcccagccc

SEQ ID NO: 1185516 - DNA, 20 bp, Homo sapiens
ctcagggctgtcccagcccc

SEQ ID NO: 1185517 - DNA, 21 bp, Homo sapiens
ctcaggggacactggccccac

SEQ ID NO: 1185518 - DNA, 20 bp, Homo sapiens
ctcaggggcaggtggtggag

SEQ ID NO: 1185519 - DNA, 23 bp, Homo sapiens
ctcaggggcaggtggtggagggg

SEQ ID NO: 1185520 - DNA, 17 bp, Homo sapiens
ctcaggggccagaggaa

SEQ ID NO: 1185521 - DNA, 23 bp, Homo sapiens
ctcaggggccagtgagggctggg

SEQ ID NO: 1185522 - DNA, 16 bp, Homo sapiens
ctcaggggcctctctc

SEQ ID NO: 1185523 - DNA, 21 bp, Homo sapiens
ctcaggggcctctctcctgcc

SEQ ID NO: 1185524 - DNA, 16 bp, Homo sapiens
ctcaggggctctaggg

SEQ ID NO: 1185525 - DNA, 19 bp, Homo sapiens
ctcaggggctgtttgagga

SEQ ID NO: 1185526 - DNA, 15 bp, Homo sapiens
ctcagggggccagct

SEQ ID NO: 1185527 - DNA, 17 bp, Homo sapiens
ctcagggggccagctgg

SEQ ID NO: 1185528 - DNA, 20 bp, Homo sapiens
ctcagggggccagctgggga

SEQ ID NO: 1185529 - DNA, 22 bp, Homo sapiens
ctcagggggccagctggggaga

SEQ ID NO: 1185530 - DNA, 19 bp, Homo sapiens
ctcagggggtaggagagca

SEQ ID NO: 1185531 - DNA, 24 bp, Homo sapiens
ctcagggggtaggagagcactgcc

SEQ ID NO: 1185532 - DNA, 14 bp, Homo sapiens
ctcaggggtggaga

SEQ ID NO: 1185533 - DNA, 17 bp, Homo sapiens
ctcaggggtggagaagt

SEQ ID NO: 1185534 - DNA, 21 bp, Homo sapiens
ctcagggtcactgaaccactg

SEQ ID NO: 1185535 - DNA, 18 bp, Homo sapiens
ctcagggtcactgtcctt

SEQ ID NO: 1185536 - DNA, 19 bp, Homo sapiens
ctcagggtcactgtccttg

SEQ ID NO: 1185537 - DNA, 17 bp, Homo sapiens
ctcagggtgtcctgagg

SEQ ID NO: 1185538 - DNA, 22 bp, Homo sapiens
ctcaggtacagcgggctgtgcc

SEQ ID NO: 1185539 - DNA, 23 bp, Homo sapiens
ctcaggtacagcgggctgtgccc

SEQ ID NO: 1185540 - DNA, 17 bp, Homo sapiens
ctcaggtagtactggga

SEQ ID NO: 1185541 - DNA, 16 bp, Homo sapiens
ctcaggtcagctggga

SEQ ID NO: 1185542 - DNA, 17 bp, Homo sapiens
ctcaggtcagctgggag

SEQ ID NO: 1185543 - DNA, 23 bp, Homo sapiens
ctcaggtcagctgggagccagtg

SEQ ID NO: 1185544 - DNA, 18 bp, Homo sapiens
ctcaggtccctgcagggc

SEQ ID NO: 1185545 - DNA, 22 bp, Homo sapiens
ctcaggtctgtaactgcccagc

SEQ ID NO: 1185546 - DNA, 23 bp, Homo sapiens
ctcaggtctgtaactgcccagcc

SEQ ID NO: 1185547 - DNA, 14 bp, Homo sapiens
ctcaggtgagaagc

SEQ ID NO: 1185548 - DNA, 19 bp, Homo sapiens
ctcaggtgagaagcagagg

SEQ ID NO: 1185549 - DNA, 19 bp, Homo sapiens
ctcaggtgatcaaaataaa

SEQ ID NO: 1185550 - DNA, 16 bp, Homo sapiens
ctcaggtgatccgccc

SEQ ID NO: 1185551 - DNA, 17 bp, Homo sapiens
ctcaggtgccactccct

SEQ ID NO: 1185552 - DNA, 21 bp, Homo sapiens
ctcaggtgccactccctgagc

SEQ ID NO: 1185553 - DNA, 13 bp, Homo sapiens
ctcaggtgcctcc

SEQ ID NO: 1185554 - DNA, 12 bp, Homo sapiens
ctcaggtgcctt

SEQ ID NO: 1185555 - DNA, 13 bp, Homo sapiens
ctcaggtgcctta

SEQ ID NO: 1185556 - DNA, 21 bp, Homo sapiens
ctcaggtggccactcatgcct

SEQ ID NO: 1185557 - DNA, 22 bp, Homo sapiens
ctcaggtggccagcctggatct

SEQ ID NO: 1185558 - DNA, 13 bp, Homo sapiens
ctcaggtggccat

SEQ ID NO: 1185559 - DNA, 15 bp, Homo sapiens
ctcaggtgttgccaa

SEQ ID NO: 1185560 - DNA, 22 bp, Homo sapiens
ctcaggtgttttttatgaagtg

SEQ ID NO: 1185561 - DNA, 12 bp, Homo sapiens
ctcaggttccag

SEQ ID NO: 1185562 - DNA, 13 bp, Homo sapiens
ctcaggttccttt

SEQ ID NO: 1185563 - DNA, 19 bp, Homo sapiens
ctcaggttggcggcagaca

SEQ ID NO: 1185564 - DNA, 14 bp, Homo sapiens
ctcaggttgtctga

SEQ ID NO: 1185565 - DNA, 12 bp, Homo sapiens
ctcagtaaacgg

SEQ ID NO: 1185566 - DNA, 20 bp, Homo sapiens
ctcagtaaacgggaacatgc

SEQ ID NO: 1185567 - DNA, 20 bp, Homo sapiens
ctcagtaaatgtacaactgc

SEQ ID NO: 1185568 - DNA, 20 bp, Homo sapiens
ctcagtaacatttctgttct

SEQ ID NO: 1185569 - DNA, 13 bp, Homo sapiens
ctcagtaatttag

SEQ ID NO: 1185570 - DNA, 19 bp, Homo sapiens
ctcagtaatttagaaatca

SEQ ID NO: 1185571 - DNA, 20 bp, Homo sapiens
cactgtccccctacccaccg

SEQ ID NO: 1185572 - DNA, 14 bp, Homo sapiens
cactgtccctgtcc

SEQ ID NO: 1185573 - DNA, 15 bp, Homo sapiens
cactgtccctgtcct

SEQ ID NO: 1185574 - DNA, 22 bp, Homo sapiens
cactgtccctgtccttctacag

SEQ ID NO: 1185575 - DNA, 12 bp, Homo sapiens
cactgtcccttg

SEQ ID NO: 1185576 - DNA, 17 bp, Homo sapiens
cactgtcccttgcctca

SEQ ID NO: 1185577 - DNA, 14 bp, Homo sapiens
cactgtcctccaag

SEQ ID NO: 1185578 - DNA, 16 bp, Homo sapiens
cactgtcctccttggc

SEQ ID NO: 1185579 - DNA, 14 bp, Homo sapiens
cactgtcctgggcg

SEQ ID NO: 1185580 - DNA, 15 bp, Homo sapiens
cactgtcctgggcgc

SEQ ID NO: 1185581 - DNA, 21 bp, Homo sapiens
cactgtctatttaagtgcaat

SEQ ID NO: 1185582 - DNA, 19 bp, Homo sapiens
cactgtctttaattctgta

SEQ ID NO: 1185583 - DNA, 16 bp, Homo sapiens
cactgtgaacattttt

SEQ ID NO: 1185584 - DNA, 14 bp, Homo sapiens
cactgtgaccaggc

SEQ ID NO: 1185585 - DNA, 20 bp, Homo sapiens
cactgtgacccccagctccg

SEQ ID NO: 1185586 - DNA, 21 bp, Homo sapiens
cactgtgatcaatatttttat

SEQ ID NO: 1185587 - DNA, 16 bp, Homo sapiens
cactgtgatttatctt

SEQ ID NO: 1185588 - DNA, 22 bp, Homo sapiens
cactgtgattttgccctcctgc

SEQ ID NO: 1185589 - DNA, 12 bp, Homo sapiens
cactgtgcagac

SEQ ID NO: 1185590 - DNA, 16 bp, Homo sapiens
cactgtgcagacccag

SEQ ID NO: 1185591 - DNA, 13 bp, Homo sapiens
cactgtgccctgg

SEQ ID NO: 1185592 - DNA, 14 bp, Homo sapiens
cactgtgccctggt

SEQ ID NO: 1185593 - DNA, 19 bp, Homo sapiens
ctcagtgaaggtggtgggg

SEQ ID NO: 1185594 - DNA, 13 bp, Homo sapiens
ctcagtgagcctc

SEQ ID NO: 1185595 - DNA, 15 bp, Homo sapiens
ctcagtgagcctcct

SEQ ID NO: 1185596 - DNA, 22 bp, Homo sapiens
ctcagtgagcctcctgtgcctg

SEQ ID NO: 1185597 - DNA, 23 bp, Homo sapiens
ctcagtgagcctcctgtgcctgg

SEQ ID NO: 1185598 - DNA, 22 bp, Homo sapiens
ctcagtgatacgtacagccaaa

SEQ ID NO: 1185599 - DNA, 14 bp, Homo sapiens
ctcagtgatttcct

SEQ ID NO: 1185600 - DNA, 14 bp, Homo sapiens
ctcagtgcatttgt

SEQ ID NO: 1185601 - DNA, 18 bp, Homo sapiens
ctcagtgccacctatgcc

SEQ ID NO: 1185602 - DNA, 12 bp, Homo sapiens
ctcagtgccact

SEQ ID NO: 1185603 - DNA, 13 bp, Homo sapiens
ctcagtgccactt

SEQ ID NO: 1185604 - DNA, 21 bp, Homo sapiens
ctcagtgccacttgacattcc

SEQ ID NO: 1185605 - DNA, 23 bp, Homo sapiens
ctcagtgccacttgacattcctt

SEQ ID NO: 1185606 - DNA, 15 bp, Homo sapiens
ctcagtgcctccaca

SEQ ID NO: 1185607 - DNA, 13 bp, Homo sapiens
ctcagtgcctcct

SEQ ID NO: 1185608 - DNA, 15 bp, Homo sapiens
ctcagtgccttcctc

SEQ ID NO: 1185609 - DNA, 19 bp, Homo sapiens
ctcagtgccttttggtttc

SEQ ID NO: 1185610 - DNA, 22 bp, Homo sapiens
ctcagtggactttccaccccct

SEQ ID NO: 1185611 - DNA, 23 bp, Homo sapiens
ctcagtggatcttcagaactgcc

SEQ ID NO: 1185612 - DNA, 22 bp, Homo sapiens
ctcagtggcccatggcatttta

SEQ ID NO: 1185613 - DNA, 17 bp, Homo sapiens
ctcagtgtcagcgggtg

SEQ ID NO: 1185614 - DNA, 20 bp, Homo sapiens
ctcagtgtcagcgggtgacg

SEQ ID NO: 1185615 - DNA, 22 bp, Homo sapiens
ctcagtgtcatttatgaaaaga

SEQ ID NO: 1185616 - DNA, 20 bp, Homo sapiens
ctcagtgttagagaaatcct

SEQ ID NO: 1185617 - DNA, 12 bp, Homo sapiens
ctcagtgttttg

SEQ ID NO: 1185618 - DNA, 20 bp, Homo sapiens
ctcagttaaaatgtctgttt

SEQ ID NO: 1185619 - DNA, 18 bp, Homo sapiens
ctcagttcaacctggtgg

SEQ ID NO: 1185620 - DNA, 12 bp, Homo sapiens
ctcagttccagg

SEQ ID NO: 1185621 - DNA, 16 bp, Homo sapiens
ctcagttccaggcctg

SEQ ID NO: 1185622 - DNA, 22 bp, Homo sapiens
ctcagttccatggcaattttgt

SEQ ID NO: 1185623 - DNA, 17 bp, Homo sapiens
ctcagttcccagctccc

SEQ ID NO: 1185624 - DNA, 15 bp, Homo sapiens
ctcagttcccttggc

SEQ ID NO: 1185625 - DNA, 13 bp, Homo sapiens
ctcagttccttca

SEQ ID NO: 1185626 - DNA, 20 bp, Homo sapiens
ctcagttctagtctctctgg

SEQ ID NO: 1185627 - DNA, 15 bp, Homo sapiens
ctcagttgtttgctt

SEQ ID NO: 1185628 - DNA, 19 bp, Homo sapiens
ctcagttgtttgcttcttg

SEQ ID NO: 1185629 - DNA, 18 bp, Homo sapiens
ctcagtttaatccttcta

SEQ ID NO: 1185630 - DNA, 16 bp, Homo sapiens
ctcagtttctccatca

SEQ ID NO: 1185631 - DNA, 15 bp, Homo sapiens
ctcagtttcttgctt

SEQ ID NO: 1185632 - DNA, 20 bp, Homo sapiens
ctcagtttggtagtgcccca

SEQ ID NO: 1185633 - DNA, 18 bp, Homo sapiens
ctcagttttatcattttc

SEQ ID NO: 1185634 - DNA, 13 bp, Homo sapiens
ctcagttttcata

SEQ ID NO: 1185635 - DNA, 14 bp, Homo sapiens
ctcagttttcataa

SEQ ID NO: 1185636 - DNA, 15 bp, Homo sapiens
ctcagttttccttct

SEQ ID NO: 1185637 - DNA, 16 bp, Homo sapiens
ctcagttttccttctg

SEQ ID NO: 1185638 - DNA, 17 bp, Homo sapiens
ctcataaaaagcaaaac

SEQ ID NO: 1185639 - DNA, 15 bp, Homo sapiens
ctcataaaactgtga

SEQ ID NO: 1185640 - DNA, 19 bp, Homo sapiens
ctcataaagatgttaaatg

SEQ ID NO: 1185641 - DNA, 15 bp, Homo sapiens
ctcataaatcttttt

SEQ ID NO: 1185642 - DNA, 17 bp, Homo sapiens
ctcataacttgagacct

SEQ ID NO: 1185643 - DNA, 22 bp, Homo sapiens
ctcataatggaaaaaaagactg

SEQ ID NO: 1185644 - DNA, 12 bp, Homo sapiens
ctcataattcct

SEQ ID NO: 1185645 - DNA, 16 bp, Homo sapiens
ctcatactcctgggct

SEQ ID NO: 1185646 - DNA, 16 bp, Homo sapiens
ctcatagattgcaaat

SEQ ID NO: 1185647 - DNA, 21 bp, Homo sapiens
ctcatagcatagccagcattc

SEQ ID NO: 1185648 - DNA, 23 bp, Homo sapiens
ctcatagcatgatattgttctcc

SEQ ID NO: 1185649 - DNA, 18 bp, Homo sapiens
ctcatagcattaactaat

SEQ ID NO: 1185650 - DNA, 17 bp, Homo sapiens
ctcatagggatgctgtg

SEQ ID NO: 1185651 - DNA, 18 bp, Homo sapiens
ctcatagggatgctgtga

SEQ ID NO: 1185652 - DNA, 13 bp, Homo sapiens
ctcatagggtgct

SEQ ID NO: 1185653 - DNA, 14 bp, Homo sapiens
ctcatagggtgctc

SEQ ID NO: 1185654 - DNA, 16 bp, Homo sapiens
ctcataggttgagcaa

SEQ ID NO: 1185655 - DNA, 15 bp, Homo sapiens
ctcatatagcacttt

SEQ ID NO: 1185656 - DNA, 13 bp, Homo sapiens
ctcatatggccca

SEQ ID NO: 1185657 - DNA, 18 bp, Homo sapiens
ctcatatggcccagtgtc

SEQ ID NO: 1185658 - DNA, 13 bp, Homo sapiens
ctcatattgtgat

SEQ ID NO: 1185659 - DNA, 13 bp, Homo sapiens
ctcatcaactgaa

SEQ ID NO: 1185660 - DNA, 21 bp, Homo sapiens
ctcatcaatcaaataagtatt

SEQ ID NO: 1185661 - DNA, 16 bp, Homo sapiens
ctcatcaccccagagg

SEQ ID NO: 1185662 - DNA, 19 bp, Homo sapiens
ctcatcaccccagaggcct

SEQ ID NO: 1185663 - DNA, 13 bp, Homo sapiens
ctcatcaggatga

SEQ ID NO: 1185664 - DNA, 22 bp, Homo sapiens
ctcatcaggatgaacccaggac

SEQ ID NO: 1185665 - DNA, 24 bp, Homo sapiens
ctcatcagtgtcctcttgctcaaa

SEQ ID NO: 1185666 - DNA, 14 bp, Homo sapiens
ctcatcatattgta

SEQ ID NO: 1185667 - DNA, 20 bp, Homo sapiens
ctcatcatccacccgctgcc

SEQ ID NO: 1185668 - DNA, 17 bp, Homo sapiens
ctcatcatgtctattgt

SEQ ID NO: 1185669 - DNA, 17 bp, Homo sapiens
ctcatcattctctgtct

SEQ ID NO: 1185670 - DNA, 23 bp, Homo sapiens
ctcatcattctctgtctcatcca

SEQ ID NO: 1185671 - DNA, 16 bp, Homo sapiens
ctcatccaccccatcc

SEQ ID NO: 1185672 - DNA, 24 bp, Homo sapiens
ctcatccaccccatccctccccag

SEQ ID NO: 1185673 - DNA, 19 bp, Homo sapiens
ctcatccatcatcatgtgt

SEQ ID NO: 1185674 - DNA, 18 bp, Homo sapiens
ctcatccatttcttttat

SEQ ID NO: 1185675 - DNA, 19 bp, Homo sapiens
ctcatccatttcttttata

SEQ ID NO: 1185676 - DNA, 14 bp, Homo sapiens
ctcatcccacgcac

SEQ ID NO: 1185677 - DNA, 19 bp, Homo sapiens
ctcatcccacgcactccat

SEQ ID NO: 1185678 - DNA, 18 bp, Homo sapiens
ctcatcccacttcctttc

SEQ ID NO: 1185679 - DNA, 16 bp, Homo sapiens
ctcatccccccacccg

SEQ ID NO: 1185680 - DNA, 20 bp, Homo sapiens
ctcatcccctcgtcctgtcc

SEQ ID NO: 1185681 - DNA, 19 bp, Homo sapiens
ctcatcccgtgttctcctt

SEQ ID NO: 1185682 - DNA, 21 bp, Homo sapiens
ctcatccgaagatggtggcca

SEQ ID NO: 1185683 - DNA, 15 bp, Homo sapiens
ctcatccgaggcagg

SEQ ID NO: 1185684 - DNA, 16 bp, Homo sapiens
ctcatcctccccagga

SEQ ID NO: 1185685 - DNA, 16 bp, Homo sapiens
ctcatcctgctctttt

SEQ ID NO: 1185686 - DNA, 18 bp, Homo sapiens
ctcatcctgctcttttgt

SEQ ID NO: 1185687 - DNA, 13 bp, Homo sapiens
ctcatcctttccc

SEQ ID NO: 1185688 - DNA, 16 bp, Homo sapiens
ctcatcctttccctct

SEQ ID NO: 1185689 - DNA, 14 bp, Homo sapiens
ctcatctatgtcat

SEQ ID NO: 1185690 - DNA, 15 bp, Homo sapiens
ctcatctatgtcata

SEQ ID NO: 1185691 - DNA, 11 bp, Homo sapiens
ctcatctcagt

SEQ ID NO: 1185692 - DNA, 23 bp, Homo sapiens
ctcatctccaaggatcctctcca

SEQ ID NO: 1185693 - DNA, 19 bp, Homo sapiens
atcacagggttgggcccag

SEQ ID NO: 1185694 - DNA, 14 bp, Homo sapiens
atcacagtctcagt

SEQ ID NO: 1185695 - DNA, 20 bp, Homo sapiens
atcacagtgttatgtagtat

SEQ ID NO: 1185696 - DNA, 15 bp, Homo sapiens
atcacattatttgca

SEQ ID NO: 1185697 - DNA, 23 bp, Homo sapiens
atcacattcccatggtggcctca

SEQ ID NO: 1185698 - DNA, 15 bp, Homo sapiens
atcacattttaagtg

SEQ ID NO: 1185699 - DNA, 19 bp, Homo sapiens
atcaccacagtaagttcct

SEQ ID NO: 1185700 - DNA, 15 bp, Homo sapiens
atcaccaccgcctct

SEQ ID NO: 1185701 - DNA, 15 bp, Homo sapiens
atcaccagcccggcc

SEQ ID NO: 1185702 - DNA, 18 bp, Homo sapiens
atcaccatgttagcctta

SEQ ID NO: 1185703 - DNA, 19 bp, Homo sapiens
atcaccatgttagccttag

SEQ ID NO: 1185704 - DNA, 14 bp, Homo sapiens
atcaccattatatt

SEQ ID NO: 1185705 - DNA, 20 bp, Homo sapiens
atcaccccaaccccccaaaa

SEQ ID NO: 1185706 - DNA, 21 bp, Homo sapiens
atcaccccagaggccttgtca

SEQ ID NO: 1185707 - DNA, 19 bp, Homo sapiens
atcacccgcccctggactt

SEQ ID NO: 1185708 - DNA, 13 bp, Homo sapiens
atcaccctcaccc

SEQ ID NO: 1185709 - DNA, 16 bp, Homo sapiens
atcaccctcttcctgt

SEQ ID NO: 1185710 - DNA, 21 bp, Homo sapiens
atcaccctgggagtttcctga

SEQ ID NO: 1185711 - DNA, 20 bp, Homo sapiens
atcaccgtgggctccctgac

SEQ ID NO: 1185712 - DNA, 15 bp, Homo sapiens
atcacctcaggccag

SEQ ID NO: 1185713 - DNA, 16 bp, Homo sapiens
atcacctcattctgaa

SEQ ID NO: 1185714 - DNA, 15 bp, Homo sapiens
atcacctcccctcct

SEQ ID NO: 1185715 - DNA, 16 bp, Homo sapiens
atcacctctactgtct

SEQ ID NO: 1185716 - DNA, 13 bp, Homo sapiens
atcacctctctgt

SEQ ID NO: 1185717 - DNA, 22 bp, Homo sapiens
atcacctctctgtagtttatgg

SEQ ID NO: 1185718 - DNA, 18 bp, Homo sapiens
atcacctgaaacactgga

SEQ ID NO: 1185719 - DNA, 21 bp, Homo sapiens
atcacctgaaacactggacct

SEQ ID NO: 1185720 - DNA, 23 bp, Homo sapiens
atcacctgaaacactggacctgg

SEQ ID NO: 1185721 - DNA, 12 bp, Homo sapiens
atcacctgccct

SEQ ID NO: 1185722 - DNA, 13 bp, Homo sapiens
atcacctgccctg

SEQ ID NO: 1185723 - DNA, 18 bp, Homo sapiens
atcacgagatcttccttc

SEQ ID NO: 1185724 - DNA, 16 bp, Homo sapiens
atcacgatttcatcct

SEQ ID NO: 1185725 - DNA, 14 bp, Homo sapiens
atcacgccactgca

SEQ ID NO: 1185726 - DNA, 17 bp, Homo sapiens
atcacgccactgcactc

SEQ ID NO: 1185727 - DNA, 13 bp, Homo sapiens
atcacgctttcct

SEQ ID NO: 1185728 - DNA, 18 bp, Homo sapiens
atcacgctttttgaaaaa

SEQ ID NO: 1185729 - DNA, 16 bp, Homo sapiens
atcacggtggtaaaga

SEQ ID NO: 1185730 - DNA, 15 bp, Homo sapiens
atcactaaactttat

SEQ ID NO: 1185731 - DNA, 17 bp, Homo sapiens
atcactagaagaaaagc

SEQ ID NO: 1185732 - DNA, 18 bp, Homo sapiens
atcactagagtgctctga

SEQ ID NO: 1185733 - DNA, 17 bp, Homo sapiens
atcactagccctccttt

SEQ ID NO: 1185734 - DNA, 22 bp, Homo sapiens
atcactagccctcctttttcca

SEQ ID NO: 1185735 - DNA, 15 bp, Homo sapiens
atcactatgcatttt

SEQ ID NO: 1185736 - DNA, 14 bp, Homo sapiens
atcactattcttaa

SEQ ID NO: 1185737 - DNA, 20 bp, Homo sapiens
atcactcactcactccccac

SEQ ID NO: 1185738 - DNA, 22 bp, Homo sapiens
atcactcactcactccccactc

SEQ ID NO: 1185739 - DNA, 13 bp, Homo sapiens
atcactcattaat

SEQ ID NO: 1185740 - DNA, 14 bp, Homo sapiens
atcactccctggat

SEQ ID NO: 1185741 - DNA, 11 bp, Homo sapiens
atcactcctgg

SEQ ID NO: 1185742 - DNA, 23 bp, Homo sapiens
atcactcttgtactgcctgccac

SEQ ID NO: 1185743 - DNA, 22 bp, Homo sapiens
atcactgaattaagccatcagg

SEQ ID NO: 1185744 - DNA, 13 bp, Homo sapiens
atcactgactctg

SEQ ID NO: 1185745 - DNA, 17 bp, Homo sapiens
atcactgagagtcagga

SEQ ID NO: 1185746 - DNA, 23 bp, Homo sapiens
atcactgagccatcatttcctgg

SEQ ID NO: 1185747 - DNA, 18 bp, Homo sapiens
atcactgccacactctcc

SEQ ID NO: 1185748 - DNA, 19 bp, Homo sapiens
atcactgccacactctcca

SEQ ID NO: 1185749 - DNA, 18 bp, Homo sapiens
atcactgccttggcccct

SEQ ID NO: 1185750 - DNA, 22 bp, Homo sapiens
atcactgccttggcccctccct

SEQ ID NO: 1185751 - DNA, 19 bp, Homo sapiens
atcactgcttgatgaagca

SEQ ID NO: 1185752 - DNA, 15 bp, Homo sapiens
atcactggagcccag

SEQ ID NO: 1185753 - DNA, 16 bp, Homo sapiens
atcactggcaatgaaa

SEQ ID NO: 1185754 - DNA, 22 bp, Homo sapiens
atcactggcaatgaaaaattct

SEQ ID NO: 1185755 - DNA, 23 bp, Homo sapiens
atcactggcaatgaaaaattctc

SEQ ID NO: 1185756 - DNA, 19 bp, Homo sapiens
atcactggctggcctgagc

SEQ ID NO: 1185757 - DNA, 20 bp, Homo sapiens
atcactggctggcctgagca

SEQ ID NO: 1185758 - DNA, 20 bp, Homo sapiens
atcactggggatggtggcac

SEQ ID NO: 1185759 - DNA, 15 bp, Homo sapiens
atcactgtaaagaca

SEQ ID NO: 1185760 - DNA, 16 bp, Homo sapiens
atcactgtcaatattt

SEQ ID NO: 1185761 - DNA, 22 bp, Homo sapiens
atcactgtgaaatttcatgatt

SEQ ID NO: 1185762 - DNA, 21 bp, Homo sapiens
atcactgttgagttctgattg

SEQ ID NO: 1185763 - DNA, 20 bp, Homo sapiens
atcactgtttagaacacaca

SEQ ID NO: 1185764 - DNA, 23 bp, Homo sapiens
atcactgtttgtttttaaaaagc

SEQ ID NO: 1185765 - DNA, 14 bp, Homo sapiens
atcacttaaacttg

SEQ ID NO: 1185766 - DNA, 14 bp, Homo sapiens
atcacttcagatct

SEQ ID NO: 1185767 - DNA, 16 bp, Homo sapiens
atcacttcatgttttg

SEQ ID NO: 1185768 - DNA, 17 bp, Homo sapiens
atcacttcatgttttgt

SEQ ID NO: 1185769 - DNA, 15 bp, Homo sapiens
atcacttcttccact

SEQ ID NO: 1185770 - DNA, 16 bp, Homo sapiens
atcacttcttccactg

SEQ ID NO: 1185771 - DNA, 19 bp, Homo sapiens
atcacttcttccactgtgt

SEQ ID NO: 1185772 - DNA, 16 bp, Homo sapiens
atcacttgtacaaaat

SEQ ID NO: 1185773 - DNA, 23 bp, Homo sapiens
atcactttaactcaggaggcaga

SEQ ID NO: 1185774 - DNA, 16 bp, Homo sapiens
atcactttgtctaact

SEQ ID NO: 1185775 - DNA, 13 bp, Homo sapiens
atcacttttcagt

SEQ ID NO: 1185776 - DNA, 13 bp, Homo sapiens
atcagaaaaggga

SEQ ID NO: 1185777 - DNA, 15 bp, Homo sapiens
atcagaaaagggaag

SEQ ID NO: 1185778 - DNA, 18 bp, Homo sapiens
atcagaaaagtaattttg

SEQ ID NO: 1185779 - DNA, 15 bp, Homo sapiens
atcagaagaaaagga

SEQ ID NO: 1185780 - DNA, 16 bp, Homo sapiens
atcagaagactttaat

SEQ ID NO: 1185781 - DNA, 13 bp, Homo sapiens
atcagaagataac

SEQ ID NO: 1185782 - DNA, 12 bp, Homo sapiens
atcagaaggaga

SEQ ID NO: 1185783 - DNA, 22 bp, Homo sapiens
atcagaagtatatctgtacaga

SEQ ID NO: 1185784 - DNA, 19 bp, Homo sapiens
atcagaatacttgcactct

SEQ ID NO: 1185785 - DNA, 19 bp, Homo sapiens
atcagaatagccacatttg

SEQ ID NO: 1185786 - DNA, 23 bp, Homo sapiens
atcagaatgaaccctcctccttt

SEQ ID NO: 1185787 - DNA, 16 bp, Homo sapiens
atcagaatgttaattt

SEQ ID NO: 1185788 - DNA, 11 bp, Homo sapiens
atcagaattct

SEQ ID NO: 1185789 - DNA, 20 bp, Homo sapiens
atcagaccataatgttacat

SEQ ID NO: 1185790 - DNA, 14 bp, Homo sapiens
atcagaccctaccc

SEQ ID NO: 1185791 - DNA, 18 bp, Homo sapiens
atcagaccctaccccacc

SEQ ID NO: 1185792 - DNA, 20 bp, Homo sapiens
atcagaccctaccccaccac

SEQ ID NO: 1185793 - DNA, 15 bp, Homo sapiens
atcagactctagaaa

SEQ ID NO: 1185794 - DNA, 13 bp, Homo sapiens
atcagactgacag

SEQ ID NO: 1185795 - DNA, 16 bp, Homo sapiens
atcagagaacagtcat

SEQ ID NO: 1185796 - DNA, 16 bp, Homo sapiens
atcagagagcaaggca

SEQ ID NO: 1185797 - DNA, 15 bp, Homo sapiens
atcagagcaggacct

SEQ ID NO: 1185798 - DNA, 23 bp, Homo sapiens
atcagagcctttcctcaaaactg

SEQ ID NO: 1185799 - DNA, 14 bp, Homo sapiens
atcagagttaccat

SEQ ID NO: 1185800 - DNA, 17 bp, Homo sapiens
atcagagttgctgcaaa

SEQ ID NO: 1185801 - DNA, 14 bp, Homo sapiens
atcagatacatcac

SEQ ID NO: 1185802 - DNA, 20 bp, Homo sapiens
atcagatatgcttactaaat

SEQ ID NO: 1185803 - DNA, 23 bp, Homo sapiens
atcagatcaagagttttggagat

SEQ ID NO: 1185804 - DNA, 22 bp, Homo sapiens
atcagatcatttcaaaactcat

SEQ ID NO: 1185805 - DNA, 22 bp, Homo sapiens
atcagatgaactcttagaaatg

SEQ ID NO: 1185806 - DNA, 22 bp, Homo sapiens
atcagatgatggccatttctaa

SEQ ID NO: 1185807 - DNA, 15 bp, Homo sapiens
atcagatgcctgctt

SEQ ID NO: 1185808 - DNA, 14 bp, Homo sapiens
atcagatgtgttcc

SEQ ID NO: 1185809 - DNA, 19 bp, Homo sapiens
atcagatgtgttcctccat

SEQ ID NO: 1185810 - DNA, 14 bp, Homo sapiens
aacagaagcagcaa

SEQ ID NO: 1185811 - DNA, 16 bp, Homo sapiens
aacagaagcatttgta

SEQ ID NO: 1185812 - DNA, 21 bp, Homo sapiens
aacagaagtgacttctggaga

SEQ ID NO: 1185813 - DNA, 13 bp, Homo sapiens
aacagaatggatt

SEQ ID NO: 1185814 - DNA, 21 bp, Homo sapiens
aacagacaaaaacagcctcac

SEQ ID NO: 1185815 - DNA, 11 bp, Homo sapiens
aacagacaagt

SEQ ID NO: 1185816 - DNA, 21 bp, Homo sapiens
aacagacaatatgtgagtgcc

SEQ ID NO: 1185817 - DNA, 11 bp, Homo sapiens
aacagacagga

SEQ ID NO: 1185818 - DNA, 19 bp, Homo sapiens
aacagaccaatagacattt

SEQ ID NO: 1185819 - DNA, 18 bp, Homo sapiens
aacagaccccctctagaa

SEQ ID NO: 1185820 - DNA, 21 bp, Homo sapiens
aacagactagaagtatttgtg

SEQ ID NO: 1185821 - DNA, 12 bp, Homo sapiens
aacagagaaaga

SEQ ID NO: 1185822 - DNA, 20 bp, Homo sapiens
aacagagaaagaaaaggcaa

SEQ ID NO: 1185823 - DNA, 20 bp, Homo sapiens
aacagaggaagaatttgtta

SEQ ID NO: 1185824 - DNA, 12 bp, Homo sapiens
aacagaggatat

SEQ ID NO: 1185825 - DNA, 19 bp, Homo sapiens
aacagagggaccaaattgc

SEQ ID NO: 1185826 - DNA, 12 bp, Homo sapiens
aacagagggcca

SEQ ID NO: 1185827 - DNA, 18 bp, Homo sapiens
aacagagtggattgggct

SEQ ID NO: 1185828 - DNA, 20 bp, Homo sapiens
aacagatataaatggctggt

SEQ ID NO: 1185829 - DNA, 11 bp, Homo sapiens
aacagatattt

SEQ ID NO: 1185830 - DNA, 16 bp, Homo sapiens
aacagatcaatttgta

SEQ ID NO: 1185831 - DNA, 14 bp, Homo sapiens
aacagatcttttac

SEQ ID NO: 1185832 - DNA, 13 bp, Homo sapiens
aacagatgaaaag

SEQ ID NO: 1185833 - DNA, 20 bp, Homo sapiens
aacagatgaaaagcctctgt

SEQ ID NO: 1185834 - DNA, 18 bp, Homo sapiens
aacagatgaccataattt

SEQ ID NO: 1185835 - DNA, 21 bp, Homo sapiens
aacagatgcaatgtgctactg

SEQ ID NO: 1185836 - DNA, 23 bp, Homo sapiens
aacagattcaggccagcccagcc

SEQ ID NO: 1185837 - DNA, 18 bp, Homo sapiens
aacagattctgattccct

SEQ ID NO: 1185838 - DNA, 13 bp, Homo sapiens
aacagatttggaa

SEQ ID NO: 1185839 - DNA, 17 bp, Homo sapiens
aacagcaagtgtttgtg

SEQ ID NO: 1185840 - DNA, 20 bp, Homo sapiens
aacagcaagtgtttgtggga

SEQ ID NO: 1185841 - DNA, 14 bp, Homo sapiens
aacagcactggctc

SEQ ID NO: 1185842 - DNA, 20 bp, Homo sapiens
aacagcactggctctctcca

SEQ ID NO: 1185843 - DNA, 23 bp, Homo sapiens
aacagcactggctctctccagga

SEQ ID NO: 1185844 - DNA, 19 bp, Homo sapiens
aacagcagactcagctctg

SEQ ID NO: 1185845 - DNA, 17 bp, Homo sapiens
aacagcagaggttcttt

SEQ ID NO: 1185846 - DNA, 13 bp, Homo sapiens
aacagcagctcat

SEQ ID NO: 1185847 - DNA, 18 bp, Homo sapiens
aacagcaggccatctttt

SEQ ID NO: 1185848 - DNA, 20 bp, Homo sapiens
aacagcaggccatcttttta

SEQ ID NO: 1185849 - DNA, 21 bp, Homo sapiens
aacagcagggtagtctggttt

SEQ ID NO: 1185850 - DNA, 12 bp, Homo sapiens
aacagcagtgat

SEQ ID NO: 1185851 - DNA, 13 bp, Homo sapiens
aacagcagtgttc

SEQ ID NO: 1185852 - DNA, 18 bp, Homo sapiens
aacagcatgaataaaaca

SEQ ID NO: 1185853 - DNA, 22 bp, Homo sapiens
aacagcatgaataaaacactca

SEQ ID NO: 1185854 - DNA, 19 bp, Homo sapiens
aacagcatgctgctttgcc

SEQ ID NO: 1185855 - DNA, 18 bp, Homo sapiens
aacagccaagacccaaca

SEQ ID NO: 1185856 - DNA, 11 bp, Homo sapiens
aacagccatgc

SEQ ID NO: 1185857 - DNA, 17 bp, Homo sapiens
aacagccatgtccaagt

SEQ ID NO: 1185858 - DNA, 22 bp, Homo sapiens
aacagccatgtccaagttcttc

SEQ ID NO: 1185859 - DNA, 17 bp, Homo sapiens
aacagcccccactccag

SEQ ID NO: 1185860 - DNA, 19 bp, Homo sapiens
aacagccctcctctgcact

SEQ ID NO: 1185861 - DNA, 21 bp, Homo sapiens
aacagccgctcctgtctgcca

SEQ ID NO: 1185862 - DNA, 13 bp, Homo sapiens
aacagcctcacag

SEQ ID NO: 1185863 - DNA, 14 bp, Homo sapiens
aacagcctcacaga

SEQ ID NO: 1185864 - DNA, 12 bp, Homo sapiens
aacagcctgggg

SEQ ID NO: 1185865 - DNA, 22 bp, Homo sapiens
aacagccttagctgccagtgct

SEQ ID NO: 1185866 - DNA, 18 bp, Homo sapiens
aacagctcagttctagtc

SEQ ID NO: 1185867 - DNA, 11 bp, Homo sapiens
aacagctcctt

SEQ ID NO: 1185868 - DNA, 15 bp, Homo sapiens
aacagctctgagatc

SEQ ID NO: 1185869 - DNA, 11 bp, Homo sapiens
atccataaaga

SEQ ID NO: 1185870 - DNA, 15 bp, Homo sapiens
atccataaatgtgtt

SEQ ID NO: 1185871 - DNA, 12 bp, Homo sapiens
atccatagattt

SEQ ID NO: 1185872 - DNA, 19 bp, Homo sapiens
atccataggactaccgcag

SEQ ID NO: 1185873 - DNA, 16 bp, Homo sapiens
atccatagtagtatga

SEQ ID NO: 1185874 - DNA, 13 bp, Homo sapiens
atccatattttat

SEQ ID NO: 1185875 - DNA, 19 bp, Homo sapiens
atccatattttattactgt

SEQ ID NO: 1185876 - DNA, 23 bp, Homo sapiens
atccatattttattactgtttat

SEQ ID NO: 1185877 - DNA, 13 bp, Homo sapiens
atccatcaggcca

SEQ ID NO: 1185878 - DNA, 15 bp, Homo sapiens
atccatccatctcca

SEQ ID NO: 1185879 - DNA, 16 bp, Homo sapiens
atccatccatctccag

SEQ ID NO: 1185880 - DNA, 13 bp, Homo sapiens
atccatccctaga

SEQ ID NO: 1185881 - DNA, 13 bp, Homo sapiens
atccatcctgcaa

SEQ ID NO: 1185882 - DNA, 23 bp, Homo sapiens
atccatcctgcaaaggcccttgt

SEQ ID NO: 1185883 - DNA, 18 bp, Homo sapiens
atccatcttgagccacag

SEQ ID NO: 1185884 - DNA, 13 bp, Homo sapiens
atccatgcacttt

SEQ ID NO: 1185885 - DNA, 15 bp, Homo sapiens
atccatgcactttaa

SEQ ID NO: 1185886 - DNA, 16 bp, Homo sapiens
atccatgccctcccag

SEQ ID NO: 1185887 - DNA, 19 bp, Homo sapiens
atccatgccctcccaggac

SEQ ID NO: 1185888 - DNA, 10 bp, Homo sapiens
atccatgctt

SEQ ID NO: 1185889 - DNA, 13 bp, Homo sapiens
atccatgcttcac

SEQ ID NO: 1185890 - DNA, 18 bp, Homo sapiens
atccatgtgaccattctg

SEQ ID NO: 1185891 - DNA, 21 bp, Homo sapiens
atccatgtgaccattctgcct

SEQ ID NO: 1185892 - DNA, 19 bp, Homo sapiens
atccatgtgattaatgttt

SEQ ID NO: 1185893 - DNA, 17 bp, Homo sapiens
ccataggactaccgcag

SEQ ID NO: 1185894 - DNA, 12 bp, Homo sapiens
ccataggagagg

SEQ ID NO: 1185895 - DNA, 22 bp, Homo sapiens
ccatagggctggggactgggga

SEQ ID NO: 1185896 - DNA, 20 bp, Homo sapiens
ccatagggtctgcagcctgc

SEQ ID NO: 1185897 - DNA, 15 bp, Homo sapiens
ccataggtagaatgt

SEQ ID NO: 1185898 - DNA, 18 bp, Homo sapiens
ccataggtttctctccct

SEQ ID NO: 1185899 - DNA, 19 bp, Homo sapiens
ccataggtttctctccctc

SEQ ID NO: 1185900 - DNA, 19 bp, Homo sapiens
ccatagtaccatttataca

SEQ ID NO: 1185901 - DNA, 17 bp, Homo sapiens
ccatagtcaatccaaga

SEQ ID NO: 1185902 - DNA, 13 bp, Homo sapiens
ccatagtggggcc

SEQ ID NO: 1185903 - DNA, 16 bp, Homo sapiens
ccatatataacagata

SEQ ID NO: 1185904 - DNA, 15 bp, Homo sapiens
ccatatatgaccaga

SEQ ID NO: 1185905 - DNA, 18 bp, Homo sapiens
ccatatatgaccagaagc

SEQ ID NO: 1185906 - DNA, 19 bp, Homo sapiens
ccatatatgctgtatttct

SEQ ID NO: 1185907 - DNA, 23 bp, Homo sapiens
ccatatatgctgtatttctttgt

SEQ ID NO: 1185908 - DNA, 16 bp, Homo sapiens
ccatatccctcccgtg

SEQ ID NO: 1185909 - DNA, 12 bp, Homo sapiens
ccatatcctggt

SEQ ID NO: 1185910 - DNA, 14 bp, Homo sapiens
ccatatgcagaaat

SEQ ID NO: 1185911 - DNA, 18 bp, Homo sapiens
ccatatgtctgcttctgt

SEQ ID NO: 1185912 - DNA, 12 bp, Homo sapiens
ccatatgtgctt

SEQ ID NO: 1185913 - DNA, 22 bp, Homo sapiens
ccatatgtgtgaattctgcaac

SEQ ID NO: 1185914 - DNA, 22 bp, Homo sapiens
ccatattaaattttttgttgac

SEQ ID NO: 1185915 - DNA, 15 bp, Homo sapiens
ccatattaattgcct

SEQ ID NO: 1185916 - DNA, 19 bp, Homo sapiens
ccatattaccacagacata

SEQ ID NO: 1185917 - DNA, 16 bp, Homo sapiens
ccatatttgatttcta

SEQ ID NO: 1185918 - DNA, 16 bp, Homo sapiens
ccatcaaaatgctttt

SEQ ID NO: 1185919 - DNA, 19 bp, Homo sapiens
ccatcaaaatgctttttat

SEQ ID NO: 1185920 - DNA, 22 bp, Homo sapiens
ccatcaaaggaatataagaaaa

SEQ ID NO: 1185921 - DNA, 17 bp, Homo sapiens
ccatcaacaaaaattgt

SEQ ID NO: 1185922 - DNA, 16 bp, Homo sapiens
ccatcaaggtccagtg

SEQ ID NO: 1185923 - DNA, 17 bp, Homo sapiens
ccatcaaggtccagtgg

SEQ ID NO: 1185924 - DNA, 16 bp, Homo sapiens
ccatcaagttgtgcca

SEQ ID NO: 1185925 - DNA, 11 bp, Homo sapiens
ccatcaataaa

SEQ ID NO: 1185926 - DNA, 15 bp, Homo sapiens
ccatcaccaccgcct

SEQ ID NO: 1185927 - DNA, 14 bp, Homo sapiens
ccatcaccgctggg

SEQ ID NO: 1185928 - DNA, 16 bp, Homo sapiens
ccatcaccgctgggtg

SEQ ID NO: 1185929 - DNA, 11 bp, Homo sapiens
ccatcacctga

SEQ ID NO: 1185930 - DNA, 22 bp, Homo sapiens
ccatcacctgaaacactggacc

SEQ ID NO: 1185931 - DNA, 23 bp, Homo sapiens
ccatcacctgaaacactggacct

SEQ ID NO: 1185932 - DNA, 19 bp, Homo sapiens
ccatcactagagtgctctg

SEQ ID NO: 1185933 - DNA, 14 bp, Homo sapiens
ccatcactcactca

SEQ ID NO: 1185934 - DNA, 22 bp, Homo sapiens
ccatcactcactcactccccac

SEQ ID NO: 1185935 - DNA, 16 bp, Homo sapiens
ccatcactcagcccct

SEQ ID NO: 1185936 - DNA, 15 bp, Homo sapiens
ccatcactcgcagga

SEQ ID NO: 1185937 - DNA, 16 bp, Homo sapiens
ccatcactcgcaggac

SEQ ID NO: 1185938 - DNA, 14 bp, Homo sapiens
ccatcactgcgcca

SEQ ID NO: 1185939 - DNA, 16 bp, Homo sapiens
ccatcacttctccccg

SEQ ID NO: 1185940 - DNA, 17 bp, Homo sapiens
ccatcagaacctgagct

SEQ ID NO: 1185941 - DNA, 15 bp, Homo sapiens
ccatcagcccctggg

SEQ ID NO: 1185942 - DNA, 21 bp, Homo sapiens
ccatcagcgggtctcctccca

SEQ ID NO: 1185943 - DNA, 20 bp, Homo sapiens
ccatcagctcccaacgagcc

SEQ ID NO: 1185944 - DNA, 13 bp, Homo sapiens
ccatcagctgcca

SEQ ID NO: 1185945 - DNA, 24 bp, Homo sapiens
ccatcagctgtaagaagagactgg

SEQ ID NO: 1185946 - DNA, 13 bp, Homo sapiens
ccatcagggccct

SEQ ID NO: 1185947 - DNA, 15 bp, Homo sapiens
ccatcagggccctgc

SEQ ID NO: 1185948 - DNA, 16 bp, Homo sapiens
ccatcagggccctgcc

SEQ ID NO: 1185949 - DNA, 13 bp, Homo sapiens
ccatcagggtggg

SEQ ID NO: 1185950 - DNA, 12 bp, Homo sapiens
ccatcagtgctc

SEQ ID NO: 1185951 - DNA, 14 bp, Homo sapiens
ccatcatcactgta

SEQ ID NO: 1185952 - DNA, 14 bp, Homo sapiens
ccatcatcccagct

SEQ ID NO: 1185953 - DNA, 20 bp, Homo sapiens
ccatcatctatagaaagcta

SEQ ID NO: 1185954 - DNA, 13 bp, Homo sapiens
ccatcatctcctg

SEQ ID NO: 1185955 - DNA, 14 bp, Homo sapiens
ccatcatgtctgta

SEQ ID NO: 1185956 - DNA, 22 bp, Homo sapiens
ccatcattttccatatcctggt

SEQ ID NO: 1185957 - DNA, 20 bp, Homo sapiens
ccatccaaataagaaaccta

SEQ ID NO: 1185958 - DNA, 18 bp, Homo sapiens
ccatccacgtggcctctc

SEQ ID NO: 1185959 - DNA, 23 bp, Homo sapiens
ccatccactgggtgtaaacacat

SEQ ID NO: 1185960 - DNA, 12 bp, Homo sapiens
ccatccagccac

SEQ ID NO: 1185961 - DNA, 15 bp, Homo sapiens
ccatccagccacgga

SEQ ID NO: 1185962 - DNA, 13 bp, Homo sapiens
ccatccagccaga

SEQ ID NO: 1185963 - DNA, 20 bp, Homo sapiens
ccatccagccagaccccacg

SEQ ID NO: 1185964 - DNA, 20 bp, Homo sapiens
ccatccaggtcttgactcat

SEQ ID NO: 1185965 - DNA, 17 bp, Homo sapiens
ccatccagtggactctg

SEQ ID NO: 1185966 - DNA, 16 bp, Homo sapiens
ccatccattaggccag

SEQ ID NO: 1185967 - DNA, 12 bp, Homo sapiens
ccatcccacacc

SEQ ID NO: 1185968 - DNA, 16 bp, Homo sapiens
ccatcccacaccctgg

SEQ ID NO: 1185969 - DNA, 20 bp, Homo sapiens
ccatcccactgctcccccaa

SEQ ID NO: 1185970 - DNA, 16 bp, Homo sapiens
ccatccccaactccat

SEQ ID NO: 1185971 - DNA, 13 bp, Homo sapiens
ccatccccaggtc

SEQ ID NO: 1185972 - DNA, 15 bp, Homo sapiens
ccatcccccttcttc

SEQ ID NO: 1185973 - DNA, 11 bp, Homo sapiens
ccatcccctcc

SEQ ID NO: 1185974 - DNA, 12 bp, Homo sapiens
ccatcccctccc

SEQ ID NO: 1185975 - DNA, 18 bp, Homo sapiens
ccatcccctccctgcctg

SEQ ID NO: 1185976 - DNA, 19 bp, Homo sapiens
ccatcccctccctgcctgc

SEQ ID NO: 1185977 - DNA, 16 bp, Homo sapiens
ccatcccgaaaatctc

SEQ ID NO: 1185978 - DNA, 19 bp, Homo sapiens
ccatcccgaaaatctctcg

SEQ ID NO: 1185979 - DNA, 17 bp, Homo sapiens
ccatcccgacatggacc

SEQ ID NO: 1185980 - DNA, 22 bp, Homo sapiens
ccatcccgcttagcctgcctca

SEQ ID NO: 1185981 - DNA, 23 bp, Homo sapiens
ccatcccgcttagcctgcctcac

SEQ ID NO: 1185982 - DNA, 16 bp, Homo sapiens
ccatccctaccactgt

SEQ ID NO: 1185983 - DNA, 16 bp, Homo sapiens
ccatccctccccagtt

SEQ ID NO: 1185984 - DNA, 18 bp, Homo sapiens
ccatccctcggacccacc

SEQ ID NO: 1185985 - DNA, 23 bp, Homo sapiens
ccatccctgcttgcccgctccca

SEQ ID NO: 1185986 - DNA, 12 bp, Homo sapiens
ccatccctgggc

SEQ ID NO: 1185987 - DNA, 14 bp, Homo sapiens
ccatccctgggggc

SEQ ID NO: 1185988 - DNA, 14 bp, Homo sapiens
ccatcccttgggga

SEQ ID NO: 1185989 - DNA, 19 bp, Homo sapiens
ccatccctttttgaagtgt

SEQ ID NO: 1185990 - DNA, 18 bp, Homo sapiens
ccatccgactgcccctgc

SEQ ID NO: 1185991 - DNA, 20 bp, Homo sapiens
ccatccgactgcccctgctg

SEQ ID NO: 1185992 - DNA, 19 bp, Homo sapiens
atcctagagtcttaaagca

SEQ ID NO: 1185993 - DNA, 22 bp, Homo sapiens
atcctagccttatcctctgatc

SEQ ID NO: 1185994 - DNA, 23 bp, Homo sapiens
atcctagccttatcctctgatct

SEQ ID NO: 1185995 - DNA, 14 bp, Homo sapiens
atcctatgcttaat

SEQ ID NO: 1185996 - DNA, 20 bp, Homo sapiens
atcctcaaacgacagaggag

SEQ ID NO: 1185997 - DNA, 19 bp, Homo sapiens
atcctcaaagaaagtgtat

SEQ ID NO: 1185998 - DNA, 21 bp, Homo sapiens
atcctcaaagaaagtgtattg

SEQ ID NO: 1185999 - DNA, 18 bp, Homo sapiens
atcctcaaatcagtcttc

SEQ ID NO: 1186000 - DNA, 12 bp, Homo sapiens
atcctcaatcca

SEQ ID NO: 1186001 - DNA, 16 bp, Homo sapiens
atcctcacactacaga

SEQ ID NO: 1186002 - DNA, 16 bp, Homo sapiens
atcctcacagtgaaca

SEQ ID NO: 1186003 - DNA, 23 bp, Homo sapiens
atcctcaccatccacagcaagat

SEQ ID NO: 1186004 - DNA, 21 bp, Homo sapiens
atcctcacccagatcaggaac

SEQ ID NO: 1186005 - DNA, 23 bp, Homo sapiens
atcctcacccagatcaggaacca

SEQ ID NO: 1186006 - DNA, 16 bp, Homo sapiens
atcctcacgccttggc

SEQ ID NO: 1186007 - DNA, 22 bp, Homo sapiens
atcctcagaggctgagccctgt

SEQ ID NO: 1186008 - DNA, 19 bp, Homo sapiens
atcctcagccgagaaattg

SEQ ID NO: 1186009 - DNA, 20 bp, Homo sapiens
atcctcatatggcccagtgt

SEQ ID NO: 1186010 - DNA, 16 bp, Homo sapiens
atcctcatccctgact

SEQ ID NO: 1186011 - DNA, 15 bp, Homo sapiens
atcctccaatgtcta

SEQ ID NO: 1186012 - DNA, 19 bp, Homo sapiens
atcctccaatgtctaattt

SEQ ID NO: 1186013 - DNA, 13 bp, Homo sapiens
atcctccacagag

SEQ ID NO: 1186014 - DNA, 11 bp, Homo sapiens
atcctccagct

SEQ ID NO: 1186015 - DNA, 12 bp, Homo sapiens
atcctccagctt

SEQ ID NO: 1186016 - DNA, 13 bp, Homo sapiens
atcctccagcttc

SEQ ID NO: 1186017 - DNA, 21 bp, Homo sapiens
atcctccagtaccttgcttct

SEQ ID NO: 1186018 - DNA, 23 bp, Homo sapiens
atcctcccaaccaaccagcaggg

SEQ ID NO: 1186019 - DNA, 16 bp, Homo sapiens
atcctccccagcgcca

SEQ ID NO: 1186020 - DNA, 11 bp, Homo sapiens
atcctcccctt

SEQ ID NO: 1186021 - DNA, 15 bp, Homo sapiens
atcctccccttccct

SEQ ID NO: 1186022 - DNA, 20 bp, Homo sapiens
atcctccctccacctcaaga

SEQ ID NO: 1186023 - DNA, 15 bp, Homo sapiens
atcctccctgcccat

SEQ ID NO: 1186024 - DNA, 16 bp, Homo sapiens
atcctccctggcagac

SEQ ID NO: 1186025 - DNA, 19 bp, Homo sapiens
atcctccctggcagacaca

SEQ ID NO: 1186026 - DNA, 12 bp, Homo sapiens
atcctcccttgc

SEQ ID NO: 1186027 - DNA, 16 bp, Homo sapiens
ccatgcctaggaacat

SEQ ID NO: 1186028 - DNA, 21 bp, Homo sapiens
ccatgcctcagccctgaccct

SEQ ID NO: 1186029 - DNA, 23 bp, Homo sapiens
ccatgcctcatgccacaccttct

SEQ ID NO: 1186030 - DNA, 21 bp, Homo sapiens
ccatgcctccctgggccacct

SEQ ID NO: 1186031 - DNA, 23 bp, Homo sapiens
ccatgcctccctgggccacctcc

SEQ ID NO: 1186032 - DNA, 15 bp, Homo sapiens
ccatgcctcctcagg

SEQ ID NO: 1186033 - DNA, 12 bp, Homo sapiens
ccatgcctgagg

SEQ ID NO: 1186034 - DNA, 13 bp, Homo sapiens
ccatgcctgaggg

SEQ ID NO: 1186035 - DNA, 14 bp, Homo sapiens
ccatgcctgagggt

SEQ ID NO: 1186036 - DNA, 18 bp, Homo sapiens
ccatgcctgagggtggag

SEQ ID NO: 1186037 - DNA, 23 bp, Homo sapiens
ccatgcctggtcccaagacagtg

SEQ ID NO: 1186038 - DNA, 13 bp, Homo sapiens
ccatgcctgtcca

SEQ ID NO: 1186039 - DNA, 14 bp, Homo sapiens
ccatgcctgtccag

SEQ ID NO: 1186040 - DNA, 17 bp, Homo sapiens
ccatgcctgtccagcct

SEQ ID NO: 1186041 - DNA, 19 bp, Homo sapiens
ccatgcgaggggccagcag

SEQ ID NO: 1186042 - DNA, 21 bp, Homo sapiens
ccatgcgaggggccagcagag

SEQ ID NO: 1186043 - DNA, 20 bp, Homo sapiens
ccatgcgtgctgagaggcga

SEQ ID NO: 1186044 - DNA, 21 bp, Homo sapiens
ccatgctatgagttttctcct

SEQ ID NO: 1186045 - DNA, 13 bp, Homo sapiens
ccatgctcatctg

SEQ ID NO: 1186046 - DNA, 16 bp, Homo sapiens
ccatgctcatctgctg

SEQ ID NO: 1186047 - DNA, 17 bp, Homo sapiens
ccatgctcatctgctgg

SEQ ID NO: 1186048 - DNA, 13 bp, Homo sapiens
ccatgctcctggc

SEQ ID NO: 1186049 - DNA, 20 bp, Homo sapiens
ccatgctccttgagaggaga

SEQ ID NO: 1186050 - DNA, 20 bp, Homo sapiens
ccatgctgaaggctcccatt

SEQ ID NO: 1186051 - DNA, 13 bp, Homo sapiens
ccatgctgaaggg

SEQ ID NO: 1186052 - DNA, 14 bp, Homo sapiens
ccatgctgcctcca

SEQ ID NO: 1186053 - DNA, 22 bp, Homo sapiens
ccatgctgctttttggcacagt

SEQ ID NO: 1186054 - DNA, 19 bp, Homo sapiens
ccatgctggatactggaca

SEQ ID NO: 1186055 - DNA, 20 bp, Homo sapiens
ccatgctggatactggacac

SEQ ID NO: 1186056 - DNA, 20 bp, Homo sapiens
ccatgctggcggcgcagagg

SEQ ID NO: 1186057 - DNA, 21 bp, Homo sapiens
ccatgctgtccctgcactgtg

SEQ ID NO: 1186058 - DNA, 22 bp, Homo sapiens
ccatgcttaacatacccgccta

SEQ ID NO: 1186059 - DNA, 22 bp, Homo sapiens
ccatgcttagtcactgcctgca

SEQ ID NO: 1186060 - DNA, 13 bp, Homo sapiens
ccatgcttcactc

SEQ ID NO: 1186061 - DNA, 18 bp, Homo sapiens
ccatgcttgcctgaagct

SEQ ID NO: 1186062 - DNA, 18 bp, Homo sapiens
ccatggaaataaaaagta

SEQ ID NO: 1186063 - DNA, 21 bp, Homo sapiens
ccatggaaataaaaagtatgt

SEQ ID NO: 1186064 - DNA, 20 bp, Homo sapiens
ccatggacactacacccagc

SEQ ID NO: 1186065 - DNA, 21 bp, Homo sapiens
ccatggacactacacccagca

SEQ ID NO: 1186066 - DNA, 21 bp, Homo sapiens
ccatggacactccagtgccag

SEQ ID NO: 1186067 - DNA, 14 bp, Homo sapiens
ccatggacaggctg

SEQ ID NO: 1186068 - DNA, 17 bp, Homo sapiens
ccatggaccagcccatt

SEQ ID NO: 1186069 - DNA, 18 bp, Homo sapiens
ccatggacgaatatgaat

SEQ ID NO: 1186070 - DNA, 17 bp, Homo sapiens
ccatggagccagctccc

SEQ ID NO: 1186071 - DNA, 18 bp, Homo sapiens
ccatggagccagctccct

SEQ ID NO: 1186072 - DNA, 22 bp, Homo sapiens
ccatggagccagctccctctat

SEQ ID NO: 1186073 - DNA, 14 bp, Homo sapiens
ccatggcaccagcc

SEQ ID NO: 1186074 - DNA, 18 bp, Homo sapiens
ccatggcaccagccccct

SEQ ID NO: 1186075 - DNA, 23 bp, Homo sapiens
ccatggcaccttcagactttgct

SEQ ID NO: 1186076 - DNA, 22 bp, Homo sapiens
ccatggcactaaaccacttctc

SEQ ID NO: 1186077 - DNA, 18 bp, Homo sapiens
ccatggcagcatggagag

SEQ ID NO: 1186078 - DNA, 11 bp, Homo sapiens
ccatggccacc

SEQ ID NO: 1186079 - DNA, 12 bp, Homo sapiens
ccatggccaccc

SEQ ID NO: 1186080 - DNA, 13 bp, Homo sapiens
ccatggccacccc

SEQ ID NO: 1186081 - DNA, 19 bp, Homo sapiens
ccatggccatttctgtgga

SEQ ID NO: 1186082 - DNA, 20 bp, Homo sapiens
ccatggccatttctgtggag

SEQ ID NO: 1186083 - DNA, 15 bp, Homo sapiens
ccatggcccccaata

SEQ ID NO: 1186084 - DNA, 20 bp, Homo sapiens
ccatggcccccaataaaggc

SEQ ID NO: 1186085 - DNA, 17 bp, Homo sapiens
ccatggccccccactcc

SEQ ID NO: 1186086 - DNA, 11 bp, Homo sapiens
ccatggccctg

SEQ ID NO: 1186087 - DNA, 13 bp, Homo sapiens
ccatggccctgtc

SEQ ID NO: 1186088 - DNA, 16 bp, Homo sapiens
ccatggccctgtccca

SEQ ID NO: 1186089 - DNA, 22 bp, Homo sapiens
ccatggccgaagccccttggag

SEQ ID NO: 1186090 - DNA, 21 bp, Homo sapiens
ccatggcgtgtccctctcgga

SEQ ID NO: 1186091 - DNA, 16 bp, Homo sapiens
ccatggctcaggcaag

SEQ ID NO: 1186092 - DNA, 18 bp, Homo sapiens
ccatggctcaggcaagcc

SEQ ID NO: 1186093 - DNA, 14 bp, Homo sapiens
ccatggctgaagct

SEQ ID NO: 1186094 - DNA, 19 bp, Homo sapiens
ccatggctgaagctggagc

SEQ ID NO: 1186095 - DNA, 21 bp, Homo sapiens
ccatggctgaagctggagcag

SEQ ID NO: 1186096 - DNA, 22 bp, Homo sapiens
ccatggctgaagctggagcagc

SEQ ID NO: 1186097 - DNA, 16 bp, Homo sapiens
ccatggcttcctgaga

SEQ ID NO: 1186098 - DNA, 20 bp, Homo sapiens
ccatggcttgttctctggaa

SEQ ID NO: 1186099 - DNA, 19 bp, Homo sapiens
ccatggctttcatcctgtg

SEQ ID NO: 1186100 - DNA, 14 bp, Homo sapiens
ccatgggagccagc

SEQ ID NO: 1186101 - DNA, 22 bp, Homo sapiens
ccatgggagctggttagaaatg

SEQ ID NO: 1186102 - DNA, 14 bp, Homo sapiens
ccatgggcagagga

SEQ ID NO: 1186103 - DNA, 15 bp, Homo sapiens
ccatgggccaccgcc

SEQ ID NO: 1186104 - DNA, 21 bp, Homo sapiens
ccatgggcccgctgcctcttg

SEQ ID NO: 1186105 - DNA, 16 bp, Homo sapiens
ccatgggcctgctgcg

SEQ ID NO: 1186106 - DNA, 23 bp, Homo sapiens
ccatgggcctgctgcgtcagacc

SEQ ID NO: 1186107 - DNA, 13 bp, Homo sapiens
ccatgggcctggg

SEQ ID NO: 1186108 - DNA, 16 bp, Homo sapiens
ccatgggcctgggcct

SEQ ID NO: 1186109 - DNA, 20 bp, Homo sapiens
ccatgggcctgggcctgctt

SEQ ID NO: 1186110 - DNA, 12 bp, Homo sapiens
ccatggggaggg

SEQ ID NO: 1186111 - DNA, 20 bp, Homo sapiens
ccatggggagggattctggt

SEQ ID NO: 1186112 - DNA, 17 bp, Homo sapiens
ccatggggtccatcccc

SEQ ID NO: 1186113 - DNA, 12 bp, Homo sapiens
ccattattttct

SEQ ID NO: 1186114 - DNA, 14 bp, Homo sapiens
ccattattttctgt

SEQ ID NO: 1186115 - DNA, 12 bp, Homo sapiens
ccattattttgt

SEQ ID NO: 1186116 - DNA, 14 bp, Homo sapiens
ccattcaacccagc

SEQ ID NO: 1186117 - DNA, 17 bp, Homo sapiens
ccattcacaagcctcct

SEQ ID NO: 1186118 - DNA, 18 bp, Homo sapiens
ccattcacaagcctcctg

SEQ ID NO: 1186119 - DNA, 18 bp, Homo sapiens
ccattcacatttgatgta

SEQ ID NO: 1186120 - DNA, 17 bp, Homo sapiens
ccattcactcttccaga

SEQ ID NO: 1186121 - DNA, 20 bp, Homo sapiens
ccattcagaaagcttcaaat

SEQ ID NO: 1186122 - DNA, 21 bp, Homo sapiens
ccattccaagtcaacactctt

SEQ ID NO: 1186123 - DNA, 21 bp, Homo sapiens
ccattccatggaaataaaaag

SEQ ID NO: 1186124 - DNA, 14 bp, Homo sapiens
ccattcccccatgt

SEQ ID NO: 1186125 - DNA, 19 bp, Homo sapiens
ccattcccccatgtggctg

SEQ ID NO: 1186126 - DNA, 12 bp, Homo sapiens
ccattcctcagg

SEQ ID NO: 1186127 - DNA, 13 bp, Homo sapiens
ccattccttagct

SEQ ID NO: 1186128 - DNA, 17 bp, Homo sapiens
ccattccttcaaataaa

SEQ ID NO: 1186129 - DNA, 18 bp, Homo sapiens
ccattccttgcgcctcag

SEQ ID NO: 1186130 - DNA, 19 bp, Homo sapiens
ccattccttgcgcctcagc

SEQ ID NO: 1186131 - DNA, 21 bp, Homo sapiens
ccattccttgcgcctcagccc

SEQ ID NO: 1186132 - DNA, 19 bp, Homo sapiens
ccattctagatcctgcacc

SEQ ID NO: 1186133 - DNA, 22 bp, Homo sapiens
ccattctagatcctgcacccca

SEQ ID NO: 1186134 - DNA, 18 bp, Homo sapiens
ccattctccacagcaacc

SEQ ID NO: 1186135 - DNA, 17 bp, Homo sapiens
ccattctcccagtctct

SEQ ID NO: 1186136 - DNA, 19 bp, Homo sapiens
ccattctcccagtctctgt

SEQ ID NO: 1186137 - DNA, 20 bp, Homo sapiens
ccattctgcctccattctga

SEQ ID NO: 1186138 - DNA, 17 bp, Homo sapiens
ccattctgcctctcctc

SEQ ID NO: 1186139 - DNA, 10 bp, Homo sapiens
ccattctgtg

SEQ ID NO: 1186140 - DNA, 22 bp, Homo sapiens
ccattctgtgaccaaaatacct

SEQ ID NO: 1186141 - DNA, 17 bp, Homo sapiens
ccattctgttttccccc

SEQ ID NO: 1186142 - DNA, 19 bp, Homo sapiens
ccattctgttttcccccag

SEQ ID NO: 1186143 - DNA, 15 bp, Homo sapiens
ccattcttcagtgtc

SEQ ID NO: 1186144 - DNA, 19 bp, Homo sapiens
ccattcttcagtgtctctg

SEQ ID NO: 1186145 - DNA, 14 bp, Homo sapiens
ccattcttcctagt

SEQ ID NO: 1186146 - DNA, 19 bp, Homo sapiens
ccattcttcctagttttct

SEQ ID NO: 1186147 - DNA, 14 bp, Homo sapiens
ccattcttctgggt

SEQ ID NO: 1186148 - DNA, 11 bp, Homo sapiens
ccattcttctt

SEQ ID NO: 1186149 - DNA, 20 bp, Homo sapiens
ccattcttgagttttgataa

SEQ ID NO: 1186150 - DNA, 20 bp, Homo sapiens
ccattctttattcttttact

SEQ ID NO: 1186151 - DNA, 15 bp, Homo sapiens
ccattcttttgtaat

SEQ ID NO: 1186152 - DNA, 16 bp, Homo sapiens
ccattcttttgtaatt

SEQ ID NO: 1186153 - DNA, 10 bp, Homo sapiens
ccattgaaat

SEQ ID NO: 1186154 - DNA, 16 bp, Homo sapiens
ccattgaaatcagcat

SEQ ID NO: 1186155 - DNA, 17 bp, Homo sapiens
ccattgaacagctgtga

SEQ ID NO: 1186156 - DNA, 16 bp, Homo sapiens
ccattgaactggaaga

SEQ ID NO: 1186157 - DNA, 21 bp, Homo sapiens
atccttttcctaattcacaca

SEQ ID NO: 1186158 - DNA, 15 bp, Homo sapiens
atcctttttctttat

SEQ ID NO: 1186159 - DNA, 18 bp, Homo sapiens
atcctttttctttataaa

SEQ ID NO: 1186160 - DNA, 16 bp, Homo sapiens
atccttttttaaaagt

SEQ ID NO: 1186161 - DNA, 19 bp, Homo sapiens
atccttttttctcttctgt

SEQ ID NO: 1186162 - DNA, 15 bp, Homo sapiens
atccttttttgtcat

SEQ ID NO: 1186163 - DNA, 16 bp, Homo sapiens
atccttttttgtcatt

SEQ ID NO: 1186164 - DNA, 14 bp, Homo sapiens
atcgaaaaaataat

SEQ ID NO: 1186165 - DNA, 19 bp, Homo sapiens
atcgaagggtttttagaga

SEQ ID NO: 1186166 - DNA, 14 bp, Homo sapiens
atcgaatgaaatta

SEQ ID NO: 1186167 - DNA, 21 bp, Homo sapiens
atcgacttgtttttgcacatg

SEQ ID NO: 1186168 - DNA, 15 bp, Homo sapiens
atcgagaccatcctg

SEQ ID NO: 1186169 - DNA, 19 bp, Homo sapiens
atcgagaccatcctggcta

SEQ ID NO: 1186170 - DNA, 17 bp, Homo sapiens
atcgagtgtagctgtga

SEQ ID NO: 1186171 - DNA, 19 bp, Homo sapiens
atcgagtgtagctgtgaaa

SEQ ID NO: 1186172 - DNA, 14 bp, Homo sapiens
atcgatatgtatat

SEQ ID NO: 1186173 - DNA, 15 bp, Homo sapiens
atcgatatgtatatc

SEQ ID NO: 1186174 - DNA, 13 bp, Homo sapiens
atcgatgaatgta

SEQ ID NO: 1186175 - DNA, 21 bp, Homo sapiens
atcgatgggggatgcttcatg

SEQ ID NO: 1186176 - DNA, 12 bp, Homo sapiens
atcgatgtgctc

SEQ ID NO: 1186177 - DNA, 13 bp, Homo sapiens
atcgatgtgctca

SEQ ID NO: 1186178 - DNA, 12 bp, Homo sapiens
atcgattggctt

SEQ ID NO: 1186179 - DNA, 17 bp, Homo sapiens
atcgcaccattctgact

SEQ ID NO: 1186180 - DNA, 23 bp, Homo sapiens
atcgcaggagtctctgccaccca

SEQ ID NO: 1186181 - DNA, 20 bp, Homo sapiens
atcgccagaggtgcttcacc

SEQ ID NO: 1186182 - DNA, 16 bp, Homo sapiens
atcgccataggccaag

SEQ ID NO: 1186183 - DNA, 17 bp, Homo sapiens
atcgccataggccaagg

SEQ ID NO: 1186184 - DNA, 15 bp, Homo sapiens
atcgcccaggcctgg

SEQ ID NO: 1186185 - DNA, 15 bp, Homo sapiens
atcgccccaactcca

SEQ ID NO: 1186186 - DNA, 16 bp, Homo sapiens
atcgcccgataaagac

SEQ ID NO: 1186187 - DNA, 13 bp, Homo sapiens
atcgccctccttt

SEQ ID NO: 1186188 - DNA, 17 bp, Homo sapiens
atcgccctcctttccct

SEQ ID NO: 1186189 - DNA, 16 bp, Homo sapiens
atcgcctctgtctcct

SEQ ID NO: 1186190 - DNA, 18 bp, Homo sapiens
atcgcgccagcgacctct

SEQ ID NO: 1186191 - DNA, 20 bp, Homo sapiens
atcgctaaagggaccatctg

SEQ ID NO: 1186192 - DNA, 16 bp, Homo sapiens
atcgctcttttccact

SEQ ID NO: 1186193 - DNA, 16 bp, Homo sapiens
atcgctgtgatgctgg

SEQ ID NO: 1186194 - DNA, 22 bp, Homo sapiens
atcgctgtgtgttagttcccaa

SEQ ID NO: 1186195 - DNA, 16 bp, Homo sapiens
atcgcttgagcccagg

SEQ ID NO: 1186196 - DNA, 17 bp, Homo sapiens
atcgctttatgtttttg

SEQ ID NO: 1186197 - DNA, 21 bp, Homo sapiens
atcgctttatgtttttggtta

SEQ ID NO: 1186198 - DNA, 13 bp, Homo sapiens
atcggaaaaataa

SEQ ID NO: 1186199 - DNA, 15 bp, Homo sapiens
atcggaaaaataatc

SEQ ID NO: 1186200 - DNA, 14 bp, Homo sapiens
atcggaagcagtgc

SEQ ID NO: 1186201 - DNA, 22 bp, Homo sapiens
atcggaagcagtgccttccata

SEQ ID NO: 1186202 - DNA, 14 bp, Homo sapiens
atcggactctgccc

SEQ ID NO: 1186203 - DNA, 15 bp, Homo sapiens
atcggactgccaaat

SEQ ID NO: 1186204 - DNA, 21 bp, Homo sapiens
atcggaggctgggcccctggg

SEQ ID NO: 1186205 - DNA, 23 bp, Homo sapiens
atcggcccacagctcccacccca

SEQ ID NO: 1186206 - DNA, 13 bp, Homo sapiens
atcggccctgtcc

SEQ ID NO: 1186207 - DNA, 23 bp, Homo sapiens
atcggctacccctcgactcagca

SEQ ID NO: 1186208 - DNA, 15 bp, Homo sapiens
atcgggaaagaagaa

SEQ ID NO: 1186209 - DNA, 18 bp, Homo sapiens
atcgggaaagaagaaact

SEQ ID NO: 1186210 - DNA, 16 bp, Homo sapiens
atcgggaacagtgttt

SEQ ID NO: 1186211 - DNA, 21 bp, Homo sapiens
atcgggaacagtgtttcccat

SEQ ID NO: 1186212 - DNA, 17 bp, Homo sapiens
atcgggagcagtgtctt

SEQ ID NO: 1186213 - DNA, 18 bp, Homo sapiens
atcgggagcagtgtcttc

SEQ ID NO: 1186214 - DNA, 21 bp, Homo sapiens
atcgggagcagtgtcttccat

SEQ ID NO: 1186215 - DNA, 14 bp, Homo sapiens
atcgggcccaggga

SEQ ID NO: 1186216 - DNA, 20 bp, Homo sapiens
atcgggtccagagaccacac

SEQ ID NO: 1186217 - DNA, 14 bp, Homo sapiens
atcggtaggcaaag

SEQ ID NO: 1186218 - DNA, 14 bp, Homo sapiens
atcgtaaagctgtt

SEQ ID NO: 1186219 - DNA, 13 bp, Homo sapiens
atcgtaaagtgct

SEQ ID NO: 1186220 - DNA, 13 bp, Homo sapiens
atcgtagaaaatt

SEQ ID NO: 1186221 - DNA, 19 bp, Homo sapiens
atcgtagaaaatttgcttt

SEQ ID NO: 1186222 - DNA, 13 bp, Homo sapiens
atcgtagaagaga

SEQ ID NO: 1186223 - DNA, 15 bp, Homo sapiens
atcgtcaaccacttt

SEQ ID NO: 1186224 - DNA, 17 bp, Homo sapiens
atcgtcatgcacagtat

SEQ ID NO: 1186225 - DNA, 22 bp, Homo sapiens
atcgtccaccccagtgtgcacg

SEQ ID NO: 1186226 - DNA, 19 bp, Homo sapiens
atcgtccagcgaccttcct

SEQ ID NO: 1186227 - DNA, 15 bp, Homo sapiens
atcgtctcatcctcc

SEQ ID NO: 1186228 - DNA, 16 bp, Homo sapiens
atcgtctcatcctcct

SEQ ID NO: 1186229 - DNA, 17 bp, Homo sapiens
atcgtctcatcctcctt

SEQ ID NO: 1186230 - DNA, 18 bp, Homo sapiens
atcgtctcatcctccttt

SEQ ID NO: 1186231 - DNA, 18 bp, Homo sapiens
atcgtgaaatcctcagcc

SEQ ID NO: 1186232 - DNA, 16 bp, Homo sapiens
atcgtgacccttcagg

SEQ ID NO: 1186233 - DNA, 22 bp, Homo sapiens
atcgtgacccttcagggccaga

SEQ ID NO: 1186234 - DNA, 15 bp, Homo sapiens
atcgtgctaaatttt

SEQ ID NO: 1186235 - DNA, 16 bp, Homo sapiens
atcgtgctaaattttc

SEQ ID NO: 1186236 - DNA, 15 bp, Homo sapiens
atctattatttggag

SEQ ID NO: 1186237 - DNA, 15 bp, Homo sapiens
atctattcagacaag

SEQ ID NO: 1186238 - DNA, 21 bp, Homo sapiens
atctattcagacaagcaacag

SEQ ID NO: 1186239 - DNA, 21 bp, Homo sapiens
atctattgcttggacttaact

SEQ ID NO: 1186240 - DNA, 16 bp, Homo sapiens
atctattgggttcatt

SEQ ID NO: 1186241 - DNA, 13 bp, Homo sapiens
atctatttaagta

SEQ ID NO: 1186242 - DNA, 12 bp, Homo sapiens
atctatttgagg

SEQ ID NO: 1186243 - DNA, 15 bp, Homo sapiens
atctatttgtacaat

SEQ ID NO: 1186244 - DNA, 23 bp, Homo sapiens
atctatttttggcagtctgaatt

SEQ ID NO: 1186245 - DNA, 14 bp, Homo sapiens
atctcaaaggagaa

SEQ ID NO: 1186246 - DNA, 16 bp, Homo sapiens
atctcaaaggagaaaa

SEQ ID NO: 1186247 - DNA, 22 bp, Homo sapiens
atctcaactttggttcctgtga

SEQ ID NO: 1186248 - DNA, 13 bp, Homo sapiens
atctcaagccagc

SEQ ID NO: 1186249 - DNA, 17 bp, Homo sapiens
atctcaatctgcagcca

SEQ ID NO: 1186250 - DNA, 17 bp, Homo sapiens
atctcacaccttagcta

SEQ ID NO: 1186251 - DNA, 13 bp, Homo sapiens
atctcacaggctg

SEQ ID NO: 1186252 - DNA, 13 bp, Homo sapiens
atctcaccccatc

SEQ ID NO: 1186253 - DNA, 23 bp, Homo sapiens
atctcaccccatcccacaccctg

SEQ ID NO: 1186254 - DNA, 16 bp, Homo sapiens
atctcacttagtcctt

SEQ ID NO: 1186255 - DNA, 15 bp, Homo sapiens
atctcacttttctcc

SEQ ID NO: 1186256 - DNA, 19 bp, Homo sapiens
atctcacttttctccatga

SEQ ID NO: 1186257 - DNA, 12 bp, Homo sapiens
atctcagaaagt

SEQ ID NO: 1186258 - DNA, 22 bp, Homo sapiens
atctcagaaccttgtcccagcc

SEQ ID NO: 1186259 - DNA, 18 bp, Homo sapiens
atctcagagtccactgtg

SEQ ID NO: 1186260 - DNA, 14 bp, Homo sapiens
atctcagatactta

SEQ ID NO: 1186261 - DNA, 17 bp, Homo sapiens
atctcagattctgtcta

SEQ ID NO: 1186262 - DNA, 20 bp, Homo sapiens
atctcagcaaagctacagga

SEQ ID NO: 1186263 - DNA, 22 bp, Homo sapiens
atctcagcaaagctacaggact

SEQ ID NO: 1186264 - DNA, 22 bp, Homo sapiens
atctcagcctcccaagtagcta

SEQ ID NO: 1186265 - DNA, 20 bp, Homo sapiens
atctcagcctcctgagcctg

SEQ ID NO: 1186266 - DNA, 21 bp, Homo sapiens
atctcagcctcctgagcctgt

SEQ ID NO: 1186267 - DNA, 24 bp, Homo sapiens
atctcagcctcctgagcctgtggg

SEQ ID NO: 1186268 - DNA, 13 bp, Homo sapiens
atctcagctttga

SEQ ID NO: 1186269 - DNA, 19 bp, Homo sapiens
atctcaggacacttccgta

SEQ ID NO: 1186270 - DNA, 14 bp, Homo sapiens
atctcaggagatgg

SEQ ID NO: 1186271 - DNA, 21 bp, Homo sapiens
atctcaggagatggagggctt

SEQ ID NO: 1186272 - DNA, 15 bp, Homo sapiens
atctcaggccacctg

SEQ ID NO: 1186273 - DNA, 17 bp, Homo sapiens
atctcaggccacctgcc

SEQ ID NO: 1186274 - DNA, 22 bp, Homo sapiens
atctcagggagggaaggggatg

SEQ ID NO: 1186275 - DNA, 13 bp, Homo sapiens
atctcagggcaga

SEQ ID NO: 1186276 - DNA, 15 bp, Homo sapiens
atctcaggtgccact

SEQ ID NO: 1186277 - DNA, 16 bp, Homo sapiens
atctcaggtgccactc

SEQ ID NO: 1186278 - DNA, 16 bp, Homo sapiens
atctcaggttggcggc

SEQ ID NO: 1186279 - DNA, 18 bp, Homo sapiens
atctcagtatgaattatt

SEQ ID NO: 1186280 - DNA, 20 bp, Homo sapiens
atctcagtgaagaatacttc

SEQ ID NO: 1186281 - DNA, 16 bp, Homo sapiens
atctcagttgtttgct

SEQ ID NO: 1186282 - DNA, 17 bp, Homo sapiens
atctcataggttgccaa

SEQ ID NO: 1186283 - DNA, 19 bp, Homo sapiens
atctcataggttgccaata

SEQ ID NO: 1186284 - DNA, 16 bp, Homo sapiens
atctcatcatgtctat

SEQ ID NO: 1186285 - DNA, 14 bp, Homo sapiens
atctcatcccccca

SEQ ID NO: 1186286 - DNA, 16 bp, Homo sapiens
atctcatcctttcctc

SEQ ID NO: 1186287 - DNA, 20 bp, Homo sapiens
atctcatctcagtgaagaat

SEQ ID NO: 1186288 - DNA, 20 bp, Homo sapiens
cccaaccaggcacctcttcc

SEQ ID NO: 1186289 - DNA, 14 bp, Homo sapiens
cccaacccaaacca

SEQ ID NO: 1186290 - DNA, 14 bp, Homo sapiens
cccaacccaatccc

SEQ ID NO: 1186291 - DNA, 15 bp, Homo sapiens
cccaacccaatccct

SEQ ID NO: 1186292 - DNA, 20 bp, Homo sapiens
cccaacccattcactacagg

SEQ ID NO: 1186293 - DNA, 17 bp, Homo sapiens
cccaacccccctcctgc

SEQ ID NO: 1186294 - DNA, 21 bp, Homo sapiens
cccaacccccgcaccaagcag

SEQ ID NO: 1186295 - DNA, 22 bp, Homo sapiens
cccaaccccgcggtgctctggc

SEQ ID NO: 1186296 - DNA, 14 bp, Homo sapiens
cccaaccctgcccc

SEQ ID NO: 1186297 - DNA, 19 bp, Homo sapiens
cccaaccctgggctgggga

SEQ ID NO: 1186298 - DNA, 23 bp, Homo sapiens
cccaaccctgggctggggaggag

SEQ ID NO: 1186299 - DNA, 20 bp, Homo sapiens
cccaacctcaatgccctgcc

SEQ ID NO: 1186300 - DNA, 13 bp, Homo sapiens
cccaacctcaggg

SEQ ID NO: 1186301 - DNA, 19 bp, Homo sapiens
cccaacctcagggctccca

SEQ ID NO: 1186302 - DNA, 22 bp, Homo sapiens
cccaacctcagggctcccaggg

SEQ ID NO: 1186303 - DNA, 15 bp, Homo sapiens
cccaacctttccctc

SEQ ID NO: 1186304 - DNA, 18 bp, Homo sapiens
cccaacgagcctcctcag

SEQ ID NO: 1186305 - DNA, 18 bp, Homo sapiens
cccaacggggtggggagg

SEQ ID NO: 1186306 - DNA, 20 bp, Homo sapiens
cccaacggggtggggagggt

SEQ ID NO: 1186307 - DNA, 15 bp, Homo sapiens
cccaacgtcccctcc

SEQ ID NO: 1186308 - DNA, 23 bp, Homo sapiens
cccaacgtcccctccgccgtgcc

SEQ ID NO: 1186309 - DNA, 20 bp, Homo sapiens
cccaactccaccagatagca

SEQ ID NO: 1186310 - DNA, 16 bp, Homo sapiens
cccaactccaggggca

SEQ ID NO: 1186311 - DNA, 12 bp, Homo sapiens
cccaactcctgg

SEQ ID NO: 1186312 - DNA, 17 bp, Homo sapiens
cccaactcgcctgtgga

SEQ ID NO: 1186313 - DNA, 16 bp, Homo sapiens
cccaactcgggctccc

SEQ ID NO: 1186314 - DNA, 15 bp, Homo sapiens
cccaactctagctgg

SEQ ID NO: 1186315 - DNA, 12 bp, Homo sapiens
cccaactctccc

SEQ ID NO: 1186316 - DNA, 19 bp, Homo sapiens
cccaactctccccagtgcc

SEQ ID NO: 1186317 - DNA, 22 bp, Homo sapiens
cccaactctccccagtgcctgc

SEQ ID NO: 1186318 - DNA, 15 bp, Homo sapiens
cccaactctcccctg

SEQ ID NO: 1186319 - DNA, 14 bp, Homo sapiens
cccaactctgagcc

SEQ ID NO: 1186320 - DNA, 16 bp, Homo sapiens
cccaactctgagccca

SEQ ID NO: 1186321 - DNA, 19 bp, Homo sapiens
cccaactcttcctcccctc

SEQ ID NO: 1186322 - DNA, 17 bp, Homo sapiens
cccaactgtgagcaagg

SEQ ID NO: 1186323 - DNA, 12 bp, Homo sapiens
cccaacttgcca

SEQ ID NO: 1186324 - DNA, 19 bp, Homo sapiens
cccaacttgccaaaatgtt

SEQ ID NO: 1186325 - DNA, 22 bp, Homo sapiens
cccaacttggcagctttttctg

SEQ ID NO: 1186326 - DNA, 18 bp, Homo sapiens
cccaagacagatgcccca

SEQ ID NO: 1186327 - DNA, 20 bp, Homo sapiens
cccaagacttcattgtccct

SEQ ID NO: 1186328 - DNA, 21 bp, Homo sapiens
cccaagagaaggggaagcact

SEQ ID NO: 1186329 - DNA, 16 bp, Homo sapiens
cccaagagaggaagga

SEQ ID NO: 1186330 - DNA, 17 bp, Homo sapiens
cccaagagaggaaggac

SEQ ID NO: 1186331 - DNA, 22 bp, Homo sapiens
cccaagagaggaaggacccctc

SEQ ID NO: 1186332 - DNA, 17 bp, Homo sapiens
cccaagagcagagtctg

SEQ ID NO: 1186333 - DNA, 16 bp, Homo sapiens
cccaagagccataagg

SEQ ID NO: 1186334 - DNA, 14 bp, Homo sapiens
cccaagaggtctga

SEQ ID NO: 1186335 - DNA, 17 bp, Homo sapiens
cccaagaggtctgagcc

SEQ ID NO: 1186336 - DNA, 22 bp, Homo sapiens
cccaagaggtctgagccctggt

SEQ ID NO: 1186337 - DNA, 20 bp, Homo sapiens
cccaagattcacacctgact

SEQ ID NO: 1186338 - DNA, 17 bp, Homo sapiens
cccaagattgagctctc

SEQ ID NO: 1186339 - DNA, 21 bp, Homo sapiens
cccaagattgagctctctgcc

SEQ ID NO: 1186340 - DNA, 19 bp, Homo sapiens
cccaagcagccgcagcgca

SEQ ID NO: 1186341 - DNA, 16 bp, Homo sapiens
cccaagccagaggctg

SEQ ID NO: 1186342 - DNA, 13 bp, Homo sapiens
cccaagccccatc

SEQ ID NO: 1186343 - DNA, 14 bp, Homo sapiens
cccaagccccatct

SEQ ID NO: 1186344 - DNA, 15 bp, Homo sapiens
cccaagccccatctc

SEQ ID NO: 1186345 - DNA, 12 bp, Homo sapiens
cccaagcctgat

SEQ ID NO: 1186346 - DNA, 19 bp, Homo sapiens
cccaagcctgatccagcct

SEQ ID NO: 1186347 - DNA, 15 bp, Homo sapiens
cccaagcctgctggc

SEQ ID NO: 1186348 - DNA, 16 bp, Homo sapiens
cccaagcctggcaagg

SEQ ID NO: 1186349 - DNA, 16 bp, Homo sapiens
cccaagcgttcctggc

SEQ ID NO: 1186350 - DNA, 18 bp, Homo sapiens
cccaagcgttcctggcct

SEQ ID NO: 1186351 - DNA, 20 bp, Homo sapiens
cccaagcgttcctggccttc

SEQ ID NO: 1186352 - DNA, 14 bp, Homo sapiens
cccaagctcctcct

SEQ ID NO: 1186353 - DNA, 14 bp, Homo sapiens
cccaagctggtctt

SEQ ID NO: 1186354 - DNA, 13 bp, Homo sapiens
cccaagctgtggc

SEQ ID NO: 1186355 - DNA, 16 bp, Homo sapiens
cccaagctgtggcagc

SEQ ID NO: 1186356 - DNA, 19 bp, Homo sapiens
cccaagctgttttcttcta

SEQ ID NO: 1186357 - DNA, 14 bp, Homo sapiens
cccaagcttggcag

SEQ ID NO: 1186358 - DNA, 16 bp, Homo sapiens
atctctctggcttctg

SEQ ID NO: 1186359 - DNA, 19 bp, Homo sapiens
atctctctggcttctgaag

SEQ ID NO: 1186360 - DNA, 13 bp, Homo sapiens
atctctctggggc

SEQ ID NO: 1186361 - DNA, 20 bp, Homo sapiens
atctctctggggccctgggc

SEQ ID NO: 1186362 - DNA, 22 bp, Homo sapiens
atctctctggggccctgggcct

SEQ ID NO: 1186363 - DNA, 13 bp, Homo sapiens
atctctgaagcat

SEQ ID NO: 1186364 - DNA, 16 bp, Homo sapiens
atctctgaagcatgtt

SEQ ID NO: 1186365 - DNA, 19 bp, Homo sapiens
atctctgaagcatgtttca

SEQ ID NO: 1186366 - DNA, 14 bp, Homo sapiens
atctctgacctctg

SEQ ID NO: 1186367 - DNA, 16 bp, Homo sapiens
atctctgacctctgct

SEQ ID NO: 1186368 - DNA, 20 bp, Homo sapiens
atctctgacctctgctgagt

SEQ ID NO: 1186369 - DNA, 23 bp, Homo sapiens
atctctgactttctttagtcttt

SEQ ID NO: 1186370 - DNA, 16 bp, Homo sapiens
atctctgagtggagga

SEQ ID NO: 1186371 - DNA, 15 bp, Homo sapiens
atctctgccgtctct

SEQ ID NO: 1186372 - DNA, 12 bp, Homo sapiens
atctctgcctct

SEQ ID NO: 1186373 - DNA, 16 bp, Homo sapiens
atctctggaaaaataa

SEQ ID NO: 1186374 - DNA, 18 bp, Homo sapiens
atctctggaaggggcagc

SEQ ID NO: 1186375 - DNA, 21 bp, Homo sapiens
atctctggaaggggcagccct

SEQ ID NO: 1186376 - DNA, 16 bp, Homo sapiens
atctctggagccagag

SEQ ID NO: 1186377 - DNA, 22 bp, Homo sapiens
atctctggtgcctaaaaaccca

SEQ ID NO: 1186378 - DNA, 20 bp, Homo sapiens
atctctgtcccattccctgg

SEQ ID NO: 1186379 - DNA, 17 bp, Homo sapiens
atctctgtgtgcacaaa

SEQ ID NO: 1186380 - DNA, 22 bp, Homo sapiens
atctctgttctgtttggcactt

SEQ ID NO: 1186381 - DNA, 20 bp, Homo sapiens
atctcttaatattgagaatc

SEQ ID NO: 1186382 - DNA, 15 bp, Homo sapiens
atctcttagaagcca

SEQ ID NO: 1186383 - DNA, 19 bp, Homo sapiens
atctcttagaagccatggg

SEQ ID NO: 1186384 - DNA, 20 bp, Homo sapiens
atctcttatcttacgaaaaa

SEQ ID NO: 1186385 - DNA, 20 bp, Homo sapiens
atctcttcattattctctgc

SEQ ID NO: 1186386 - DNA, 19 bp, Homo sapiens
atctcttctgggttccttc

SEQ ID NO: 1186387 - DNA, 17 bp, Homo sapiens
atctcttcttatacaga

SEQ ID NO: 1186388 - DNA, 20 bp, Homo sapiens
atctcttcttttggcttcca

SEQ ID NO: 1186389 - DNA, 18 bp, Homo sapiens
atctcttgattataaatg

SEQ ID NO: 1186390 - DNA, 15 bp, Homo sapiens
atctcttgcccttcc

SEQ ID NO: 1186391 - DNA, 16 bp, Homo sapiens
atctcttgcccttcct

SEQ ID NO: 1186392 - DNA, 20 bp, Homo sapiens
atctcttgggagtcttgggt

SEQ ID NO: 1186393 - DNA, 21 bp, Homo sapiens
atctcttgggagtcttgggtg

SEQ ID NO: 1186394 - DNA, 23 bp, Homo sapiens
atctcttgggagtcttgggtggc

SEQ ID NO: 1186395 - DNA, 19 bp, Homo sapiens
atctctttcacattgtttg

SEQ ID NO: 1186396 - DNA, 12 bp, Homo sapiens
atctctttccct

SEQ ID NO: 1186397 - DNA, 22 bp, Homo sapiens
atctctttctaaagacaggaga

SEQ ID NO: 1186398 - DNA, 17 bp, Homo sapiens
atctctttgatctactt

SEQ ID NO: 1186399 - DNA, 20 bp, Homo sapiens
atctctttggttcctgtata

SEQ ID NO: 1186400 - DNA, 19 bp, Homo sapiens
atctcttttatatttgtag

SEQ ID NO: 1186401 - DNA, 20 bp, Homo sapiens
atctcttttatatttgtagg

SEQ ID NO: 1186402 - DNA, 10 bp, Homo sapiens
atctcttttc

SEQ ID NO: 1186403 - DNA, 22 bp, Homo sapiens
atctctttttatttaaatgtga

SEQ ID NO: 1186404 - DNA, 19 bp, Homo sapiens
atctgaaaaatacttttgg

SEQ ID NO: 1186405 - DNA, 16 bp, Homo sapiens
atctgaaaatgtatgt

SEQ ID NO: 1186406 - DNA, 16 bp, Homo sapiens
atctgaaagtatattt

SEQ ID NO: 1186407 - DNA, 16 bp, Homo sapiens
atctgaagaaagttat

SEQ ID NO: 1186408 - DNA, 15 bp, Homo sapiens
atctgaattcctgta

SEQ ID NO: 1186409 - DNA, 18 bp, Homo sapiens
atctgaatttttaaacaa

SEQ ID NO: 1186410 - DNA, 13 bp, Homo sapiens
atctgacacaaaa

SEQ ID NO: 1186411 - DNA, 16 bp, Homo sapiens
atctgacagcaggcca

SEQ ID NO: 1186412 - DNA, 16 bp, Homo sapiens
atctgaccagcagcgc

SEQ ID NO: 1186413 - DNA, 23 bp, Homo sapiens
atctgagaaacctgttgaagatt

SEQ ID NO: 1186414 - DNA, 20 bp, Homo sapiens
atctgagaacacgttgccag

SEQ ID NO: 1186415 - DNA, 14 bp, Homo sapiens
cccacaacacgcct

SEQ ID NO: 1186416 - DNA, 19 bp, Homo sapiens
cccacaacccaaaaggttt

SEQ ID NO: 1186417 - DNA, 18 bp, Homo sapiens
cccacaaggaaccctcag

SEQ ID NO: 1186418 - DNA, 16 bp, Homo sapiens
cccacaagtggtggta

SEQ ID NO: 1186419 - DNA, 13 bp, Homo sapiens
cccacacacagat

SEQ ID NO: 1186420 - DNA, 15 bp, Homo sapiens
cccacacacaggcct

SEQ ID NO: 1186421 - DNA, 19 bp, Homo sapiens
cccacacacaggccttctg

SEQ ID NO: 1186422 - DNA, 13 bp, Homo sapiens
cccacacactcgc

SEQ ID NO: 1186423 - DNA, 22 bp, Homo sapiens
cccacacacttagccattgaaa

SEQ ID NO: 1186424 - DNA, 15 bp, Homo sapiens
cccacacagcctcta

SEQ ID NO: 1186425 - DNA, 14 bp, Homo sapiens
cccacacagctgcc

SEQ ID NO: 1186426 - DNA, 22 bp, Homo sapiens
cccacacagctgccctagctga

SEQ ID NO: 1186427 - DNA, 12 bp, Homo sapiens
cccacacagggc

SEQ ID NO: 1186428 - DNA, 15 bp, Homo sapiens
cccacacagggcact

SEQ ID NO: 1186429 - DNA, 16 bp, Homo sapiens
cccacacattccaggg

SEQ ID NO: 1186430 - DNA, 18 bp, Homo sapiens
cccacacattccagggct

SEQ ID NO: 1186431 - DNA, 19 bp, Homo sapiens
cccacacattccagggctg

SEQ ID NO: 1186432 - DNA, 16 bp, Homo sapiens
cccacaccccagccca

SEQ ID NO: 1186433 - DNA, 12 bp, Homo sapiens
cccacaccctgg

SEQ ID NO: 1186434 - DNA, 17 bp, Homo sapiens
cccacaccgtcttcctt

SEQ ID NO: 1186435 - DNA, 19 bp, Homo sapiens
cccacaccgtcttccttca

SEQ ID NO: 1186436 - DNA, 15 bp, Homo sapiens
cccacaccgtgtaaa

SEQ ID NO: 1186437 - DNA, 18 bp, Homo sapiens
cccacacctcctctcact

SEQ ID NO: 1186438 - DNA, 14 bp, Homo sapiens
cccacacggcagcc

SEQ ID NO: 1186439 - DNA, 17 bp, Homo sapiens
cccacactgaaaccaaa

SEQ ID NO: 1186440 - DNA, 17 bp, Homo sapiens
cccacacttgtgccagc

SEQ ID NO: 1186441 - DNA, 17 bp, Homo sapiens
cccacacttgttccagc

SEQ ID NO: 1186442 - DNA, 13 bp, Homo sapiens
cccacagaacctt

SEQ ID NO: 1186443 - DNA, 17 bp, Homo sapiens
cccacagacctgcagtg

SEQ ID NO: 1186444 - DNA, 23 bp, Homo sapiens
cccacagactcaaatgctcagac

SEQ ID NO: 1186445 - DNA, 18 bp, Homo sapiens
cccacagactccggcctg

SEQ ID NO: 1186446 - DNA, 20 bp, Homo sapiens
cccacagactgccccagcca

SEQ ID NO: 1186447 - DNA, 13 bp, Homo sapiens
cccacagagcctg

SEQ ID NO: 1186448 - DNA, 16 bp, Homo sapiens
cccacagagcctgaat

SEQ ID NO: 1186449 - DNA, 17 bp, Homo sapiens
cccacagagcctggctt

SEQ ID NO: 1186450 - DNA, 18 bp, Homo sapiens
cccacagagtgctggact

SEQ ID NO: 1186451 - DNA, 19 bp, Homo sapiens
cccacagcgagcctgtgcc

SEQ ID NO: 1186452 - DNA, 18 bp, Homo sapiens
cccacagctacctgagac

SEQ ID NO: 1186453 - DNA, 12 bp, Homo sapiens
cccacagctctg

SEQ ID NO: 1186454 - DNA, 18 bp, Homo sapiens
cccacagcttcctgaggg

SEQ ID NO: 1186455 - DNA, 20 bp, Homo sapiens
cccacaggaagcctgcagtc

SEQ ID NO: 1186456 - DNA, 17 bp, Homo sapiens
cccacaggagggccagc

SEQ ID NO: 1186457 - DNA, 22 bp, Homo sapiens
cccacaggagttgtgagccctc

SEQ ID NO: 1186458 - DNA, 12 bp, Homo sapiens
cccacaggcctg

SEQ ID NO: 1186459 - DNA, 14 bp, Homo sapiens
cccacaggtgaggg

SEQ ID NO: 1186460 - DNA, 21 bp, Homo sapiens
cccacagtgagaggggagggc

SEQ ID NO: 1186461 - DNA, 19 bp, Homo sapiens
cccacatagtgatggttcc

SEQ ID NO: 1186462 - DNA, 13 bp, Homo sapiens
cccacatcccagg

SEQ ID NO: 1186463 - DNA, 14 bp, Homo sapiens
cccacatcccaggc

SEQ ID NO: 1186464 - DNA, 20 bp, Homo sapiens
cccacatcccaggcttcacc

SEQ ID NO: 1186465 - DNA, 16 bp, Homo sapiens
cccacatctttcctca

SEQ ID NO: 1186466 - DNA, 18 bp, Homo sapiens
cccacatgaggacatgat

SEQ ID NO: 1186467 - DNA, 14 bp, Homo sapiens
cccacatgaggcca

SEQ ID NO: 1186468 - DNA, 13 bp, Homo sapiens
cccacatgcctgc

SEQ ID NO: 1186469 - DNA, 18 bp, Homo sapiens
cccacatgcctgcgcctg

SEQ ID NO: 1186470 - DNA, 14 bp, Homo sapiens
cccacattaaagaa

SEQ ID NO: 1186471 - DNA, 16 bp, Homo sapiens
cccacattctatagcc

SEQ ID NO: 1186472 - DNA, 18 bp, Homo sapiens
cccacattctgatgagca

SEQ ID NO: 1186473 - DNA, 13 bp, Homo sapiens
cccacatttgatg

SEQ ID NO: 1186474 - DNA, 19 bp, Homo sapiens
cccacatttgggctcaggg

SEQ ID NO: 1186475 - DNA, 20 bp, Homo sapiens
cccacatttgggctcagggt

SEQ ID NO: 1186476 - DNA, 21 bp, Homo sapiens
cccaccaacatcccattgccc

SEQ ID NO: 1186477 - DNA, 15 bp, Homo sapiens
cccaccaacctccag

SEQ ID NO: 1186478 - DNA, 15 bp, Homo sapiens
cccaccaactctgca

SEQ ID NO: 1186479 - DNA, 17 bp, Homo sapiens
cccaccaactctgcact

SEQ ID NO: 1186480 - DNA, 23 bp, Homo sapiens
cccacctggggtctctctcccta

SEQ ID NO: 1186481 - DNA, 17 bp, Homo sapiens
cccacctgtttctggaa

SEQ ID NO: 1186482 - DNA, 19 bp, Homo sapiens
cccaccttcaattcctggg

SEQ ID NO: 1186483 - DNA, 20 bp, Homo sapiens
cccaccttcaattcctgggc

SEQ ID NO: 1186484 - DNA, 22 bp, Homo sapiens
cccaccttcaattcctgggccc

SEQ ID NO: 1186485 - DNA, 15 bp, Homo sapiens
cccaccttccccaga

SEQ ID NO: 1186486 - DNA, 22 bp, Homo sapiens
cccaccttgccagggcagggtc

SEQ ID NO: 1186487 - DNA, 20 bp, Homo sapiens
cccaccttgttggagcctgc

SEQ ID NO: 1186488 - DNA, 15 bp, Homo sapiens
cccacctttcccaga

SEQ ID NO: 1186489 - DNA, 22 bp, Homo sapiens
cccacctttgggatcagcctcc

SEQ ID NO: 1186490 - DNA, 17 bp, Homo sapiens
cccacgaaactgccctg

SEQ ID NO: 1186491 - DNA, 16 bp, Homo sapiens
cccacgacccctgcct

SEQ ID NO: 1186492 - DNA, 23 bp, Homo sapiens
cccacgacccctgcctcgagggc

SEQ ID NO: 1186493 - DNA, 17 bp, Homo sapiens
cccacgaggagcagcag

SEQ ID NO: 1186494 - DNA, 15 bp, Homo sapiens
cccacgagggctggc

SEQ ID NO: 1186495 - DNA, 15 bp, Homo sapiens
cccacgagtcacctg

SEQ ID NO: 1186496 - DNA, 19 bp, Homo sapiens
cccacgagtcacctgcaag

SEQ ID NO: 1186497 - DNA, 22 bp, Homo sapiens
cccacgattttctccagctcag

SEQ ID NO: 1186498 - DNA, 22 bp, Homo sapiens
cccacgcctgtcctcctggaag

SEQ ID NO: 1186499 - DNA, 16 bp, Homo sapiens
cccacgctcctgccct

SEQ ID NO: 1186500 - DNA, 24 bp, Homo sapiens
cccacgctgaccatgcgtcagggg

SEQ ID NO: 1186501 - DNA, 13 bp, Homo sapiens
cccacggagacag

SEQ ID NO: 1186502 - DNA, 14 bp, Homo sapiens
cccacggagacaga

SEQ ID NO: 1186503 - DNA, 19 bp, Homo sapiens
cccacggggcctcgggacc

SEQ ID NO: 1186504 - DNA, 21 bp, Homo sapiens
cccacgtagggggctctgggc

SEQ ID NO: 1186505 - DNA, 20 bp, Homo sapiens
cccacgtgagagaatctgcc

SEQ ID NO: 1186506 - DNA, 17 bp, Homo sapiens
cccacgttctcacaccc

SEQ ID NO: 1186507 - DNA, 14 bp, Homo sapiens
cccactagagggcc

SEQ ID NO: 1186508 - DNA, 18 bp, Homo sapiens
cccactagagggcccatc

SEQ ID NO: 1186509 - DNA, 17 bp, Homo sapiens
cccactatcctcactcc

SEQ ID NO: 1186510 - DNA, 18 bp, Homo sapiens
cccactatccttcgtgaa

SEQ ID NO: 1186511 - DNA, 14 bp, Homo sapiens
cccactcaccagcc

SEQ ID NO: 1186512 - DNA, 15 bp, Homo sapiens
cccactcaccagccc

SEQ ID NO: 1186513 - DNA, 16 bp, Homo sapiens
cccactcaggattggg

SEQ ID NO: 1186514 - DNA, 17 bp, Homo sapiens
cccactcagtgcctcca

SEQ ID NO: 1186515 - DNA, 19 bp, Homo sapiens
cccactccaccctgttagt

SEQ ID NO: 1186516 - DNA, 15 bp, Homo sapiens
cccactccagtccac

SEQ ID NO: 1186517 - DNA, 12 bp, Homo sapiens
cccactcccaca

SEQ ID NO: 1186518 - DNA, 16 bp, Homo sapiens
cccactcccccaccca

SEQ ID NO: 1186519 - DNA, 13 bp, Homo sapiens
cccactcccctca

SEQ ID NO: 1186520 - DNA, 15 bp, Homo sapiens
cccactcccctcaca

SEQ ID NO: 1186521 - DNA, 13 bp, Homo sapiens
cccactcccgaaa

SEQ ID NO: 1186522 - DNA, 15 bp, Homo sapiens
cccactccctggcca

SEQ ID NO: 1186523 - DNA, 21 bp, Homo sapiens
cccactctaggggtcaggctc

SEQ ID NO: 1186524 - DNA, 11 bp, Homo sapiens
cccactctccc

SEQ ID NO: 1186525 - DNA, 14 bp, Homo sapiens
cccactctccccac

SEQ ID NO: 1186526 - DNA, 17 bp, Homo sapiens
cccactctctcacccac

SEQ ID NO: 1186527 - DNA, 19 bp, Homo sapiens
cccactctgcggcccgggc

SEQ ID NO: 1186528 - DNA, 12 bp, Homo sapiens
cccactctggtg

SEQ ID NO: 1186529 - DNA, 21 bp, Homo sapiens
cccactctggtggccacttca

SEQ ID NO: 1186530 - DNA, 21 bp, Homo sapiens
cccactctgtaatagttcagt

SEQ ID NO: 1186531 - DNA, 21 bp, Homo sapiens
cccactgaattgacatgaccc

SEQ ID NO: 1186532 - DNA, 22 bp, Homo sapiens
cccactgatctctactaccaca

SEQ ID NO: 1186533 - DNA, 19 bp, Homo sapiens
cccactgcaacttgtgaac

SEQ ID NO: 1186534 - DNA, 18 bp, Homo sapiens
cccactgcaatcctgtct

SEQ ID NO: 1186535 - DNA, 13 bp, Homo sapiens
cccactgccagca

SEQ ID NO: 1186536 - DNA, 15 bp, Homo sapiens
cccactgccagcagc

SEQ ID NO: 1186537 - DNA, 12 bp, Homo sapiens
cccactgcccac

SEQ ID NO: 1186538 - DNA, 16 bp, Homo sapiens
cccactgcccaccccc

SEQ ID NO: 1186539 - DNA, 17 bp, Homo sapiens
cccactgcccaccccct

SEQ ID NO: 1186540 - DNA, 20 bp, Homo sapiens
cccactgcctcctgcctggg

SEQ ID NO: 1186541 - DNA, 13 bp, Homo sapiens
cccactgcctgcc

SEQ ID NO: 1186542 - DNA, 14 bp, Homo sapiens
cccactgcctgccc

SEQ ID NO: 1186543 - DNA, 21 bp, Homo sapiens
cccactgctaaggctgctggc

SEQ ID NO: 1186544 - DNA, 13 bp, Homo sapiens
cccactgctgagc

SEQ ID NO: 1186545 - DNA, 15 bp, Homo sapiens
cccactggacaacac

SEQ ID NO: 1186546 - DNA, 17 bp, Homo sapiens
cccactggacaacactg

SEQ ID NO: 1186547 - DNA, 16 bp, Homo sapiens
cccactggactcacct

SEQ ID NO: 1186548 - DNA, 13 bp, Homo sapiens
cccactggccgct

SEQ ID NO: 1186549 - DNA, 17 bp, Homo sapiens
cccactggccgctgagc

SEQ ID NO: 1186550 - DNA, 20 bp, Homo sapiens
cccactgggactcccagcag

SEQ ID NO: 1186551 - DNA, 13 bp, Homo sapiens
cccactgggccag

SEQ ID NO: 1186552 - DNA, 21 bp, Homo sapiens
cccactggggtccagggagca

SEQ ID NO: 1186553 - DNA, 17 bp, Homo sapiens
cccactgtatgatttat

SEQ ID NO: 1186554 - DNA, 14 bp, Homo sapiens
cccactgtcctggg

SEQ ID NO: 1186555 - DNA, 15 bp, Homo sapiens
cccactgtcctgggc

SEQ ID NO: 1186556 - DNA, 17 bp, Homo sapiens
cccactgtcctgggcgc

SEQ ID NO: 1186557 - DNA, 18 bp, Homo sapiens
cccactgtcctgggcgcc

SEQ ID NO: 1186558 - DNA, 22 bp, Homo sapiens
cccactgtcctgggcgccctgg

SEQ ID NO: 1186559 - DNA, 15 bp, Homo sapiens
cccactgtgcctcag

SEQ ID NO: 1186560 - DNA, 21 bp, Homo sapiens
cccactgtttctcttgagctg

SEQ ID NO: 1186561 - DNA, 23 bp, Homo sapiens
cccactgtttctcttgagctggc

SEQ ID NO: 1186562 - DNA, 14 bp, Homo sapiens
cccacttagccgca

SEQ ID NO: 1186563 - DNA, 16 bp, Homo sapiens
cccacttagccgcacc

SEQ ID NO: 1186564 - DNA, 23 bp, Homo sapiens
cccacttagccgtccatggcacc

SEQ ID NO: 1186565 - DNA, 19 bp, Homo sapiens
cccacttatgctgctgtga

SEQ ID NO: 1186566 - DNA, 20 bp, Homo sapiens
cccacttatgctgctgtgaa

SEQ ID NO: 1186567 - DNA, 13 bp, Homo sapiens
cccacttcctttc

SEQ ID NO: 1186568 - DNA, 14 bp, Homo sapiens
cccacttcctttcc

SEQ ID NO: 1186569 - DNA, 17 bp, Homo sapiens
cccacttctggccacat

SEQ ID NO: 1186570 - DNA, 22 bp, Homo sapiens
cccacttctggccacatcagcc

SEQ ID NO: 1186571 - DNA, 16 bp, Homo sapiens
cccacttctgtgccac

SEQ ID NO: 1186572 - DNA, 17 bp, Homo sapiens
cccacttgattgagaaa

SEQ ID NO: 1186573 - DNA, 18 bp, Homo sapiens
cccacttgattgagaaag

SEQ ID NO: 1186574 - DNA, 20 bp, Homo sapiens
cccacttgattgagaaagat

SEQ ID NO: 1186575 - DNA, 16 bp, Homo sapiens
cccacttgcagtcttg

SEQ ID NO: 1186576 - DNA, 13 bp, Homo sapiens
cccacttgcctct

SEQ ID NO: 1186577 - DNA, 15 bp, Homo sapiens
cccacttgcctcttc

SEQ ID NO: 1186578 - DNA, 12 bp, Homo sapiens
cccacttggggc

SEQ ID NO: 1186579 - DNA, 13 bp, Homo sapiens
cccacttggggcc

SEQ ID NO: 1186580 - DNA, 15 bp, Homo sapiens
cccactttggcttat

SEQ ID NO: 1186581 - DNA, 18 bp, Homo sapiens
cccactttgtctgtacat

SEQ ID NO: 1186582 - DNA, 21 bp, Homo sapiens
cccactttgtctgtacatact

SEQ ID NO: 1186583 - DNA, 20 bp, Homo sapiens
cccagaaaaaaaaaaactta

SEQ ID NO: 1186584 - DNA, 14 bp, Homo sapiens
cccagaaaaactgg

SEQ ID NO: 1186585 - DNA, 23 bp, Homo sapiens
cccagaaaaactggctctgattg

SEQ ID NO: 1186586 - DNA, 17 bp, Homo sapiens
cccagaaacatctctgg

SEQ ID NO: 1186587 - DNA, 21 bp, Homo sapiens
cccagaaagcctctctctccc

SEQ ID NO: 1186588 - DNA, 15 bp, Homo sapiens
cccagaaagctgcca

SEQ ID NO: 1186589 - DNA, 13 bp, Homo sapiens
cccagaaatcact

SEQ ID NO: 1186590 - DNA, 16 bp, Homo sapiens
cccagaaatcactgtg

SEQ ID NO: 1186591 - DNA, 20 bp, Homo sapiens
cccagaaatcactgtgaaat

SEQ ID NO: 1186592 - DNA, 18 bp, Homo sapiens
cccagaacaaaaagaaat

SEQ ID NO: 1186593 - DNA, 23 bp, Homo sapiens
cccagaacaaaaagaaatcttgt

SEQ ID NO: 1186594 - DNA, 15 bp, Homo sapiens
cccagaactgccccc

SEQ ID NO: 1186595 - DNA, 18 bp, Homo sapiens
cccagaactgcccccact

SEQ ID NO: 1186596 - DNA, 19 bp, Homo sapiens
cccagaactgcccccactg

SEQ ID NO: 1186597 - DNA, 21 bp, Homo sapiens
cccagaactggctgggcccct

SEQ ID NO: 1186598 - DNA, 23 bp, Homo sapiens
cccagaactggctgggcccctgg

SEQ ID NO: 1186599 - DNA, 19 bp, Homo sapiens
cccagaacttccctgattg

SEQ ID NO: 1186600 - DNA, 23 bp, Homo sapiens
cccagaaggcagggaaaggctct

SEQ ID NO: 1186601 - DNA, 19 bp, Homo sapiens
cccagaataagttattgca

SEQ ID NO: 1186602 - DNA, 15 bp, Homo sapiens
cccagcaggtgggga

SEQ ID NO: 1186603 - DNA, 16 bp, Homo sapiens
cccagcaggtggggag

SEQ ID NO: 1186604 - DNA, 19 bp, Homo sapiens
cccagcaggtggggagggg

SEQ ID NO: 1186605 - DNA, 21 bp, Homo sapiens
cccagcagtgtggagaccctg

SEQ ID NO: 1186606 - DNA, 15 bp, Homo sapiens
cccagcatccctgga

SEQ ID NO: 1186607 - DNA, 20 bp, Homo sapiens
cccagcatccctggagcagg

SEQ ID NO: 1186608 - DNA, 20 bp, Homo sapiens
cccagcatcgggggcctgca

SEQ ID NO: 1186609 - DNA, 22 bp, Homo sapiens
cccagcatcgggggcctgcaaa

SEQ ID NO: 1186610 - DNA, 12 bp, Homo sapiens
cccagcatctcc

SEQ ID NO: 1186611 - DNA, 15 bp, Homo sapiens
cccagcatctcccag

SEQ ID NO: 1186612 - DNA, 17 bp, Homo sapiens
cccagcatctcccagca

SEQ ID NO: 1186613 - DNA, 19 bp, Homo sapiens
cccagcatctcccagcaag

SEQ ID NO: 1186614 - DNA, 15 bp, Homo sapiens
cccagcatgcaggtg

SEQ ID NO: 1186615 - DNA, 17 bp, Homo sapiens
cccagcattccagctct

SEQ ID NO: 1186616 - DNA, 19 bp, Homo sapiens
cccagcattccagctctgc

SEQ ID NO: 1186617 - DNA, 18 bp, Homo sapiens
cccagcattgcagtatgg

SEQ ID NO: 1186618 - DNA, 18 bp, Homo sapiens
cccagcattgctggttct

SEQ ID NO: 1186619 - DNA, 20 bp, Homo sapiens
cccagcatttccagagcaga

SEQ ID NO: 1186620 - DNA, 23 bp, Homo sapiens
cccagccacagtgttatgctctg

SEQ ID NO: 1186621 - DNA, 12 bp, Homo sapiens
cccagccacccc

SEQ ID NO: 1186622 - DNA, 19 bp, Homo sapiens
cccagccaccccgggctct

SEQ ID NO: 1186623 - DNA, 17 bp, Homo sapiens
cccagccacgactgcca

SEQ ID NO: 1186624 - DNA, 15 bp, Homo sapiens
cccagccactgccaa

SEQ ID NO: 1186625 - DNA, 13 bp, Homo sapiens
cccagccagaaag

SEQ ID NO: 1186626 - DNA, 14 bp, Homo sapiens
cccagccagaaagc

SEQ ID NO: 1186627 - DNA, 21 bp, Homo sapiens
cccagccagccacccctgcca

SEQ ID NO: 1186628 - DNA, 15 bp, Homo sapiens
cccagccagcccttc

SEQ ID NO: 1186629 - DNA, 16 bp, Homo sapiens
cccagccagcccttcc

SEQ ID NO: 1186630 - DNA, 12 bp, Homo sapiens
cccagccagctg

SEQ ID NO: 1186631 - DNA, 18 bp, Homo sapiens
cccagccagctgcagggc

SEQ ID NO: 1186632 - DNA, 22 bp, Homo sapiens
cccagccagctgcagggcacgg

SEQ ID NO: 1186633 - DNA, 15 bp, Homo sapiens
cccagccaggagcag

SEQ ID NO: 1186634 - DNA, 12 bp, Homo sapiens
cccagccaggcc

SEQ ID NO: 1186635 - DNA, 21 bp, Homo sapiens
cccagccaggccccaggcagg

SEQ ID NO: 1186636 - DNA, 12 bp, Homo sapiens
cccagccaggct

SEQ ID NO: 1186637 - DNA, 13 bp, Homo sapiens
cccagccaggcta

SEQ ID NO: 1186638 - DNA, 13 bp, Homo sapiens
cccagccatctgc

SEQ ID NO: 1186639 - DNA, 15 bp, Homo sapiens
cccagccatctgccc

SEQ ID NO: 1186640 - DNA, 20 bp, Homo sapiens
cccagccatctgcccagggg

SEQ ID NO: 1186641 - DNA, 18 bp, Homo sapiens
cccagccattaccatgga

SEQ ID NO: 1186642 - DNA, 13 bp, Homo sapiens
cccagcccaaagg

SEQ ID NO: 1186643 - DNA, 19 bp, Homo sapiens
cccagcccaaaggggacag

SEQ ID NO: 1186644 - DNA, 16 bp, Homo sapiens
cccagcccacagagcc

SEQ ID NO: 1186645 - DNA, 16 bp, Homo sapiens
cccagcccaccctgct

SEQ ID NO: 1186646 - DNA, 15 bp, Homo sapiens
cccagcccacctcaa

SEQ ID NO: 1186647 - DNA, 14 bp, Homo sapiens
cccagcccagagcc

SEQ ID NO: 1186648 - DNA, 19 bp, Homo sapiens
cccagcccagagccacctg

SEQ ID NO: 1186649 - DNA, 13 bp, Homo sapiens
cccagcccagctg

SEQ ID NO: 1186650 - DNA, 16 bp, Homo sapiens
cccagcccagctggtg

SEQ ID NO: 1186651 - DNA, 18 bp, Homo sapiens
cccagcccagctggtggg

SEQ ID NO: 1186652 - DNA, 15 bp, Homo sapiens
cccagcccattgctg

SEQ ID NO: 1186653 - DNA, 18 bp, Homo sapiens
cccagcccattgctgcca

SEQ ID NO: 1186654 - DNA, 14 bp, Homo sapiens
cccagccccaactc

SEQ ID NO: 1186655 - DNA, 16 bp, Homo sapiens
cccagccccagcccct

SEQ ID NO: 1186656 - DNA, 16 bp, Homo sapiens
cccagccccgactcca

SEQ ID NO: 1186657 - DNA, 19 bp, Homo sapiens
cccagccccgactccagcc

SEQ ID NO: 1186658 - DNA, 22 bp, Homo sapiens
cccagccccgactccagccagc

SEQ ID NO: 1186659 - DNA, 23 bp, Homo sapiens
cccagccccgactccagccagcg

SEQ ID NO: 1186660 - DNA, 17 bp, Homo sapiens
cccagccccgctcaggc

SEQ ID NO: 1186661 - DNA, 14 bp, Homo sapiens
cccagcccctagaa

SEQ ID NO: 1186662 - DNA, 19 bp, Homo sapiens
cccagcccctagaaaccca

SEQ ID NO: 1186663 - DNA, 21 bp, Homo sapiens
cccagcccctagaaacccaag

SEQ ID NO: 1186664 - DNA, 14 bp, Homo sapiens
cccagcccctccac

SEQ ID NO: 1186665 - DNA, 22 bp, Homo sapiens
cccagcccctctcccctctctg

SEQ ID NO: 1186666 - DNA, 15 bp, Homo sapiens
cccagccccttctcc

SEQ ID NO: 1186667 - DNA, 20 bp, Homo sapiens
cccagccccttctcccagca

SEQ ID NO: 1186668 - DNA, 23 bp, Homo sapiens
cccagccccttttctctgctctt

SEQ ID NO: 1186669 - DNA, 17 bp, Homo sapiens
cccagccctatggatgt

SEQ ID NO: 1186670 - DNA, 18 bp, Homo sapiens
cccagccctcagtcaccc

SEQ ID NO: 1186671 - DNA, 14 bp, Homo sapiens
cccagccctcatcc

SEQ ID NO: 1186672 - DNA, 15 bp, Homo sapiens
cccagccctcatccc

SEQ ID NO: 1186673 - DNA, 19 bp, Homo sapiens
cccagccctcatcccgagc

SEQ ID NO: 1186674 - DNA, 20 bp, Homo sapiens
cccagccctccccgcagtgg

SEQ ID NO: 1186675 - DNA, 23 bp, Homo sapiens
cccagccctccttatcaaaggac

SEQ ID NO: 1186676 - DNA, 18 bp, Homo sapiens
cccagccctccttcaggg

SEQ ID NO: 1186677 - DNA, 13 bp, Homo sapiens
cctgatgcccctt

SEQ ID NO: 1186678 - DNA, 13 bp, Homo sapiens
cctgatgctgaca

SEQ ID NO: 1186679 - DNA, 13 bp, Homo sapiens
cctgatgctgccc

SEQ ID NO: 1186680 - DNA, 16 bp, Homo sapiens
cctgatgctgccccgt

SEQ ID NO: 1186681 - DNA, 22 bp, Homo sapiens
cctgatgctgccccgttccctg

SEQ ID NO: 1186682 - DNA, 21 bp, Homo sapiens
cctgatggaagtaaagcctca

SEQ ID NO: 1186683 - DNA, 16 bp, Homo sapiens
cctgatggaccctcag

SEQ ID NO: 1186684 - DNA, 16 bp, Homo sapiens
cctgatggccaagagc

SEQ ID NO: 1186685 - DNA, 11 bp, Homo sapiens
cctgatggccc

SEQ ID NO: 1186686 - DNA, 18 bp, Homo sapiens
cctgatggcctttggacc

SEQ ID NO: 1186687 - DNA, 20 bp, Homo sapiens
cctgatggtcagctcccttc

SEQ ID NO: 1186688 - DNA, 21 bp, Homo sapiens
cctgatggtcagctcccttct

SEQ ID NO: 1186689 - DNA, 19 bp, Homo sapiens
cctgatggtgctgctcagg

SEQ ID NO: 1186690 - DNA, 22 bp, Homo sapiens
cctgatggtgctgctcaggccc

SEQ ID NO: 1186691 - DNA, 20 bp, Homo sapiens
cctgatggtgtcattctgcc

SEQ ID NO: 1186692 - DNA, 23 bp, Homo sapiens
cctgatggtgtcattctgcctgc

SEQ ID NO: 1186693 - DNA, 13 bp, Homo sapiens
cctgatgtagctt

SEQ ID NO: 1186694 - DNA, 20 bp, Homo sapiens
cctgattaccagtctgatta

SEQ ID NO: 1186695 - DNA, 22 bp, Homo sapiens
cctgattcttgattcctggctc

SEQ ID NO: 1186696 - DNA, 13 bp, Homo sapiens
cctgattgacctg

SEQ ID NO: 1186697 - DNA, 17 bp, Homo sapiens
cctgattgacctgctcc

SEQ ID NO: 1186698 - DNA, 20 bp, Homo sapiens
cctgattgatcacacagtgt

SEQ ID NO: 1186699 - DNA, 21 bp, Homo sapiens
cctgattgatcacacagtgtt

SEQ ID NO: 1186700 - DNA, 15 bp, Homo sapiens
cctgattgtattttt

SEQ ID NO: 1186701 - DNA, 17 bp, Homo sapiens
cctgatttctctgaaca

SEQ ID NO: 1186702 - DNA, 21 bp, Homo sapiens
cctgatttcttattgaatttg

SEQ ID NO: 1186703 - DNA, 18 bp, Homo sapiens
cctgatttggtacttttg

SEQ ID NO: 1186704 - DNA, 15 bp, Homo sapiens
cctgcaaaaaatact

SEQ ID NO: 1186705 - DNA, 12 bp, Homo sapiens
cctgcaaaaaga

SEQ ID NO: 1186706 - DNA, 20 bp, Homo sapiens
cctgcaaaaagaaaaaaaga

SEQ ID NO: 1186707 - DNA, 22 bp, Homo sapiens
caatgaatccccgaccccccta

SEQ ID NO: 1186708 - DNA, 12 bp, Homo sapiens
caatgaatgtat

SEQ ID NO: 1186709 - DNA, 14 bp, Homo sapiens
caatgaatgtatat

SEQ ID NO: 1186710 - DNA, 23 bp, Homo sapiens
caatgacatccagaaagctgagg

SEQ ID NO: 1186711 - DNA, 15 bp, Homo sapiens
caatgactcaaagtc

SEQ ID NO: 1186712 - DNA, 18 bp, Homo sapiens
caatgacttactgtacat

SEQ ID NO: 1186713 - DNA, 17 bp, Homo sapiens
caatgacttttaaagat

SEQ ID NO: 1186714 - DNA, 15 bp, Homo sapiens
caatgagatgcatga

SEQ ID NO: 1186715 - DNA, 12 bp, Homo sapiens
caatgagctgta

SEQ ID NO: 1186716 - DNA, 13 bp, Homo sapiens
caatgagctgtat

SEQ ID NO: 1186717 - DNA, 20 bp, Homo sapiens
caatgatacccaacagttta

SEQ ID NO: 1186718 - DNA, 22 bp, Homo sapiens
caatgatacccaacagtttatt

SEQ ID NO: 1186719 - DNA, 21 bp, Homo sapiens
caatgatcacatctaaagctt

SEQ ID NO: 1186720 - DNA, 14 bp, Homo sapiens
caatgatgaatgag

SEQ ID NO: 1186721 - DNA, 19 bp, Homo sapiens
caatgatgatgataatgat

SEQ ID NO: 1186722 - DNA, 18 bp, Homo sapiens
caatgatgtgaccctcaa

SEQ ID NO: 1186723 - DNA, 22 bp, Homo sapiens
caatgattgttaatttacagct

SEQ ID NO: 1186724 - DNA, 18 bp, Homo sapiens
caatgcacctaaagaaaa

SEQ ID NO: 1186725 - DNA, 15 bp, Homo sapiens
caatgcagtcagtgt

SEQ ID NO: 1186726 - DNA, 19 bp, Homo sapiens
caatgcagtcagtgtttct

SEQ ID NO: 1186727 - DNA, 19 bp, Homo sapiens
caatgcatacaataaaaga

SEQ ID NO: 1186728 - DNA, 18 bp, Homo sapiens
caatgcatgtgctgtctc

SEQ ID NO: 1186729 - DNA, 19 bp, Homo sapiens
caatgcatgtgctgtctcc

SEQ ID NO: 1186730 - DNA, 21 bp, Homo sapiens
caatgccagggcccaggagga

SEQ ID NO: 1186731 - DNA, 19 bp, Homo sapiens
caatgccatcagcccctgg

SEQ ID NO: 1186732 - DNA, 21 bp, Homo sapiens
caatgccatcagcccctggga

SEQ ID NO: 1186733 - DNA, 23 bp, Homo sapiens
caatgccatcagcccctgggaac

SEQ ID NO: 1186734 - DNA, 13 bp, Homo sapiens
caatgccatcatc

SEQ ID NO: 1186735 - DNA, 18 bp, Homo sapiens
caatgccatttcagtggc

SEQ ID NO: 1186736 - DNA, 15 bp, Homo sapiens
caatgccctgccatt

SEQ ID NO: 1186737 - DNA, 19 bp, Homo sapiens
caatgcctcacgagatttg

SEQ ID NO: 1186738 - DNA, 15 bp, Homo sapiens
caatgcctgtgaagc

SEQ ID NO: 1186739 - DNA, 22 bp, Homo sapiens
caatgcctttttagatgtattt

SEQ ID NO: 1186740 - DNA, 17 bp, Homo sapiens
caatgcgacaagtagtt

SEQ ID NO: 1186741 - DNA, 15 bp, Homo sapiens
caatgctctggagtg

SEQ ID NO: 1186742 - DNA, 14 bp, Homo sapiens
caatgctgatttgg

SEQ ID NO: 1186743 - DNA, 13 bp, Homo sapiens
caatgctgggccc

SEQ ID NO: 1186744 - DNA, 14 bp, Homo sapiens
caatgctgggccct

SEQ ID NO: 1186745 - DNA, 22 bp, Homo sapiens
caatgctgtacgtactgcattt

SEQ ID NO: 1186746 - DNA, 17 bp, Homo sapiens
caatgctgttgtaaaca

SEQ ID NO: 1186747 - DNA, 21 bp, Homo sapiens
caatgcttaaactaaataatg

SEQ ID NO: 1186748 - DNA, 17 bp, Homo sapiens
caatgctttatttgtaa

SEQ ID NO: 1186749 - DNA, 20 bp, Homo sapiens
caatgctttatttgtaaatt

SEQ ID NO: 1186750 - DNA, 18 bp, Homo sapiens
caatgctttgggaggcca

SEQ ID NO: 1186751 - DNA, 19 bp, Homo sapiens
caatgctttgggaggccaa

SEQ ID NO: 1186752 - DNA, 22 bp, Homo sapiens
caatgctttgggaggccaaggc

SEQ ID NO: 1186753 - DNA, 19 bp, Homo sapiens
caatggaaaacctggggga

SEQ ID NO: 1186754 - DNA, 20 bp, Homo sapiens
caatggaaaacctgggggat

SEQ ID NO: 1186755 - DNA, 15 bp, Homo sapiens
caatggaaacctcac

SEQ ID NO: 1186756 - DNA, 16 bp, Homo sapiens
caatggaaacctcacg

SEQ ID NO: 1186757 - DNA, 16 bp, Homo sapiens
caatggataaatcagt

SEQ ID NO: 1186758 - DNA, 13 bp, Homo sapiens
caatggatttgat

SEQ ID NO: 1186759 - DNA, 21 bp, Homo sapiens
caatggcagcattcccaccaa

SEQ ID NO: 1186760 - DNA, 20 bp, Homo sapiens
caatggcagctagactggag

SEQ ID NO: 1186761 - DNA, 19 bp, Homo sapiens
caatggccagagcctctgg

SEQ ID NO: 1186762 - DNA, 20 bp, Homo sapiens
caatggccagagcctctggc

SEQ ID NO: 1186763 - DNA, 22 bp, Homo sapiens
caatggccagagcctctggccc

SEQ ID NO: 1186764 - DNA, 16 bp, Homo sapiens
caatggctaattccca

SEQ ID NO: 1186765 - DNA, 18 bp, Homo sapiens
caatggctaattcccaga

SEQ ID NO: 1186766 - DNA, 19 bp, Homo sapiens
caatggctaattcccagag

SEQ ID NO: 1186767 - DNA, 21 bp, Homo sapiens
caatgggaaatactactcctg

SEQ ID NO: 1186768 - DNA, 23 bp, Homo sapiens
caatgggaagcagacaataactt

SEQ ID NO: 1186769 - DNA, 16 bp, Homo sapiens
caatgggaagcaggga

SEQ ID NO: 1186770 - DNA, 15 bp, Homo sapiens
caatgggaccgtgcc

SEQ ID NO: 1186771 - DNA, 19 bp, Homo sapiens
caatgggagctgaggccac

SEQ ID NO: 1186772 - DNA, 18 bp, Homo sapiens
caatgggccgtcccctct

SEQ ID NO: 1186773 - DNA, 17 bp, Homo sapiens
caatgggggagggaggg

SEQ ID NO: 1186774 - DNA, 20 bp, Homo sapiens
caatgggtcttagctctttc

SEQ ID NO: 1186775 - DNA, 14 bp, Homo sapiens
caatgggtggtgaa

SEQ ID NO: 1186776 - DNA, 23 bp, Homo sapiens
caatgggtttttccctgtacagt

SEQ ID NO: 1186777 - DNA, 22 bp, Homo sapiens
caatggtactctaatcagtcct

SEQ ID NO: 1186778 - DNA, 21 bp, Homo sapiens
caatggtgatcctctattttg

SEQ ID NO: 1186779 - DNA, 15 bp, Homo sapiens
caatggtgcaaaaaa

SEQ ID NO: 1186780 - DNA, 21 bp, Homo sapiens
caatggtgcttcccccacccc

SEQ ID NO: 1186781 - DNA, 22 bp, Homo sapiens
caatggtgttgccctgagtgga

SEQ ID NO: 1186782 - DNA, 21 bp, Homo sapiens
caatggttgggacaatggcaa

SEQ ID NO: 1186783 - DNA, 21 bp, Homo sapiens
caatggtttgtgtcaaaactg

SEQ ID NO: 1186784 - DNA, 17 bp, Homo sapiens
caatggtttttaaattt

SEQ ID NO: 1186785 - DNA, 14 bp, Homo sapiens
caatgtaaatattt

SEQ ID NO: 1186786 - DNA, 17 bp, Homo sapiens
caatgtaaatattttaa

SEQ ID NO: 1186787 - DNA, 16 bp, Homo sapiens
caatgtacaattatgt

SEQ ID NO: 1186788 - DNA, 22 bp, Homo sapiens
caatgtacaattatgtctcttg

SEQ ID NO: 1186789 - DNA, 22 bp, Homo sapiens
caatgtacaggaagtagttcta

SEQ ID NO: 1186790 - DNA, 17 bp, Homo sapiens
caatgtataaagattgt

SEQ ID NO: 1186791 - DNA, 18 bp, Homo sapiens
caatgtataaagattgta

SEQ ID NO: 1186792 - DNA, 20 bp, Homo sapiens
caatgtataaagattgtact

SEQ ID NO: 1186793 - DNA, 20 bp, Homo sapiens
caatgtatctttattaaaac

SEQ ID NO: 1186794 - DNA, 22 bp, Homo sapiens
caatgtatgtacaatacaatgt

SEQ ID NO: 1186795 - DNA, 21 bp, Homo sapiens
caatgtcacaacctctctgat

SEQ ID NO: 1186796 - DNA, 14 bp, Homo sapiens
caatgtcacttaaa

SEQ ID NO: 1186797 - DNA, 21 bp, Homo sapiens
caatgtcaggaacagaaggat

SEQ ID NO: 1186798 - DNA, 21 bp, Homo sapiens
caatgtcatatactgccatgt

SEQ ID NO: 1186799 - DNA, 21 bp, Homo sapiens
caatgtcgagtatattattat

SEQ ID NO: 1186800 - DNA, 15 bp, Homo sapiens
caatgtctcccacac

SEQ ID NO: 1186801 - DNA, 16 bp, Homo sapiens
caatgtctcccacacc

SEQ ID NO: 1186802 - DNA, 15 bp, Homo sapiens
caatgtctgagtgaa

SEQ ID NO: 1186803 - DNA, 20 bp, Homo sapiens
caatgtctgagtgaacctgt

SEQ ID NO: 1186804 - DNA, 23 bp, Homo sapiens
caatgtcttaaataaaactattt

SEQ ID NO: 1186805 - DNA, 21 bp, Homo sapiens
caatgtcttgatgcatgcact

SEQ ID NO: 1186806 - DNA, 19 bp, Homo sapiens
caatgtgaaacacatgcca

SEQ ID NO: 1186807 - DNA, 14 bp, Homo sapiens
caatgtgaacttta

SEQ ID NO: 1186808 - DNA, 18 bp, Homo sapiens
caatgtgaactttattaa

SEQ ID NO: 1186809 - DNA, 13 bp, Homo sapiens
caatgtgaccagg

SEQ ID NO: 1186810 - DNA, 23 bp, Homo sapiens
caatgtgactgaaacaaaatgtt

SEQ ID NO: 1186811 - DNA, 15 bp, Homo sapiens
caatgtgataaaacc

SEQ ID NO: 1186812 - DNA, 15 bp, Homo sapiens
caatgtgattctaat

SEQ ID NO: 1186813 - DNA, 15 bp, Homo sapiens
caatgtgattcttct

SEQ ID NO: 1186814 - DNA, 14 bp, Homo sapiens
caatgtgccttgat

SEQ ID NO: 1186815 - DNA, 16 bp, Homo sapiens
caatgtgctactgatt

SEQ ID NO: 1186816 - DNA, 13 bp, Homo sapiens
caatgtgctctcg

SEQ ID NO: 1186817 - DNA, 18 bp, Homo sapiens
caatgtggacgtgcactg

SEQ ID NO: 1186818 - DNA, 22 bp, Homo sapiens
caatgtggacgtgcactgacag

SEQ ID NO: 1186819 - DNA, 24 bp, Homo sapiens
caatgtggacgtgcactgacagcc

SEQ ID NO: 1186820 - DNA, 20 bp, Homo sapiens
caatgtggagcagcagccac

SEQ ID NO: 1186821 - DNA, 23 bp, Homo sapiens
caatgtggcaaggaaaaacaggt

SEQ ID NO: 1186822 - DNA, 18 bp, Homo sapiens
caatgtggtgacacctcc

SEQ ID NO: 1186823 - DNA, 15 bp, Homo sapiens
caatgtgtataaatt

SEQ ID NO: 1186824 - DNA, 16 bp, Homo sapiens
caatgtgtataaattg

SEQ ID NO: 1186825 - DNA, 12 bp, Homo sapiens
caatgttcattg

SEQ ID NO: 1186826 - DNA, 18 bp, Homo sapiens
cggcccagatgtgtcccc

SEQ ID NO: 1186827 - DNA, 20 bp, Homo sapiens
cgggcccacctggccacctg

SEQ ID NO: 1186828 - DNA, 21 bp, Homo sapiens
cgggccccatcctcatccctg

SEQ ID NO: 1186829 - DNA, 22 bp, Homo sapiens
cgggccccatcctcatccctga

SEQ ID NO: 1186830 - DNA, 14 bp, Homo sapiens
cgggcccccctgaa

SEQ ID NO: 1186831 - DNA, 15 bp, Homo sapiens
cgggcccccgccccg

SEQ ID NO: 1186832 - DNA, 19 bp, Homo sapiens
cgggcccctccatccaccc

SEQ ID NO: 1186833 - DNA, 18 bp, Homo sapiens
cgggcccgttgaggatga

SEQ ID NO: 1186834 - DNA, 22 bp, Homo sapiens
cgggcccgttgaggatgaggcc

SEQ ID NO: 1186835 - DNA, 23 bp, Homo sapiens
caattttatgtttttatttatga

SEQ ID NO: 1186836 - DNA, 13 bp, Homo sapiens
caattttgatctt

SEQ ID NO: 1186837 - DNA, 12 bp, Homo sapiens
caattttgtaac

SEQ ID NO: 1186838 - DNA, 12 bp, Homo sapiens
caatttttaata

SEQ ID NO: 1186839 - DNA, 15 bp, Homo sapiens
caatttttaataaat

SEQ ID NO: 1186840 - DNA, 15 bp, Homo sapiens
caatttttcccagta

SEQ ID NO: 1186841 - DNA, 17 bp, Homo sapiens
caatttttcccagtatt

SEQ ID NO: 1186842 - DNA, 18 bp, Homo sapiens
caatttttcccagtattt

SEQ ID NO: 1186843 - DNA, 18 bp, Homo sapiens
caatttttgtctcagaag

SEQ ID NO: 1186844 - DNA, 20 bp, Homo sapiens
caattttttaagtgaaaata

SEQ ID NO: 1186845 - DNA, 17 bp, Homo sapiens
caattttttatttttat

SEQ ID NO: 1186846 - DNA, 23 bp, Homo sapiens
cacaaaaaaatatcagacaagca

SEQ ID NO: 1186847 - DNA, 12 bp, Homo sapiens
cacaaaaacaat

SEQ ID NO: 1186848 - DNA, 14 bp, Homo sapiens
cacaaaaaggagcg

SEQ ID NO: 1186849 - DNA, 19 bp, Homo sapiens
cacaaaaaggcaaatattg

SEQ ID NO: 1186850 - DNA, 22 bp, Homo sapiens
cacaaaaaggcaaatattgaag

SEQ ID NO: 1186851 - DNA, 12 bp, Homo sapiens
cacaaaaatgaa

SEQ ID NO: 1186852 - DNA, 16 bp, Homo sapiens
cacaaaacccagacct

SEQ ID NO: 1186853 - DNA, 20 bp, Homo sapiens
cacaaaactacttttctaaa

SEQ ID NO: 1186854 - DNA, 22 bp, Homo sapiens
cacaaaactccgcccccagcct

SEQ ID NO: 1186855 - DNA, 18 bp, Homo sapiens
cacaaaacttcagtgtgg

SEQ ID NO: 1186856 - DNA, 16 bp, Homo sapiens
cacaaaacttgaaaga

SEQ ID NO: 1186857 - DNA, 18 bp, Homo sapiens
cacaaaagttagctgagc

SEQ ID NO: 1186858 - DNA, 17 bp, Homo sapiens
cacaaaatgataatcaa

SEQ ID NO: 1186859 - DNA, 21 bp, Homo sapiens
cacaaaattagaaaggacaac

SEQ ID NO: 1186860 - DNA, 16 bp, Homo sapiens
cacaaacattgctgcc

SEQ ID NO: 1186861 - DNA, 15 bp, Homo sapiens
cacaaaccatgcaaa

SEQ ID NO: 1186862 - DNA, 13 bp, Homo sapiens
cacaaaccctgct

SEQ ID NO: 1186863 - DNA, 17 bp, Homo sapiens
cacaaaccttctgcctt

SEQ ID NO: 1186864 - DNA, 17 bp, Homo sapiens
cacaaacggagcccctg

SEQ ID NO: 1186865 - DNA, 15 bp, Homo sapiens
cacaaactacctctg

SEQ ID NO: 1186866 - DNA, 12 bp, Homo sapiens
cacaaactgtaa

SEQ ID NO: 1186867 - DNA, 14 bp, Homo sapiens
cacaaactgtaaat

SEQ ID NO: 1186868 - DNA, 15 bp, Homo sapiens
cacaaactgtaaata

SEQ ID NO: 1186869 - DNA, 21 bp, Homo sapiens
cacaaactgtgaaaatagtgt

SEQ ID NO: 1186870 - DNA, 20 bp, Homo sapiens
cacaaagagaaaaagaaatg

SEQ ID NO: 1186871 - DNA, 14 bp, Homo sapiens
cacaaagcaaaggc

SEQ ID NO: 1186872 - DNA, 17 bp, Homo sapiens
cacaaagcaaaggcagt

SEQ ID NO: 1186873 - DNA, 18 bp, Homo sapiens
cacaaagcacagtttgaa

SEQ ID NO: 1186874 - DNA, 14 bp, Homo sapiens
cacaaagcccaagg

SEQ ID NO: 1186875 - DNA, 19 bp, Homo sapiens
cacaaagcggggggagggt

SEQ ID NO: 1186876 - DNA, 13 bp, Homo sapiens
cacaaagcttcta

SEQ ID NO: 1186877 - DNA, 17 bp, Homo sapiens
cacaaagcttctaaagc

SEQ ID NO: 1186878 - DNA, 13 bp, Homo sapiens
cacaaaggagagc

SEQ ID NO: 1186879 - DNA, 17 bp, Homo sapiens
cacaaaggtggaataaa

SEQ ID NO: 1186880 - DNA, 21 bp, Homo sapiens
cacaaaggtggaataaacatt

SEQ ID NO: 1186881 - DNA, 17 bp, Homo sapiens
cacaaagttctcagagc

SEQ ID NO: 1186882 - DNA, 18 bp, Homo sapiens
cacaaagttctcagagct

SEQ ID NO: 1186883 - DNA, 13 bp, Homo sapiens
cacaaatatttat

SEQ ID NO: 1186884 - DNA, 21 bp, Homo sapiens
cacaaatatttattttctttc

SEQ ID NO: 1186885 - DNA, 15 bp, Homo sapiens
cacaaatctttttct

SEQ ID NO: 1186886 - DNA, 15 bp, Homo sapiens
cacaaatgctcaaag

SEQ ID NO: 1186887 - DNA, 13 bp, Homo sapiens
cacaaatgtcatt

SEQ ID NO: 1186888 - DNA, 17 bp, Homo sapiens
cacaaatgtcattgtct

SEQ ID NO: 1186889 - DNA, 18 bp, Homo sapiens
cacaaatgtcattgtcta

SEQ ID NO: 1186890 - DNA, 21 bp, Homo sapiens
cacaaatgtcattgtctactc

SEQ ID NO: 1186891 - DNA, 14 bp, Homo sapiens
cacaaattagttat

SEQ ID NO: 1186892 - DNA, 18 bp, Homo sapiens
cacaaattttcaagttta

SEQ ID NO: 1186893 - DNA, 20 bp, Homo sapiens
cacaaattttcaagtttaca

SEQ ID NO: 1186894 - DNA, 16 bp, Homo sapiens
cacaacacacacactc

SEQ ID NO: 1186895 - DNA, 13 bp, Homo sapiens
cacaacagccctg

SEQ ID NO: 1186896 - DNA, 20 bp, Homo sapiens
cacaacagccctgcctgaga

SEQ ID NO: 1186897 - DNA, 15 bp, Homo sapiens
cacaacatttgcaga

SEQ ID NO: 1186898 - DNA, 19 bp, Homo sapiens
cacaacccaagcaacattt

SEQ ID NO: 1186899 - DNA, 17 bp, Homo sapiens
cacaacctagggcaagt

SEQ ID NO: 1186900 - DNA, 18 bp, Homo sapiens
cacaacctctctgatctt

SEQ ID NO: 1186901 - DNA, 23 bp, Homo sapiens
cacaacctctctgatcttgtgct

SEQ ID NO: 1186902 - DNA, 14 bp, Homo sapiens
cacaacctgaacct

SEQ ID NO: 1186903 - DNA, 12 bp, Homo sapiens
cacaactccctt

SEQ ID NO: 1186904 - DNA, 12 bp, Homo sapiens
cacaactgctgt

SEQ ID NO: 1186905 - DNA, 20 bp, Homo sapiens
cacaacttgtcacccaaagc

SEQ ID NO: 1186906 - DNA, 12 bp, Homo sapiens
cacaacttgttt

SEQ ID NO: 1186907 - DNA, 14 bp, Homo sapiens
cacaactttgcaaa

SEQ ID NO: 1186908 - DNA, 20 bp, Homo sapiens
cacaactttgcaaattattt

SEQ ID NO: 1186909 - DNA, 20 bp, Homo sapiens
cacaagaacacacacatata

SEQ ID NO: 1186910 - DNA, 21 bp, Homo sapiens
cacaagagcccagcagggcct

SEQ ID NO: 1186911 - DNA, 15 bp, Homo sapiens
cacaagaggaagaga

SEQ ID NO: 1186912 - DNA, 18 bp, Homo sapiens
cacaagatggaatttatc

SEQ ID NO: 1186913 - DNA, 15 bp, Homo sapiens
cacaagattcccaga

SEQ ID NO: 1186914 - DNA, 19 bp, Homo sapiens
cacaagattcccagagaca

SEQ ID NO: 1186915 - DNA, 15 bp, Homo sapiens
cacaagccacagaag

SEQ ID NO: 1186916 - DNA, 14 bp, Homo sapiens
cacaagcctcctgt

SEQ ID NO: 1186917 - DNA, 16 bp, Homo sapiens
cacaagcctcctgtac

SEQ ID NO: 1186918 - DNA, 23 bp, Homo sapiens
cacaagcctcttctgaagatgga

SEQ ID NO: 1186919 - DNA, 23 bp, Homo sapiens
cacaagctctcgggactagctgc

SEQ ID NO: 1186920 - DNA, 12 bp, Homo sapiens
cacaagctgagc

SEQ ID NO: 1186921 - DNA, 13 bp, Homo sapiens
cacaagctgagca

SEQ ID NO: 1186922 - DNA, 14 bp, Homo sapiens
cacaagctgcactg

SEQ ID NO: 1186923 - DNA, 16 bp, Homo sapiens
cacaagctgcactgtg

SEQ ID NO: 1186924 - DNA, 17 bp, Homo sapiens
cacaagctgcactgtga

SEQ ID NO: 1186925 - DNA, 20 bp, Homo sapiens
cacaagctgcactgtgaacc

SEQ ID NO: 1186926 - DNA, 18 bp, Homo sapiens
cacaaggaaccctcaggc

SEQ ID NO: 1186927 - DNA, 15 bp, Homo sapiens
cacaaggaataaatg

SEQ ID NO: 1186928 - DNA, 18 bp, Homo sapiens
cacaaggaataaatgaga

SEQ ID NO: 1186929 - DNA, 14 bp, Homo sapiens
cacaaggctgacca

SEQ ID NO: 1186930 - DNA, 21 bp, Homo sapiens
cacaaggctgaccaagagaga

SEQ ID NO: 1186931 - DNA, 17 bp, Homo sapiens
cacaaggggcccttgga

SEQ ID NO: 1186932 - DNA, 15 bp, Homo sapiens
cacaaggtcaggagt

SEQ ID NO: 1186933 - DNA, 12 bp, Homo sapiens
cacaaggtcccc

SEQ ID NO: 1186934 - DNA, 21 bp, Homo sapiens
cacaagtagatgcctgaactt

SEQ ID NO: 1186935 - DNA, 16 bp, Homo sapiens
cacaagtcctgtgaat

SEQ ID NO: 1186936 - DNA, 20 bp, Homo sapiens
cacaagtcctgtgaatttct

SEQ ID NO: 1186937 - DNA, 13 bp, Homo sapiens
cacaagtcttcca

SEQ ID NO: 1186938 - DNA, 20 bp, Homo sapiens
cacaagtgaatctttctcct

SEQ ID NO: 1186939 - DNA, 21 bp, Homo sapiens
cacaagtgaatctttctcctg

SEQ ID NO: 1186940 - DNA, 13 bp, Homo sapiens
cacaagtggtggt

SEQ ID NO: 1186941 - DNA, 14 bp, Homo sapiens
cacaagtggtggta

SEQ ID NO: 1186942 - DNA, 20 bp, Homo sapiens
cacaagtggtggtaaccctg

SEQ ID NO: 1186943 - DNA, 14 bp, Homo sapiens
cacaagttgtgttt

SEQ ID NO: 1186944 - DNA, 23 bp, Homo sapiens
cacaatacagtaagtaaagtggt

SEQ ID NO: 1186945 - DNA, 13 bp, Homo sapiens
cacaatatttctt

SEQ ID NO: 1186946 - DNA, 11 bp, Homo sapiens
cacaatatttt

SEQ ID NO: 1186947 - DNA, 20 bp, Homo sapiens
cacaatcactaaactttatt

SEQ ID NO: 1186948 - DNA, 21 bp, Homo sapiens
cacaatcactaaactttattt

SEQ ID NO: 1186949 - DNA, 19 bp, Homo sapiens
cacaatcagtttatcctga

SEQ ID NO: 1186950 - DNA, 16 bp, Homo sapiens
cgtatggctccacacc

SEQ ID NO: 1186951 - DNA, 19 bp, Homo sapiens
cgtatgtaacatgatgtta

SEQ ID NO: 1186952 - DNA, 15 bp, Homo sapiens
cgtatgttatacaac

SEQ ID NO: 1186953 - DNA, 15 bp, Homo sapiens
cgtattggtccagct

SEQ ID NO: 1186954 - DNA, 19 bp, Homo sapiens
cgtatttatatttggaaag

SEQ ID NO: 1186955 - DNA, 15 bp, Homo sapiens
cgtatttctccagac

SEQ ID NO: 1186956 - DNA, 12 bp, Homo sapiens
cgtcaccaccac

SEQ ID NO: 1186957 - DNA, 15 bp, Homo sapiens
cgtcaccaccacccc

SEQ ID NO: 1186958 - DNA, 18 bp, Homo sapiens
cgtcaccatctcaggcca

SEQ ID NO: 1186959 - DNA, 14 bp, Homo sapiens
cgtcacgctccctg

SEQ ID NO: 1186960 - DNA, 22 bp, Homo sapiens
cgtcacgctccctgacttctcc

SEQ ID NO: 1186961 - DNA, 18 bp, Homo sapiens
cgtcagccatcagccatg

SEQ ID NO: 1186962 - DNA, 18 bp, Homo sapiens
cgtcagcgcaccaaaact

SEQ ID NO: 1186963 - DNA, 11 bp, Homo sapiens
cgtcagctgct

SEQ ID NO: 1186964 - DNA, 16 bp, Homo sapiens
cgtcagctgcttctgc

SEQ ID NO: 1186965 - DNA, 20 bp, Homo sapiens
cgtcagggcccaagtccctg

SEQ ID NO: 1186966 - DNA, 17 bp, Homo sapiens
cgtcaggggtgcacagt

SEQ ID NO: 1186967 - DNA, 18 bp, Homo sapiens
cgtcagggttggtgtgct

SEQ ID NO: 1186968 - DNA, 19 bp, Homo sapiens
cgtcatcacttttcagtga

SEQ ID NO: 1186969 - DNA, 23 bp, Homo sapiens
cacacgagcaaacccagaggtgg

SEQ ID NO: 1186970 - DNA, 17 bp, Homo sapiens
cacacgcacgcacacac

SEQ ID NO: 1186971 - DNA, 19 bp, Homo sapiens
cacacgcaggaactcccag

SEQ ID NO: 1186972 - DNA, 22 bp, Homo sapiens
cacacgcaggaactcccagcaa

SEQ ID NO: 1186973 - DNA, 14 bp, Homo sapiens
cacacgcaggcggc

SEQ ID NO: 1186974 - DNA, 17 bp, Homo sapiens
cacacgcctcccactgg

SEQ ID NO: 1186975 - DNA, 14 bp, Homo sapiens
cacacgcctgtagt

SEQ ID NO: 1186976 - DNA, 21 bp, Homo sapiens
cacacggactcccgggccacg

SEQ ID NO: 1186977 - DNA, 18 bp, Homo sapiens
cacacggagaggccactg

SEQ ID NO: 1186978 - DNA, 21 bp, Homo sapiens
cacacggaggcatctgcaccc

SEQ ID NO: 1186979 - DNA, 19 bp, Homo sapiens
cacacggctggtcactctg

SEQ ID NO: 1186980 - DNA, 21 bp, Homo sapiens
cacacggctggtcactctgcc

SEQ ID NO: 1186981 - DNA, 17 bp, Homo sapiens
cacacgtacttaaatga

SEQ ID NO: 1186982 - DNA, 10 bp, Homo sapiens
cacacgtgtg

SEQ ID NO: 1186983 - DNA, 19 bp, Homo sapiens
cacacgttgacgggccgca

SEQ ID NO: 1186984 - DNA, 22 bp, Homo sapiens
cacactaccgaatgtgtcttta

SEQ ID NO: 1186985 - DNA, 17 bp, Homo sapiens
cacactagggactatca

SEQ ID NO: 1186986 - DNA, 17 bp, Homo sapiens
cacactattaccatgag

SEQ ID NO: 1186987 - DNA, 19 bp, Homo sapiens
cacactattaccatgagaa

SEQ ID NO: 1186988 - DNA, 14 bp, Homo sapiens
cacactcaaggaca

SEQ ID NO: 1186989 - DNA, 20 bp, Homo sapiens
cacactcaaggacaggagcc

SEQ ID NO: 1186990 - DNA, 19 bp, Homo sapiens
cacactcaccagtggcctt

SEQ ID NO: 1186991 - DNA, 13 bp, Homo sapiens
cacactcagtgca

SEQ ID NO: 1186992 - DNA, 16 bp, Homo sapiens
cacactccaagatatg

SEQ ID NO: 1186993 - DNA, 11 bp, Homo sapiens
cacactccagt

SEQ ID NO: 1186994 - DNA, 23 bp, Homo sapiens
cacactcccaaggttggagccca

SEQ ID NO: 1186995 - DNA, 16 bp, Homo sapiens
cacactcgcccgccca

SEQ ID NO: 1186996 - DNA, 20 bp, Homo sapiens
cacactctcatgtccccttc

SEQ ID NO: 1186997 - DNA, 14 bp, Homo sapiens
cacactctctgcag

SEQ ID NO: 1186998 - DNA, 16 bp, Homo sapiens
cacactctctgcagcc

SEQ ID NO: 1186999 - DNA, 19 bp, Homo sapiens
cacactctctgcagcccag

SEQ ID NO: 1187000 - DNA, 22 bp, Homo sapiens
cacactctctgcagcccagcct

SEQ ID NO: 1187001 - DNA, 23 bp, Homo sapiens
cacactctctgcagcccagccta

SEQ ID NO: 1187002 - DNA, 21 bp, Homo sapiens
cacactgaggcttaggcctct

SEQ ID NO: 1187003 - DNA, 15 bp, Homo sapiens
cacactgagttctat

SEQ ID NO: 1187004 - DNA, 17 bp, Homo sapiens
cacactgagttctatca

SEQ ID NO: 1187005 - DNA, 22 bp, Homo sapiens
cacactgatacataaaaattaa

SEQ ID NO: 1187006 - DNA, 20 bp, Homo sapiens
cacactgatgggctggggca

SEQ ID NO: 1187007 - DNA, 22 bp, Homo sapiens
cacactgatgggctggggcagg

SEQ ID NO: 1187008 - DNA, 23 bp, Homo sapiens
cacactgctaggtgggccagccc

SEQ ID NO: 1187009 - DNA, 13 bp, Homo sapiens
cacactgctctta

SEQ ID NO: 1187010 - DNA, 15 bp, Homo sapiens
cacactgctgtcctc

SEQ ID NO: 1187011 - DNA, 16 bp, Homo sapiens
cacactgctgtcctct

SEQ ID NO: 1187012 - DNA, 23 bp, Homo sapiens
cacactgctgtcctctccccctt

SEQ ID NO: 1187013 - DNA, 13 bp, Homo sapiens
cacactggaatat

SEQ ID NO: 1187014 - DNA, 18 bp, Homo sapiens
cacactggaatataaaac

SEQ ID NO: 1187015 - DNA, 13 bp, Homo sapiens
cacactggactcc

SEQ ID NO: 1187016 - DNA, 16 bp, Homo sapiens
cacactggtacttaga

SEQ ID NO: 1187017 - DNA, 15 bp, Homo sapiens
cacactggttctcaa

SEQ ID NO: 1187018 - DNA, 23 bp, Homo sapiens
cacactgtagcattacagtgggt

SEQ ID NO: 1187019 - DNA, 20 bp, Homo sapiens
cacactgtcatgcttcatca

SEQ ID NO: 1187020 - DNA, 14 bp, Homo sapiens
cacactgtctgggg

SEQ ID NO: 1187021 - DNA, 13 bp, Homo sapiens
cacactgtcttcc

SEQ ID NO: 1187022 - DNA, 17 bp, Homo sapiens
cacactgtggccaggcc

SEQ ID NO: 1187023 - DNA, 16 bp, Homo sapiens
cacactgtgtcctggt

SEQ ID NO: 1187024 - DNA, 22 bp, Homo sapiens
cacactgtgtgaggctgtgtct

SEQ ID NO: 1187025 - DNA, 16 bp, Homo sapiens
cacacttactttttct

SEQ ID NO: 1187026 - DNA, 15 bp, Homo sapiens
cacacttccccatct

SEQ ID NO: 1187027 - DNA, 15 bp, Homo sapiens
cacacttccctggcg

SEQ ID NO: 1187028 - DNA, 23 bp, Homo sapiens
cacacttcctgtccagagagaga

SEQ ID NO: 1187029 - DNA, 13 bp, Homo sapiens
cacacttccttta

SEQ ID NO: 1187030 - DNA, 22 bp, Homo sapiens
cacacttctgtgagacccccac

SEQ ID NO: 1187031 - DNA, 17 bp, Homo sapiens
cacacttgagaggatga

SEQ ID NO: 1187032 - DNA, 23 bp, Homo sapiens
cacacttgtgtgtgggctgtgag

SEQ ID NO: 1187033 - DNA, 18 bp, Homo sapiens
cacacttgttccagctct

SEQ ID NO: 1187034 - DNA, 19 bp, Homo sapiens
cacacttgttccagctctt

SEQ ID NO: 1187035 - DNA, 23 bp, Homo sapiens
cacagaaaataaggcacccatct

SEQ ID NO: 1187036 - DNA, 12 bp, Homo sapiens
cacagaaacctt

SEQ ID NO: 1187037 - DNA, 17 bp, Homo sapiens
cacagaaacttgaactc

SEQ ID NO: 1187038 - DNA, 13 bp, Homo sapiens
cacagaacccttg

SEQ ID NO: 1187039 - DNA, 21 bp, Homo sapiens
cacagaacctactgttccttt

SEQ ID NO: 1187040 - DNA, 15 bp, Homo sapiens
cacagaaccttcaac

SEQ ID NO: 1187041 - DNA, 19 bp, Homo sapiens
cacagaagacttcccagct

SEQ ID NO: 1187042 - DNA, 14 bp, Homo sapiens
cacagaagccagga

SEQ ID NO: 1187043 - DNA, 16 bp, Homo sapiens
cacagaagccaggagc

SEQ ID NO: 1187044 - DNA, 14 bp, Homo sapiens
cacagaatgctcag

SEQ ID NO: 1187045 - DNA, 19 bp, Homo sapiens
cacagacacaatatgtatg

SEQ ID NO: 1187046 - DNA, 18 bp, Homo sapiens
cacagacatactaaccag

SEQ ID NO: 1187047 - DNA, 16 bp, Homo sapiens
cacagacccaggaccc

SEQ ID NO: 1187048 - DNA, 21 bp, Homo sapiens
cacagacccaggacccccgag

SEQ ID NO: 1187049 - DNA, 12 bp, Homo sapiens
cacagacccctc

SEQ ID NO: 1187050 - DNA, 16 bp, Homo sapiens
cacagacctgcagtga

SEQ ID NO: 1187051 - DNA, 18 bp, Homo sapiens
cacagacctgcagtgagg

SEQ ID NO: 1187052 - DNA, 18 bp, Homo sapiens
cacagacctggagcccct

SEQ ID NO: 1187053 - DNA, 22 bp, Homo sapiens
cacagacctggagcccctgggt

SEQ ID NO: 1187054 - DNA, 23 bp, Homo sapiens
cacagacctggagcccctgggtg

SEQ ID NO: 1187055 - DNA, 20 bp, Homo sapiens
cacagacggcctaggggtgg

SEQ ID NO: 1187056 - DNA, 22 bp, Homo sapiens
cacagacgttaggcatttcctg

SEQ ID NO: 1187057 - DNA, 13 bp, Homo sapiens
cacagactatttt

SEQ ID NO: 1187058 - DNA, 22 bp, Homo sapiens
cacagactccggcctgtaatca

SEQ ID NO: 1187059 - DNA, 19 bp, Homo sapiens
cacagactcttacgtggag

SEQ ID NO: 1187060 - DNA, 23 bp, Homo sapiens
cacagactgaactcgcagggaat

SEQ ID NO: 1187061 - DNA, 18 bp, Homo sapiens
cacagactgccccagcca

SEQ ID NO: 1187062 - DNA, 19 bp, Homo sapiens
cacagactggcaataaact

SEQ ID NO: 1187063 - DNA, 19 bp, Homo sapiens
cacagactggttttgcaac

SEQ ID NO: 1187064 - DNA, 17 bp, Homo sapiens
cacagacttctggaagg

SEQ ID NO: 1187065 - DNA, 14 bp, Homo sapiens
cacagagaaataca

SEQ ID NO: 1187066 - DNA, 17 bp, Homo sapiens
cacagagaaatacaaaa

SEQ ID NO: 1187067 - DNA, 13 bp, Homo sapiens
cacagagaagctg

SEQ ID NO: 1187068 - DNA, 14 bp, Homo sapiens
cacagagaagctgg

SEQ ID NO: 1187069 - DNA, 10 bp, Homo sapiens
cacagagaga

SEQ ID NO: 1187070 - DNA, 20 bp, Homo sapiens
cacagagagacagacttgag

SEQ ID NO: 1187071 - DNA, 22 bp, Homo sapiens
cacagagagacagacttgagaa

SEQ ID NO: 1187072 - DNA, 15 bp, Homo sapiens
cacagctcctgccag

SEQ ID NO: 1187073 - DNA, 15 bp, Homo sapiens
cacagctctgggcct

SEQ ID NO: 1187074 - DNA, 19 bp, Homo sapiens
cacagctctgggcctcttt

SEQ ID NO: 1187075 - DNA, 20 bp, Homo sapiens
cacagctctgggcctctttt

SEQ ID NO: 1187076 - DNA, 19 bp, Homo sapiens
cacagctcttccagggcag

SEQ ID NO: 1187077 - DNA, 20 bp, Homo sapiens
cacagctcttccagggcagc

SEQ ID NO: 1187078 - DNA, 21 bp, Homo sapiens
cacagctcttccagggcagcg

SEQ ID NO: 1187079 - DNA, 15 bp, Homo sapiens
cacagctgaagagca

SEQ ID NO: 1187080 - DNA, 12 bp, Homo sapiens
cacagctgcagc

SEQ ID NO: 1187081 - DNA, 15 bp, Homo sapiens
cacagctgcagctgg

SEQ ID NO: 1187082 - DNA, 16 bp, Homo sapiens
cacagctgcagctggg

SEQ ID NO: 1187083 - DNA, 17 bp, Homo sapiens
cacagctgcagctgggc

SEQ ID NO: 1187084 - DNA, 15 bp, Homo sapiens
cacagctgccctgct

SEQ ID NO: 1187085 - DNA, 13 bp, Homo sapiens
cacagctgctgga

SEQ ID NO: 1187086 - DNA, 15 bp, Homo sapiens
cacagctgctggaga

SEQ ID NO: 1187087 - DNA, 18 bp, Homo sapiens
cacagctgctgttctcag

SEQ ID NO: 1187088 - DNA, 12 bp, Homo sapiens
cacagctgcttg

SEQ ID NO: 1187089 - DNA, 12 bp, Homo sapiens
cacagctgggca

SEQ ID NO: 1187090 - DNA, 17 bp, Homo sapiens
cacagctgggcagggtg

SEQ ID NO: 1187091 - DNA, 11 bp, Homo sapiens
cacagctgtct

SEQ ID NO: 1187092 - DNA, 12 bp, Homo sapiens
cacagctgtctg

SEQ ID NO: 1187093 - DNA, 18 bp, Homo sapiens
cacagctgtctgccaggc

SEQ ID NO: 1187094 - DNA, 19 bp, Homo sapiens
cacagctgtctgccaggca

SEQ ID NO: 1187095 - DNA, 16 bp, Homo sapiens
cacagcttagatttca

SEQ ID NO: 1187096 - DNA, 19 bp, Homo sapiens
cacagcttagatttcatag

SEQ ID NO: 1187097 - DNA, 13 bp, Homo sapiens
cacagcttctcca

SEQ ID NO: 1187098 - DNA, 14 bp, Homo sapiens
cacagcttctccaa

SEQ ID NO: 1187099 - DNA, 18 bp, Homo sapiens
cacagcttgacctgaggc

SEQ ID NO: 1187100 - DNA, 19 bp, Homo sapiens
cacagcttgacctgaggct

SEQ ID NO: 1187101 - DNA, 16 bp, Homo sapiens
cacagcttgggtcagg

SEQ ID NO: 1187102 - DNA, 14 bp, Homo sapiens
cgtgtagcgtcctg

SEQ ID NO: 1187103 - DNA, 20 bp, Homo sapiens
cgtgtagtggaagagcagcc

SEQ ID NO: 1187104 - DNA, 23 bp, Homo sapiens
cgtgtagtggaagagcagcctga

SEQ ID NO: 1187105 - DNA, 16 bp, Homo sapiens
cgtgtatcctggggct

SEQ ID NO: 1187106 - DNA, 14 bp, Homo sapiens
cgtgtatgtttctt

SEQ ID NO: 1187107 - DNA, 17 bp, Homo sapiens
cgtgtcaagctgctctg

SEQ ID NO: 1187108 - DNA, 15 bp, Homo sapiens
cgtgtcaatgtgtgc

SEQ ID NO: 1187109 - DNA, 17 bp, Homo sapiens
cgtgtcagtaatttata

SEQ ID NO: 1187110 - DNA, 22 bp, Homo sapiens
cgtgtccagactcagagggctg

SEQ ID NO: 1187111 - DNA, 17 bp, Homo sapiens
cgtgtcccaaggagctg

SEQ ID NO: 1187112 - DNA, 18 bp, Homo sapiens
cgtgtcccctgacagggc

SEQ ID NO: 1187113 - DNA, 16 bp, Homo sapiens
cgtgtccgtccaccct

SEQ ID NO: 1187114 - DNA, 21 bp, Homo sapiens
cgtgtccgtccacccttccat

SEQ ID NO: 1187115 - DNA, 16 bp, Homo sapiens
cgtgtccgtctgtctg

SEQ ID NO: 1187116 - DNA, 14 bp, Homo sapiens
cgtgtcctcctctg

SEQ ID NO: 1187117 - DNA, 14 bp, Homo sapiens
cgtgtctcagcctc

SEQ ID NO: 1187118 - DNA, 23 bp, Homo sapiens
cgtgtctctcccaccccggcctc

SEQ ID NO: 1187119 - DNA, 14 bp, Homo sapiens
cgtgtcttccactt

SEQ ID NO: 1187120 - DNA, 12 bp, Homo sapiens
cgtgtgaatgta

SEQ ID NO: 1187121 - DNA, 20 bp, Homo sapiens
cgtgtgagtgtgacagggcc

SEQ ID NO: 1187122 - DNA, 18 bp, Homo sapiens
cgtgtgcacacacaccac

SEQ ID NO: 1187123 - DNA, 23 bp, Homo sapiens
cgtgtgccatggatctgatctgt

SEQ ID NO: 1187124 - DNA, 16 bp, Homo sapiens
cgtgtgcgtgcatgtg

SEQ ID NO: 1187125 - DNA, 18 bp, Homo sapiens
cgtgtgctgctgctgcta

SEQ ID NO: 1187126 - DNA, 18 bp, Homo sapiens
cgtgtgctgtggccaggc

SEQ ID NO: 1187127 - DNA, 14 bp, Homo sapiens
cgtgtggcctccgt

SEQ ID NO: 1187128 - DNA, 22 bp, Homo sapiens
cgtgtggcctccgtcctgtcac

SEQ ID NO: 1187129 - DNA, 16 bp, Homo sapiens
cgtgtggctcctggta

SEQ ID NO: 1187130 - DNA, 12 bp, Homo sapiens
cgtgtgggtggc

SEQ ID NO: 1187131 - DNA, 17 bp, Homo sapiens
cgtgtggtttccctgcc

SEQ ID NO: 1187132 - DNA, 18 bp, Homo sapiens
cgtgtggtttccctgccc

SEQ ID NO: 1187133 - DNA, 20 bp, Homo sapiens
cgtgtggtttccctgcccct

SEQ ID NO: 1187134 - DNA, 19 bp, Homo sapiens
cgtgtgtacacgggactga

SEQ ID NO: 1187135 - DNA, 19 bp, Homo sapiens
cgtgtgtagatagtatgca

SEQ ID NO: 1187136 - DNA, 16 bp, Homo sapiens
cgtgtgtatttctaag

SEQ ID NO: 1187137 - DNA, 14 bp, Homo sapiens
cgtgtgtccaggct

SEQ ID NO: 1187138 - DNA, 16 bp, Homo sapiens
cgtgtgtccaggctct

SEQ ID NO: 1187139 - DNA, 17 bp, Homo sapiens
cgtgtgtccatgtgtgt

SEQ ID NO: 1187140 - DNA, 19 bp, Homo sapiens
cgtgtgtcccagatgctgt

SEQ ID NO: 1187141 - DNA, 17 bp, Homo sapiens
cgtgtgtgacactgatg

SEQ ID NO: 1187142 - DNA, 15 bp, Homo sapiens
cgtgttacccactgc

SEQ ID NO: 1187143 - DNA, 19 bp, Homo sapiens
cgtgttagtgtgtgtgcat

SEQ ID NO: 1187144 - DNA, 13 bp, Homo sapiens
cgtgttatgaatc

SEQ ID NO: 1187145 - DNA, 15 bp, Homo sapiens
cgtgttatgaatctg

SEQ ID NO: 1187146 - DNA, 17 bp, Homo sapiens
cgtgttcagcagaacct

SEQ ID NO: 1187147 - DNA, 14 bp, Homo sapiens
cgtgttcaggacac

SEQ ID NO: 1187148 - DNA, 15 bp, Homo sapiens
cgtgttcccctcttg

SEQ ID NO: 1187149 - DNA, 15 bp, Homo sapiens
cgtgttgccttgaac

SEQ ID NO: 1187150 - DNA, 17 bp, Homo sapiens
cgtgtttgcttaaaata

SEQ ID NO: 1187151 - DNA, 12 bp, Homo sapiens
cgtgtttgtgtt

SEQ ID NO: 1187152 - DNA, 14 bp, Homo sapiens
cgtgttttcaagga

SEQ ID NO: 1187153 - DNA, 20 bp, Homo sapiens
cgttaacctttttgtaaata

SEQ ID NO: 1187154 - DNA, 18 bp, Homo sapiens
cgttaatagattatttca

SEQ ID NO: 1187155 - DNA, 19 bp, Homo sapiens
cgttaatagattatttcat

SEQ ID NO: 1187156 - DNA, 20 bp, Homo sapiens
cgttaatagattatttcata

SEQ ID NO: 1187157 - DNA, 19 bp, Homo sapiens
cgttactcagggctcctcc

SEQ ID NO: 1187158 - DNA, 22 bp, Homo sapiens
cgttactcagggctcctcccag

SEQ ID NO: 1187159 - DNA, 16 bp, Homo sapiens
cgttagctcctgtggc

SEQ ID NO: 1187160 - DNA, 16 bp, Homo sapiens
cgttagtaatctgtat

SEQ ID NO: 1187161 - DNA, 22 bp, Homo sapiens
cgttcacctccaagcatttcat

SEQ ID NO: 1187162 - DNA, 23 bp, Homo sapiens
cgttcacctccaagcatttcatg

SEQ ID NO: 1187163 - DNA, 13 bp, Homo sapiens
cgttcactccaat

SEQ ID NO: 1187164 - DNA, 14 bp, Homo sapiens
cgttcagcccctga

SEQ ID NO: 1187165 - DNA, 19 bp, Homo sapiens
cgttcattgcctttccagg

SEQ ID NO: 1187166 - DNA, 19 bp, Homo sapiens
cgttccccttggcttcctc

SEQ ID NO: 1187167 - DNA, 21 bp, Homo sapiens
cgttccccttggcttcctccg

SEQ ID NO: 1187168 - DNA, 13 bp, Homo sapiens
cgttccctgtcag

SEQ ID NO: 1187169 - DNA, 14 bp, Homo sapiens
cgttcccttctccc

SEQ ID NO: 1187170 - DNA, 17 bp, Homo sapiens
cgttcctattgtcatta

SEQ ID NO: 1187171 - DNA, 18 bp, Homo sapiens
cgttccttactgcagaat

SEQ ID NO: 1187172 - DNA, 16 bp, Homo sapiens
cgttcctttcttttcc

SEQ ID NO: 1187173 - DNA, 21 bp, Homo sapiens
cgttcgtacgcccaggacagc

SEQ ID NO: 1187174 - DNA, 16 bp, Homo sapiens
cgttctcaagaatcta

SEQ ID NO: 1187175 - DNA, 14 bp, Homo sapiens
cgttctcacaccca

SEQ ID NO: 1187176 - DNA, 16 bp, Homo sapiens
cgttctcccaaagatt

SEQ ID NO: 1187177 - DNA, 19 bp, Homo sapiens
cgttctcccagcactgcct

SEQ ID NO: 1187178 - DNA, 22 bp, Homo sapiens
cgttctcccagcactgcctcct

SEQ ID NO: 1187179 - DNA, 23 bp, Homo sapiens
cgttctcccagcactgcctcctg

SEQ ID NO: 1187180 - DNA, 13 bp, Homo sapiens
cgttctcctgctt

SEQ ID NO: 1187181 - DNA, 12 bp, Homo sapiens
cgttctccttcc

SEQ ID NO: 1187182 - DNA, 14 bp, Homo sapiens
cgttctctgtccta

SEQ ID NO: 1187183 - DNA, 13 bp, Homo sapiens
cgttctctttaaa

SEQ ID NO: 1187184 - DNA, 19 bp, Homo sapiens
cgttctgccttccttgtta

SEQ ID NO: 1187185 - DNA, 18 bp, Homo sapiens
cgttctgctgaccaaatg

SEQ ID NO: 1187186 - DNA, 17 bp, Homo sapiens
cgttctgctggcctgga

SEQ ID NO: 1187187 - DNA, 18 bp, Homo sapiens
cgttctgctggcctggat

SEQ ID NO: 1187188 - DNA, 16 bp, Homo sapiens
cgttctggactctgcc

SEQ ID NO: 1187189 - DNA, 17 bp, Homo sapiens
cgttctggactctgccc

SEQ ID NO: 1187190 - DNA, 12 bp, Homo sapiens
cgttcttgtaat

SEQ ID NO: 1187191 - DNA, 18 bp, Homo sapiens
cgttgacgggccgcagga

SEQ ID NO: 1187192 - DNA, 16 bp, Homo sapiens
cgttgaggatgaggcc

SEQ ID NO: 1187193 - DNA, 23 bp, Homo sapiens
cgttgcaaccactgcaatatctt

SEQ ID NO: 1187194 - DNA, 14 bp, Homo sapiens
cgttggagagcagc

SEQ ID NO: 1187195 - DNA, 16 bp, Homo sapiens
cacaggtgtctgccta

SEQ ID NO: 1187196 - DNA, 19 bp, Homo sapiens
cacaggttagggtgtgtgc

SEQ ID NO: 1187197 - DNA, 20 bp, Homo sapiens
cacaggttttttcaatttat

SEQ ID NO: 1187198 - DNA, 20 bp, Homo sapiens
cacagtacagcatgtgcctt

SEQ ID NO: 1187199 - DNA, 18 bp, Homo sapiens
cacagtaccggattctct

SEQ ID NO: 1187200 - DNA, 21 bp, Homo sapiens
cacagtactcactttttccaa

SEQ ID NO: 1187201 - DNA, 17 bp, Homo sapiens
cacagtactttattgta

SEQ ID NO: 1187202 - DNA, 15 bp, Homo sapiens
cacagtagagtaggg

SEQ ID NO: 1187203 - DNA, 13 bp, Homo sapiens
cacagtatatttt

SEQ ID NO: 1187204 - DNA, 17 bp, Homo sapiens
cacagtcaaaataattc

SEQ ID NO: 1187205 - DNA, 19 bp, Homo sapiens
cacagtcaaggtcacttaa

SEQ ID NO: 1187206 - DNA, 23 bp, Homo sapiens
cacagtcacccctccctccctct

SEQ ID NO: 1187207 - DNA, 20 bp, Homo sapiens
cacagtccacagctgaagag

SEQ ID NO: 1187208 - DNA, 18 bp, Homo sapiens
cacagtccaggaacaagc

SEQ ID NO: 1187209 - DNA, 15 bp, Homo sapiens
cacagtcccattcct

SEQ ID NO: 1187210 - DNA, 22 bp, Homo sapiens
cacagtctctttaatcttcagt

SEQ ID NO: 1187211 - DNA, 21 bp, Homo sapiens
cacagtgaaacgcaattttac

SEQ ID NO: 1187212 - DNA, 15 bp, Homo sapiens
cacagtgaagtgctg

SEQ ID NO: 1187213 - DNA, 14 bp, Homo sapiens
cacagtgacttcct

SEQ ID NO: 1187214 - DNA, 17 bp, Homo sapiens
cacagtgacttctgaga

SEQ ID NO: 1187215 - DNA, 21 bp, Homo sapiens
cacagtgactttacaggaggt

SEQ ID NO: 1187216 - DNA, 17 bp, Homo sapiens
cacagtgagaggggagg

SEQ ID NO: 1187217 - DNA, 11 bp, Homo sapiens
cacagtgatat

SEQ ID NO: 1187218 - DNA, 19 bp, Homo sapiens
cacagtgatgaatgtacta

SEQ ID NO: 1187219 - DNA, 21 bp, Homo sapiens
cacagtgatgccgggcgccag

SEQ ID NO: 1187220 - DNA, 14 bp, Homo sapiens
cacagtgatttttt

SEQ ID NO: 1187221 - DNA, 19 bp, Homo sapiens
cacagtgcatctcagccca

SEQ ID NO: 1187222 - DNA, 18 bp, Homo sapiens
cacagtgcattatgtaca

SEQ ID NO: 1187223 - DNA, 16 bp, Homo sapiens
cacagtgcctggccca

SEQ ID NO: 1187224 - DNA, 12 bp, Homo sapiens
cacagtgctgcc

SEQ ID NO: 1187225 - DNA, 15 bp, Homo sapiens
cacagtgctgcttct

SEQ ID NO: 1187226 - DNA, 22 bp, Homo sapiens
cacagtgctttccgtggcactg

SEQ ID NO: 1187227 - DNA, 19 bp, Homo sapiens
cacagtggactcagcagtg

SEQ ID NO: 1187228 - DNA, 13 bp, Homo sapiens
cacagtgggagct

SEQ ID NO: 1187229 - DNA, 14 bp, Homo sapiens
cacagtgggagctg

SEQ ID NO: 1187230 - DNA, 19 bp, Homo sapiens
cacagtgggatgaaccagc

SEQ ID NO: 1187231 - DNA, 21 bp, Homo sapiens
cacagtggggctgcaggcagg

SEQ ID NO: 1187232 - DNA, 13 bp, Homo sapiens
cacagtgggtggc

SEQ ID NO: 1187233 - DNA, 15 bp, Homo sapiens
cacagtgggtggcac

SEQ ID NO: 1187234 - DNA, 18 bp, Homo sapiens
cacagtgtctgtatcgga

SEQ ID NO: 1187235 - DNA, 23 bp, Homo sapiens
cacagtgttaaatgaaattgtaa

SEQ ID NO: 1187236 - DNA, 20 bp, Homo sapiens
ctaaatcttttataggattt

SEQ ID NO: 1187237 - DNA, 21 bp, Homo sapiens
ctaaatgaatgagccaaaatg

SEQ ID NO: 1187238 - DNA, 14 bp, Homo sapiens
ctaaatgaatgttt

SEQ ID NO: 1187239 - DNA, 12 bp, Homo sapiens
ctaaatgatggt

SEQ ID NO: 1187240 - DNA, 21 bp, Homo sapiens
ctaaatgcagacaacaccttc

SEQ ID NO: 1187241 - DNA, 22 bp, Homo sapiens
ctaaatgcatatcctgagccat

SEQ ID NO: 1187242 - DNA, 17 bp, Homo sapiens
ctaaatgcccagttcac

SEQ ID NO: 1187243 - DNA, 18 bp, Homo sapiens
ctaaatgcccagttcact

SEQ ID NO: 1187244 - DNA, 19 bp, Homo sapiens
ctaaatgccttagaaatgt

SEQ ID NO: 1187245 - DNA, 17 bp, Homo sapiens
ctaaatggaaccactct

SEQ ID NO: 1187246 - DNA, 13 bp, Homo sapiens
ctaaatggcctca

SEQ ID NO: 1187247 - DNA, 17 bp, Homo sapiens
ctaaatggcctcatgtg

SEQ ID NO: 1187248 - DNA, 15 bp, Homo sapiens
ctaaatggtgttaca

SEQ ID NO: 1187249 - DNA, 12 bp, Homo sapiens
ctaaatgtaaaa

SEQ ID NO: 1187250 - DNA, 17 bp, Homo sapiens
ctaaatgtaaaatttgg

SEQ ID NO: 1187251 - DNA, 24 bp, Homo sapiens
ctaaatgttaactacatattgtct

SEQ ID NO: 1187252 - DNA, 16 bp, Homo sapiens
ctaaatgttgaaagat

SEQ ID NO: 1187253 - DNA, 23 bp, Homo sapiens
ctaaattaatactcctcctttta

SEQ ID NO: 1187254 - DNA, 14 bp, Homo sapiens
ctaaattatttact

SEQ ID NO: 1187255 - DNA, 15 bp, Homo sapiens
ctaaattatttactg

SEQ ID NO: 1187256 - DNA, 23 bp, Homo sapiens
ctaaattatttactgcaaaaaga

SEQ ID NO: 1187257 - DNA, 14 bp, Homo sapiens
ctaaattccacact

SEQ ID NO: 1187258 - DNA, 13 bp, Homo sapiens
ctaaatttaatgc

SEQ ID NO: 1187259 - DNA, 16 bp, Homo sapiens
ctaaatttaatgctgc

SEQ ID NO: 1187260 - DNA, 17 bp, Homo sapiens
ctaaatttattaaataa

SEQ ID NO: 1187261 - DNA, 13 bp, Homo sapiens
ctaaattttctga

SEQ ID NO: 1187262 - DNA, 16 bp, Homo sapiens
ctaaattttcttttaa

SEQ ID NO: 1187263 - DNA, 21 bp, Homo sapiens
ctaaattttcttttaagcatt

SEQ ID NO: 1187264 - DNA, 15 bp, Homo sapiens
ctaaattttgttact

SEQ ID NO: 1187265 - DNA, 18 bp, Homo sapiens
ctaaattttgttactgat

SEQ ID NO: 1187266 - DNA, 16 bp, Homo sapiens
ctaaatttttcataga

SEQ ID NO: 1187267 - DNA, 16 bp, Homo sapiens
ctaacaaatgtaaaat

SEQ ID NO: 1187268 - DNA, 16 bp, Homo sapiens
ctaacacattaaatgt

SEQ ID NO: 1187269 - DNA, 17 bp, Homo sapiens
ctaacacattatcggga

SEQ ID NO: 1187270 - DNA, 15 bp, Homo sapiens
ctaacactggcccct

SEQ ID NO: 1187271 - DNA, 16 bp, Homo sapiens
ctaacactggccccta

SEQ ID NO: 1187272 - DNA, 12 bp, Homo sapiens
ctaacactggct

SEQ ID NO: 1187273 - DNA, 18 bp, Homo sapiens
ctaacagataagcaagag

SEQ ID NO: 1187274 - DNA, 23 bp, Homo sapiens
ctaacagcaacagcaagaaataa

SEQ ID NO: 1187275 - DNA, 12 bp, Homo sapiens
ctaacagccctc

SEQ ID NO: 1187276 - DNA, 17 bp, Homo sapiens
ctaacagtccttgcttt

SEQ ID NO: 1187277 - DNA, 22 bp, Homo sapiens
ctaacagtttgcctgctgtatt

SEQ ID NO: 1187278 - DNA, 23 bp, Homo sapiens
ctaacataaaatctgtgaattaa

SEQ ID NO: 1187279 - DNA, 13 bp, Homo sapiens
ctaacatatgtat

SEQ ID NO: 1187280 - DNA, 13 bp, Homo sapiens
ctaacatctttac

SEQ ID NO: 1187281 - DNA, 17 bp, Homo sapiens
ctaacatgccctgttca

SEQ ID NO: 1187282 - DNA, 15 bp, Homo sapiens
ctaacattatttatt

SEQ ID NO: 1187283 - DNA, 19 bp, Homo sapiens
ctaacatttttgaggaagt

SEQ ID NO: 1187284 - DNA, 15 bp, Homo sapiens
ctaaccaagctgagt

SEQ ID NO: 1187285 - DNA, 13 bp, Homo sapiens
ctaaccatcccca

SEQ ID NO: 1187286 - DNA, 15 bp, Homo sapiens
ctaaccatccccaac

SEQ ID NO: 1187287 - DNA, 17 bp, Homo sapiens
ctaaccatccccaactc

SEQ ID NO: 1187288 - DNA, 13 bp, Homo sapiens
ctaaccccttcca

SEQ ID NO: 1187289 - DNA, 16 bp, Homo sapiens
ctaacccctttcctgc

SEQ ID NO: 1187290 - DNA, 13 bp, Homo sapiens
ctaaccctgtgga

SEQ ID NO: 1187291 - DNA, 18 bp, Homo sapiens
ctaaccctgtggaagcat

SEQ ID NO: 1187292 - DNA, 18 bp, Homo sapiens
ctaacccttaaaaatgca

SEQ ID NO: 1187293 - DNA, 21 bp, Homo sapiens
ctaacctctaaccctcattgc

SEQ ID NO: 1187294 - DNA, 19 bp, Homo sapiens
ctaacctcttttctgcatc

SEQ ID NO: 1187295 - DNA, 14 bp, Homo sapiens
ctaaccttgaatgc

SEQ ID NO: 1187296 - DNA, 16 bp, Homo sapiens
ctaaccttgaatgctg

SEQ ID NO: 1187297 - DNA, 19 bp, Homo sapiens
ctaaccttgaatgctgcca

SEQ ID NO: 1187298 - DNA, 13 bp, Homo sapiens
ctaaccttgcctg

SEQ ID NO: 1187299 - DNA, 20 bp, Homo sapiens
ctaaccttgcctggtacagt

SEQ ID NO: 1187300 - DNA, 20 bp, Homo sapiens
ctaacgaaatatcaaagtca

SEQ ID NO: 1187301 - DNA, 15 bp, Homo sapiens
ctaactaaataccat

SEQ ID NO: 1187302 - DNA, 15 bp, Homo sapiens
ctaactaactggcag

SEQ ID NO: 1187303 - DNA, 21 bp, Homo sapiens
ctaactagaattagtatgtct

SEQ ID NO: 1187304 - DNA, 14 bp, Homo sapiens
ctaactatgcaata

SEQ ID NO: 1187305 - DNA, 14 bp, Homo sapiens
ctaactcaccagcc

SEQ ID NO: 1187306 - DNA, 14 bp, Homo sapiens
ctaactccgagagc

SEQ ID NO: 1187307 - DNA, 14 bp, Homo sapiens
ctaactcctgagaa

SEQ ID NO: 1187308 - DNA, 16 bp, Homo sapiens
ctaactctattaatga

SEQ ID NO: 1187309 - DNA, 16 bp, Homo sapiens
ctaactgactctgtta

SEQ ID NO: 1187310 - DNA, 21 bp, Homo sapiens
ctaactgactctgttattgat

SEQ ID NO: 1187311 - DNA, 21 bp, Homo sapiens
ctaactgcttcatctcctttt

SEQ ID NO: 1187312 - DNA, 15 bp, Homo sapiens
ctaactgtaaatcat

SEQ ID NO: 1187313 - DNA, 17 bp, Homo sapiens
ctaactgtaaatcatgt

SEQ ID NO: 1187314 - DNA, 14 bp, Homo sapiens
ctaactgtgatttg

SEQ ID NO: 1187315 - DNA, 15 bp, Homo sapiens
ctaactgtggaatat

SEQ ID NO: 1187316 - DNA, 15 bp, Homo sapiens
ctaacttcaccatat

SEQ ID NO: 1187317 - DNA, 16 bp, Homo sapiens
ctaacttcaccatatt

SEQ ID NO: 1187318 - DNA, 18 bp, Homo sapiens
caccaactctgcactcca

SEQ ID NO: 1187319 - DNA, 16 bp, Homo sapiens
caccaacttacaaaaa

SEQ ID NO: 1187320 - DNA, 16 bp, Homo sapiens
caccaacttgccacat

SEQ ID NO: 1187321 - DNA, 22 bp, Homo sapiens
caccaagacttgttttatgctc

SEQ ID NO: 1187322 - DNA, 13 bp, Homo sapiens
caccaagcacagc

SEQ ID NO: 1187323 - DNA, 13 bp, Homo sapiens
caccaagcagtgg

SEQ ID NO: 1187324 - DNA, 14 bp, Homo sapiens
caccaagcagtggc

SEQ ID NO: 1187325 - DNA, 14 bp, Homo sapiens
caccaagctcacag

SEQ ID NO: 1187326 - DNA, 13 bp, Homo sapiens
caccaaggcagtg

SEQ ID NO: 1187327 - DNA, 21 bp, Homo sapiens
caccaaggcagtgcatgcatg

SEQ ID NO: 1187328 - DNA, 16 bp, Homo sapiens
caccaagggacaggag

SEQ ID NO: 1187329 - DNA, 18 bp, Homo sapiens
caccaagggacaggagaa

SEQ ID NO: 1187330 - DNA, 14 bp, Homo sapiens
caccaaggtcttca

SEQ ID NO: 1187331 - DNA, 21 bp, Homo sapiens
caccaaggtcttcagccatca

SEQ ID NO: 1187332 - DNA, 21 bp, Homo sapiens
caccaatattaacacgctgcc

SEQ ID NO: 1187333 - DNA, 23 bp, Homo sapiens
caccaatattaacacgctgcctg

SEQ ID NO: 1187334 - DNA, 16 bp, Homo sapiens
caccacaagctgagca

SEQ ID NO: 1187335 - DNA, 17 bp, Homo sapiens
caccacacccaggtctc

SEQ ID NO: 1187336 - DNA, 20 bp, Homo sapiens
caccacacccaggtctcttc

SEQ ID NO: 1187337 - DNA, 17 bp, Homo sapiens
caccacactgaatctcc

SEQ ID NO: 1187338 - DNA, 12 bp, Homo sapiens
caccacagacac

SEQ ID NO: 1187339 - DNA, 13 bp, Homo sapiens
caccacagacaca

SEQ ID NO: 1187340 - DNA, 14 bp, Homo sapiens
caccacagagaaga

SEQ ID NO: 1187341 - DNA, 15 bp, Homo sapiens
caccacatctgccag

SEQ ID NO: 1187342 - DNA, 16 bp, Homo sapiens
caccacattgcctcat

SEQ ID NO: 1187343 - DNA, 13 bp, Homo sapiens
caccaccaagcca

SEQ ID NO: 1187344 - DNA, 18 bp, Homo sapiens
caccaccacactacacag

SEQ ID NO: 1187345 - DNA, 21 bp, Homo sapiens
caccaccacgcagccgccgcc

SEQ ID NO: 1187346 - DNA, 15 bp, Homo sapiens
caccaccactggcca

SEQ ID NO: 1187347 - DNA, 23 bp, Homo sapiens
caccaccactggccaccaggctg

SEQ ID NO: 1187348 - DNA, 15 bp, Homo sapiens
caccaccaggagcag

SEQ ID NO: 1187349 - DNA, 22 bp, Homo sapiens
caccaccaggagcagcagccag

SEQ ID NO: 1187350 - DNA, 23 bp, Homo sapiens
caccaccaggagcagcagccagc

SEQ ID NO: 1187351 - DNA, 13 bp, Homo sapiens
caccaccagggtg

SEQ ID NO: 1187352 - DNA, 21 bp, Homo sapiens
caccaccagggtggaccaggc

SEQ ID NO: 1187353 - DNA, 13 bp, Homo sapiens
caccaccatgccc

SEQ ID NO: 1187354 - DNA, 13 bp, Homo sapiens
caccacccagccc

SEQ ID NO: 1187355 - DNA, 17 bp, Homo sapiens
caccacccagcccttcc

SEQ ID NO: 1187356 - DNA, 16 bp, Homo sapiens
caccaccccaacaaac

SEQ ID NO: 1187357 - DNA, 14 bp, Homo sapiens
caccaccctcaggt

SEQ ID NO: 1187358 - DNA, 18 bp, Homo sapiens
caccaccctcaggtgcct

SEQ ID NO: 1187359 - DNA, 20 bp, Homo sapiens
caccaccgaatatattactg

SEQ ID NO: 1187360 - DNA, 15 bp, Homo sapiens
caccaccgcctctgg

SEQ ID NO: 1187361 - DNA, 17 bp, Homo sapiens
caccaccggccccctcc

SEQ ID NO: 1187362 - DNA, 16 bp, Homo sapiens
caccacctcactcctg

SEQ ID NO: 1187363 - DNA, 14 bp, Homo sapiens
caccacctccctca

SEQ ID NO: 1187364 - DNA, 13 bp, Homo sapiens
caccacctctgtg

SEQ ID NO: 1187365 - DNA, 14 bp, Homo sapiens
caccacctggagtg

SEQ ID NO: 1187366 - DNA, 15 bp, Homo sapiens
caccaccttcccagc

SEQ ID NO: 1187367 - DNA, 16 bp, Homo sapiens
caccaccttcccagct

SEQ ID NO: 1187368 - DNA, 22 bp, Homo sapiens
ctaagccagggcccctggatct

SEQ ID NO: 1187369 - DNA, 12 bp, Homo sapiens
ctaagcccccag

SEQ ID NO: 1187370 - DNA, 15 bp, Homo sapiens
ctaagcccccagggc

SEQ ID NO: 1187371 - DNA, 16 bp, Homo sapiens
ctaagcccccagggcc

SEQ ID NO: 1187372 - DNA, 17 bp, Homo sapiens
ctaagcccccagggcct

SEQ ID NO: 1187373 - DNA, 17 bp, Homo sapiens
ctaagccccgtccccta

SEQ ID NO: 1187374 - DNA, 20 bp, Homo sapiens
ctaagccctcgaaccaaggc

SEQ ID NO: 1187375 - DNA, 21 bp, Homo sapiens
ctaagccctcgaaccaaggca

SEQ ID NO: 1187376 - DNA, 22 bp, Homo sapiens
ctaagccctcgaaccaaggcag

SEQ ID NO: 1187377 - DNA, 21 bp, Homo sapiens
ctaagcctatacgtttctgtg

SEQ ID NO: 1187378 - DNA, 24 bp, Homo sapiens
ctaagcctatacgtttctgtggag

SEQ ID NO: 1187379 - DNA, 13 bp, Homo sapiens
ctaagcctgttgc

SEQ ID NO: 1187380 - DNA, 18 bp, Homo sapiens
ctaagcggtggaggaagg

SEQ ID NO: 1187381 - DNA, 15 bp, Homo sapiens
ctaagcgtgctgaca

SEQ ID NO: 1187382 - DNA, 17 bp, Homo sapiens
ctaagctaggaatgaaa

SEQ ID NO: 1187383 - DNA, 19 bp, Homo sapiens
ctaagctattcagtaataa

SEQ ID NO: 1187384 - DNA, 15 bp, Homo sapiens
ctaagctgctctaaa

SEQ ID NO: 1187385 - DNA, 21 bp, Homo sapiens
ctaagctggagctcttggaag

SEQ ID NO: 1187386 - DNA, 22 bp, Homo sapiens
ctaagctgtttgccaagctgaa

SEQ ID NO: 1187387 - DNA, 15 bp, Homo sapiens
ctaaggaaaattaat

SEQ ID NO: 1187388 - DNA, 14 bp, Homo sapiens
ctaaggaaccttcc

SEQ ID NO: 1187389 - DNA, 22 bp, Homo sapiens
ctaaggaagccagtcaccttct

SEQ ID NO: 1187390 - DNA, 13 bp, Homo sapiens
ctaaggacaaatt

SEQ ID NO: 1187391 - DNA, 14 bp, Homo sapiens
ctaaggacaaatta

SEQ ID NO: 1187392 - DNA, 17 bp, Homo sapiens
ctaaggacaaattagca

SEQ ID NO: 1187393 - DNA, 16 bp, Homo sapiens
ctaaggacacactaat

SEQ ID NO: 1187394 - DNA, 16 bp, Homo sapiens
ctaaggagcagcggga

SEQ ID NO: 1187395 - DNA, 13 bp, Homo sapiens
ctaaggagcatga

SEQ ID NO: 1187396 - DNA, 22 bp, Homo sapiens
ctaaggaggggaaaaaaatgtt

SEQ ID NO: 1187397 - DNA, 17 bp, Homo sapiens
ctaaggatacctgcttt

SEQ ID NO: 1187398 - DNA, 17 bp, Homo sapiens
ctaaggatctctcagga

SEQ ID NO: 1187399 - DNA, 23 bp, Homo sapiens
ctaaggatctctcaggagcacag

SEQ ID NO: 1187400 - DNA, 19 bp, Homo sapiens
ctaaggatgtcacagggcc

SEQ ID NO: 1187401 - DNA, 11 bp, Homo sapiens
ctaaggatttt

SEQ ID NO: 1187402 - DNA, 20 bp, Homo sapiens
ctaaggcacccacaaataaa

SEQ ID NO: 1187403 - DNA, 14 bp, Homo sapiens
ctaaggctcctcct

SEQ ID NO: 1187404 - DNA, 14 bp, Homo sapiens
ctaaggctgctggc

SEQ ID NO: 1187405 - DNA, 19 bp, Homo sapiens
ctaagggaagatcactgta

SEQ ID NO: 1187406 - DNA, 22 bp, Homo sapiens
ctaagggagagtggtatttgca

SEQ ID NO: 1187407 - DNA, 15 bp, Homo sapiens
ctaagggcagccctc

SEQ ID NO: 1187408 - DNA, 16 bp, Homo sapiens
ctaagggcagccctcc

SEQ ID NO: 1187409 - DNA, 18 bp, Homo sapiens
ctaagggtgggtgctcag

SEQ ID NO: 1187410 - DNA, 19 bp, Homo sapiens
ctaagggtgggtgctcaga

SEQ ID NO: 1187411 - DNA, 15 bp, Homo sapiens
ctaaggtccctgggg

SEQ ID NO: 1187412 - DNA, 22 bp, Homo sapiens
ctaaggttgtctacgggggcac

SEQ ID NO: 1187413 - DNA, 17 bp, Homo sapiens
ctaagtaaatacaattt

SEQ ID NO: 1187414 - DNA, 18 bp, Homo sapiens
ctaagtaaatacaatttt

SEQ ID NO: 1187415 - DNA, 17 bp, Homo sapiens
ctaagtaaataggaatt

SEQ ID NO: 1187416 - DNA, 20 bp, Homo sapiens
ctaagtaagtttcttcctgc

SEQ ID NO: 1187417 - DNA, 18 bp, Homo sapiens
ctaagtatcaagtataga

SEQ ID NO: 1187418 - DNA, 11 bp, Homo sapiens
ctaagtattta

SEQ ID NO: 1187419 - DNA, 17 bp, Homo sapiens
ctaagtatttaaatgtt

SEQ ID NO: 1187420 - DNA, 14 bp, Homo sapiens
ctaagtatttccca

SEQ ID NO: 1187421 - DNA, 15 bp, Homo sapiens
ctaagtcaaaacttg

SEQ ID NO: 1187422 - DNA, 22 bp, Homo sapiens
ctaagtcaagatcaacattcca

SEQ ID NO: 1187423 - DNA, 17 bp, Homo sapiens
ctaagtcaggtaatata

SEQ ID NO: 1187424 - DNA, 18 bp, Homo sapiens
ctaagtcaggtaatatac

SEQ ID NO: 1187425 - DNA, 17 bp, Homo sapiens
ctaagtcccttcctatt

SEQ ID NO: 1187426 - DNA, 12 bp, Homo sapiens
ctaagtctctgt

SEQ ID NO: 1187427 - DNA, 14 bp, Homo sapiens
ctaagtctttccat

SEQ ID NO: 1187428 - DNA, 13 bp, Homo sapiens
ctaagtctttccc

SEQ ID NO: 1187429 - DNA, 12 bp, Homo sapiens
ctaagtgtaacc

SEQ ID NO: 1187430 - DNA, 20 bp, Homo sapiens
ctaagtgtaacctcagtatt

SEQ ID NO: 1187431 - DNA, 15 bp, Homo sapiens
ctaagttaatttaaa

SEQ ID NO: 1187432 - DNA, 16 bp, Homo sapiens
ctaagttatagtatat

SEQ ID NO: 1187433 - DNA, 14 bp, Homo sapiens
ctaagttcacatta

SEQ ID NO: 1187434 - DNA, 20 bp, Homo sapiens
ctaagttcatgtttgtaaat

SEQ ID NO: 1187435 - DNA, 18 bp, Homo sapiens
ctaagttttcaaatttgt

SEQ ID NO: 1187436 - DNA, 19 bp, Homo sapiens
ctaagtttttttcattttt

SEQ ID NO: 1187437 - DNA, 17 bp, Homo sapiens
ctaataaaaagcttttg

SEQ ID NO: 1187438 - DNA, 15 bp, Homo sapiens
ctaataaactaataa

SEQ ID NO: 1187439 - DNA, 17 bp, Homo sapiens
ctaataaactaataatt

SEQ ID NO: 1187440 - DNA, 21 bp, Homo sapiens
ctaataaactaataattgcag

SEQ ID NO: 1187441 - DNA, 20 bp, Homo sapiens
ctaatttttttgtattttag

SEQ ID NO: 1187442 - DNA, 19 bp, Homo sapiens
ctacaaaaagcataaaaat

SEQ ID NO: 1187443 - DNA, 21 bp, Homo sapiens
ctacaaaacctgatgttaaaa

SEQ ID NO: 1187444 - DNA, 22 bp, Homo sapiens
ctacaaacaaaagcagccctct

SEQ ID NO: 1187445 - DNA, 16 bp, Homo sapiens
ctacaaagtaaaatga

SEQ ID NO: 1187446 - DNA, 13 bp, Homo sapiens
ctacaaatatagg

SEQ ID NO: 1187447 - DNA, 14 bp, Homo sapiens
ctacaaatcagtaa

SEQ ID NO: 1187448 - DNA, 15 bp, Homo sapiens
ctacaaatcagtaat

SEQ ID NO: 1187449 - DNA, 22 bp, Homo sapiens
ctacaaatttatgcatttcatt

SEQ ID NO: 1187450 - DNA, 20 bp, Homo sapiens
ctacaaccccagcctcctga

SEQ ID NO: 1187451 - DNA, 16 bp, Homo sapiens
ctacaacttaatggaa

SEQ ID NO: 1187452 - DNA, 21 bp, Homo sapiens
ctacaacttttgttttctgat

SEQ ID NO: 1187453 - DNA, 17 bp, Homo sapiens
ctacaagagcagcctgt

SEQ ID NO: 1187454 - DNA, 16 bp, Homo sapiens
ctacaagcatatttga

SEQ ID NO: 1187455 - DNA, 19 bp, Homo sapiens
ctacaagcatatttgagaa

SEQ ID NO: 1187456 - DNA, 14 bp, Homo sapiens
ctacaagtgtttta

SEQ ID NO: 1187457 - DNA, 14 bp, Homo sapiens
ctacaataaaaaga

SEQ ID NO: 1187458 - DNA, 18 bp, Homo sapiens
ctacaataaaaagaaatt

SEQ ID NO: 1187459 - DNA, 12 bp, Homo sapiens
ctacaatcatgg

SEQ ID NO: 1187460 - DNA, 13 bp, Homo sapiens
ctacaatcatggt

SEQ ID NO: 1187461 - DNA, 16 bp, Homo sapiens
ctacaatgatggtaaa

SEQ ID NO: 1187462 - DNA, 20 bp, Homo sapiens
ctacaatgctcatgtccctg

SEQ ID NO: 1187463 - DNA, 13 bp, Homo sapiens
ctacaatgtgaac

SEQ ID NO: 1187464 - DNA, 17 bp, Homo sapiens
ctacaatgtgaacttta

SEQ ID NO: 1187465 - DNA, 18 bp, Homo sapiens
ctacaatgtgaactttat

SEQ ID NO: 1187466 - DNA, 16 bp, Homo sapiens
ctacaattcattgtgt

SEQ ID NO: 1187467 - DNA, 18 bp, Homo sapiens
ctacaattcctctgataa

SEQ ID NO: 1187468 - DNA, 20 bp, Homo sapiens
ctacaattcctctgataata

SEQ ID NO: 1187469 - DNA, 21 bp, Homo sapiens
ctacaatttgttaattcctat

SEQ ID NO: 1187470 - DNA, 15 bp, Homo sapiens
ctacaattttctccc

SEQ ID NO: 1187471 - DNA, 21 bp, Homo sapiens
ctacacactgcatgtttgtga

SEQ ID NO: 1187472 - DNA, 22 bp, Homo sapiens
ctacacagacattaagaagagc

SEQ ID NO: 1187473 - DNA, 18 bp, Homo sapiens
ctacacagcacaccagcc

SEQ ID NO: 1187474 - DNA, 24 bp, Homo sapiens
ctacacagcacaccagccgctgca

SEQ ID NO: 1187475 - DNA, 23 bp, Homo sapiens
ctacacaggagtcttcagaccca

SEQ ID NO: 1187476 - DNA, 15 bp, Homo sapiens
ctacacaggggccct

SEQ ID NO: 1187477 - DNA, 15 bp, Homo sapiens
ctacacagtaaaaac

SEQ ID NO: 1187478 - DNA, 18 bp, Homo sapiens
ctacacatacagaaagaa

SEQ ID NO: 1187479 - DNA, 20 bp, Homo sapiens
ctacacatacagaaagaagc

SEQ ID NO: 1187480 - DNA, 15 bp, Homo sapiens
ctacacatgtaaaat

SEQ ID NO: 1187481 - DNA, 11 bp, Homo sapiens
ctacacccagc

SEQ ID NO: 1187482 - DNA, 22 bp, Homo sapiens
ctacacccctcccctgccctag

SEQ ID NO: 1187483 - DNA, 15 bp, Homo sapiens
ctacacccctgtgct

SEQ ID NO: 1187484 - DNA, 15 bp, Homo sapiens
ctacaccccttttcc

SEQ ID NO: 1187485 - DNA, 18 bp, Homo sapiens
ctacacccttttccagct

SEQ ID NO: 1187486 - DNA, 14 bp, Homo sapiens
ctacacctccctcc

SEQ ID NO: 1187487 - DNA, 15 bp, Homo sapiens
ctacaccttgccttg

SEQ ID NO: 1187488 - DNA, 20 bp, Homo sapiens
ctacaccttgcttttttact

SEQ ID NO: 1187489 - DNA, 17 bp, Homo sapiens
ctacactggtgtgtccc

SEQ ID NO: 1187490 - DNA, 13 bp, Homo sapiens
ctacagaaaatgc

SEQ ID NO: 1187491 - DNA, 17 bp, Homo sapiens
ctacagaaaatgctggc

SEQ ID NO: 1187492 - DNA, 19 bp, Homo sapiens
ctacagaaaatgctggctg

SEQ ID NO: 1187493 - DNA, 21 bp, Homo sapiens
ctacagaaaccaggtaagccc

SEQ ID NO: 1187494 - DNA, 19 bp, Homo sapiens
ctacagaaatactgctctg

SEQ ID NO: 1187495 - DNA, 20 bp, Homo sapiens
ctacagaaatactgctctga

SEQ ID NO: 1187496 - DNA, 13 bp, Homo sapiens
ctacagaacctga

SEQ ID NO: 1187497 - DNA, 15 bp, Homo sapiens
ctacagaacctgagg

SEQ ID NO: 1187498 - DNA, 19 bp, Homo sapiens
ctacagaacttcagaaaga

SEQ ID NO: 1187499 - DNA, 17 bp, Homo sapiens
caccatcccctcctagc

SEQ ID NO: 1187500 - DNA, 22 bp, Homo sapiens
caccatcccctcctagcacaag

SEQ ID NO: 1187501 - DNA, 19 bp, Homo sapiens
caccatccctttttgaagt

SEQ ID NO: 1187502 - DNA, 12 bp, Homo sapiens
caccatcctcag

SEQ ID NO: 1187503 - DNA, 20 bp, Homo sapiens
caccatcctgcagcctcctc

SEQ ID NO: 1187504 - DNA, 21 bp, Homo sapiens
caccatcctgcagcctcctcc

SEQ ID NO: 1187505 - DNA, 14 bp, Homo sapiens
caccatctcaggcc

SEQ ID NO: 1187506 - DNA, 12 bp, Homo sapiens
caccatctgctt

SEQ ID NO: 1187507 - DNA, 20 bp, Homo sapiens
caccatgcactgtaaatatc

SEQ ID NO: 1187508 - DNA, 16 bp, Homo sapiens
caccatgcagcccctg

SEQ ID NO: 1187509 - DNA, 16 bp, Homo sapiens
caccatgcttgcctga

SEQ ID NO: 1187510 - DNA, 18 bp, Homo sapiens
caccatgcttgcctgaag

SEQ ID NO: 1187511 - DNA, 15 bp, Homo sapiens
caccatgggaaactg

SEQ ID NO: 1187512 - DNA, 20 bp, Homo sapiens
caccatgggaggtggggcct

SEQ ID NO: 1187513 - DNA, 22 bp, Homo sapiens
caccatgggaggtggggcctca

SEQ ID NO: 1187514 - DNA, 20 bp, Homo sapiens
caccatgttgcccaggctgg

SEQ ID NO: 1187515 - DNA, 19 bp, Homo sapiens
caccatgttggccaggctg

SEQ ID NO: 1187516 - DNA, 19 bp, Homo sapiens
caccattataaaaacactt

SEQ ID NO: 1187517 - DNA, 16 bp, Homo sapiens
caccattcacatttga

SEQ ID NO: 1187518 - DNA, 14 bp, Homo sapiens
caccattcctgcct

SEQ ID NO: 1187519 - DNA, 14 bp, Homo sapiens
caccattgaaggct

SEQ ID NO: 1187520 - DNA, 15 bp, Homo sapiens
caccattgaaggctt

SEQ ID NO: 1187521 - DNA, 16 bp, Homo sapiens
caccattgaaggctta

SEQ ID NO: 1187522 - DNA, 21 bp, Homo sapiens
caccattggacagtctccctg

SEQ ID NO: 1187523 - DNA, 18 bp, Homo sapiens
caccatttcttggcattg

SEQ ID NO: 1187524 - DNA, 21 bp, Homo sapiens
cacccaaaaatatctcctcca

SEQ ID NO: 1187525 - DNA, 22 bp, Homo sapiens
cacccaaaacacgcacaccctg

SEQ ID NO: 1187526 - DNA, 23 bp, Homo sapiens
cacccaaaagtcaaaaggtgcct

SEQ ID NO: 1187527 - DNA, 17 bp, Homo sapiens
cacccaaacacttctgc

SEQ ID NO: 1187528 - DNA, 18 bp, Homo sapiens
cacccaaacacttctgct

SEQ ID NO: 1187529 - DNA, 19 bp, Homo sapiens
cacccaaacacttctgctt

SEQ ID NO: 1187530 - DNA, 21 bp, Homo sapiens
cacccaaaccccttcccacga

SEQ ID NO: 1187531 - DNA, 21 bp, Homo sapiens
cacccaaagcctgtcccagga

SEQ ID NO: 1187532 - DNA, 17 bp, Homo sapiens
cacccaacagctcagag

SEQ ID NO: 1187533 - DNA, 24 bp, Homo sapiens
cacccaaccctatctcctgacaga

SEQ ID NO: 1187534 - DNA, 16 bp, Homo sapiens
cacccaagcaaggcca

SEQ ID NO: 1187535 - DNA, 22 bp, Homo sapiens
cacccaagcctgatccagcctt

SEQ ID NO: 1187536 - DNA, 14 bp, Homo sapiens
cacccaagcctgct

SEQ ID NO: 1187537 - DNA, 16 bp, Homo sapiens
cacccaagcctgctgg

SEQ ID NO: 1187538 - DNA, 20 bp, Homo sapiens
cacccaagcctgctggctgc

SEQ ID NO: 1187539 - DNA, 15 bp, Homo sapiens
cacccaagcttggca

SEQ ID NO: 1187540 - DNA, 19 bp, Homo sapiens
cacccaatcaagggaagaa

SEQ ID NO: 1187541 - DNA, 16 bp, Homo sapiens
cacccaattcaaaaca

SEQ ID NO: 1187542 - DNA, 15 bp, Homo sapiens
cacccaattggccca

SEQ ID NO: 1187543 - DNA, 23 bp, Homo sapiens
cacccaattggcccaacactgtc

SEQ ID NO: 1187544 - DNA, 14 bp, Homo sapiens
cacccacaagcccg

SEQ ID NO: 1187545 - DNA, 21 bp, Homo sapiens
cacccacacactcgcccgccc

SEQ ID NO: 1187546 - DNA, 16 bp, Homo sapiens
cacccacacagctgcc

SEQ ID NO: 1187547 - DNA, 14 bp, Homo sapiens
cacccaccccacag

SEQ ID NO: 1187548 - DNA, 11 bp, Homo sapiens
cacccaccccc

SEQ ID NO: 1187549 - DNA, 14 bp, Homo sapiens
cacccacccccagg

SEQ ID NO: 1187550 - DNA, 15 bp, Homo sapiens
cacccacccccaggc

SEQ ID NO: 1187551 - DNA, 17 bp, Homo sapiens
cacccacccccaggcct

SEQ ID NO: 1187552 - DNA, 19 bp, Homo sapiens
cacccacccccaggcctcc

SEQ ID NO: 1187553 - DNA, 14 bp, Homo sapiens
cacccacccctgca

SEQ ID NO: 1187554 - DNA, 24 bp, Homo sapiens
cacccacccgccgcctcccacggc

SEQ ID NO: 1187555 - DNA, 13 bp, Homo sapiens
cacccaccctggg

SEQ ID NO: 1187556 - DNA, 15 bp, Homo sapiens
cacccaccctttttt

SEQ ID NO: 1187557 - DNA, 22 bp, Homo sapiens
cacccaccgtccgccctgctcc

SEQ ID NO: 1187558 - DNA, 12 bp, Homo sapiens
cacccacctcca

SEQ ID NO: 1187559 - DNA, 13 bp, Homo sapiens
cacccacctccct

SEQ ID NO: 1187560 - DNA, 15 bp, Homo sapiens
cacccacctccctgc

SEQ ID NO: 1187561 - DNA, 16 bp, Homo sapiens
cacccacctccctgcc

SEQ ID NO: 1187562 - DNA, 19 bp, Homo sapiens
cacccacctcggcctccca

SEQ ID NO: 1187563 - DNA, 18 bp, Homo sapiens
caccccctttgctgtgag

SEQ ID NO: 1187564 - DNA, 20 bp, Homo sapiens
caccccgaaatcagccccca

SEQ ID NO: 1187565 - DNA, 15 bp, Homo sapiens
caccccgagggctga

SEQ ID NO: 1187566 - DNA, 16 bp, Homo sapiens
caccccgccgttccct

SEQ ID NO: 1187567 - DNA, 14 bp, Homo sapiens
caccccgccttggc

SEQ ID NO: 1187568 - DNA, 23 bp, Homo sapiens
caccccgcttttgcagcagagga

SEQ ID NO: 1187569 - DNA, 19 bp, Homo sapiens
caccccggcctccactccc

SEQ ID NO: 1187570 - DNA, 19 bp, Homo sapiens
caccccggggaccctgtga

SEQ ID NO: 1187571 - DNA, 15 bp, Homo sapiens
cacccctaaagagat

SEQ ID NO: 1187572 - DNA, 18 bp, Homo sapiens
cacccctacccctggctg

SEQ ID NO: 1187573 - DNA, 12 bp, Homo sapiens
cacccctaggac

SEQ ID NO: 1187574 - DNA, 20 bp, Homo sapiens
cacccctcaacacctctgca

SEQ ID NO: 1187575 - DNA, 14 bp, Homo sapiens
cacccctcactccc

SEQ ID NO: 1187576 - DNA, 13 bp, Homo sapiens
cacccctccagga

SEQ ID NO: 1187577 - DNA, 10 bp, Homo sapiens
cacccctccc

SEQ ID NO: 1187578 - DNA, 13 bp, Homo sapiens
cacccctccctgc

SEQ ID NO: 1187579 - DNA, 18 bp, Homo sapiens
cacccctccgtgtggagc

SEQ ID NO: 1187580 - DNA, 12 bp, Homo sapiens
cacccctgcact

SEQ ID NO: 1187581 - DNA, 11 bp, Homo sapiens
cacccctgccc

SEQ ID NO: 1187582 - DNA, 18 bp, Homo sapiens
cacccctgcccccacttc

SEQ ID NO: 1187583 - DNA, 18 bp, Homo sapiens
cacccctgcccccagccc

SEQ ID NO: 1187584 - DNA, 16 bp, Homo sapiens
cacccctgggcaggcg

SEQ ID NO: 1187585 - DNA, 14 bp, Homo sapiens
cacccctgggggct

SEQ ID NO: 1187586 - DNA, 13 bp, Homo sapiens
cacccctgtgctc

SEQ ID NO: 1187587 - DNA, 14 bp, Homo sapiens
caccccttccatgt

SEQ ID NO: 1187588 - DNA, 12 bp, Homo sapiens
caccccttcccc

SEQ ID NO: 1187589 - DNA, 14 bp, Homo sapiens
caccccttccccac

SEQ ID NO: 1187590 - DNA, 12 bp, Homo sapiens
caccccttcctg

SEQ ID NO: 1187591 - DNA, 14 bp, Homo sapiens
caccccttcctgtc

SEQ ID NO: 1187592 - DNA, 19 bp, Homo sapiens
caccccttcgacatgctgc

SEQ ID NO: 1187593 - DNA, 15 bp, Homo sapiens
caccccttggcccct

SEQ ID NO: 1187594 - DNA, 17 bp, Homo sapiens
caccccttggcccctca

SEQ ID NO: 1187595 - DNA, 21 bp, Homo sapiens
cacccctttcctccccataca

SEQ ID NO: 1187596 - DNA, 22 bp, Homo sapiens
cacccctttctagttcaatgcc

SEQ ID NO: 1187597 - DNA, 17 bp, Homo sapiens
cacccgaagtcctgtca

SEQ ID NO: 1187598 - DNA, 18 bp, Homo sapiens
cacccgaagtcctgtcac

SEQ ID NO: 1187599 - DNA, 15 bp, Homo sapiens
cacccgactcctcaa

SEQ ID NO: 1187600 - DNA, 16 bp, Homo sapiens
cacccgactcctcaaa

SEQ ID NO: 1187601 - DNA, 16 bp, Homo sapiens
cacccgagtacctcca

SEQ ID NO: 1187602 - DNA, 19 bp, Homo sapiens
cacccgagtacctccagtc

SEQ ID NO: 1187603 - DNA, 13 bp, Homo sapiens
cacccgatgctgc

SEQ ID NO: 1187604 - DNA, 20 bp, Homo sapiens
cacccgccgccactaggtgt

SEQ ID NO: 1187605 - DNA, 23 bp, Homo sapiens
cacccgccgccactaggtgtccc

SEQ ID NO: 1187606 - DNA, 17 bp, Homo sapiens
cacccgcttcctgtttc

SEQ ID NO: 1187607 - DNA, 22 bp, Homo sapiens
cacccggacaggtggggcctca

SEQ ID NO: 1187608 - DNA, 23 bp, Homo sapiens
cacccggacaggtggggcctcag

SEQ ID NO: 1187609 - DNA, 18 bp, Homo sapiens
cacccggccacagctgct

SEQ ID NO: 1187610 - DNA, 19 bp, Homo sapiens
cacccggccacagctgctg

SEQ ID NO: 1187611 - DNA, 17 bp, Homo sapiens
cacccgggctgcctgcc

SEQ ID NO: 1187612 - DNA, 19 bp, Homo sapiens
cacccggggccagagacat

SEQ ID NO: 1187613 - DNA, 17 bp, Homo sapiens
cacccgggggagcccag

SEQ ID NO: 1187614 - DNA, 20 bp, Homo sapiens
cacccggtggctctggtatg

SEQ ID NO: 1187615 - DNA, 19 bp, Homo sapiens
cacccgtcctccctcagcc

SEQ ID NO: 1187616 - DNA, 21 bp, Homo sapiens
cacccgtcctccctcagcctc

SEQ ID NO: 1187617 - DNA, 17 bp, Homo sapiens
cacccgtggggtgctgc

SEQ ID NO: 1187618 - DNA, 21 bp, Homo sapiens
cacccgtgtggtaccttcagc

SEQ ID NO: 1187619 - DNA, 18 bp, Homo sapiens
cacccgttctgctggcct

SEQ ID NO: 1187620 - DNA, 20 bp, Homo sapiens
cacccgttctgctggcctgg

SEQ ID NO: 1187621 - DNA, 21 bp, Homo sapiens
cacccgttctgctggcctgga

SEQ ID NO: 1187622 - DNA, 16 bp, Homo sapiens
caccctaccagctcct

SEQ ID NO: 1187623 - DNA, 18 bp, Homo sapiens
caccctaccagctcctcc

SEQ ID NO: 1187624 - DNA, 19 bp, Homo sapiens
caccctaccagctcctcca

SEQ ID NO: 1187625 - DNA, 17 bp, Homo sapiens
caccctaggcagcctgc

SEQ ID NO: 1187626 - DNA, 20 bp, Homo sapiens
caccctagtcccttcccctc

SEQ ID NO: 1187627 - DNA, 13 bp, Homo sapiens
caccctatatata

SEQ ID NO: 1187628 - DNA, 17 bp, Homo sapiens
caccctatccctgtaca

SEQ ID NO: 1187629 - DNA, 18 bp, Homo sapiens
caccctatccctgtacag

SEQ ID NO: 1187630 - DNA, 21 bp, Homo sapiens
ctaccccttcctgtcctgcct

SEQ ID NO: 1187631 - DNA, 13 bp, Homo sapiens
ctaccccttggaa

SEQ ID NO: 1187632 - DNA, 17 bp, Homo sapiens
ctacccctttcttctcg

SEQ ID NO: 1187633 - DNA, 13 bp, Homo sapiens
ctacccgagccca

SEQ ID NO: 1187634 - DNA, 15 bp, Homo sapiens
ctacccgagcccagc

SEQ ID NO: 1187635 - DNA, 22 bp, Homo sapiens
ctacccgtgcctgggcccctcc

SEQ ID NO: 1187636 - DNA, 18 bp, Homo sapiens
ctaccctagccattcctg

SEQ ID NO: 1187637 - DNA, 16 bp, Homo sapiens
ctaccctcccaccccc

SEQ ID NO: 1187638 - DNA, 14 bp, Homo sapiens
ctaccctccttcca

SEQ ID NO: 1187639 - DNA, 16 bp, Homo sapiens
ctaccctcgggcccac

SEQ ID NO: 1187640 - DNA, 19 bp, Homo sapiens
ctaccctcgggcccacctg

SEQ ID NO: 1187641 - DNA, 18 bp, Homo sapiens
ctaccctgagctgaggca

SEQ ID NO: 1187642 - DNA, 14 bp, Homo sapiens
ctaccctgattctt

SEQ ID NO: 1187643 - DNA, 17 bp, Homo sapiens
ctaccctgtcctttgca

SEQ ID NO: 1187644 - DNA, 21 bp, Homo sapiens
ctaccctgtctgtcccttttc

SEQ ID NO: 1187645 - DNA, 19 bp, Homo sapiens
ctaccctttttctccagct

SEQ ID NO: 1187646 - DNA, 15 bp, Homo sapiens
ctaccgatggtccca

SEQ ID NO: 1187647 - DNA, 16 bp, Homo sapiens
ctaccgatggtcccag

SEQ ID NO: 1187648 - DNA, 13 bp, Homo sapiens
ctaccgcaggccc

SEQ ID NO: 1187649 - DNA, 13 bp, Homo sapiens
ctaccgccctggg

SEQ ID NO: 1187650 - DNA, 16 bp, Homo sapiens
ctaccgccctgggctg

SEQ ID NO: 1187651 - DNA, 17 bp, Homo sapiens
ctaccgccctgggctgg

SEQ ID NO: 1187652 - DNA, 21 bp, Homo sapiens
ctaccgctcccctctcctccg

SEQ ID NO: 1187653 - DNA, 14 bp, Homo sapiens
ctaccgtatttcag

SEQ ID NO: 1187654 - DNA, 16 bp, Homo sapiens
ctacctataggaaagt

SEQ ID NO: 1187655 - DNA, 17 bp, Homo sapiens
ctacctcaagttcttgg

SEQ ID NO: 1187656 - DNA, 18 bp, Homo sapiens
ctacctcaagttcttgga

SEQ ID NO: 1187657 - DNA, 15 bp, Homo sapiens
ctacctcacctgggc

SEQ ID NO: 1187658 - DNA, 16 bp, Homo sapiens
ctacctcacctgggca

SEQ ID NO: 1187659 - DNA, 16 bp, Homo sapiens
ctacctcagcctcctg

SEQ ID NO: 1187660 - DNA, 13 bp, Homo sapiens
ctacctcaggcag

SEQ ID NO: 1187661 - DNA, 15 bp, Homo sapiens
ctacctcatctctga

SEQ ID NO: 1187662 - DNA, 15 bp, Homo sapiens
ctacctccaccctgc

SEQ ID NO: 1187663 - DNA, 17 bp, Homo sapiens
ctacctccaccctgcat

SEQ ID NO: 1187664 - DNA, 11 bp, Homo sapiens
ctacctccctc

SEQ ID NO: 1187665 - DNA, 12 bp, Homo sapiens
ctacctccctcc

SEQ ID NO: 1187666 - DNA, 13 bp, Homo sapiens
ctacctccctccc

SEQ ID NO: 1187667 - DNA, 14 bp, Homo sapiens
ctacctccctcctc

SEQ ID NO: 1187668 - DNA, 15 bp, Homo sapiens
ctacctcccttgcct

SEQ ID NO: 1187669 - DNA, 16 bp, Homo sapiens
ctacctctctgtccct

SEQ ID NO: 1187670 - DNA, 13 bp, Homo sapiens
ctacctctctttc

SEQ ID NO: 1187671 - DNA, 23 bp, Homo sapiens
ctacctcttttgagactttgccc

SEQ ID NO: 1187672 - DNA, 16 bp, Homo sapiens
ctacctggagggaaga

SEQ ID NO: 1187673 - DNA, 23 bp, Homo sapiens
ctacctggagggaagagtggagg

SEQ ID NO: 1187674 - DNA, 17 bp, Homo sapiens
ctacctggggactcctc

SEQ ID NO: 1187675 - DNA, 21 bp, Homo sapiens
ctacctgtgtttttttctaaa

SEQ ID NO: 1187676 - DNA, 12 bp, Homo sapiens
ctaccttcctgt

SEQ ID NO: 1187677 - DNA, 13 bp, Homo sapiens
ctaccttcctgtc

SEQ ID NO: 1187678 - DNA, 19 bp, Homo sapiens
ctaccttcctgtccctgag

SEQ ID NO: 1187679 - DNA, 14 bp, Homo sapiens
ctaccttgaaaata

SEQ ID NO: 1187680 - DNA, 22 bp, Homo sapiens
ctaccttgctagctagccagcc

SEQ ID NO: 1187681 - DNA, 23 bp, Homo sapiens
ctaccttgctagctagccagcca

SEQ ID NO: 1187682 - DNA, 16 bp, Homo sapiens
ctaccttgttgtgttt

SEQ ID NO: 1187683 - DNA, 20 bp, Homo sapiens
ctacctttttatatttaaaa

SEQ ID NO: 1187684 - DNA, 22 bp, Homo sapiens
ctaccttttttttttgagttta

SEQ ID NO: 1187685 - DNA, 17 bp, Homo sapiens
ctacgctcatctctgga

SEQ ID NO: 1187686 - DNA, 18 bp, Homo sapiens
cacctatctcgtgggaga

SEQ ID NO: 1187687 - DNA, 16 bp, Homo sapiens
cacctatgttattttg

SEQ ID NO: 1187688 - DNA, 15 bp, Homo sapiens
cacctcaccaaggat

SEQ ID NO: 1187689 - DNA, 12 bp, Homo sapiens
cacctcacctct

SEQ ID NO: 1187690 - DNA, 13 bp, Homo sapiens
cacctcactcctg

SEQ ID NO: 1187691 - DNA, 14 bp, Homo sapiens
cacctcactcctgt

SEQ ID NO: 1187692 - DNA, 20 bp, Homo sapiens
cacctcagaaagtcaccagg

SEQ ID NO: 1187693 - DNA, 19 bp, Homo sapiens
cacctcagaggctgttctt

SEQ ID NO: 1187694 - DNA, 21 bp, Homo sapiens
cacctcagagtggagttgaaa

SEQ ID NO: 1187695 - DNA, 15 bp, Homo sapiens
cacctcagcctccca

SEQ ID NO: 1187696 - DNA, 12 bp, Homo sapiens
cacctcagcctt

SEQ ID NO: 1187697 - DNA, 13 bp, Homo sapiens
cacctcagccttg

SEQ ID NO: 1187698 - DNA, 15 bp, Homo sapiens
cacctcaggccaggt

SEQ ID NO: 1187699 - DNA, 13 bp, Homo sapiens
cacctcagggcac

SEQ ID NO: 1187700 - DNA, 17 bp, Homo sapiens
cacctcagttcccttgg

SEQ ID NO: 1187701 - DNA, 22 bp, Homo sapiens
cacctcagttcccttggcctca

SEQ ID NO: 1187702 - DNA, 13 bp, Homo sapiens
cacctcatgagtc

SEQ ID NO: 1187703 - DNA, 18 bp, Homo sapiens
cacctcatgcccaccccc

SEQ ID NO: 1187704 - DNA, 21 bp, Homo sapiens
cacctcatgcccaccccctgc

SEQ ID NO: 1187705 - DNA, 20 bp, Homo sapiens
cacctcatggattgccacag

SEQ ID NO: 1187706 - DNA, 14 bp, Homo sapiens
cacctcattctgaa

SEQ ID NO: 1187707 - DNA, 22 bp, Homo sapiens
cacctccaagcatttcatgaaa

SEQ ID NO: 1187708 - DNA, 16 bp, Homo sapiens
cacctccacatcctcc

SEQ ID NO: 1187709 - DNA, 12 bp, Homo sapiens
cacctccaccca

SEQ ID NO: 1187710 - DNA, 15 bp, Homo sapiens
cacctccacccagcc

SEQ ID NO: 1187711 - DNA, 16 bp, Homo sapiens
cacctccacccagccc

SEQ ID NO: 1187712 - DNA, 17 bp, Homo sapiens
cacctccacccagcccc

SEQ ID NO: 1187713 - DNA, 18 bp, Homo sapiens
cacctccacccagcccct

SEQ ID NO: 1187714 - DNA, 19 bp, Homo sapiens
cacctccacccagcccctg

SEQ ID NO: 1187715 - DNA, 18 bp, Homo sapiens
cacctccacgccactgcc

SEQ ID NO: 1187716 - DNA, 17 bp, Homo sapiens
cacctccagcccgggag

SEQ ID NO: 1187717 - DNA, 18 bp, Homo sapiens
cacctccagcccgggagc

SEQ ID NO: 1187718 - DNA, 18 bp, Homo sapiens
cacctccaggcaggccag

SEQ ID NO: 1187719 - DNA, 21 bp, Homo sapiens
cacctccaggcaggccaggct

SEQ ID NO: 1187720 - DNA, 13 bp, Homo sapiens
cacctccaggcct

SEQ ID NO: 1187721 - DNA, 10 bp, Homo sapiens
cacctcccag

SEQ ID NO: 1187722 - DNA, 12 bp, Homo sapiens
cacctcccagga

SEQ ID NO: 1187723 - DNA, 20 bp, Homo sapiens
cacctcccatttctgttgct

SEQ ID NO: 1187724 - DNA, 22 bp, Homo sapiens
cacctccccacacacaggcctt

SEQ ID NO: 1187725 - DNA, 16 bp, Homo sapiens
cacctccccagcattc

SEQ ID NO: 1187726 - DNA, 14 bp, Homo sapiens
cacctcccccatct

SEQ ID NO: 1187727 - DNA, 14 bp, Homo sapiens
cacctccccccact

SEQ ID NO: 1187728 - DNA, 21 bp, Homo sapiens
cacctccccccactgcaggcc

SEQ ID NO: 1187729 - DNA, 11 bp, Homo sapiens
cacctccccct

SEQ ID NO: 1187730 - DNA, 17 bp, Homo sapiens
cacctccccctacccat

SEQ ID NO: 1187731 - DNA, 21 bp, Homo sapiens
cacctccccctacccatatcc

SEQ ID NO: 1187732 - DNA, 21 bp, Homo sapiens
cacctccccctttcacactgg

SEQ ID NO: 1187733 - DNA, 23 bp, Homo sapiens
cacctccccctttcacactggat

SEQ ID NO: 1187734 - DNA, 16 bp, Homo sapiens
cacctccccgctggga

SEQ ID NO: 1187735 - DNA, 13 bp, Homo sapiens
cacctcccctatc

SEQ ID NO: 1187736 - DNA, 11 bp, Homo sapiens
cacctcccctc

SEQ ID NO: 1187737 - DNA, 23 bp, Homo sapiens
cacctcccctccttgcctcctgt

SEQ ID NO: 1187738 - DNA, 12 bp, Homo sapiens
cacctccctccc

SEQ ID NO: 1187739 - DNA, 15 bp, Homo sapiens
cacctccctccccag

SEQ ID NO: 1187740 - DNA, 13 bp, Homo sapiens
cacctccctctgc

SEQ ID NO: 1187741 - DNA, 13 bp, Homo sapiens
cacctccctgcct

SEQ ID NO: 1187742 - DNA, 21 bp, Homo sapiens
cacctccctgcgcccttgagg

SEQ ID NO: 1187743 - DNA, 18 bp, Homo sapiens
cacctccctgctcagtgc

SEQ ID NO: 1187744 - DNA, 12 bp, Homo sapiens
cacctcccttcc

SEQ ID NO: 1187745 - DNA, 22 bp, Homo sapiens
cacctcccttcccacctactgc

SEQ ID NO: 1187746 - DNA, 18 bp, Homo sapiens
cacctccgcttgccagag

SEQ ID NO: 1187747 - DNA, 18 bp, Homo sapiens
cacctccggctgcctagc

SEQ ID NO: 1187748 - DNA, 22 bp, Homo sapiens
cacctccggctgcctagccctc

SEQ ID NO: 1187749 - DNA, 20 bp, Homo sapiens
cacctcctaccccttcctgt

SEQ ID NO: 1187750 - DNA, 13 bp, Homo sapiens
cacctcctaccct

SEQ ID NO: 1187751 - DNA, 21 bp, Homo sapiens
cacctcctagaggtgggcagc

SEQ ID NO: 1187752 - DNA, 22 bp, Homo sapiens
cacctcctagaggtgggcagct

SEQ ID NO: 1187753 - DNA, 23 bp, Homo sapiens
cacctcctagaggtgggcagctg

SEQ ID NO: 1187754 - DNA, 13 bp, Homo sapiens
cacctcctccact

SEQ ID NO: 1187755 - DNA, 20 bp, Homo sapiens
cacctcctccccctgttctg

SEQ ID NO: 1187756 - DNA, 19 bp, Homo sapiens
cacctcctgagaaggcgag

SEQ ID NO: 1187757 - DNA, 14 bp, Homo sapiens
cacctcctgcggct

SEQ ID NO: 1187758 - DNA, 17 bp, Homo sapiens
cacctcctgcggctcag

SEQ ID NO: 1187759 - DNA, 18 bp, Homo sapiens
cacctcctgcggctcagc

SEQ ID NO: 1187760 - DNA, 20 bp, Homo sapiens
cacctcctgcggctcagcct

SEQ ID NO: 1187761 - DNA, 22 bp, Homo sapiens
cacctcctgcggctcagccttg

SEQ ID NO: 1187762 - DNA, 19 bp, Homo sapiens
cacctcgctcccctctgga

SEQ ID NO: 1187763 - DNA, 20 bp, Homo sapiens
cacctcgctcccctctggaa

SEQ ID NO: 1187764 - DNA, 18 bp, Homo sapiens
cacctcggggacaccaga

SEQ ID NO: 1187765 - DNA, 15 bp, Homo sapiens
ctagagcctcgacac

SEQ ID NO: 1187766 - DNA, 17 bp, Homo sapiens
ctagagctccagttctt

SEQ ID NO: 1187767 - DNA, 17 bp, Homo sapiens
ctagagctgagagtctg

SEQ ID NO: 1187768 - DNA, 15 bp, Homo sapiens
ctagaggaaaagaaa

SEQ ID NO: 1187769 - DNA, 15 bp, Homo sapiens
ctagaggcagggagg

SEQ ID NO: 1187770 - DNA, 21 bp, Homo sapiens
ctagaggccagccccacccag

SEQ ID NO: 1187771 - DNA, 14 bp, Homo sapiens
ctagaggccaggga

SEQ ID NO: 1187772 - DNA, 17 bp, Homo sapiens
ctagaggccagggcagc

SEQ ID NO: 1187773 - DNA, 12 bp, Homo sapiens
ctagaggcctga

SEQ ID NO: 1187774 - DNA, 13 bp, Homo sapiens
ctagaggcctgag

SEQ ID NO: 1187775 - DNA, 15 bp, Homo sapiens
ctagaggcctgagga

SEQ ID NO: 1187776 - DNA, 22 bp, Homo sapiens
ctagaggcctgaggatgagctg

SEQ ID NO: 1187777 - DNA, 16 bp, Homo sapiens
ctagagggacctctcc

SEQ ID NO: 1187778 - DNA, 14 bp, Homo sapiens
ctagagggcccatc

SEQ ID NO: 1187779 - DNA, 16 bp, Homo sapiens
ctagagggttcctgta

SEQ ID NO: 1187780 - DNA, 15 bp, Homo sapiens
ctagaggtcaggacg

SEQ ID NO: 1187781 - DNA, 20 bp, Homo sapiens
ctagaggtgggcagctgggc

SEQ ID NO: 1187782 - DNA, 22 bp, Homo sapiens
ctagaggtgggcagctgggccc

SEQ ID NO: 1187783 - DNA, 23 bp, Homo sapiens
ctagaggtgttacagaggaccct

SEQ ID NO: 1187784 - DNA, 23 bp, Homo sapiens
ctagaggttgcagcatgagactt

SEQ ID NO: 1187785 - DNA, 18 bp, Homo sapiens
ctagagtcatgtgagcct

SEQ ID NO: 1187786 - DNA, 15 bp, Homo sapiens
ctagagtcctcactc

SEQ ID NO: 1187787 - DNA, 20 bp, Homo sapiens
ctagagtctgaacagctgta

SEQ ID NO: 1187788 - DNA, 15 bp, Homo sapiens
ctagagtcttaaagc

SEQ ID NO: 1187789 - DNA, 21 bp, Homo sapiens
ctagagtgaacttgggccact

SEQ ID NO: 1187790 - DNA, 13 bp, Homo sapiens
ctagagtgtagcc

SEQ ID NO: 1187791 - DNA, 15 bp, Homo sapiens
ctagagtgtagccta

SEQ ID NO: 1187792 - DNA, 16 bp, Homo sapiens
ctagagtgtagcctaa

SEQ ID NO: 1187793 - DNA, 15 bp, Homo sapiens
ctagagttcggtctg

SEQ ID NO: 1187794 - DNA, 13 bp, Homo sapiens
ctagataaaaaga

SEQ ID NO: 1187795 - DNA, 16 bp, Homo sapiens
ctagataaaaagatgg

SEQ ID NO: 1187796 - DNA, 12 bp, Homo sapiens
ctagataaaagc

SEQ ID NO: 1187797 - DNA, 17 bp, Homo sapiens
ctagatacaataaattg

SEQ ID NO: 1187798 - DNA, 22 bp, Homo sapiens
ctagatacagaagcccatgtct

SEQ ID NO: 1187799 - DNA, 13 bp, Homo sapiens
ctagatactggaa

SEQ ID NO: 1187800 - DNA, 13 bp, Homo sapiens
ctagatactgtat

SEQ ID NO: 1187801 - DNA, 18 bp, Homo sapiens
ctagatcatatttaaaga

SEQ ID NO: 1187802 - DNA, 19 bp, Homo sapiens
ctagatccacacacagagg

SEQ ID NO: 1187803 - DNA, 21 bp, Homo sapiens
ctagatccacacacagaggaa

SEQ ID NO: 1187804 - DNA, 18 bp, Homo sapiens
ctagatcctgcaccccag

SEQ ID NO: 1187805 - DNA, 20 bp, Homo sapiens
ctagatgattttttgaaagt

SEQ ID NO: 1187806 - DNA, 21 bp, Homo sapiens
ctagatgattttttgaaagtt

SEQ ID NO: 1187807 - DNA, 16 bp, Homo sapiens
ctagatgcatcactgg

SEQ ID NO: 1187808 - DNA, 17 bp, Homo sapiens
ctagatgcatcactggg

SEQ ID NO: 1187809 - DNA, 21 bp, Homo sapiens
caccttcccagctctccctct

SEQ ID NO: 1187810 - DNA, 22 bp, Homo sapiens
caccttcccagctctccctctg

SEQ ID NO: 1187811 - DNA, 11 bp, Homo sapiens
caccttcccca

SEQ ID NO: 1187812 - DNA, 10 bp, Homo sapiens
caccttccct

SEQ ID NO: 1187813 - DNA, 13 bp, Homo sapiens
caccttcccttct

SEQ ID NO: 1187814 - DNA, 20 bp, Homo sapiens
caccttcccttctacaagga

SEQ ID NO: 1187815 - DNA, 12 bp, Homo sapiens
caccttcccttg

SEQ ID NO: 1187816 - DNA, 17 bp, Homo sapiens
caccttcccttgccact

SEQ ID NO: 1187817 - DNA, 19 bp, Homo sapiens
caccttcccttgccacttt

SEQ ID NO: 1187818 - DNA, 21 bp, Homo sapiens
caccttcccttgccactttgc

SEQ ID NO: 1187819 - DNA, 14 bp, Homo sapiens
caccttcctcactt

SEQ ID NO: 1187820 - DNA, 20 bp, Homo sapiens
caccttcctcacttccatac

SEQ ID NO: 1187821 - DNA, 15 bp, Homo sapiens
caccttcctcctgca

SEQ ID NO: 1187822 - DNA, 18 bp, Homo sapiens
caccttcctcctgcagac

SEQ ID NO: 1187823 - DNA, 16 bp, Homo sapiens
caccttcctgtgggtg

SEQ ID NO: 1187824 - DNA, 17 bp, Homo sapiens
caccttctgagtattct

SEQ ID NO: 1187825 - DNA, 17 bp, Homo sapiens
caccttctgtccccagc

SEQ ID NO: 1187826 - DNA, 21 bp, Homo sapiens
caccttctgtccccagccctg

SEQ ID NO: 1187827 - DNA, 17 bp, Homo sapiens
caccttcttaaaagaaa

SEQ ID NO: 1187828 - DNA, 20 bp, Homo sapiens
caccttcttggcttctggga

SEQ ID NO: 1187829 - DNA, 18 bp, Homo sapiens
caccttctttctggactg

SEQ ID NO: 1187830 - DNA, 13 bp, Homo sapiens
caccttgccaggg

SEQ ID NO: 1187831 - DNA, 18 bp, Homo sapiens
caccttgccagggcaggg

SEQ ID NO: 1187832 - DNA, 16 bp, Homo sapiens
caccttgccgagagag

SEQ ID NO: 1187833 - DNA, 17 bp, Homo sapiens
caccttgccgagagagg

SEQ ID NO: 1187834 - DNA, 16 bp, Homo sapiens
caccttgcttgaggga

SEQ ID NO: 1187835 - DNA, 17 bp, Homo sapiens
caccttggacatcctcc

SEQ ID NO: 1187836 - DNA, 19 bp, Homo sapiens
caccttggaccctggtgac

SEQ ID NO: 1187837 - DNA, 17 bp, Homo sapiens
caccttggactcctccc

SEQ ID NO: 1187838 - DNA, 22 bp, Homo sapiens
caccttggactcctcccacaat

SEQ ID NO: 1187839 - DNA, 14 bp, Homo sapiens
caccttggatggtt

SEQ ID NO: 1187840 - DNA, 15 bp, Homo sapiens
caccttggcccagga

SEQ ID NO: 1187841 - DNA, 17 bp, Homo sapiens
caccttggcccaggagc

SEQ ID NO: 1187842 - DNA, 22 bp, Homo sapiens
caccttggcccaggagctctgc

SEQ ID NO: 1187843 - DNA, 16 bp, Homo sapiens
caccttggcttgttat

SEQ ID NO: 1187844 - DNA, 19 bp, Homo sapiens
caccttggtccctctcaga

SEQ ID NO: 1187845 - DNA, 12 bp, Homo sapiens
caccttgttaca

SEQ ID NO: 1187846 - DNA, 13 bp, Homo sapiens
caccttgttacaa

SEQ ID NO: 1187847 - DNA, 19 bp, Homo sapiens
cacctttagaacaggagac

SEQ ID NO: 1187848 - DNA, 12 bp, Homo sapiens
cacctttattaa

SEQ ID NO: 1187849 - DNA, 13 bp, Homo sapiens
cacctttcctctc

SEQ ID NO: 1187850 - DNA, 20 bp, Homo sapiens
cacctttcctctccctcagg

SEQ ID NO: 1187851 - DNA, 17 bp, Homo sapiens
cacctttctagttgaaa

SEQ ID NO: 1187852 - DNA, 14 bp, Homo sapiens
cacctttctgggct

SEQ ID NO: 1187853 - DNA, 15 bp, Homo sapiens
cacctttctgggctt

SEQ ID NO: 1187854 - DNA, 23 bp, Homo sapiens
cacctttctgggctttctcctgg

SEQ ID NO: 1187855 - DNA, 18 bp, Homo sapiens
cacctttgcacaggatgc

SEQ ID NO: 1187856 - DNA, 17 bp, Homo sapiens
cacctttgggatcagcc

SEQ ID NO: 1187857 - DNA, 20 bp, Homo sapiens
cacctttgggatcagcctcc

SEQ ID NO: 1187858 - DNA, 11 bp, Homo sapiens
cacctttgtct

SEQ ID NO: 1187859 - DNA, 21 bp, Homo sapiens
cacctttgtctggatgcacac

SEQ ID NO: 1187860 - DNA, 20 bp, Homo sapiens
caccttttcagcgatgtatg

SEQ ID NO: 1187861 - DNA, 18 bp, Homo sapiens
caccttttcatgtacagc

SEQ ID NO: 1187862 - DNA, 23 bp, Homo sapiens
caccttttcatgtacagcattaa

SEQ ID NO: 1187863 - DNA, 14 bp, Homo sapiens
caccttttctgtgg

SEQ ID NO: 1187864 - DNA, 14 bp, Homo sapiens
caccttttttccta

SEQ ID NO: 1187865 - DNA, 20 bp, Homo sapiens
cacgaaacttgttattgtga

SEQ ID NO: 1187866 - DNA, 13 bp, Homo sapiens
cacgaaatgttat

SEQ ID NO: 1187867 - DNA, 16 bp, Homo sapiens
cacgaacccacctgct

SEQ ID NO: 1187868 - DNA, 15 bp, Homo sapiens
cacgaactgttcaca

SEQ ID NO: 1187869 - DNA, 21 bp, Homo sapiens
cacgaacttgaaagttttcta

SEQ ID NO: 1187870 - DNA, 12 bp, Homo sapiens
cacgaagcctta

SEQ ID NO: 1187871 - DNA, 18 bp, Homo sapiens
cacgaagccttaagccat

SEQ ID NO: 1187872 - DNA, 21 bp, Homo sapiens
cacgaaggtaaaaagtatttt

SEQ ID NO: 1187873 - DNA, 16 bp, Homo sapiens
cacgaagtgttgcatg

SEQ ID NO: 1187874 - DNA, 18 bp, Homo sapiens
cacgaatttgctggggaa

SEQ ID NO: 1187875 - DNA, 16 bp, Homo sapiens
cacgacccctgcctcg

SEQ ID NO: 1187876 - DNA, 19 bp, Homo sapiens
cacgacgccctctccccac

SEQ ID NO: 1187877 - DNA, 16 bp, Homo sapiens
cacgactgcccggcag

SEQ ID NO: 1187878 - DNA, 16 bp, Homo sapiens
cacgactgtctccatg

SEQ ID NO: 1187879 - DNA, 21 bp, Homo sapiens
cacgagatcttccttccgctc

SEQ ID NO: 1187880 - DNA, 13 bp, Homo sapiens
cacgagatttctt

SEQ ID NO: 1187881 - DNA, 22 bp, Homo sapiens
cacgagatttcttttttatgtg

SEQ ID NO: 1187882 - DNA, 24 bp, Homo sapiens
cacgagatttcttttttatgtgat

SEQ ID NO: 1187883 - DNA, 19 bp, Homo sapiens
cacgagcaaacccagaggt

SEQ ID NO: 1187884 - DNA, 20 bp, Homo sapiens
cacgagcaaacccagaggtg

SEQ ID NO: 1187885 - DNA, 16 bp, Homo sapiens
cacgagccacaagctg

SEQ ID NO: 1187886 - DNA, 18 bp, Homo sapiens
cacgagccacaagctgca

SEQ ID NO: 1187887 - DNA, 20 bp, Homo sapiens
cacgagccacaagctgcact

SEQ ID NO: 1187888 - DNA, 21 bp, Homo sapiens
cacgagccacaagctgcactg

SEQ ID NO: 1187889 - DNA, 22 bp, Homo sapiens
cacgaggaatctgtgggtctgg

SEQ ID NO: 1187890 - DNA, 15 bp, Homo sapiens
cacgaggagcagcag

SEQ ID NO: 1187891 - DNA, 14 bp, Homo sapiens
cacgaggctgcccc

SEQ ID NO: 1187892 - DNA, 22 bp, Homo sapiens
cacgagggctggctggcctcac

SEQ ID NO: 1187893 - DNA, 19 bp, Homo sapiens
cacgaggggacccatgggg

SEQ ID NO: 1187894 - DNA, 22 bp, Homo sapiens
cacgagggtctcccctcctgca

SEQ ID NO: 1187895 - DNA, 18 bp, Homo sapiens
cacgagtcacctgcaagc

SEQ ID NO: 1187896 - DNA, 20 bp, Homo sapiens
cacgataaataatcggccca

SEQ ID NO: 1187897 - DNA, 16 bp, Homo sapiens
cacgatcccctccccc

SEQ ID NO: 1187898 - DNA, 15 bp, Homo sapiens
ctagtagtgtggcct

SEQ ID NO: 1187899 - DNA, 21 bp, Homo sapiens
ctagtagtgtggcctgtgcca

SEQ ID NO: 1187900 - DNA, 16 bp, Homo sapiens
ctagtcaagctcctcc

SEQ ID NO: 1187901 - DNA, 18 bp, Homo sapiens
ctagtcaccgacagcggc

SEQ ID NO: 1187902 - DNA, 13 bp, Homo sapiens
ctagtcagagaga

SEQ ID NO: 1187903 - DNA, 21 bp, Homo sapiens
ctagtcatttccaaacttgaa

SEQ ID NO: 1187904 - DNA, 18 bp, Homo sapiens
ctagtcccctttcctcta

SEQ ID NO: 1187905 - DNA, 17 bp, Homo sapiens
ctagtcccttcccctcc

SEQ ID NO: 1187906 - DNA, 21 bp, Homo sapiens
ctagtcccttcccctccctgg

SEQ ID NO: 1187907 - DNA, 23 bp, Homo sapiens
ctagtcccttcccctccctggct

SEQ ID NO: 1187908 - DNA, 20 bp, Homo sapiens
ctagtctacttcttaaaatt

SEQ ID NO: 1187909 - DNA, 20 bp, Homo sapiens
ctagtctcctttgcactgag

SEQ ID NO: 1187910 - DNA, 21 bp, Homo sapiens
ctagtctcctttgcactgagg

SEQ ID NO: 1187911 - DNA, 17 bp, Homo sapiens
ctagtctgtaactcttt

SEQ ID NO: 1187912 - DNA, 16 bp, Homo sapiens
ctagtctgtcagggcc

SEQ ID NO: 1187913 - DNA, 12 bp, Homo sapiens
ctagtcttctgg

SEQ ID NO: 1187914 - DNA, 14 bp, Homo sapiens
ctagtctttccagt

SEQ ID NO: 1187915 - DNA, 15 bp, Homo sapiens
ctagtcttttgcttt

SEQ ID NO: 1187916 - DNA, 12 bp, Homo sapiens
ctagtgaaactt

SEQ ID NO: 1187917 - DNA, 16 bp, Homo sapiens
ctagtgaaacttttct

SEQ ID NO: 1187918 - DNA, 17 bp, Homo sapiens
ctagtgaaggcttctct

SEQ ID NO: 1187919 - DNA, 21 bp, Homo sapiens
ctagtgaaggcttctctctgt

SEQ ID NO: 1187920 - DNA, 17 bp, Homo sapiens
ctagtgaagtggcctct

SEQ ID NO: 1187921 - DNA, 20 bp, Homo sapiens
ctagtgacttgtgtcccatg

SEQ ID NO: 1187922 - DNA, 13 bp, Homo sapiens
ctagtgagcctgg

SEQ ID NO: 1187923 - DNA, 16 bp, Homo sapiens
ctagtgagtcagcacc

SEQ ID NO: 1187924 - DNA, 19 bp, Homo sapiens
ctagtgagtcagcaccttg

SEQ ID NO: 1187925 - DNA, 13 bp, Homo sapiens
ctagtgcaaatca

SEQ ID NO: 1187926 - DNA, 16 bp, Homo sapiens
ctagtgcaaatcatag

SEQ ID NO: 1187927 - DNA, 13 bp, Homo sapiens
ctagtgcagctga

SEQ ID NO: 1187928 - DNA, 15 bp, Homo sapiens
ctagtgcagctgatt

SEQ ID NO: 1187929 - DNA, 19 bp, Homo sapiens
ctagtgcagctgattttaa

SEQ ID NO: 1187930 - DNA, 23 bp, Homo sapiens
ctagtgcagctgattttaacaat

SEQ ID NO: 1187931 - DNA, 15 bp, Homo sapiens
cacgccgccctccat

SEQ ID NO: 1187932 - DNA, 13 bp, Homo sapiens
cacgccggcctct

SEQ ID NO: 1187933 - DNA, 18 bp, Homo sapiens
cacgccggcctctgctgc

SEQ ID NO: 1187934 - DNA, 20 bp, Homo sapiens
cacgccgggagaagccacct

SEQ ID NO: 1187935 - DNA, 23 bp, Homo sapiens
cacgccgggagaagccaccttcc

SEQ ID NO: 1187936 - DNA, 21 bp, Homo sapiens
cacgcctatgatcccagcact

SEQ ID NO: 1187937 - DNA, 16 bp, Homo sapiens
cacgcctatgccctgc

SEQ ID NO: 1187938 - DNA, 15 bp, Homo sapiens
cacgcctcctggcca

SEQ ID NO: 1187939 - DNA, 17 bp, Homo sapiens
cacgcctcctggccaga

SEQ ID NO: 1187940 - DNA, 15 bp, Homo sapiens
cacgcctgcaggctg

SEQ ID NO: 1187941 - DNA, 22 bp, Homo sapiens
cacgcctgcaggctggagactg

SEQ ID NO: 1187942 - DNA, 14 bp, Homo sapiens
cacgcctgccatct

SEQ ID NO: 1187943 - DNA, 18 bp, Homo sapiens
cacgcctgccatcttctc

SEQ ID NO: 1187944 - DNA, 12 bp, Homo sapiens
cacgcctggcta

SEQ ID NO: 1187945 - DNA, 17 bp, Homo sapiens
cacgcctgtcctcctgg

SEQ ID NO: 1187946 - DNA, 19 bp, Homo sapiens
cacgcctgtcctcctggaa

SEQ ID NO: 1187947 - DNA, 15 bp, Homo sapiens
cacgccttggcctcc

SEQ ID NO: 1187948 - DNA, 20 bp, Homo sapiens
cacgccttgttcctgctctt

SEQ ID NO: 1187949 - DNA, 14 bp, Homo sapiens
cacgcgtatttaca

SEQ ID NO: 1187950 - DNA, 16 bp, Homo sapiens
cacgcgtgattgaccc

SEQ ID NO: 1187951 - DNA, 20 bp, Homo sapiens
cacgcgtgtgctcctctcct

SEQ ID NO: 1187952 - DNA, 14 bp, Homo sapiens
cacgctcagtgccc

SEQ ID NO: 1187953 - DNA, 12 bp, Homo sapiens
cacgctccagct

SEQ ID NO: 1187954 - DNA, 13 bp, Homo sapiens
cacgctccagctg

SEQ ID NO: 1187955 - DNA, 14 bp, Homo sapiens
cacgctccagctgc

SEQ ID NO: 1187956 - DNA, 15 bp, Homo sapiens
cacgctccagctgcc

SEQ ID NO: 1187957 - DNA, 18 bp, Homo sapiens
cacgctccagctgccccg

SEQ ID NO: 1187958 - DNA, 19 bp, Homo sapiens
cacgctcccccgcagtccc

SEQ ID NO: 1187959 - DNA, 13 bp, Homo sapiens
cacgctcccctcc

SEQ ID NO: 1187960 - DNA, 14 bp, Homo sapiens
cacgctcccctcca

SEQ ID NO: 1187961 - DNA, 12 bp, Homo sapiens
cacgctcgctgc

SEQ ID NO: 1187962 - DNA, 18 bp, Homo sapiens
cacgctcgctgccatcac

SEQ ID NO: 1187963 - DNA, 22 bp, Homo sapiens
cacgctcttgaggaagcccagg

SEQ ID NO: 1187964 - DNA, 18 bp, Homo sapiens
cacgctgcctgccaaagt

SEQ ID NO: 1187965 - DNA, 14 bp, Homo sapiens
cacgctgcctggtc

SEQ ID NO: 1187966 - DNA, 15 bp, Homo sapiens
cacgctgcctggtct

SEQ ID NO: 1187967 - DNA, 13 bp, Homo sapiens
cacgctgtctcca

SEQ ID NO: 1187968 - DNA, 16 bp, Homo sapiens
cacgctgtctccagac

SEQ ID NO: 1187969 - DNA, 19 bp, Homo sapiens
cacgcttttaattctcatt

SEQ ID NO: 1187970 - DNA, 21 bp, Homo sapiens
cacgcttttaattctcatttg

SEQ ID NO: 1187971 - DNA, 14 bp, Homo sapiens
cacggaagttttca

SEQ ID NO: 1187972 - DNA, 15 bp, Homo sapiens
cacggactctcccag

SEQ ID NO: 1187973 - DNA, 15 bp, Homo sapiens
cacggagagaaggcc

SEQ ID NO: 1187974 - DNA, 21 bp, Homo sapiens
cacggagcagttcagagtgga

SEQ ID NO: 1187975 - DNA, 18 bp, Homo sapiens
cacggagccactcctctg

SEQ ID NO: 1187976 - DNA, 21 bp, Homo sapiens
cacggagccactcctctgact

SEQ ID NO: 1187977 - DNA, 16 bp, Homo sapiens
cacggagggagcgaca

SEQ ID NO: 1187978 - DNA, 14 bp, Homo sapiens
cacggagggaggca

SEQ ID NO: 1187979 - DNA, 23 bp, Homo sapiens
cacggagggggacggggctcagc

SEQ ID NO: 1187980 - DNA, 16 bp, Homo sapiens
cacggatggtgcatgg

SEQ ID NO: 1187981 - DNA, 18 bp, Homo sapiens
cacggatggtgcatgggc

SEQ ID NO: 1187982 - DNA, 20 bp, Homo sapiens
cacggatggtgcatgggctc

SEQ ID NO: 1187983 - DNA, 20 bp, Homo sapiens
cacggcagccacagcttggg

SEQ ID NO: 1187984 - DNA, 22 bp, Homo sapiens
cacggcaggcgtgtggcagcca

SEQ ID NO: 1187985 - DNA, 12 bp, Homo sapiens
cacggccaccct

SEQ ID NO: 1187986 - DNA, 13 bp, Homo sapiens
cacggccaccctc

SEQ ID NO: 1187987 - DNA, 15 bp, Homo sapiens
cacggccaccctcct

SEQ ID NO: 1187988 - DNA, 23 bp, Homo sapiens
cacggccacgtcatgtctctaaa

SEQ ID NO: 1187989 - DNA, 17 bp, Homo sapiens
cacggcccggcccctca

SEQ ID NO: 1187990 - DNA, 20 bp, Homo sapiens
cacggcctttctagcctggc

SEQ ID NO: 1187991 - DNA, 17 bp, Homo sapiens
cacggcgggatcctcca

SEQ ID NO: 1187992 - DNA, 18 bp, Homo sapiens
cacggcgggatcctccac

SEQ ID NO: 1187993 - DNA, 12 bp, Homo sapiens
cacggctccgag

SEQ ID NO: 1187994 - DNA, 20 bp, Homo sapiens
cacggctccgagggcggcca

SEQ ID NO: 1187995 - DNA, 23 bp, Homo sapiens
cacggctccgagggcggccaggg

SEQ ID NO: 1187996 - DNA, 16 bp, Homo sapiens
cacggctgcgcactgt

SEQ ID NO: 1187997 - DNA, 18 bp, Homo sapiens
cacgggcatgcacacggc

SEQ ID NO: 1187998 - DNA, 21 bp, Homo sapiens
cacgggctctatgcctgcact

SEQ ID NO: 1187999 - DNA, 13 bp, Homo sapiens
cacgggctgtctg

SEQ ID NO: 1188000 - DNA, 13 bp, Homo sapiens
cacggggacctgg

SEQ ID NO: 1188001 - DNA, 16 bp, Homo sapiens
cacggggatcacagcg

SEQ ID NO: 1188002 - DNA, 22 bp, Homo sapiens
cacggggccgacattgtctccc

SEQ ID NO: 1188003 - DNA, 22 bp, Homo sapiens
cacggggttggctgttccagac

SEQ ID NO: 1188004 - DNA, 23 bp, Homo sapiens
cacggggttggctgttccagact

SEQ ID NO: 1188005 - DNA, 22 bp, Homo sapiens
cacgggtggggaaaggaggtgg

SEQ ID NO: 1188006 - DNA, 14 bp, Homo sapiens
cacgggtggtcccc

SEQ ID NO: 1188007 - DNA, 14 bp, Homo sapiens
cacggtccgcggcc

SEQ ID NO: 1188008 - DNA, 12 bp, Homo sapiens
cacggtctgagc

SEQ ID NO: 1188009 - DNA, 17 bp, Homo sapiens
cacggtctggggaagag

SEQ ID NO: 1188010 - DNA, 16 bp, Homo sapiens
cacggtgaaaccccat

SEQ ID NO: 1188011 - DNA, 17 bp, Homo sapiens
cacggtgacacaggtca

SEQ ID NO: 1188012 - DNA, 20 bp, Homo sapiens
cacggtgactctgtccagct

SEQ ID NO: 1188013 - DNA, 15 bp, Homo sapiens
cacggtgcctttttt

SEQ ID NO: 1188014 - DNA, 22 bp, Homo sapiens
cacggtttatcctcttggtgtc

SEQ ID NO: 1188015 - DNA, 23 bp, Homo sapiens
cacggtttatcctcttggtgtct

SEQ ID NO: 1188016 - DNA, 11 bp, Homo sapiens
cacggtttgtg

SEQ ID NO: 1188017 - DNA, 15 bp, Homo sapiens
cacgtacaaaatcca

SEQ ID NO: 1188018 - DNA, 18 bp, Homo sapiens
cacgtaggttccccagag

SEQ ID NO: 1188019 - DNA, 18 bp, Homo sapiens
cacgtatagtcctagctg

SEQ ID NO: 1188020 - DNA, 15 bp, Homo sapiens
cacgtattgctgtgt

SEQ ID NO: 1188021 - DNA, 22 bp, Homo sapiens
cacgtatttatatttggaaaga

SEQ ID NO: 1188022 - DNA, 21 bp, Homo sapiens
cacgtcccaccccacctcttg

SEQ ID NO: 1188023 - DNA, 12 bp, Homo sapiens
cacgtcccagca

SEQ ID NO: 1188024 - DNA, 14 bp, Homo sapiens
cacgtcccagcatc

SEQ ID NO: 1188025 - DNA, 21 bp, Homo sapiens
ctataatgtaagctctactga

SEQ ID NO: 1188026 - DNA, 21 bp, Homo sapiens
ctataattgtaaatattttga

SEQ ID NO: 1188027 - DNA, 22 bp, Homo sapiens
ctataattgtaaatattttgat

SEQ ID NO: 1188028 - DNA, 14 bp, Homo sapiens
ctatacacacacac

SEQ ID NO: 1188029 - DNA, 18 bp, Homo sapiens
ctatacagaacagagggc

SEQ ID NO: 1188030 - DNA, 22 bp, Homo sapiens
ctatacagaacagagggccaga

SEQ ID NO: 1188031 - DNA, 12 bp, Homo sapiens
ctatacagccat

SEQ ID NO: 1188032 - DNA, 15 bp, Homo sapiens
ctatacatatcttta

SEQ ID NO: 1188033 - DNA, 17 bp, Homo sapiens
ctatacatatctttatt

SEQ ID NO: 1188034 - DNA, 20 bp, Homo sapiens
ctatacatatctttattaat

SEQ ID NO: 1188035 - DNA, 18 bp, Homo sapiens
ctatacatctctccccaa

SEQ ID NO: 1188036 - DNA, 21 bp, Homo sapiens
ctatacatgttggaaatgtgt

SEQ ID NO: 1188037 - DNA, 22 bp, Homo sapiens
ctatacatgttggaaatgtgtt

SEQ ID NO: 1188038 - DNA, 14 bp, Homo sapiens
ctatacctgccttt

SEQ ID NO: 1188039 - DNA, 19 bp, Homo sapiens
ctatacgcagcgtgcttta

SEQ ID NO: 1188040 - DNA, 17 bp, Homo sapiens
ctatacgtttctgtgga

SEQ ID NO: 1188041 - DNA, 17 bp, Homo sapiens
ctatactgcatactttt

SEQ ID NO: 1188042 - DNA, 13 bp, Homo sapiens
ctatactgcctct

SEQ ID NO: 1188043 - DNA, 17 bp, Homo sapiens
ctatactggaaatgtaa

SEQ ID NO: 1188044 - DNA, 23 bp, Homo sapiens
ctatagaaatagaacactgcctc

SEQ ID NO: 1188045 - DNA, 20 bp, Homo sapiens
ctatagaaatattgtgctta

SEQ ID NO: 1188046 - DNA, 19 bp, Homo sapiens
ctatagagagggggctctc

SEQ ID NO: 1188047 - DNA, 14 bp, Homo sapiens
ctatagccaaaaat

SEQ ID NO: 1188048 - DNA, 13 bp, Homo sapiens
ctatagcctgggg

SEQ ID NO: 1188049 - DNA, 14 bp, Homo sapiens
ctatagcctggggt

SEQ ID NO: 1188050 - DNA, 21 bp, Homo sapiens
ctatagcctggggtggggtca

SEQ ID NO: 1188051 - DNA, 16 bp, Homo sapiens
ctatagctcaggacct

SEQ ID NO: 1188052 - DNA, 12 bp, Homo sapiens
ctataggaaagt

SEQ ID NO: 1188053 - DNA, 18 bp, Homo sapiens
cactcaccccagcctcat

SEQ ID NO: 1188054 - DNA, 13 bp, Homo sapiens
cactcaccccctt

SEQ ID NO: 1188055 - DNA, 16 bp, Homo sapiens
cactcaccccctttgc

SEQ ID NO: 1188056 - DNA, 16 bp, Homo sapiens
cactcacccttcctgg

SEQ ID NO: 1188057 - DNA, 18 bp, Homo sapiens
cactcacccttcctggcc

SEQ ID NO: 1188058 - DNA, 15 bp, Homo sapiens
cactcactcactcca

SEQ ID NO: 1188059 - DNA, 16 bp, Homo sapiens
cactcactcactccaa

SEQ ID NO: 1188060 - DNA, 18 bp, Homo sapiens
cactcactcactccccac

SEQ ID NO: 1188061 - DNA, 16 bp, Homo sapiens
cactcactccaagacc

SEQ ID NO: 1188062 - DNA, 13 bp, Homo sapiens
cactcactcccca

SEQ ID NO: 1188063 - DNA, 14 bp, Homo sapiens
cactcactccccac

SEQ ID NO: 1188064 - DNA, 15 bp, Homo sapiens
cactcactgaggcca

SEQ ID NO: 1188065 - DNA, 15 bp, Homo sapiens
cactcagaggccccc

SEQ ID NO: 1188066 - DNA, 18 bp, Homo sapiens
cactcagaggcccccagt

SEQ ID NO: 1188067 - DNA, 19 bp, Homo sapiens
cactcagaggcccccagtg

SEQ ID NO: 1188068 - DNA, 12 bp, Homo sapiens
cactcagcacaa

SEQ ID NO: 1188069 - DNA, 11 bp, Homo sapiens
cactcagcccc

SEQ ID NO: 1188070 - DNA, 16 bp, Homo sapiens
cactcagcccctaccc

SEQ ID NO: 1188071 - DNA, 16 bp, Homo sapiens
cactcagcccctagga

SEQ ID NO: 1188072 - DNA, 17 bp, Homo sapiens
cactcagcccctaggag

SEQ ID NO: 1188073 - DNA, 22 bp, Homo sapiens
cactcagctgtcctgcagcaaa

SEQ ID NO: 1188074 - DNA, 20 bp, Homo sapiens
cactcagcttaattctcctt

SEQ ID NO: 1188075 - DNA, 22 bp, Homo sapiens
cactcagcttaattctccttcc

SEQ ID NO: 1188076 - DNA, 12 bp, Homo sapiens
cactcaggccac

SEQ ID NO: 1188077 - DNA, 16 bp, Homo sapiens
cactcagggcagctgc

SEQ ID NO: 1188078 - DNA, 20 bp, Homo sapiens
cactcagggcagctgcctgg

SEQ ID NO: 1188079 - DNA, 22 bp, Homo sapiens
cactcaggggaccccactcccc

SEQ ID NO: 1188080 - DNA, 15 bp, Homo sapiens
cactcaggtgcacac

SEQ ID NO: 1188081 - DNA, 22 bp, Homo sapiens
cactcagtactgtacagggtgg

SEQ ID NO: 1188082 - DNA, 14 bp, Homo sapiens
cactcagtctcttc

SEQ ID NO: 1188083 - DNA, 15 bp, Homo sapiens
cactcagtctcttcc

SEQ ID NO: 1188084 - DNA, 16 bp, Homo sapiens
cactcagtctcttcca

SEQ ID NO: 1188085 - DNA, 19 bp, Homo sapiens
cactcagtgagcctcctgt

SEQ ID NO: 1188086 - DNA, 14 bp, Homo sapiens
cactcagtgcctcc

SEQ ID NO: 1188087 - DNA, 21 bp, Homo sapiens
cactcagtgcctccacatgct

SEQ ID NO: 1188088 - DNA, 22 bp, Homo sapiens
cactcagtgcctccacatgctg

SEQ ID NO: 1188089 - DNA, 17 bp, Homo sapiens
cactcatagggtgctct

SEQ ID NO: 1188090 - DNA, 16 bp, Homo sapiens
cactcatcccctcact

SEQ ID NO: 1188091 - DNA, 15 bp, Homo sapiens
cactcatgtggactg

SEQ ID NO: 1188092 - DNA, 16 bp, Homo sapiens
cactcattgctgagcc

SEQ ID NO: 1188093 - DNA, 23 bp, Homo sapiens
cactcattgctgagcctctgctc

SEQ ID NO: 1188094 - DNA, 12 bp, Homo sapiens
cactcatttcat

SEQ ID NO: 1188095 - DNA, 19 bp, Homo sapiens
cactcatttcatctcattt

SEQ ID NO: 1188096 - DNA, 15 bp, Homo sapiens
cactccaaaaacagc

SEQ ID NO: 1188097 - DNA, 11 bp, Homo sapiens
cactccaaact

SEQ ID NO: 1188098 - DNA, 13 bp, Homo sapiens
cactccaagacca

SEQ ID NO: 1188099 - DNA, 18 bp, Homo sapiens
cactccaagaccaccagg

SEQ ID NO: 1188100 - DNA, 19 bp, Homo sapiens
cactccaagatatggacac

SEQ ID NO: 1188101 - DNA, 21 bp, Homo sapiens
cactccaatgtctgctgagga

SEQ ID NO: 1188102 - DNA, 14 bp, Homo sapiens
cactccacagtgtt

SEQ ID NO: 1188103 - DNA, 16 bp, Homo sapiens
cactccaccatcactc

SEQ ID NO: 1188104 - DNA, 14 bp, Homo sapiens
cactccactctgat

SEQ ID NO: 1188105 - DNA, 14 bp, Homo sapiens
cactccagacccct

SEQ ID NO: 1188106 - DNA, 21 bp, Homo sapiens
cactccagcctgagcaacaga

SEQ ID NO: 1188107 - DNA, 15 bp, Homo sapiens
cactccagcctgggc

SEQ ID NO: 1188108 - DNA, 15 bp, Homo sapiens
cactccagcctgggg

SEQ ID NO: 1188109 - DNA, 16 bp, Homo sapiens
cactccagcctgggtg

SEQ ID NO: 1188110 - DNA, 22 bp, Homo sapiens
cactccaggcatatgtttcccc

SEQ ID NO: 1188111 - DNA, 13 bp, Homo sapiens
cactccagtgcca

SEQ ID NO: 1188112 - DNA, 22 bp, Homo sapiens
cactccagtttttgtttttgca

SEQ ID NO: 1188113 - DNA, 16 bp, Homo sapiens
cactccatggccaccc

SEQ ID NO: 1188114 - DNA, 23 bp, Homo sapiens
cactcccaagggacagcaagtga

SEQ ID NO: 1188115 - DNA, 17 bp, Homo sapiens
cactcccacatgggccc

SEQ ID NO: 1188116 - DNA, 14 bp, Homo sapiens
cactcccacgcctg

SEQ ID NO: 1188117 - DNA, 17 bp, Homo sapiens
cactcccatctccttac

SEQ ID NO: 1188118 - DNA, 14 bp, Homo sapiens
cactccccacggga

SEQ ID NO: 1188119 - DNA, 23 bp, Homo sapiens
cactccccagagctgtgccagca

SEQ ID NO: 1188120 - DNA, 18 bp, Homo sapiens
cactccccagccccagcc

SEQ ID NO: 1188121 - DNA, 15 bp, Homo sapiens
cactcccccacccat

SEQ ID NO: 1188122 - DNA, 19 bp, Homo sapiens
cactcccccacccatgggg

SEQ ID NO: 1188123 - DNA, 21 bp, Homo sapiens
cactcccccacccatggggag

SEQ ID NO: 1188124 - DNA, 21 bp, Homo sapiens
cactccccctaaacccctgtc

SEQ ID NO: 1188125 - DNA, 21 bp, Homo sapiens
cactcccgaaagcctttcctc

SEQ ID NO: 1188126 - DNA, 16 bp, Homo sapiens
cactcccgctgcacac

SEQ ID NO: 1188127 - DNA, 19 bp, Homo sapiens
cactcccgctgcacacaga

SEQ ID NO: 1188128 - DNA, 13 bp, Homo sapiens
cactccctcctgg

SEQ ID NO: 1188129 - DNA, 23 bp, Homo sapiens
cactccctcctggagctctgtgg

SEQ ID NO: 1188130 - DNA, 13 bp, Homo sapiens
cactccctcttgg

SEQ ID NO: 1188131 - DNA, 14 bp, Homo sapiens
cactccctcttggt

SEQ ID NO: 1188132 - DNA, 17 bp, Homo sapiens
cactccctgctccacga

SEQ ID NO: 1188133 - DNA, 12 bp, Homo sapiens
cactccctggcc

SEQ ID NO: 1188134 - DNA, 14 bp, Homo sapiens
cactccctggcctt

SEQ ID NO: 1188135 - DNA, 17 bp, Homo sapiens
cactccctggccttgcc

SEQ ID NO: 1188136 - DNA, 14 bp, Homo sapiens
cactccctgggaca

SEQ ID NO: 1188137 - DNA, 14 bp, Homo sapiens
cactcccttgctgg

SEQ ID NO: 1188138 - DNA, 22 bp, Homo sapiens
cactcccttgctggccccagcc

SEQ ID NO: 1188139 - DNA, 22 bp, Homo sapiens
cactcctaggagagccaacctc

SEQ ID NO: 1188140 - DNA, 23 bp, Homo sapiens
cactcctatgtactatccccaaa

SEQ ID NO: 1188141 - DNA, 12 bp, Homo sapiens
cactcctccctc

SEQ ID NO: 1188142 - DNA, 22 bp, Homo sapiens
cactcctctactcttacagagc

SEQ ID NO: 1188143 - DNA, 15 bp, Homo sapiens
cactcctctcccaca

SEQ ID NO: 1188144 - DNA, 20 bp, Homo sapiens
cactcctctctagggcagaa

SEQ ID NO: 1188145 - DNA, 20 bp, Homo sapiens
cactcctctgactcagggct

SEQ ID NO: 1188146 - DNA, 11 bp, Homo sapiens
cactcctgaat

SEQ ID NO: 1188147 - DNA, 10 bp, Homo sapiens
cactcctggg

SEQ ID NO: 1188148 - DNA, 19 bp, Homo sapiens
cactcctgggctctgaaca

SEQ ID NO: 1188149 - DNA, 21 bp, Homo sapiens
cactcctgggctctgaacaca

SEQ ID NO: 1188150 - DNA, 16 bp, Homo sapiens
cactcctgtcccgcct

SEQ ID NO: 1188151 - DNA, 14 bp, Homo sapiens
cactcctgtccctg

SEQ ID NO: 1188152 - DNA, 15 bp, Homo sapiens
cactcctgtccctgt

SEQ ID NO: 1188153 - DNA, 19 bp, Homo sapiens
cactcctgtccctgtagct

SEQ ID NO: 1188154 - DNA, 19 bp, Homo sapiens
cactccttccttcaggact

SEQ ID NO: 1188155 - DNA, 17 bp, Homo sapiens
cactccttctctcactg

SEQ ID NO: 1188156 - DNA, 22 bp, Homo sapiens
cactcgacccagaatggagcct

SEQ ID NO: 1188157 - DNA, 19 bp, Homo sapiens
cactcgagaccatcctggc

SEQ ID NO: 1188158 - DNA, 19 bp, Homo sapiens
ctatgtatgtttttttcca

SEQ ID NO: 1188159 - DNA, 17 bp, Homo sapiens
ctatgtattttcctaat

SEQ ID NO: 1188160 - DNA, 23 bp, Homo sapiens
ctatgtcatttttaatgtatcta

SEQ ID NO: 1188161 - DNA, 16 bp, Homo sapiens
ctatgtcccttgctgt

SEQ ID NO: 1188162 - DNA, 14 bp, Homo sapiens
ctatgtcctaagga

SEQ ID NO: 1188163 - DNA, 18 bp, Homo sapiens
ctatgtcctaaggacaca

SEQ ID NO: 1188164 - DNA, 15 bp, Homo sapiens
ctatgtctgccttcg

SEQ ID NO: 1188165 - DNA, 17 bp, Homo sapiens
ctatgtgccagttcctg

SEQ ID NO: 1188166 - DNA, 17 bp, Homo sapiens
ctatgtgccttatgttg

SEQ ID NO: 1188167 - DNA, 13 bp, Homo sapiens
ctatgtgctgggt

SEQ ID NO: 1188168 - DNA, 15 bp, Homo sapiens
ctatgtgctgggtgc

SEQ ID NO: 1188169 - DNA, 17 bp, Homo sapiens
ctatgtgtttctgtaac

SEQ ID NO: 1188170 - DNA, 22 bp, Homo sapiens
ctatgtgtttttctcatatttg

SEQ ID NO: 1188171 - DNA, 16 bp, Homo sapiens
ctatgttactattttc

SEQ ID NO: 1188172 - DNA, 14 bp, Homo sapiens
ctatgttccccagg

SEQ ID NO: 1188173 - DNA, 13 bp, Homo sapiens
ctatgttccctcc

SEQ ID NO: 1188174 - DNA, 14 bp, Homo sapiens
ctatgttggtttca

SEQ ID NO: 1188175 - DNA, 19 bp, Homo sapiens
ctatgtttgtgtgatttcc

SEQ ID NO: 1188176 - DNA, 17 bp, Homo sapiens
ctcaagtcttccctgat

SEQ ID NO: 1188177 - DNA, 23 bp, Homo sapiens
ctcaagtgatctgtccacctcgg

SEQ ID NO: 1188178 - DNA, 20 bp, Homo sapiens
ctcaagtgtagaagaaaata

SEQ ID NO: 1188179 - DNA, 17 bp, Homo sapiens
ctcaagttcttggacca

SEQ ID NO: 1188180 - DNA, 14 bp, Homo sapiens
ctcaagtttaaaag

SEQ ID NO: 1188181 - DNA, 13 bp, Homo sapiens
ctcaataaagatt

SEQ ID NO: 1188182 - DNA, 16 bp, Homo sapiens
ctcaataaatgattct

SEQ ID NO: 1188183 - DNA, 12 bp, Homo sapiens
ctcaatattaaa

SEQ ID NO: 1188184 - DNA, 16 bp, Homo sapiens
ctcaatattcctgaat

SEQ ID NO: 1188185 - DNA, 14 bp, Homo sapiens
ctcaatcactgctc

SEQ ID NO: 1188186 - DNA, 15 bp, Homo sapiens
ctcaatcagtgcagt

SEQ ID NO: 1188187 - DNA, 16 bp, Homo sapiens
ctcaatcccacatacg

SEQ ID NO: 1188188 - DNA, 19 bp, Homo sapiens
ctcaatcctaatttctcct

SEQ ID NO: 1188189 - DNA, 20 bp, Homo sapiens
ctcaatcctaatttctcctc

SEQ ID NO: 1188190 - DNA, 14 bp, Homo sapiens
ctcaatcctctaag

SEQ ID NO: 1188191 - DNA, 17 bp, Homo sapiens
ctcaatctgcagccatt

SEQ ID NO: 1188192 - DNA, 13 bp, Homo sapiens
ctcaatgaaaaat

SEQ ID NO: 1188193 - DNA, 22 bp, Homo sapiens
ctcaatgcattgtcttgtggag

SEQ ID NO: 1188194 - DNA, 16 bp, Homo sapiens
ctcaatgccctgccat

SEQ ID NO: 1188195 - DNA, 16 bp, Homo sapiens
ctcaatgcctggagac

SEQ ID NO: 1188196 - DNA, 19 bp, Homo sapiens
ctcaatgcctggagacaga

SEQ ID NO: 1188197 - DNA, 19 bp, Homo sapiens
ctcaatgctgggccctctt

SEQ ID NO: 1188198 - DNA, 17 bp, Homo sapiens
ctcaatgctttatttgt

SEQ ID NO: 1188199 - DNA, 13 bp, Homo sapiens
ctcaatggactgg

SEQ ID NO: 1188200 - DNA, 20 bp, Homo sapiens
ctcaatggactggaagggga

SEQ ID NO: 1188201 - DNA, 12 bp, Homo sapiens
ctcaatttcagc

SEQ ID NO: 1188202 - DNA, 13 bp, Homo sapiens
ctcaatttcagca

SEQ ID NO: 1188203 - DNA, 14 bp, Homo sapiens
ctcaatttcagcac

SEQ ID NO: 1188204 - DNA, 19 bp, Homo sapiens
ctcaatttcctcatctggg

SEQ ID NO: 1188205 - DNA, 16 bp, Homo sapiens
ctcaatttctgaacac

SEQ ID NO: 1188206 - DNA, 16 bp, Homo sapiens
ctcaatttttgtctca

SEQ ID NO: 1188207 - DNA, 17 bp, Homo sapiens
ctcaatttttgtctcag

SEQ ID NO: 1188208 - DNA, 18 bp, Homo sapiens
ctcaatttttgtctcaga

SEQ ID NO: 1188209 - DNA, 20 bp, Homo sapiens
ctcaatttttgtctcagaag

SEQ ID NO: 1188210 - DNA, 23 bp, Homo sapiens
ctcacaaaaaggcaaatattgaa

SEQ ID NO: 1188211 - DNA, 17 bp, Homo sapiens
ctcacaacttgggttct

SEQ ID NO: 1188212 - DNA, 18 bp, Homo sapiens
ctcacaagcctcttctga

SEQ ID NO: 1188213 - DNA, 21 bp, Homo sapiens
ctcacaatagccgatatcaga

SEQ ID NO: 1188214 - DNA, 19 bp, Homo sapiens
ctcacacacacccccccac

SEQ ID NO: 1188215 - DNA, 17 bp, Homo sapiens
ctcacacatcacattcc

SEQ ID NO: 1188216 - DNA, 23 bp, Homo sapiens
ctcacacccaccgtccgccctgc

SEQ ID NO: 1188217 - DNA, 13 bp, Homo sapiens
ctcacacccctgt

SEQ ID NO: 1188218 - DNA, 15 bp, Homo sapiens
ctcacacccctgtcc

SEQ ID NO: 1188219 - DNA, 20 bp, Homo sapiens
ctcacacccctgtcccaccc

SEQ ID NO: 1188220 - DNA, 22 bp, Homo sapiens
ctcacaccgttcgtacgcccag

SEQ ID NO: 1188221 - DNA, 15 bp, Homo sapiens
ctcacacctgaactg

SEQ ID NO: 1188222 - DNA, 19 bp, Homo sapiens
ctcacactccagtggcaga

SEQ ID NO: 1188223 - DNA, 13 bp, Homo sapiens
ctcacactcctgg

SEQ ID NO: 1188224 - DNA, 18 bp, Homo sapiens
ctcacactcctgggctct

SEQ ID NO: 1188225 - DNA, 21 bp, Homo sapiens
ctcacactcctgggctctgaa

SEQ ID NO: 1188226 - DNA, 14 bp, Homo sapiens
ctcacactctctgc

SEQ ID NO: 1188227 - DNA, 17 bp, Homo sapiens
ctcacactctctgcagc

SEQ ID NO: 1188228 - DNA, 19 bp, Homo sapiens
ctcacactctctgcagccc

SEQ ID NO: 1188229 - DNA, 20 bp, Homo sapiens
ctcacactctctgcagccca

SEQ ID NO: 1188230 - DNA, 22 bp, Homo sapiens
ctcacactgatgggctggggca

SEQ ID NO: 1188231 - DNA, 17 bp, Homo sapiens
ctcacactgctgtcctc

SEQ ID NO: 1188232 - DNA, 13 bp, Homo sapiens
ctcacagaagaat

SEQ ID NO: 1188233 - DNA, 18 bp, Homo sapiens
ctcacagacctctgcttg

SEQ ID NO: 1188234 - DNA, 17 bp, Homo sapiens
ctcacagacctggagcc

SEQ ID NO: 1188235 - DNA, 17 bp, Homo sapiens
ctcacagccgcattggt

SEQ ID NO: 1188236 - DNA, 17 bp, Homo sapiens
ctcacagcttctccaag

SEQ ID NO: 1188237 - DNA, 17 bp, Homo sapiens
ctcacaggccctggaga

SEQ ID NO: 1188238 - DNA, 18 bp, Homo sapiens
ctcacagggatgctggtg

SEQ ID NO: 1188239 - DNA, 13 bp, Homo sapiens
ctcacagggcagg

SEQ ID NO: 1188240 - DNA, 14 bp, Homo sapiens
ctcacagggcaggc

SEQ ID NO: 1188241 - DNA, 22 bp, Homo sapiens
ctcacagtacagcatgtgcctt

SEQ ID NO: 1188242 - DNA, 20 bp, Homo sapiens
ctcacagtctctttaatctt

SEQ ID NO: 1188243 - DNA, 15 bp, Homo sapiens
ctcacagtgctttta

SEQ ID NO: 1188244 - DNA, 21 bp, Homo sapiens
ctcacagtgttgcccaggctg

SEQ ID NO: 1188245 - DNA, 17 bp, Homo sapiens
ctcacagttcctcgccc

SEQ ID NO: 1188246 - DNA, 18 bp, Homo sapiens
ctcacagttcctcgccct

SEQ ID NO: 1188247 - DNA, 21 bp, Homo sapiens
ctcacagttcctcgccctggg

SEQ ID NO: 1188248 - DNA, 15 bp, Homo sapiens
ctcacataaaaaaga

SEQ ID NO: 1188249 - DNA, 13 bp, Homo sapiens
ctcacataagccc

SEQ ID NO: 1188250 - DNA, 21 bp, Homo sapiens
ctcacataagcccagttcatc

SEQ ID NO: 1188251 - DNA, 14 bp, Homo sapiens
ctcacatactgact

SEQ ID NO: 1188252 - DNA, 14 bp, Homo sapiens
ctcacatccatcta

SEQ ID NO: 1188253 - DNA, 17 bp, Homo sapiens
ctcacatcctcctgccc

SEQ ID NO: 1188254 - DNA, 15 bp, Homo sapiens
ctcacatcctctcca

SEQ ID NO: 1188255 - DNA, 19 bp, Homo sapiens
ctcacatgggactgggata

SEQ ID NO: 1188256 - DNA, 22 bp, Homo sapiens
ctcacatgtcagtaccttcaaa

SEQ ID NO: 1188257 - DNA, 15 bp, Homo sapiens
ctcacatttttttct

SEQ ID NO: 1188258 - DNA, 17 bp, Homo sapiens
ctcaccaacttgccaca

SEQ ID NO: 1188259 - DNA, 18 bp, Homo sapiens
ctcaccacaagctgagca

SEQ ID NO: 1188260 - DNA, 15 bp, Homo sapiens
ctcaccacacccagg

SEQ ID NO: 1188261 - DNA, 20 bp, Homo sapiens
ctcaccaccacactacacag

SEQ ID NO: 1188262 - DNA, 13 bp, Homo sapiens
ctcaccaccccca

SEQ ID NO: 1188263 - DNA, 23 bp, Homo sapiens
ctcaccactaccagccagcctca

SEQ ID NO: 1188264 - DNA, 22 bp, Homo sapiens
ctcaccactgttttatatctct

SEQ ID NO: 1188265 - DNA, 21 bp, Homo sapiens
ctcaccagccccactgccagc

SEQ ID NO: 1188266 - DNA, 21 bp, Homo sapiens
ctcaccagctggggtcctgtc

SEQ ID NO: 1188267 - DNA, 23 bp, Homo sapiens
ctcaccaggcccacgaggagcag

SEQ ID NO: 1188268 - DNA, 17 bp, Homo sapiens
ctcaccagtggcctttc

SEQ ID NO: 1188269 - DNA, 20 bp, Homo sapiens
ctcaccagtgtcccctccac

SEQ ID NO: 1188270 - DNA, 14 bp, Homo sapiens
ctcacccaccagct

SEQ ID NO: 1188271 - DNA, 21 bp, Homo sapiens
ctcacccaccatggaccagcc

SEQ ID NO: 1188272 - DNA, 17 bp, Homo sapiens
ctcacccacccctgcac

SEQ ID NO: 1188273 - DNA, 16 bp, Homo sapiens
ctcacccagatcagga

SEQ ID NO: 1188274 - DNA, 13 bp, Homo sapiens
ctcacccagcctg

SEQ ID NO: 1188275 - DNA, 16 bp, Homo sapiens
ctcacccatgtgccaa

SEQ ID NO: 1188276 - DNA, 14 bp, Homo sapiens
ctcaccccagcctc

SEQ ID NO: 1188277 - DNA, 13 bp, Homo sapiens
ctcaccccagctc

SEQ ID NO: 1188278 - DNA, 22 bp, Homo sapiens
ctcaccccatcccacaccctgg

SEQ ID NO: 1188279 - DNA, 16 bp, Homo sapiens
ctcacccccaggtgtt

SEQ ID NO: 1188280 - DNA, 17 bp, Homo sapiens
ctcacccccaggtgttg

SEQ ID NO: 1188281 - DNA, 16 bp, Homo sapiens
ctcaccccgtctgggg

SEQ ID NO: 1188282 - DNA, 14 bp, Homo sapiens
ctcacccctcgcca

SEQ ID NO: 1188283 - DNA, 15 bp, Homo sapiens
ctcacccctgggcag

SEQ ID NO: 1188284 - DNA, 18 bp, Homo sapiens
ctcacccctgggcaggcg

SEQ ID NO: 1188285 - DNA, 16 bp, Homo sapiens
ctcaccctactctgga

SEQ ID NO: 1188286 - DNA, 18 bp, Homo sapiens
ctcaccctactctggatg

SEQ ID NO: 1188287 - DNA, 23 bp, Homo sapiens
ctcaccctccacaaagcaaaggc

SEQ ID NO: 1188288 - DNA, 16 bp, Homo sapiens
ctcacccttcctggcc

SEQ ID NO: 1188289 - DNA, 19 bp, Homo sapiens
ctcacccttcctggcccag

SEQ ID NO: 1188290 - DNA, 21 bp, Homo sapiens
ctcacccttcctggcccaggc

SEQ ID NO: 1188291 - DNA, 22 bp, Homo sapiens
ctcacccttcctggcccaggcc

SEQ ID NO: 1188292 - DNA, 14 bp, Homo sapiens
gcccgaatgcctgt

SEQ ID NO: 1188293 - DNA, 12 bp, Homo sapiens
gcccgacagcct

SEQ ID NO: 1188294 - DNA, 17 bp, Homo sapiens
gcccgacagcctggcac

SEQ ID NO: 1188295 - DNA, 19 bp, Homo sapiens
gcccgacagcctggcacag

SEQ ID NO: 1188296 - DNA, 20 bp, Homo sapiens
gcccgacaggtgggcctggg

SEQ ID NO: 1188297 - DNA, 15 bp, Homo sapiens
gcccgacagtgccat

SEQ ID NO: 1188298 - DNA, 17 bp, Homo sapiens
gcccgacagttctgaac

SEQ ID NO: 1188299 - DNA, 18 bp, Homo sapiens
gcccgacttgctgttttg

SEQ ID NO: 1188300 - DNA, 23 bp, Homo sapiens
gcccgacttgctgttttgttctg

SEQ ID NO: 1188301 - DNA, 12 bp, Homo sapiens
gcccgagctggt

SEQ ID NO: 1188302 - DNA, 14 bp, Homo sapiens
gcccgagctggtgc

SEQ ID NO: 1188303 - DNA, 21 bp, Homo sapiens
gcccgagggatggtgccccta

SEQ ID NO: 1188304 - DNA, 19 bp, Homo sapiens
gcccgcacccctccctgct

SEQ ID NO: 1188305 - DNA, 15 bp, Homo sapiens
gcccgcagcccagac

SEQ ID NO: 1188306 - DNA, 20 bp, Homo sapiens
gcccgcaggaactgggctgg

SEQ ID NO: 1188307 - DNA, 12 bp, Homo sapiens
gcccgcagggcc

SEQ ID NO: 1188308 - DNA, 12 bp, Homo sapiens
gcccgcatgtgt

SEQ ID NO: 1188309 - DNA, 14 bp, Homo sapiens
gcccgccagcctca

SEQ ID NO: 1188310 - DNA, 15 bp, Homo sapiens
gcccgccagcctcag

SEQ ID NO: 1188311 - DNA, 15 bp, Homo sapiens
gcccgcccactgtcc

SEQ ID NO: 1188312 - DNA, 17 bp, Homo sapiens
gcccgcccactgtcctg

SEQ ID NO: 1188313 - DNA, 22 bp, Homo sapiens
gcccgcccactgtcctgggcgc

SEQ ID NO: 1188314 - DNA, 14 bp, Homo sapiens
gcccgcccctcagt

SEQ ID NO: 1188315 - DNA, 15 bp, Homo sapiens
gcccgccctcacctc

SEQ ID NO: 1188316 - DNA, 19 bp, Homo sapiens
gcccgccctcacctctgat

SEQ ID NO: 1188317 - DNA, 12 bp, Homo sapiens
gcccgccctctg

SEQ ID NO: 1188318 - DNA, 18 bp, Homo sapiens
gcccgccctctgcctcct

SEQ ID NO: 1188319 - DNA, 19 bp, Homo sapiens
gcccgccgtctgcaggggc

SEQ ID NO: 1188320 - DNA, 20 bp, Homo sapiens
gcccgccgtctgcaggggcc

SEQ ID NO: 1188321 - DNA, 20 bp, Homo sapiens
gcccgcctgccgtgcatggc

SEQ ID NO: 1188322 - DNA, 18 bp, Homo sapiens
gcccgcctggcagaactg

SEQ ID NO: 1188323 - DNA, 23 bp, Homo sapiens
gcccgcgccctcgcccccgcccc

SEQ ID NO: 1188324 - DNA, 13 bp, Homo sapiens
gcccgcggcctgg

SEQ ID NO: 1188325 - DNA, 20 bp, Homo sapiens
gcccgcggcgcgaccctccc

SEQ ID NO: 1188326 - DNA, 16 bp, Homo sapiens
gcccgctcccaacccc

SEQ ID NO: 1188327 - DNA, 21 bp, Homo sapiens
gcccgctgagctgagtggcca

SEQ ID NO: 1188328 - DNA, 12 bp, Homo sapiens
gcccgctgcctc

SEQ ID NO: 1188329 - DNA, 17 bp, Homo sapiens
gcccgctgcctcttggc

SEQ ID NO: 1188330 - DNA, 17 bp, Homo sapiens
gcccgctgggctgagcc

SEQ ID NO: 1188331 - DNA, 22 bp, Homo sapiens
gcccggaagcgccaggctggag

SEQ ID NO: 1188332 - DNA, 14 bp, Homo sapiens
gcccggaccttggc

SEQ ID NO: 1188333 - DNA, 22 bp, Homo sapiens
gcccggagattggacggcctga

SEQ ID NO: 1188334 - DNA, 15 bp, Homo sapiens
gcccggagcagcagg

SEQ ID NO: 1188335 - DNA, 14 bp, Homo sapiens
gcccggatgcttct

SEQ ID NO: 1188336 - DNA, 12 bp, Homo sapiens
gcccggccagcc

SEQ ID NO: 1188337 - DNA, 14 bp, Homo sapiens
gcccggccccaccc

SEQ ID NO: 1188338 - DNA, 20 bp, Homo sapiens
gcccggccccaccccctggg

SEQ ID NO: 1188339 - DNA, 13 bp, Homo sapiens
gcccggcccctca

SEQ ID NO: 1188340 - DNA, 22 bp, Homo sapiens
gcccggcccctcaccctctgtc

SEQ ID NO: 1188341 - DNA, 23 bp, Homo sapiens
gcccggcccctcaccctctgtcc

SEQ ID NO: 1188342 - DNA, 22 bp, Homo sapiens
gcccggccctcccccagctcct

SEQ ID NO: 1188343 - DNA, 23 bp, Homo sapiens
gcccggccctcccccagctcctt

SEQ ID NO: 1188344 - DNA, 21 bp, Homo sapiens
gcccggcgccgggcaccaact

SEQ ID NO: 1188345 - DNA, 18 bp, Homo sapiens
gcccggctaatttttgta

SEQ ID NO: 1188346 - DNA, 12 bp, Homo sapiens
gcccggctgctg

SEQ ID NO: 1188347 - DNA, 13 bp, Homo sapiens
gcccgggagccta

SEQ ID NO: 1188348 - DNA, 18 bp, Homo sapiens
gcccgggcacccacaagc

SEQ ID NO: 1188349 - DNA, 19 bp, Homo sapiens
gcccgggcacccacaagcc

SEQ ID NO: 1188350 - DNA, 17 bp, Homo sapiens
gcccgggcccccgcccc

SEQ ID NO: 1188351 - DNA, 15 bp, Homo sapiens
gcccgggctgcctgg

SEQ ID NO: 1188352 - DNA, 14 bp, Homo sapiens
gcccggggagctgc

SEQ ID NO: 1188353 - DNA, 18 bp, Homo sapiens
gcccggggagctgcagag

SEQ ID NO: 1188354 - DNA, 22 bp, Homo sapiens
gcccggggctgtcccgtgcatg

SEQ ID NO: 1188355 - DNA, 19 bp, Homo sapiens
gcccgggggacgcctgccc

SEQ ID NO: 1188356 - DNA, 23 bp, Homo sapiens
gcccgggtgtgcctgccctggag

SEQ ID NO: 1188357 - DNA, 17 bp, Homo sapiens
gcccggtaagagcaaaa

SEQ ID NO: 1188358 - DNA, 17 bp, Homo sapiens
gcccggttgccatggag

SEQ ID NO: 1188359 - DNA, 16 bp, Homo sapiens
gcccgtcggagctgcc

SEQ ID NO: 1188360 - DNA, 17 bp, Homo sapiens
gcccgtcggagctgcct

SEQ ID NO: 1188361 - DNA, 13 bp, Homo sapiens
gcccgtcggccct

SEQ ID NO: 1188362 - DNA, 15 bp, Homo sapiens
gcccgtcggccctgc

SEQ ID NO: 1188363 - DNA, 16 bp, Homo sapiens
gcccgtcggccctgcg

SEQ ID NO: 1188364 - DNA, 14 bp, Homo sapiens
gcccgtctcagtgt

SEQ ID NO: 1188365 - DNA, 14 bp, Homo sapiens
gcccgtcttcagcc

SEQ ID NO: 1188366 - DNA, 16 bp, Homo sapiens
gcccgtcttcagccta

SEQ ID NO: 1188367 - DNA, 20 bp, Homo sapiens
gcccgtgaagcagtgcctcg

SEQ ID NO: 1188368 - DNA, 18 bp, Homo sapiens
gcccgtgcagtacaggca

SEQ ID NO: 1188369 - DNA, 19 bp, Homo sapiens
gcccgtggacaccccagac

SEQ ID NO: 1188370 - DNA, 21 bp, Homo sapiens
gcccgtggacaccccagacct

SEQ ID NO: 1188371 - DNA, 18 bp, Homo sapiens
gcccgtggcctggcatct

SEQ ID NO: 1188372 - DNA, 22 bp, Homo sapiens
gcccgtggcctggcatctgtgt

SEQ ID NO: 1188373 - DNA, 22 bp, Homo sapiens
gcccgtggtggcggtggctgcc

SEQ ID NO: 1188374 - DNA, 23 bp, Homo sapiens
gcccgtggtggcggtggctgccc

SEQ ID NO: 1188375 - DNA, 15 bp, Homo sapiens
gcccgtttcagaagg

SEQ ID NO: 1188376 - DNA, 22 bp, Homo sapiens
gcccgttttaccaataaactga

SEQ ID NO: 1188377 - DNA, 18 bp, Homo sapiens
gccctaaaccctgttcct

SEQ ID NO: 1188378 - DNA, 18 bp, Homo sapiens
gccctaaccccttccaga

SEQ ID NO: 1188379 - DNA, 21 bp, Homo sapiens
gccctaagaggtttttcctct

SEQ ID NO: 1188380 - DNA, 14 bp, Homo sapiens
gccctaagccccca

SEQ ID NO: 1188381 - DNA, 20 bp, Homo sapiens
gccctaagcctgtccccaga

SEQ ID NO: 1188382 - DNA, 14 bp, Homo sapiens
gccctaagggactt

SEQ ID NO: 1188383 - DNA, 14 bp, Homo sapiens
gccctaagggagtg

SEQ ID NO: 1188384 - DNA, 17 bp, Homo sapiens
tccctacattccccaga

SEQ ID NO: 1188385 - DNA, 21 bp, Homo sapiens
tccctacccaatgtctcccac

SEQ ID NO: 1188386 - DNA, 22 bp, Homo sapiens
tccctacccaatgtctcccaca

SEQ ID NO: 1188387 - DNA, 14 bp, Homo sapiens
tccctacctccctc

SEQ ID NO: 1188388 - DNA, 16 bp, Homo sapiens
tccctacctccctcct

SEQ ID NO: 1188389 - DNA, 17 bp, Homo sapiens
tccctacctccctcctc

SEQ ID NO: 1188390 - DNA, 19 bp, Homo sapiens
tccctacctccctcctcag

SEQ ID NO: 1188391 - DNA, 20 bp, Homo sapiens
tccctacctccctcctcagg

SEQ ID NO: 1188392 - DNA, 17 bp, Homo sapiens
tccctactcccctgggc

SEQ ID NO: 1188393 - DNA, 18 bp, Homo sapiens
tccctactcccctgggca

SEQ ID NO: 1188394 - DNA, 16 bp, Homo sapiens
tccctacttcctgtga

SEQ ID NO: 1188395 - DNA, 19 bp, Homo sapiens
tccctagaaacttccaaat

SEQ ID NO: 1188396 - DNA, 18 bp, Homo sapiens
tccctagaagagcacaga

SEQ ID NO: 1188397 - DNA, 24 bp, Homo sapiens
tccctagaagagcacagagccctg

SEQ ID NO: 1188398 - DNA, 13 bp, Homo sapiens
tccctagactgca

SEQ ID NO: 1188399 - DNA, 19 bp, Homo sapiens
tccctagagggttcctgta

SEQ ID NO: 1188400 - DNA, 15 bp, Homo sapiens
tccctagcccttcca

SEQ ID NO: 1188401 - DNA, 17 bp, Homo sapiens
tccctagcccttccagc

SEQ ID NO: 1188402 - DNA, 18 bp, Homo sapiens
tccctagcccttccagcc

SEQ ID NO: 1188403 - DNA, 21 bp, Homo sapiens
tccctagcccttccagcctgg

SEQ ID NO: 1188404 - DNA, 19 bp, Homo sapiens
tccctagctttagaccctg

SEQ ID NO: 1188405 - DNA, 22 bp, Homo sapiens
tccctagctttagaccctgggt

SEQ ID NO: 1188406 - DNA, 22 bp, Homo sapiens
tccctatacactagacaaaact

SEQ ID NO: 1188407 - DNA, 22 bp, Homo sapiens
tccctatatgcacccctggaac

SEQ ID NO: 1188408 - DNA, 23 bp, Homo sapiens
tccctatctattaaagtgacttt

SEQ ID NO: 1188409 - DNA, 14 bp, Homo sapiens
tccctatggaaaga

SEQ ID NO: 1188410 - DNA, 16 bp, Homo sapiens
tccctattagagaaga

SEQ ID NO: 1188411 - DNA, 17 bp, Homo sapiens
tccctcaaagaggcctt

SEQ ID NO: 1188412 - DNA, 18 bp, Homo sapiens
tccctcaacaagggagag

SEQ ID NO: 1188413 - DNA, 16 bp, Homo sapiens
gccctgagctttctgc

SEQ ID NO: 1188414 - DNA, 20 bp, Homo sapiens
gccctgaggacctctcagca

SEQ ID NO: 1188415 - DNA, 20 bp, Homo sapiens
gccctgaggcggaggctgtg

SEQ ID NO: 1188416 - DNA, 23 bp, Homo sapiens
gccctgaggcggaggctgtgctc

SEQ ID NO: 1188417 - DNA, 19 bp, Homo sapiens
gccctgaggggctgggctg

SEQ ID NO: 1188418 - DNA, 21 bp, Homo sapiens
gccctgaggggctggggaggg

SEQ ID NO: 1188419 - DNA, 22 bp, Homo sapiens
gccctgaggggctggggagggg

SEQ ID NO: 1188420 - DNA, 23 bp, Homo sapiens
gccctgaggggctggggaggggg

SEQ ID NO: 1188421 - DNA, 15 bp, Homo sapiens
gccctgaggtgtggg

SEQ ID NO: 1188422 - DNA, 23 bp, Homo sapiens
gccctgaggtgtgggggctgcag

SEQ ID NO: 1188423 - DNA, 24 bp, Homo sapiens
gccctgaggtgtgggggctgcagc

SEQ ID NO: 1188424 - DNA, 18 bp, Homo sapiens
gccctgagttttacccag

SEQ ID NO: 1188425 - DNA, 16 bp, Homo sapiens
gccctgcacctgtgca

SEQ ID NO: 1188426 - DNA, 17 bp, Homo sapiens
gccctgcacctgtgcag

SEQ ID NO: 1188427 - DNA, 21 bp, Homo sapiens
gccctgcagaggggaaaccag

SEQ ID NO: 1188428 - DNA, 11 bp, Homo sapiens
gccctgcagca

SEQ ID NO: 1188429 - DNA, 12 bp, Homo sapiens
gccctgcagcac

SEQ ID NO: 1188430 - DNA, 14 bp, Homo sapiens
gccctgcagccagc

SEQ ID NO: 1188431 - DNA, 15 bp, Homo sapiens
gccctgcagccagct

SEQ ID NO: 1188432 - DNA, 12 bp, Homo sapiens
gccctgcaggag

SEQ ID NO: 1188433 - DNA, 13 bp, Homo sapiens
gccctgcaggagc

SEQ ID NO: 1188434 - DNA, 19 bp, Homo sapiens
gccctgcaggagcagggcg

SEQ ID NO: 1188435 - DNA, 15 bp, Homo sapiens
gccctgcaggcacag

SEQ ID NO: 1188436 - DNA, 19 bp, Homo sapiens
gccctgcaggcacagagga

SEQ ID NO: 1188437 - DNA, 15 bp, Homo sapiens
gccctgcattttcat

SEQ ID NO: 1188438 - DNA, 20 bp, Homo sapiens
gccctgccacgtcccgctgc

SEQ ID NO: 1188439 - DNA, 17 bp, Homo sapiens
gccctgccattggcctc

SEQ ID NO: 1188440 - DNA, 18 bp, Homo sapiens
gccctgccattggcctct

SEQ ID NO: 1188441 - DNA, 13 bp, Homo sapiens
gccctgcccaagt

SEQ ID NO: 1188442 - DNA, 20 bp, Homo sapiens
gccctgcccaccctccctcc

SEQ ID NO: 1188443 - DNA, 11 bp, Homo sapiens
gccctgcccag

SEQ ID NO: 1188444 - DNA, 22 bp, Homo sapiens
gccctgcccatactgagcctgc

SEQ ID NO: 1188445 - DNA, 18 bp, Homo sapiens
gccctgccccaggcctgg

SEQ ID NO: 1188446 - DNA, 19 bp, Homo sapiens
gccctgccccaggcctgga

SEQ ID NO: 1188447 - DNA, 20 bp, Homo sapiens
gccctgccccaggcctggac

SEQ ID NO: 1188448 - DNA, 21 bp, Homo sapiens
gccctgcccccatctccccag

SEQ ID NO: 1188449 - DNA, 22 bp, Homo sapiens
gccctgcccccatctccccagg

SEQ ID NO: 1188450 - DNA, 23 bp, Homo sapiens
gccctgcccccatctccccaggc

SEQ ID NO: 1188451 - DNA, 13 bp, Homo sapiens
gccctgccccctc

SEQ ID NO: 1188452 - DNA, 15 bp, Homo sapiens
gccctgccccgcctt

SEQ ID NO: 1188453 - DNA, 22 bp, Homo sapiens
gccctgcccggggagctgcaga

SEQ ID NO: 1188454 - DNA, 13 bp, Homo sapiens
gccctgccctgca

SEQ ID NO: 1188455 - DNA, 15 bp, Homo sapiens
gccctgccctggcag

SEQ ID NO: 1188456 - DNA, 12 bp, Homo sapiens
gccctgccctgt

SEQ ID NO: 1188457 - DNA, 19 bp, Homo sapiens
gccctgcccttggcaccac

SEQ ID NO: 1188458 - DNA, 20 bp, Homo sapiens
gccctgcccttggcaccacc

SEQ ID NO: 1188459 - DNA, 18 bp, Homo sapiens
gccctgcctcagccaggc

SEQ ID NO: 1188460 - DNA, 14 bp, Homo sapiens
gccctgcctctgtg

SEQ ID NO: 1188461 - DNA, 13 bp, Homo sapiens
gccctgcctgacc

SEQ ID NO: 1188462 - DNA, 12 bp, Homo sapiens
gccctgcctgag

SEQ ID NO: 1188463 - DNA, 13 bp, Homo sapiens
gccctgcctgagg

SEQ ID NO: 1188464 - DNA, 14 bp, Homo sapiens
gccctgcctgagga

SEQ ID NO: 1188465 - DNA, 16 bp, Homo sapiens
gccctgcctgaggagg

SEQ ID NO: 1188466 - DNA, 17 bp, Homo sapiens
gccctgcctgaggagga

SEQ ID NO: 1188467 - DNA, 12 bp, Homo sapiens
gccctgcctgcc

SEQ ID NO: 1188468 - DNA, 16 bp, Homo sapiens
gccctgcctgcccact

SEQ ID NO: 1188469 - DNA, 13 bp, Homo sapiens
gccctgcctgcct

SEQ ID NO: 1188470 - DNA, 16 bp, Homo sapiens
gccctgcctgcctctt

SEQ ID NO: 1188471 - DNA, 15 bp, Homo sapiens
gccctgcctgctgca

SEQ ID NO: 1188472 - DNA, 22 bp, Homo sapiens
gccctgccttgccgctcccctt

SEQ ID NO: 1188473 - DNA, 22 bp, Homo sapiens
gccctgcgaagtggctctcagg

SEQ ID NO: 1188474 - DNA, 13 bp, Homo sapiens
gccctgcgggcca

SEQ ID NO: 1188475 - DNA, 16 bp, Homo sapiens
gccctgcgggccacag

SEQ ID NO: 1188476 - DNA, 18 bp, Homo sapiens
gccctgcgggccacaggg

SEQ ID NO: 1188477 - DNA, 16 bp, Homo sapiens
gccctgcgtcggccct

SEQ ID NO: 1188478 - DNA, 16 bp, Homo sapiens
gccctgcgttggagcc

SEQ ID NO: 1188479 - DNA, 20 bp, Homo sapiens
gccctgcgttggagccactc

SEQ ID NO: 1188480 - DNA, 14 bp, Homo sapiens
gccctgctcctccc

SEQ ID NO: 1188481 - DNA, 17 bp, Homo sapiens
gccctgctcctccctgg

SEQ ID NO: 1188482 - DNA, 15 bp, Homo sapiens
gccctgctcctgcag

SEQ ID NO: 1188483 - DNA, 16 bp, Homo sapiens
gccctgctcctgcagc

SEQ ID NO: 1188484 - DNA, 13 bp, Homo sapiens
gccctgctgagtc

SEQ ID NO: 1188485 - DNA, 21 bp, Homo sapiens
gccctgctgccgcctcccagc

SEQ ID NO: 1188486 - DNA, 23 bp, Homo sapiens
gccctgctgccgcctcccagcct

SEQ ID NO: 1188487 - DNA, 13 bp, Homo sapiens
gccctgctgggga

SEQ ID NO: 1188488 - DNA, 14 bp, Homo sapiens
gccctgctggggct

SEQ ID NO: 1188489 - DNA, 14 bp, Homo sapiens
gccctgctgtggga

SEQ ID NO: 1188490 - DNA, 15 bp, Homo sapiens
gccctgcttcctgct

SEQ ID NO: 1188491 - DNA, 16 bp, Homo sapiens
gccctgcttcctgctt

SEQ ID NO: 1188492 - DNA, 19 bp, Homo sapiens
gccctgcttcctgcttgcc

SEQ ID NO: 1188493 - DNA, 22 bp, Homo sapiens
gccctgcttcctgcttgccaag

SEQ ID NO: 1188494 - DNA, 20 bp, Homo sapiens
gccctggaagccggcggccc

SEQ ID NO: 1188495 - DNA, 16 bp, Homo sapiens
gccctggacagatggc

SEQ ID NO: 1188496 - DNA, 20 bp, Homo sapiens
gccctggacagatggcccaa

SEQ ID NO: 1188497 - DNA, 11 bp, Homo sapiens
gccctggagcc

SEQ ID NO: 1188498 - DNA, 18 bp, Homo sapiens
gccctggagccagggcag

SEQ ID NO: 1188499 - DNA, 14 bp, Homo sapiens
gccctggaggcggt

SEQ ID NO: 1188500 - DNA, 14 bp, Homo sapiens
gccctggaggtggc

SEQ ID NO: 1188501 - DNA, 18 bp, Homo sapiens
gccctggaggtggctgag

SEQ ID NO: 1188502 - DNA, 20 bp, Homo sapiens
gccctggatgcccaggaatc

SEQ ID NO: 1188503 - DNA, 19 bp, Homo sapiens
gccctggcaacatagtgag

SEQ ID NO: 1188504 - DNA, 15 bp, Homo sapiens
gccctggccaagctt

SEQ ID NO: 1188505 - DNA, 20 bp, Homo sapiens
gccctggccactaaagcttc

SEQ ID NO: 1188506 - DNA, 14 bp, Homo sapiens
gccctggcctcccc

SEQ ID NO: 1188507 - DNA, 16 bp, Homo sapiens
gccctggcctcccctg

SEQ ID NO: 1188508 - DNA, 20 bp, Homo sapiens
gccctggcctcccctgccac

SEQ ID NO: 1188509 - DNA, 24 bp, Homo sapiens
gccctggcctcccctgccaccagg

SEQ ID NO: 1188510 - DNA, 12 bp, Homo sapiens
gccctggcctgc

SEQ ID NO: 1188511 - DNA, 15 bp, Homo sapiens
gccctggcctgctgg

SEQ ID NO: 1188512 - DNA, 17 bp, Homo sapiens
gccctggcctgctgggc

SEQ ID NO: 1188513 - DNA, 15 bp, Homo sapiens
gccctggctcccaca

SEQ ID NO: 1188514 - DNA, 21 bp, Homo sapiens
gccccaggggacgtgggccct

SEQ ID NO: 1188515 - DNA, 14 bp, Homo sapiens
gccccaggggcagc

SEQ ID NO: 1188516 - DNA, 17 bp, Homo sapiens
gccccaggggcagcaag

SEQ ID NO: 1188517 - DNA, 17 bp, Homo sapiens
gccccagggtcttccct

SEQ ID NO: 1188518 - DNA, 16 bp, Homo sapiens
gccccagggtgcccag

SEQ ID NO: 1188519 - DNA, 22 bp, Homo sapiens
gccccagtagtcagaagcaggt

SEQ ID NO: 1188520 - DNA, 12 bp, Homo sapiens
gccccagtgctg

SEQ ID NO: 1188521 - DNA, 18 bp, Homo sapiens
gccccagttcaatctccc

SEQ ID NO: 1188522 - DNA, 22 bp, Homo sapiens
gccccagttcctgtggctccct

SEQ ID NO: 1188523 - DNA, 21 bp, Homo sapiens
gccccagtttggggtgccaag

SEQ ID NO: 1188524 - DNA, 14 bp, Homo sapiens
gccccatcagtgct

SEQ ID NO: 1188525 - DNA, 22 bp, Homo sapiens
gccccatccaaccactgtacac

SEQ ID NO: 1188526 - DNA, 23 bp, Homo sapiens
gccccatccaccgccagcttccc

SEQ ID NO: 1188527 - DNA, 17 bp, Homo sapiens
gccccatcctcatccct

SEQ ID NO: 1188528 - DNA, 16 bp, Homo sapiens
gccccatcctccagca

SEQ ID NO: 1188529 - DNA, 20 bp, Homo sapiens
gccccatcgccccaactcca

SEQ ID NO: 1188530 - DNA, 16 bp, Homo sapiens
gccccatcgccccacc

SEQ ID NO: 1188531 - DNA, 17 bp, Homo sapiens
gccccatcgccccaccg

SEQ ID NO: 1188532 - DNA, 14 bp, Homo sapiens
gccccatcttgatc

SEQ ID NO: 1188533 - DNA, 14 bp, Homo sapiens
gccccatgctctgc

SEQ ID NO: 1188534 - DNA, 15 bp, Homo sapiens
gccccatgctctgcc

SEQ ID NO: 1188535 - DNA, 18 bp, Homo sapiens
gccccatgctctgcccca

SEQ ID NO: 1188536 - DNA, 21 bp, Homo sapiens
gccccatgctctgccccaagc

SEQ ID NO: 1188537 - DNA, 16 bp, Homo sapiens
gccccatgtctctcag

SEQ ID NO: 1188538 - DNA, 18 bp, Homo sapiens
gccccatgtctctcagaa

SEQ ID NO: 1188539 - DNA, 14 bp, Homo sapiens
gccccattcctaag

SEQ ID NO: 1188540 - DNA, 12 bp, Homo sapiens
gccccattcctg

SEQ ID NO: 1188541 - DNA, 18 bp, Homo sapiens
gcccccaacacaggcaag

SEQ ID NO: 1188542 - DNA, 20 bp, Homo sapiens
gcccccaacacaggcaagtc

SEQ ID NO: 1188543 - DNA, 20 bp, Homo sapiens
gcccccaaccccgcggtgct

SEQ ID NO: 1188544 - DNA, 19 bp, Homo sapiens
gcccccaacctcagggctc

SEQ ID NO: 1188545 - DNA, 17 bp, Homo sapiens
gcccccaataaaggcag

SEQ ID NO: 1188546 - DNA, 21 bp, Homo sapiens
gcccccaccactaggactctg

SEQ ID NO: 1188547 - DNA, 15 bp, Homo sapiens
gcccccaccagcagc

SEQ ID NO: 1188548 - DNA, 22 bp, Homo sapiens
gcccccaccccttccccaggcc

SEQ ID NO: 1188549 - DNA, 20 bp, Homo sapiens
gcccccaccgaggttcccag

SEQ ID NO: 1188550 - DNA, 17 bp, Homo sapiens
gcccccaccggaactgg

SEQ ID NO: 1188551 - DNA, 17 bp, Homo sapiens
gcccccaccgggctgca

SEQ ID NO: 1188552 - DNA, 20 bp, Homo sapiens
gcccccaccgggctgcaggt

SEQ ID NO: 1188553 - DNA, 14 bp, Homo sapiens
gcccccacttgcct

SEQ ID NO: 1188554 - DNA, 11 bp, Homo sapiens
gcccccagaaa

SEQ ID NO: 1188555 - DNA, 22 bp, Homo sapiens
gcccccagaaagcctcctgccc

SEQ ID NO: 1188556 - DNA, 22 bp, Homo sapiens
gcccccagatagagctgggtgg

SEQ ID NO: 1188557 - DNA, 12 bp, Homo sapiens
gcccccagcaga

SEQ ID NO: 1188558 - DNA, 21 bp, Homo sapiens
gcccccagccccggggtgagt

SEQ ID NO: 1188559 - DNA, 16 bp, Homo sapiens
gcccccagccctgggg

SEQ ID NO: 1188560 - DNA, 13 bp, Homo sapiens
gcccccagcctca

SEQ ID NO: 1188561 - DNA, 15 bp, Homo sapiens
gcccccagcctcagc

SEQ ID NO: 1188562 - DNA, 16 bp, Homo sapiens
gcccccagcctcagcc

SEQ ID NO: 1188563 - DNA, 18 bp, Homo sapiens
gcccccagcctcagccca

SEQ ID NO: 1188564 - DNA, 12 bp, Homo sapiens
gcccccagcctg

SEQ ID NO: 1188565 - DNA, 18 bp, Homo sapiens
gcccccagcctggccaga

SEQ ID NO: 1188566 - DNA, 12 bp, Homo sapiens
gcccccagctgg

SEQ ID NO: 1188567 - DNA, 15 bp, Homo sapiens
gcccccaggatctgg

SEQ ID NO: 1188568 - DNA, 21 bp, Homo sapiens
gcccccaggattcccccagcc

SEQ ID NO: 1188569 - DNA, 12 bp, Homo sapiens
gcccccaggcca

SEQ ID NO: 1188570 - DNA, 15 bp, Homo sapiens
gcccccagggccccc

SEQ ID NO: 1188571 - DNA, 17 bp, Homo sapiens
gcccccagggcctccag

SEQ ID NO: 1188572 - DNA, 18 bp, Homo sapiens
gcccccagggcctccagg

SEQ ID NO: 1188573 - DNA, 20 bp, Homo sapiens
gcccccagggcctccagggc

SEQ ID NO: 1188574 - DNA, 21 bp, Homo sapiens
gcccccagggcctccagggcc

SEQ ID NO: 1188575 - DNA, 22 bp, Homo sapiens
gcccccagggcctccagggccc

SEQ ID NO: 1188576 - DNA, 17 bp, Homo sapiens
gcccccagtccccaccc

SEQ ID NO: 1188577 - DNA, 22 bp, Homo sapiens
gcccccagtccccacccctgcc

SEQ ID NO: 1188578 - DNA, 23 bp, Homo sapiens
gcccccagtgtgcacgagtggga

SEQ ID NO: 1188579 - DNA, 15 bp, Homo sapiens
gcccccatccagcca

SEQ ID NO: 1188580 - DNA, 20 bp, Homo sapiens
gcccccatctccccaggcct

SEQ ID NO: 1188581 - DNA, 14 bp, Homo sapiens
gcccccatctgtct

SEQ ID NO: 1188582 - DNA, 19 bp, Homo sapiens
gcccccatctgtcttcagc

SEQ ID NO: 1188583 - DNA, 17 bp, Homo sapiens
gcccccatggggtcctt

SEQ ID NO: 1188584 - DNA, 18 bp, Homo sapiens
gcccccatggggtccttg

SEQ ID NO: 1188585 - DNA, 17 bp, Homo sapiens
gccccccaaagtgctgg

SEQ ID NO: 1188586 - DNA, 20 bp, Homo sapiens
gccccccacacttccctggc

SEQ ID NO: 1188587 - DNA, 13 bp, Homo sapiens
gccccccacccca

SEQ ID NO: 1188588 - DNA, 14 bp, Homo sapiens
gccccccaccccag

SEQ ID NO: 1188589 - DNA, 23 bp, Homo sapiens
gccccccacctttgggatcagcc

SEQ ID NO: 1188590 - DNA, 20 bp, Homo sapiens
gccccccagagagagctctg

SEQ ID NO: 1188591 - DNA, 14 bp, Homo sapiens
gccccccagagcca

SEQ ID NO: 1188592 - DNA, 16 bp, Homo sapiens
gccccccagagccagg

SEQ ID NO: 1188593 - DNA, 19 bp, Homo sapiens
gccccccagagccagggct

SEQ ID NO: 1188594 - DNA, 15 bp, Homo sapiens
gccccccagggctag

SEQ ID NO: 1188595 - DNA, 13 bp, Homo sapiens
gcccccccaccca

SEQ ID NO: 1188596 - DNA, 22 bp, Homo sapiens
gcccccccctcaaggggcaggg

SEQ ID NO: 1188597 - DNA, 16 bp, Homo sapiens
gccccccctcttttgg

SEQ ID NO: 1188598 - DNA, 22 bp, Homo sapiens
gccccccctcttttggccttgt

SEQ ID NO: 1188599 - DNA, 16 bp, Homo sapiens
gccccccgaggctgct

SEQ ID NO: 1188600 - DNA, 17 bp, Homo sapiens
gccccccgcacagccac

SEQ ID NO: 1188601 - DNA, 18 bp, Homo sapiens
gccccccgcacagccacc

SEQ ID NO: 1188602 - DNA, 22 bp, Homo sapiens
gccccccgcacagccacccgtg

SEQ ID NO: 1188603 - DNA, 21 bp, Homo sapiens
gcccccctagaataatctcat

SEQ ID NO: 1188604 - DNA, 16 bp, Homo sapiens
gcccccctcccaacag

SEQ ID NO: 1188605 - DNA, 15 bp, Homo sapiens
gcccccctcctccag

SEQ ID NO: 1188606 - DNA, 20 bp, Homo sapiens
gcccccctttggcactggat

SEQ ID NO: 1188607 - DNA, 17 bp, Homo sapiens
gcccccgacggctgtga

SEQ ID NO: 1188608 - DNA, 15 bp, Homo sapiens
gcccccgagccctga

SEQ ID NO: 1188609 - DNA, 23 bp, Homo sapiens
gcccccgagccctgactcctgga

SEQ ID NO: 1188610 - DNA, 13 bp, Homo sapiens
gcccccgagctgg

SEQ ID NO: 1188611 - DNA, 14 bp, Homo sapiens
gcccccgccccaga

SEQ ID NO: 1188612 - DNA, 16 bp, Homo sapiens
gcccccgccccagagt

SEQ ID NO: 1188613 - DNA, 22 bp, Homo sapiens
gcccccgccccagagtggccca

SEQ ID NO: 1188614 - DNA, 19 bp, Homo sapiens
gcccccgccccaggcttcc

SEQ ID NO: 1188615 - DNA, 15 bp, Homo sapiens
gcccccgcctgccac

SEQ ID NO: 1188616 - DNA, 20 bp, Homo sapiens
gcccccgcgccctccctccg

SEQ ID NO: 1188617 - DNA, 19 bp, Homo sapiens
gcccccgcgggttctagac

SEQ ID NO: 1188618 - DNA, 22 bp, Homo sapiens
gcccccgcgggttctagacgcc

SEQ ID NO: 1188619 - DNA, 21 bp, Homo sapiens
gcccccgctcccgctcccagg

SEQ ID NO: 1188620 - DNA, 15 bp, Homo sapiens
gcccccgcttagccc

SEQ ID NO: 1188621 - DNA, 21 bp, Homo sapiens
gcccccgcttagccccgctga

SEQ ID NO: 1188622 - DNA, 15 bp, Homo sapiens
gcccccggctttcct

SEQ ID NO: 1188623 - DNA, 18 bp, Homo sapiens
gcccccgggcctgcacag

SEQ ID NO: 1188624 - DNA, 19 bp, Homo sapiens
gcccccgggcctgcacaga

SEQ ID NO: 1188625 - DNA, 16 bp, Homo sapiens
gccccctccagctcat

SEQ ID NO: 1188626 - DNA, 19 bp, Homo sapiens
gccccctccagctcatgac

SEQ ID NO: 1188627 - DNA, 13 bp, Homo sapiens
gccccctccccca

SEQ ID NO: 1188628 - DNA, 20 bp, Homo sapiens
gccccctccccccagactct

SEQ ID NO: 1188629 - DNA, 16 bp, Homo sapiens
gccccctccgccctgc

SEQ ID NO: 1188630 - DNA, 18 bp, Homo sapiens
gccccctccgccctgcca

SEQ ID NO: 1188631 - DNA, 16 bp, Homo sapiens
gccccctcctctagct

SEQ ID NO: 1188632 - DNA, 20 bp, Homo sapiens
gccccctcctctagctgtgg

SEQ ID NO: 1188633 - DNA, 21 bp, Homo sapiens
gccccctcctctcccatcccc

SEQ ID NO: 1188634 - DNA, 13 bp, Homo sapiens
gccccctcctgaa

SEQ ID NO: 1188635 - DNA, 15 bp, Homo sapiens
gccccctcctgaacc

SEQ ID NO: 1188636 - DNA, 17 bp, Homo sapiens
gcccctcctctgccacc

SEQ ID NO: 1188637 - DNA, 23 bp, Homo sapiens
gcccctcctctgccacctcccct

SEQ ID NO: 1188638 - DNA, 14 bp, Homo sapiens
gcccctccttgcaa

SEQ ID NO: 1188639 - DNA, 22 bp, Homo sapiens
gcccctccttgcaaccaggcag

SEQ ID NO: 1188640 - DNA, 21 bp, Homo sapiens
gcccctcgcacacagggctca

SEQ ID NO: 1188641 - DNA, 23 bp, Homo sapiens
gcccctcgcacacagggctcaca

SEQ ID NO: 1188642 - DNA, 15 bp, Homo sapiens
gcccctcgctgctgc

SEQ ID NO: 1188643 - DNA, 17 bp, Homo sapiens
gcccctcgttgcccagc

SEQ ID NO: 1188644 - DNA, 15 bp, Homo sapiens
gcccctctcccctct

SEQ ID NO: 1188645 - DNA, 20 bp, Homo sapiens
gcccctctcccctctctgct

SEQ ID NO: 1188646 - DNA, 11 bp, Homo sapiens
gcccctctctc

SEQ ID NO: 1188647 - DNA, 19 bp, Homo sapiens
gcccctctgcccagcttgg

SEQ ID NO: 1188648 - DNA, 14 bp, Homo sapiens
gcccctctggtcgc

SEQ ID NO: 1188649 - DNA, 13 bp, Homo sapiens
gcccctctgttct

SEQ ID NO: 1188650 - DNA, 22 bp, Homo sapiens
gcccctctgttctctcccctca

SEQ ID NO: 1188651 - DNA, 13 bp, Homo sapiens
gcccctcttccct

SEQ ID NO: 1188652 - DNA, 14 bp, Homo sapiens
gcccctcttccctt

SEQ ID NO: 1188653 - DNA, 21 bp, Homo sapiens
gcccctcttcccttcctccat

SEQ ID NO: 1188654 - DNA, 13 bp, Homo sapiens
gcccctcttgccc

SEQ ID NO: 1188655 - DNA, 21 bp, Homo sapiens
gcccctcttgccccccacccc

SEQ ID NO: 1188656 - DNA, 13 bp, Homo sapiens
gcccctgacatca

SEQ ID NO: 1188657 - DNA, 23 bp, Homo sapiens
gcccctgagagtggtgccctgga

SEQ ID NO: 1188658 - DNA, 20 bp, Homo sapiens
gcccctgagcaatgtctgtg

SEQ ID NO: 1188659 - DNA, 22 bp, Homo sapiens
gcccctgagcaatgtctgtgct

SEQ ID NO: 1188660 - DNA, 18 bp, Homo sapiens
gcccctgagtccgcctgc

SEQ ID NO: 1188661 - DNA, 20 bp, Homo sapiens
gcccctgagtccgcctgcgc

SEQ ID NO: 1188662 - DNA, 21 bp, Homo sapiens
gcccctgagtccgcctgcgcc

SEQ ID NO: 1188663 - DNA, 24 bp, Homo sapiens
gcccctgagtccgcctgcgcctcc

SEQ ID NO: 1188664 - DNA, 17 bp, Homo sapiens
gcccctgatctctgacc

SEQ ID NO: 1188665 - DNA, 18 bp, Homo sapiens
gcccctgatctctgacct

SEQ ID NO: 1188666 - DNA, 16 bp, Homo sapiens
gcccctgatgcagcct

SEQ ID NO: 1188667 - DNA, 17 bp, Homo sapiens
gcccctgatgcagcctg

SEQ ID NO: 1188668 - DNA, 23 bp, Homo sapiens
gcccctgatgcagcctgtggctt

SEQ ID NO: 1188669 - DNA, 13 bp, Homo sapiens
gcccctgcacaaa

SEQ ID NO: 1188670 - DNA, 17 bp, Homo sapiens
gcccctgcacaggcaca

SEQ ID NO: 1188671 - DNA, 20 bp, Homo sapiens
gcccctgcatccccttggct

SEQ ID NO: 1188672 - DNA, 23 bp, Homo sapiens
gcccctgcatccccttggctgtg

SEQ ID NO: 1188673 - DNA, 18 bp, Homo sapiens
gcccctgccccggaggaa

SEQ ID NO: 1188674 - DNA, 14 bp, Homo sapiens
gcccctgccccgtc

SEQ ID NO: 1188675 - DNA, 14 bp, Homo sapiens
gcccctgcctgaca

SEQ ID NO: 1188676 - DNA, 15 bp, Homo sapiens
gcccctgcctgccat

SEQ ID NO: 1188677 - DNA, 21 bp, Homo sapiens
gcccctgcctgccatgtacct

SEQ ID NO: 1188678 - DNA, 22 bp, Homo sapiens
gcccctgcctgccatgtacctc

SEQ ID NO: 1188679 - DNA, 12 bp, Homo sapiens
gcccctgctccc

SEQ ID NO: 1188680 - DNA, 13 bp, Homo sapiens
gcccctgctgcct

SEQ ID NO: 1188681 - DNA, 20 bp, Homo sapiens
gcccctgctgcctccccaac

SEQ ID NO: 1188682 - DNA, 21 bp, Homo sapiens
gcccctgctgtctctctgggc

SEQ ID NO: 1188683 - DNA, 16 bp, Homo sapiens
gcccctgctgtgctgc

SEQ ID NO: 1188684 - DNA, 19 bp, Homo sapiens
gcccctggacaagcagagg

SEQ ID NO: 1188685 - DNA, 20 bp, Homo sapiens
gcccctggacccctggggtg

SEQ ID NO: 1188686 - DNA, 16 bp, Homo sapiens
gcccctggacttctta

SEQ ID NO: 1188687 - DNA, 14 bp, Homo sapiens
gcccctggagccag

SEQ ID NO: 1188688 - DNA, 16 bp, Homo sapiens
gcccctggcccagcgg

SEQ ID NO: 1188689 - DNA, 23 bp, Homo sapiens
gcccctggcccagcggcccctcc

SEQ ID NO: 1188690 - DNA, 20 bp, Homo sapiens
gcccctggcccatctcagcc

SEQ ID NO: 1188691 - DNA, 21 bp, Homo sapiens
gcccctggcccatctcagcct

SEQ ID NO: 1188692 - DNA, 12 bp, Homo sapiens
gcccctggctgg

SEQ ID NO: 1188693 - DNA, 14 bp, Homo sapiens
gcccctgggaacag

SEQ ID NO: 1188694 - DNA, 20 bp, Homo sapiens
gcccctgggaacaggcccca

SEQ ID NO: 1188695 - DNA, 15 bp, Homo sapiens
gcccctgggatggga

SEQ ID NO: 1188696 - DNA, 18 bp, Homo sapiens
gcccctgggcccttgtgc

SEQ ID NO: 1188697 - DNA, 22 bp, Homo sapiens
gcccctgggcttggcctgctgt

SEQ ID NO: 1188698 - DNA, 23 bp, Homo sapiens
gcccctgggcttggcctgctgtg

SEQ ID NO: 1188699 - DNA, 13 bp, Homo sapiens
gcccctggggaca

SEQ ID NO: 1188700 - DNA, 20 bp, Homo sapiens
gcccctggggacagagccac

SEQ ID NO: 1188701 - DNA, 15 bp, Homo sapiens
gcccctggggctgta

SEQ ID NO: 1188702 - DNA, 23 bp, Homo sapiens
gcccctggggctgtatttatctc

SEQ ID NO: 1188703 - DNA, 20 bp, Homo sapiens
gcccctgggtgggtggtggg

SEQ ID NO: 1188704 - DNA, 22 bp, Homo sapiens
gcccctgggtgggtggtgggga

SEQ ID NO: 1188705 - DNA, 17 bp, Homo sapiens
gcccctggtaagcagag

SEQ ID NO: 1188706 - DNA, 19 bp, Homo sapiens
gcccctggtaagcagaggc

SEQ ID NO: 1188707 - DNA, 20 bp, Homo sapiens
gcccctggtaagcagaggct

SEQ ID NO: 1188708 - DNA, 18 bp, Homo sapiens
gcccctggtgccctgaga

SEQ ID NO: 1188709 - DNA, 22 bp, Homo sapiens
gcccctgtaaggtttcaatgca

SEQ ID NO: 1188710 - DNA, 20 bp, Homo sapiens
gcccctgtcccacctggctc

SEQ ID NO: 1188711 - DNA, 22 bp, Homo sapiens
gcccctgtcccacctggctccc

SEQ ID NO: 1188712 - DNA, 16 bp, Homo sapiens
gcccctgtcgcccacc

SEQ ID NO: 1188713 - DNA, 22 bp, Homo sapiens
gcccctgtcgcccacccagctg

SEQ ID NO: 1188714 - DNA, 23 bp, Homo sapiens
gcccctgtcgcccacccagctgg

SEQ ID NO: 1188715 - DNA, 15 bp, Homo sapiens
gcccctgtctggaag

SEQ ID NO: 1188716 - DNA, 16 bp, Homo sapiens
gcccctgtctggaaga

SEQ ID NO: 1188717 - DNA, 14 bp, Homo sapiens
gcccctgtgaccct

SEQ ID NO: 1188718 - DNA, 15 bp, Homo sapiens
gcccctgtgaccctc

SEQ ID NO: 1188719 - DNA, 18 bp, Homo sapiens
gcccctgtgaccctctca

SEQ ID NO: 1188720 - DNA, 21 bp, Homo sapiens
gcccaagaggtctgagccctg

SEQ ID NO: 1188721 - DNA, 16 bp, Homo sapiens
gcccaagccagaggct

SEQ ID NO: 1188722 - DNA, 18 bp, Homo sapiens
gcccaagccagaggctgg

SEQ ID NO: 1188723 - DNA, 21 bp, Homo sapiens
gcccaagccagaggctgggtt

SEQ ID NO: 1188724 - DNA, 16 bp, Homo sapiens
gcccaagccccatctc

SEQ ID NO: 1188725 - DNA, 20 bp, Homo sapiens
gcccaagcccgacttgctgt

SEQ ID NO: 1188726 - DNA, 15 bp, Homo sapiens
gcccaaggctcccgg

SEQ ID NO: 1188727 - DNA, 15 bp, Homo sapiens
gcccaagggatctgg

SEQ ID NO: 1188728 - DNA, 18 bp, Homo sapiens
gcccaagggcctcccacc

SEQ ID NO: 1188729 - DNA, 20 bp, Homo sapiens
gcccaaggtcccctccacat

SEQ ID NO: 1188730 - DNA, 20 bp, Homo sapiens
gcccaaggttaaaaagttca

SEQ ID NO: 1188731 - DNA, 17 bp, Homo sapiens
gcccaagtccctgtttt

SEQ ID NO: 1188732 - DNA, 20 bp, Homo sapiens
gcccaagtgaccagggaagt

SEQ ID NO: 1188733 - DNA, 15 bp, Homo sapiens
gcccaagtgggcagt

SEQ ID NO: 1188734 - DNA, 13 bp, Homo sapiens
gcccaagtgggtc

SEQ ID NO: 1188735 - DNA, 18 bp, Homo sapiens
gcccaatattataatttt

SEQ ID NO: 1188736 - DNA, 14 bp, Homo sapiens
gcccaatgaaatga

SEQ ID NO: 1188737 - DNA, 14 bp, Homo sapiens
gcccaatgaattat

SEQ ID NO: 1188738 - DNA, 20 bp, Homo sapiens
gcccaatgagactctagggt

SEQ ID NO: 1188739 - DNA, 22 bp, Homo sapiens
gcccaatgctttgggaggccaa

SEQ ID NO: 1188740 - DNA, 18 bp, Homo sapiens
gcccaattttaatctgaa

SEQ ID NO: 1188741 - DNA, 23 bp, Homo sapiens
gcccacaacttgtcacccaaagc

SEQ ID NO: 1188742 - DNA, 15 bp, Homo sapiens
gcccacagagcctga

SEQ ID NO: 1188743 - DNA, 14 bp, Homo sapiens
gcccacagcgagcc

SEQ ID NO: 1188744 - DNA, 19 bp, Homo sapiens
gcccacagctcccacccca

SEQ ID NO: 1188745 - DNA, 14 bp, Homo sapiens
gcccacatcccagg

SEQ ID NO: 1188746 - DNA, 13 bp, Homo sapiens
gcccacatgggac

SEQ ID NO: 1188747 - DNA, 16 bp, Homo sapiens
gcccacattggaccca

SEQ ID NO: 1188748 - DNA, 18 bp, Homo sapiens
gcccaccaatctgccctt

SEQ ID NO: 1188749 - DNA, 13 bp, Homo sapiens
gcccaccagccag

SEQ ID NO: 1188750 - DNA, 14 bp, Homo sapiens
gcccaccagccagc

SEQ ID NO: 1188751 - DNA, 18 bp, Homo sapiens
gcccaccagccagccctg

SEQ ID NO: 1188752 - DNA, 23 bp, Homo sapiens
gcccaccagccagccctggccca

SEQ ID NO: 1188753 - DNA, 11 bp, Homo sapiens
gcccaccagga

SEQ ID NO: 1188754 - DNA, 23 bp, Homo sapiens
gcccaccaggagcacctggaccc

SEQ ID NO: 1188755 - DNA, 16 bp, Homo sapiens
gcccaccatcaccacc

SEQ ID NO: 1188756 - DNA, 12 bp, Homo sapiens
gcccacccagct

SEQ ID NO: 1188757 - DNA, 13 bp, Homo sapiens
gcccacccagctg

SEQ ID NO: 1188758 - DNA, 15 bp, Homo sapiens
gcccacccagggagc

SEQ ID NO: 1188759 - DNA, 23 bp, Homo sapiens
gcccacccagggagctgatgccc

SEQ ID NO: 1188760 - DNA, 13 bp, Homo sapiens
gcccacccaggtc

SEQ ID NO: 1188761 - DNA, 23 bp, Homo sapiens
gcccacccccagtctccagggac

SEQ ID NO: 1188762 - DNA, 13 bp, Homo sapiens
gcccaccccccag

SEQ ID NO: 1188763 - DNA, 15 bp, Homo sapiens
gcccaccccccagcc

SEQ ID NO: 1188764 - DNA, 18 bp, Homo sapiens
gcccaccccccagcctcc

SEQ ID NO: 1188765 - DNA, 19 bp, Homo sapiens
gcccaccccccagcctcca

SEQ ID NO: 1188766 - DNA, 23 bp, Homo sapiens
gcccacccccgggatcctgcccc

SEQ ID NO: 1188767 - DNA, 15 bp, Homo sapiens
gcccaccccctcaag

SEQ ID NO: 1188768 - DNA, 14 bp, Homo sapiens
gcccaccccctgcc

SEQ ID NO: 1188769 - DNA, 15 bp, Homo sapiens
gcccaccccctgccc

SEQ ID NO: 1188770 - DNA, 20 bp, Homo sapiens
gcccaccccctgccctgcac

SEQ ID NO: 1188771 - DNA, 11 bp, Homo sapiens
gcccacccctc

SEQ ID NO: 1188772 - DNA, 15 bp, Homo sapiens
gcccacccctcaaca

SEQ ID NO: 1188773 - DNA, 21 bp, Homo sapiens
gcccacccctcactccccagg

SEQ ID NO: 1188774 - DNA, 23 bp, Homo sapiens
gcccacccgtcttcaatctctgt

SEQ ID NO: 1188775 - DNA, 13 bp, Homo sapiens
gcccaccctacca

SEQ ID NO: 1188776 - DNA, 16 bp, Homo sapiens
gcccaccctaccagct

SEQ ID NO: 1188777 - DNA, 18 bp, Homo sapiens
gcccaccctaccagctcc

SEQ ID NO: 1188778 - DNA, 20 bp, Homo sapiens
gcccaccctaccagctcctc

SEQ ID NO: 1188779 - DNA, 18 bp, Homo sapiens
gcccaccctctgcccagg

SEQ ID NO: 1188780 - DNA, 20 bp, Homo sapiens
gcccaccctctgcccaggga

SEQ ID NO: 1188781 - DNA, 22 bp, Homo sapiens
gcccaccctctgcccagggagt

SEQ ID NO: 1188782 - DNA, 14 bp, Homo sapiens
gcccaccgccctcc

SEQ ID NO: 1188783 - DNA, 20 bp, Homo sapiens
gcccaccgccctcctccact

SEQ ID NO: 1188784 - DNA, 17 bp, Homo sapiens
gcccacctcaacccaga

SEQ ID NO: 1188785 - DNA, 21 bp, Homo sapiens
gcccacctccttccagcactg

SEQ ID NO: 1188786 - DNA, 15 bp, Homo sapiens
gcccacctcgctccc

SEQ ID NO: 1188787 - DNA, 13 bp, Homo sapiens
gcccacctctccc

SEQ ID NO: 1188788 - DNA, 17 bp, Homo sapiens
gcccacctctccctgca

SEQ ID NO: 1188789 - DNA, 16 bp, Homo sapiens
gcccacctgaaagcct

SEQ ID NO: 1188790 - DNA, 19 bp, Homo sapiens
gcccacctgaaagcctgtc

SEQ ID NO: 1188791 - DNA, 14 bp, Homo sapiens
gcccacctgcccat

SEQ ID NO: 1188792 - DNA, 20 bp, Homo sapiens
gcccacctgcccatcacagg

SEQ ID NO: 1188793 - DNA, 16 bp, Homo sapiens
gcccacctggccacct

SEQ ID NO: 1188794 - DNA, 19 bp, Homo sapiens
gcccaccttggaccctggt

SEQ ID NO: 1188795 - DNA, 16 bp, Homo sapiens
gcccacgaggagcagc

SEQ ID NO: 1188796 - DNA, 17 bp, Homo sapiens
gcccacgaggagcagca

SEQ ID NO: 1188797 - DNA, 14 bp, Homo sapiens
gcccacgcagagga

SEQ ID NO: 1188798 - DNA, 15 bp, Homo sapiens
gcccacgcagaggac

SEQ ID NO: 1188799 - DNA, 14 bp, Homo sapiens
gcccacgccggcct

SEQ ID NO: 1188800 - DNA, 20 bp, Homo sapiens
gcccacgccggcctctgctg

SEQ ID NO: 1188801 - DNA, 15 bp, Homo sapiens
gcccacggtctgagc

SEQ ID NO: 1188802 - DNA, 20 bp, Homo sapiens
gcccacgtagggggctctgg

SEQ ID NO: 1188803 - DNA, 14 bp, Homo sapiens
gcccactagagggc

SEQ ID NO: 1188804 - DNA, 20 bp, Homo sapiens
gcccactagagggcccatca

SEQ ID NO: 1188805 - DNA, 22 bp, Homo sapiens
gcccactagagggcccatcagg

SEQ ID NO: 1188806 - DNA, 18 bp, Homo sapiens
gcccactccccagcccca

SEQ ID NO: 1188807 - DNA, 15 bp, Homo sapiens
gcccactccctgcct

SEQ ID NO: 1188808 - DNA, 22 bp, Homo sapiens
gcccactctgtaatagttcagt

SEQ ID NO: 1188809 - DNA, 20 bp, Homo sapiens
gcccactgcctcctgcctgg

SEQ ID NO: 1188810 - DNA, 22 bp, Homo sapiens
gcccactgctcgtggactgtgc

SEQ ID NO: 1188811 - DNA, 17 bp, Homo sapiens
gcccactggccgctgag

SEQ ID NO: 1188812 - DNA, 13 bp, Homo sapiens
gcccactgtcctg

SEQ ID NO: 1188813 - DNA, 23 bp, Homo sapiens
gcccactgtgcctcagagaccag

SEQ ID NO: 1188814 - DNA, 23 bp, Homo sapiens
gcccacttagccgtccatggcac

SEQ ID NO: 1188815 - DNA, 18 bp, Homo sapiens
gcccacttgattgagaaa

SEQ ID NO: 1188816 - DNA, 20 bp, Homo sapiens
gcccacttgattgagaaaga

SEQ ID NO: 1188817 - DNA, 16 bp, Homo sapiens
gcccagaacaaaaaga

SEQ ID NO: 1188818 - DNA, 21 bp, Homo sapiens
gcccagaacaaaaagaaatct

SEQ ID NO: 1188819 - DNA, 14 bp, Homo sapiens
gcccagaaccacag

SEQ ID NO: 1188820 - DNA, 22 bp, Homo sapiens
gcccagaactgcccccactgtc

SEQ ID NO: 1188821 - DNA, 15 bp, Homo sapiens
gcccagaacttccct

SEQ ID NO: 1188822 - DNA, 16 bp, Homo sapiens
gcccagaataagttat

SEQ ID NO: 1188823 - DNA, 18 bp, Homo sapiens
gcccagaatccccaagtg

SEQ ID NO: 1188824 - DNA, 19 bp, Homo sapiens
gcccagacacagactggca

SEQ ID NO: 1188825 - DNA, 22 bp, Homo sapiens
gcccagacacagactggcaata

SEQ ID NO: 1188826 - DNA, 23 bp, Homo sapiens
gcccagacacagactggcaataa

SEQ ID NO: 1188827 - DNA, 23 bp, Homo sapiens
gcccagacccagcccgcggcctg

SEQ ID NO: 1188828 - DNA, 20 bp, Homo sapiens
gcccagactctgagctgctc

SEQ ID NO: 1188829 - DNA, 23 bp, Homo sapiens
gcccagactctgagctgctcacc

SEQ ID NO: 1188830 - DNA, 15 bp, Homo sapiens
gcccagactgatgag

SEQ ID NO: 1188831 - DNA, 22 bp, Homo sapiens
gcccagactgatgagcacatct

SEQ ID NO: 1188832 - DNA, 21 bp, Homo sapiens
gcccagacttgcggggggtgg

SEQ ID NO: 1188833 - DNA, 14 bp, Homo sapiens
gcccagagaacagc

SEQ ID NO: 1188834 - DNA, 17 bp, Homo sapiens
gcccagagaccccttcc

SEQ ID NO: 1188835 - DNA, 22 bp, Homo sapiens
gcccagagatgcctccaccgct

SEQ ID NO: 1188836 - DNA, 14 bp, Homo sapiens
gcccagagcaggaa

SEQ ID NO: 1188837 - DNA, 15 bp, Homo sapiens
gcccagagccacctg

SEQ ID NO: 1188838 - DNA, 13 bp, Homo sapiens
gcccagagccctt

SEQ ID NO: 1188839 - DNA, 21 bp, Homo sapiens
gcccagaggactcccaaccct

SEQ ID NO: 1188840 - DNA, 21 bp, Homo sapiens
gcccagatacgggggctgtga

SEQ ID NO: 1188841 - DNA, 16 bp, Homo sapiens
gcccagatcagctcct

SEQ ID NO: 1188842 - DNA, 20 bp, Homo sapiens
gcccagatgtgtccccccca

SEQ ID NO: 1188843 - DNA, 13 bp, Homo sapiens
gcccagcagctca

SEQ ID NO: 1188844 - DNA, 12 bp, Homo sapiens
tccccagactca

SEQ ID NO: 1188845 - DNA, 15 bp, Homo sapiens
tccccagagagcagg

SEQ ID NO: 1188846 - DNA, 16 bp, Homo sapiens
tccccagagagcaggc

SEQ ID NO: 1188847 - DNA, 19 bp, Homo sapiens
tccccagagaggcactcag

SEQ ID NO: 1188848 - DNA, 17 bp, Homo sapiens
tccccagagcccagctc

SEQ ID NO: 1188849 - DNA, 22 bp, Homo sapiens
tccccagagcccagctcttgct

SEQ ID NO: 1188850 - DNA, 15 bp, Homo sapiens
tccccagagtgggat

SEQ ID NO: 1188851 - DNA, 15 bp, Homo sapiens
tccccagatctccca

SEQ ID NO: 1188852 - DNA, 10 bp, Homo sapiens
tccccagcag

SEQ ID NO: 1188853 - DNA, 17 bp, Homo sapiens
tccccagccagcccttc

SEQ ID NO: 1188854 - DNA, 22 bp, Homo sapiens
tccccagccagggagcttgcca

SEQ ID NO: 1188855 - DNA, 22 bp, Homo sapiens
tccccagcccagggttccccca

SEQ ID NO: 1188856 - DNA, 20 bp, Homo sapiens
tccccagccccagccccttc

SEQ ID NO: 1188857 - DNA, 12 bp, Homo sapiens
tccccagccctg

SEQ ID NO: 1188858 - DNA, 18 bp, Homo sapiens
tccccagccctggctctg

SEQ ID NO: 1188859 - DNA, 13 bp, Homo sapiens
tccccagcccttc

SEQ ID NO: 1188860 - DNA, 14 bp, Homo sapiens
tccccagcccttct

SEQ ID NO: 1188861 - DNA, 16 bp, Homo sapiens
tccccagcccttctgc

SEQ ID NO: 1188862 - DNA, 22 bp, Homo sapiens
tccccagcccttctgcctttct

SEQ ID NO: 1188863 - DNA, 16 bp, Homo sapiens
tccccagcctgggccc

SEQ ID NO: 1188864 - DNA, 21 bp, Homo sapiens
tccccaggcatttgccaaggg

SEQ ID NO: 1188865 - DNA, 14 bp, Homo sapiens
tccccaggcccacc

SEQ ID NO: 1188866 - DNA, 21 bp, Homo sapiens
tccccaggcccaccatcacca

SEQ ID NO: 1188867 - DNA, 15 bp, Homo sapiens
tccccaggcccagcc

SEQ ID NO: 1188868 - DNA, 19 bp, Homo sapiens
tccccaggcccagccctcc

SEQ ID NO: 1188869 - DNA, 20 bp, Homo sapiens
tccccaggcccagccctcct

SEQ ID NO: 1188870 - DNA, 22 bp, Homo sapiens
tccccaggcccagccctccttc

SEQ ID NO: 1188871 - DNA, 16 bp, Homo sapiens
tccccaggcctccagc

SEQ ID NO: 1188872 - DNA, 19 bp, Homo sapiens
tccccaggcctccagcctc

SEQ ID NO: 1188873 - DNA, 20 bp, Homo sapiens
tccccaggcctccagcctct

SEQ ID NO: 1188874 - DNA, 21 bp, Homo sapiens
tccccaggcctccagcctctc

SEQ ID NO: 1188875 - DNA, 16 bp, Homo sapiens
tccccaggcctggctc

SEQ ID NO: 1188876 - DNA, 13 bp, Homo sapiens
tccccaggctgga

SEQ ID NO: 1188877 - DNA, 15 bp, Homo sapiens
tccccagggaaggaa

SEQ ID NO: 1188878 - DNA, 17 bp, Homo sapiens
tccccagggagctctgg

SEQ ID NO: 1188879 - DNA, 18 bp, Homo sapiens
tccccagggagctctggg

SEQ ID NO: 1188880 - DNA, 20 bp, Homo sapiens
tccccagggagctctgggga

SEQ ID NO: 1188881 - DNA, 16 bp, Homo sapiens
tccccagggcccctcc

SEQ ID NO: 1188882 - DNA, 18 bp, Homo sapiens
tccccaggggtcccagcc

SEQ ID NO: 1188883 - DNA, 22 bp, Homo sapiens
tccccaggggtcccagccaccc

SEQ ID NO: 1188884 - DNA, 19 bp, Homo sapiens
tccccaggtcctgtctctg

SEQ ID NO: 1188885 - DNA, 18 bp, Homo sapiens
tccccaggtggctgaccc

SEQ ID NO: 1188886 - DNA, 21 bp, Homo sapiens
tccccagtagctgggattaca

SEQ ID NO: 1188887 - DNA, 21 bp, Homo sapiens
tccccagtccccagccctggg

SEQ ID NO: 1188888 - DNA, 10 bp, Homo sapiens
tccccagtgc

SEQ ID NO: 1188889 - DNA, 21 bp, Homo sapiens
tccccagtgcctgccactctc

SEQ ID NO: 1188890 - DNA, 17 bp, Homo sapiens
tccccagtttgcagaaa

SEQ ID NO: 1188891 - DNA, 14 bp, Homo sapiens
tccccatacacaca

SEQ ID NO: 1188892 - DNA, 15 bp, Homo sapiens
tccccatacacacac

SEQ ID NO: 1188893 - DNA, 23 bp, Homo sapiens
tccccatcccattttcatcctga

SEQ ID NO: 1188894 - DNA, 15 bp, Homo sapiens
tccccatccccacca

SEQ ID NO: 1188895 - DNA, 18 bp, Homo sapiens
tccccatccccaccagct

SEQ ID NO: 1188896 - DNA, 22 bp, Homo sapiens
tccccatcccgaagccatcact

SEQ ID NO: 1188897 - DNA, 19 bp, Homo sapiens
tccccatcctccagcttct

SEQ ID NO: 1188898 - DNA, 14 bp, Homo sapiens
tccccatctccctg

SEQ ID NO: 1188899 - DNA, 11 bp, Homo sapiens
tccccatctct

SEQ ID NO: 1188900 - DNA, 13 bp, Homo sapiens
tccccatctctgt

SEQ ID NO: 1188901 - DNA, 21 bp, Homo sapiens
tccccatgcttaacatacccg

SEQ ID NO: 1188902 - DNA, 23 bp, Homo sapiens
tccccatggcttgttctctggaa

SEQ ID NO: 1188903 - DNA, 17 bp, Homo sapiens
tccccatgggcacagtg

SEQ ID NO: 1188904 - DNA, 24 bp, Homo sapiens
tccccatgggcacagtggtgaccc

SEQ ID NO: 1188905 - DNA, 16 bp, Homo sapiens
tccccattctctgcct

SEQ ID NO: 1188906 - DNA, 14 bp, Homo sapiens
tccccattcttcct

SEQ ID NO: 1188907 - DNA, 22 bp, Homo sapiens
tccccattcttcctagttttct

SEQ ID NO: 1188908 - DNA, 19 bp, Homo sapiens
tccccatttcccatctgca

SEQ ID NO: 1188909 - DNA, 20 bp, Homo sapiens
tccccatttcccatctgcac

SEQ ID NO: 1188910 - DNA, 15 bp, Homo sapiens
tccccatttcctgta

SEQ ID NO: 1188911 - DNA, 12 bp, Homo sapiens
tcccccaacaga

SEQ ID NO: 1188912 - DNA, 20 bp, Homo sapiens
tcccccaacccccaccccac

SEQ ID NO: 1188913 - DNA, 17 bp, Homo sapiens
tcccccaaccccctgca

SEQ ID NO: 1188914 - DNA, 17 bp, Homo sapiens
tcccccaacctcagact

SEQ ID NO: 1188915 - DNA, 21 bp, Homo sapiens
tcccccaactctgagcccatg

SEQ ID NO: 1188916 - DNA, 10 bp, Homo sapiens
tcccccaaga

SEQ ID NO: 1188917 - DNA, 13 bp, Homo sapiens
tcccccaccactc

SEQ ID NO: 1188918 - DNA, 19 bp, Homo sapiens
tcccccacccacctcctgc

SEQ ID NO: 1188919 - DNA, 20 bp, Homo sapiens
tcccccacccatggggagga

SEQ ID NO: 1188920 - DNA, 21 bp, Homo sapiens
tcccccaccccctccccaggg

SEQ ID NO: 1188921 - DNA, 11 bp, Homo sapiens
tcccccaccct

SEQ ID NO: 1188922 - DNA, 23 bp, Homo sapiens
tcccccaccggtccagctggcct

SEQ ID NO: 1188923 - DNA, 20 bp, Homo sapiens
tcccccacctcggtcactcc

SEQ ID NO: 1188924 - DNA, 12 bp, Homo sapiens
tcccccacctga

SEQ ID NO: 1188925 - DNA, 20 bp, Homo sapiens
tcccccagagtgctgtcggg

SEQ ID NO: 1188926 - DNA, 11 bp, Homo sapiens
tcccccagcaa

SEQ ID NO: 1188927 - DNA, 22 bp, Homo sapiens
tcccccagcaacgcccctccaa

SEQ ID NO: 1188928 - DNA, 12 bp, Homo sapiens
tcccccagcaga

SEQ ID NO: 1188929 - DNA, 23 bp, Homo sapiens
tcccccagcatcgggggcctgca

SEQ ID NO: 1188930 - DNA, 11 bp, Homo sapiens
tcccccagcca

SEQ ID NO: 1188931 - DNA, 21 bp, Homo sapiens
tcccccagccatgccagctgg

SEQ ID NO: 1188932 - DNA, 15 bp, Homo sapiens
tcccccagccctgtg

SEQ ID NO: 1188933 - DNA, 12 bp, Homo sapiens
tcccccagctcc

SEQ ID NO: 1188934 - DNA, 13 bp, Homo sapiens
tcccccagctcct

SEQ ID NO: 1188935 - DNA, 15 bp, Homo sapiens
tcccccagctgcgtt

SEQ ID NO: 1188936 - DNA, 20 bp, Homo sapiens
tcccccataaaatgatcctg

SEQ ID NO: 1188937 - DNA, 23 bp, Homo sapiens
tcccccatcatgtggcccaactc

SEQ ID NO: 1188938 - DNA, 13 bp, Homo sapiens
tcccccatcccta

SEQ ID NO: 1188939 - DNA, 15 bp, Homo sapiens
tcccccatccctacc

SEQ ID NO: 1188940 - DNA, 20 bp, Homo sapiens
tcccccatccctaccactgt

SEQ ID NO: 1188941 - DNA, 21 bp, Homo sapiens
tcccccatcctccccttccct

SEQ ID NO: 1188942 - DNA, 17 bp, Homo sapiens
tcccccatgtggctgaa

SEQ ID NO: 1188943 - DNA, 12 bp, Homo sapiens
tccccccacccg

SEQ ID NO: 1188944 - DNA, 23 bp, Homo sapiens
tccccccactgcaggccccgctt

SEQ ID NO: 1188945 - DNA, 12 bp, Homo sapiens
tccccccagacc

SEQ ID NO: 1188946 - DNA, 18 bp, Homo sapiens
tccccccagctccctgca

SEQ ID NO: 1188947 - DNA, 20 bp, Homo sapiens
tccccccagctccctgcacc

SEQ ID NO: 1188948 - DNA, 22 bp, Homo sapiens
tccccccatcccagggtcccac

SEQ ID NO: 1188949 - DNA, 18 bp, Homo sapiens
tccccccatctctgagtg

SEQ ID NO: 1188950 - DNA, 13 bp, Homo sapiens
tcccccccagcct

SEQ ID NO: 1188951 - DNA, 15 bp, Homo sapiens
tcccccccagcctgg

SEQ ID NO: 1188952 - DNA, 16 bp, Homo sapiens
tcccccccagcctggc

SEQ ID NO: 1188953 - DNA, 21 bp, Homo sapiens
tccccccccaggccctcccac

SEQ ID NO: 1188954 - DNA, 22 bp, Homo sapiens
tccccccgcctctgtctggagc

SEQ ID NO: 1188955 - DNA, 12 bp, Homo sapiens
tcccccctctcc

SEQ ID NO: 1188956 - DNA, 18 bp, Homo sapiens
tcccccctctcctcccag

SEQ ID NO: 1188957 - DNA, 17 bp, Homo sapiens
tcccccgacactgctgc

SEQ ID NO: 1188958 - DNA, 19 bp, Homo sapiens
tcccccgacactgctgcac

SEQ ID NO: 1188959 - DNA, 20 bp, Homo sapiens
tcccccgacactgctgcacc

SEQ ID NO: 1188960 - DNA, 21 bp, Homo sapiens
tcccccgacactgctgcacca

SEQ ID NO: 1188961 - DNA, 18 bp, Homo sapiens
tcccccgaccaatcccca

SEQ ID NO: 1188962 - DNA, 21 bp, Homo sapiens
tcccccgaccaatccccagcc

SEQ ID NO: 1188963 - DNA, 21 bp, Homo sapiens
tcccccgactgcctgtctcca

SEQ ID NO: 1188964 - DNA, 20 bp, Homo sapiens
tcccccgcagtccccagccc

SEQ ID NO: 1188965 - DNA, 15 bp, Homo sapiens
tcccccgccagcccc

SEQ ID NO: 1188966 - DNA, 16 bp, Homo sapiens
tcccccggggcaaggt

SEQ ID NO: 1188967 - DNA, 18 bp, Homo sapiens
tcccccgtgttcccctct

SEQ ID NO: 1188968 - DNA, 17 bp, Homo sapiens
tccccctaaaccaactg

SEQ ID NO: 1188969 - DNA, 14 bp, Homo sapiens
tccccctacccata

SEQ ID NO: 1188970 - DNA, 22 bp, Homo sapiens
tccccctatttattgactttga

SEQ ID NO: 1188971 - DNA, 22 bp, Homo sapiens
tccccctcagatgatctctcca

SEQ ID NO: 1188972 - DNA, 16 bp, Homo sapiens
tccccctcagcaagcc

SEQ ID NO: 1188973 - DNA, 18 bp, Homo sapiens
tccccctcccccttctcc

SEQ ID NO: 1188974 - DNA, 16 bp, Homo sapiens
tccccctccctgccca

SEQ ID NO: 1188975 - DNA, 11 bp, Homo sapiens
tccccctcctc

SEQ ID NO: 1188976 - DNA, 16 bp, Homo sapiens
tccccctcctctccct

SEQ ID NO: 1188977 - DNA, 15 bp, Homo sapiens
tccccctccttgtgc

SEQ ID NO: 1188978 - DNA, 18 bp, Homo sapiens
tccccctccttgtgcctt

SEQ ID NO: 1188979 - DNA, 16 bp, Homo sapiens
tccccctctgcttctc

SEQ ID NO: 1188980 - DNA, 23 bp, Homo sapiens
tccccctgcaaaaagaaaaaaag

SEQ ID NO: 1188981 - DNA, 17 bp, Homo sapiens
tccccctgccagtgcct

SEQ ID NO: 1188982 - DNA, 18 bp, Homo sapiens
tccccctgccagtgcctt

SEQ ID NO: 1188983 - DNA, 12 bp, Homo sapiens
tccccctgccct

SEQ ID NO: 1188984 - DNA, 15 bp, Homo sapiens
tccccctgccctcgt

SEQ ID NO: 1188985 - DNA, 20 bp, Homo sapiens
tccccctgccctcgtggcca

SEQ ID NO: 1188986 - DNA, 22 bp, Homo sapiens
tccccctgccctcgtggccagc

SEQ ID NO: 1188987 - DNA, 16 bp, Homo sapiens
tccccctgccctgtgc

SEQ ID NO: 1188988 - DNA, 20 bp, Homo sapiens
tccccctgccctgtgccgca

SEQ ID NO: 1188989 - DNA, 13 bp, Homo sapiens
tccccctgcctcc

SEQ ID NO: 1188990 - DNA, 10 bp, Homo sapiens
tccccctggg

SEQ ID NO: 1188991 - DNA, 12 bp, Homo sapiens
tccccctgggct

SEQ ID NO: 1188992 - DNA, 15 bp, Homo sapiens
tcccccttcacaaag

SEQ ID NO: 1188993 - DNA, 15 bp, Homo sapiens
tcccccttcagctcc

SEQ ID NO: 1188994 - DNA, 17 bp, Homo sapiens
tcccccttcagctcctg

SEQ ID NO: 1188995 - DNA, 18 bp, Homo sapiens
tcccccttcagctcctga

SEQ ID NO: 1188996 - DNA, 19 bp, Homo sapiens
tcccccttcagctcctgag

SEQ ID NO: 1188997 - DNA, 12 bp, Homo sapiens
tcccccttctcc

SEQ ID NO: 1188998 - DNA, 21 bp, Homo sapiens
tcccccttcttcctcccctca

SEQ ID NO: 1188999 - DNA, 22 bp, Homo sapiens
tcccccttgatcgacttcttgg

SEQ ID NO: 1189000 - DNA, 17 bp, Homo sapiens
tcccccttgtcttcccc

SEQ ID NO: 1189001 - DNA, 16 bp, Homo sapiens
tccccctttcaaggaa

SEQ ID NO: 1189002 - DNA, 13 bp, Homo sapiens
tccccgacccccc

SEQ ID NO: 1189003 - DNA, 14 bp, Homo sapiens
tccccgacccccct

SEQ ID NO: 1189004 - DNA, 17 bp, Homo sapiens
tccccgaggagctgggc

SEQ ID NO: 1189005 - DNA, 15 bp, Homo sapiens
tccccgaggctgccc

SEQ ID NO: 1189006 - DNA, 20 bp, Homo sapiens
tccccgaggctgccccaggc

SEQ ID NO: 1189007 - DNA, 19 bp, Homo sapiens
tccccgagggcgaaggcca

SEQ ID NO: 1189008 - DNA, 23 bp, Homo sapiens
tccccgaggttgtggggaggctg

SEQ ID NO: 1189009 - DNA, 13 bp, Homo sapiens
tccccgcctggcc

SEQ ID NO: 1189010 - DNA, 15 bp, Homo sapiens
tccccgcctggccag

SEQ ID NO: 1189011 - DNA, 19 bp, Homo sapiens
tccccgcctggccaggagc

SEQ ID NO: 1189012 - DNA, 18 bp, Homo sapiens
tccccgcgcgttccttcg

SEQ ID NO: 1189013 - DNA, 18 bp, Homo sapiens
tccccgctccgtctctgt

SEQ ID NO: 1189014 - DNA, 12 bp, Homo sapiens
tccccgcttccc

SEQ ID NO: 1189015 - DNA, 16 bp, Homo sapiens
tccccggcaggcctga

SEQ ID NO: 1189016 - DNA, 20 bp, Homo sapiens
tccccggcaggcctgagaat

SEQ ID NO: 1189017 - DNA, 15 bp, Homo sapiens
tccccggccctacca

SEQ ID NO: 1189018 - DNA, 21 bp, Homo sapiens
tccccggggttccccacacag

SEQ ID NO: 1189019 - DNA, 19 bp, Homo sapiens
tccccggttgctggtcagg

SEQ ID NO: 1189020 - DNA, 15 bp, Homo sapiens
tcccctaaagcctca

SEQ ID NO: 1189021 - DNA, 15 bp, Homo sapiens
tcccctaacccccag

SEQ ID NO: 1189022 - DNA, 19 bp, Homo sapiens
tcccctaacccccagtcct

SEQ ID NO: 1189023 - DNA, 21 bp, Homo sapiens
tcccctaacccccagtcctca

SEQ ID NO: 1189024 - DNA, 14 bp, Homo sapiens
tcccctaacctcat

SEQ ID NO: 1189025 - DNA, 14 bp, Homo sapiens
tcccctacagaatt

SEQ ID NO: 1189026 - DNA, 18 bp, Homo sapiens
tcccctatccacccagcc

SEQ ID NO: 1189027 - DNA, 21 bp, Homo sapiens
tcccctatccacccagcccat

SEQ ID NO: 1189028 - DNA, 16 bp, Homo sapiens
tcccctatcctcccct

SEQ ID NO: 1189029 - DNA, 12 bp, Homo sapiens
tcccctattttt

SEQ ID NO: 1189030 - DNA, 17 bp, Homo sapiens
tcccctcaacaccctgc

SEQ ID NO: 1189031 - DNA, 17 bp, Homo sapiens
tcccctcacatcctcct

SEQ ID NO: 1189032 - DNA, 18 bp, Homo sapiens
tcccctcacatcctcctg

SEQ ID NO: 1189033 - DNA, 22 bp, Homo sapiens
tcccctcacatcctcctgccca

SEQ ID NO: 1189034 - DNA, 14 bp, Homo sapiens
tcccctcacccaaa

SEQ ID NO: 1189035 - DNA, 17 bp, Homo sapiens
tcccctcactctgtcag

SEQ ID NO: 1189036 - DNA, 18 bp, Homo sapiens
tcccctcactctgtcagc

SEQ ID NO: 1189037 - DNA, 22 bp, Homo sapiens
tcccctcactctgtcagccagc

SEQ ID NO: 1189038 - DNA, 15 bp, Homo sapiens
tcccctcagagccca

SEQ ID NO: 1189039 - DNA, 16 bp, Homo sapiens
tcccctcagagctctt

SEQ ID NO: 1189040 - DNA, 13 bp, Homo sapiens
tcccctcagcctg

SEQ ID NO: 1189041 - DNA, 16 bp, Homo sapiens
tcccctcagcgcaggc

SEQ ID NO: 1189042 - DNA, 21 bp, Homo sapiens
tcccctcagcgcaggctgcag

SEQ ID NO: 1189043 - DNA, 12 bp, Homo sapiens
tcccctccactg

SEQ ID NO: 1189044 - DNA, 21 bp, Homo sapiens
tcccctccatccccatcggcc

SEQ ID NO: 1189045 - DNA, 22 bp, Homo sapiens
tcccctccatccccatcggccc

SEQ ID NO: 1189046 - DNA, 21 bp, Homo sapiens
tcccctcccaggggagccagc

SEQ ID NO: 1189047 - DNA, 14 bp, Homo sapiens
tcccctcccagtcc

SEQ ID NO: 1189048 - DNA, 14 bp, Homo sapiens
tcccctcccatctg

SEQ ID NO: 1189049 - DNA, 11 bp, Homo sapiens
tcccctcccca

SEQ ID NO: 1189050 - DNA, 17 bp, Homo sapiens
tcccctccccactcctc

SEQ ID NO: 1189051 - DNA, 18 bp, Homo sapiens
tcccctccccagcccaat

SEQ ID NO: 1189052 - DNA, 16 bp, Homo sapiens
tcccctccccagctcc

SEQ ID NO: 1189053 - DNA, 17 bp, Homo sapiens
tcccctccccagctccc

SEQ ID NO: 1189054 - DNA, 16 bp, Homo sapiens
tcccctcccccagaaa

SEQ ID NO: 1189055 - DNA, 16 bp, Homo sapiens
tcccctccctcccaca

SEQ ID NO: 1189056 - DNA, 14 bp, Homo sapiens
tcccctccctcgtg

SEQ ID NO: 1189057 - DNA, 12 bp, Homo sapiens
tcccctccctct

SEQ ID NO: 1189058 - DNA, 16 bp, Homo sapiens
tcccctccctcttcct

SEQ ID NO: 1189059 - DNA, 18 bp, Homo sapiens
tcccctccctgcctgctc

SEQ ID NO: 1189060 - DNA, 19 bp, Homo sapiens
tcccctccctgcctgctcc

SEQ ID NO: 1189061 - DNA, 21 bp, Homo sapiens
tcccctccctggctcccatga

SEQ ID NO: 1189062 - DNA, 14 bp, Homo sapiens
tcccctccctgtca

SEQ ID NO: 1189063 - DNA, 20 bp, Homo sapiens
tcccctcccttgtccttgaa

SEQ ID NO: 1189064 - DNA, 14 bp, Homo sapiens
tcccctcctcttcc

SEQ ID NO: 1189065 - DNA, 14 bp, Homo sapiens
tcccctcctgcaca

SEQ ID NO: 1189066 - DNA, 18 bp, Homo sapiens
tcccctccttctcccttt

SEQ ID NO: 1189067 - DNA, 14 bp, Homo sapiens
tcccctccttgggc

SEQ ID NO: 1189068 - DNA, 17 bp, Homo sapiens
tcccctcgtcccatcca

SEQ ID NO: 1189069 - DNA, 20 bp, Homo sapiens
tcccctcgtcccatccagct

SEQ ID NO: 1189070 - DNA, 19 bp, Homo sapiens
tcccctcgtcctgtcccag

SEQ ID NO: 1189071 - DNA, 20 bp, Homo sapiens
tcccctcgtcctgtcccaga

SEQ ID NO: 1189072 - DNA, 16 bp, Homo sapiens
tcccctcgtgtcagct

SEQ ID NO: 1189073 - DNA, 19 bp, Homo sapiens
tcccctcgtgtcagctcag

SEQ ID NO: 1189074 - DNA, 19 bp, Homo sapiens
tcccctcgtgtgactctct

SEQ ID NO: 1189075 - DNA, 14 bp, Homo sapiens
tcccctctcagaac

SEQ ID NO: 1189076 - DNA, 15 bp, Homo sapiens
tcccctctcagaaca

SEQ ID NO: 1189077 - DNA, 23 bp, Homo sapiens
tcccctctcagaacatactgatt

SEQ ID NO: 1189078 - DNA, 23 bp, Homo sapiens
tcccctctcaggagagtgtgcaa

SEQ ID NO: 1189079 - DNA, 14 bp, Homo sapiens
tcccctctcccagg

SEQ ID NO: 1189080 - DNA, 15 bp, Homo sapiens
tcccctctccccttg

SEQ ID NO: 1189081 - DNA, 17 bp, Homo sapiens
tcccctctccctgggga

SEQ ID NO: 1189082 - DNA, 15 bp, Homo sapiens
tcccctctctctggg

SEQ ID NO: 1189083 - DNA, 11 bp, Homo sapiens
tcccctctctg

SEQ ID NO: 1189084 - DNA, 18 bp, Homo sapiens
tcccctctctgctccaga

SEQ ID NO: 1189085 - DNA, 19 bp, Homo sapiens
tcccctctcttgcacccgc

SEQ ID NO: 1189086 - DNA, 15 bp, Homo sapiens
tcccctctgctgctg

SEQ ID NO: 1189087 - DNA, 10 bp, Homo sapiens
tcccctctgt

SEQ ID NO: 1189088 - DNA, 15 bp, Homo sapiens
tcccctctgtgcttc

SEQ ID NO: 1189089 - DNA, 23 bp, Homo sapiens
tcccctcttcctaccctgcctcc

SEQ ID NO: 1189090 - DNA, 13 bp, Homo sapiens
tcccctcttcctc

SEQ ID NO: 1189091 - DNA, 15 bp, Homo sapiens
tcccctcttcctctt

SEQ ID NO: 1189092 - DNA, 13 bp, Homo sapiens
tcccctctttgaa

SEQ ID NO: 1189093 - DNA, 15 bp, Homo sapiens
tcccctgagaggttt

SEQ ID NO: 1189094 - DNA, 15 bp, Homo sapiens
gcccagcaggcaggc

SEQ ID NO: 1189095 - DNA, 16 bp, Homo sapiens
gcccagcaggcaggca

SEQ ID NO: 1189096 - DNA, 17 bp, Homo sapiens
gcccagcaggcaggcac

SEQ ID NO: 1189097 - DNA, 14 bp, Homo sapiens
gcccagcaggccca

SEQ ID NO: 1189098 - DNA, 15 bp, Homo sapiens
gcccagcaggcccag

SEQ ID NO: 1189099 - DNA, 19 bp, Homo sapiens
gcccagcaggcccagcatg

SEQ ID NO: 1189100 - DNA, 22 bp, Homo sapiens
gcccagcagtgtggagaccctg

SEQ ID NO: 1189101 - DNA, 20 bp, Homo sapiens
gcccagccaaaccctgtctg

SEQ ID NO: 1189102 - DNA, 15 bp, Homo sapiens
gcccagccacccctc

SEQ ID NO: 1189103 - DNA, 15 bp, Homo sapiens
gcccagccagccacc

SEQ ID NO: 1189104 - DNA, 11 bp, Homo sapiens
gcccagccagg

SEQ ID NO: 1189105 - DNA, 15 bp, Homo sapiens
gcccagccaggagca

SEQ ID NO: 1189106 - DNA, 17 bp, Homo sapiens
gcccagccaggagcaga

SEQ ID NO: 1189107 - DNA, 14 bp, Homo sapiens
gcccagccagggtg

SEQ ID NO: 1189108 - DNA, 23 bp, Homo sapiens
gcccagccattaccatggagaca

SEQ ID NO: 1189109 - DNA, 14 bp, Homo sapiens
gcccagcccagctg

SEQ ID NO: 1189110 - DNA, 15 bp, Homo sapiens
gcccagcccagctgg

SEQ ID NO: 1189111 - DNA, 11 bp, Homo sapiens
gcccagcccct

SEQ ID NO: 1189112 - DNA, 12 bp, Homo sapiens
gcccagccccta

SEQ ID NO: 1189113 - DNA, 20 bp, Homo sapiens
gcccagcccctactgctgtg

SEQ ID NO: 1189114 - DNA, 21 bp, Homo sapiens
gcccagcccctactgctgtga

SEQ ID NO: 1189115 - DNA, 16 bp, Homo sapiens
gcccagcccctgttta

SEQ ID NO: 1189116 - DNA, 20 bp, Homo sapiens
gcccagccccttttctctgc

SEQ ID NO: 1189117 - DNA, 16 bp, Homo sapiens
gcccagccctaaacat

SEQ ID NO: 1189118 - DNA, 14 bp, Homo sapiens
gcccagccctcctt

SEQ ID NO: 1189119 - DNA, 20 bp, Homo sapiens
gcccagccggcctctctggc

SEQ ID NO: 1189120 - DNA, 17 bp, Homo sapiens
gcccagcctagtcaggg

SEQ ID NO: 1189121 - DNA, 11 bp, Homo sapiens
gcccagcctct

SEQ ID NO: 1189122 - DNA, 12 bp, Homo sapiens
gcccagcctctc

SEQ ID NO: 1189123 - DNA, 22 bp, Homo sapiens
gcccagcctctccccgctctgg

SEQ ID NO: 1189124 - DNA, 10 bp, Homo sapiens
gcccagcctg

SEQ ID NO: 1189125 - DNA, 15 bp, Homo sapiens
gcccagcctgggagc

SEQ ID NO: 1189126 - DNA, 16 bp, Homo sapiens
gcccagcctgggagcc

SEQ ID NO: 1189127 - DNA, 20 bp, Homo sapiens
gcccagcctgggagcccaga

SEQ ID NO: 1189128 - DNA, 15 bp, Homo sapiens
gcccagcgctcgcca

SEQ ID NO: 1189129 - DNA, 20 bp, Homo sapiens
gcccagcgctcgccacgctc

SEQ ID NO: 1189130 - DNA, 23 bp, Homo sapiens
gcccagcggcccctcccacacac

SEQ ID NO: 1189131 - DNA, 18 bp, Homo sapiens
gcccagctacattcctca

SEQ ID NO: 1189132 - DNA, 23 bp, Homo sapiens
gcccagctacattcctcagctgc

SEQ ID NO: 1189133 - DNA, 21 bp, Homo sapiens
gcccagctcatgtaggtgagc

SEQ ID NO: 1189134 - DNA, 23 bp, Homo sapiens
gcccagctcatgtaggtgagcct

SEQ ID NO: 1189135 - DNA, 14 bp, Homo sapiens
gcccagctcctcac

SEQ ID NO: 1189136 - DNA, 13 bp, Homo sapiens
gcccagctctgag

SEQ ID NO: 1189137 - DNA, 16 bp, Homo sapiens
gcccagctcttgctct

SEQ ID NO: 1189138 - DNA, 14 bp, Homo sapiens
gcccagctgcacct

SEQ ID NO: 1189139 - DNA, 18 bp, Homo sapiens
gcccagctgcacctgcca

SEQ ID NO: 1189140 - DNA, 14 bp, Homo sapiens
gcccagctgggtca

SEQ ID NO: 1189141 - DNA, 17 bp, Homo sapiens
gcccagctgtagccatg

SEQ ID NO: 1189142 - DNA, 18 bp, Homo sapiens
gcccagctgtagccatgg

SEQ ID NO: 1189143 - DNA, 21 bp, Homo sapiens
gcccagctgtagccatggctc

SEQ ID NO: 1189144 - DNA, 23 bp, Homo sapiens
gcccagctgtagccatggctcag

SEQ ID NO: 1189145 - DNA, 21 bp, Homo sapiens
gcccagcttgaaaccttcact

SEQ ID NO: 1189146 - DNA, 15 bp, Homo sapiens
gcccagcttgggccc

SEQ ID NO: 1189147 - DNA, 17 bp, Homo sapiens
gcccagcttgggcccag

SEQ ID NO: 1189148 - DNA, 19 bp, Homo sapiens
gcccagcttgggcccagct

SEQ ID NO: 1189149 - DNA, 16 bp, Homo sapiens
gcccaggaccagctgg

SEQ ID NO: 1189150 - DNA, 17 bp, Homo sapiens
gcccaggaccagctggg

SEQ ID NO: 1189151 - DNA, 18 bp, Homo sapiens
gcccaggaccatcatcct

SEQ ID NO: 1189152 - DNA, 14 bp, Homo sapiens
gcccaggactctgg

SEQ ID NO: 1189153 - DNA, 10 bp, Homo sapiens
gcccaggaga

SEQ ID NO: 1189154 - DNA, 15 bp, Homo sapiens
gcccaggagagccag

SEQ ID NO: 1189155 - DNA, 19 bp, Homo sapiens
gcccaggagagccagccct

SEQ ID NO: 1189156 - DNA, 21 bp, Homo sapiens
gcccaggagagccagccctcc

SEQ ID NO: 1189157 - DNA, 11 bp, Homo sapiens
gcccaggagca

SEQ ID NO: 1189158 - DNA, 18 bp, Homo sapiens
gcccaggagcaacagcct

SEQ ID NO: 1189159 - DNA, 15 bp, Homo sapiens
gcccaggagctctgc

SEQ ID NO: 1189160 - DNA, 21 bp, Homo sapiens
gcccaggagctctgcgccagg

SEQ ID NO: 1189161 - DNA, 22 bp, Homo sapiens
gcccaggagctctgcgccaggc

SEQ ID NO: 1189162 - DNA, 23 bp, Homo sapiens
gcccaggagctctgcgccaggca

SEQ ID NO: 1189163 - DNA, 20 bp, Homo sapiens
gcccaggaggaccgcctgcc

SEQ ID NO: 1189164 - DNA, 24 bp, Homo sapiens
gcccaggcaccaccaggagcagca

SEQ ID NO: 1189165 - DNA, 14 bp, Homo sapiens
gcccaggcagcctc

SEQ ID NO: 1189166 - DNA, 19 bp, Homo sapiens
gcccaggcagcctcaaggc

SEQ ID NO: 1189167 - DNA, 12 bp, Homo sapiens
gcccaggcaggt

SEQ ID NO: 1189168 - DNA, 20 bp, Homo sapiens
gcccaggcatctccttgggc

SEQ ID NO: 1189169 - DNA, 22 bp, Homo sapiens
gcccaggccatgtggcctgccc

SEQ ID NO: 1189170 - DNA, 11 bp, Homo sapiens
gcccaggcccc

SEQ ID NO: 1189171 - DNA, 12 bp, Homo sapiens
gcccaggccccc

SEQ ID NO: 1189172 - DNA, 20 bp, Homo sapiens
gcccaggcccccggctttcc

SEQ ID NO: 1189173 - DNA, 14 bp, Homo sapiens
gcccaggcccttgg

SEQ ID NO: 1189174 - DNA, 18 bp, Homo sapiens
gcccaggcccttggctgc

SEQ ID NO: 1189175 - DNA, 20 bp, Homo sapiens
gcccaggcccttggctgcag

SEQ ID NO: 1189176 - DNA, 21 bp, Homo sapiens
gcccaggccgttccccttggc

SEQ ID NO: 1189177 - DNA, 15 bp, Homo sapiens
gcccaggcctgctgg

SEQ ID NO: 1189178 - DNA, 12 bp, Homo sapiens
gcccaggcctgg

SEQ ID NO: 1189179 - DNA, 14 bp, Homo sapiens
gcccaggcctggag

SEQ ID NO: 1189180 - DNA, 20 bp, Homo sapiens
gcccaggccttgctgactct

SEQ ID NO: 1189181 - DNA, 15 bp, Homo sapiens
gcccaggctggagtg

SEQ ID NO: 1189182 - DNA, 19 bp, Homo sapiens
gcccagggagaggccatga

SEQ ID NO: 1189183 - DNA, 12 bp, Homo sapiens
gcccagggaggc

SEQ ID NO: 1189184 - DNA, 14 bp, Homo sapiens
gcccagggaggcag

SEQ ID NO: 1189185 - DNA, 16 bp, Homo sapiens
gcccagggaggcagcg

SEQ ID NO: 1189186 - DNA, 19 bp, Homo sapiens
gcccagggaggcagcgtgg

SEQ ID NO: 1189187 - DNA, 21 bp, Homo sapiens
gcccagggaggcagcgtgggc

SEQ ID NO: 1189188 - DNA, 23 bp, Homo sapiens
gcccagggcccgggcacccacaa

SEQ ID NO: 1189189 - DNA, 14 bp, Homo sapiens
gcccagggcctgca

SEQ ID NO: 1189190 - DNA, 12 bp, Homo sapiens
gcccagggctca

SEQ ID NO: 1189191 - DNA, 16 bp, Homo sapiens
gcccagggctcagcct

SEQ ID NO: 1189192 - DNA, 18 bp, Homo sapiens
gcccagggctcctgcact

SEQ ID NO: 1189193 - DNA, 21 bp, Homo sapiens
gcccagggctgggaggaagga

SEQ ID NO: 1189194 - DNA, 22 bp, Homo sapiens
gcccaggggagaatgcagccca

SEQ ID NO: 1189195 - DNA, 15 bp, Homo sapiens
gcccaggggtgcccc

SEQ ID NO: 1189196 - DNA, 18 bp, Homo sapiens
gcccaggggtgccccctc

SEQ ID NO: 1189197 - DNA, 20 bp, Homo sapiens
gcccaggggtgccccctcct

SEQ ID NO: 1189198 - DNA, 18 bp, Homo sapiens
gcccagggtcctgtgcct

SEQ ID NO: 1189199 - DNA, 21 bp, Homo sapiens
gcccagggtcctgtgcctgga

SEQ ID NO: 1189200 - DNA, 14 bp, Homo sapiens
gcccagggtgcagt

SEQ ID NO: 1189201 - DNA, 19 bp, Homo sapiens
gcccagggtggctgccagc

SEQ ID NO: 1189202 - DNA, 19 bp, Homo sapiens
gcccagggttcccccagcc

SEQ ID NO: 1189203 - DNA, 20 bp, Homo sapiens
gcccagggttcccccagccc

SEQ ID NO: 1189204 - DNA, 15 bp, Homo sapiens
gcccaggtaccaccc

SEQ ID NO: 1189205 - DNA, 18 bp, Homo sapiens
gcccaggtaccacccttc

SEQ ID NO: 1189206 - DNA, 21 bp, Homo sapiens
gcccaggtaccacccttcaga

SEQ ID NO: 1189207 - DNA, 23 bp, Homo sapiens
gcccaggtcaccaagcagtggcc

SEQ ID NO: 1189208 - DNA, 16 bp, Homo sapiens
gcccaggtcctctgat

SEQ ID NO: 1189209 - DNA, 19 bp, Homo sapiens
gcccaggtggcctcctggc

SEQ ID NO: 1189210 - DNA, 22 bp, Homo sapiens
gcccagtacatttaaatttttt

SEQ ID NO: 1189211 - DNA, 22 bp, Homo sapiens
gcccagtacctagctggctctg

SEQ ID NO: 1189212 - DNA, 17 bp, Homo sapiens
gcccagtagaccttgtt

SEQ ID NO: 1189213 - DNA, 15 bp, Homo sapiens
gcccagtcctgggtt

SEQ ID NO: 1189214 - DNA, 15 bp, Homo sapiens
gcccagtccttccac

SEQ ID NO: 1189215 - DNA, 15 bp, Homo sapiens
gcccagtgaagcctc

SEQ ID NO: 1189216 - DNA, 17 bp, Homo sapiens
gcccagtgaagcctctg

SEQ ID NO: 1189217 - DNA, 15 bp, Homo sapiens
gcccagtgcactgaa

SEQ ID NO: 1189218 - DNA, 17 bp, Homo sapiens
gcccagtgccactgccc

SEQ ID NO: 1189219 - DNA, 12 bp, Homo sapiens
tcccctgagccc

SEQ ID NO: 1189220 - DNA, 16 bp, Homo sapiens
tcccctgcacctggcc

SEQ ID NO: 1189221 - DNA, 13 bp, Homo sapiens
tcccctgcagcct

SEQ ID NO: 1189222 - DNA, 14 bp, Homo sapiens
tcccctgcagcctg

SEQ ID NO: 1189223 - DNA, 15 bp, Homo sapiens
tcccctgcagcctgg

SEQ ID NO: 1189224 - DNA, 16 bp, Homo sapiens
tcccctgccaccaggc

SEQ ID NO: 1189225 - DNA, 17 bp, Homo sapiens
tcccctgccaccaggcc

SEQ ID NO: 1189226 - DNA, 21 bp, Homo sapiens
tcccctgccaccgactgccca

SEQ ID NO: 1189227 - DNA, 22 bp, Homo sapiens
tcccctgccaccgactgcccag

SEQ ID NO: 1189228 - DNA, 20 bp, Homo sapiens
tcccctgccagggcagggcc

SEQ ID NO: 1189229 - DNA, 15 bp, Homo sapiens
tcccctgccctgctg

SEQ ID NO: 1189230 - DNA, 13 bp, Homo sapiens
tcccctgccctgg

SEQ ID NO: 1189231 - DNA, 15 bp, Homo sapiens
tcccctgccctggtc

SEQ ID NO: 1189232 - DNA, 17 bp, Homo sapiens
tcccctgccctggtcca

SEQ ID NO: 1189233 - DNA, 14 bp, Homo sapiens
tcccctgcctcctg

SEQ ID NO: 1189234 - DNA, 12 bp, Homo sapiens
tcccctgccttg

SEQ ID NO: 1189235 - DNA, 20 bp, Homo sapiens
tcccctgctactcctgtgct

SEQ ID NO: 1189236 - DNA, 15 bp, Homo sapiens
tcccctgctgacctt

SEQ ID NO: 1189237 - DNA, 19 bp, Homo sapiens
tcccctgctgaccttggag

SEQ ID NO: 1189238 - DNA, 14 bp, Homo sapiens
tcccctgctgaggc

SEQ ID NO: 1189239 - DNA, 16 bp, Homo sapiens
tcccctgctgaggcag

SEQ ID NO: 1189240 - DNA, 17 bp, Homo sapiens
tcccctggactgggagg

SEQ ID NO: 1189241 - DNA, 22 bp, Homo sapiens
tcccctggagtgtgtcagagcc

SEQ ID NO: 1189242 - DNA, 19 bp, Homo sapiens
tcccctggcctcagttccc

SEQ ID NO: 1189243 - DNA, 21 bp, Homo sapiens
tcccctggcctcagttcccag

SEQ ID NO: 1189244 - DNA, 15 bp, Homo sapiens
tcccctgggatgctg

SEQ ID NO: 1189245 - DNA, 19 bp, Homo sapiens
tcccctgggatgctgaccc

SEQ ID NO: 1189246 - DNA, 23 bp, Homo sapiens
tcccctgggatgctgacccagga

SEQ ID NO: 1189247 - DNA, 21 bp, Homo sapiens
tcccctgggcatcttctggct

SEQ ID NO: 1189248 - DNA, 22 bp, Homo sapiens
tcccctgggcatcttctggctt

SEQ ID NO: 1189249 - DNA, 14 bp, Homo sapiens
tcccctggggacgc

SEQ ID NO: 1189250 - DNA, 19 bp, Homo sapiens
tcccctgtagagtgggagc

SEQ ID NO: 1189251 - DNA, 20 bp, Homo sapiens
tcccctgtcagtttcccctc

SEQ ID NO: 1189252 - DNA, 16 bp, Homo sapiens
tcccctgtcccaccaa

SEQ ID NO: 1189253 - DNA, 12 bp, Homo sapiens
tcccctgtgggg

SEQ ID NO: 1189254 - DNA, 12 bp, Homo sapiens
tcccctgtgtca

SEQ ID NO: 1189255 - DNA, 16 bp, Homo sapiens
tcccctgtttgcatga

SEQ ID NO: 1189256 - DNA, 17 bp, Homo sapiens
tccccttagaggacctg

SEQ ID NO: 1189257 - DNA, 17 bp, Homo sapiens
tccccttccactgaggg

SEQ ID NO: 1189258 - DNA, 20 bp, Homo sapiens
tccccttccccaattactat

SEQ ID NO: 1189259 - DNA, 13 bp, Homo sapiens
tccccttccccca

SEQ ID NO: 1189260 - DNA, 15 bp, Homo sapiens
tccccttcccctgct

SEQ ID NO: 1189261 - DNA, 17 bp, Homo sapiens
tccccttcccctgctga

SEQ ID NO: 1189262 - DNA, 13 bp, Homo sapiens
tccccttccctgc

SEQ ID NO: 1189263 - DNA, 21 bp, Homo sapiens
tccccttcctaaatatccaaa

SEQ ID NO: 1189264 - DNA, 19 bp, Homo sapiens
tccccttcctggacacact

SEQ ID NO: 1189265 - DNA, 17 bp, Homo sapiens
tccccttcctgttcttc

SEQ ID NO: 1189266 - DNA, 19 bp, Homo sapiens
tccccttcctgttcttcct

SEQ ID NO: 1189267 - DNA, 14 bp, Homo sapiens
tccccttcctgttt

SEQ ID NO: 1189268 - DNA, 18 bp, Homo sapiens
tccccttcttcccgcccc

SEQ ID NO: 1189269 - DNA, 23 bp, Homo sapiens
tccccttcttcccgccccacctc

SEQ ID NO: 1189270 - DNA, 12 bp, Homo sapiens
tccccttcttgc

SEQ ID NO: 1189271 - DNA, 15 bp, Homo sapiens
tccccttgcccaggg

SEQ ID NO: 1189272 - DNA, 18 bp, Homo sapiens
tccccttgcccttgccct

SEQ ID NO: 1189273 - DNA, 14 bp, Homo sapiens
tccccttggacctc

SEQ ID NO: 1189274 - DNA, 17 bp, Homo sapiens
tccccttggacctccag

SEQ ID NO: 1189275 - DNA, 18 bp, Homo sapiens
tccccttggacctccagg

SEQ ID NO: 1189276 - DNA, 16 bp, Homo sapiens
tccccttggcttcctc

SEQ ID NO: 1189277 - DNA, 22 bp, Homo sapiens
tccccttggcttcctccgtcca

SEQ ID NO: 1189278 - DNA, 14 bp, Homo sapiens
gccccaacctgctg

SEQ ID NO: 1189279 - DNA, 14 bp, Homo sapiens
gccccaactcctgg

SEQ ID NO: 1189280 - DNA, 15 bp, Homo sapiens
gccccaactcctgga

SEQ ID NO: 1189281 - DNA, 22 bp, Homo sapiens
gccccaactcctggaagctgtg

SEQ ID NO: 1189282 - DNA, 16 bp, Homo sapiens
gccccaactcgggctc

SEQ ID NO: 1189283 - DNA, 20 bp, Homo sapiens
gccccaactcgggctcccgg

SEQ ID NO: 1189284 - DNA, 23 bp, Homo sapiens
gccccaagaggggcgggctcaga

SEQ ID NO: 1189285 - DNA, 13 bp, Homo sapiens
gccccaagcagcc

SEQ ID NO: 1189286 - DNA, 14 bp, Homo sapiens
gccccaagcagcca

SEQ ID NO: 1189287 - DNA, 15 bp, Homo sapiens
gccccaagcagccag

SEQ ID NO: 1189288 - DNA, 16 bp, Homo sapiens
gccccaagcagccagc

SEQ ID NO: 1189289 - DNA, 19 bp, Homo sapiens
gccccaagcagccagccag

SEQ ID NO: 1189290 - DNA, 20 bp, Homo sapiens
gccccaaggccccagggaca

SEQ ID NO: 1189291 - DNA, 15 bp, Homo sapiens
gccccaagggctggg

SEQ ID NO: 1189292 - DNA, 17 bp, Homo sapiens
gccccaaggttccagag

SEQ ID NO: 1189293 - DNA, 19 bp, Homo sapiens
gccccaaggttccagaggc

SEQ ID NO: 1189294 - DNA, 19 bp, Homo sapiens
gccccaaggtttacatagt

SEQ ID NO: 1189295 - DNA, 21 bp, Homo sapiens
gccccaagtcctgaagaggcg

SEQ ID NO: 1189296 - DNA, 13 bp, Homo sapiens
gccccaagttggg

SEQ ID NO: 1189297 - DNA, 19 bp, Homo sapiens
gccccaatccctttattac

SEQ ID NO: 1189298 - DNA, 20 bp, Homo sapiens
gccccaatcttgcccactgg

SEQ ID NO: 1189299 - DNA, 21 bp, Homo sapiens
gccccaatgtatgtgtggctg

SEQ ID NO: 1189300 - DNA, 21 bp, Homo sapiens
gccccacaaaacttcagtgtg

SEQ ID NO: 1189301 - DNA, 20 bp, Homo sapiens
gccccacacggaggcatctg

SEQ ID NO: 1189302 - DNA, 15 bp, Homo sapiens
gccccacagctacct

SEQ ID NO: 1189303 - DNA, 17 bp, Homo sapiens
gccccacagctacctga

SEQ ID NO: 1189304 - DNA, 14 bp, Homo sapiens
gccccaccacctag

SEQ ID NO: 1189305 - DNA, 18 bp, Homo sapiens
gccccaccacctaggcca

SEQ ID NO: 1189306 - DNA, 23 bp, Homo sapiens
gccccaccacctaggccactcct

SEQ ID NO: 1189307 - DNA, 17 bp, Homo sapiens
gccccacccaccctctg

SEQ ID NO: 1189308 - DNA, 11 bp, Homo sapiens
gccccacccag

SEQ ID NO: 1189309 - DNA, 15 bp, Homo sapiens
gccccacccaggagg

SEQ ID NO: 1189310 - DNA, 15 bp, Homo sapiens
gccccacccagggct

SEQ ID NO: 1189311 - DNA, 23 bp, Homo sapiens
gccccacccagggctccctcctg

SEQ ID NO: 1189312 - DNA, 13 bp, Homo sapiens
gccccacccccag

SEQ ID NO: 1189313 - DNA, 18 bp, Homo sapiens
gccccacccccagccagg

SEQ ID NO: 1189314 - DNA, 17 bp, Homo sapiens
gccccacccccctcctc

SEQ ID NO: 1189315 - DNA, 21 bp, Homo sapiens
gccccacccccctcctccccc

SEQ ID NO: 1189316 - DNA, 15 bp, Homo sapiens
gccccaccctgggcc

SEQ ID NO: 1189317 - DNA, 24 bp, Homo sapiens
gccccaccctgggccctgggctgg

SEQ ID NO: 1189318 - DNA, 17 bp, Homo sapiens
gccccacctacttgtga

SEQ ID NO: 1189319 - DNA, 20 bp, Homo sapiens
gccccacctacttgtgactg

SEQ ID NO: 1189320 - DNA, 12 bp, Homo sapiens
gccccacctccc

SEQ ID NO: 1189321 - DNA, 23 bp, Homo sapiens
gccccacctccccacacacaggc

SEQ ID NO: 1189322 - DNA, 14 bp, Homo sapiens
gccccacctccctg

SEQ ID NO: 1189323 - DNA, 17 bp, Homo sapiens
gccccacctccctgcgc

SEQ ID NO: 1189324 - DNA, 20 bp, Homo sapiens
gccccacctcggcacacact

SEQ ID NO: 1189325 - DNA, 13 bp, Homo sapiens
gccccacctgagc

SEQ ID NO: 1189326 - DNA, 15 bp, Homo sapiens
gccccacctttatta

SEQ ID NO: 1189327 - DNA, 19 bp, Homo sapiens
gccccacgccctctcctcc

SEQ ID NO: 1189328 - DNA, 23 bp, Homo sapiens
gccccacggagacagaggaaagg

SEQ ID NO: 1189329 - DNA, 22 bp, Homo sapiens
gccccactcccttgctggcccc

SEQ ID NO: 1189330 - DNA, 23 bp, Homo sapiens
gccccactcccttgctggcccca

SEQ ID NO: 1189331 - DNA, 12 bp, Homo sapiens
gccccactgcca

SEQ ID NO: 1189332 - DNA, 14 bp, Homo sapiens
gccccactgccagc

SEQ ID NO: 1189333 - DNA, 15 bp, Homo sapiens
gccccactggacaac

SEQ ID NO: 1189334 - DNA, 19 bp, Homo sapiens
gccccactggacaacactg

SEQ ID NO: 1189335 - DNA, 13 bp, Homo sapiens
gccccactggctg

SEQ ID NO: 1189336 - DNA, 17 bp, Homo sapiens
gccccacttcaccccca

SEQ ID NO: 1189337 - DNA, 16 bp, Homo sapiens
gccccacttctggcat

SEQ ID NO: 1189338 - DNA, 23 bp, Homo sapiens
gccccacttctggcatgggacag

SEQ ID NO: 1189339 - DNA, 21 bp, Homo sapiens
gccccacttctggccacatca

SEQ ID NO: 1189340 - DNA, 18 bp, Homo sapiens
gccccagaaggcagggaa

SEQ ID NO: 1189341 - DNA, 19 bp, Homo sapiens
gccccagacaacagcccag

SEQ ID NO: 1189342 - DNA, 20 bp, Homo sapiens
gccccagacaacagcccagg

SEQ ID NO: 1189343 - DNA, 16 bp, Homo sapiens
gccccagacagggtgg

SEQ ID NO: 1189344 - DNA, 21 bp, Homo sapiens
gccccagacagggtgggcttc

SEQ ID NO: 1189345 - DNA, 12 bp, Homo sapiens
gccccagactga

SEQ ID NO: 1189346 - DNA, 16 bp, Homo sapiens
gccccagactgggccc

SEQ ID NO: 1189347 - DNA, 21 bp, Homo sapiens
gccagggccatgtcagacaca

SEQ ID NO: 1189348 - DNA, 17 bp, Homo sapiens
gccagggcccagagccc

SEQ ID NO: 1189349 - DNA, 21 bp, Homo sapiens
gccagggcccagagcccttga

SEQ ID NO: 1189350 - DNA, 13 bp, Homo sapiens
gccagggcccagg

SEQ ID NO: 1189351 - DNA, 14 bp, Homo sapiens
gccagggcccagga

SEQ ID NO: 1189352 - DNA, 14 bp, Homo sapiens
gccagggcccaggc

SEQ ID NO: 1189353 - DNA, 13 bp, Homo sapiens
gccagggccctgc

SEQ ID NO: 1189354 - DNA, 19 bp, Homo sapiens
gccagggccctgcagaggg

SEQ ID NO: 1189355 - DNA, 22 bp, Homo sapiens
gccagggctatagctcaggacc

SEQ ID NO: 1189356 - DNA, 18 bp, Homo sapiens
gccagggctcaccagctg

SEQ ID NO: 1189357 - DNA, 19 bp, Homo sapiens
gccagggctcaccagctgg

SEQ ID NO: 1189358 - DNA, 11 bp, Homo sapiens
gccagggctgc

SEQ ID NO: 1189359 - DNA, 18 bp, Homo sapiens
gccagggctgccctgaga

SEQ ID NO: 1189360 - DNA, 13 bp, Homo sapiens
gccagggctggat

SEQ ID NO: 1189361 - DNA, 23 bp, Homo sapiens
gccagggctggatggacagacac

SEQ ID NO: 1189362 - DNA, 12 bp, Homo sapiens
gccagggctggg

SEQ ID NO: 1189363 - DNA, 21 bp, Homo sapiens
gccagggctggggacagaggg

SEQ ID NO: 1189364 - DNA, 10 bp, Homo sapiens
gccagggctt

SEQ ID NO: 1189365 - DNA, 16 bp, Homo sapiens
gccagggcttcctctt

SEQ ID NO: 1189366 - DNA, 17 bp, Homo sapiens
gccaggggaaaatcagc

SEQ ID NO: 1189367 - DNA, 22 bp, Homo sapiens
gccaggggaaaatcagcctgct

SEQ ID NO: 1189368 - DNA, 17 bp, Homo sapiens
gccaggggcaggcaggg

SEQ ID NO: 1189369 - DNA, 18 bp, Homo sapiens
gccaggggcaggcagggc

SEQ ID NO: 1189370 - DNA, 18 bp, Homo sapiens
gccaggggcttgagaagg

SEQ ID NO: 1189371 - DNA, 16 bp, Homo sapiens
gccaggggtaacctgg

SEQ ID NO: 1189372 - DNA, 21 bp, Homo sapiens
gccagggtagagcaaaggaga

SEQ ID NO: 1189373 - DNA, 17 bp, Homo sapiens
gccagggtctctccctc

SEQ ID NO: 1189374 - DNA, 19 bp, Homo sapiens
gccagggtctctccctcag

SEQ ID NO: 1189375 - DNA, 22 bp, Homo sapiens
gccagggtctgtgtgaatgtgg

SEQ ID NO: 1189376 - DNA, 19 bp, Homo sapiens
gccagggtgagagtctggg

SEQ ID NO: 1189377 - DNA, 15 bp, Homo sapiens
gccagggtgctgtcg

SEQ ID NO: 1189378 - DNA, 18 bp, Homo sapiens
gccagggtgggaagagaa

SEQ ID NO: 1189379 - DNA, 16 bp, Homo sapiens
gccagggtgggctggg

SEQ ID NO: 1189380 - DNA, 20 bp, Homo sapiens
gccagggtggtcttgatctc

SEQ ID NO: 1189381 - DNA, 23 bp, Homo sapiens
gccagggtgtgactcgggagctg

SEQ ID NO: 1189382 - DNA, 14 bp, Homo sapiens
gccagggtgtggcc

SEQ ID NO: 1189383 - DNA, 21 bp, Homo sapiens
gccaggtaatgtgaataaatt

SEQ ID NO: 1189384 - DNA, 21 bp, Homo sapiens
gccaggtactgcattctctcc

SEQ ID NO: 1189385 - DNA, 22 bp, Homo sapiens
gccaggtactgcattctctccc

SEQ ID NO: 1189386 - DNA, 23 bp, Homo sapiens
gccaggtactgcattctctccca

SEQ ID NO: 1189387 - DNA, 19 bp, Homo sapiens
gccaggtgcaatctactgg

SEQ ID NO: 1189388 - DNA, 19 bp, Homo sapiens
gccaggtgcagaccttggg

SEQ ID NO: 1189389 - DNA, 16 bp, Homo sapiens
gccaggtgcggcctgg

SEQ ID NO: 1189390 - DNA, 17 bp, Homo sapiens
gccaggtgcggcctggg

SEQ ID NO: 1189391 - DNA, 22 bp, Homo sapiens
gccaggtgcggcctggggggaa

SEQ ID NO: 1189392 - DNA, 18 bp, Homo sapiens
gccaggtggccactccag

SEQ ID NO: 1189393 - DNA, 14 bp, Homo sapiens
gccaggtgggcgga

SEQ ID NO: 1189394 - DNA, 16 bp, Homo sapiens
gccaggtgggcggaca

SEQ ID NO: 1189395 - DNA, 23 bp, Homo sapiens
gccagtaaatgggggtgcatttg

SEQ ID NO: 1189396 - DNA, 21 bp, Homo sapiens
gccagtatctatatatgtgta

SEQ ID NO: 1189397 - DNA, 22 bp, Homo sapiens
gccagtatctatatatgtgtat

SEQ ID NO: 1189398 - DNA, 17 bp, Homo sapiens
gccagtatttttaaagg

SEQ ID NO: 1189399 - DNA, 14 bp, Homo sapiens
gccagtatttttta

SEQ ID NO: 1189400 - DNA, 15 bp, Homo sapiens
gccagtcaccttctg

SEQ ID NO: 1189401 - DNA, 20 bp, Homo sapiens
gccagtcaccttctgggcaa

SEQ ID NO: 1189402 - DNA, 12 bp, Homo sapiens
gccagtcactgc

SEQ ID NO: 1189403 - DNA, 13 bp, Homo sapiens
gccagtcactgct

SEQ ID NO: 1189404 - DNA, 14 bp, Homo sapiens
gccagtcactgctg

SEQ ID NO: 1189405 - DNA, 16 bp, Homo sapiens
gccagtcactgctgca

SEQ ID NO: 1189406 - DNA, 17 bp, Homo sapiens
gccagtcactgctgcaa

SEQ ID NO: 1189407 - DNA, 20 bp, Homo sapiens
gccagtccaggctgccgtgg

SEQ ID NO: 1189408 - DNA, 21 bp, Homo sapiens
gccagtccaggctgccgtggg

SEQ ID NO: 1189409 - DNA, 20 bp, Homo sapiens
gccagtccccatttctgcct

SEQ ID NO: 1189410 - DNA, 15 bp, Homo sapiens
gccagtccccgagga

SEQ ID NO: 1189411 - DNA, 22 bp, Homo sapiens
gccagtccccgaggagctgggc

SEQ ID NO: 1189412 - DNA, 21 bp, Homo sapiens
gccagtcctcctgggagcccc

SEQ ID NO: 1189413 - DNA, 14 bp, Homo sapiens
gccagtcctgcctg

SEQ ID NO: 1189414 - DNA, 21 bp, Homo sapiens
gccagtcctggtcctggctgc

SEQ ID NO: 1189415 - DNA, 18 bp, Homo sapiens
gccagtcgggagagccag

SEQ ID NO: 1189416 - DNA, 13 bp, Homo sapiens
gccagtctcagag

SEQ ID NO: 1189417 - DNA, 14 bp, Homo sapiens
gccagtctcagaga

SEQ ID NO: 1189418 - DNA, 15 bp, Homo sapiens
gccagtctcagagac

SEQ ID NO: 1189419 - DNA, 19 bp, Homo sapiens
gccagtctcagagaccagc

SEQ ID NO: 1189420 - DNA, 15 bp, Homo sapiens
gccagtctcccaggc

SEQ ID NO: 1189421 - DNA, 17 bp, Homo sapiens
gccagtctgggctgccg

SEQ ID NO: 1189422 - DNA, 20 bp, Homo sapiens
gccagtctgtggatcagaga

SEQ ID NO: 1189423 - DNA, 19 bp, Homo sapiens
gccagtcttgcctaggcca

SEQ ID NO: 1189424 - DNA, 13 bp, Homo sapiens
gccagtcttgtgt

SEQ ID NO: 1189425 - DNA, 23 bp, Homo sapiens
gccagtgaagggttttgtgtgtt

SEQ ID NO: 1189426 - DNA, 15 bp, Homo sapiens
gccagtgacctttga

SEQ ID NO: 1189427 - DNA, 18 bp, Homo sapiens
gccagtgactttttctga

SEQ ID NO: 1189428 - DNA, 14 bp, Homo sapiens
gccagtgagggctg

SEQ ID NO: 1189429 - DNA, 14 bp, Homo sapiens
gccagtgcagccac

SEQ ID NO: 1189430 - DNA, 12 bp, Homo sapiens
gccagtgccagg

SEQ ID NO: 1189431 - DNA, 16 bp, Homo sapiens
gccagtgccagggtgg

SEQ ID NO: 1189432 - DNA, 17 bp, Homo sapiens
gccagtgccagggtggg

SEQ ID NO: 1189433 - DNA, 10 bp, Homo sapiens
gccagtgcct

SEQ ID NO: 1189434 - DNA, 21 bp, Homo sapiens
gccagtgccttacctcctgcc

SEQ ID NO: 1189435 - DNA, 15 bp, Homo sapiens
gccagtgctgcttct

SEQ ID NO: 1189436 - DNA, 14 bp, Homo sapiens
gccagtggaagaaa

SEQ ID NO: 1189437 - DNA, 17 bp, Homo sapiens
gccagtggcacaggaga

SEQ ID NO: 1189438 - DNA, 17 bp, Homo sapiens
gccagtgggcctggtag

SEQ ID NO: 1189439 - DNA, 19 bp, Homo sapiens
gccagtgggcctggtagca

SEQ ID NO: 1189440 - DNA, 16 bp, Homo sapiens
gccagtggggcctgtg

SEQ ID NO: 1189441 - DNA, 19 bp, Homo sapiens
gccagtggtgatgtaaaaa

SEQ ID NO: 1189442 - DNA, 19 bp, Homo sapiens
gccagtgttgtgggcttcc

SEQ ID NO: 1189443 - DNA, 17 bp, Homo sapiens
gccagtgtttaaaactt

SEQ ID NO: 1189444 - DNA, 15 bp, Homo sapiens
gccagttaaggaaag

SEQ ID NO: 1189445 - DNA, 13 bp, Homo sapiens
gccagttcatctt

SEQ ID NO: 1189446 - DNA, 18 bp, Homo sapiens
gccagttcatctttttat

SEQ ID NO: 1189447 - DNA, 19 bp, Homo sapiens
gccagttctccttccctgc

SEQ ID NO: 1189448 - DNA, 15 bp, Homo sapiens
gccagttgatctgct

SEQ ID NO: 1189449 - DNA, 19 bp, Homo sapiens
gccagttgatctgctctgt

SEQ ID NO: 1189450 - DNA, 19 bp, Homo sapiens
gccagttggacacaggtga

SEQ ID NO: 1189451 - DNA, 19 bp, Homo sapiens
gccagttgggctcgcactg

SEQ ID NO: 1189452 - DNA, 20 bp, Homo sapiens
gccagtttctctgccttctt

SEQ ID NO: 1189453 - DNA, 18 bp, Homo sapiens
gccataacgtgcccccag

SEQ ID NO: 1189454 - DNA, 14 bp, Homo sapiens
gccataattttgca

SEQ ID NO: 1189455 - DNA, 16 bp, Homo sapiens
gccataattttgcata

SEQ ID NO: 1189456 - DNA, 21 bp, Homo sapiens
gccatagaccctgaggccctg

SEQ ID NO: 1189457 - DNA, 16 bp, Homo sapiens
gccatagaggcccagg

SEQ ID NO: 1189458 - DNA, 17 bp, Homo sapiens
gccatagaggcccaggc

SEQ ID NO: 1189459 - DNA, 19 bp, Homo sapiens
gccatagccccagtaggac

SEQ ID NO: 1189460 - DNA, 13 bp, Homo sapiens
gccatagccccat

SEQ ID NO: 1189461 - DNA, 15 bp, Homo sapiens
gccatagggggctgc

SEQ ID NO: 1189462 - DNA, 16 bp, Homo sapiens
gccatagggggctgca

SEQ ID NO: 1189463 - DNA, 23 bp, Homo sapiens
gccatagggtctgcagcctgctg

SEQ ID NO: 1189464 - DNA, 17 bp, Homo sapiens
gccatataagtttgaag

SEQ ID NO: 1189465 - DNA, 19 bp, Homo sapiens
gccatataagtttgaagga

SEQ ID NO: 1189466 - DNA, 18 bp, Homo sapiens
gccatatatgctgtattt

SEQ ID NO: 1189467 - DNA, 16 bp, Homo sapiens
gccatattaaattttt

SEQ ID NO: 1189468 - DNA, 22 bp, Homo sapiens
gccatattaattgcctgttaaa

SEQ ID NO: 1189469 - DNA, 16 bp, Homo sapiens
gccatcaaaatgcttt

SEQ ID NO: 1189470 - DNA, 16 bp, Homo sapiens
gccatcaagagactga

SEQ ID NO: 1189471 - DNA, 19 bp, Homo sapiens
gccatcactagaagaaaag

SEQ ID NO: 1189472 - DNA, 18 bp, Homo sapiens
gccatcactcagccccta

SEQ ID NO: 1189473 - DNA, 16 bp, Homo sapiens
gccatcacttctcccc

SEQ ID NO: 1189474 - DNA, 18 bp, Homo sapiens
gccatcacttctccccgc

SEQ ID NO: 1189475 - DNA, 13 bp, Homo sapiens
gccatcagcccct

SEQ ID NO: 1189476 - DNA, 14 bp, Homo sapiens
gccatcagcccctg

SEQ ID NO: 1189477 - DNA, 15 bp, Homo sapiens
gccatcagcccctgg

SEQ ID NO: 1189478 - DNA, 16 bp, Homo sapiens
gccatcagcccctggg

SEQ ID NO: 1189479 - DNA, 17 bp, Homo sapiens
gccatcagcccctggga

SEQ ID NO: 1189480 - DNA, 14 bp, Homo sapiens
gccatcagggccct

SEQ ID NO: 1189481 - DNA, 20 bp, Homo sapiens
gccatcagggccctgcccca

SEQ ID NO: 1189482 - DNA, 19 bp, Homo sapiens
gccatcataggaagggacc

SEQ ID NO: 1189483 - DNA, 17 bp, Homo sapiens
gccatcatgccttgata

SEQ ID NO: 1189484 - DNA, 18 bp, Homo sapiens
gccatcatttttgatgac

SEQ ID NO: 1189485 - DNA, 21 bp, Homo sapiens
gccatccagggtctggcagag

SEQ ID NO: 1189486 - DNA, 17 bp, Homo sapiens
gccatcccgcttagcct

SEQ ID NO: 1189487 - DNA, 20 bp, Homo sapiens
gccatcccgcttagcctgcc

SEQ ID NO: 1189488 - DNA, 19 bp, Homo sapiens
gccatccctgggcccctcc

SEQ ID NO: 1189489 - DNA, 21 bp, Homo sapiens
gccatcccttcggagccaaca

SEQ ID NO: 1189490 - DNA, 13 bp, Homo sapiens
gccatcccttggg

SEQ ID NO: 1189491 - DNA, 19 bp, Homo sapiens
gccatcctaaaagccaccc

SEQ ID NO: 1189492 - DNA, 16 bp, Homo sapiens
gccatcctacccagcg

SEQ ID NO: 1189493 - DNA, 21 bp, Homo sapiens
gccatcctcaaacgacagagg

SEQ ID NO: 1189494 - DNA, 23 bp, Homo sapiens
gccatcctcaaacgacagaggag

SEQ ID NO: 1189495 - DNA, 24 bp, Homo sapiens
gccatcctcaaacgacagaggagc

SEQ ID NO: 1189496 - DNA, 12 bp, Homo sapiens
gccatcctgatg

SEQ ID NO: 1189497 - DNA, 13 bp, Homo sapiens
gccatcctgttaa

SEQ ID NO: 1189498 - DNA, 18 bp, Homo sapiens
gccatctaatgcttgttt

SEQ ID NO: 1189499 - DNA, 15 bp, Homo sapiens
gccatctagccagcc

SEQ ID NO: 1189500 - DNA, 15 bp, Homo sapiens
gccatctcagattct

SEQ ID NO: 1189501 - DNA, 18 bp, Homo sapiens
gccatctcatgaggggag

SEQ ID NO: 1189502 - DNA, 20 bp, Homo sapiens
gccatctcatgaggggagag

SEQ ID NO: 1189503 - DNA, 16 bp, Homo sapiens
gccatctccctcccca

SEQ ID NO: 1189504 - DNA, 15 bp, Homo sapiens
gccatctgacagcag

SEQ ID NO: 1189505 - DNA, 15 bp, Homo sapiens
gccatctgcccaggg

SEQ ID NO: 1189506 - DNA, 17 bp, Homo sapiens
gccatctgcccaggggt

SEQ ID NO: 1189507 - DNA, 20 bp, Homo sapiens
gccatctgcccaggggtgcc

SEQ ID NO: 1189508 - DNA, 16 bp, Homo sapiens
gccatctgcgcagggt

SEQ ID NO: 1189509 - DNA, 21 bp, Homo sapiens
gccatctgggctcctccaggg

SEQ ID NO: 1189510 - DNA, 19 bp, Homo sapiens
gccatctgtgtgcagcaac

SEQ ID NO: 1189511 - DNA, 19 bp, Homo sapiens
gccatcttaaaaagcgggt

SEQ ID NO: 1189512 - DNA, 21 bp, Homo sapiens
tcccagccccaggcctggcct

SEQ ID NO: 1189513 - DNA, 22 bp, Homo sapiens
tcccagccccaggcctggcctc

SEQ ID NO: 1189514 - DNA, 16 bp, Homo sapiens
tcccagccctatggat

SEQ ID NO: 1189515 - DNA, 13 bp, Homo sapiens
tcccagccctcat

SEQ ID NO: 1189516 - DNA, 14 bp, Homo sapiens
tcccagccctcatc

SEQ ID NO: 1189517 - DNA, 18 bp, Homo sapiens
tcccagccctcatcccac

SEQ ID NO: 1189518 - DNA, 23 bp, Homo sapiens
tcccagccggccaatggaaacct

SEQ ID NO: 1189519 - DNA, 10 bp, Homo sapiens
tcccagcctg

SEQ ID NO: 1189520 - DNA, 12 bp, Homo sapiens
tcccagcctgct

SEQ ID NO: 1189521 - DNA, 18 bp, Homo sapiens
tcccagcctgctgagagc

SEQ ID NO: 1189522 - DNA, 19 bp, Homo sapiens
tcccagcctgctgagagcc

SEQ ID NO: 1189523 - DNA, 14 bp, Homo sapiens
tcccagcctggggc

SEQ ID NO: 1189524 - DNA, 15 bp, Homo sapiens
tcccagcctggggct

SEQ ID NO: 1189525 - DNA, 15 bp, Homo sapiens
tcccagcctgtggtt

SEQ ID NO: 1189526 - DNA, 19 bp, Homo sapiens
tcccagcgagccacaggaa

SEQ ID NO: 1189527 - DNA, 16 bp, Homo sapiens
tcccagcggcctcagg

SEQ ID NO: 1189528 - DNA, 20 bp, Homo sapiens
tcccagcggttcctgtgcag

SEQ ID NO: 1189529 - DNA, 16 bp, Homo sapiens
tcccagctacctcaac

SEQ ID NO: 1189530 - DNA, 16 bp, Homo sapiens
tcccagctactcggga

SEQ ID NO: 1189531 - DNA, 17 bp, Homo sapiens
tcccagctacttgggag

SEQ ID NO: 1189532 - DNA, 16 bp, Homo sapiens
tcccagctaggaagag

SEQ ID NO: 1189533 - DNA, 23 bp, Homo sapiens
tcccagctcctttctcctgtgaa

SEQ ID NO: 1189534 - DNA, 22 bp, Homo sapiens
tcccagctctccctctggccct

SEQ ID NO: 1189535 - DNA, 14 bp, Homo sapiens
tcccagctgcactt

SEQ ID NO: 1189536 - DNA, 14 bp, Homo sapiens
tcccagctgcttta

SEQ ID NO: 1189537 - DNA, 20 bp, Homo sapiens
tcccagctgctttacttaaa

SEQ ID NO: 1189538 - DNA, 16 bp, Homo sapiens
tcccagcttgcccccg

SEQ ID NO: 1189539 - DNA, 19 bp, Homo sapiens
tcccagcttgtaggagctg

SEQ ID NO: 1189540 - DNA, 15 bp, Homo sapiens
tcccaggacaagcac

SEQ ID NO: 1189541 - DNA, 17 bp, Homo sapiens
tcccaggacaagcacga

SEQ ID NO: 1189542 - DNA, 15 bp, Homo sapiens
tcccaggaccctcca

SEQ ID NO: 1189543 - DNA, 16 bp, Homo sapiens
tcccaggactcaccct

SEQ ID NO: 1189544 - DNA, 16 bp, Homo sapiens
tcccaggagacagttc

SEQ ID NO: 1189545 - DNA, 15 bp, Homo sapiens
tcccaggagaccatt

SEQ ID NO: 1189546 - DNA, 18 bp, Homo sapiens
tcccaggagatgggtcca

SEQ ID NO: 1189547 - DNA, 21 bp, Homo sapiens
tcccaggagatgggtccaggg

SEQ ID NO: 1189548 - DNA, 21 bp, Homo sapiens
tcccaggcatgcagctgcctg

SEQ ID NO: 1189549 - DNA, 12 bp, Homo sapiens
tcccaggcccac

SEQ ID NO: 1189550 - DNA, 17 bp, Homo sapiens
tcccaggccccctgcat

SEQ ID NO: 1189551 - DNA, 16 bp, Homo sapiens
tcccaggcccctggag

SEQ ID NO: 1189552 - DNA, 17 bp, Homo sapiens
tcccaggccggcccaga

SEQ ID NO: 1189553 - DNA, 16 bp, Homo sapiens
tcccaggcgccccttc

SEQ ID NO: 1189554 - DNA, 15 bp, Homo sapiens
tcccaggctgagcct

SEQ ID NO: 1189555 - DNA, 18 bp, Homo sapiens
tcccaggctgagcctcag

SEQ ID NO: 1189556 - DNA, 16 bp, Homo sapiens
tcccaggctgctggag

SEQ ID NO: 1189557 - DNA, 22 bp, Homo sapiens
tcccaggctgctggagtgcagt

SEQ ID NO: 1189558 - DNA, 12 bp, Homo sapiens
tcccaggctgga

SEQ ID NO: 1189559 - DNA, 19 bp, Homo sapiens
tcccaggctggagtgcagt

SEQ ID NO: 1189560 - DNA, 20 bp, Homo sapiens
tcccaggctggagtgcagtg

SEQ ID NO: 1189561 - DNA, 20 bp, Homo sapiens
tcccagggaaggacttggag

SEQ ID NO: 1189562 - DNA, 13 bp, Homo sapiens
tcccagggaccag

SEQ ID NO: 1189563 - DNA, 19 bp, Homo sapiens
tcccagggagtgagcagct

SEQ ID NO: 1189564 - DNA, 10 bp, Homo sapiens
tcccagggat

SEQ ID NO: 1189565 - DNA, 18 bp, Homo sapiens
tcccagggccctcccagc

SEQ ID NO: 1189566 - DNA, 19 bp, Homo sapiens
tcccagggccctcccagcc

SEQ ID NO: 1189567 - DNA, 14 bp, Homo sapiens
tcccagggccctgg

SEQ ID NO: 1189568 - DNA, 14 bp, Homo sapiens
tcccagggcctcct

SEQ ID NO: 1189569 - DNA, 17 bp, Homo sapiens
tcccagggcctcctggg

SEQ ID NO: 1189570 - DNA, 18 bp, Homo sapiens
tcccagggctctgcaggc

SEQ ID NO: 1189571 - DNA, 11 bp, Homo sapiens
tcccagggctg

SEQ ID NO: 1189572 - DNA, 12 bp, Homo sapiens
tcccaggggacc

SEQ ID NO: 1189573 - DNA, 15 bp, Homo sapiens
tcccaggggagccag

SEQ ID NO: 1189574 - DNA, 17 bp, Homo sapiens
tcccaggggagccagct

SEQ ID NO: 1189575 - DNA, 18 bp, Homo sapiens
tcccaggggagccagctg

SEQ ID NO: 1189576 - DNA, 21 bp, Homo sapiens
tcccaggggagccagctgctt

SEQ ID NO: 1189577 - DNA, 22 bp, Homo sapiens
tcccaggggtctccctggctcc

SEQ ID NO: 1189578 - DNA, 15 bp, Homo sapiens
tcccagggtcccacc

SEQ ID NO: 1189579 - DNA, 17 bp, Homo sapiens
tcccagggtcccacccc

SEQ ID NO: 1189580 - DNA, 19 bp, Homo sapiens
tcccagggtcccaccccca

SEQ ID NO: 1189581 - DNA, 16 bp, Homo sapiens
tcccaggtaccagctg

SEQ ID NO: 1189582 - DNA, 19 bp, Homo sapiens
tcccaggtaccagctgcgc

SEQ ID NO: 1189583 - DNA, 21 bp, Homo sapiens
tcccaggtgcgtgtgtctctg

SEQ ID NO: 1189584 - DNA, 21 bp, Homo sapiens
tcccaggtggattttgtggag

SEQ ID NO: 1189585 - DNA, 15 bp, Homo sapiens
tcccaggttccagca

SEQ ID NO: 1189586 - DNA, 18 bp, Homo sapiens
tcccagtcactcctctct

SEQ ID NO: 1189587 - DNA, 13 bp, Homo sapiens
tcccagtcagaaa

SEQ ID NO: 1189588 - DNA, 15 bp, Homo sapiens
tcccagtcctccaga

SEQ ID NO: 1189589 - DNA, 16 bp, Homo sapiens
tcccagtctctggcag

SEQ ID NO: 1189590 - DNA, 18 bp, Homo sapiens
tcccagtgaactcctgcc

SEQ ID NO: 1189591 - DNA, 20 bp, Homo sapiens
tcccagtgaatccctgggag

SEQ ID NO: 1189592 - DNA, 12 bp, Homo sapiens
tcccagtgacaa

SEQ ID NO: 1189593 - DNA, 22 bp, Homo sapiens
tcccagtgacacttcagagagc

SEQ ID NO: 1189594 - DNA, 15 bp, Homo sapiens
tcccagtgagactgc

SEQ ID NO: 1189595 - DNA, 19 bp, Homo sapiens
tcccagtgagactgcccca

SEQ ID NO: 1189596 - DNA, 19 bp, Homo sapiens
tcccagtgccgagaaggaa

SEQ ID NO: 1189597 - DNA, 14 bp, Homo sapiens
tcccagtggcctca

SEQ ID NO: 1189598 - DNA, 20 bp, Homo sapiens
tcccagtgggaggggcaggc

SEQ ID NO: 1189599 - DNA, 21 bp, Homo sapiens
tcccagtgggaggggcaggct

SEQ ID NO: 1189600 - DNA, 23 bp, Homo sapiens
tcccagtgggaggggcaggctga

SEQ ID NO: 1189601 - DNA, 17 bp, Homo sapiens
tcccagtgggtgatgct

SEQ ID NO: 1189602 - DNA, 15 bp, Homo sapiens
tcccagtgtcagtat

SEQ ID NO: 1189603 - DNA, 11 bp, Homo sapiens
tcccagtgtgt

SEQ ID NO: 1189604 - DNA, 14 bp, Homo sapiens
tcccagttaaagat

SEQ ID NO: 1189605 - DNA, 23 bp, Homo sapiens
tcccagttcaggagtcccaagga

SEQ ID NO: 1189606 - DNA, 22 bp, Homo sapiens
tcccataattttcttcatgcaa

SEQ ID NO: 1189607 - DNA, 22 bp, Homo sapiens
tcccatcattacccttccctgc

SEQ ID NO: 1189608 - DNA, 17 bp, Homo sapiens
tcccatccagcgtctgc

SEQ ID NO: 1189609 - DNA, 12 bp, Homo sapiens
tcccatccaggc

SEQ ID NO: 1189610 - DNA, 13 bp, Homo sapiens
tcccatccaggca

SEQ ID NO: 1189611 - DNA, 15 bp, Homo sapiens
tcccatccaggcagt

SEQ ID NO: 1189612 - DNA, 14 bp, Homo sapiens
tcccatccagggcc

SEQ ID NO: 1189613 - DNA, 18 bp, Homo sapiens
tcccatcccactgctccc

SEQ ID NO: 1189614 - DNA, 15 bp, Homo sapiens
tcccatccccctgcc

SEQ ID NO: 1189615 - DNA, 17 bp, Homo sapiens
tcccatccccctgccct

SEQ ID NO: 1189616 - DNA, 18 bp, Homo sapiens
tcccatcctaccctcggg

SEQ ID NO: 1189617 - DNA, 21 bp, Homo sapiens
tcccatcctgatcccagaccc

SEQ ID NO: 1189618 - DNA, 17 bp, Homo sapiens
tcccatcctggggcagc

SEQ ID NO: 1189619 - DNA, 18 bp, Homo sapiens
tcccatcctggggcagca

SEQ ID NO: 1189620 - DNA, 22 bp, Homo sapiens
tcccatcgtctcggccttcaca

SEQ ID NO: 1189621 - DNA, 15 bp, Homo sapiens
tcccatctccaggga

SEQ ID NO: 1189622 - DNA, 17 bp, Homo sapiens
tcccatctccagggaag

SEQ ID NO: 1189623 - DNA, 18 bp, Homo sapiens
tcccatctcctgatttct

SEQ ID NO: 1189624 - DNA, 23 bp, Homo sapiens
tcccatctcctgatttctctgaa

SEQ ID NO: 1189625 - DNA, 14 bp, Homo sapiens
tcccatctctccca

SEQ ID NO: 1189626 - DNA, 21 bp, Homo sapiens
tcccatctctcccacttcctc

SEQ ID NO: 1189627 - DNA, 22 bp, Homo sapiens
tcccatctctcccacttcctcc

SEQ ID NO: 1189628 - DNA, 14 bp, Homo sapiens
tcccatctgccctc

SEQ ID NO: 1189629 - DNA, 16 bp, Homo sapiens
tcccatctgccctccc

SEQ ID NO: 1189630 - DNA, 13 bp, Homo sapiens
tcccatctggctc

SEQ ID NO: 1189631 - DNA, 20 bp, Homo sapiens
tcccatctggtcatttggtt

SEQ ID NO: 1189632 - DNA, 14 bp, Homo sapiens
tcccatcttggcct

SEQ ID NO: 1189633 - DNA, 19 bp, Homo sapiens
tcccatgaacacactgtgt

SEQ ID NO: 1189634 - DNA, 17 bp, Homo sapiens
tcccatgacccacccct

SEQ ID NO: 1189635 - DNA, 24 bp, Homo sapiens
tcccatgacccacccctgtgctcc

SEQ ID NO: 1189636 - DNA, 15 bp, Homo sapiens
tcccatgactgcacc

SEQ ID NO: 1189637 - DNA, 15 bp, Homo sapiens
tcccaccaactctgc

SEQ ID NO: 1189638 - DNA, 16 bp, Homo sapiens
tcccaccaactctgca

SEQ ID NO: 1189639 - DNA, 18 bp, Homo sapiens
tcccaccaactctgcact

SEQ ID NO: 1189640 - DNA, 19 bp, Homo sapiens
tcccaccaactctgcactc

SEQ ID NO: 1189641 - DNA, 17 bp, Homo sapiens
tcccaccacagcaggtg

SEQ ID NO: 1189642 - DNA, 14 bp, Homo sapiens
tcccaccacaggca

SEQ ID NO: 1189643 - DNA, 21 bp, Homo sapiens
tcccaccaccttggactcctc

SEQ ID NO: 1189644 - DNA, 21 bp, Homo sapiens
tcccaccagaacgcaccccac

SEQ ID NO: 1189645 - DNA, 16 bp, Homo sapiens
tcccaccattcctgcc

SEQ ID NO: 1189646 - DNA, 23 bp, Homo sapiens
tcccacccacacagctgccctag

SEQ ID NO: 1189647 - DNA, 12 bp, Homo sapiens
tcccaccccacc

SEQ ID NO: 1189648 - DNA, 22 bp, Homo sapiens
tcccaccccacccccttcagtg

SEQ ID NO: 1189649 - DNA, 21 bp, Homo sapiens
tcccaccccactcaggggacc

SEQ ID NO: 1189650 - DNA, 17 bp, Homo sapiens
tcccaccccagaaatca

SEQ ID NO: 1189651 - DNA, 18 bp, Homo sapiens
tcccaccccagaaatcac

SEQ ID NO: 1189652 - DNA, 19 bp, Homo sapiens
tcccaccccagaaatcact

SEQ ID NO: 1189653 - DNA, 22 bp, Homo sapiens
tcccaccccattttctgtgggc

SEQ ID NO: 1189654 - DNA, 22 bp, Homo sapiens
tcccacccccaacccccagagg

SEQ ID NO: 1189655 - DNA, 12 bp, Homo sapiens
tcccacccccag

SEQ ID NO: 1189656 - DNA, 15 bp, Homo sapiens
tcccaccccctcctc

SEQ ID NO: 1189657 - DNA, 21 bp, Homo sapiens
tcccaccccctcctcccccag

SEQ ID NO: 1189658 - DNA, 20 bp, Homo sapiens
tcccacccccttctctgctc

SEQ ID NO: 1189659 - DNA, 22 bp, Homo sapiens
tcccacccccttctctgctcca

SEQ ID NO: 1189660 - DNA, 19 bp, Homo sapiens
tcccacccctgcctcccat

SEQ ID NO: 1189661 - DNA, 23 bp, Homo sapiens
tcccaccccttcataccgcctcg

SEQ ID NO: 1189662 - DNA, 19 bp, Homo sapiens
tcccaccccttggcccctc

SEQ ID NO: 1189663 - DNA, 16 bp, Homo sapiens
tcccacccgatgctgc

SEQ ID NO: 1189664 - DNA, 18 bp, Homo sapiens
tcccacccgatgctgctt

SEQ ID NO: 1189665 - DNA, 14 bp, Homo sapiens
tcccacccggccac

SEQ ID NO: 1189666 - DNA, 22 bp, Homo sapiens
tcccacccggccacagctgctg

SEQ ID NO: 1189667 - DNA, 23 bp, Homo sapiens
tcccacccggccacagctgctgg

SEQ ID NO: 1189668 - DNA, 15 bp, Homo sapiens
tcccaccctaagggc

SEQ ID NO: 1189669 - DNA, 17 bp, Homo sapiens
tcccaccctaagggcag

SEQ ID NO: 1189670 - DNA, 17 bp, Homo sapiens
tcccaccctccacctct

SEQ ID NO: 1189671 - DNA, 19 bp, Homo sapiens
tcccaccctgcgggccagg

SEQ ID NO: 1189672 - DNA, 21 bp, Homo sapiens
tcccaccctgcgggccagggt

SEQ ID NO: 1189673 - DNA, 14 bp, Homo sapiens
tcccaccgccccca

SEQ ID NO: 1189674 - DNA, 15 bp, Homo sapiens
tcccaccgcccccac

SEQ ID NO: 1189675 - DNA, 16 bp, Homo sapiens
tcccaccgcccccacc

SEQ ID NO: 1189676 - DNA, 21 bp, Homo sapiens
tcccaccgggagcctccccct

SEQ ID NO: 1189677 - DNA, 18 bp, Homo sapiens
tcccacctagtgccccag

SEQ ID NO: 1189678 - DNA, 19 bp, Homo sapiens
tcccacctagtgccccaga

SEQ ID NO: 1189679 - DNA, 21 bp, Homo sapiens
tcccacctagtgccccagact

SEQ ID NO: 1189680 - DNA, 19 bp, Homo sapiens
tcccacctgacacaccagg

SEQ ID NO: 1189681 - DNA, 18 bp, Homo sapiens
tcccacgaatttgctggg

SEQ ID NO: 1189682 - DNA, 21 bp, Homo sapiens
tcccacgaatttgctggggaa

SEQ ID NO: 1189683 - DNA, 20 bp, Homo sapiens
tcccacgcactccatgagca

SEQ ID NO: 1189684 - DNA, 23 bp, Homo sapiens
tcccacgcctgtcctcctggaag

SEQ ID NO: 1189685 - DNA, 17 bp, Homo sapiens
tcccacgtctggccagg

SEQ ID NO: 1189686 - DNA, 14 bp, Homo sapiens
tcccacgtgtcttc

SEQ ID NO: 1189687 - DNA, 18 bp, Homo sapiens
tcccacgtgtcttccact

SEQ ID NO: 1189688 - DNA, 22 bp, Homo sapiens
tcccactaaaggggttccaaat

SEQ ID NO: 1189689 - DNA, 19 bp, Homo sapiens
tcccactatttattactga

SEQ ID NO: 1189690 - DNA, 12 bp, Homo sapiens
tcccactggaag

SEQ ID NO: 1189691 - DNA, 13 bp, Homo sapiens
tcccactgggact

SEQ ID NO: 1189692 - DNA, 13 bp, Homo sapiens
tcccactgttctg

SEQ ID NO: 1189693 - DNA, 16 bp, Homo sapiens
tcccacttcactgtga

SEQ ID NO: 1189694 - DNA, 13 bp, Homo sapiens
tcccacttcctcc

SEQ ID NO: 1189695 - DNA, 15 bp, Homo sapiens
tcccacttcctccta

SEQ ID NO: 1189696 - DNA, 16 bp, Homo sapiens
tcccacttcctcctac

SEQ ID NO: 1189697 - DNA, 19 bp, Homo sapiens
tcccacttcctcctacctg

SEQ ID NO: 1189698 - DNA, 22 bp, Homo sapiens
tcccacttcctcctacctgggg

SEQ ID NO: 1189699 - DNA, 17 bp, Homo sapiens
tcccacttggaggcctt

SEQ ID NO: 1189700 - DNA, 15 bp, Homo sapiens
tcccactttctgttc

SEQ ID NO: 1189701 - DNA, 16 bp, Homo sapiens
tcccactttctgttcc

SEQ ID NO: 1189702 - DNA, 19 bp, Homo sapiens
tcccactttgtctgtacat

SEQ ID NO: 1189703 - DNA, 18 bp, Homo sapiens
tcccagaaaaactggctc

SEQ ID NO: 1189704 - DNA, 19 bp, Homo sapiens
tcccagaaacatctctggc

SEQ ID NO: 1189705 - DNA, 22 bp, Homo sapiens
tcccagaaacatctctggccca

SEQ ID NO: 1189706 - DNA, 23 bp, Homo sapiens
tcccagaaacatctctggcccag

SEQ ID NO: 1189707 - DNA, 14 bp, Homo sapiens
tcccagaatcccag

SEQ ID NO: 1189708 - DNA, 16 bp, Homo sapiens
tcccagacaggccctc

SEQ ID NO: 1189709 - DNA, 17 bp, Homo sapiens
tcccagacaggccctcc

SEQ ID NO: 1189710 - DNA, 18 bp, Homo sapiens
tcccagacaggccctccc

SEQ ID NO: 1189711 - DNA, 23 bp, Homo sapiens
tcccagacaggccctccctgtct

SEQ ID NO: 1189712 - DNA, 22 bp, Homo sapiens
tcccagacagtggatatgaccc

SEQ ID NO: 1189713 - DNA, 21 bp, Homo sapiens
tcccagaccagccaagggtcc

SEQ ID NO: 1189714 - DNA, 16 bp, Homo sapiens
tcccagacccattcct

SEQ ID NO: 1189715 - DNA, 23 bp, Homo sapiens
tcccagaccttaagacactgtga

SEQ ID NO: 1189716 - DNA, 23 bp, Homo sapiens
tcccagactaaaggatccagaga

SEQ ID NO: 1189717 - DNA, 16 bp, Homo sapiens
tcccagactctgcctc

SEQ ID NO: 1189718 - DNA, 13 bp, Homo sapiens
tcccagagaacaa

SEQ ID NO: 1189719 - DNA, 14 bp, Homo sapiens
tcccagagaacaat

SEQ ID NO: 1189720 - DNA, 16 bp, Homo sapiens
tcccagagacaggaaa

SEQ ID NO: 1189721 - DNA, 20 bp, Homo sapiens
tcccagagacaggaaaatcc

SEQ ID NO: 1189722 - DNA, 9 bp, Homo sapiens
tcccagagc

SEQ ID NO: 1189723 - DNA, 15 bp, Homo sapiens
tcccagagcacctca

SEQ ID NO: 1189724 - DNA, 17 bp, Homo sapiens
tcccagagcaggaggcc

SEQ ID NO: 1189725 - DNA, 21 bp, Homo sapiens
tcccagagcaggaggcccctg

SEQ ID NO: 1189726 - DNA, 20 bp, Homo sapiens
tcccagagcttattggccac

SEQ ID NO: 1189727 - DNA, 14 bp, Homo sapiens
tcccagaggagcag

SEQ ID NO: 1189728 - DNA, 16 bp, Homo sapiens
tcccagaggagccacc

SEQ ID NO: 1189729 - DNA, 21 bp, Homo sapiens
tcccagaggagccaccagttc

SEQ ID NO: 1189730 - DNA, 16 bp, Homo sapiens
tcccagaggtccagcc

SEQ ID NO: 1189731 - DNA, 19 bp, Homo sapiens
tcccagaggtccagcccat

SEQ ID NO: 1189732 - DNA, 22 bp, Homo sapiens
tcccagaggtccagcccatctc

SEQ ID NO: 1189733 - DNA, 23 bp, Homo sapiens
tcccagaggtccagcccatctcg

SEQ ID NO: 1189734 - DNA, 21 bp, Homo sapiens
tcccagaggtgggatcctccc

SEQ ID NO: 1189735 - DNA, 19 bp, Homo sapiens
tcccagaggttatctgcct

SEQ ID NO: 1189736 - DNA, 23 bp, Homo sapiens
tcccagaggttatctgcctggcc

SEQ ID NO: 1189737 - DNA, 24 bp, Homo sapiens
tcccagaggttatctgcctggcct

SEQ ID NO: 1189738 - DNA, 21 bp, Homo sapiens
tcccagagtgctgggattaca

SEQ ID NO: 1189739 - DNA, 16 bp, Homo sapiens
tcccagatacttgggg

SEQ ID NO: 1189740 - DNA, 18 bp, Homo sapiens
tcccagatacttgggggg

SEQ ID NO: 1189741 - DNA, 22 bp, Homo sapiens
tccattgaagccgactctggcc

SEQ ID NO: 1189742 - DNA, 18 bp, Homo sapiens
tccattgcctagctcttt

SEQ ID NO: 1189743 - DNA, 19 bp, Homo sapiens
tccattgcttattcttgag

SEQ ID NO: 1189744 - DNA, 19 bp, Homo sapiens
tccattggatctgcaagaa

SEQ ID NO: 1189745 - DNA, 16 bp, Homo sapiens
tccattggttcttcct

SEQ ID NO: 1189746 - DNA, 17 bp, Homo sapiens
tccattggttcttcctt

SEQ ID NO: 1189747 - DNA, 11 bp, Homo sapiens
gtgccaggaca

SEQ ID NO: 1189748 - DNA, 12 bp, Homo sapiens
gtgccaggacca

SEQ ID NO: 1189749 - DNA, 14 bp, Homo sapiens
gtgccaggaccagc

SEQ ID NO: 1189750 - DNA, 16 bp, Homo sapiens
gtgccaggaccagcct

SEQ ID NO: 1189751 - DNA, 13 bp, Homo sapiens
gtgccaggcccgg

SEQ ID NO: 1189752 - DNA, 17 bp, Homo sapiens
gtgccaggcccggggct

SEQ ID NO: 1189753 - DNA, 19 bp, Homo sapiens
gtgccaggcccggggctgg

SEQ ID NO: 1189754 - DNA, 20 bp, Homo sapiens
gtgccaggcccggggctggc

SEQ ID NO: 1189755 - DNA, 16 bp, Homo sapiens
gtgccaggcttgcctg

SEQ ID NO: 1189756 - DNA, 17 bp, Homo sapiens
gtgccaggcttgcctgg

SEQ ID NO: 1189757 - DNA, 20 bp, Homo sapiens
gtgccaggcttgcctgggct

SEQ ID NO: 1189758 - DNA, 23 bp, Homo sapiens
gtgccagggctgggccccttcca

SEQ ID NO: 1189759 - DNA, 20 bp, Homo sapiens
gtgccagggtgggctgggga

SEQ ID NO: 1189760 - DNA, 17 bp, Homo sapiens
gtgccagtcaagaagaa

SEQ ID NO: 1189761 - DNA, 18 bp, Homo sapiens
gtgccagtcttgtgtctg

SEQ ID NO: 1189762 - DNA, 22 bp, Homo sapiens
gtgccagttcctgtaacaggtg

SEQ ID NO: 1189763 - DNA, 15 bp, Homo sapiens
gtgccatactaatga

SEQ ID NO: 1189764 - DNA, 17 bp, Homo sapiens
gtgccatactaatgatg

SEQ ID NO: 1189765 - DNA, 14 bp, Homo sapiens
gtgccatgctgggc

SEQ ID NO: 1189766 - DNA, 21 bp, Homo sapiens
gtgccatggccccccactccc

SEQ ID NO: 1189767 - DNA, 22 bp, Homo sapiens
gtgccatgtaaatccccactgg

SEQ ID NO: 1189768 - DNA, 19 bp, Homo sapiens
gtgccattatatttgcatt

SEQ ID NO: 1189769 - DNA, 23 bp, Homo sapiens
gtgccattccactccactcaggt

SEQ ID NO: 1189770 - DNA, 20 bp, Homo sapiens
gtgccattgtactccagcct

SEQ ID NO: 1189771 - DNA, 23 bp, Homo sapiens
gtgccattgtactccagcctggg

SEQ ID NO: 1189772 - DNA, 17 bp, Homo sapiens
gtgccattttcgaagga

SEQ ID NO: 1189773 - DNA, 19 bp, Homo sapiens
gtgcccaaacaccagtcac

SEQ ID NO: 1189774 - DNA, 20 bp, Homo sapiens
gtgcccaagaatagatgctg

SEQ ID NO: 1189775 - DNA, 12 bp, Homo sapiens
gtgcccaagcca

SEQ ID NO: 1189776 - DNA, 20 bp, Homo sapiens
gtgcccaagccagaggctgg

SEQ ID NO: 1189777 - DNA, 15 bp, Homo sapiens
gtgcccaagtgggca

SEQ ID NO: 1189778 - DNA, 21 bp, Homo sapiens
gtgcccacaggccgccctgcg

SEQ ID NO: 1189779 - DNA, 15 bp, Homo sapiens
gtgcccacatcccag

SEQ ID NO: 1189780 - DNA, 20 bp, Homo sapiens
gtgcccacatcccaggcttc

SEQ ID NO: 1189781 - DNA, 16 bp, Homo sapiens
gtgcccacatttgatg

SEQ ID NO: 1189782 - DNA, 23 bp, Homo sapiens
gtgcccaccaacatcccattgcc

SEQ ID NO: 1189783 - DNA, 14 bp, Homo sapiens
gtgcccagggtggc

SEQ ID NO: 1189784 - DNA, 16 bp, Homo sapiens
gtgcccagggttttgc

SEQ ID NO: 1189785 - DNA, 22 bp, Homo sapiens
gtgcccagggttttgccccaag

SEQ ID NO: 1189786 - DNA, 15 bp, Homo sapiens
gtgcccatcctgcca

SEQ ID NO: 1189787 - DNA, 13 bp, Homo sapiens
gtgcccattccta

SEQ ID NO: 1189788 - DNA, 12 bp, Homo sapiens
gtgccccacagc

SEQ ID NO: 1189789 - DNA, 14 bp, Homo sapiens
gtgccccacagcta

SEQ ID NO: 1189790 - DNA, 17 bp, Homo sapiens
gtgccccacctccccac

SEQ ID NO: 1189791 - DNA, 18 bp, Homo sapiens
gtgccccacctccccaca

SEQ ID NO: 1189792 - DNA, 15 bp, Homo sapiens
gtgccccagactgag

SEQ ID NO: 1189793 - DNA, 18 bp, Homo sapiens
gtgccccagactgagctc

SEQ ID NO: 1189794 - DNA, 20 bp, Homo sapiens
gtgccccagactgagctctc

SEQ ID NO: 1189795 - DNA, 12 bp, Homo sapiens
gtgccccagctg

SEQ ID NO: 1189796 - DNA, 14 bp, Homo sapiens
gtgccccagctgcc

SEQ ID NO: 1189797 - DNA, 16 bp, Homo sapiens
gtgccccagctgccag

SEQ ID NO: 1189798 - DNA, 12 bp, Homo sapiens
gtgccccaggga

SEQ ID NO: 1189799 - DNA, 21 bp, Homo sapiens
gtgccccatgcctgtccagcc

SEQ ID NO: 1189800 - DNA, 13 bp, Homo sapiens
gtgccccatgtcc

SEQ ID NO: 1189801 - DNA, 14 bp, Homo sapiens
gtgcccccagagtg

SEQ ID NO: 1189802 - DNA, 13 bp, Homo sapiens
gtgcccccagcct

SEQ ID NO: 1189803 - DNA, 15 bp, Homo sapiens
gtgcccccagcctca

SEQ ID NO: 1189804 - DNA, 16 bp, Homo sapiens
gtgcccccagcctcag

SEQ ID NO: 1189805 - DNA, 19 bp, Homo sapiens
gtgcccccagcctcagccc

SEQ ID NO: 1189806 - DNA, 18 bp, Homo sapiens
gtgcccccctcctccagt

SEQ ID NO: 1189807 - DNA, 17 bp, Homo sapiens
gtgcccccgcctgccac

SEQ ID NO: 1189808 - DNA, 17 bp, Homo sapiens
gtgcccccgggaatgga

SEQ ID NO: 1189809 - DNA, 13 bp, Homo sapiens
gtgccccctcctc

SEQ ID NO: 1189810 - DNA, 14 bp, Homo sapiens
gtgccccctcctct

SEQ ID NO: 1189811 - DNA, 18 bp, Homo sapiens
gtgccccctcctctccca

SEQ ID NO: 1189812 - DNA, 17 bp, Homo sapiens
gtgccccctctaccatt

SEQ ID NO: 1189813 - DNA, 21 bp, Homo sapiens
gtgccccctctggtgtctttg

SEQ ID NO: 1189814 - DNA, 17 bp, Homo sapiens
gtgccccgcgggctttg

SEQ ID NO: 1189815 - DNA, 17 bp, Homo sapiens
gtgccccttaagggttg

SEQ ID NO: 1189816 - DNA, 14 bp, Homo sapiens
gtgcccctttcctt

SEQ ID NO: 1189817 - DNA, 17 bp, Homo sapiens
gtgcccgcaggaactgg

SEQ ID NO: 1189818 - DNA, 17 bp, Homo sapiens
gtgcccgcatgtgtgcc

SEQ ID NO: 1189819 - DNA, 20 bp, Homo sapiens
gtgcccgcatgtgtgcctgg

SEQ ID NO: 1189820 - DNA, 15 bp, Homo sapiens
gtgccctagatcaac

SEQ ID NO: 1189821 - DNA, 14 bp, Homo sapiens
gtgccctcacccca

SEQ ID NO: 1189822 - DNA, 15 bp, Homo sapiens
gtgccctccaaagag

SEQ ID NO: 1189823 - DNA, 15 bp, Homo sapiens
gtgccctgcaggcac

SEQ ID NO: 1189824 - DNA, 18 bp, Homo sapiens
gtgccctgcccccatctc

SEQ ID NO: 1189825 - DNA, 20 bp, Homo sapiens
gtgccctggaggctgacaca

SEQ ID NO: 1189826 - DNA, 18 bp, Homo sapiens
gtgccctggctccttgca

SEQ ID NO: 1189827 - DNA, 23 bp, Homo sapiens
gtgccctggctccttgcagcagg

SEQ ID NO: 1189828 - DNA, 14 bp, Homo sapiens
gtgccctgggccag

SEQ ID NO: 1189829 - DNA, 15 bp, Homo sapiens
gtgccctgggccagg

SEQ ID NO: 1189830 - DNA, 18 bp, Homo sapiens
gtgccctgggccaggcag

SEQ ID NO: 1189831 - DNA, 23 bp, Homo sapiens
gtgccctggtggagaaagcactg

SEQ ID NO: 1189832 - DNA, 12 bp, Homo sapiens
gtgcccttgggg

SEQ ID NO: 1189833 - DNA, 19 bp, Homo sapiens
gtgcccttttccagcctca

SEQ ID NO: 1189834 - DNA, 22 bp, Homo sapiens
gtgccgagaaggaagcctccca

SEQ ID NO: 1189835 - DNA, 14 bp, Homo sapiens
gtgccgcactctgg

SEQ ID NO: 1189836 - DNA, 16 bp, Homo sapiens
gtgccgcctgctcctc

SEQ ID NO: 1189837 - DNA, 21 bp, Homo sapiens
gtgccgcctgctcctcactgg

SEQ ID NO: 1189838 - DNA, 19 bp, Homo sapiens
gtgccggcggcagccccac

SEQ ID NO: 1189839 - DNA, 23 bp, Homo sapiens
gtgccggcggcagccccacttca

SEQ ID NO: 1189840 - DNA, 14 bp, Homo sapiens
gtgccggctgtgga

SEQ ID NO: 1189841 - DNA, 16 bp, Homo sapiens
gtgccggggaggggca

SEQ ID NO: 1189842 - DNA, 20 bp, Homo sapiens
gtgccggggaggggcagaga

SEQ ID NO: 1189843 - DNA, 19 bp, Homo sapiens
gtgccgtgtgagtgtgaca

SEQ ID NO: 1189844 - DNA, 15 bp, Homo sapiens
gtgccgttactctcc

SEQ ID NO: 1189845 - DNA, 18 bp, Homo sapiens
gtgccgttactctccaac

SEQ ID NO: 1189846 - DNA, 22 bp, Homo sapiens
gtgcctaggttggtttcccctg

SEQ ID NO: 1189847 - DNA, 24 bp, Homo sapiens
gtgcctaggttggtttcccctgca

SEQ ID NO: 1189848 - DNA, 19 bp, Homo sapiens
gtgcctcagagaccagggc

SEQ ID NO: 1189849 - DNA, 14 bp, Homo sapiens
gtgcctcagagcag

SEQ ID NO: 1189850 - DNA, 13 bp, Homo sapiens
gtgcctcaggacc

SEQ ID NO: 1189851 - DNA, 14 bp, Homo sapiens
gtgcctcaggccag

SEQ ID NO: 1189852 - DNA, 19 bp, Homo sapiens
gtgcctcagttttccttct

SEQ ID NO: 1189853 - DNA, 19 bp, Homo sapiens
gtgcctccaagcggccctg

SEQ ID NO: 1189854 - DNA, 22 bp, Homo sapiens
gtgcctccaccaccactggcca

SEQ ID NO: 1189855 - DNA, 16 bp, Homo sapiens
gtgcctccaggaccag

SEQ ID NO: 1189856 - DNA, 17 bp, Homo sapiens
gtgcctcccttcccagt

SEQ ID NO: 1189857 - DNA, 23 bp, Homo sapiens
gtgcctcccttcccagtgggctg

SEQ ID NO: 1189858 - DNA, 21 bp, Homo sapiens
gtgcctcctcaaacccagtct

SEQ ID NO: 1189859 - DNA, 22 bp, Homo sapiens
gtgcctcctgcagtttgggaga

SEQ ID NO: 1189860 - DNA, 13 bp, Homo sapiens
gtgcctccttcca

SEQ ID NO: 1189861 - DNA, 18 bp, Homo sapiens
gtggaagccctccttcca

SEQ ID NO: 1189862 - DNA, 21 bp, Homo sapiens
gtggaaggcattgtcctgtga

SEQ ID NO: 1189863 - DNA, 17 bp, Homo sapiens
gtggaagggggaggagt

SEQ ID NO: 1189864 - DNA, 17 bp, Homo sapiens
gtggaagtatacctggc

SEQ ID NO: 1189865 - DNA, 19 bp, Homo sapiens
gtggaagttcttcaagagg

SEQ ID NO: 1189866 - DNA, 18 bp, Homo sapiens
gtggaatgagtgtgcatg

SEQ ID NO: 1189867 - DNA, 17 bp, Homo sapiens
gtggaatgttggataag

SEQ ID NO: 1189868 - DNA, 19 bp, Homo sapiens
gtggaattttgagaaaaat

SEQ ID NO: 1189869 - DNA, 20 bp, Homo sapiens
gtggaattttgagaaaaata

SEQ ID NO: 1189870 - DNA, 22 bp, Homo sapiens
gtggacaccaggagtccctggt

SEQ ID NO: 1189871 - DNA, 19 bp, Homo sapiens
gtggacaccgctcagtatt

SEQ ID NO: 1189872 - DNA, 14 bp, Homo sapiens
gtggacagtcaggg

SEQ ID NO: 1189873 - DNA, 15 bp, Homo sapiens
gtggacagtcctggg

SEQ ID NO: 1189874 - DNA, 16 bp, Homo sapiens
gtggacagtcctggga

SEQ ID NO: 1189875 - DNA, 17 bp, Homo sapiens
gtggacatatgtatact

SEQ ID NO: 1189876 - DNA, 19 bp, Homo sapiens
gtggacatatgtatactta

SEQ ID NO: 1189877 - DNA, 13 bp, Homo sapiens
gtggacatggtca

SEQ ID NO: 1189878 - DNA, 16 bp, Homo sapiens
gtggaccaggcctgga

SEQ ID NO: 1189879 - DNA, 22 bp, Homo sapiens
gtggaccctggaccattccagg

SEQ ID NO: 1189880 - DNA, 17 bp, Homo sapiens
gtggaccctgtggccag

SEQ ID NO: 1189881 - DNA, 14 bp, Homo sapiens
gtggacctagcctg

SEQ ID NO: 1189882 - DNA, 20 bp, Homo sapiens
cttgagccttgaactttgac

SEQ ID NO: 1189883 - DNA, 14 bp, Homo sapiens
cttgagcggagccc

SEQ ID NO: 1189884 - DNA, 13 bp, Homo sapiens
cttgagctcagga

SEQ ID NO: 1189885 - DNA, 13 bp, Homo sapiens
cttgagctctgta

SEQ ID NO: 1189886 - DNA, 16 bp, Homo sapiens
cttgagctctgtaact

SEQ ID NO: 1189887 - DNA, 23 bp, Homo sapiens
cttgagctctgtaacttacacct

SEQ ID NO: 1189888 - DNA, 13 bp, Homo sapiens
cttgagctgagat

SEQ ID NO: 1189889 - DNA, 12 bp, Homo sapiens
cttgagctggcc

SEQ ID NO: 1189890 - DNA, 23 bp, Homo sapiens
cttgagctggcctctctagcaca

SEQ ID NO: 1189891 - DNA, 17 bp, Homo sapiens
cttgagcttaaacagaa

SEQ ID NO: 1189892 - DNA, 20 bp, Homo sapiens
cttgagcttggcagctgaac

SEQ ID NO: 1189893 - DNA, 21 bp, Homo sapiens
cttgagcttggcagctgaact

SEQ ID NO: 1189894 - DNA, 18 bp, Homo sapiens
cttgaggaagcccaggct

SEQ ID NO: 1189895 - DNA, 19 bp, Homo sapiens
cttgaggaagcccaggctc

SEQ ID NO: 1189896 - DNA, 22 bp, Homo sapiens
cttgaggagtgtgagaatcaaa

SEQ ID NO: 1189897 - DNA, 17 bp, Homo sapiens
cttgaggattgtggaaa

SEQ ID NO: 1189898 - DNA, 12 bp, Homo sapiens
cttgagggaggg

SEQ ID NO: 1189899 - DNA, 16 bp, Homo sapiens
cttgagggcccagagc

SEQ ID NO: 1189900 - DNA, 18 bp, Homo sapiens
cttgagggcccagagcag

SEQ ID NO: 1189901 - DNA, 12 bp, Homo sapiens
cttgagggctgc

SEQ ID NO: 1189902 - DNA, 13 bp, Homo sapiens
cttgagggctgca

SEQ ID NO: 1189903 - DNA, 14 bp, Homo sapiens
cttgagggctgcag

SEQ ID NO: 1189904 - DNA, 12 bp, Homo sapiens
cttgaggggaag

SEQ ID NO: 1189905 - DNA, 14 bp, Homo sapiens
cttgaggggaagct

SEQ ID NO: 1189906 - DNA, 23 bp, Homo sapiens
cttgaggggaagctagtcttttg

SEQ ID NO: 1189907 - DNA, 13 bp, Homo sapiens
cttgagggtgggc

SEQ ID NO: 1189908 - DNA, 17 bp, Homo sapiens
cttgagggtgggccagc

SEQ ID NO: 1189909 - DNA, 16 bp, Homo sapiens
cttgaggtcaggagtt

SEQ ID NO: 1189910 - DNA, 22 bp, Homo sapiens
cttgaggtcttttgacatgtgg

SEQ ID NO: 1189911 - DNA, 17 bp, Homo sapiens
cttgaggtgaatttcat

SEQ ID NO: 1189912 - DNA, 17 bp, Homo sapiens
cttgagtcagaaaacag

SEQ ID NO: 1189913 - DNA, 23 bp, Homo sapiens
cttgagtcagaaaacagagaaag

SEQ ID NO: 1189914 - DNA, 22 bp, Homo sapiens
cttgagtgagaagagcttgcac

SEQ ID NO: 1189915 - DNA, 23 bp, Homo sapiens
cttgagtggggttatctctgtgt

SEQ ID NO: 1189916 - DNA, 13 bp, Homo sapiens
cttgagtgttcct

SEQ ID NO: 1189917 - DNA, 21 bp, Homo sapiens
cttgagtgttcctttttaaat

SEQ ID NO: 1189918 - DNA, 17 bp, Homo sapiens
cttgagttcccagatgg

SEQ ID NO: 1189919 - DNA, 16 bp, Homo sapiens
cttgagttcctctgca

SEQ ID NO: 1189920 - DNA, 18 bp, Homo sapiens
cttgagttggagtactat

SEQ ID NO: 1189921 - DNA, 21 bp, Homo sapiens
cttgagttggagtactatatt

SEQ ID NO: 1189922 - DNA, 16 bp, Homo sapiens
cttgagttttatttat

SEQ ID NO: 1189923 - DNA, 21 bp, Homo sapiens
cttgagttttgataaagtaat

SEQ ID NO: 1189924 - DNA, 14 bp, Homo sapiens
cttgataaatatat

SEQ ID NO: 1189925 - DNA, 18 bp, Homo sapiens
cttgataaatatatatga

SEQ ID NO: 1189926 - DNA, 22 bp, Homo sapiens
cttgataaatatatatgatcat

SEQ ID NO: 1189927 - DNA, 21 bp, Homo sapiens
cttgataatattagtgattct

SEQ ID NO: 1189928 - DNA, 15 bp, Homo sapiens
cttgatacattcaaa

SEQ ID NO: 1189929 - DNA, 18 bp, Homo sapiens
cttgatacattcaaattt

SEQ ID NO: 1189930 - DNA, 19 bp, Homo sapiens
cttgatacccccctctgtc

SEQ ID NO: 1189931 - DNA, 19 bp, Homo sapiens
gtggttgctgttttcctcc

SEQ ID NO: 1189932 - DNA, 13 bp, Homo sapiens
gtggttgtgcctt

SEQ ID NO: 1189933 - DNA, 16 bp, Homo sapiens
gtggttgtgccttttg

SEQ ID NO: 1189934 - DNA, 15 bp, Homo sapiens
gtggtttcagaaatg

SEQ ID NO: 1189935 - DNA, 16 bp, Homo sapiens
gtggtttcagaaatgt

SEQ ID NO: 1189936 - DNA, 14 bp, Homo sapiens
gtggtttcatgtta

SEQ ID NO: 1189937 - DNA, 14 bp, Homo sapiens
gtggtttccctgcc

SEQ ID NO: 1189938 - DNA, 16 bp, Homo sapiens
gtggtttcggaaaaaa

SEQ ID NO: 1189939 - DNA, 13 bp, Homo sapiens
gtggtttgacagc

SEQ ID NO: 1189940 - DNA, 16 bp, Homo sapiens
gtggtttgagacactg

SEQ ID NO: 1189941 - DNA, 16 bp, Homo sapiens
gtggtttgcttgctct

SEQ ID NO: 1189942 - DNA, 20 bp, Homo sapiens
gtggttttatactgaaggaa

SEQ ID NO: 1189943 - DNA, 20 bp, Homo sapiens
gtggttttcagagcaggagg

SEQ ID NO: 1189944 - DNA, 21 bp, Homo sapiens
gtggttttcagagcaggaggc

SEQ ID NO: 1189945 - DNA, 16 bp, Homo sapiens
gtggttttttccccct

SEQ ID NO: 1189946 - DNA, 16 bp, Homo sapiens
gtgtaaaaaatggaaa

SEQ ID NO: 1189947 - DNA, 20 bp, Homo sapiens
gtgtaaaaaatggaaaaaaa

SEQ ID NO: 1189948 - DNA, 13 bp, Homo sapiens
gtgtaaaaaggaa

SEQ ID NO: 1189949 - DNA, 15 bp, Homo sapiens
gtgtaaaatgtatat

SEQ ID NO: 1189950 - DNA, 15 bp, Homo sapiens
gtgtaaaccaaagcc

SEQ ID NO: 1189951 - DNA, 22 bp, Homo sapiens
gtgtaaaccaaagccctaaaat

SEQ ID NO: 1189952 - DNA, 19 bp, Homo sapiens
gtgtaaataatttgcactg

SEQ ID NO: 1189953 - DNA, 13 bp, Homo sapiens
gtgtaaatagaag

SEQ ID NO: 1189954 - DNA, 19 bp, Homo sapiens
gtgtaacaattgtgtagcc

SEQ ID NO: 1189955 - DNA, 21 bp, Homo sapiens
gtgtaacagctgaggtctctt

SEQ ID NO: 1189956 - DNA, 17 bp, Homo sapiens
gtgtaacaggtctcctc

SEQ ID NO: 1189957 - DNA, 23 bp, Homo sapiens
gtgtaacctcagtatttatgtaa

SEQ ID NO: 1189958 - DNA, 14 bp, Homo sapiens
gtgtaacttcctgc

SEQ ID NO: 1189959 - DNA, 17 bp, Homo sapiens
gtgtaacttcctgctgc

SEQ ID NO: 1189960 - DNA, 19 bp, Homo sapiens
gtgtaacttcctgctgcac

SEQ ID NO: 1189961 - DNA, 19 bp, Homo sapiens
gtgtaactttaaacatcta

SEQ ID NO: 1189962 - DNA, 20 bp, Homo sapiens
gtgtaagaacaatgccaggg

SEQ ID NO: 1189963 - DNA, 13 bp, Homo sapiens
gtgtaagaactgt

SEQ ID NO: 1189964 - DNA, 17 bp, Homo sapiens
gtgtaagaactgtacat

SEQ ID NO: 1189965 - DNA, 21 bp, Homo sapiens
gtgtaagatttgtttttaaac

SEQ ID NO: 1189966 - DNA, 14 bp, Homo sapiens
gtgtaattatcatg

SEQ ID NO: 1189967 - DNA, 20 bp, Homo sapiens
gtgtacagcacagaatgagt

SEQ ID NO: 1189968 - DNA, 12 bp, Homo sapiens
gtgtacaggtac

SEQ ID NO: 1189969 - DNA, 13 bp, Homo sapiens
gtgtacagtcttg

SEQ ID NO: 1189970 - DNA, 20 bp, Homo sapiens
gtgtacagtgaattgtcttt

SEQ ID NO: 1189971 - DNA, 14 bp, Homo sapiens
gtgtacatcatgtt

SEQ ID NO: 1189972 - DNA, 17 bp, Homo sapiens
gtgtaccatttgcctcc

SEQ ID NO: 1189973 - DNA, 22 bp, Homo sapiens
gtgtaccctggggcaatagggt

SEQ ID NO: 1189974 - DNA, 21 bp, Homo sapiens
gtgtacctcctctcagtgttt

SEQ ID NO: 1189975 - DNA, 18 bp, Homo sapiens
gtgtactcactgaagcct

SEQ ID NO: 1189976 - DNA, 20 bp, Homo sapiens
gtgtactgggttaatggcta

SEQ ID NO: 1189977 - DNA, 14 bp, Homo sapiens
gtgtactgtaaaga

SEQ ID NO: 1189978 - DNA, 19 bp, Homo sapiens
gtgtacttcccgggccagg

SEQ ID NO: 1189979 - DNA, 23 bp, Homo sapiens
gtgtacttcccgggccagggctg

SEQ ID NO: 1189980 - DNA, 19 bp, Homo sapiens
gtgtagacctgagctggga

SEQ ID NO: 1189981 - DNA, 18 bp, Homo sapiens
gtgtagactgtaactttt

SEQ ID NO: 1189982 - DNA, 18 bp, Homo sapiens
gtgtagatgtagcattgt

SEQ ID NO: 1189983 - DNA, 15 bp, Homo sapiens
gtgtagatttgaaaa

SEQ ID NO: 1189984 - DNA, 16 bp, Homo sapiens
gtgtagcatcttcctc

SEQ ID NO: 1189985 - DNA, 15 bp, Homo sapiens
gtgtagccgccctga

SEQ ID NO: 1189986 - DNA, 16 bp, Homo sapiens
gtgtagccgccctgag

SEQ ID NO: 1189987 - DNA, 22 bp, Homo sapiens
gtgtagcctaaagggcagggcc

SEQ ID NO: 1189988 - DNA, 16 bp, Homo sapiens
gtgtagccttctcccc

SEQ ID NO: 1189989 - DNA, 12 bp, Homo sapiens
gtgtagcctttt

SEQ ID NO: 1189990 - DNA, 14 bp, Homo sapiens
gtgtagcgggagga

SEQ ID NO: 1189991 - DNA, 13 bp, Homo sapiens
gtgtagctgagct

SEQ ID NO: 1189992 - DNA, 23 bp, Homo sapiens
gtgtagctgcaaaaataatcatg

SEQ ID NO: 1189993 - DNA, 16 bp, Homo sapiens
gtgtagctgtaagggc

SEQ ID NO: 1189994 - DNA, 18 bp, Homo sapiens
gtgtagctgtaagggcag

SEQ ID NO: 1189995 - DNA, 13 bp, Homo sapiens
gtgtaggcagaca

SEQ ID NO: 1189996 - DNA, 16 bp, Homo sapiens
gtgtaggggccacctc

SEQ ID NO: 1189997 - DNA, 18 bp, Homo sapiens
gtgtaggggccacctcct

SEQ ID NO: 1189998 - DNA, 20 bp, Homo sapiens
gtgtaggggccacctcctcc

SEQ ID NO: 1189999 - DNA, 22 bp, Homo sapiens
gtgtaggttatctttttaaaaa

SEQ ID NO: 1190000 - DNA, 20 bp, Homo sapiens
gtgtagtggaagagcagcct

SEQ ID NO: 1190001 - DNA, 16 bp, Homo sapiens
gtgtataaactgctgt

SEQ ID NO: 1190002 - DNA, 14 bp, Homo sapiens
gtgtatacatgcca

SEQ ID NO: 1190003 - DNA, 17 bp, Homo sapiens
gtgtatataattttatg

SEQ ID NO: 1190004 - DNA, 22 bp, Homo sapiens
cttgcataataagctaaagagg

SEQ ID NO: 1190005 - DNA, 15 bp, Homo sapiens
cttgcatacatatat

SEQ ID NO: 1190006 - DNA, 21 bp, Homo sapiens
cttgcataggctcttaagcag

SEQ ID NO: 1190007 - DNA, 17 bp, Homo sapiens
cttgcatccattgttgt

SEQ ID NO: 1190008 - DNA, 13 bp, Homo sapiens
cttgcatctaatg

SEQ ID NO: 1190009 - DNA, 16 bp, Homo sapiens
cttgcatctaatgaaa

SEQ ID NO: 1190010 - DNA, 21 bp, Homo sapiens
cttgcatgtacttgaaggatg

SEQ ID NO: 1190011 - DNA, 14 bp, Homo sapiens
cttgcattcccagt

SEQ ID NO: 1190012 - DNA, 16 bp, Homo sapiens
cttgcattcccagtgg

SEQ ID NO: 1190013 - DNA, 22 bp, Homo sapiens
cttgcatttctgactttatcct

SEQ ID NO: 1190014 - DNA, 21 bp, Homo sapiens
cttgccaaaatgttggctgcg

SEQ ID NO: 1190015 - DNA, 14 bp, Homo sapiens
cttgccaaggcaga

SEQ ID NO: 1190016 - DNA, 23 bp, Homo sapiens
cttgccaatgaggtctgaaatgg

SEQ ID NO: 1190017 - DNA, 13 bp, Homo sapiens
cttgccacacccc

SEQ ID NO: 1190018 - DNA, 16 bp, Homo sapiens
cttgccacactcttct

SEQ ID NO: 1190019 - DNA, 18 bp, Homo sapiens
cttgccacggtttatcct

SEQ ID NO: 1190020 - DNA, 15 bp, Homo sapiens
cttgccactgcactc

SEQ ID NO: 1190021 - DNA, 17 bp, Homo sapiens
cttgccactgcactcca

SEQ ID NO: 1190022 - DNA, 15 bp, Homo sapiens
cttgccactgcctct

SEQ ID NO: 1190023 - DNA, 17 bp, Homo sapiens
cttgccagcctccttgc

SEQ ID NO: 1190024 - DNA, 18 bp, Homo sapiens
cttgccagcctccttgct

SEQ ID NO: 1190025 - DNA, 16 bp, Homo sapiens
cttgccaggctccctt

SEQ ID NO: 1190026 - DNA, 11 bp, Homo sapiens
cttgccatcac

SEQ ID NO: 1190027 - DNA, 13 bp, Homo sapiens
cttgccatcactg

SEQ ID NO: 1190028 - DNA, 12 bp, Homo sapiens
cttgccatcctg

SEQ ID NO: 1190029 - DNA, 15 bp, Homo sapiens
cttgccatcctgatg

SEQ ID NO: 1190030 - DNA, 23 bp, Homo sapiens
cttgccatgcaggaagaggccca

SEQ ID NO: 1190031 - DNA, 17 bp, Homo sapiens
cttgccattccaaaata

SEQ ID NO: 1190032 - DNA, 18 bp, Homo sapiens
cttgccatttgtagcttt

SEQ ID NO: 1190033 - DNA, 16 bp, Homo sapiens
cttgcccacaggtgcg

SEQ ID NO: 1190034 - DNA, 21 bp, Homo sapiens
cttgcccactggccgctgagc

SEQ ID NO: 1190035 - DNA, 17 bp, Homo sapiens
cttgcccagactacagg

SEQ ID NO: 1190036 - DNA, 19 bp, Homo sapiens
cttgcccagagatgcctcc

SEQ ID NO: 1190037 - DNA, 22 bp, Homo sapiens
cttgcccagagatgcctccacc

SEQ ID NO: 1190038 - DNA, 13 bp, Homo sapiens
cttgcccagcagc

SEQ ID NO: 1190039 - DNA, 16 bp, Homo sapiens
cttgcccagcagctca

SEQ ID NO: 1190040 - DNA, 14 bp, Homo sapiens
cttgcccagggctc

SEQ ID NO: 1190041 - DNA, 16 bp, Homo sapiens
cttgcccagggctcag

SEQ ID NO: 1190042 - DNA, 23 bp, Homo sapiens
cttgcccagggctcagcctggtg

SEQ ID NO: 1190043 - DNA, 19 bp, Homo sapiens
cttgcccagggtgcagtgt

SEQ ID NO: 1190044 - DNA, 21 bp, Homo sapiens
cttgcccagggtgcagtgtga

SEQ ID NO: 1190045 - DNA, 14 bp, Homo sapiens
cttgcccatcagcc

SEQ ID NO: 1190046 - DNA, 12 bp, Homo sapiens
cttgcccatcct

SEQ ID NO: 1190047 - DNA, 13 bp, Homo sapiens
cttgcccatcctg

SEQ ID NO: 1190048 - DNA, 17 bp, Homo sapiens
cttgccccactctgcct

SEQ ID NO: 1190049 - DNA, 20 bp, Homo sapiens
cttgccccaggactctggca

SEQ ID NO: 1190050 - DNA, 13 bp, Homo sapiens
cttgccccaggcc

SEQ ID NO: 1190051 - DNA, 14 bp, Homo sapiens
cttgccccatcact

SEQ ID NO: 1190052 - DNA, 16 bp, Homo sapiens
cttgcccccatccctc

SEQ ID NO: 1190053 - DNA, 14 bp, Homo sapiens
cttgccccccaccc

SEQ ID NO: 1190054 - DNA, 15 bp, Homo sapiens
cttgccccccacccc

SEQ ID NO: 1190055 - DNA, 19 bp, Homo sapiens
cttgccccccaccccagcc

SEQ ID NO: 1190056 - DNA, 19 bp, Homo sapiens
cttgccccccgccctcatg

SEQ ID NO: 1190057 - DNA, 12 bp, Homo sapiens
cttgccccttgt

SEQ ID NO: 1190058 - DNA, 21 bp, Homo sapiens
cttgccccttgtcctgaagcc

SEQ ID NO: 1190059 - DNA, 22 bp, Homo sapiens
cttgcccgcacccctccctgct

SEQ ID NO: 1190060 - DNA, 12 bp, Homo sapiens
gtgtcatggctg

SEQ ID NO: 1190061 - DNA, 17 bp, Homo sapiens
gtgtcattctgcctgct

SEQ ID NO: 1190062 - DNA, 18 bp, Homo sapiens
gtgtcatttatgaaaaga

SEQ ID NO: 1190063 - DNA, 19 bp, Homo sapiens
gtgtcatttccggctgctg

SEQ ID NO: 1190064 - DNA, 23 bp, Homo sapiens
gtgtccaagggccgtgcccttgc

SEQ ID NO: 1190065 - DNA, 17 bp, Homo sapiens
gtgtccaagtgtgtgtg

SEQ ID NO: 1190066 - DNA, 15 bp, Homo sapiens
gtgtccagcagctgc

SEQ ID NO: 1190067 - DNA, 13 bp, Homo sapiens
gtgtccagcttcc

SEQ ID NO: 1190068 - DNA, 17 bp, Homo sapiens
gtgtccagcttccaaag

SEQ ID NO: 1190069 - DNA, 19 bp, Homo sapiens
gtgtccagcttccaaagcc

SEQ ID NO: 1190070 - DNA, 22 bp, Homo sapiens
gtgtccagcttccaaagcctag

SEQ ID NO: 1190071 - DNA, 21 bp, Homo sapiens
gtgtccatgcgctcagggcca

SEQ ID NO: 1190072 - DNA, 15 bp, Homo sapiens
gtgtccatgtgtgtg

SEQ ID NO: 1190073 - DNA, 13 bp, Homo sapiens
gtgtccattttgc

SEQ ID NO: 1190074 - DNA, 15 bp, Homo sapiens
gtgtcccaaggagct

SEQ ID NO: 1190075 - DNA, 21 bp, Homo sapiens
gtgtcccatgacccacccctg

SEQ ID NO: 1190076 - DNA, 23 bp, Homo sapiens
gtgtcccatgacccacccctgtg

SEQ ID NO: 1190077 - DNA, 19 bp, Homo sapiens
gtgtcccattggtgttgtc

SEQ ID NO: 1190078 - DNA, 14 bp, Homo sapiens
gtgtccccaacgtc

SEQ ID NO: 1190079 - DNA, 21 bp, Homo sapiens
gtgtccccaacgtcccctccg

SEQ ID NO: 1190080 - DNA, 20 bp, Homo sapiens
gtgtcccccccaggccttgt

SEQ ID NO: 1190081 - DNA, 22 bp, Homo sapiens
gtgtccccccttgaagcaataa

SEQ ID NO: 1190082 - DNA, 13 bp, Homo sapiens
gtgtcccctcact

SEQ ID NO: 1190083 - DNA, 20 bp, Homo sapiens
gtgtcccctcactctgtcag

SEQ ID NO: 1190084 - DNA, 13 bp, Homo sapiens
gtgtcccctccac

SEQ ID NO: 1190085 - DNA, 20 bp, Homo sapiens
gtgtcccctccactgtcaca

SEQ ID NO: 1190086 - DNA, 18 bp, Homo sapiens
gtgtcccctgacagggcc

SEQ ID NO: 1190087 - DNA, 20 bp, Homo sapiens
gtgtcccctgacctgtccag

SEQ ID NO: 1190088 - DNA, 12 bp, Homo sapiens
gtgtccgagagg

SEQ ID NO: 1190089 - DNA, 21 bp, Homo sapiens
gtgtccgccatccagggtctg

SEQ ID NO: 1190090 - DNA, 15 bp, Homo sapiens
gtgtcctaaaaatgg

SEQ ID NO: 1190091 - DNA, 15 bp, Homo sapiens
gtgtcctaaatgcaa

SEQ ID NO: 1190092 - DNA, 15 bp, Homo sapiens
gtgtcctcacggtgc

SEQ ID NO: 1190093 - DNA, 16 bp, Homo sapiens
gtgtcctccaggagct

SEQ ID NO: 1190094 - DNA, 21 bp, Homo sapiens
gtgtcctctgcctgggctctg

SEQ ID NO: 1190095 - DNA, 17 bp, Homo sapiens
gtgtcctctgtgcccac

SEQ ID NO: 1190096 - DNA, 13 bp, Homo sapiens
gtgtcctgcctgt

SEQ ID NO: 1190097 - DNA, 20 bp, Homo sapiens
gtgtcctgcctgtctgcccc

SEQ ID NO: 1190098 - DNA, 15 bp, Homo sapiens
gtgtccttccctgca

SEQ ID NO: 1190099 - DNA, 20 bp, Homo sapiens
gtgtccttgaactgaggccc

SEQ ID NO: 1190100 - DNA, 21 bp, Homo sapiens
gtgtccttgaactgaggccct

SEQ ID NO: 1190101 - DNA, 22 bp, Homo sapiens
gtgtccttgaactgaggccctg

SEQ ID NO: 1190102 - DNA, 17 bp, Homo sapiens
gtgtcgagtcaaaatgt

SEQ ID NO: 1190103 - DNA, 12 bp, Homo sapiens
gtgtctcagcct

SEQ ID NO: 1190104 - DNA, 23 bp, Homo sapiens
gtgtctcagggtgcagaggtcag

SEQ ID NO: 1190105 - DNA, 13 bp, Homo sapiens
gtgtctcccaaca

SEQ ID NO: 1190106 - DNA, 21 bp, Homo sapiens
gtgtctcggagggattcccct

SEQ ID NO: 1190107 - DNA, 14 bp, Homo sapiens
gtgtctctcccacc

SEQ ID NO: 1190108 - DNA, 20 bp, Homo sapiens
gtgtctctcccaccccggcc

SEQ ID NO: 1190109 - DNA, 14 bp, Homo sapiens
gtgtctctgggcct

SEQ ID NO: 1190110 - DNA, 18 bp, Homo sapiens
gtgtctctgggcctgtgt

SEQ ID NO: 1190111 - DNA, 14 bp, Homo sapiens
gtgtctctgtctct

SEQ ID NO: 1190112 - DNA, 15 bp, Homo sapiens
gtgtctctgtttcct

SEQ ID NO: 1190113 - DNA, 17 bp, Homo sapiens
gtgtctctgtttcctga

SEQ ID NO: 1190114 - DNA, 22 bp, Homo sapiens
gtgtctcttttatgttcagctt

SEQ ID NO: 1190115 - DNA, 19 bp, Homo sapiens
gtgtctcttttctctttct

SEQ ID NO: 1190116 - DNA, 20 bp, Homo sapiens
gtgtctgcattgttattgtg

SEQ ID NO: 1190117 - DNA, 15 bp, Homo sapiens
gtgtctgctaatgta

SEQ ID NO: 1190118 - DNA, 21 bp, Homo sapiens
gtgtctgctttaaagggcctg

SEQ ID NO: 1190119 - DNA, 22 bp, Homo sapiens
gtgtctggagacctggatttga

SEQ ID NO: 1190120 - DNA, 20 bp, Homo sapiens
gtgtctggatcagtaaaatt

SEQ ID NO: 1190121 - DNA, 16 bp, Homo sapiens
gtgtctgggagagcct

SEQ ID NO: 1190122 - DNA, 20 bp, Homo sapiens
gtgtctgggagagcctggca

SEQ ID NO: 1190123 - DNA, 21 bp, Homo sapiens
gtgtctggtttctgtccccgg

SEQ ID NO: 1190124 - DNA, 13 bp, Homo sapiens
gtgtctgtcacag

SEQ ID NO: 1190125 - DNA, 19 bp, Homo sapiens
gtgtctgtcacaggctggg

SEQ ID NO: 1190126 - DNA, 16 bp, Homo sapiens
cttgctcagtgcctcc

SEQ ID NO: 1190127 - DNA, 17 bp, Homo sapiens
cttgctcagtgcctcct

SEQ ID NO: 1190128 - DNA, 19 bp, Homo sapiens
cttgctcagtgcctcctgg

SEQ ID NO: 1190129 - DNA, 20 bp, Homo sapiens
cttgctcagtgcctcctggc

SEQ ID NO: 1190130 - DNA, 16 bp, Homo sapiens
cttgctcattcttgag

SEQ ID NO: 1190131 - DNA, 15 bp, Homo sapiens
cttgctccagattct

SEQ ID NO: 1190132 - DNA, 16 bp, Homo sapiens
cttgctccagattctg

SEQ ID NO: 1190133 - DNA, 17 bp, Homo sapiens
cttgctccagattctga

SEQ ID NO: 1190134 - DNA, 20 bp, Homo sapiens
cttgctcctagcagacagaa

SEQ ID NO: 1190135 - DNA, 23 bp, Homo sapiens
cttgctcctagcagacagaaact

SEQ ID NO: 1190136 - DNA, 15 bp, Homo sapiens
cttgctcctggggag

SEQ ID NO: 1190137 - DNA, 20 bp, Homo sapiens
cttgctctccctcttctcaa

SEQ ID NO: 1190138 - DNA, 13 bp, Homo sapiens
cttgctctctctc

SEQ ID NO: 1190139 - DNA, 22 bp, Homo sapiens
cttgctctctctccctgccttt

SEQ ID NO: 1190140 - DNA, 20 bp, Homo sapiens
cttgctctttctactctgaa

SEQ ID NO: 1190141 - DNA, 15 bp, Homo sapiens
cttgctgaccccagg

SEQ ID NO: 1190142 - DNA, 19 bp, Homo sapiens
cttgctgaccccaggtcag

SEQ ID NO: 1190143 - DNA, 12 bp, Homo sapiens
cttgctgagggg

SEQ ID NO: 1190144 - DNA, 17 bp, Homo sapiens
cttgctgaggggcaggg

SEQ ID NO: 1190145 - DNA, 22 bp, Homo sapiens
cttgctgaggggcagggagagc

SEQ ID NO: 1190146 - DNA, 16 bp, Homo sapiens
cttgctgatgctcctc

SEQ ID NO: 1190147 - DNA, 15 bp, Homo sapiens
cttgctgatggctgc

SEQ ID NO: 1190148 - DNA, 14 bp, Homo sapiens
cttgctgcaggccc

SEQ ID NO: 1190149 - DNA, 16 bp, Homo sapiens
cttgctgcaggccctc

SEQ ID NO: 1190150 - DNA, 18 bp, Homo sapiens
cttgctgcaggccctccc

SEQ ID NO: 1190151 - DNA, 13 bp, Homo sapiens
cttgctgctgtct

SEQ ID NO: 1190152 - DNA, 14 bp, Homo sapiens
cttgctgctgtgcc

SEQ ID NO: 1190153 - DNA, 15 bp, Homo sapiens
cttgctgctgtgcct

SEQ ID NO: 1190154 - DNA, 11 bp, Homo sapiens
cttgctgcttt

SEQ ID NO: 1190155 - DNA, 19 bp, Homo sapiens
cttgctgctttagtcccga

SEQ ID NO: 1190156 - DNA, 12 bp, Homo sapiens
cttgctggcccc

SEQ ID NO: 1190157 - DNA, 18 bp, Homo sapiens
cttgctggccccagccct

SEQ ID NO: 1190158 - DNA, 12 bp, Homo sapiens
cttgctggctct

SEQ ID NO: 1190159 - DNA, 16 bp, Homo sapiens
cttgctggctctgaga

SEQ ID NO: 1190160 - DNA, 14 bp, Homo sapiens
cttgctgggccagg

SEQ ID NO: 1190161 - DNA, 15 bp, Homo sapiens
cttgctgggccaggg

SEQ ID NO: 1190162 - DNA, 20 bp, Homo sapiens
cttgctggggtccagggctg

SEQ ID NO: 1190163 - DNA, 23 bp, Homo sapiens
cttgctggggtccagggctgttg

SEQ ID NO: 1190164 - DNA, 11 bp, Homo sapiens
cttgctgggta

SEQ ID NO: 1190165 - DNA, 19 bp, Homo sapiens
cttgctgtatgctgatcat

SEQ ID NO: 1190166 - DNA, 18 bp, Homo sapiens
cttgctgtccaggcagct

SEQ ID NO: 1190167 - DNA, 22 bp, Homo sapiens
cttgctgtccaggcagctccct

SEQ ID NO: 1190168 - DNA, 14 bp, Homo sapiens
cttgctgtcctagg

SEQ ID NO: 1190169 - DNA, 20 bp, Homo sapiens
cttgctgtcctaggccacac

SEQ ID NO: 1190170 - DNA, 13 bp, Homo sapiens
cttgctgtcctga

SEQ ID NO: 1190171 - DNA, 18 bp, Homo sapiens
cttgctgtcctgatctgt

SEQ ID NO: 1190172 - DNA, 13 bp, Homo sapiens
cttgctgtctctg

SEQ ID NO: 1190173 - DNA, 22 bp, Homo sapiens
cttgctgtgtgaccctgggcaa

SEQ ID NO: 1190174 - DNA, 14 bp, Homo sapiens
cttgctgttcagtg

SEQ ID NO: 1190175 - DNA, 18 bp, Homo sapiens
cttgctgttcagtgcttt

SEQ ID NO: 1190176 - DNA, 20 bp, Homo sapiens
cttgctgttgacatatttaa

SEQ ID NO: 1190177 - DNA, 18 bp, Homo sapiens
cttgctgttttgttctgt

SEQ ID NO: 1190178 - DNA, 22 bp, Homo sapiens
cttgcttaaatttcttatgtga

SEQ ID NO: 1190179 - DNA, 17 bp, Homo sapiens
cttgcttacatcctctg

SEQ ID NO: 1190180 - DNA, 15 bp, Homo sapiens
cttgcttacctctca

SEQ ID NO: 1190181 - DNA, 20 bp, Homo sapiens
cttgcttagagtgcccagca

SEQ ID NO: 1190182 - DNA, 19 bp, Homo sapiens
cttgcttctaaatgcccag

SEQ ID NO: 1190183 - DNA, 20 bp, Homo sapiens
cttgcttctcccatttcctg

SEQ ID NO: 1190184 - DNA, 23 bp, Homo sapiens
cttgcttctcccatttcctgatc

SEQ ID NO: 1190185 - DNA, 20 bp, Homo sapiens
cttgcttcttactgataatt

SEQ ID NO: 1190186 - DNA, 13 bp, Homo sapiens
cttgcttgaggga

SEQ ID NO: 1190187 - DNA, 19 bp, Homo sapiens
cttgcttgccgagcctaat

SEQ ID NO: 1190188 - DNA, 13 bp, Homo sapiens
tattggttcttcc

SEQ ID NO: 1190189 - DNA, 18 bp, Homo sapiens
tattgtaaaacattcaca

SEQ ID NO: 1190190 - DNA, 21 bp, Homo sapiens
tattgtaaactttttcaatgg

SEQ ID NO: 1190191 - DNA, 16 bp, Homo sapiens
tattgtaaatactgga

SEQ ID NO: 1190192 - DNA, 18 bp, Homo sapiens
tattgtaaatactggact

SEQ ID NO: 1190193 - DNA, 11 bp, Homo sapiens
tattgtaagaa

SEQ ID NO: 1190194 - DNA, 19 bp, Homo sapiens
tattgtaagaaatactgta

SEQ ID NO: 1190195 - DNA, 11 bp, Homo sapiens
tattgtaatat

SEQ ID NO: 1190196 - DNA, 14 bp, Homo sapiens
tattgtacaaatgt

SEQ ID NO: 1190197 - DNA, 15 bp, Homo sapiens
tattgtacagactgt

SEQ ID NO: 1190198 - DNA, 20 bp, Homo sapiens
tattgtacagctgtttaaga

SEQ ID NO: 1190199 - DNA, 11 bp, Homo sapiens
tattgtacagt

SEQ ID NO: 1190200 - DNA, 15 bp, Homo sapiens
tattgtacagttttt

SEQ ID NO: 1190201 - DNA, 13 bp, Homo sapiens
tattgtaccattt

SEQ ID NO: 1190202 - DNA, 11 bp, Homo sapiens
tattgtacctc

SEQ ID NO: 1190203 - DNA, 15 bp, Homo sapiens
tattgtagcatttct

SEQ ID NO: 1190204 - DNA, 13 bp, Homo sapiens
tattgtataaaaa

SEQ ID NO: 1190205 - DNA, 14 bp, Homo sapiens
tattgtatattctg

SEQ ID NO: 1190206 - DNA, 17 bp, Homo sapiens
tattgtatattctggaa

SEQ ID NO: 1190207 - DNA, 12 bp, Homo sapiens
tattgtatgtaa

SEQ ID NO: 1190208 - DNA, 17 bp, Homo sapiens
tattgtattgttagatg

SEQ ID NO: 1190209 - DNA, 18 bp, Homo sapiens
tattgtattgttagatgt

SEQ ID NO: 1190210 - DNA, 19 bp, Homo sapiens
tattgtcagaaaagtgatt

SEQ ID NO: 1190211 - DNA, 16 bp, Homo sapiens
tattgtcagatatttt

SEQ ID NO: 1190212 - DNA, 14 bp, Homo sapiens
tattgtcagccatc

SEQ ID NO: 1190213 - DNA, 11 bp, Homo sapiens
tattgtcatct

SEQ ID NO: 1190214 - DNA, 15 bp, Homo sapiens
tattgtccattgtcc

SEQ ID NO: 1190215 - DNA, 13 bp, Homo sapiens
tattgtctactct

SEQ ID NO: 1190216 - DNA, 16 bp, Homo sapiens
tattgtctactctgaa

SEQ ID NO: 1190217 - DNA, 16 bp, Homo sapiens
tattgtctgtaaatct

SEQ ID NO: 1190218 - DNA, 22 bp, Homo sapiens
tattgtctgtaaatctaacatt

SEQ ID NO: 1190219 - DNA, 22 bp, Homo sapiens
tattgtgaatatttggaattga

SEQ ID NO: 1190220 - DNA, 22 bp, Homo sapiens
tattgtgagttttctatttcac

SEQ ID NO: 1190221 - DNA, 19 bp, Homo sapiens
tattgtggaataaatcctt

SEQ ID NO: 1190222 - DNA, 16 bp, Homo sapiens
tattgtggatgtgttc

SEQ ID NO: 1190223 - DNA, 17 bp, Homo sapiens
tattgtgttgactttat

SEQ ID NO: 1190224 - DNA, 22 bp, Homo sapiens
tattgtgttgactttataaatt

SEQ ID NO: 1190225 - DNA, 16 bp, Homo sapiens
tattgttaaattacat

SEQ ID NO: 1190226 - DNA, 18 bp, Homo sapiens
tattgttaatggttctta

SEQ ID NO: 1190227 - DNA, 16 bp, Homo sapiens
tattgttagaaaatga

SEQ ID NO: 1190228 - DNA, 14 bp, Homo sapiens
tattgttagatgtt

SEQ ID NO: 1190229 - DNA, 15 bp, Homo sapiens
tattgttataaataa

SEQ ID NO: 1190230 - DNA, 18 bp, Homo sapiens
tattgttctaatgcaaca

SEQ ID NO: 1190231 - DNA, 14 bp, Homo sapiens
tattgttgaaaaag

SEQ ID NO: 1190232 - DNA, 13 bp, Homo sapiens
tattgttgccttt

SEQ ID NO: 1190233 - DNA, 13 bp, Homo sapiens
tattgttgtcctt

SEQ ID NO: 1190234 - DNA, 18 bp, Homo sapiens
tattgttgtccttttcat

SEQ ID NO: 1190235 - DNA, 22 bp, Homo sapiens
tattgttgtccttttcataggt

SEQ ID NO: 1190236 - DNA, 13 bp, Homo sapiens
tattgttgttact

SEQ ID NO: 1190237 - DNA, 16 bp, Homo sapiens
tattgtttaaaattca

SEQ ID NO: 1190238 - DNA, 20 bp, Homo sapiens
tattgtttaaaattcagttt

SEQ ID NO: 1190239 - DNA, 14 bp, Homo sapiens
tattgtttccctcg

SEQ ID NO: 1190240 - DNA, 13 bp, Homo sapiens
tattgtttctgca

SEQ ID NO: 1190241 - DNA, 17 bp, Homo sapiens
tattgtttgatgttttt

SEQ ID NO: 1190242 - DNA, 14 bp, Homo sapiens
tattgttttacaat

SEQ ID NO: 1190243 - DNA, 17 bp, Homo sapiens
tattgttttacaatagt

SEQ ID NO: 1190244 - DNA, 20 bp, Homo sapiens
tattgttttacaatagttct

SEQ ID NO: 1190245 - DNA, 22 bp, Homo sapiens
tattgttttacaatagttctgt

SEQ ID NO: 1190246 - DNA, 18 bp, Homo sapiens
tattgttttctgtaaata

SEQ ID NO: 1190247 - DNA, 15 bp, Homo sapiens
tattgtttttatttc

SEQ ID NO: 1190248 - DNA, 22 bp, Homo sapiens
tattgtttttccttgtatttaa

SEQ ID NO: 1190249 - DNA, 14 bp, Homo sapiens
tatttaaaaaatta

SEQ ID NO: 1190250 - DNA, 23 bp, Homo sapiens
tatttaaaaacaaaaagcaacag

SEQ ID NO: 1190251 - DNA, 16 bp, Homo sapiens
tatttaaaaatgtctt

SEQ ID NO: 1190252 - DNA, 21 bp, Homo sapiens
tatttaaaaattgtttcttga

SEQ ID NO: 1190253 - DNA, 13 bp, Homo sapiens
tatttaaaacttg

SEQ ID NO: 1190254 - DNA, 15 bp, Homo sapiens
tatttaaaatagcaa

SEQ ID NO: 1190255 - DNA, 15 bp, Homo sapiens
tatttaaaccttttt

SEQ ID NO: 1190256 - DNA, 21 bp, Homo sapiens
tatttaaacctttttcttgat

SEQ ID NO: 1190257 - DNA, 12 bp, Homo sapiens
tatttaaactat

SEQ ID NO: 1190258 - DNA, 18 bp, Homo sapiens
tatttaaagacaaagaca

SEQ ID NO: 1190259 - DNA, 14 bp, Homo sapiens
tatttaaagacagg

SEQ ID NO: 1190260 - DNA, 22 bp, Homo sapiens
tatttaaagacagggaagagca

SEQ ID NO: 1190261 - DNA, 20 bp, Homo sapiens
tatttaaatgcatgtcttaa

SEQ ID NO: 1190262 - DNA, 18 bp, Homo sapiens
tatttaaatgtgaatttc

SEQ ID NO: 1190263 - DNA, 15 bp, Homo sapiens
tatttaacaagatct

SEQ ID NO: 1190264 - DNA, 12 bp, Homo sapiens
tatttaacagaa

SEQ ID NO: 1190265 - DNA, 13 bp, Homo sapiens
tatttaacagaaa

SEQ ID NO: 1190266 - DNA, 19 bp, Homo sapiens
tatttaacagaaattgtat

SEQ ID NO: 1190267 - DNA, 15 bp, Homo sapiens
tatttaacagctgaa

SEQ ID NO: 1190268 - DNA, 23 bp, Homo sapiens
tatttaacagctgaattatctat

SEQ ID NO: 1190269 - DNA, 16 bp, Homo sapiens
gatggagagaggggaa

SEQ ID NO: 1190270 - DNA, 15 bp, Homo sapiens
gatggagaggcggcc

SEQ ID NO: 1190271 - DNA, 12 bp, Homo sapiens
gatggagcccat

SEQ ID NO: 1190272 - DNA, 18 bp, Homo sapiens
gatggagcccccagatag

SEQ ID NO: 1190273 - DNA, 22 bp, Homo sapiens
gatggagcgcacctgccccctg

SEQ ID NO: 1190274 - DNA, 15 bp, Homo sapiens
gatggaggaaaaagg

SEQ ID NO: 1190275 - DNA, 19 bp, Homo sapiens
gatggaggactccaggcag

SEQ ID NO: 1190276 - DNA, 13 bp, Homo sapiens
gatggaggagaag

SEQ ID NO: 1190277 - DNA, 15 bp, Homo sapiens
gatggaggccagagt

SEQ ID NO: 1190278 - DNA, 16 bp, Homo sapiens
gatggaggccagagtc

SEQ ID NO: 1190279 - DNA, 21 bp, Homo sapiens
gatggaggggtggtcctgact

SEQ ID NO: 1190280 - DNA, 22 bp, Homo sapiens
gatggaggggtggtcctgactc

SEQ ID NO: 1190281 - DNA, 14 bp, Homo sapiens
gatggagtgtgcag

SEQ ID NO: 1190282 - DNA, 17 bp, Homo sapiens
gatggataaactgagcc

SEQ ID NO: 1190283 - DNA, 18 bp, Homo sapiens
gatggataaactgagcct

SEQ ID NO: 1190284 - DNA, 19 bp, Homo sapiens
gatggatatatgtttttga

SEQ ID NO: 1190285 - DNA, 16 bp, Homo sapiens
gatggatcaccattat

SEQ ID NO: 1190286 - DNA, 17 bp, Homo sapiens
gatggatgcatcacact

SEQ ID NO: 1190287 - DNA, 16 bp, Homo sapiens
gatggatggcacaatg

SEQ ID NO: 1190288 - DNA, 21 bp, Homo sapiens
gatggattcccccccctttcc

SEQ ID NO: 1190289 - DNA, 16 bp, Homo sapiens
gatggattctcagata

SEQ ID NO: 1190290 - DNA, 22 bp, Homo sapiens
gatggatttccagccaaagcct

SEQ ID NO: 1190291 - DNA, 19 bp, Homo sapiens
gatggcaaaaaaaaaaaag

SEQ ID NO: 1190292 - DNA, 23 bp, Homo sapiens
gatggcacaatgaatgtatattt

SEQ ID NO: 1190293 - DNA, 21 bp, Homo sapiens
gatggcacttagctatcagaa

SEQ ID NO: 1190294 - DNA, 13 bp, Homo sapiens
gatggcagactct

SEQ ID NO: 1190295 - DNA, 19 bp, Homo sapiens
gatggcagactctttaata

SEQ ID NO: 1190296 - DNA, 13 bp, Homo sapiens
gatggcagagcca

SEQ ID NO: 1190297 - DNA, 23 bp, Homo sapiens
gatggcagagccaggctgttgga

SEQ ID NO: 1190298 - DNA, 15 bp, Homo sapiens
gatggcatcctgtga

SEQ ID NO: 1190299 - DNA, 21 bp, Homo sapiens
gatggcatcctgtgaagtcct

SEQ ID NO: 1190300 - DNA, 20 bp, Homo sapiens
gatggcatttggtctcaggc

SEQ ID NO: 1190301 - DNA, 23 bp, Homo sapiens
gatggcatttggtctcaggcagc

SEQ ID NO: 1190302 - DNA, 24 bp, Homo sapiens
gatggcatttggtctcaggcagca

SEQ ID NO: 1190303 - DNA, 14 bp, Homo sapiens
gatggccaagagca

SEQ ID NO: 1190304 - DNA, 18 bp, Homo sapiens
gatggccaagggggtgga

SEQ ID NO: 1190305 - DNA, 22 bp, Homo sapiens
gatggccaagggggtggacgca

SEQ ID NO: 1190306 - DNA, 14 bp, Homo sapiens
gatggccagcccct

SEQ ID NO: 1190307 - DNA, 14 bp, Homo sapiens
gatggcccaaggga

SEQ ID NO: 1190308 - DNA, 17 bp, Homo sapiens
gatggcccaagggatgg

SEQ ID NO: 1190309 - DNA, 14 bp, Homo sapiens
gatggcccagcagg

SEQ ID NO: 1190310 - DNA, 23 bp, Homo sapiens
gatggccccaacaagcaccccgc

SEQ ID NO: 1190311 - DNA, 21 bp, Homo sapiens
gatgtctctggggcagatccc

SEQ ID NO: 1190312 - DNA, 17 bp, Homo sapiens
gatgtctcttgtagaag

SEQ ID NO: 1190313 - DNA, 22 bp, Homo sapiens
gatgtctgtgagtacctggtca

SEQ ID NO: 1190314 - DNA, 17 bp, Homo sapiens
gatgtcttccctgggct

SEQ ID NO: 1190315 - DNA, 13 bp, Homo sapiens
gatgtcttctgcc

SEQ ID NO: 1190316 - DNA, 20 bp, Homo sapiens
gatgtcttctgcctgttata

SEQ ID NO: 1190317 - DNA, 13 bp, Homo sapiens
gatgtcttggaac

SEQ ID NO: 1190318 - DNA, 23 bp, Homo sapiens
gatgtctttttattaaaatattt

SEQ ID NO: 1190319 - DNA, 21 bp, Homo sapiens
gatgtgaagataatttgcata

SEQ ID NO: 1190320 - DNA, 14 bp, Homo sapiens
gatgtgaagccaat

SEQ ID NO: 1190321 - DNA, 23 bp, Homo sapiens
gatgtgaagccaattcagacagg

SEQ ID NO: 1190322 - DNA, 21 bp, Homo sapiens
gatgtgaagctcacactgatg

SEQ ID NO: 1190323 - DNA, 21 bp, Homo sapiens
gatgtgaatactcttcccaca

SEQ ID NO: 1190324 - DNA, 18 bp, Homo sapiens
gatgtgaattattgacac

SEQ ID NO: 1190325 - DNA, 20 bp, Homo sapiens
gatgtgaattattgacactg

SEQ ID NO: 1190326 - DNA, 15 bp, Homo sapiens
gatgtgacattccat

SEQ ID NO: 1190327 - DNA, 12 bp, Homo sapiens
gatgtgactttt

SEQ ID NO: 1190328 - DNA, 13 bp, Homo sapiens
gatgtgacttttt

SEQ ID NO: 1190329 - DNA, 21 bp, Homo sapiens
gatgtgagccaccgtgcctgg

SEQ ID NO: 1190330 - DNA, 23 bp, Homo sapiens
gatgtgagccaccgtgcctggcc

SEQ ID NO: 1190331 - DNA, 21 bp, Homo sapiens
gatgtgagtcctgttgaagac

SEQ ID NO: 1190332 - DNA, 16 bp, Homo sapiens
gatgtgcaacctgtgg

SEQ ID NO: 1190333 - DNA, 23 bp, Homo sapiens
gatgtgcaacctgtggctcaggg

SEQ ID NO: 1190334 - DNA, 19 bp, Homo sapiens
gatgtgcaagcgacgacag

SEQ ID NO: 1190335 - DNA, 11 bp, Homo sapiens
gatgtgcattc

SEQ ID NO: 1190336 - DNA, 20 bp, Homo sapiens
gatgtgccattttaaaaaaa

SEQ ID NO: 1190337 - DNA, 18 bp, Homo sapiens
gatgtgccctagatcaac

SEQ ID NO: 1190338 - DNA, 19 bp, Homo sapiens
gatgtgctataatctgttt

SEQ ID NO: 1190339 - DNA, 12 bp, Homo sapiens
gatgtgctcagc

SEQ ID NO: 1190340 - DNA, 15 bp, Homo sapiens
gatgtgctcagccaa

SEQ ID NO: 1190341 - DNA, 17 bp, Homo sapiens
gatgtggaacctgttta

SEQ ID NO: 1190342 - DNA, 19 bp, Homo sapiens
gatgtggaatgcagtcctc

SEQ ID NO: 1190343 - DNA, 19 bp, Homo sapiens
gatgtggacgtcacgctcc

SEQ ID NO: 1190344 - DNA, 20 bp, Homo sapiens
gatgtggaggaagagccacc

SEQ ID NO: 1190345 - DNA, 19 bp, Homo sapiens
gatgtggatccctttagaa

SEQ ID NO: 1190346 - DNA, 12 bp, Homo sapiens
gatgtggccctg

SEQ ID NO: 1190347 - DNA, 13 bp, Homo sapiens
gatgtggccctgg

SEQ ID NO: 1190348 - DNA, 20 bp, Homo sapiens
gatgtggccctggcctgctg

SEQ ID NO: 1190349 - DNA, 21 bp, Homo sapiens
gatgtggccctggcctgctgg

SEQ ID NO: 1190350 - DNA, 21 bp, Homo sapiens
gatgtggcttctggctcctcg

SEQ ID NO: 1190351 - DNA, 14 bp, Homo sapiens
gatgtgggcagctt

SEQ ID NO: 1190352 - DNA, 20 bp, Homo sapiens
gatgtggtaggtgataaaga

SEQ ID NO: 1190353 - DNA, 15 bp, Homo sapiens
gatgtgtatcagtgt

SEQ ID NO: 1190354 - DNA, 18 bp, Homo sapiens
gatgtgtcctcagggagc

SEQ ID NO: 1190355 - DNA, 14 bp, Homo sapiens
gatgtgtctgggag

SEQ ID NO: 1190356 - DNA, 15 bp, Homo sapiens
gatgtgtctgggaga

SEQ ID NO: 1190357 - DNA, 17 bp, Homo sapiens
gatgtgtctgggagagc

SEQ ID NO: 1190358 - DNA, 21 bp, Homo sapiens
gatgtgtctgggagagcctgg

SEQ ID NO: 1190359 - DNA, 17 bp, Homo sapiens
gatgtgtcttcaatttg

SEQ ID NO: 1190360 - DNA, 20 bp, Homo sapiens
gatgtgttcattcaagctat

SEQ ID NO: 1190361 - DNA, 21 bp, Homo sapiens
gatgtgttcctccattttctt

SEQ ID NO: 1190362 - DNA, 12 bp, Homo sapiens
gatgtgttgtga

SEQ ID NO: 1190363 - DNA, 14 bp, Homo sapiens
gatgtgttgtgata

SEQ ID NO: 1190364 - DNA, 16 bp, Homo sapiens
gatgtgttttgcacgt

SEQ ID NO: 1190365 - DNA, 17 bp, Homo sapiens
gatgttaaaataaatgg

SEQ ID NO: 1190366 - DNA, 20 bp, Homo sapiens
gatgttaacaagaggggaaa

SEQ ID NO: 1190367 - DNA, 14 bp, Homo sapiens
gatgttaaccagaa

SEQ ID NO: 1190368 - DNA, 20 bp, Homo sapiens
gatgttacatcacagtgttt

SEQ ID NO: 1190369 - DNA, 21 bp, Homo sapiens
gatgttagcagacccagctta

SEQ ID NO: 1190370 - DNA, 14 bp, Homo sapiens
gatgttatgaacag

SEQ ID NO: 1190371 - DNA, 18 bp, Homo sapiens
gatgttatgaacagctgt

SEQ ID NO: 1190372 - DNA, 23 bp, Homo sapiens
gatgttatgaacagctgtgtctg

SEQ ID NO: 1190373 - DNA, 14 bp, Homo sapiens
gatgttcagagtgg

SEQ ID NO: 1190374 - DNA, 16 bp, Homo sapiens
gatgttcagagtggct

SEQ ID NO: 1190375 - DNA, 18 bp, Homo sapiens
gatgttcagagtggctca

SEQ ID NO: 1190376 - DNA, 17 bp, Homo sapiens
gatgttcagcactgtcc

SEQ ID NO: 1190377 - DNA, 21 bp, Homo sapiens
gatgttcatttttaaagcctg

SEQ ID NO: 1190378 - DNA, 18 bp, Homo sapiens
gatgttccacctgccaca

SEQ ID NO: 1190379 - DNA, 16 bp, Homo sapiens
gatgttccagtgagga

SEQ ID NO: 1190380 - DNA, 22 bp, Homo sapiens
gatgttccttaccaaggatttt

SEQ ID NO: 1190381 - DNA, 21 bp, Homo sapiens
gatgttctgcctctccctggg

SEQ ID NO: 1190382 - DNA, 22 bp, Homo sapiens
gatgttctgcctctccctgggt

SEQ ID NO: 1190383 - DNA, 19 bp, Homo sapiens
gatgttgaaatatgcatac

SEQ ID NO: 1190384 - DNA, 13 bp, Homo sapiens
gatgttgaactgg

SEQ ID NO: 1190385 - DNA, 13 bp, Homo sapiens
gatgttgaacttt

SEQ ID NO: 1190386 - DNA, 16 bp, Homo sapiens
gatgttgaggggagga

SEQ ID NO: 1190387 - DNA, 18 bp, Homo sapiens
gatgttgaggggaggagg

SEQ ID NO: 1190388 - DNA, 19 bp, Homo sapiens
gatgttgcttctgaatcac

SEQ ID NO: 1190389 - DNA, 15 bp, Homo sapiens
gatgttgtaaataaa

SEQ ID NO: 1190390 - DNA, 16 bp, Homo sapiens
gatgttgtgtattgtg

SEQ ID NO: 1190391 - DNA, 14 bp, Homo sapiens
gatgtttaacaaat

SEQ ID NO: 1190392 - DNA, 16 bp, Homo sapiens
gatgtttacatggcgc

SEQ ID NO: 1190393 - DNA, 12 bp, Homo sapiens
gatgtttataaa

SEQ ID NO: 1190394 - DNA, 13 bp, Homo sapiens
gatgtttcatttt

SEQ ID NO: 1190395 - DNA, 13 bp, Homo sapiens
gatgtttccagac

SEQ ID NO: 1190396 - DNA, 21 bp, Homo sapiens
gatgtttcgagtaaacttgaa

SEQ ID NO: 1190397 - DNA, 20 bp, Homo sapiens
gatgtttcttttgtatgtaa

SEQ ID NO: 1190398 - DNA, 17 bp, Homo sapiens
tatttcccttccaaaga

SEQ ID NO: 1190399 - DNA, 15 bp, Homo sapiens
tatttcctaaggcat

SEQ ID NO: 1190400 - DNA, 15 bp, Homo sapiens
tatttcctcttggta

SEQ ID NO: 1190401 - DNA, 15 bp, Homo sapiens
tatttcctgaaataa

SEQ ID NO: 1190402 - DNA, 18 bp, Homo sapiens
tatttcctgaaataaatg

SEQ ID NO: 1190403 - DNA, 11 bp, Homo sapiens
tatttcctgac

SEQ ID NO: 1190404 - DNA, 15 bp, Homo sapiens
tatttcctgacttga

SEQ ID NO: 1190405 - DNA, 21 bp, Homo sapiens
tatttcctgacttgagtgttc

SEQ ID NO: 1190406 - DNA, 12 bp, Homo sapiens
tatttcctgcta

SEQ ID NO: 1190407 - DNA, 11 bp, Homo sapiens
tatttccttta

SEQ ID NO: 1190408 - DNA, 14 bp, Homo sapiens
tatttcctttatgt

SEQ ID NO: 1190409 - DNA, 16 bp, Homo sapiens
tatttcctttatgtga

SEQ ID NO: 1190410 - DNA, 17 bp, Homo sapiens
tatttcgctatagattt

SEQ ID NO: 1190411 - DNA, 15 bp, Homo sapiens
tatttctaagtattt

SEQ ID NO: 1190412 - DNA, 16 bp, Homo sapiens
tatttctaagtattta

SEQ ID NO: 1190413 - DNA, 17 bp, Homo sapiens
tatttctaagtatttaa

SEQ ID NO: 1190414 - DNA, 17 bp, Homo sapiens
tatttctagcagagtga

SEQ ID NO: 1190415 - DNA, 17 bp, Homo sapiens
tatttctagctttttaa

SEQ ID NO: 1190416 - DNA, 17 bp, Homo sapiens
tatttctagtccaaaat

SEQ ID NO: 1190417 - DNA, 16 bp, Homo sapiens
tatttctatgagaaaa

SEQ ID NO: 1190418 - DNA, 15 bp, Homo sapiens
tatttctatgtaaat

SEQ ID NO: 1190419 - DNA, 22 bp, Homo sapiens
tatttctatgtaaattattgta

SEQ ID NO: 1190420 - DNA, 14 bp, Homo sapiens
tatttctatgtcat

SEQ ID NO: 1190421 - DNA, 21 bp, Homo sapiens
tatttctattattaattgcaa

SEQ ID NO: 1190422 - DNA, 14 bp, Homo sapiens
tatttctattcctt

SEQ ID NO: 1190423 - DNA, 21 bp, Homo sapiens
tatttctctatgtttattcta

SEQ ID NO: 1190424 - DNA, 13 bp, Homo sapiens
tatttctctcccc

SEQ ID NO: 1190425 - DNA, 19 bp, Homo sapiens
tatttctctggcaaacttt

SEQ ID NO: 1190426 - DNA, 14 bp, Homo sapiens
tatttctctgtgta

SEQ ID NO: 1190427 - DNA, 21 bp, Homo sapiens
tatttctctgtgtatttatat

SEQ ID NO: 1190428 - DNA, 21 bp, Homo sapiens
tatttctgagaaggtccttaa

SEQ ID NO: 1190429 - DNA, 13 bp, Homo sapiens
tatttctgatcta

SEQ ID NO: 1190430 - DNA, 21 bp, Homo sapiens
tatttctgatttcataattca

SEQ ID NO: 1190431 - DNA, 17 bp, Homo sapiens
tatttctgggtcttttg

SEQ ID NO: 1190432 - DNA, 18 bp, Homo sapiens
tatttctgggtcttttgc

SEQ ID NO: 1190433 - DNA, 17 bp, Homo sapiens
tattttgaaaaagagaa

SEQ ID NO: 1190434 - DNA, 21 bp, Homo sapiens
tattttgatacaaatgtttat

SEQ ID NO: 1190435 - DNA, 17 bp, Homo sapiens
tattttgatgtaaagat

SEQ ID NO: 1190436 - DNA, 20 bp, Homo sapiens
tattttgctccctctgttag

SEQ ID NO: 1190437 - DNA, 16 bp, Homo sapiens
tattttgctttggtta

SEQ ID NO: 1190438 - DNA, 13 bp, Homo sapiens
tattttggaaact

SEQ ID NO: 1190439 - DNA, 16 bp, Homo sapiens
tattttggaaactgct

SEQ ID NO: 1190440 - DNA, 17 bp, Homo sapiens
tattttggcttcatttc

SEQ ID NO: 1190441 - DNA, 18 bp, Homo sapiens
tattttgggcctgttcct

SEQ ID NO: 1190442 - DNA, 20 bp, Homo sapiens
tattttgtaatattctgttt

SEQ ID NO: 1190443 - DNA, 10 bp, Homo sapiens
tattttgtat

SEQ ID NO: 1190444 - DNA, 15 bp, Homo sapiens
tattttgtatatatc

SEQ ID NO: 1190445 - DNA, 15 bp, Homo sapiens
tattttgtatgaaat

SEQ ID NO: 1190446 - DNA, 12 bp, Homo sapiens
tattttgtctaa

SEQ ID NO: 1190447 - DNA, 15 bp, Homo sapiens
tattttgtgtacaag

SEQ ID NO: 1190448 - DNA, 23 bp, Homo sapiens
tattttgtgtcctccaggagctt

SEQ ID NO: 1190449 - DNA, 21 bp, Homo sapiens
tattttgtgtgaccaactgtg

SEQ ID NO: 1190450 - DNA, 23 bp, Homo sapiens
tattttgtgtgaccaactgtgtt

SEQ ID NO: 1190451 - DNA, 16 bp, Homo sapiens
tattttgttgtgcact

SEQ ID NO: 1190452 - DNA, 17 bp, Homo sapiens
tattttgttttaatcta

SEQ ID NO: 1190453 - DNA, 19 bp, Homo sapiens
tatttttaaaaagaaatct

SEQ ID NO: 1190454 - DNA, 15 bp, Homo sapiens
tatttttaaaatatt

SEQ ID NO: 1190455 - DNA, 17 bp, Homo sapiens
tatttttaaaatattac

SEQ ID NO: 1190456 - DNA, 21 bp, Homo sapiens
tatttttaaaatatttaactt

SEQ ID NO: 1190457 - DNA, 15 bp, Homo sapiens
tatttttaaaggcat

SEQ ID NO: 1190458 - DNA, 19 bp, Homo sapiens
tatttttaactctggattt

SEQ ID NO: 1190459 - DNA, 16 bp, Homo sapiens
tatttttaagaaaaat

SEQ ID NO: 1190460 - DNA, 17 bp, Homo sapiens
tatttttaagaaaaatt

SEQ ID NO: 1190461 - DNA, 22 bp, Homo sapiens
tatttttaagaaaaattcacaa

SEQ ID NO: 1190462 - DNA, 13 bp, Homo sapiens
tatttttaatcag

SEQ ID NO: 1190463 - DNA, 17 bp, Homo sapiens
tatttttacctaaagac

SEQ ID NO: 1190464 - DNA, 24 bp, Homo sapiens
tatttttataattaaagatgccat

SEQ ID NO: 1190465 - DNA, 17 bp, Homo sapiens
tatttttatacaaacct

SEQ ID NO: 1190466 - DNA, 21 bp, Homo sapiens
tatttttatatttagttatag

SEQ ID NO: 1190467 - DNA, 12 bp, Homo sapiens
tatttttatctt

SEQ ID NO: 1190468 - DNA, 12 bp, Homo sapiens
tatttttattat

SEQ ID NO: 1190469 - DNA, 15 bp, Homo sapiens
tatttttcaaggaag

SEQ ID NO: 1190470 - DNA, 18 bp, Homo sapiens
tatttttcaataaagcat

SEQ ID NO: 1190471 - DNA, 14 bp, Homo sapiens
tatttttcagttcc

SEQ ID NO: 1190472 - DNA, 11 bp, Homo sapiens
tatttttcata

SEQ ID NO: 1190473 - DNA, 15 bp, Homo sapiens
tatttttcatattgt

SEQ ID NO: 1190474 - DNA, 13 bp, Homo sapiens
tatttttctaagt

SEQ ID NO: 1190475 - DNA, 20 bp, Homo sapiens
tatttttctaagtgtaacct

SEQ ID NO: 1190476 - DNA, 15 bp, Homo sapiens
tatttttctctttgt

SEQ ID NO: 1190477 - DNA, 14 bp, Homo sapiens
tatttttctgagat

SEQ ID NO: 1190478 - DNA, 14 bp, Homo sapiens
tatttttcttttcc

SEQ ID NO: 1190479 - DNA, 16 bp, Homo sapiens
tatttttcttttcctg

SEQ ID NO: 1190480 - DNA, 15 bp, Homo sapiens
tatttttctttttaa

SEQ ID NO: 1190481 - DNA, 18 bp, Homo sapiens
tatttttgaagtaaatta

SEQ ID NO: 1190482 - DNA, 22 bp, Homo sapiens
tatttttgaagtaaattaaaca

SEQ ID NO: 1190483 - DNA, 18 bp, Homo sapiens
tatttttgacatggaaat

SEQ ID NO: 1190484 - DNA, 18 bp, Homo sapiens
tatttttgctgcttctga

SEQ ID NO: 1190485 - DNA, 20 bp, Homo sapiens
tatttttggcagtctgaatt

SEQ ID NO: 1190486 - DNA, 15 bp, Homo sapiens
tatttttggggcatc

SEQ ID NO: 1190487 - DNA, 21 bp, Homo sapiens
tatttttgggtttggccaggg

SEQ ID NO: 1190488 - DNA, 15 bp, Homo sapiens
tatttttgtacttga

SEQ ID NO: 1190489 - DNA, 13 bp, Homo sapiens
tatttttgtcctt

SEQ ID NO: 1190490 - DNA, 14 bp, Homo sapiens
tatttttgtccttg

SEQ ID NO: 1190491 - DNA, 17 bp, Homo sapiens
tatttttgtctgcagct

SEQ ID NO: 1190492 - DNA, 21 bp, Homo sapiens
tatttttgtgttttcttgtaa

SEQ ID NO: 1190493 - DNA, 17 bp, Homo sapiens
tattttttaaaacacta

SEQ ID NO: 1190494 - DNA, 14 bp, Homo sapiens
tattttttaagaaa

SEQ ID NO: 1190495 - DNA, 15 bp, Homo sapiens
tattttttaattatt

SEQ ID NO: 1190496 - DNA, 16 bp, Homo sapiens
tattttttaatttgat

SEQ ID NO: 1190497 - DNA, 23 bp, Homo sapiens
tattttttaatttgatgaaagct

SEQ ID NO: 1190498 - DNA, 14 bp, Homo sapiens
tattttttataaat

SEQ ID NO: 1190499 - DNA, 11 bp, Homo sapiens
tattttttcaa

SEQ ID NO: 1190500 - DNA, 13 bp, Homo sapiens
tattttttcctta

SEQ ID NO: 1190501 - DNA, 14 bp, Homo sapiens
tattttttcctttt

SEQ ID NO: 1190502 - DNA, 19 bp, Homo sapiens
tattttttcttttctttac

SEQ ID NO: 1190503 - DNA, 14 bp, Homo sapiens
tattttttcttttg

SEQ ID NO: 1190504 - DNA, 21 bp, Homo sapiens
tattttttcttttgtaattgt

SEQ ID NO: 1190505 - DNA, 13 bp, Homo sapiens
tattttttgcaag

SEQ ID NO: 1190506 - DNA, 17 bp, Homo sapiens
tattttttgtataattg

SEQ ID NO: 1190507 - DNA, 17 bp, Homo sapiens
tatttttttcttttctt

SEQ ID NO: 1190508 - DNA, 20 bp, Homo sapiens
tattttttttggcctgtttg

SEQ ID NO: 1190509 - DNA, 16 bp, Homo sapiens
tatttttttttctaag

SEQ ID NO: 1190510 - DNA, 22 bp, Homo sapiens
tatttttttttctttttaaagt

SEQ ID NO: 1190511 - DNA, 19 bp, Homo sapiens
tcaaaaaaaaaaaaaaaga

SEQ ID NO: 1190512 - DNA, 21 bp, Homo sapiens
tcaaaaaaaagaaaatgtctt

SEQ ID NO: 1190513 - DNA, 14 bp, Homo sapiens
tcaaaaaaagaaaa

SEQ ID NO: 1190514 - DNA, 12 bp, Homo sapiens
tcaaaaaattat

SEQ ID NO: 1190515 - DNA, 13 bp, Homo sapiens
tcaaaaaattgca

SEQ ID NO: 1190516 - DNA, 17 bp, Homo sapiens
tcaaaaacaaagctgat

SEQ ID NO: 1190517 - DNA, 14 bp, Homo sapiens
tcaaaaagaaatca

SEQ ID NO: 1190518 - DNA, 16 bp, Homo sapiens
tcaaaaagcagagtgg

SEQ ID NO: 1190519 - DNA, 20 bp, Homo sapiens
tcaaaaagcagagtggactg

SEQ ID NO: 1190520 - DNA, 14 bp, Homo sapiens
tcaaaaagtgttta

SEQ ID NO: 1190521 - DNA, 15 bp, Homo sapiens
tcaaaaagtgtttat

SEQ ID NO: 1190522 - DNA, 16 bp, Homo sapiens
tcaaaaatataactta

SEQ ID NO: 1190523 - DNA, 20 bp, Homo sapiens
tcaaaaattatctatagcta

SEQ ID NO: 1190524 - DNA, 16 bp, Homo sapiens
tcaaaacaaaggccta

SEQ ID NO: 1190525 - DNA, 14 bp, Homo sapiens
tcaaaacactgtgg

SEQ ID NO: 1190526 - DNA, 22 bp, Homo sapiens
tcaaaacattgtgccatgtcaa

SEQ ID NO: 1190527 - DNA, 16 bp, Homo sapiens
tcaaaacctgcagtta

SEQ ID NO: 1190528 - DNA, 16 bp, Homo sapiens
tcaaaactacaaatca

SEQ ID NO: 1190529 - DNA, 19 bp, Homo sapiens
tcaaaagaatcagaaacag

SEQ ID NO: 1190530 - DNA, 17 bp, Homo sapiens
gattccactacacctgg

SEQ ID NO: 1190531 - DNA, 21 bp, Homo sapiens
gattccattccatggaaataa

SEQ ID NO: 1190532 - DNA, 18 bp, Homo sapiens
gattcccagaccttaaga

SEQ ID NO: 1190533 - DNA, 14 bp, Homo sapiens
gattcccagagaca

SEQ ID NO: 1190534 - DNA, 13 bp, Homo sapiens
gattcccccagcc

SEQ ID NO: 1190535 - DNA, 14 bp, Homo sapiens
gattcccctgtgtc

SEQ ID NO: 1190536 - DNA, 21 bp, Homo sapiens
gattccctcctgctactctgt

SEQ ID NO: 1190537 - DNA, 17 bp, Homo sapiens
gattcctacccctcttc

SEQ ID NO: 1190538 - DNA, 18 bp, Homo sapiens
gattcctacccctcttcc

SEQ ID NO: 1190539 - DNA, 21 bp, Homo sapiens
gattcctcgcgacatcttctc

SEQ ID NO: 1190540 - DNA, 22 bp, Homo sapiens
gattcctcttggcaagatgttt

SEQ ID NO: 1190541 - DNA, 12 bp, Homo sapiens
gattcctgaccc

SEQ ID NO: 1190542 - DNA, 17 bp, Homo sapiens
gattcctgacccaggcc

SEQ ID NO: 1190543 - DNA, 13 bp, Homo sapiens
gattcctgggcct

SEQ ID NO: 1190544 - DNA, 20 bp, Homo sapiens
gattcctggtttgactcagt

SEQ ID NO: 1190545 - DNA, 16 bp, Homo sapiens
gattcgaatgacactg

SEQ ID NO: 1190546 - DNA, 17 bp, Homo sapiens
gattcgggggctgacct

SEQ ID NO: 1190547 - DNA, 19 bp, Homo sapiens
gattctaatttttaagcaa

SEQ ID NO: 1190548 - DNA, 15 bp, Homo sapiens
gattctattatatat

SEQ ID NO: 1190549 - DNA, 15 bp, Homo sapiens
gattctatttatatg

SEQ ID NO: 1190550 - DNA, 21 bp, Homo sapiens
gattctatttatatgtacatg

SEQ ID NO: 1190551 - DNA, 14 bp, Homo sapiens
gattctcagggctg

SEQ ID NO: 1190552 - DNA, 15 bp, Homo sapiens
gattctcagggctgg

SEQ ID NO: 1190553 - DNA, 13 bp, Homo sapiens
gattctcataact

SEQ ID NO: 1190554 - DNA, 14 bp, Homo sapiens
gattctcctgcctc

SEQ ID NO: 1190555 - DNA, 20 bp, Homo sapiens
gattctcctgcctcagcctt

SEQ ID NO: 1190556 - DNA, 17 bp, Homo sapiens
tcaaattgctgcttgga

SEQ ID NO: 1190557 - DNA, 13 bp, Homo sapiens
tcaaattgtatct

SEQ ID NO: 1190558 - DNA, 22 bp, Homo sapiens
tcaaatttagaaactaattgac

SEQ ID NO: 1190559 - DNA, 20 bp, Homo sapiens
tcaaatttattttaatgtaa

SEQ ID NO: 1190560 - DNA, 23 bp, Homo sapiens
tcaaatttattttaatgtaaaga

SEQ ID NO: 1190561 - DNA, 18 bp, Homo sapiens
tcaaatttatttttttct

SEQ ID NO: 1190562 - DNA, 12 bp, Homo sapiens
tcaaatttcaca

SEQ ID NO: 1190563 - DNA, 23 bp, Homo sapiens
tcaaatttgccatgacatttcat

SEQ ID NO: 1190564 - DNA, 13 bp, Homo sapiens
tcaaatttgtaca

SEQ ID NO: 1190565 - DNA, 12 bp, Homo sapiens
tcaacaaacatt

SEQ ID NO: 1190566 - DNA, 14 bp, Homo sapiens
tcaacaaagaaaca

SEQ ID NO: 1190567 - DNA, 20 bp, Homo sapiens
tcaacaaagaaacaaagatg

SEQ ID NO: 1190568 - DNA, 21 bp, Homo sapiens
tcaacaaagaaacaaagatgt

SEQ ID NO: 1190569 - DNA, 14 bp, Homo sapiens
tcaacaaagcacag

SEQ ID NO: 1190570 - DNA, 18 bp, Homo sapiens
tcaacaaatattcactgg

SEQ ID NO: 1190571 - DNA, 21 bp, Homo sapiens
tcaacaactttgtgctttcct

SEQ ID NO: 1190572 - DNA, 15 bp, Homo sapiens
tcaacaagaagaatt

SEQ ID NO: 1190573 - DNA, 17 bp, Homo sapiens
tcaacaagaagaatttg

SEQ ID NO: 1190574 - DNA, 16 bp, Homo sapiens
tcaacaagggagagac

SEQ ID NO: 1190575 - DNA, 19 bp, Homo sapiens
tcaacaagggagagacctc

SEQ ID NO: 1190576 - DNA, 15 bp, Homo sapiens
tcaacaattctaaaa

SEQ ID NO: 1190577 - DNA, 18 bp, Homo sapiens
tcaacaatttcaataaaa

SEQ ID NO: 1190578 - DNA, 19 bp, Homo sapiens
tcaacacaggtagcacaga

SEQ ID NO: 1190579 - DNA, 17 bp, Homo sapiens
tcaacaccctgcttctc

SEQ ID NO: 1190580 - DNA, 21 bp, Homo sapiens
tcaacaccctgcttctcccgg

SEQ ID NO: 1190581 - DNA, 16 bp, Homo sapiens
tcaacactcttcttga

SEQ ID NO: 1190582 - DNA, 20 bp, Homo sapiens
tcaacagaagtatcaagcca

SEQ ID NO: 1190583 - DNA, 17 bp, Homo sapiens
tcaacagagaaggcagg

SEQ ID NO: 1190584 - DNA, 19 bp, Homo sapiens
tcaacagagaaggcaggaa

SEQ ID NO: 1190585 - DNA, 14 bp, Homo sapiens
tcaacagtaaacca

SEQ ID NO: 1190586 - DNA, 22 bp, Homo sapiens
tcaacagtaaaccactgaaaaa

SEQ ID NO: 1190587 - DNA, 17 bp, Homo sapiens
tcaacatcaatgttcat

SEQ ID NO: 1190588 - DNA, 18 bp, Homo sapiens
tcaacatcaatgttcatt

SEQ ID NO: 1190589 - DNA, 21 bp, Homo sapiens
tcaacatcaatgttcattgta

SEQ ID NO: 1190590 - DNA, 21 bp, Homo sapiens
tcaacatggcaattgcactca

SEQ ID NO: 1190591 - DNA, 16 bp, Homo sapiens
tcaacatgtgtttctg

SEQ ID NO: 1190592 - DNA, 14 bp, Homo sapiens
tcaacattctttgc

SEQ ID NO: 1190593 - DNA, 18 bp, Homo sapiens
tcaacatttttttttctc

SEQ ID NO: 1190594 - DNA, 16 bp, Homo sapiens
tcaaccaactgcacaa

SEQ ID NO: 1190595 - DNA, 23 bp, Homo sapiens
tcaaccactgtaaaatgaaatta

SEQ ID NO: 1190596 - DNA, 14 bp, Homo sapiens
tcaaccagcagatg

SEQ ID NO: 1190597 - DNA, 17 bp, Homo sapiens
tcaaccataaaagaagt

SEQ ID NO: 1190598 - DNA, 13 bp, Homo sapiens
tcaaccatcctgg

SEQ ID NO: 1190599 - DNA, 16 bp, Homo sapiens
tcaaccatcgctttat

SEQ ID NO: 1190600 - DNA, 17 bp, Homo sapiens
tcaacccaagctctggg

SEQ ID NO: 1190601 - DNA, 17 bp, Homo sapiens
tcaaccccagacactgg

SEQ ID NO: 1190602 - DNA, 18 bp, Homo sapiens
tcaaccccagacactggt

SEQ ID NO: 1190603 - DNA, 12 bp, Homo sapiens
tcaacccccctc

SEQ ID NO: 1190604 - DNA, 15 bp, Homo sapiens
tcaacccccctccca

SEQ ID NO: 1190605 - DNA, 20 bp, Homo sapiens
tcaacccccctcccagacag

SEQ ID NO: 1190606 - DNA, 15 bp, Homo sapiens
tcaaccgtacaatgg

SEQ ID NO: 1190607 - DNA, 13 bp, Homo sapiens
tcaacctcctgga

SEQ ID NO: 1190608 - DNA, 16 bp, Homo sapiens
tcaacctcctgggttc

SEQ ID NO: 1190609 - DNA, 18 bp, Homo sapiens
tcaacctgggcaaagcct

SEQ ID NO: 1190610 - DNA, 19 bp, Homo sapiens
tcaacctggtggcaccaga

SEQ ID NO: 1190611 - DNA, 23 bp, Homo sapiens
tcaacctttgtgtggctcctggt

SEQ ID NO: 1190612 - DNA, 15 bp, Homo sapiens
tcaacgcagccctgc

SEQ ID NO: 1190613 - DNA, 19 bp, Homo sapiens
tcaacgcctcactgaaaca

SEQ ID NO: 1190614 - DNA, 14 bp, Homo sapiens
tcaacgcctctcct

SEQ ID NO: 1190615 - DNA, 18 bp, Homo sapiens
tcaactaattttatttct

SEQ ID NO: 1190616 - DNA, 23 bp, Homo sapiens
tcaactaattttatttctatttt

SEQ ID NO: 1190617 - DNA, 21 bp, Homo sapiens
tcaactccctgccccccagcc

SEQ ID NO: 1190618 - DNA, 15 bp, Homo sapiens
tcaactcctggctcc

SEQ ID NO: 1190619 - DNA, 19 bp, Homo sapiens
tcaactcgggggcgcctgg

SEQ ID NO: 1190620 - DNA, 17 bp, Homo sapiens
tcaactctacccctgct

SEQ ID NO: 1190621 - DNA, 18 bp, Homo sapiens
tcaactctcactcctgaa

SEQ ID NO: 1190622 - DNA, 12 bp, Homo sapiens
tcaactctgaag

SEQ ID NO: 1190623 - DNA, 14 bp, Homo sapiens
tcaactctttgtta

SEQ ID NO: 1190624 - DNA, 16 bp, Homo sapiens
tcaactctttgttatt

SEQ ID NO: 1190625 - DNA, 22 bp, Homo sapiens
tcaactctttgttatttgaaaa

SEQ ID NO: 1190626 - DNA, 20 bp, Homo sapiens
tcaactgcctactccaaaat

SEQ ID NO: 1190627 - DNA, 13 bp, Homo sapiens
tcaacttaacatg

SEQ ID NO: 1190628 - DNA, 19 bp, Homo sapiens
tcaacttctggctcctcaa

SEQ ID NO: 1190629 - DNA, 19 bp, Homo sapiens
tcaactttggttcctgtga

SEQ ID NO: 1190630 - DNA, 14 bp, Homo sapiens
tcaacttttaactt

SEQ ID NO: 1190631 - DNA, 14 bp, Homo sapiens
tcaacttttgacaa

SEQ ID NO: 1190632 - DNA, 14 bp, Homo sapiens
tcaagaaaatcttt

SEQ ID NO: 1190633 - DNA, 23 bp, Homo sapiens
tcaagaaaatctttgttgaagtt

SEQ ID NO: 1190634 - DNA, 15 bp, Homo sapiens
tcaagaaacagccag

SEQ ID NO: 1190635 - DNA, 12 bp, Homo sapiens
tcaagaaactga

SEQ ID NO: 1190636 - DNA, 13 bp, Homo sapiens
tcaagaaactgag

SEQ ID NO: 1190637 - DNA, 20 bp, Homo sapiens
tcaagaaactgaggaatttt

SEQ ID NO: 1190638 - DNA, 23 bp, Homo sapiens
tcaagaaactgaggaattttctt

SEQ ID NO: 1190639 - DNA, 14 bp, Homo sapiens
tcaagaaaggaggg

SEQ ID NO: 1190640 - DNA, 15 bp, Homo sapiens
tcaagaaaggcccgg

SEQ ID NO: 1190641 - DNA, 17 bp, Homo sapiens
tcaagaaaggcccggaa

SEQ ID NO: 1190642 - DNA, 18 bp, Homo sapiens
tcaagaaatgtctctgct

SEQ ID NO: 1190643 - DNA, 18 bp, Homo sapiens
tcaagaagaaaaaggttt

SEQ ID NO: 1190644 - DNA, 15 bp, Homo sapiens
tcaagaagggctgca

SEQ ID NO: 1190645 - DNA, 19 bp, Homo sapiens
tcaagaagtcttgaagttg

SEQ ID NO: 1190646 - DNA, 11 bp, Homo sapiens
tcaagaataaa

SEQ ID NO: 1190647 - DNA, 20 bp, Homo sapiens
tcaagaatctagaagatgtg

SEQ ID NO: 1190648 - DNA, 14 bp, Homo sapiens
tcaagaatgaaaaa

SEQ ID NO: 1190649 - DNA, 15 bp, Homo sapiens
tcaagaatgaaaaat

SEQ ID NO: 1190650 - DNA, 15 bp, Homo sapiens
tcaagaccagcctgg

SEQ ID NO: 1190651 - DNA, 20 bp, Homo sapiens
tcaagaccagcctgggcaac

SEQ ID NO: 1190652 - DNA, 23 bp, Homo sapiens
tcaagacccccatttgtcccaga

SEQ ID NO: 1190653 - DNA, 18 bp, Homo sapiens
tcaagacctgagtatttt

SEQ ID NO: 1190654 - DNA, 15 bp, Homo sapiens
tcaagactatctaca

SEQ ID NO: 1190655 - DNA, 23 bp, Homo sapiens
tcaagactttgatccttggaaac

SEQ ID NO: 1190656 - DNA, 16 bp, Homo sapiens
tcaagagaaacttcaa

SEQ ID NO: 1190657 - DNA, 15 bp, Homo sapiens
tcaagagactgagtc

SEQ ID NO: 1190658 - DNA, 20 bp, Homo sapiens
tcaagagctagaaaaataaa

SEQ ID NO: 1190659 - DNA, 15 bp, Homo sapiens
tcaagaggaatctgt

SEQ ID NO: 1190660 - DNA, 23 bp, Homo sapiens
tcaagaggaatctgtttctctgc

SEQ ID NO: 1190661 - DNA, 16 bp, Homo sapiens
tcaagaggcagagttc

SEQ ID NO: 1190662 - DNA, 20 bp, Homo sapiens
tcaagagggcactggtggcc

SEQ ID NO: 1190663 - DNA, 19 bp, Homo sapiens
tcaagaggtgggagggccc

SEQ ID NO: 1190664 - DNA, 14 bp, Homo sapiens
gatttttggtattt

SEQ ID NO: 1190665 - DNA, 16 bp, Homo sapiens
gatttttggtatttat

SEQ ID NO: 1190666 - DNA, 20 bp, Homo sapiens
gatttttggtatttatgtaa

SEQ ID NO: 1190667 - DNA, 14 bp, Homo sapiens
gattttttaaaatt

SEQ ID NO: 1190668 - DNA, 21 bp, Homo sapiens
gattttttaaaattttggaat

SEQ ID NO: 1190669 - DNA, 18 bp, Homo sapiens
gattttttaattgtttaa

SEQ ID NO: 1190670 - DNA, 18 bp, Homo sapiens
gattttttattattattc

SEQ ID NO: 1190671 - DNA, 17 bp, Homo sapiens
gattttttcaaaaaagt

SEQ ID NO: 1190672 - DNA, 14 bp, Homo sapiens
gattttttcccttt

SEQ ID NO: 1190673 - DNA, 20 bp, Homo sapiens
gattttttccctttttatgt

SEQ ID NO: 1190674 - DNA, 18 bp, Homo sapiens
gattttttccttcaaagt

SEQ ID NO: 1190675 - DNA, 21 bp, Homo sapiens
gattttttttttaagtgacat

SEQ ID NO: 1190676 - DNA, 18 bp, Homo sapiens
gcaaaaaaaaaaaaaagc

SEQ ID NO: 1190677 - DNA, 18 bp, Homo sapiens
gcaaaaaaaaacttaaag

SEQ ID NO: 1190678 - DNA, 12 bp, Homo sapiens
tcaataaacagc

SEQ ID NO: 1190679 - DNA, 21 bp, Homo sapiens
tcaataaacagcttcatgcct

SEQ ID NO: 1190680 - DNA, 20 bp, Homo sapiens
tcaataaacttagaggaaaa

SEQ ID NO: 1190681 - DNA, 16 bp, Homo sapiens
tcaataaagaaaactt

SEQ ID NO: 1190682 - DNA, 15 bp, Homo sapiens
tcaataaagcagagc

SEQ ID NO: 1190683 - DNA, 16 bp, Homo sapiens
tcaataaagcagagcc

SEQ ID NO: 1190684 - DNA, 18 bp, Homo sapiens
tcaataaagcagagccaa

SEQ ID NO: 1190685 - DNA, 22 bp, Homo sapiens
tcaataaagcagagccaaggcc

SEQ ID NO: 1190686 - DNA, 23 bp, Homo sapiens
tcaataaagcagagccaaggcca

SEQ ID NO: 1190687 - DNA, 15 bp, Homo sapiens
tcaataaagcattta

SEQ ID NO: 1190688 - DNA, 18 bp, Homo sapiens
tcaataaatgacacccag

SEQ ID NO: 1190689 - DNA, 22 bp, Homo sapiens
tcaataaatgacacccagacct

SEQ ID NO: 1190690 - DNA, 23 bp, Homo sapiens
tcaataaatgtatcatttttgtg

SEQ ID NO: 1190691 - DNA, 13 bp, Homo sapiens
tcaataagaaggt

SEQ ID NO: 1190692 - DNA, 22 bp, Homo sapiens
tcaataagaaggtagaatgagt

SEQ ID NO: 1190693 - DNA, 15 bp, Homo sapiens
tcaataatatatttt

SEQ ID NO: 1190694 - DNA, 18 bp, Homo sapiens
tcaataatatattttctg

SEQ ID NO: 1190695 - DNA, 18 bp, Homo sapiens
tcaatacactagttgttt

SEQ ID NO: 1190696 - DNA, 13 bp, Homo sapiens
tcaatacagtgaa

SEQ ID NO: 1190697 - DNA, 15 bp, Homo sapiens
tcaataccgctcagt

SEQ ID NO: 1190698 - DNA, 18 bp, Homo sapiens
tcaataccgctcagtatt

SEQ ID NO: 1190699 - DNA, 20 bp, Homo sapiens
tcaataccgctcagtatttt

SEQ ID NO: 1190700 - DNA, 20 bp, Homo sapiens
tcaatactgagccatttata

SEQ ID NO: 1190701 - DNA, 23 bp, Homo sapiens
tcaatactgtatgccttctgtat

SEQ ID NO: 1190702 - DNA, 18 bp, Homo sapiens
tcaatacttgaatatgga

SEQ ID NO: 1190703 - DNA, 22 bp, Homo sapiens
tcaatacttgaatatggaacat

SEQ ID NO: 1190704 - DNA, 16 bp, Homo sapiens
tcaatagatctccagc

SEQ ID NO: 1190705 - DNA, 12 bp, Homo sapiens
tcaatagccact

SEQ ID NO: 1190706 - DNA, 13 bp, Homo sapiens
tcaatagccacta

SEQ ID NO: 1190707 - DNA, 22 bp, Homo sapiens
tcaatagccactaaccttgcct

SEQ ID NO: 1190708 - DNA, 22 bp, Homo sapiens
tcaataggaaagcatatgcagc

SEQ ID NO: 1190709 - DNA, 19 bp, Homo sapiens
tcaatagtaaaagataaca

SEQ ID NO: 1190710 - DNA, 13 bp, Homo sapiens
tcaatagttgaat

SEQ ID NO: 1190711 - DNA, 22 bp, Homo sapiens
tcaatatattgaacttttgtac

SEQ ID NO: 1190712 - DNA, 17 bp, Homo sapiens
tcaatatcccaacattc

SEQ ID NO: 1190713 - DNA, 18 bp, Homo sapiens
tcaatatccctcttgtaa

SEQ ID NO: 1190714 - DNA, 21 bp, Homo sapiens
tcaatatctaatatatatgaa

SEQ ID NO: 1190715 - DNA, 16 bp, Homo sapiens
tcaatattaaatacag

SEQ ID NO: 1190716 - DNA, 22 bp, Homo sapiens
tcaatattcctgaatgaaatat

SEQ ID NO: 1190717 - DNA, 19 bp, Homo sapiens
tcaatattgaatttttcct

SEQ ID NO: 1190718 - DNA, 16 bp, Homo sapiens
tcaatattgacatttg

SEQ ID NO: 1190719 - DNA, 20 bp, Homo sapiens
tcaatatttattattttcac

SEQ ID NO: 1190720 - DNA, 20 bp, Homo sapiens
tcaatatttttatttttaac

SEQ ID NO: 1190721 - DNA, 17 bp, Homo sapiens
tcaatcaactttactgt

SEQ ID NO: 1190722 - DNA, 18 bp, Homo sapiens
tcaatcaactttactgta

SEQ ID NO: 1190723 - DNA, 14 bp, Homo sapiens
tcaatcagccttta

SEQ ID NO: 1190724 - DNA, 14 bp, Homo sapiens
tcaatcagtgcagt

SEQ ID NO: 1190725 - DNA, 19 bp, Homo sapiens
tcaatcatctgtgtgaaaa

SEQ ID NO: 1190726 - DNA, 17 bp, Homo sapiens
tcaatccaggctacaat

SEQ ID NO: 1190727 - DNA, 16 bp, Homo sapiens
tcaatcccaattctgt

SEQ ID NO: 1190728 - DNA, 21 bp, Homo sapiens
tcaatcctaatttctcctccc

SEQ ID NO: 1190729 - DNA, 22 bp, Homo sapiens
tcaatcctaatttctcctccct

SEQ ID NO: 1190730 - DNA, 12 bp, Homo sapiens
tcaatcctggta

SEQ ID NO: 1190731 - DNA, 14 bp, Homo sapiens
tcaatcctggtaac

SEQ ID NO: 1190732 - DNA, 18 bp, Homo sapiens
tcaatctaaggccttccc

SEQ ID NO: 1190733 - DNA, 18 bp, Homo sapiens
tcaatctcccgctgctgc

SEQ ID NO: 1190734 - DNA, 11 bp, Homo sapiens
tcaatctctgt

SEQ ID NO: 1190735 - DNA, 21 bp, Homo sapiens
tcaatctgcagccattcttca

SEQ ID NO: 1190736 - DNA, 16 bp, Homo sapiens
tcaatctgtaaactgt

SEQ ID NO: 1190737 - DNA, 16 bp, Homo sapiens
tcaatctgtttttcat

SEQ ID NO: 1190738 - DNA, 11 bp, Homo sapiens
tcaatgaaaaa

SEQ ID NO: 1190739 - DNA, 22 bp, Homo sapiens
tcaatgaaaaatagtgtctttg

SEQ ID NO: 1190740 - DNA, 15 bp, Homo sapiens
tcaatgaagccagct

SEQ ID NO: 1190741 - DNA, 20 bp, Homo sapiens
tcaatgaccattcaattagt

SEQ ID NO: 1190742 - DNA, 21 bp, Homo sapiens
tcaatgatgttagcctgattt

SEQ ID NO: 1190743 - DNA, 22 bp, Homo sapiens
tcaatgcaagagtgattgcagc

SEQ ID NO: 1190744 - DNA, 18 bp, Homo sapiens
tcaatgcgttttgttgta

SEQ ID NO: 1190745 - DNA, 17 bp, Homo sapiens
tcaatgcttaggagaca

SEQ ID NO: 1190746 - DNA, 23 bp, Homo sapiens
tcaatggcctaaaactggcctga

SEQ ID NO: 1190747 - DNA, 14 bp, Homo sapiens
tcaatgggaaatac

SEQ ID NO: 1190748 - DNA, 22 bp, Homo sapiens
tcaatgggaaatactactcctg

SEQ ID NO: 1190749 - DNA, 17 bp, Homo sapiens
tcaatgggcaatgacag

SEQ ID NO: 1190750 - DNA, 20 bp, Homo sapiens
tcaatggttgggacaatggc

SEQ ID NO: 1190751 - DNA, 17 bp, Homo sapiens
tcaatgtacttgtttga

SEQ ID NO: 1190752 - DNA, 19 bp, Homo sapiens
tcaatgtacttgtttgaat

SEQ ID NO: 1190753 - DNA, 14 bp, Homo sapiens
tcaatgtcagcctt

SEQ ID NO: 1190754 - DNA, 21 bp, Homo sapiens
tcaatgtgattctaatgtctt

SEQ ID NO: 1190755 - DNA, 13 bp, Homo sapiens
tcaatgtgcagtg

SEQ ID NO: 1190756 - DNA, 17 bp, Homo sapiens
tcaatgtgtataaattg

SEQ ID NO: 1190757 - DNA, 16 bp, Homo sapiens
tcaatgtgtctttcta

SEQ ID NO: 1190758 - DNA, 22 bp, Homo sapiens
tcaatgtttatgcaaggaagga

SEQ ID NO: 1190759 - DNA, 23 bp, Homo sapiens
tcaatgtttatgcaaggaaggaa

SEQ ID NO: 1190760 - DNA, 20 bp, Homo sapiens
tcaattaaacagctggtcct

SEQ ID NO: 1190761 - DNA, 13 bp, Homo sapiens
tcaattaaatgta

SEQ ID NO: 1190762 - DNA, 16 bp, Homo sapiens
tcaattaacatcgtgg

SEQ ID NO: 1190763 - DNA, 17 bp, Homo sapiens
tcaattaattgattcct

SEQ ID NO: 1190764 - DNA, 21 bp, Homo sapiens
tcaattaccagaaagataaca

SEQ ID NO: 1190765 - DNA, 13 bp, Homo sapiens
tcaattactggtc

SEQ ID NO: 1190766 - DNA, 23 bp, Homo sapiens
tcaattacttattttaggaaatt

SEQ ID NO: 1190767 - DNA, 18 bp, Homo sapiens
tcaattagtggtcataaa

SEQ ID NO: 1190768 - DNA, 20 bp, Homo sapiens
tcaattagtggtcataaaat

SEQ ID NO: 1190769 - DNA, 16 bp, Homo sapiens
tcaattattacattta

SEQ ID NO: 1190770 - DNA, 22 bp, Homo sapiens
tcaattattacatttatacatc

SEQ ID NO: 1190771 - DNA, 16 bp, Homo sapiens
tcaattcctctgggaa

SEQ ID NO: 1190772 - DNA, 18 bp, Homo sapiens
tcaattgcatctcccaga

SEQ ID NO: 1190773 - DNA, 22 bp, Homo sapiens
tcaattggcagtgactttgtat

SEQ ID NO: 1190774 - DNA, 13 bp, Homo sapiens
tcaatttatgaat

SEQ ID NO: 1190775 - DNA, 20 bp, Homo sapiens
tcaatttattcaagaaaagt

SEQ ID NO: 1190776 - DNA, 12 bp, Homo sapiens
tcaatttcagca

SEQ ID NO: 1190777 - DNA, 18 bp, Homo sapiens
tcaatttccctgactcct

SEQ ID NO: 1190778 - DNA, 21 bp, Homo sapiens
tcaatttccctgactcctcta

SEQ ID NO: 1190779 - DNA, 15 bp, Homo sapiens
tcaatttctgtgttg

SEQ ID NO: 1190780 - DNA, 20 bp, Homo sapiens
tcaatttggagcattaacta

SEQ ID NO: 1190781 - DNA, 14 bp, Homo sapiens
tcaatttgtcatgt

SEQ ID NO: 1190782 - DNA, 16 bp, Homo sapiens
tcaattttatccctca

SEQ ID NO: 1190783 - DNA, 14 bp, Homo sapiens
tcaattttcattaa

SEQ ID NO: 1190784 - DNA, 14 bp, Homo sapiens
tcaattttctttaa

SEQ ID NO: 1190785 - DNA, 13 bp, Homo sapiens
tcaattttgactt

SEQ ID NO: 1190786 - DNA, 18 bp, Homo sapiens
tcaattttgacttaatgt

SEQ ID NO: 1190787 - DNA, 18 bp, Homo sapiens
tcaatttttcccagtatt

SEQ ID NO: 1190788 - DNA, 20 bp, Homo sapiens
tcaatttttggttgaataaa

SEQ ID NO: 1190789 - DNA, 17 bp, Homo sapiens
tcaatttttgtctcaga

SEQ ID NO: 1190790 - DNA, 21 bp, Homo sapiens
tcaatttttgtttttgagtac

SEQ ID NO: 1190791 - DNA, 20 bp, Homo sapiens
tcacaaaaaggcaaatattg

SEQ ID NO: 1190792 - DNA, 17 bp, Homo sapiens
tcacaaaacctggcaca

SEQ ID NO: 1190793 - DNA, 22 bp, Homo sapiens
tcacaaaattttattcctatat

SEQ ID NO: 1190794 - DNA, 23 bp, Homo sapiens
tcacaaaccttctttaaggcata

SEQ ID NO: 1190795 - DNA, 21 bp, Homo sapiens
tcacaaactgatctaaaatgt

SEQ ID NO: 1190796 - DNA, 14 bp, Homo sapiens
gcaagccagggccc

SEQ ID NO: 1190797 - DNA, 17 bp, Homo sapiens
gcaagccagggcccaga

SEQ ID NO: 1190798 - DNA, 18 bp, Homo sapiens
gcaagccagggcccagag

SEQ ID NO: 1190799 - DNA, 16 bp, Homo sapiens
tcaccccctcctggca

SEQ ID NO: 1190800 - DNA, 17 bp, Homo sapiens
tcaccccctcctggcaa

SEQ ID NO: 1190801 - DNA, 18 bp, Homo sapiens
tcaccccctcctggcaat

SEQ ID NO: 1190802 - DNA, 18 bp, Homo sapiens
tcacccccttctccatcc

SEQ ID NO: 1190803 - DNA, 20 bp, Homo sapiens
tcaccccctttgctgtgagg

SEQ ID NO: 1190804 - DNA, 13 bp, Homo sapiens
tcacccctcagca

SEQ ID NO: 1190805 - DNA, 13 bp, Homo sapiens
tcacccctcgcca

SEQ ID NO: 1190806 - DNA, 16 bp, Homo sapiens
tcacccctgggcaggc

SEQ ID NO: 1190807 - DNA, 17 bp, Homo sapiens
tcaccctacctgtgcct

SEQ ID NO: 1190808 - DNA, 21 bp, Homo sapiens
gcacagctgtctgccaggcac

SEQ ID NO: 1190809 - DNA, 19 bp, Homo sapiens
gcacagcttagatttcata

SEQ ID NO: 1190810 - DNA, 15 bp, Homo sapiens
gcacagcttcttctg

SEQ ID NO: 1190811 - DNA, 14 bp, Homo sapiens
gcacagcttgacct

SEQ ID NO: 1190812 - DNA, 22 bp, Homo sapiens
gcacagcttgacctgaggctgt

SEQ ID NO: 1190813 - DNA, 13 bp, Homo sapiens
gcacagcttgggt

SEQ ID NO: 1190814 - DNA, 22 bp, Homo sapiens
gcacaggacatgcggtagccag

SEQ ID NO: 1190815 - DNA, 16 bp, Homo sapiens
gcacaggagactccaa

SEQ ID NO: 1190816 - DNA, 23 bp, Homo sapiens
gcacaggcactgaacaggctggg

SEQ ID NO: 1190817 - DNA, 12 bp, Homo sapiens
gcacaggcagct

SEQ ID NO: 1190818 - DNA, 17 bp, Homo sapiens
gcacagggagtgcacat

SEQ ID NO: 1190819 - DNA, 22 bp, Homo sapiens
gcacagggagtgcacatatcca

SEQ ID NO: 1190820 - DNA, 16 bp, Homo sapiens
gcacagggcagtggga

SEQ ID NO: 1190821 - DNA, 20 bp, Homo sapiens
gcacaggggccccagatctg

SEQ ID NO: 1190822 - DNA, 12 bp, Homo sapiens
gcacagggtctg

SEQ ID NO: 1190823 - DNA, 21 bp, Homo sapiens
gcacaggtcccacctccagcc

SEQ ID NO: 1190824 - DNA, 14 bp, Homo sapiens
gcacaggtgacaga

SEQ ID NO: 1190825 - DNA, 14 bp, Homo sapiens
gcacagtcaggggc

SEQ ID NO: 1190826 - DNA, 23 bp, Homo sapiens
gcacagtccacagctgaagagca

SEQ ID NO: 1190827 - DNA, 12 bp, Homo sapiens
gcacagtccaga

SEQ ID NO: 1190828 - DNA, 15 bp, Homo sapiens
gcacagtccagaccc

SEQ ID NO: 1190829 - DNA, 16 bp, Homo sapiens
gcacagtccaggaaca

SEQ ID NO: 1190830 - DNA, 18 bp, Homo sapiens
gcacagtgacttctgaga

SEQ ID NO: 1190831 - DNA, 19 bp, Homo sapiens
gcacagtgatatatttcta

SEQ ID NO: 1190832 - DNA, 17 bp, Homo sapiens
gcacagtgatgccgggc

SEQ ID NO: 1190833 - DNA, 20 bp, Homo sapiens
gcacagtgatgccgggcgcc

SEQ ID NO: 1190834 - DNA, 14 bp, Homo sapiens
gcacagtgctgccc

SEQ ID NO: 1190835 - DNA, 14 bp, Homo sapiens
gcacagtggaaagt

SEQ ID NO: 1190836 - DNA, 20 bp, Homo sapiens
gcacagtggactcagcagtg

SEQ ID NO: 1190837 - DNA, 16 bp, Homo sapiens
gcacagtgggagctga

SEQ ID NO: 1190838 - DNA, 18 bp, Homo sapiens
gcacagtgggagctgagc

SEQ ID NO: 1190839 - DNA, 19 bp, Homo sapiens
gcacagtgggagctgagct

SEQ ID NO: 1190840 - DNA, 19 bp, Homo sapiens
gcacagttgtctattctga

SEQ ID NO: 1190841 - DNA, 23 bp, Homo sapiens
gcacagttttctggctggagcct

SEQ ID NO: 1190842 - DNA, 20 bp, Homo sapiens
gcacataactggattttgaa

SEQ ID NO: 1190843 - DNA, 22 bp, Homo sapiens
gcacataactggattttgaacg

SEQ ID NO: 1190844 - DNA, 22 bp, Homo sapiens
gcacatacacctcgtcaagagc

SEQ ID NO: 1190845 - DNA, 16 bp, Homo sapiens
gcacatactgtgttcc

SEQ ID NO: 1190846 - DNA, 16 bp, Homo sapiens
gcacatagagcttttt

SEQ ID NO: 1190847 - DNA, 21 bp, Homo sapiens
gcacatagagctttttaatag

SEQ ID NO: 1190848 - DNA, 21 bp, Homo sapiens
gcacataggctggtggccttg

SEQ ID NO: 1190849 - DNA, 22 bp, Homo sapiens
gcacataggctggtggccttgg

SEQ ID NO: 1190850 - DNA, 23 bp, Homo sapiens
gcacataggctggtggccttggg

SEQ ID NO: 1190851 - DNA, 17 bp, Homo sapiens
gcacatagtagaacgct

SEQ ID NO: 1190852 - DNA, 23 bp, Homo sapiens
gcacatatggaattttgcaaaga

SEQ ID NO: 1190853 - DNA, 15 bp, Homo sapiens
gcacatcagaaagga

SEQ ID NO: 1190854 - DNA, 13 bp, Homo sapiens
gcacatccctgga

SEQ ID NO: 1190855 - DNA, 13 bp, Homo sapiens
gcacatctctctg

SEQ ID NO: 1190856 - DNA, 19 bp, Homo sapiens
gcacatctctctgccctct

SEQ ID NO: 1190857 - DNA, 13 bp, Homo sapiens
gcacatctgcatt

SEQ ID NO: 1190858 - DNA, 19 bp, Homo sapiens
gcacatgacaactttgcca

SEQ ID NO: 1190859 - DNA, 19 bp, Homo sapiens
gcacatgcctgtagtccca

SEQ ID NO: 1190860 - DNA, 14 bp, Homo sapiens
gcacatgcgcactc

SEQ ID NO: 1190861 - DNA, 14 bp, Homo sapiens
gcacatgcgggctc

SEQ ID NO: 1190862 - DNA, 21 bp, Homo sapiens
gcacatgctgtctggccctgg

SEQ ID NO: 1190863 - DNA, 21 bp, Homo sapiens
gcacatgcttagcttatcttt

SEQ ID NO: 1190864 - DNA, 16 bp, Homo sapiens
gcacatggccatagag

SEQ ID NO: 1190865 - DNA, 21 bp, Homo sapiens
gcacatggccatagaggccca

SEQ ID NO: 1190866 - DNA, 15 bp, Homo sapiens
gcacatgtaataaat

SEQ ID NO: 1190867 - DNA, 20 bp, Homo sapiens
gcacatgtctgtcctcagag

SEQ ID NO: 1190868 - DNA, 21 bp, Homo sapiens
gcacatgtctgtcctcagagc

SEQ ID NO: 1190869 - DNA, 15 bp, Homo sapiens
gcacattcctggccc

SEQ ID NO: 1190870 - DNA, 16 bp, Homo sapiens
gcacattcctggcccc

SEQ ID NO: 1190871 - DNA, 17 bp, Homo sapiens
gcacattgcccatggct

SEQ ID NO: 1190872 - DNA, 22 bp, Homo sapiens
gcacattgcccatggctgggaa

SEQ ID NO: 1190873 - DNA, 13 bp, Homo sapiens
gcacattgcctgt

SEQ ID NO: 1190874 - DNA, 20 bp, Homo sapiens
gcacattgcctgttctgctt

SEQ ID NO: 1190875 - DNA, 18 bp, Homo sapiens
gcacattgttgttttttt

SEQ ID NO: 1190876 - DNA, 16 bp, Homo sapiens
gcacatttctggattg

SEQ ID NO: 1190877 - DNA, 21 bp, Homo sapiens
gcacatttttttctatgcata

SEQ ID NO: 1190878 - DNA, 23 bp, Homo sapiens
gcacatttttttctatgcataaa

SEQ ID NO: 1190879 - DNA, 17 bp, Homo sapiens
gcaccaaaataagaaaa

SEQ ID NO: 1190880 - DNA, 18 bp, Homo sapiens
gcaccaaaataagaaaag

SEQ ID NO: 1190881 - DNA, 22 bp, Homo sapiens
gcaccaaagacatcagtctcca

SEQ ID NO: 1190882 - DNA, 14 bp, Homo sapiens
gcaccaaatgtcag

SEQ ID NO: 1190883 - DNA, 22 bp, Homo sapiens
gcaccaaatgtcagaagcttgg

SEQ ID NO: 1190884 - DNA, 19 bp, Homo sapiens
gcaccaacctcactgccct

SEQ ID NO: 1190885 - DNA, 20 bp, Homo sapiens
gcaccaagggacaggagaag

SEQ ID NO: 1190886 - DNA, 14 bp, Homo sapiens
gcaccacaaaatat

SEQ ID NO: 1190887 - DNA, 17 bp, Homo sapiens
gcaccacattgcctcat

SEQ ID NO: 1190888 - DNA, 18 bp, Homo sapiens
gcaccacattgcctcatt

SEQ ID NO: 1190889 - DNA, 22 bp, Homo sapiens
gcaccaccacacagtcacccct

SEQ ID NO: 1190890 - DNA, 23 bp, Homo sapiens
gcaccaccacacagtcacccctc

SEQ ID NO: 1190891 - DNA, 13 bp, Homo sapiens
gcaccaccaggag

SEQ ID NO: 1190892 - DNA, 20 bp, Homo sapiens
gcaccaccaggagcagcagc

SEQ ID NO: 1190893 - DNA, 23 bp, Homo sapiens
gcaccaccaggagcagcagccag

SEQ ID NO: 1190894 - DNA, 13 bp, Homo sapiens
gcaccaccatgcc

SEQ ID NO: 1190895 - DNA, 19 bp, Homo sapiens
gcaccaccatgccaggcta

SEQ ID NO: 1190896 - DNA, 11 bp, Homo sapiens
gcaccacccta

SEQ ID NO: 1190897 - DNA, 22 bp, Homo sapiens
gcaccaccctagtcccttcccc

SEQ ID NO: 1190898 - DNA, 18 bp, Homo sapiens
gcaccacctacacaggag

SEQ ID NO: 1190899 - DNA, 20 bp, Homo sapiens
gcaccacctacacaggagtc

SEQ ID NO: 1190900 - DNA, 15 bp, Homo sapiens
gcaccacgggcccgg

SEQ ID NO: 1190901 - DNA, 19 bp, Homo sapiens
gcaccactgcactccagcc

SEQ ID NO: 1190902 - DNA, 20 bp, Homo sapiens
gcaccactgcactccagcct

SEQ ID NO: 1190903 - DNA, 21 bp, Homo sapiens
gcaccactgctgaggagtctg

SEQ ID NO: 1190904 - DNA, 18 bp, Homo sapiens
gcaccactgtgtatttaa

SEQ ID NO: 1190905 - DNA, 22 bp, Homo sapiens
gcaccacttatttattgttgcc

SEQ ID NO: 1190906 - DNA, 16 bp, Homo sapiens
gcaccagaatgtatat

SEQ ID NO: 1190907 - DNA, 18 bp, Homo sapiens
gcaccagagcaacctctc

SEQ ID NO: 1190908 - DNA, 22 bp, Homo sapiens
gcaccagagtgaaagggctatg

SEQ ID NO: 1190909 - DNA, 17 bp, Homo sapiens
gcaccagatgcaacctc

SEQ ID NO: 1190910 - DNA, 13 bp, Homo sapiens
gcaccagcagcct

SEQ ID NO: 1190911 - DNA, 14 bp, Homo sapiens
gcaccagcagcctg

SEQ ID NO: 1190912 - DNA, 15 bp, Homo sapiens
gcaccagcagcctgg

SEQ ID NO: 1190913 - DNA, 13 bp, Homo sapiens
gcaccagccagcg

SEQ ID NO: 1190914 - DNA, 19 bp, Homo sapiens
gcaccagccagcgtagcag

SEQ ID NO: 1190915 - DNA, 14 bp, Homo sapiens
gcaccagccccctg

SEQ ID NO: 1190916 - DNA, 19 bp, Homo sapiens
gcaccagccccctggatgg

SEQ ID NO: 1190917 - DNA, 13 bp, Homo sapiens
gcaccagctctgt

SEQ ID NO: 1190918 - DNA, 11 bp, Homo sapiens
gcaccagctgc

SEQ ID NO: 1190919 - DNA, 18 bp, Homo sapiens
gcaccagcttctccaggc

SEQ ID NO: 1190920 - DNA, 14 bp, Homo sapiens
tcactgagctcccc

SEQ ID NO: 1190921 - DNA, 20 bp, Homo sapiens
tcactgagctccccagatct

SEQ ID NO: 1190922 - DNA, 21 bp, Homo sapiens
tcactgagctccccagatctc

SEQ ID NO: 1190923 - DNA, 23 bp, Homo sapiens
tcactgaggccatcagggccctg

SEQ ID NO: 1190924 - DNA, 14 bp, Homo sapiens
tcactgatgtacaa

SEQ ID NO: 1190925 - DNA, 17 bp, Homo sapiens
tcactgatgtacaatta

SEQ ID NO: 1190926 - DNA, 17 bp, Homo sapiens
tcactgcaacttctgcc

SEQ ID NO: 1190927 - DNA, 18 bp, Homo sapiens
tcactgcaagctctgcct

SEQ ID NO: 1190928 - DNA, 18 bp, Homo sapiens
tcactgcaattttgtgta

SEQ ID NO: 1190929 - DNA, 15 bp, Homo sapiens
tcactgcagcctcaa

SEQ ID NO: 1190930 - DNA, 18 bp, Homo sapiens
tcactgcatttggtcagg

SEQ ID NO: 1190931 - DNA, 23 bp, Homo sapiens
tcactgcattttgtttgaaactt

SEQ ID NO: 1190932 - DNA, 14 bp, Homo sapiens
tcactgccaggcca

SEQ ID NO: 1190933 - DNA, 23 bp, Homo sapiens
tcactgccaggccagcctccgag

SEQ ID NO: 1190934 - DNA, 12 bp, Homo sapiens
tcactgccatga

SEQ ID NO: 1190935 - DNA, 15 bp, Homo sapiens
tcactgccatgatag

SEQ ID NO: 1190936 - DNA, 18 bp, Homo sapiens
tcactgccatgccagctt

SEQ ID NO: 1190937 - DNA, 16 bp, Homo sapiens
tcactgcccaccaaag

SEQ ID NO: 1190938 - DNA, 20 bp, Homo sapiens
tcactgccgacatccctccc

SEQ ID NO: 1190939 - DNA, 22 bp, Homo sapiens
tcactgcctgcagaggtctgtg

SEQ ID NO: 1190940 - DNA, 15 bp, Homo sapiens
tcactgcctgtagag

SEQ ID NO: 1190941 - DNA, 19 bp, Homo sapiens
gcacctgggccccactgga

SEQ ID NO: 1190942 - DNA, 15 bp, Homo sapiens
gcacctggggagtgg

SEQ ID NO: 1190943 - DNA, 15 bp, Homo sapiens
gcacctgtagtccca

SEQ ID NO: 1190944 - DNA, 16 bp, Homo sapiens
gcacctgtagtcccag

SEQ ID NO: 1190945 - DNA, 18 bp, Homo sapiens
gcacctgtagtcccagct

SEQ ID NO: 1190946 - DNA, 21 bp, Homo sapiens
gcacctgtccccaccctccac

SEQ ID NO: 1190947 - DNA, 23 bp, Homo sapiens
gcacctgtccccaccctccactc

SEQ ID NO: 1190948 - DNA, 23 bp, Homo sapiens
gcacctgtcggtggctgcctttg

SEQ ID NO: 1190949 - DNA, 11 bp, Homo sapiens
gcacctgtctg

SEQ ID NO: 1190950 - DNA, 22 bp, Homo sapiens
gcacctgtctggattgttttta

SEQ ID NO: 1190951 - DNA, 19 bp, Homo sapiens
gcaccttaccaactttctg

SEQ ID NO: 1190952 - DNA, 20 bp, Homo sapiens
gcaccttaccaactttctgt

SEQ ID NO: 1190953 - DNA, 19 bp, Homo sapiens
gcaccttcaagcgctccag

SEQ ID NO: 1190954 - DNA, 12 bp, Homo sapiens
gcaccttcctcc

SEQ ID NO: 1190955 - DNA, 14 bp, Homo sapiens
gcaccttcctcctc

SEQ ID NO: 1190956 - DNA, 17 bp, Homo sapiens
gcaccttcctcctcccc

SEQ ID NO: 1190957 - DNA, 21 bp, Homo sapiens
gcaccttcctcctccccgctc

SEQ ID NO: 1190958 - DNA, 16 bp, Homo sapiens
gcaccttctttctgga

SEQ ID NO: 1190959 - DNA, 16 bp, Homo sapiens
gcaccttgctgtgtga

SEQ ID NO: 1190960 - DNA, 16 bp, Homo sapiens
gcaccttggcccagga

SEQ ID NO: 1190961 - DNA, 19 bp, Homo sapiens
gcaccttggcccaggagct

SEQ ID NO: 1190962 - DNA, 18 bp, Homo sapiens
gcacctttctagttgaaa

SEQ ID NO: 1190963 - DNA, 14 bp, Homo sapiens
gcacctttctctga

SEQ ID NO: 1190964 - DNA, 20 bp, Homo sapiens
gcaccttttcatgtacagca

SEQ ID NO: 1190965 - DNA, 19 bp, Homo sapiens
gcacgaacccacctgctga

SEQ ID NO: 1190966 - DNA, 23 bp, Homo sapiens
gcacgaacccacctgctgagaga

SEQ ID NO: 1190967 - DNA, 16 bp, Homo sapiens
gcacgaccgccccagt

SEQ ID NO: 1190968 - DNA, 14 bp, Homo sapiens
gcacgacgccctct

SEQ ID NO: 1190969 - DNA, 17 bp, Homo sapiens
gcacgacgccctctccc

SEQ ID NO: 1190970 - DNA, 21 bp, Homo sapiens
gcacgacgccctctccccacc

SEQ ID NO: 1190971 - DNA, 16 bp, Homo sapiens
gcacgatttctgttta

SEQ ID NO: 1190972 - DNA, 15 bp, Homo sapiens
gcacgcacacacaca

SEQ ID NO: 1190973 - DNA, 16 bp, Homo sapiens
gcacgcacacacacaa

SEQ ID NO: 1190974 - DNA, 17 bp, Homo sapiens
gcacgcacacacacata

SEQ ID NO: 1190975 - DNA, 20 bp, Homo sapiens
gcacgcacacgcacacatct

SEQ ID NO: 1190976 - DNA, 14 bp, Homo sapiens
gcacgcacctgtag

SEQ ID NO: 1190977 - DNA, 15 bp, Homo sapiens
gcacgcacctgtagt

SEQ ID NO: 1190978 - DNA, 16 bp, Homo sapiens
gcacgcacctgtagtc

SEQ ID NO: 1190979 - DNA, 16 bp, Homo sapiens
gcacgcatctgtagtt

SEQ ID NO: 1190980 - DNA, 21 bp, Homo sapiens
gcacgcctgccatcttctccc

SEQ ID NO: 1190981 - DNA, 19 bp, Homo sapiens
gcacgcgcgagtgtgctgt

SEQ ID NO: 1190982 - DNA, 15 bp, Homo sapiens
gcacgctcgctgcca

SEQ ID NO: 1190983 - DNA, 16 bp, Homo sapiens
gcacgctcgctgccat

SEQ ID NO: 1190984 - DNA, 19 bp, Homo sapiens
gcacgctgcctgccaaagt

SEQ ID NO: 1190985 - DNA, 18 bp, Homo sapiens
gcacggcccggcccctca

SEQ ID NO: 1190986 - DNA, 15 bp, Homo sapiens
gcacggctgctcggc

SEQ ID NO: 1190987 - DNA, 22 bp, Homo sapiens
gcacgggatgcgtgggaggcag

SEQ ID NO: 1190988 - DNA, 15 bp, Homo sapiens
gcacgggcatgcaca

SEQ ID NO: 1190989 - DNA, 19 bp, Homo sapiens
gcacgggcatgcacacggc

SEQ ID NO: 1190990 - DNA, 15 bp, Homo sapiens
gcacgggccctccct

SEQ ID NO: 1190991 - DNA, 24 bp, Homo sapiens
gcacggtctggggaagaggatgag

SEQ ID NO: 1190992 - DNA, 12 bp, Homo sapiens
gcacggtttgtg

SEQ ID NO: 1190993 - DNA, 14 bp, Homo sapiens
gcacggtttgtgag

SEQ ID NO: 1190994 - DNA, 15 bp, Homo sapiens
gcacggtttgtgaga

SEQ ID NO: 1190995 - DNA, 16 bp, Homo sapiens
gcacggtttgtgagag

SEQ ID NO: 1190996 - DNA, 22 bp, Homo sapiens
gcacgtagctgaggccggatgc

SEQ ID NO: 1190997 - DNA, 18 bp, Homo sapiens
gcacgtaggttccccaga

SEQ ID NO: 1190998 - DNA, 22 bp, Homo sapiens
gcacgtaggttccccagagagc

SEQ ID NO: 1190999 - DNA, 14 bp, Homo sapiens
gcacgtattgctgt

SEQ ID NO: 1191000 - DNA, 20 bp, Homo sapiens
gcacgtggagagctggtgcc

SEQ ID NO: 1191001 - DNA, 20 bp, Homo sapiens
gcacgtggagatagtgccag

SEQ ID NO: 1191002 - DNA, 14 bp, Homo sapiens
gcacgtggcctctt

SEQ ID NO: 1191003 - DNA, 16 bp, Homo sapiens
gcacgtggggcccact

SEQ ID NO: 1191004 - DNA, 17 bp, Homo sapiens
gcacgtggggcccactg

SEQ ID NO: 1191005 - DNA, 18 bp, Homo sapiens
gcacgtggggcccactgc

SEQ ID NO: 1191006 - DNA, 19 bp, Homo sapiens
gcacgtgtgggccgtggct

SEQ ID NO: 1191007 - DNA, 16 bp, Homo sapiens
gcacgttgctgaaggt

SEQ ID NO: 1191008 - DNA, 17 bp, Homo sapiens
gcactaaagccagcctg

SEQ ID NO: 1191009 - DNA, 20 bp, Homo sapiens
gcactaaagtatgtaaagta

SEQ ID NO: 1191010 - DNA, 20 bp, Homo sapiens
gcactaacgttgagcccctg

SEQ ID NO: 1191011 - DNA, 13 bp, Homo sapiens
gcactacaatcat

SEQ ID NO: 1191012 - DNA, 14 bp, Homo sapiens
gcactacaatcatg

SEQ ID NO: 1191013 - DNA, 13 bp, Homo sapiens
gcactacatgtgg

SEQ ID NO: 1191014 - DNA, 13 bp, Homo sapiens
gcactactcctct

SEQ ID NO: 1191015 - DNA, 19 bp, Homo sapiens
gcactactcctctgcagtg

SEQ ID NO: 1191016 - DNA, 19 bp, Homo sapiens
gcactactgggtgtcattt

SEQ ID NO: 1191017 - DNA, 24 bp, Homo sapiens
gcactagactggtggcaggggctt

SEQ ID NO: 1191018 - DNA, 22 bp, Homo sapiens
gcactagcattttcttgaacca

SEQ ID NO: 1191019 - DNA, 14 bp, Homo sapiens
gcactaggacttgg

SEQ ID NO: 1191020 - DNA, 13 bp, Homo sapiens
gcactaggcaggt

SEQ ID NO: 1191021 - DNA, 21 bp, Homo sapiens
gcactaggggatataggagag

SEQ ID NO: 1191022 - DNA, 22 bp, Homo sapiens
gcactagtttgattattatgtt

SEQ ID NO: 1191023 - DNA, 23 bp, Homo sapiens
gcactagtttgattattatgttt

SEQ ID NO: 1191024 - DNA, 15 bp, Homo sapiens
gcactataatgtaag

SEQ ID NO: 1191025 - DNA, 15 bp, Homo sapiens
gcactatatttgtat

SEQ ID NO: 1191026 - DNA, 16 bp, Homo sapiens
gcactatatttgtata

SEQ ID NO: 1191027 - DNA, 17 bp, Homo sapiens
gcactatgctttccttc

SEQ ID NO: 1191028 - DNA, 15 bp, Homo sapiens
gcactatttatttac

SEQ ID NO: 1191029 - DNA, 21 bp, Homo sapiens
gcactatttatttacaaatgt

SEQ ID NO: 1191030 - DNA, 13 bp, Homo sapiens
gcactattttata

SEQ ID NO: 1191031 - DNA, 18 bp, Homo sapiens
gcactattttatatttaa

SEQ ID NO: 1191032 - DNA, 19 bp, Homo sapiens
gcactattttatatttaaa

SEQ ID NO: 1191033 - DNA, 21 bp, Homo sapiens
gcactcaaacctggagctgag

SEQ ID NO: 1191034 - DNA, 16 bp, Homo sapiens
gcactcacacaggacc

SEQ ID NO: 1191035 - DNA, 16 bp, Homo sapiens
gcactcacagacctgg

SEQ ID NO: 1191036 - DNA, 20 bp, Homo sapiens
gcactcagtgagcctcctgt

SEQ ID NO: 1191037 - DNA, 12 bp, Homo sapiens
gcactcatgtgg

SEQ ID NO: 1191038 - DNA, 14 bp, Homo sapiens
gcactccaaacctg

SEQ ID NO: 1191039 - DNA, 13 bp, Homo sapiens
gcactccagcctg

SEQ ID NO: 1191040 - DNA, 14 bp, Homo sapiens
gcactccagcctgg

SEQ ID NO: 1191041 - DNA, 21 bp, Homo sapiens
gcactccagcctgggcgacag

SEQ ID NO: 1191042 - DNA, 23 bp, Homo sapiens
tcagacaccctcaacctcttctg

SEQ ID NO: 1191043 - DNA, 16 bp, Homo sapiens
tcagacactacatgat

SEQ ID NO: 1191044 - DNA, 21 bp, Homo sapiens
tcagacactgccgacatcagc

SEQ ID NO: 1191045 - DNA, 23 bp, Homo sapiens
tcagacagaacttgaatgtgtca

SEQ ID NO: 1191046 - DNA, 18 bp, Homo sapiens
tcagacatacagctgcct

SEQ ID NO: 1191047 - DNA, 21 bp, Homo sapiens
tcagacatacagctgcctacc

SEQ ID NO: 1191048 - DNA, 20 bp, Homo sapiens
tcagacatctccagtgtgcc

SEQ ID NO: 1191049 - DNA, 15 bp, Homo sapiens
tcagacattccaagg

SEQ ID NO: 1191050 - DNA, 15 bp, Homo sapiens
tcagaccataatgtt

SEQ ID NO: 1191051 - DNA, 12 bp, Homo sapiens
tcagacccagag

SEQ ID NO: 1191052 - DNA, 12 bp, Homo sapiens
tcagaccccccc

SEQ ID NO: 1191053 - DNA, 19 bp, Homo sapiens
tcagaccccctcagccttg

SEQ ID NO: 1191054 - DNA, 15 bp, Homo sapiens
tcagacccctgcctg

SEQ ID NO: 1191055 - DNA, 18 bp, Homo sapiens
tcagacccctttgagaga

SEQ ID NO: 1191056 - DNA, 18 bp, Homo sapiens
tcagaccctaccccacca

SEQ ID NO: 1191057 - DNA, 17 bp, Homo sapiens
tcagacctgtcttccaa

SEQ ID NO: 1191058 - DNA, 22 bp, Homo sapiens
tcagacctgtcttccaaggaga

SEQ ID NO: 1191059 - DNA, 21 bp, Homo sapiens
tcagaccttggatcagatgaa

SEQ ID NO: 1191060 - DNA, 19 bp, Homo sapiens
tcagactaagaaatattcc

SEQ ID NO: 1191061 - DNA, 21 bp, Homo sapiens
tcagactaagaaatattccaa

SEQ ID NO: 1191062 - DNA, 20 bp, Homo sapiens
tcagactagccactcctgcc

SEQ ID NO: 1191063 - DNA, 21 bp, Homo sapiens
tcagactcaagtacccattct

SEQ ID NO: 1191064 - DNA, 14 bp, Homo sapiens
tcagactgaacatg

SEQ ID NO: 1191065 - DNA, 16 bp, Homo sapiens
tcagactgacactact

SEQ ID NO: 1191066 - DNA, 18 bp, Homo sapiens
tcagactgacagtttaca

SEQ ID NO: 1191067 - DNA, 14 bp, Homo sapiens
tcagactgtttagt

SEQ ID NO: 1191068 - DNA, 14 bp, Homo sapiens
tcagacttgtcaag

SEQ ID NO: 1191069 - DNA, 17 bp, Homo sapiens
tcagactttaaagaata

SEQ ID NO: 1191070 - DNA, 23 bp, Homo sapiens
tcagactttaaagaataatatgc

SEQ ID NO: 1191071 - DNA, 15 bp, Homo sapiens
tcagactttgctgca

SEQ ID NO: 1191072 - DNA, 22 bp, Homo sapiens
tcagactttgtgttcatttcat

SEQ ID NO: 1191073 - DNA, 16 bp, Homo sapiens
tcagagaattactatt

SEQ ID NO: 1191074 - DNA, 12 bp, Homo sapiens
tcagagacactg

SEQ ID NO: 1191075 - DNA, 23 bp, Homo sapiens
gcagaagaattgaacccaggagg

SEQ ID NO: 1191076 - DNA, 12 bp, Homo sapiens
gcagaagagggt

SEQ ID NO: 1191077 - DNA, 16 bp, Homo sapiens
gcagaagagggtgtgt

SEQ ID NO: 1191078 - DNA, 13 bp, Homo sapiens
gcagaagcagccc

SEQ ID NO: 1191079 - DNA, 16 bp, Homo sapiens
gcagaagcagggtacc

SEQ ID NO: 1191080 - DNA, 12 bp, Homo sapiens
gcagaagccaga

SEQ ID NO: 1191081 - DNA, 20 bp, Homo sapiens
gcagaaggaaaaatgtgtaa

SEQ ID NO: 1191082 - DNA, 17 bp, Homo sapiens
gcagaagtgtcaccctg

SEQ ID NO: 1191083 - DNA, 22 bp, Homo sapiens
gcagaagtgtcaccctgtgggt

SEQ ID NO: 1191084 - DNA, 17 bp, Homo sapiens
gcagaataatggaaaca

SEQ ID NO: 1191085 - DNA, 16 bp, Homo sapiens
gcagaatactggtctc

SEQ ID NO: 1191086 - DNA, 19 bp, Homo sapiens
gcagaatactggtctcagg

SEQ ID NO: 1191087 - DNA, 22 bp, Homo sapiens
gcagaatgaacccatagggagc

SEQ ID NO: 1191088 - DNA, 16 bp, Homo sapiens
gcagaatgaatctatg

SEQ ID NO: 1191089 - DNA, 14 bp, Homo sapiens
gcagaatggagaaa

SEQ ID NO: 1191090 - DNA, 16 bp, Homo sapiens
gcagaatggagaaagt

SEQ ID NO: 1191091 - DNA, 20 bp, Homo sapiens
gcagaatggagaaagtaagt

SEQ ID NO: 1191092 - DNA, 16 bp, Homo sapiens
gcagaatggaggcagg

SEQ ID NO: 1191093 - DNA, 17 bp, Homo sapiens
gcagaatgtttttaaaa

SEQ ID NO: 1191094 - DNA, 11 bp, Homo sapiens
gcagaatttta

SEQ ID NO: 1191095 - DNA, 13 bp, Homo sapiens
gcagaattttaat

SEQ ID NO: 1191096 - DNA, 13 bp, Homo sapiens
gcagacaaacaga

SEQ ID NO: 1191097 - DNA, 14 bp, Homo sapiens
gcagacaaagtcaa

SEQ ID NO: 1191098 - DNA, 21 bp, Homo sapiens
gcagacaacaccttcctcctg

SEQ ID NO: 1191099 - DNA, 23 bp, Homo sapiens
gcagacaacaccttcctcctgca

SEQ ID NO: 1191100 - DNA, 14 bp, Homo sapiens
gcagacaaccttgt

SEQ ID NO: 1191101 - DNA, 19 bp, Homo sapiens
gcagacacagggacttgaa

SEQ ID NO: 1191102 - DNA, 15 bp, Homo sapiens
gcagacacctggact

SEQ ID NO: 1191103 - DNA, 12 bp, Homo sapiens
gcagacagagcc

SEQ ID NO: 1191104 - DNA, 14 bp, Homo sapiens
gcagacagagccag

SEQ ID NO: 1191105 - DNA, 15 bp, Homo sapiens
gcagacagagccagg

SEQ ID NO: 1191106 - DNA, 17 bp, Homo sapiens
gcagacagagccaggag

SEQ ID NO: 1191107 - DNA, 14 bp, Homo sapiens
gcagacagagggga

SEQ ID NO: 1191108 - DNA, 15 bp, Homo sapiens
gcagacagaggggat

SEQ ID NO: 1191109 - DNA, 13 bp, Homo sapiens
gcagacagcagct

SEQ ID NO: 1191110 - DNA, 18 bp, Homo sapiens
gcagacagcagctcaggc

SEQ ID NO: 1191111 - DNA, 19 bp, Homo sapiens
gcagacagcagctcaggca

SEQ ID NO: 1191112 - DNA, 20 bp, Homo sapiens
gcagacagcagctcaggcac

SEQ ID NO: 1191113 - DNA, 15 bp, Homo sapiens
gcagacagcaggcag

SEQ ID NO: 1191114 - DNA, 18 bp, Homo sapiens
gcagacagcaggcagcgc

SEQ ID NO: 1191115 - DNA, 19 bp, Homo sapiens
gcagacagcaggcagcgcc

SEQ ID NO: 1191116 - DNA, 20 bp, Homo sapiens
gcagacagcaggcagcgcca

SEQ ID NO: 1191117 - DNA, 15 bp, Homo sapiens
gcagacagctccacc

SEQ ID NO: 1191118 - DNA, 21 bp, Homo sapiens
gcagacaggccatgtgagcca

SEQ ID NO: 1191119 - DNA, 21 bp, Homo sapiens
gcagacagtctgttatgcact

SEQ ID NO: 1191120 - DNA, 22 bp, Homo sapiens
gcagacagtctgttatgcactg

SEQ ID NO: 1191121 - DNA, 14 bp, Homo sapiens
gcagacatctctgg

SEQ ID NO: 1191122 - DNA, 21 bp, Homo sapiens
gcagacatctctggagccaga

SEQ ID NO: 1191123 - DNA, 23 bp, Homo sapiens
gcagacatctctggagccagaga

SEQ ID NO: 1191124 - DNA, 13 bp, Homo sapiens
gcagacattctca

SEQ ID NO: 1191125 - DNA, 17 bp, Homo sapiens
gcagacattctcaaagc

SEQ ID NO: 1191126 - DNA, 16 bp, Homo sapiens
gcagacccagtcccac

SEQ ID NO: 1191127 - DNA, 20 bp, Homo sapiens
gcagacccatacctttccag

SEQ ID NO: 1191128 - DNA, 16 bp, Homo sapiens
gcagacctaagccctg

SEQ ID NO: 1191129 - DNA, 19 bp, Homo sapiens
gcagacctacctgcagtgg

SEQ ID NO: 1191130 - DNA, 22 bp, Homo sapiens
gcagacctgtcaccctgcagga

SEQ ID NO: 1191131 - DNA, 13 bp, Homo sapiens
gcagaccttactc

SEQ ID NO: 1191132 - DNA, 18 bp, Homo sapiens
gcagacgcagcagctggg

SEQ ID NO: 1191133 - DNA, 21 bp, Homo sapiens
gcagacgcagcagctgggacc

SEQ ID NO: 1191134 - DNA, 13 bp, Homo sapiens
gcagacggtctgt

SEQ ID NO: 1191135 - DNA, 21 bp, Homo sapiens
gcagactagaattctagtgct

SEQ ID NO: 1191136 - DNA, 17 bp, Homo sapiens
gcagactcagtttgtca

SEQ ID NO: 1191137 - DNA, 14 bp, Homo sapiens
gcagactccagccc

SEQ ID NO: 1191138 - DNA, 16 bp, Homo sapiens
gcagactccagcccct

SEQ ID NO: 1191139 - DNA, 18 bp, Homo sapiens
gcagactccagcccctgg

SEQ ID NO: 1191140 - DNA, 19 bp, Homo sapiens
gcagactccagcccctgga

SEQ ID NO: 1191141 - DNA, 20 bp, Homo sapiens
gcagactccagcccctggac

SEQ ID NO: 1191142 - DNA, 20 bp, Homo sapiens
gcagactgcttggccagatg

SEQ ID NO: 1191143 - DNA, 20 bp, Homo sapiens
gcagactggggcatcctgtg

SEQ ID NO: 1191144 - DNA, 12 bp, Homo sapiens
gcagactgtgaa

SEQ ID NO: 1191145 - DNA, 17 bp, Homo sapiens
gcagactgtgaacttga

SEQ ID NO: 1191146 - DNA, 22 bp, Homo sapiens
gcagactgtgaacttgactggg

SEQ ID NO: 1191147 - DNA, 16 bp, Homo sapiens
gcagacttcccagcta

SEQ ID NO: 1191148 - DNA, 20 bp, Homo sapiens
gcagactttcccaaatgtat

SEQ ID NO: 1191149 - DNA, 18 bp, Homo sapiens
gcagacttttcagaagat

SEQ ID NO: 1191150 - DNA, 20 bp, Homo sapiens
gcagagaaacttaagcaaag

SEQ ID NO: 1191151 - DNA, 21 bp, Homo sapiens
gcagagaaacttaagcaaagg

SEQ ID NO: 1191152 - DNA, 18 bp, Homo sapiens
gcagagaaagaagagaca

SEQ ID NO: 1191153 - DNA, 14 bp, Homo sapiens
gcagagaaggcctc

SEQ ID NO: 1191154 - DNA, 21 bp, Homo sapiens
gcagagaatggctgggtcagg

SEQ ID NO: 1191155 - DNA, 17 bp, Homo sapiens
gcagagacaggacctga

SEQ ID NO: 1191156 - DNA, 13 bp, Homo sapiens
gcagagacctcca

SEQ ID NO: 1191157 - DNA, 12 bp, Homo sapiens
gcagagagaagc

SEQ ID NO: 1191158 - DNA, 13 bp, Homo sapiens
gcagagagaagcc

SEQ ID NO: 1191159 - DNA, 16 bp, Homo sapiens
gcagagaggtggccac

SEQ ID NO: 1191160 - DNA, 19 bp, Homo sapiens
gcagagagtacagactgca

SEQ ID NO: 1191161 - DNA, 15 bp, Homo sapiens
gcagagatgtactgc

SEQ ID NO: 1191162 - DNA, 16 bp, Homo sapiens
gcagagatgtactgca

SEQ ID NO: 1191163 - DNA, 22 bp, Homo sapiens
gcagagatgtactgcaaagtcg

SEQ ID NO: 1191164 - DNA, 18 bp, Homo sapiens
gcagccggagggaggcac

SEQ ID NO: 1191165 - DNA, 14 bp, Homo sapiens
gcagccgtcccagg

SEQ ID NO: 1191166 - DNA, 17 bp, Homo sapiens
gcagccgtcccaggcca

SEQ ID NO: 1191167 - DNA, 18 bp, Homo sapiens
gcagccgtcccaggccac

SEQ ID NO: 1191168 - DNA, 14 bp, Homo sapiens
gcagccgtgccttc

SEQ ID NO: 1191169 - DNA, 15 bp, Homo sapiens
gcagccgtgccttca

SEQ ID NO: 1191170 - DNA, 20 bp, Homo sapiens
gcagcctatgggggctctcg

SEQ ID NO: 1191171 - DNA, 21 bp, Homo sapiens
gcagcctcaaaacgggtcagt

SEQ ID NO: 1191172 - DNA, 14 bp, Homo sapiens
gcagcctcaaggcc

SEQ ID NO: 1191173 - DNA, 15 bp, Homo sapiens
gcagcctccagagcc

SEQ ID NO: 1191174 - DNA, 19 bp, Homo sapiens
gcagcctccagagccagcc

SEQ ID NO: 1191175 - DNA, 21 bp, Homo sapiens
gcagcctccagagccagcctg

SEQ ID NO: 1191176 - DNA, 22 bp, Homo sapiens
gcagcctccagagccagcctgg

SEQ ID NO: 1191177 - DNA, 12 bp, Homo sapiens
gcagcctccagt

SEQ ID NO: 1191178 - DNA, 16 bp, Homo sapiens
gcagcctccctctgac

SEQ ID NO: 1191179 - DNA, 23 bp, Homo sapiens
gcagcctccgtcatccatgccct

SEQ ID NO: 1191180 - DNA, 23 bp, Homo sapiens
gcagcctcgagtgcccctgtccc

SEQ ID NO: 1191181 - DNA, 14 bp, Homo sapiens
gcagcctcgcacag

SEQ ID NO: 1191182 - DNA, 16 bp, Homo sapiens
gcagcctcgcacaggc

SEQ ID NO: 1191183 - DNA, 18 bp, Homo sapiens
gcagcctcgcacaggccc

SEQ ID NO: 1191184 - DNA, 17 bp, Homo sapiens
gcagcctctctggctgg

SEQ ID NO: 1191185 - DNA, 20 bp, Homo sapiens
gcagcctctctggctggtct

SEQ ID NO: 1191186 - DNA, 14 bp, Homo sapiens
gcagcctctgaagt

SEQ ID NO: 1191187 - DNA, 22 bp, Homo sapiens
gcagcctctgaagttggacagc

SEQ ID NO: 1191188 - DNA, 20 bp, Homo sapiens
gcagcctctggacagccagt

SEQ ID NO: 1191189 - DNA, 13 bp, Homo sapiens
gcagcctgaagcc

SEQ ID NO: 1191190 - DNA, 14 bp, Homo sapiens
gcagcctgaagcct

SEQ ID NO: 1191191 - DNA, 12 bp, Homo sapiens
gcagcctgatgg

SEQ ID NO: 1191192 - DNA, 21 bp, Homo sapiens
gcagcctgctctagtgggaca

SEQ ID NO: 1191193 - DNA, 13 bp, Homo sapiens
gcagcctggagac

SEQ ID NO: 1191194 - DNA, 16 bp, Homo sapiens
gcagcctgggctccct

SEQ ID NO: 1191195 - DNA, 17 bp, Homo sapiens
gcagcctggggcggtgt

SEQ ID NO: 1191196 - DNA, 14 bp, Homo sapiens
gcagcctggggctg

SEQ ID NO: 1191197 - DNA, 14 bp, Homo sapiens
gcagcctgggtctg

SEQ ID NO: 1191198 - DNA, 19 bp, Homo sapiens
gcagcctgggtctggatgg

SEQ ID NO: 1191199 - DNA, 24 bp, Homo sapiens
gcagcctggtcactaggcatcacc

SEQ ID NO: 1191200 - DNA, 14 bp, Homo sapiens
gcagcctgtatgtg

SEQ ID NO: 1191201 - DNA, 20 bp, Homo sapiens
gcagcctgtatgtggtgtgg

SEQ ID NO: 1191202 - DNA, 22 bp, Homo sapiens
gcagcctgtatgtggtgtgggg

SEQ ID NO: 1191203 - DNA, 18 bp, Homo sapiens
gcagcctgtgagggagtg

SEQ ID NO: 1191204 - DNA, 15 bp, Homo sapiens
gcagcctgtgcctgc

SEQ ID NO: 1191205 - DNA, 14 bp, Homo sapiens
gcagcctgtggcat

SEQ ID NO: 1191206 - DNA, 11 bp, Homo sapiens
gcagcctgttt

SEQ ID NO: 1191207 - DNA, 21 bp, Homo sapiens
gcagccttgcgctgtcccagg

SEQ ID NO: 1191208 - DNA, 15 bp, Homo sapiens
gcagcctttaatgca

SEQ ID NO: 1191209 - DNA, 20 bp, Homo sapiens
gcagccttttctggtccctc

SEQ ID NO: 1191210 - DNA, 14 bp, Homo sapiens
gcagcgacccttgg

SEQ ID NO: 1191211 - DNA, 15 bp, Homo sapiens
gcagcgacccttggt

SEQ ID NO: 1191212 - DNA, 17 bp, Homo sapiens
tcagcccctcttccctt

SEQ ID NO: 1191213 - DNA, 18 bp, Homo sapiens
tcagcccctgatctctga

SEQ ID NO: 1191214 - DNA, 13 bp, Homo sapiens
tcagcccctggga

SEQ ID NO: 1191215 - DNA, 17 bp, Homo sapiens
tcagcccgtttcagaag

SEQ ID NO: 1191216 - DNA, 19 bp, Homo sapiens
tcagccctagggtggagag

SEQ ID NO: 1191217 - DNA, 17 bp, Homo sapiens
tcagccctccctgcccc

SEQ ID NO: 1191218 - DNA, 18 bp, Homo sapiens
tcagccctccctgcccct

SEQ ID NO: 1191219 - DNA, 23 bp, Homo sapiens
tcagccctgaggtgaaagggagc

SEQ ID NO: 1191220 - DNA, 12 bp, Homo sapiens
tcagccctggcc

SEQ ID NO: 1191221 - DNA, 17 bp, Homo sapiens
tcagccctggccaagct

SEQ ID NO: 1191222 - DNA, 21 bp, Homo sapiens
tcagccctggccaagctttga

SEQ ID NO: 1191223 - DNA, 14 bp, Homo sapiens
tcagccctggcccc

SEQ ID NO: 1191224 - DNA, 15 bp, Homo sapiens
tcagccctggcctgg

SEQ ID NO: 1191225 - DNA, 17 bp, Homo sapiens
tcagccctggcctggct

SEQ ID NO: 1191226 - DNA, 12 bp, Homo sapiens
tcagccctgggc

SEQ ID NO: 1191227 - DNA, 18 bp, Homo sapiens
tcagccctgggccccacc

SEQ ID NO: 1191228 - DNA, 21 bp, Homo sapiens
tcagccctgggccccaccacc

SEQ ID NO: 1191229 - DNA, 22 bp, Homo sapiens
tcagccctgggccccaccacct

SEQ ID NO: 1191230 - DNA, 12 bp, Homo sapiens
tcagccctgtgt

SEQ ID NO: 1191231 - DNA, 23 bp, Homo sapiens
tcagccctgtgtctgtcacaggc

SEQ ID NO: 1191232 - DNA, 13 bp, Homo sapiens
tcagcccttgccc

SEQ ID NO: 1191233 - DNA, 13 bp, Homo sapiens
tcagcccttggct

SEQ ID NO: 1191234 - DNA, 11 bp, Homo sapiens
tcagccctttg

SEQ ID NO: 1191235 - DNA, 14 bp, Homo sapiens
tcagccctttgctc

SEQ ID NO: 1191236 - DNA, 17 bp, Homo sapiens
tcagccgagaaattggg

SEQ ID NO: 1191237 - DNA, 18 bp, Homo sapiens
tcagccgagccgggcctg

SEQ ID NO: 1191238 - DNA, 19 bp, Homo sapiens
tcagccgagccgggcctgg

SEQ ID NO: 1191239 - DNA, 16 bp, Homo sapiens
tcagccgggccctgag

SEQ ID NO: 1191240 - DNA, 23 bp, Homo sapiens
tcagccgtgtaaccatggaccca

SEQ ID NO: 1191241 - DNA, 15 bp, Homo sapiens
tcagcctactgcctc

SEQ ID NO: 1191242 - DNA, 19 bp, Homo sapiens
tcagcctagccgacctcag

SEQ ID NO: 1191243 - DNA, 21 bp, Homo sapiens
tcagcctagccgacctcagcc

SEQ ID NO: 1191244 - DNA, 23 bp, Homo sapiens
tcagcctagccgacctcagcctt

SEQ ID NO: 1191245 - DNA, 22 bp, Homo sapiens
tcagcctcccaagtagctggga

SEQ ID NO: 1191246 - DNA, 20 bp, Homo sapiens
tcagcctcccaggtagctgg

SEQ ID NO: 1191247 - DNA, 16 bp, Homo sapiens
tcagcctccccttctt

SEQ ID NO: 1191248 - DNA, 20 bp, Homo sapiens
tcagcctcccgagtagctgg

SEQ ID NO: 1191249 - DNA, 13 bp, Homo sapiens
tcagcctccctca

SEQ ID NO: 1191250 - DNA, 17 bp, Homo sapiens
tcagcctccctcagccc

SEQ ID NO: 1191251 - DNA, 22 bp, Homo sapiens
tcagcctccctcagcccccagg

SEQ ID NO: 1191252 - DNA, 15 bp, Homo sapiens
tcagcctcctgagcc

SEQ ID NO: 1191253 - DNA, 18 bp, Homo sapiens
tcagcctcctgagcctgt

SEQ ID NO: 1191254 - DNA, 20 bp, Homo sapiens
tcagcctcctgagtagctgg

SEQ ID NO: 1191255 - DNA, 21 bp, Homo sapiens
tcagcctcctgagtagctggg

SEQ ID NO: 1191256 - DNA, 15 bp, Homo sapiens
tcagcctcctgggta

SEQ ID NO: 1191257 - DNA, 11 bp, Homo sapiens
tcagcctgagt

SEQ ID NO: 1191258 - DNA, 20 bp, Homo sapiens
tcagcctgcccacctctccc

SEQ ID NO: 1191259 - DNA, 16 bp, Homo sapiens
tcagcctgctccagct

SEQ ID NO: 1191260 - DNA, 16 bp, Homo sapiens
tcagcctgctgcccag

SEQ ID NO: 1191261 - DNA, 21 bp, Homo sapiens
tcagcctgctgcccaggctgt

SEQ ID NO: 1191262 - DNA, 20 bp, Homo sapiens
tcagcctggagaggcctggg

SEQ ID NO: 1191263 - DNA, 16 bp, Homo sapiens
tcagcctggggctctc

SEQ ID NO: 1191264 - DNA, 18 bp, Homo sapiens
tcagcctggggctctctg

SEQ ID NO: 1191265 - DNA, 20 bp, Homo sapiens
tcagcctggggctctctgac

SEQ ID NO: 1191266 - DNA, 14 bp, Homo sapiens
tcagcctggtgggc

SEQ ID NO: 1191267 - DNA, 18 bp, Homo sapiens
tcagcctggtgggcctcc

SEQ ID NO: 1191268 - DNA, 16 bp, Homo sapiens
tcagcctgtgctgccc

SEQ ID NO: 1191269 - DNA, 17 bp, Homo sapiens
tcagcctgtgctgcccg

SEQ ID NO: 1191270 - DNA, 21 bp, Homo sapiens
tcagccttccccctcccaggg

SEQ ID NO: 1191271 - DNA, 22 bp, Homo sapiens
tcagccttccccttgcccaggg

SEQ ID NO: 1191272 - DNA, 15 bp, Homo sapiens
tcagccttcgtgtgg

SEQ ID NO: 1191273 - DNA, 19 bp, Homo sapiens
tcagccttcgtgtggctcc

SEQ ID NO: 1191274 - DNA, 14 bp, Homo sapiens
tcagccttctgagt

SEQ ID NO: 1191275 - DNA, 18 bp, Homo sapiens
tcagccttgcacacccac

SEQ ID NO: 1191276 - DNA, 21 bp, Homo sapiens
tcagccttgcacacccactgc

SEQ ID NO: 1191277 - DNA, 22 bp, Homo sapiens
tcagccttgcacacccactgcc

SEQ ID NO: 1191278 - DNA, 18 bp, Homo sapiens
tcagcctttaggtcttta

SEQ ID NO: 1191279 - DNA, 12 bp, Homo sapiens
tcagcctttgtt

SEQ ID NO: 1191280 - DNA, 22 bp, Homo sapiens
tcagcgaagtctcatgggaagc

SEQ ID NO: 1191281 - DNA, 16 bp, Homo sapiens
tcagcgactggatgct

SEQ ID NO: 1191282 - DNA, 14 bp, Homo sapiens
tcagcgcaggctgc

SEQ ID NO: 1191283 - DNA, 17 bp, Homo sapiens
tcagcgcaggctgcaga

SEQ ID NO: 1191284 - DNA, 20 bp, Homo sapiens
tcagcgcaggctgcagagcc

SEQ ID NO: 1191285 - DNA, 12 bp, Homo sapiens
tcagcggagggg

SEQ ID NO: 1191286 - DNA, 15 bp, Homo sapiens
tcaggggtgcacagt

SEQ ID NO: 1191287 - DNA, 17 bp, Homo sapiens
tcaggggtgcattctgg

SEQ ID NO: 1191288 - DNA, 12 bp, Homo sapiens
tcaggggtgtgc

SEQ ID NO: 1191289 - DNA, 18 bp, Homo sapiens
tcagggtcaaagacagaa

SEQ ID NO: 1191290 - DNA, 15 bp, Homo sapiens
tcagggtcctgccct

SEQ ID NO: 1191291 - DNA, 16 bp, Homo sapiens
tcagggtcctgccctc

SEQ ID NO: 1191292 - DNA, 24 bp, Homo sapiens
tcagggtctttctgatgacgcctg

SEQ ID NO: 1191293 - DNA, 18 bp, Homo sapiens
tcagggtgaactgcaaag

SEQ ID NO: 1191294 - DNA, 22 bp, Homo sapiens
tcagggtgcagcccaatctgcc

SEQ ID NO: 1191295 - DNA, 20 bp, Homo sapiens
tcagggtgggccactctccc

SEQ ID NO: 1191296 - DNA, 18 bp, Homo sapiens
tcagggttggtgtgctga

SEQ ID NO: 1191297 - DNA, 15 bp, Homo sapiens
tcaggtaacactaca

SEQ ID NO: 1191298 - DNA, 16 bp, Homo sapiens
tcaggtaatcatttta

SEQ ID NO: 1191299 - DNA, 17 bp, Homo sapiens
tcaggtaggcccttgtc

SEQ ID NO: 1191300 - DNA, 14 bp, Homo sapiens
tcaggtcagctggg

SEQ ID NO: 1191301 - DNA, 20 bp, Homo sapiens
tcaggtcagctgggagccag

SEQ ID NO: 1191302 - DNA, 23 bp, Homo sapiens
tcaggtcccacgtctggccaggc

SEQ ID NO: 1191303 - DNA, 22 bp, Homo sapiens
tcaggtccgtgggccgtatctg

SEQ ID NO: 1191304 - DNA, 14 bp, Homo sapiens
tcaggtctgtaact

SEQ ID NO: 1191305 - DNA, 15 bp, Homo sapiens
tcaggtctgtaactg

SEQ ID NO: 1191306 - DNA, 21 bp, Homo sapiens
tcaggtctgtaactgcccagc

SEQ ID NO: 1191307 - DNA, 14 bp, Homo sapiens
tcaggtgaacactt

SEQ ID NO: 1191308 - DNA, 17 bp, Homo sapiens
tcaggtgacgtgattct

SEQ ID NO: 1191309 - DNA, 22 bp, Homo sapiens
tcaggtgacttctagcagagac

SEQ ID NO: 1191310 - DNA, 16 bp, Homo sapiens
tcaggtgagaagcaga

SEQ ID NO: 1191311 - DNA, 21 bp, Homo sapiens
tcaggtgagaagcagaggaag

SEQ ID NO: 1191312 - DNA, 17 bp, Homo sapiens
tcaggtgatcaaaataa

SEQ ID NO: 1191313 - DNA, 20 bp, Homo sapiens
tcaggtgatccgcccacctc

SEQ ID NO: 1191314 - DNA, 12 bp, Homo sapiens
tcaggtgccact

SEQ ID NO: 1191315 - DNA, 19 bp, Homo sapiens
tcaggtgccactccctgag

SEQ ID NO: 1191316 - DNA, 20 bp, Homo sapiens
tcaggtgccactccctgagc

SEQ ID NO: 1191317 - DNA, 16 bp, Homo sapiens
tcaggtgccactgacc

SEQ ID NO: 1191318 - DNA, 18 bp, Homo sapiens
tcaggtgcttttgatgtg

SEQ ID NO: 1191319 - DNA, 11 bp, Homo sapiens
tcaggtggcca

SEQ ID NO: 1191320 - DNA, 13 bp, Homo sapiens
tcaggtggccatg

SEQ ID NO: 1191321 - DNA, 23 bp, Homo sapiens
tcaggtgtagtagttctgtgttg

SEQ ID NO: 1191322 - DNA, 22 bp, Homo sapiens
tcaggtgtgcctgttgctttct

SEQ ID NO: 1191323 - DNA, 14 bp, Homo sapiens
tcaggtgttgccaa

SEQ ID NO: 1191324 - DNA, 18 bp, Homo sapiens
tcaggtgttttaagactg

SEQ ID NO: 1191325 - DNA, 22 bp, Homo sapiens
tcaggtgttttttatgaagtgc

SEQ ID NO: 1191326 - DNA, 21 bp, Homo sapiens
tcaggttccagaacagccctc

SEQ ID NO: 1191327 - DNA, 13 bp, Homo sapiens
tcaggttcctttt

SEQ ID NO: 1191328 - DNA, 20 bp, Homo sapiens
tcaggttgtagtaaagaaat

SEQ ID NO: 1191329 - DNA, 15 bp, Homo sapiens
tcaggtttaacattt

SEQ ID NO: 1191330 - DNA, 18 bp, Homo sapiens
tcaggtttgcctgagggc

SEQ ID NO: 1191331 - DNA, 13 bp, Homo sapiens
tcaggtttggggt

SEQ ID NO: 1191332 - DNA, 14 bp, Homo sapiens
tcaggtttgttttg

SEQ ID NO: 1191333 - DNA, 15 bp, Homo sapiens
tcaggtttgttttgt

SEQ ID NO: 1191334 - DNA, 13 bp, Homo sapiens
tcaggttttgtaa

SEQ ID NO: 1191335 - DNA, 22 bp, Homo sapiens
tcagtaaataacaggcatttgt

SEQ ID NO: 1191336 - DNA, 18 bp, Homo sapiens
tcagtaaataactggaaa

SEQ ID NO: 1191337 - DNA, 15 bp, Homo sapiens
tcagtaacataactg

SEQ ID NO: 1191338 - DNA, 22 bp, Homo sapiens
tcagtaacataactgcttcttg

SEQ ID NO: 1191339 - DNA, 18 bp, Homo sapiens
tcagtaacatttctgttc

SEQ ID NO: 1191340 - DNA, 16 bp, Homo sapiens
tcagtaacccagctgc

SEQ ID NO: 1191341 - DNA, 17 bp, Homo sapiens
tcagtaagaaaaagaag

SEQ ID NO: 1191342 - DNA, 13 bp, Homo sapiens
tcagtaagccgtg

SEQ ID NO: 1191343 - DNA, 13 bp, Homo sapiens
tcagtaataactc

SEQ ID NO: 1191344 - DNA, 20 bp, Homo sapiens
tcagtacacttggtgtactg

SEQ ID NO: 1191345 - DNA, 16 bp, Homo sapiens
tcagtacgatcaagtt

SEQ ID NO: 1191346 - DNA, 19 bp, Homo sapiens
tcagtacgatcaagttgtt

SEQ ID NO: 1191347 - DNA, 21 bp, Homo sapiens
gcaggcttggggaaaatggcc

SEQ ID NO: 1191348 - DNA, 17 bp, Homo sapiens
gcagggaaagctccacg

SEQ ID NO: 1191349 - DNA, 22 bp, Homo sapiens
gcagggaaaggctctgaaagcc

SEQ ID NO: 1191350 - DNA, 14 bp, Homo sapiens
gcagggaagagggc

SEQ ID NO: 1191351 - DNA, 21 bp, Homo sapiens
gcagggaagaggggtgcagag

SEQ ID NO: 1191352 - DNA, 14 bp, Homo sapiens
gcagggacatgggg

SEQ ID NO: 1191353 - DNA, 16 bp, Homo sapiens
gcagggacatggggca

SEQ ID NO: 1191354 - DNA, 22 bp, Homo sapiens
gcagggacatggggcaagccag

SEQ ID NO: 1191355 - DNA, 22 bp, Homo sapiens
gcagggacccggggtctcctgg

SEQ ID NO: 1191356 - DNA, 19 bp, Homo sapiens
gcagggagacatctgcacc

SEQ ID NO: 1191357 - DNA, 13 bp, Homo sapiens
gcagggagagcgc

SEQ ID NO: 1191358 - DNA, 19 bp, Homo sapiens
gcagggagagcgcctcttc

SEQ ID NO: 1191359 - DNA, 14 bp, Homo sapiens
gcagggagagttgg

SEQ ID NO: 1191360 - DNA, 18 bp, Homo sapiens
gcagggagcaactctcca

SEQ ID NO: 1191361 - DNA, 16 bp, Homo sapiens
gcagggagctcaagcc

SEQ ID NO: 1191362 - DNA, 16 bp, Homo sapiens
gcagggagggcttctg

SEQ ID NO: 1191363 - DNA, 13 bp, Homo sapiens
gcagggaggggac

SEQ ID NO: 1191364 - DNA, 12 bp, Homo sapiens
gcagggaggggc

SEQ ID NO: 1191365 - DNA, 19 bp, Homo sapiens
gcagggaggggctggggca

SEQ ID NO: 1191366 - DNA, 20 bp, Homo sapiens
gcagggaggggctggggcag

SEQ ID NO: 1191367 - DNA, 16 bp, Homo sapiens
gcagggagtgatgatt

SEQ ID NO: 1191368 - DNA, 21 bp, Homo sapiens
gcagggatgatggcagagcca

SEQ ID NO: 1191369 - DNA, 22 bp, Homo sapiens
gcagggatgatggcagagccag

SEQ ID NO: 1191370 - DNA, 23 bp, Homo sapiens
gcagggcacagatgaccaaagtc

SEQ ID NO: 1191371 - DNA, 18 bp, Homo sapiens
gcagggcacggggacctg

SEQ ID NO: 1191372 - DNA, 18 bp, Homo sapiens
gcagggcagcctgtcacc

SEQ ID NO: 1191373 - DNA, 13 bp, Homo sapiens
gcagggcagtcat

SEQ ID NO: 1191374 - DNA, 22 bp, Homo sapiens
gcagggcatctcctgtgcatgg

SEQ ID NO: 1191375 - DNA, 17 bp, Homo sapiens
gcagggccacctgcagg

SEQ ID NO: 1191376 - DNA, 18 bp, Homo sapiens
gcagggccacctgcagga

SEQ ID NO: 1191377 - DNA, 18 bp, Homo sapiens
gcagggccagggcaatgc

SEQ ID NO: 1191378 - DNA, 21 bp, Homo sapiens
gcagggccatgcagacctcat

SEQ ID NO: 1191379 - DNA, 19 bp, Homo sapiens
gcagggcccaccttggacc

SEQ ID NO: 1191380 - DNA, 20 bp, Homo sapiens
gcagggcccacgtgtatagt

SEQ ID NO: 1191381 - DNA, 12 bp, Homo sapiens
gcagggcccctg

SEQ ID NO: 1191382 - DNA, 23 bp, Homo sapiens
gcagggccgctcgatgcctttgc

SEQ ID NO: 1191383 - DNA, 14 bp, Homo sapiens
gcagggcggggctg

SEQ ID NO: 1191384 - DNA, 21 bp, Homo sapiens
gcagggctaccctgagctgag

SEQ ID NO: 1191385 - DNA, 13 bp, Homo sapiens
gcagggctcccat

SEQ ID NO: 1191386 - DNA, 12 bp, Homo sapiens
gcagggctctga

SEQ ID NO: 1191387 - DNA, 22 bp, Homo sapiens
gcagggctggcacgtgacaggc

SEQ ID NO: 1191388 - DNA, 14 bp, Homo sapiens
gcagggctgggcct

SEQ ID NO: 1191389 - DNA, 19 bp, Homo sapiens
gcagggctgggcctgcgag

SEQ ID NO: 1191390 - DNA, 14 bp, Homo sapiens
gcagggctggtctt

SEQ ID NO: 1191391 - DNA, 23 bp, Homo sapiens
gcagggctgtgcttgaaggccct

SEQ ID NO: 1191392 - DNA, 13 bp, Homo sapiens
gcagggcttctcc

SEQ ID NO: 1191393 - DNA, 14 bp, Homo sapiens
gcagggcttctcct

SEQ ID NO: 1191394 - DNA, 18 bp, Homo sapiens
gcaggggaattttctctc

SEQ ID NO: 1191395 - DNA, 19 bp, Homo sapiens
gcaggggaattttctctcc

SEQ ID NO: 1191396 - DNA, 20 bp, Homo sapiens
gcaggggaattttctctcca

SEQ ID NO: 1191397 - DNA, 21 bp, Homo sapiens
gcaggggaattttctctccat

SEQ ID NO: 1191398 - DNA, 18 bp, Homo sapiens
gcaggggagacaggagcc

SEQ ID NO: 1191399 - DNA, 15 bp, Homo sapiens
gcaggggagcttggg

SEQ ID NO: 1191400 - DNA, 17 bp, Homo sapiens
gcaggggagcttgggac

SEQ ID NO: 1191401 - DNA, 21 bp, Homo sapiens
gcaggggagcttgggactcag

SEQ ID NO: 1191402 - DNA, 16 bp, Homo sapiens
gcaggggcaggcgcag

SEQ ID NO: 1191403 - DNA, 21 bp, Homo sapiens
gcaggggcaggcgcagaggtc

SEQ ID NO: 1191404 - DNA, 18 bp, Homo sapiens
gcaggggcatctgtctgt

SEQ ID NO: 1191405 - DNA, 23 bp, Homo sapiens
gcaggggcccacttggggccttc

SEQ ID NO: 1191406 - DNA, 16 bp, Homo sapiens
gcaggggcctggagat

SEQ ID NO: 1191407 - DNA, 13 bp, Homo sapiens
tcagtgcagtttc

SEQ ID NO: 1191408 - DNA, 14 bp, Homo sapiens
tcagtgcagtttct

SEQ ID NO: 1191409 - DNA, 16 bp, Homo sapiens
tcagtgcatttgtgct

SEQ ID NO: 1191410 - DNA, 20 bp, Homo sapiens
tcagtgccacctatgcctgt

SEQ ID NO: 1191411 - DNA, 15 bp, Homo sapiens
tcagtgccacttgac

SEQ ID NO: 1191412 - DNA, 20 bp, Homo sapiens
tcagtgccacttgacattcc

SEQ ID NO: 1191413 - DNA, 13 bp, Homo sapiens
tcagtgcccacca

SEQ ID NO: 1191414 - DNA, 14 bp, Homo sapiens
tcagtgccctccag

SEQ ID NO: 1191415 - DNA, 20 bp, Homo sapiens
tcagtgcctggtgttctgaa

SEQ ID NO: 1191416 - DNA, 18 bp, Homo sapiens
tcagtgccttcctctctc

SEQ ID NO: 1191417 - DNA, 14 bp, Homo sapiens
tcagtgctcagaaa

SEQ ID NO: 1191418 - DNA, 18 bp, Homo sapiens
tcagtgctcgagacacag

SEQ ID NO: 1191419 - DNA, 13 bp, Homo sapiens
tcagtgctctcag

SEQ ID NO: 1191420 - DNA, 12 bp, Homo sapiens
tcagtgctgcct

SEQ ID NO: 1191421 - DNA, 13 bp, Homo sapiens
tcagtgctgcctg

SEQ ID NO: 1191422 - DNA, 14 bp, Homo sapiens
tcagtgctgtggcc

SEQ ID NO: 1191423 - DNA, 19 bp, Homo sapiens
tcagtgctgtggcctgggc

SEQ ID NO: 1191424 - DNA, 13 bp, Homo sapiens
tcagtgcttgggc

SEQ ID NO: 1191425 - DNA, 17 bp, Homo sapiens
tcagtgcttgggctcca

SEQ ID NO: 1191426 - DNA, 23 bp, Homo sapiens
tcagtgctttttccttttcatct

SEQ ID NO: 1191427 - DNA, 19 bp, Homo sapiens
tcagtggactttccacccc

SEQ ID NO: 1191428 - DNA, 17 bp, Homo sapiens
tcagtggcgagaaataa

SEQ ID NO: 1191429 - DNA, 22 bp, Homo sapiens
tcagtggctggaattaaaacaa

SEQ ID NO: 1191430 - DNA, 19 bp, Homo sapiens
tcagtgggaacgtgactgc

SEQ ID NO: 1191431 - DNA, 23 bp, Homo sapiens
tcagtgggacaaaccagagcaga

SEQ ID NO: 1191432 - DNA, 14 bp, Homo sapiens
tcagtgggagaaaa

SEQ ID NO: 1191433 - DNA, 18 bp, Homo sapiens
tcagtggtagctctggct

SEQ ID NO: 1191434 - DNA, 16 bp, Homo sapiens
tcagtggtttctactt

SEQ ID NO: 1191435 - DNA, 14 bp, Homo sapiens
tcagtgtaaagtgt

SEQ ID NO: 1191436 - DNA, 22 bp, Homo sapiens
tcagtgtagaacctaattcaat

SEQ ID NO: 1191437 - DNA, 19 bp, Homo sapiens
tcagtgtagcgggaggaag

SEQ ID NO: 1191438 - DNA, 13 bp, Homo sapiens
tcagtgtattgtt

SEQ ID NO: 1191439 - DNA, 14 bp, Homo sapiens
tcagtgtatttgta

SEQ ID NO: 1191440 - DNA, 16 bp, Homo sapiens
tcagtgtatttgtatt

SEQ ID NO: 1191441 - DNA, 22 bp, Homo sapiens
tcagtgtatttttgtaaaaaat

SEQ ID NO: 1191442 - DNA, 14 bp, Homo sapiens
tcagtgtcccaggc

SEQ ID NO: 1191443 - DNA, 16 bp, Homo sapiens
tcagtgtcccaggcag

SEQ ID NO: 1191444 - DNA, 18 bp, Homo sapiens
tcagtgtcgggaattttc

SEQ ID NO: 1191445 - DNA, 12 bp, Homo sapiens
tcagtgtctctg

SEQ ID NO: 1191446 - DNA, 16 bp, Homo sapiens
tcagtgtgagtcagaa

SEQ ID NO: 1191447 - DNA, 17 bp, Homo sapiens
tcagtgtgagtcagaat

SEQ ID NO: 1191448 - DNA, 23 bp, Homo sapiens
tcagtgtggagaggggtgcaccc

SEQ ID NO: 1191449 - DNA, 16 bp, Homo sapiens
tcagtgtgtaaataat

SEQ ID NO: 1191450 - DNA, 15 bp, Homo sapiens
tcagtgttaaaaaat

SEQ ID NO: 1191451 - DNA, 15 bp, Homo sapiens
tcagtgttaaatgtg

SEQ ID NO: 1191452 - DNA, 21 bp, Homo sapiens
tcagtgttaaatgtgatgaat

SEQ ID NO: 1191453 - DNA, 16 bp, Homo sapiens
tcagtgttaaattcat

SEQ ID NO: 1191454 - DNA, 19 bp, Homo sapiens
tcagtgttacctgtgtgct

SEQ ID NO: 1191455 - DNA, 12 bp, Homo sapiens
tcagtgtttaca

SEQ ID NO: 1191456 - DNA, 23 bp, Homo sapiens
tcagtgttttggactccatctct

SEQ ID NO: 1191457 - DNA, 20 bp, Homo sapiens
tcagttacaagattgtaagt

SEQ ID NO: 1191458 - DNA, 17 bp, Homo sapiens
tcagttaccaaacatta

SEQ ID NO: 1191459 - DNA, 18 bp, Homo sapiens
tcagttacccactcggtc

SEQ ID NO: 1191460 - DNA, 14 bp, Homo sapiens
tcagttactcagcc

SEQ ID NO: 1191461 - DNA, 15 bp, Homo sapiens
tcagttactcagccc

SEQ ID NO: 1191462 - DNA, 16 bp, Homo sapiens
tcagttactctgaagg

SEQ ID NO: 1191463 - DNA, 14 bp, Homo sapiens
tcagttataaagtc

SEQ ID NO: 1191464 - DNA, 16 bp, Homo sapiens
tcagttatatgatatt

SEQ ID NO: 1191465 - DNA, 15 bp, Homo sapiens
tcagttcaaaaggag

SEQ ID NO: 1191466 - DNA, 22 bp, Homo sapiens
tcagttcaacctggtggcacca

SEQ ID NO: 1191467 - DNA, 20 bp, Homo sapiens
tcagttcaactttcagaagt

SEQ ID NO: 1191468 - DNA, 19 bp, Homo sapiens
tcagttcattgtggtcctt

SEQ ID NO: 1191469 - DNA, 12 bp, Homo sapiens
tcagttccaaga

SEQ ID NO: 1191470 - DNA, 23 bp, Homo sapiens
tcagttcccagacagctttttag

SEQ ID NO: 1191471 - DNA, 13 bp, Homo sapiens
tcagttcccagct

SEQ ID NO: 1191472 - DNA, 23 bp, Homo sapiens
tcagttcccagctccccccgccc

SEQ ID NO: 1191473 - DNA, 22 bp, Homo sapiens
tcagttcccggagcacagccct

SEQ ID NO: 1191474 - DNA, 12 bp, Homo sapiens
gcaggttcctgg

SEQ ID NO: 1191475 - DNA, 14 bp, Homo sapiens
gcaggttcctgggg

SEQ ID NO: 1191476 - DNA, 15 bp, Homo sapiens
gcaggttcctggggc

SEQ ID NO: 1191477 - DNA, 16 bp, Homo sapiens
gcaggttcctggggcc

SEQ ID NO: 1191478 - DNA, 18 bp, Homo sapiens
gcaggttcctggggccgc

SEQ ID NO: 1191479 - DNA, 19 bp, Homo sapiens
gcaggttctgcctgctttg

SEQ ID NO: 1191480 - DNA, 12 bp, Homo sapiens
gcaggttcttga

SEQ ID NO: 1191481 - DNA, 16 bp, Homo sapiens
gcaggttcttgatgtc

SEQ ID NO: 1191482 - DNA, 16 bp, Homo sapiens
gcaggttgaagccatg

SEQ ID NO: 1191483 - DNA, 16 bp, Homo sapiens
gcaggttgaggggctc

SEQ ID NO: 1191484 - DNA, 18 bp, Homo sapiens
gcaggtttcatttcttat

SEQ ID NO: 1191485 - DNA, 21 bp, Homo sapiens
gcaggtttctccttgaagcaa

SEQ ID NO: 1191486 - DNA, 19 bp, Homo sapiens
gcagtaaatacttgcagtt

SEQ ID NO: 1191487 - DNA, 15 bp, Homo sapiens
gcagtaagtcttttt

SEQ ID NO: 1191488 - DNA, 13 bp, Homo sapiens
gcagtaataaaaa

SEQ ID NO: 1191489 - DNA, 22 bp, Homo sapiens
gcagtaccctccattgggcaca

SEQ ID NO: 1191490 - DNA, 16 bp, Homo sapiens
gcagtacctataaagt

SEQ ID NO: 1191491 - DNA, 18 bp, Homo sapiens
gcagtacctgggaaagga

SEQ ID NO: 1191492 - DNA, 18 bp, Homo sapiens
gcagtagatgtgcttctg

SEQ ID NO: 1191493 - DNA, 22 bp, Homo sapiens
gcagtagctttggggaaaggga

SEQ ID NO: 1191494 - DNA, 17 bp, Homo sapiens
gcagtagtctctgtgct

SEQ ID NO: 1191495 - DNA, 16 bp, Homo sapiens
gcagtagttttcaaaa

SEQ ID NO: 1191496 - DNA, 20 bp, Homo sapiens
gcagtatataataactttat

SEQ ID NO: 1191497 - DNA, 12 bp, Homo sapiens
gcagtatatttc

SEQ ID NO: 1191498 - DNA, 17 bp, Homo sapiens
gcagtatgatggcagga

SEQ ID NO: 1191499 - DNA, 16 bp, Homo sapiens
gcagtattttgtgtcc

SEQ ID NO: 1191500 - DNA, 14 bp, Homo sapiens
gcagtcaccaccca

SEQ ID NO: 1191501 - DNA, 13 bp, Homo sapiens
gcagtcactgtga

SEQ ID NO: 1191502 - DNA, 19 bp, Homo sapiens
gcagtcagagtccagtgct

SEQ ID NO: 1191503 - DNA, 15 bp, Homo sapiens
gcagtccccagccct

SEQ ID NO: 1191504 - DNA, 17 bp, Homo sapiens
gcagtccccagcccttc

SEQ ID NO: 1191505 - DNA, 14 bp, Homo sapiens
gcagtcctgaggag

SEQ ID NO: 1191506 - DNA, 15 bp, Homo sapiens
gcagtcgcaggatcc

SEQ ID NO: 1191507 - DNA, 21 bp, Homo sapiens
gcagtcgcaggatccgctgcc

SEQ ID NO: 1191508 - DNA, 20 bp, Homo sapiens
gcagtcggcatgccaggacc

SEQ ID NO: 1191509 - DNA, 18 bp, Homo sapiens
gcagtcgggggctggcct

SEQ ID NO: 1191510 - DNA, 13 bp, Homo sapiens
gcagtcgtgcctg

SEQ ID NO: 1191511 - DNA, 18 bp, Homo sapiens
gcagtcgtgcctgtgtcc

SEQ ID NO: 1191512 - DNA, 19 bp, Homo sapiens
gcagtcgtggctttggcag

SEQ ID NO: 1191513 - DNA, 21 bp, Homo sapiens
gcagtcgtgtaattggcccaa

SEQ ID NO: 1191514 - DNA, 18 bp, Homo sapiens
gcagtctaccctgtcctt

SEQ ID NO: 1191515 - DNA, 18 bp, Homo sapiens
gcagtctcgggtggctag

SEQ ID NO: 1191516 - DNA, 13 bp, Homo sapiens
gcagtctgaaccc

SEQ ID NO: 1191517 - DNA, 18 bp, Homo sapiens
gcagtctgaacccttgtg

SEQ ID NO: 1191518 - DNA, 22 bp, Homo sapiens
gcagtctgaacccttgtgcttg

SEQ ID NO: 1191519 - DNA, 20 bp, Homo sapiens
gcagtctgcccacgcagagg

SEQ ID NO: 1191520 - DNA, 23 bp, Homo sapiens
gcagtctgctctgctgctctgac

SEQ ID NO: 1191521 - DNA, 20 bp, Homo sapiens
gcagtcttgcaacagtgcca

SEQ ID NO: 1191522 - DNA, 12 bp, Homo sapiens
gcagtcttgctc

SEQ ID NO: 1191523 - DNA, 20 bp, Homo sapiens
gcagtgaatgattcagtgtt

SEQ ID NO: 1191524 - DNA, 16 bp, Homo sapiens
gcagtgaatttgaata

SEQ ID NO: 1191525 - DNA, 18 bp, Homo sapiens
gcagtgactggcaggtgc

SEQ ID NO: 1191526 - DNA, 14 bp, Homo sapiens
gcagtgactttgta

SEQ ID NO: 1191527 - DNA, 22 bp, Homo sapiens
gcagtgagaaaaagctcctgtc

SEQ ID NO: 1191528 - DNA, 17 bp, Homo sapiens
gcagtgagactgcaggt

SEQ ID NO: 1191529 - DNA, 21 bp, Homo sapiens
tcatcactttgacctaaatta

SEQ ID NO: 1191530 - DNA, 15 bp, Homo sapiens
tcatcacttttcagt

SEQ ID NO: 1191531 - DNA, 15 bp, Homo sapiens
tcatcagagcctttc

SEQ ID NO: 1191532 - DNA, 18 bp, Homo sapiens
tcatcagaggggagcagc

SEQ ID NO: 1191533 - DNA, 13 bp, Homo sapiens
tcatcagatgcct

SEQ ID NO: 1191534 - DNA, 22 bp, Homo sapiens
tcatcagatgcttgcggcaaaa

SEQ ID NO: 1191535 - DNA, 16 bp, Homo sapiens
tcatcagccaccatcc

SEQ ID NO: 1191536 - DNA, 17 bp, Homo sapiens
tcatcagccagcaagag

SEQ ID NO: 1191537 - DNA, 20 bp, Homo sapiens
tcatcaggctctgttcctca

SEQ ID NO: 1191538 - DNA, 14 bp, Homo sapiens
tcatcagggcctgg

SEQ ID NO: 1191539 - DNA, 21 bp, Homo sapiens
tcatcagggcctggggcctga

SEQ ID NO: 1191540 - DNA, 20 bp, Homo sapiens
tcatcatattgtatgtaagt

SEQ ID NO: 1191541 - DNA, 15 bp, Homo sapiens
tcatcatcagggcct

SEQ ID NO: 1191542 - DNA, 13 bp, Homo sapiens
tcatcatgatgga

SEQ ID NO: 1191543 - DNA, 21 bp, Homo sapiens
tcatcatgcttatgttaaact

SEQ ID NO: 1191544 - DNA, 13 bp, Homo sapiens
tcatcattctctg

SEQ ID NO: 1191545 - DNA, 14 bp, Homo sapiens
tcatcattctctgt

SEQ ID NO: 1191546 - DNA, 19 bp, Homo sapiens
tcatcattctctgtctcat

SEQ ID NO: 1191547 - DNA, 15 bp, Homo sapiens
tcatcattcttgtgg

SEQ ID NO: 1191548 - DNA, 17 bp, Homo sapiens
tcatcattcttgtggga

SEQ ID NO: 1191549 - DNA, 19 bp, Homo sapiens
tcatcattcttgtgggaga

SEQ ID NO: 1191550 - DNA, 23 bp, Homo sapiens
tcatcattcttgtgggagacagc

SEQ ID NO: 1191551 - DNA, 19 bp, Homo sapiens
tcatcattgtatatatgtg

SEQ ID NO: 1191552 - DNA, 16 bp, Homo sapiens
tcatcatttcagccaa

SEQ ID NO: 1191553 - DNA, 21 bp, Homo sapiens
tcatccaaaatattttttgca

SEQ ID NO: 1191554 - DNA, 14 bp, Homo sapiens
tcatccaacaagaa

SEQ ID NO: 1191555 - DNA, 16 bp, Homo sapiens
tcatccaacaagaaga

SEQ ID NO: 1191556 - DNA, 19 bp, Homo sapiens
tcatccaacaagaagaaat

SEQ ID NO: 1191557 - DNA, 18 bp, Homo sapiens
tcatccaatcctcactgg

SEQ ID NO: 1191558 - DNA, 20 bp, Homo sapiens
tcatccaatcctcactgggt

SEQ ID NO: 1191559 - DNA, 22 bp, Homo sapiens
tcatccaatcctcactgggtgg

SEQ ID NO: 1191560 - DNA, 14 bp, Homo sapiens
tcatccaccccatc

SEQ ID NO: 1191561 - DNA, 20 bp, Homo sapiens
tcatccaccccatccctccc

SEQ ID NO: 1191562 - DNA, 19 bp, Homo sapiens
tcatccacccgctgcccct

SEQ ID NO: 1191563 - DNA, 20 bp, Homo sapiens
tcatccacccgctgcccctc

SEQ ID NO: 1191564 - DNA, 21 bp, Homo sapiens
tcatccacccgctgcccctcc

SEQ ID NO: 1191565 - DNA, 22 bp, Homo sapiens
tcatccacccgctgcccctccc

SEQ ID NO: 1191566 - DNA, 19 bp, Homo sapiens
tcatccactagtgcaaatc

SEQ ID NO: 1191567 - DNA, 14 bp, Homo sapiens
tcatccaggactga

SEQ ID NO: 1191568 - DNA, 12 bp, Homo sapiens
tcatccaggcct

SEQ ID NO: 1191569 - DNA, 12 bp, Homo sapiens
tcatccatcatc

SEQ ID NO: 1191570 - DNA, 16 bp, Homo sapiens
tcatccatcatcatgt

SEQ ID NO: 1191571 - DNA, 14 bp, Homo sapiens
tcatccatgccctc

SEQ ID NO: 1191572 - DNA, 14 bp, Homo sapiens
tcatccatttcttt

SEQ ID NO: 1191573 - DNA, 20 bp, Homo sapiens
tcatcccacttcctttccta

SEQ ID NO: 1191574 - DNA, 20 bp, Homo sapiens
tcatcccattaatcatttcc

SEQ ID NO: 1191575 - DNA, 22 bp, Homo sapiens
tcatcccattaatcatttcccc

SEQ ID NO: 1191576 - DNA, 21 bp, Homo sapiens
tcatccccaggggtcccagcc

SEQ ID NO: 1191577 - DNA, 13 bp, Homo sapiens
tcatccccccacc

SEQ ID NO: 1191578 - DNA, 13 bp, Homo sapiens
tcatcccccctgc

SEQ ID NO: 1191579 - DNA, 19 bp, Homo sapiens
tcatcccccctgctgccca

SEQ ID NO: 1191580 - DNA, 14 bp, Homo sapiens
tcatccccctgtgg

SEQ ID NO: 1191581 - DNA, 15 bp, Homo sapiens
tcatccccctgtgga

SEQ ID NO: 1191582 - DNA, 11 bp, Homo sapiens
tcatcccctcc

SEQ ID NO: 1191583 - DNA, 14 bp, Homo sapiens
tcatcccctctcag

SEQ ID NO: 1191584 - DNA, 15 bp, Homo sapiens
tcatcccctctcagg

SEQ ID NO: 1191585 - DNA, 23 bp, Homo sapiens
tcatcccgagcacctccacatcc

SEQ ID NO: 1191586 - DNA, 14 bp, Homo sapiens
tcatccgaggcagg

SEQ ID NO: 1191587 - DNA, 15 bp, Homo sapiens
tcatccgaggcaggg

SEQ ID NO: 1191588 - DNA, 18 bp, Homo sapiens
tcatccgcctgtgggcgc

SEQ ID NO: 1191589 - DNA, 14 bp, Homo sapiens
tcatcctaacatga

SEQ ID NO: 1191590 - DNA, 13 bp, Homo sapiens
tcatcctcaggaa

SEQ ID NO: 1191591 - DNA, 21 bp, Homo sapiens
tcatcctccagtaccttgctt

SEQ ID NO: 1191592 - DNA, 14 bp, Homo sapiens
tcatcctcctggaa

SEQ ID NO: 1191593 - DNA, 15 bp, Homo sapiens
tcatcctcctggaac

SEQ ID NO: 1191594 - DNA, 16 bp, Homo sapiens
tcatcctcctggaacc

SEQ ID NO: 1191595 - DNA, 22 bp, Homo sapiens
tcatcctcctggaaccttgctg

SEQ ID NO: 1191596 - DNA, 23 bp, Homo sapiens
tcatcctcctggaaccttgctgt

SEQ ID NO: 1191597 - DNA, 13 bp, Homo sapiens
tcatcctgaccaa

SEQ ID NO: 1191598 - DNA, 17 bp, Homo sapiens
tcatcctgccctgcagc

SEQ ID NO: 1191599 - DNA, 18 bp, Homo sapiens
tcatcctgccctgcagca

SEQ ID NO: 1191600 - DNA, 20 bp, Homo sapiens
tcatcctgtagggcacccaa

SEQ ID NO: 1191601 - DNA, 20 bp, Homo sapiens
tcatcctgtgtcccctgacc

SEQ ID NO: 1191602 - DNA, 15 bp, Homo sapiens
tcatcctgttttctc

SEQ ID NO: 1191603 - DNA, 16 bp, Homo sapiens
tcatcctgttttctct

SEQ ID NO: 1191604 - DNA, 17 bp, Homo sapiens
tcatccttggtgctctt

SEQ ID NO: 1191605 - DNA, 16 bp, Homo sapiens
tcatcctttccctctc

SEQ ID NO: 1191606 - DNA, 20 bp, Homo sapiens
tcatcctttgttctgagcat

SEQ ID NO: 1191607 - DNA, 17 bp, Homo sapiens
tcatccttttttctctt

SEQ ID NO: 1191608 - DNA, 17 bp, Homo sapiens
gcatcccttcccacatg

SEQ ID NO: 1191609 - DNA, 23 bp, Homo sapiens
gcatcccttcccacatgcctgcg

SEQ ID NO: 1191610 - DNA, 19 bp, Homo sapiens
gcatcccttcgcctgcagc

SEQ ID NO: 1191611 - DNA, 16 bp, Homo sapiens
gcatccgcaggtgctg

SEQ ID NO: 1191612 - DNA, 17 bp, Homo sapiens
gcatccgcaggtgctgg

SEQ ID NO: 1191613 - DNA, 18 bp, Homo sapiens
gcatccgcaggtgctggt

SEQ ID NO: 1191614 - DNA, 20 bp, Homo sapiens
gcatccgcaggtgctggtcc

SEQ ID NO: 1191615 - DNA, 18 bp, Homo sapiens
gcatccgtagttccctga

SEQ ID NO: 1191616 - DNA, 19 bp, Homo sapiens
gcatccgtagttccctgaa

SEQ ID NO: 1191617 - DNA, 14 bp, Homo sapiens
gcatccgtcctggg

SEQ ID NO: 1191618 - DNA, 14 bp, Homo sapiens
gcatcctatgctta

SEQ ID NO: 1191619 - DNA, 16 bp, Homo sapiens
gcatcctatgcttaat

SEQ ID NO: 1191620 - DNA, 18 bp, Homo sapiens
gcatcctccacaatagca

SEQ ID NO: 1191621 - DNA, 16 bp, Homo sapiens
gcatcctcctcagccc

SEQ ID NO: 1191622 - DNA, 21 bp, Homo sapiens
gcatcctgagccccgccctct

SEQ ID NO: 1191623 - DNA, 16 bp, Homo sapiens
gcatcctgaggccagt

SEQ ID NO: 1191624 - DNA, 19 bp, Homo sapiens
gcatcctgaggccagtggc

SEQ ID NO: 1191625 - DNA, 11 bp, Homo sapiens
gcatcctggat

SEQ ID NO: 1191626 - DNA, 13 bp, Homo sapiens
gcatcctggatga

SEQ ID NO: 1191627 - DNA, 15 bp, Homo sapiens
gcatccttgcctgtc

SEQ ID NO: 1191628 - DNA, 17 bp, Homo sapiens
gcatccttgcctgtcta

SEQ ID NO: 1191629 - DNA, 12 bp, Homo sapiens
gcatcgcaggag

SEQ ID NO: 1191630 - DNA, 20 bp, Homo sapiens
gcatcgggaaagaagaaact

SEQ ID NO: 1191631 - DNA, 19 bp, Homo sapiens
gcatcgggagcacccagag

SEQ ID NO: 1191632 - DNA, 17 bp, Homo sapiens
gcatcgggggcctgcaa

SEQ ID NO: 1191633 - DNA, 15 bp, Homo sapiens
gcatcgtagaagaga

SEQ ID NO: 1191634 - DNA, 22 bp, Homo sapiens
gcatcgtagaagagatgtggca

SEQ ID NO: 1191635 - DNA, 18 bp, Homo sapiens
gcatctaatgaaaaacaa

SEQ ID NO: 1191636 - DNA, 21 bp, Homo sapiens
gcatctacttgccagaaccaa

SEQ ID NO: 1191637 - DNA, 22 bp, Homo sapiens
gcatctcaaaacagagggctgc

SEQ ID NO: 1191638 - DNA, 17 bp, Homo sapiens
gcatctcagtatgaatt

SEQ ID NO: 1191639 - DNA, 15 bp, Homo sapiens
gcatctcctgtgcat

SEQ ID NO: 1191640 - DNA, 14 bp, Homo sapiens
gcatctctgtactt

SEQ ID NO: 1191641 - DNA, 17 bp, Homo sapiens
gcatctctgtactttgc

SEQ ID NO: 1191642 - DNA, 16 bp, Homo sapiens
gcatctcttccccaga

SEQ ID NO: 1191643 - DNA, 20 bp, Homo sapiens
gcatctcttccccagagagg

SEQ ID NO: 1191644 - DNA, 16 bp, Homo sapiens
gcatctcttgaggcca

SEQ ID NO: 1191645 - DNA, 17 bp, Homo sapiens
gcatctcttgaggccag

SEQ ID NO: 1191646 - DNA, 19 bp, Homo sapiens
gcatctgacacaaaaaaag

SEQ ID NO: 1191647 - DNA, 15 bp, Homo sapiens
gcatctgagaaaggt

SEQ ID NO: 1191648 - DNA, 13 bp, Homo sapiens
gcatctgatagaa

SEQ ID NO: 1191649 - DNA, 12 bp, Homo sapiens
gcatctgcccct

SEQ ID NO: 1191650 - DNA, 14 bp, Homo sapiens
gcatctgcccctcc

SEQ ID NO: 1191651 - DNA, 22 bp, Homo sapiens
gcatggctcagatcggccacag

SEQ ID NO: 1191652 - DNA, 13 bp, Homo sapiens
gcatggctccagt

SEQ ID NO: 1191653 - DNA, 21 bp, Homo sapiens
gcatggctccagtctgctgcc

SEQ ID NO: 1191654 - DNA, 14 bp, Homo sapiens
gcatggctgtctgc

SEQ ID NO: 1191655 - DNA, 19 bp, Homo sapiens
gcatgggaaagccacctct

SEQ ID NO: 1191656 - DNA, 20 bp, Homo sapiens
gcatgggaaagccacctctc

SEQ ID NO: 1191657 - DNA, 14 bp, Homo sapiens
gcatgggaggtgag

SEQ ID NO: 1191658 - DNA, 15 bp, Homo sapiens
gcatgggcactccct

SEQ ID NO: 1191659 - DNA, 17 bp, Homo sapiens
gcatgggcctctctggg

SEQ ID NO: 1191660 - DNA, 13 bp, Homo sapiens
gcatgggcctggc

SEQ ID NO: 1191661 - DNA, 22 bp, Homo sapiens
gcatgggcctggccacctctct

SEQ ID NO: 1191662 - DNA, 18 bp, Homo sapiens
gcatgggcgcaggcccag

SEQ ID NO: 1191663 - DNA, 19 bp, Homo sapiens
gcatgggcgcaggcccagt

SEQ ID NO: 1191664 - DNA, 16 bp, Homo sapiens
gcatggggaggcagca

SEQ ID NO: 1191665 - DNA, 23 bp, Homo sapiens
gcatggggataaaggagaaggca

SEQ ID NO: 1191666 - DNA, 16 bp, Homo sapiens
gcatggggcagaggct

SEQ ID NO: 1191667 - DNA, 14 bp, Homo sapiens
gcatggggcatgtc

SEQ ID NO: 1191668 - DNA, 13 bp, Homo sapiens
gcatggggcccct

SEQ ID NO: 1191669 - DNA, 14 bp, Homo sapiens
gcatggggcccctg

SEQ ID NO: 1191670 - DNA, 19 bp, Homo sapiens
gcatggggcccctggccca

SEQ ID NO: 1191671 - DNA, 17 bp, Homo sapiens
gcatggggtcagcccca

SEQ ID NO: 1191672 - DNA, 15 bp, Homo sapiens
gcatggggtttttat

SEQ ID NO: 1191673 - DNA, 18 bp, Homo sapiens
gcatgggtccaagagaca

SEQ ID NO: 1191674 - DNA, 20 bp, Homo sapiens
gcatgggtccaagagacatg

SEQ ID NO: 1191675 - DNA, 18 bp, Homo sapiens
gcatgggtccagggcctg

SEQ ID NO: 1191676 - DNA, 21 bp, Homo sapiens
gcatgggtccagggcctgaca

SEQ ID NO: 1191677 - DNA, 18 bp, Homo sapiens
gcatggtcacacactgat

SEQ ID NO: 1191678 - DNA, 22 bp, Homo sapiens
gcatggtgagtgttggggttga

SEQ ID NO: 1191679 - DNA, 13 bp, Homo sapiens
gcatggtgcagtt

SEQ ID NO: 1191680 - DNA, 17 bp, Homo sapiens
gcatggtggctcatgcc

SEQ ID NO: 1191681 - DNA, 21 bp, Homo sapiens
gcatggtggctcatgcctgta

SEQ ID NO: 1191682 - DNA, 18 bp, Homo sapiens
gcatggtggtgcgtgcct

SEQ ID NO: 1191683 - DNA, 18 bp, Homo sapiens
gcatggttccttccctgg

SEQ ID NO: 1191684 - DNA, 20 bp, Homo sapiens
gcatgtaccatttgcatggc

SEQ ID NO: 1191685 - DNA, 14 bp, Homo sapiens
gcatgtagccagtt

SEQ ID NO: 1191686 - DNA, 21 bp, Homo sapiens
gcatgtagccagttaaggaaa

SEQ ID NO: 1191687 - DNA, 13 bp, Homo sapiens
gcatgtagtaaca

SEQ ID NO: 1191688 - DNA, 21 bp, Homo sapiens
gcatgtagtaacactaatata

SEQ ID NO: 1191689 - DNA, 15 bp, Homo sapiens
gcatgtattggcctg

SEQ ID NO: 1191690 - DNA, 19 bp, Homo sapiens
gcatgtattggcctggagg

SEQ ID NO: 1191691 - DNA, 16 bp, Homo sapiens
gcatgtcaacttttga

SEQ ID NO: 1191692 - DNA, 22 bp, Homo sapiens
gcatgtcagaggaccccagggt

SEQ ID NO: 1191693 - DNA, 17 bp, Homo sapiens
gcatgtcccacccaccc

SEQ ID NO: 1191694 - DNA, 19 bp, Homo sapiens
gcatgtcctgtaaaggtta

SEQ ID NO: 1191695 - DNA, 17 bp, Homo sapiens
gcatgtctctgcttcca

SEQ ID NO: 1191696 - DNA, 12 bp, Homo sapiens
gcatgtctgcac

SEQ ID NO: 1191697 - DNA, 13 bp, Homo sapiens
gcatgtctgcacc

SEQ ID NO: 1191698 - DNA, 18 bp, Homo sapiens
gcatgtctgcacctccgc

SEQ ID NO: 1191699 - DNA, 15 bp, Homo sapiens
gcatgtctgttcttc

SEQ ID NO: 1191700 - DNA, 16 bp, Homo sapiens
gcatgtctgttcttct

SEQ ID NO: 1191701 - DNA, 15 bp, Homo sapiens
gcatgtcttttaaaa

SEQ ID NO: 1191702 - DNA, 21 bp, Homo sapiens
gcatgtgaagcatgctttgct

SEQ ID NO: 1191703 - DNA, 11 bp, Homo sapiens
gcatgtgccaa

SEQ ID NO: 1191704 - DNA, 14 bp, Homo sapiens
gcatgtgccctcct

SEQ ID NO: 1191705 - DNA, 19 bp, Homo sapiens
gcatgtgccctcctgaggg

SEQ ID NO: 1191706 - DNA, 18 bp, Homo sapiens
gcatgtgcggctgaactg

SEQ ID NO: 1191707 - DNA, 19 bp, Homo sapiens
gcatgtgcggctgaactga

SEQ ID NO: 1191708 - DNA, 15 bp, Homo sapiens
gcatgtgtcccttcc

SEQ ID NO: 1191709 - DNA, 11 bp, Homo sapiens
gcatgtgtgcc

SEQ ID NO: 1191710 - DNA, 17 bp, Homo sapiens
gcatgtgtgcctgtggc

SEQ ID NO: 1191711 - DNA, 18 bp, Homo sapiens
gcatgtgtgcctgtggca

SEQ ID NO: 1191712 - DNA, 19 bp, Homo sapiens
gcatgtgtgcctgtggcag

SEQ ID NO: 1191713 - DNA, 16 bp, Homo sapiens
gcatgtgtgtgctcag

SEQ ID NO: 1191714 - DNA, 15 bp, Homo sapiens
gcatgtgtgtgtctg

SEQ ID NO: 1191715 - DNA, 22 bp, Homo sapiens
gcatgtgttaatcttaatgtat

SEQ ID NO: 1191716 - DNA, 21 bp, Homo sapiens
gcatgttaagtgccattacta

SEQ ID NO: 1191717 - DNA, 14 bp, Homo sapiens
gcatgttatgttta

SEQ ID NO: 1191718 - DNA, 16 bp, Homo sapiens
gcatgttgctgaggag

SEQ ID NO: 1191719 - DNA, 22 bp, Homo sapiens
gcatgttggggtttcctttacc

SEQ ID NO: 1191720 - DNA, 21 bp, Homo sapiens
gcatgttgttttttcatagtg

SEQ ID NO: 1191721 - DNA, 12 bp, Homo sapiens
gcatgtttactt

SEQ ID NO: 1191722 - DNA, 18 bp, Homo sapiens
gcatgtttattctgttcc

SEQ ID NO: 1191723 - DNA, 14 bp, Homo sapiens
gcatgtttgaaatg

SEQ ID NO: 1191724 - DNA, 15 bp, Homo sapiens
gcatgtttgaaatga

SEQ ID NO: 1191725 - DNA, 18 bp, Homo sapiens
gcatgttttgtgcatttg

SEQ ID NO: 1191726 - DNA, 13 bp, Homo sapiens
gcattaaaagaaa

SEQ ID NO: 1191727 - DNA, 17 bp, Homo sapiens
gcattaaaccacatcat

SEQ ID NO: 1191728 - DNA, 22 bp, Homo sapiens
gcattaaattcacaaactttta

SEQ ID NO: 1191729 - DNA, 13 bp, Homo sapiens
gcattaacacaaa

SEQ ID NO: 1191730 - DNA, 21 bp, Homo sapiens
gcattaaccactctacagact

SEQ ID NO: 1191731 - DNA, 16 bp, Homo sapiens
gcattaactaaatgct

SEQ ID NO: 1191732 - DNA, 16 bp, Homo sapiens
gcattaacttctctgg

SEQ ID NO: 1191733 - DNA, 15 bp, Homo sapiens
gcattaagcacacac

SEQ ID NO: 1191734 - DNA, 12 bp, Homo sapiens
gcattaatgttt

SEQ ID NO: 1191735 - DNA, 13 bp, Homo sapiens
gcattaattatta

SEQ ID NO: 1191736 - DNA, 14 bp, Homo sapiens
gcattacagagagg

SEQ ID NO: 1191737 - DNA, 19 bp, Homo sapiens
gcattacagagaggagaaa

SEQ ID NO: 1191738 - DNA, 21 bp, Homo sapiens
tcatgggaatgatagcccaga

SEQ ID NO: 1191739 - DNA, 23 bp, Homo sapiens
tcatgggagggggcttgaagcca

SEQ ID NO: 1191740 - DNA, 17 bp, Homo sapiens
tcatggggatctggggg

SEQ ID NO: 1191741 - DNA, 19 bp, Homo sapiens
tcatggggatctggggggt

SEQ ID NO: 1191742 - DNA, 16 bp, Homo sapiens
tcatggggtggggttg

SEQ ID NO: 1191743 - DNA, 15 bp, Homo sapiens
tcatgggtcaagaga

SEQ ID NO: 1191744 - DNA, 17 bp, Homo sapiens
tcatgggtcctagccct

SEQ ID NO: 1191745 - DNA, 15 bp, Homo sapiens
tcatggtaatgacag

SEQ ID NO: 1191746 - DNA, 18 bp, Homo sapiens
tcatggtactaccccagc

SEQ ID NO: 1191747 - DNA, 14 bp, Homo sapiens
tcatggtagatttt

SEQ ID NO: 1191748 - DNA, 14 bp, Homo sapiens
tcatggtgaaaatg

SEQ ID NO: 1191749 - DNA, 22 bp, Homo sapiens
tcatggtgaccaccccctgttc

SEQ ID NO: 1191750 - DNA, 16 bp, Homo sapiens
tcatggtgtgttacac

SEQ ID NO: 1191751 - DNA, 13 bp, Homo sapiens
tcatgtaaatgct

SEQ ID NO: 1191752 - DNA, 16 bp, Homo sapiens
tcatgtaaatgctcat

SEQ ID NO: 1191753 - DNA, 22 bp, Homo sapiens
tcatgtaaatgctcattttctt

SEQ ID NO: 1191754 - DNA, 22 bp, Homo sapiens
tcatgtaaattgactgtactag

SEQ ID NO: 1191755 - DNA, 13 bp, Homo sapiens
tcatgtaactctc

SEQ ID NO: 1191756 - DNA, 15 bp, Homo sapiens
tcatgtacagcatta

SEQ ID NO: 1191757 - DNA, 16 bp, Homo sapiens
tcatgtaccatcaata

SEQ ID NO: 1191758 - DNA, 14 bp, Homo sapiens
tcatgtacttcctg

SEQ ID NO: 1191759 - DNA, 15 bp, Homo sapiens
tcatgtacttcctgt

SEQ ID NO: 1191760 - DNA, 16 bp, Homo sapiens
tcatgtaggtgagcct

SEQ ID NO: 1191761 - DNA, 17 bp, Homo sapiens
tcatgtaggtgagcctg

SEQ ID NO: 1191762 - DNA, 18 bp, Homo sapiens
tcatgtaggtgagcctgg

SEQ ID NO: 1191763 - DNA, 20 bp, Homo sapiens
tcatgtaggtgagcctgggc

SEQ ID NO: 1191764 - DNA, 16 bp, Homo sapiens
tcatgtatatttagtt

SEQ ID NO: 1191765 - DNA, 12 bp, Homo sapiens
tcatgtatgttt

SEQ ID NO: 1191766 - DNA, 14 bp, Homo sapiens
tcatgtattttatg

SEQ ID NO: 1191767 - DNA, 23 bp, Homo sapiens
tcatgtcaaatatttagatgtaa

SEQ ID NO: 1191768 - DNA, 17 bp, Homo sapiens
tcatgtcaacttctggc

SEQ ID NO: 1191769 - DNA, 18 bp, Homo sapiens
tcatgtcaacttctggct

SEQ ID NO: 1191770 - DNA, 19 bp, Homo sapiens
tcatgtcaggcctgtgtgt

SEQ ID NO: 1191771 - DNA, 13 bp, Homo sapiens
tcatgtccctcca

SEQ ID NO: 1191772 - DNA, 22 bp, Homo sapiens
tcatgtccctgtccccaggccc

SEQ ID NO: 1191773 - DNA, 23 bp, Homo sapiens
tcatgtccctgtccccaggccca

SEQ ID NO: 1191774 - DNA, 15 bp, Homo sapiens
gccaaacccagacaa

SEQ ID NO: 1191775 - DNA, 17 bp, Homo sapiens
gccaaagaaacaagctg

SEQ ID NO: 1191776 - DNA, 20 bp, Homo sapiens
gccaaagaaacaagctgtgc

SEQ ID NO: 1191777 - DNA, 21 bp, Homo sapiens
gccaaagaaacaagctgtgca

SEQ ID NO: 1191778 - DNA, 19 bp, Homo sapiens
gccaaagaaatgggcctgc

SEQ ID NO: 1191779 - DNA, 21 bp, Homo sapiens
gccaaagaaccaaagaagaaa

SEQ ID NO: 1191780 - DNA, 16 bp, Homo sapiens
gccaaagaaggcaggg

SEQ ID NO: 1191781 - DNA, 17 bp, Homo sapiens
gccaaagaaggcaggga

SEQ ID NO: 1191782 - DNA, 19 bp, Homo sapiens
gccaaagacttagtatatt

SEQ ID NO: 1191783 - DNA, 19 bp, Homo sapiens
gccaaagagcctcccacca

SEQ ID NO: 1191784 - DNA, 22 bp, Homo sapiens
gccaaagagcctttccaaagag

SEQ ID NO: 1191785 - DNA, 13 bp, Homo sapiens
gccaaagataaaa

SEQ ID NO: 1191786 - DNA, 15 bp, Homo sapiens
gccaaagataaaagg

SEQ ID NO: 1191787 - DNA, 16 bp, Homo sapiens
gccaaagataatctct

SEQ ID NO: 1191788 - DNA, 14 bp, Homo sapiens
gccaaagatcactt

SEQ ID NO: 1191789 - DNA, 13 bp, Homo sapiens
gccaaagccccat

SEQ ID NO: 1191790 - DNA, 17 bp, Homo sapiens
gccaaaggggagccaga

SEQ ID NO: 1191791 - DNA, 15 bp, Homo sapiens
gccaaagtacagaat

SEQ ID NO: 1191792 - DNA, 15 bp, Homo sapiens
gccaaagtgcagccc

SEQ ID NO: 1191793 - DNA, 19 bp, Homo sapiens
gccaaagttttcaaactgc

SEQ ID NO: 1191794 - DNA, 14 bp, Homo sapiens
gccaaatagcaaag

SEQ ID NO: 1191795 - DNA, 15 bp, Homo sapiens
gccaaatatgcactt

SEQ ID NO: 1191796 - DNA, 22 bp, Homo sapiens
gccaaatatgcactttccctag

SEQ ID NO: 1191797 - DNA, 15 bp, Homo sapiens
gccaaatatgtcctg

SEQ ID NO: 1191798 - DNA, 18 bp, Homo sapiens
gccaaatccgctctcttc

SEQ ID NO: 1191799 - DNA, 20 bp, Homo sapiens
gccaaatccgctctcttcct

SEQ ID NO: 1191800 - DNA, 14 bp, Homo sapiens
gccaaatgcaaaat

SEQ ID NO: 1191801 - DNA, 16 bp, Homo sapiens
gccaaatgcaaaatta

SEQ ID NO: 1191802 - DNA, 14 bp, Homo sapiens
gccaaatgttcatc

SEQ ID NO: 1191803 - DNA, 18 bp, Homo sapiens
gccaaatgttcatcctca

SEQ ID NO: 1191804 - DNA, 21 bp, Homo sapiens
gccaaatttaaaactgttgga

SEQ ID NO: 1191805 - DNA, 19 bp, Homo sapiens
gccaaatttcctgtttgaa

SEQ ID NO: 1191806 - DNA, 21 bp, Homo sapiens
gccaacaactctgcctttatg

SEQ ID NO: 1191807 - DNA, 20 bp, Homo sapiens
gccaacaagaccgccccagg

SEQ ID NO: 1191808 - DNA, 22 bp, Homo sapiens
gccaacaagaccgccccagggc

SEQ ID NO: 1191809 - DNA, 17 bp, Homo sapiens
gccaacagaagcttcca

SEQ ID NO: 1191810 - DNA, 15 bp, Homo sapiens
gccaacagcacctcc

SEQ ID NO: 1191811 - DNA, 21 bp, Homo sapiens
gccaacagggtagatttctct

SEQ ID NO: 1191812 - DNA, 22 bp, Homo sapiens
gccaacagggtagatttctctt

SEQ ID NO: 1191813 - DNA, 13 bp, Homo sapiens
gccaaccagcccg

SEQ ID NO: 1191814 - DNA, 15 bp, Homo sapiens
gccaaccagcctttg

SEQ ID NO: 1191815 - DNA, 19 bp, Homo sapiens
gccaaccaggacccagggt

SEQ ID NO: 1191816 - DNA, 13 bp, Homo sapiens
gccaaccatacct

SEQ ID NO: 1191817 - DNA, 13 bp, Homo sapiens
gccaaccccaccc

SEQ ID NO: 1191818 - DNA, 15 bp, Homo sapiens
gccaaccccacccag

SEQ ID NO: 1191819 - DNA, 18 bp, Homo sapiens
gccaaccccacccagctc

SEQ ID NO: 1191820 - DNA, 14 bp, Homo sapiens
gccaacccctgtgg

SEQ ID NO: 1191821 - DNA, 17 bp, Homo sapiens
gccaaccctgcctgccg

SEQ ID NO: 1191822 - DNA, 22 bp, Homo sapiens
gccaaccctgcctgccgctgca

SEQ ID NO: 1191823 - DNA, 22 bp, Homo sapiens
gccaacctcggcttgtgggctg

SEQ ID NO: 1191824 - DNA, 17 bp, Homo sapiens
gccaacctgatgcccct

SEQ ID NO: 1191825 - DNA, 21 bp, Homo sapiens
gccaacctgatgccccttccc

SEQ ID NO: 1191826 - DNA, 22 bp, Homo sapiens
gccaacctgttcttagagtgta

SEQ ID NO: 1191827 - DNA, 14 bp, Homo sapiens
gccaacgacaaagc

SEQ ID NO: 1191828 - DNA, 17 bp, Homo sapiens
gccaacgagacacattg

SEQ ID NO: 1191829 - DNA, 14 bp, Homo sapiens
gccaactcctcaca

SEQ ID NO: 1191830 - DNA, 20 bp, Homo sapiens
gccaactgaagccttcttct

SEQ ID NO: 1191831 - DNA, 19 bp, Homo sapiens
gccaactgcaaaaaaagcc

SEQ ID NO: 1191832 - DNA, 19 bp, Homo sapiens
gccaacttcccacacggca

SEQ ID NO: 1191833 - DNA, 23 bp, Homo sapiens
gccaacttcccacacggcagccc

SEQ ID NO: 1191834 - DNA, 16 bp, Homo sapiens
gccaacttctcccacc

SEQ ID NO: 1191835 - DNA, 19 bp, Homo sapiens
gccaacttctcccacccct

SEQ ID NO: 1191836 - DNA, 15 bp, Homo sapiens
gccaacttgagggcc

SEQ ID NO: 1191837 - DNA, 20 bp, Homo sapiens
gccaacttgagggcccagag

SEQ ID NO: 1191838 - DNA, 21 bp, Homo sapiens
gccaacttgagggcccagagc

SEQ ID NO: 1191839 - DNA, 13 bp, Homo sapiens
gccaacttgtaaa

SEQ ID NO: 1191840 - DNA, 15 bp, Homo sapiens
gccaacttgtaaata

SEQ ID NO: 1191841 - DNA, 15 bp, Homo sapiens
gccaagaaacgtctt

SEQ ID NO: 1191842 - DNA, 21 bp, Homo sapiens
gccaagaaacgtcttctaaac

SEQ ID NO: 1191843 - DNA, 20 bp, Homo sapiens
gccaagaagcagtggcctta

SEQ ID NO: 1191844 - DNA, 18 bp, Homo sapiens
gccaagaagtttaaggaa

SEQ ID NO: 1191845 - DNA, 13 bp, Homo sapiens
gccaagaatactt

SEQ ID NO: 1191846 - DNA, 16 bp, Homo sapiens
gccaagaatacttgaa

SEQ ID NO: 1191847 - DNA, 15 bp, Homo sapiens
gccaagaatattgca

SEQ ID NO: 1191848 - DNA, 16 bp, Homo sapiens
gccaagaatattgcaa

SEQ ID NO: 1191849 - DNA, 18 bp, Homo sapiens
gccaagaatattgcaaaa

SEQ ID NO: 1191850 - DNA, 23 bp, Homo sapiens
gccaagaatattgcaaaatacat

SEQ ID NO: 1191851 - DNA, 22 bp, Homo sapiens
gccaagacaaatcaacagaagc

SEQ ID NO: 1191852 - DNA, 23 bp, Homo sapiens
gccaagacaaatcaacagaagca

SEQ ID NO: 1191853 - DNA, 15 bp, Homo sapiens
gccaagacagatgga

SEQ ID NO: 1191854 - DNA, 12 bp, Homo sapiens
gccaagactcct

SEQ ID NO: 1191855 - DNA, 17 bp, Homo sapiens
gccaagactcctcaggc

SEQ ID NO: 1191856 - DNA, 18 bp, Homo sapiens
gccaagacttggcaacag

SEQ ID NO: 1191857 - DNA, 23 bp, Homo sapiens
gccaagacttggcaacagaagca

SEQ ID NO: 1191858 - DNA, 20 bp, Homo sapiens
gccaagagcagaggcagcga

SEQ ID NO: 1191859 - DNA, 20 bp, Homo sapiens
gccaagagcatcgtgaccct

SEQ ID NO: 1191860 - DNA, 19 bp, Homo sapiens
gccaagatggaagtcacct

SEQ ID NO: 1191861 - DNA, 22 bp, Homo sapiens
gccaagcaaaccaatggtgatc

SEQ ID NO: 1191862 - DNA, 13 bp, Homo sapiens
gccaagcccaata

SEQ ID NO: 1191863 - DNA, 23 bp, Homo sapiens
gccaagcccctgccctggggaga

SEQ ID NO: 1191864 - DNA, 21 bp, Homo sapiens
gccaagccctaagcctgtccc

SEQ ID NO: 1191865 - DNA, 18 bp, Homo sapiens
gccaagctaatctgcctg

SEQ ID NO: 1191866 - DNA, 16 bp, Homo sapiens
gccaagctccaagccc

SEQ ID NO: 1191867 - DNA, 16 bp, Homo sapiens
gccaagctccctggag

SEQ ID NO: 1191868 - DNA, 17 bp, Homo sapiens
gccaagctccctggagc

SEQ ID NO: 1191869 - DNA, 20 bp, Homo sapiens
tcattttgcagaaggaaatg

SEQ ID NO: 1191870 - DNA, 14 bp, Homo sapiens
tcattttggagctt

SEQ ID NO: 1191871 - DNA, 22 bp, Homo sapiens
tcattttggtaaaatacttctt

SEQ ID NO: 1191872 - DNA, 17 bp, Homo sapiens
tcattttggtctgtttt

SEQ ID NO: 1191873 - DNA, 17 bp, Homo sapiens
tcattttgtaacaaatg

SEQ ID NO: 1191874 - DNA, 12 bp, Homo sapiens
tcattttgtaat

SEQ ID NO: 1191875 - DNA, 21 bp, Homo sapiens
tcattttgttgcttttgtgaa

SEQ ID NO: 1191876 - DNA, 14 bp, Homo sapiens
tcatttttaaatgt

SEQ ID NO: 1191877 - DNA, 12 bp, Homo sapiens
tcatttttaatt

SEQ ID NO: 1191878 - DNA, 14 bp, Homo sapiens
tcatttttatagca

SEQ ID NO: 1191879 - DNA, 16 bp, Homo sapiens
tcatttttatagcaac

SEQ ID NO: 1191880 - DNA, 17 bp, Homo sapiens
tcatttttccaggactc

SEQ ID NO: 1191881 - DNA, 18 bp, Homo sapiens
tcatttttccaggactct

SEQ ID NO: 1191882 - DNA, 19 bp, Homo sapiens
tcatttttccaggactctt

SEQ ID NO: 1191883 - DNA, 13 bp, Homo sapiens
tcatttttccttt

SEQ ID NO: 1191884 - DNA, 15 bp, Homo sapiens
tcatttttcctttag

SEQ ID NO: 1191885 - DNA, 12 bp, Homo sapiens
tcatttttgtat

SEQ ID NO: 1191886 - DNA, 13 bp, Homo sapiens
tcatttttgtata

SEQ ID NO: 1191887 - DNA, 22 bp, Homo sapiens
tcatttttgtgagcctctttgt

SEQ ID NO: 1191888 - DNA, 14 bp, Homo sapiens
tcatttttgtgcac

SEQ ID NO: 1191889 - DNA, 18 bp, Homo sapiens
tcatttttttctctctgg

SEQ ID NO: 1191890 - DNA, 22 bp, Homo sapiens
tcatttttttctctctggagcc

SEQ ID NO: 1191891 - DNA, 13 bp, Homo sapiens
tcattttttttaa

SEQ ID NO: 1191892 - DNA, 17 bp, Homo sapiens
tcattttttttaagaaa

SEQ ID NO: 1191893 - DNA, 21 bp, Homo sapiens
tccaaaaaagcaaacacaaga

SEQ ID NO: 1191894 - DNA, 14 bp, Homo sapiens
tccaaaaaattaaa

SEQ ID NO: 1191895 - DNA, 22 bp, Homo sapiens
tccaaaaacattttatttttaa

SEQ ID NO: 1191896 - DNA, 13 bp, Homo sapiens
gccaccccaaccc

SEQ ID NO: 1191897 - DNA, 13 bp, Homo sapiens
gccacccccgccc

SEQ ID NO: 1191898 - DNA, 16 bp, Homo sapiens
gccacccccgccccca

SEQ ID NO: 1191899 - DNA, 18 bp, Homo sapiens
gccacccccgctggagga

SEQ ID NO: 1191900 - DNA, 17 bp, Homo sapiens
gccaccccgagggctga

SEQ ID NO: 1191901 - DNA, 15 bp, Homo sapiens
gccaccccgtgccac

SEQ ID NO: 1191902 - DNA, 20 bp, Homo sapiens
gccacccctaaactccaggg

SEQ ID NO: 1191903 - DNA, 15 bp, Homo sapiens
gccacccctgccact

SEQ ID NO: 1191904 - DNA, 15 bp, Homo sapiens
gccaccccttcctcc

SEQ ID NO: 1191905 - DNA, 18 bp, Homo sapiens
gccaccccttcctcccca

SEQ ID NO: 1191906 - DNA, 22 bp, Homo sapiens
gccacccgtaggcagcctctct

SEQ ID NO: 1191907 - DNA, 22 bp, Homo sapiens
gccacccgtggggtgctgccct

SEQ ID NO: 1191908 - DNA, 13 bp, Homo sapiens
gccaccctacctg

SEQ ID NO: 1191909 - DNA, 18 bp, Homo sapiens
gccaccctacctgttcag

SEQ ID NO: 1191910 - DNA, 19 bp, Homo sapiens
gccaccctacctgttcagt

SEQ ID NO: 1191911 - DNA, 23 bp, Homo sapiens
gccaccctcctccctccaagcct

SEQ ID NO: 1191912 - DNA, 12 bp, Homo sapiens
gccaccctctgg

SEQ ID NO: 1191913 - DNA, 14 bp, Homo sapiens
gccaccctctggga

SEQ ID NO: 1191914 - DNA, 16 bp, Homo sapiens
gccaccctctgggagt

SEQ ID NO: 1191915 - DNA, 13 bp, Homo sapiens
gccaccctgcccc

SEQ ID NO: 1191916 - DNA, 15 bp, Homo sapiens
gccaccctgccccta

SEQ ID NO: 1191917 - DNA, 14 bp, Homo sapiens
gccaccctgctgca

SEQ ID NO: 1191918 - DNA, 22 bp, Homo sapiens
gccaccctgctgcactaggact

SEQ ID NO: 1191919 - DNA, 14 bp, Homo sapiens
gccacccttggcct

SEQ ID NO: 1191920 - DNA, 17 bp, Homo sapiens
gccaccgactgcccagc

SEQ ID NO: 1191921 - DNA, 22 bp, Homo sapiens
gccaccgactgcccagccactc

SEQ ID NO: 1191922 - DNA, 18 bp, Homo sapiens
gccaccgcccagctcatg

SEQ ID NO: 1191923 - DNA, 21 bp, Homo sapiens
gccaccgcgccctcctgccca

SEQ ID NO: 1191924 - DNA, 23 bp, Homo sapiens
gccaccggcctgtgggtctctga

SEQ ID NO: 1191925 - DNA, 22 bp, Homo sapiens
gccacctatctcgtgggagagc

SEQ ID NO: 1191926 - DNA, 16 bp, Homo sapiens
gccacctatgcctgtg

SEQ ID NO: 1191927 - DNA, 13 bp, Homo sapiens
gccacctccccta

SEQ ID NO: 1191928 - DNA, 13 bp, Homo sapiens
gccacctccctct

SEQ ID NO: 1191929 - DNA, 15 bp, Homo sapiens
gccacctccgccaga

SEQ ID NO: 1191930 - DNA, 17 bp, Homo sapiens
gccacctccgccagacc

SEQ ID NO: 1191931 - DNA, 22 bp, Homo sapiens
gccacctcctaccccttcctgt

SEQ ID NO: 1191932 - DNA, 15 bp, Homo sapiens
gccacctctccaagg

SEQ ID NO: 1191933 - DNA, 17 bp, Homo sapiens
gccacctctccaagggc

SEQ ID NO: 1191934 - DNA, 15 bp, Homo sapiens
gccacctctccctca

SEQ ID NO: 1191935 - DNA, 16 bp, Homo sapiens
gccacctctctccttt

SEQ ID NO: 1191936 - DNA, 22 bp, Homo sapiens
gccacctctggccaaatatgca

SEQ ID NO: 1191937 - DNA, 20 bp, Homo sapiens
gccacctgaggtgggcccag

SEQ ID NO: 1191938 - DNA, 23 bp, Homo sapiens
gccacctgaggtgggcccaggac

SEQ ID NO: 1191939 - DNA, 23 bp, Homo sapiens
gccacctgaggtgggctggggct

SEQ ID NO: 1191940 - DNA, 12 bp, Homo sapiens
gccacctgcaag

SEQ ID NO: 1191941 - DNA, 12 bp, Homo sapiens
gccacctgcagg

SEQ ID NO: 1191942 - DNA, 22 bp, Homo sapiens
gccacctgccacccccaggtct

SEQ ID NO: 1191943 - DNA, 21 bp, Homo sapiens
gccacctgcccccttctccca

SEQ ID NO: 1191944 - DNA, 13 bp, Homo sapiens
gccacctgcctgc

SEQ ID NO: 1191945 - DNA, 21 bp, Homo sapiens
gccacctgcctgcgtcttccg

SEQ ID NO: 1191946 - DNA, 22 bp, Homo sapiens
gccacctgcctgcgtcttccgc

SEQ ID NO: 1191947 - DNA, 23 bp, Homo sapiens
gccacctgggaacacagttctgg

SEQ ID NO: 1191948 - DNA, 22 bp, Homo sapiens
gccacctgtccggcccagtgcc

SEQ ID NO: 1191949 - DNA, 23 bp, Homo sapiens
gccacctgtccggcccagtgcca

SEQ ID NO: 1191950 - DNA, 17 bp, Homo sapiens
gccaccttcccacccct

SEQ ID NO: 1191951 - DNA, 15 bp, Homo sapiens
gccaccttggaggag

SEQ ID NO: 1191952 - DNA, 19 bp, Homo sapiens
gccaccttgtgtgtttaaa

SEQ ID NO: 1191953 - DNA, 15 bp, Homo sapiens
gccacctttgtgcag

SEQ ID NO: 1191954 - DNA, 23 bp, Homo sapiens
gccacctttgtgcagcttcgagg

SEQ ID NO: 1191955 - DNA, 20 bp, Homo sapiens
gccacgcaggccacccgggc

SEQ ID NO: 1191956 - DNA, 15 bp, Homo sapiens
gccacgccccagccc

SEQ ID NO: 1191957 - DNA, 18 bp, Homo sapiens
gccacgccccagcccgac

SEQ ID NO: 1191958 - DNA, 21 bp, Homo sapiens
gccacgcctatgccctgccct

SEQ ID NO: 1191959 - DNA, 14 bp, Homo sapiens
gccacgctcagtgc

SEQ ID NO: 1191960 - DNA, 16 bp, Homo sapiens
gccacgctcagtgccc

SEQ ID NO: 1191961 - DNA, 17 bp, Homo sapiens
gccacgctccagctgcc

SEQ ID NO: 1191962 - DNA, 13 bp, Homo sapiens
gccacgctgtcct

SEQ ID NO: 1191963 - DNA, 19 bp, Homo sapiens
gccacgctgtcctctcgag

SEQ ID NO: 1191964 - DNA, 14 bp, Homo sapiens
gccacggagggagg

SEQ ID NO: 1191965 - DNA, 13 bp, Homo sapiens
gccacggccaccc

SEQ ID NO: 1191966 - DNA, 17 bp, Homo sapiens
gccacggccaccctcct

SEQ ID NO: 1191967 - DNA, 13 bp, Homo sapiens
gccacgggggcag

SEQ ID NO: 1191968 - DNA, 15 bp, Homo sapiens
gccacgtcccagcat

SEQ ID NO: 1191969 - DNA, 22 bp, Homo sapiens
gccacgtcccagcatccctgga

SEQ ID NO: 1191970 - DNA, 23 bp, Homo sapiens
gccacgtcccagcatccctggag

SEQ ID NO: 1191971 - DNA, 15 bp, Homo sapiens
gccacgtcccgctgc

SEQ ID NO: 1191972 - DNA, 16 bp, Homo sapiens
gccacgtcccgctgcc

SEQ ID NO: 1191973 - DNA, 17 bp, Homo sapiens
gccacgtgtgctgtggc

SEQ ID NO: 1191974 - DNA, 22 bp, Homo sapiens
gccactaaccttgcctggtaca

SEQ ID NO: 1191975 - DNA, 20 bp, Homo sapiens
gccactaagcagaggagggg

SEQ ID NO: 1191976 - DNA, 23 bp, Homo sapiens
gccactacactccagcctgagca

SEQ ID NO: 1191977 - DNA, 19 bp, Homo sapiens
gccactaggtgtccccaac

SEQ ID NO: 1191978 - DNA, 22 bp, Homo sapiens
gccactagtgacagtttctttt

SEQ ID NO: 1191979 - DNA, 23 bp, Homo sapiens
gccactagtgacagtttcttttg

SEQ ID NO: 1191980 - DNA, 14 bp, Homo sapiens
gccactcactaggc

SEQ ID NO: 1191981 - DNA, 15 bp, Homo sapiens
gccactcactaggcc

SEQ ID NO: 1191982 - DNA, 13 bp, Homo sapiens
gccactcagaggc

SEQ ID NO: 1191983 - DNA, 15 bp, Homo sapiens
gccactcagaggccc

SEQ ID NO: 1191984 - DNA, 17 bp, Homo sapiens
gccactcagaggccccc

SEQ ID NO: 1191985 - DNA, 20 bp, Homo sapiens
gccactcaggaggctgaggc

SEQ ID NO: 1191986 - DNA, 20 bp, Homo sapiens
gccactcatattctgggctc

SEQ ID NO: 1191987 - DNA, 16 bp, Homo sapiens
gccactcattcctgta

SEQ ID NO: 1191988 - DNA, 12 bp, Homo sapiens
gccactcatttc

SEQ ID NO: 1191989 - DNA, 15 bp, Homo sapiens
gccactcatttcatc

SEQ ID NO: 1191990 - DNA, 18 bp, Homo sapiens
gccactcatttcatctca

SEQ ID NO: 1191991 - DNA, 16 bp, Homo sapiens
gccactccagacccct

SEQ ID NO: 1191992 - DNA, 21 bp, Homo sapiens
gccactccagttttctcctct

SEQ ID NO: 1191993 - DNA, 13 bp, Homo sapiens
gccactccctgag

SEQ ID NO: 1191994 - DNA, 12 bp, Homo sapiens
gccactcctccc

SEQ ID NO: 1191995 - DNA, 14 bp, Homo sapiens
gccactcctgtccc

SEQ ID NO: 1191996 - DNA, 17 bp, Homo sapiens
gccactcctgtcccgcc

SEQ ID NO: 1191997 - DNA, 20 bp, Homo sapiens
gccactccttccttcaggac

SEQ ID NO: 1191998 - DNA, 19 bp, Homo sapiens
gccactcgcagtcgcagga

SEQ ID NO: 1191999 - DNA, 23 bp, Homo sapiens
gccactcgggaggctgagacagg

SEQ ID NO: 1192000 - DNA, 17 bp, Homo sapiens
gccactctcccctccct

SEQ ID NO: 1192001 - DNA, 20 bp, Homo sapiens
tccacagttgccaccacctc

SEQ ID NO: 1192002 - DNA, 16 bp, Homo sapiens
tccacataaatgctcc

SEQ ID NO: 1192003 - DNA, 14 bp, Homo sapiens
tccacatcccagca

SEQ ID NO: 1192004 - DNA, 17 bp, Homo sapiens
tccacatcccagcagcc

SEQ ID NO: 1192005 - DNA, 20 bp, Homo sapiens
tccacatccccagagcccag

SEQ ID NO: 1192006 - DNA, 21 bp, Homo sapiens
tccacatccccagagcccagc

SEQ ID NO: 1192007 - DNA, 19 bp, Homo sapiens
tccacatcctccacgttct

SEQ ID NO: 1192008 - DNA, 22 bp, Homo sapiens
tccacatcctttctaaacaaga

SEQ ID NO: 1192009 - DNA, 14 bp, Homo sapiens
tccacatctgcctt

SEQ ID NO: 1192010 - DNA, 18 bp, Homo sapiens
tccacatctgccttaaaa

SEQ ID NO: 1192011 - DNA, 16 bp, Homo sapiens
tccacatgctgcctgg

SEQ ID NO: 1192012 - DNA, 20 bp, Homo sapiens
tccacatgtgaactttttct

SEQ ID NO: 1192013 - DNA, 12 bp, Homo sapiens
tccacattctac

SEQ ID NO: 1192014 - DNA, 15 bp, Homo sapiens
tccacattctacttc

SEQ ID NO: 1192015 - DNA, 18 bp, Homo sapiens
tccacattctacttcagc

SEQ ID NO: 1192016 - DNA, 19 bp, Homo sapiens
tccacattctacttcagct

SEQ ID NO: 1192017 - DNA, 18 bp, Homo sapiens
tccacatttgtcacagaa

SEQ ID NO: 1192018 - DNA, 15 bp, Homo sapiens
gccactgccccccga

SEQ ID NO: 1192019 - DNA, 18 bp, Homo sapiens
gccactgccccccgaggc

SEQ ID NO: 1192020 - DNA, 21 bp, Homo sapiens
gccactgcccgagctggtgca

SEQ ID NO: 1192021 - DNA, 22 bp, Homo sapiens
gccactgccgcctactggacgc

SEQ ID NO: 1192022 - DNA, 22 bp, Homo sapiens
gccactgccttcgcttcttgcc

SEQ ID NO: 1192023 - DNA, 17 bp, Homo sapiens
gccactgcctttcagaa

SEQ ID NO: 1192024 - DNA, 16 bp, Homo sapiens
gccactgctccgtgga

SEQ ID NO: 1192025 - DNA, 23 bp, Homo sapiens
gccactgcttttccctttgtgag

SEQ ID NO: 1192026 - DNA, 12 bp, Homo sapiens
gccactgggccc

SEQ ID NO: 1192027 - DNA, 14 bp, Homo sapiens
gccactgggcccct

SEQ ID NO: 1192028 - DNA, 15 bp, Homo sapiens
gccactgggcccctg

SEQ ID NO: 1192029 - DNA, 17 bp, Homo sapiens
gccactgggcccctgtc

SEQ ID NO: 1192030 - DNA, 23 bp, Homo sapiens
gccactgggcccctgtccccagt

SEQ ID NO: 1192031 - DNA, 24 bp, Homo sapiens
gccactgggcccctgtccccagtc

SEQ ID NO: 1192032 - DNA, 12 bp, Homo sapiens
gccactgggctc

SEQ ID NO: 1192033 - DNA, 13 bp, Homo sapiens
gccactgggctct

SEQ ID NO: 1192034 - DNA, 14 bp, Homo sapiens
gccactgggctctg

SEQ ID NO: 1192035 - DNA, 16 bp, Homo sapiens
gccactgggctctgga

SEQ ID NO: 1192036 - DNA, 18 bp, Homo sapiens
gccactggggactttatt

SEQ ID NO: 1192037 - DNA, 19 bp, Homo sapiens
gccactgggtctcactcct

SEQ ID NO: 1192038 - DNA, 17 bp, Homo sapiens
gccactgtccctgtcct

SEQ ID NO: 1192039 - DNA, 19 bp, Homo sapiens
gccactgtgaagagaacca

SEQ ID NO: 1192040 - DNA, 20 bp, Homo sapiens
gccactgtggccagagctgg

SEQ ID NO: 1192041 - DNA, 13 bp, Homo sapiens
gccactgtgggtg

SEQ ID NO: 1192042 - DNA, 19 bp, Homo sapiens
gccactgtgtctctgtttc

SEQ ID NO: 1192043 - DNA, 16 bp, Homo sapiens
gccactgtgtgccttc

SEQ ID NO: 1192044 - DNA, 13 bp, Homo sapiens
gccacttaatgta

SEQ ID NO: 1192045 - DNA, 17 bp, Homo sapiens
gccacttcattccagca

SEQ ID NO: 1192046 - DNA, 20 bp, Homo sapiens
gccacttcattccagcagct

SEQ ID NO: 1192047 - DNA, 22 bp, Homo sapiens
gccacttcattccagcagctgc

SEQ ID NO: 1192048 - DNA, 18 bp, Homo sapiens
gccacttccttttaactg

SEQ ID NO: 1192049 - DNA, 18 bp, Homo sapiens
gccacttctcactcacca

SEQ ID NO: 1192050 - DNA, 23 bp, Homo sapiens
gccacttctcactcaccactacc

SEQ ID NO: 1192051 - DNA, 22 bp, Homo sapiens
gccacttcttaaaggcctggaa

SEQ ID NO: 1192052 - DNA, 16 bp, Homo sapiens
gccacttgacattcct

SEQ ID NO: 1192053 - DNA, 15 bp, Homo sapiens
gccacttggcccaga

SEQ ID NO: 1192054 - DNA, 16 bp, Homo sapiens
gccacttggcccagaa

SEQ ID NO: 1192055 - DNA, 19 bp, Homo sapiens
gccactttacccacctaga

SEQ ID NO: 1192056 - DNA, 20 bp, Homo sapiens
gccactttacccacctagaa

SEQ ID NO: 1192057 - DNA, 19 bp, Homo sapiens
gccactttgcaaaggagct

SEQ ID NO: 1192058 - DNA, 23 bp, Homo sapiens
gccactttgcacgacgccctctc

SEQ ID NO: 1192059 - DNA, 22 bp, Homo sapiens
gccactttggcttctcctgtga

SEQ ID NO: 1192060 - DNA, 23 bp, Homo sapiens
gccactttggtacatggccagtg

SEQ ID NO: 1192061 - DNA, 23 bp, Homo sapiens
gccacttttgactagggattcag

SEQ ID NO: 1192062 - DNA, 14 bp, Homo sapiens
gccagaaggagggc

SEQ ID NO: 1192063 - DNA, 15 bp, Homo sapiens
gccagaaggagggca

SEQ ID NO: 1192064 - DNA, 19 bp, Homo sapiens
gccagaaggagggcagagc

SEQ ID NO: 1192065 - DNA, 21 bp, Homo sapiens
gccagaagtaccagactagat

SEQ ID NO: 1192066 - DNA, 18 bp, Homo sapiens
gccagacaaaatttgaga

SEQ ID NO: 1192067 - DNA, 22 bp, Homo sapiens
gccagacaaataggagtgagtg

SEQ ID NO: 1192068 - DNA, 15 bp, Homo sapiens
gccagacactctgct

SEQ ID NO: 1192069 - DNA, 22 bp, Homo sapiens
gccagacactgagcttctgaga

SEQ ID NO: 1192070 - DNA, 21 bp, Homo sapiens
gccagacagccccaagcttct

SEQ ID NO: 1192071 - DNA, 22 bp, Homo sapiens
gccagacagccccaagcttctg

SEQ ID NO: 1192072 - DNA, 16 bp, Homo sapiens
gccagaccagcaggct

SEQ ID NO: 1192073 - DNA, 16 bp, Homo sapiens
gccagaccatggacac

SEQ ID NO: 1192074 - DNA, 21 bp, Homo sapiens
gccagaccccgtggctctggg

SEQ ID NO: 1192075 - DNA, 15 bp, Homo sapiens
gccagacctagcagg

SEQ ID NO: 1192076 - DNA, 13 bp, Homo sapiens
gccagacctcaac

SEQ ID NO: 1192077 - DNA, 18 bp, Homo sapiens
gccagacgctgccgctgc

SEQ ID NO: 1192078 - DNA, 13 bp, Homo sapiens
gccagactctggt

SEQ ID NO: 1192079 - DNA, 14 bp, Homo sapiens
gccagactggaaga

SEQ ID NO: 1192080 - DNA, 23 bp, Homo sapiens
gccagagagcaggggagcttggg

SEQ ID NO: 1192081 - DNA, 12 bp, Homo sapiens
gccagagaggag

SEQ ID NO: 1192082 - DNA, 19 bp, Homo sapiens
gccagagaggagcacctga

SEQ ID NO: 1192083 - DNA, 23 bp, Homo sapiens
gccagagaggagcacctgaaccc

SEQ ID NO: 1192084 - DNA, 18 bp, Homo sapiens
gccagagagggcccagct

SEQ ID NO: 1192085 - DNA, 24 bp, Homo sapiens
gccagagagggcccagctgtagcc

SEQ ID NO: 1192086 - DNA, 18 bp, Homo sapiens
gccagagcaggagcccct

SEQ ID NO: 1192087 - DNA, 16 bp, Homo sapiens
gccagagccccaagca

SEQ ID NO: 1192088 - DNA, 19 bp, Homo sapiens
gccagagccggccgccttc

SEQ ID NO: 1192089 - DNA, 12 bp, Homo sapiens
gccagagcctgg

SEQ ID NO: 1192090 - DNA, 13 bp, Homo sapiens
gccagagcctggg

SEQ ID NO: 1192091 - DNA, 15 bp, Homo sapiens
gccagagctagggct

SEQ ID NO: 1192092 - DNA, 16 bp, Homo sapiens
gccagagctagggctg

SEQ ID NO: 1192093 - DNA, 11 bp, Homo sapiens
gccagagctga

SEQ ID NO: 1192094 - DNA, 16 bp, Homo sapiens
gccagagctggaaggc

SEQ ID NO: 1192095 - DNA, 23 bp, Homo sapiens
gccagagctggaaggcagggcag

SEQ ID NO: 1192096 - DNA, 12 bp, Homo sapiens
gccagagctggg

SEQ ID NO: 1192097 - DNA, 15 bp, Homo sapiens
gccagagctgggagg

SEQ ID NO: 1192098 - DNA, 22 bp, Homo sapiens
gccagagctgggtggggacagt

SEQ ID NO: 1192099 - DNA, 14 bp, Homo sapiens
gccagagctgtgcc

SEQ ID NO: 1192100 - DNA, 15 bp, Homo sapiens
gccagagctgtgcct

SEQ ID NO: 1192101 - DNA, 22 bp, Homo sapiens
gccagagctgtgcctgctcagc

SEQ ID NO: 1192102 - DNA, 20 bp, Homo sapiens
gccagaggaactgtccagag

SEQ ID NO: 1192103 - DNA, 22 bp, Homo sapiens
gccagaggaactgtccagagag

SEQ ID NO: 1192104 - DNA, 21 bp, Homo sapiens
gccagaggaatcctggcagcc

SEQ ID NO: 1192105 - DNA, 13 bp, Homo sapiens
gccagaggagaag

SEQ ID NO: 1192106 - DNA, 13 bp, Homo sapiens
gccagaggagggc

SEQ ID NO: 1192107 - DNA, 16 bp, Homo sapiens
gccagaggagggcaga

SEQ ID NO: 1192108 - DNA, 16 bp, Homo sapiens
gccagaggcccccagc

SEQ ID NO: 1192109 - DNA, 18 bp, Homo sapiens
gccagaggcccccagccc

SEQ ID NO: 1192110 - DNA, 19 bp, Homo sapiens
gccagaggcccccagccca

SEQ ID NO: 1192111 - DNA, 20 bp, Homo sapiens
gccagaggcccccagcccag

SEQ ID NO: 1192112 - DNA, 15 bp, Homo sapiens
gccagagggccagca

SEQ ID NO: 1192113 - DNA, 17 bp, Homo sapiens
gccagagggccagcagg

SEQ ID NO: 1192114 - DNA, 20 bp, Homo sapiens
gccagagggccagcaggctc

SEQ ID NO: 1192115 - DNA, 21 bp, Homo sapiens
gccagagggccagcaggctcc

SEQ ID NO: 1192116 - DNA, 19 bp, Homo sapiens
gccagaggtgcttcaccct

SEQ ID NO: 1192117 - DNA, 17 bp, Homo sapiens
gccagaggtgggcaggt

SEQ ID NO: 1192118 - DNA, 19 bp, Homo sapiens
gccagaggtgggcaggtgg

SEQ ID NO: 1192119 - DNA, 19 bp, Homo sapiens
gccagagtcaccttttctg

SEQ ID NO: 1192120 - DNA, 17 bp, Homo sapiens
gccagagtcctttccaa

SEQ ID NO: 1192121 - DNA, 15 bp, Homo sapiens
gccagagtggcctgg

SEQ ID NO: 1192122 - DNA, 22 bp, Homo sapiens
gccagagtggcctggccaggag

SEQ ID NO: 1192123 - DNA, 13 bp, Homo sapiens
gccagagttcctg

SEQ ID NO: 1192124 - DNA, 18 bp, Homo sapiens
gccagagttcctgcggag

SEQ ID NO: 1192125 - DNA, 22 bp, Homo sapiens
gccagatataactgtcttgttt

SEQ ID NO: 1192126 - DNA, 15 bp, Homo sapiens
gccagatccacccta

SEQ ID NO: 1192127 - DNA, 16 bp, Homo sapiens
gccagatgatcaactc

SEQ ID NO: 1192128 - DNA, 21 bp, Homo sapiens
tccactccatgtttgcaatgc

SEQ ID NO: 1192129 - DNA, 18 bp, Homo sapiens
tccactcccccacctgac

SEQ ID NO: 1192130 - DNA, 18 bp, Homo sapiens
tccactccctgctccacg

SEQ ID NO: 1192131 - DNA, 12 bp, Homo sapiens
tccactcctctc

SEQ ID NO: 1192132 - DNA, 14 bp, Homo sapiens
tccactcgtgtgtt

SEQ ID NO: 1192133 - DNA, 20 bp, Homo sapiens
tccactctaccctcccaccc

SEQ ID NO: 1192134 - DNA, 17 bp, Homo sapiens
tccactctagttctaga

SEQ ID NO: 1192135 - DNA, 12 bp, Homo sapiens
tccactctgctt

SEQ ID NO: 1192136 - DNA, 15 bp, Homo sapiens
tccactctgcttctc

SEQ ID NO: 1192137 - DNA, 19 bp, Homo sapiens
tccactctgcttctctgac

SEQ ID NO: 1192138 - DNA, 21 bp, Homo sapiens
tccactctggattcagccttc

SEQ ID NO: 1192139 - DNA, 21 bp, Homo sapiens
gaagagaagaaatagcagagc

SEQ ID NO: 1192140 - DNA, 14 bp, Homo sapiens
gaagagaagacaaa

SEQ ID NO: 1192141 - DNA, 14 bp, Homo sapiens
gaagagaagctgct

SEQ ID NO: 1192142 - DNA, 15 bp, Homo sapiens
gaagagaagctgctg

SEQ ID NO: 1192143 - DNA, 20 bp, Homo sapiens
gaagagaagctgctgaccaa

SEQ ID NO: 1192144 - DNA, 23 bp, Homo sapiens
gaagagacagagacaagtaattt

SEQ ID NO: 1192145 - DNA, 12 bp, Homo sapiens
gaagagagagcc

SEQ ID NO: 1192146 - DNA, 22 bp, Homo sapiens
gaagagaggaaataacagagag

SEQ ID NO: 1192147 - DNA, 13 bp, Homo sapiens
gaagagaggcacc

SEQ ID NO: 1192148 - DNA, 17 bp, Homo sapiens
gaagagaggcacctgct

SEQ ID NO: 1192149 - DNA, 20 bp, Homo sapiens
gaagagaggcacctgctgga

SEQ ID NO: 1192150 - DNA, 16 bp, Homo sapiens
gaagagaggggaagaa

SEQ ID NO: 1192151 - DNA, 18 bp, Homo sapiens
gaagagaggggaagaatt

SEQ ID NO: 1192152 - DNA, 22 bp, Homo sapiens
gaagagaggggaagaatttaat

SEQ ID NO: 1192153 - DNA, 21 bp, Homo sapiens
gaagagaggtgccggggaggg

SEQ ID NO: 1192154 - DNA, 15 bp, Homo sapiens
gaagagcacagagcc

SEQ ID NO: 1192155 - DNA, 23 bp, Homo sapiens
gaagagcaggcacatggaggagc

SEQ ID NO: 1192156 - DNA, 21 bp, Homo sapiens
gaagagcaggtgactgtgctg

SEQ ID NO: 1192157 - DNA, 11 bp, Homo sapiens
gaagagccacc

SEQ ID NO: 1192158 - DNA, 12 bp, Homo sapiens
gaagagccacct

SEQ ID NO: 1192159 - DNA, 23 bp, Homo sapiens
gaagagccacctgcaagatggac

SEQ ID NO: 1192160 - DNA, 15 bp, Homo sapiens
gaagagccctggaca

SEQ ID NO: 1192161 - DNA, 17 bp, Homo sapiens
gaagagcctgaagctgg

SEQ ID NO: 1192162 - DNA, 22 bp, Homo sapiens
gaagagcgagagatcaaagatg

SEQ ID NO: 1192163 - DNA, 17 bp, Homo sapiens
gaagagcgctcctctgc

SEQ ID NO: 1192164 - DNA, 18 bp, Homo sapiens
gaagagcgctcctctgcc

SEQ ID NO: 1192165 - DNA, 19 bp, Homo sapiens
gaagagctatggcccagaa

SEQ ID NO: 1192166 - DNA, 19 bp, Homo sapiens
gaagagctcccctccacag

SEQ ID NO: 1192167 - DNA, 19 bp, Homo sapiens
gaagagctgtcttcccctg

SEQ ID NO: 1192168 - DNA, 17 bp, Homo sapiens
gaagagcttgcacagcc

SEQ ID NO: 1192169 - DNA, 13 bp, Homo sapiens
gaagaggactttt

SEQ ID NO: 1192170 - DNA, 22 bp, Homo sapiens
gaagaggagattggccagtgag

SEQ ID NO: 1192171 - DNA, 23 bp, Homo sapiens
gaagaggagattggccagtgaga

SEQ ID NO: 1192172 - DNA, 14 bp, Homo sapiens
gaagaggaggaggt

SEQ ID NO: 1192173 - DNA, 15 bp, Homo sapiens
gaagaggaggaggtg

SEQ ID NO: 1192174 - DNA, 18 bp, Homo sapiens
gaagaggaggggaagagg

SEQ ID NO: 1192175 - DNA, 17 bp, Homo sapiens
gaagaggatgagcagag

SEQ ID NO: 1192176 - DNA, 17 bp, Homo sapiens
gaagaggccaaaggaat

SEQ ID NO: 1192177 - DNA, 21 bp, Homo sapiens
gaagaggcccactagagggcc

SEQ ID NO: 1192178 - DNA, 22 bp, Homo sapiens
gaagaggcctaagtcaaaactt

SEQ ID NO: 1192179 - DNA, 15 bp, Homo sapiens
gaagaggcgggccag

SEQ ID NO: 1192180 - DNA, 16 bp, Homo sapiens
gaagaggcgggccagc

SEQ ID NO: 1192181 - DNA, 21 bp, Homo sapiens
gaagagggaatggatggggag

SEQ ID NO: 1192182 - DNA, 16 bp, Homo sapiens
gaagagggcccagccc

SEQ ID NO: 1192183 - DNA, 17 bp, Homo sapiens
gaagagggcccagccca

SEQ ID NO: 1192184 - DNA, 13 bp, Homo sapiens
gaagagggcctgt

SEQ ID NO: 1192185 - DNA, 17 bp, Homo sapiens
gaagaggggcagccctt

SEQ ID NO: 1192186 - DNA, 18 bp, Homo sapiens
gaagagggtgtgtttgaa

SEQ ID NO: 1192187 - DNA, 17 bp, Homo sapiens
gaagagtgggtttcaca

SEQ ID NO: 1192188 - DNA, 18 bp, Homo sapiens
gaagagtgggtttcacaa

SEQ ID NO: 1192189 - DNA, 23 bp, Homo sapiens
gaagagtttaaagagaaaaggga

SEQ ID NO: 1192190 - DNA, 21 bp, Homo sapiens
gaagataagtgtatttttcaa

SEQ ID NO: 1192191 - DNA, 20 bp, Homo sapiens
gaagataatattaaggaaga

SEQ ID NO: 1192192 - DNA, 15 bp, Homo sapiens
gaagataatcattgc

SEQ ID NO: 1192193 - DNA, 16 bp, Homo sapiens
gaagataatcattgct

SEQ ID NO: 1192194 - DNA, 23 bp, Homo sapiens
gaagataatgttctttaatgttg

SEQ ID NO: 1192195 - DNA, 16 bp, Homo sapiens
gaagataatttgcata

SEQ ID NO: 1192196 - DNA, 17 bp, Homo sapiens
gaagataggctctgcac

SEQ ID NO: 1192197 - DNA, 20 bp, Homo sapiens
gaagataggctctgcacaga

SEQ ID NO: 1192198 - DNA, 19 bp, Homo sapiens
gaagatataacattcagtt

SEQ ID NO: 1192199 - DNA, 21 bp, Homo sapiens
gaagatattatttgtcttaaa

SEQ ID NO: 1192200 - DNA, 20 bp, Homo sapiens
gaagatattgggaaggaaat

SEQ ID NO: 1192201 - DNA, 14 bp, Homo sapiens
gaagatcactgtag

SEQ ID NO: 1192202 - DNA, 21 bp, Homo sapiens
gaagatcatatacgtgaaaat

SEQ ID NO: 1192203 - DNA, 19 bp, Homo sapiens
gaagatcccctctcctgcc

SEQ ID NO: 1192204 - DNA, 22 bp, Homo sapiens
gaagatccgagcgacggctcct

SEQ ID NO: 1192205 - DNA, 17 bp, Homo sapiens
gaagatcctagtgacca

SEQ ID NO: 1192206 - DNA, 15 bp, Homo sapiens
gaagatctgcaaaca

SEQ ID NO: 1192207 - DNA, 16 bp, Homo sapiens
taaattacatttttaa

SEQ ID NO: 1192208 - DNA, 19 bp, Homo sapiens
taaattactatctgttgaa

SEQ ID NO: 1192209 - DNA, 13 bp, Homo sapiens
taaattagaaaat

SEQ ID NO: 1192210 - DNA, 20 bp, Homo sapiens
taaattagaatgaatttatc

SEQ ID NO: 1192211 - DNA, 17 bp, Homo sapiens
taaattaggaataaata

SEQ ID NO: 1192212 - DNA, 21 bp, Homo sapiens
taaattaggaataaataaaaa

SEQ ID NO: 1192213 - DNA, 18 bp, Homo sapiens
taaattagttcagccatt

SEQ ID NO: 1192214 - DNA, 18 bp, Homo sapiens
taaattatcttatgaaaa

SEQ ID NO: 1192215 - DNA, 17 bp, Homo sapiens
taaattatggcatttct

SEQ ID NO: 1192216 - DNA, 18 bp, Homo sapiens
taaattatgtaatgcaaa

SEQ ID NO: 1192217 - DNA, 19 bp, Homo sapiens
taaattatgtaatgcaaaa

SEQ ID NO: 1192218 - DNA, 22 bp, Homo sapiens
taaattatgtgaccataatgta

SEQ ID NO: 1192219 - DNA, 23 bp, Homo sapiens
taaattattaagcagactggaaa

SEQ ID NO: 1192220 - DNA, 22 bp, Homo sapiens
taaattattcagaactatttaa

SEQ ID NO: 1192221 - DNA, 14 bp, Homo sapiens
taaattattgtaaa

SEQ ID NO: 1192222 - DNA, 13 bp, Homo sapiens
taaattatttatg

SEQ ID NO: 1192223 - DNA, 15 bp, Homo sapiens
taaattatttgctaa

SEQ ID NO: 1192224 - DNA, 20 bp, Homo sapiens
taaattatttgctaagcata

SEQ ID NO: 1192225 - DNA, 23 bp, Homo sapiens
taaattcaaccactgtaaaatga

SEQ ID NO: 1192226 - DNA, 18 bp, Homo sapiens
taaattcacaaactttta

SEQ ID NO: 1192227 - DNA, 18 bp, Homo sapiens
taaattcagtcctaagaa

SEQ ID NO: 1192228 - DNA, 15 bp, Homo sapiens
taaattcatcagaat

SEQ ID NO: 1192229 - DNA, 16 bp, Homo sapiens
taaattcatttctaga

SEQ ID NO: 1192230 - DNA, 17 bp, Homo sapiens
taaattcatttctagac

SEQ ID NO: 1192231 - DNA, 20 bp, Homo sapiens
taaattccacagattatcaa

SEQ ID NO: 1192232 - DNA, 15 bp, Homo sapiens
taaattccactgaaa

SEQ ID NO: 1192233 - DNA, 16 bp, Homo sapiens
taaattccactgaaaa

SEQ ID NO: 1192234 - DNA, 18 bp, Homo sapiens
taaattccactgaaaatt

SEQ ID NO: 1192235 - DNA, 22 bp, Homo sapiens
taaattccactgaaaatttaac

SEQ ID NO: 1192236 - DNA, 13 bp, Homo sapiens
taaattccactgg

SEQ ID NO: 1192237 - DNA, 16 bp, Homo sapiens
taaattccactggact

SEQ ID NO: 1192238 - DNA, 18 bp, Homo sapiens
taaattccagaggactct

SEQ ID NO: 1192239 - DNA, 22 bp, Homo sapiens
taaattccagaggactctgctt

SEQ ID NO: 1192240 - DNA, 19 bp, Homo sapiens
taaattcccgttttgtcac

SEQ ID NO: 1192241 - DNA, 23 bp, Homo sapiens
taaattctagtgtccataaataa

SEQ ID NO: 1192242 - DNA, 13 bp, Homo sapiens
taaattctatgtt

SEQ ID NO: 1192243 - DNA, 16 bp, Homo sapiens
taaattctatgttaaa

SEQ ID NO: 1192244 - DNA, 19 bp, Homo sapiens
taaattctatgttaaatac

SEQ ID NO: 1192245 - DNA, 23 bp, Homo sapiens
taaattctatgttaaatactgtg

SEQ ID NO: 1192246 - DNA, 22 bp, Homo sapiens
taaattctctctcttgcaggaa

SEQ ID NO: 1192247 - DNA, 18 bp, Homo sapiens
taaattctggtatacatt

SEQ ID NO: 1192248 - DNA, 16 bp, Homo sapiens
taaattcttgcaaagt

SEQ ID NO: 1192249 - DNA, 17 bp, Homo sapiens
taaattcttgcaaagta

SEQ ID NO: 1192250 - DNA, 18 bp, Homo sapiens
taaattcttgcaaagtat

SEQ ID NO: 1192251 - DNA, 19 bp, Homo sapiens
taaattgaatcagtataaa

SEQ ID NO: 1192252 - DNA, 17 bp, Homo sapiens
taaattgatttgttatg

SEQ ID NO: 1192253 - DNA, 15 bp, Homo sapiens
taaattgcacagagc

SEQ ID NO: 1192254 - DNA, 16 bp, Homo sapiens
taaattgcacagagca

SEQ ID NO: 1192255 - DNA, 16 bp, Homo sapiens
taaattgcctgatttg

SEQ ID NO: 1192256 - DNA, 15 bp, Homo sapiens
taaattgctccttga

SEQ ID NO: 1192257 - DNA, 20 bp, Homo sapiens
taaattggcatggaaattta

SEQ ID NO: 1192258 - DNA, 18 bp, Homo sapiens
taaattgtacattttgta

SEQ ID NO: 1192259 - DNA, 22 bp, Homo sapiens
taaattgtacattttgtaaaat

SEQ ID NO: 1192260 - DNA, 22 bp, Homo sapiens
gaccacaccactaaccatcccc

SEQ ID NO: 1192261 - DNA, 19 bp, Homo sapiens
gaccacacccgaagtcctg

SEQ ID NO: 1192262 - DNA, 23 bp, Homo sapiens
gaccacacccgaagtcctgtcac

SEQ ID NO: 1192263 - DNA, 22 bp, Homo sapiens
gaccacactgcacacagtgact

SEQ ID NO: 1192264 - DNA, 16 bp, Homo sapiens
gaccacagcacagcca

SEQ ID NO: 1192265 - DNA, 21 bp, Homo sapiens
gaccacagggttcaaaatgtc

SEQ ID NO: 1192266 - DNA, 23 bp, Homo sapiens
gaccacagggttcaaaatgtctg

SEQ ID NO: 1192267 - DNA, 20 bp, Homo sapiens
gaccacataagaaggcaatt

SEQ ID NO: 1192268 - DNA, 20 bp, Homo sapiens
gaccacatctgtcctcaccc

SEQ ID NO: 1192269 - DNA, 16 bp, Homo sapiens
gaccaccaaagtcaaa

SEQ ID NO: 1192270 - DNA, 21 bp, Homo sapiens
gaccaccagccgccccagccc

SEQ ID NO: 1192271 - DNA, 19 bp, Homo sapiens
taattgttgttctgttaac

SEQ ID NO: 1192272 - DNA, 18 bp, Homo sapiens
taattgttgtttgtatgt

SEQ ID NO: 1192273 - DNA, 22 bp, Homo sapiens
taattgttgtttgtatgtataa

SEQ ID NO: 1192274 - DNA, 23 bp, Homo sapiens
taattgttgtttgtatgtataat

SEQ ID NO: 1192275 - DNA, 15 bp, Homo sapiens
taattgtttcagaat

SEQ ID NO: 1192276 - DNA, 20 bp, Homo sapiens
taattgtttccaacttgtct

SEQ ID NO: 1192277 - DNA, 16 bp, Homo sapiens
taattgttttgcactt

SEQ ID NO: 1192278 - DNA, 18 bp, Homo sapiens
taattgttttttaaagca

SEQ ID NO: 1192279 - DNA, 15 bp, Homo sapiens
taatttaaaaaataa

SEQ ID NO: 1192280 - DNA, 14 bp, Homo sapiens
taatttaaacaggc

SEQ ID NO: 1192281 - DNA, 17 bp, Homo sapiens
taatttaaacaggccca

SEQ ID NO: 1192282 - DNA, 19 bp, Homo sapiens
taatttaaacaggcccagc

SEQ ID NO: 1192283 - DNA, 13 bp, Homo sapiens
taatttaaagaga

SEQ ID NO: 1192284 - DNA, 21 bp, Homo sapiens
taatttaatggggtctgtaaa

SEQ ID NO: 1192285 - DNA, 13 bp, Homo sapiens
taatttaatgtat

SEQ ID NO: 1192286 - DNA, 13 bp, Homo sapiens
taatttaattgct

SEQ ID NO: 1192287 - DNA, 21 bp, Homo sapiens
taatttacaaaaatataaaat

SEQ ID NO: 1192288 - DNA, 21 bp, Homo sapiens
taatttacaggttcttaggct

SEQ ID NO: 1192289 - DNA, 20 bp, Homo sapiens
taatttactggacaaagaat

SEQ ID NO: 1192290 - DNA, 15 bp, Homo sapiens
taatttagaaaactt

SEQ ID NO: 1192291 - DNA, 17 bp, Homo sapiens
taatttagaaaacttta

SEQ ID NO: 1192292 - DNA, 15 bp, Homo sapiens
taatttagaaatcat

SEQ ID NO: 1192293 - DNA, 22 bp, Homo sapiens
taatttagaagatattatttgt

SEQ ID NO: 1192294 - DNA, 21 bp, Homo sapiens
taatttagacttcaagcatgg

SEQ ID NO: 1192295 - DNA, 16 bp, Homo sapiens
taatttagttattgat

SEQ ID NO: 1192296 - DNA, 17 bp, Homo sapiens
taatttagttgtttcta

SEQ ID NO: 1192297 - DNA, 16 bp, Homo sapiens
taatttagtttcatat

SEQ ID NO: 1192298 - DNA, 15 bp, Homo sapiens
taatttataaataca

SEQ ID NO: 1192299 - DNA, 13 bp, Homo sapiens
taatttatacttt

SEQ ID NO: 1192300 - DNA, 14 bp, Homo sapiens
taatttatagcaag

SEQ ID NO: 1192301 - DNA, 23 bp, Homo sapiens
taatttatcttgtctctgggctt

SEQ ID NO: 1192302 - DNA, 14 bp, Homo sapiens
taatttatgagttt

SEQ ID NO: 1192303 - DNA, 11 bp, Homo sapiens
taatttatgca

SEQ ID NO: 1192304 - DNA, 13 bp, Homo sapiens
taatttatgtgct

SEQ ID NO: 1192305 - DNA, 14 bp, Homo sapiens
taatttattattga

SEQ ID NO: 1192306 - DNA, 20 bp, Homo sapiens
taatttattattgaaattgt

SEQ ID NO: 1192307 - DNA, 20 bp, Homo sapiens
taatttattgtttttccttg

SEQ ID NO: 1192308 - DNA, 17 bp, Homo sapiens
taatttatttattaaga

SEQ ID NO: 1192309 - DNA, 16 bp, Homo sapiens
taatttatttgtttcc

SEQ ID NO: 1192310 - DNA, 19 bp, Homo sapiens
taatttattttgctccctc

SEQ ID NO: 1192311 - DNA, 20 bp, Homo sapiens
taatttattttgctccctct

SEQ ID NO: 1192312 - DNA, 20 bp, Homo sapiens
taatttcaaaaatataactt

SEQ ID NO: 1192313 - DNA, 21 bp, Homo sapiens
taatttcaaaaatataactta

SEQ ID NO: 1192314 - DNA, 12 bp, Homo sapiens
taatttcaaaat

SEQ ID NO: 1192315 - DNA, 20 bp, Homo sapiens
taatttcaaaatgcttttta

SEQ ID NO: 1192316 - DNA, 13 bp, Homo sapiens
taatttcaaatgt

SEQ ID NO: 1192317 - DNA, 14 bp, Homo sapiens
taatttcaggaaaa

SEQ ID NO: 1192318 - DNA, 19 bp, Homo sapiens
taatttcagggaaattaat

SEQ ID NO: 1192319 - DNA, 11 bp, Homo sapiens
taatttcagtg

SEQ ID NO: 1192320 - DNA, 10 bp, Homo sapiens
taatttcctt

SEQ ID NO: 1192321 - DNA, 16 bp, Homo sapiens
taatttccttctgtta

SEQ ID NO: 1192322 - DNA, 11 bp, Homo sapiens
taatttccttt

SEQ ID NO: 1192323 - DNA, 13 bp, Homo sapiens
taatttccttttt

SEQ ID NO: 1192324 - DNA, 19 bp, Homo sapiens
taatttcctttttgacact

SEQ ID NO: 1192325 - DNA, 17 bp, Homo sapiens
taatttcgccttaaact

SEQ ID NO: 1192326 - DNA, 19 bp, Homo sapiens
taatttctaagaagttact

SEQ ID NO: 1192327 - DNA, 19 bp, Homo sapiens
taatttctcctcccttcct

SEQ ID NO: 1192328 - DNA, 18 bp, Homo sapiens
taatttctgccatttcat

SEQ ID NO: 1192329 - DNA, 20 bp, Homo sapiens
taatttcttcccccaaagcc

SEQ ID NO: 1192330 - DNA, 17 bp, Homo sapiens
taatttctttttttcct

SEQ ID NO: 1192331 - DNA, 13 bp, Homo sapiens
taatttgaatgta

SEQ ID NO: 1192332 - DNA, 16 bp, Homo sapiens
taatttgaatgtattt

SEQ ID NO: 1192333 - DNA, 17 bp, Homo sapiens
taatttgagaattattc

SEQ ID NO: 1192334 - DNA, 15 bp, Homo sapiens
taatttgagagaaat

SEQ ID NO: 1192335 - DNA, 18 bp, Homo sapiens
taatttgagtgtatatat

SEQ ID NO: 1192336 - DNA, 18 bp, Homo sapiens
taatttgatgaaagctga

SEQ ID NO: 1192337 - DNA, 24 bp, Homo sapiens
taatttgatgaaagctgattactg

SEQ ID NO: 1192338 - DNA, 22 bp, Homo sapiens
taatttgatggtatttctttct

SEQ ID NO: 1192339 - DNA, 12 bp, Homo sapiens
taatttgcatta

SEQ ID NO: 1192340 - DNA, 21 bp, Homo sapiens
taatttggagcacaaaattca

SEQ ID NO: 1192341 - DNA, 23 bp, Homo sapiens
taatttggagcacaaaattcaaa

SEQ ID NO: 1192342 - DNA, 19 bp, Homo sapiens
taatttggataataaaaat

SEQ ID NO: 1192343 - DNA, 23 bp, Homo sapiens
taatttgtaaacttctgaagact

SEQ ID NO: 1192344 - DNA, 12 bp, Homo sapiens
taatttgtacaa

SEQ ID NO: 1192345 - DNA, 19 bp, Homo sapiens
taatttgtacaatggttta

SEQ ID NO: 1192346 - DNA, 23 bp, Homo sapiens
taatttgtacaatggtttattcc

SEQ ID NO: 1192347 - DNA, 21 bp, Homo sapiens
taatttgtacatatgtaaaat

SEQ ID NO: 1192348 - DNA, 21 bp, Homo sapiens
taatttgtatgctaaatgagg

SEQ ID NO: 1192349 - DNA, 15 bp, Homo sapiens
taatttgtcttagtt

SEQ ID NO: 1192350 - DNA, 20 bp, Homo sapiens
taatttgtgaatttgcaaca

SEQ ID NO: 1192351 - DNA, 22 bp, Homo sapiens
taatttgtgatacaatgctgtg

SEQ ID NO: 1192352 - DNA, 21 bp, Homo sapiens
taattttaaataacctctggc

SEQ ID NO: 1192353 - DNA, 14 bp, Homo sapiens
taattttaaccaaa

SEQ ID NO: 1192354 - DNA, 15 bp, Homo sapiens
taattttaactgatt

SEQ ID NO: 1192355 - DNA, 17 bp, Homo sapiens
taattttaatattcttt

SEQ ID NO: 1192356 - DNA, 16 bp, Homo sapiens
taattttaatgctgtt

SEQ ID NO: 1192357 - DNA, 21 bp, Homo sapiens
taattttacacgcttttgtga

SEQ ID NO: 1192358 - DNA, 21 bp, Homo sapiens
taattttaccaagagtaactt

SEQ ID NO: 1192359 - DNA, 14 bp, Homo sapiens
taattttagggaca

SEQ ID NO: 1192360 - DNA, 19 bp, Homo sapiens
taattttagtaatttccta

SEQ ID NO: 1192361 - DNA, 14 bp, Homo sapiens
taattttagttttt

SEQ ID NO: 1192362 - DNA, 23 bp, Homo sapiens
taattttagtttttcattaaata

SEQ ID NO: 1192363 - DNA, 18 bp, Homo sapiens
taattttatgaatgtctt

SEQ ID NO: 1192364 - DNA, 14 bp, Homo sapiens
taattttattcatt

SEQ ID NO: 1192365 - DNA, 19 bp, Homo sapiens
taattttattttaaaattt

SEQ ID NO: 1192366 - DNA, 12 bp, Homo sapiens
taattttctaag

SEQ ID NO: 1192367 - DNA, 16 bp, Homo sapiens
taattttctatcagaa

SEQ ID NO: 1192368 - DNA, 23 bp, Homo sapiens
taattttcttcatgcaatgacat

SEQ ID NO: 1192369 - DNA, 19 bp, Homo sapiens
taattttctttatggaaaa

SEQ ID NO: 1192370 - DNA, 16 bp, Homo sapiens
taattttgatatacat

SEQ ID NO: 1192371 - DNA, 13 bp, Homo sapiens
taattttgatttt

SEQ ID NO: 1192372 - DNA, 15 bp, Homo sapiens
taattttggaataat

SEQ ID NO: 1192373 - DNA, 16 bp, Homo sapiens
taattttggaataatt

SEQ ID NO: 1192374 - DNA, 13 bp, Homo sapiens
taattttggattt

SEQ ID NO: 1192375 - DNA, 14 bp, Homo sapiens
taattttgtacgta

SEQ ID NO: 1192376 - DNA, 20 bp, Homo sapiens
taattttgtacgtatgaatg

SEQ ID NO: 1192377 - DNA, 12 bp, Homo sapiens
taattttgtcac

SEQ ID NO: 1192378 - DNA, 19 bp, Homo sapiens
taattttgtgcattctttg

SEQ ID NO: 1192379 - DNA, 19 bp, Homo sapiens
taattttgttgaaaatggt

SEQ ID NO: 1192380 - DNA, 12 bp, Homo sapiens
taatttttaact

SEQ ID NO: 1192381 - DNA, 22 bp, Homo sapiens
taatttttaacttttggaatca

SEQ ID NO: 1192382 - DNA, 14 bp, Homo sapiens
gacccacactgcca

SEQ ID NO: 1192383 - DNA, 13 bp, Homo sapiens
gacccacagctct

SEQ ID NO: 1192384 - DNA, 15 bp, Homo sapiens
gacccacagctctgg

SEQ ID NO: 1192385 - DNA, 17 bp, Homo sapiens
gacccacagctctgggc

SEQ ID NO: 1192386 - DNA, 18 bp, Homo sapiens
gacccacagctctgggcc

SEQ ID NO: 1192387 - DNA, 19 bp, Homo sapiens
gacccacagctctgggcct

SEQ ID NO: 1192388 - DNA, 20 bp, Homo sapiens
gacccacagctctgggcctc

SEQ ID NO: 1192389 - DNA, 21 bp, Homo sapiens
gacccacagctctgggcctct

SEQ ID NO: 1192390 - DNA, 22 bp, Homo sapiens
gacccacagctctgggcctctt

SEQ ID NO: 1192391 - DNA, 23 bp, Homo sapiens
gacccacagctctgggcctcttt

SEQ ID NO: 1192392 - DNA, 21 bp, Homo sapiens
gacccacccatcttcctgctg

SEQ ID NO: 1192393 - DNA, 22 bp, Homo sapiens
gacccacccatcttcctgctgc

SEQ ID NO: 1192394 - DNA, 21 bp, Homo sapiens
gacccaccccaactctcccca

SEQ ID NO: 1192395 - DNA, 23 bp, Homo sapiens
gacccaccccaactctccccagt

SEQ ID NO: 1192396 - DNA, 12 bp, Homo sapiens
gacccacccctg

SEQ ID NO: 1192397 - DNA, 16 bp, Homo sapiens
taatttttttcaatat

SEQ ID NO: 1192398 - DNA, 22 bp, Homo sapiens
taatttttttcaatatttatta

SEQ ID NO: 1192399 - DNA, 20 bp, Homo sapiens
taattttttttaaaatagaa

SEQ ID NO: 1192400 - DNA, 14 bp, Homo sapiens
taattttttttcct

SEQ ID NO: 1192401 - DNA, 18 bp, Homo sapiens
taatttttttttcataga

SEQ ID NO: 1192402 - DNA, 23 bp, Homo sapiens
tacaaaaaatgcagaacttaatc

SEQ ID NO: 1192403 - DNA, 12 bp, Homo sapiens
tacaaaaataaa

SEQ ID NO: 1192404 - DNA, 15 bp, Homo sapiens
tacaaaaataaattt

SEQ ID NO: 1192405 - DNA, 22 bp, Homo sapiens
tacaaaaataaatttatatgaa

SEQ ID NO: 1192406 - DNA, 17 bp, Homo sapiens
tacaaaaatataaaata

SEQ ID NO: 1192407 - DNA, 20 bp, Homo sapiens
tacaaaaatataaaatatga

SEQ ID NO: 1192408 - DNA, 18 bp, Homo sapiens
tacaaaacctcaaaccag

SEQ ID NO: 1192409 - DNA, 19 bp, Homo sapiens
tacaaaacctgatgttaaa

SEQ ID NO: 1192410 - DNA, 13 bp, Homo sapiens
tacaaaactgcca

SEQ ID NO: 1192411 - DNA, 22 bp, Homo sapiens
tacaaaactgctttgtgcatat

SEQ ID NO: 1192412 - DNA, 12 bp, Homo sapiens
tacaaaacttcc

SEQ ID NO: 1192413 - DNA, 16 bp, Homo sapiens
tacaaaagaagatgaa

SEQ ID NO: 1192414 - DNA, 13 bp, Homo sapiens
tacaaaagatgta

SEQ ID NO: 1192415 - DNA, 20 bp, Homo sapiens
tacaaaataaacaaataaca

SEQ ID NO: 1192416 - DNA, 12 bp, Homo sapiens
tacaaaatattt

SEQ ID NO: 1192417 - DNA, 19 bp, Homo sapiens
tacaaaatatttaagtgaa

SEQ ID NO: 1192418 - DNA, 22 bp, Homo sapiens
tacaaaatatttaagtgaagga

SEQ ID NO: 1192419 - DNA, 12 bp, Homo sapiens
tacaaaattgcc

SEQ ID NO: 1192420 - DNA, 16 bp, Homo sapiens
tacaaaatttattctc

SEQ ID NO: 1192421 - DNA, 10 bp, Homo sapiens
tacaaacaaa

SEQ ID NO: 1192422 - DNA, 22 bp, Homo sapiens
tacaaacaagtggatgttttta

SEQ ID NO: 1192423 - DNA, 12 bp, Homo sapiens
tacaaacatgaa

SEQ ID NO: 1192424 - DNA, 23 bp, Homo sapiens
tacaaaccaagagcttttacaga

SEQ ID NO: 1192425 - DNA, 22 bp, Homo sapiens
tacaaaccactgtgaacatttt

SEQ ID NO: 1192426 - DNA, 18 bp, Homo sapiens
tacaaactcagatccttg

SEQ ID NO: 1192427 - DNA, 13 bp, Homo sapiens
tacaaactgcaat

SEQ ID NO: 1192428 - DNA, 17 bp, Homo sapiens
tacaaagaaataacaag

SEQ ID NO: 1192429 - DNA, 19 bp, Homo sapiens
tacaaagagccttcctatt

SEQ ID NO: 1192430 - DNA, 21 bp, Homo sapiens
tacaaagaggtgtacaggtac

SEQ ID NO: 1192431 - DNA, 13 bp, Homo sapiens
tacaaagatgact

SEQ ID NO: 1192432 - DNA, 19 bp, Homo sapiens
tacaaagctttgctacaaa

SEQ ID NO: 1192433 - DNA, 22 bp, Homo sapiens
tacaaagtaaaatgaacatttt

SEQ ID NO: 1192434 - DNA, 16 bp, Homo sapiens
tacaaagtaatttctt

SEQ ID NO: 1192435 - DNA, 14 bp, Homo sapiens
tacaaagtgtacca

SEQ ID NO: 1192436 - DNA, 13 bp, Homo sapiens
tacaaataaacag

SEQ ID NO: 1192437 - DNA, 15 bp, Homo sapiens
tacaaataaacagtt

SEQ ID NO: 1192438 - DNA, 18 bp, Homo sapiens
tacaaataaacagttgtt

SEQ ID NO: 1192439 - DNA, 17 bp, Homo sapiens
tacaaatactcttagga

SEQ ID NO: 1192440 - DNA, 23 bp, Homo sapiens
tacaaatactcttaggaagagaa

SEQ ID NO: 1192441 - DNA, 17 bp, Homo sapiens
tacaaatataagaataa

SEQ ID NO: 1192442 - DNA, 18 bp, Homo sapiens
tacaaatataagaataaa

SEQ ID NO: 1192443 - DNA, 15 bp, Homo sapiens
tacaaatataggttt

SEQ ID NO: 1192444 - DNA, 17 bp, Homo sapiens
tacaaatatattatata

SEQ ID NO: 1192445 - DNA, 17 bp, Homo sapiens
tacaaatcagaagtcat

SEQ ID NO: 1192446 - DNA, 19 bp, Homo sapiens
tacaaatcagaagtcatct

SEQ ID NO: 1192447 - DNA, 21 bp, Homo sapiens
tacaaatcagaagtcatcttg

SEQ ID NO: 1192448 - DNA, 22 bp, Homo sapiens
tacaaatgtgaaacggaagctc

SEQ ID NO: 1192449 - DNA, 12 bp, Homo sapiens
tacaaatgtgat

SEQ ID NO: 1192450 - DNA, 16 bp, Homo sapiens
tacaaatgtgataata

SEQ ID NO: 1192451 - DNA, 19 bp, Homo sapiens
tacaaatgtttataactct

SEQ ID NO: 1192452 - DNA, 20 bp, Homo sapiens
tacaaatgtttataactcta

SEQ ID NO: 1192453 - DNA, 12 bp, Homo sapiens
tacaaatgtttt

SEQ ID NO: 1192454 - DNA, 13 bp, Homo sapiens
tacaaattagaaa

SEQ ID NO: 1192455 - DNA, 15 bp, Homo sapiens
tacaaattagaaaat

SEQ ID NO: 1192456 - DNA, 14 bp, Homo sapiens
tacaaattgtcgtt

SEQ ID NO: 1192457 - DNA, 20 bp, Homo sapiens
tacaaattgtcgtttttatt

SEQ ID NO: 1192458 - DNA, 15 bp, Homo sapiens
tacaaatttatgcat

SEQ ID NO: 1192459 - DNA, 20 bp, Homo sapiens
tacaaatttggccttaagaa

SEQ ID NO: 1192460 - DNA, 22 bp, Homo sapiens
tacaaatttggccttaagaact

SEQ ID NO: 1192461 - DNA, 24 bp, Homo sapiens
tacaaatttggccttaagaactgt

SEQ ID NO: 1192462 - DNA, 13 bp, Homo sapiens
tacaaattttcac

SEQ ID NO: 1192463 - DNA, 20 bp, Homo sapiens
tacaaattttcactgctgct

SEQ ID NO: 1192464 - DNA, 13 bp, Homo sapiens
tacaaattttgta

SEQ ID NO: 1192465 - DNA, 21 bp, Homo sapiens
tacaacataatctagtttaca

SEQ ID NO: 1192466 - DNA, 14 bp, Homo sapiens
tacaaccaagctct

SEQ ID NO: 1192467 - DNA, 19 bp, Homo sapiens
tacaaccaagctctctgca

SEQ ID NO: 1192468 - DNA, 20 bp, Homo sapiens
tacaaccaagctctctgcat

SEQ ID NO: 1192469 - DNA, 12 bp, Homo sapiens
tacaaccttcat

SEQ ID NO: 1192470 - DNA, 20 bp, Homo sapiens
tacaacgattgtatttgtga

SEQ ID NO: 1192471 - DNA, 18 bp, Homo sapiens
tacaactaaaaataaatt

SEQ ID NO: 1192472 - DNA, 23 bp, Homo sapiens
tacaactgcctcgaaacacagaa

SEQ ID NO: 1192473 - DNA, 17 bp, Homo sapiens
tacaactgtaaagcaaa

SEQ ID NO: 1192474 - DNA, 16 bp, Homo sapiens
tacaacttaatggaaa

SEQ ID NO: 1192475 - DNA, 14 bp, Homo sapiens
tacaacttcaagtg

SEQ ID NO: 1192476 - DNA, 22 bp, Homo sapiens
tacaacttctccttagacactt

SEQ ID NO: 1192477 - DNA, 16 bp, Homo sapiens
tacaacttgatttttt

SEQ ID NO: 1192478 - DNA, 19 bp, Homo sapiens
tacaacttgattttttcaa

SEQ ID NO: 1192479 - DNA, 11 bp, Homo sapiens
tacaactttac

SEQ ID NO: 1192480 - DNA, 13 bp, Homo sapiens
tacaactttacca

SEQ ID NO: 1192481 - DNA, 21 bp, Homo sapiens
tacaagaagcattttgtaagt

SEQ ID NO: 1192482 - DNA, 22 bp, Homo sapiens
tacaagaagtttattctcattt

SEQ ID NO: 1192483 - DNA, 17 bp, Homo sapiens
tacaagagagtgaaatt

SEQ ID NO: 1192484 - DNA, 18 bp, Homo sapiens
tacaagatattgatgata

SEQ ID NO: 1192485 - DNA, 15 bp, Homo sapiens
tacaagatggcgacc

SEQ ID NO: 1192486 - DNA, 21 bp, Homo sapiens
tacaagatggcgaccaccaaa

SEQ ID NO: 1192487 - DNA, 23 bp, Homo sapiens
tacaagatggcgaccaccaaagt

SEQ ID NO: 1192488 - DNA, 16 bp, Homo sapiens
tacaagcatatttgag

SEQ ID NO: 1192489 - DNA, 16 bp, Homo sapiens
tacaagcttaaagctt

SEQ ID NO: 1192490 - DNA, 17 bp, Homo sapiens
tacaagcttaaagcttg

SEQ ID NO: 1192491 - DNA, 17 bp, Homo sapiens
tacaaggacagacagca

SEQ ID NO: 1192492 - DNA, 18 bp, Homo sapiens
tacaaggacattcactgc

SEQ ID NO: 1192493 - DNA, 15 bp, Homo sapiens
tacaagtaacaaaaa

SEQ ID NO: 1192494 - DNA, 17 bp, Homo sapiens
tacaagtaatattatta

SEQ ID NO: 1192495 - DNA, 17 bp, Homo sapiens
tacaagtatatgtgaaa

SEQ ID NO: 1192496 - DNA, 19 bp, Homo sapiens
tacaagtatttttaattaa

SEQ ID NO: 1192497 - DNA, 14 bp, Homo sapiens
tacaagtcagtagg

SEQ ID NO: 1192498 - DNA, 22 bp, Homo sapiens
tacaagtggctccccacctgga

SEQ ID NO: 1192499 - DNA, 17 bp, Homo sapiens
tacaagtggtgaccaaa

SEQ ID NO: 1192500 - DNA, 14 bp, Homo sapiens
tacaagtgtatatc

SEQ ID NO: 1192501 - DNA, 15 bp, Homo sapiens
tacaagtgtatatca

SEQ ID NO: 1192502 - DNA, 18 bp, Homo sapiens
tacaagtgttttagatgt

SEQ ID NO: 1192503 - DNA, 23 bp, Homo sapiens
tacaagtgttttagatgttacta

SEQ ID NO: 1192504 - DNA, 22 bp, Homo sapiens
tacacggactgaggtgcctgct

SEQ ID NO: 1192505 - DNA, 16 bp, Homo sapiens
tacacgtatctcttgg

SEQ ID NO: 1192506 - DNA, 17 bp, Homo sapiens
tacacgtatctcttggt

SEQ ID NO: 1192507 - DNA, 16 bp, Homo sapiens
tacacgtctggacccc

SEQ ID NO: 1192508 - DNA, 14 bp, Homo sapiens
tacacgtgcctgta

SEQ ID NO: 1192509 - DNA, 15 bp, Homo sapiens
tacacgtttatctta

SEQ ID NO: 1192510 - DNA, 22 bp, Homo sapiens
tacactaatatatggacctagc

SEQ ID NO: 1192511 - DNA, 20 bp, Homo sapiens
tacactaccaaacactcagt

SEQ ID NO: 1192512 - DNA, 17 bp, Homo sapiens
tacactagacaaaactg

SEQ ID NO: 1192513 - DNA, 14 bp, Homo sapiens
tacactagttgttt

SEQ ID NO: 1192514 - DNA, 18 bp, Homo sapiens
tacactatgataaagttg

SEQ ID NO: 1192515 - DNA, 16 bp, Homo sapiens
tacactcaggctttca

SEQ ID NO: 1192516 - DNA, 18 bp, Homo sapiens
tacactcaggctttcact

SEQ ID NO: 1192517 - DNA, 16 bp, Homo sapiens
tacactccagcctgag

SEQ ID NO: 1192518 - DNA, 16 bp, Homo sapiens
tacactctttgtaaga

SEQ ID NO: 1192519 - DNA, 18 bp, Homo sapiens
tacactgaatatttatat

SEQ ID NO: 1192520 - DNA, 15 bp, Homo sapiens
tacactgacttgaga

SEQ ID NO: 1192521 - DNA, 16 bp, Homo sapiens
tacactgagcagggag

SEQ ID NO: 1192522 - DNA, 13 bp, Homo sapiens
tacactgaggact

SEQ ID NO: 1192523 - DNA, 14 bp, Homo sapiens
tacactgaggactg

SEQ ID NO: 1192524 - DNA, 18 bp, Homo sapiens
tacactgcactttgttta

SEQ ID NO: 1192525 - DNA, 22 bp, Homo sapiens
tacactggaggagagaagaatg

SEQ ID NO: 1192526 - DNA, 20 bp, Homo sapiens
gaccctctgtccccaggcct

SEQ ID NO: 1192527 - DNA, 19 bp, Homo sapiens
gaccctcttgcccatcctg

SEQ ID NO: 1192528 - DNA, 17 bp, Homo sapiens
gaccctgaacccacacc

SEQ ID NO: 1192529 - DNA, 20 bp, Homo sapiens
gaccctgaacccacacctgg

SEQ ID NO: 1192530 - DNA, 11 bp, Homo sapiens
gaccctgaggc

SEQ ID NO: 1192531 - DNA, 13 bp, Homo sapiens
gaccctgaggccc

SEQ ID NO: 1192532 - DNA, 18 bp, Homo sapiens
gaccctgaggccctgggc

SEQ ID NO: 1192533 - DNA, 19 bp, Homo sapiens
gaccctgaggccctgggct

SEQ ID NO: 1192534 - DNA, 13 bp, Homo sapiens
gaccctgcaccct

SEQ ID NO: 1192535 - DNA, 12 bp, Homo sapiens
gaccctgccaca

SEQ ID NO: 1192536 - DNA, 20 bp, Homo sapiens
gaccctgccacagccagagg

SEQ ID NO: 1192537 - DNA, 23 bp, Homo sapiens
gaccctgccacagccagaggagg

SEQ ID NO: 1192538 - DNA, 14 bp, Homo sapiens
gaccctgccccctg

SEQ ID NO: 1192539 - DNA, 21 bp, Homo sapiens
gaccctgccccctgccagccg

SEQ ID NO: 1192540 - DNA, 17 bp, Homo sapiens
gaccctgcctgagccca

SEQ ID NO: 1192541 - DNA, 22 bp, Homo sapiens
gaccctgcgaaggggccctggt

SEQ ID NO: 1192542 - DNA, 12 bp, Homo sapiens
gaccctgcggcc

SEQ ID NO: 1192543 - DNA, 22 bp, Homo sapiens
gaccctggaattcagcaccctg

SEQ ID NO: 1192544 - DNA, 14 bp, Homo sapiens
gaccctgggtggga

SEQ ID NO: 1192545 - DNA, 17 bp, Homo sapiens
gaccctgggtgggctct

SEQ ID NO: 1192546 - DNA, 22 bp, Homo sapiens
gaccctgggtgggctctgtgca

SEQ ID NO: 1192547 - DNA, 22 bp, Homo sapiens
gaccctggtgacctcctgtcac

SEQ ID NO: 1192548 - DNA, 19 bp, Homo sapiens
gaccctgtatatagcccag

SEQ ID NO: 1192549 - DNA, 23 bp, Homo sapiens
gaccctgtccggcccagtgccac

SEQ ID NO: 1192550 - DNA, 23 bp, Homo sapiens
gaccctgtctcaaaaaaagaaaa

SEQ ID NO: 1192551 - DNA, 12 bp, Homo sapiens
gaccctgtctct

SEQ ID NO: 1192552 - DNA, 13 bp, Homo sapiens
gaccctgtggcca

SEQ ID NO: 1192553 - DNA, 20 bp, Homo sapiens
gacccttacagcctctgact

SEQ ID NO: 1192554 - DNA, 23 bp, Homo sapiens
gacccttaggatggggctcccag

SEQ ID NO: 1192555 - DNA, 16 bp, Homo sapiens
gacccttcccagccct

SEQ ID NO: 1192556 - DNA, 22 bp, Homo sapiens
gacccttcccagccctcatccc

SEQ ID NO: 1192557 - DNA, 17 bp, Homo sapiens
gacccttctccaaaggc

SEQ ID NO: 1192558 - DNA, 15 bp, Homo sapiens
gacccttgcctgcct

SEQ ID NO: 1192559 - DNA, 16 bp, Homo sapiens
gacccttgcctgcctc

SEQ ID NO: 1192560 - DNA, 22 bp, Homo sapiens
gacccttgcctgcctcctaggc

SEQ ID NO: 1192561 - DNA, 21 bp, Homo sapiens
gacccttggcctccatttctg

SEQ ID NO: 1192562 - DNA, 24 bp, Homo sapiens
gacccttggcctccatttctgtct

SEQ ID NO: 1192563 - DNA, 17 bp, Homo sapiens
gacccttggtgtttccc

SEQ ID NO: 1192564 - DNA, 18 bp, Homo sapiens
gacccttggtgtttccct

SEQ ID NO: 1192565 - DNA, 22 bp, Homo sapiens
gacccttggtgtttcccttcct

SEQ ID NO: 1192566 - DNA, 23 bp, Homo sapiens
gaccctttagccaaacccttgtc

SEQ ID NO: 1192567 - DNA, 12 bp, Homo sapiens
gaccctttcctc

SEQ ID NO: 1192568 - DNA, 16 bp, Homo sapiens
gaccctttcctccccc

SEQ ID NO: 1192569 - DNA, 22 bp, Homo sapiens
gaccctttccttccttccctgg

SEQ ID NO: 1192570 - DNA, 18 bp, Homo sapiens
gaccgactaccccagtcc

SEQ ID NO: 1192571 - DNA, 15 bp, Homo sapiens
gaccgattatgcttt

SEQ ID NO: 1192572 - DNA, 15 bp, Homo sapiens
gaccgcccagctctc

SEQ ID NO: 1192573 - DNA, 16 bp, Homo sapiens
gaccgcccagctctcc

SEQ ID NO: 1192574 - DNA, 16 bp, Homo sapiens
gaccgccccctcctct

SEQ ID NO: 1192575 - DNA, 20 bp, Homo sapiens
gaccgcctgccctgcctggg

SEQ ID NO: 1192576 - DNA, 13 bp, Homo sapiens
gaccgcctggccc

SEQ ID NO: 1192577 - DNA, 14 bp, Homo sapiens
gaccgcctggccct

SEQ ID NO: 1192578 - DNA, 15 bp, Homo sapiens
gaccgcctggccctc

SEQ ID NO: 1192579 - DNA, 16 bp, Homo sapiens
gaccgcttcacccctg

SEQ ID NO: 1192580 - DNA, 21 bp, Homo sapiens
gaccgcttgtggggacccagg

SEQ ID NO: 1192581 - DNA, 17 bp, Homo sapiens
gaccggacttttctgca

SEQ ID NO: 1192582 - DNA, 16 bp, Homo sapiens
gaccgggccctgggtt

SEQ ID NO: 1192583 - DNA, 14 bp, Homo sapiens
gaccgggggctgct

SEQ ID NO: 1192584 - DNA, 17 bp, Homo sapiens
gaccgggggctgctggg

SEQ ID NO: 1192585 - DNA, 16 bp, Homo sapiens
gaccgggtgggcctgg

SEQ ID NO: 1192586 - DNA, 17 bp, Homo sapiens
gaccggtgctgcaggag

SEQ ID NO: 1192587 - DNA, 16 bp, Homo sapiens
gaccgtactctcacat

SEQ ID NO: 1192588 - DNA, 13 bp, Homo sapiens
gaccgtccagggg

SEQ ID NO: 1192589 - DNA, 21 bp, Homo sapiens
gaccgtgccattgtactccag

SEQ ID NO: 1192590 - DNA, 17 bp, Homo sapiens
gaccgtgccccacctcc

SEQ ID NO: 1192591 - DNA, 18 bp, Homo sapiens
gaccgtgccccacctccc

SEQ ID NO: 1192592 - DNA, 19 bp, Homo sapiens
gaccgtgccccacctcccc

SEQ ID NO: 1192593 - DNA, 22 bp, Homo sapiens
gaccgtgccccacctccccaca

SEQ ID NO: 1192594 - DNA, 17 bp, Homo sapiens
gaccgtgcgagctgccg

SEQ ID NO: 1192595 - DNA, 21 bp, Homo sapiens
gaccgttttcatcctggcctc

SEQ ID NO: 1192596 - DNA, 18 bp, Homo sapiens
gaccgttttgtattgctt

SEQ ID NO: 1192597 - DNA, 20 bp, Homo sapiens
gacctaaatggcctcatgtg

SEQ ID NO: 1192598 - DNA, 17 bp, Homo sapiens
gacctaacattcgatct

SEQ ID NO: 1192599 - DNA, 21 bp, Homo sapiens
gacctaagtcaggtaatatac

SEQ ID NO: 1192600 - DNA, 18 bp, Homo sapiens
gacctaatgctggcctga

SEQ ID NO: 1192601 - DNA, 20 bp, Homo sapiens
gacctacagacagacataca

SEQ ID NO: 1192602 - DNA, 14 bp, Homo sapiens
gacctacagtgctg

SEQ ID NO: 1192603 - DNA, 16 bp, Homo sapiens
gacctaccaggacaga

SEQ ID NO: 1192604 - DNA, 18 bp, Homo sapiens
gacctaccaggacagaac

SEQ ID NO: 1192605 - DNA, 12 bp, Homo sapiens
gacctacctccc

SEQ ID NO: 1192606 - DNA, 14 bp, Homo sapiens
gacctacctccctc

SEQ ID NO: 1192607 - DNA, 21 bp, Homo sapiens
gacctagaagcttaacactat

SEQ ID NO: 1192608 - DNA, 19 bp, Homo sapiens
gacctagaccagtttgcat

SEQ ID NO: 1192609 - DNA, 14 bp, Homo sapiens
gacctagcaggctg

SEQ ID NO: 1192610 - DNA, 19 bp, Homo sapiens
gacctagctctttgggcct

SEQ ID NO: 1192611 - DNA, 17 bp, Homo sapiens
gacctagctgttgtaaa

SEQ ID NO: 1192612 - DNA, 21 bp, Homo sapiens
gacctagggaggaccttatct

SEQ ID NO: 1192613 - DNA, 23 bp, Homo sapiens
gacctatacagaacagagggcca

SEQ ID NO: 1192614 - DNA, 15 bp, Homo sapiens
gacctatgcagggag

SEQ ID NO: 1192615 - DNA, 22 bp, Homo sapiens
gacctatgtcctaaggacacac

SEQ ID NO: 1192616 - DNA, 16 bp, Homo sapiens
gacctattcaccctcc

SEQ ID NO: 1192617 - DNA, 19 bp, Homo sapiens
gacctattcaccctccact

SEQ ID NO: 1192618 - DNA, 14 bp, Homo sapiens
gacctcaagccatc

SEQ ID NO: 1192619 - DNA, 16 bp, Homo sapiens
gacctcaagggacagg

SEQ ID NO: 1192620 - DNA, 20 bp, Homo sapiens
gacctcacacctgggggaca

SEQ ID NO: 1192621 - DNA, 19 bp, Homo sapiens
gacctcagagtccaggccc

SEQ ID NO: 1192622 - DNA, 11 bp, Homo sapiens
gacctcagcct

SEQ ID NO: 1192623 - DNA, 12 bp, Homo sapiens
gacctcagcctg

SEQ ID NO: 1192624 - DNA, 16 bp, Homo sapiens
gacctcagcctgtgct

SEQ ID NO: 1192625 - DNA, 21 bp, Homo sapiens
gacctcagctgcacattcctg

SEQ ID NO: 1192626 - DNA, 17 bp, Homo sapiens
gaccttcatttcatgta

SEQ ID NO: 1192627 - DNA, 15 bp, Homo sapiens
gaccttccagagccc

SEQ ID NO: 1192628 - DNA, 16 bp, Homo sapiens
gaccttccctccgcct

SEQ ID NO: 1192629 - DNA, 22 bp, Homo sapiens
gaccttcctcatccaccccatc

SEQ ID NO: 1192630 - DNA, 16 bp, Homo sapiens
gaccttcgggctgtgc

SEQ ID NO: 1192631 - DNA, 19 bp, Homo sapiens
gaccttcgggctgtgcccg

SEQ ID NO: 1192632 - DNA, 15 bp, Homo sapiens
gaccttgaatctttt

SEQ ID NO: 1192633 - DNA, 14 bp, Homo sapiens
gaccttggcgctct

SEQ ID NO: 1192634 - DNA, 19 bp, Homo sapiens
gaccttggcgctctcagct

SEQ ID NO: 1192635 - DNA, 22 bp, Homo sapiens
gaccttggcgctctcagctttc

SEQ ID NO: 1192636 - DNA, 21 bp, Homo sapiens
gaccttgggccaaatccgctc

SEQ ID NO: 1192637 - DNA, 16 bp, Homo sapiens
gaccttgttacttctg

SEQ ID NO: 1192638 - DNA, 17 bp, Homo sapiens
gaccttgttacttctga

SEQ ID NO: 1192639 - DNA, 23 bp, Homo sapiens
gacctttaagaaaaatgaaaact

SEQ ID NO: 1192640 - DNA, 18 bp, Homo sapiens
gacctttatttttctatc

SEQ ID NO: 1192641 - DNA, 23 bp, Homo sapiens
gacctttccaccacagccagcac

SEQ ID NO: 1192642 - DNA, 23 bp, Homo sapiens
gacctttgatgaattcttcctct

SEQ ID NO: 1192643 - DNA, 17 bp, Homo sapiens
gacctttgggttctttc

SEQ ID NO: 1192644 - DNA, 18 bp, Homo sapiens
gacctttgggttctttct

SEQ ID NO: 1192645 - DNA, 18 bp, Homo sapiens
gacctttgtcttctataa

SEQ ID NO: 1192646 - DNA, 16 bp, Homo sapiens
gacgaaaaagaggcat

SEQ ID NO: 1192647 - DNA, 15 bp, Homo sapiens
gacgaacggaagggt

SEQ ID NO: 1192648 - DNA, 21 bp, Homo sapiens
gacgacacctggagactgtcc

SEQ ID NO: 1192649 - DNA, 22 bp, Homo sapiens
gacgagacccaagggcagagca

SEQ ID NO: 1192650 - DNA, 15 bp, Homo sapiens
gacgagcatccccct

SEQ ID NO: 1192651 - DNA, 24 bp, Homo sapiens
gacgagcatccccctcctctccct

SEQ ID NO: 1192652 - DNA, 16 bp, Homo sapiens
gacgagttcatgggga

SEQ ID NO: 1192653 - DNA, 17 bp, Homo sapiens
gacgagttgatttcctc

SEQ ID NO: 1192654 - DNA, 12 bp, Homo sapiens
tacagtcttgta

SEQ ID NO: 1192655 - DNA, 19 bp, Homo sapiens
tacagtgaaattttggtga

SEQ ID NO: 1192656 - DNA, 16 bp, Homo sapiens
tacagtgactccctgg

SEQ ID NO: 1192657 - DNA, 14 bp, Homo sapiens
tacagtgagccaag

SEQ ID NO: 1192658 - DNA, 20 bp, Homo sapiens
tacagtgaggactcggccac

SEQ ID NO: 1192659 - DNA, 13 bp, Homo sapiens
tacagtgaggagg

SEQ ID NO: 1192660 - DNA, 20 bp, Homo sapiens
tacagtgcagacaggccatg

SEQ ID NO: 1192661 - DNA, 21 bp, Homo sapiens
tacagtgcagagccttctcag

SEQ ID NO: 1192662 - DNA, 21 bp, Homo sapiens
tacagtgcccaccgccctcct

SEQ ID NO: 1192663 - DNA, 24 bp, Homo sapiens
tacagtgcccaccgccctcctcca

SEQ ID NO: 1192664 - DNA, 11 bp, Homo sapiens
tacagtggttt

SEQ ID NO: 1192665 - DNA, 16 bp, Homo sapiens
tacagtgtacagtctt

SEQ ID NO: 1192666 - DNA, 23 bp, Homo sapiens
tacagtgtctgtgccatggattt

SEQ ID NO: 1192667 - DNA, 12 bp, Homo sapiens
tacagtgtcttt

SEQ ID NO: 1192668 - DNA, 23 bp, Homo sapiens
tacagtgtctttttttgtatagt

SEQ ID NO: 1192669 - DNA, 13 bp, Homo sapiens
tacagtgtgtgtg

SEQ ID NO: 1192670 - DNA, 18 bp, Homo sapiens
tacagttagggttttgca

SEQ ID NO: 1192671 - DNA, 13 bp, Homo sapiens
tacagttctgctc

SEQ ID NO: 1192672 - DNA, 17 bp, Homo sapiens
tacagttgaaaaacagc

SEQ ID NO: 1192673 - DNA, 16 bp, Homo sapiens
tacagttgttggcctc

SEQ ID NO: 1192674 - DNA, 13 bp, Homo sapiens
tacagtttgactt

SEQ ID NO: 1192675 - DNA, 19 bp, Homo sapiens
tacagtttgtgttttaaaa

SEQ ID NO: 1192676 - DNA, 21 bp, Homo sapiens
tacagtttgtgttttaaaaaa

SEQ ID NO: 1192677 - DNA, 23 bp, Homo sapiens
tacagtttgtgttttaaaaaaac

SEQ ID NO: 1192678 - DNA, 17 bp, Homo sapiens
tacagttttaactgtgg

SEQ ID NO: 1192679 - DNA, 19 bp, Homo sapiens
tacagttttaactgtggat

SEQ ID NO: 1192680 - DNA, 14 bp, Homo sapiens
tacagttttcattg

SEQ ID NO: 1192681 - DNA, 13 bp, Homo sapiens
tacataaaagaaa

SEQ ID NO: 1192682 - DNA, 17 bp, Homo sapiens
tacataaactgacttta

SEQ ID NO: 1192683 - DNA, 16 bp, Homo sapiens
tacataaagctccctt

SEQ ID NO: 1192684 - DNA, 16 bp, Homo sapiens
tacataaattccagag

SEQ ID NO: 1192685 - DNA, 14 bp, Homo sapiens
tacataacacattt

SEQ ID NO: 1192686 - DNA, 20 bp, Homo sapiens
tacataactctgtaaaaaca

SEQ ID NO: 1192687 - DNA, 18 bp, Homo sapiens
tacataacttgatataga

SEQ ID NO: 1192688 - DNA, 22 bp, Homo sapiens
tacataacttgatatagaaagc

SEQ ID NO: 1192689 - DNA, 16 bp, Homo sapiens
tacataaggatgactt

SEQ ID NO: 1192690 - DNA, 15 bp, Homo sapiens
tacataagtttagga

SEQ ID NO: 1192691 - DNA, 20 bp, Homo sapiens
tacataatgcgtgcatacca

SEQ ID NO: 1192692 - DNA, 19 bp, Homo sapiens
tacataatgggccactgaa

SEQ ID NO: 1192693 - DNA, 13 bp, Homo sapiens
tacataatgtttt

SEQ ID NO: 1192694 - DNA, 13 bp, Homo sapiens
tacatacacacac

SEQ ID NO: 1192695 - DNA, 13 bp, Homo sapiens
tacatacacatac

SEQ ID NO: 1192696 - DNA, 16 bp, Homo sapiens
tacatacaccagcatt

SEQ ID NO: 1192697 - DNA, 20 bp, Homo sapiens
tacatacaccagcattcctt

SEQ ID NO: 1192698 - DNA, 15 bp, Homo sapiens
tacatacatacatat

SEQ ID NO: 1192699 - DNA, 15 bp, Homo sapiens
tacatacatatatat

SEQ ID NO: 1192700 - DNA, 15 bp, Homo sapiens
tacatacattgtata

SEQ ID NO: 1192701 - DNA, 22 bp, Homo sapiens
tacataccctggccgccccctg

SEQ ID NO: 1192702 - DNA, 21 bp, Homo sapiens
tacatacgcaaaaacttcctt

SEQ ID NO: 1192703 - DNA, 12 bp, Homo sapiens
tacatactgcag

SEQ ID NO: 1192704 - DNA, 12 bp, Homo sapiens
tacatactgctg

SEQ ID NO: 1192705 - DNA, 13 bp, Homo sapiens
tacatactggcct

SEQ ID NO: 1192706 - DNA, 16 bp, Homo sapiens
tacatactggcctctg

SEQ ID NO: 1192707 - DNA, 14 bp, Homo sapiens
tacatagagctcta

SEQ ID NO: 1192708 - DNA, 13 bp, Homo sapiens
tacatagatcagc

SEQ ID NO: 1192709 - DNA, 18 bp, Homo sapiens
tacatagatcagccatta

SEQ ID NO: 1192710 - DNA, 21 bp, Homo sapiens
tacatagatcagccattaaaa

SEQ ID NO: 1192711 - DNA, 14 bp, Homo sapiens
tacatagatgctta

SEQ ID NO: 1192712 - DNA, 21 bp, Homo sapiens
tacatagatttatttttcagt

SEQ ID NO: 1192713 - DNA, 22 bp, Homo sapiens
tacatagcagactttcccaaat

SEQ ID NO: 1192714 - DNA, 15 bp, Homo sapiens
tacatagtctgttcc

SEQ ID NO: 1192715 - DNA, 17 bp, Homo sapiens
tacatagtgctgctgtg

SEQ ID NO: 1192716 - DNA, 20 bp, Homo sapiens
tacatataaaatgtaattac

SEQ ID NO: 1192717 - DNA, 17 bp, Homo sapiens
tacatatatacattgct

SEQ ID NO: 1192718 - DNA, 16 bp, Homo sapiens
tacatatatatataca

SEQ ID NO: 1192719 - DNA, 12 bp, Homo sapiens
tacatatatatt

SEQ ID NO: 1192720 - DNA, 22 bp, Homo sapiens
tacatatatattttttgctttt

SEQ ID NO: 1192721 - DNA, 18 bp, Homo sapiens
tacatatatctacacata

SEQ ID NO: 1192722 - DNA, 15 bp, Homo sapiens
tacatatcgctgact

SEQ ID NO: 1192723 - DNA, 20 bp, Homo sapiens
tacatatcgctgacttcatg

SEQ ID NO: 1192724 - DNA, 12 bp, Homo sapiens
tacatatcttta

SEQ ID NO: 1192725 - DNA, 22 bp, Homo sapiens
tacatatctttattaatcacta

SEQ ID NO: 1192726 - DNA, 17 bp, Homo sapiens
tacatatgagaatatac

SEQ ID NO: 1192727 - DNA, 21 bp, Homo sapiens
tacatatgagaatatacctta

SEQ ID NO: 1192728 - DNA, 22 bp, Homo sapiens
tacatatgagtgtggaagccgg

SEQ ID NO: 1192729 - DNA, 18 bp, Homo sapiens
tacatatgctgatctttt

SEQ ID NO: 1192730 - DNA, 17 bp, Homo sapiens
tacatatgctttaagaa

SEQ ID NO: 1192731 - DNA, 21 bp, Homo sapiens
tacatatgctttaagaatcga

SEQ ID NO: 1192732 - DNA, 17 bp, Homo sapiens
tacatatggatgttact

SEQ ID NO: 1192733 - DNA, 18 bp, Homo sapiens
tacatatggatgttactc

SEQ ID NO: 1192734 - DNA, 19 bp, Homo sapiens
tacatatggatgttactct

SEQ ID NO: 1192735 - DNA, 17 bp, Homo sapiens
tacatatttgagactag

SEQ ID NO: 1192736 - DNA, 14 bp, Homo sapiens
tacatattttgtat

SEQ ID NO: 1192737 - DNA, 15 bp, Homo sapiens
tacatattttgtatt

SEQ ID NO: 1192738 - DNA, 20 bp, Homo sapiens
tacatcaagtccatctgaca

SEQ ID NO: 1192739 - DNA, 21 bp, Homo sapiens
tacatcaagtccatctgacaa

SEQ ID NO: 1192740 - DNA, 16 bp, Homo sapiens
tacatcacgttaaagt

SEQ ID NO: 1192741 - DNA, 19 bp, Homo sapiens
tacatcactttgtgaatta

SEQ ID NO: 1192742 - DNA, 23 bp, Homo sapiens
tacatccaaagcagacagctcca

SEQ ID NO: 1192743 - DNA, 14 bp, Homo sapiens
tacatcccagcctg

SEQ ID NO: 1192744 - DNA, 19 bp, Homo sapiens
tacatcgtttactttttaa

SEQ ID NO: 1192745 - DNA, 15 bp, Homo sapiens
tacatctaatgcttc

SEQ ID NO: 1192746 - DNA, 19 bp, Homo sapiens
tacatctattttggattgt

SEQ ID NO: 1192747 - DNA, 23 bp, Homo sapiens
tacatctattttggattgtatat

SEQ ID NO: 1192748 - DNA, 17 bp, Homo sapiens
tacatcttctgtgaaat

SEQ ID NO: 1192749 - DNA, 20 bp, Homo sapiens
tacatcttctgtgaaatata

SEQ ID NO: 1192750 - DNA, 23 bp, Homo sapiens
tacatcttgttggtacctttcta

SEQ ID NO: 1192751 - DNA, 20 bp, Homo sapiens
tacatcttttcaacaagtaa

SEQ ID NO: 1192752 - DNA, 15 bp, Homo sapiens
tacatcttttctaat

SEQ ID NO: 1192753 - DNA, 20 bp, Homo sapiens
tacatgaagaatagaaacaa

SEQ ID NO: 1192754 - DNA, 16 bp, Homo sapiens
tacatgacatttattt

SEQ ID NO: 1192755 - DNA, 13 bp, Homo sapiens
tacatgactgggc

SEQ ID NO: 1192756 - DNA, 13 bp, Homo sapiens
tacatgactgttt

SEQ ID NO: 1192757 - DNA, 22 bp, Homo sapiens
tacatgactgtttcttttgtaa

SEQ ID NO: 1192758 - DNA, 15 bp, Homo sapiens
tacatgagaaagatg

SEQ ID NO: 1192759 - DNA, 16 bp, Homo sapiens
tacatgagaaggaact

SEQ ID NO: 1192760 - DNA, 15 bp, Homo sapiens
tacatgatacatttt

SEQ ID NO: 1192761 - DNA, 16 bp, Homo sapiens
tacatgcaatttatta

SEQ ID NO: 1192762 - DNA, 13 bp, Homo sapiens
tacatgcacacac

SEQ ID NO: 1192763 - DNA, 14 bp, Homo sapiens
tacatgcagcccat

SEQ ID NO: 1192764 - DNA, 22 bp, Homo sapiens
tacatgcagcccatgcccacct

SEQ ID NO: 1192765 - DNA, 14 bp, Homo sapiens
tacatgcatataat

SEQ ID NO: 1192766 - DNA, 17 bp, Homo sapiens
tacatgctaagagaagt

SEQ ID NO: 1192767 - DNA, 16 bp, Homo sapiens
tacatgctatgctgaa

SEQ ID NO: 1192768 - DNA, 23 bp, Homo sapiens
tacatgctatgctgaagacattc

SEQ ID NO: 1192769 - DNA, 14 bp, Homo sapiens
tacatgctgctaat

SEQ ID NO: 1192770 - DNA, 22 bp, Homo sapiens
tacatgctggttacctgttcca

SEQ ID NO: 1192771 - DNA, 16 bp, Homo sapiens
tacatggaaaggattt

SEQ ID NO: 1192772 - DNA, 22 bp, Homo sapiens
tacatggcagagtttgtgtgtt

SEQ ID NO: 1192773 - DNA, 19 bp, Homo sapiens
tacatggcgccctgcctcc

SEQ ID NO: 1192774 - DNA, 20 bp, Homo sapiens
tacatggtggtgatgtccaa

SEQ ID NO: 1192775 - DNA, 20 bp, Homo sapiens
tacatgtaactatttcttca

SEQ ID NO: 1192776 - DNA, 18 bp, Homo sapiens
tacatgtaagtgtggttt

SEQ ID NO: 1192777 - DNA, 23 bp, Homo sapiens
tacatgtaagtgtggttttgtaa

SEQ ID NO: 1192778 - DNA, 13 bp, Homo sapiens
tacatgtaatttg

SEQ ID NO: 1192779 - DNA, 21 bp, Homo sapiens
gacgatatactccctgccctt

SEQ ID NO: 1192780 - DNA, 13 bp, Homo sapiens
gacgatcgcccag

SEQ ID NO: 1192781 - DNA, 16 bp, Homo sapiens
gacgatgggtgttgct

SEQ ID NO: 1192782 - DNA, 13 bp, Homo sapiens
gacgcacagtgca

SEQ ID NO: 1192783 - DNA, 19 bp, Homo sapiens
gacgcaccactgccaatgc

SEQ ID NO: 1192784 - DNA, 17 bp, Homo sapiens
gacgcacgctcgctgcc

SEQ ID NO: 1192785 - DNA, 16 bp, Homo sapiens
gacgcaggaatggaaa

SEQ ID NO: 1192786 - DNA, 21 bp, Homo sapiens
gacgccaacttctcccacccc

SEQ ID NO: 1192787 - DNA, 17 bp, Homo sapiens
gacgccaaggaggtggg

SEQ ID NO: 1192788 - DNA, 18 bp, Homo sapiens
gacgccactcatttcatc

SEQ ID NO: 1192789 - DNA, 21 bp, Homo sapiens
gacgccactcatttcatctca

SEQ ID NO: 1192790 - DNA, 15 bp, Homo sapiens
gacgccactccctgg

SEQ ID NO: 1192791 - DNA, 16 bp, Homo sapiens
gacgccatgtgatgga

SEQ ID NO: 1192792 - DNA, 14 bp, Homo sapiens
gacgcccagctccg

SEQ ID NO: 1192793 - DNA, 18 bp, Homo sapiens
gacgccctctccccaccc

SEQ ID NO: 1192794 - DNA, 11 bp, Homo sapiens
gacgccctgcg

SEQ ID NO: 1192795 - DNA, 18 bp, Homo sapiens
gacgcctgagacagcacc

SEQ ID NO: 1192796 - DNA, 13 bp, Homo sapiens
gacgcctgaggaa

SEQ ID NO: 1192797 - DNA, 14 bp, Homo sapiens
gacgcctgaggaac

SEQ ID NO: 1192798 - DNA, 12 bp, Homo sapiens
gacgcctgcagg

SEQ ID NO: 1192799 - DNA, 20 bp, Homo sapiens
gacgcctgccctccccagag

SEQ ID NO: 1192800 - DNA, 22 bp, Homo sapiens
gacgcctgccctccccagagca

SEQ ID NO: 1192801 - DNA, 15 bp, Homo sapiens
gacgcctgccctgcc

SEQ ID NO: 1192802 - DNA, 19 bp, Homo sapiens
gacgcctgggggtgccagg

SEQ ID NO: 1192803 - DNA, 20 bp, Homo sapiens
gacgctcccctgagaggttt

SEQ ID NO: 1192804 - DNA, 13 bp, Homo sapiens
gacgctgcagagc

SEQ ID NO: 1192805 - DNA, 18 bp, Homo sapiens
gacgctgccctgcatgct

SEQ ID NO: 1192806 - DNA, 21 bp, Homo sapiens
gacgctgccgctgccgctgca

SEQ ID NO: 1192807 - DNA, 16 bp, Homo sapiens
gacgcttgtgacagtg

SEQ ID NO: 1192808 - DNA, 20 bp, Homo sapiens
gacgcttttgagtgggccct

SEQ ID NO: 1192809 - DNA, 22 bp, Homo sapiens
gacgcttttgagtgggccctgc

SEQ ID NO: 1192810 - DNA, 15 bp, Homo sapiens
gacggagagaaaaaa

SEQ ID NO: 1192811 - DNA, 23 bp, Homo sapiens
gacggataggcaggaacatacag

SEQ ID NO: 1192812 - DNA, 19 bp, Homo sapiens
gacggcaggctcactgcca

SEQ ID NO: 1192813 - DNA, 20 bp, Homo sapiens
gacggccaatggtgcttccc

SEQ ID NO: 1192814 - DNA, 13 bp, Homo sapiens
gacggccctgcct

SEQ ID NO: 1192815 - DNA, 15 bp, Homo sapiens
gacggccctgcctgc

SEQ ID NO: 1192816 - DNA, 17 bp, Homo sapiens
gacggccctgcctgcct

SEQ ID NO: 1192817 - DNA, 18 bp, Homo sapiens
gacggccctgcctgcctc

SEQ ID NO: 1192818 - DNA, 19 bp, Homo sapiens
gacggccctgcctgcctct

SEQ ID NO: 1192819 - DNA, 15 bp, Homo sapiens
gacggccctgctggg

SEQ ID NO: 1192820 - DNA, 21 bp, Homo sapiens
gacggccggccggacctctga

SEQ ID NO: 1192821 - DNA, 18 bp, Homo sapiens
gacggcctaggggtggcg

SEQ ID NO: 1192822 - DNA, 14 bp, Homo sapiens
gacggcctccagga

SEQ ID NO: 1192823 - DNA, 15 bp, Homo sapiens
gacggcctccaggag

SEQ ID NO: 1192824 - DNA, 16 bp, Homo sapiens
gacggcctccaggagg

SEQ ID NO: 1192825 - DNA, 15 bp, Homo sapiens
gacggcctgatgctc

SEQ ID NO: 1192826 - DNA, 22 bp, Homo sapiens
gacggctcctcagagcgccagg

SEQ ID NO: 1192827 - DNA, 14 bp, Homo sapiens
gacggctcctcccc

SEQ ID NO: 1192828 - DNA, 12 bp, Homo sapiens
gacggctgggca

SEQ ID NO: 1192829 - DNA, 13 bp, Homo sapiens
gacggctgggcac

SEQ ID NO: 1192830 - DNA, 11 bp, Homo sapiens
gacggctgggg

SEQ ID NO: 1192831 - DNA, 13 bp, Homo sapiens
gacggctgtgacg

SEQ ID NO: 1192832 - DNA, 20 bp, Homo sapiens
gacgggcacacagactggag

SEQ ID NO: 1192833 - DNA, 18 bp, Homo sapiens
gacgggcatcgcaggagt

SEQ ID NO: 1192834 - DNA, 22 bp, Homo sapiens
gacgggccctccttccctcctg

SEQ ID NO: 1192835 - DNA, 18 bp, Homo sapiens
gacgggccgcaggaggga

SEQ ID NO: 1192836 - DNA, 16 bp, Homo sapiens
gacggggactggggat

SEQ ID NO: 1192837 - DNA, 21 bp, Homo sapiens
gacggtaagtgttctcatgaa

SEQ ID NO: 1192838 - DNA, 19 bp, Homo sapiens
gacggtcctttaggcagcc

SEQ ID NO: 1192839 - DNA, 23 bp, Homo sapiens
gacggtcctttaggcagcctgcc

SEQ ID NO: 1192840 - DNA, 12 bp, Homo sapiens
gacggtgccaag

SEQ ID NO: 1192841 - DNA, 13 bp, Homo sapiens
gacggtgccaagg

SEQ ID NO: 1192842 - DNA, 17 bp, Homo sapiens
gacggtgccaagggccc

SEQ ID NO: 1192843 - DNA, 18 bp, Homo sapiens
gacggtgcccaagccaga

SEQ ID NO: 1192844 - DNA, 17 bp, Homo sapiens
gacggtgctcactccca

SEQ ID NO: 1192845 - DNA, 15 bp, Homo sapiens
gacggtgtggctgat

SEQ ID NO: 1192846 - DNA, 23 bp, Homo sapiens
gacggtgttttgccatgttggcc

SEQ ID NO: 1192847 - DNA, 17 bp, Homo sapiens
gacggttaacttgtata

SEQ ID NO: 1192848 - DNA, 23 bp, Homo sapiens
gacggttaacttgtatattccac

SEQ ID NO: 1192849 - DNA, 14 bp, Homo sapiens
gacggttgtaagca

SEQ ID NO: 1192850 - DNA, 21 bp, Homo sapiens
gacggtttcaaaccaggattt

SEQ ID NO: 1192851 - DNA, 17 bp, Homo sapiens
gacggtttctagcctct

SEQ ID NO: 1192852 - DNA, 15 bp, Homo sapiens
gacgtacttgcagtt

SEQ ID NO: 1192853 - DNA, 20 bp, Homo sapiens
gacgtcactttttggccatg

SEQ ID NO: 1192854 - DNA, 20 bp, Homo sapiens
gacgtcaggccctgactcct

SEQ ID NO: 1192855 - DNA, 15 bp, Homo sapiens
gacgtccctgcccat

SEQ ID NO: 1192856 - DNA, 13 bp, Homo sapiens
gacgtccttccat

SEQ ID NO: 1192857 - DNA, 17 bp, Homo sapiens
gacgtctggggtgtggg

SEQ ID NO: 1192858 - DNA, 15 bp, Homo sapiens
gacgtcttcagagtc

SEQ ID NO: 1192859 - DNA, 18 bp, Homo sapiens
gacgtgcacctgtactca

SEQ ID NO: 1192860 - DNA, 14 bp, Homo sapiens
gacgtgcactgaca

SEQ ID NO: 1192861 - DNA, 22 bp, Homo sapiens
gacgtgcactgtgaatcctggc

SEQ ID NO: 1192862 - DNA, 23 bp, Homo sapiens
gacgtgccttttgcacccctccc

SEQ ID NO: 1192863 - DNA, 14 bp, Homo sapiens
gacgtgctggcctt

SEQ ID NO: 1192864 - DNA, 11 bp, Homo sapiens
gacgtgctggg

SEQ ID NO: 1192865 - DNA, 18 bp, Homo sapiens
gacgtggaacctctgtct

SEQ ID NO: 1192866 - DNA, 20 bp, Homo sapiens
gacgtggaacctctgtctca

SEQ ID NO: 1192867 - DNA, 22 bp, Homo sapiens
gacgtggaacctctgtctcatc

SEQ ID NO: 1192868 - DNA, 20 bp, Homo sapiens
gacgtggagcggggtatgaa

SEQ ID NO: 1192869 - DNA, 23 bp, Homo sapiens
gacgtgggccctgcaggctgcag

SEQ ID NO: 1192870 - DNA, 19 bp, Homo sapiens
gactcccccaaccaaggaa

SEQ ID NO: 1192871 - DNA, 22 bp, Homo sapiens
gactcccccaaccaaggaagga

SEQ ID NO: 1192872 - DNA, 22 bp, Homo sapiens
gactcccgccccgggctggccc

SEQ ID NO: 1192873 - DNA, 23 bp, Homo sapiens
gactcccgccccgggctggccct

SEQ ID NO: 1192874 - DNA, 15 bp, Homo sapiens
gactccctccccacc

SEQ ID NO: 1192875 - DNA, 16 bp, Homo sapiens
gactccctccccaccc

SEQ ID NO: 1192876 - DNA, 17 bp, Homo sapiens
gactccctccccaccca

SEQ ID NO: 1192877 - DNA, 18 bp, Homo sapiens
gactccctccccacccaa

SEQ ID NO: 1192878 - DNA, 19 bp, Homo sapiens
gactccctccccacccaag

SEQ ID NO: 1192879 - DNA, 13 bp, Homo sapiens
gactccctcctca

SEQ ID NO: 1192880 - DNA, 14 bp, Homo sapiens
gactccctcctcac

SEQ ID NO: 1192881 - DNA, 19 bp, Homo sapiens
gactccctcctcacctctg

SEQ ID NO: 1192882 - DNA, 19 bp, Homo sapiens
gactccctgagtctggacc

SEQ ID NO: 1192883 - DNA, 14 bp, Homo sapiens
gactccctgggagc

SEQ ID NO: 1192884 - DNA, 24 bp, Homo sapiens
gactccctgtgggggtggccatcc

SEQ ID NO: 1192885 - DNA, 13 bp, Homo sapiens
gactccggaggac

SEQ ID NO: 1192886 - DNA, 21 bp, Homo sapiens
gactccggggccccactggct

SEQ ID NO: 1192887 - DNA, 18 bp, Homo sapiens
gactcctcaaaccacttg

SEQ ID NO: 1192888 - DNA, 17 bp, Homo sapiens
gactcctcctttttcca

SEQ ID NO: 1192889 - DNA, 13 bp, Homo sapiens
gactcctctggct

SEQ ID NO: 1192890 - DNA, 11 bp, Homo sapiens
gactcctctgt

SEQ ID NO: 1192891 - DNA, 18 bp, Homo sapiens
gactcctgaggacagctg

SEQ ID NO: 1192892 - DNA, 13 bp, Homo sapiens
gactcctgccctg

SEQ ID NO: 1192893 - DNA, 21 bp, Homo sapiens
gactcctgcctgagtttccag

SEQ ID NO: 1192894 - DNA, 14 bp, Homo sapiens
gactcctggactcc

SEQ ID NO: 1192895 - DNA, 21 bp, Homo sapiens
gactcctggactccggaggac

SEQ ID NO: 1192896 - DNA, 12 bp, Homo sapiens
gactcctggcag

SEQ ID NO: 1192897 - DNA, 21 bp, Homo sapiens
gactcctggcagggccacctg

SEQ ID NO: 1192898 - DNA, 10 bp, Homo sapiens
gactcctggg

SEQ ID NO: 1192899 - DNA, 14 bp, Homo sapiens
gactcctggtctgt

SEQ ID NO: 1192900 - DNA, 12 bp, Homo sapiens
gactccttctcc

SEQ ID NO: 1192901 - DNA, 13 bp, Homo sapiens
gactcgaaactga

SEQ ID NO: 1192902 - DNA, 15 bp, Homo sapiens
gactcgaaactgaca

SEQ ID NO: 1192903 - DNA, 15 bp, Homo sapiens
gactcgacaaaggcc

SEQ ID NO: 1192904 - DNA, 19 bp, Homo sapiens
gactcgcagcacccacagc

SEQ ID NO: 1192905 - DNA, 12 bp, Homo sapiens
gactcgccccca

SEQ ID NO: 1192906 - DNA, 18 bp, Homo sapiens
gactcgggagctgcacac

SEQ ID NO: 1192907 - DNA, 22 bp, Homo sapiens
gactcgggagctgcacacacct

SEQ ID NO: 1192908 - DNA, 16 bp, Homo sapiens
gactcgggggtgggga

SEQ ID NO: 1192909 - DNA, 14 bp, Homo sapiens
taccagctcccagg

SEQ ID NO: 1192910 - DNA, 22 bp, Homo sapiens
taccagctcctccagccctgcc

SEQ ID NO: 1192911 - DNA, 13 bp, Homo sapiens
taccagctgcgct

SEQ ID NO: 1192912 - DNA, 19 bp, Homo sapiens
taccagcttaatagctgta

SEQ ID NO: 1192913 - DNA, 17 bp, Homo sapiens
taccaggcaaattcact

SEQ ID NO: 1192914 - DNA, 21 bp, Homo sapiens
taccaggcaccaaaagaagta

SEQ ID NO: 1192915 - DNA, 18 bp, Homo sapiens
taccaggtgtgcctggaa

SEQ ID NO: 1192916 - DNA, 19 bp, Homo sapiens
taccaggtgtgcctggaag

SEQ ID NO: 1192917 - DNA, 14 bp, Homo sapiens
taccaggttgaaag

SEQ ID NO: 1192918 - DNA, 20 bp, Homo sapiens
taccagtatttagaagccaa

SEQ ID NO: 1192919 - DNA, 16 bp, Homo sapiens
taccagtgaaccaaag

SEQ ID NO: 1192920 - DNA, 15 bp, Homo sapiens
taccataaagccttt

SEQ ID NO: 1192921 - DNA, 17 bp, Homo sapiens
taccataaagcctttaa

SEQ ID NO: 1192922 - DNA, 17 bp, Homo sapiens
taccatactgtctctgg

SEQ ID NO: 1192923 - DNA, 18 bp, Homo sapiens
taccatactgtctctgga

SEQ ID NO: 1192924 - DNA, 20 bp, Homo sapiens
taccatactgtctctggagt

SEQ ID NO: 1192925 - DNA, 22 bp, Homo sapiens
taccataggaagacataaaact

SEQ ID NO: 1192926 - DNA, 23 bp, Homo sapiens
taccataggaagacataaaactt

SEQ ID NO: 1192927 - DNA, 22 bp, Homo sapiens
taccatgagaagagggcctgtg

SEQ ID NO: 1192928 - DNA, 22 bp, Homo sapiens
taccatgctgctttttggcaca

SEQ ID NO: 1192929 - DNA, 16 bp, Homo sapiens
taccatgtcactgtgg

SEQ ID NO: 1192930 - DNA, 23 bp, Homo sapiens
taccatgtgaaactctaccctga

SEQ ID NO: 1192931 - DNA, 16 bp, Homo sapiens
taccatgtgtgctaat

SEQ ID NO: 1192932 - DNA, 18 bp, Homo sapiens
taccattaaaactgcttt

SEQ ID NO: 1192933 - DNA, 19 bp, Homo sapiens
taccattaaaactgctttt

SEQ ID NO: 1192934 - DNA, 20 bp, Homo sapiens
taccattaaaactgcttttt

SEQ ID NO: 1192935 - DNA, 15 bp, Homo sapiens
taccattaattacat

SEQ ID NO: 1192936 - DNA, 13 bp, Homo sapiens
taccattcagatc

SEQ ID NO: 1192937 - DNA, 15 bp, Homo sapiens
taccattcagatcac

SEQ ID NO: 1192938 - DNA, 20 bp, Homo sapiens
taccattcagatcactgaat

SEQ ID NO: 1192939 - DNA, 21 bp, Homo sapiens
taccattccttcaaataaaga

SEQ ID NO: 1192940 - DNA, 14 bp, Homo sapiens
taccatttatgaag

SEQ ID NO: 1192941 - DNA, 16 bp, Homo sapiens
taccatttcagagagg

SEQ ID NO: 1192942 - DNA, 22 bp, Homo sapiens
taccatttgtaataaagtatat

SEQ ID NO: 1192943 - DNA, 23 bp, Homo sapiens
taccatttgtaataaagtatata

SEQ ID NO: 1192944 - DNA, 19 bp, Homo sapiens
taccattttaacgctgcct

SEQ ID NO: 1192945 - DNA, 19 bp, Homo sapiens
taccattttacatttctat

SEQ ID NO: 1192946 - DNA, 15 bp, Homo sapiens
tacccaaactgcttt

SEQ ID NO: 1192947 - DNA, 11 bp, Homo sapiens
tacccaaagga

SEQ ID NO: 1192948 - DNA, 22 bp, Homo sapiens
tacccaaaggatactgtaacac

SEQ ID NO: 1192949 - DNA, 17 bp, Homo sapiens
tacccaaatgtccctgc

SEQ ID NO: 1192950 - DNA, 21 bp, Homo sapiens
tacccaaccactcaaattaat

SEQ ID NO: 1192951 - DNA, 23 bp, Homo sapiens
tacccaacggccctgcagccagc

SEQ ID NO: 1192952 - DNA, 18 bp, Homo sapiens
tacccaatgtctcccaca

SEQ ID NO: 1192953 - DNA, 22 bp, Homo sapiens
tacccaatgtctcccacaccca

SEQ ID NO: 1192954 - DNA, 16 bp, Homo sapiens
tacccacacattccag

SEQ ID NO: 1192955 - DNA, 20 bp, Homo sapiens
tacccacacattccagggct

SEQ ID NO: 1192956 - DNA, 22 bp, Homo sapiens
tacccacaggtgaggggcagga

SEQ ID NO: 1192957 - DNA, 18 bp, Homo sapiens
tacccacatgtacagaca

SEQ ID NO: 1192958 - DNA, 20 bp, Homo sapiens
tacccacccttacttcctgg

SEQ ID NO: 1192959 - DNA, 22 bp, Homo sapiens
tacccacctagaacactaactc

SEQ ID NO: 1192960 - DNA, 21 bp, Homo sapiens
tacccacttctaaatagcaat

SEQ ID NO: 1192961 - DNA, 15 bp, Homo sapiens
tacccagagaatata

SEQ ID NO: 1192962 - DNA, 20 bp, Homo sapiens
tacccagagaatatatacat

SEQ ID NO: 1192963 - DNA, 18 bp, Homo sapiens
tacccagccatctgccca

SEQ ID NO: 1192964 - DNA, 19 bp, Homo sapiens
tacccagccatctgcccag

SEQ ID NO: 1192965 - DNA, 19 bp, Homo sapiens
tacccagcgtggcccaggc

SEQ ID NO: 1192966 - DNA, 20 bp, Homo sapiens
tacccagcgtggcccaggcc

SEQ ID NO: 1192967 - DNA, 21 bp, Homo sapiens
tacccaggaccaagccacagc

SEQ ID NO: 1192968 - DNA, 12 bp, Homo sapiens
tacccagtggaa

SEQ ID NO: 1192969 - DNA, 18 bp, Homo sapiens
tacccatcggtgtccatt

SEQ ID NO: 1192970 - DNA, 21 bp, Homo sapiens
tacccatcggtgtccatttat

SEQ ID NO: 1192971 - DNA, 20 bp, Homo sapiens
tacccatctagtacttgaaa

SEQ ID NO: 1192972 - DNA, 15 bp, Homo sapiens
tacccatcttaaaaa

SEQ ID NO: 1192973 - DNA, 18 bp, Homo sapiens
tacccatcttaaaaacaa

SEQ ID NO: 1192974 - DNA, 19 bp, Homo sapiens
tacccatcttaaaaacaac

SEQ ID NO: 1192975 - DNA, 19 bp, Homo sapiens
tacccatctttaatttata

SEQ ID NO: 1192976 - DNA, 13 bp, Homo sapiens
tacccatgagcct

SEQ ID NO: 1192977 - DNA, 15 bp, Homo sapiens
tacccatgagcctgc

SEQ ID NO: 1192978 - DNA, 22 bp, Homo sapiens
tacccattctgttttcccccag

SEQ ID NO: 1192979 - DNA, 18 bp, Homo sapiens
tacccattgttcccttcc

SEQ ID NO: 1192980 - DNA, 17 bp, Homo sapiens
taccccacaacacgcct

SEQ ID NO: 1192981 - DNA, 12 bp, Homo sapiens
taccccaccctc

SEQ ID NO: 1192982 - DNA, 15 bp, Homo sapiens
taccccaccctcagc

SEQ ID NO: 1192983 - DNA, 22 bp, Homo sapiens
taccccaccctcagcacccctt

SEQ ID NO: 1192984 - DNA, 23 bp, Homo sapiens
taccccagcctcgttggagagca

SEQ ID NO: 1192985 - DNA, 13 bp, Homo sapiens
taccccatacccc

SEQ ID NO: 1192986 - DNA, 21 bp, Homo sapiens
tacccccaggtggaaggcaga

SEQ ID NO: 1192987 - DNA, 15 bp, Homo sapiens
taccccccaccttgg

SEQ ID NO: 1192988 - DNA, 15 bp, Homo sapiens
tacccccctctgtct

SEQ ID NO: 1192989 - DNA, 20 bp, Homo sapiens
taccccctcaaaccctgccc

SEQ ID NO: 1192990 - DNA, 18 bp, Homo sapiens
taccccctcatcccccag

SEQ ID NO: 1192991 - DNA, 20 bp, Homo sapiens
tacctgccttttaagtttga

SEQ ID NO: 1192992 - DNA, 17 bp, Homo sapiens
tacctggcaattcacaa

SEQ ID NO: 1192993 - DNA, 15 bp, Homo sapiens
tacctggcagacttg

SEQ ID NO: 1192994 - DNA, 15 bp, Homo sapiens
tacctggctttttaa

SEQ ID NO: 1192995 - DNA, 19 bp, Homo sapiens
tacctgggaaaggacccac

SEQ ID NO: 1192996 - DNA, 15 bp, Homo sapiens
tacctggggactcct

SEQ ID NO: 1192997 - DNA, 18 bp, Homo sapiens
tacctggggactcctcaa

SEQ ID NO: 1192998 - DNA, 18 bp, Homo sapiens
tacctgggtttccagggc

SEQ ID NO: 1192999 - DNA, 23 bp, Homo sapiens
tacctggtccccactgctgagct

SEQ ID NO: 1193000 - DNA, 12 bp, Homo sapiens
tacctggtgctc

SEQ ID NO: 1193001 - DNA, 21 bp, Homo sapiens
tacctggtgctcgggaaggga

SEQ ID NO: 1193002 - DNA, 19 bp, Homo sapiens
tacctgtcttgctcctggg

SEQ ID NO: 1193003 - DNA, 20 bp, Homo sapiens
tacctgtgcgttactaattg

SEQ ID NO: 1193004 - DNA, 12 bp, Homo sapiens
tacctgtggata

SEQ ID NO: 1193005 - DNA, 21 bp, Homo sapiens
tacctgtgtttttttctaaaa

SEQ ID NO: 1193006 - DNA, 22 bp, Homo sapiens
tacctgtgtttttttctaaaaa

SEQ ID NO: 1193007 - DNA, 16 bp, Homo sapiens
tacctgttatttatca

SEQ ID NO: 1193008 - DNA, 20 bp, Homo sapiens
tacctgttatttatcaattt

SEQ ID NO: 1193009 - DNA, 14 bp, Homo sapiens
tacctgttcctccc

SEQ ID NO: 1193010 - DNA, 15 bp, Homo sapiens
taccttcaatactta

SEQ ID NO: 1193011 - DNA, 13 bp, Homo sapiens
taccttcagccct

SEQ ID NO: 1193012 - DNA, 15 bp, Homo sapiens
taccttcagccctgg

SEQ ID NO: 1193013 - DNA, 14 bp, Homo sapiens
taccttcatgtgat

SEQ ID NO: 1193014 - DNA, 14 bp, Homo sapiens
taccttccttccct

SEQ ID NO: 1193015 - DNA, 20 bp, Homo sapiens
taccttctatgtattagtgt

SEQ ID NO: 1193016 - DNA, 20 bp, Homo sapiens
taccttctggttgcttcaga

SEQ ID NO: 1193017 - DNA, 12 bp, Homo sapiens
taccttctttca

SEQ ID NO: 1193018 - DNA, 11 bp, Homo sapiens
taccttgaaaa

SEQ ID NO: 1193019 - DNA, 18 bp, Homo sapiens
taccttgccaattagtaa

SEQ ID NO: 1193020 - DNA, 13 bp, Homo sapiens
taccttgctgtgg

SEQ ID NO: 1193021 - DNA, 18 bp, Homo sapiens
taccttgcttttgcttct

SEQ ID NO: 1193022 - DNA, 17 bp, Homo sapiens
taccttggggctgggga

SEQ ID NO: 1193023 - DNA, 13 bp, Homo sapiens
taccttggttccc

SEQ ID NO: 1193024 - DNA, 16 bp, Homo sapiens
taccttgtagcagtgt

SEQ ID NO: 1193025 - DNA, 14 bp, Homo sapiens
taccttgtatactg

SEQ ID NO: 1193026 - DNA, 16 bp, Homo sapiens
taccttgtatactgta

SEQ ID NO: 1193027 - DNA, 13 bp, Homo sapiens
taccttgtgcatt

SEQ ID NO: 1193028 - DNA, 16 bp, Homo sapiens
tacctttatggtttct

SEQ ID NO: 1193029 - DNA, 23 bp, Homo sapiens
tacctttccagggtcaaagtaca

SEQ ID NO: 1193030 - DNA, 16 bp, Homo sapiens
tacctttctagcctta

SEQ ID NO: 1193031 - DNA, 21 bp, Homo sapiens
tacctttgcgtggatcaagct

SEQ ID NO: 1193032 - DNA, 16 bp, Homo sapiens
taccttttatgtagca

SEQ ID NO: 1193033 - DNA, 14 bp, Homo sapiens
taccttttcagggc

SEQ ID NO: 1193034 - DNA, 12 bp, Homo sapiens
taccttttccta

SEQ ID NO: 1193035 - DNA, 11 bp, Homo sapiens
taccttttcta

SEQ ID NO: 1193036 - DNA, 13 bp, Homo sapiens
taccttttctata

SEQ ID NO: 1193037 - DNA, 15 bp, Homo sapiens
taccttttctataag

SEQ ID NO: 1193038 - DNA, 18 bp, Homo sapiens
tacctttttatatttaaa

SEQ ID NO: 1193039 - DNA, 16 bp, Homo sapiens
gactgctgctccccac

SEQ ID NO: 1193040 - DNA, 17 bp, Homo sapiens
gactgctgctgcctggc

SEQ ID NO: 1193041 - DNA, 11 bp, Homo sapiens
gactgctggct

SEQ ID NO: 1193042 - DNA, 20 bp, Homo sapiens
gactgctgggaggttaaaaa

SEQ ID NO: 1193043 - DNA, 20 bp, Homo sapiens
gactgcttcccatcctaccc

SEQ ID NO: 1193044 - DNA, 15 bp, Homo sapiens
gactgcttggccaga

SEQ ID NO: 1193045 - DNA, 18 bp, Homo sapiens
gactgcttggccagatgc

SEQ ID NO: 1193046 - DNA, 22 bp, Homo sapiens
gactggaaaagtgatgtatttt

SEQ ID NO: 1193047 - DNA, 17 bp, Homo sapiens
gactggaaccagggaga

SEQ ID NO: 1193048 - DNA, 17 bp, Homo sapiens
gactggaagttgtggat

SEQ ID NO: 1193049 - DNA, 21 bp, Homo sapiens
gactggagaaaacccctccca

SEQ ID NO: 1193050 - DNA, 14 bp, Homo sapiens
gactggagcatctg

SEQ ID NO: 1193051 - DNA, 20 bp, Homo sapiens
gactggaggaacacagagaa

SEQ ID NO: 1193052 - DNA, 16 bp, Homo sapiens
gactggaggcccctgg

SEQ ID NO: 1193053 - DNA, 20 bp, Homo sapiens
gactggaggcccctggagcc

SEQ ID NO: 1193054 - DNA, 16 bp, Homo sapiens
gactggaggtgggcat

SEQ ID NO: 1193055 - DNA, 17 bp, Homo sapiens
gactggatgctcgccat

SEQ ID NO: 1193056 - DNA, 13 bp, Homo sapiens
gactggcaataaa

SEQ ID NO: 1193057 - DNA, 20 bp, Homo sapiens
gactggcacttagcccaaga

SEQ ID NO: 1193058 - DNA, 22 bp, Homo sapiens
gactggcagactcaaggggctg

SEQ ID NO: 1193059 - DNA, 23 bp, Homo sapiens
gactggcaggtgcagatgggctg

SEQ ID NO: 1193060 - DNA, 20 bp, Homo sapiens
gactggcgttcacctccctg

SEQ ID NO: 1193061 - DNA, 21 bp, Homo sapiens
gactggctagagtcctcactc

SEQ ID NO: 1193062 - DNA, 23 bp, Homo sapiens
gactggctagagtcctcactccc

SEQ ID NO: 1193063 - DNA, 14 bp, Homo sapiens
gactggctggctgc

SEQ ID NO: 1193064 - DNA, 16 bp, Homo sapiens
gactggctggctgcag

SEQ ID NO: 1193065 - DNA, 17 bp, Homo sapiens
gactggctgtgcccctg

SEQ ID NO: 1193066 - DNA, 22 bp, Homo sapiens
gactggctgtgcccctgatgca

SEQ ID NO: 1193067 - DNA, 22 bp, Homo sapiens
gactgggaagataggctctgca

SEQ ID NO: 1193068 - DNA, 20 bp, Homo sapiens
gactgggaccgtgcgagctg

SEQ ID NO: 1193069 - DNA, 21 bp, Homo sapiens
gactgggagccacttctcccc

SEQ ID NO: 1193070 - DNA, 22 bp, Homo sapiens
gactgggagccacttctcccca

SEQ ID NO: 1193071 - DNA, 16 bp, Homo sapiens
gactgggagtcagagc

SEQ ID NO: 1193072 - DNA, 18 bp, Homo sapiens
gactgggagtcagagccc

SEQ ID NO: 1193073 - DNA, 19 bp, Homo sapiens
gactgggagtcagagccct

SEQ ID NO: 1193074 - DNA, 23 bp, Homo sapiens
gactgggagtcagagccctggct

SEQ ID NO: 1193075 - DNA, 18 bp, Homo sapiens
gactgggcaacactgcag

SEQ ID NO: 1193076 - DNA, 22 bp, Homo sapiens
gactgggcaacactgcaggaca

SEQ ID NO: 1193077 - DNA, 20 bp, Homo sapiens
gactgggcctcccttgggct

SEQ ID NO: 1193078 - DNA, 21 bp, Homo sapiens
gactgggcctcccttgggctg

SEQ ID NO: 1193079 - DNA, 15 bp, Homo sapiens
gactgggctagggag

SEQ ID NO: 1193080 - DNA, 16 bp, Homo sapiens
gactggggatgtggga

SEQ ID NO: 1193081 - DNA, 23 bp, Homo sapiens
gactggggatgtgggagggagca

SEQ ID NO: 1193082 - DNA, 18 bp, Homo sapiens
gactgggggactgggagt

SEQ ID NO: 1193083 - DNA, 14 bp, Homo sapiens
gactgggggccaga

SEQ ID NO: 1193084 - DNA, 16 bp, Homo sapiens
gactggtaagtaactg

SEQ ID NO: 1193085 - DNA, 21 bp, Homo sapiens
gactggtcaccttgcactcct

SEQ ID NO: 1193086 - DNA, 23 bp, Homo sapiens
gactggtgctataggctggagaa

SEQ ID NO: 1193087 - DNA, 20 bp, Homo sapiens
gactggtgggggttctggca

SEQ ID NO: 1193088 - DNA, 22 bp, Homo sapiens
gactggtgttatcaccgtgggc

SEQ ID NO: 1193089 - DNA, 13 bp, Homo sapiens
gactggttgtcag

SEQ ID NO: 1193090 - DNA, 17 bp, Homo sapiens
gactgtaaacacagaca

SEQ ID NO: 1193091 - DNA, 18 bp, Homo sapiens
gactgtaaacacagacag

SEQ ID NO: 1193092 - DNA, 22 bp, Homo sapiens
gactgtaaacatcagcaagact

SEQ ID NO: 1193093 - DNA, 14 bp, Homo sapiens
gactgtaacttttt

SEQ ID NO: 1193094 - DNA, 13 bp, Homo sapiens
gactgtaagatgt

SEQ ID NO: 1193095 - DNA, 15 bp, Homo sapiens
gactgtaagatgttg

SEQ ID NO: 1193096 - DNA, 22 bp, Homo sapiens
gactgtaagatgttgttttagg

SEQ ID NO: 1193097 - DNA, 22 bp, Homo sapiens
gactgtacaaagtagaagtctt

SEQ ID NO: 1193098 - DNA, 13 bp, Homo sapiens
gactgtacagaga

SEQ ID NO: 1193099 - DNA, 16 bp, Homo sapiens
gactgtacagagactc

SEQ ID NO: 1193100 - DNA, 22 bp, Homo sapiens
gactgtacagagactctatttt

SEQ ID NO: 1193101 - DNA, 11 bp, Homo sapiens
gactgtactgg

SEQ ID NO: 1193102 - DNA, 14 bp, Homo sapiens
gactgtagccacag

SEQ ID NO: 1193103 - DNA, 15 bp, Homo sapiens
gactgtagccacagc

SEQ ID NO: 1193104 - DNA, 16 bp, Homo sapiens
gactgtagccacagct

SEQ ID NO: 1193105 - DNA, 21 bp, Homo sapiens
gactgtagccacagctgctgt

SEQ ID NO: 1193106 - DNA, 22 bp, Homo sapiens
gactgtatctaggcatttcatt

SEQ ID NO: 1193107 - DNA, 15 bp, Homo sapiens
gactgtatctgtgta

SEQ ID NO: 1193108 - DNA, 22 bp, Homo sapiens
gactgtcaaatgaacttttaca

SEQ ID NO: 1193109 - DNA, 22 bp, Homo sapiens
gactgtcaagtacaagcaagac

SEQ ID NO: 1193110 - DNA, 22 bp, Homo sapiens
gactgtcacggggttccctcct

SEQ ID NO: 1193111 - DNA, 13 bp, Homo sapiens
gactgtccctgcc

SEQ ID NO: 1193112 - DNA, 13 bp, Homo sapiens
gactgtcctccca

SEQ ID NO: 1193113 - DNA, 16 bp, Homo sapiens
gacttggagggtctgg

SEQ ID NO: 1193114 - DNA, 19 bp, Homo sapiens
gacttggcaacagaagcag

SEQ ID NO: 1193115 - DNA, 18 bp, Homo sapiens
gacttggcaggtgcctgt

SEQ ID NO: 1193116 - DNA, 16 bp, Homo sapiens
gacttggccccagacg

SEQ ID NO: 1193117 - DNA, 14 bp, Homo sapiens
gacttggctgtcct

SEQ ID NO: 1193118 - DNA, 16 bp, Homo sapiens
gacttggctgtccttc

SEQ ID NO: 1193119 - DNA, 20 bp, Homo sapiens
gacttggctgtccttcccct

SEQ ID NO: 1193120 - DNA, 13 bp, Homo sapiens
gacttggggccag

SEQ ID NO: 1193121 - DNA, 21 bp, Homo sapiens
gacttggtaagatgactctga

SEQ ID NO: 1193122 - DNA, 15 bp, Homo sapiens
gacttggttggtagg

SEQ ID NO: 1193123 - DNA, 20 bp, Homo sapiens
gacttggttggtagggtggg

SEQ ID NO: 1193124 - DNA, 12 bp, Homo sapiens
gacttgtaacat

SEQ ID NO: 1193125 - DNA, 21 bp, Homo sapiens
gacttgtaggaatctgccttc

SEQ ID NO: 1193126 - DNA, 16 bp, Homo sapiens
gacttgtgtctctgtg

SEQ ID NO: 1193127 - DNA, 18 bp, Homo sapiens
gacttgttttatgctcag

SEQ ID NO: 1193128 - DNA, 17 bp, Homo sapiens
gactttaaaaaaacaat

SEQ ID NO: 1193129 - DNA, 22 bp, Homo sapiens
gactttaatcactgctgaagat

SEQ ID NO: 1193130 - DNA, 13 bp, Homo sapiens
gactttagaaata

SEQ ID NO: 1193131 - DNA, 17 bp, Homo sapiens
gactttagcttttcctt

SEQ ID NO: 1193132 - DNA, 17 bp, Homo sapiens
gactttatctcctgctc

SEQ ID NO: 1193133 - DNA, 17 bp, Homo sapiens
gactttatgtagttttt

SEQ ID NO: 1193134 - DNA, 13 bp, Homo sapiens
gactttatttatt

SEQ ID NO: 1193135 - DNA, 14 bp, Homo sapiens
gactttatttattt

SEQ ID NO: 1193136 - DNA, 15 bp, Homo sapiens
gactttatttatttc

SEQ ID NO: 1193137 - DNA, 19 bp, Homo sapiens
gactttatttatttctagt

SEQ ID NO: 1193138 - DNA, 19 bp, Homo sapiens
gactttattttctggtaga

SEQ ID NO: 1193139 - DNA, 19 bp, Homo sapiens
gactttccaccccctccct

SEQ ID NO: 1193140 - DNA, 14 bp, Homo sapiens
gactttccattaca

SEQ ID NO: 1193141 - DNA, 22 bp, Homo sapiens
gactttcccaaatgtattgatt

SEQ ID NO: 1193142 - DNA, 11 bp, Homo sapiens
gactttcctgc

SEQ ID NO: 1193143 - DNA, 12 bp, Homo sapiens
gactttcctgca

SEQ ID NO: 1193144 - DNA, 19 bp, Homo sapiens
gactttctctaataataaa

SEQ ID NO: 1193145 - DNA, 20 bp, Homo sapiens
gactttctctaataataaat

SEQ ID NO: 1193146 - DNA, 21 bp, Homo sapiens
gactttctctaataataaata

SEQ ID NO: 1193147 - DNA, 18 bp, Homo sapiens
gactttctgaaaacactt

SEQ ID NO: 1193148 - DNA, 19 bp, Homo sapiens
gactttctgattactgtcc

SEQ ID NO: 1193149 - DNA, 12 bp, Homo sapiens
gactttctgctg

SEQ ID NO: 1193150 - DNA, 12 bp, Homo sapiens
gactttctgtga

SEQ ID NO: 1193151 - DNA, 13 bp, Homo sapiens
gactttctgtgac

SEQ ID NO: 1193152 - DNA, 13 bp, Homo sapiens
gactttctgttgg

SEQ ID NO: 1193153 - DNA, 19 bp, Homo sapiens
gactttcttctagtgcttt

SEQ ID NO: 1193154 - DNA, 11 bp, Homo sapiens
gactttgacaa

SEQ ID NO: 1193155 - DNA, 17 bp, Homo sapiens
gactttgatccttggaa

SEQ ID NO: 1193156 - DNA, 18 bp, Homo sapiens
gactttgatccttggaaa

SEQ ID NO: 1193157 - DNA, 23 bp, Homo sapiens
gactttgatccttggaaaccgtg

SEQ ID NO: 1193158 - DNA, 19 bp, Homo sapiens
gactttgctgcattttaca

SEQ ID NO: 1193159 - DNA, 21 bp, Homo sapiens
gactttgctgttactgcttct

SEQ ID NO: 1193160 - DNA, 15 bp, Homo sapiens
gactttgcttagtat

SEQ ID NO: 1193161 - DNA, 17 bp, Homo sapiens
gactttgtctaataaag

SEQ ID NO: 1193162 - DNA, 16 bp, Homo sapiens
gacttttatgtgagat

SEQ ID NO: 1193163 - DNA, 20 bp, Homo sapiens
gacttttatgtgagatttcc

SEQ ID NO: 1193164 - DNA, 22 bp, Homo sapiens
gacttttcgaccaattcaaccc

SEQ ID NO: 1193165 - DNA, 19 bp, Homo sapiens
gacttttcgttaacattga

SEQ ID NO: 1193166 - DNA, 13 bp, Homo sapiens
gacttttctgatt

SEQ ID NO: 1193167 - DNA, 13 bp, Homo sapiens
gacttttctgtaa

SEQ ID NO: 1193168 - DNA, 13 bp, Homo sapiens
gacttttctttct

SEQ ID NO: 1193169 - DNA, 17 bp, Homo sapiens
tactatccagttactgc

SEQ ID NO: 1193170 - DNA, 19 bp, Homo sapiens
tactatcctgtaaatatat

SEQ ID NO: 1193171 - DNA, 18 bp, Homo sapiens
tactatgacaatcttatt

SEQ ID NO: 1193172 - DNA, 14 bp, Homo sapiens
tactatgatcagaa

SEQ ID NO: 1193173 - DNA, 22 bp, Homo sapiens
tactatggctgatttatttcta

SEQ ID NO: 1193174 - DNA, 18 bp, Homo sapiens
tactatggtgtgttgtat

SEQ ID NO: 1193175 - DNA, 12 bp, Homo sapiens
tactatgtatca

SEQ ID NO: 1193176 - DNA, 16 bp, Homo sapiens
tactatgtatcaatga

SEQ ID NO: 1193177 - DNA, 20 bp, Homo sapiens
tactatgtgccagttcctgt

SEQ ID NO: 1193178 - DNA, 14 bp, Homo sapiens
tactatgtgctggg

SEQ ID NO: 1193179 - DNA, 20 bp, Homo sapiens
tactattaagcagtaaaaac

SEQ ID NO: 1193180 - DNA, 23 bp, Homo sapiens
tactattcttggttcttatttaa

SEQ ID NO: 1193181 - DNA, 16 bp, Homo sapiens
tactattgaactgtat

SEQ ID NO: 1193182 - DNA, 15 bp, Homo sapiens
tactattgttacatt

SEQ ID NO: 1193183 - DNA, 13 bp, Homo sapiens
tactatttagata

SEQ ID NO: 1193184 - DNA, 12 bp, Homo sapiens
tactatttcaca

SEQ ID NO: 1193185 - DNA, 13 bp, Homo sapiens
tactatttcacaa

SEQ ID NO: 1193186 - DNA, 11 bp, Homo sapiens
tactatttcca

SEQ ID NO: 1193187 - DNA, 17 bp, Homo sapiens
tactattttgacagtta

SEQ ID NO: 1193188 - DNA, 23 bp, Homo sapiens
tactcaaatgagtaacatttgct

SEQ ID NO: 1193189 - DNA, 13 bp, Homo sapiens
tactcaaatggtg

SEQ ID NO: 1193190 - DNA, 15 bp, Homo sapiens
tactcaagaggctga

SEQ ID NO: 1193191 - DNA, 19 bp, Homo sapiens
tactcaagaggctgaggca

SEQ ID NO: 1193192 - DNA, 14 bp, Homo sapiens
tactcaatggattt

SEQ ID NO: 1193193 - DNA, 17 bp, Homo sapiens
tactcagaagcctgagg

SEQ ID NO: 1193194 - DNA, 15 bp, Homo sapiens
tactcagaatagctg

SEQ ID NO: 1193195 - DNA, 16 bp, Homo sapiens
tactcagaattctcta

SEQ ID NO: 1193196 - DNA, 15 bp, Homo sapiens
tactcagagcagagc

SEQ ID NO: 1193197 - DNA, 21 bp, Homo sapiens
tactcagagcagagcaaatga

SEQ ID NO: 1193198 - DNA, 16 bp, Homo sapiens
tactcagcagcagaga

SEQ ID NO: 1193199 - DNA, 20 bp, Homo sapiens
tactcagcagcagagagccc

SEQ ID NO: 1193200 - DNA, 21 bp, Homo sapiens
tactcagcagcagagagccct

SEQ ID NO: 1193201 - DNA, 16 bp, Homo sapiens
tactcagcagccctcc

SEQ ID NO: 1193202 - DNA, 17 bp, Homo sapiens
tactcagcagccctcct

SEQ ID NO: 1193203 - DNA, 20 bp, Homo sapiens
tactcagcagccctcctcac

SEQ ID NO: 1193204 - DNA, 15 bp, Homo sapiens
tactcagccctgggc

SEQ ID NO: 1193205 - DNA, 13 bp, Homo sapiens
tactcagcctgct

SEQ ID NO: 1193206 - DNA, 17 bp, Homo sapiens
tactcagggctcctccc

SEQ ID NO: 1193207 - DNA, 20 bp, Homo sapiens
tactcaggggatgtttacct

SEQ ID NO: 1193208 - DNA, 15 bp, Homo sapiens
tactcagtatagcat

SEQ ID NO: 1193209 - DNA, 17 bp, Homo sapiens
tactcagtgactgttgt

SEQ ID NO: 1193210 - DNA, 23 bp, Homo sapiens
tactcatcggcaggcgcatgagt

SEQ ID NO: 1193211 - DNA, 14 bp, Homo sapiens
tactcatgaatgaa

SEQ ID NO: 1193212 - DNA, 11 bp, Homo sapiens
tactcattttt

SEQ ID NO: 1193213 - DNA, 22 bp, Homo sapiens
tactccaaggtttataaagcag

SEQ ID NO: 1193214 - DNA, 19 bp, Homo sapiens
tactccactgccctggcag

SEQ ID NO: 1193215 - DNA, 23 bp, Homo sapiens
tactccactgccctggcagcagc

SEQ ID NO: 1193216 - DNA, 16 bp, Homo sapiens
tactccactggtctgt

SEQ ID NO: 1193217 - DNA, 22 bp, Homo sapiens
tactcccactcccggcctgtca

SEQ ID NO: 1193218 - DNA, 15 bp, Homo sapiens
tactcccccaccact

SEQ ID NO: 1193219 - DNA, 17 bp, Homo sapiens
tactcccccaccactca

SEQ ID NO: 1193220 - DNA, 19 bp, Homo sapiens
tactcccccaccactcagg

SEQ ID NO: 1193221 - DNA, 21 bp, Homo sapiens
tactcccccaccactcaggcc

SEQ ID NO: 1193222 - DNA, 23 bp, Homo sapiens
tactcccccaccactcaggccac

SEQ ID NO: 1193223 - DNA, 15 bp, Homo sapiens
tactccccttgagct

SEQ ID NO: 1193224 - DNA, 13 bp, Homo sapiens
tactccctccaat

SEQ ID NO: 1193225 - DNA, 18 bp, Homo sapiens
tactccctgcagatgcca

SEQ ID NO: 1193226 - DNA, 15 bp, Homo sapiens
tactcccttctgtag

SEQ ID NO: 1193227 - DNA, 14 bp, Homo sapiens
tactccgttcctgg

SEQ ID NO: 1193228 - DNA, 14 bp, Homo sapiens
tactcctacctcag

SEQ ID NO: 1193229 - DNA, 14 bp, Homo sapiens
tactcctagaagaa

SEQ ID NO: 1193230 - DNA, 15 bp, Homo sapiens
tactcctagaagaac

SEQ ID NO: 1193231 - DNA, 17 bp, Homo sapiens
tactcctagaagaacca

SEQ ID NO: 1193232 - DNA, 21 bp, Homo sapiens
tactcctagaagaaccaaata

SEQ ID NO: 1193233 - DNA, 13 bp, Homo sapiens
tactcctcctctt

SEQ ID NO: 1193234 - DNA, 22 bp, Homo sapiens
tactcctctgcagtgccttggg

SEQ ID NO: 1193235 - DNA, 21 bp, Homo sapiens
tactccttaagaacacaaagc

SEQ ID NO: 1193236 - DNA, 19 bp, Homo sapiens
tactggagtggaaggtcta

SEQ ID NO: 1193237 - DNA, 23 bp, Homo sapiens
tactggagtggaaggtctattgg

SEQ ID NO: 1193238 - DNA, 14 bp, Homo sapiens
tactggataaattg

SEQ ID NO: 1193239 - DNA, 15 bp, Homo sapiens
tactggatctcttaa

SEQ ID NO: 1193240 - DNA, 22 bp, Homo sapiens
tactggcacctgaaattaattt

SEQ ID NO: 1193241 - DNA, 12 bp, Homo sapiens
tactggcagctc

SEQ ID NO: 1193242 - DNA, 12 bp, Homo sapiens
tactggcattaa

SEQ ID NO: 1193243 - DNA, 18 bp, Homo sapiens
tactggcattaattatta

SEQ ID NO: 1193244 - DNA, 12 bp, Homo sapiens
tactggcctctg

SEQ ID NO: 1193245 - DNA, 14 bp, Homo sapiens
tactggcctctgtg

SEQ ID NO: 1193246 - DNA, 22 bp, Homo sapiens
tactgggaatggaaggctttgc

SEQ ID NO: 1193247 - DNA, 23 bp, Homo sapiens
tactgggccttagtgggccaggg

SEQ ID NO: 1193248 - DNA, 19 bp, Homo sapiens
tactggggggctttggcct

SEQ ID NO: 1193249 - DNA, 22 bp, Homo sapiens
tactgggtgaggaaatccattg

SEQ ID NO: 1193250 - DNA, 15 bp, Homo sapiens
tactgggtgtcattt

SEQ ID NO: 1193251 - DNA, 23 bp, Homo sapiens
tactgggtgtcatttcattccat

SEQ ID NO: 1193252 - DNA, 16 bp, Homo sapiens
tactgggtttcaagaa

SEQ ID NO: 1193253 - DNA, 17 bp, Homo sapiens
tactggtaagattgtta

SEQ ID NO: 1193254 - DNA, 22 bp, Homo sapiens
tactggtattagttaaaacaca

SEQ ID NO: 1193255 - DNA, 23 bp, Homo sapiens
tactggtccaaaagattgctgaa

SEQ ID NO: 1193256 - DNA, 18 bp, Homo sapiens
tactggtcttgtggaatt

SEQ ID NO: 1193257 - DNA, 19 bp, Homo sapiens
tactggtgcagtcattatg

SEQ ID NO: 1193258 - DNA, 23 bp, Homo sapiens
tactggtttccccagggaaggaa

SEQ ID NO: 1193259 - DNA, 14 bp, Homo sapiens
tactgtaaaagtta

SEQ ID NO: 1193260 - DNA, 16 bp, Homo sapiens
tactgtaacattcagg

SEQ ID NO: 1193261 - DNA, 15 bp, Homo sapiens
tactgtaactgctca

SEQ ID NO: 1193262 - DNA, 16 bp, Homo sapiens
tactgtaactgctcag

SEQ ID NO: 1193263 - DNA, 15 bp, Homo sapiens
tactgtaattcctca

SEQ ID NO: 1193264 - DNA, 20 bp, Homo sapiens
tactgtaatttgtgatacaa

SEQ ID NO: 1193265 - DNA, 14 bp, Homo sapiens
tactgtaattttat

SEQ ID NO: 1193266 - DNA, 14 bp, Homo sapiens
tactgtacaataaa

SEQ ID NO: 1193267 - DNA, 15 bp, Homo sapiens
tactgtacaataaaa

SEQ ID NO: 1193268 - DNA, 19 bp, Homo sapiens
tactgtacagattgctgct

SEQ ID NO: 1193269 - DNA, 21 bp, Homo sapiens
tactgtacatgaaaacacatt

SEQ ID NO: 1193270 - DNA, 18 bp, Homo sapiens
tactgtactttgccattt

SEQ ID NO: 1193271 - DNA, 22 bp, Homo sapiens
tactgtactttgccatttttct

SEQ ID NO: 1193272 - DNA, 13 bp, Homo sapiens
tactgtatatgta

SEQ ID NO: 1193273 - DNA, 16 bp, Homo sapiens
tactgtatgtgccaaa

SEQ ID NO: 1193274 - DNA, 17 bp, Homo sapiens
tactgtattttgtattg

SEQ ID NO: 1193275 - DNA, 14 bp, Homo sapiens
tactgtatttttac

SEQ ID NO: 1193276 - DNA, 22 bp, Homo sapiens
tactgtatttttacctttttcc

SEQ ID NO: 1193277 - DNA, 14 bp, Homo sapiens
tactgtctcactga

SEQ ID NO: 1193278 - DNA, 20 bp, Homo sapiens
tactgtctcctccctgggct

SEQ ID NO: 1193279 - DNA, 13 bp, Homo sapiens
tactgtctctgga

SEQ ID NO: 1193280 - DNA, 15 bp, Homo sapiens
tactgtctctggagt

SEQ ID NO: 1193281 - DNA, 20 bp, Homo sapiens
tactgtctggttttaacaat

SEQ ID NO: 1193282 - DNA, 16 bp, Homo sapiens
tactgtctttattctt

SEQ ID NO: 1193283 - DNA, 13 bp, Homo sapiens
tactgtgactgat

SEQ ID NO: 1193284 - DNA, 20 bp, Homo sapiens
tactgtgcagaataatggaa

SEQ ID NO: 1193285 - DNA, 12 bp, Homo sapiens
tactgtgcctgg

SEQ ID NO: 1193286 - DNA, 18 bp, Homo sapiens
tactgtggaaaagaaaca

SEQ ID NO: 1193287 - DNA, 23 bp, Homo sapiens
tactgtgtacagaattctgctac

SEQ ID NO: 1193288 - DNA, 20 bp, Homo sapiens
tactgtgtatgttttatatc

SEQ ID NO: 1193289 - DNA, 21 bp, Homo sapiens
tactgtgtgtgtgaatgaaca

SEQ ID NO: 1193290 - DNA, 14 bp, Homo sapiens
tactgtgttcctgg

SEQ ID NO: 1193291 - DNA, 16 bp, Homo sapiens
tactgtgttcctggca

SEQ ID NO: 1193292 - DNA, 13 bp, Homo sapiens
tactgttatagaa

SEQ ID NO: 1193293 - DNA, 16 bp, Homo sapiens
tactgttcctttcaga

SEQ ID NO: 1193294 - DNA, 18 bp, Homo sapiens
tactgttctatactattc

SEQ ID NO: 1193295 - DNA, 16 bp, Homo sapiens
tactgttgcacagcca

SEQ ID NO: 1193296 - DNA, 19 bp, Homo sapiens
tactgtttctcaagtgttt

SEQ ID NO: 1193297 - DNA, 17 bp, Homo sapiens
tactgtttcttgcactg

SEQ ID NO: 1193298 - DNA, 18 bp, Homo sapiens
tactgtttcttgcactga

SEQ ID NO: 1193299 - DNA, 15 bp, Homo sapiens
tactgttttaattgt

SEQ ID NO: 1193300 - DNA, 15 bp, Homo sapiens
gagaatagagctgcc

SEQ ID NO: 1193301 - DNA, 21 bp, Homo sapiens
gagaatataccttatttattt

SEQ ID NO: 1193302 - DNA, 12 bp, Homo sapiens
gagaatatatac

SEQ ID NO: 1193303 - DNA, 23 bp, Homo sapiens
gagaatattagctttactgtttg

SEQ ID NO: 1193304 - DNA, 13 bp, Homo sapiens
gagaatcaaagat

SEQ ID NO: 1193305 - DNA, 22 bp, Homo sapiens
gagaatcactaggtaacttatt

SEQ ID NO: 1193306 - DNA, 21 bp, Homo sapiens
gagaatccaagggttgagagc

SEQ ID NO: 1193307 - DNA, 18 bp, Homo sapiens
gagaatcctctcctttct

SEQ ID NO: 1193308 - DNA, 19 bp, Homo sapiens
gagaatcgcttgaacctgg

SEQ ID NO: 1193309 - DNA, 15 bp, Homo sapiens
gagaatctgggggtg

SEQ ID NO: 1193310 - DNA, 19 bp, Homo sapiens
gagaatctgggggtgagga

SEQ ID NO: 1193311 - DNA, 13 bp, Homo sapiens
gagaatgaattca

SEQ ID NO: 1193312 - DNA, 20 bp, Homo sapiens
gagaatgagaagggaaggcc

SEQ ID NO: 1193313 - DNA, 19 bp, Homo sapiens
gagaatgagagcgacacag

SEQ ID NO: 1193314 - DNA, 13 bp, Homo sapiens
gagaatgagcctc

SEQ ID NO: 1193315 - DNA, 17 bp, Homo sapiens
gagaatgagggccaaga

SEQ ID NO: 1193316 - DNA, 14 bp, Homo sapiens
gagaatgagtggga

SEQ ID NO: 1193317 - DNA, 22 bp, Homo sapiens
gagaatgcagcccaccaggagc

SEQ ID NO: 1193318 - DNA, 20 bp, Homo sapiens
gagaatgcccttctccttat

SEQ ID NO: 1193319 - DNA, 14 bp, Homo sapiens
gagaatggagacag

SEQ ID NO: 1193320 - DNA, 22 bp, Homo sapiens
gagaatggctgggtcagggcca

SEQ ID NO: 1193321 - DNA, 17 bp, Homo sapiens
gagaatggggttcctgc

SEQ ID NO: 1193322 - DNA, 21 bp, Homo sapiens
gagaatgtattttcatagatg

SEQ ID NO: 1193323 - DNA, 23 bp, Homo sapiens
gagaatgtgtgtgtgtggcaggg

SEQ ID NO: 1193324 - DNA, 16 bp, Homo sapiens
gagaatgtgtttcaaa

SEQ ID NO: 1193325 - DNA, 17 bp, Homo sapiens
gagaatgtgtttcaaaa

SEQ ID NO: 1193326 - DNA, 19 bp, Homo sapiens
gagaatgttcccaatttga

SEQ ID NO: 1193327 - DNA, 18 bp, Homo sapiens
gagaattaagttttaaat

SEQ ID NO: 1193328 - DNA, 22 bp, Homo sapiens
gagaattcttacatgttttctt

SEQ ID NO: 1193329 - DNA, 15 bp, Homo sapiens
gagaattgtatcatt

SEQ ID NO: 1193330 - DNA, 20 bp, Homo sapiens
gagaattgtgctttcaccag

SEQ ID NO: 1193331 - DNA, 18 bp, Homo sapiens
gagacaaaatatttccca

SEQ ID NO: 1193332 - DNA, 22 bp, Homo sapiens
gagacaaacacctcccaggaga

SEQ ID NO: 1193333 - DNA, 16 bp, Homo sapiens
gagacaaagcaggagt

SEQ ID NO: 1193334 - DNA, 19 bp, Homo sapiens
gagacaaagcaggagtgga

SEQ ID NO: 1193335 - DNA, 14 bp, Homo sapiens
gagacaaatccttt

SEQ ID NO: 1193336 - DNA, 15 bp, Homo sapiens
gagacaaatcctttc

SEQ ID NO: 1193337 - DNA, 15 bp, Homo sapiens
gagacaaatctttaa

SEQ ID NO: 1193338 - DNA, 18 bp, Homo sapiens
gagacaaatctttaagaa

SEQ ID NO: 1193339 - DNA, 14 bp, Homo sapiens
gagacaagccctgg

SEQ ID NO: 1193340 - DNA, 16 bp, Homo sapiens
gagacaagccctggca

SEQ ID NO: 1193341 - DNA, 16 bp, Homo sapiens
gagacaatgttttctt

SEQ ID NO: 1193342 - DNA, 22 bp, Homo sapiens
gagacacattggaccagatgag

SEQ ID NO: 1193343 - DNA, 15 bp, Homo sapiens
gagacactggcccct

SEQ ID NO: 1193344 - DNA, 17 bp, Homo sapiens
gagacactggcccctca

SEQ ID NO: 1193345 - DNA, 16 bp, Homo sapiens
gagacactgttgataa

SEQ ID NO: 1193346 - DNA, 17 bp, Homo sapiens
gagacacttgccttctt

SEQ ID NO: 1193347 - DNA, 18 bp, Homo sapiens
gagacagaatgtatctgt

SEQ ID NO: 1193348 - DNA, 20 bp, Homo sapiens
gagacagaatgtatctgtga

SEQ ID NO: 1193349 - DNA, 22 bp, Homo sapiens
gagacagaccggggttcaagcc

SEQ ID NO: 1193350 - DNA, 15 bp, Homo sapiens
gagacagatacctcc

SEQ ID NO: 1193351 - DNA, 16 bp, Homo sapiens
gagacagatacctcca

SEQ ID NO: 1193352 - DNA, 17 bp, Homo sapiens
gagacagatcactcctg

SEQ ID NO: 1193353 - DNA, 19 bp, Homo sapiens
gagacagcagcctgtatgt

SEQ ID NO: 1193354 - DNA, 18 bp, Homo sapiens
gagacagccacttggttt

SEQ ID NO: 1193355 - DNA, 13 bp, Homo sapiens
gagacagcccagg

SEQ ID NO: 1193356 - DNA, 15 bp, Homo sapiens
gagacagcttctctg

SEQ ID NO: 1193357 - DNA, 17 bp, Homo sapiens
gagacaggacagaatgt

SEQ ID NO: 1193358 - DNA, 14 bp, Homo sapiens
gagagaggctgcct

SEQ ID NO: 1193359 - DNA, 17 bp, Homo sapiens
gagagagggcacatctc

SEQ ID NO: 1193360 - DNA, 15 bp, Homo sapiens
gagagaggggaagag

SEQ ID NO: 1193361 - DNA, 20 bp, Homo sapiens
gagagaggtatttaactgca

SEQ ID NO: 1193362 - DNA, 17 bp, Homo sapiens
gagagaggttgaaaaac

SEQ ID NO: 1193363 - DNA, 14 bp, Homo sapiens
gagagagtttcaaa

SEQ ID NO: 1193364 - DNA, 14 bp, Homo sapiens
gagagatcaaagat

SEQ ID NO: 1193365 - DNA, 15 bp, Homo sapiens
gagagatcaaagatg

SEQ ID NO: 1193366 - DNA, 11 bp, Homo sapiens
gagagatgaga

SEQ ID NO: 1193367 - DNA, 17 bp, Homo sapiens
gagagatgagaagccag

SEQ ID NO: 1193368 - DNA, 15 bp, Homo sapiens
gagagattctgtgat

SEQ ID NO: 1193369 - DNA, 23 bp, Homo sapiens
gagagattggccagcaaaaactg

SEQ ID NO: 1193370 - DNA, 13 bp, Homo sapiens
gagagcaactctg

SEQ ID NO: 1193371 - DNA, 20 bp, Homo sapiens
gagagcaactctgagatcta

SEQ ID NO: 1193372 - DNA, 16 bp, Homo sapiens
gagagcagaggtctcc

SEQ ID NO: 1193373 - DNA, 20 bp, Homo sapiens
gagagcagcgcccaggcctg

SEQ ID NO: 1193374 - DNA, 21 bp, Homo sapiens
gagagcagcgcccaggcctgc

SEQ ID NO: 1193375 - DNA, 22 bp, Homo sapiens
gagagcagcgcccaggcctgct

SEQ ID NO: 1193376 - DNA, 15 bp, Homo sapiens
gagagcagctccctt

SEQ ID NO: 1193377 - DNA, 21 bp, Homo sapiens
gagagcagctccctttctcag

SEQ ID NO: 1193378 - DNA, 12 bp, Homo sapiens
gagagcagctgg

SEQ ID NO: 1193379 - DNA, 13 bp, Homo sapiens
gagagcagctggc

SEQ ID NO: 1193380 - DNA, 23 bp, Homo sapiens
gagagcagctttaaactcaggga

SEQ ID NO: 1193381 - DNA, 14 bp, Homo sapiens
gagagcaggcaggg

SEQ ID NO: 1193382 - DNA, 13 bp, Homo sapiens
gagagcaggctgg

SEQ ID NO: 1193383 - DNA, 17 bp, Homo sapiens
gagagcaggctggcagc

SEQ ID NO: 1193384 - DNA, 15 bp, Homo sapiens
gagagcaggggagct

SEQ ID NO: 1193385 - DNA, 13 bp, Homo sapiens
gagagcagtgggc

SEQ ID NO: 1193386 - DNA, 18 bp, Homo sapiens
gagagcagtgggcaggtg

SEQ ID NO: 1193387 - DNA, 18 bp, Homo sapiens
gagagccaacctcggctt

SEQ ID NO: 1193388 - DNA, 16 bp, Homo sapiens
gagagccactgggccc

SEQ ID NO: 1193389 - DNA, 17 bp, Homo sapiens
gagagccactgggcccc

SEQ ID NO: 1193390 - DNA, 14 bp, Homo sapiens
gagagccagcagca

SEQ ID NO: 1193391 - DNA, 13 bp, Homo sapiens
gagagccagccct

SEQ ID NO: 1193392 - DNA, 20 bp, Homo sapiens
gagagccagccctccctgtc

SEQ ID NO: 1193393 - DNA, 13 bp, Homo sapiens
gagagccagctct

SEQ ID NO: 1193394 - DNA, 18 bp, Homo sapiens
gagagccaggatgcccag

SEQ ID NO: 1193395 - DNA, 11 bp, Homo sapiens
gagagccagta

SEQ ID NO: 1193396 - DNA, 15 bp, Homo sapiens
gagagccatgaagca

SEQ ID NO: 1193397 - DNA, 10 bp, Homo sapiens
gagagcccag

SEQ ID NO: 1193398 - DNA, 20 bp, Homo sapiens
gagagcccccaccagcagca

SEQ ID NO: 1193399 - DNA, 20 bp, Homo sapiens
gagagcccggcgcccctgcc

SEQ ID NO: 1193400 - DNA, 10 bp, Homo sapiens
gagagccctg

SEQ ID NO: 1193401 - DNA, 12 bp, Homo sapiens
gagagccctgga

SEQ ID NO: 1193402 - DNA, 21 bp, Homo sapiens
gagagccctggattaggaggg

SEQ ID NO: 1193403 - DNA, 14 bp, Homo sapiens
gagagcctcttagt

SEQ ID NO: 1193404 - DNA, 21 bp, Homo sapiens
gagagcctgctcccccacccc

SEQ ID NO: 1193405 - DNA, 23 bp, Homo sapiens
gagagcctgctcccccaccccct

SEQ ID NO: 1193406 - DNA, 12 bp, Homo sapiens
gagagcctggca

SEQ ID NO: 1193407 - DNA, 21 bp, Homo sapiens
gagagctctaaccagatggaa

SEQ ID NO: 1193408 - DNA, 13 bp, Homo sapiens
gagagctggtgcc

SEQ ID NO: 1193409 - DNA, 17 bp, Homo sapiens
gagagctggtgcccgga

SEQ ID NO: 1193410 - DNA, 14 bp, Homo sapiens
gagagctgtattaa

SEQ ID NO: 1193411 - DNA, 15 bp, Homo sapiens
gagagctttgtgctt

SEQ ID NO: 1193412 - DNA, 20 bp, Homo sapiens
gagaggaaaagtaaggtgca

SEQ ID NO: 1193413 - DNA, 11 bp, Homo sapiens
gagaggaagga

SEQ ID NO: 1193414 - DNA, 12 bp, Homo sapiens
gagaggaaggac

SEQ ID NO: 1193415 - DNA, 19 bp, Homo sapiens
gagaggaaggacccctcac

SEQ ID NO: 1193416 - DNA, 10 bp, Homo sapiens
gagaggacag

SEQ ID NO: 1193417 - DNA, 16 bp, Homo sapiens
gagaggacggccctgc

SEQ ID NO: 1193418 - DNA, 22 bp, Homo sapiens
gagaggacggccctgcctgcct

SEQ ID NO: 1193419 - DNA, 20 bp, Homo sapiens
gagaggactgtagggagggc

SEQ ID NO: 1193420 - DNA, 13 bp, Homo sapiens
gagaggagaaaaa

SEQ ID NO: 1193421 - DNA, 14 bp, Homo sapiens
gagaggagaaacac

SEQ ID NO: 1193422 - DNA, 17 bp, Homo sapiens
gagaggagacggagggg

SEQ ID NO: 1193423 - DNA, 12 bp, Homo sapiens
gagaggagcacc

SEQ ID NO: 1193424 - DNA, 18 bp, Homo sapiens
gagaggagcacctgaacc

SEQ ID NO: 1193425 - DNA, 21 bp, Homo sapiens
gagaggaggcagccccctcca

SEQ ID NO: 1193426 - DNA, 21 bp, Homo sapiens
gagaggatacatttaataaaa

SEQ ID NO: 1193427 - DNA, 14 bp, Homo sapiens
gagaggcaatgatt

SEQ ID NO: 1193428 - DNA, 17 bp, Homo sapiens
gagaggcacctgctgga

SEQ ID NO: 1193429 - DNA, 22 bp, Homo sapiens
gagaggcagacttccctgaatg

SEQ ID NO: 1193430 - DNA, 12 bp, Homo sapiens
gagaggcagcaa

SEQ ID NO: 1193431 - DNA, 13 bp, Homo sapiens
tacttttggctcc

SEQ ID NO: 1193432 - DNA, 12 bp, Homo sapiens
tacttttgtaaa

SEQ ID NO: 1193433 - DNA, 15 bp, Homo sapiens
tactttttaaaaaac

SEQ ID NO: 1193434 - DNA, 14 bp, Homo sapiens
tactttttaaatgt

SEQ ID NO: 1193435 - DNA, 22 bp, Homo sapiens
tactttttaactggcttcattt

SEQ ID NO: 1193436 - DNA, 18 bp, Homo sapiens
tactttttaatttttaag

SEQ ID NO: 1193437 - DNA, 13 bp, Homo sapiens
tactttttcctgg

SEQ ID NO: 1193438 - DNA, 20 bp, Homo sapiens
tactttttgaacttttcatt

SEQ ID NO: 1193439 - DNA, 14 bp, Homo sapiens
tactttttgtagag

SEQ ID NO: 1193440 - DNA, 21 bp, Homo sapiens
tactttttgtatttagtagtt

SEQ ID NO: 1193441 - DNA, 18 bp, Homo sapiens
tacttttttaaatatttt

SEQ ID NO: 1193442 - DNA, 22 bp, Homo sapiens
tacttttttaaatattttctat

SEQ ID NO: 1193443 - DNA, 13 bp, Homo sapiens
tacttttttaaca

SEQ ID NO: 1193444 - DNA, 20 bp, Homo sapiens
tacttttttacactgataaa

SEQ ID NO: 1193445 - DNA, 23 bp, Homo sapiens
tactttttttgttatagattgtc

SEQ ID NO: 1193446 - DNA, 19 bp, Homo sapiens
tacttttttttagttcaat

SEQ ID NO: 1193447 - DNA, 17 bp, Homo sapiens
tagaaaaaaacatgaat

SEQ ID NO: 1193448 - DNA, 17 bp, Homo sapiens
tagaaaaaaagaaaaaa

SEQ ID NO: 1193449 - DNA, 18 bp, Homo sapiens
tagaaaaaggggcctgag

SEQ ID NO: 1193450 - DNA, 19 bp, Homo sapiens
tagaaaaaggggcctgagt

SEQ ID NO: 1193451 - DNA, 17 bp, Homo sapiens
tagaaaaataaaatgtt

SEQ ID NO: 1193452 - DNA, 18 bp, Homo sapiens
tagaaaaataaaatgttt

SEQ ID NO: 1193453 - DNA, 18 bp, Homo sapiens
tagaaaaatctcattccc

SEQ ID NO: 1193454 - DNA, 17 bp, Homo sapiens
tagaaaaatttcacgat

SEQ ID NO: 1193455 - DNA, 23 bp, Homo sapiens
tagaaaacaggaaaaaaactttt

SEQ ID NO: 1193456 - DNA, 16 bp, Homo sapiens
tagaaaactgaaaatc

SEQ ID NO: 1193457 - DNA, 20 bp, Homo sapiens
tagaaaactgaaaatctaat

SEQ ID NO: 1193458 - DNA, 21 bp, Homo sapiens
tagaaaactgaaaatctaata

SEQ ID NO: 1193459 - DNA, 18 bp, Homo sapiens
tagaaaagagacttctct

SEQ ID NO: 1193460 - DNA, 11 bp, Homo sapiens
tagaaaaggcg

SEQ ID NO: 1193461 - DNA, 18 bp, Homo sapiens
tagaaaagtatgttctaa

SEQ ID NO: 1193462 - DNA, 18 bp, Homo sapiens
tagaaaagtgaattgaag

SEQ ID NO: 1193463 - DNA, 12 bp, Homo sapiens
tagaaaagttat

SEQ ID NO: 1193464 - DNA, 21 bp, Homo sapiens
tagaaaagttgcagatgtatt

SEQ ID NO: 1193465 - DNA, 21 bp, Homo sapiens
tagaaaatagagcttttaaaa

SEQ ID NO: 1193466 - DNA, 14 bp, Homo sapiens
tagaaaatataagt

SEQ ID NO: 1193467 - DNA, 13 bp, Homo sapiens
tagaaaatattct

SEQ ID NO: 1193468 - DNA, 15 bp, Homo sapiens
tagaaaatcttagta

SEQ ID NO: 1193469 - DNA, 14 bp, Homo sapiens
tagaaaatcttcat

SEQ ID NO: 1193470 - DNA, 21 bp, Homo sapiens
tagaaaatgacttatttctgc

SEQ ID NO: 1193471 - DNA, 20 bp, Homo sapiens
tagaaaatgtgaccctccaa

SEQ ID NO: 1193472 - DNA, 12 bp, Homo sapiens
tagaaaatgtgt

SEQ ID NO: 1193473 - DNA, 23 bp, Homo sapiens
tagaaaattaaaataggcatatt

SEQ ID NO: 1193474 - DNA, 16 bp, Homo sapiens
tagaaaattagactgt

SEQ ID NO: 1193475 - DNA, 14 bp, Homo sapiens
tagaaaattatttg

SEQ ID NO: 1193476 - DNA, 15 bp, Homo sapiens
tagaaaattcataac

SEQ ID NO: 1193477 - DNA, 13 bp, Homo sapiens
tagaaaatttgct

SEQ ID NO: 1193478 - DNA, 23 bp, Homo sapiens
tagaaaatttgttattttgcaac

SEQ ID NO: 1193479 - DNA, 17 bp, Homo sapiens
tagaaacaaacatctaa

SEQ ID NO: 1193480 - DNA, 14 bp, Homo sapiens
tagaaacagaaata

SEQ ID NO: 1193481 - DNA, 16 bp, Homo sapiens
tagaattgaaaatgca

SEQ ID NO: 1193482 - DNA, 13 bp, Homo sapiens
tagaattgcattg

SEQ ID NO: 1193483 - DNA, 14 bp, Homo sapiens
tagaattgcattga

SEQ ID NO: 1193484 - DNA, 15 bp, Homo sapiens
tagaatttattcaat

SEQ ID NO: 1193485 - DNA, 22 bp, Homo sapiens
tagaatttattcaattcctctg

SEQ ID NO: 1193486 - DNA, 16 bp, Homo sapiens
tagaattttaagtgct

SEQ ID NO: 1193487 - DNA, 22 bp, Homo sapiens
tagaattttgagtattccatga

SEQ ID NO: 1193488 - DNA, 20 bp, Homo sapiens
tagacaaaaagtatattaaa

SEQ ID NO: 1193489 - DNA, 18 bp, Homo sapiens
tagacaaaaggaaaggtc

SEQ ID NO: 1193490 - DNA, 20 bp, Homo sapiens
tagacaaagccttaagcaaa

SEQ ID NO: 1193491 - DNA, 21 bp, Homo sapiens
tagacaaagccttaagcaaat

SEQ ID NO: 1193492 - DNA, 20 bp, Homo sapiens
tagacaaatagaaaatggtc

SEQ ID NO: 1193493 - DNA, 19 bp, Homo sapiens
tagacaacctgaaatttat

SEQ ID NO: 1193494 - DNA, 17 bp, Homo sapiens
tagacaacctttctgta

SEQ ID NO: 1193495 - DNA, 19 bp, Homo sapiens
tagacaacgatgaatttct

SEQ ID NO: 1193496 - DNA, 14 bp, Homo sapiens
tagacaagatattg

SEQ ID NO: 1193497 - DNA, 17 bp, Homo sapiens
tagacaagatattgtac

SEQ ID NO: 1193498 - DNA, 21 bp, Homo sapiens
tagacaagatattgtacataa

SEQ ID NO: 1193499 - DNA, 21 bp, Homo sapiens
tagacagaaaccaagccatta

SEQ ID NO: 1193500 - DNA, 14 bp, Homo sapiens
tagacagaacacct

SEQ ID NO: 1193501 - DNA, 21 bp, Homo sapiens
tagacagagttgcttaatgaa

SEQ ID NO: 1193502 - DNA, 14 bp, Homo sapiens
tagacagtaaaata

SEQ ID NO: 1193503 - DNA, 22 bp, Homo sapiens
tagacagtatgagtcaatgtgc

SEQ ID NO: 1193504 - DNA, 15 bp, Homo sapiens
tagacagtattgcca

SEQ ID NO: 1193505 - DNA, 21 bp, Homo sapiens
tagacagtattgccacctctg

SEQ ID NO: 1193506 - DNA, 12 bp, Homo sapiens
tagacatatttg

SEQ ID NO: 1193507 - DNA, 21 bp, Homo sapiens
tagacattatgtgagtttcct

SEQ ID NO: 1193508 - DNA, 13 bp, Homo sapiens
tagacatttttgt

SEQ ID NO: 1193509 - DNA, 16 bp, Homo sapiens
tagaccaaagcaaaga

SEQ ID NO: 1193510 - DNA, 19 bp, Homo sapiens
tagaccagcagacagagcc

SEQ ID NO: 1193511 - DNA, 22 bp, Homo sapiens
tagaccagcagacagagccagg

SEQ ID NO: 1193512 - DNA, 14 bp, Homo sapiens
tagaccagtttgca

SEQ ID NO: 1193513 - DNA, 20 bp, Homo sapiens
tagaccagtttgcatgattc

SEQ ID NO: 1193514 - DNA, 23 bp, Homo sapiens
tagaccatttatctgggattatg

SEQ ID NO: 1193515 - DNA, 16 bp, Homo sapiens
tagaccctcgggcccc

SEQ ID NO: 1193516 - DNA, 18 bp, Homo sapiens
tagaccctgaggccctgg

SEQ ID NO: 1193517 - DNA, 19 bp, Homo sapiens
tagaccctgaggccctggg

SEQ ID NO: 1193518 - DNA, 14 bp, Homo sapiens
tagacctcagcctg

SEQ ID NO: 1193519 - DNA, 16 bp, Homo sapiens
tagacctcagcctgtg

SEQ ID NO: 1193520 - DNA, 22 bp, Homo sapiens
tagacctcagcctgtgctgccc

SEQ ID NO: 1193521 - DNA, 18 bp, Homo sapiens
tagacctccccctcactt

SEQ ID NO: 1193522 - DNA, 17 bp, Homo sapiens
tagaccttgagggtggg

SEQ ID NO: 1193523 - DNA, 22 bp, Homo sapiens
tagaccttgagggtgggccagc

SEQ ID NO: 1193524 - DNA, 15 bp, Homo sapiens
tagacgcccctccca

SEQ ID NO: 1193525 - DNA, 18 bp, Homo sapiens
tagacgcccctcccaagc

SEQ ID NO: 1193526 - DNA, 21 bp, Homo sapiens
tagactagttctcttgtcctg

SEQ ID NO: 1193527 - DNA, 22 bp, Homo sapiens
tagactagttctcttgtcctgt

SEQ ID NO: 1193528 - DNA, 14 bp, Homo sapiens
tagactataaatgt

SEQ ID NO: 1193529 - DNA, 20 bp, Homo sapiens
tagactcaagggggtgacag

SEQ ID NO: 1193530 - DNA, 19 bp, Homo sapiens
tagactcatcttactgtac

SEQ ID NO: 1193531 - DNA, 18 bp, Homo sapiens
tagactccttctccccaa

SEQ ID NO: 1193532 - DNA, 18 bp, Homo sapiens
tagactcttcccctccct

SEQ ID NO: 1193533 - DNA, 22 bp, Homo sapiens
tagactcttcccctccctccca

SEQ ID NO: 1193534 - DNA, 19 bp, Homo sapiens
tagactgaggtataaagac

SEQ ID NO: 1193535 - DNA, 22 bp, Homo sapiens
tagactgtaactttttttcagt

SEQ ID NO: 1193536 - DNA, 13 bp, Homo sapiens
tagacttccccat

SEQ ID NO: 1193537 - DNA, 14 bp, Homo sapiens
tagacttccccatc

SEQ ID NO: 1193538 - DNA, 15 bp, Homo sapiens
tagacttccccatcc

SEQ ID NO: 1193539 - DNA, 17 bp, Homo sapiens
tagacttccccatcccg

SEQ ID NO: 1193540 - DNA, 20 bp, Homo sapiens
tagacttcgactcaggatcc

SEQ ID NO: 1193541 - DNA, 22 bp, Homo sapiens
tagacttcgactcaggatccag

SEQ ID NO: 1193542 - DNA, 13 bp, Homo sapiens
tagacttctggtt

SEQ ID NO: 1193543 - DNA, 17 bp, Homo sapiens
tagacttctggttgtat

SEQ ID NO: 1193544 - DNA, 21 bp, Homo sapiens
tagacttgaaagttttccagt

SEQ ID NO: 1193545 - DNA, 15 bp, Homo sapiens
tagacttgaaatact

SEQ ID NO: 1193546 - DNA, 19 bp, Homo sapiens
tagactttctcagtgggac

SEQ ID NO: 1193547 - DNA, 11 bp, Homo sapiens
tagactttctg

SEQ ID NO: 1193548 - DNA, 12 bp, Homo sapiens
tagactttgctt

SEQ ID NO: 1193549 - DNA, 16 bp, Homo sapiens
tagagaagcaagtaaa

SEQ ID NO: 1193550 - DNA, 12 bp, Homo sapiens
tagagaatgttc

SEQ ID NO: 1193551 - DNA, 16 bp, Homo sapiens
tagagaatgttccaga

SEQ ID NO: 1193552 - DNA, 22 bp, Homo sapiens
tagagaatgttccagacattct

SEQ ID NO: 1193553 - DNA, 19 bp, Homo sapiens
tagagacaggacagaatgt

SEQ ID NO: 1193554 - DNA, 14 bp, Homo sapiens
tagagactgtagat

SEQ ID NO: 1193555 - DNA, 18 bp, Homo sapiens
tagagagaggaggcagcc

SEQ ID NO: 1193556 - DNA, 23 bp, Homo sapiens
tagagagcatctgcaacaaaaag

SEQ ID NO: 1193557 - DNA, 13 bp, Homo sapiens
tagagagctattt

SEQ ID NO: 1193558 - DNA, 22 bp, Homo sapiens
tagagaggacaatactggggtt

SEQ ID NO: 1193559 - DNA, 13 bp, Homo sapiens
tagagaggcccgc

SEQ ID NO: 1193560 - DNA, 23 bp, Homo sapiens
gagatgcactatatgtttacaca

SEQ ID NO: 1193561 - DNA, 16 bp, Homo sapiens
gagatgcagaggtaaa

SEQ ID NO: 1193562 - DNA, 14 bp, Homo sapiens
gagatgcctccacc

SEQ ID NO: 1193563 - DNA, 15 bp, Homo sapiens
gagatgcctccaccg

SEQ ID NO: 1193564 - DNA, 20 bp, Homo sapiens
gagatgcctccaccgctgcc

SEQ ID NO: 1193565 - DNA, 22 bp, Homo sapiens
gagatgcctccaccgctgccta

SEQ ID NO: 1193566 - DNA, 15 bp, Homo sapiens
gagatgcttctctcc

SEQ ID NO: 1193567 - DNA, 20 bp, Homo sapiens
gagatgcttctctccttgcc

SEQ ID NO: 1193568 - DNA, 20 bp, Homo sapiens
gagatggaagttgcagtgag

SEQ ID NO: 1193569 - DNA, 13 bp, Homo sapiens
gagatggacatgg

SEQ ID NO: 1193570 - DNA, 22 bp, Homo sapiens
gagatggacatggctcattgta

SEQ ID NO: 1193571 - DNA, 12 bp, Homo sapiens
gagatggccata

SEQ ID NO: 1193572 - DNA, 15 bp, Homo sapiens
gagatggccatgctc

SEQ ID NO: 1193573 - DNA, 15 bp, Homo sapiens
gagatggccccaaca

SEQ ID NO: 1193574 - DNA, 20 bp, Homo sapiens
gagatgggaatgaggtggga

SEQ ID NO: 1193575 - DNA, 13 bp, Homo sapiens
gagatggggcggg

SEQ ID NO: 1193576 - DNA, 23 bp, Homo sapiens
gagatggggcgggggtgtgtctg

SEQ ID NO: 1193577 - DNA, 18 bp, Homo sapiens
gagatgggggcttcttcc

SEQ ID NO: 1193578 - DNA, 21 bp, Homo sapiens
gagatgggggcttcttcctca

SEQ ID NO: 1193579 - DNA, 20 bp, Homo sapiens
gagatggtaatctacagctc

SEQ ID NO: 1193580 - DNA, 23 bp, Homo sapiens
gagatggtcagtgtggagagggg

SEQ ID NO: 1193581 - DNA, 19 bp, Homo sapiens
gagatggttaaaaaggcca

SEQ ID NO: 1193582 - DNA, 22 bp, Homo sapiens
gagatgtaaaatgagtttgtat

SEQ ID NO: 1193583 - DNA, 16 bp, Homo sapiens
gagatgtaattgtttt

SEQ ID NO: 1193584 - DNA, 18 bp, Homo sapiens
gagatgtatgaaggcttt

SEQ ID NO: 1193585 - DNA, 20 bp, Homo sapiens
gagatgttgaggggaggagg

SEQ ID NO: 1193586 - DNA, 15 bp, Homo sapiens
gagatgtttgccaaa

SEQ ID NO: 1193587 - DNA, 16 bp, Homo sapiens
gagattagagggaggt

SEQ ID NO: 1193588 - DNA, 17 bp, Homo sapiens
gagattcagttttcatt

SEQ ID NO: 1193589 - DNA, 12 bp, Homo sapiens
gagattcatttt

SEQ ID NO: 1193590 - DNA, 18 bp, Homo sapiens
gagattcctattactgca

SEQ ID NO: 1193591 - DNA, 21 bp, Homo sapiens
gagattctggatctcctgctg

SEQ ID NO: 1193592 - DNA, 15 bp, Homo sapiens
gagattctgtgatct

SEQ ID NO: 1193593 - DNA, 22 bp, Homo sapiens
gagattcttcgtgtatagctgt

SEQ ID NO: 1193594 - DNA, 16 bp, Homo sapiens
gagattgaactccaag

SEQ ID NO: 1193595 - DNA, 14 bp, Homo sapiens
gagattgaatttca

SEQ ID NO: 1193596 - DNA, 21 bp, Homo sapiens
gagattgcaccactgcactcc

SEQ ID NO: 1193597 - DNA, 21 bp, Homo sapiens
gagattgcgccattgcactcc

SEQ ID NO: 1193598 - DNA, 21 bp, Homo sapiens
gagattggatcaagtattact

SEQ ID NO: 1193599 - DNA, 16 bp, Homo sapiens
gagattggccagcaaa

SEQ ID NO: 1193600 - DNA, 16 bp, Homo sapiens
gagatttcccttcatt

SEQ ID NO: 1193601 - DNA, 18 bp, Homo sapiens
gagatttcttgttgctca

SEQ ID NO: 1193602 - DNA, 16 bp, Homo sapiens
tagaggggaaggaaat

SEQ ID NO: 1193603 - DNA, 23 bp, Homo sapiens
tagaggtaccagcaatatgtaaa

SEQ ID NO: 1193604 - DNA, 20 bp, Homo sapiens
tagaggtcctctggagccct

SEQ ID NO: 1193605 - DNA, 17 bp, Homo sapiens
tagaggtgagaaattta

SEQ ID NO: 1193606 - DNA, 18 bp, Homo sapiens
tagaggtgggcagctggg

SEQ ID NO: 1193607 - DNA, 19 bp, Homo sapiens
tagaggtgttacagaggac

SEQ ID NO: 1193608 - DNA, 21 bp, Homo sapiens
tagaggttctgggttttctga

SEQ ID NO: 1193609 - DNA, 13 bp, Homo sapiens
tagaggttttgta

SEQ ID NO: 1193610 - DNA, 15 bp, Homo sapiens
tagagtaatgatgta

SEQ ID NO: 1193611 - DNA, 19 bp, Homo sapiens
tagagtagaagatttgatg

SEQ ID NO: 1193612 - DNA, 21 bp, Homo sapiens
tagagtatttcccttccaaag

SEQ ID NO: 1193613 - DNA, 18 bp, Homo sapiens
tagagtcaactacacaaa

SEQ ID NO: 1193614 - DNA, 13 bp, Homo sapiens
tagagtcagcctt

SEQ ID NO: 1193615 - DNA, 22 bp, Homo sapiens
tagagtcatctccatcagctgt

SEQ ID NO: 1193616 - DNA, 17 bp, Homo sapiens
tagagtcattcatattt

SEQ ID NO: 1193617 - DNA, 13 bp, Homo sapiens
tagagtcctcact

SEQ ID NO: 1193618 - DNA, 22 bp, Homo sapiens
tagagtcttacaatcaaatctc

SEQ ID NO: 1193619 - DNA, 16 bp, Homo sapiens
tagagtgctctgaccc

SEQ ID NO: 1193620 - DNA, 17 bp, Homo sapiens
tagagtggttattcatt

SEQ ID NO: 1193621 - DNA, 15 bp, Homo sapiens
tagagtgtagctgta

SEQ ID NO: 1193622 - DNA, 13 bp, Homo sapiens
tagagttcttctt

SEQ ID NO: 1193623 - DNA, 17 bp, Homo sapiens
tagagttgatactacag

SEQ ID NO: 1193624 - DNA, 12 bp, Homo sapiens
tagagttgctga

SEQ ID NO: 1193625 - DNA, 21 bp, Homo sapiens
tagagtttacagtttgtgttt

SEQ ID NO: 1193626 - DNA, 13 bp, Homo sapiens
tagagtttctgtt

SEQ ID NO: 1193627 - DNA, 15 bp, Homo sapiens
tagagtttctgtttg

SEQ ID NO: 1193628 - DNA, 20 bp, Homo sapiens
tagagtttctgtttgattct

SEQ ID NO: 1193629 - DNA, 21 bp, Homo sapiens
tagagtttctgtttgattctt

SEQ ID NO: 1193630 - DNA, 17 bp, Homo sapiens
tagagtttgctattaga

SEQ ID NO: 1193631 - DNA, 15 bp, Homo sapiens
tagataaaagctgaa

SEQ ID NO: 1193632 - DNA, 15 bp, Homo sapiens
tagataaactcagaa

SEQ ID NO: 1193633 - DNA, 13 bp, Homo sapiens
tagataaattgta

SEQ ID NO: 1193634 - DNA, 21 bp, Homo sapiens
tagataaattgtagggcttta

SEQ ID NO: 1193635 - DNA, 18 bp, Homo sapiens
tagataacttcttgaaaa

SEQ ID NO: 1193636 - DNA, 18 bp, Homo sapiens
tagataatacaccactac

SEQ ID NO: 1193637 - DNA, 17 bp, Homo sapiens
tagataatatttctgaa

SEQ ID NO: 1193638 - DNA, 12 bp, Homo sapiens
tagatacaataa

SEQ ID NO: 1193639 - DNA, 15 bp, Homo sapiens
tagatagccctgtcc

SEQ ID NO: 1193640 - DNA, 15 bp, Homo sapiens
tagatatatgctctg

SEQ ID NO: 1193641 - DNA, 14 bp, Homo sapiens
tagatatcctctcc

SEQ ID NO: 1193642 - DNA, 22 bp, Homo sapiens
tagatatcctctccccctcctc

SEQ ID NO: 1193643 - DNA, 22 bp, Homo sapiens
tagatattgaggccaagaatat

SEQ ID NO: 1193644 - DNA, 21 bp, Homo sapiens
tagatattgttttctgtaaat

SEQ ID NO: 1193645 - DNA, 23 bp, Homo sapiens
tagatcaaatactttaaaggaaa

SEQ ID NO: 1193646 - DNA, 18 bp, Homo sapiens
tagatcaaatagttgcat

SEQ ID NO: 1193647 - DNA, 15 bp, Homo sapiens
tagatcagccattaa

SEQ ID NO: 1193648 - DNA, 15 bp, Homo sapiens
tagatcagtatttca

SEQ ID NO: 1193649 - DNA, 22 bp, Homo sapiens
tagatcccatgtcacctcagct

SEQ ID NO: 1193650 - DNA, 18 bp, Homo sapiens
tagatcctgcaccccagc

SEQ ID NO: 1193651 - DNA, 19 bp, Homo sapiens
tagatcgcttgagcccagg

SEQ ID NO: 1193652 - DNA, 14 bp, Homo sapiens
tagatctctcctgc

SEQ ID NO: 1193653 - DNA, 19 bp, Homo sapiens
tagatctgtcccttaataa

SEQ ID NO: 1193654 - DNA, 22 bp, Homo sapiens
tagatctgtcccttaataaaaa

SEQ ID NO: 1193655 - DNA, 15 bp, Homo sapiens
tagatcttctgaaat

SEQ ID NO: 1193656 - DNA, 18 bp, Homo sapiens
tagatgaactagatgtat

SEQ ID NO: 1193657 - DNA, 22 bp, Homo sapiens
tagatgagtgggaggcgtgccc

SEQ ID NO: 1193658 - DNA, 19 bp, Homo sapiens
tagatgcaagatatttata

SEQ ID NO: 1193659 - DNA, 16 bp, Homo sapiens
tagatgcctgaacttg

SEQ ID NO: 1193660 - DNA, 20 bp, Homo sapiens
tagatgctgaatatctgttc

SEQ ID NO: 1193661 - DNA, 23 bp, Homo sapiens
tagatggaatggaaaagcaactt

SEQ ID NO: 1193662 - DNA, 16 bp, Homo sapiens
tagatggcgatgtgtt

SEQ ID NO: 1193663 - DNA, 19 bp, Homo sapiens
tagatgtagcattgttcca

SEQ ID NO: 1193664 - DNA, 17 bp, Homo sapiens
tagatgtagtatttttt

SEQ ID NO: 1193665 - DNA, 20 bp, Homo sapiens
tagatgtatttttgatgtat

SEQ ID NO: 1193666 - DNA, 17 bp, Homo sapiens
tagatgtcatgaggaaa

SEQ ID NO: 1193667 - DNA, 22 bp, Homo sapiens
tagatgtccctttcttggccag

SEQ ID NO: 1193668 - DNA, 21 bp, Homo sapiens
tagatgtcttcatcacttctt

SEQ ID NO: 1193669 - DNA, 20 bp, Homo sapiens
tagatgtgcaacctgtggct

SEQ ID NO: 1193670 - DNA, 21 bp, Homo sapiens
tagatgttctaagtctttcca

SEQ ID NO: 1193671 - DNA, 16 bp, Homo sapiens
tagattaaaaattata

SEQ ID NO: 1193672 - DNA, 18 bp, Homo sapiens
tagattaagagatgggtt

SEQ ID NO: 1193673 - DNA, 22 bp, Homo sapiens
tagattacagagggctcatttt

SEQ ID NO: 1193674 - DNA, 14 bp, Homo sapiens
tagattaggaaggt

SEQ ID NO: 1193675 - DNA, 16 bp, Homo sapiens
tagattatggagcttt

SEQ ID NO: 1193676 - DNA, 18 bp, Homo sapiens
tagattatttcatatact

SEQ ID NO: 1193677 - DNA, 17 bp, Homo sapiens
tagattatttctgtatt

SEQ ID NO: 1193678 - DNA, 22 bp, Homo sapiens
tagattcacctgtaaaacttta

SEQ ID NO: 1193679 - DNA, 18 bp, Homo sapiens
tagattcaggggaagggc

SEQ ID NO: 1193680 - DNA, 17 bp, Homo sapiens
tagattcaggtaataca

SEQ ID NO: 1193681 - DNA, 21 bp, Homo sapiens
tagattcctcttgcctctctc

SEQ ID NO: 1193682 - DNA, 22 bp, Homo sapiens
tagattcctcttgcctctctca

SEQ ID NO: 1193683 - DNA, 16 bp, Homo sapiens
tagattgattgtattg

SEQ ID NO: 1193684 - DNA, 12 bp, Homo sapiens
tagattgcagaa

SEQ ID NO: 1193685 - DNA, 18 bp, Homo sapiens
tagattgtccttttgcaa

SEQ ID NO: 1193686 - DNA, 13 bp, Homo sapiens
gagcagagctctc

SEQ ID NO: 1193687 - DNA, 13 bp, Homo sapiens
gagcagaggcagc

SEQ ID NO: 1193688 - DNA, 15 bp, Homo sapiens
gagcagaggggctga

SEQ ID NO: 1193689 - DNA, 17 bp, Homo sapiens
gagcagagtctgggcct

SEQ ID NO: 1193690 - DNA, 15 bp, Homo sapiens
gagcagatggacagc

SEQ ID NO: 1193691 - DNA, 21 bp, Homo sapiens
gagcagcagcaccaaccacag

SEQ ID NO: 1193692 - DNA, 19 bp, Homo sapiens
gagcagcagcacctttctc

SEQ ID NO: 1193693 - DNA, 11 bp, Homo sapiens
gagcagcagcc

SEQ ID NO: 1193694 - DNA, 12 bp, Homo sapiens
gagcagcagcca

SEQ ID NO: 1193695 - DNA, 16 bp, Homo sapiens
gagcagcagccagcac

SEQ ID NO: 1193696 - DNA, 17 bp, Homo sapiens
gagcagcagccagcacc

SEQ ID NO: 1193697 - DNA, 22 bp, Homo sapiens
gagcagcagcgctcggcccgga

SEQ ID NO: 1193698 - DNA, 23 bp, Homo sapiens
gagcagcagcgctcggcccggag

SEQ ID NO: 1193699 - DNA, 16 bp, Homo sapiens
gagcagcagcttgggg

SEQ ID NO: 1193700 - DNA, 17 bp, Homo sapiens
gagcagcagcttgggga

SEQ ID NO: 1193701 - DNA, 13 bp, Homo sapiens
gagcagcaggtgc

SEQ ID NO: 1193702 - DNA, 11 bp, Homo sapiens
gagcagccaga

SEQ ID NO: 1193703 - DNA, 16 bp, Homo sapiens
gagcagccagagctgt

SEQ ID NO: 1193704 - DNA, 13 bp, Homo sapiens
gagcagccaggac

SEQ ID NO: 1193705 - DNA, 16 bp, Homo sapiens
gagcagccaggacccg

SEQ ID NO: 1193706 - DNA, 19 bp, Homo sapiens
gagcagcccccgggccgct

SEQ ID NO: 1193707 - DNA, 23 bp, Homo sapiens
gagcagcccccgggccgctggct

SEQ ID NO: 1193708 - DNA, 15 bp, Homo sapiens
gagcagccgccagct

SEQ ID NO: 1193709 - DNA, 21 bp, Homo sapiens
gagcagccgccagctgggagc

SEQ ID NO: 1193710 - DNA, 17 bp, Homo sapiens
gagcagcctcgaggctg

SEQ ID NO: 1193711 - DNA, 21 bp, Homo sapiens
gagcagcctcgaggctggtgg

SEQ ID NO: 1193712 - DNA, 13 bp, Homo sapiens
gagcagcctctgg

SEQ ID NO: 1193713 - DNA, 16 bp, Homo sapiens
gagcagcgcccaggcc

SEQ ID NO: 1193714 - DNA, 17 bp, Homo sapiens
gagcagcgcccaggcct

SEQ ID NO: 1193715 - DNA, 18 bp, Homo sapiens
gagcagcgcccaggcctg

SEQ ID NO: 1193716 - DNA, 23 bp, Homo sapiens
gagcagcggattgctctggagca

SEQ ID NO: 1193717 - DNA, 15 bp, Homo sapiens
gagcagctactgtaa

SEQ ID NO: 1193718 - DNA, 21 bp, Homo sapiens
gagcagctactgtaacttttt

SEQ ID NO: 1193719 - DNA, 14 bp, Homo sapiens
gagcagctggctct

SEQ ID NO: 1193720 - DNA, 14 bp, Homo sapiens
gagcagctggggta

SEQ ID NO: 1193721 - DNA, 23 bp, Homo sapiens
gagcagcttccttctgggactgg

SEQ ID NO: 1193722 - DNA, 20 bp, Homo sapiens
gagcagcttcggtgtgcaga

SEQ ID NO: 1193723 - DNA, 17 bp, Homo sapiens
gagcagcttcttgggct

SEQ ID NO: 1193724 - DNA, 18 bp, Homo sapiens
gagccatcactagaagaa

SEQ ID NO: 1193725 - DNA, 20 bp, Homo sapiens
gagccatcactagaagaaaa

SEQ ID NO: 1193726 - DNA, 21 bp, Homo sapiens
gagccatcactagaagaaaag

SEQ ID NO: 1193727 - DNA, 15 bp, Homo sapiens
gagccatgccaggct

SEQ ID NO: 1193728 - DNA, 15 bp, Homo sapiens
gagccatgcctccct

SEQ ID NO: 1193729 - DNA, 17 bp, Homo sapiens
gagccatgcgccccctc

SEQ ID NO: 1193730 - DNA, 17 bp, Homo sapiens
gagccatgctacagtta

SEQ ID NO: 1193731 - DNA, 13 bp, Homo sapiens
gagccatgggcct

SEQ ID NO: 1193732 - DNA, 14 bp, Homo sapiens
gagccatgggcctg

SEQ ID NO: 1193733 - DNA, 18 bp, Homo sapiens
gagccatgggcctgggcc

SEQ ID NO: 1193734 - DNA, 21 bp, Homo sapiens
gagccatgggcctgggcctgc

SEQ ID NO: 1193735 - DNA, 22 bp, Homo sapiens
gagccatgggcctgggcctgct

SEQ ID NO: 1193736 - DNA, 20 bp, Homo sapiens
gagccattgaacagctgtga

SEQ ID NO: 1193737 - DNA, 20 bp, Homo sapiens
gagcccaaccaggccctgcc

SEQ ID NO: 1193738 - DNA, 16 bp, Homo sapiens
gagcccacactgccac

SEQ ID NO: 1193739 - DNA, 13 bp, Homo sapiens
gagcccacagcga

SEQ ID NO: 1193740 - DNA, 19 bp, Homo sapiens
gagcccacagcgagcctgt

SEQ ID NO: 1193741 - DNA, 14 bp, Homo sapiens
gagcccaccagcca

SEQ ID NO: 1193742 - DNA, 15 bp, Homo sapiens
gagcccaccagccag

SEQ ID NO: 1193743 - DNA, 17 bp, Homo sapiens
gagcccaccagccagcc

SEQ ID NO: 1193744 - DNA, 22 bp, Homo sapiens
gagcccaccagccagccctggc

SEQ ID NO: 1193745 - DNA, 21 bp, Homo sapiens
gagcccacgcccgactagcag

SEQ ID NO: 1193746 - DNA, 12 bp, Homo sapiens
gagcccactcct

SEQ ID NO: 1193747 - DNA, 19 bp, Homo sapiens
gagcccagagggtggcaag

SEQ ID NO: 1193748 - DNA, 18 bp, Homo sapiens
gagcccagccctccccat

SEQ ID NO: 1193749 - DNA, 16 bp, Homo sapiens
gagcccagcctgggag

SEQ ID NO: 1193750 - DNA, 14 bp, Homo sapiens
gagcccagctacat

SEQ ID NO: 1193751 - DNA, 18 bp, Homo sapiens
gagcccagctacattcct

SEQ ID NO: 1193752 - DNA, 19 bp, Homo sapiens
gagcccagctacattcctc

SEQ ID NO: 1193753 - DNA, 20 bp, Homo sapiens
gagcccagctacattcctca

SEQ ID NO: 1193754 - DNA, 12 bp, Homo sapiens
gagcccagctct

SEQ ID NO: 1193755 - DNA, 13 bp, Homo sapiens
gagcccagctctt

SEQ ID NO: 1193756 - DNA, 13 bp, Homo sapiens
gagcccagctggg

SEQ ID NO: 1193757 - DNA, 22 bp, Homo sapiens
gagcccagggcatcttgctggc

SEQ ID NO: 1193758 - DNA, 12 bp, Homo sapiens
gagcccagggga

SEQ ID NO: 1193759 - DNA, 17 bp, Homo sapiens
gagcccagtcattgtac

SEQ ID NO: 1193760 - DNA, 18 bp, Homo sapiens
gagcccagtcgagacctc

SEQ ID NO: 1193761 - DNA, 19 bp, Homo sapiens
gagcccagtgaagcctctg

SEQ ID NO: 1193762 - DNA, 23 bp, Homo sapiens
gagcccatggtaacgaaccccta

SEQ ID NO: 1193763 - DNA, 20 bp, Homo sapiens
gagcccatgttctgccccca

SEQ ID NO: 1193764 - DNA, 21 bp, Homo sapiens
gagcccatgttctgcccccag

SEQ ID NO: 1193765 - DNA, 21 bp, Homo sapiens
gagccccaagtcctgaagagg

SEQ ID NO: 1193766 - DNA, 16 bp, Homo sapiens
gagccccaggcctctg

SEQ ID NO: 1193767 - DNA, 17 bp, Homo sapiens
gagccccaggcctctgt

SEQ ID NO: 1193768 - DNA, 14 bp, Homo sapiens
gagccccagggtct

SEQ ID NO: 1193769 - DNA, 24 bp, Homo sapiens
gagccccagggtcttccctacctc

SEQ ID NO: 1193770 - DNA, 18 bp, Homo sapiens
gagccccattcctgggaa

SEQ ID NO: 1193771 - DNA, 20 bp, Homo sapiens
gagcccccaacacaggcaag

SEQ ID NO: 1193772 - DNA, 14 bp, Homo sapiens
gagcccccaccagc

SEQ ID NO: 1193773 - DNA, 17 bp, Homo sapiens
gagcccccaccagcagc

SEQ ID NO: 1193774 - DNA, 23 bp, Homo sapiens
gagcccccaccagcagcacaatt

SEQ ID NO: 1193775 - DNA, 14 bp, Homo sapiens
gagcccccaccttg

SEQ ID NO: 1193776 - DNA, 12 bp, Homo sapiens
gagcccccagat

SEQ ID NO: 1193777 - DNA, 22 bp, Homo sapiens
gagcccccagatagagctgggt

SEQ ID NO: 1193778 - DNA, 17 bp, Homo sapiens
gagcccccagcagaggc

SEQ ID NO: 1193779 - DNA, 18 bp, Homo sapiens
gagcccccagcagaggca

SEQ ID NO: 1193780 - DNA, 23 bp, Homo sapiens
gagcccccagcagaggcaggctg

SEQ ID NO: 1193781 - DNA, 21 bp, Homo sapiens
gagcccccgccccgccccaca

SEQ ID NO: 1193782 - DNA, 14 bp, Homo sapiens
gagccccgccctct

SEQ ID NO: 1193783 - DNA, 20 bp, Homo sapiens
gagccccgccctcttcctga

SEQ ID NO: 1193784 - DNA, 21 bp, Homo sapiens
gagccccgccctcttcctgac

SEQ ID NO: 1193785 - DNA, 13 bp, Homo sapiens
gagcccctcccca

SEQ ID NO: 1193786 - DNA, 12 bp, Homo sapiens
gagcccctcctc

SEQ ID NO: 1193787 - DNA, 21 bp, Homo sapiens
gagcccctcctccagcccctg

SEQ ID NO: 1193788 - DNA, 22 bp, Homo sapiens
gagcccctcctccagcccctgt

SEQ ID NO: 1193789 - DNA, 16 bp, Homo sapiens
gagcccctcctccccc

SEQ ID NO: 1193790 - DNA, 13 bp, Homo sapiens
gagcccctgggtg

SEQ ID NO: 1193791 - DNA, 14 bp, Homo sapiens
gagcccctgggtgg

SEQ ID NO: 1193792 - DNA, 13 bp, Homo sapiens
gagcccctggtcc

SEQ ID NO: 1193793 - DNA, 20 bp, Homo sapiens
gagcccctgtctagagaggg

SEQ ID NO: 1193794 - DNA, 22 bp, Homo sapiens
gagcccctgtctagagagggag

SEQ ID NO: 1193795 - DNA, 17 bp, Homo sapiens
gagccccttctgctcag

SEQ ID NO: 1193796 - DNA, 20 bp, Homo sapiens
gagccccttctgctcagctc

SEQ ID NO: 1193797 - DNA, 18 bp, Homo sapiens
gagcccgatattctccct

SEQ ID NO: 1193798 - DNA, 15 bp, Homo sapiens
gagcccgcagcccag

SEQ ID NO: 1193799 - DNA, 18 bp, Homo sapiens
gagcccgcagcccagacc

SEQ ID NO: 1193800 - DNA, 14 bp, Homo sapiens
gagcccgcagggcc

SEQ ID NO: 1193801 - DNA, 20 bp, Homo sapiens
gagcccgcagggccatgcag

SEQ ID NO: 1193802 - DNA, 21 bp, Homo sapiens
gagcccgcagggccatgcaga

SEQ ID NO: 1193803 - DNA, 21 bp, Homo sapiens
gagcccgcttcaagctctctg

SEQ ID NO: 1193804 - DNA, 14 bp, Homo sapiens
gagcccgggctgcc

SEQ ID NO: 1193805 - DNA, 20 bp, Homo sapiens
gagcccgtgcagtacaggca

SEQ ID NO: 1193806 - DNA, 21 bp, Homo sapiens
gagcccgtgcagtacaggcaa

SEQ ID NO: 1193807 - DNA, 18 bp, Homo sapiens
gagccctaaccccttcca

SEQ ID NO: 1193808 - DNA, 19 bp, Homo sapiens
gagccctaaccccttccag

SEQ ID NO: 1193809 - DNA, 11 bp, Homo sapiens
gagccctcaga

SEQ ID NO: 1193810 - DNA, 14 bp, Homo sapiens
gagccctcaggctc

SEQ ID NO: 1193811 - DNA, 15 bp, Homo sapiens
gagccctcaggctcc

SEQ ID NO: 1193812 - DNA, 16 bp, Homo sapiens
gagccctcaggctccc

SEQ ID NO: 1193813 - DNA, 14 bp, Homo sapiens
gagccctcccccaa

SEQ ID NO: 1193814 - DNA, 21 bp, Homo sapiens
gagccctctcactccagccaa

SEQ ID NO: 1193815 - DNA, 23 bp, Homo sapiens
gagccctctcactccagccaaag

SEQ ID NO: 1193816 - DNA, 16 bp, Homo sapiens
tagccaggatggtctc

SEQ ID NO: 1193817 - DNA, 23 bp, Homo sapiens
tagccagtgactttttctgagct

SEQ ID NO: 1193818 - DNA, 16 bp, Homo sapiens
tagccagtgctccagg

SEQ ID NO: 1193819 - DNA, 23 bp, Homo sapiens
tagccagtgctccaggcacccag

SEQ ID NO: 1193820 - DNA, 19 bp, Homo sapiens
tagccatcccttggggaag

SEQ ID NO: 1193821 - DNA, 21 bp, Homo sapiens
tagccatgatttgtcccagcc

SEQ ID NO: 1193822 - DNA, 23 bp, Homo sapiens
tagccatgatttgtcccagcctg

SEQ ID NO: 1193823 - DNA, 20 bp, Homo sapiens
tagccatggctcaggcaagc

SEQ ID NO: 1193824 - DNA, 15 bp, Homo sapiens
tagccattacccacg

SEQ ID NO: 1193825 - DNA, 19 bp, Homo sapiens
tagccattcctggtaccca

SEQ ID NO: 1193826 - DNA, 14 bp, Homo sapiens
tagcccaaaaccaa

SEQ ID NO: 1193827 - DNA, 17 bp, Homo sapiens
tagcccaagaggtctga

SEQ ID NO: 1193828 - DNA, 18 bp, Homo sapiens
tagcccactccctgccta

SEQ ID NO: 1193829 - DNA, 15 bp, Homo sapiens
tagcccagactctga

SEQ ID NO: 1193830 - DNA, 16 bp, Homo sapiens
tagcccaggagcaaca

SEQ ID NO: 1193831 - DNA, 19 bp, Homo sapiens
tagcccaggtcctctgata

SEQ ID NO: 1193832 - DNA, 14 bp, Homo sapiens
tagcccagtgtttt

SEQ ID NO: 1193833 - DNA, 20 bp, Homo sapiens
tagcccagtgttttctttga

SEQ ID NO: 1193834 - DNA, 22 bp, Homo sapiens
tagcccatggacttcacataag

SEQ ID NO: 1193835 - DNA, 14 bp, Homo sapiens
tagccccagactgg

SEQ ID NO: 1193836 - DNA, 21 bp, Homo sapiens
tagccccagactgggcccagg

SEQ ID NO: 1193837 - DNA, 16 bp, Homo sapiens
tagccccctggcctct

SEQ ID NO: 1193838 - DNA, 17 bp, Homo sapiens
tagccccctggcctctg

SEQ ID NO: 1193839 - DNA, 18 bp, Homo sapiens
tagcccctctctcacaca

SEQ ID NO: 1193840 - DNA, 12 bp, Homo sapiens
tagcccctctgg

SEQ ID NO: 1193841 - DNA, 14 bp, Homo sapiens
tagcccctgaaagc

SEQ ID NO: 1193842 - DNA, 22 bp, Homo sapiens
tagcccctggggtggccaccag

SEQ ID NO: 1193843 - DNA, 10 bp, Homo sapiens
tagcccttcc

SEQ ID NO: 1193844 - DNA, 17 bp, Homo sapiens
tagcccttccagcctgg

SEQ ID NO: 1193845 - DNA, 14 bp, Homo sapiens
tagcttattataga

SEQ ID NO: 1193846 - DNA, 18 bp, Homo sapiens
tagcttattgatcccaca

SEQ ID NO: 1193847 - DNA, 21 bp, Homo sapiens
tagcttcaccccaatcccagc

SEQ ID NO: 1193848 - DNA, 16 bp, Homo sapiens
tagcttcagtcattaa

SEQ ID NO: 1193849 - DNA, 21 bp, Homo sapiens
tagcttcagtcattaaattac

SEQ ID NO: 1193850 - DNA, 17 bp, Homo sapiens
tagcttcagttgttctt

SEQ ID NO: 1193851 - DNA, 18 bp, Homo sapiens
tagcttccacctcatgga

SEQ ID NO: 1193852 - DNA, 14 bp, Homo sapiens
tagcttcctccaga

SEQ ID NO: 1193853 - DNA, 21 bp, Homo sapiens
tagcttctaccatgaacagaa

SEQ ID NO: 1193854 - DNA, 15 bp, Homo sapiens
tagcttctgcttttc

SEQ ID NO: 1193855 - DNA, 22 bp, Homo sapiens
tagcttctgcttttctgccctg

SEQ ID NO: 1193856 - DNA, 20 bp, Homo sapiens
tagcttgcctaatggctttc

SEQ ID NO: 1193857 - DNA, 17 bp, Homo sapiens
tagcttgtatagtgtaa

SEQ ID NO: 1193858 - DNA, 21 bp, Homo sapiens
tagctttaaaaccacagctgg

SEQ ID NO: 1193859 - DNA, 16 bp, Homo sapiens
tagctttaacttaaat

SEQ ID NO: 1193860 - DNA, 14 bp, Homo sapiens
tagctttaccctca

SEQ ID NO: 1193861 - DNA, 21 bp, Homo sapiens
tagctttatatatggacatgg

SEQ ID NO: 1193862 - DNA, 14 bp, Homo sapiens
tagctttattcttc

SEQ ID NO: 1193863 - DNA, 22 bp, Homo sapiens
tagctttatttttcttttcctg

SEQ ID NO: 1193864 - DNA, 23 bp, Homo sapiens
tagctttctcctcatccatttct

SEQ ID NO: 1193865 - DNA, 15 bp, Homo sapiens
tagcttttaaaaaat

SEQ ID NO: 1193866 - DNA, 14 bp, Homo sapiens
tagcttttattgta

SEQ ID NO: 1193867 - DNA, 12 bp, Homo sapiens
tagcttttcctt

SEQ ID NO: 1193868 - DNA, 14 bp, Homo sapiens
tagcttttgattag

SEQ ID NO: 1193869 - DNA, 14 bp, Homo sapiens
tagcttttggggag

SEQ ID NO: 1193870 - DNA, 18 bp, Homo sapiens
tagctttttattatttta

SEQ ID NO: 1193871 - DNA, 21 bp, Homo sapiens
taggaaaatcatgtgctcaga

SEQ ID NO: 1193872 - DNA, 13 bp, Homo sapiens
taggaaaatgaga

SEQ ID NO: 1193873 - DNA, 12 bp, Homo sapiens
taggaaaattat

SEQ ID NO: 1193874 - DNA, 10 bp, Homo sapiens
taggaaacac

SEQ ID NO: 1193875 - DNA, 21 bp, Homo sapiens
taggaaaccccccaatgtctg

SEQ ID NO: 1193876 - DNA, 20 bp, Homo sapiens
taggaaacttgtagaaacga

SEQ ID NO: 1193877 - DNA, 14 bp, Homo sapiens
taggaaataaaacc

SEQ ID NO: 1193878 - DNA, 20 bp, Homo sapiens
taggaaatctagaagtagtc

SEQ ID NO: 1193879 - DNA, 22 bp, Homo sapiens
taggaactgtctcaaaaggatg

SEQ ID NO: 1193880 - DNA, 17 bp, Homo sapiens
taggaagaaagaagaca

SEQ ID NO: 1193881 - DNA, 23 bp, Homo sapiens
taggaagaacgttttttcctcag

SEQ ID NO: 1193882 - DNA, 21 bp, Homo sapiens
taggaagacacattatcttct

SEQ ID NO: 1193883 - DNA, 15 bp, Homo sapiens
taggaagacataaaa

SEQ ID NO: 1193884 - DNA, 14 bp, Homo sapiens
taggaagagaaacc

SEQ ID NO: 1193885 - DNA, 19 bp, Homo sapiens
taggaagagaaaccaggga

SEQ ID NO: 1193886 - DNA, 18 bp, Homo sapiens
taggaagagcaggactcc

SEQ ID NO: 1193887 - DNA, 20 bp, Homo sapiens
taggaagggatctgagaaca

SEQ ID NO: 1193888 - DNA, 13 bp, Homo sapiens
taggaagtggctg

SEQ ID NO: 1193889 - DNA, 18 bp, Homo sapiens
taggaagtggctggtctg

SEQ ID NO: 1193890 - DNA, 17 bp, Homo sapiens
taggaagttgacttata

SEQ ID NO: 1193891 - DNA, 22 bp, Homo sapiens
taggaagttgacttatagtaca

SEQ ID NO: 1193892 - DNA, 14 bp, Homo sapiens
taggaatagaggaa

SEQ ID NO: 1193893 - DNA, 22 bp, Homo sapiens
taggaatgtccaccatgaactt

SEQ ID NO: 1193894 - DNA, 18 bp, Homo sapiens
taggaattctttgcattc

SEQ ID NO: 1193895 - DNA, 20 bp, Homo sapiens
taggacaatcagtcccctcc

SEQ ID NO: 1193896 - DNA, 18 bp, Homo sapiens
taggaccaagcatcttgg

SEQ ID NO: 1193897 - DNA, 17 bp, Homo sapiens
taggaccactcagcccc

SEQ ID NO: 1193898 - DNA, 19 bp, Homo sapiens
taggaccactcagccccta

SEQ ID NO: 1193899 - DNA, 13 bp, Homo sapiens
taggaccagagcg

SEQ ID NO: 1193900 - DNA, 20 bp, Homo sapiens
taggacgccaacttctccca

SEQ ID NO: 1193901 - DNA, 20 bp, Homo sapiens
taggactacagacatgtgca

SEQ ID NO: 1193902 - DNA, 21 bp, Homo sapiens
taggactaccgcaggcccgga

SEQ ID NO: 1193903 - DNA, 13 bp, Homo sapiens
taggactcagaaa

SEQ ID NO: 1193904 - DNA, 14 bp, Homo sapiens
taggactctgaggc

SEQ ID NO: 1193905 - DNA, 15 bp, Homo sapiens
taggactctgaggct

SEQ ID NO: 1193906 - DNA, 14 bp, Homo sapiens
taggactgcagtgt

SEQ ID NO: 1193907 - DNA, 13 bp, Homo sapiens
taggactgtagaa

SEQ ID NO: 1193908 - DNA, 14 bp, Homo sapiens
taggactgtagaaa

SEQ ID NO: 1193909 - DNA, 21 bp, Homo sapiens
taggacttaaaattagtcttt

SEQ ID NO: 1193910 - DNA, 17 bp, Homo sapiens
taggagaaccaaatctg

SEQ ID NO: 1193911 - DNA, 20 bp, Homo sapiens
taggagaaccaaatctggaa

SEQ ID NO: 1193912 - DNA, 20 bp, Homo sapiens
taggagacagatcactcctg

SEQ ID NO: 1193913 - DNA, 21 bp, Homo sapiens
taggagacagatcactcctgg

SEQ ID NO: 1193914 - DNA, 22 bp, Homo sapiens
taggagagactgaaagcagcag

SEQ ID NO: 1193915 - DNA, 20 bp, Homo sapiens
taggagagattgggagaaat

SEQ ID NO: 1193916 - DNA, 22 bp, Homo sapiens
taggagagattgggagaaatca

SEQ ID NO: 1193917 - DNA, 19 bp, Homo sapiens
taggagagcactgcctcta

SEQ ID NO: 1193918 - DNA, 12 bp, Homo sapiens
taggagaggaga

SEQ ID NO: 1193919 - DNA, 16 bp, Homo sapiens
taggagataccaggtt

SEQ ID NO: 1193920 - DNA, 18 bp, Homo sapiens
taggagcaagaagaaaat

SEQ ID NO: 1193921 - DNA, 20 bp, Homo sapiens
taggagcaagaagaaaatgt

SEQ ID NO: 1193922 - DNA, 21 bp, Homo sapiens
taggagcaagggcacaaactg

SEQ ID NO: 1193923 - DNA, 12 bp, Homo sapiens
taggagcccttc

SEQ ID NO: 1193924 - DNA, 16 bp, Homo sapiens
taggagcccttctctt

SEQ ID NO: 1193925 - DNA, 16 bp, Homo sapiens
taggagctgaggtttc

SEQ ID NO: 1193926 - DNA, 17 bp, Homo sapiens
taggagcttaagaaaga

SEQ ID NO: 1193927 - DNA, 24 bp, Homo sapiens
taggaggaaacagttctcactggg

SEQ ID NO: 1193928 - DNA, 22 bp, Homo sapiens
taggaggctgcatgctctggaa

SEQ ID NO: 1193929 - DNA, 14 bp, Homo sapiens
taggagggagacac

SEQ ID NO: 1193930 - DNA, 21 bp, Homo sapiens
taggagggggcggcagggctg

SEQ ID NO: 1193931 - DNA, 16 bp, Homo sapiens
taggagggtgggaagg

SEQ ID NO: 1193932 - DNA, 23 bp, Homo sapiens
taggagtctgagcatccatcaat

SEQ ID NO: 1193933 - DNA, 23 bp, Homo sapiens
taggagtgagtgtatgtgtgtgt

SEQ ID NO: 1193934 - DNA, 21 bp, Homo sapiens
taggagtgggtgacaagagcc

SEQ ID NO: 1193935 - DNA, 17 bp, Homo sapiens
taggagtggttctcatt

SEQ ID NO: 1193936 - DNA, 19 bp, Homo sapiens
taggagttctctgatgcag

SEQ ID NO: 1193937 - DNA, 16 bp, Homo sapiens
taggataaaaagccag

SEQ ID NO: 1193938 - DNA, 15 bp, Homo sapiens
taggataatacataa

SEQ ID NO: 1193939 - DNA, 16 bp, Homo sapiens
taggatagacactgga

SEQ ID NO: 1193940 - DNA, 17 bp, Homo sapiens
taggatagacactggac

SEQ ID NO: 1193941 - DNA, 15 bp, Homo sapiens
taggatattgattta

SEQ ID NO: 1193942 - DNA, 21 bp, Homo sapiens
taggatccagtgatccttaca

SEQ ID NO: 1193943 - DNA, 15 bp, Homo sapiens
taggatcctggaggc

SEQ ID NO: 1193944 - DNA, 21 bp, Homo sapiens
taggatgcggctttctctgcc

SEQ ID NO: 1193945 - DNA, 18 bp, Homo sapiens
gagcgctttctggaaaag

SEQ ID NO: 1193946 - DNA, 13 bp, Homo sapiens
gagcgggagggag

SEQ ID NO: 1193947 - DNA, 22 bp, Homo sapiens
gagcgggagggagtctcaggag

SEQ ID NO: 1193948 - DNA, 12 bp, Homo sapiens
gagcgggcaggg

SEQ ID NO: 1193949 - DNA, 18 bp, Homo sapiens
gagcggggctgggaggaa

SEQ ID NO: 1193950 - DNA, 15 bp, Homo sapiens
gagcgtcactgccca

SEQ ID NO: 1193951 - DNA, 23 bp, Homo sapiens
gagcgtcagggttggtgtgctga

SEQ ID NO: 1193952 - DNA, 19 bp, Homo sapiens
gagcgtggaagggggagga

SEQ ID NO: 1193953 - DNA, 13 bp, Homo sapiens
gagcgtggccttg

SEQ ID NO: 1193954 - DNA, 16 bp, Homo sapiens
gagcgtggccttggga

SEQ ID NO: 1193955 - DNA, 17 bp, Homo sapiens
gagcgtggccttgggag

SEQ ID NO: 1193956 - DNA, 18 bp, Homo sapiens
gagcgtggccttgggagg

SEQ ID NO: 1193957 - DNA, 19 bp, Homo sapiens
gagcgtggccttgggagga

SEQ ID NO: 1193958 - DNA, 21 bp, Homo sapiens
gagcgtgtagcgtcctgagga

SEQ ID NO: 1193959 - DNA, 22 bp, Homo sapiens
gagcgtgtagcgtcctgaggaa

SEQ ID NO: 1193960 - DNA, 20 bp, Homo sapiens
gagcgttagactgacttgtt

SEQ ID NO: 1193961 - DNA, 22 bp, Homo sapiens
gagctaaactccttcctggcct

SEQ ID NO: 1193962 - DNA, 21 bp, Homo sapiens
gagctaaattacaattgtcat

SEQ ID NO: 1193963 - DNA, 15 bp, Homo sapiens
gagctaacactggcc

SEQ ID NO: 1193964 - DNA, 19 bp, Homo sapiens
gagctaacactggccccta

SEQ ID NO: 1193965 - DNA, 18 bp, Homo sapiens
gagctaagggtgggtgct

SEQ ID NO: 1193966 - DNA, 13 bp, Homo sapiens
taggcagcctgcc

SEQ ID NO: 1193967 - DNA, 17 bp, Homo sapiens
taggcagcttctaagag

SEQ ID NO: 1193968 - DNA, 17 bp, Homo sapiens
taggcaggaacatacag

SEQ ID NO: 1193969 - DNA, 19 bp, Homo sapiens
taggcaggaacatacagac

SEQ ID NO: 1193970 - DNA, 15 bp, Homo sapiens
taggcaggacctgtg

SEQ ID NO: 1193971 - DNA, 23 bp, Homo sapiens
taggcagggcagggtagtgcagg

SEQ ID NO: 1193972 - DNA, 15 bp, Homo sapiens
taggcagggggccct

SEQ ID NO: 1193973 - DNA, 17 bp, Homo sapiens
taggcagggggccctgc

SEQ ID NO: 1193974 - DNA, 19 bp, Homo sapiens
taggcagggggccctgccc

SEQ ID NO: 1193975 - DNA, 20 bp, Homo sapiens
taggcattaacacaaaggag

SEQ ID NO: 1193976 - DNA, 16 bp, Homo sapiens
taggcattatttaatg

SEQ ID NO: 1193977 - DNA, 20 bp, Homo sapiens
taggcattatttaatgtttg

SEQ ID NO: 1193978 - DNA, 20 bp, Homo sapiens
taggcatttcattatgcttt

SEQ ID NO: 1193979 - DNA, 16 bp, Homo sapiens
taggcatttcctgctg

SEQ ID NO: 1193980 - DNA, 14 bp, Homo sapiens
taggccaaggccca

SEQ ID NO: 1193981 - DNA, 17 bp, Homo sapiens
taggccaaggcccaact

SEQ ID NO: 1193982 - DNA, 21 bp, Homo sapiens
taggccacattgacagtggtg

SEQ ID NO: 1193983 - DNA, 21 bp, Homo sapiens
taggccagggcatgtgtatgt

SEQ ID NO: 1193984 - DNA, 16 bp, Homo sapiens
taggccatctgtaaat

SEQ ID NO: 1193985 - DNA, 20 bp, Homo sapiens
taggccatgaaaaaaatgat

SEQ ID NO: 1193986 - DNA, 13 bp, Homo sapiens
taggcccaggcct

SEQ ID NO: 1193987 - DNA, 21 bp, Homo sapiens
taggcccccacttgcctcttc

SEQ ID NO: 1193988 - DNA, 15 bp, Homo sapiens
taggcccttgtcctg

SEQ ID NO: 1193989 - DNA, 20 bp, Homo sapiens
taggcccttgtcctgccagc

SEQ ID NO: 1193990 - DNA, 21 bp, Homo sapiens
taggcccttgtcctgccagct

SEQ ID NO: 1193991 - DNA, 14 bp, Homo sapiens
taggcctcagccag

SEQ ID NO: 1193992 - DNA, 22 bp, Homo sapiens
taggcctcagccagagaagcta

SEQ ID NO: 1193993 - DNA, 19 bp, Homo sapiens
taggcctcaggtgaaactc

SEQ ID NO: 1193994 - DNA, 20 bp, Homo sapiens
taggcctcatttctttgtct

SEQ ID NO: 1193995 - DNA, 20 bp, Homo sapiens
taggcggcgatttttgtatg

SEQ ID NO: 1193996 - DNA, 16 bp, Homo sapiens
taggcgggaaggaggg

SEQ ID NO: 1193997 - DNA, 18 bp, Homo sapiens
taggcggtcatgtgtgca

SEQ ID NO: 1193998 - DNA, 20 bp, Homo sapiens
taggctacaattttctccca

SEQ ID NO: 1193999 - DNA, 17 bp, Homo sapiens
taggctattaaaaaagt

SEQ ID NO: 1194000 - DNA, 17 bp, Homo sapiens
taggctattcctgagag

SEQ ID NO: 1194001 - DNA, 18 bp, Homo sapiens
taggctatttgtaaatct

SEQ ID NO: 1194002 - DNA, 17 bp, Homo sapiens
taggctcgccttccctc

SEQ ID NO: 1194003 - DNA, 22 bp, Homo sapiens
taggctcgccttccctcctgct

SEQ ID NO: 1194004 - DNA, 18 bp, Homo sapiens
taggctctgcacagatgg

SEQ ID NO: 1194005 - DNA, 15 bp, Homo sapiens
taggctcttaagcag

SEQ ID NO: 1194006 - DNA, 16 bp, Homo sapiens
taggctcttaagcagc

SEQ ID NO: 1194007 - DNA, 19 bp, Homo sapiens
taggctcttaagcagcatg

SEQ ID NO: 1194008 - DNA, 21 bp, Homo sapiens
taggctcttaagcagcatgga

SEQ ID NO: 1194009 - DNA, 15 bp, Homo sapiens
taggctggagaagct

SEQ ID NO: 1194010 - DNA, 21 bp, Homo sapiens
taggctgggcctcccctgggc

SEQ ID NO: 1194011 - DNA, 19 bp, Homo sapiens
taggctgtaactactttat

SEQ ID NO: 1194012 - DNA, 16 bp, Homo sapiens
taggctgtctgtgcca

SEQ ID NO: 1194013 - DNA, 22 bp, Homo sapiens
taggctgtggggtctggctgtg

SEQ ID NO: 1194014 - DNA, 15 bp, Homo sapiens
taggctgttcccttt

SEQ ID NO: 1194015 - DNA, 18 bp, Homo sapiens
taggctgttccctttgcc

SEQ ID NO: 1194016 - DNA, 20 bp, Homo sapiens
taggctgttccctttgcctt

SEQ ID NO: 1194017 - DNA, 13 bp, Homo sapiens
taggcttctatta

SEQ ID NO: 1194018 - DNA, 15 bp, Homo sapiens
taggcttctattacc

SEQ ID NO: 1194019 - DNA, 16 bp, Homo sapiens
taggcttctattacct

SEQ ID NO: 1194020 - DNA, 17 bp, Homo sapiens
taggcttctattaccta

SEQ ID NO: 1194021 - DNA, 20 bp, Homo sapiens
tagggaaaaaccagcgtgtg

SEQ ID NO: 1194022 - DNA, 20 bp, Homo sapiens
tagggaaaatggatatagaa

SEQ ID NO: 1194023 - DNA, 23 bp, Homo sapiens
tagggaaaccttggagaggagag

SEQ ID NO: 1194024 - DNA, 15 bp, Homo sapiens
tagggaactggggaa

SEQ ID NO: 1194025 - DNA, 20 bp, Homo sapiens
tagggaagaaaactatcctg

SEQ ID NO: 1194026 - DNA, 15 bp, Homo sapiens
tagggaagcagggac

SEQ ID NO: 1194027 - DNA, 19 bp, Homo sapiens
tagggaagctggcctgaga

SEQ ID NO: 1194028 - DNA, 21 bp, Homo sapiens
tagggaatgagagttccttct

SEQ ID NO: 1194029 - DNA, 18 bp, Homo sapiens
tagggactatcaggtaat

SEQ ID NO: 1194030 - DNA, 13 bp, Homo sapiens
tagggacttaaaa

SEQ ID NO: 1194031 - DNA, 14 bp, Homo sapiens
tagggacttaaaaa

SEQ ID NO: 1194032 - DNA, 18 bp, Homo sapiens
tagggagaatatttacta

SEQ ID NO: 1194033 - DNA, 16 bp, Homo sapiens
tagggagacagggtag

SEQ ID NO: 1194034 - DNA, 24 bp, Homo sapiens
tagggagagggaagagggagacca

SEQ ID NO: 1194035 - DNA, 18 bp, Homo sapiens
tagggagggcggcagggg

SEQ ID NO: 1194036 - DNA, 20 bp, Homo sapiens
tagggataagaattgtctct

SEQ ID NO: 1194037 - DNA, 23 bp, Homo sapiens
tagggatataaaaacagattctg

SEQ ID NO: 1194038 - DNA, 17 bp, Homo sapiens
tagggatccctcatctg

SEQ ID NO: 1194039 - DNA, 15 bp, Homo sapiens
tagggattcaggctg

SEQ ID NO: 1194040 - DNA, 15 bp, Homo sapiens
tagggcaccaggggt

SEQ ID NO: 1194041 - DNA, 13 bp, Homo sapiens
tagggcactgggc

SEQ ID NO: 1194042 - DNA, 14 bp, Homo sapiens
tagggcactgggct

SEQ ID NO: 1194043 - DNA, 15 bp, Homo sapiens
tagggcactgggctg

SEQ ID NO: 1194044 - DNA, 16 bp, Homo sapiens
tagggccctggaggcg

SEQ ID NO: 1194045 - DNA, 21 bp, Homo sapiens
tagggcctggtccctgggagg

SEQ ID NO: 1194046 - DNA, 14 bp, Homo sapiens
tagggctaaatgtt

SEQ ID NO: 1194047 - DNA, 12 bp, Homo sapiens
tagggctgctgc

SEQ ID NO: 1194048 - DNA, 14 bp, Homo sapiens
tagggctgctgctt

SEQ ID NO: 1194049 - DNA, 15 bp, Homo sapiens
tagggctgctgcttc

SEQ ID NO: 1194050 - DNA, 17 bp, Homo sapiens
tagggctgctgcttctg

SEQ ID NO: 1194051 - DNA, 16 bp, Homo sapiens
tagggctgcttttctt

SEQ ID NO: 1194052 - DNA, 14 bp, Homo sapiens
tagggctggaccta

SEQ ID NO: 1194053 - DNA, 17 bp, Homo sapiens
tagggctggggactggg

SEQ ID NO: 1194054 - DNA, 20 bp, Homo sapiens
tagggctgtagacttacttt

SEQ ID NO: 1194055 - DNA, 15 bp, Homo sapiens
taggggcagcctccg

SEQ ID NO: 1194056 - DNA, 11 bp, Homo sapiens
taggggcaggt

SEQ ID NO: 1194057 - DNA, 12 bp, Homo sapiens
taggggccacct

SEQ ID NO: 1194058 - DNA, 18 bp, Homo sapiens
taggggccacctcctccc

SEQ ID NO: 1194059 - DNA, 21 bp, Homo sapiens
taggggccacctcctccccct

SEQ ID NO: 1194060 - DNA, 17 bp, Homo sapiens
tagggggacggggctga

SEQ ID NO: 1194061 - DNA, 16 bp, Homo sapiens
tagggggtgggagggg

SEQ ID NO: 1194062 - DNA, 17 bp, Homo sapiens
taggggtcaggctccat

SEQ ID NO: 1194063 - DNA, 13 bp, Homo sapiens
taggggtcctggg

SEQ ID NO: 1194064 - DNA, 17 bp, Homo sapiens
taggggtgttgacacac

SEQ ID NO: 1194065 - DNA, 18 bp, Homo sapiens
taggggttgaagaaaaca

SEQ ID NO: 1194066 - DNA, 16 bp, Homo sapiens
tagggtaaatcagtaa

SEQ ID NO: 1194067 - DNA, 13 bp, Homo sapiens
tagggtaagaaga

SEQ ID NO: 1194068 - DNA, 18 bp, Homo sapiens
tagggtagaatgattaat

SEQ ID NO: 1194069 - DNA, 15 bp, Homo sapiens
tagggtatattttcc

SEQ ID NO: 1194070 - DNA, 20 bp, Homo sapiens
tagggtcactttgccattat

SEQ ID NO: 1194071 - DNA, 14 bp, Homo sapiens
tagggtcagccatt

SEQ ID NO: 1194072 - DNA, 15 bp, Homo sapiens
tagggtcggaaccca

SEQ ID NO: 1194073 - DNA, 13 bp, Homo sapiens
gagctgggagaca

SEQ ID NO: 1194074 - DNA, 15 bp, Homo sapiens
gagctgggagccagg

SEQ ID NO: 1194075 - DNA, 14 bp, Homo sapiens
gagctgggaggaaa

SEQ ID NO: 1194076 - DNA, 12 bp, Homo sapiens
gagctgggccca

SEQ ID NO: 1194077 - DNA, 13 bp, Homo sapiens
gagctgggcccag

SEQ ID NO: 1194078 - DNA, 14 bp, Homo sapiens
gagctgggcccagc

SEQ ID NO: 1194079 - DNA, 22 bp, Homo sapiens
gagctgggcccagcccctccac

SEQ ID NO: 1194080 - DNA, 15 bp, Homo sapiens
gagctgggcccctgc

SEQ ID NO: 1194081 - DNA, 19 bp, Homo sapiens
gagctgggcccctgcacag

SEQ ID NO: 1194082 - DNA, 22 bp, Homo sapiens
gagctgggcccctgcacaggca

SEQ ID NO: 1194083 - DNA, 19 bp, Homo sapiens
gagctggggacctggtacc

SEQ ID NO: 1194084 - DNA, 17 bp, Homo sapiens
gagctggggaggtggga

SEQ ID NO: 1194085 - DNA, 24 bp, Homo sapiens
gagctggggaggtgggaggccagg

SEQ ID NO: 1194086 - DNA, 14 bp, Homo sapiens
gagctggggccaca

SEQ ID NO: 1194087 - DNA, 18 bp, Homo sapiens
gagctggggctgccagcc

SEQ ID NO: 1194088 - DNA, 15 bp, Homo sapiens
taggtatgaataagt

SEQ ID NO: 1194089 - DNA, 16 bp, Homo sapiens
taggtatttaagactg

SEQ ID NO: 1194090 - DNA, 17 bp, Homo sapiens
taggtatttaagactga

SEQ ID NO: 1194091 - DNA, 14 bp, Homo sapiens
taggtatttcaaaa

SEQ ID NO: 1194092 - DNA, 21 bp, Homo sapiens
taggtatttctaacgccagca

SEQ ID NO: 1194093 - DNA, 16 bp, Homo sapiens
taggtcaaactcccta

SEQ ID NO: 1194094 - DNA, 15 bp, Homo sapiens
taggtcaagtaataa

SEQ ID NO: 1194095 - DNA, 20 bp, Homo sapiens
taggtcaagtaataaaaaga

SEQ ID NO: 1194096 - DNA, 12 bp, Homo sapiens
taggtcactggc

SEQ ID NO: 1194097 - DNA, 14 bp, Homo sapiens
taggtcactggctc

SEQ ID NO: 1194098 - DNA, 19 bp, Homo sapiens
taggtcactggctctccaa

SEQ ID NO: 1194099 - DNA, 20 bp, Homo sapiens
taggtcactggctctccaag

SEQ ID NO: 1194100 - DNA, 21 bp, Homo sapiens
taggtcactggctctccaagt

SEQ ID NO: 1194101 - DNA, 24 bp, Homo sapiens
taggtcactggctctccaagtgcc

SEQ ID NO: 1194102 - DNA, 13 bp, Homo sapiens
taggtcagatgga

SEQ ID NO: 1194103 - DNA, 18 bp, Homo sapiens
taggtcagtctaacagtt

SEQ ID NO: 1194104 - DNA, 23 bp, Homo sapiens
taggtcccaattcggggcctgct

SEQ ID NO: 1194105 - DNA, 12 bp, Homo sapiens
taggtcctcact

SEQ ID NO: 1194106 - DNA, 19 bp, Homo sapiens
taggtcgttttccaaagag

SEQ ID NO: 1194107 - DNA, 13 bp, Homo sapiens
taggtctcatctc

SEQ ID NO: 1194108 - DNA, 18 bp, Homo sapiens
taggtctcatctcttcag

SEQ ID NO: 1194109 - DNA, 15 bp, Homo sapiens
taggtctcctcaggg

SEQ ID NO: 1194110 - DNA, 16 bp, Homo sapiens
taggtctcctcagggt

SEQ ID NO: 1194111 - DNA, 21 bp, Homo sapiens
taggtctcctcagggtggggg

SEQ ID NO: 1194112 - DNA, 14 bp, Homo sapiens
taggtctgaaattt

SEQ ID NO: 1194113 - DNA, 17 bp, Homo sapiens
taggtctgatattcaaa

SEQ ID NO: 1194114 - DNA, 15 bp, Homo sapiens
taggtctttctctca

SEQ ID NO: 1194115 - DNA, 19 bp, Homo sapiens
taggtctttctctcagtga

SEQ ID NO: 1194116 - DNA, 13 bp, Homo sapiens
taggtgacatata

SEQ ID NO: 1194117 - DNA, 23 bp, Homo sapiens
taggtgacatgtctactttttaa

SEQ ID NO: 1194118 - DNA, 12 bp, Homo sapiens
taggtgagcctg

SEQ ID NO: 1194119 - DNA, 16 bp, Homo sapiens
taggtgatgggcagat

SEQ ID NO: 1194120 - DNA, 15 bp, Homo sapiens
taggtgccaggctgt

SEQ ID NO: 1194121 - DNA, 23 bp, Homo sapiens
taggtgggccagcccctcccacc

SEQ ID NO: 1194122 - DNA, 18 bp, Homo sapiens
taggtgtaaatgagaaga

SEQ ID NO: 1194123 - DNA, 14 bp, Homo sapiens
taggtgtccccaac

SEQ ID NO: 1194124 - DNA, 14 bp, Homo sapiens
taggtgtctctggg

SEQ ID NO: 1194125 - DNA, 15 bp, Homo sapiens
taggtgtctctgggc

SEQ ID NO: 1194126 - DNA, 19 bp, Homo sapiens
taggtgtctctgggcctgt

SEQ ID NO: 1194127 - DNA, 21 bp, Homo sapiens
taggtgtctctgggcctgtgt

SEQ ID NO: 1194128 - DNA, 17 bp, Homo sapiens
taggtgtgggggaagca

SEQ ID NO: 1194129 - DNA, 17 bp, Homo sapiens
taggttaaagctaaact

SEQ ID NO: 1194130 - DNA, 18 bp, Homo sapiens
taggttaaagctaaactg

SEQ ID NO: 1194131 - DNA, 21 bp, Homo sapiens
taggttccccagagagcaggc

SEQ ID NO: 1194132 - DNA, 15 bp, Homo sapiens
taggttcccctgtca

SEQ ID NO: 1194133 - DNA, 21 bp, Homo sapiens
taggttccctgttcttcctcc

SEQ ID NO: 1194134 - DNA, 22 bp, Homo sapiens
taggttccctgttcttcctcca

SEQ ID NO: 1194135 - DNA, 15 bp, Homo sapiens
taggtttctctccct

SEQ ID NO: 1194136 - DNA, 15 bp, Homo sapiens
taggtttttattagt

SEQ ID NO: 1194137 - DNA, 20 bp, Homo sapiens
taggtttttctcatgtatct

SEQ ID NO: 1194138 - DNA, 19 bp, Homo sapiens
tagtaaaatgcttacagga

SEQ ID NO: 1194139 - DNA, 14 bp, Homo sapiens
tagtaaacatatgt

SEQ ID NO: 1194140 - DNA, 17 bp, Homo sapiens
tagtaaacatatgttcc

SEQ ID NO: 1194141 - DNA, 21 bp, Homo sapiens
tagtaaacattaagtaaatgc

SEQ ID NO: 1194142 - DNA, 21 bp, Homo sapiens
tagtaaatcacgctttttgaa

SEQ ID NO: 1194143 - DNA, 11 bp, Homo sapiens
tagtaaatgtg

SEQ ID NO: 1194144 - DNA, 18 bp, Homo sapiens
tagtaacttcttatggaa

SEQ ID NO: 1194145 - DNA, 17 bp, Homo sapiens
tagtaagatgcactgaa

SEQ ID NO: 1194146 - DNA, 16 bp, Homo sapiens
tagtaagcatctactt

SEQ ID NO: 1194147 - DNA, 15 bp, Homo sapiens
tagtaagttaatgta

SEQ ID NO: 1194148 - DNA, 23 bp, Homo sapiens
tagtaagttaatgtatataaaaa

SEQ ID NO: 1194149 - DNA, 22 bp, Homo sapiens
tagtaatagtccaatatttggc

SEQ ID NO: 1194150 - DNA, 14 bp, Homo sapiens
tagtaatcacagtt

SEQ ID NO: 1194151 - DNA, 17 bp, Homo sapiens
tagtaatctgcattatt

SEQ ID NO: 1194152 - DNA, 15 bp, Homo sapiens
tagtaatgttttata

SEQ ID NO: 1194153 - DNA, 13 bp, Homo sapiens
tagtaatttcctt

SEQ ID NO: 1194154 - DNA, 14 bp, Homo sapiens
tagtaatttctttt

SEQ ID NO: 1194155 - DNA, 20 bp, Homo sapiens
tagtaatttctttttttcct

SEQ ID NO: 1194156 - DNA, 21 bp, Homo sapiens
tagtaatttctttttttcctt

SEQ ID NO: 1194157 - DNA, 18 bp, Homo sapiens
tagtacataattgattaa

SEQ ID NO: 1194158 - DNA, 18 bp, Homo sapiens
tagtaccatttatacaaa

SEQ ID NO: 1194159 - DNA, 19 bp, Homo sapiens
tagtaccatttatacaaat

SEQ ID NO: 1194160 - DNA, 20 bp, Homo sapiens
tagtaccatttatacaaatt

SEQ ID NO: 1194161 - DNA, 23 bp, Homo sapiens
tagtactagagatattttgtaaa

SEQ ID NO: 1194162 - DNA, 17 bp, Homo sapiens
tagtactccttaagaac

SEQ ID NO: 1194163 - DNA, 15 bp, Homo sapiens
tagtactgctcttgt

SEQ ID NO: 1194164 - DNA, 15 bp, Homo sapiens
tagtactgtattggc

SEQ ID NO: 1194165 - DNA, 18 bp, Homo sapiens
tagtacttcttctgtaat

SEQ ID NO: 1194166 - DNA, 21 bp, Homo sapiens
tagtagaaagacatctgcctg

SEQ ID NO: 1194167 - DNA, 20 bp, Homo sapiens
tagtagaaattttacaatag

SEQ ID NO: 1194168 - DNA, 20 bp, Homo sapiens
tagtagaactggatcccaac

SEQ ID NO: 1194169 - DNA, 12 bp, Homo sapiens
tagtagatttct

SEQ ID NO: 1194170 - DNA, 14 bp, Homo sapiens
tagtagcatgttga

SEQ ID NO: 1194171 - DNA, 22 bp, Homo sapiens
tagtagcccttcagtcttaata

SEQ ID NO: 1194172 - DNA, 16 bp, Homo sapiens
tagtagccctttctgt

SEQ ID NO: 1194173 - DNA, 18 bp, Homo sapiens
tagtagccctttctgtgt

SEQ ID NO: 1194174 - DNA, 18 bp, Homo sapiens
tagtaggggttgaagaaa

SEQ ID NO: 1194175 - DNA, 22 bp, Homo sapiens
tagtagtcaaaaacaaagctga

SEQ ID NO: 1194176 - DNA, 23 bp, Homo sapiens
tagtagtcaaaaacaaagctgat

SEQ ID NO: 1194177 - DNA, 20 bp, Homo sapiens
tagtagttaaataactgtgt

SEQ ID NO: 1194178 - DNA, 14 bp, Homo sapiens
tagtagtttgggtg

SEQ ID NO: 1194179 - DNA, 14 bp, Homo sapiens
tagtataaagaaaa

SEQ ID NO: 1194180 - DNA, 17 bp, Homo sapiens
tagtatacgtataaata

SEQ ID NO: 1194181 - DNA, 16 bp, Homo sapiens
tagtatatctggacaa

SEQ ID NO: 1194182 - DNA, 14 bp, Homo sapiens
tagtatccacagga

SEQ ID NO: 1194183 - DNA, 18 bp, Homo sapiens
tagtatgaggcatttgtt

SEQ ID NO: 1194184 - DNA, 18 bp, Homo sapiens
tagtatgcagttgataag

SEQ ID NO: 1194185 - DNA, 17 bp, Homo sapiens
tagtatgggaaaaaaac

SEQ ID NO: 1194186 - DNA, 20 bp, Homo sapiens
tagtatgggaaaaaaactga

SEQ ID NO: 1194187 - DNA, 21 bp, Homo sapiens
tagtatgggaaaaaaactgaa

SEQ ID NO: 1194188 - DNA, 22 bp, Homo sapiens
tagtatgggaaaaaaactgaag

SEQ ID NO: 1194189 - DNA, 15 bp, Homo sapiens
tagtatggttctcag

SEQ ID NO: 1194190 - DNA, 14 bp, Homo sapiens
tagtatgtctgttt

SEQ ID NO: 1194191 - DNA, 20 bp, Homo sapiens
tagtatgtctgtttttgtat

SEQ ID NO: 1194192 - DNA, 23 bp, Homo sapiens
tagtattatcttgttcaggaaaa

SEQ ID NO: 1194193 - DNA, 14 bp, Homo sapiens
tagtattcaggcac

SEQ ID NO: 1194194 - DNA, 23 bp, Homo sapiens
tagtattcaggcactgagaatga

SEQ ID NO: 1194195 - DNA, 20 bp, Homo sapiens
tagtattcttgagggacaat

SEQ ID NO: 1194196 - DNA, 13 bp, Homo sapiens
tagtattgttgtc

SEQ ID NO: 1194197 - DNA, 17 bp, Homo sapiens
tagtattgttgtccttt

SEQ ID NO: 1194198 - DNA, 18 bp, Homo sapiens
tagtatttaactacatct

SEQ ID NO: 1194199 - DNA, 22 bp, Homo sapiens
tagtatttaactacatctgcct

SEQ ID NO: 1194200 - DNA, 20 bp, Homo sapiens
gaggacacaatggcacctct

SEQ ID NO: 1194201 - DNA, 13 bp, Homo sapiens
gaggacacagaga

SEQ ID NO: 1194202 - DNA, 17 bp, Homo sapiens
gaggacacagcacaagg

SEQ ID NO: 1194203 - DNA, 22 bp, Homo sapiens
gaggacacagcacaagggcaca

SEQ ID NO: 1194204 - DNA, 23 bp, Homo sapiens
gaggacacagcacaagggcacat

SEQ ID NO: 1194205 - DNA, 18 bp, Homo sapiens
gaggacagacggccggcc

SEQ ID NO: 1194206 - DNA, 13 bp, Homo sapiens
gaggacaggcagg

SEQ ID NO: 1194207 - DNA, 15 bp, Homo sapiens
gaggacaggcaggcc

SEQ ID NO: 1194208 - DNA, 16 bp, Homo sapiens
gaggacaggcaggcca

SEQ ID NO: 1194209 - DNA, 18 bp, Homo sapiens
gaggacaggcaggccaga

SEQ ID NO: 1194210 - DNA, 17 bp, Homo sapiens
gaggcaaattaactgta

SEQ ID NO: 1194211 - DNA, 20 bp, Homo sapiens
gaggcaaccccctcggagcc

SEQ ID NO: 1194212 - DNA, 13 bp, Homo sapiens
gaggcaagagaat

SEQ ID NO: 1194213 - DNA, 22 bp, Homo sapiens
gaggcaagagggaggggacaga

SEQ ID NO: 1194214 - DNA, 13 bp, Homo sapiens
gaggcaagccctg

SEQ ID NO: 1194215 - DNA, 19 bp, Homo sapiens
gaggcaccagctctgtggc

SEQ ID NO: 1194216 - DNA, 20 bp, Homo sapiens
gaggcaccagctctgtggcc

SEQ ID NO: 1194217 - DNA, 23 bp, Homo sapiens
gaggcaccagctctgtggcctgt

SEQ ID NO: 1194218 - DNA, 16 bp, Homo sapiens
gaggcaccggcgctgc

SEQ ID NO: 1194219 - DNA, 18 bp, Homo sapiens
gaggcaccggcgctgcag

SEQ ID NO: 1194220 - DNA, 20 bp, Homo sapiens
gaggcaccggcgctgcaggt

SEQ ID NO: 1194221 - DNA, 13 bp, Homo sapiens
gaggcacctccag

SEQ ID NO: 1194222 - DNA, 14 bp, Homo sapiens
gaggcacctccagg

SEQ ID NO: 1194223 - DNA, 15 bp, Homo sapiens
gaggcacctccaggc

SEQ ID NO: 1194224 - DNA, 17 bp, Homo sapiens
gaggcacctccaggcag

SEQ ID NO: 1194225 - DNA, 20 bp, Homo sapiens
gaggcacctccaggcaggcc

SEQ ID NO: 1194226 - DNA, 22 bp, Homo sapiens
gaggcacctccaggcaggccag

SEQ ID NO: 1194227 - DNA, 21 bp, Homo sapiens
gaggcactagtcaccgacagc

SEQ ID NO: 1194228 - DNA, 12 bp, Homo sapiens
gaggcagacagc

SEQ ID NO: 1194229 - DNA, 20 bp, Homo sapiens
gaggcagacagcagctcagg

SEQ ID NO: 1194230 - DNA, 22 bp, Homo sapiens
gaggcagacagcagctcaggca

SEQ ID NO: 1194231 - DNA, 22 bp, Homo sapiens
gaggcagacttccctgaatgta

SEQ ID NO: 1194232 - DNA, 17 bp, Homo sapiens
gaggcagagaaagaaga

SEQ ID NO: 1194233 - DNA, 21 bp, Homo sapiens
gaggcagagaaagaagagaca

SEQ ID NO: 1194234 - DNA, 18 bp, Homo sapiens
gaggcagagaatctcttg

SEQ ID NO: 1194235 - DNA, 19 bp, Homo sapiens
gaggcagagacctccaata

SEQ ID NO: 1194236 - DNA, 18 bp, Homo sapiens
gaggcagagcgggaggga

SEQ ID NO: 1194237 - DNA, 13 bp, Homo sapiens
gaggcagcagagc

SEQ ID NO: 1194238 - DNA, 12 bp, Homo sapiens
gaggcagccagg

SEQ ID NO: 1194239 - DNA, 21 bp, Homo sapiens
gaggcagcgtgaaagcagatg

SEQ ID NO: 1194240 - DNA, 18 bp, Homo sapiens
gaggcaggaatgggggtc

SEQ ID NO: 1194241 - DNA, 19 bp, Homo sapiens
gaggcaggaatgggggtca

SEQ ID NO: 1194242 - DNA, 20 bp, Homo sapiens
gaggcaggagaattgctgga

SEQ ID NO: 1194243 - DNA, 17 bp, Homo sapiens
gaggcaggcattcctga

SEQ ID NO: 1194244 - DNA, 15 bp, Homo sapiens
gaggcagggagggga

SEQ ID NO: 1194245 - DNA, 15 bp, Homo sapiens
gaggcagggctctcc

SEQ ID NO: 1194246 - DNA, 17 bp, Homo sapiens
gaggcagggctctcccg

SEQ ID NO: 1194247 - DNA, 13 bp, Homo sapiens
gaggcagggctgg

SEQ ID NO: 1194248 - DNA, 14 bp, Homo sapiens
gaggcagggctgga

SEQ ID NO: 1194249 - DNA, 13 bp, Homo sapiens
gaggcaggggctg

SEQ ID NO: 1194250 - DNA, 21 bp, Homo sapiens
gaggcagtgctgatccggctg

SEQ ID NO: 1194251 - DNA, 18 bp, Homo sapiens
gaggcatacacacagcag

SEQ ID NO: 1194252 - DNA, 17 bp, Homo sapiens
gaggcatggcaattctg

SEQ ID NO: 1194253 - DNA, 16 bp, Homo sapiens
gaggcatgggtgagca

SEQ ID NO: 1194254 - DNA, 13 bp, Homo sapiens
gaggcatggtgtg

SEQ ID NO: 1194255 - DNA, 18 bp, Homo sapiens
gaggcattcggggaagct

SEQ ID NO: 1194256 - DNA, 19 bp, Homo sapiens
gaggccaaaggctggtggc

SEQ ID NO: 1194257 - DNA, 12 bp, Homo sapiens
gaggccaaggca

SEQ ID NO: 1194258 - DNA, 13 bp, Homo sapiens
gaggccaaggtgg

SEQ ID NO: 1194259 - DNA, 16 bp, Homo sapiens
gaggccaataaaaagt

SEQ ID NO: 1194260 - DNA, 19 bp, Homo sapiens
gaggccaataaaaagttca

SEQ ID NO: 1194261 - DNA, 13 bp, Homo sapiens
gaggccaccccaa

SEQ ID NO: 1194262 - DNA, 22 bp, Homo sapiens
gaggccaccccaaaccccagcc

SEQ ID NO: 1194263 - DNA, 23 bp, Homo sapiens
gaggccaccccaaaccccagccc

SEQ ID NO: 1194264 - DNA, 16 bp, Homo sapiens
gaggccacctctccaa

SEQ ID NO: 1194265 - DNA, 16 bp, Homo sapiens
gaggccacttagggaa

SEQ ID NO: 1194266 - DNA, 12 bp, Homo sapiens
gaggccagacca

SEQ ID NO: 1194267 - DNA, 11 bp, Homo sapiens
gaggccagagt

SEQ ID NO: 1194268 - DNA, 22 bp, Homo sapiens
gaggccagagtctcccagtggg

SEQ ID NO: 1194269 - DNA, 16 bp, Homo sapiens
gaggccagccccaccc

SEQ ID NO: 1194270 - DNA, 12 bp, Homo sapiens
gaggccaggagt

SEQ ID NO: 1194271 - DNA, 19 bp, Homo sapiens
gaggccagtgttgtgggct

SEQ ID NO: 1194272 - DNA, 14 bp, Homo sapiens
gaggccatcagggc

SEQ ID NO: 1194273 - DNA, 15 bp, Homo sapiens
gaggccatctcagga

SEQ ID NO: 1194274 - DNA, 19 bp, Homo sapiens
gaggccattgtgtgagcct

SEQ ID NO: 1194275 - DNA, 18 bp, Homo sapiens
gaggcccaagagccctgt

SEQ ID NO: 1194276 - DNA, 15 bp, Homo sapiens
gaggcccaaggagct

SEQ ID NO: 1194277 - DNA, 15 bp, Homo sapiens
gaggcccactagagg

SEQ ID NO: 1194278 - DNA, 17 bp, Homo sapiens
gaggcccactagagggc

SEQ ID NO: 1194279 - DNA, 16 bp, Homo sapiens
gaggcccagccgcagg

SEQ ID NO: 1194280 - DNA, 15 bp, Homo sapiens
gaggcccagcctgtc

SEQ ID NO: 1194281 - DNA, 21 bp, Homo sapiens
gaggcccagcctgtcctggta

SEQ ID NO: 1194282 - DNA, 12 bp, Homo sapiens
gaggcccaggca

SEQ ID NO: 1194283 - DNA, 18 bp, Homo sapiens
gaggcccaggcaccacca

SEQ ID NO: 1194284 - DNA, 15 bp, Homo sapiens
gaggcccccagccca

SEQ ID NO: 1194285 - DNA, 14 bp, Homo sapiens
gaggcccccagtgg

SEQ ID NO: 1194286 - DNA, 19 bp, Homo sapiens
gaggcccccagtggggaca

SEQ ID NO: 1194287 - DNA, 18 bp, Homo sapiens
gaggcccccgtcagggag

SEQ ID NO: 1194288 - DNA, 17 bp, Homo sapiens
gaggcccctggagccag

SEQ ID NO: 1194289 - DNA, 15 bp, Homo sapiens
gaggcccctggccca

SEQ ID NO: 1194290 - DNA, 20 bp, Homo sapiens
gaggcccctgggtccttcta

SEQ ID NO: 1194291 - DNA, 17 bp, Homo sapiens
gaggccctcctgtgctg

SEQ ID NO: 1194292 - DNA, 23 bp, Homo sapiens
gaggccctgaagcctccgtggaa

SEQ ID NO: 1194293 - DNA, 15 bp, Homo sapiens
gaggccctgccacgt

SEQ ID NO: 1194294 - DNA, 23 bp, Homo sapiens
gaggccctgccacgtcccgctgc

SEQ ID NO: 1194295 - DNA, 13 bp, Homo sapiens
gaggccctgcctg

SEQ ID NO: 1194296 - DNA, 13 bp, Homo sapiens
gaggccctgggct

SEQ ID NO: 1194297 - DNA, 16 bp, Homo sapiens
gaggccctggtgtcag

SEQ ID NO: 1194298 - DNA, 21 bp, Homo sapiens
gaggccctggtgtcaggcagg

SEQ ID NO: 1194299 - DNA, 18 bp, Homo sapiens
gaggccgaggtgggcaga

SEQ ID NO: 1194300 - DNA, 16 bp, Homo sapiens
gaggccgcggcctccc

SEQ ID NO: 1194301 - DNA, 15 bp, Homo sapiens
gaggccgctagaggc

SEQ ID NO: 1194302 - DNA, 17 bp, Homo sapiens
gaggccgcttagtgctg

SEQ ID NO: 1194303 - DNA, 14 bp, Homo sapiens
gaggcctacagagg

SEQ ID NO: 1194304 - DNA, 21 bp, Homo sapiens
gaggcctcagtggactttcca

SEQ ID NO: 1194305 - DNA, 14 bp, Homo sapiens
gaggcctcatccct

SEQ ID NO: 1194306 - DNA, 15 bp, Homo sapiens
gaggcctctctcagg

SEQ ID NO: 1194307 - DNA, 21 bp, Homo sapiens
gaggcctctctcaggagcagg

SEQ ID NO: 1194308 - DNA, 22 bp, Homo sapiens
gaggcctctctcaggagcaggg

SEQ ID NO: 1194309 - DNA, 13 bp, Homo sapiens
gaggcctctggcc

SEQ ID NO: 1194310 - DNA, 19 bp, Homo sapiens
gaggcctcttggacctctg

SEQ ID NO: 1194311 - DNA, 20 bp, Homo sapiens
gaggcctgaagccagctgcc

SEQ ID NO: 1194312 - DNA, 14 bp, Homo sapiens
gaggcctgatgctg

SEQ ID NO: 1194313 - DNA, 18 bp, Homo sapiens
gaggcctgatgctgcccc

SEQ ID NO: 1194314 - DNA, 21 bp, Homo sapiens
gaggcctgcaaaccttcctgg

SEQ ID NO: 1194315 - DNA, 18 bp, Homo sapiens
gaggcctgccccctgggc

SEQ ID NO: 1194316 - DNA, 12 bp, Homo sapiens
gaggcctggacc

SEQ ID NO: 1194317 - DNA, 13 bp, Homo sapiens
gaggcctggccag

SEQ ID NO: 1194318 - DNA, 14 bp, Homo sapiens
gaggcctggccagg

SEQ ID NO: 1194319 - DNA, 14 bp, Homo sapiens
gaggcctgggccgc

SEQ ID NO: 1194320 - DNA, 16 bp, Homo sapiens
gaggcctgggccgctg

SEQ ID NO: 1194321 - DNA, 21 bp, Homo sapiens
gaggcctgggccgctgccacg

SEQ ID NO: 1194322 - DNA, 18 bp, Homo sapiens
gaggcctgggctgggaaa

SEQ ID NO: 1194323 - DNA, 18 bp, Homo sapiens
gaggcctgggggacccct

SEQ ID NO: 1194324 - DNA, 21 bp, Homo sapiens
gaggcctggggtgggacaggg

SEQ ID NO: 1194325 - DNA, 16 bp, Homo sapiens
gaggccttccagctgc

SEQ ID NO: 1194326 - DNA, 17 bp, Homo sapiens
gaggccttggggtgggg

SEQ ID NO: 1194327 - DNA, 19 bp, Homo sapiens
gaggccttggggtgggggc

SEQ ID NO: 1194328 - DNA, 22 bp, Homo sapiens
gaggccttggggtgggggccag

SEQ ID NO: 1194329 - DNA, 23 bp, Homo sapiens
gaggccttggggtgggggccagg

SEQ ID NO: 1194330 - DNA, 19 bp, Homo sapiens
gaggccttgtcatcctccc

SEQ ID NO: 1194331 - DNA, 19 bp, Homo sapiens
tagtgtgaatattccttta

SEQ ID NO: 1194332 - DNA, 15 bp, Homo sapiens
tagttttttcatctt

SEQ ID NO: 1194333 - DNA, 22 bp, Homo sapiens
gaggccttgtgtgtcaggccct

SEQ ID NO: 1194334 - DNA, 21 bp, Homo sapiens
gaggcgcagggacatggggca

SEQ ID NO: 1194335 - DNA, 14 bp, Homo sapiens
gaggcgcgtctgcc

SEQ ID NO: 1194336 - DNA, 20 bp, Homo sapiens
gaggcggaccttgtagtgag

SEQ ID NO: 1194337 - DNA, 13 bp, Homo sapiens
gaggcggaggctg

SEQ ID NO: 1194338 - DNA, 18 bp, Homo sapiens
gaggcggaggctgtgctc

SEQ ID NO: 1194339 - DNA, 13 bp, Homo sapiens
gaggcggcagctc

SEQ ID NO: 1194340 - DNA, 14 bp, Homo sapiens
gaggcgggccagcc

SEQ ID NO: 1194341 - DNA, 16 bp, Homo sapiens
gaggcgggccagccag

SEQ ID NO: 1194342 - DNA, 13 bp, Homo sapiens
gaggcggggagga

SEQ ID NO: 1194343 - DNA, 22 bp, Homo sapiens
gaggcgtcttcatctccctgcc

SEQ ID NO: 1194344 - DNA, 23 bp, Homo sapiens
gaggcgtcttcatctccctgcca

SEQ ID NO: 1194345 - DNA, 21 bp, Homo sapiens
gaggcgtgcccccctcctcca

SEQ ID NO: 1194346 - DNA, 16 bp, Homo sapiens
gaggcgtggaggagag

SEQ ID NO: 1194347 - DNA, 18 bp, Homo sapiens
gaggcgtggaggagagga

SEQ ID NO: 1194348 - DNA, 17 bp, Homo sapiens
gaggcgtgtgcaggccg

SEQ ID NO: 1194349 - DNA, 23 bp, Homo sapiens
gaggctacaggggttagcctgga

SEQ ID NO: 1194350 - DNA, 22 bp, Homo sapiens
gaggctaggtgggttgaaagcc

SEQ ID NO: 1194351 - DNA, 10 bp, Homo sapiens
gaggctcagg

SEQ ID NO: 1194352 - DNA, 12 bp, Homo sapiens
gaggctcaggtc

SEQ ID NO: 1194353 - DNA, 13 bp, Homo sapiens
gaggctccccgcc

SEQ ID NO: 1194354 - DNA, 21 bp, Homo sapiens
gaggctccccgcctccactct

SEQ ID NO: 1194355 - DNA, 13 bp, Homo sapiens
gaggctccggccc

SEQ ID NO: 1194356 - DNA, 21 bp, Homo sapiens
gaggctgacacagaggctggc

SEQ ID NO: 1194357 - DNA, 19 bp, Homo sapiens
gaggctgacgtgtgaggga

SEQ ID NO: 1194358 - DNA, 13 bp, Homo sapiens
gaggctgagaaat

SEQ ID NO: 1194359 - DNA, 20 bp, Homo sapiens
gaggctgagaaatgcagaga

SEQ ID NO: 1194360 - DNA, 14 bp, Homo sapiens
gaggctgagacagg

SEQ ID NO: 1194361 - DNA, 12 bp, Homo sapiens
gaggctgaggca

SEQ ID NO: 1194362 - DNA, 18 bp, Homo sapiens
gaggctgaggcagaagaa

SEQ ID NO: 1194363 - DNA, 14 bp, Homo sapiens
gaggctgaggcagg

SEQ ID NO: 1194364 - DNA, 16 bp, Homo sapiens
gaggctgaggcaggag

SEQ ID NO: 1194365 - DNA, 18 bp, Homo sapiens
gaggctgaggcaggagac

SEQ ID NO: 1194366 - DNA, 14 bp, Homo sapiens
gaggctgaggcctg

SEQ ID NO: 1194367 - DNA, 19 bp, Homo sapiens
gaggctgaggctggcacag

SEQ ID NO: 1194368 - DNA, 20 bp, Homo sapiens
gaggctgaggctggcacagg

SEQ ID NO: 1194369 - DNA, 18 bp, Homo sapiens
gaggctgaggtgggcaga

SEQ ID NO: 1194370 - DNA, 19 bp, Homo sapiens
gaggctgcacccctgggcc

SEQ ID NO: 1194371 - DNA, 22 bp, Homo sapiens
gaggctgcactggagccacagg

SEQ ID NO: 1194372 - DNA, 20 bp, Homo sapiens
gaggctgcagaaggccaaga

SEQ ID NO: 1194373 - DNA, 16 bp, Homo sapiens
gaggctgcagagctga

SEQ ID NO: 1194374 - DNA, 11 bp, Homo sapiens
gaggctgcagc

SEQ ID NO: 1194375 - DNA, 13 bp, Homo sapiens
gaggctgcagcag

SEQ ID NO: 1194376 - DNA, 14 bp, Homo sapiens
gaggctgcagcagg

SEQ ID NO: 1194377 - DNA, 20 bp, Homo sapiens
gaggctgcagcaggtgctgg

SEQ ID NO: 1194378 - DNA, 14 bp, Homo sapiens
gaggctgcagtcag

SEQ ID NO: 1194379 - DNA, 19 bp, Homo sapiens
gaggctgcatgctctggaa

SEQ ID NO: 1194380 - DNA, 13 bp, Homo sapiens
gaggctgccccag

SEQ ID NO: 1194381 - DNA, 15 bp, Homo sapiens
gaggctgccccaggc

SEQ ID NO: 1194382 - DNA, 19 bp, Homo sapiens
gaggctgcccccatccagc

SEQ ID NO: 1194383 - DNA, 15 bp, Homo sapiens
gaggctgcccctctc

SEQ ID NO: 1194384 - DNA, 23 bp, Homo sapiens
gaggctgccgagacagaccctct

SEQ ID NO: 1194385 - DNA, 14 bp, Homo sapiens
gaggctgcctctcc

SEQ ID NO: 1194386 - DNA, 18 bp, Homo sapiens
gaggctgcctgctgtgct

SEQ ID NO: 1194387 - DNA, 15 bp, Homo sapiens
gaggctggaggcagg

SEQ ID NO: 1194388 - DNA, 16 bp, Homo sapiens
gaggctggaggcaggg

SEQ ID NO: 1194389 - DNA, 18 bp, Homo sapiens
gaggctggaggcagggcc

SEQ ID NO: 1194390 - DNA, 19 bp, Homo sapiens
gaggctggaggcagggcct

SEQ ID NO: 1194391 - DNA, 13 bp, Homo sapiens
gaggctggcaggt

SEQ ID NO: 1194392 - DNA, 21 bp, Homo sapiens
gaggctggccaaggtgtccag

SEQ ID NO: 1194393 - DNA, 18 bp, Homo sapiens
gaggctggcctctacatc

SEQ ID NO: 1194394 - DNA, 15 bp, Homo sapiens
gaggctgggagtccc

SEQ ID NO: 1194395 - DNA, 19 bp, Homo sapiens
gaggctgggcccctgggat

SEQ ID NO: 1194396 - DNA, 22 bp, Homo sapiens
gaggctggggccccatcttgat

SEQ ID NO: 1194397 - DNA, 20 bp, Homo sapiens
gaggctggtgctgtggccag

SEQ ID NO: 1194398 - DNA, 23 bp, Homo sapiens
gaggctgtcagtgtatggggcag

SEQ ID NO: 1194399 - DNA, 13 bp, Homo sapiens
gaggctgtctggg

SEQ ID NO: 1194400 - DNA, 15 bp, Homo sapiens
gaggctgtgtctctg

SEQ ID NO: 1194401 - DNA, 17 bp, Homo sapiens
gaggctgtgtgcctggg

SEQ ID NO: 1194402 - DNA, 20 bp, Homo sapiens
gaggctgtgtgcctggggga

SEQ ID NO: 1194403 - DNA, 22 bp, Homo sapiens
gaggcttagagagaggaggcag

SEQ ID NO: 1194404 - DNA, 18 bp, Homo sapiens
gaggcttcacgccgggag

SEQ ID NO: 1194405 - DNA, 21 bp, Homo sapiens
gaggcttccagagagtcctct

SEQ ID NO: 1194406 - DNA, 21 bp, Homo sapiens
gaggcttccaggctcttcctg

SEQ ID NO: 1194407 - DNA, 21 bp, Homo sapiens
gaggcttcctgcgtcctcctc

SEQ ID NO: 1194408 - DNA, 18 bp, Homo sapiens
gaggcttcggagtttctt

SEQ ID NO: 1194409 - DNA, 19 bp, Homo sapiens
gaggcttctccgccagcct

SEQ ID NO: 1194410 - DNA, 14 bp, Homo sapiens
gaggcttctccttc

SEQ ID NO: 1194411 - DNA, 22 bp, Homo sapiens
gaggcttcttcagatcagtgct

SEQ ID NO: 1194412 - DNA, 18 bp, Homo sapiens
gaggcttgtcagagctgg

SEQ ID NO: 1194413 - DNA, 16 bp, Homo sapiens
gaggctttaaaaagaa

SEQ ID NO: 1194414 - DNA, 19 bp, Homo sapiens
gaggctttaagctccagct

SEQ ID NO: 1194415 - DNA, 16 bp, Homo sapiens
gaggctttcaaatgta

SEQ ID NO: 1194416 - DNA, 17 bp, Homo sapiens
gaggctttcaaatgtac

SEQ ID NO: 1194417 - DNA, 14 bp, Homo sapiens
gaggcttttcactg

SEQ ID NO: 1194418 - DNA, 15 bp, Homo sapiens
gaggcttttcactgc

SEQ ID NO: 1194419 - DNA, 19 bp, Homo sapiens
gagggaaactcagatgtcc

SEQ ID NO: 1194420 - DNA, 15 bp, Homo sapiens
gagggaaagtgcata

SEQ ID NO: 1194421 - DNA, 16 bp, Homo sapiens
gagggaaatctgtaaa

SEQ ID NO: 1194422 - DNA, 17 bp, Homo sapiens
gagggaaccaccagcgt

SEQ ID NO: 1194423 - DNA, 19 bp, Homo sapiens
gagggaagaccagaattcc

SEQ ID NO: 1194424 - DNA, 13 bp, Homo sapiens
gagggaaggagcc

SEQ ID NO: 1194425 - DNA, 15 bp, Homo sapiens
gagggaaggagccca

SEQ ID NO: 1194426 - DNA, 15 bp, Homo sapiens
gagggaagggccacc

SEQ ID NO: 1194427 - DNA, 16 bp, Homo sapiens
gagggaagggccaccc

SEQ ID NO: 1194428 - DNA, 18 bp, Homo sapiens
gagggaagggccaccctg

SEQ ID NO: 1194429 - DNA, 17 bp, Homo sapiens
gagggaaggggatggag

SEQ ID NO: 1194430 - DNA, 22 bp, Homo sapiens
gagggaaggggatggaggccag

SEQ ID NO: 1194431 - DNA, 23 bp, Homo sapiens
gagggaaggggatggaggccaga

SEQ ID NO: 1194432 - DNA, 18 bp, Homo sapiens
gagggaagtcctgggagg

SEQ ID NO: 1194433 - DNA, 20 bp, Homo sapiens
gagggaatgttccctgcacc

SEQ ID NO: 1194434 - DNA, 18 bp, Homo sapiens
gagggaattgaggtctgc

SEQ ID NO: 1194435 - DNA, 20 bp, Homo sapiens
gagggacacatgcccctccc

SEQ ID NO: 1194436 - DNA, 21 bp, Homo sapiens
gagggacacatgcccctcccc

SEQ ID NO: 1194437 - DNA, 20 bp, Homo sapiens
gagggacagcagattccaca

SEQ ID NO: 1194438 - DNA, 23 bp, Homo sapiens
gagggacagcagattccacagga

SEQ ID NO: 1194439 - DNA, 15 bp, Homo sapiens
gagggacagggcagg

SEQ ID NO: 1194440 - DNA, 17 bp, Homo sapiens
gagggacagggcaggcg

SEQ ID NO: 1194441 - DNA, 14 bp, Homo sapiens
gagggacctctccc

SEQ ID NO: 1194442 - DNA, 18 bp, Homo sapiens
gagggacctctcccaggg

SEQ ID NO: 1194443 - DNA, 13 bp, Homo sapiens
gagggagaaggga

SEQ ID NO: 1194444 - DNA, 22 bp, Homo sapiens
gagggagaatccaagggttgag

SEQ ID NO: 1194445 - DNA, 15 bp, Homo sapiens
gagggagacggccct

SEQ ID NO: 1194446 - DNA, 16 bp, Homo sapiens
gagggagacggccctg

SEQ ID NO: 1194447 - DNA, 13 bp, Homo sapiens
gagggagagagag

SEQ ID NO: 1194448 - DNA, 22 bp, Homo sapiens
gagggagagagagagagagagg

SEQ ID NO: 1194449 - DNA, 12 bp, Homo sapiens
gagggagcagac

SEQ ID NO: 1194450 - DNA, 16 bp, Homo sapiens
gagggagccatggaag

SEQ ID NO: 1194451 - DNA, 17 bp, Homo sapiens
gagggagccttgtgaga

SEQ ID NO: 1194452 - DNA, 13 bp, Homo sapiens
gagggagctgctg

SEQ ID NO: 1194453 - DNA, 17 bp, Homo sapiens
gagggagctgctggctg

SEQ ID NO: 1194454 - DNA, 19 bp, Homo sapiens
tatacatgaaaattttaaa

SEQ ID NO: 1194455 - DNA, 12 bp, Homo sapiens
tatacatgtgtg

SEQ ID NO: 1194456 - DNA, 20 bp, Homo sapiens
tatacatgttggaaatgtgt

SEQ ID NO: 1194457 - DNA, 18 bp, Homo sapiens
tatacattagttttaatc

SEQ ID NO: 1194458 - DNA, 22 bp, Homo sapiens
tatacattctttatcttgacat

SEQ ID NO: 1194459 - DNA, 21 bp, Homo sapiens
tatacattgaattcattataa

SEQ ID NO: 1194460 - DNA, 22 bp, Homo sapiens
tatacattgtgtgaaaaaagaa

SEQ ID NO: 1194461 - DNA, 21 bp, Homo sapiens
tatacatttcataaggcctgc

SEQ ID NO: 1194462 - DNA, 15 bp, Homo sapiens
tatacattttctaaa

SEQ ID NO: 1194463 - DNA, 24 bp, Homo sapiens
cttggagagagaggctgcctcagc

SEQ ID NO: 1194464 - DNA, 17 bp, Homo sapiens
cttggagagcaaaggcc

SEQ ID NO: 1194465 - DNA, 14 bp, Homo sapiens
cttggagagcagct

SEQ ID NO: 1194466 - DNA, 14 bp, Homo sapiens
cttggagaggagag

SEQ ID NO: 1194467 - DNA, 18 bp, Homo sapiens
cttggagcctaaagagaa

SEQ ID NO: 1194468 - DNA, 18 bp, Homo sapiens
cttggagcctctttttcc

SEQ ID NO: 1194469 - DNA, 20 bp, Homo sapiens
cttggagcctctttttcctt

SEQ ID NO: 1194470 - DNA, 23 bp, Homo sapiens
cttggagcctctttttccttctt

SEQ ID NO: 1194471 - DNA, 14 bp, Homo sapiens
cttggagctgtgag

SEQ ID NO: 1194472 - DNA, 19 bp, Homo sapiens
cttggagctttttcaaaag

SEQ ID NO: 1194473 - DNA, 15 bp, Homo sapiens
cttggaggaatgaca

SEQ ID NO: 1194474 - DNA, 23 bp, Homo sapiens
cttggaggaggatgccacgcact

SEQ ID NO: 1194475 - DNA, 22 bp, Homo sapiens
cttggagggagaggtggcagga

SEQ ID NO: 1194476 - DNA, 13 bp, Homo sapiens
cttggagggatgg

SEQ ID NO: 1194477 - DNA, 23 bp, Homo sapiens
cttggagggatggagaggcggcc

SEQ ID NO: 1194478 - DNA, 19 bp, Homo sapiens
cttggagggtctgggggca

SEQ ID NO: 1194479 - DNA, 20 bp, Homo sapiens
cttggagggtctgggggcag

SEQ ID NO: 1194480 - DNA, 18 bp, Homo sapiens
cttggagtattggggtct

SEQ ID NO: 1194481 - DNA, 23 bp, Homo sapiens
cttggataatgctgttgcctcat

SEQ ID NO: 1194482 - DNA, 22 bp, Homo sapiens
cttggatatataggctattttc

SEQ ID NO: 1194483 - DNA, 21 bp, Homo sapiens
cttggatcgctaagctggctc

SEQ ID NO: 1194484 - DNA, 13 bp, Homo sapiens
cttggatctgggg

SEQ ID NO: 1194485 - DNA, 14 bp, Homo sapiens
cttggatctggggt

SEQ ID NO: 1194486 - DNA, 21 bp, Homo sapiens
cttggatgcgagcttggcctt

SEQ ID NO: 1194487 - DNA, 23 bp, Homo sapiens
cttggatgcgagcttggccttgg

SEQ ID NO: 1194488 - DNA, 16 bp, Homo sapiens
cttggatggacttgta

SEQ ID NO: 1194489 - DNA, 13 bp, Homo sapiens
cttggattaaata

SEQ ID NO: 1194490 - DNA, 15 bp, Homo sapiens
cttggattaaataca

SEQ ID NO: 1194491 - DNA, 21 bp, Homo sapiens
cttggattattttaaatcatt

SEQ ID NO: 1194492 - DNA, 15 bp, Homo sapiens
cttggattctctaac

SEQ ID NO: 1194493 - DNA, 20 bp, Homo sapiens
cttggattctctgagaaatg

SEQ ID NO: 1194494 - DNA, 17 bp, Homo sapiens
cttggattctttccatt

SEQ ID NO: 1194495 - DNA, 18 bp, Homo sapiens
cttggattctttccattt

SEQ ID NO: 1194496 - DNA, 22 bp, Homo sapiens
cttggattggacaggagatcag

SEQ ID NO: 1194497 - DNA, 14 bp, Homo sapiens
cttggcaagatgtt

SEQ ID NO: 1194498 - DNA, 20 bp, Homo sapiens
cttggcacccccatgctgcc

SEQ ID NO: 1194499 - DNA, 16 bp, Homo sapiens
cttggcagctttttct

SEQ ID NO: 1194500 - DNA, 17 bp, Homo sapiens
cttggcagctttttctg

SEQ ID NO: 1194501 - DNA, 16 bp, Homo sapiens
cttggcaggtgcctgt

SEQ ID NO: 1194502 - DNA, 13 bp, Homo sapiens
cttggcatacaaa

SEQ ID NO: 1194503 - DNA, 16 bp, Homo sapiens
cttggcatacaaaata

SEQ ID NO: 1194504 - DNA, 17 bp, Homo sapiens
cttggcatacaaaatat

SEQ ID NO: 1194505 - DNA, 19 bp, Homo sapiens
cttggcatcacagggcaga

SEQ ID NO: 1194506 - DNA, 20 bp, Homo sapiens
cttggcatcacagggcagag

SEQ ID NO: 1194507 - DNA, 21 bp, Homo sapiens
cttggcatgggcgcaggccca

SEQ ID NO: 1194508 - DNA, 12 bp, Homo sapiens
cttggcatttct

SEQ ID NO: 1194509 - DNA, 20 bp, Homo sapiens
cttggcccagaaagctgcgg

SEQ ID NO: 1194510 - DNA, 20 bp, Homo sapiens
cttggcccaggagctctgcg

SEQ ID NO: 1194511 - DNA, 23 bp, Homo sapiens
cttggcccaggagctctgcgcca

SEQ ID NO: 1194512 - DNA, 12 bp, Homo sapiens
cttggccccaga

SEQ ID NO: 1194513 - DNA, 21 bp, Homo sapiens
cttggccccagaggaccgaga

SEQ ID NO: 1194514 - DNA, 21 bp, Homo sapiens
cttggccccccaaagtgctgg

SEQ ID NO: 1194515 - DNA, 15 bp, Homo sapiens
cttggcccctcacat

SEQ ID NO: 1194516 - DNA, 23 bp, Homo sapiens
cttggcccctcacatcctctcca

SEQ ID NO: 1194517 - DNA, 14 bp, Homo sapiens
cttggccctttcct

SEQ ID NO: 1194518 - DNA, 19 bp, Homo sapiens
cttggccgcataggcccag

SEQ ID NO: 1194519 - DNA, 14 bp, Homo sapiens
cttggcctcacggg

SEQ ID NO: 1194520 - DNA, 15 bp, Homo sapiens
cttggcctcccaaag

SEQ ID NO: 1194521 - DNA, 17 bp, Homo sapiens
cttggcctcccagagta

SEQ ID NO: 1194522 - DNA, 17 bp, Homo sapiens
cttggcctgatcagacc

SEQ ID NO: 1194523 - DNA, 13 bp, Homo sapiens
cttggcctgctgt

SEQ ID NO: 1194524 - DNA, 16 bp, Homo sapiens
cttggcctgctgtgat

SEQ ID NO: 1194525 - DNA, 13 bp, Homo sapiens
cttggcctggaga

SEQ ID NO: 1194526 - DNA, 16 bp, Homo sapiens
cttggcctggagagga

SEQ ID NO: 1194527 - DNA, 13 bp, Homo sapiens
cttggcctgtcca

SEQ ID NO: 1194528 - DNA, 22 bp, Homo sapiens
cttggcctgtctcatccccagg

SEQ ID NO: 1194529 - DNA, 23 bp, Homo sapiens
cttggccttggcatgggcgcagg

SEQ ID NO: 1194530 - DNA, 20 bp, Homo sapiens
gtgtgcatggaagttggggc

SEQ ID NO: 1194531 - DNA, 14 bp, Homo sapiens
gtgtgcatgtgtgt

SEQ ID NO: 1194532 - DNA, 17 bp, Homo sapiens
gtgtgcccaagtgggca

SEQ ID NO: 1194533 - DNA, 15 bp, Homo sapiens
gtgtgccctgggcca

SEQ ID NO: 1194534 - DNA, 13 bp, Homo sapiens
gtgtgcctcctag

SEQ ID NO: 1194535 - DNA, 18 bp, Homo sapiens
gtgtgcctgcagccccgc

SEQ ID NO: 1194536 - DNA, 17 bp, Homo sapiens
gtgtgcctgccctggag

SEQ ID NO: 1194537 - DNA, 13 bp, Homo sapiens
gtgtgcctggaag

SEQ ID NO: 1194538 - DNA, 16 bp, Homo sapiens
gtgtgcctgggggagt

SEQ ID NO: 1194539 - DNA, 13 bp, Homo sapiens
gtgtgcctgtggc

SEQ ID NO: 1194540 - DNA, 17 bp, Homo sapiens
gtgtgccttctgccaac

SEQ ID NO: 1194541 - DNA, 14 bp, Homo sapiens
gtgtgcgtgcgtgt

SEQ ID NO: 1194542 - DNA, 18 bp, Homo sapiens
gtgtgcgtgcgtgtgcgt

SEQ ID NO: 1194543 - DNA, 18 bp, Homo sapiens
gtgtgctcctctccttac

SEQ ID NO: 1194544 - DNA, 14 bp, Homo sapiens
gtgtgctgctgctg

SEQ ID NO: 1194545 - DNA, 19 bp, Homo sapiens
gtgtgctgggagctccact

SEQ ID NO: 1194546 - DNA, 22 bp, Homo sapiens
gtgtgctgtatggcccaggcag

SEQ ID NO: 1194547 - DNA, 18 bp, Homo sapiens
gtgtgcttgaatgtgagt

SEQ ID NO: 1194548 - DNA, 17 bp, Homo sapiens
gtgtggaagggaccaag

SEQ ID NO: 1194549 - DNA, 16 bp, Homo sapiens
gtgtggactgtgatgc

SEQ ID NO: 1194550 - DNA, 21 bp, Homo sapiens
gtgtggagaagcggctggcag

SEQ ID NO: 1194551 - DNA, 10 bp, Homo sapiens
gtgtggagca

SEQ ID NO: 1194552 - DNA, 12 bp, Homo sapiens
gtgtggagcacg

SEQ ID NO: 1194553 - DNA, 22 bp, Homo sapiens
gtgtggagttcaccttggaagg

SEQ ID NO: 1194554 - DNA, 16 bp, Homo sapiens
gtgtggcagccacacg

SEQ ID NO: 1194555 - DNA, 20 bp, Homo sapiens
gtgtggccaaccaggaccca

SEQ ID NO: 1194556 - DNA, 14 bp, Homo sapiens
gtgtggccctgcca

SEQ ID NO: 1194557 - DNA, 11 bp, Homo sapiens
gtgtggcctca

SEQ ID NO: 1194558 - DNA, 12 bp, Homo sapiens
gtgtggcctcag

SEQ ID NO: 1194559 - DNA, 13 bp, Homo sapiens
gtgtggcctcagc

SEQ ID NO: 1194560 - DNA, 23 bp, Homo sapiens
gtgtggcctccctggctcctccg

SEQ ID NO: 1194561 - DNA, 20 bp, Homo sapiens
gtgtggcctccgtcctgtca

SEQ ID NO: 1194562 - DNA, 21 bp, Homo sapiens
gtgtggcctccgtcctgtcac

SEQ ID NO: 1194563 - DNA, 13 bp, Homo sapiens
gtgtggcgtggcc

SEQ ID NO: 1194564 - DNA, 15 bp, Homo sapiens
gtgtggcgtggcccg

SEQ ID NO: 1194565 - DNA, 20 bp, Homo sapiens
gtgtggctcctaccagcaaa

SEQ ID NO: 1194566 - DNA, 14 bp, Homo sapiens
gtgtggctcctggt

SEQ ID NO: 1194567 - DNA, 14 bp, Homo sapiens
gtgtggctccttcc

SEQ ID NO: 1194568 - DNA, 13 bp, Homo sapiens
gtgtggctggtgt

SEQ ID NO: 1194569 - DNA, 17 bp, Homo sapiens
gtgtggctggtgtcccc

SEQ ID NO: 1194570 - DNA, 17 bp, Homo sapiens
gtgtggctgtgggtgtg

SEQ ID NO: 1194571 - DNA, 13 bp, Homo sapiens
gtgtgggaaggga

SEQ ID NO: 1194572 - DNA, 15 bp, Homo sapiens
gtgtgggatacttag

SEQ ID NO: 1194573 - DNA, 19 bp, Homo sapiens
gtgtgggatacttagtggt

SEQ ID NO: 1194574 - DNA, 19 bp, Homo sapiens
gtgtggggacacagcagtg

SEQ ID NO: 1194575 - DNA, 13 bp, Homo sapiens
gtgtgggggagat

SEQ ID NO: 1194576 - DNA, 22 bp, Homo sapiens
gtgtgggggagattctgggttt

SEQ ID NO: 1194577 - DNA, 18 bp, Homo sapiens
gtgtggggggacagacag

SEQ ID NO: 1194578 - DNA, 22 bp, Homo sapiens
gtgtgggttagtcgggtgccag

SEQ ID NO: 1194579 - DNA, 18 bp, Homo sapiens
gtgtggtaccttcagccc

SEQ ID NO: 1194580 - DNA, 20 bp, Homo sapiens
gtgtggtaccttcagccctg

SEQ ID NO: 1194581 - DNA, 22 bp, Homo sapiens
gtgtggtaccttcagccctggc

SEQ ID NO: 1194582 - DNA, 13 bp, Homo sapiens
gtgtggtgcagtg

SEQ ID NO: 1194583 - DNA, 17 bp, Homo sapiens
gtgtggtgctacaggga

SEQ ID NO: 1194584 - DNA, 19 bp, Homo sapiens
gtgtggtggagccagggcc

SEQ ID NO: 1194585 - DNA, 23 bp, Homo sapiens
cttgggccagaagtaccagacta

SEQ ID NO: 1194586 - DNA, 22 bp, Homo sapiens
cttgggcccagctgggctctgc

SEQ ID NO: 1194587 - DNA, 16 bp, Homo sapiens
cttgggccctttgagt

SEQ ID NO: 1194588 - DNA, 22 bp, Homo sapiens
cttgggcgccgtgctgggcagc

SEQ ID NO: 1194589 - DNA, 23 bp, Homo sapiens
cttgggcgccgtgctgggcagcc

SEQ ID NO: 1194590 - DNA, 15 bp, Homo sapiens
cttgggcggctgaga

SEQ ID NO: 1194591 - DNA, 22 bp, Homo sapiens
cttgggcggctgagagccccag

SEQ ID NO: 1194592 - DNA, 24 bp, Homo sapiens
cttgggcgtctcccccagagtgct

SEQ ID NO: 1194593 - DNA, 13 bp, Homo sapiens
cttgggctactgg

SEQ ID NO: 1194594 - DNA, 19 bp, Homo sapiens
cttgggctactggcagctc

SEQ ID NO: 1194595 - DNA, 13 bp, Homo sapiens
cttgggctccctg

SEQ ID NO: 1194596 - DNA, 12 bp, Homo sapiens
cttgggctcctg

SEQ ID NO: 1194597 - DNA, 14 bp, Homo sapiens
cttgggctcctggc

SEQ ID NO: 1194598 - DNA, 14 bp, Homo sapiens
cttgggctgaccca

SEQ ID NO: 1194599 - DNA, 19 bp, Homo sapiens
cttgggctgacccagcatc

SEQ ID NO: 1194600 - DNA, 17 bp, Homo sapiens
cttgggctgagactgga

SEQ ID NO: 1194601 - DNA, 16 bp, Homo sapiens
cttgggctgagtgcag

SEQ ID NO: 1194602 - DNA, 19 bp, Homo sapiens
cttgggctgagtgcagcca

SEQ ID NO: 1194603 - DNA, 16 bp, Homo sapiens
cttgggctggtcagag

SEQ ID NO: 1194604 - DNA, 20 bp, Homo sapiens
cttgggctggtcagagtggc

SEQ ID NO: 1194605 - DNA, 19 bp, Homo sapiens
cttgggcttccatttgtgt

SEQ ID NO: 1194606 - DNA, 21 bp, Homo sapiens
cttggggaaaatggccatgca

SEQ ID NO: 1194607 - DNA, 18 bp, Homo sapiens
cttggggaatttcctcta

SEQ ID NO: 1194608 - DNA, 11 bp, Homo sapiens
cttggggaggc

SEQ ID NO: 1194609 - DNA, 14 bp, Homo sapiens
cttggggcaacaga

SEQ ID NO: 1194610 - DNA, 21 bp, Homo sapiens
cttggggccaccaaagctgcc

SEQ ID NO: 1194611 - DNA, 22 bp, Homo sapiens
cttggggccaccaaagctgccc

SEQ ID NO: 1194612 - DNA, 23 bp, Homo sapiens
cttggggccaccaaagctgccca

SEQ ID NO: 1194613 - DNA, 13 bp, Homo sapiens
cttggggcctggc

SEQ ID NO: 1194614 - DNA, 14 bp, Homo sapiens
cttggggctcagcc

SEQ ID NO: 1194615 - DNA, 22 bp, Homo sapiens
cttgggggaacgatgtgtctgt

SEQ ID NO: 1194616 - DNA, 24 bp, Homo sapiens
cttgggggatgactagaggcaggg

SEQ ID NO: 1194617 - DNA, 19 bp, Homo sapiens
cttgggggctcccagggca

SEQ ID NO: 1194618 - DNA, 22 bp, Homo sapiens
cttggggggccaaagaaggcag

SEQ ID NO: 1194619 - DNA, 16 bp, Homo sapiens
cttggggggctgaggt

SEQ ID NO: 1194620 - DNA, 16 bp, Homo sapiens
cttgggggggtggccg

SEQ ID NO: 1194621 - DNA, 13 bp, Homo sapiens
cttgggggtcagg

SEQ ID NO: 1194622 - DNA, 21 bp, Homo sapiens
cttgggggttttcaatgtgaa

SEQ ID NO: 1194623 - DNA, 17 bp, Homo sapiens
cttggggtaagccagag

SEQ ID NO: 1194624 - DNA, 19 bp, Homo sapiens
cttggggtaagccagagcc

SEQ ID NO: 1194625 - DNA, 14 bp, Homo sapiens
cttggggtactctt

SEQ ID NO: 1194626 - DNA, 22 bp, Homo sapiens
cttggggtcaggaacagtggct

SEQ ID NO: 1194627 - DNA, 23 bp, Homo sapiens
cttggggtcaggaacagtggctg

SEQ ID NO: 1194628 - DNA, 15 bp, Homo sapiens
cttggggtcccaggg

SEQ ID NO: 1194629 - DNA, 17 bp, Homo sapiens
cttggggtcccagggaa

SEQ ID NO: 1194630 - DNA, 15 bp, Homo sapiens
cttggggtgggggcc

SEQ ID NO: 1194631 - DNA, 19 bp, Homo sapiens
cttggggtgggggccaggc

SEQ ID NO: 1194632 - DNA, 18 bp, Homo sapiens
cttggggtgtggggtggg

SEQ ID NO: 1194633 - DNA, 22 bp, Homo sapiens
cttggggttaagtctcctgtct

SEQ ID NO: 1194634 - DNA, 22 bp, Homo sapiens
cttggggttcataggggcaggt

SEQ ID NO: 1194635 - DNA, 20 bp, Homo sapiens
cttggggttttcagtatgaa

SEQ ID NO: 1194636 - DNA, 21 bp, Homo sapiens
cttgggtagggcagacatgcc

SEQ ID NO: 1194637 - DNA, 16 bp, Homo sapiens
cttgggtccaccatgc

SEQ ID NO: 1194638 - DNA, 20 bp, Homo sapiens
cttgggtccaccatgcagaa

SEQ ID NO: 1194639 - DNA, 23 bp, Homo sapiens
cttgggtcccccacgtgacagtg

SEQ ID NO: 1194640 - DNA, 17 bp, Homo sapiens
cttgggtctgccctgcc

SEQ ID NO: 1194641 - DNA, 21 bp, Homo sapiens
cttgggtgtaacaggtctcct

SEQ ID NO: 1194642 - DNA, 23 bp, Homo sapiens
cttgggttcaagtgattctcctg

SEQ ID NO: 1194643 - DNA, 14 bp, Homo sapiens
cttgggttctgata

SEQ ID NO: 1194644 - DNA, 21 bp, Homo sapiens
cttgggttgatctcttagaag

SEQ ID NO: 1194645 - DNA, 19 bp, Homo sapiens
cttggtaagtgaatttatg

SEQ ID NO: 1194646 - DNA, 23 bp, Homo sapiens
cttggtactactagatgtcttta

SEQ ID NO: 1194647 - DNA, 14 bp, Homo sapiens
cttggtactgaaaa

SEQ ID NO: 1194648 - DNA, 15 bp, Homo sapiens
cttggtagcagcctg

SEQ ID NO: 1194649 - DNA, 22 bp, Homo sapiens
cttggtatgtgccaggcttgcc

SEQ ID NO: 1194650 - DNA, 19 bp, Homo sapiens
cttggtattattctgtttt

SEQ ID NO: 1194651 - DNA, 21 bp, Homo sapiens
cttggtattattctgttttgc

SEQ ID NO: 1194652 - DNA, 12 bp, Homo sapiens
cttggtcaaact

SEQ ID NO: 1194653 - DNA, 15 bp, Homo sapiens
cttggtcaaactttt

SEQ ID NO: 1194654 - DNA, 16 bp, Homo sapiens
cttggtcaagaaagga

SEQ ID NO: 1194655 - DNA, 14 bp, Homo sapiens
cttggtcacataca

SEQ ID NO: 1194656 - DNA, 13 bp, Homo sapiens
gtgttagagaaat

SEQ ID NO: 1194657 - DNA, 14 bp, Homo sapiens
gtgttagtgtctgt

SEQ ID NO: 1194658 - DNA, 20 bp, Homo sapiens
gtgttataatgggtaatata

SEQ ID NO: 1194659 - DNA, 18 bp, Homo sapiens
gtgttatattccaaggaa

SEQ ID NO: 1194660 - DNA, 19 bp, Homo sapiens
gtgttatattccaaggaaa

SEQ ID NO: 1194661 - DNA, 16 bp, Homo sapiens
gtgttatcaggcgtcc

SEQ ID NO: 1194662 - DNA, 13 bp, Homo sapiens
gtgttatgtattt

SEQ ID NO: 1194663 - DNA, 17 bp, Homo sapiens
gtgttattacttcctca

SEQ ID NO: 1194664 - DNA, 16 bp, Homo sapiens
gtgttatttaaagaag

SEQ ID NO: 1194665 - DNA, 17 bp, Homo sapiens
gtgttatttaaagaaga

SEQ ID NO: 1194666 - DNA, 13 bp, Homo sapiens
gtgttatttttca

SEQ ID NO: 1194667 - DNA, 14 bp, Homo sapiens
gtgttcaatattta

SEQ ID NO: 1194668 - DNA, 16 bp, Homo sapiens
gtgttcaatattttct

SEQ ID NO: 1194669 - DNA, 14 bp, Homo sapiens
gtgttcagaggcag

SEQ ID NO: 1194670 - DNA, 18 bp, Homo sapiens
gtgttcagctctttccaa

SEQ ID NO: 1194671 - DNA, 12 bp, Homo sapiens
gtgttcatacat

SEQ ID NO: 1194672 - DNA, 22 bp, Homo sapiens
gtgttcatttggtgttcctgga

SEQ ID NO: 1194673 - DNA, 15 bp, Homo sapiens
gtgttccaacaacca

SEQ ID NO: 1194674 - DNA, 22 bp, Homo sapiens
gtgttccccaagcgcctggctg

SEQ ID NO: 1194675 - DNA, 19 bp, Homo sapiens
gtgttcccctcttgtctcc

SEQ ID NO: 1194676 - DNA, 19 bp, Homo sapiens
gtgttccccttccactgag

SEQ ID NO: 1194677 - DNA, 23 bp, Homo sapiens
gtgttccccttccactgagggca

SEQ ID NO: 1194678 - DNA, 22 bp, Homo sapiens
gtgttcctatattccaggttta

SEQ ID NO: 1194679 - DNA, 20 bp, Homo sapiens
gtgttcctcggtgggccaga

SEQ ID NO: 1194680 - DNA, 16 bp, Homo sapiens
gtgttcctgaagctgc

SEQ ID NO: 1194681 - DNA, 15 bp, Homo sapiens
gtgttcctggcaata

SEQ ID NO: 1194682 - DNA, 18 bp, Homo sapiens
gtgttcctggcaatagtg

SEQ ID NO: 1194683 - DNA, 19 bp, Homo sapiens
gtgttcctggcagtttaaa

SEQ ID NO: 1194684 - DNA, 21 bp, Homo sapiens
gtgttcctggcccactctgta

SEQ ID NO: 1194685 - DNA, 23 bp, Homo sapiens
gtgttcgggggagcagagagagc

SEQ ID NO: 1194686 - DNA, 22 bp, Homo sapiens
gtgttctattgctgagaagcaa

SEQ ID NO: 1194687 - DNA, 16 bp, Homo sapiens
gtgttctcatgaagca

SEQ ID NO: 1194688 - DNA, 20 bp, Homo sapiens
gtgttctcatgaagcaggag

SEQ ID NO: 1194689 - DNA, 21 bp, Homo sapiens
gtgttctcatgaagcaggagg

SEQ ID NO: 1194690 - DNA, 14 bp, Homo sapiens
gtgttctctcttat

SEQ ID NO: 1194691 - DNA, 11 bp, Homo sapiens
gtgttctgggc

SEQ ID NO: 1194692 - DNA, 14 bp, Homo sapiens
gtgttctgggctgg

SEQ ID NO: 1194693 - DNA, 17 bp, Homo sapiens
gtgttctgggctggggc

SEQ ID NO: 1194694 - DNA, 19 bp, Homo sapiens
gtgttctgtgggcttggcc

SEQ ID NO: 1194695 - DNA, 18 bp, Homo sapiens
gtgttctgtttgaaacta

SEQ ID NO: 1194696 - DNA, 14 bp, Homo sapiens
gtgttctgtttgtt

SEQ ID NO: 1194697 - DNA, 17 bp, Homo sapiens
gtgttctgtttgttaaa

SEQ ID NO: 1194698 - DNA, 15 bp, Homo sapiens
gtgttctgttttctc

SEQ ID NO: 1194699 - DNA, 16 bp, Homo sapiens
gtgttgaagaagggtt

SEQ ID NO: 1194700 - DNA, 20 bp, Homo sapiens
gtgttgacactgttttcctt

SEQ ID NO: 1194701 - DNA, 16 bp, Homo sapiens
gtgttgactgctgctc

SEQ ID NO: 1194702 - DNA, 14 bp, Homo sapiens
gtgttgaggttttt

SEQ ID NO: 1194703 - DNA, 13 bp, Homo sapiens
gtgttgagtgaag

SEQ ID NO: 1194704 - DNA, 16 bp, Homo sapiens
gtgttgcactgaacag

SEQ ID NO: 1194705 - DNA, 20 bp, Homo sapiens
gtgttgccaaatatgtcctg

SEQ ID NO: 1194706 - DNA, 19 bp, Homo sapiens
cttgtaaatgtttcttttc

SEQ ID NO: 1194707 - DNA, 16 bp, Homo sapiens
cttgtaactaaaataa

SEQ ID NO: 1194708 - DNA, 17 bp, Homo sapiens
cttgtaactaaaataat

SEQ ID NO: 1194709 - DNA, 14 bp, Homo sapiens
cttgtaactccacc

SEQ ID NO: 1194710 - DNA, 17 bp, Homo sapiens
cttgtaactccaccaac

SEQ ID NO: 1194711 - DNA, 21 bp, Homo sapiens
cttgtaactccaccaacccat

SEQ ID NO: 1194712 - DNA, 14 bp, Homo sapiens
cttgtaagaccctt

SEQ ID NO: 1194713 - DNA, 21 bp, Homo sapiens
cttgtaatgatatagccagaa

SEQ ID NO: 1194714 - DNA, 13 bp, Homo sapiens
cttgtaattctaa

SEQ ID NO: 1194715 - DNA, 21 bp, Homo sapiens
cttgtaatttaaacaggccca

SEQ ID NO: 1194716 - DNA, 22 bp, Homo sapiens
cttgtaatttttttaatttaca

SEQ ID NO: 1194717 - DNA, 22 bp, Homo sapiens
cttgtaccatagaaaaatgtat

SEQ ID NO: 1194718 - DNA, 24 bp, Homo sapiens
cttgtactaagccaggaggcttta

SEQ ID NO: 1194719 - DNA, 15 bp, Homo sapiens
cttgtacttctgtgt

SEQ ID NO: 1194720 - DNA, 19 bp, Homo sapiens
cttgtaggaatctgccttc

SEQ ID NO: 1194721 - DNA, 12 bp, Homo sapiens
cttgtataatat

SEQ ID NO: 1194722 - DNA, 15 bp, Homo sapiens
cttgtatagtgtaaa

SEQ ID NO: 1194723 - DNA, 23 bp, Homo sapiens
cttgtatatatggatcagaggag

SEQ ID NO: 1194724 - DNA, 23 bp, Homo sapiens
cttgtatattccaccattcacat

SEQ ID NO: 1194725 - DNA, 17 bp, Homo sapiens
cttgtatatttgtacaa

SEQ ID NO: 1194726 - DNA, 15 bp, Homo sapiens
cttgtatcaaatgtt

SEQ ID NO: 1194727 - DNA, 19 bp, Homo sapiens
cttgtatcaacactgttac

SEQ ID NO: 1194728 - DNA, 23 bp, Homo sapiens
cttgtattaaactcttcacaaaa

SEQ ID NO: 1194729 - DNA, 18 bp, Homo sapiens
cttgtattgtaaatgtgg

SEQ ID NO: 1194730 - DNA, 21 bp, Homo sapiens
cttgtattgtaaatgtggatt

SEQ ID NO: 1194731 - DNA, 20 bp, Homo sapiens
cttgtatttaaatattaaat

SEQ ID NO: 1194732 - DNA, 12 bp, Homo sapiens
cttgtatttaat

SEQ ID NO: 1194733 - DNA, 17 bp, Homo sapiens
cttgtattttgttaaag

SEQ ID NO: 1194734 - DNA, 19 bp, Homo sapiens
cttgtattttgttaaagct

SEQ ID NO: 1194735 - DNA, 20 bp, Homo sapiens
cttgtattttgttaaagctg

SEQ ID NO: 1194736 - DNA, 13 bp, Homo sapiens
cttgtcaaagaag

SEQ ID NO: 1194737 - DNA, 15 bp, Homo sapiens
cttgtcaatatttaa

SEQ ID NO: 1194738 - DNA, 19 bp, Homo sapiens
cttgtcaatatttaaacat

SEQ ID NO: 1194739 - DNA, 22 bp, Homo sapiens
cttgtcaatatttaaacatggt

SEQ ID NO: 1194740 - DNA, 14 bp, Homo sapiens
cttgtcacaggaat

SEQ ID NO: 1194741 - DNA, 18 bp, Homo sapiens
cttgtcacccaaagcctg

SEQ ID NO: 1194742 - DNA, 20 bp, Homo sapiens
cttgtcacccaaagcctgtc

SEQ ID NO: 1194743 - DNA, 22 bp, Homo sapiens
cttgtcacgaattccatcttgt

SEQ ID NO: 1194744 - DNA, 15 bp, Homo sapiens
cttgtcactggtaga

SEQ ID NO: 1194745 - DNA, 14 bp, Homo sapiens
cttgtcagagctgg

SEQ ID NO: 1194746 - DNA, 15 bp, Homo sapiens
cttgtcagagctggg

SEQ ID NO: 1194747 - DNA, 22 bp, Homo sapiens
cttgtcatagactcctttgcta

SEQ ID NO: 1194748 - DNA, 14 bp, Homo sapiens
cttgtcattccaga

SEQ ID NO: 1194749 - DNA, 15 bp, Homo sapiens
cttgtcattgagcct

SEQ ID NO: 1194750 - DNA, 15 bp, Homo sapiens
cttgtccacattcta

SEQ ID NO: 1194751 - DNA, 14 bp, Homo sapiens
cttgtccagcgcct

SEQ ID NO: 1194752 - DNA, 18 bp, Homo sapiens
cttgtccagcgcctagtg

SEQ ID NO: 1194753 - DNA, 13 bp, Homo sapiens
cttgtccagctga

SEQ ID NO: 1194754 - DNA, 15 bp, Homo sapiens
cttgtccaggaactg

SEQ ID NO: 1194755 - DNA, 17 bp, Homo sapiens
cttgtcccaattaaaat

SEQ ID NO: 1194756 - DNA, 21 bp, Homo sapiens
cttgtcccacgtgtcttccac

SEQ ID NO: 1194757 - DNA, 12 bp, Homo sapiens
cttgtcccttgg

SEQ ID NO: 1194758 - DNA, 14 bp, Homo sapiens
cttgtccctttccc

SEQ ID NO: 1194759 - DNA, 21 bp, Homo sapiens
cttgtccctttccctaccttt

SEQ ID NO: 1194760 - DNA, 18 bp, Homo sapiens
cttgtcctagcttgggag

SEQ ID NO: 1194761 - DNA, 12 bp, Homo sapiens
cttgtcctcagc

SEQ ID NO: 1194762 - DNA, 16 bp, Homo sapiens
cttgtcctcagccagt

SEQ ID NO: 1194763 - DNA, 13 bp, Homo sapiens
cttgtcctcagct

SEQ ID NO: 1194764 - DNA, 14 bp, Homo sapiens
cttgtcctgaagcc

SEQ ID NO: 1194765 - DNA, 16 bp, Homo sapiens
cttgtcctgccagctg

SEQ ID NO: 1194766 - DNA, 17 bp, Homo sapiens
cttgtcctgccagctgc

SEQ ID NO: 1194767 - DNA, 18 bp, Homo sapiens
cttgtcctgccagctgcc

SEQ ID NO: 1194768 - DNA, 14 bp, Homo sapiens
cttgtcctgctctc

SEQ ID NO: 1194769 - DNA, 14 bp, Homo sapiens
cttgtcctggaata

SEQ ID NO: 1194770 - DNA, 13 bp, Homo sapiens
cttgtcctggccc

SEQ ID NO: 1194771 - DNA, 18 bp, Homo sapiens
cttgtcctggcccttcag

SEQ ID NO: 1194772 - DNA, 20 bp, Homo sapiens
cttgtcctggcccttcagtc

SEQ ID NO: 1194773 - DNA, 19 bp, Homo sapiens
cttgtcgcgcgtctcccat

SEQ ID NO: 1194774 - DNA, 20 bp, Homo sapiens
cttgtcgcgcgtctcccatc

SEQ ID NO: 1194775 - DNA, 16 bp, Homo sapiens
cttgtcgggggcccaa

SEQ ID NO: 1194776 - DNA, 12 bp, Homo sapiens
cttgtctcccct

SEQ ID NO: 1194777 - DNA, 13 bp, Homo sapiens
cttgtctcctttc

SEQ ID NO: 1194778 - DNA, 18 bp, Homo sapiens
cttgtctcctttctgact

SEQ ID NO: 1194779 - DNA, 18 bp, Homo sapiens
cttgtctctcactgcatt

SEQ ID NO: 1194780 - DNA, 14 bp, Homo sapiens
cttgtctctgggct

SEQ ID NO: 1194781 - DNA, 21 bp, Homo sapiens
cttgtctgaggcctcatccct

SEQ ID NO: 1194782 - DNA, 23 bp, Homo sapiens
cttgtctgattggctcacccaag

SEQ ID NO: 1194783 - DNA, 20 bp, Homo sapiens
cttgtctggcaaaagaaaaa

SEQ ID NO: 1194784 - DNA, 16 bp, Homo sapiens
cttgtctgggaattgt

SEQ ID NO: 1194785 - DNA, 13 bp, Homo sapiens
cttgtctgggtgc

SEQ ID NO: 1194786 - DNA, 18 bp, Homo sapiens
cttgtcttcccccctctc

SEQ ID NO: 1194787 - DNA, 13 bp, Homo sapiens
cttgtctttattt

SEQ ID NO: 1194788 - DNA, 15 bp, Homo sapiens
cttgtctttcctcct

SEQ ID NO: 1194789 - DNA, 21 bp, Homo sapiens
cttgtctttcctcctaccttt

SEQ ID NO: 1194790 - DNA, 14 bp, Homo sapiens
cttgtcttttcaga

SEQ ID NO: 1194791 - DNA, 12 bp, Homo sapiens
cttgtcttttga

SEQ ID NO: 1194792 - DNA, 14 bp, Homo sapiens
cttgtgaactccat

SEQ ID NO: 1194793 - DNA, 18 bp, Homo sapiens
cttgtgaactccatcatt

SEQ ID NO: 1194794 - DNA, 22 bp, Homo sapiens
cttgtgaactccatcattcatc

SEQ ID NO: 1194795 - DNA, 20 bp, Homo sapiens
cttgtgaattcccagactct

SEQ ID NO: 1194796 - DNA, 19 bp, Homo sapiens
cttgtgacagtgcctcttc

SEQ ID NO: 1194797 - DNA, 18 bp, Homo sapiens
cttgtgacgtgcactgtg

SEQ ID NO: 1194798 - DNA, 18 bp, Homo sapiens
cttgtgactcagcagagg

SEQ ID NO: 1194799 - DNA, 22 bp, Homo sapiens
cttgtgagagcccattcccacc

SEQ ID NO: 1194800 - DNA, 23 bp, Homo sapiens
cttgtgagagcccattcccacca

SEQ ID NO: 1194801 - DNA, 18 bp, Homo sapiens
cttgtgagatccttcaca

SEQ ID NO: 1194802 - DNA, 15 bp, Homo sapiens
cttgtgattatttat

SEQ ID NO: 1194803 - DNA, 16 bp, Homo sapiens
cttgtgattgctgcca

SEQ ID NO: 1194804 - DNA, 14 bp, Homo sapiens
cttgtgatttccat

SEQ ID NO: 1194805 - DNA, 15 bp, Homo sapiens
cttgtgatttccatt

SEQ ID NO: 1194806 - DNA, 21 bp, Homo sapiens
cttgtgatttctttaaaagaa

SEQ ID NO: 1194807 - DNA, 16 bp, Homo sapiens
cttgtgcatgtttact

SEQ ID NO: 1194808 - DNA, 12 bp, Homo sapiens
cttgtgccagcc

SEQ ID NO: 1194809 - DNA, 16 bp, Homo sapiens
cttgtgccctgccccc

SEQ ID NO: 1194810 - DNA, 18 bp, Homo sapiens
cttgtgcccttgtatagt

SEQ ID NO: 1194811 - DNA, 21 bp, Homo sapiens
cttgtgcctcccttcccagtg

SEQ ID NO: 1194812 - DNA, 15 bp, Homo sapiens
cttgtgcctgctcct

SEQ ID NO: 1194813 - DNA, 19 bp, Homo sapiens
cttgtgcctgctcctgtac

SEQ ID NO: 1194814 - DNA, 22 bp, Homo sapiens
cttgtgctcctcttgattcctg

SEQ ID NO: 1194815 - DNA, 13 bp, Homo sapiens
cttgtgctcggga

SEQ ID NO: 1194816 - DNA, 23 bp, Homo sapiens
cttgtgcttggtggggctcgtgg

SEQ ID NO: 1194817 - DNA, 24 bp, Homo sapiens
cttgtgcttggtggggctcgtggc

SEQ ID NO: 1194818 - DNA, 17 bp, Homo sapiens
cttgtgctttgctcttg

SEQ ID NO: 1194819 - DNA, 20 bp, Homo sapiens
cttgtgcttttcctatttgt

SEQ ID NO: 1194820 - DNA, 21 bp, Homo sapiens
cttgtggactggctgtgcccc

SEQ ID NO: 1194821 - DNA, 22 bp, Homo sapiens
cttgtggaggatgaatagatgt

SEQ ID NO: 1194822 - DNA, 21 bp, Homo sapiens
cttgtggccccttttactttt

SEQ ID NO: 1194823 - DNA, 14 bp, Homo sapiens
cttgtggcctcaag

SEQ ID NO: 1194824 - DNA, 20 bp, Homo sapiens
cttgtggccttttttataac

SEQ ID NO: 1194825 - DNA, 14 bp, Homo sapiens
cttgtgggagacag

SEQ ID NO: 1194826 - DNA, 15 bp, Homo sapiens
cttgtgggagacagc

SEQ ID NO: 1194827 - DNA, 23 bp, Homo sapiens
cttgtgggagacagcagcctgta

SEQ ID NO: 1194828 - DNA, 22 bp, Homo sapiens
gttaaggaaatgttgagggcaa

SEQ ID NO: 1194829 - DNA, 16 bp, Homo sapiens
gttaaggcaacattcc

SEQ ID NO: 1194830 - DNA, 12 bp, Homo sapiens
gttaaggcctga

SEQ ID NO: 1194831 - DNA, 13 bp, Homo sapiens
gttaagggaagga

SEQ ID NO: 1194832 - DNA, 22 bp, Homo sapiens
gttaagtgccattactactgta

SEQ ID NO: 1194833 - DNA, 23 bp, Homo sapiens
gttaagtgccattactactgtac

SEQ ID NO: 1194834 - DNA, 20 bp, Homo sapiens
gttaatataccccaaattgt

SEQ ID NO: 1194835 - DNA, 15 bp, Homo sapiens
gttaatctcccagcc

SEQ ID NO: 1194836 - DNA, 13 bp, Homo sapiens
gttaatgctttct

SEQ ID NO: 1194837 - DNA, 15 bp, Homo sapiens
gttaatgctttctga

SEQ ID NO: 1194838 - DNA, 15 bp, Homo sapiens
gttaatggtagcatt

SEQ ID NO: 1194839 - DNA, 18 bp, Homo sapiens
gttaatgtatataaaaat

SEQ ID NO: 1194840 - DNA, 21 bp, Homo sapiens
gttaattcagcactgatttca

SEQ ID NO: 1194841 - DNA, 14 bp, Homo sapiens
gttaattcatttgg

SEQ ID NO: 1194842 - DNA, 23 bp, Homo sapiens
gttaatttaaagttgtttgtgcc

SEQ ID NO: 1194843 - DNA, 17 bp, Homo sapiens
gttaatttattttgctc

SEQ ID NO: 1194844 - DNA, 19 bp, Homo sapiens
gttaatttttcctgcatgt

SEQ ID NO: 1194845 - DNA, 21 bp, Homo sapiens
gttaatttttcctgcatgttc

SEQ ID NO: 1194846 - DNA, 21 bp, Homo sapiens
gttaattttttggtacaaaaa

SEQ ID NO: 1194847 - DNA, 14 bp, Homo sapiens
gttacaaactgcaa

SEQ ID NO: 1194848 - DNA, 19 bp, Homo sapiens
gttacaaactgcaatagag

SEQ ID NO: 1194849 - DNA, 21 bp, Homo sapiens
gttacaagtttgctaaaagaa

SEQ ID NO: 1194850 - DNA, 23 bp, Homo sapiens
gttacaagtttgctaaaagaaga

SEQ ID NO: 1194851 - DNA, 22 bp, Homo sapiens
gttacacagaaatgctgctggc

SEQ ID NO: 1194852 - DNA, 17 bp, Homo sapiens
gttacacatttttcaga

SEQ ID NO: 1194853 - DNA, 15 bp, Homo sapiens
gttacactaaaaggt

SEQ ID NO: 1194854 - DNA, 18 bp, Homo sapiens
gttacactttttggaagt

SEQ ID NO: 1194855 - DNA, 18 bp, Homo sapiens
gttacagagaatttctaa

SEQ ID NO: 1194856 - DNA, 23 bp, Homo sapiens
gttacagagaatttctaaagtaa

SEQ ID NO: 1194857 - DNA, 18 bp, Homo sapiens
gttacagcctgttagtaa

SEQ ID NO: 1194858 - DNA, 22 bp, Homo sapiens
gttacaggcaccgagaatgttg

SEQ ID NO: 1194859 - DNA, 13 bp, Homo sapiens
gttacagttctgt

SEQ ID NO: 1194860 - DNA, 14 bp, Homo sapiens
gttacagttctgtg

SEQ ID NO: 1194861 - DNA, 19 bp, Homo sapiens
gttacataaggatgacttt

SEQ ID NO: 1194862 - DNA, 22 bp, Homo sapiens
gttacataaggatgactttttt

SEQ ID NO: 1194863 - DNA, 19 bp, Homo sapiens
gttaccaagtatgaagtat

SEQ ID NO: 1194864 - DNA, 20 bp, Homo sapiens
gttaccaagtatgaagtata

SEQ ID NO: 1194865 - DNA, 21 bp, Homo sapiens
gttaccactcttttgctgtgc

SEQ ID NO: 1194866 - DNA, 18 bp, Homo sapiens
gttaccatactgtctctg

SEQ ID NO: 1194867 - DNA, 21 bp, Homo sapiens
gttaccatactgtctctggag

SEQ ID NO: 1194868 - DNA, 15 bp, Homo sapiens
gttaccatgtctttc

SEQ ID NO: 1194869 - DNA, 15 bp, Homo sapiens
gttacccaggctgga

SEQ ID NO: 1194870 - DNA, 17 bp, Homo sapiens
gttaccgagtatctgta

SEQ ID NO: 1194871 - DNA, 12 bp, Homo sapiens
gttacctccctc

SEQ ID NO: 1194872 - DNA, 15 bp, Homo sapiens
gttacctcctataaa

SEQ ID NO: 1194873 - DNA, 19 bp, Homo sapiens
gttacctcctccatcttac

SEQ ID NO: 1194874 - DNA, 21 bp, Homo sapiens
gttacctctatataccaaagc

SEQ ID NO: 1194875 - DNA, 21 bp, Homo sapiens
gttacctgtcttgctcctggg

SEQ ID NO: 1194876 - DNA, 14 bp, Homo sapiens
gttacctgtgtgct

SEQ ID NO: 1194877 - DNA, 18 bp, Homo sapiens
gttacctgttagctccct

SEQ ID NO: 1194878 - DNA, 18 bp, Homo sapiens
gttacctgttccattgtt

SEQ ID NO: 1194879 - DNA, 22 bp, Homo sapiens
gttaccttatagttactgtgta

SEQ ID NO: 1194880 - DNA, 14 bp, Homo sapiens
gttacgaagacaaa

SEQ ID NO: 1194881 - DNA, 13 bp, Homo sapiens
gttactagcctct

SEQ ID NO: 1194882 - DNA, 16 bp, Homo sapiens
gttactaggtaacttc

SEQ ID NO: 1194883 - DNA, 20 bp, Homo sapiens
gttactcagcagcagagagc

SEQ ID NO: 1194884 - DNA, 12 bp, Homo sapiens
gttactcagccc

SEQ ID NO: 1194885 - DNA, 16 bp, Homo sapiens
gttactcagccctggg

SEQ ID NO: 1194886 - DNA, 22 bp, Homo sapiens
gttactcagggctcctcccagc

SEQ ID NO: 1194887 - DNA, 20 bp, Homo sapiens
gttactcagtgttagagaaa

SEQ ID NO: 1194888 - DNA, 15 bp, Homo sapiens
gttactctcttgcac

SEQ ID NO: 1194889 - DNA, 21 bp, Homo sapiens
gttactctcttgcaccaaatt

SEQ ID NO: 1194890 - DNA, 14 bp, Homo sapiens
gttactctggttct

SEQ ID NO: 1194891 - DNA, 19 bp, Homo sapiens
gttactgatcatgcattgt

SEQ ID NO: 1194892 - DNA, 16 bp, Homo sapiens
gttactgctgattctt

SEQ ID NO: 1194893 - DNA, 17 bp, Homo sapiens
gttactgcttctctttg

SEQ ID NO: 1194894 - DNA, 23 bp, Homo sapiens
gttactgcttctctttgtgcagt

SEQ ID NO: 1194895 - DNA, 12 bp, Homo sapiens
gttactgctttg

SEQ ID NO: 1194896 - DNA, 19 bp, Homo sapiens
gttactggataaattgttt

SEQ ID NO: 1194897 - DNA, 22 bp, Homo sapiens
gttactggtgatgttgaaatat

SEQ ID NO: 1194898 - DNA, 17 bp, Homo sapiens
gttacttacctaaacag

SEQ ID NO: 1194899 - DNA, 13 bp, Homo sapiens
gttacttcctact

SEQ ID NO: 1194900 - DNA, 14 bp, Homo sapiens
gttacttcttctct

SEQ ID NO: 1194901 - DNA, 15 bp, Homo sapiens
gttacttcttctctt

SEQ ID NO: 1194902 - DNA, 16 bp, Homo sapiens
gttacttcttctctta

SEQ ID NO: 1194903 - DNA, 16 bp, Homo sapiens
gttacttgaaatacca

SEQ ID NO: 1194904 - DNA, 21 bp, Homo sapiens
gttactttatgtttgtctttt

SEQ ID NO: 1194905 - DNA, 21 bp, Homo sapiens
gttactttctttcagatgttt

SEQ ID NO: 1194906 - DNA, 21 bp, Homo sapiens
gttagaaaatgacttatttct

SEQ ID NO: 1194907 - DNA, 23 bp, Homo sapiens
gttagaagcaaggagaaaatata

SEQ ID NO: 1194908 - DNA, 18 bp, Homo sapiens
gttagacgccttccaggt

SEQ ID NO: 1194909 - DNA, 22 bp, Homo sapiens
gttagacgccttccaggtcagg

SEQ ID NO: 1194910 - DNA, 23 bp, Homo sapiens
gttagacgccttccaggtcagga

SEQ ID NO: 1194911 - DNA, 23 bp, Homo sapiens
cttgtttgattttagctgcagaa

SEQ ID NO: 1194912 - DNA, 22 bp, Homo sapiens
cttgtttggtttggtttgcttt

SEQ ID NO: 1194913 - DNA, 15 bp, Homo sapiens
cttgtttgtcttcca

SEQ ID NO: 1194914 - DNA, 13 bp, Homo sapiens
cttgtttgttttg

SEQ ID NO: 1194915 - DNA, 13 bp, Homo sapiens
cttgttttataaa

SEQ ID NO: 1194916 - DNA, 17 bp, Homo sapiens
cttgttttcagcccccc

SEQ ID NO: 1194917 - DNA, 14 bp, Homo sapiens
cttgttttggacag

SEQ ID NO: 1194918 - DNA, 22 bp, Homo sapiens
cttgttttgtttgcttccatta

SEQ ID NO: 1194919 - DNA, 18 bp, Homo sapiens
cttgtttttggaaagaaa

SEQ ID NO: 1194920 - DNA, 23 bp, Homo sapiens
cttgttttttgtttgtttgttgc

SEQ ID NO: 1194921 - DNA, 20 bp, Homo sapiens
cttgttttttttttccactt

SEQ ID NO: 1194922 - DNA, 21 bp, Homo sapiens
cttgttttttttttccactta

SEQ ID NO: 1194923 - DNA, 14 bp, Homo sapiens
ctttaaaaaaacaa

SEQ ID NO: 1194924 - DNA, 16 bp, Homo sapiens
ctttaaaaaagactga

SEQ ID NO: 1194925 - DNA, 14 bp, Homo sapiens
ctttaaaaaggaaa

SEQ ID NO: 1194926 - DNA, 20 bp, Homo sapiens
ctttaaaaaggaaatttgtt

SEQ ID NO: 1194927 - DNA, 19 bp, Homo sapiens
ctttaaaacaagtgtgatg

SEQ ID NO: 1194928 - DNA, 16 bp, Homo sapiens
ctttaaaaccacagct

SEQ ID NO: 1194929 - DNA, 16 bp, Homo sapiens
ctttaaaaccagttac

SEQ ID NO: 1194930 - DNA, 12 bp, Homo sapiens
ctttaaaagaat

SEQ ID NO: 1194931 - DNA, 13 bp, Homo sapiens
ctttaaaagagag

SEQ ID NO: 1194932 - DNA, 21 bp, Homo sapiens
ctttaaaagagagagagagaa

SEQ ID NO: 1194933 - DNA, 16 bp, Homo sapiens
ctttaaaaggaaagaa

SEQ ID NO: 1194934 - DNA, 17 bp, Homo sapiens
ctttaaaaggaaagaaa

SEQ ID NO: 1194935 - DNA, 13 bp, Homo sapiens
ctttaaaaggcaa

SEQ ID NO: 1194936 - DNA, 15 bp, Homo sapiens
ctttaaaagtatctt

SEQ ID NO: 1194937 - DNA, 17 bp, Homo sapiens
ctttaaaagtatcttta

SEQ ID NO: 1194938 - DNA, 20 bp, Homo sapiens
ctttaaaagtatctttaaca

SEQ ID NO: 1194939 - DNA, 20 bp, Homo sapiens
ctttaaaagtcattattcct

SEQ ID NO: 1194940 - DNA, 15 bp, Homo sapiens
ctttaaaataaaaaa

SEQ ID NO: 1194941 - DNA, 23 bp, Homo sapiens
ctttaaaataaggataataatca

SEQ ID NO: 1194942 - DNA, 14 bp, Homo sapiens
ctttaaaatgcgaa

SEQ ID NO: 1194943 - DNA, 17 bp, Homo sapiens
ctttaaaatgcgaaatt

SEQ ID NO: 1194944 - DNA, 22 bp, Homo sapiens
ctttaaaatgcgaaattattgg

SEQ ID NO: 1194945 - DNA, 18 bp, Homo sapiens
ctttaaacaaatatgaaa

SEQ ID NO: 1194946 - DNA, 18 bp, Homo sapiens
ctttaaacatctagcagt

SEQ ID NO: 1194947 - DNA, 19 bp, Homo sapiens
ctttaaacctttcataatt

SEQ ID NO: 1194948 - DNA, 23 bp, Homo sapiens
ctttaaactatgttcctaacaaa

SEQ ID NO: 1194949 - DNA, 23 bp, Homo sapiens
ctttatgtggaaaacagaacatc

SEQ ID NO: 1194950 - DNA, 12 bp, Homo sapiens
ctttatgtgtaa

SEQ ID NO: 1194951 - DNA, 14 bp, Homo sapiens
ctttatgtgtaaat

SEQ ID NO: 1194952 - DNA, 12 bp, Homo sapiens
ctttatgttgta

SEQ ID NO: 1194953 - DNA, 13 bp, Homo sapiens
ctttattaaaatc

SEQ ID NO: 1194954 - DNA, 18 bp, Homo sapiens
ctttattaaaatcttaaa

SEQ ID NO: 1194955 - DNA, 21 bp, Homo sapiens
ctttattaaatacaaaacttc

SEQ ID NO: 1194956 - DNA, 13 bp, Homo sapiens
ctttattaccagt

SEQ ID NO: 1194957 - DNA, 20 bp, Homo sapiens
ctttattaccccctccttca

SEQ ID NO: 1194958 - DNA, 22 bp, Homo sapiens
ctttattaccccctccttcaga

SEQ ID NO: 1194959 - DNA, 14 bp, Homo sapiens
ctttattactcccc

SEQ ID NO: 1194960 - DNA, 21 bp, Homo sapiens
ctttattcaataaaaaaaaga

SEQ ID NO: 1194961 - DNA, 20 bp, Homo sapiens
ctttattccagaatgctgta

SEQ ID NO: 1194962 - DNA, 16 bp, Homo sapiens
ctttattcttgctggg

SEQ ID NO: 1194963 - DNA, 12 bp, Homo sapiens
ctttattgaatt

SEQ ID NO: 1194964 - DNA, 13 bp, Homo sapiens
ctttattgaatta

SEQ ID NO: 1194965 - DNA, 21 bp, Homo sapiens
ctttattgaattagaaaatta

SEQ ID NO: 1194966 - DNA, 13 bp, Homo sapiens
ctttattgagaaa

SEQ ID NO: 1194967 - DNA, 20 bp, Homo sapiens
ctttattgcactaggaattc

SEQ ID NO: 1194968 - DNA, 14 bp, Homo sapiens
ctttattgcatata

SEQ ID NO: 1194969 - DNA, 18 bp, Homo sapiens
ctttattgcccatgggat

SEQ ID NO: 1194970 - DNA, 14 bp, Homo sapiens
ctttattgcttttt

SEQ ID NO: 1194971 - DNA, 19 bp, Homo sapiens
ctttattgcttttttgtat

SEQ ID NO: 1194972 - DNA, 14 bp, Homo sapiens
ctttattgtctgta

SEQ ID NO: 1194973 - DNA, 15 bp, Homo sapiens
ctttatttaaatgca

SEQ ID NO: 1194974 - DNA, 21 bp, Homo sapiens
ctttatttaaatgcatgtctt

SEQ ID NO: 1194975 - DNA, 24 bp, Homo sapiens
ctttatttaaatgcatgtcttaaa

SEQ ID NO: 1194976 - DNA, 17 bp, Homo sapiens
ctttatttctagcagag

SEQ ID NO: 1194977 - DNA, 17 bp, Homo sapiens
ctttatttgtaaaccat

SEQ ID NO: 1194978 - DNA, 21 bp, Homo sapiens
ctttatttgtaaaccattgta

SEQ ID NO: 1194979 - DNA, 15 bp, Homo sapiens
ctttatttgtaaatt

SEQ ID NO: 1194980 - DNA, 14 bp, Homo sapiens
ctttattttattga

SEQ ID NO: 1194981 - DNA, 15 bp, Homo sapiens
ctttattttattgaa

SEQ ID NO: 1194982 - DNA, 16 bp, Homo sapiens
ctttattttattgaaa

SEQ ID NO: 1194983 - DNA, 13 bp, Homo sapiens
ctttattttctgg

SEQ ID NO: 1194984 - DNA, 16 bp, Homo sapiens
ctttatttttctatct

SEQ ID NO: 1194985 - DNA, 20 bp, Homo sapiens
ctttatttttctctttctcc

SEQ ID NO: 1194986 - DNA, 23 bp, Homo sapiens
ctttatttttctctttctccctt

SEQ ID NO: 1194987 - DNA, 15 bp, Homo sapiens
ctttatttttgttaa

SEQ ID NO: 1194988 - DNA, 22 bp, Homo sapiens
ctttattttttaagtatttata

SEQ ID NO: 1194989 - DNA, 23 bp, Homo sapiens
ctttattttttaagtatttatat

SEQ ID NO: 1194990 - DNA, 14 bp, Homo sapiens
ctttcaaaaacatg

SEQ ID NO: 1194991 - DNA, 15 bp, Homo sapiens
ctttcaaaccagctt

SEQ ID NO: 1194992 - DNA, 14 bp, Homo sapiens
ctttcaaagaaatc

SEQ ID NO: 1194993 - DNA, 13 bp, Homo sapiens
ctttcaaatgtac

SEQ ID NO: 1194994 - DNA, 14 bp, Homo sapiens
ctttcaaattatat

SEQ ID NO: 1194995 - DNA, 14 bp, Homo sapiens
ctttcaacttgcat

SEQ ID NO: 1194996 - DNA, 19 bp, Homo sapiens
ctttcaagcggtgcctaag

SEQ ID NO: 1194997 - DNA, 13 bp, Homo sapiens
ctttcaaggctgg

SEQ ID NO: 1194998 - DNA, 14 bp, Homo sapiens
ctttcaaggctggg

SEQ ID NO: 1194999 - DNA, 23 bp, Homo sapiens
ctttcaagtgcctttctgcagtt

SEQ ID NO: 1195000 - DNA, 18 bp, Homo sapiens
ctttcaataaatgtatca

SEQ ID NO: 1195001 - DNA, 18 bp, Homo sapiens
ctttcaattgtattttat

SEQ ID NO: 1195002 - DNA, 14 bp, Homo sapiens
ctttcacaaaaaag

SEQ ID NO: 1195003 - DNA, 13 bp, Homo sapiens
ctttcacaagcaa

SEQ ID NO: 1195004 - DNA, 14 bp, Homo sapiens
ctttcacacatctg

SEQ ID NO: 1195005 - DNA, 18 bp, Homo sapiens
ctttcacacatctgggtg

SEQ ID NO: 1195006 - DNA, 14 bp, Homo sapiens
ctttcacagctcct

SEQ ID NO: 1195007 - DNA, 24 bp, Homo sapiens
ctttcacattgtttgctgctattg

SEQ ID NO: 1195008 - DNA, 15 bp, Homo sapiens
ctttcaccagaattt

SEQ ID NO: 1195009 - DNA, 20 bp, Homo sapiens
ctttcactataatgtgaaat

SEQ ID NO: 1195010 - DNA, 14 bp, Homo sapiens
ctttcactggaatg

SEQ ID NO: 1195011 - DNA, 17 bp, Homo sapiens
ctttcacttcttcctat

SEQ ID NO: 1195012 - DNA, 15 bp, Homo sapiens
ctttcacttgatgtt

SEQ ID NO: 1195013 - DNA, 16 bp, Homo sapiens
ctttcacttttagttg

SEQ ID NO: 1195014 - DNA, 14 bp, Homo sapiens
ctttcagagacagc

SEQ ID NO: 1195015 - DNA, 20 bp, Homo sapiens
ctttcagatgaccttttgga

SEQ ID NO: 1195016 - DNA, 16 bp, Homo sapiens
ctttcagatgtcttct

SEQ ID NO: 1195017 - DNA, 20 bp, Homo sapiens
ctttcagatgtcttctgcct

SEQ ID NO: 1195018 - DNA, 21 bp, Homo sapiens
ctttcagctgtgtctgacatg

SEQ ID NO: 1195019 - DNA, 20 bp, Homo sapiens
ctttcaggctacctttttct

SEQ ID NO: 1195020 - DNA, 15 bp, Homo sapiens
ctttcagtacttttt

SEQ ID NO: 1195021 - DNA, 13 bp, Homo sapiens
ctttcagtggaat

SEQ ID NO: 1195022 - DNA, 14 bp, Homo sapiens
ctttcagttagcct

SEQ ID NO: 1195023 - DNA, 19 bp, Homo sapiens
ctttcagtttcaggagtgc

SEQ ID NO: 1195024 - DNA, 16 bp, Homo sapiens
ctttcataatttttaa

SEQ ID NO: 1195025 - DNA, 15 bp, Homo sapiens
ctttcatagagaggc

SEQ ID NO: 1195026 - DNA, 13 bp, Homo sapiens
ctttcatatagtt

SEQ ID NO: 1195027 - DNA, 16 bp, Homo sapiens
ctttcatcacactggg

SEQ ID NO: 1195028 - DNA, 13 bp, Homo sapiens
ctttcatcctgtg

SEQ ID NO: 1195029 - DNA, 15 bp, Homo sapiens
ctttcatcctgtgtc

SEQ ID NO: 1195030 - DNA, 13 bp, Homo sapiens
ctttcatgaccac

SEQ ID NO: 1195031 - DNA, 17 bp, Homo sapiens
ctttcatgtaaactgtg

SEQ ID NO: 1195032 - DNA, 14 bp, Homo sapiens
ctttcattaggcaa

SEQ ID NO: 1195033 - DNA, 15 bp, Homo sapiens
ctttcattaggcaaa

SEQ ID NO: 1195034 - DNA, 22 bp, Homo sapiens
ctttcattcagcctttagaaat

SEQ ID NO: 1195035 - DNA, 22 bp, Homo sapiens
ctttcattgctaagactaactc

SEQ ID NO: 1195036 - DNA, 18 bp, Homo sapiens
ctttcatttgctttggaa

SEQ ID NO: 1195037 - DNA, 10 bp, Homo sapiens
ctttcatttt

SEQ ID NO: 1195038 - DNA, 20 bp, Homo sapiens
ctttccaaattatttcttaa

SEQ ID NO: 1195039 - DNA, 15 bp, Homo sapiens
ctttccaaggcttct

SEQ ID NO: 1195040 - DNA, 16 bp, Homo sapiens
ctttccaatagaaaga

SEQ ID NO: 1195041 - DNA, 12 bp, Homo sapiens
gttattttctac

SEQ ID NO: 1195042 - DNA, 17 bp, Homo sapiens
gttattttctacagtgg

SEQ ID NO: 1195043 - DNA, 15 bp, Homo sapiens
gttattttcttgttt

SEQ ID NO: 1195044 - DNA, 17 bp, Homo sapiens
gttattttcttgtttaa

SEQ ID NO: 1195045 - DNA, 18 bp, Homo sapiens
gttattttgatgtaaaga

SEQ ID NO: 1195046 - DNA, 19 bp, Homo sapiens
gttatttttctcttgtacc

SEQ ID NO: 1195047 - DNA, 22 bp, Homo sapiens
gttatttttgtttcttccaaag

SEQ ID NO: 1195048 - DNA, 14 bp, Homo sapiens
gttcaaaattctaa

SEQ ID NO: 1195049 - DNA, 18 bp, Homo sapiens
gttcaaactactgtacat

SEQ ID NO: 1195050 - DNA, 22 bp, Homo sapiens
gttcaaagatattttgctttgt

SEQ ID NO: 1195051 - DNA, 23 bp, Homo sapiens
gttcaaagccacattatttctag

SEQ ID NO: 1195052 - DNA, 21 bp, Homo sapiens
gttcaaagtgtatatttattc

SEQ ID NO: 1195053 - DNA, 14 bp, Homo sapiens
gttcaaatcctcac

SEQ ID NO: 1195054 - DNA, 13 bp, Homo sapiens
gttcaacaaagaa

SEQ ID NO: 1195055 - DNA, 22 bp, Homo sapiens
gttcaacaaagaaacaaagatg

SEQ ID NO: 1195056 - DNA, 20 bp, Homo sapiens
gttcaacctggtggcaccag

SEQ ID NO: 1195057 - DNA, 13 bp, Homo sapiens
gttcaagccatgg

SEQ ID NO: 1195058 - DNA, 21 bp, Homo sapiens
gttcaaggtcactgtttcctg

SEQ ID NO: 1195059 - DNA, 17 bp, Homo sapiens
gttcaagtgattctctt

SEQ ID NO: 1195060 - DNA, 23 bp, Homo sapiens
gttcaataaagcactgagcaagt

SEQ ID NO: 1195061 - DNA, 14 bp, Homo sapiens
gttcaataagcatt

SEQ ID NO: 1195062 - DNA, 15 bp, Homo sapiens
gttcaatgaaataaa

SEQ ID NO: 1195063 - DNA, 18 bp, Homo sapiens
gttcaatgcaaagtaaaa

SEQ ID NO: 1195064 - DNA, 20 bp, Homo sapiens
gttcaatgcaaagtaaaaaa

SEQ ID NO: 1195065 - DNA, 22 bp, Homo sapiens
gttcaatgcctcacgagatttg

SEQ ID NO: 1195066 - DNA, 20 bp, Homo sapiens
gttcaattttttttaatcta

SEQ ID NO: 1195067 - DNA, 16 bp, Homo sapiens
gttcacaaactgtgaa

SEQ ID NO: 1195068 - DNA, 20 bp, Homo sapiens
gttcacaaactgtgaaaata

SEQ ID NO: 1195069 - DNA, 13 bp, Homo sapiens
gttcacagaagga

SEQ ID NO: 1195070 - DNA, 16 bp, Homo sapiens
gttcacccacagggct

SEQ ID NO: 1195071 - DNA, 22 bp, Homo sapiens
gttcacctccaagcatttcatg

SEQ ID NO: 1195072 - DNA, 13 bp, Homo sapiens
ctttctgccttag

SEQ ID NO: 1195073 - DNA, 17 bp, Homo sapiens
ctttctgctcagcttct

SEQ ID NO: 1195074 - DNA, 15 bp, Homo sapiens
ctttctgctctgcca

SEQ ID NO: 1195075 - DNA, 14 bp, Homo sapiens
ctttctggccccag

SEQ ID NO: 1195076 - DNA, 15 bp, Homo sapiens
ctttctggcctgcct

SEQ ID NO: 1195077 - DNA, 13 bp, Homo sapiens
ctttctggcctgt

SEQ ID NO: 1195078 - DNA, 12 bp, Homo sapiens
ctttctgggagc

SEQ ID NO: 1195079 - DNA, 12 bp, Homo sapiens
ctttctgggctt

SEQ ID NO: 1195080 - DNA, 14 bp, Homo sapiens
ctttctgggctttc

SEQ ID NO: 1195081 - DNA, 19 bp, Homo sapiens
ctttctggtgttttatttc

SEQ ID NO: 1195082 - DNA, 22 bp, Homo sapiens
ctttctggttgtttttgttctt

SEQ ID NO: 1195083 - DNA, 13 bp, Homo sapiens
ctttctgtagcct

SEQ ID NO: 1195084 - DNA, 23 bp, Homo sapiens
ctttctgtctaggttaaagctaa

SEQ ID NO: 1195085 - DNA, 14 bp, Homo sapiens
ctttctgtctgctt

SEQ ID NO: 1195086 - DNA, 15 bp, Homo sapiens
ctttctgtgaagcta

SEQ ID NO: 1195087 - DNA, 21 bp, Homo sapiens
ctttctgtgaagctaatacaa

SEQ ID NO: 1195088 - DNA, 22 bp, Homo sapiens
ctttctgtgccctactcattgg

SEQ ID NO: 1195089 - DNA, 20 bp, Homo sapiens
ctttctgttccaaattcagt

SEQ ID NO: 1195090 - DNA, 15 bp, Homo sapiens
ctttctgttgtcatt

SEQ ID NO: 1195091 - DNA, 21 bp, Homo sapiens
ctttctgttttctgtttgtaa

SEQ ID NO: 1195092 - DNA, 22 bp, Homo sapiens
ctttctgttttctgtttgtaaa

SEQ ID NO: 1195093 - DNA, 12 bp, Homo sapiens
ctttcttaaaaa

SEQ ID NO: 1195094 - DNA, 22 bp, Homo sapiens
ctttcttaagccctttgctctg

SEQ ID NO: 1195095 - DNA, 23 bp, Homo sapiens
ctttcttaagccctttgctctgg

SEQ ID NO: 1195096 - DNA, 19 bp, Homo sapiens
ctttcttaattttgtcttt

SEQ ID NO: 1195097 - DNA, 21 bp, Homo sapiens
ctttcttataatactctgttg

SEQ ID NO: 1195098 - DNA, 22 bp, Homo sapiens
ctttcttcaccaagtgcaatag

SEQ ID NO: 1195099 - DNA, 14 bp, Homo sapiens
ctttcttcccgtgt

SEQ ID NO: 1195100 - DNA, 13 bp, Homo sapiens
ctttcttccgcac

SEQ ID NO: 1195101 - DNA, 14 bp, Homo sapiens
ctttcttcctctgc

SEQ ID NO: 1195102 - DNA, 16 bp, Homo sapiens
ctttcttcctcttctt

SEQ ID NO: 1195103 - DNA, 13 bp, Homo sapiens
ctttcttcctgca

SEQ ID NO: 1195104 - DNA, 13 bp, Homo sapiens
ctttcttcctttc

SEQ ID NO: 1195105 - DNA, 16 bp, Homo sapiens
ctttcttctattttat

SEQ ID NO: 1195106 - DNA, 22 bp, Homo sapiens
ctttcttgacaaaacctaactt

SEQ ID NO: 1195107 - DNA, 13 bp, Homo sapiens
ctttcttgcagat

SEQ ID NO: 1195108 - DNA, 20 bp, Homo sapiens
ctttcttgctggctctgaga

SEQ ID NO: 1195109 - DNA, 21 bp, Homo sapiens
ctttcttgctggttgtcattt

SEQ ID NO: 1195110 - DNA, 13 bp, Homo sapiens
ctttcttggccag

SEQ ID NO: 1195111 - DNA, 14 bp, Homo sapiens
ctttcttggccagt

SEQ ID NO: 1195112 - DNA, 21 bp, Homo sapiens
ctttcttgggatagtgttctg

SEQ ID NO: 1195113 - DNA, 21 bp, Homo sapiens
ctttcttgtcttttcagaagc

SEQ ID NO: 1195114 - DNA, 19 bp, Homo sapiens
ctttcttgtgccctgggcc

SEQ ID NO: 1195115 - DNA, 17 bp, Homo sapiens
ctttctttaaagttctt

SEQ ID NO: 1195116 - DNA, 18 bp, Homo sapiens
ctttctttacctgagacc

SEQ ID NO: 1195117 - DNA, 16 bp, Homo sapiens
ctttctttcacaaaaa

SEQ ID NO: 1195118 - DNA, 17 bp, Homo sapiens
ctttctttcagatgttt

SEQ ID NO: 1195119 - DNA, 21 bp, Homo sapiens
ctttctttccaaaacatttct

SEQ ID NO: 1195120 - DNA, 21 bp, Homo sapiens
ctttctttgcaccaaagacat

SEQ ID NO: 1195121 - DNA, 18 bp, Homo sapiens
ctttctttgtttctttct

SEQ ID NO: 1195122 - DNA, 18 bp, Homo sapiens
ctttcttttgattcttcc

SEQ ID NO: 1195123 - DNA, 13 bp, Homo sapiens
ctttctttttctg

SEQ ID NO: 1195124 - DNA, 14 bp, Homo sapiens
ctttctttttctgg

SEQ ID NO: 1195125 - DNA, 18 bp, Homo sapiens
ctttctttttctggaaat

SEQ ID NO: 1195126 - DNA, 20 bp, Homo sapiens
ctttctttttcttcttccct

SEQ ID NO: 1195127 - DNA, 15 bp, Homo sapiens
ctttgaaaaaaaata

SEQ ID NO: 1195128 - DNA, 23 bp, Homo sapiens
ctttgaaaacaattcagtggtct

SEQ ID NO: 1195129 - DNA, 17 bp, Homo sapiens
ctttgaaaagttggaag

SEQ ID NO: 1195130 - DNA, 20 bp, Homo sapiens
ctttgaaaagttggaaggat

SEQ ID NO: 1195131 - DNA, 16 bp, Homo sapiens
ctttgaaaatatttct

SEQ ID NO: 1195132 - DNA, 20 bp, Homo sapiens
ctttgaaaatatttctatgt

SEQ ID NO: 1195133 - DNA, 22 bp, Homo sapiens
ctttgaaacaagataactgaga

SEQ ID NO: 1195134 - DNA, 17 bp, Homo sapiens
ctttgaaacctcagggc

SEQ ID NO: 1195135 - DNA, 14 bp, Homo sapiens
ctttgaaataaaaa

SEQ ID NO: 1195136 - DNA, 21 bp, Homo sapiens
ctttgaaatagtctgtgtgaa

SEQ ID NO: 1195137 - DNA, 23 bp, Homo sapiens
ctttgaaatgtgtttctgtataa

SEQ ID NO: 1195138 - DNA, 13 bp, Homo sapiens
ctttgaagcctca

SEQ ID NO: 1195139 - DNA, 13 bp, Homo sapiens
ctttgaagggcaa

SEQ ID NO: 1195140 - DNA, 13 bp, Homo sapiens
ctttgaagtagct

SEQ ID NO: 1195141 - DNA, 18 bp, Homo sapiens
ctttgaataaaaatgcac

SEQ ID NO: 1195142 - DNA, 21 bp, Homo sapiens
ctttgaatattttttgaaggt

SEQ ID NO: 1195143 - DNA, 18 bp, Homo sapiens
ctttgaatctctgtatat

SEQ ID NO: 1195144 - DNA, 23 bp, Homo sapiens
ctttgaatgctaagaatgcatta

SEQ ID NO: 1195145 - DNA, 17 bp, Homo sapiens
ctttgaattttctgtgt

SEQ ID NO: 1195146 - DNA, 14 bp, Homo sapiens
ctttgacaaggaaa

SEQ ID NO: 1195147 - DNA, 22 bp, Homo sapiens
ctttgacaaggaaaatctatat

SEQ ID NO: 1195148 - DNA, 18 bp, Homo sapiens
ctttgaccagatctttct

SEQ ID NO: 1195149 - DNA, 18 bp, Homo sapiens
ctttgacctcaacctgtg

SEQ ID NO: 1195150 - DNA, 14 bp, Homo sapiens
ctttgacctctgca

SEQ ID NO: 1195151 - DNA, 18 bp, Homo sapiens
ctttgacctctgcagcaa

SEQ ID NO: 1195152 - DNA, 20 bp, Homo sapiens
ctttgacctctgcagcaata

SEQ ID NO: 1195153 - DNA, 16 bp, Homo sapiens
ctttgactcacctgtt

SEQ ID NO: 1195154 - DNA, 13 bp, Homo sapiens
ctttgactgtcag

SEQ ID NO: 1195155 - DNA, 22 bp, Homo sapiens
ctttgacttcttgcttcagtca

SEQ ID NO: 1195156 - DNA, 21 bp, Homo sapiens
ctttgactttatctcctgctc

SEQ ID NO: 1195157 - DNA, 15 bp, Homo sapiens
ctttgactttttgca

SEQ ID NO: 1195158 - DNA, 13 bp, Homo sapiens
ctttgagaagatg

SEQ ID NO: 1195159 - DNA, 18 bp, Homo sapiens
ctttgagatagaagaact

SEQ ID NO: 1195160 - DNA, 19 bp, Homo sapiens
ctttgagatagaagaactg

SEQ ID NO: 1195161 - DNA, 16 bp, Homo sapiens
ctttgagatctgggga

SEQ ID NO: 1195162 - DNA, 18 bp, Homo sapiens
ctttgagatctggggagg

SEQ ID NO: 1195163 - DNA, 21 bp, Homo sapiens
ctttgagcccattcttctggg

SEQ ID NO: 1195164 - DNA, 17 bp, Homo sapiens
ctttgagcctgcatctt

SEQ ID NO: 1195165 - DNA, 18 bp, Homo sapiens
ctttgagcctgcatcttc

SEQ ID NO: 1195166 - DNA, 13 bp, Homo sapiens
ctttgaggaaacc

SEQ ID NO: 1195167 - DNA, 16 bp, Homo sapiens
ctttgaggctctgtca

SEQ ID NO: 1195168 - DNA, 16 bp, Homo sapiens
ctttgaggctttctaa

SEQ ID NO: 1195169 - DNA, 17 bp, Homo sapiens
ctttgaggttgctttgt

SEQ ID NO: 1195170 - DNA, 21 bp, Homo sapiens
ctttgagtaccaaatccacaa

SEQ ID NO: 1195171 - DNA, 21 bp, Homo sapiens
ctttgagtgcagtcctgatca

SEQ ID NO: 1195172 - DNA, 13 bp, Homo sapiens
ctttgagtgtaaa

SEQ ID NO: 1195173 - DNA, 15 bp, Homo sapiens
ctttgatatttcaat

SEQ ID NO: 1195174 - DNA, 14 bp, Homo sapiens
ctttgatcacagga

SEQ ID NO: 1195175 - DNA, 17 bp, Homo sapiens
ctttgatcacaggagca

SEQ ID NO: 1195176 - DNA, 19 bp, Homo sapiens
ctttgatcccagaaagtat

SEQ ID NO: 1195177 - DNA, 17 bp, Homo sapiens
ctttgatccttctgagc

SEQ ID NO: 1195178 - DNA, 14 bp, Homo sapiens
ctttgatccttgga

SEQ ID NO: 1195179 - DNA, 15 bp, Homo sapiens
ctttgatccttggaa

SEQ ID NO: 1195180 - DNA, 16 bp, Homo sapiens
ctttgatctctgctta

SEQ ID NO: 1195181 - DNA, 23 bp, Homo sapiens
ctttgatctggacagaacattta

SEQ ID NO: 1195182 - DNA, 18 bp, Homo sapiens
ctttgatgaattcttcct

SEQ ID NO: 1195183 - DNA, 19 bp, Homo sapiens
ctttgatgaattcttcctc

SEQ ID NO: 1195184 - DNA, 21 bp, Homo sapiens
ctttgatgaattcttcctctc

SEQ ID NO: 1195185 - DNA, 21 bp, Homo sapiens
ctttgatgattaattcacctt

SEQ ID NO: 1195186 - DNA, 21 bp, Homo sapiens
ctttgattatttgcatgttat

SEQ ID NO: 1195187 - DNA, 22 bp, Homo sapiens
ctttgattatttgcatgttatg

SEQ ID NO: 1195188 - DNA, 13 bp, Homo sapiens
ctttgatttacag

SEQ ID NO: 1195189 - DNA, 18 bp, Homo sapiens
ctttgatttacagcaagt

SEQ ID NO: 1195190 - DNA, 13 bp, Homo sapiens
ctttgatttgtac

SEQ ID NO: 1195191 - DNA, 18 bp, Homo sapiens
ctttgatttgtaccattc

SEQ ID NO: 1195192 - DNA, 21 bp, Homo sapiens
ctttgatttttatccatttct

SEQ ID NO: 1195193 - DNA, 23 bp, Homo sapiens
ctttgatttttatccatttcttt

SEQ ID NO: 1195194 - DNA, 15 bp, Homo sapiens
gttctagagaagagg

SEQ ID NO: 1195195 - DNA, 18 bp, Homo sapiens
gttctaggaactcagtgc

SEQ ID NO: 1195196 - DNA, 14 bp, Homo sapiens
gttctagtgttttc

SEQ ID NO: 1195197 - DNA, 17 bp, Homo sapiens
gttctagtgttttcaat

SEQ ID NO: 1195198 - DNA, 13 bp, Homo sapiens
gttctagttttca

SEQ ID NO: 1195199 - DNA, 15 bp, Homo sapiens
gttctagttttcagt

SEQ ID NO: 1195200 - DNA, 23 bp, Homo sapiens
gttctatcaggggtgcattctgg

SEQ ID NO: 1195201 - DNA, 19 bp, Homo sapiens
gttctatcagttatccttt

SEQ ID NO: 1195202 - DNA, 18 bp, Homo sapiens
gttctatttttgtttaca

SEQ ID NO: 1195203 - DNA, 12 bp, Homo sapiens
gttctcaatgaa

SEQ ID NO: 1195204 - DNA, 15 bp, Homo sapiens
gttctcaatgaaaaa

SEQ ID NO: 1195205 - DNA, 12 bp, Homo sapiens
gttctcacaccc

SEQ ID NO: 1195206 - DNA, 17 bp, Homo sapiens
gttctcagatcttgaca

SEQ ID NO: 1195207 - DNA, 18 bp, Homo sapiens
gttctcagatcttgacag

SEQ ID NO: 1195208 - DNA, 17 bp, Homo sapiens
gttctcaggtgttgcca

SEQ ID NO: 1195209 - DNA, 19 bp, Homo sapiens
gttctcatgaactacccca

SEQ ID NO: 1195210 - DNA, 19 bp, Homo sapiens
gttctcatgaagcaggagg

SEQ ID NO: 1195211 - DNA, 15 bp, Homo sapiens
gttctcatttgatca

SEQ ID NO: 1195212 - DNA, 22 bp, Homo sapiens
gttctccaacatcacagcccag

SEQ ID NO: 1195213 - DNA, 23 bp, Homo sapiens
gttctccaacatcacagcccagc

SEQ ID NO: 1195214 - DNA, 19 bp, Homo sapiens
gttctccagcttcagctca

SEQ ID NO: 1195215 - DNA, 23 bp, Homo sapiens
gttctcccagcactgcctcctgt

SEQ ID NO: 1195216 - DNA, 16 bp, Homo sapiens
gttctccctttctctc

SEQ ID NO: 1195217 - DNA, 19 bp, Homo sapiens
gttctccgggtgtggcctc

SEQ ID NO: 1195218 - DNA, 18 bp, Homo sapiens
gttctccgttagctcctg

SEQ ID NO: 1195219 - DNA, 19 bp, Homo sapiens
gttctccgttagctcctgt

SEQ ID NO: 1195220 - DNA, 22 bp, Homo sapiens
gttctccgttagctcctgtggc

SEQ ID NO: 1195221 - DNA, 21 bp, Homo sapiens
gttctcctggaggcaggggct

SEQ ID NO: 1195222 - DNA, 14 bp, Homo sapiens
gttctccttcctca

SEQ ID NO: 1195223 - DNA, 16 bp, Homo sapiens
gttctcgaactcctga

SEQ ID NO: 1195224 - DNA, 21 bp, Homo sapiens
gttctcgaactcctgacctca

SEQ ID NO: 1195225 - DNA, 23 bp, Homo sapiens
gttctcgttttgggccagaggca

SEQ ID NO: 1195226 - DNA, 15 bp, Homo sapiens
gttctctcttctcca

SEQ ID NO: 1195227 - DNA, 15 bp, Homo sapiens
gttctctctttgcat

SEQ ID NO: 1195228 - DNA, 15 bp, Homo sapiens
gttctctgatgcaga

SEQ ID NO: 1195229 - DNA, 16 bp, Homo sapiens
gttctctgctgagggc

SEQ ID NO: 1195230 - DNA, 14 bp, Homo sapiens
gttctctgggagaa

SEQ ID NO: 1195231 - DNA, 14 bp, Homo sapiens
gttctctgtcccca

SEQ ID NO: 1195232 - DNA, 18 bp, Homo sapiens
gttctcttcccaggcctt

SEQ ID NO: 1195233 - DNA, 21 bp, Homo sapiens
gttctcttgctttcacattgt

SEQ ID NO: 1195234 - DNA, 12 bp, Homo sapiens
gttctctttgga

SEQ ID NO: 1195235 - DNA, 15 bp, Homo sapiens
gttctctttggaaat

SEQ ID NO: 1195236 - DNA, 15 bp, Homo sapiens
gttctgaaataaact

SEQ ID NO: 1195237 - DNA, 20 bp, Homo sapiens
gttctgaaatgtcagttctg

SEQ ID NO: 1195238 - DNA, 21 bp, Homo sapiens
gttctgaaattaaagtatgca

SEQ ID NO: 1195239 - DNA, 23 bp, Homo sapiens
gttctgaagccatgtagccaccc

SEQ ID NO: 1195240 - DNA, 16 bp, Homo sapiens
gttctgacacacgtat

SEQ ID NO: 1195241 - DNA, 23 bp, Homo sapiens
gttctgacattaacagttttcca

SEQ ID NO: 1195242 - DNA, 23 bp, Homo sapiens
gttctgagaactgactttctccc

SEQ ID NO: 1195243 - DNA, 19 bp, Homo sapiens
gttctgagccgggcaagtc

SEQ ID NO: 1195244 - DNA, 14 bp, Homo sapiens
gttctgaggggtgt

SEQ ID NO: 1195245 - DNA, 18 bp, Homo sapiens
gttctgagtcctgagact

SEQ ID NO: 1195246 - DNA, 14 bp, Homo sapiens
gttctgagtgtttt

SEQ ID NO: 1195247 - DNA, 15 bp, Homo sapiens
gttctgcaaaataca

SEQ ID NO: 1195248 - DNA, 14 bp, Homo sapiens
gttctgcaaataga

SEQ ID NO: 1195249 - DNA, 18 bp, Homo sapiens
gttctgcaaatagaaaac

SEQ ID NO: 1195250 - DNA, 17 bp, Homo sapiens
gttctgcaaattaatgt

SEQ ID NO: 1195251 - DNA, 15 bp, Homo sapiens
gttctgcaagaatta

SEQ ID NO: 1195252 - DNA, 22 bp, Homo sapiens
gttctgcatcacccgcccctgg

SEQ ID NO: 1195253 - DNA, 17 bp, Homo sapiens
gttctgccacctctgac

SEQ ID NO: 1195254 - DNA, 15 bp, Homo sapiens
gttctgccagatctt

SEQ ID NO: 1195255 - DNA, 21 bp, Homo sapiens
gttctgcccaaattatgtgaa

SEQ ID NO: 1195256 - DNA, 23 bp, Homo sapiens
gttctgcccaaattatgtgaaat

SEQ ID NO: 1195257 - DNA, 18 bp, Homo sapiens
gttctgccctgcctgagg

SEQ ID NO: 1195258 - DNA, 19 bp, Homo sapiens
gttctgccctgcctgagga

SEQ ID NO: 1195259 - DNA, 20 bp, Homo sapiens
gttctgccctgcctgaggag

SEQ ID NO: 1195260 - DNA, 13 bp, Homo sapiens
gttctgcctctcc

SEQ ID NO: 1195261 - DNA, 17 bp, Homo sapiens
gttctgcctctccctgg

SEQ ID NO: 1195262 - DNA, 20 bp, Homo sapiens
gttctgcctctccctgggtc

SEQ ID NO: 1195263 - DNA, 20 bp, Homo sapiens
gttctgcctttagcctggac

SEQ ID NO: 1195264 - DNA, 19 bp, Homo sapiens
gttctgctacccactgcca

SEQ ID NO: 1195265 - DNA, 23 bp, Homo sapiens
gttctgctcatcattctctgtct

SEQ ID NO: 1195266 - DNA, 21 bp, Homo sapiens
gttctgctcccagatgccttc

SEQ ID NO: 1195267 - DNA, 13 bp, Homo sapiens
gttctgctcctct

SEQ ID NO: 1195268 - DNA, 17 bp, Homo sapiens
gttctgctcctctccag

SEQ ID NO: 1195269 - DNA, 18 bp, Homo sapiens
gttctgctcctctccagg

SEQ ID NO: 1195270 - DNA, 22 bp, Homo sapiens
gttctgctcctctccaggcacc

SEQ ID NO: 1195271 - DNA, 22 bp, Homo sapiens
gttctgctgaccaaatggccag

SEQ ID NO: 1195272 - DNA, 13 bp, Homo sapiens
gttctgctggcct

SEQ ID NO: 1195273 - DNA, 23 bp, Homo sapiens
gttctgcttcaaggcttccactg

SEQ ID NO: 1195274 - DNA, 14 bp, Homo sapiens
gttctggcaggacc

SEQ ID NO: 1195275 - DNA, 15 bp, Homo sapiens
gttctggcaggacct

SEQ ID NO: 1195276 - DNA, 16 bp, Homo sapiens
gttctggctgtttgag

SEQ ID NO: 1195277 - DNA, 12 bp, Homo sapiens
gttctgggctgg

SEQ ID NO: 1195278 - DNA, 23 bp, Homo sapiens
gttctggggcatcagccagctac

SEQ ID NO: 1195279 - DNA, 15 bp, Homo sapiens
gttctggggcccctt

SEQ ID NO: 1195280 - DNA, 17 bp, Homo sapiens
gttctgggttttctgaa

SEQ ID NO: 1195281 - DNA, 12 bp, Homo sapiens
gttctgtgaaga

SEQ ID NO: 1195282 - DNA, 14 bp, Homo sapiens
gttctgtgactgaa

SEQ ID NO: 1195283 - DNA, 22 bp, Homo sapiens
gttctgtgactgaagaagatga

SEQ ID NO: 1195284 - DNA, 15 bp, Homo sapiens
gttctgtgcctcccc

SEQ ID NO: 1195285 - DNA, 18 bp, Homo sapiens
gttctgtggtcacagtga

SEQ ID NO: 1195286 - DNA, 18 bp, Homo sapiens
gttctgtggttcctctgc

SEQ ID NO: 1195287 - DNA, 19 bp, Homo sapiens
gttctgtggttttcccctc

SEQ ID NO: 1195288 - DNA, 17 bp, Homo sapiens
gttctgtgtagagaatg

SEQ ID NO: 1195289 - DNA, 22 bp, Homo sapiens
gttctgtgtcctctgcctgggc

SEQ ID NO: 1195290 - DNA, 13 bp, Homo sapiens
gttctgtgtcttt

SEQ ID NO: 1195291 - DNA, 14 bp, Homo sapiens
gttctgttaactga

SEQ ID NO: 1195292 - DNA, 18 bp, Homo sapiens
gttctgttaactgaatac

SEQ ID NO: 1195293 - DNA, 21 bp, Homo sapiens
gttctgttaactgaataccac

SEQ ID NO: 1195294 - DNA, 14 bp, Homo sapiens
gttctgttctgggg

SEQ ID NO: 1195295 - DNA, 16 bp, Homo sapiens
gttctgttctggggga

SEQ ID NO: 1195296 - DNA, 20 bp, Homo sapiens
gttctgttgaaggtgccatt

SEQ ID NO: 1195297 - DNA, 18 bp, Homo sapiens
gttctgttgatcccactt

SEQ ID NO: 1195298 - DNA, 22 bp, Homo sapiens
gttctgtttgttaaaactggca

SEQ ID NO: 1195299 - DNA, 20 bp, Homo sapiens
gttcttaaatgtttatactg

SEQ ID NO: 1195300 - DNA, 16 bp, Homo sapiens
gttcttaagacgtgat

SEQ ID NO: 1195301 - DNA, 13 bp, Homo sapiens
cttttaagaaaaa

SEQ ID NO: 1195302 - DNA, 13 bp, Homo sapiens
cttttaagaaaca

SEQ ID NO: 1195303 - DNA, 17 bp, Homo sapiens
cttttaagcatttgtat

SEQ ID NO: 1195304 - DNA, 20 bp, Homo sapiens
cttttaagcatttgtatatt

SEQ ID NO: 1195305 - DNA, 17 bp, Homo sapiens
cttttaagtgccttgga

SEQ ID NO: 1195306 - DNA, 16 bp, Homo sapiens
cttttaatacagggta

SEQ ID NO: 1195307 - DNA, 15 bp, Homo sapiens
cttttaatgaacaaa

SEQ ID NO: 1195308 - DNA, 12 bp, Homo sapiens
cttttaatgaat

SEQ ID NO: 1195309 - DNA, 23 bp, Homo sapiens
cttttaatgaatttaaggcaaaa

SEQ ID NO: 1195310 - DNA, 15 bp, Homo sapiens
cttttaatgcttcat

SEQ ID NO: 1195311 - DNA, 20 bp, Homo sapiens
cttttaattaaataaaagct

SEQ ID NO: 1195312 - DNA, 20 bp, Homo sapiens
cttttaattagatcctgaaa

SEQ ID NO: 1195313 - DNA, 12 bp, Homo sapiens
cttttaattcat

SEQ ID NO: 1195314 - DNA, 19 bp, Homo sapiens
cttttacagaatgcattaa

SEQ ID NO: 1195315 - DNA, 16 bp, Homo sapiens
cttttacattctgtgt

SEQ ID NO: 1195316 - DNA, 13 bp, Homo sapiens
cttttctgcattt

SEQ ID NO: 1195317 - DNA, 21 bp, Homo sapiens
cttttctgccctgccctcagc

SEQ ID NO: 1195318 - DNA, 19 bp, Homo sapiens
cttttctgccctggctgct

SEQ ID NO: 1195319 - DNA, 16 bp, Homo sapiens
cttttctgctgttgcc

SEQ ID NO: 1195320 - DNA, 18 bp, Homo sapiens
cttttctggtccctcttc

SEQ ID NO: 1195321 - DNA, 12 bp, Homo sapiens
cttttctggttc

SEQ ID NO: 1195322 - DNA, 13 bp, Homo sapiens
cttttctgtattt

SEQ ID NO: 1195323 - DNA, 23 bp, Homo sapiens
cttttctgtccgagctttgaaaa

SEQ ID NO: 1195324 - DNA, 16 bp, Homo sapiens
cttttctgtcctgggc

SEQ ID NO: 1195325 - DNA, 16 bp, Homo sapiens
cttttctgttctagtt

SEQ ID NO: 1195326 - DNA, 14 bp, Homo sapiens
cttttcttactcct

SEQ ID NO: 1195327 - DNA, 11 bp, Homo sapiens
cttttcttatt

SEQ ID NO: 1195328 - DNA, 17 bp, Homo sapiens
cttttcttcttcctggt

SEQ ID NO: 1195329 - DNA, 17 bp, Homo sapiens
cttttcttggcttgttt

SEQ ID NO: 1195330 - DNA, 11 bp, Homo sapiens
cttttcttgta

SEQ ID NO: 1195331 - DNA, 23 bp, Homo sapiens
cttttctttgaaggatgactaca

SEQ ID NO: 1195332 - DNA, 23 bp, Homo sapiens
cttttctttgaccagatctttct

SEQ ID NO: 1195333 - DNA, 15 bp, Homo sapiens
cttttcttttctaac

SEQ ID NO: 1195334 - DNA, 14 bp, Homo sapiens
cttttctttttctc

SEQ ID NO: 1195335 - DNA, 18 bp, Homo sapiens
cttttcttttttaaagta

SEQ ID NO: 1195336 - DNA, 22 bp, Homo sapiens
cttttctttttttctttaataa

SEQ ID NO: 1195337 - DNA, 17 bp, Homo sapiens
cttttgaaaactgctga

SEQ ID NO: 1195338 - DNA, 14 bp, Homo sapiens
cttttgaaatctgt

SEQ ID NO: 1195339 - DNA, 22 bp, Homo sapiens
cttttgaactggcaattgtcta

SEQ ID NO: 1195340 - DNA, 16 bp, Homo sapiens
cttttgaacttgtcac

SEQ ID NO: 1195341 - DNA, 17 bp, Homo sapiens
cttttgaagtcttccct

SEQ ID NO: 1195342 - DNA, 21 bp, Homo sapiens
cttttgaagtcttccctcaga

SEQ ID NO: 1195343 - DNA, 22 bp, Homo sapiens
cttttgaagtcttccctcagat

SEQ ID NO: 1195344 - DNA, 20 bp, Homo sapiens
cttttgaatccatgcttggg

SEQ ID NO: 1195345 - DNA, 23 bp, Homo sapiens
cttttgaatccatgcttgggtgt

SEQ ID NO: 1195346 - DNA, 17 bp, Homo sapiens
cttttgacactgctcta

SEQ ID NO: 1195347 - DNA, 13 bp, Homo sapiens
cttttgacatgtg

SEQ ID NO: 1195348 - DNA, 11 bp, Homo sapiens
cttttgacatt

SEQ ID NO: 1195349 - DNA, 16 bp, Homo sapiens
cttttgacattttatt

SEQ ID NO: 1195350 - DNA, 14 bp, Homo sapiens
cttttgagaggggt

SEQ ID NO: 1195351 - DNA, 22 bp, Homo sapiens
cttttgaggatgggatgtattt

SEQ ID NO: 1195352 - DNA, 19 bp, Homo sapiens
cttttgagtgggccctgcc

SEQ ID NO: 1195353 - DNA, 23 bp, Homo sapiens
cttttgagtgggccctgcccggg

SEQ ID NO: 1195354 - DNA, 15 bp, Homo sapiens
cttttgagtgtgtgt

SEQ ID NO: 1195355 - DNA, 13 bp, Homo sapiens
cttttgagtgttc

SEQ ID NO: 1195356 - DNA, 15 bp, Homo sapiens
cttttgatgacttca

SEQ ID NO: 1195357 - DNA, 15 bp, Homo sapiens
cttttgatggggaga

SEQ ID NO: 1195358 - DNA, 19 bp, Homo sapiens
cttttgatggggagaaagg

SEQ ID NO: 1195359 - DNA, 21 bp, Homo sapiens
cttttgcaaagaaagaaaaaa

SEQ ID NO: 1195360 - DNA, 18 bp, Homo sapiens
cttttgcaacttaatact

SEQ ID NO: 1195361 - DNA, 12 bp, Homo sapiens
cttttgcacccc

SEQ ID NO: 1195362 - DNA, 18 bp, Homo sapiens
cttttgcacccctcccat

SEQ ID NO: 1195363 - DNA, 19 bp, Homo sapiens
cttttgcacctgctctctt

SEQ ID NO: 1195364 - DNA, 14 bp, Homo sapiens
cttttgcagaagag

SEQ ID NO: 1195365 - DNA, 19 bp, Homo sapiens
cttttgcagcagaggagct

SEQ ID NO: 1195366 - DNA, 22 bp, Homo sapiens
cttttgcataagattaaaggaa

SEQ ID NO: 1195367 - DNA, 19 bp, Homo sapiens
cttttgcatttcctgtgtt

SEQ ID NO: 1195368 - DNA, 21 bp, Homo sapiens
cttttgccaactgaagccttc

SEQ ID NO: 1195369 - DNA, 18 bp, Homo sapiens
cttttgccactgctgtgt

SEQ ID NO: 1195370 - DNA, 16 bp, Homo sapiens
cttttgcccattttga

SEQ ID NO: 1195371 - DNA, 14 bp, Homo sapiens
cttttgccccagaa

SEQ ID NO: 1195372 - DNA, 22 bp, Homo sapiens
cttttgcccgttgaggtagagg

SEQ ID NO: 1195373 - DNA, 18 bp, Homo sapiens
cttttgccgttattaaaa

SEQ ID NO: 1195374 - DNA, 15 bp, Homo sapiens
cttttgcctggctgt

SEQ ID NO: 1195375 - DNA, 23 bp, Homo sapiens
cttttgctactaagttcacatta

SEQ ID NO: 1195376 - DNA, 16 bp, Homo sapiens
cttttgctagatggaa

SEQ ID NO: 1195377 - DNA, 15 bp, Homo sapiens
cttttgctgtctttc

SEQ ID NO: 1195378 - DNA, 19 bp, Homo sapiens
cttttgctgtctttctcta

SEQ ID NO: 1195379 - DNA, 20 bp, Homo sapiens
cttttgcttaccttttccta

SEQ ID NO: 1195380 - DNA, 20 bp, Homo sapiens
cttttgcttgccaaagtaca

SEQ ID NO: 1195381 - DNA, 15 bp, Homo sapiens
cttttgcttttggca

SEQ ID NO: 1195382 - DNA, 9 bp, Homo sapiens
cttttggaa

SEQ ID NO: 1195383 - DNA, 18 bp, Homo sapiens
cttttggaacatttcttt

SEQ ID NO: 1195384 - DNA, 14 bp, Homo sapiens
cttttggaatgact

SEQ ID NO: 1195385 - DNA, 17 bp, Homo sapiens
cttttggggagggaggg

SEQ ID NO: 1195386 - DNA, 19 bp, Homo sapiens
cttttggggagggagggga

SEQ ID NO: 1195387 - DNA, 21 bp, Homo sapiens
cttttggtaaagactggcttt

SEQ ID NO: 1195388 - DNA, 19 bp, Homo sapiens
cttttggtcttcagcctcc

SEQ ID NO: 1195389 - DNA, 23 bp, Homo sapiens
cttttggtcttcagcctccctca

SEQ ID NO: 1195390 - DNA, 23 bp, Homo sapiens
cttttggtttcaccttccctcga

SEQ ID NO: 1195391 - DNA, 14 bp, Homo sapiens
cttttggtttctgc

SEQ ID NO: 1195392 - DNA, 17 bp, Homo sapiens
cttttggtttgggggcg

SEQ ID NO: 1195393 - DNA, 22 bp, Homo sapiens
cttttggttttaaacctttaat

SEQ ID NO: 1195394 - DNA, 20 bp, Homo sapiens
cttttgtaattgtgtaaaaa

SEQ ID NO: 1195395 - DNA, 22 bp, Homo sapiens
cttttgtaattgtgtaaaaaat

SEQ ID NO: 1195396 - DNA, 12 bp, Homo sapiens
cttttgtaattt

SEQ ID NO: 1195397 - DNA, 17 bp, Homo sapiens
cttttgtaatttgaatt

SEQ ID NO: 1195398 - DNA, 22 bp, Homo sapiens
cttttgtagatggcgatgtgtt

SEQ ID NO: 1195399 - DNA, 23 bp, Homo sapiens
cttttgtagatggcgatgtgtta

SEQ ID NO: 1195400 - DNA, 17 bp, Homo sapiens
cttttgtaggctgttcc

SEQ ID NO: 1195401 - DNA, 15 bp, Homo sapiens
cttttgtatcttcct

SEQ ID NO: 1195402 - DNA, 16 bp, Homo sapiens
cttttgtatcttcctt

SEQ ID NO: 1195403 - DNA, 17 bp, Homo sapiens
cttttgtatcttccttt

SEQ ID NO: 1195404 - DNA, 16 bp, Homo sapiens
cttttgtatgtaaatg

SEQ ID NO: 1195405 - DNA, 20 bp, Homo sapiens
cttttgtatgtaaatgtgca

SEQ ID NO: 1195406 - DNA, 16 bp, Homo sapiens
cttttgtattaaaaaa

SEQ ID NO: 1195407 - DNA, 13 bp, Homo sapiens
cttttgtattaag

SEQ ID NO: 1195408 - DNA, 16 bp, Homo sapiens
cttttgtccccagggc

SEQ ID NO: 1195409 - DNA, 19 bp, Homo sapiens
cttttgtccttcctgtgcc

SEQ ID NO: 1195410 - DNA, 16 bp, Homo sapiens
cttttgtctaattaaa

SEQ ID NO: 1195411 - DNA, 17 bp, Homo sapiens
cttttgtgatgaacata

SEQ ID NO: 1195412 - DNA, 21 bp, Homo sapiens
cttttgtgatgaacatattca

SEQ ID NO: 1195413 - DNA, 23 bp, Homo sapiens
cttttgtgatgaacatattcatg

SEQ ID NO: 1195414 - DNA, 12 bp, Homo sapiens
cttttgtgcatt

SEQ ID NO: 1195415 - DNA, 20 bp, Homo sapiens
cttttgtggacttgtctgac

SEQ ID NO: 1195416 - DNA, 21 bp, Homo sapiens
cttttgtgggtttctctgtgc

SEQ ID NO: 1195417 - DNA, 19 bp, Homo sapiens
cttttgtgtaataagaaag

SEQ ID NO: 1195418 - DNA, 21 bp, Homo sapiens
cttttgtgttcctatggaaac

SEQ ID NO: 1195419 - DNA, 18 bp, Homo sapiens
cttttgttaaataatatg

SEQ ID NO: 1195420 - DNA, 18 bp, Homo sapiens
cttttgttagggctgctt

SEQ ID NO: 1195421 - DNA, 13 bp, Homo sapiens
cttttgttctaga

SEQ ID NO: 1195422 - DNA, 14 bp, Homo sapiens
cttttgttctagac

SEQ ID NO: 1195423 - DNA, 20 bp, Homo sapiens
cttttgttctcttctgcgta

SEQ ID NO: 1195424 - DNA, 16 bp, Homo sapiens
cttttgttctgagggg

SEQ ID NO: 1195425 - DNA, 16 bp, Homo sapiens
cttttgttgtacttta

SEQ ID NO: 1195426 - DNA, 19 bp, Homo sapiens
cttttgttgtactttatat

SEQ ID NO: 1195427 - DNA, 23 bp, Homo sapiens
cttttgttgtactttatatcttg

SEQ ID NO: 1195428 - DNA, 13 bp, Homo sapiens
cttttgttgtgac

SEQ ID NO: 1195429 - DNA, 14 bp, Homo sapiens
cttttgttgtgact

SEQ ID NO: 1195430 - DNA, 20 bp, Homo sapiens
cttttgttttctgatggcca

SEQ ID NO: 1195431 - DNA, 18 bp, Homo sapiens
gttgccccattcctaaga

SEQ ID NO: 1195432 - DNA, 23 bp, Homo sapiens
gttgccgcagcggtgggaaggaa

SEQ ID NO: 1195433 - DNA, 12 bp, Homo sapiens
gttgcctccccc

SEQ ID NO: 1195434 - DNA, 21 bp, Homo sapiens
gttgcctcccccgcctccagt

SEQ ID NO: 1195435 - DNA, 15 bp, Homo sapiens
gttgcctctcttgcc

SEQ ID NO: 1195436 - DNA, 18 bp, Homo sapiens
gttgccttaaagaaagtc

SEQ ID NO: 1195437 - DNA, 23 bp, Homo sapiens
gttgtcaatattaaatacagaca

SEQ ID NO: 1195438 - DNA, 12 bp, Homo sapiens
gttgtcagctga

SEQ ID NO: 1195439 - DNA, 21 bp, Homo sapiens
gttgtcataacatttaaagag

SEQ ID NO: 1195440 - DNA, 15 bp, Homo sapiens
gttgtcattgtccag

SEQ ID NO: 1195441 - DNA, 17 bp, Homo sapiens
gttgtcattgtccagct

SEQ ID NO: 1195442 - DNA, 18 bp, Homo sapiens
gttgtcattgtccagctg

SEQ ID NO: 1195443 - DNA, 22 bp, Homo sapiens
gttgtccaattgttgacagttc

SEQ ID NO: 1195444 - DNA, 12 bp, Homo sapiens
gttgtccaggaa

SEQ ID NO: 1195445 - DNA, 18 bp, Homo sapiens
gttgtcccaatgaaatac

SEQ ID NO: 1195446 - DNA, 16 bp, Homo sapiens
gttgtcccatctgccc

SEQ ID NO: 1195447 - DNA, 18 bp, Homo sapiens
gttgtccccgctggctca

SEQ ID NO: 1195448 - DNA, 14 bp, Homo sapiens
gttgtccttgcccc

SEQ ID NO: 1195449 - DNA, 17 bp, Homo sapiens
gttgtcgtaaagatttg

SEQ ID NO: 1195450 - DNA, 20 bp, Homo sapiens
gttgtctattctgagccttg

SEQ ID NO: 1195451 - DNA, 18 bp, Homo sapiens
gttgtctccttccattca

SEQ ID NO: 1195452 - DNA, 20 bp, Homo sapiens
gttgtctctgatgcagctta

SEQ ID NO: 1195453 - DNA, 23 bp, Homo sapiens
gttgtctctgttggtccactgtg

SEQ ID NO: 1195454 - DNA, 16 bp, Homo sapiens
gttgtctggcaaggac

SEQ ID NO: 1195455 - DNA, 14 bp, Homo sapiens
gttgtgaaatgtaa

SEQ ID NO: 1195456 - DNA, 15 bp, Homo sapiens
gttgtgaaatgtaac

SEQ ID NO: 1195457 - DNA, 23 bp, Homo sapiens
gttgtgactgccaggataaagct

SEQ ID NO: 1195458 - DNA, 23 bp, Homo sapiens
gttgtgactttttagccagtgac

SEQ ID NO: 1195459 - DNA, 19 bp, Homo sapiens
gttgtgagccctctagggc

SEQ ID NO: 1195460 - DNA, 13 bp, Homo sapiens
gttgtgagctgga

SEQ ID NO: 1195461 - DNA, 21 bp, Homo sapiens
gttgtgatagctaacatttta

SEQ ID NO: 1195462 - DNA, 22 bp, Homo sapiens
gttgtgattacctgctgcatga

SEQ ID NO: 1195463 - DNA, 14 bp, Homo sapiens
gttgtggccaatgt

SEQ ID NO: 1195464 - DNA, 18 bp, Homo sapiens
gttgtgggcttcctgctg

SEQ ID NO: 1195465 - DNA, 12 bp, Homo sapiens
gttgtgggcttt

SEQ ID NO: 1195466 - DNA, 13 bp, Homo sapiens
gttgtggggaggc

SEQ ID NO: 1195467 - DNA, 18 bp, Homo sapiens
gttgtggggaggctgcac

SEQ ID NO: 1195468 - DNA, 18 bp, Homo sapiens
gttgtgtcataaattaca

SEQ ID NO: 1195469 - DNA, 23 bp, Homo sapiens
gttgtgtctgtgccctccaaaga

SEQ ID NO: 1195470 - DNA, 15 bp, Homo sapiens
gttgtgtgagcgtgg

SEQ ID NO: 1195471 - DNA, 16 bp, Homo sapiens
gttgtgtgagcgtggc

SEQ ID NO: 1195472 - DNA, 19 bp, Homo sapiens
gttgtgtgagcgtggcctt

SEQ ID NO: 1195473 - DNA, 20 bp, Homo sapiens
gttgtgtgagcgtggccttg

SEQ ID NO: 1195474 - DNA, 23 bp, Homo sapiens
gttgtgtgagcgtggccttggga

SEQ ID NO: 1195475 - DNA, 16 bp, Homo sapiens
gttgtgtgtatatgta

SEQ ID NO: 1195476 - DNA, 13 bp, Homo sapiens
gttgtgttcctgg

SEQ ID NO: 1195477 - DNA, 17 bp, Homo sapiens
gttgtgttcctggctga

SEQ ID NO: 1195478 - DNA, 21 bp, Homo sapiens
gttgttaattttattgcaaag

SEQ ID NO: 1195479 - DNA, 20 bp, Homo sapiens
gttgttactaactaaactct

SEQ ID NO: 1195480 - DNA, 10 bp, Homo sapiens
gttgttcttt

SEQ ID NO: 1195481 - DNA, 17 bp, Homo sapiens
gttgttctttctcttct

SEQ ID NO: 1195482 - DNA, 14 bp, Homo sapiens
gttgttgcatgttt

SEQ ID NO: 1195483 - DNA, 12 bp, Homo sapiens
gttgttgtagta

SEQ ID NO: 1195484 - DNA, 15 bp, Homo sapiens
gttgttgtttgccaa

SEQ ID NO: 1195485 - DNA, 21 bp, Homo sapiens
gttgtttaacacttctgtatg

SEQ ID NO: 1195486 - DNA, 15 bp, Homo sapiens
gttgtttataataaa

SEQ ID NO: 1195487 - DNA, 17 bp, Homo sapiens
gttgtttctgttccaaa

SEQ ID NO: 1195488 - DNA, 23 bp, Homo sapiens
gttgtttgaggcaaattaactgt

SEQ ID NO: 1195489 - DNA, 16 bp, Homo sapiens
gttgttttgtatgagc

SEQ ID NO: 1195490 - DNA, 15 bp, Homo sapiens
gttgttttgtgtata

SEQ ID NO: 1195491 - DNA, 19 bp, Homo sapiens
gttgtttttaagtcctgta

SEQ ID NO: 1195492 - DNA, 14 bp, Homo sapiens
gttgttttttcata

SEQ ID NO: 1195493 - DNA, 19 bp, Homo sapiens
gttgttttttgaaaacatg

SEQ ID NO: 1195494 - DNA, 13 bp, Homo sapiens
gtttaaaaagtaa

SEQ ID NO: 1195495 - DNA, 14 bp, Homo sapiens
gtttaaaaagtaag

SEQ ID NO: 1195496 - DNA, 23 bp, Homo sapiens
gtttaaaaagtaagttaataatg

SEQ ID NO: 1195497 - DNA, 18 bp, Homo sapiens
gtttaaaagaaaaaatga

SEQ ID NO: 1195498 - DNA, 22 bp, Homo sapiens
gtttaaaataaaatgaaaattg

SEQ ID NO: 1195499 - DNA, 13 bp, Homo sapiens
gtttaaaatgtgt

SEQ ID NO: 1195500 - DNA, 13 bp, Homo sapiens
gtttaaaattcag

SEQ ID NO: 1195501 - DNA, 16 bp, Homo sapiens
gtttaaaattcagttt

SEQ ID NO: 1195502 - DNA, 20 bp, Homo sapiens
gtttaaacaatctttcatgt

SEQ ID NO: 1195503 - DNA, 14 bp, Homo sapiens
gtttaaagaaagtg

SEQ ID NO: 1195504 - DNA, 21 bp, Homo sapiens
gtttaaagaaagtgtatttgg

SEQ ID NO: 1195505 - DNA, 18 bp, Homo sapiens
gtttaaagagaaaaggga

SEQ ID NO: 1195506 - DNA, 22 bp, Homo sapiens
gtttaaagagaaaagggaaaaa

SEQ ID NO: 1195507 - DNA, 23 bp, Homo sapiens
gtttaaagagaaaagggaaaaaa

SEQ ID NO: 1195508 - DNA, 22 bp, Homo sapiens
gtttaaagtcacatccctgtaa

SEQ ID NO: 1195509 - DNA, 14 bp, Homo sapiens
gtttaaataaagta

SEQ ID NO: 1195510 - DNA, 22 bp, Homo sapiens
gtttaaataaagtatcatgcat

SEQ ID NO: 1195511 - DNA, 20 bp, Homo sapiens
gtttaaatagcctaaatgat

SEQ ID NO: 1195512 - DNA, 14 bp, Homo sapiens
gtttaaatcatgta

SEQ ID NO: 1195513 - DNA, 15 bp, Homo sapiens
gtttaaatgccaaaa

SEQ ID NO: 1195514 - DNA, 20 bp, Homo sapiens
gtttaaattgatagcagata

SEQ ID NO: 1195515 - DNA, 12 bp, Homo sapiens
gtttaaattgta

SEQ ID NO: 1195516 - DNA, 15 bp, Homo sapiens
gtttaacaaatctaa

SEQ ID NO: 1195517 - DNA, 16 bp, Homo sapiens
gtttaacaaatctaat

SEQ ID NO: 1195518 - DNA, 13 bp, Homo sapiens
gtttaacatatat

SEQ ID NO: 1195519 - DNA, 16 bp, Homo sapiens
gtttaacatatatatt

SEQ ID NO: 1195520 - DNA, 14 bp, Homo sapiens
gtttaacattcaca

SEQ ID NO: 1195521 - DNA, 16 bp, Homo sapiens
gtttaacattcacagc

SEQ ID NO: 1195522 - DNA, 13 bp, Homo sapiens
gtttaacatttgc

SEQ ID NO: 1195523 - DNA, 22 bp, Homo sapiens
gtttaacatttgccttgcagaa

SEQ ID NO: 1195524 - DNA, 17 bp, Homo sapiens
gtttaactttaaaactg

SEQ ID NO: 1195525 - DNA, 12 bp, Homo sapiens
gtttaacttttt

SEQ ID NO: 1195526 - DNA, 23 bp, Homo sapiens
gtttaagaaaaaataacacacat

SEQ ID NO: 1195527 - DNA, 21 bp, Homo sapiens
gtttaagtgactgatggctaa

SEQ ID NO: 1195528 - DNA, 20 bp, Homo sapiens
gtttaagttgtattaaaaat

SEQ ID NO: 1195529 - DNA, 15 bp, Homo sapiens
gtttaatattgagaa

SEQ ID NO: 1195530 - DNA, 17 bp, Homo sapiens
gtttaatattgagaaag

SEQ ID NO: 1195531 - DNA, 14 bp, Homo sapiens
gtttaatctgttat

SEQ ID NO: 1195532 - DNA, 13 bp, Homo sapiens
gtttaatgttaca

SEQ ID NO: 1195533 - DNA, 20 bp, Homo sapiens
gtttaatgttctgtgataca

SEQ ID NO: 1195534 - DNA, 16 bp, Homo sapiens
gtttacaagtgtatat

SEQ ID NO: 1195535 - DNA, 15 bp, Homo sapiens
gtttacacttcatat

SEQ ID NO: 1195536 - DNA, 18 bp, Homo sapiens
gtttacagaaaaatcttg

SEQ ID NO: 1195537 - DNA, 23 bp, Homo sapiens
gtttacagcactactctgtgcca

SEQ ID NO: 1195538 - DNA, 14 bp, Homo sapiens
gtttacagtttgtg

SEQ ID NO: 1195539 - DNA, 16 bp, Homo sapiens
gtttacagtttgtgtt

SEQ ID NO: 1195540 - DNA, 13 bp, Homo sapiens
gtttacattttta

SEQ ID NO: 1195541 - DNA, 13 bp, Homo sapiens
gtttaccatttgt

SEQ ID NO: 1195542 - DNA, 20 bp, Homo sapiens
gtttaccatttgtaataaag

SEQ ID NO: 1195543 - DNA, 19 bp, Homo sapiens
gtttaccggttgtttagaa

SEQ ID NO: 1195544 - DNA, 23 bp, Homo sapiens
gtttacctcatccatgcacttta

SEQ ID NO: 1195545 - DNA, 15 bp, Homo sapiens
gtttacctggtgctc

SEQ ID NO: 1195546 - DNA, 22 bp, Homo sapiens
gtttactatgtgccagttcctg

SEQ ID NO: 1195547 - DNA, 22 bp, Homo sapiens
gtttacttctttagcattttta

SEQ ID NO: 1195548 - DNA, 19 bp, Homo sapiens
gtttacttttcagggcatc

SEQ ID NO: 1195549 - DNA, 22 bp, Homo sapiens
gtttactttttaactggcttca

SEQ ID NO: 1195550 - DNA, 17 bp, Homo sapiens
gtttactttttggctgg

SEQ ID NO: 1195551 - DNA, 20 bp, Homo sapiens
gtttagaaaagtattcgtta

SEQ ID NO: 1195552 - DNA, 16 bp, Homo sapiens
gtttagagaattatgg

SEQ ID NO: 1195553 - DNA, 14 bp, Homo sapiens
gtttagataataca

SEQ ID NO: 1195554 - DNA, 14 bp, Homo sapiens
gtttagatgaatgc

SEQ ID NO: 1195555 - DNA, 12 bp, Homo sapiens
gtttagcctgga

SEQ ID NO: 1195556 - DNA, 15 bp, Homo sapiens
gtttagcttcctcca

SEQ ID NO: 1195557 - DNA, 19 bp, Homo sapiens
gtttaggatcatctctgca

SEQ ID NO: 1195558 - DNA, 18 bp, Homo sapiens
gtttaggcctcatttctt

SEQ ID NO: 1195559 - DNA, 17 bp, Homo sapiens
gtttctccttgaagcaa

SEQ ID NO: 1195560 - DNA, 16 bp, Homo sapiens
gtttctctctacagtg

SEQ ID NO: 1195561 - DNA, 19 bp, Homo sapiens
gtttctctctacagtgcca

SEQ ID NO: 1195562 - DNA, 23 bp, Homo sapiens
gtttctctgccgctacctccctc

SEQ ID NO: 1195563 - DNA, 14 bp, Homo sapiens
gtttctctgccttc

SEQ ID NO: 1195564 - DNA, 14 bp, Homo sapiens
gtttctctttcctt

SEQ ID NO: 1195565 - DNA, 18 bp, Homo sapiens
gtttctgaaaatgtttaa

SEQ ID NO: 1195566 - DNA, 16 bp, Homo sapiens
gtttctgaaaattcca

SEQ ID NO: 1195567 - DNA, 19 bp, Homo sapiens
gtttctgacccactgatct

SEQ ID NO: 1195568 - DNA, 21 bp, Homo sapiens
gaaaagacggatggcaggatc

SEQ ID NO: 1195569 - DNA, 15 bp, Homo sapiens
gaaaagactgtgggt

SEQ ID NO: 1195570 - DNA, 22 bp, Homo sapiens
gaaaagactgtgggtggggagg

SEQ ID NO: 1195571 - DNA, 17 bp, Homo sapiens
gaaaagacttttgttga

SEQ ID NO: 1195572 - DNA, 22 bp, Homo sapiens
gaaaagacttttgttgaaatag

SEQ ID NO: 1195573 - DNA, 20 bp, Homo sapiens
gaaaagagaggtttctggta

SEQ ID NO: 1195574 - DNA, 21 bp, Homo sapiens
gaaaagagatattttaaaatg

SEQ ID NO: 1195575 - DNA, 20 bp, Homo sapiens
gaaaagaggagtttcgaggt

SEQ ID NO: 1195576 - DNA, 15 bp, Homo sapiens
gaaaagagtatgtag

SEQ ID NO: 1195577 - DNA, 13 bp, Homo sapiens
gaaaagataaacc

SEQ ID NO: 1195578 - DNA, 13 bp, Homo sapiens
gaaaagattttaa

SEQ ID NO: 1195579 - DNA, 14 bp, Homo sapiens
gaaaagattttatt

SEQ ID NO: 1195580 - DNA, 17 bp, Homo sapiens
gaaaagattttatttat

SEQ ID NO: 1195581 - DNA, 19 bp, Homo sapiens
gaaaagcagacgcagcagc

SEQ ID NO: 1195582 - DNA, 14 bp, Homo sapiens
gaaaagcagctctc

SEQ ID NO: 1195583 - DNA, 16 bp, Homo sapiens
gaaaagcatttttcaa

SEQ ID NO: 1195584 - DNA, 12 bp, Homo sapiens
gaaaagccaagc

SEQ ID NO: 1195585 - DNA, 17 bp, Homo sapiens
gaaaagcccacaggcct

SEQ ID NO: 1195586 - DNA, 23 bp, Homo sapiens
gaaaagcccccagttaatactcc

SEQ ID NO: 1195587 - DNA, 17 bp, Homo sapiens
gaaaagccctcatcttc

SEQ ID NO: 1195588 - DNA, 15 bp, Homo sapiens
gaaaagcctctgttt

SEQ ID NO: 1195589 - DNA, 24 bp, Homo sapiens
gaaaagctagtgtacctcctctca

SEQ ID NO: 1195590 - DNA, 19 bp, Homo sapiens
gaaaaggaaaaaaagcaaa

SEQ ID NO: 1195591 - DNA, 13 bp, Homo sapiens
gaaaaggaagact

SEQ ID NO: 1195592 - DNA, 17 bp, Homo sapiens
gaaaaggagaggaaact

SEQ ID NO: 1195593 - DNA, 13 bp, Homo sapiens
gaaaaggatctaa

SEQ ID NO: 1195594 - DNA, 12 bp, Homo sapiens
gaaaaggcaaaa

SEQ ID NO: 1195595 - DNA, 20 bp, Homo sapiens
gaaaagggactgctgggagg

SEQ ID NO: 1195596 - DNA, 22 bp, Homo sapiens
gaaaagggagtttaaaaatggt

SEQ ID NO: 1195597 - DNA, 18 bp, Homo sapiens
gaaaagggcactcccaac

SEQ ID NO: 1195598 - DNA, 21 bp, Homo sapiens
gaaaaggggagcacaaggcct

SEQ ID NO: 1195599 - DNA, 19 bp, Homo sapiens
gaaaagggtcttcttggca

SEQ ID NO: 1195600 - DNA, 21 bp, Homo sapiens
gaaaaggtgtccttttccttt

SEQ ID NO: 1195601 - DNA, 16 bp, Homo sapiens
gaaaaggttgaataat

SEQ ID NO: 1195602 - DNA, 22 bp, Homo sapiens
gaaaaggtttatgaaaaagaag

SEQ ID NO: 1195603 - DNA, 23 bp, Homo sapiens
gaaaaggtttatgaaaaagaaga

SEQ ID NO: 1195604 - DNA, 19 bp, Homo sapiens
gaaaagtaatgaagaatca

SEQ ID NO: 1195605 - DNA, 14 bp, Homo sapiens
gaaaagtaattttg

SEQ ID NO: 1195606 - DNA, 18 bp, Homo sapiens
gaaaagtaattttgtcac

SEQ ID NO: 1195607 - DNA, 16 bp, Homo sapiens
gaaaagtacatttaat

SEQ ID NO: 1195608 - DNA, 19 bp, Homo sapiens
gaaaagtatgttctaacct

SEQ ID NO: 1195609 - DNA, 16 bp, Homo sapiens
gaaaagtgaattgaag

SEQ ID NO: 1195610 - DNA, 19 bp, Homo sapiens
gaaaagtgatgtattttca

SEQ ID NO: 1195611 - DNA, 21 bp, Homo sapiens
gaaaagtgatgtattttcata

SEQ ID NO: 1195612 - DNA, 20 bp, Homo sapiens
gaaaagtgcatatttatcca

SEQ ID NO: 1195613 - DNA, 18 bp, Homo sapiens
gaaaagtggcaagaccaa

SEQ ID NO: 1195614 - DNA, 18 bp, Homo sapiens
gaaaagtgggctgcagca

SEQ ID NO: 1195615 - DNA, 20 bp, Homo sapiens
gaaaagttaaactaaaaaaa

SEQ ID NO: 1195616 - DNA, 23 bp, Homo sapiens
gaaaagttcaatactcttgaaat

SEQ ID NO: 1195617 - DNA, 14 bp, Homo sapiens
gaaaagttgcagat

SEQ ID NO: 1195618 - DNA, 23 bp, Homo sapiens
gaaaagtttagcccctgaaagcc

SEQ ID NO: 1195619 - DNA, 13 bp, Homo sapiens
gaaaagtttataa

SEQ ID NO: 1195620 - DNA, 15 bp, Homo sapiens
gaaaataaaacacac

SEQ ID NO: 1195621 - DNA, 16 bp, Homo sapiens
gaaaataaaacacacc

SEQ ID NO: 1195622 - DNA, 11 bp, Homo sapiens
gaaaataaagt

SEQ ID NO: 1195623 - DNA, 21 bp, Homo sapiens
gaaaataacaagagttttaac

SEQ ID NO: 1195624 - DNA, 18 bp, Homo sapiens
gaaaataagaatagaaat

SEQ ID NO: 1195625 - DNA, 21 bp, Homo sapiens
gaaaataaggcacccatctgt

SEQ ID NO: 1195626 - DNA, 21 bp, Homo sapiens
gaaaataatattatttaaact

SEQ ID NO: 1195627 - DNA, 18 bp, Homo sapiens
gaaaataattttccaagt

SEQ ID NO: 1195628 - DNA, 19 bp, Homo sapiens
gaaaatacaacttaaataa

SEQ ID NO: 1195629 - DNA, 20 bp, Homo sapiens
gaaaataccataggaagaca

SEQ ID NO: 1195630 - DNA, 19 bp, Homo sapiens
gaaaatacctaattgtgga

SEQ ID NO: 1195631 - DNA, 19 bp, Homo sapiens
gaaaatacctattttatat

SEQ ID NO: 1195632 - DNA, 13 bp, Homo sapiens
gaaaatagattag

SEQ ID NO: 1195633 - DNA, 16 bp, Homo sapiens
gaaaatagtgtaagaa

SEQ ID NO: 1195634 - DNA, 21 bp, Homo sapiens
gaaaatagtgtaagaactgta

SEQ ID NO: 1195635 - DNA, 16 bp, Homo sapiens
gaaaatataaccagcc

SEQ ID NO: 1195636 - DNA, 14 bp, Homo sapiens
gaaaatataagtaa

SEQ ID NO: 1195637 - DNA, 13 bp, Homo sapiens
gaaaatataataa

SEQ ID NO: 1195638 - DNA, 17 bp, Homo sapiens
gaaaatataataaaaga

SEQ ID NO: 1195639 - DNA, 16 bp, Homo sapiens
gaaaatataatattta

SEQ ID NO: 1195640 - DNA, 22 bp, Homo sapiens
gaaaatatagacattctcacat

SEQ ID NO: 1195641 - DNA, 17 bp, Homo sapiens
gaaaatatatgtatttt

SEQ ID NO: 1195642 - DNA, 22 bp, Homo sapiens
gaaaatatatgtatttttatat

SEQ ID NO: 1195643 - DNA, 22 bp, Homo sapiens
gaaaatatctgctcaaaacttt

SEQ ID NO: 1195644 - DNA, 14 bp, Homo sapiens
gaaaatatttcatt

SEQ ID NO: 1195645 - DNA, 19 bp, Homo sapiens
gaaaatatttcctgacttg

SEQ ID NO: 1195646 - DNA, 21 bp, Homo sapiens
gaaaatatttcctgacttgag

SEQ ID NO: 1195647 - DNA, 15 bp, Homo sapiens
gaaaatatttctatg

SEQ ID NO: 1195648 - DNA, 20 bp, Homo sapiens
gaaaatattttgtctaaaat

SEQ ID NO: 1195649 - DNA, 17 bp, Homo sapiens
gaaaatcactttgtcta

SEQ ID NO: 1195650 - DNA, 11 bp, Homo sapiens
gaaaatcagca

SEQ ID NO: 1195651 - DNA, 14 bp, Homo sapiens
gaaaatcagcctgc

SEQ ID NO: 1195652 - DNA, 22 bp, Homo sapiens
gaaaatcagcctgctccagctg

SEQ ID NO: 1195653 - DNA, 13 bp, Homo sapiens
gaaaatcatattg

SEQ ID NO: 1195654 - DNA, 15 bp, Homo sapiens
gaaaatcatcaagaa

SEQ ID NO: 1195655 - DNA, 20 bp, Homo sapiens
gaaaatcatcaagaagggct

SEQ ID NO: 1195656 - DNA, 15 bp, Homo sapiens
gaaaatccaggtcat

SEQ ID NO: 1195657 - DNA, 19 bp, Homo sapiens
gaaaatcccatgagataaa

SEQ ID NO: 1195658 - DNA, 15 bp, Homo sapiens
gaaaatctatatttg

SEQ ID NO: 1195659 - DNA, 19 bp, Homo sapiens
gaaaatctatatttgtctt

SEQ ID NO: 1195660 - DNA, 18 bp, Homo sapiens
gaaaatgaaatgcatatt

SEQ ID NO: 1195661 - DNA, 23 bp, Homo sapiens
gaaaatgaatttgggatactaaa

SEQ ID NO: 1195662 - DNA, 16 bp, Homo sapiens
gaaaatgacttatttc

SEQ ID NO: 1195663 - DNA, 17 bp, Homo sapiens
gaaaatgacttatttct

SEQ ID NO: 1195664 - DNA, 14 bp, Homo sapiens
gaaaatgactttat

SEQ ID NO: 1195665 - DNA, 14 bp, Homo sapiens
gaaaatgagccctg

SEQ ID NO: 1195666 - DNA, 17 bp, Homo sapiens
gaaaatgagccctggct

SEQ ID NO: 1195667 - DNA, 23 bp, Homo sapiens
gaaaatgagtttttatggggctg

SEQ ID NO: 1195668 - DNA, 21 bp, Homo sapiens
gaaaatgattcctggacatca

SEQ ID NO: 1195669 - DNA, 22 bp, Homo sapiens
gaaaatgcagcagggatgccct

SEQ ID NO: 1195670 - DNA, 22 bp, Homo sapiens
gaaaatgcattttcttcagaat

SEQ ID NO: 1195671 - DNA, 22 bp, Homo sapiens
gaaaatgcctcaattcacatag

SEQ ID NO: 1195672 - DNA, 15 bp, Homo sapiens
gaaaatgcggttata

SEQ ID NO: 1195673 - DNA, 19 bp, Homo sapiens
gaaaatgctcttaaaatat

SEQ ID NO: 1195674 - DNA, 20 bp, Homo sapiens
gaaaatgctcttaaaatatc

SEQ ID NO: 1195675 - DNA, 22 bp, Homo sapiens
gaaaatgctcttaaaatatctt

SEQ ID NO: 1195676 - DNA, 14 bp, Homo sapiens
gaaaatgcttctgt

SEQ ID NO: 1195677 - DNA, 19 bp, Homo sapiens
gaaaatggacattgagata

SEQ ID NO: 1195678 - DNA, 22 bp, Homo sapiens
gaaaatggatatagaaaatctt

SEQ ID NO: 1195679 - DNA, 15 bp, Homo sapiens
gaaaatggccatgca

SEQ ID NO: 1195680 - DNA, 21 bp, Homo sapiens
gaaacgagactttccattaca

SEQ ID NO: 1195681 - DNA, 14 bp, Homo sapiens
gaaacgcagacact

SEQ ID NO: 1195682 - DNA, 17 bp, Homo sapiens
gaaacgggctccttccc

SEQ ID NO: 1195683 - DNA, 18 bp, Homo sapiens
gaaacgggctccttcccc

SEQ ID NO: 1195684 - DNA, 20 bp, Homo sapiens
gaaacgggctccttcccctg

SEQ ID NO: 1195685 - DNA, 23 bp, Homo sapiens
gaaacggtatcctccctgcccat

SEQ ID NO: 1195686 - DNA, 19 bp, Homo sapiens
gaaacgtgttaaaggtttt

SEQ ID NO: 1195687 - DNA, 14 bp, Homo sapiens
gaaactaaacagaa

SEQ ID NO: 1195688 - DNA, 18 bp, Homo sapiens
gaaactaaacagaaaact

SEQ ID NO: 1195689 - DNA, 14 bp, Homo sapiens
gaaactaacttggt

SEQ ID NO: 1195690 - DNA, 13 bp, Homo sapiens
gaaactaagccag

SEQ ID NO: 1195691 - DNA, 21 bp, Homo sapiens
gaaactaagccaggcctggct

SEQ ID NO: 1195692 - DNA, 23 bp, Homo sapiens
gaaactaagccaggcctggctgg

SEQ ID NO: 1195693 - DNA, 20 bp, Homo sapiens
gaaactaattgactttagaa

SEQ ID NO: 1195694 - DNA, 21 bp, Homo sapiens
gaaactaattgactttagaaa

SEQ ID NO: 1195695 - DNA, 13 bp, Homo sapiens
gaaactatgtgtt

SEQ ID NO: 1195696 - DNA, 20 bp, Homo sapiens
gaaactatgtgtttttctca

SEQ ID NO: 1195697 - DNA, 13 bp, Homo sapiens
gtttgtagccagg

SEQ ID NO: 1195698 - DNA, 16 bp, Homo sapiens
gtttgtagtaaaagtg

SEQ ID NO: 1195699 - DNA, 22 bp, Homo sapiens
gtttgtatttggaatatttgaa

SEQ ID NO: 1195700 - DNA, 20 bp, Homo sapiens
gtttgtattttttatttaca

SEQ ID NO: 1195701 - DNA, 21 bp, Homo sapiens
gtttgtattttttatttacat

SEQ ID NO: 1195702 - DNA, 16 bp, Homo sapiens
gtttgtcctgggttct

SEQ ID NO: 1195703 - DNA, 20 bp, Homo sapiens
gtttgtcctttttcactttg

SEQ ID NO: 1195704 - DNA, 14 bp, Homo sapiens
gtttgtctatttta

SEQ ID NO: 1195705 - DNA, 19 bp, Homo sapiens
gtttgtctattttaaaata

SEQ ID NO: 1195706 - DNA, 18 bp, Homo sapiens
gtttgtctgtcttcatag

SEQ ID NO: 1195707 - DNA, 11 bp, Homo sapiens
gtttgtctgtt

SEQ ID NO: 1195708 - DNA, 18 bp, Homo sapiens
gtttgtctgtttgtttca

SEQ ID NO: 1195709 - DNA, 20 bp, Homo sapiens
gtttgtcttggatatatagg

SEQ ID NO: 1195710 - DNA, 22 bp, Homo sapiens
gtttgtgaacgctgtgatgctg

SEQ ID NO: 1195711 - DNA, 19 bp, Homo sapiens
gtttgtgacagtaaccatt

SEQ ID NO: 1195712 - DNA, 19 bp, Homo sapiens
gtttgtggaaaatgaaaat

SEQ ID NO: 1195713 - DNA, 13 bp, Homo sapiens
gtttgtggcctca

SEQ ID NO: 1195714 - DNA, 14 bp, Homo sapiens
gtttgtggcctcag

SEQ ID NO: 1195715 - DNA, 20 bp, Homo sapiens
gtttgtggctgggggcagga

SEQ ID NO: 1195716 - DNA, 22 bp, Homo sapiens
gtttgtggctgggggcaggagg

SEQ ID NO: 1195717 - DNA, 17 bp, Homo sapiens
gtttgtgggacacaaca

SEQ ID NO: 1195718 - DNA, 14 bp, Homo sapiens
gtttgtgtgtctta

SEQ ID NO: 1195719 - DNA, 15 bp, Homo sapiens
gtttgtgtgtcttaa

SEQ ID NO: 1195720 - DNA, 15 bp, Homo sapiens
gtttgtgtgttgtct

SEQ ID NO: 1195721 - DNA, 22 bp, Homo sapiens
gtttgtgttctgtttgttaaaa

SEQ ID NO: 1195722 - DNA, 21 bp, Homo sapiens
gtttgtgttttaaaaaaactg

SEQ ID NO: 1195723 - DNA, 22 bp, Homo sapiens
gtttgtgttttaaaaaaactga

SEQ ID NO: 1195724 - DNA, 15 bp, Homo sapiens
gtttgttaaaactgg

SEQ ID NO: 1195725 - DNA, 17 bp, Homo sapiens
gtttgttaaaactggca

SEQ ID NO: 1195726 - DNA, 23 bp, Homo sapiens
gtttgttctccgggtgtggcctc

SEQ ID NO: 1195727 - DNA, 14 bp, Homo sapiens
gtttgttctgttct

SEQ ID NO: 1195728 - DNA, 22 bp, Homo sapiens
gtttgttgagctggtaacatcg

SEQ ID NO: 1195729 - DNA, 18 bp, Homo sapiens
gtttgtttctccccctgg

SEQ ID NO: 1195730 - DNA, 12 bp, Homo sapiens
gtttgtttgctt

SEQ ID NO: 1195731 - DNA, 14 bp, Homo sapiens
gtttgtttgcttaa

SEQ ID NO: 1195732 - DNA, 11 bp, Homo sapiens
gtttgtttgtc

SEQ ID NO: 1195733 - DNA, 16 bp, Homo sapiens
gtttgtttttgcttgt

SEQ ID NO: 1195734 - DNA, 12 bp, Homo sapiens
gtttgtttttgg

SEQ ID NO: 1195735 - DNA, 17 bp, Homo sapiens
gtttgttttttcatgcg

SEQ ID NO: 1195736 - DNA, 12 bp, Homo sapiens
gtttgttttttt

SEQ ID NO: 1195737 - DNA, 17 bp, Homo sapiens
gtttgtttttttgccac

SEQ ID NO: 1195738 - DNA, 18 bp, Homo sapiens
gttttaaaaaaactgaag

SEQ ID NO: 1195739 - DNA, 12 bp, Homo sapiens
gttttaaaagca

SEQ ID NO: 1195740 - DNA, 21 bp, Homo sapiens
gttttaaaataagttaaaggc

SEQ ID NO: 1195741 - DNA, 11 bp, Homo sapiens
gttttaaaatg

SEQ ID NO: 1195742 - DNA, 15 bp, Homo sapiens
gttttaaaatgcaga

SEQ ID NO: 1195743 - DNA, 23 bp, Homo sapiens
gttttaaacattaatagcagcct

SEQ ID NO: 1195744 - DNA, 15 bp, Homo sapiens
gttttaaagtgatta

SEQ ID NO: 1195745 - DNA, 20 bp, Homo sapiens
gttttaaagttcattgcaat

SEQ ID NO: 1195746 - DNA, 22 bp, Homo sapiens
gttttaaatgtacagacatatt

SEQ ID NO: 1195747 - DNA, 20 bp, Homo sapiens
gttttaacaatccattcaca

SEQ ID NO: 1195748 - DNA, 15 bp, Homo sapiens
gttttaacttccagt

SEQ ID NO: 1195749 - DNA, 14 bp, Homo sapiens
gttttaataaaaga

SEQ ID NO: 1195750 - DNA, 23 bp, Homo sapiens
gttttaattccaatatgatgact

SEQ ID NO: 1195751 - DNA, 19 bp, Homo sapiens
gttttacagagaggataca

SEQ ID NO: 1195752 - DNA, 13 bp, Homo sapiens
gttttacatttta

SEQ ID NO: 1195753 - DNA, 19 bp, Homo sapiens
gttttaccaataaactgag

SEQ ID NO: 1195754 - DNA, 19 bp, Homo sapiens
gttttaccttttgatgttc

SEQ ID NO: 1195755 - DNA, 17 bp, Homo sapiens
gttttacgcaaggaagg

SEQ ID NO: 1195756 - DNA, 21 bp, Homo sapiens
gttttactcttaaatcatttg

SEQ ID NO: 1195757 - DNA, 12 bp, Homo sapiens
gttttactcttt

SEQ ID NO: 1195758 - DNA, 15 bp, Homo sapiens
gttttactgcagctt

SEQ ID NO: 1195759 - DNA, 18 bp, Homo sapiens
gttttactgcagctttgt

SEQ ID NO: 1195760 - DNA, 14 bp, Homo sapiens
gttttactgtgaaa

SEQ ID NO: 1195761 - DNA, 18 bp, Homo sapiens
gttttacttttaaactgt

SEQ ID NO: 1195762 - DNA, 21 bp, Homo sapiens
gttttacttttaaactgtgta

SEQ ID NO: 1195763 - DNA, 12 bp, Homo sapiens
gttttagatgtt

SEQ ID NO: 1195764 - DNA, 20 bp, Homo sapiens
gttttaggaaacttgtagaa

SEQ ID NO: 1195765 - DNA, 17 bp, Homo sapiens
gttttaggtagaaaaac

SEQ ID NO: 1195766 - DNA, 14 bp, Homo sapiens
gttttagttgcaga

SEQ ID NO: 1195767 - DNA, 21 bp, Homo sapiens
gttttataaggtctgacatca

SEQ ID NO: 1195768 - DNA, 13 bp, Homo sapiens
gttttatatacct

SEQ ID NO: 1195769 - DNA, 14 bp, Homo sapiens
gttttatatcaaat

SEQ ID NO: 1195770 - DNA, 12 bp, Homo sapiens
gttttatatctt

SEQ ID NO: 1195771 - DNA, 19 bp, Homo sapiens
gttttatatttttatagac

SEQ ID NO: 1195772 - DNA, 22 bp, Homo sapiens
gttttatcatgacatgttatat

SEQ ID NO: 1195773 - DNA, 15 bp, Homo sapiens
gttttattctgactt

SEQ ID NO: 1195774 - DNA, 22 bp, Homo sapiens
gttttattgtccttcagagctc

SEQ ID NO: 1195775 - DNA, 13 bp, Homo sapiens
gttttatttatat

SEQ ID NO: 1195776 - DNA, 21 bp, Homo sapiens
gttttatttatcaaaatgtag

SEQ ID NO: 1195777 - DNA, 13 bp, Homo sapiens
gttttatttccta

SEQ ID NO: 1195778 - DNA, 17 bp, Homo sapiens
gttttatttgtcagttt

SEQ ID NO: 1195779 - DNA, 15 bp, Homo sapiens
gttttcaaaacacat

SEQ ID NO: 1195780 - DNA, 17 bp, Homo sapiens
gttttcaaaataaaaat

SEQ ID NO: 1195781 - DNA, 18 bp, Homo sapiens
gttttcaaactgctgcat

SEQ ID NO: 1195782 - DNA, 20 bp, Homo sapiens
gttttcaataacaaagcaca

SEQ ID NO: 1195783 - DNA, 13 bp, Homo sapiens
gttttcaatgatg

SEQ ID NO: 1195784 - DNA, 17 bp, Homo sapiens
gttttcacactgataca

SEQ ID NO: 1195785 - DNA, 21 bp, Homo sapiens
gttttcacactgatacataaa

SEQ ID NO: 1195786 - DNA, 22 bp, Homo sapiens
gttttcacttgtattgacttta

SEQ ID NO: 1195787 - DNA, 19 bp, Homo sapiens
gttttcagaacctcttccc

SEQ ID NO: 1195788 - DNA, 17 bp, Homo sapiens
gttttcagtgtacatgg

SEQ ID NO: 1195789 - DNA, 14 bp, Homo sapiens
gttttcataataaa

SEQ ID NO: 1195790 - DNA, 16 bp, Homo sapiens
gttttcatcatttcag

SEQ ID NO: 1195791 - DNA, 16 bp, Homo sapiens
gttttcattatgttca

SEQ ID NO: 1195792 - DNA, 17 bp, Homo sapiens
gttttcattatgttcat

SEQ ID NO: 1195793 - DNA, 17 bp, Homo sapiens
gttttcatttggttcat

SEQ ID NO: 1195794 - DNA, 15 bp, Homo sapiens
gttttccactgtgct

SEQ ID NO: 1195795 - DNA, 20 bp, Homo sapiens
gttttccaggtcctcagatg

SEQ ID NO: 1195796 - DNA, 15 bp, Homo sapiens
gttttccatgaaaac

SEQ ID NO: 1195797 - DNA, 23 bp, Homo sapiens
gttttcccccagcaacgcccctc

SEQ ID NO: 1195798 - DNA, 14 bp, Homo sapiens
gttttcccctggcc

SEQ ID NO: 1195799 - DNA, 20 bp, Homo sapiens
gttttcccttgaggaaacaa

SEQ ID NO: 1195800 - DNA, 22 bp, Homo sapiens
gttttcctataatataataaat

SEQ ID NO: 1195801 - DNA, 22 bp, Homo sapiens
gttttcctcccttctgctactg

SEQ ID NO: 1195802 - DNA, 22 bp, Homo sapiens
gttttccttgctatttcaataa

SEQ ID NO: 1195803 - DNA, 14 bp, Homo sapiens
gttttcgaaaatca

SEQ ID NO: 1195804 - DNA, 18 bp, Homo sapiens
gttttcgaagctcagccc

SEQ ID NO: 1195805 - DNA, 20 bp, Homo sapiens
gttttcgaagctcagcccac

SEQ ID NO: 1195806 - DNA, 18 bp, Homo sapiens
gttttcgtaccttcccac

SEQ ID NO: 1195807 - DNA, 17 bp, Homo sapiens
gttttctcagaacagct

SEQ ID NO: 1195808 - DNA, 18 bp, Homo sapiens
gttttctccctctcatgt

SEQ ID NO: 1195809 - DNA, 21 bp, Homo sapiens
gttttctcctcccaggaactg

SEQ ID NO: 1195810 - DNA, 20 bp, Homo sapiens
gttttctcctgcctgtgctg

SEQ ID NO: 1195811 - DNA, 21 bp, Homo sapiens
gttttctccttcccttctttg

SEQ ID NO: 1195812 - DNA, 16 bp, Homo sapiens
gttttctctaacttct

SEQ ID NO: 1195813 - DNA, 14 bp, Homo sapiens
gttttctctgaaca

SEQ ID NO: 1195814 - DNA, 19 bp, Homo sapiens
gttttctcttgagagggtg

SEQ ID NO: 1195815 - DNA, 13 bp, Homo sapiens
gttttctgaaaca

SEQ ID NO: 1195816 - DNA, 13 bp, Homo sapiens
gttttctgagccc

SEQ ID NO: 1195817 - DNA, 19 bp, Homo sapiens
gttttctgagcccgggctg

SEQ ID NO: 1195818 - DNA, 23 bp, Homo sapiens
gttttctgatggccaaaatacca

SEQ ID NO: 1195819 - DNA, 16 bp, Homo sapiens
gttttctgtaaataac

SEQ ID NO: 1195820 - DNA, 12 bp, Homo sapiens
gttttctgtaga

SEQ ID NO: 1195821 - DNA, 15 bp, Homo sapiens
gttttctgttctttc

SEQ ID NO: 1195822 - DNA, 20 bp, Homo sapiens
gaaactcacctgctggcccc

SEQ ID NO: 1195823 - DNA, 16 bp, Homo sapiens
gaaactccacatctgc

SEQ ID NO: 1195824 - DNA, 15 bp, Homo sapiens
gaaactccagatgcc

SEQ ID NO: 1195825 - DNA, 15 bp, Homo sapiens
gaaactcccctgggg

SEQ ID NO: 1195826 - DNA, 15 bp, Homo sapiens
gaaactccgaagaaa

SEQ ID NO: 1195827 - DNA, 20 bp, Homo sapiens
gaaactccttttgctgtctt

SEQ ID NO: 1195828 - DNA, 14 bp, Homo sapiens
gaaactctggctca

SEQ ID NO: 1195829 - DNA, 15 bp, Homo sapiens
gaaactgaaagtgtt

SEQ ID NO: 1195830 - DNA, 21 bp, Homo sapiens
gaaactgaaagtgttttactc

SEQ ID NO: 1195831 - DNA, 22 bp, Homo sapiens
gaaactgaggaattttctttgt

SEQ ID NO: 1195832 - DNA, 13 bp, Homo sapiens
gaaactgatttct

SEQ ID NO: 1195833 - DNA, 14 bp, Homo sapiens
gaaactgatttctt

SEQ ID NO: 1195834 - DNA, 11 bp, Homo sapiens
gaaactgccaa

SEQ ID NO: 1195835 - DNA, 16 bp, Homo sapiens
gaaactggaagctgtt

SEQ ID NO: 1195836 - DNA, 12 bp, Homo sapiens
gaaactggctga

SEQ ID NO: 1195837 - DNA, 22 bp, Homo sapiens
gaaactgtggggcttacagaaa

SEQ ID NO: 1195838 - DNA, 20 bp, Homo sapiens
gaaacttaccaattgatgtt

SEQ ID NO: 1195839 - DNA, 16 bp, Homo sapiens
gaaacttagaggaaaa

SEQ ID NO: 1195840 - DNA, 11 bp, Homo sapiens
gaaacttctga

SEQ ID NO: 1195841 - DNA, 18 bp, Homo sapiens
gaaacttctgatgtttat

SEQ ID NO: 1195842 - DNA, 13 bp, Homo sapiens
gaaacttgaactc

SEQ ID NO: 1195843 - DNA, 12 bp, Homo sapiens
gaaacttggctc

SEQ ID NO: 1195844 - DNA, 14 bp, Homo sapiens
gaaacttggctgga

SEQ ID NO: 1195845 - DNA, 23 bp, Homo sapiens
gaaacttggctggaatttctgct

SEQ ID NO: 1195846 - DNA, 18 bp, Homo sapiens
gaaactttatttaaatgc

SEQ ID NO: 1195847 - DNA, 20 bp, Homo sapiens
gaaacttttgttagggctgc

SEQ ID NO: 1195848 - DNA, 21 bp, Homo sapiens
gaaacttttttcattttgaaa

SEQ ID NO: 1195849 - DNA, 23 bp, Homo sapiens
gaaacttttttcattttgaaaag

SEQ ID NO: 1195850 - DNA, 16 bp, Homo sapiens
gaaagaaaaaacaaaa

SEQ ID NO: 1195851 - DNA, 24 bp, Homo sapiens
gaaagaaaaataccatgtctctaa

SEQ ID NO: 1195852 - DNA, 19 bp, Homo sapiens
gaaagaaaagaccctgaga

SEQ ID NO: 1195853 - DNA, 13 bp, Homo sapiens
gaaagaaaaggca

SEQ ID NO: 1195854 - DNA, 15 bp, Homo sapiens
gaaagaaaaggcaaa

SEQ ID NO: 1195855 - DNA, 21 bp, Homo sapiens
gaaagaaattctgaagagagt

SEQ ID NO: 1195856 - DNA, 19 bp, Homo sapiens
gaaagaacatggacttgta

SEQ ID NO: 1195857 - DNA, 20 bp, Homo sapiens
gaaagaacgctgatttaaag

SEQ ID NO: 1195858 - DNA, 11 bp, Homo sapiens
gaaagaactta

SEQ ID NO: 1195859 - DNA, 19 bp, Homo sapiens
gaaagaagcagttctcaca

SEQ ID NO: 1195860 - DNA, 13 bp, Homo sapiens
gaaagaattattt

SEQ ID NO: 1195861 - DNA, 20 bp, Homo sapiens
gaaagaattgatcagaatcc

SEQ ID NO: 1195862 - DNA, 19 bp, Homo sapiens
gaaagacaggaagaccaag

SEQ ID NO: 1195863 - DNA, 18 bp, Homo sapiens
gaaagacagtatgagaaa

SEQ ID NO: 1195864 - DNA, 22 bp, Homo sapiens
gaaagaccatgcatttaaagta

SEQ ID NO: 1195865 - DNA, 21 bp, Homo sapiens
gaaagacggattgcattagaa

SEQ ID NO: 1195866 - DNA, 18 bp, Homo sapiens
gaaagactatctaaatgt

SEQ ID NO: 1195867 - DNA, 20 bp, Homo sapiens
gaaagactatctaaatgttg

SEQ ID NO: 1195868 - DNA, 19 bp, Homo sapiens
gaaagactgaagaaagtgt

SEQ ID NO: 1195869 - DNA, 13 bp, Homo sapiens
gaaagagaaacac

SEQ ID NO: 1195870 - DNA, 11 bp, Homo sapiens
gaaagagaatg

SEQ ID NO: 1195871 - DNA, 18 bp, Homo sapiens
gaaagagaatgaactgtg

SEQ ID NO: 1195872 - DNA, 18 bp, Homo sapiens
gaaagagacagagtgctg

SEQ ID NO: 1195873 - DNA, 13 bp, Homo sapiens
gaaagaggaagca

SEQ ID NO: 1195874 - DNA, 24 bp, Homo sapiens
gaaagaggaggacccctgccttcc

SEQ ID NO: 1195875 - DNA, 17 bp, Homo sapiens
gaaagaggcaccaggaa

SEQ ID NO: 1195876 - DNA, 20 bp, Homo sapiens
gaaagaggcaccaggaagcc

SEQ ID NO: 1195877 - DNA, 21 bp, Homo sapiens
gaaagaggcaccaggaagccg

SEQ ID NO: 1195878 - DNA, 13 bp, Homo sapiens
gaaagagggagca

SEQ ID NO: 1195879 - DNA, 15 bp, Homo sapiens
gaaagaggggcctga

SEQ ID NO: 1195880 - DNA, 16 bp, Homo sapiens
gaaagaggggcctgat

SEQ ID NO: 1195881 - DNA, 21 bp, Homo sapiens
gaaagagggtcccagggctgc

SEQ ID NO: 1195882 - DNA, 16 bp, Homo sapiens
gaaagagtctgggacc

SEQ ID NO: 1195883 - DNA, 17 bp, Homo sapiens
gaaagagttaagaatgt

SEQ ID NO: 1195884 - DNA, 18 bp, Homo sapiens
gaaagagttaagaatgtc

SEQ ID NO: 1195885 - DNA, 17 bp, Homo sapiens
gaaagatgagcttttct

SEQ ID NO: 1195886 - DNA, 17 bp, Homo sapiens
gaaagatgatttgtatg

SEQ ID NO: 1195887 - DNA, 23 bp, Homo sapiens
gaaagatttgttactgtattttt

SEQ ID NO: 1195888 - DNA, 14 bp, Homo sapiens
gaaagcaataaatg

SEQ ID NO: 1195889 - DNA, 18 bp, Homo sapiens
gaaagcagaactgaagcc

SEQ ID NO: 1195890 - DNA, 19 bp, Homo sapiens
gaaagcagaactgaagcca

SEQ ID NO: 1195891 - DNA, 23 bp, Homo sapiens
gaaagcagaactgaagccacttg

SEQ ID NO: 1195892 - DNA, 21 bp, Homo sapiens
gaaagcagagcctcctgggaa

SEQ ID NO: 1195893 - DNA, 18 bp, Homo sapiens
gaaagcataaagctcaaa

SEQ ID NO: 1195894 - DNA, 18 bp, Homo sapiens
gaaagcatcacctcaggc

SEQ ID NO: 1195895 - DNA, 18 bp, Homo sapiens
gaaagcatgtctctgctt

SEQ ID NO: 1195896 - DNA, 14 bp, Homo sapiens
gaaagccacctctc

SEQ ID NO: 1195897 - DNA, 16 bp, Homo sapiens
gaaagccagacaactt

SEQ ID NO: 1195898 - DNA, 19 bp, Homo sapiens
gaaagccattgaccaccca

SEQ ID NO: 1195899 - DNA, 18 bp, Homo sapiens
gaaagccccagcactaac

SEQ ID NO: 1195900 - DNA, 22 bp, Homo sapiens
gaaagccctgagctttctgcta

SEQ ID NO: 1195901 - DNA, 16 bp, Homo sapiens
gaaagcctcctgcccc

SEQ ID NO: 1195902 - DNA, 22 bp, Homo sapiens
gaaagcctcctgccccctgcca

SEQ ID NO: 1195903 - DNA, 23 bp, Homo sapiens
gaaagcctcctgccccctgccag

SEQ ID NO: 1195904 - DNA, 17 bp, Homo sapiens
gaaagcctctctctccc

SEQ ID NO: 1195905 - DNA, 22 bp, Homo sapiens
gaaagcctgtaagcctgcaagc

SEQ ID NO: 1195906 - DNA, 20 bp, Homo sapiens
gaaagcctgtctctttccac

SEQ ID NO: 1195907 - DNA, 18 bp, Homo sapiens
gaaagcctgttcccctca

SEQ ID NO: 1195908 - DNA, 24 bp, Homo sapiens
gaaagcctgttcccctcactggat

SEQ ID NO: 1195909 - DNA, 16 bp, Homo sapiens
gaaagcgggcagcccc

SEQ ID NO: 1195910 - DNA, 17 bp, Homo sapiens
gaaagctcactgtagct

SEQ ID NO: 1195911 - DNA, 22 bp, Homo sapiens
gaaagctccacggtgcgtggct

SEQ ID NO: 1195912 - DNA, 21 bp, Homo sapiens
gaaagctggtaaactatttgt

SEQ ID NO: 1195913 - DNA, 15 bp, Homo sapiens
gaaagcttttattcc

SEQ ID NO: 1195914 - DNA, 12 bp, Homo sapiens
gaaaggaaaaga

SEQ ID NO: 1195915 - DNA, 13 bp, Homo sapiens
gaaaggaaacctt

SEQ ID NO: 1195916 - DNA, 21 bp, Homo sapiens
gaaaggaagcattgtaaaata

SEQ ID NO: 1195917 - DNA, 15 bp, Homo sapiens
gaaaggactcagtgt

SEQ ID NO: 1195918 - DNA, 11 bp, Homo sapiens
gaaaggagact

SEQ ID NO: 1195919 - DNA, 18 bp, Homo sapiens
gaaaggatataaaaggat

SEQ ID NO: 1195920 - DNA, 22 bp, Homo sapiens
gaaaggatatttaagaaaatac

SEQ ID NO: 1195921 - DNA, 15 bp, Homo sapiens
gaaaggatgtggaag

SEQ ID NO: 1195922 - DNA, 18 bp, Homo sapiens
gaaaggcagccctcacct

SEQ ID NO: 1195923 - DNA, 15 bp, Homo sapiens
taaaaaggaaatttg

SEQ ID NO: 1195924 - DNA, 16 bp, Homo sapiens
taaaaaggaacgtata

SEQ ID NO: 1195925 - DNA, 15 bp, Homo sapiens
taaaaaggaaggaga

SEQ ID NO: 1195926 - DNA, 18 bp, Homo sapiens
taaaaaggacatcagcaa

SEQ ID NO: 1195927 - DNA, 21 bp, Homo sapiens
taaaaaggtctgttaatgtca

SEQ ID NO: 1195928 - DNA, 19 bp, Homo sapiens
taaaaagtaataaaattca

SEQ ID NO: 1195929 - DNA, 16 bp, Homo sapiens
taaaaagtatatgtta

SEQ ID NO: 1195930 - DNA, 22 bp, Homo sapiens
taaaaagtccataccttatata

SEQ ID NO: 1195931 - DNA, 17 bp, Homo sapiens
taaaaagtcttcactct

SEQ ID NO: 1195932 - DNA, 18 bp, Homo sapiens
taaaaagtgaacttttgt

SEQ ID NO: 1195933 - DNA, 20 bp, Homo sapiens
taaaaataaacaagcatttc

SEQ ID NO: 1195934 - DNA, 15 bp, Homo sapiens
taaaaataagtcaac

SEQ ID NO: 1195935 - DNA, 22 bp, Homo sapiens
taaaaataattattttattgtg

SEQ ID NO: 1195936 - DNA, 13 bp, Homo sapiens
taaaaatacaaaa

SEQ ID NO: 1195937 - DNA, 14 bp, Homo sapiens
taaaaatacatatc

SEQ ID NO: 1195938 - DNA, 14 bp, Homo sapiens
taaaaataccttct

SEQ ID NO: 1195939 - DNA, 15 bp, Homo sapiens
taaaaatagatatat

SEQ ID NO: 1195940 - DNA, 18 bp, Homo sapiens
taaaaatagatatataag

SEQ ID NO: 1195941 - DNA, 21 bp, Homo sapiens
taaaaatagatcaataaatgt

SEQ ID NO: 1195942 - DNA, 15 bp, Homo sapiens
taaaaatataaattg

SEQ ID NO: 1195943 - DNA, 19 bp, Homo sapiens
taaaaatataaattgtaca

SEQ ID NO: 1195944 - DNA, 16 bp, Homo sapiens
taaaaatatgtaattt

SEQ ID NO: 1195945 - DNA, 17 bp, Homo sapiens
taaaaatatttcagata

SEQ ID NO: 1195946 - DNA, 18 bp, Homo sapiens
taaaaatattttttctgt

SEQ ID NO: 1195947 - DNA, 20 bp, Homo sapiens
taaaaatattttttctgtac

SEQ ID NO: 1195948 - DNA, 18 bp, Homo sapiens
taaaaatcctaaaatatg

SEQ ID NO: 1195949 - DNA, 23 bp, Homo sapiens
taaaaatctcaaatttctaaatc

SEQ ID NO: 1195950 - DNA, 15 bp, Homo sapiens
taaaaatctccatta

SEQ ID NO: 1195951 - DNA, 18 bp, Homo sapiens
taaaaatgaaagtgactt

SEQ ID NO: 1195952 - DNA, 18 bp, Homo sapiens
taaaaatgagtcatttgt

SEQ ID NO: 1195953 - DNA, 22 bp, Homo sapiens
taaaaatggaaactatattgac

SEQ ID NO: 1195954 - DNA, 18 bp, Homo sapiens
gaaatccccccttcagaa

SEQ ID NO: 1195955 - DNA, 18 bp, Homo sapiens
gaaatccctgtttaatat

SEQ ID NO: 1195956 - DNA, 22 bp, Homo sapiens
gaaatccgagcggctacaaagc

SEQ ID NO: 1195957 - DNA, 20 bp, Homo sapiens
gaaatcctagtttcctctcc

SEQ ID NO: 1195958 - DNA, 22 bp, Homo sapiens
gaaatcctagtttcctctcctt

SEQ ID NO: 1195959 - DNA, 23 bp, Homo sapiens
gaaatcctagtttcctctccttc

SEQ ID NO: 1195960 - DNA, 12 bp, Homo sapiens
gaaatcctcagc

SEQ ID NO: 1195961 - DNA, 19 bp, Homo sapiens
gaaatccttgactggacct

SEQ ID NO: 1195962 - DNA, 15 bp, Homo sapiens
gaaatctagtatttc

SEQ ID NO: 1195963 - DNA, 17 bp, Homo sapiens
gaaatctgtaaagccag

SEQ ID NO: 1195964 - DNA, 18 bp, Homo sapiens
gaaatctgtaaagccagt

SEQ ID NO: 1195965 - DNA, 22 bp, Homo sapiens
gaaatctgtatctgtagtgaga

SEQ ID NO: 1195966 - DNA, 13 bp, Homo sapiens
gaaatctgtttgt

SEQ ID NO: 1195967 - DNA, 17 bp, Homo sapiens
gaaatcttgcttcagac

SEQ ID NO: 1195968 - DNA, 21 bp, Homo sapiens
gaaatcttgcttcagaccatc

SEQ ID NO: 1195969 - DNA, 14 bp, Homo sapiens
gaaatcttttaaaa

SEQ ID NO: 1195970 - DNA, 18 bp, Homo sapiens
gaaatgaaaaaaaaaaac

SEQ ID NO: 1195971 - DNA, 19 bp, Homo sapiens
gaaatgaaaaaaaaaaaca

SEQ ID NO: 1195972 - DNA, 13 bp, Homo sapiens
gaaatgaataatt

SEQ ID NO: 1195973 - DNA, 18 bp, Homo sapiens
gaaatgaataatttccca

SEQ ID NO: 1195974 - DNA, 14 bp, Homo sapiens
gaaatgaccaatat

SEQ ID NO: 1195975 - DNA, 24 bp, Homo sapiens
gaaatgaccttcattctgagacca

SEQ ID NO: 1195976 - DNA, 22 bp, Homo sapiens
gaaatgactgccggtcatttga

SEQ ID NO: 1195977 - DNA, 22 bp, Homo sapiens
gaaatgaggtctgtttaaagtg

SEQ ID NO: 1195978 - DNA, 16 bp, Homo sapiens
gaaatgagtggccagc

SEQ ID NO: 1195979 - DNA, 17 bp, Homo sapiens
gaaatgagtggccagcg

SEQ ID NO: 1195980 - DNA, 14 bp, Homo sapiens
gaaatgataaagac

SEQ ID NO: 1195981 - DNA, 19 bp, Homo sapiens
gaaatgataaagactttta

SEQ ID NO: 1195982 - DNA, 22 bp, Homo sapiens
gaaatgatagagaactgaagga

SEQ ID NO: 1195983 - DNA, 21 bp, Homo sapiens
gaaatgattaaaatgtttgag

SEQ ID NO: 1195984 - DNA, 22 bp, Homo sapiens
gaaatgattcaaattgctgctt

SEQ ID NO: 1195985 - DNA, 17 bp, Homo sapiens
gaaatgcaaaaatctct

SEQ ID NO: 1195986 - DNA, 13 bp, Homo sapiens
gaaatgcactgta

SEQ ID NO: 1195987 - DNA, 13 bp, Homo sapiens
gaaatgcagaaat

SEQ ID NO: 1195988 - DNA, 15 bp, Homo sapiens
gaaatgcatatttgc

SEQ ID NO: 1195989 - DNA, 23 bp, Homo sapiens
gaaatgcatccattcctcaggga

SEQ ID NO: 1195990 - DNA, 20 bp, Homo sapiens
gaaatgcattattttgaatg

SEQ ID NO: 1195991 - DNA, 15 bp, Homo sapiens
gaaatgccagaaaca

SEQ ID NO: 1195992 - DNA, 17 bp, Homo sapiens
gaaatgctcaagaatgt

SEQ ID NO: 1195993 - DNA, 17 bp, Homo sapiens
gaaatgctgcattttaa

SEQ ID NO: 1195994 - DNA, 17 bp, Homo sapiens
gaaatgctgcctgcctg

SEQ ID NO: 1195995 - DNA, 15 bp, Homo sapiens
gaaatgctgggctga

SEQ ID NO: 1195996 - DNA, 21 bp, Homo sapiens
gaaatgctttgaggctttcta

SEQ ID NO: 1195997 - DNA, 24 bp, Homo sapiens
gaaatggaggatctctaaagagca

SEQ ID NO: 1195998 - DNA, 16 bp, Homo sapiens
gaaatggatactacat

SEQ ID NO: 1195999 - DNA, 24 bp, Homo sapiens
gaaatggcgtctgctctggtggct

SEQ ID NO: 1196000 - DNA, 17 bp, Homo sapiens
gaaatggcttgaagcca

SEQ ID NO: 1196001 - DNA, 17 bp, Homo sapiens
gaaatgggacttaactc

SEQ ID NO: 1196002 - DNA, 15 bp, Homo sapiens
gaaatgggagatggt

SEQ ID NO: 1196003 - DNA, 12 bp, Homo sapiens
gaaatgggcagt

SEQ ID NO: 1196004 - DNA, 15 bp, Homo sapiens
gaaatgggcctgcct

SEQ ID NO: 1196005 - DNA, 19 bp, Homo sapiens
gaaatggtttcctctggat

SEQ ID NO: 1196006 - DNA, 14 bp, Homo sapiens
gaaatgtaaatgtt

SEQ ID NO: 1196007 - DNA, 16 bp, Homo sapiens
gaaatgtaacatgaag

SEQ ID NO: 1196008 - DNA, 19 bp, Homo sapiens
gaaatgtaacatgaagcaa

SEQ ID NO: 1196009 - DNA, 21 bp, Homo sapiens
gaaatgtaaggctgtgtaaga

SEQ ID NO: 1196010 - DNA, 13 bp, Homo sapiens
gaaatgtaatact

SEQ ID NO: 1196011 - DNA, 18 bp, Homo sapiens
gaaatgtacttttggata

SEQ ID NO: 1196012 - DNA, 22 bp, Homo sapiens
gaaatgtagcacttacgtaaaa

SEQ ID NO: 1196013 - DNA, 15 bp, Homo sapiens
gaaatgtagccctgg

SEQ ID NO: 1196014 - DNA, 17 bp, Homo sapiens
gaaatgtcagttctgat

SEQ ID NO: 1196015 - DNA, 12 bp, Homo sapiens
gaaatgtcctgc

SEQ ID NO: 1196016 - DNA, 16 bp, Homo sapiens
gaaatgtctctgctcc

SEQ ID NO: 1196017 - DNA, 15 bp, Homo sapiens
gaaatgtctgctggt

SEQ ID NO: 1196018 - DNA, 21 bp, Homo sapiens
gaaatgttattttttaattat

SEQ ID NO: 1196019 - DNA, 18 bp, Homo sapiens
gaaatgttttgtaaacat

SEQ ID NO: 1196020 - DNA, 22 bp, Homo sapiens
gaaatgttttgtaaacatttat

SEQ ID NO: 1196021 - DNA, 16 bp, Homo sapiens
gaaattaaagaaatga

SEQ ID NO: 1196022 - DNA, 15 bp, Homo sapiens
gaaattaaagtatgc

SEQ ID NO: 1196023 - DNA, 16 bp, Homo sapiens
gaaattaaagtatgca

SEQ ID NO: 1196024 - DNA, 17 bp, Homo sapiens
gaaattaagaaggcaaa

SEQ ID NO: 1196025 - DNA, 18 bp, Homo sapiens
gaaattaagaaggcaaaa

SEQ ID NO: 1196026 - DNA, 23 bp, Homo sapiens
gaaattaagactttatgtagttt

SEQ ID NO: 1196027 - DNA, 22 bp, Homo sapiens
gaaattaagcattttgaaacaa

SEQ ID NO: 1196028 - DNA, 15 bp, Homo sapiens
gaaattaatttgtga

SEQ ID NO: 1196029 - DNA, 16 bp, Homo sapiens
gaaattacctgtggat

SEQ ID NO: 1196030 - DNA, 17 bp, Homo sapiens
gaaattacctgtggata

SEQ ID NO: 1196031 - DNA, 19 bp, Homo sapiens
gaaattactacaaaatttg

SEQ ID NO: 1196032 - DNA, 13 bp, Homo sapiens
gaaattagccggg

SEQ ID NO: 1196033 - DNA, 16 bp, Homo sapiens
gaaattagctgtgtga

SEQ ID NO: 1196034 - DNA, 20 bp, Homo sapiens
gaaattaggggttaaagcag

SEQ ID NO: 1196035 - DNA, 19 bp, Homo sapiens
gaaattaggttgaaacata

SEQ ID NO: 1196036 - DNA, 14 bp, Homo sapiens
gaaattagtctttt

SEQ ID NO: 1196037 - DNA, 22 bp, Homo sapiens
gaaattatgtgacattttacat

SEQ ID NO: 1196038 - DNA, 23 bp, Homo sapiens
gaaattatgtgacattttacatt

SEQ ID NO: 1196039 - DNA, 14 bp, Homo sapiens
gaaattattggttg

SEQ ID NO: 1196040 - DNA, 21 bp, Homo sapiens
gaaattattggttggtgtgaa

SEQ ID NO: 1196041 - DNA, 13 bp, Homo sapiens
gaaattatttaat

SEQ ID NO: 1196042 - DNA, 18 bp, Homo sapiens
gaaattcaggtacagaaa

SEQ ID NO: 1196043 - DNA, 23 bp, Homo sapiens
gaaattccagcaataagaaatga

SEQ ID NO: 1196044 - DNA, 12 bp, Homo sapiens
taaaatcacttc

SEQ ID NO: 1196045 - DNA, 20 bp, Homo sapiens
taaaatcagctattttgtga

SEQ ID NO: 1196046 - DNA, 13 bp, Homo sapiens
taaaatccataga

SEQ ID NO: 1196047 - DNA, 17 bp, Homo sapiens
taaaatcctaagacaca

SEQ ID NO: 1196048 - DNA, 22 bp, Homo sapiens
taaaatcctaagacacaaatgc

SEQ ID NO: 1196049 - DNA, 15 bp, Homo sapiens
taaaatctaaaattt

SEQ ID NO: 1196050 - DNA, 15 bp, Homo sapiens
taaaatctcctaaat

SEQ ID NO: 1196051 - DNA, 15 bp, Homo sapiens
taaaatctcttgatt

SEQ ID NO: 1196052 - DNA, 16 bp, Homo sapiens
taaaatctcttgatta

SEQ ID NO: 1196053 - DNA, 16 bp, Homo sapiens
taaaatctgatttaat

SEQ ID NO: 1196054 - DNA, 23 bp, Homo sapiens
taaaatctgatttaatgttttct

SEQ ID NO: 1196055 - DNA, 16 bp, Homo sapiens
taaaatctggaaatct

SEQ ID NO: 1196056 - DNA, 13 bp, Homo sapiens
taaaatcttaaac

SEQ ID NO: 1196057 - DNA, 21 bp, Homo sapiens
taaaatcttgcagttttgtaa

SEQ ID NO: 1196058 - DNA, 19 bp, Homo sapiens
taaaatcttggcacagaaa

SEQ ID NO: 1196059 - DNA, 13 bp, Homo sapiens
taaaatgaacatc

SEQ ID NO: 1196060 - DNA, 15 bp, Homo sapiens
taaaatgaacatttt

SEQ ID NO: 1196061 - DNA, 13 bp, Homo sapiens
taaaatgaataat

SEQ ID NO: 1196062 - DNA, 16 bp, Homo sapiens
taaaatgacaaagcca

SEQ ID NO: 1196063 - DNA, 13 bp, Homo sapiens
taaaatgagtttg

SEQ ID NO: 1196064 - DNA, 21 bp, Homo sapiens
taaaatgagtttgtattatta

SEQ ID NO: 1196065 - DNA, 14 bp, Homo sapiens
taaaatgatcctgc

SEQ ID NO: 1196066 - DNA, 15 bp, Homo sapiens
taaaatgattgaaaa

SEQ ID NO: 1196067 - DNA, 15 bp, Homo sapiens
taaaatgattgtaaa

SEQ ID NO: 1196068 - DNA, 17 bp, Homo sapiens
taaaatgattgtaaaat

SEQ ID NO: 1196069 - DNA, 18 bp, Homo sapiens
taaaatgattgtaaaata

SEQ ID NO: 1196070 - DNA, 15 bp, Homo sapiens
taaaatgattttatc

SEQ ID NO: 1196071 - DNA, 17 bp, Homo sapiens
taaaatgcagattcata

SEQ ID NO: 1196072 - DNA, 20 bp, Homo sapiens
taaaatgcaggtgaactttt

SEQ ID NO: 1196073 - DNA, 16 bp, Homo sapiens
taaaatgcatgatttt

SEQ ID NO: 1196074 - DNA, 20 bp, Homo sapiens
taaaatgccatagtttgtga

SEQ ID NO: 1196075 - DNA, 20 bp, Homo sapiens
taaaatgcccatttcgaaga

SEQ ID NO: 1196076 - DNA, 19 bp, Homo sapiens
taaaatgctcaatttcagc

SEQ ID NO: 1196077 - DNA, 13 bp, Homo sapiens
taaaatggaaaat

SEQ ID NO: 1196078 - DNA, 22 bp, Homo sapiens
taaaatggaaaattttctcctt

SEQ ID NO: 1196079 - DNA, 22 bp, Homo sapiens
taaaatggacacaaattttcaa

SEQ ID NO: 1196080 - DNA, 15 bp, Homo sapiens
taaaatggacatttt

SEQ ID NO: 1196081 - DNA, 14 bp, Homo sapiens
taaaatggttatgt

SEQ ID NO: 1196082 - DNA, 19 bp, Homo sapiens
taaaatgtaaaactccatt

SEQ ID NO: 1196083 - DNA, 19 bp, Homo sapiens
taaaatgtacactggatat

SEQ ID NO: 1196084 - DNA, 14 bp, Homo sapiens
taaaatgtataaat

SEQ ID NO: 1196085 - DNA, 12 bp, Homo sapiens
taaaatgtatat

SEQ ID NO: 1196086 - DNA, 14 bp, Homo sapiens
gaacatttatatca

SEQ ID NO: 1196087 - DNA, 20 bp, Homo sapiens
gaacatttcaaattgaattt

SEQ ID NO: 1196088 - DNA, 16 bp, Homo sapiens
gaacatttcatggtgt

SEQ ID NO: 1196089 - DNA, 23 bp, Homo sapiens
gaacatttgatatttttccattt

SEQ ID NO: 1196090 - DNA, 21 bp, Homo sapiens
gaacatttgggttactatttc

SEQ ID NO: 1196091 - DNA, 13 bp, Homo sapiens
gaaccaaagctca

SEQ ID NO: 1196092 - DNA, 16 bp, Homo sapiens
gaaccaaatacctcaa

SEQ ID NO: 1196093 - DNA, 16 bp, Homo sapiens
gaaccaaatctggaag

SEQ ID NO: 1196094 - DNA, 17 bp, Homo sapiens
gaaccaaatctggaagc

SEQ ID NO: 1196095 - DNA, 15 bp, Homo sapiens
gaaccaacactaaca

SEQ ID NO: 1196096 - DNA, 14 bp, Homo sapiens
gaaccaacatcttt

SEQ ID NO: 1196097 - DNA, 21 bp, Homo sapiens
gaaccaaggcagcctccagag

SEQ ID NO: 1196098 - DNA, 24 bp, Homo sapiens
gaaccaagtggaccttgagaccac

SEQ ID NO: 1196099 - DNA, 21 bp, Homo sapiens
gaaccacatttcctctgttct

SEQ ID NO: 1196100 - DNA, 15 bp, Homo sapiens
gaaccaccactgcct

SEQ ID NO: 1196101 - DNA, 21 bp, Homo sapiens
gaaccaccagcgttcccttct

SEQ ID NO: 1196102 - DNA, 19 bp, Homo sapiens
gaaccacgtgaaactgctg

SEQ ID NO: 1196103 - DNA, 19 bp, Homo sapiens
gaaccactacatgcagccc

SEQ ID NO: 1196104 - DNA, 13 bp, Homo sapiens
gaaccactttctt

SEQ ID NO: 1196105 - DNA, 15 bp, Homo sapiens
gaaccactttcttat

SEQ ID NO: 1196106 - DNA, 16 bp, Homo sapiens
gaaccagactcttgcc

SEQ ID NO: 1196107 - DNA, 15 bp, Homo sapiens
gaaccagagggcatg

SEQ ID NO: 1196108 - DNA, 23 bp, Homo sapiens
gaaccagatgagtaaaggagtaa

SEQ ID NO: 1196109 - DNA, 21 bp, Homo sapiens
gaaccagcagaaatgccccca

SEQ ID NO: 1196110 - DNA, 20 bp, Homo sapiens
gaaccagcatctcagcgcca

SEQ ID NO: 1196111 - DNA, 17 bp, Homo sapiens
gaaccagcccagcctgc

SEQ ID NO: 1196112 - DNA, 18 bp, Homo sapiens
gaaccagccggggcctta

SEQ ID NO: 1196113 - DNA, 17 bp, Homo sapiens
gaaccagctcatctcca

SEQ ID NO: 1196114 - DNA, 17 bp, Homo sapiens
gaaccagggaggagagg

SEQ ID NO: 1196115 - DNA, 13 bp, Homo sapiens
gaaccagggcctc

SEQ ID NO: 1196116 - DNA, 15 bp, Homo sapiens
gaaccagggcctccc

SEQ ID NO: 1196117 - DNA, 18 bp, Homo sapiens
gaaccagggctcttctca

SEQ ID NO: 1196118 - DNA, 20 bp, Homo sapiens
gaaccagtctcctcactctg

SEQ ID NO: 1196119 - DNA, 14 bp, Homo sapiens
gaaccagtgcagac

SEQ ID NO: 1196120 - DNA, 16 bp, Homo sapiens
gaaccagttaagagac

SEQ ID NO: 1196121 - DNA, 19 bp, Homo sapiens
gaaccagtttcaggtgttt

SEQ ID NO: 1196122 - DNA, 16 bp, Homo sapiens
gaaccatgaagacagg

SEQ ID NO: 1196123 - DNA, 19 bp, Homo sapiens
gaaccatttaagagactct

SEQ ID NO: 1196124 - DNA, 21 bp, Homo sapiens
gaacccaaagagacagctctt

SEQ ID NO: 1196125 - DNA, 16 bp, Homo sapiens
gaacccaagtgcctca

SEQ ID NO: 1196126 - DNA, 13 bp, Homo sapiens
gaacccacctgct

SEQ ID NO: 1196127 - DNA, 14 bp, Homo sapiens
gaacccacctgctg

SEQ ID NO: 1196128 - DNA, 16 bp, Homo sapiens
gaacccaggaggtgga

SEQ ID NO: 1196129 - DNA, 15 bp, Homo sapiens
gaaccccatgggctt

SEQ ID NO: 1196130 - DNA, 17 bp, Homo sapiens
gaaccccatgggcttgg

SEQ ID NO: 1196131 - DNA, 21 bp, Homo sapiens
gaaccccctccctgtcccagg

SEQ ID NO: 1196132 - DNA, 23 bp, Homo sapiens
gaaccccctccctgtcccagggc

SEQ ID NO: 1196133 - DNA, 21 bp, Homo sapiens
gaacccctagaaaggagagaa

SEQ ID NO: 1196134 - DNA, 17 bp, Homo sapiens
gaacccctctgtcttca

SEQ ID NO: 1196135 - DNA, 12 bp, Homo sapiens
gaacccctgtgt

SEQ ID NO: 1196136 - DNA, 17 bp, Homo sapiens
gaaccctaaagcaaatc

SEQ ID NO: 1196137 - DNA, 11 bp, Homo sapiens
gaaccctcagg

SEQ ID NO: 1196138 - DNA, 15 bp, Homo sapiens
gaaccctcaggccac

SEQ ID NO: 1196139 - DNA, 20 bp, Homo sapiens
gaaccctcaggccaccctcc

SEQ ID NO: 1196140 - DNA, 22 bp, Homo sapiens
gaaccctcaggccaccctccac

SEQ ID NO: 1196141 - DNA, 14 bp, Homo sapiens
gaaccctcctcctt

SEQ ID NO: 1196142 - DNA, 13 bp, Homo sapiens
gaaccctcttgcc

SEQ ID NO: 1196143 - DNA, 13 bp, Homo sapiens
gaaccctgtgctg

SEQ ID NO: 1196144 - DNA, 15 bp, Homo sapiens
gaacccttgtgcttg

SEQ ID NO: 1196145 - DNA, 17 bp, Homo sapiens
gaacccttttggccccc

SEQ ID NO: 1196146 - DNA, 12 bp, Homo sapiens
gaaccgagaagg

SEQ ID NO: 1196147 - DNA, 21 bp, Homo sapiens
gaaccgagcaaagatcaaaat

SEQ ID NO: 1196148 - DNA, 15 bp, Homo sapiens
gaaccgcacagctca

SEQ ID NO: 1196149 - DNA, 17 bp, Homo sapiens
gaaccgcacagctcagg

SEQ ID NO: 1196150 - DNA, 21 bp, Homo sapiens
gaaccgcacagctcaggaggc

SEQ ID NO: 1196151 - DNA, 16 bp, Homo sapiens
gaaccgctcacctaga

SEQ ID NO: 1196152 - DNA, 22 bp, Homo sapiens
gaaccgctcacctagagccaga

SEQ ID NO: 1196153 - DNA, 13 bp, Homo sapiens
gaaccgtgacatc

SEQ ID NO: 1196154 - DNA, 17 bp, Homo sapiens
gaaccgtgacatcagcg

SEQ ID NO: 1196155 - DNA, 21 bp, Homo sapiens
gaacctacagttttaactgtg

SEQ ID NO: 1196156 - DNA, 19 bp, Homo sapiens
gaacctactgttcctttca

SEQ ID NO: 1196157 - DNA, 13 bp, Homo sapiens
gaacctatcttta

SEQ ID NO: 1196158 - DNA, 15 bp, Homo sapiens
gaacctattttcatt

SEQ ID NO: 1196159 - DNA, 16 bp, Homo sapiens
gaacctattttcattt

SEQ ID NO: 1196160 - DNA, 18 bp, Homo sapiens
gaacctcccagaggtcca

SEQ ID NO: 1196161 - DNA, 21 bp, Homo sapiens
gaacctcccagaggtccagcc

SEQ ID NO: 1196162 - DNA, 22 bp, Homo sapiens
gaacctcccagaggtccagccc

SEQ ID NO: 1196163 - DNA, 14 bp, Homo sapiens
gaacctctgtctca

SEQ ID NO: 1196164 - DNA, 18 bp, Homo sapiens
gaacctctgtctcatcct

SEQ ID NO: 1196165 - DNA, 18 bp, Homo sapiens
gaacctgaagaactattt

SEQ ID NO: 1196166 - DNA, 12 bp, Homo sapiens
gaacctgagcta

SEQ ID NO: 1196167 - DNA, 17 bp, Homo sapiens
gaacttacacttggagc

SEQ ID NO: 1196168 - DNA, 18 bp, Homo sapiens
gaacttacacttggagcc

SEQ ID NO: 1196169 - DNA, 19 bp, Homo sapiens
gaacttacacttggagccc

SEQ ID NO: 1196170 - DNA, 19 bp, Homo sapiens
gaacttagatgttaaatgt

SEQ ID NO: 1196171 - DNA, 20 bp, Homo sapiens
gaacttatcctaaaacaaat

SEQ ID NO: 1196172 - DNA, 17 bp, Homo sapiens
gaacttcacataggaag

SEQ ID NO: 1196173 - DNA, 13 bp, Homo sapiens
gaacttcatggat

SEQ ID NO: 1196174 - DNA, 15 bp, Homo sapiens
gaacttctaatatat

SEQ ID NO: 1196175 - DNA, 17 bp, Homo sapiens
gaacttctctcagactt

SEQ ID NO: 1196176 - DNA, 15 bp, Homo sapiens
gaacttgaaagtttt

SEQ ID NO: 1196177 - DNA, 15 bp, Homo sapiens
gaacttgaactgatt

SEQ ID NO: 1196178 - DNA, 16 bp, Homo sapiens
gaacttgagctctgta

SEQ ID NO: 1196179 - DNA, 20 bp, Homo sapiens
gaacttgagctctgtaactt

SEQ ID NO: 1196180 - DNA, 21 bp, Homo sapiens
gaacttgagctctgtaactta

SEQ ID NO: 1196181 - DNA, 22 bp, Homo sapiens
gaacttgagctctgtaacttac

SEQ ID NO: 1196182 - DNA, 15 bp, Homo sapiens
gaacttgatttgcat

SEQ ID NO: 1196183 - DNA, 15 bp, Homo sapiens
gaacttgcattgtga

SEQ ID NO: 1196184 - DNA, 19 bp, Homo sapiens
gaacttgcgagtccaaggc

SEQ ID NO: 1196185 - DNA, 17 bp, Homo sapiens
gaactttagggggtggg

SEQ ID NO: 1196186 - DNA, 15 bp, Homo sapiens
gaactttagtgaaac

SEQ ID NO: 1196187 - DNA, 18 bp, Homo sapiens
gaactttctccctcatcg

SEQ ID NO: 1196188 - DNA, 16 bp, Homo sapiens
gaactttgacctctgc

SEQ ID NO: 1196189 - DNA, 23 bp, Homo sapiens
gaactttgacctctgcagcaata

SEQ ID NO: 1196190 - DNA, 23 bp, Homo sapiens
gaacttttacagaatgcattaaa

SEQ ID NO: 1196191 - DNA, 13 bp, Homo sapiens
gaacttttgtaat

SEQ ID NO: 1196192 - DNA, 20 bp, Homo sapiens
gaacttttgtaatttgaatt

SEQ ID NO: 1196193 - DNA, 20 bp, Homo sapiens
gaacttttgtactgaatttt

SEQ ID NO: 1196194 - DNA, 24 bp, Homo sapiens
gaactttttatttgaggagacgaa

SEQ ID NO: 1196195 - DNA, 14 bp, Homo sapiens
gaactttttgtagg

SEQ ID NO: 1196196 - DNA, 13 bp, Homo sapiens
gaagaaaaagaag

SEQ ID NO: 1196197 - DNA, 14 bp, Homo sapiens
gaagaaaaagaagc

SEQ ID NO: 1196198 - DNA, 22 bp, Homo sapiens
gaagaaaactcctttagcaggt

SEQ ID NO: 1196199 - DNA, 18 bp, Homo sapiens
gaagaaaattgctgtgcc

SEQ ID NO: 1196200 - DNA, 20 bp, Homo sapiens
gaagaaacaaggttttcagt

SEQ ID NO: 1196201 - DNA, 18 bp, Homo sapiens
gaagaaagccagacaact

SEQ ID NO: 1196202 - DNA, 13 bp, Homo sapiens
gaagaaagcccct

SEQ ID NO: 1196203 - DNA, 17 bp, Homo sapiens
gaagaaagtcaaaaaat

SEQ ID NO: 1196204 - DNA, 21 bp, Homo sapiens
gaagaaattcaggtacagaaa

SEQ ID NO: 1196205 - DNA, 22 bp, Homo sapiens
gaagaaattcaggtacagaaaa

SEQ ID NO: 1196206 - DNA, 18 bp, Homo sapiens
gaagaaattcctgtagca

SEQ ID NO: 1196207 - DNA, 22 bp, Homo sapiens
gaagaaattcctgtagcatctt

SEQ ID NO: 1196208 - DNA, 19 bp, Homo sapiens
gaagaacacagcatgtgcc

SEQ ID NO: 1196209 - DNA, 17 bp, Homo sapiens
gaagaaccaaatacctc

SEQ ID NO: 1196210 - DNA, 14 bp, Homo sapiens
gaagaaccagccca

SEQ ID NO: 1196211 - DNA, 16 bp, Homo sapiens
gaagaaccagcccagc

SEQ ID NO: 1196212 - DNA, 17 bp, Homo sapiens
gaagaaccagcccagcc

SEQ ID NO: 1196213 - DNA, 20 bp, Homo sapiens
gaagaaccagcccagcctgc

SEQ ID NO: 1196214 - DNA, 21 bp, Homo sapiens
gaagaaccagcccagcctgcc

SEQ ID NO: 1196215 - DNA, 22 bp, Homo sapiens
gaagaacgttttttcctcagtg

SEQ ID NO: 1196216 - DNA, 13 bp, Homo sapiens
taaacctcctgcc

SEQ ID NO: 1196217 - DNA, 19 bp, Homo sapiens
taaacctgaagatgtctcc

SEQ ID NO: 1196218 - DNA, 19 bp, Homo sapiens
taaacctgtagaatcaatt

SEQ ID NO: 1196219 - DNA, 14 bp, Homo sapiens
taaaccttaatatt

SEQ ID NO: 1196220 - DNA, 19 bp, Homo sapiens
taaaccttaatatttcttc

SEQ ID NO: 1196221 - DNA, 13 bp, Homo sapiens
taaaccttcagaa

SEQ ID NO: 1196222 - DNA, 23 bp, Homo sapiens
taaaccttgtgctacttagtaaa

SEQ ID NO: 1196223 - DNA, 17 bp, Homo sapiens
taaacctttttcttgat

SEQ ID NO: 1196224 - DNA, 22 bp, Homo sapiens
taaacctttttcttgatcttaa

SEQ ID NO: 1196225 - DNA, 13 bp, Homo sapiens
taaaccttttttg

SEQ ID NO: 1196226 - DNA, 17 bp, Homo sapiens
taaacggtgctatttct

SEQ ID NO: 1196227 - DNA, 16 bp, Homo sapiens
taaacggttcagtttc

SEQ ID NO: 1196228 - DNA, 17 bp, Homo sapiens
taaacgtgatgatcagc

SEQ ID NO: 1196229 - DNA, 13 bp, Homo sapiens
taaacgtggattt

SEQ ID NO: 1196230 - DNA, 18 bp, Homo sapiens
taaacgtggattttaaaa

SEQ ID NO: 1196231 - DNA, 18 bp, Homo sapiens
taaactaaaatctgttac

SEQ ID NO: 1196232 - DNA, 20 bp, Homo sapiens
taaactaaaatctgttacca

SEQ ID NO: 1196233 - DNA, 14 bp, Homo sapiens
taaactaaataatg

SEQ ID NO: 1196234 - DNA, 15 bp, Homo sapiens
taaactaaataatga

SEQ ID NO: 1196235 - DNA, 16 bp, Homo sapiens
taaactaaataatgaa

SEQ ID NO: 1196236 - DNA, 18 bp, Homo sapiens
taaactaaataatgaata

SEQ ID NO: 1196237 - DNA, 13 bp, Homo sapiens
taaactaaatgtg

SEQ ID NO: 1196238 - DNA, 16 bp, Homo sapiens
taaactaagatctgtt

SEQ ID NO: 1196239 - DNA, 23 bp, Homo sapiens
taaactaatacgtgccagatata

SEQ ID NO: 1196240 - DNA, 18 bp, Homo sapiens
taaactactctttgattt

SEQ ID NO: 1196241 - DNA, 15 bp, Homo sapiens
taaactataagcaag

SEQ ID NO: 1196242 - DNA, 14 bp, Homo sapiens
taaactatattttc

SEQ ID NO: 1196243 - DNA, 13 bp, Homo sapiens
taaactatcagtt

SEQ ID NO: 1196244 - DNA, 17 bp, Homo sapiens
taaactatcagtttgtc

SEQ ID NO: 1196245 - DNA, 23 bp, Homo sapiens
taaactatgttcctaacaaaatg

SEQ ID NO: 1196246 - DNA, 22 bp, Homo sapiens
taaactattagagtatttccct

SEQ ID NO: 1196247 - DNA, 16 bp, Homo sapiens
taaactcaaaactctt

SEQ ID NO: 1196248 - DNA, 19 bp, Homo sapiens
taaactcaaaacttaacat

SEQ ID NO: 1196249 - DNA, 22 bp, Homo sapiens
taaactcaaaatatttgtacat

SEQ ID NO: 1196250 - DNA, 15 bp, Homo sapiens
taaactcaagacaat

SEQ ID NO: 1196251 - DNA, 14 bp, Homo sapiens
taaactcaagattt

SEQ ID NO: 1196252 - DNA, 18 bp, Homo sapiens
taaactcagatctgatca

SEQ ID NO: 1196253 - DNA, 11 bp, Homo sapiens
taaactcaggg

SEQ ID NO: 1196254 - DNA, 20 bp, Homo sapiens
taaactcagggacagagcca

SEQ ID NO: 1196255 - DNA, 15 bp, Homo sapiens
taaactcctgtcctt

SEQ ID NO: 1196256 - DNA, 16 bp, Homo sapiens
taaactccttcctggc

SEQ ID NO: 1196257 - DNA, 13 bp, Homo sapiens
taaactctctagc

SEQ ID NO: 1196258 - DNA, 20 bp, Homo sapiens
taaactctctagcttaagtg

SEQ ID NO: 1196259 - DNA, 21 bp, Homo sapiens
taaactctctttgggaatgtt

SEQ ID NO: 1196260 - DNA, 13 bp, Homo sapiens
taaactctgcatc

SEQ ID NO: 1196261 - DNA, 12 bp, Homo sapiens
taaactctgggg

SEQ ID NO: 1196262 - DNA, 17 bp, Homo sapiens
taaactgaaaaatgtca

SEQ ID NO: 1196263 - DNA, 19 bp, Homo sapiens
taaactgaaaaatgtcagt

SEQ ID NO: 1196264 - DNA, 22 bp, Homo sapiens
taaactgaatattttggaaact

SEQ ID NO: 1196265 - DNA, 18 bp, Homo sapiens
taaactgaatctatggct

SEQ ID NO: 1196266 - DNA, 14 bp, Homo sapiens
taaactgactttat

SEQ ID NO: 1196267 - DNA, 17 bp, Homo sapiens
taaactgcaaacagaaa

SEQ ID NO: 1196268 - DNA, 18 bp, Homo sapiens
taaactgcaaacagaaat

SEQ ID NO: 1196269 - DNA, 20 bp, Homo sapiens
taaactgcagcctctctggc

SEQ ID NO: 1196270 - DNA, 19 bp, Homo sapiens
taaactgcggtcagatgtg

SEQ ID NO: 1196271 - DNA, 15 bp, Homo sapiens
taaactgctgtcaat

SEQ ID NO: 1196272 - DNA, 19 bp, Homo sapiens
taaactgggaaggctttca

SEQ ID NO: 1196273 - DNA, 23 bp, Homo sapiens
taaactgggaaggctttcaggct

SEQ ID NO: 1196274 - DNA, 15 bp, Homo sapiens
taaactgtacagtgt

SEQ ID NO: 1196275 - DNA, 20 bp, Homo sapiens
taaactgtacagtgtctttt

SEQ ID NO: 1196276 - DNA, 16 bp, Homo sapiens
taaactgtattaaatc

SEQ ID NO: 1196277 - DNA, 15 bp, Homo sapiens
taaactgtgtacata

SEQ ID NO: 1196278 - DNA, 18 bp, Homo sapiens
taaactgtgtacataact

SEQ ID NO: 1196279 - DNA, 22 bp, Homo sapiens
taaactgtgtattccaagacat

SEQ ID NO: 1196280 - DNA, 18 bp, Homo sapiens
taaactgttaaacaactc

SEQ ID NO: 1196281 - DNA, 22 bp, Homo sapiens
taaactgttagcactgttgatg

SEQ ID NO: 1196282 - DNA, 23 bp, Homo sapiens
taaactgttagcactgttgatgt

SEQ ID NO: 1196283 - DNA, 13 bp, Homo sapiens
taaactgttgctc

SEQ ID NO: 1196284 - DNA, 14 bp, Homo sapiens
taaacttaatctaa

SEQ ID NO: 1196285 - DNA, 15 bp, Homo sapiens
taaacttagaggaaa

SEQ ID NO: 1196286 - DNA, 15 bp, Homo sapiens
taaacttccaaagaa

SEQ ID NO: 1196287 - DNA, 21 bp, Homo sapiens
taaacttccaaagaaagttct

SEQ ID NO: 1196288 - DNA, 20 bp, Homo sapiens
taaacttctgaagactgaga

SEQ ID NO: 1196289 - DNA, 15 bp, Homo sapiens
taaataacctctggc

SEQ ID NO: 1196290 - DNA, 18 bp, Homo sapiens
taaataacctctggccct

SEQ ID NO: 1196291 - DNA, 23 bp, Homo sapiens
taaataacctctggcccttggaa

SEQ ID NO: 1196292 - DNA, 13 bp, Homo sapiens
taaataactgtgt

SEQ ID NO: 1196293 - DNA, 11 bp, Homo sapiens
taaataagaaa

SEQ ID NO: 1196294 - DNA, 21 bp, Homo sapiens
taaataagaaacaactctttg

SEQ ID NO: 1196295 - DNA, 15 bp, Homo sapiens
taaataagagcatga

SEQ ID NO: 1196296 - DNA, 18 bp, Homo sapiens
taaataagagcatgattt

SEQ ID NO: 1196297 - DNA, 16 bp, Homo sapiens
taaataagatgattta

SEQ ID NO: 1196298 - DNA, 22 bp, Homo sapiens
taaataaggaatttcctcccaa

SEQ ID NO: 1196299 - DNA, 20 bp, Homo sapiens
taaataatcccattctttat

SEQ ID NO: 1196300 - DNA, 18 bp, Homo sapiens
taaataatgcttcagata

SEQ ID NO: 1196301 - DNA, 17 bp, Homo sapiens
taaataatttattacaa

SEQ ID NO: 1196302 - DNA, 16 bp, Homo sapiens
taaataatttgcactg

SEQ ID NO: 1196303 - DNA, 19 bp, Homo sapiens
taaataattttaaataacc

SEQ ID NO: 1196304 - DNA, 21 bp, Homo sapiens
taaataattttaaataacctc

SEQ ID NO: 1196305 - DNA, 13 bp, Homo sapiens
taaataattttct

SEQ ID NO: 1196306 - DNA, 23 bp, Homo sapiens
taaatacaccacctcactcctgt

SEQ ID NO: 1196307 - DNA, 17 bp, Homo sapiens
taaatacagacactaag

SEQ ID NO: 1196308 - DNA, 19 bp, Homo sapiens
taaatacagacactaagtt

SEQ ID NO: 1196309 - DNA, 23 bp, Homo sapiens
taaatacagataattcatttgta

SEQ ID NO: 1196310 - DNA, 16 bp, Homo sapiens
taaatacagcatactt

SEQ ID NO: 1196311 - DNA, 18 bp, Homo sapiens
taaatacaggaaacagtt

SEQ ID NO: 1196312 - DNA, 15 bp, Homo sapiens
taaatacaggaagaa

SEQ ID NO: 1196313 - DNA, 17 bp, Homo sapiens
taaatacagtcttccat

SEQ ID NO: 1196314 - DNA, 21 bp, Homo sapiens
taaatacatacggtcaggttt

SEQ ID NO: 1196315 - DNA, 12 bp, Homo sapiens
taaatacatgtt

SEQ ID NO: 1196316 - DNA, 17 bp, Homo sapiens
taaataccaagagcaat

SEQ ID NO: 1196317 - DNA, 15 bp, Homo sapiens
taaatacgtgtcaaa

SEQ ID NO: 1196318 - DNA, 14 bp, Homo sapiens
taaatactcatgaa

SEQ ID NO: 1196319 - DNA, 16 bp, Homo sapiens
taaatactcatgaatg

SEQ ID NO: 1196320 - DNA, 17 bp, Homo sapiens
taaatactcatgaatga

SEQ ID NO: 1196321 - DNA, 13 bp, Homo sapiens
taaatactggact

SEQ ID NO: 1196322 - DNA, 13 bp, Homo sapiens
taaatactgtgaa

SEQ ID NO: 1196323 - DNA, 15 bp, Homo sapiens
taaatactgtgaaat

SEQ ID NO: 1196324 - DNA, 21 bp, Homo sapiens
taaatactgtgcagaataatg

SEQ ID NO: 1196325 - DNA, 15 bp, Homo sapiens
taaatacttgcagtt

SEQ ID NO: 1196326 - DNA, 11 bp, Homo sapiens
taaatactttg

SEQ ID NO: 1196327 - DNA, 17 bp, Homo sapiens
taaatactttttcagtt

SEQ ID NO: 1196328 - DNA, 23 bp, Homo sapiens
taaatactttttcagttgtttag

SEQ ID NO: 1196329 - DNA, 15 bp, Homo sapiens
taaatagaaatatag

SEQ ID NO: 1196330 - DNA, 20 bp, Homo sapiens
taaatagaactatctgcatt

SEQ ID NO: 1196331 - DNA, 16 bp, Homo sapiens
taaatagcataaaatg

SEQ ID NO: 1196332 - DNA, 17 bp, Homo sapiens
taaatagcctaaatgat

SEQ ID NO: 1196333 - DNA, 12 bp, Homo sapiens
taaataggattt

SEQ ID NO: 1196334 - DNA, 15 bp, Homo sapiens
taaatagttaatata

SEQ ID NO: 1196335 - DNA, 15 bp, Homo sapiens
taaatataaatagct

SEQ ID NO: 1196336 - DNA, 17 bp, Homo sapiens
taaatataaatagctaa

SEQ ID NO: 1196337 - DNA, 15 bp, Homo sapiens
taaatataattctgt

SEQ ID NO: 1196338 - DNA, 17 bp, Homo sapiens
taaatataccactcttt

SEQ ID NO: 1196339 - DNA, 15 bp, Homo sapiens
taaatatataaatat

SEQ ID NO: 1196340 - DNA, 17 bp, Homo sapiens
taaatatataaatatat

SEQ ID NO: 1196341 - DNA, 13 bp, Homo sapiens
taaatatatataa

SEQ ID NO: 1196342 - DNA, 17 bp, Homo sapiens
taaatatatatgtcaat

SEQ ID NO: 1196343 - DNA, 21 bp, Homo sapiens
taaatatatattttgtacttt

SEQ ID NO: 1196344 - DNA, 20 bp, Homo sapiens
taaatatatatttttaaaat

SEQ ID NO: 1196345 - DNA, 18 bp, Homo sapiens
taaatatatatttttcaa

SEQ ID NO: 1196346 - DNA, 15 bp, Homo sapiens
taaatatatgtatgt

SEQ ID NO: 1196347 - DNA, 19 bp, Homo sapiens
taaatatccacagtactca

SEQ ID NO: 1196348 - DNA, 15 bp, Homo sapiens
taaatatcccagaga

SEQ ID NO: 1196349 - DNA, 16 bp, Homo sapiens
taaatatcccagagaa

SEQ ID NO: 1196350 - DNA, 19 bp, Homo sapiens
cttagcgtcaagacatttg

SEQ ID NO: 1196351 - DNA, 16 bp, Homo sapiens
cttagcgttctggact

SEQ ID NO: 1196352 - DNA, 17 bp, Homo sapiens
cttagcgttctggactc

SEQ ID NO: 1196353 - DNA, 23 bp, Homo sapiens
cttagcgttctggactctgcccc

SEQ ID NO: 1196354 - DNA, 24 bp, Homo sapiens
cttagcgttctggactctgcccca

SEQ ID NO: 1196355 - DNA, 21 bp, Homo sapiens
cttagctaaatgcaatttaaa

SEQ ID NO: 1196356 - DNA, 22 bp, Homo sapiens
cttagctaaatgcaatttaaaa

SEQ ID NO: 1196357 - DNA, 22 bp, Homo sapiens
cttagctactgtatgcaaagtc

SEQ ID NO: 1196358 - DNA, 14 bp, Homo sapiens
cttagctatcagaa

SEQ ID NO: 1196359 - DNA, 20 bp, Homo sapiens
cttagctatccttggctttc

SEQ ID NO: 1196360 - DNA, 14 bp, Homo sapiens
cttagctctttctc

SEQ ID NO: 1196361 - DNA, 14 bp, Homo sapiens
cttagctgagtgga

SEQ ID NO: 1196362 - DNA, 12 bp, Homo sapiens
cttagctgccag

SEQ ID NO: 1196363 - DNA, 19 bp, Homo sapiens
cttagctgccagtgctggt

SEQ ID NO: 1196364 - DNA, 14 bp, Homo sapiens
cttagctgtctgct

SEQ ID NO: 1196365 - DNA, 17 bp, Homo sapiens
cttagctgtctgctcag

SEQ ID NO: 1196366 - DNA, 16 bp, Homo sapiens
cttagcttacaggaag

SEQ ID NO: 1196367 - DNA, 23 bp, Homo sapiens
cttagcttagacctcagcctgtg

SEQ ID NO: 1196368 - DNA, 13 bp, Homo sapiens
cttagctttattt

SEQ ID NO: 1196369 - DNA, 13 bp, Homo sapiens
cttagctttgaaa

SEQ ID NO: 1196370 - DNA, 20 bp, Homo sapiens
cttaggaaaatgcttctgtt

SEQ ID NO: 1196371 - DNA, 17 bp, Homo sapiens
cttaggaaccttctccc

SEQ ID NO: 1196372 - DNA, 22 bp, Homo sapiens
cttaggaagagaaaccagggag

SEQ ID NO: 1196373 - DNA, 21 bp, Homo sapiens
cttaggagacagatcactcct

SEQ ID NO: 1196374 - DNA, 17 bp, Homo sapiens
cttaggagcaagaagaa

SEQ ID NO: 1196375 - DNA, 20 bp, Homo sapiens
cttaggatggggctcccagc

SEQ ID NO: 1196376 - DNA, 18 bp, Homo sapiens
cttaggatgtgtgcatgt

SEQ ID NO: 1196377 - DNA, 22 bp, Homo sapiens
cttaggatgtgtgcatgtgtgt

SEQ ID NO: 1196378 - DNA, 14 bp, Homo sapiens
cttaggcactaaag

SEQ ID NO: 1196379 - DNA, 16 bp, Homo sapiens
cttaggcactgaggga

SEQ ID NO: 1196380 - DNA, 17 bp, Homo sapiens
cttaggcatgcacagct

SEQ ID NO: 1196381 - DNA, 16 bp, Homo sapiens
cttaggcatgtgctgg

SEQ ID NO: 1196382 - DNA, 17 bp, Homo sapiens
cttaggcattatttaat

SEQ ID NO: 1196383 - DNA, 13 bp, Homo sapiens
cttaggccttcct

SEQ ID NO: 1196384 - DNA, 16 bp, Homo sapiens
cttaggctttgtatga

SEQ ID NO: 1196385 - DNA, 12 bp, Homo sapiens
cttagggaaaga

SEQ ID NO: 1196386 - DNA, 16 bp, Homo sapiens
cttagggaagaaaaag

SEQ ID NO: 1196387 - DNA, 20 bp, Homo sapiens
cttagggaagaaaaagcaag

SEQ ID NO: 1196388 - DNA, 19 bp, Homo sapiens
cttagggaaggatacaaaa

SEQ ID NO: 1196389 - DNA, 21 bp, Homo sapiens
cttagggacaggaccccagct

SEQ ID NO: 1196390 - DNA, 22 bp, Homo sapiens
cttagggacaggaccccagctc

SEQ ID NO: 1196391 - DNA, 23 bp, Homo sapiens
cttagggacaggaccccagctct

SEQ ID NO: 1196392 - DNA, 20 bp, Homo sapiens
cttaggggaaccctgtccct

SEQ ID NO: 1196393 - DNA, 18 bp, Homo sapiens
cttagggtggctttaatt

SEQ ID NO: 1196394 - DNA, 16 bp, Homo sapiens
cttagggtttggagct

SEQ ID NO: 1196395 - DNA, 19 bp, Homo sapiens
cttaggtcgcgctcttgca

SEQ ID NO: 1196396 - DNA, 14 bp, Homo sapiens
cttaggtgccaggc

SEQ ID NO: 1196397 - DNA, 15 bp, Homo sapiens
cttaggtgccaggct

SEQ ID NO: 1196398 - DNA, 23 bp, Homo sapiens
cttaggttggcaaaaaggcagga

SEQ ID NO: 1196399 - DNA, 14 bp, Homo sapiens
cttaggttttcttt

SEQ ID NO: 1196400 - DNA, 16 bp, Homo sapiens
cttagtagattaaaaa

SEQ ID NO: 1196401 - DNA, 21 bp, Homo sapiens
cttagtatgcagttgataaga

SEQ ID NO: 1196402 - DNA, 16 bp, Homo sapiens
cttagtatttctcagg

SEQ ID NO: 1196403 - DNA, 14 bp, Homo sapiens
cttagtcactgcct

SEQ ID NO: 1196404 - DNA, 16 bp, Homo sapiens
cttagtccagttgtgt

SEQ ID NO: 1196405 - DNA, 17 bp, Homo sapiens
cttagtccagttgtgtt

SEQ ID NO: 1196406 - DNA, 22 bp, Homo sapiens
cttagtcccccaactctgagcc

SEQ ID NO: 1196407 - DNA, 23 bp, Homo sapiens
cttagtcccccaactctgagccc

SEQ ID NO: 1196408 - DNA, 15 bp, Homo sapiens
cttagtcttctcata

SEQ ID NO: 1196409 - DNA, 16 bp, Homo sapiens
cttagtcttctcatag

SEQ ID NO: 1196410 - DNA, 23 bp, Homo sapiens
cttagtgcccgcctaggagttga

SEQ ID NO: 1196411 - DNA, 20 bp, Homo sapiens
cttagtgcggacaagtttta

SEQ ID NO: 1196412 - DNA, 22 bp, Homo sapiens
cttagtgcttcagagtttgtgt

SEQ ID NO: 1196413 - DNA, 23 bp, Homo sapiens
cttagtgcttcagagtttgtgtg

SEQ ID NO: 1196414 - DNA, 14 bp, Homo sapiens
cttagtgggccagg

SEQ ID NO: 1196415 - DNA, 16 bp, Homo sapiens
cttagtggtatgtctc

SEQ ID NO: 1196416 - DNA, 17 bp, Homo sapiens
cttagtggtatgtctct

SEQ ID NO: 1196417 - DNA, 18 bp, Homo sapiens
cttagtggtatgtctctt

SEQ ID NO: 1196418 - DNA, 15 bp, Homo sapiens
cttagtgtatgatta

SEQ ID NO: 1196419 - DNA, 12 bp, Homo sapiens
cttagtgttcaa

SEQ ID NO: 1196420 - DNA, 22 bp, Homo sapiens
cttagttaaaattgatttcttc

SEQ ID NO: 1196421 - DNA, 15 bp, Homo sapiens
cttagttctcactgt

SEQ ID NO: 1196422 - DNA, 19 bp, Homo sapiens
cttagttcttgaattgtta

SEQ ID NO: 1196423 - DNA, 15 bp, Homo sapiens
cttagttgatattca

SEQ ID NO: 1196424 - DNA, 17 bp, Homo sapiens
cttagttggctttgccc

SEQ ID NO: 1196425 - DNA, 22 bp, Homo sapiens
cttagtttgtgatgtaaggcac

SEQ ID NO: 1196426 - DNA, 17 bp, Homo sapiens
cttagtttgtgtgttgt

SEQ ID NO: 1196427 - DNA, 23 bp, Homo sapiens
cttagtttgtgtgttgtctcttg

SEQ ID NO: 1196428 - DNA, 22 bp, Homo sapiens
cttataaactatttttttctta

SEQ ID NO: 1196429 - DNA, 22 bp, Homo sapiens
cttataacctagttaaagaaag

SEQ ID NO: 1196430 - DNA, 19 bp, Homo sapiens
cttataagtgaagtgatac

SEQ ID NO: 1196431 - DNA, 16 bp, Homo sapiens
cttataataaaggact

SEQ ID NO: 1196432 - DNA, 20 bp, Homo sapiens
cttataataaaggactgtaa

SEQ ID NO: 1196433 - DNA, 23 bp, Homo sapiens
cttataatgtgtgttgtgtgagc

SEQ ID NO: 1196434 - DNA, 17 bp, Homo sapiens
cttataccaaagggaaa

SEQ ID NO: 1196435 - DNA, 21 bp, Homo sapiens
cttatacgaaataattgttgt

SEQ ID NO: 1196436 - DNA, 18 bp, Homo sapiens
cttatactgtacaataaa

SEQ ID NO: 1196437 - DNA, 16 bp, Homo sapiens
cttatactgtatatga

SEQ ID NO: 1196438 - DNA, 17 bp, Homo sapiens
cttatagggtaaaaaaa

SEQ ID NO: 1196439 - DNA, 17 bp, Homo sapiens
cttatagttaatatttt

SEQ ID NO: 1196440 - DNA, 21 bp, Homo sapiens
cttatagttactgtgtaatta

SEQ ID NO: 1196441 - DNA, 17 bp, Homo sapiens
cttatataaaatagact

SEQ ID NO: 1196442 - DNA, 16 bp, Homo sapiens
cttatatctggcctct

SEQ ID NO: 1196443 - DNA, 21 bp, Homo sapiens
cttatatctggcctctgcttt

SEQ ID NO: 1196444 - DNA, 18 bp, Homo sapiens
cttatatgccaagctaat

SEQ ID NO: 1196445 - DNA, 17 bp, Homo sapiens
gtctgtgactggatctt

SEQ ID NO: 1196446 - DNA, 18 bp, Homo sapiens
gtctgtgccctccaaaga

SEQ ID NO: 1196447 - DNA, 12 bp, Homo sapiens
gtctgtgctctt

SEQ ID NO: 1196448 - DNA, 14 bp, Homo sapiens
gtctgtgctgaggc

SEQ ID NO: 1196449 - DNA, 15 bp, Homo sapiens
gtctgtgctgtgcct

SEQ ID NO: 1196450 - DNA, 17 bp, Homo sapiens
gtctgtgctgtgcctgc

SEQ ID NO: 1196451 - DNA, 18 bp, Homo sapiens
gtctgtgctgtgcctgct

SEQ ID NO: 1196452 - DNA, 19 bp, Homo sapiens
gtctgtgctgtgcctgcta

SEQ ID NO: 1196453 - DNA, 14 bp, Homo sapiens
gtctgtgggcttca

SEQ ID NO: 1196454 - DNA, 22 bp, Homo sapiens
gtctgtggggtggttccgggct

SEQ ID NO: 1196455 - DNA, 17 bp, Homo sapiens
gtctgtgtgcatcatgt

SEQ ID NO: 1196456 - DNA, 20 bp, Homo sapiens
gtctgtgtgctgtttgaaaa

SEQ ID NO: 1196457 - DNA, 18 bp, Homo sapiens
gtctgtgtggtggagcca

SEQ ID NO: 1196458 - DNA, 20 bp, Homo sapiens
gtctgtgttccaaccactga

SEQ ID NO: 1196459 - DNA, 16 bp, Homo sapiens
gtctgttaacttaata

SEQ ID NO: 1196460 - DNA, 15 bp, Homo sapiens
gtctgttaccatgtc

SEQ ID NO: 1196461 - DNA, 19 bp, Homo sapiens
gtctgttaccttgttaata

SEQ ID NO: 1196462 - DNA, 17 bp, Homo sapiens
gtctgttcactgcattc

SEQ ID NO: 1196463 - DNA, 14 bp, Homo sapiens
gtctgttctgcagt

SEQ ID NO: 1196464 - DNA, 13 bp, Homo sapiens
gtctgttcttgaa

SEQ ID NO: 1196465 - DNA, 17 bp, Homo sapiens
gtctgttctttccaaag

SEQ ID NO: 1196466 - DNA, 18 bp, Homo sapiens
gtctgttggcaggctggc

SEQ ID NO: 1196467 - DNA, 19 bp, Homo sapiens
gtctgttggcaggctggcc

SEQ ID NO: 1196468 - DNA, 20 bp, Homo sapiens
gtctgttggcaggctggcca

SEQ ID NO: 1196469 - DNA, 21 bp, Homo sapiens
gtctgttggcaggctggccag

SEQ ID NO: 1196470 - DNA, 13 bp, Homo sapiens
gtctgtttaaagt

SEQ ID NO: 1196471 - DNA, 23 bp, Homo sapiens
gtctttcttgggatagtgttctg

SEQ ID NO: 1196472 - DNA, 15 bp, Homo sapiens
gtctttgcacatgtg

SEQ ID NO: 1196473 - DNA, 14 bp, Homo sapiens
gtctttgcagggca

SEQ ID NO: 1196474 - DNA, 21 bp, Homo sapiens
gtctttggataataggaattc

SEQ ID NO: 1196475 - DNA, 20 bp, Homo sapiens
gtctttgtaatgtcaccacc

SEQ ID NO: 1196476 - DNA, 22 bp, Homo sapiens
gtctttgtaatgtcaccacctt

SEQ ID NO: 1196477 - DNA, 13 bp, Homo sapiens
gtctttgtgggag

SEQ ID NO: 1196478 - DNA, 18 bp, Homo sapiens
gtctttgtgtgttatatt

SEQ ID NO: 1196479 - DNA, 20 bp, Homo sapiens
gtctttgtgtgttatattcc

SEQ ID NO: 1196480 - DNA, 17 bp, Homo sapiens
gtctttgttatgacagt

SEQ ID NO: 1196481 - DNA, 13 bp, Homo sapiens
gtcttttaaactg

SEQ ID NO: 1196482 - DNA, 14 bp, Homo sapiens
gtcttttaaactgg

SEQ ID NO: 1196483 - DNA, 14 bp, Homo sapiens
gtcttttaccctgt

SEQ ID NO: 1196484 - DNA, 17 bp, Homo sapiens
gtcttttaccctgtgtc

SEQ ID NO: 1196485 - DNA, 19 bp, Homo sapiens
gtcttttaccctgtgtcag

SEQ ID NO: 1196486 - DNA, 20 bp, Homo sapiens
gtcttttcaagtaattttca

SEQ ID NO: 1196487 - DNA, 21 bp, Homo sapiens
gtcttttcaagtaattttcat

SEQ ID NO: 1196488 - DNA, 20 bp, Homo sapiens
gtcttttccactcctatgga

SEQ ID NO: 1196489 - DNA, 15 bp, Homo sapiens
gtcttttctcctccg

SEQ ID NO: 1196490 - DNA, 23 bp, Homo sapiens
gtcttttgcatgtcgcacaatgt

SEQ ID NO: 1196491 - DNA, 16 bp, Homo sapiens
gtcttttgcttttggc

SEQ ID NO: 1196492 - DNA, 16 bp, Homo sapiens
gtcttttggttatgaa

SEQ ID NO: 1196493 - DNA, 16 bp, Homo sapiens
gtcttttgttctctga

SEQ ID NO: 1196494 - DNA, 23 bp, Homo sapiens
gtctttttctttttttggtaaat

SEQ ID NO: 1196495 - DNA, 13 bp, Homo sapiens
gtctttttttgta

SEQ ID NO: 1196496 - DNA, 21 bp, Homo sapiens
gtctttttttgtattataaaa

SEQ ID NO: 1196497 - DNA, 17 bp, Homo sapiens
gtcttttttttcatcct

SEQ ID NO: 1196498 - DNA, 19 bp, Homo sapiens
gtgaaaacatatttgtgaa

SEQ ID NO: 1196499 - DNA, 23 bp, Homo sapiens
gtgaaaagaaaaatgagcctggc

SEQ ID NO: 1196500 - DNA, 16 bp, Homo sapiens
gtgaaaagattttatt

SEQ ID NO: 1196501 - DNA, 21 bp, Homo sapiens
gtgaaaagcacagctgtatat

SEQ ID NO: 1196502 - DNA, 14 bp, Homo sapiens
gtgaaaagctccat

SEQ ID NO: 1196503 - DNA, 20 bp, Homo sapiens
gtgaaaatagtgtaagaact

SEQ ID NO: 1196504 - DNA, 17 bp, Homo sapiens
gtgaaaatggtccagga

SEQ ID NO: 1196505 - DNA, 16 bp, Homo sapiens
gtgaaacacaccaggc

SEQ ID NO: 1196506 - DNA, 17 bp, Homo sapiens
gtgaaacacaccaggct

SEQ ID NO: 1196507 - DNA, 14 bp, Homo sapiens
gtgaaacagagaaa

SEQ ID NO: 1196508 - DNA, 20 bp, Homo sapiens
gtgaaacataataataatgg

SEQ ID NO: 1196509 - DNA, 23 bp, Homo sapiens
gtgaaacctttagggcagcttgc

SEQ ID NO: 1196510 - DNA, 23 bp, Homo sapiens
gtgaaacgactcaaaatgacagt

SEQ ID NO: 1196511 - DNA, 16 bp, Homo sapiens
gtgaaacttcctaagt

SEQ ID NO: 1196512 - DNA, 18 bp, Homo sapiens
gtgaaacttgtgctatag

SEQ ID NO: 1196513 - DNA, 14 bp, Homo sapiens
gtgaaactttcatt

SEQ ID NO: 1196514 - DNA, 21 bp, Homo sapiens
gtgaaagggagctatcaggaa

SEQ ID NO: 1196515 - DNA, 15 bp, Homo sapiens
gtgaaagtgaggaaa

SEQ ID NO: 1196516 - DNA, 15 bp, Homo sapiens
gtgaaatacatcctt

SEQ ID NO: 1196517 - DNA, 21 bp, Homo sapiens
gtgaaatagttcaaagccaag

SEQ ID NO: 1196518 - DNA, 14 bp, Homo sapiens
gtgaaatcctcagc

SEQ ID NO: 1196519 - DNA, 15 bp, Homo sapiens
gtgaaattaagcatt

SEQ ID NO: 1196520 - DNA, 21 bp, Homo sapiens
gtgaaatttattagttaatat

SEQ ID NO: 1196521 - DNA, 16 bp, Homo sapiens
gtgaaatttgcctctg

SEQ ID NO: 1196522 - DNA, 14 bp, Homo sapiens
gtgaaattttggtg

SEQ ID NO: 1196523 - DNA, 21 bp, Homo sapiens
gtgaacactagccagacactc

SEQ ID NO: 1196524 - DNA, 13 bp, Homo sapiens
gtgaacactgtga

SEQ ID NO: 1196525 - DNA, 16 bp, Homo sapiens
gtgaacagctggtgcc

SEQ ID NO: 1196526 - DNA, 16 bp, Homo sapiens
gtgaacatcccttatt

SEQ ID NO: 1196527 - DNA, 14 bp, Homo sapiens
gtgaacattcccag

SEQ ID NO: 1196528 - DNA, 14 bp, Homo sapiens
gtgaaccctggggc

SEQ ID NO: 1196529 - DNA, 18 bp, Homo sapiens
gtgaaccctggggcctga

SEQ ID NO: 1196530 - DNA, 19 bp, Homo sapiens
gtgaaccctggggcctgac

SEQ ID NO: 1196531 - DNA, 14 bp, Homo sapiens
gtgaacctgtataa

SEQ ID NO: 1196532 - DNA, 16 bp, Homo sapiens
gtgaacgatttagaaa

SEQ ID NO: 1196533 - DNA, 23 bp, Homo sapiens
gtgaacgctgtgatgctgtgtgc

SEQ ID NO: 1196534 - DNA, 21 bp, Homo sapiens
gtgaactatatcagtagtgta

SEQ ID NO: 1196535 - DNA, 22 bp, Homo sapiens
gtgaactcaccctgggagccag

SEQ ID NO: 1196536 - DNA, 14 bp, Homo sapiens
gtgaactccatcat

SEQ ID NO: 1196537 - DNA, 16 bp, Homo sapiens
gtgaactgacaggcag

SEQ ID NO: 1196538 - DNA, 15 bp, Homo sapiens
gtgaactgggcacag

SEQ ID NO: 1196539 - DNA, 13 bp, Homo sapiens
gtgaactgggcat

SEQ ID NO: 1196540 - DNA, 21 bp, Homo sapiens
gtgaacttacacttggagccc

SEQ ID NO: 1196541 - DNA, 18 bp, Homo sapiens
gtgaacttcttgaatcta

SEQ ID NO: 1196542 - DNA, 17 bp, Homo sapiens
gtgaacttgggccactg

SEQ ID NO: 1196543 - DNA, 15 bp, Homo sapiens
gtgaacttttgtaat

SEQ ID NO: 1196544 - DNA, 21 bp, Homo sapiens
gtgaactttttctaggtggca

SEQ ID NO: 1196545 - DNA, 14 bp, Homo sapiens
gtgaagaaagccag

SEQ ID NO: 1196546 - DNA, 24 bp, Homo sapiens
gtgaagacagaaacccagtaactt

SEQ ID NO: 1196547 - DNA, 20 bp, Homo sapiens
gtgaagaggctgcttctcta

SEQ ID NO: 1196548 - DNA, 19 bp, Homo sapiens
gtgaagagggagaagcatg

SEQ ID NO: 1196549 - DNA, 13 bp, Homo sapiens
gtgaagaggggca

SEQ ID NO: 1196550 - DNA, 14 bp, Homo sapiens
gtgaagaggggcag

SEQ ID NO: 1196551 - DNA, 16 bp, Homo sapiens
gtgaagagtttcacaa

SEQ ID NO: 1196552 - DNA, 14 bp, Homo sapiens
gtgaagataatttg

SEQ ID NO: 1196553 - DNA, 15 bp, Homo sapiens
gtgaagataatttgc

SEQ ID NO: 1196554 - DNA, 17 bp, Homo sapiens
gtgaagataatttgcat

SEQ ID NO: 1196555 - DNA, 17 bp, Homo sapiens
gtgaagcatgctttgct

SEQ ID NO: 1196556 - DNA, 18 bp, Homo sapiens
gtgaagcatgctttgctg

SEQ ID NO: 1196557 - DNA, 14 bp, Homo sapiens
gtgaagctaatgtc

SEQ ID NO: 1196558 - DNA, 13 bp, Homo sapiens
gtgaaggaaataa

SEQ ID NO: 1196559 - DNA, 22 bp, Homo sapiens
gtgaaggattatggaaaaataa

SEQ ID NO: 1196560 - DNA, 19 bp, Homo sapiens
gtgaaggcccaagagcaga

SEQ ID NO: 1196561 - DNA, 17 bp, Homo sapiens
gtgaaggcttctctctg

SEQ ID NO: 1196562 - DNA, 12 bp, Homo sapiens
gtgaagggatgg

SEQ ID NO: 1196563 - DNA, 21 bp, Homo sapiens
gtgaagtccttcagtgagccc

SEQ ID NO: 1196564 - DNA, 15 bp, Homo sapiens
gtgaagtgaatctga

SEQ ID NO: 1196565 - DNA, 15 bp, Homo sapiens
gtgaagtgtggctgg

SEQ ID NO: 1196566 - DNA, 17 bp, Homo sapiens
gtgaagtgtggctggtg

SEQ ID NO: 1196567 - DNA, 18 bp, Homo sapiens
gtgaagtgtggctggtgt

SEQ ID NO: 1196568 - DNA, 15 bp, Homo sapiens
gtgaagttgcttctt

SEQ ID NO: 1196569 - DNA, 19 bp, Homo sapiens
gtgaagtttaattgactta

SEQ ID NO: 1196570 - DNA, 19 bp, Homo sapiens
gtgaagtttggagattttt

SEQ ID NO: 1196571 - DNA, 23 bp, Homo sapiens
gtgaagttttccttgctatttca

SEQ ID NO: 1196572 - DNA, 18 bp, Homo sapiens
gtgaataaaaattgatga

SEQ ID NO: 1196573 - DNA, 16 bp, Homo sapiens
gtgaataaatgtcttg

SEQ ID NO: 1196574 - DNA, 15 bp, Homo sapiens
gtgaatacaattaaa

SEQ ID NO: 1196575 - DNA, 17 bp, Homo sapiens
gtgaatacaattaaagg

SEQ ID NO: 1196576 - DNA, 22 bp, Homo sapiens
cttcaagtgcatgctctctgca

SEQ ID NO: 1196577 - DNA, 18 bp, Homo sapiens
cttcaagttaaagtgaat

SEQ ID NO: 1196578 - DNA, 22 bp, Homo sapiens
cttcaagttgtaaaaatgaaag

SEQ ID NO: 1196579 - DNA, 14 bp, Homo sapiens
cttcaatataagaa

SEQ ID NO: 1196580 - DNA, 18 bp, Homo sapiens
cttcaatataagaagcaa

SEQ ID NO: 1196581 - DNA, 22 bp, Homo sapiens
cttcaatataagaagcaatctt

SEQ ID NO: 1196582 - DNA, 18 bp, Homo sapiens
cttcaatgctagaaaatc

SEQ ID NO: 1196583 - DNA, 13 bp, Homo sapiens
cttcaattaaaat

SEQ ID NO: 1196584 - DNA, 16 bp, Homo sapiens
cttcaattaaaattac

SEQ ID NO: 1196585 - DNA, 16 bp, Homo sapiens
cttcaattcctgggcc

SEQ ID NO: 1196586 - DNA, 19 bp, Homo sapiens
cttcaatttgtataaaatg

SEQ ID NO: 1196587 - DNA, 14 bp, Homo sapiens
cttcacaaagccca

SEQ ID NO: 1196588 - DNA, 15 bp, Homo sapiens
cttcacaaagcccaa

SEQ ID NO: 1196589 - DNA, 23 bp, Homo sapiens
cttcacaaagcccaagggatctg

SEQ ID NO: 1196590 - DNA, 20 bp, Homo sapiens
cttcacaaatgtcattgtct

SEQ ID NO: 1196591 - DNA, 16 bp, Homo sapiens
cttcacacacaggcaa

SEQ ID NO: 1196592 - DNA, 22 bp, Homo sapiens
cttcacacacaggcaactgagg

SEQ ID NO: 1196593 - DNA, 21 bp, Homo sapiens
gtgaattcccagactctgcct

SEQ ID NO: 1196594 - DNA, 22 bp, Homo sapiens
gtgaattgcctgcagagagaag

SEQ ID NO: 1196595 - DNA, 19 bp, Homo sapiens
gtgaattgtgaccaagtta

SEQ ID NO: 1196596 - DNA, 22 bp, Homo sapiens
gtgaatttcagtataaagatca

SEQ ID NO: 1196597 - DNA, 14 bp, Homo sapiens
gtgaatttctaaat

SEQ ID NO: 1196598 - DNA, 13 bp, Homo sapiens
gtgaatttgaatg

SEQ ID NO: 1196599 - DNA, 16 bp, Homo sapiens
gtgaatttgaatgaaa

SEQ ID NO: 1196600 - DNA, 17 bp, Homo sapiens
gtgaattttcaaggcct

SEQ ID NO: 1196601 - DNA, 13 bp, Homo sapiens
gtgaatttttaag

SEQ ID NO: 1196602 - DNA, 14 bp, Homo sapiens
gtgaatttttctct

SEQ ID NO: 1196603 - DNA, 11 bp, Homo sapiens
gtgaatttttg

SEQ ID NO: 1196604 - DNA, 14 bp, Homo sapiens
gtgaatttttgcct

SEQ ID NO: 1196605 - DNA, 20 bp, Homo sapiens
gtgaatttttgcctatcttt

SEQ ID NO: 1196606 - DNA, 23 bp, Homo sapiens
gtgaatttttttgttttgttttt

SEQ ID NO: 1196607 - DNA, 20 bp, Homo sapiens
gtgacaaaaaattaaagcat

SEQ ID NO: 1196608 - DNA, 13 bp, Homo sapiens
gtgacaaaattca

SEQ ID NO: 1196609 - DNA, 12 bp, Homo sapiens
gtgacaaaccat

SEQ ID NO: 1196610 - DNA, 17 bp, Homo sapiens
gtgacaaagactcctct

SEQ ID NO: 1196611 - DNA, 23 bp, Homo sapiens
gtgacaaagactcctctgggcct

SEQ ID NO: 1196612 - DNA, 18 bp, Homo sapiens
gtgacaaagccagaggag

SEQ ID NO: 1196613 - DNA, 19 bp, Homo sapiens
gtgacaaagccagaggaga

SEQ ID NO: 1196614 - DNA, 19 bp, Homo sapiens
gtgacaaatgttgaccttt

SEQ ID NO: 1196615 - DNA, 17 bp, Homo sapiens
gtgacaaccctggcctc

SEQ ID NO: 1196616 - DNA, 14 bp, Homo sapiens
gtgacaagagcctg

SEQ ID NO: 1196617 - DNA, 14 bp, Homo sapiens
gtgacaaggcccca

SEQ ID NO: 1196618 - DNA, 18 bp, Homo sapiens
gtgacaaggccccagaga

SEQ ID NO: 1196619 - DNA, 12 bp, Homo sapiens
gtgacaataaaa

SEQ ID NO: 1196620 - DNA, 16 bp, Homo sapiens
gtgacaattttgtaca

SEQ ID NO: 1196621 - DNA, 22 bp, Homo sapiens
gtgacacagcagcttcaccaga

SEQ ID NO: 1196622 - DNA, 15 bp, Homo sapiens
gtgacaccaataaat

SEQ ID NO: 1196623 - DNA, 19 bp, Homo sapiens
gtgacaccaataaatgttt

SEQ ID NO: 1196624 - DNA, 19 bp, Homo sapiens
gtgacactctcgtggtatg

SEQ ID NO: 1196625 - DNA, 20 bp, Homo sapiens
gtgacacttcagagagctgg

SEQ ID NO: 1196626 - DNA, 22 bp, Homo sapiens
gtgacacttcagagagctggta

SEQ ID NO: 1196627 - DNA, 23 bp, Homo sapiens
gtgacagaaccgagaagggggtg

SEQ ID NO: 1196628 - DNA, 17 bp, Homo sapiens
gtgacagacaggctctt

SEQ ID NO: 1196629 - DNA, 23 bp, Homo sapiens
gtgacagaccacatctttatctg

SEQ ID NO: 1196630 - DNA, 15 bp, Homo sapiens
gtgacagactcctga

SEQ ID NO: 1196631 - DNA, 20 bp, Homo sapiens
gtgacagactcctgaggaca

SEQ ID NO: 1196632 - DNA, 19 bp, Homo sapiens
gtgacagactttggacagt

SEQ ID NO: 1196633 - DNA, 21 bp, Homo sapiens
gtgacagactttggacagtgg

SEQ ID NO: 1196634 - DNA, 21 bp, Homo sapiens
gtgacagatgccaacttccca

SEQ ID NO: 1196635 - DNA, 13 bp, Homo sapiens
gtgacagctttct

SEQ ID NO: 1196636 - DNA, 16 bp, Homo sapiens
gtgacaggaaagccct

SEQ ID NO: 1196637 - DNA, 18 bp, Homo sapiens
gtgacaggaaagccctcc

SEQ ID NO: 1196638 - DNA, 19 bp, Homo sapiens
gtgacaggaaagccctccc

SEQ ID NO: 1196639 - DNA, 18 bp, Homo sapiens
gtgacaggctcgtcagcc

SEQ ID NO: 1196640 - DNA, 23 bp, Homo sapiens
gtgacagggaaacctttttttga

SEQ ID NO: 1196641 - DNA, 18 bp, Homo sapiens
gtgacagtcatcatcagg

SEQ ID NO: 1196642 - DNA, 15 bp, Homo sapiens
gtgacagtgcctggg

SEQ ID NO: 1196643 - DNA, 17 bp, Homo sapiens
gtgacagtgccttctct

SEQ ID NO: 1196644 - DNA, 14 bp, Homo sapiens
gtgacatcctgctt

SEQ ID NO: 1196645 - DNA, 13 bp, Homo sapiens
gtgacatgaagca

SEQ ID NO: 1196646 - DNA, 19 bp, Homo sapiens
gtgacatgattctgaactt

SEQ ID NO: 1196647 - DNA, 22 bp, Homo sapiens
gtgacatgattctgaacttttg

SEQ ID NO: 1196648 - DNA, 15 bp, Homo sapiens
gtgacatggtgcctg

SEQ ID NO: 1196649 - DNA, 13 bp, Homo sapiens
gtgacatgtaaca

SEQ ID NO: 1196650 - DNA, 17 bp, Homo sapiens
gtgacattttacattaa

SEQ ID NO: 1196651 - DNA, 19 bp, Homo sapiens
gtgacattttacattaaat

SEQ ID NO: 1196652 - DNA, 20 bp, Homo sapiens
gtgaccaactgtgttgtatt

SEQ ID NO: 1196653 - DNA, 15 bp, Homo sapiens
gtgaccaccttctgt

SEQ ID NO: 1196654 - DNA, 17 bp, Homo sapiens
gtgaccaggcatcctcc

SEQ ID NO: 1196655 - DNA, 22 bp, Homo sapiens
gtgaccatcttcataatttgct

SEQ ID NO: 1196656 - DNA, 12 bp, Homo sapiens
gtgaccatgttc

SEQ ID NO: 1196657 - DNA, 13 bp, Homo sapiens
gtgaccattctgc

SEQ ID NO: 1196658 - DNA, 14 bp, Homo sapiens
gtgaccattctgcc

SEQ ID NO: 1196659 - DNA, 21 bp, Homo sapiens
gtgacccacagctctgggcct

SEQ ID NO: 1196660 - DNA, 21 bp, Homo sapiens
gtgaccccatcactcgcagga

SEQ ID NO: 1196661 - DNA, 17 bp, Homo sapiens
gtgacccgtgaatgtgc

SEQ ID NO: 1196662 - DNA, 16 bp, Homo sapiens
gtgaccctcagctgtc

SEQ ID NO: 1196663 - DNA, 17 bp, Homo sapiens
gtgaccctcagctgtca

SEQ ID NO: 1196664 - DNA, 18 bp, Homo sapiens
gtgaccctcagctgtcac

SEQ ID NO: 1196665 - DNA, 20 bp, Homo sapiens
gtgaccctccaaatggagaa

SEQ ID NO: 1196666 - DNA, 13 bp, Homo sapiens
gtgaccctctgaa

SEQ ID NO: 1196667 - DNA, 21 bp, Homo sapiens
gtgaccctctgaatggtccag

SEQ ID NO: 1196668 - DNA, 17 bp, Homo sapiens
gtgacccttcagggcca

SEQ ID NO: 1196669 - DNA, 21 bp, Homo sapiens
gtgaccggacttttctgcaaa

SEQ ID NO: 1196670 - DNA, 19 bp, Homo sapiens
gtgaccgggggctgctggg

SEQ ID NO: 1196671 - DNA, 12 bp, Homo sapiens
gtgacctcctgt

SEQ ID NO: 1196672 - DNA, 13 bp, Homo sapiens
gtgacctcctgtc

SEQ ID NO: 1196673 - DNA, 17 bp, Homo sapiens
gtgacctgatttcagaa

SEQ ID NO: 1196674 - DNA, 22 bp, Homo sapiens
gtgacctgggtatcccctgcct

SEQ ID NO: 1196675 - DNA, 13 bp, Homo sapiens
gtgacctgtttat

SEQ ID NO: 1196676 - DNA, 16 bp, Homo sapiens
gtgacctttgacctcg

SEQ ID NO: 1196677 - DNA, 15 bp, Homo sapiens
gtgacgaaaacattg

SEQ ID NO: 1196678 - DNA, 17 bp, Homo sapiens
gtgacgcctgagacagc

SEQ ID NO: 1196679 - DNA, 20 bp, Homo sapiens
gtgacgcctgagacagcacc

SEQ ID NO: 1196680 - DNA, 20 bp, Homo sapiens
gtgacggtcctttaggcagc

SEQ ID NO: 1196681 - DNA, 18 bp, Homo sapiens
gtgactagcgcctggcct

SEQ ID NO: 1196682 - DNA, 17 bp, Homo sapiens
gtgactatatagagatg

SEQ ID NO: 1196683 - DNA, 14 bp, Homo sapiens
gtgactatgaactt

SEQ ID NO: 1196684 - DNA, 15 bp, Homo sapiens
gtgactcacccaagc

SEQ ID NO: 1196685 - DNA, 19 bp, Homo sapiens
gtgactcctgaagggaagg

SEQ ID NO: 1196686 - DNA, 15 bp, Homo sapiens
gtgactcgggagctg

SEQ ID NO: 1196687 - DNA, 17 bp, Homo sapiens
gtgactcgggagctgca

SEQ ID NO: 1196688 - DNA, 21 bp, Homo sapiens
gtgactctcctgcctcagcct

SEQ ID NO: 1196689 - DNA, 15 bp, Homo sapiens
gtgactctgggcagg

SEQ ID NO: 1196690 - DNA, 20 bp, Homo sapiens
gtgactctttcctaaagcca

SEQ ID NO: 1196691 - DNA, 21 bp, Homo sapiens
gtgactctttcctaaagccaa

SEQ ID NO: 1196692 - DNA, 19 bp, Homo sapiens
gtgactgaaacaaaatgtt

SEQ ID NO: 1196693 - DNA, 14 bp, Homo sapiens
gtgactgaaaccat

SEQ ID NO: 1196694 - DNA, 18 bp, Homo sapiens
gtgactgaaaccattttc

SEQ ID NO: 1196695 - DNA, 19 bp, Homo sapiens
gtgactgaaaccattttcc

SEQ ID NO: 1196696 - DNA, 19 bp, Homo sapiens
gtgactgaagaagatgagc

SEQ ID NO: 1196697 - DNA, 18 bp, Homo sapiens
gtgactgaatttcttttg

SEQ ID NO: 1196698 - DNA, 17 bp, Homo sapiens
gtgactgaatttgggcc

SEQ ID NO: 1196699 - DNA, 21 bp, Homo sapiens
gtgactgaatttgggcctctt

SEQ ID NO: 1196700 - DNA, 21 bp, Homo sapiens
gtgactgatgttacatcacag

SEQ ID NO: 1196701 - DNA, 16 bp, Homo sapiens
gtgactgccaggataa

SEQ ID NO: 1196702 - DNA, 20 bp, Homo sapiens
gtgactgccccaactcctgg

SEQ ID NO: 1196703 - DNA, 21 bp, Homo sapiens
gtgactgccccaactcctgga

SEQ ID NO: 1196704 - DNA, 17 bp, Homo sapiens
gtgactgcgatcttcag

SEQ ID NO: 1196705 - DNA, 24 bp, Homo sapiens
gtgactggcaggtgcagatgggct

SEQ ID NO: 1196706 - DNA, 23 bp, Homo sapiens
gtgactgtcccaccgggagcctc

SEQ ID NO: 1196707 - DNA, 18 bp, Homo sapiens
gtgactgtgtaactttct

SEQ ID NO: 1196708 - DNA, 18 bp, Homo sapiens
gtgacttacaatttgcac

SEQ ID NO: 1196709 - DNA, 23 bp, Homo sapiens
gtgacttattccctgagactttt

SEQ ID NO: 1196710 - DNA, 18 bp, Homo sapiens
gtgacttctcccctgccc

SEQ ID NO: 1196711 - DNA, 19 bp, Homo sapiens
gtgacttctcccctgccct

SEQ ID NO: 1196712 - DNA, 16 bp, Homo sapiens
gtgactttaaaagaaa

SEQ ID NO: 1196713 - DNA, 21 bp, Homo sapiens
gtgagaaatagctgaaaaggg

SEQ ID NO: 1196714 - DNA, 14 bp, Homo sapiens
gtgatatcacctct

SEQ ID NO: 1196715 - DNA, 20 bp, Homo sapiens
gtgatatcacctctcttcag

SEQ ID NO: 1196716 - DNA, 17 bp, Homo sapiens
gtgatcaactgttcagg

SEQ ID NO: 1196717 - DNA, 16 bp, Homo sapiens
gtgatcaataaaatgt

SEQ ID NO: 1196718 - DNA, 17 bp, Homo sapiens
gtgatcaattaaatgta

SEQ ID NO: 1196719 - DNA, 15 bp, Homo sapiens
gtgatcactgagcca

SEQ ID NO: 1196720 - DNA, 18 bp, Homo sapiens
gtgatcatagctcactgt

SEQ ID NO: 1196721 - DNA, 17 bp, Homo sapiens
gtgatcatgtgtggaag

SEQ ID NO: 1196722 - DNA, 22 bp, Homo sapiens
gtgatccagccctggttctggc

SEQ ID NO: 1196723 - DNA, 19 bp, Homo sapiens
gtgatccatccatctccag

SEQ ID NO: 1196724 - DNA, 19 bp, Homo sapiens
gtgatcctctattttgtga

SEQ ID NO: 1196725 - DNA, 19 bp, Homo sapiens
gtgatccttccacctcagt

SEQ ID NO: 1196726 - DNA, 12 bp, Homo sapiens
gtgatctatgtt

SEQ ID NO: 1196727 - DNA, 13 bp, Homo sapiens
gtgatctccatat

SEQ ID NO: 1196728 - DNA, 19 bp, Homo sapiens
gtgatctgtttgaggagag

SEQ ID NO: 1196729 - DNA, 21 bp, Homo sapiens
gtgatgaggccgcggcctccc

SEQ ID NO: 1196730 - DNA, 17 bp, Homo sapiens
gtgatgccaaagatgtt

SEQ ID NO: 1196731 - DNA, 20 bp, Homo sapiens
gtgatgccaaagatgtttga

SEQ ID NO: 1196732 - DNA, 19 bp, Homo sapiens
gtgatgccacacagagtgg

SEQ ID NO: 1196733 - DNA, 20 bp, Homo sapiens
gtgatgccgtcctgctggag

SEQ ID NO: 1196734 - DNA, 21 bp, Homo sapiens
gtgatgccgtcctgctggagt

SEQ ID NO: 1196735 - DNA, 13 bp, Homo sapiens
gtgatgctgtgat

SEQ ID NO: 1196736 - DNA, 16 bp, Homo sapiens
gtgatgcttttgctgc

SEQ ID NO: 1196737 - DNA, 19 bp, Homo sapiens
gtgatgcttttgctgctgc

SEQ ID NO: 1196738 - DNA, 22 bp, Homo sapiens
gtgatgcttttgctgctgctta

SEQ ID NO: 1196739 - DNA, 21 bp, Homo sapiens
gtgatgggccaccggggcaag

SEQ ID NO: 1196740 - DNA, 14 bp, Homo sapiens
gtgatgggggagag

SEQ ID NO: 1196741 - DNA, 15 bp, Homo sapiens
gtgatgggggagagg

SEQ ID NO: 1196742 - DNA, 16 bp, Homo sapiens
gtgatggtgtagccct

SEQ ID NO: 1196743 - DNA, 16 bp, Homo sapiens
gtgatggtgtccttcc

SEQ ID NO: 1196744 - DNA, 16 bp, Homo sapiens
gtgatggttcccctgt

SEQ ID NO: 1196745 - DNA, 23 bp, Homo sapiens
gtgatggttcccctgttcactct

SEQ ID NO: 1196746 - DNA, 15 bp, Homo sapiens
gtgatgtaccagttt

SEQ ID NO: 1196747 - DNA, 18 bp, Homo sapiens
gtgatgtcagaaacaatg

SEQ ID NO: 1196748 - DNA, 15 bp, Homo sapiens
gtgatgtgaagccaa

SEQ ID NO: 1196749 - DNA, 18 bp, Homo sapiens
gtgatgtgcctgtaatct

SEQ ID NO: 1196750 - DNA, 17 bp, Homo sapiens
gtgatgttgaaatatgc

SEQ ID NO: 1196751 - DNA, 18 bp, Homo sapiens
gtgatgtttggattgata

SEQ ID NO: 1196752 - DNA, 18 bp, Homo sapiens
gtgattaaacgtgcagac

SEQ ID NO: 1196753 - DNA, 14 bp, Homo sapiens
gtgattaacttgct

SEQ ID NO: 1196754 - DNA, 15 bp, Homo sapiens
gtgattaacttgctt

SEQ ID NO: 1196755 - DNA, 14 bp, Homo sapiens
gtgattaatgtttt

SEQ ID NO: 1196756 - DNA, 17 bp, Homo sapiens
gtgattacctgctgcat

SEQ ID NO: 1196757 - DNA, 21 bp, Homo sapiens
gtgattacgtgtatgtttctt

SEQ ID NO: 1196758 - DNA, 18 bp, Homo sapiens
gtgattatctctttgatc

SEQ ID NO: 1196759 - DNA, 16 bp, Homo sapiens
gtgattatttcacttt

SEQ ID NO: 1196760 - DNA, 23 bp, Homo sapiens
gtgattcaatctgtaaactgtgt

SEQ ID NO: 1196761 - DNA, 21 bp, Homo sapiens
gtgattcctaagccacttgaa

SEQ ID NO: 1196762 - DNA, 18 bp, Homo sapiens
gtgattcgggggctgacc

SEQ ID NO: 1196763 - DNA, 16 bp, Homo sapiens
gtgattctcagggctg

SEQ ID NO: 1196764 - DNA, 18 bp, Homo sapiens
gtgattctcagggctgga

SEQ ID NO: 1196765 - DNA, 21 bp, Homo sapiens
gtgattctgatttcagttttt

SEQ ID NO: 1196766 - DNA, 17 bp, Homo sapiens
gtgattgacagctttgc

SEQ ID NO: 1196767 - DNA, 23 bp, Homo sapiens
gtgattgacagctttgctgctga

SEQ ID NO: 1196768 - DNA, 19 bp, Homo sapiens
gtgattgattcagtatctt

SEQ ID NO: 1196769 - DNA, 13 bp, Homo sapiens
gtgattgcacaga

SEQ ID NO: 1196770 - DNA, 13 bp, Homo sapiens
gtgattgcagctt

SEQ ID NO: 1196771 - DNA, 18 bp, Homo sapiens
gtgattgcagctttatgt

SEQ ID NO: 1196772 - DNA, 19 bp, Homo sapiens
gtgattgcagctttatgtt

SEQ ID NO: 1196773 - DNA, 13 bp, Homo sapiens
gtgattgctgcca

SEQ ID NO: 1196774 - DNA, 23 bp, Homo sapiens
gtgattgtggaatggagattcag

SEQ ID NO: 1196775 - DNA, 13 bp, Homo sapiens
gtgattgtgtctg

SEQ ID NO: 1196776 - DNA, 14 bp, Homo sapiens
gtgatttcctctaa

SEQ ID NO: 1196777 - DNA, 22 bp, Homo sapiens
gtgatttcctctaaagaaactt

SEQ ID NO: 1196778 - DNA, 21 bp, Homo sapiens
gtgatttctttaaaagaatga

SEQ ID NO: 1196779 - DNA, 14 bp, Homo sapiens
gtgatttgaattct

SEQ ID NO: 1196780 - DNA, 21 bp, Homo sapiens
gtgattttatgatcagtgttg

SEQ ID NO: 1196781 - DNA, 18 bp, Homo sapiens
gtgattttatttttgcaa

SEQ ID NO: 1196782 - DNA, 23 bp, Homo sapiens
gtgattttatttttgcaaaataa

SEQ ID NO: 1196783 - DNA, 17 bp, Homo sapiens
gtgattttgccctcctg

SEQ ID NO: 1196784 - DNA, 22 bp, Homo sapiens
gtgcaaaaaaaaacttaaagca

SEQ ID NO: 1196785 - DNA, 13 bp, Homo sapiens
gtgcaaaaaacat

SEQ ID NO: 1196786 - DNA, 14 bp, Homo sapiens
gtgcaaaatggtca

SEQ ID NO: 1196787 - DNA, 19 bp, Homo sapiens
gtgcaaacaacctgaatct

SEQ ID NO: 1196788 - DNA, 21 bp, Homo sapiens
gtgcaaacagtaacgtgtgcg

SEQ ID NO: 1196789 - DNA, 15 bp, Homo sapiens
gtgcaaagactctga

SEQ ID NO: 1196790 - DNA, 18 bp, Homo sapiens
gtgcaaagactctgagcc

SEQ ID NO: 1196791 - DNA, 16 bp, Homo sapiens
gtgcaaaggtgtgctt

SEQ ID NO: 1196792 - DNA, 13 bp, Homo sapiens
gtgcaaattttgc

SEQ ID NO: 1196793 - DNA, 20 bp, Homo sapiens
gtgcaacagcactggctctc

SEQ ID NO: 1196794 - DNA, 23 bp, Homo sapiens
gtgcaacagcactggctctctcc

SEQ ID NO: 1196795 - DNA, 16 bp, Homo sapiens
gtgcaacatctctgaa

SEQ ID NO: 1196796 - DNA, 14 bp, Homo sapiens
gtgcaacccttacc

SEQ ID NO: 1196797 - DNA, 19 bp, Homo sapiens
gtgcaacctcgctgagggc

SEQ ID NO: 1196798 - DNA, 18 bp, Homo sapiens
gtgcaactggccagccaa

SEQ ID NO: 1196799 - DNA, 17 bp, Homo sapiens
gtgcaactttttaaagt

SEQ ID NO: 1196800 - DNA, 17 bp, Homo sapiens
gtgcaagacctagtccc

SEQ ID NO: 1196801 - DNA, 21 bp, Homo sapiens
gtgcaaggagtgtaaaatgta

SEQ ID NO: 1196802 - DNA, 16 bp, Homo sapiens
gtgcaaggtggccttt

SEQ ID NO: 1196803 - DNA, 20 bp, Homo sapiens
gtgcaagtatgtgagtgtgt

SEQ ID NO: 1196804 - DNA, 17 bp, Homo sapiens
gtgcaagtgtctgtgtg

SEQ ID NO: 1196805 - DNA, 20 bp, Homo sapiens
gtgcaagttgaggacttctt

SEQ ID NO: 1196806 - DNA, 12 bp, Homo sapiens
gtgcaatagaag

SEQ ID NO: 1196807 - DNA, 17 bp, Homo sapiens
gtgcaatcacagctcac

SEQ ID NO: 1196808 - DNA, 21 bp, Homo sapiens
gtgcaatcagagtgtacaaat

SEQ ID NO: 1196809 - DNA, 19 bp, Homo sapiens
gtgcaatgggggagggagg

SEQ ID NO: 1196810 - DNA, 20 bp, Homo sapiens
gtgcaatgtaaatattttaa

SEQ ID NO: 1196811 - DNA, 22 bp, Homo sapiens
gtgcaatgtaaatattttaaag

SEQ ID NO: 1196812 - DNA, 21 bp, Homo sapiens
gtgcaatgtctgagtgaacct

SEQ ID NO: 1196813 - DNA, 22 bp, Homo sapiens
gtgcaattacagcaaaaaggga

SEQ ID NO: 1196814 - DNA, 14 bp, Homo sapiens
gtgcacaaatacaa

SEQ ID NO: 1196815 - DNA, 18 bp, Homo sapiens
gtgcacacatcaccaggt

SEQ ID NO: 1196816 - DNA, 19 bp, Homo sapiens
gtgcacacgtgtgtatgag

SEQ ID NO: 1196817 - DNA, 14 bp, Homo sapiens
gtgcacagtgattt

SEQ ID NO: 1196818 - DNA, 15 bp, Homo sapiens
gtgcacccacctgtt

SEQ ID NO: 1196819 - DNA, 22 bp, Homo sapiens
gtgcacccacctgttttctgaa

SEQ ID NO: 1196820 - DNA, 17 bp, Homo sapiens
gtgcacccactcaccag

SEQ ID NO: 1196821 - DNA, 20 bp, Homo sapiens
gtgcacccactcaccagggt

SEQ ID NO: 1196822 - DNA, 22 bp, Homo sapiens
gtgcacccactcaccagggtcc

SEQ ID NO: 1196823 - DNA, 20 bp, Homo sapiens
gtgcaccttaccaactttct

SEQ ID NO: 1196824 - DNA, 16 bp, Homo sapiens
gtgcacgcctgcaggc

SEQ ID NO: 1196825 - DNA, 12 bp, Homo sapiens
gtgcacgttgct

SEQ ID NO: 1196826 - DNA, 15 bp, Homo sapiens
gtgcactccagcttc

SEQ ID NO: 1196827 - DNA, 19 bp, Homo sapiens
gtgcactgcccatggacag

SEQ ID NO: 1196828 - DNA, 20 bp, Homo sapiens
gtgcactgctccctggggtt

SEQ ID NO: 1196829 - DNA, 14 bp, Homo sapiens
gtgcactgggcagg

SEQ ID NO: 1196830 - DNA, 13 bp, Homo sapiens
gtgcactgtcact

SEQ ID NO: 1196831 - DNA, 23 bp, Homo sapiens
gtgcactgtcactttgctctggg

SEQ ID NO: 1196832 - DNA, 17 bp, Homo sapiens
gtgcactttctaatgtt

SEQ ID NO: 1196833 - DNA, 16 bp, Homo sapiens
cttccagctgctgtct

SEQ ID NO: 1196834 - DNA, 16 bp, Homo sapiens
cttccagcttcttttg

SEQ ID NO: 1196835 - DNA, 15 bp, Homo sapiens
ctgacagctgctcct

SEQ ID NO: 1196836 - DNA, 19 bp, Homo sapiens
ctgacagctgctcctagag

SEQ ID NO: 1196837 - DNA, 19 bp, Homo sapiens
ctgacagggacatgccctg

SEQ ID NO: 1196838 - DNA, 16 bp, Homo sapiens
ctgacagggagcagcc

SEQ ID NO: 1196839 - DNA, 21 bp, Homo sapiens
ctgacaggtgaggtctgttcc

SEQ ID NO: 1196840 - DNA, 18 bp, Homo sapiens
ctgacaggtgatgctctg

SEQ ID NO: 1196841 - DNA, 21 bp, Homo sapiens
ctgacaggtgatgctctggct

SEQ ID NO: 1196842 - DNA, 14 bp, Homo sapiens
ctgacagtccacag

SEQ ID NO: 1196843 - DNA, 16 bp, Homo sapiens
ctgacagtttttctgt

SEQ ID NO: 1196844 - DNA, 16 bp, Homo sapiens
ctgacatatctacact

SEQ ID NO: 1196845 - DNA, 14 bp, Homo sapiens
ctgacatattcaag

SEQ ID NO: 1196846 - DNA, 18 bp, Homo sapiens
ctgacatattcaagtgat

SEQ ID NO: 1196847 - DNA, 23 bp, Homo sapiens
ctgacatcatcattcttgtggga

SEQ ID NO: 1196848 - DNA, 14 bp, Homo sapiens
ctgacatcccttcc

SEQ ID NO: 1196849 - DNA, 15 bp, Homo sapiens
ctgacatcccttcct

SEQ ID NO: 1196850 - DNA, 16 bp, Homo sapiens
ctgacatcccttcctg

SEQ ID NO: 1196851 - DNA, 17 bp, Homo sapiens
ctgacatcccttcctgg

SEQ ID NO: 1196852 - DNA, 19 bp, Homo sapiens
ctgacatcccttcctggaa

SEQ ID NO: 1196853 - DNA, 22 bp, Homo sapiens
ctgacatcccttcctggaaaca

SEQ ID NO: 1196854 - DNA, 16 bp, Homo sapiens
ctgacatctggaatct

SEQ ID NO: 1196855 - DNA, 16 bp, Homo sapiens
ctgacatctgtgtttc

SEQ ID NO: 1196856 - DNA, 15 bp, Homo sapiens
ctgacatgccctccc

SEQ ID NO: 1196857 - DNA, 23 bp, Homo sapiens
ctgacatgtaccccctttccctt

SEQ ID NO: 1196858 - DNA, 14 bp, Homo sapiens
ctgacatgtggggc

SEQ ID NO: 1196859 - DNA, 20 bp, Homo sapiens
ctgacattaacagttttcca

SEQ ID NO: 1196860 - DNA, 16 bp, Homo sapiens
ctgacattcacctgcc

SEQ ID NO: 1196861 - DNA, 20 bp, Homo sapiens
ctgacattgccaaaaaggat

SEQ ID NO: 1196862 - DNA, 15 bp, Homo sapiens
ctgacatttatattt

SEQ ID NO: 1196863 - DNA, 20 bp, Homo sapiens
ctgacatttatatttgtgta

SEQ ID NO: 1196864 - DNA, 23 bp, Homo sapiens
ctgaccaaatggccagttttctg

SEQ ID NO: 1196865 - DNA, 15 bp, Homo sapiens
ctgaccaatattgta

SEQ ID NO: 1196866 - DNA, 18 bp, Homo sapiens
ctgaccaatattgtacag

SEQ ID NO: 1196867 - DNA, 21 bp, Homo sapiens
ctgaccaatattgtacagttt

SEQ ID NO: 1196868 - DNA, 17 bp, Homo sapiens
ctgaccaattgtgctgc

SEQ ID NO: 1196869 - DNA, 19 bp, Homo sapiens
ctgaccaattgtgctgcca

SEQ ID NO: 1196870 - DNA, 13 bp, Homo sapiens
ctgaccacacttc

SEQ ID NO: 1196871 - DNA, 20 bp, Homo sapiens
ctgaccacacttcctgtcca

SEQ ID NO: 1196872 - DNA, 12 bp, Homo sapiens
ctgaccacagca

SEQ ID NO: 1196873 - DNA, 14 bp, Homo sapiens
ctgaccacagcaca

SEQ ID NO: 1196874 - DNA, 12 bp, Homo sapiens
ctgaccaccctc

SEQ ID NO: 1196875 - DNA, 13 bp, Homo sapiens
ctgaccaccctcc

SEQ ID NO: 1196876 - DNA, 14 bp, Homo sapiens
ctgaccaccctccc

SEQ ID NO: 1196877 - DNA, 17 bp, Homo sapiens
ctgaccaccctcccctc

SEQ ID NO: 1196878 - DNA, 14 bp, Homo sapiens
ctgaccagcagcgc

SEQ ID NO: 1196879 - DNA, 16 bp, Homo sapiens
ctgaccagcagcgcct

SEQ ID NO: 1196880 - DNA, 13 bp, Homo sapiens
ctgaccagctgct

SEQ ID NO: 1196881 - DNA, 15 bp, Homo sapiens
ctgaccagctggagt

SEQ ID NO: 1196882 - DNA, 18 bp, Homo sapiens
ctgaccaggcccaaggag

SEQ ID NO: 1196883 - DNA, 16 bp, Homo sapiens
ctgaccatccactcta

SEQ ID NO: 1196884 - DNA, 19 bp, Homo sapiens
ctgaccatccactctaccc

SEQ ID NO: 1196885 - DNA, 22 bp, Homo sapiens
ctgaccatccactctaccctcc

SEQ ID NO: 1196886 - DNA, 23 bp, Homo sapiens
ctgaccatccactctaccctccc

SEQ ID NO: 1196887 - DNA, 23 bp, Homo sapiens
ctgaccatgcgtcaggggcctag

SEQ ID NO: 1196888 - DNA, 20 bp, Homo sapiens
ctgaccatggttttggctct

SEQ ID NO: 1196889 - DNA, 13 bp, Homo sapiens
ctgacccaaagca

SEQ ID NO: 1196890 - DNA, 14 bp, Homo sapiens
ctgacccaaagcaa

SEQ ID NO: 1196891 - DNA, 16 bp, Homo sapiens
ctgacccaaagcaaaa

SEQ ID NO: 1196892 - DNA, 13 bp, Homo sapiens
ctgacccaactgg

SEQ ID NO: 1196893 - DNA, 14 bp, Homo sapiens
ctgacccacctgcg

SEQ ID NO: 1196894 - DNA, 17 bp, Homo sapiens
ctgacccacggggcagt

SEQ ID NO: 1196895 - DNA, 20 bp, Homo sapiens
ctgacccagagtggagtctg

SEQ ID NO: 1196896 - DNA, 23 bp, Homo sapiens
ctgacccagagtggagtctgagt

SEQ ID NO: 1196897 - DNA, 13 bp, Homo sapiens
ctgacccagcatc

SEQ ID NO: 1196898 - DNA, 16 bp, Homo sapiens
ctgacccagcatctcc

SEQ ID NO: 1196899 - DNA, 21 bp, Homo sapiens
ctgacccagccccttgagaaa

SEQ ID NO: 1196900 - DNA, 13 bp, Homo sapiens
ctgacccaggaat

SEQ ID NO: 1196901 - DNA, 20 bp, Homo sapiens
ctgacccaggaatagtggac

SEQ ID NO: 1196902 - DNA, 13 bp, Homo sapiens
ctgacccaggccg

SEQ ID NO: 1196903 - DNA, 17 bp, Homo sapiens
ctgacccaggccgcagc

SEQ ID NO: 1196904 - DNA, 13 bp, Homo sapiens
ctgacccagtccc

SEQ ID NO: 1196905 - DNA, 15 bp, Homo sapiens
ctgacccagtccctg

SEQ ID NO: 1196906 - DNA, 21 bp, Homo sapiens
ctgaccccaaacaccttccag

SEQ ID NO: 1196907 - DNA, 22 bp, Homo sapiens
ctgaccccaaacaccttccagc

SEQ ID NO: 1196908 - DNA, 12 bp, Homo sapiens
ctgaccccaggt

SEQ ID NO: 1196909 - DNA, 19 bp, Homo sapiens
ctgaccccccccattagaa

SEQ ID NO: 1196910 - DNA, 15 bp, Homo sapiens
ctgaccccctcccct

SEQ ID NO: 1196911 - DNA, 18 bp, Homo sapiens
ctgaccccgagaagtgct

SEQ ID NO: 1196912 - DNA, 18 bp, Homo sapiens
ctgaccccggggggctgg

SEQ ID NO: 1196913 - DNA, 16 bp, Homo sapiens
ctgacccctccctgca

SEQ ID NO: 1196914 - DNA, 19 bp, Homo sapiens
ctgacccctccctgcaggg

SEQ ID NO: 1196915 - DNA, 14 bp, Homo sapiens
ctgacccctctggt

SEQ ID NO: 1196916 - DNA, 14 bp, Homo sapiens
ctgacccctgcctg

SEQ ID NO: 1196917 - DNA, 23 bp, Homo sapiens
ctgacccggttgcagtcactgtg

SEQ ID NO: 1196918 - DNA, 18 bp, Homo sapiens
ctgaccctcccactccca

SEQ ID NO: 1196919 - DNA, 12 bp, Homo sapiens
ctgaccctctgc

SEQ ID NO: 1196920 - DNA, 13 bp, Homo sapiens
ctgaccctgagga

SEQ ID NO: 1196921 - DNA, 12 bp, Homo sapiens
ctgaccctgggc

SEQ ID NO: 1196922 - DNA, 13 bp, Homo sapiens
ctgaccctgggct

SEQ ID NO: 1196923 - DNA, 20 bp, Homo sapiens
ctgaccctgtatatagccca

SEQ ID NO: 1196924 - DNA, 23 bp, Homo sapiens
ctgacccttacagcctctgactt

SEQ ID NO: 1196925 - DNA, 23 bp, Homo sapiens
ctgacccttctccaaaggctctg

SEQ ID NO: 1196926 - DNA, 15 bp, Homo sapiens
ctgacccttttctga

SEQ ID NO: 1196927 - DNA, 23 bp, Homo sapiens
ctgaccgttttcacttgtctcct

SEQ ID NO: 1196928 - DNA, 19 bp, Homo sapiens
ctgacctagaccagtttgc

SEQ ID NO: 1196929 - DNA, 15 bp, Homo sapiens
ctgacctcaggtgat

SEQ ID NO: 1196930 - DNA, 23 bp, Homo sapiens
ctgacttcatctcccacctagca

SEQ ID NO: 1196931 - DNA, 16 bp, Homo sapiens
ctgacttcctctgatt

SEQ ID NO: 1196932 - DNA, 23 bp, Homo sapiens
ctgacttctagctgtctgtgaat

SEQ ID NO: 1196933 - DNA, 17 bp, Homo sapiens
ctgacttctctgaatca

SEQ ID NO: 1196934 - DNA, 13 bp, Homo sapiens
ctgacttctgcct

SEQ ID NO: 1196935 - DNA, 14 bp, Homo sapiens
ctgacttctgcctg

SEQ ID NO: 1196936 - DNA, 15 bp, Homo sapiens
ctgacttctggagat

SEQ ID NO: 1196937 - DNA, 21 bp, Homo sapiens
ctgacttgagtgttccttttt

SEQ ID NO: 1196938 - DNA, 15 bp, Homo sapiens
ctgacttgctgtgtg

SEQ ID NO: 1196939 - DNA, 13 bp, Homo sapiens
ctgacttgcttta

SEQ ID NO: 1196940 - DNA, 15 bp, Homo sapiens
ctgacttggcactta

SEQ ID NO: 1196941 - DNA, 16 bp, Homo sapiens
ctgacttggcacttaa

SEQ ID NO: 1196942 - DNA, 16 bp, Homo sapiens
ctgacttggctgggga

SEQ ID NO: 1196943 - DNA, 17 bp, Homo sapiens
ctgacttgtttgtcttc

SEQ ID NO: 1196944 - DNA, 20 bp, Homo sapiens
ctgacttgtttgtcttccat

SEQ ID NO: 1196945 - DNA, 12 bp, Homo sapiens
ctgactttactt

SEQ ID NO: 1196946 - DNA, 14 bp, Homo sapiens
ctgactttacttgt

SEQ ID NO: 1196947 - DNA, 13 bp, Homo sapiens
ctgactttctccc

SEQ ID NO: 1196948 - DNA, 18 bp, Homo sapiens
ctgactttctgattactg

SEQ ID NO: 1196949 - DNA, 22 bp, Homo sapiens
ctgactttgcccccttgcccat

SEQ ID NO: 1196950 - DNA, 12 bp, Homo sapiens
ctgagaaaaaaa

SEQ ID NO: 1196951 - DNA, 22 bp, Homo sapiens
ctgagaaagcccacctgggctg

SEQ ID NO: 1196952 - DNA, 11 bp, Homo sapiens
ctgagaagaat

SEQ ID NO: 1196953 - DNA, 16 bp, Homo sapiens
ctgagaagaggaggag

SEQ ID NO: 1196954 - DNA, 18 bp, Homo sapiens
ctgagaagaggtccttgg

SEQ ID NO: 1196955 - DNA, 13 bp, Homo sapiens
ctgagaagcaaac

SEQ ID NO: 1196956 - DNA, 18 bp, Homo sapiens
ctgagaagctgctccagg

SEQ ID NO: 1196957 - DNA, 18 bp, Homo sapiens
ctgagaaggcaggcctcc

SEQ ID NO: 1196958 - DNA, 17 bp, Homo sapiens
ctgagaaggtccttaat

SEQ ID NO: 1196959 - DNA, 16 bp, Homo sapiens
ctgagaagtactttac

SEQ ID NO: 1196960 - DNA, 22 bp, Homo sapiens
ctgagaatcacggtggtaaaga

SEQ ID NO: 1196961 - DNA, 16 bp, Homo sapiens
ctgagaatctgggggt

SEQ ID NO: 1196962 - DNA, 22 bp, Homo sapiens
ctgagaatctttattgagaaag

SEQ ID NO: 1196963 - DNA, 16 bp, Homo sapiens
ctgagaatgatggttt

SEQ ID NO: 1196964 - DNA, 21 bp, Homo sapiens
ctgagaattgttgagatactt

SEQ ID NO: 1196965 - DNA, 22 bp, Homo sapiens
ctgagaatttaaaaataagaaa

SEQ ID NO: 1196966 - DNA, 16 bp, Homo sapiens
ggccttgcccagagat

SEQ ID NO: 1196967 - DNA, 22 bp, Homo sapiens
ggccttgcccgccagcctcagt

SEQ ID NO: 1196968 - DNA, 14 bp, Homo sapiens
ggccttgcccgtcg

SEQ ID NO: 1196969 - DNA, 15 bp, Homo sapiens
ggccttgcctggcct

SEQ ID NO: 1196970 - DNA, 17 bp, Homo sapiens
ggccttgcctggcctga

SEQ ID NO: 1196971 - DNA, 15 bp, Homo sapiens
ggccttgcggaagcc

SEQ ID NO: 1196972 - DNA, 19 bp, Homo sapiens
ggccttgcggaagccatag

SEQ ID NO: 1196973 - DNA, 20 bp, Homo sapiens
ggccttgcggaagccatagg

SEQ ID NO: 1196974 - DNA, 15 bp, Homo sapiens
ggccttgctgactct

SEQ ID NO: 1196975 - DNA, 18 bp, Homo sapiens
ggccttgctgactctctg

SEQ ID NO: 1196976 - DNA, 22 bp, Homo sapiens
ggccttgctgactctctgagct

SEQ ID NO: 1196977 - DNA, 14 bp, Homo sapiens
ggccttgctggggt

SEQ ID NO: 1196978 - DNA, 20 bp, Homo sapiens
ggccttgctggggtccaggg

SEQ ID NO: 1196979 - DNA, 21 bp, Homo sapiens
ggccttgctggggtccagggc

SEQ ID NO: 1196980 - DNA, 10 bp, Homo sapiens
ggccttgctt

SEQ ID NO: 1196981 - DNA, 21 bp, Homo sapiens
ggccttgcttctcttctttcc

SEQ ID NO: 1196982 - DNA, 21 bp, Homo sapiens
ggccttgctttgtctggcctc

SEQ ID NO: 1196983 - DNA, 23 bp, Homo sapiens
ggccttgctttgtctggcctcac

SEQ ID NO: 1196984 - DNA, 19 bp, Homo sapiens
ggccttggcatgggcgcag

SEQ ID NO: 1196985 - DNA, 22 bp, Homo sapiens
ggccttggcatgggcgcaggcc

SEQ ID NO: 1196986 - DNA, 21 bp, Homo sapiens
ggccttggggtgggggccagg

SEQ ID NO: 1196987 - DNA, 13 bp, Homo sapiens
ggccttggtcctt

SEQ ID NO: 1196988 - DNA, 22 bp, Homo sapiens
ggccttggtggagcagccagag

SEQ ID NO: 1196989 - DNA, 23 bp, Homo sapiens
ggccttggtggagcagccagagc

SEQ ID NO: 1196990 - DNA, 21 bp, Homo sapiens
ggccttgtcctacgtccaagg

SEQ ID NO: 1196991 - DNA, 15 bp, Homo sapiens
ggccttgtctgggtg

SEQ ID NO: 1196992 - DNA, 23 bp, Homo sapiens
ggcctttaaaacgcgtctgcctg

SEQ ID NO: 1196993 - DNA, 20 bp, Homo sapiens
ggcctttcaggtccaggcca

SEQ ID NO: 1196994 - DNA, 22 bp, Homo sapiens
ggcctttcctgtgccaacctga

SEQ ID NO: 1196995 - DNA, 11 bp, Homo sapiens
ggcctttcctt

SEQ ID NO: 1196996 - DNA, 16 bp, Homo sapiens
ggcctttctcctcccc

SEQ ID NO: 1196997 - DNA, 23 bp, Homo sapiens
ggcctttgcaagatgcttggttg

SEQ ID NO: 1196998 - DNA, 19 bp, Homo sapiens
ggcctttggacccagggcc

SEQ ID NO: 1196999 - DNA, 18 bp, Homo sapiens
ggcctttgtgctgcgcct

SEQ ID NO: 1197000 - DNA, 13 bp, Homo sapiens
ggccttttccaaa

SEQ ID NO: 1197001 - DNA, 13 bp, Homo sapiens
ggccttttctgtg

SEQ ID NO: 1197002 - DNA, 18 bp, Homo sapiens
ggccttttgcccggaggc

SEQ ID NO: 1197003 - DNA, 15 bp, Homo sapiens
ggcgaatcatttgtt

SEQ ID NO: 1197004 - DNA, 19 bp, Homo sapiens
ggcgaattcatcccctccc

SEQ ID NO: 1197005 - DNA, 13 bp, Homo sapiens
ggcgacactcagg

SEQ ID NO: 1197006 - DNA, 16 bp, Homo sapiens
ggcgacactcagggca

SEQ ID NO: 1197007 - DNA, 17 bp, Homo sapiens
ggcgacactcagggcag

SEQ ID NO: 1197008 - DNA, 15 bp, Homo sapiens
ggcgaccaccaaagt

SEQ ID NO: 1197009 - DNA, 21 bp, Homo sapiens
ggcgaccaccgcccctggccg

SEQ ID NO: 1197010 - DNA, 11 bp, Homo sapiens
ggcgacctcct

SEQ ID NO: 1197011 - DNA, 15 bp, Homo sapiens
ggcgactctgcagag

SEQ ID NO: 1197012 - DNA, 15 bp, Homo sapiens
ggcgagcctgactct

SEQ ID NO: 1197013 - DNA, 23 bp, Homo sapiens
ggcgagtccaggagctcaggaag

SEQ ID NO: 1197014 - DNA, 23 bp, Homo sapiens
ggcgagtctggggacctggcact

SEQ ID NO: 1197015 - DNA, 18 bp, Homo sapiens
ggcgatccacctgtctca

SEQ ID NO: 1197016 - DNA, 22 bp, Homo sapiens
ggcgatccacctgtctcagcct

SEQ ID NO: 1197017 - DNA, 18 bp, Homo sapiens
ggcgcaaaggtgcctcat

SEQ ID NO: 1197018 - DNA, 12 bp, Homo sapiens
ggcgcactgtga

SEQ ID NO: 1197019 - DNA, 19 bp, Homo sapiens
ggcgcagaggtcccagccc

SEQ ID NO: 1197020 - DNA, 21 bp, Homo sapiens
ggcgcagaggtcccagcccca

SEQ ID NO: 1197021 - DNA, 14 bp, Homo sapiens
ggcgcagccaaggc

SEQ ID NO: 1197022 - DNA, 17 bp, Homo sapiens
ggcgcagccaaggccga

SEQ ID NO: 1197023 - DNA, 11 bp, Homo sapiens
ggcgcaggagg

SEQ ID NO: 1197024 - DNA, 13 bp, Homo sapiens
ggcgcaggcccag

SEQ ID NO: 1197025 - DNA, 21 bp, Homo sapiens
ggcgcagggacatggggcaag

SEQ ID NO: 1197026 - DNA, 17 bp, Homo sapiens
ggcgcatattaagcact

SEQ ID NO: 1197027 - DNA, 17 bp, Homo sapiens
ggcgcatgagtatctgt

SEQ ID NO: 1197028 - DNA, 19 bp, Homo sapiens
ggcgcatgtctgcacctcc

SEQ ID NO: 1197029 - DNA, 18 bp, Homo sapiens
ggcgccaggacagcagca

SEQ ID NO: 1197030 - DNA, 22 bp, Homo sapiens
ggcgccaggggcgggggaccta

SEQ ID NO: 1197031 - DNA, 18 bp, Homo sapiens
ggcgccagggtgctgtcg

SEQ ID NO: 1197032 - DNA, 15 bp, Homo sapiens
ggcgcccccagtgtg

SEQ ID NO: 1197033 - DNA, 13 bp, Homo sapiens
ggcgcccctgcca

SEQ ID NO: 1197034 - DNA, 18 bp, Homo sapiens
ggcgcccctgcctgtgcc

SEQ ID NO: 1197035 - DNA, 15 bp, Homo sapiens
ggcgccctctctgct

SEQ ID NO: 1197036 - DNA, 18 bp, Homo sapiens
ggcgccctctctgctcct

SEQ ID NO: 1197037 - DNA, 18 bp, Homo sapiens
ggcgccgggcaccaactc

SEQ ID NO: 1197038 - DNA, 17 bp, Homo sapiens
ggcgccgtgctgggcag

SEQ ID NO: 1197039 - DNA, 20 bp, Homo sapiens
ggcgccgtgctgggcagccc

SEQ ID NO: 1197040 - DNA, 21 bp, Homo sapiens
ggcgccgtgctgggcagcccg

SEQ ID NO: 1197041 - DNA, 16 bp, Homo sapiens
ggcgcctgccctgccc

SEQ ID NO: 1197042 - DNA, 11 bp, Homo sapiens
ggcgcctggag

SEQ ID NO: 1197043 - DNA, 14 bp, Homo sapiens
ggcgccttttcagc

SEQ ID NO: 1197044 - DNA, 15 bp, Homo sapiens
ggcgccttttcagcc

SEQ ID NO: 1197045 - DNA, 18 bp, Homo sapiens
ggcgccttttcagccctt

SEQ ID NO: 1197046 - DNA, 17 bp, Homo sapiens
ggcgcggcggctctgcc

SEQ ID NO: 1197047 - DNA, 15 bp, Homo sapiens
ggcgcgggaggcacc

SEQ ID NO: 1197048 - DNA, 19 bp, Homo sapiens
ggcgcggtggctcacgcct

SEQ ID NO: 1197049 - DNA, 17 bp, Homo sapiens
ggcgcgtctgccccacc

SEQ ID NO: 1197050 - DNA, 21 bp, Homo sapiens
ggcgctcaggacccaggccct

SEQ ID NO: 1197051 - DNA, 14 bp, Homo sapiens
ggcgctcgctcagg

SEQ ID NO: 1197052 - DNA, 19 bp, Homo sapiens
ctgagccccagggtgccca

SEQ ID NO: 1197053 - DNA, 13 bp, Homo sapiens
ctgagcccccacc

SEQ ID NO: 1197054 - DNA, 17 bp, Homo sapiens
ctgagcccccggctagt

SEQ ID NO: 1197055 - DNA, 19 bp, Homo sapiens
ctgagccccgccctcttcc

SEQ ID NO: 1197056 - DNA, 22 bp, Homo sapiens
ctgagccccgccctcttcctga

SEQ ID NO: 1197057 - DNA, 15 bp, Homo sapiens
ctgagcccctacccc

SEQ ID NO: 1197058 - DNA, 16 bp, Homo sapiens
ctgagcccctggtctt

SEQ ID NO: 1197059 - DNA, 20 bp, Homo sapiens
ctgagcccgcagcccagacc

SEQ ID NO: 1197060 - DNA, 14 bp, Homo sapiens
ctgagcccgggctg

SEQ ID NO: 1197061 - DNA, 15 bp, Homo sapiens
ctgagcccgggctgc

SEQ ID NO: 1197062 - DNA, 16 bp, Homo sapiens
ctgagcccgggctgcc

SEQ ID NO: 1197063 - DNA, 17 bp, Homo sapiens
ctgagcccgggctgcct

SEQ ID NO: 1197064 - DNA, 15 bp, Homo sapiens
ctgagccctctcact

SEQ ID NO: 1197065 - DNA, 16 bp, Homo sapiens
ctgagccctctcactc

SEQ ID NO: 1197066 - DNA, 17 bp, Homo sapiens
ctgagccctctcactcc

SEQ ID NO: 1197067 - DNA, 22 bp, Homo sapiens
ctgagccctctcactccagcca

SEQ ID NO: 1197068 - DNA, 12 bp, Homo sapiens
ctgagccctggc

SEQ ID NO: 1197069 - DNA, 18 bp, Homo sapiens
ctgagccctggtgtgttt

SEQ ID NO: 1197070 - DNA, 14 bp, Homo sapiens
ctgagccctgtacc

SEQ ID NO: 1197071 - DNA, 20 bp, Homo sapiens
ctgagccctgtacccacccc

SEQ ID NO: 1197072 - DNA, 21 bp, Homo sapiens
ctgagccctgtacccacccca

SEQ ID NO: 1197073 - DNA, 19 bp, Homo sapiens
ctgagccggccccaggctc

SEQ ID NO: 1197074 - DNA, 15 bp, Homo sapiens
ctgagcctcacagca

SEQ ID NO: 1197075 - DNA, 17 bp, Homo sapiens
ctgagcctcacagcagt

SEQ ID NO: 1197076 - DNA, 14 bp, Homo sapiens
ctgagcctcacttg

SEQ ID NO: 1197077 - DNA, 18 bp, Homo sapiens
ctgagcctcgtgtccaga

SEQ ID NO: 1197078 - DNA, 21 bp, Homo sapiens
ctgagcctctcacctgtactc

SEQ ID NO: 1197079 - DNA, 14 bp, Homo sapiens
ctgagcctctgctc

SEQ ID NO: 1197080 - DNA, 13 bp, Homo sapiens
ctgagcctgcatt

SEQ ID NO: 1197081 - DNA, 12 bp, Homo sapiens
ctgagcctggtc

SEQ ID NO: 1197082 - DNA, 11 bp, Homo sapiens
ctgagcctgtg

SEQ ID NO: 1197083 - DNA, 17 bp, Homo sapiens
ctgagcgattattatct

SEQ ID NO: 1197084 - DNA, 13 bp, Homo sapiens
ctgagcgcctcca

SEQ ID NO: 1197085 - DNA, 22 bp, Homo sapiens
ctgagcgcctccatccaaggcc

SEQ ID NO: 1197086 - DNA, 16 bp, Homo sapiens
ctgagcgctgtggact

SEQ ID NO: 1197087 - DNA, 16 bp, Homo sapiens
ctgagcggaggctcgg

SEQ ID NO: 1197088 - DNA, 16 bp, Homo sapiens
ctgagcggcaccctgg

SEQ ID NO: 1197089 - DNA, 15 bp, Homo sapiens
ctgagcgggaggcag

SEQ ID NO: 1197090 - DNA, 16 bp, Homo sapiens
ctgagcgggaggcaga

SEQ ID NO: 1197091 - DNA, 21 bp, Homo sapiens
ctgagcgtggaagggggagga

SEQ ID NO: 1197092 - DNA, 15 bp, Homo sapiens
ctgagctagcctcca

SEQ ID NO: 1197093 - DNA, 21 bp, Homo sapiens
ctgagctagcctccagctttg

SEQ ID NO: 1197094 - DNA, 15 bp, Homo sapiens
ggcgggagaactgaa

SEQ ID NO: 1197095 - DNA, 16 bp, Homo sapiens
ggcgggagcatctctt

SEQ ID NO: 1197096 - DNA, 11 bp, Homo sapiens
ggcgggcaagt

SEQ ID NO: 1197097 - DNA, 22 bp, Homo sapiens
ggcgggcacctatagtcccagc

SEQ ID NO: 1197098 - DNA, 24 bp, Homo sapiens
ggcgggcactgggtacccaagtga

SEQ ID NO: 1197099 - DNA, 18 bp, Homo sapiens
ggcgggcagagggctgga

SEQ ID NO: 1197100 - DNA, 13 bp, Homo sapiens
ggcgggccagcca

SEQ ID NO: 1197101 - DNA, 14 bp, Homo sapiens
ggcgggccagccag

SEQ ID NO: 1197102 - DNA, 17 bp, Homo sapiens
ggcgggccagccaggcg

SEQ ID NO: 1197103 - DNA, 15 bp, Homo sapiens
ggcgggccagggtgg

SEQ ID NO: 1197104 - DNA, 20 bp, Homo sapiens
ggcgggccagggtgggaaga

SEQ ID NO: 1197105 - DNA, 23 bp, Homo sapiens
ggcgggccagggtgggaagagaa

SEQ ID NO: 1197106 - DNA, 16 bp, Homo sapiens
ggcgggctcagagctt

SEQ ID NO: 1197107 - DNA, 18 bp, Homo sapiens
ggcgggctcagagctttg

SEQ ID NO: 1197108 - DNA, 20 bp, Homo sapiens
ggcgggctcagagctttgtc

SEQ ID NO: 1197109 - DNA, 21 bp, Homo sapiens
ggcggggaagggtgcatagct

SEQ ID NO: 1197110 - DNA, 21 bp, Homo sapiens
ggcgggggcacgtgtgggccg

SEQ ID NO: 1197111 - DNA, 12 bp, Homo sapiens
ggcggggtgggg

SEQ ID NO: 1197112 - DNA, 19 bp, Homo sapiens
ggcggggttagagccaagc

SEQ ID NO: 1197113 - DNA, 20 bp, Homo sapiens
ggcggtccccatccccacca

SEQ ID NO: 1197114 - DNA, 22 bp, Homo sapiens
ggcggtggccacagcgtgctgg

SEQ ID NO: 1197115 - DNA, 21 bp, Homo sapiens
ggcggtgggcacccaccctgg

SEQ ID NO: 1197116 - DNA, 16 bp, Homo sapiens
ggcgtcaggcagaggc

SEQ ID NO: 1197117 - DNA, 19 bp, Homo sapiens
ggcgtcaggcagaggcaac

SEQ ID NO: 1197118 - DNA, 21 bp, Homo sapiens
ggcgtcaggggtgcacagtcc

SEQ ID NO: 1197119 - DNA, 24 bp, Homo sapiens
ggcgtcaggggtgcacagtccaca

SEQ ID NO: 1197120 - DNA, 16 bp, Homo sapiens
ggcgtctcccccagag

SEQ ID NO: 1197121 - DNA, 18 bp, Homo sapiens
ggcgtctcccccagagtg

SEQ ID NO: 1197122 - DNA, 19 bp, Homo sapiens
ggcgtctgactccctcccc

SEQ ID NO: 1197123 - DNA, 12 bp, Homo sapiens
ggcgtctgctct

SEQ ID NO: 1197124 - DNA, 16 bp, Homo sapiens
ggcgtctgttccccct

SEQ ID NO: 1197125 - DNA, 22 bp, Homo sapiens
ggcgtcttcatctccctgccat

SEQ ID NO: 1197126 - DNA, 12 bp, Homo sapiens
ggcgtcttgccc

SEQ ID NO: 1197127 - DNA, 18 bp, Homo sapiens
ggcgtgagacccagtgca

SEQ ID NO: 1197128 - DNA, 22 bp, Homo sapiens
ggcgtgcccccctcctccagta

SEQ ID NO: 1197129 - DNA, 14 bp, Homo sapiens
ggcgtggaggagag

SEQ ID NO: 1197130 - DNA, 14 bp, Homo sapiens
ggcgtggaggagga

SEQ ID NO: 1197131 - DNA, 18 bp, Homo sapiens
ggcgtgggagccagcctc

SEQ ID NO: 1197132 - DNA, 15 bp, Homo sapiens
ggcgtgggtctctgg

SEQ ID NO: 1197133 - DNA, 17 bp, Homo sapiens
ggcgtgggtctctgggg

SEQ ID NO: 1197134 - DNA, 21 bp, Homo sapiens
ggcgtggtggctcatgcctgt

SEQ ID NO: 1197135 - DNA, 20 bp, Homo sapiens
ggcgtgtggtttccctgccc

SEQ ID NO: 1197136 - DNA, 14 bp, Homo sapiens
ggcgtgtgtgacac

SEQ ID NO: 1197137 - DNA, 17 bp, Homo sapiens
ggcgttcacctccctgc

SEQ ID NO: 1197138 - DNA, 17 bp, Homo sapiens
ggcgttctcccaaagat

SEQ ID NO: 1197139 - DNA, 18 bp, Homo sapiens
ggcgttgggagcctagct

SEQ ID NO: 1197140 - DNA, 14 bp, Homo sapiens
ggcgtttttctcgt

SEQ ID NO: 1197141 - DNA, 21 bp, Homo sapiens
ggctaaaaaagctgaatcaga

SEQ ID NO: 1197142 - DNA, 17 bp, Homo sapiens
ggctaacctggacctgg

SEQ ID NO: 1197143 - DNA, 18 bp, Homo sapiens
ggctaacctggacctgga

SEQ ID NO: 1197144 - DNA, 20 bp, Homo sapiens
ggctaagagctagcgctgcc

SEQ ID NO: 1197145 - DNA, 17 bp, Homo sapiens
ggctaagcggtggagga

SEQ ID NO: 1197146 - DNA, 12 bp, Homo sapiens
ggctaatttaac

SEQ ID NO: 1197147 - DNA, 22 bp, Homo sapiens
ggctacagaatagggtggcaga

SEQ ID NO: 1197148 - DNA, 19 bp, Homo sapiens
ggctacccctcgactcagc

SEQ ID NO: 1197149 - DNA, 12 bp, Homo sapiens
ggctaccctccc

SEQ ID NO: 1197150 - DNA, 19 bp, Homo sapiens
ggctacctcacctgggcag

SEQ ID NO: 1197151 - DNA, 15 bp, Homo sapiens
ggctacgaatcttcc

SEQ ID NO: 1197152 - DNA, 16 bp, Homo sapiens
ggctactcagcagccc

SEQ ID NO: 1197153 - DNA, 17 bp, Homo sapiens
ggctactcagcagccct

SEQ ID NO: 1197154 - DNA, 18 bp, Homo sapiens
ggctactcagcagccctc

SEQ ID NO: 1197155 - DNA, 23 bp, Homo sapiens
ggctactgcagctttacatgcaa

SEQ ID NO: 1197156 - DNA, 19 bp, Homo sapiens
ggctactgccactgtgtgc

SEQ ID NO: 1197157 - DNA, 14 bp, Homo sapiens
ggctactggcagct

SEQ ID NO: 1197158 - DNA, 15 bp, Homo sapiens
ggctagacaggaacc

SEQ ID NO: 1197159 - DNA, 18 bp, Homo sapiens
ggctagaggccagcccca

SEQ ID NO: 1197160 - DNA, 20 bp, Homo sapiens
ggctagaggccagccccacc

SEQ ID NO: 1197161 - DNA, 17 bp, Homo sapiens
ggctagaggttcaaaga

SEQ ID NO: 1197162 - DNA, 20 bp, Homo sapiens
ggctagagtcctcactccca

SEQ ID NO: 1197163 - DNA, 20 bp, Homo sapiens
ggctagagtgcggtggcgcg

SEQ ID NO: 1197164 - DNA, 12 bp, Homo sapiens
ggctagccctga

SEQ ID NO: 1197165 - DNA, 14 bp, Homo sapiens
ggctagccctgagc

SEQ ID NO: 1197166 - DNA, 15 bp, Homo sapiens
ggctagccctgagcc

SEQ ID NO: 1197167 - DNA, 18 bp, Homo sapiens
ggctagccctgagcccgg

SEQ ID NO: 1197168 - DNA, 20 bp, Homo sapiens
ggctagcctttcttgtagcc

SEQ ID NO: 1197169 - DNA, 23 bp, Homo sapiens
ggctaggtatcattcaactctcc

SEQ ID NO: 1197170 - DNA, 19 bp, Homo sapiens
ggctagtcaagctcctcct

SEQ ID NO: 1197171 - DNA, 15 bp, Homo sapiens
ggctagtcagagaga

SEQ ID NO: 1197172 - DNA, 21 bp, Homo sapiens
ggctagtggggtgaacagctg

SEQ ID NO: 1197173 - DNA, 23 bp, Homo sapiens
ggctagtggggtgaacagctggt

SEQ ID NO: 1197174 - DNA, 20 bp, Homo sapiens
ctgaggcctggactttcctg

SEQ ID NO: 1197175 - DNA, 22 bp, Homo sapiens
ctgaggcctggactttcctgca

SEQ ID NO: 1197176 - DNA, 14 bp, Homo sapiens
ctgaggcctgggcc

SEQ ID NO: 1197177 - DNA, 13 bp, Homo sapiens
ctgaggccttctc

SEQ ID NO: 1197178 - DNA, 17 bp, Homo sapiens
ctgaggccttgtgtgtc

SEQ ID NO: 1197179 - DNA, 23 bp, Homo sapiens
ctgaggccttgtgtgtcaggccc

SEQ ID NO: 1197180 - DNA, 20 bp, Homo sapiens
ctgaggcggaggctgtgctc

SEQ ID NO: 1197181 - DNA, 14 bp, Homo sapiens
ctgaggctgaggca

SEQ ID NO: 1197182 - DNA, 14 bp, Homo sapiens
ctgaggctgtggtc

SEQ ID NO: 1197183 - DNA, 19 bp, Homo sapiens
ctgaggctgtggtcacagc

SEQ ID NO: 1197184 - DNA, 19 bp, Homo sapiens
ctgaggcttaggcctctct

SEQ ID NO: 1197185 - DNA, 20 bp, Homo sapiens
ctgaggcttcacgccgggag

SEQ ID NO: 1197186 - DNA, 15 bp, Homo sapiens
ctgaggctttggatt

SEQ ID NO: 1197187 - DNA, 17 bp, Homo sapiens
ctgaggctttggatttg

SEQ ID NO: 1197188 - DNA, 21 bp, Homo sapiens
ctgaggctttggatttgacat

SEQ ID NO: 1197189 - DNA, 17 bp, Homo sapiens
ctgagggaaatgttttg

SEQ ID NO: 1197190 - DNA, 21 bp, Homo sapiens
ctgagggaaatgttttgtaaa

SEQ ID NO: 1197191 - DNA, 19 bp, Homo sapiens
ctgagggaccaactgggcc

SEQ ID NO: 1197192 - DNA, 20 bp, Homo sapiens
ctgagggaccaactgggccc

SEQ ID NO: 1197193 - DNA, 12 bp, Homo sapiens
ctgagggagcct

SEQ ID NO: 1197194 - DNA, 17 bp, Homo sapiens
ctgagggaggacctggg

SEQ ID NO: 1197195 - DNA, 13 bp, Homo sapiens
ctgagggaggagg

SEQ ID NO: 1197196 - DNA, 17 bp, Homo sapiens
ctgagggaggaggccac

SEQ ID NO: 1197197 - DNA, 22 bp, Homo sapiens
ctgagggaggaggccacctctc

SEQ ID NO: 1197198 - DNA, 23 bp, Homo sapiens
ctgagggaggaggccacctctcc

SEQ ID NO: 1197199 - DNA, 11 bp, Homo sapiens
ctgagggaggg

SEQ ID NO: 1197200 - DNA, 18 bp, Homo sapiens
ctgagggagggagccatg

SEQ ID NO: 1197201 - DNA, 18 bp, Homo sapiens
ctgagggatctgagtagg

SEQ ID NO: 1197202 - DNA, 15 bp, Homo sapiens
ctgagggcagtgccc

SEQ ID NO: 1197203 - DNA, 16 bp, Homo sapiens
ctgagggcagtgccct

SEQ ID NO: 1197204 - DNA, 14 bp, Homo sapiens
ctgagggccacact

SEQ ID NO: 1197205 - DNA, 16 bp, Homo sapiens
ctgagggccacactat

SEQ ID NO: 1197206 - DNA, 22 bp, Homo sapiens
ctgagggcccctctgcccagct

SEQ ID NO: 1197207 - DNA, 16 bp, Homo sapiens
ctgagggctccatgct

SEQ ID NO: 1197208 - DNA, 20 bp, Homo sapiens
ctgagggctccatgctgaag

SEQ ID NO: 1197209 - DNA, 16 bp, Homo sapiens
ctgagggctctgtttg

SEQ ID NO: 1197210 - DNA, 15 bp, Homo sapiens
ctgaggggacgggca

SEQ ID NO: 1197211 - DNA, 23 bp, Homo sapiens
ctgaggggaggatcactggagcc

SEQ ID NO: 1197212 - DNA, 17 bp, Homo sapiens
ctgaggggaggcacctc

SEQ ID NO: 1197213 - DNA, 21 bp, Homo sapiens
ctgaggggcaacgaagaaaaa

SEQ ID NO: 1197214 - DNA, 18 bp, Homo sapiens
ctgaggggcactctcccc

SEQ ID NO: 1197215 - DNA, 12 bp, Homo sapiens
ctgaggggcagg

SEQ ID NO: 1197216 - DNA, 13 bp, Homo sapiens
ctgaggggcaggg

SEQ ID NO: 1197217 - DNA, 18 bp, Homo sapiens
ctgaggggcatctgcccc

SEQ ID NO: 1197218 - DNA, 16 bp, Homo sapiens
ctgaggggcctgcgcc

SEQ ID NO: 1197219 - DNA, 15 bp, Homo sapiens
ctgaggggctgggct

SEQ ID NO: 1197220 - DNA, 21 bp, Homo sapiens
ggcatcagggcctttctcctc

SEQ ID NO: 1197221 - DNA, 23 bp, Homo sapiens
ggcatcatgcatcttactgaagg

SEQ ID NO: 1197222 - DNA, 19 bp, Homo sapiens
ggcatccacccagtgctgc

SEQ ID NO: 1197223 - DNA, 20 bp, Homo sapiens
ggcatccacccagtgctgcc

SEQ ID NO: 1197224 - DNA, 22 bp, Homo sapiens
ggcatccacccagtgctgccat

SEQ ID NO: 1197225 - DNA, 14 bp, Homo sapiens
ggcatccttgcctg

SEQ ID NO: 1197226 - DNA, 21 bp, Homo sapiens
ggcatccttgcctgtctaaag

SEQ ID NO: 1197227 - DNA, 22 bp, Homo sapiens
ggcatccttgcctgtctaaagc

SEQ ID NO: 1197228 - DNA, 14 bp, Homo sapiens
ggcatcgcaggagt

SEQ ID NO: 1197229 - DNA, 18 bp, Homo sapiens
ggcatcgcatccgtcctg

SEQ ID NO: 1197230 - DNA, 17 bp, Homo sapiens
ggcatctcctgtgcatg

SEQ ID NO: 1197231 - DNA, 21 bp, Homo sapiens
ggcatctcctgtgcatgggtg

SEQ ID NO: 1197232 - DNA, 21 bp, Homo sapiens
ggcatctcttccccagagagg

SEQ ID NO: 1197233 - DNA, 20 bp, Homo sapiens
ggcatctgacacaaaaaaag

SEQ ID NO: 1197234 - DNA, 15 bp, Homo sapiens
ggcatctgcaccctc

SEQ ID NO: 1197235 - DNA, 20 bp, Homo sapiens
gctttttattccctgcccaa

SEQ ID NO: 1197236 - DNA, 13 bp, Homo sapiens
gctttttcacagt

SEQ ID NO: 1197237 - DNA, 21 bp, Homo sapiens
gctttttccttttcatctgtt

SEQ ID NO: 1197238 - DNA, 15 bp, Homo sapiens
gctttttctgtggag

SEQ ID NO: 1197239 - DNA, 15 bp, Homo sapiens
gctttttttttctct

SEQ ID NO: 1197240 - DNA, 17 bp, Homo sapiens
ggaaaaaaaaaaagaaa

SEQ ID NO: 1197241 - DNA, 15 bp, Homo sapiens
ctgattttgtatgta

SEQ ID NO: 1197242 - DNA, 16 bp, Homo sapiens
ctgattttgtatgtaa

SEQ ID NO: 1197243 - DNA, 19 bp, Homo sapiens
ctgattttgtatgtaaata

SEQ ID NO: 1197244 - DNA, 15 bp, Homo sapiens
ctgatttttcctttc

SEQ ID NO: 1197245 - DNA, 13 bp, Homo sapiens
ctgcaaaaaatac

SEQ ID NO: 1197246 - DNA, 15 bp, Homo sapiens
ctgcaaaaatattta

SEQ ID NO: 1197247 - DNA, 21 bp, Homo sapiens
ctgcaaaaatggatattatta

SEQ ID NO: 1197248 - DNA, 18 bp, Homo sapiens
ctgcaaaaggactctcag

SEQ ID NO: 1197249 - DNA, 19 bp, Homo sapiens
ctgcaaaatgaggaatgta

SEQ ID NO: 1197250 - DNA, 19 bp, Homo sapiens
ctgcaaaattaaatctaga

SEQ ID NO: 1197251 - DNA, 23 bp, Homo sapiens
ctgcaaaatttgatgccaggaca

SEQ ID NO: 1197252 - DNA, 13 bp, Homo sapiens
ctgcaaaatttta

SEQ ID NO: 1197253 - DNA, 15 bp, Homo sapiens
ctgcaaacagaacag

SEQ ID NO: 1197254 - DNA, 21 bp, Homo sapiens
ctgcaaacagaacagggtcat

SEQ ID NO: 1197255 - DNA, 20 bp, Homo sapiens
ctgcaaacctgacccctgct

SEQ ID NO: 1197256 - DNA, 23 bp, Homo sapiens
ctgcaaaccttcctgggaggaca

SEQ ID NO: 1197257 - DNA, 20 bp, Homo sapiens
ctgcaaactcactgctcaag

SEQ ID NO: 1197258 - DNA, 14 bp, Homo sapiens
ctgcaaagagaaac

SEQ ID NO: 1197259 - DNA, 15 bp, Homo sapiens
ctgcaaagagaaacc

SEQ ID NO: 1197260 - DNA, 18 bp, Homo sapiens
ctgcaaagcccagcttga

SEQ ID NO: 1197261 - DNA, 12 bp, Homo sapiens
ctgcaaagcttt

SEQ ID NO: 1197262 - DNA, 15 bp, Homo sapiens
ctgcaaagctttggc

SEQ ID NO: 1197263 - DNA, 22 bp, Homo sapiens
ctgcaaagctttggctgagacc

SEQ ID NO: 1197264 - DNA, 22 bp, Homo sapiens
ctgcaaaggactgttttttcct

SEQ ID NO: 1197265 - DNA, 14 bp, Homo sapiens
ctgcaaaggagaag

SEQ ID NO: 1197266 - DNA, 15 bp, Homo sapiens
ctgcaaaggcccttg

SEQ ID NO: 1197267 - DNA, 24 bp, Homo sapiens
ctgcaaaggcccttgtcattgcct

SEQ ID NO: 1197268 - DNA, 13 bp, Homo sapiens
ctgcaaaggcctg

SEQ ID NO: 1197269 - DNA, 14 bp, Homo sapiens
ctgcaaaggcctgg

SEQ ID NO: 1197270 - DNA, 16 bp, Homo sapiens
ctgcaaaggcctgggc

SEQ ID NO: 1197271 - DNA, 19 bp, Homo sapiens
ctgcaaagggaactgaaga

SEQ ID NO: 1197272 - DNA, 16 bp, Homo sapiens
ctgcaaagtcgccagt

SEQ ID NO: 1197273 - DNA, 17 bp, Homo sapiens
ctgcaaataaagccttt

SEQ ID NO: 1197274 - DNA, 19 bp, Homo sapiens
ctgcaaatactgtatattc

SEQ ID NO: 1197275 - DNA, 17 bp, Homo sapiens
ctgcaaatagaaaacag

SEQ ID NO: 1197276 - DNA, 19 bp, Homo sapiens
ctgcaaatagaaaacagga

SEQ ID NO: 1197277 - DNA, 15 bp, Homo sapiens
ctgcaaatcaggctt

SEQ ID NO: 1197278 - DNA, 17 bp, Homo sapiens
ctgcaaatctagtgccg

SEQ ID NO: 1197279 - DNA, 19 bp, Homo sapiens
ctgcaaatctgatggcctt

SEQ ID NO: 1197280 - DNA, 20 bp, Homo sapiens
ctgcaaatctgatggcctta

SEQ ID NO: 1197281 - DNA, 12 bp, Homo sapiens
ctgcaacaaaaa

SEQ ID NO: 1197282 - DNA, 21 bp, Homo sapiens
ctgcaacaaaatgtagaatat

SEQ ID NO: 1197283 - DNA, 15 bp, Homo sapiens
ctgcaacctctgcct

SEQ ID NO: 1197284 - DNA, 15 bp, Homo sapiens
ctgcaactagccaag

SEQ ID NO: 1197285 - DNA, 16 bp, Homo sapiens
ctgcaactagccaagg

SEQ ID NO: 1197286 - DNA, 21 bp, Homo sapiens
ctgcaactgctcagctctggt

SEQ ID NO: 1197287 - DNA, 21 bp, Homo sapiens
ctgcaacttctatcctttctt

SEQ ID NO: 1197288 - DNA, 14 bp, Homo sapiens
ctgcaacttctgcc

SEQ ID NO: 1197289 - DNA, 15 bp, Homo sapiens
ctgcaacttgtgaac

SEQ ID NO: 1197290 - DNA, 20 bp, Homo sapiens
ctgcaacttgtgaactccat

SEQ ID NO: 1197291 - DNA, 22 bp, Homo sapiens
ctgcaagaagcgccgactccct

SEQ ID NO: 1197292 - DNA, 15 bp, Homo sapiens
ctgcaagaattaaaa

SEQ ID NO: 1197293 - DNA, 16 bp, Homo sapiens
ctgcaagaattaaaac

SEQ ID NO: 1197294 - DNA, 19 bp, Homo sapiens
ctgcaagaattaaaactga

SEQ ID NO: 1197295 - DNA, 21 bp, Homo sapiens
ctgcaagaattaaaactgagt

SEQ ID NO: 1197296 - DNA, 21 bp, Homo sapiens
ctgcaagaccacggagggagc

SEQ ID NO: 1197297 - DNA, 18 bp, Homo sapiens
ctgcaagagccttggtgt

SEQ ID NO: 1197298 - DNA, 13 bp, Homo sapiens
ctgcaagatggac

SEQ ID NO: 1197299 - DNA, 22 bp, Homo sapiens
ctgcaagatggacacgagccac

SEQ ID NO: 1197300 - DNA, 14 bp, Homo sapiens
ctgcaagcacagcc

SEQ ID NO: 1197301 - DNA, 20 bp, Homo sapiens
ctgcaagcacatctgcattt

SEQ ID NO: 1197302 - DNA, 18 bp, Homo sapiens
ctgcaagcatttttccat

SEQ ID NO: 1197303 - DNA, 20 bp, Homo sapiens
ctgcaagcatttttccatct

SEQ ID NO: 1197304 - DNA, 15 bp, Homo sapiens
ctgcaagccccaggg

SEQ ID NO: 1197305 - DNA, 20 bp, Homo sapiens
ctgcaagccccagggcctgg

SEQ ID NO: 1197306 - DNA, 13 bp, Homo sapiens
ctgcaagcctgtc

SEQ ID NO: 1197307 - DNA, 15 bp, Homo sapiens
ctgcaagggcccaga

SEQ ID NO: 1197308 - DNA, 16 bp, Homo sapiens
ctgcaagggcccagag

SEQ ID NO: 1197309 - DNA, 17 bp, Homo sapiens
ctgcaagggcccagagt

SEQ ID NO: 1197310 - DNA, 16 bp, Homo sapiens
ggcttctgttctctgc

SEQ ID NO: 1197311 - DNA, 13 bp, Homo sapiens
ggcttcttaaaaa

SEQ ID NO: 1197312 - DNA, 12 bp, Homo sapiens
ggcttcttcctc

SEQ ID NO: 1197313 - DNA, 22 bp, Homo sapiens
ggcttcttcctcacactgctgt

SEQ ID NO: 1197314 - DNA, 12 bp, Homo sapiens
ggcttgaagcca

SEQ ID NO: 1197315 - DNA, 15 bp, Homo sapiens
ggcttgaagccaaag

SEQ ID NO: 1197316 - DNA, 14 bp, Homo sapiens
ggcttgaagctgtg

SEQ ID NO: 1197317 - DNA, 16 bp, Homo sapiens
ggcttgagctgcagaa

SEQ ID NO: 1197318 - DNA, 16 bp, Homo sapiens
ggcttgagggagggct

SEQ ID NO: 1197319 - DNA, 19 bp, Homo sapiens
ggcttgagtgagaagagct

SEQ ID NO: 1197320 - DNA, 14 bp, Homo sapiens
ggcttgcatgccaa

SEQ ID NO: 1197321 - DNA, 13 bp, Homo sapiens
ggcttgccccagg

SEQ ID NO: 1197322 - DNA, 13 bp, Homo sapiens
ggcttgctccagg

SEQ ID NO: 1197323 - DNA, 14 bp, Homo sapiens
ggcttgctgctccg

SEQ ID NO: 1197324 - DNA, 21 bp, Homo sapiens
ggcttgctgtttactcccttc

SEQ ID NO: 1197325 - DNA, 17 bp, Homo sapiens
ggcttgcttgccgagcc

SEQ ID NO: 1197326 - DNA, 17 bp, Homo sapiens
ggcttggagtggccaaa

SEQ ID NO: 1197327 - DNA, 17 bp, Homo sapiens
ggcttggatcctgggct

SEQ ID NO: 1197328 - DNA, 14 bp, Homo sapiens
ggcttggcatctgt

SEQ ID NO: 1197329 - DNA, 17 bp, Homo sapiens
ggcttggcatctgtgtg

SEQ ID NO: 1197330 - DNA, 12 bp, Homo sapiens
ggcttggcctgc

SEQ ID NO: 1197331 - DNA, 16 bp, Homo sapiens
ggcttggcctgctgtg

SEQ ID NO: 1197332 - DNA, 22 bp, Homo sapiens
ggcttggctcttggcttccaga

SEQ ID NO: 1197333 - DNA, 17 bp, Homo sapiens
ggcttgtaactccacca

SEQ ID NO: 1197334 - DNA, 17 bp, Homo sapiens
ggcttgtagaattttta

SEQ ID NO: 1197335 - DNA, 15 bp, Homo sapiens
ggcttgtcagagctg

SEQ ID NO: 1197336 - DNA, 16 bp, Homo sapiens
ggcttgtcagagctgg

SEQ ID NO: 1197337 - DNA, 15 bp, Homo sapiens
ggcttgtgctcggga

SEQ ID NO: 1197338 - DNA, 13 bp, Homo sapiens
ggcttgtgggctg

SEQ ID NO: 1197339 - DNA, 14 bp, Homo sapiens
ggcttgtgggctgg

SEQ ID NO: 1197340 - DNA, 14 bp, Homo sapiens
ggcttgttttccaa

SEQ ID NO: 1197341 - DNA, 16 bp, Homo sapiens
ggctttaaaagaaaaa

SEQ ID NO: 1197342 - DNA, 17 bp, Homo sapiens
ggctttaaaagaaaaaa

SEQ ID NO: 1197343 - DNA, 23 bp, Homo sapiens
ggctttaaactaccctccagagt

SEQ ID NO: 1197344 - DNA, 18 bp, Homo sapiens
ggctttaaataaattaag

SEQ ID NO: 1197345 - DNA, 18 bp, Homo sapiens
ggctttaagctccagctt

SEQ ID NO: 1197346 - DNA, 13 bp, Homo sapiens
ggctttaattgta

SEQ ID NO: 1197347 - DNA, 16 bp, Homo sapiens
ggctttaattgtataa

SEQ ID NO: 1197348 - DNA, 17 bp, Homo sapiens
ggctttaattgtataag

SEQ ID NO: 1197349 - DNA, 20 bp, Homo sapiens
ggctttacatactttatcaa

SEQ ID NO: 1197350 - DNA, 16 bp, Homo sapiens
ggctttcaaggctggg

SEQ ID NO: 1197351 - DNA, 18 bp, Homo sapiens
ggctttcaaggctggggc

SEQ ID NO: 1197352 - DNA, 22 bp, Homo sapiens
ggctttcattattagtactgct

SEQ ID NO: 1197353 - DNA, 22 bp, Homo sapiens
ggctttctccggggtctgtgct

SEQ ID NO: 1197354 - DNA, 23 bp, Homo sapiens
ggctttctccggggtctgtgctg

SEQ ID NO: 1197355 - DNA, 15 bp, Homo sapiens
ggctttctcctggag

SEQ ID NO: 1197356 - DNA, 12 bp, Homo sapiens
ggctttctctgc

SEQ ID NO: 1197357 - DNA, 14 bp, Homo sapiens
ggctttctctgcct

SEQ ID NO: 1197358 - DNA, 16 bp, Homo sapiens
ggctttctcttcccct

SEQ ID NO: 1197359 - DNA, 22 bp, Homo sapiens
ggctttctcttccccttcctgt

SEQ ID NO: 1197360 - DNA, 20 bp, Homo sapiens
ggctttgcaggctctgggct

SEQ ID NO: 1197361 - DNA, 18 bp, Homo sapiens
ggctttgccatgggcctg

SEQ ID NO: 1197362 - DNA, 17 bp, Homo sapiens
ggctttgccattgtgaa

SEQ ID NO: 1197363 - DNA, 17 bp, Homo sapiens
ggctttgcccacccctc

SEQ ID NO: 1197364 - DNA, 18 bp, Homo sapiens
gggacagagacacctgca

SEQ ID NO: 1197365 - DNA, 20 bp, Homo sapiens
gggacagagacacctgcacc

SEQ ID NO: 1197366 - DNA, 12 bp, Homo sapiens
gggacagagctg

SEQ ID NO: 1197367 - DNA, 22 bp, Homo sapiens
gggacagagtagccaggttctg

SEQ ID NO: 1197368 - DNA, 22 bp, Homo sapiens
gggacagattggcaatgggccg

SEQ ID NO: 1197369 - DNA, 19 bp, Homo sapiens
gggacagcccagagcctgg

SEQ ID NO: 1197370 - DNA, 22 bp, Homo sapiens
gggacaggaccccagctctgcg

SEQ ID NO: 1197371 - DNA, 12 bp, Homo sapiens
gggacaggctga

SEQ ID NO: 1197372 - DNA, 19 bp, Homo sapiens
gggacaggctgaagagagg

SEQ ID NO: 1197373 - DNA, 12 bp, Homo sapiens
gggacagggagg

SEQ ID NO: 1197374 - DNA, 19 bp, Homo sapiens
gggacagggagggggacct

SEQ ID NO: 1197375 - DNA, 17 bp, Homo sapiens
gggacaggtgggcctgg

SEQ ID NO: 1197376 - DNA, 19 bp, Homo sapiens
gggacagtgataggcccaa

SEQ ID NO: 1197377 - DNA, 20 bp, Homo sapiens
gggacagttggcagagaagg

SEQ ID NO: 1197378 - DNA, 20 bp, Homo sapiens
gggacatggcacaggcccgc

SEQ ID NO: 1197379 - DNA, 18 bp, Homo sapiens
gggaccaaccctggggaa

SEQ ID NO: 1197380 - DNA, 19 bp, Homo sapiens
gggaccaaggcaaggcagg

SEQ ID NO: 1197381 - DNA, 22 bp, Homo sapiens
gggaccaattctggacagacag

SEQ ID NO: 1197382 - DNA, 14 bp, Homo sapiens
gggaccacatctgt

SEQ ID NO: 1197383 - DNA, 18 bp, Homo sapiens
gggaccacatctgtcctc

SEQ ID NO: 1197384 - DNA, 16 bp, Homo sapiens
gggaccactgggtgag

SEQ ID NO: 1197385 - DNA, 17 bp, Homo sapiens
gggaccactgggtgaga

SEQ ID NO: 1197386 - DNA, 22 bp, Homo sapiens
gggaccatcactgagagtcagg

SEQ ID NO: 1197387 - DNA, 17 bp, Homo sapiens
gggaccattgacctcag

SEQ ID NO: 1197388 - DNA, 20 bp, Homo sapiens
gggaccattgacctcagctg

SEQ ID NO: 1197389 - DNA, 16 bp, Homo sapiens
gggacccaagtctgaa

SEQ ID NO: 1197390 - DNA, 18 bp, Homo sapiens
gggacccacccagcccct

SEQ ID NO: 1197391 - DNA, 13 bp, Homo sapiens
gggacccagctcc

SEQ ID NO: 1197392 - DNA, 12 bp, Homo sapiens
gggacccaggct

SEQ ID NO: 1197393 - DNA, 13 bp, Homo sapiens
gggacccccgccc

SEQ ID NO: 1197394 - DNA, 14 bp, Homo sapiens
gggacccccgcccc

SEQ ID NO: 1197395 - DNA, 19 bp, Homo sapiens
gggacccccgccccctgcc

SEQ ID NO: 1197396 - DNA, 18 bp, Homo sapiens
gggaccccctcgccagct

SEQ ID NO: 1197397 - DNA, 22 bp, Homo sapiens
gggacccctcccaacctcaatg

SEQ ID NO: 1197398 - DNA, 22 bp, Homo sapiens
gggacccctcgcaaccctgcct

SEQ ID NO: 1197399 - DNA, 20 bp, Homo sapiens
gggacccctgctcccagcct

SEQ ID NO: 1197400 - DNA, 22 bp, Homo sapiens
gggacccctgctcccagcctgc

SEQ ID NO: 1197401 - DNA, 23 bp, Homo sapiens
gggacccctgctcccagcctgct

SEQ ID NO: 1197402 - DNA, 12 bp, Homo sapiens
gggaccctgcct

SEQ ID NO: 1197403 - DNA, 13 bp, Homo sapiens
gggaccctggggc

SEQ ID NO: 1197404 - DNA, 16 bp, Homo sapiens
gggaccctttccttcc

SEQ ID NO: 1197405 - DNA, 14 bp, Homo sapiens
gggaccgcctggcc

SEQ ID NO: 1197406 - DNA, 20 bp, Homo sapiens
gggaccgcctggccctccct

SEQ ID NO: 1197407 - DNA, 20 bp, Homo sapiens
gggaccggcggaccccagcc

SEQ ID NO: 1197408 - DNA, 18 bp, Homo sapiens
gggaccggtgctgcagga

SEQ ID NO: 1197409 - DNA, 23 bp, Homo sapiens
gggaccgtgccccacctccccac

SEQ ID NO: 1197410 - DNA, 17 bp, Homo sapiens
gggacctaatgctggcc

SEQ ID NO: 1197411 - DNA, 21 bp, Homo sapiens
gggacctaatgctggcctgac

SEQ ID NO: 1197412 - DNA, 21 bp, Homo sapiens
gggacctatacagaacagagg

SEQ ID NO: 1197413 - DNA, 12 bp, Homo sapiens
gggacctcaggg

SEQ ID NO: 1197414 - DNA, 16 bp, Homo sapiens
gggacctcaggggcac

SEQ ID NO: 1197415 - DNA, 22 bp, Homo sapiens
gggacctcccctgaggctcagg

SEQ ID NO: 1197416 - DNA, 15 bp, Homo sapiens
gggacctcctccctc

SEQ ID NO: 1197417 - DNA, 12 bp, Homo sapiens
gggacctctccc

SEQ ID NO: 1197418 - DNA, 23 bp, Homo sapiens
gggacctctcccagggtccctgg

SEQ ID NO: 1197419 - DNA, 13 bp, Homo sapiens
gggacctggatag

SEQ ID NO: 1197420 - DNA, 12 bp, Homo sapiens
gggacctggggg

SEQ ID NO: 1197421 - DNA, 19 bp, Homo sapiens
gggacctgtcccccactct

SEQ ID NO: 1197422 - DNA, 13 bp, Homo sapiens
gggaccttagaaa

SEQ ID NO: 1197423 - DNA, 20 bp, Homo sapiens
gggacgcctgccctgcccag

SEQ ID NO: 1197424 - DNA, 21 bp, Homo sapiens
gggacgcctgggggtgccagg

SEQ ID NO: 1197425 - DNA, 16 bp, Homo sapiens
gggacgcggaggagga

SEQ ID NO: 1197426 - DNA, 17 bp, Homo sapiens
gggacggggctgacatc

SEQ ID NO: 1197427 - DNA, 18 bp, Homo sapiens
gggacgggggtgggaggt

SEQ ID NO: 1197428 - DNA, 17 bp, Homo sapiens
gggacggtgcccaagcc

SEQ ID NO: 1197429 - DNA, 19 bp, Homo sapiens
gggacgtggctcagccagc

SEQ ID NO: 1197430 - DNA, 15 bp, Homo sapiens
gggacgtgtacagca

SEQ ID NO: 1197431 - DNA, 17 bp, Homo sapiens
gggacgtgtacagcaca

SEQ ID NO: 1197432 - DNA, 19 bp, Homo sapiens
gggacgtgtacagcacaga

SEQ ID NO: 1197433 - DNA, 18 bp, Homo sapiens
gggactaggacctgagcc

SEQ ID NO: 1197434 - DNA, 19 bp, Homo sapiens
gggactagtgagtcagcac

SEQ ID NO: 1197435 - DNA, 22 bp, Homo sapiens
gggactcagccttcagacagag

SEQ ID NO: 1197436 - DNA, 20 bp, Homo sapiens
gggactcaggtctgtaactg

SEQ ID NO: 1197437 - DNA, 18 bp, Homo sapiens
gggactcagtgagctggg

SEQ ID NO: 1197438 - DNA, 18 bp, Homo sapiens
gggactccatagctcctt

SEQ ID NO: 1197439 - DNA, 19 bp, Homo sapiens
gggactctgagcgggaggc

SEQ ID NO: 1197440 - DNA, 20 bp, Homo sapiens
ctgcactgggaaggaaacaa

SEQ ID NO: 1197441 - DNA, 22 bp, Homo sapiens
ctgcactggggagcccgtctca

SEQ ID NO: 1197442 - DNA, 20 bp, Homo sapiens
ctgcactgtgaacctgggca

SEQ ID NO: 1197443 - DNA, 15 bp, Homo sapiens
ctgcactgtgccccg

SEQ ID NO: 1197444 - DNA, 16 bp, Homo sapiens
ctgcactgttgctgac

SEQ ID NO: 1197445 - DNA, 16 bp, Homo sapiens
ctgcacttcagacacc

SEQ ID NO: 1197446 - DNA, 19 bp, Homo sapiens
ctgcactttcccccttccc

SEQ ID NO: 1197447 - DNA, 13 bp, Homo sapiens
ctgcactttgttt

SEQ ID NO: 1197448 - DNA, 19 bp, Homo sapiens
ctgcactttgtttagaaaa

SEQ ID NO: 1197449 - DNA, 19 bp, Homo sapiens
ctgcagaaggaaaaatgtg

SEQ ID NO: 1197450 - DNA, 22 bp, Homo sapiens
ctgcagaaggaaaaatgtgtaa

SEQ ID NO: 1197451 - DNA, 13 bp, Homo sapiens
ctgcagaaggcca

SEQ ID NO: 1197452 - DNA, 19 bp, Homo sapiens
ctgcagaaggccaagaatc

SEQ ID NO: 1197453 - DNA, 24 bp, Homo sapiens
ctgcagaatgggccactgtagggg

SEQ ID NO: 1197454 - DNA, 17 bp, Homo sapiens
ctgcagacacctggact

SEQ ID NO: 1197455 - DNA, 18 bp, Homo sapiens
ctgcagacacctggactg

SEQ ID NO: 1197456 - DNA, 13 bp, Homo sapiens
ctgcagacaggct

SEQ ID NO: 1197457 - DNA, 15 bp, Homo sapiens
ctgcagacattctca

SEQ ID NO: 1197458 - DNA, 17 bp, Homo sapiens
ctgcagaccatccagag

SEQ ID NO: 1197459 - DNA, 18 bp, Homo sapiens
ctgcagacctcaagccat

SEQ ID NO: 1197460 - DNA, 16 bp, Homo sapiens
ctgcagacctcactgt

SEQ ID NO: 1197461 - DNA, 16 bp, Homo sapiens
ctgcagacgggaatgc

SEQ ID NO: 1197462 - DNA, 19 bp, Homo sapiens
ctgcagacgggaatgccta

SEQ ID NO: 1197463 - DNA, 18 bp, Homo sapiens
ctgcagacttcccagcta

SEQ ID NO: 1197464 - DNA, 20 bp, Homo sapiens
ctgcagagaaacgcgctcct

SEQ ID NO: 1197465 - DNA, 10 bp, Homo sapiens
ctgcagagca

SEQ ID NO: 1197466 - DNA, 13 bp, Homo sapiens
ctgcagagcaata

SEQ ID NO: 1197467 - DNA, 14 bp, Homo sapiens
ctgcagagcaataa

SEQ ID NO: 1197468 - DNA, 21 bp, Homo sapiens
ctgcagagcaataacactata

SEQ ID NO: 1197469 - DNA, 22 bp, Homo sapiens
ctgcagagcacaaacttcagaa

SEQ ID NO: 1197470 - DNA, 20 bp, Homo sapiens
ctgcagagcaggaaacatga

SEQ ID NO: 1197471 - DNA, 13 bp, Homo sapiens
ctgcagagcccgg

SEQ ID NO: 1197472 - DNA, 14 bp, Homo sapiens
ctgcagagcccggc

SEQ ID NO: 1197473 - DNA, 16 bp, Homo sapiens
ctgcagagcccggccc

SEQ ID NO: 1197474 - DNA, 11 bp, Homo sapiens
ctgcagaggcc

SEQ ID NO: 1197475 - DNA, 17 bp, Homo sapiens
ctgcagaggccagaggc

SEQ ID NO: 1197476 - DNA, 20 bp, Homo sapiens
ctgcagagggagacggccct

SEQ ID NO: 1197477 - DNA, 21 bp, Homo sapiens
ctgcagaggggaaaccagtgt

SEQ ID NO: 1197478 - DNA, 22 bp, Homo sapiens
ctgcagagggttaggagtgggt

SEQ ID NO: 1197479 - DNA, 17 bp, Homo sapiens
ctgcagagtctgcccca

SEQ ID NO: 1197480 - DNA, 18 bp, Homo sapiens
ctgcagagtctgccccac

SEQ ID NO: 1197481 - DNA, 21 bp, Homo sapiens
ctgcagagttctcctggaggc

SEQ ID NO: 1197482 - DNA, 22 bp, Homo sapiens
ctgcagagttctcctggaggca

SEQ ID NO: 1197483 - DNA, 14 bp, Homo sapiens
ctgcagatagccca

SEQ ID NO: 1197484 - DNA, 15 bp, Homo sapiens
ctgcagatagcccag

SEQ ID NO: 1197485 - DNA, 23 bp, Homo sapiens
ctgcagtagtctctgtgctttga

SEQ ID NO: 1197486 - DNA, 11 bp, Homo sapiens
ctgcagtcaca

SEQ ID NO: 1197487 - DNA, 21 bp, Homo sapiens
ctgcagtcagtcatgatggca

SEQ ID NO: 1197488 - DNA, 16 bp, Homo sapiens
ctgcagtcatctcccc

SEQ ID NO: 1197489 - DNA, 15 bp, Homo sapiens
ctgcagtcccacact

SEQ ID NO: 1197490 - DNA, 16 bp, Homo sapiens
ctgcagtcccacactg

SEQ ID NO: 1197491 - DNA, 16 bp, Homo sapiens
ctgcagtcctccgggg

SEQ ID NO: 1197492 - DNA, 17 bp, Homo sapiens
ctgcagtcggcatgcca

SEQ ID NO: 1197493 - DNA, 19 bp, Homo sapiens
ctgcagtcggcatgccagg

SEQ ID NO: 1197494 - DNA, 14 bp, Homo sapiens
ctgcagtctgcaga

SEQ ID NO: 1197495 - DNA, 15 bp, Homo sapiens
ctgcagtgagctgtg

SEQ ID NO: 1197496 - DNA, 16 bp, Homo sapiens
ctgcagtgaggctgta

SEQ ID NO: 1197497 - DNA, 12 bp, Homo sapiens
ctgcagtgaggg

SEQ ID NO: 1197498 - DNA, 17 bp, Homo sapiens
ctgcagtgatgcaataa

SEQ ID NO: 1197499 - DNA, 16 bp, Homo sapiens
ctgcagttaccacagc

SEQ ID NO: 1197500 - DNA, 15 bp, Homo sapiens
ctgcagttacttttg

SEQ ID NO: 1197501 - DNA, 20 bp, Homo sapiens
ctgcagttctactcaggctg

SEQ ID NO: 1197502 - DNA, 15 bp, Homo sapiens
ctgcagtttcctgga

SEQ ID NO: 1197503 - DNA, 16 bp, Homo sapiens
ctgcagtttcctggaa

SEQ ID NO: 1197504 - DNA, 17 bp, Homo sapiens
ctgcagtttggccctgg

SEQ ID NO: 1197505 - DNA, 19 bp, Homo sapiens
ctgcagtttggccctggag

SEQ ID NO: 1197506 - DNA, 22 bp, Homo sapiens
ctgcagttttgctatctgggct

SEQ ID NO: 1197507 - DNA, 14 bp, Homo sapiens
ctgcatacaatctg

SEQ ID NO: 1197508 - DNA, 13 bp, Homo sapiens
ctgcatactttga

SEQ ID NO: 1197509 - DNA, 18 bp, Homo sapiens
ctgcatagctctatttta

SEQ ID NO: 1197510 - DNA, 19 bp, Homo sapiens
ctgcatagctctattttaa

SEQ ID NO: 1197511 - DNA, 20 bp, Homo sapiens
ctgcataggagtttggagga

SEQ ID NO: 1197512 - DNA, 23 bp, Homo sapiens
ctgcataggagtttggaggaagt

SEQ ID NO: 1197513 - DNA, 16 bp, Homo sapiens
ctgcatagtctgttcc

SEQ ID NO: 1197514 - DNA, 15 bp, Homo sapiens
ctgcatatgaaagga

SEQ ID NO: 1197515 - DNA, 14 bp, Homo sapiens
ctgcatatgttgaa

SEQ ID NO: 1197516 - DNA, 12 bp, Homo sapiens
ctgcatatttct

SEQ ID NO: 1197517 - DNA, 21 bp, Homo sapiens
ctgcatatttctgtatatttg

SEQ ID NO: 1197518 - DNA, 20 bp, Homo sapiens
ctgcatcacccgcccctgga

SEQ ID NO: 1197519 - DNA, 13 bp, Homo sapiens
ctgcatcatctgt

SEQ ID NO: 1197520 - DNA, 17 bp, Homo sapiens
ctgcatcatctgtagat

SEQ ID NO: 1197521 - DNA, 18 bp, Homo sapiens
ctgcatcccagcacctgc

SEQ ID NO: 1197522 - DNA, 21 bp, Homo sapiens
ctgcatcccagcacctgcctc

SEQ ID NO: 1197523 - DNA, 15 bp, Homo sapiens
ctgcatccccttggc

SEQ ID NO: 1197524 - DNA, 23 bp, Homo sapiens
ctgcatcctgaggccagtggccc

SEQ ID NO: 1197525 - DNA, 16 bp, Homo sapiens
ctgcatcgtttcatct

SEQ ID NO: 1197526 - DNA, 19 bp, Homo sapiens
ctgcatctaagcatctggg

SEQ ID NO: 1197527 - DNA, 15 bp, Homo sapiens
ctgcatctactccca

SEQ ID NO: 1197528 - DNA, 18 bp, Homo sapiens
ctgcatctactcccaagt

SEQ ID NO: 1197529 - DNA, 17 bp, Homo sapiens
ctgcatctgaccagcag

SEQ ID NO: 1197530 - DNA, 20 bp, Homo sapiens
ctgcatctgaccagcagcgc

SEQ ID NO: 1197531 - DNA, 21 bp, Homo sapiens
ctgcatctgaccagcagcgcc

SEQ ID NO: 1197532 - DNA, 22 bp, Homo sapiens
ctgcatctgaccagcagcgcct

SEQ ID NO: 1197533 - DNA, 14 bp, Homo sapiens
ctgcatcttcttgc

SEQ ID NO: 1197534 - DNA, 21 bp, Homo sapiens
ctgcatcttggggacatctct

SEQ ID NO: 1197535 - DNA, 22 bp, Homo sapiens
ctgcatgaccaaagtgataaat

SEQ ID NO: 1197536 - DNA, 15 bp, Homo sapiens
ctgcatgacctacca

SEQ ID NO: 1197537 - DNA, 20 bp, Homo sapiens
ctgcatgacctaccaggaca

SEQ ID NO: 1197538 - DNA, 20 bp, Homo sapiens
ctgcatgatgtttgcccaaa

SEQ ID NO: 1197539 - DNA, 20 bp, Homo sapiens
ctgcatgcctggtctttcct

SEQ ID NO: 1197540 - DNA, 22 bp, Homo sapiens
ctgcatgcctggtctttcctct

SEQ ID NO: 1197541 - DNA, 15 bp, Homo sapiens
ctgcatgctctggaa

SEQ ID NO: 1197542 - DNA, 17 bp, Homo sapiens
ctgcatgctctggaagc

SEQ ID NO: 1197543 - DNA, 22 bp, Homo sapiens
ctgcatgctgcccagccactcc

SEQ ID NO: 1197544 - DNA, 12 bp, Homo sapiens
ctgcatggacct

SEQ ID NO: 1197545 - DNA, 22 bp, Homo sapiens
ctgcatggacctaacattcgat

SEQ ID NO: 1197546 - DNA, 13 bp, Homo sapiens
ctgcatggagcct

SEQ ID NO: 1197547 - DNA, 15 bp, Homo sapiens
ctgcatggagcctgg

SEQ ID NO: 1197548 - DNA, 14 bp, Homo sapiens
ctgcatggggaggc

SEQ ID NO: 1197549 - DNA, 18 bp, Homo sapiens
ctgcatggggaggcagca

SEQ ID NO: 1197550 - DNA, 21 bp, Homo sapiens
ctgcatggggaggcagcagag

SEQ ID NO: 1197551 - DNA, 18 bp, Homo sapiens
ctgcatggggcagaggct

SEQ ID NO: 1197552 - DNA, 24 bp, Homo sapiens
ctgcatgtactagtcctctagaaa

SEQ ID NO: 1197553 - DNA, 15 bp, Homo sapiens
ctgcatgtggcttct

SEQ ID NO: 1197554 - DNA, 18 bp, Homo sapiens
ctgcatgtggcttctctg

SEQ ID NO: 1197555 - DNA, 19 bp, Homo sapiens
ctgcatgtggcttctctgt

SEQ ID NO: 1197556 - DNA, 22 bp, Homo sapiens
ctgcatgtggcttctctgtctc

SEQ ID NO: 1197557 - DNA, 22 bp, Homo sapiens
ctgcatgtggcttttttaaaaa

SEQ ID NO: 1197558 - DNA, 22 bp, Homo sapiens
ctgcatgtgtcatgaagaatgt

SEQ ID NO: 1197559 - DNA, 20 bp, Homo sapiens
ctgcattaccgcgttgtaaa

SEQ ID NO: 1197560 - DNA, 21 bp, Homo sapiens
ctgcattaccgcgttgtaaaa

SEQ ID NO: 1197561 - DNA, 12 bp, Homo sapiens
ctgcattagaaa

SEQ ID NO: 1197562 - DNA, 15 bp, Homo sapiens
ctgcattagaaaaag

SEQ ID NO: 1197563 - DNA, 13 bp, Homo sapiens
ctgcattatctat

SEQ ID NO: 1197564 - DNA, 21 bp, Homo sapiens
ctgcattatctatgcagcatg

SEQ ID NO: 1197565 - DNA, 13 bp, Homo sapiens
ctgcattccgcag

SEQ ID NO: 1197566 - DNA, 15 bp, Homo sapiens
ctgcattcctgtgcc

SEQ ID NO: 1197567 - DNA, 18 bp, Homo sapiens
ctgcattctgcacgctgc

SEQ ID NO: 1197568 - DNA, 20 bp, Homo sapiens
ctgcattcttaacaaactct

SEQ ID NO: 1197569 - DNA, 18 bp, Homo sapiens
ctgcattcttctgagcac

SEQ ID NO: 1197570 - DNA, 12 bp, Homo sapiens
gggagggatcag

SEQ ID NO: 1197571 - DNA, 15 bp, Homo sapiens
gggagggcagctggc

SEQ ID NO: 1197572 - DNA, 16 bp, Homo sapiens
gggagggccagggagg

SEQ ID NO: 1197573 - DNA, 21 bp, Homo sapiens
gggagggcggcaggggcctgg

SEQ ID NO: 1197574 - DNA, 22 bp, Homo sapiens
gggagggcggcaggggcctgga

SEQ ID NO: 1197575 - DNA, 14 bp, Homo sapiens
gggagggcgtcagg

SEQ ID NO: 1197576 - DNA, 18 bp, Homo sapiens
gggagggcgtcaggcaga

SEQ ID NO: 1197577 - DNA, 14 bp, Homo sapiens
gggagggctcctgg

SEQ ID NO: 1197578 - DNA, 15 bp, Homo sapiens
gggagggctcctggg

SEQ ID NO: 1197579 - DNA, 17 bp, Homo sapiens
gggagggctcctggggc

SEQ ID NO: 1197580 - DNA, 21 bp, Homo sapiens
gggagggctcctggggcagag

SEQ ID NO: 1197581 - DNA, 16 bp, Homo sapiens
gggaggggaaaagcat

SEQ ID NO: 1197582 - DNA, 18 bp, Homo sapiens
gggaggggaaggggccgg

SEQ ID NO: 1197583 - DNA, 12 bp, Homo sapiens
gggaggggcagg

SEQ ID NO: 1197584 - DNA, 13 bp, Homo sapiens
gggaggggccctc

SEQ ID NO: 1197585 - DNA, 19 bp, Homo sapiens
gggaggggcctagggagcc

SEQ ID NO: 1197586 - DNA, 10 bp, Homo sapiens
gggaggggcg

SEQ ID NO: 1197587 - DNA, 19 bp, Homo sapiens
gggaggggcgctggcccag

SEQ ID NO: 1197588 - DNA, 21 bp, Homo sapiens
gggaggggcgctggcccagcc

SEQ ID NO: 1197589 - DNA, 19 bp, Homo sapiens
gggaggggctggggcaggc

SEQ ID NO: 1197590 - DNA, 14 bp, Homo sapiens
gggagggggtcctg

SEQ ID NO: 1197591 - DNA, 17 bp, Homo sapiens
gggaggggttgttttgg

SEQ ID NO: 1197592 - DNA, 15 bp, Homo sapiens
gggagggtaccagca

SEQ ID NO: 1197593 - DNA, 11 bp, Homo sapiens
gggagggtctt

SEQ ID NO: 1197594 - DNA, 16 bp, Homo sapiens
gggagggttcccctgg

SEQ ID NO: 1197595 - DNA, 18 bp, Homo sapiens
gggagggttcccctggcc

SEQ ID NO: 1197596 - DNA, 19 bp, Homo sapiens
gggagggttcccctggcct

SEQ ID NO: 1197597 - DNA, 18 bp, Homo sapiens
gggaggtcaaggctgcag

SEQ ID NO: 1197598 - DNA, 15 bp, Homo sapiens
gggaggtccaagcag

SEQ ID NO: 1197599 - DNA, 15 bp, Homo sapiens
gggaggtcgaggtag

SEQ ID NO: 1197600 - DNA, 21 bp, Homo sapiens
gggaggtctcgtcccagccct

SEQ ID NO: 1197601 - DNA, 14 bp, Homo sapiens
gggaggtgggaggc

SEQ ID NO: 1197602 - DNA, 18 bp, Homo sapiens
gggaggtgggaggccagg

SEQ ID NO: 1197603 - DNA, 20 bp, Homo sapiens
gggaggtgtttaaagagagg

SEQ ID NO: 1197604 - DNA, 21 bp, Homo sapiens
gggaggttttattctgacttc

SEQ ID NO: 1197605 - DNA, 17 bp, Homo sapiens
gggagtcagagccctgg

SEQ ID NO: 1197606 - DNA, 19 bp, Homo sapiens
gggagtcaggcctgggcag

SEQ ID NO: 1197607 - DNA, 17 bp, Homo sapiens
gggagtcccagagccct

SEQ ID NO: 1197608 - DNA, 17 bp, Homo sapiens
gggagtccccttttctt

SEQ ID NO: 1197609 - DNA, 15 bp, Homo sapiens
gggagtcccgtcagg

SEQ ID NO: 1197610 - DNA, 17 bp, Homo sapiens
gggagtccttacctcgg

SEQ ID NO: 1197611 - DNA, 16 bp, Homo sapiens
gggagtctcaggagga

SEQ ID NO: 1197612 - DNA, 20 bp, Homo sapiens
gggagtcttaataaaataaa

SEQ ID NO: 1197613 - DNA, 14 bp, Homo sapiens
gggagtgagcagct

SEQ ID NO: 1197614 - DNA, 15 bp, Homo sapiens
gggagtgagcagcta

SEQ ID NO: 1197615 - DNA, 16 bp, Homo sapiens
gggagtgagcagctac

SEQ ID NO: 1197616 - DNA, 13 bp, Homo sapiens
gggagtgaggggt

SEQ ID NO: 1197617 - DNA, 23 bp, Homo sapiens
gggagtgctggctcacagtacag

SEQ ID NO: 1197618 - DNA, 18 bp, Homo sapiens
gggagtgggacagagtct

SEQ ID NO: 1197619 - DNA, 21 bp, Homo sapiens
gggagtgggacagagtctggg

SEQ ID NO: 1197620 - DNA, 15 bp, Homo sapiens
gggagtgggcacctc

SEQ ID NO: 1197621 - DNA, 16 bp, Homo sapiens
gggagtgggcacctca

SEQ ID NO: 1197622 - DNA, 17 bp, Homo sapiens
gggataacagaggcagg

SEQ ID NO: 1197623 - DNA, 16 bp, Homo sapiens
gggataagagtgtgag

SEQ ID NO: 1197624 - DNA, 13 bp, Homo sapiens
gggatagaggaaa

SEQ ID NO: 1197625 - DNA, 19 bp, Homo sapiens
gggatagtgttctgctcct

SEQ ID NO: 1197626 - DNA, 20 bp, Homo sapiens
gggatagtgttctgctcctg

SEQ ID NO: 1197627 - DNA, 21 bp, Homo sapiens
gggatagtgttctgctcctgc

SEQ ID NO: 1197628 - DNA, 22 bp, Homo sapiens
gggatatggcaggactcctggc

SEQ ID NO: 1197629 - DNA, 20 bp, Homo sapiens
gggatattgccttatttgtc

SEQ ID NO: 1197630 - DNA, 21 bp, Homo sapiens
gggatatttcctaaggcatgt

SEQ ID NO: 1197631 - DNA, 20 bp, Homo sapiens
gggatcaaacctttctggcc

SEQ ID NO: 1197632 - DNA, 22 bp, Homo sapiens
gggatcaaacctttctggcctg

SEQ ID NO: 1197633 - DNA, 15 bp, Homo sapiens
gggatcagccccgcc

SEQ ID NO: 1197634 - DNA, 23 bp, Homo sapiens
gggatcagccccgcctgtcacaa

SEQ ID NO: 1197635 - DNA, 22 bp, Homo sapiens
gggatccacttcttggttcctg

SEQ ID NO: 1197636 - DNA, 14 bp, Homo sapiens
gggatccagttcca

SEQ ID NO: 1197637 - DNA, 22 bp, Homo sapiens
gggatccccgcctggccaggag

SEQ ID NO: 1197638 - DNA, 17 bp, Homo sapiens
gggatccgactgctttg

SEQ ID NO: 1197639 - DNA, 17 bp, Homo sapiens
gggatcctccacagaga

SEQ ID NO: 1197640 - DNA, 20 bp, Homo sapiens
gggatcctccacagagagga

SEQ ID NO: 1197641 - DNA, 21 bp, Homo sapiens
gggatcctctccaccctcctc

SEQ ID NO: 1197642 - DNA, 13 bp, Homo sapiens
gggatcctgcccc

SEQ ID NO: 1197643 - DNA, 18 bp, Homo sapiens
gggatcgatgtgctcagc

SEQ ID NO: 1197644 - DNA, 16 bp, Homo sapiens
gggatctaggagagga

SEQ ID NO: 1197645 - DNA, 12 bp, Homo sapiens
gggatctgagaa

SEQ ID NO: 1197646 - DNA, 16 bp, Homo sapiens
gggatctgtttgaaca

SEQ ID NO: 1197647 - DNA, 23 bp, Homo sapiens
gggatcttcccacaggagggcca

SEQ ID NO: 1197648 - DNA, 18 bp, Homo sapiens
gggatcttgcattcccag

SEQ ID NO: 1197649 - DNA, 20 bp, Homo sapiens
gggatgacatgcactcagct

SEQ ID NO: 1197650 - DNA, 17 bp, Homo sapiens
gggatgactagaggcag

SEQ ID NO: 1197651 - DNA, 23 bp, Homo sapiens
gggatgactagaggcagggaggg

SEQ ID NO: 1197652 - DNA, 18 bp, Homo sapiens
gggatgatggcagagcca

SEQ ID NO: 1197653 - DNA, 22 bp, Homo sapiens
gggatgatggcagagccaggct

SEQ ID NO: 1197654 - DNA, 16 bp, Homo sapiens
gggatgattcaagcca

SEQ ID NO: 1197655 - DNA, 21 bp, Homo sapiens
gggatgccaacaccttcttgg

SEQ ID NO: 1197656 - DNA, 15 bp, Homo sapiens
gggatgccaatttcc

SEQ ID NO: 1197657 - DNA, 20 bp, Homo sapiens
gggatgcccccaggcagcca

SEQ ID NO: 1197658 - DNA, 19 bp, Homo sapiens
gggatgcctcaccacaccc

SEQ ID NO: 1197659 - DNA, 18 bp, Homo sapiens
gggatgcgtgggaggcag

SEQ ID NO: 1197660 - DNA, 16 bp, Homo sapiens
gggatgctgggctggg

SEQ ID NO: 1197661 - DNA, 17 bp, Homo sapiens
gggatgctgggctgggc

SEQ ID NO: 1197662 - DNA, 19 bp, Homo sapiens
gggatggagaggcggcctc

SEQ ID NO: 1197663 - DNA, 15 bp, Homo sapiens
gggatggaggagaag

SEQ ID NO: 1197664 - DNA, 15 bp, Homo sapiens
gggatggaggccaga

SEQ ID NO: 1197665 - DNA, 15 bp, Homo sapiens
gggatggaggggagt

SEQ ID NO: 1197666 - DNA, 14 bp, Homo sapiens
gggatgggccaggg

SEQ ID NO: 1197667 - DNA, 15 bp, Homo sapiens
gggatgggggaagat

SEQ ID NO: 1197668 - DNA, 12 bp, Homo sapiens
gggatgggtggg

SEQ ID NO: 1197669 - DNA, 18 bp, Homo sapiens
gggatggtggagggccac

SEQ ID NO: 1197670 - DNA, 14 bp, Homo sapiens
gggatggtggcaca

SEQ ID NO: 1197671 - DNA, 19 bp, Homo sapiens
gggatggtggcacaggcac

SEQ ID NO: 1197672 - DNA, 12 bp, Homo sapiens
gggatgtagaac

SEQ ID NO: 1197673 - DNA, 22 bp, Homo sapiens
gggatgtgaattgcctgcagag

SEQ ID NO: 1197674 - DNA, 17 bp, Homo sapiens
gggatgttctgcctctc

SEQ ID NO: 1197675 - DNA, 17 bp, Homo sapiens
gggatgtttacctggtg

SEQ ID NO: 1197676 - DNA, 19 bp, Homo sapiens
gggatgtttacctggtgct

SEQ ID NO: 1197677 - DNA, 15 bp, Homo sapiens
gggattaagggcaaa

SEQ ID NO: 1197678 - DNA, 15 bp, Homo sapiens
gggattacaggcatg

SEQ ID NO: 1197679 - DNA, 20 bp, Homo sapiens
gggattacaggcgtgagcca

SEQ ID NO: 1197680 - DNA, 23 bp, Homo sapiens
gggattattagaatcaaacattt

SEQ ID NO: 1197681 - DNA, 14 bp, Homo sapiens
gggattcaggggct

SEQ ID NO: 1197682 - DNA, 16 bp, Homo sapiens
gggattcctgacccag

SEQ ID NO: 1197683 - DNA, 17 bp, Homo sapiens
gggattcctgacccagg

SEQ ID NO: 1197684 - DNA, 16 bp, Homo sapiens
gggattcctgagctgg

SEQ ID NO: 1197685 - DNA, 20 bp, Homo sapiens
gggattcctgagctggcctg

SEQ ID NO: 1197686 - DNA, 16 bp, Homo sapiens
gggattgggggctggt

SEQ ID NO: 1197687 - DNA, 13 bp, Homo sapiens
gggattgtccctg

SEQ ID NO: 1197688 - DNA, 20 bp, Homo sapiens
gggatttaatttccagggtt

SEQ ID NO: 1197689 - DNA, 18 bp, Homo sapiens
gggatttcttcgctgctc

SEQ ID NO: 1197690 - DNA, 18 bp, Homo sapiens
gggattttagcctcttcc

SEQ ID NO: 1197691 - DNA, 23 bp, Homo sapiens
gggcaaaatcgccataggccaag

SEQ ID NO: 1197692 - DNA, 14 bp, Homo sapiens
gggcaaagagctcc

SEQ ID NO: 1197693 - DNA, 21 bp, Homo sapiens
gggcaaagccacaaggctggc

SEQ ID NO: 1197694 - DNA, 13 bp, Homo sapiens
gggcaaagcttgt

SEQ ID NO: 1197695 - DNA, 19 bp, Homo sapiens
ctgcattgctagataaaag

SEQ ID NO: 1197696 - DNA, 13 bp, Homo sapiens
ctgcattggcttt

SEQ ID NO: 1197697 - DNA, 14 bp, Homo sapiens
ctgcattgtaaata

SEQ ID NO: 1197698 - DNA, 19 bp, Homo sapiens
ctgcattgttattgtggaa

SEQ ID NO: 1197699 - DNA, 20 bp, Homo sapiens
ctgcatttaaaagatacagt

SEQ ID NO: 1197700 - DNA, 19 bp, Homo sapiens
ctgcatttataaagaccgt

SEQ ID NO: 1197701 - DNA, 17 bp, Homo sapiens
ctgcatttcctcgcagc

SEQ ID NO: 1197702 - DNA, 23 bp, Homo sapiens
ctgcatttggcaggaagatgtat

SEQ ID NO: 1197703 - DNA, 15 bp, Homo sapiens
ctgcatttgtgaaat

SEQ ID NO: 1197704 - DNA, 17 bp, Homo sapiens
ctgcatttgtgaaatga

SEQ ID NO: 1197705 - DNA, 9 bp, Homo sapiens
ctgcatttt

SEQ ID NO: 1197706 - DNA, 22 bp, Homo sapiens
ctgcattttacacatgtgctga

SEQ ID NO: 1197707 - DNA, 19 bp, Homo sapiens
ctgcattttattctggatg

SEQ ID NO: 1197708 - DNA, 17 bp, Homo sapiens
ctgcattttcaccccac

SEQ ID NO: 1197709 - DNA, 14 bp, Homo sapiens
ctgcattttgctat

SEQ ID NO: 1197710 - DNA, 21 bp, Homo sapiens
ctgcattttgctattgtaaat

SEQ ID NO: 1197711 - DNA, 21 bp, Homo sapiens
ctgccaaaaccacatgggctg

SEQ ID NO: 1197712 - DNA, 16 bp, Homo sapiens
ctgccaaaatgctcta

SEQ ID NO: 1197713 - DNA, 22 bp, Homo sapiens
ctgccaaaatgctctagtgcct

SEQ ID NO: 1197714 - DNA, 13 bp, Homo sapiens
ctgccaaacacat

SEQ ID NO: 1197715 - DNA, 21 bp, Homo sapiens
ctgccaaagggaaatatcatt

SEQ ID NO: 1197716 - DNA, 13 bp, Homo sapiens
ctgccaaagtagt

SEQ ID NO: 1197717 - DNA, 17 bp, Homo sapiens
ctgccaaagtagtcctg

SEQ ID NO: 1197718 - DNA, 20 bp, Homo sapiens
ctgccaaagtgcctgggaag

SEQ ID NO: 1197719 - DNA, 17 bp, Homo sapiens
ctgccaacatactttaa

SEQ ID NO: 1197720 - DNA, 17 bp, Homo sapiens
ctgccaacgcctcctgt

SEQ ID NO: 1197721 - DNA, 18 bp, Homo sapiens
ctgccaacgcctcctgtc

SEQ ID NO: 1197722 - DNA, 16 bp, Homo sapiens
ctgccaagactcctca

SEQ ID NO: 1197723 - DNA, 17 bp, Homo sapiens
ctgccaagcttcctgtg

SEQ ID NO: 1197724 - DNA, 23 bp, Homo sapiens
ctgccaagcttggagtgacctaa

SEQ ID NO: 1197725 - DNA, 18 bp, Homo sapiens
ctgccaaggccagagtgg

SEQ ID NO: 1197726 - DNA, 20 bp, Homo sapiens
ctgccaaggtggagggaagg

SEQ ID NO: 1197727 - DNA, 17 bp, Homo sapiens
ctgccaataacattctt

SEQ ID NO: 1197728 - DNA, 15 bp, Homo sapiens
ctgccatagggtctg

SEQ ID NO: 1197729 - DNA, 23 bp, Homo sapiens
ctgccatagggtctgcagcctgc

SEQ ID NO: 1197730 - DNA, 17 bp, Homo sapiens
ctgccatatataacaga

SEQ ID NO: 1197731 - DNA, 20 bp, Homo sapiens
ctgccatctagccagcccct

SEQ ID NO: 1197732 - DNA, 22 bp, Homo sapiens
ctgccatcttagtttggattct

SEQ ID NO: 1197733 - DNA, 23 bp, Homo sapiens
ctgccatcttagtttggattctt

SEQ ID NO: 1197734 - DNA, 14 bp, Homo sapiens
ctgccatcttccca

SEQ ID NO: 1197735 - DNA, 15 bp, Homo sapiens
ctgccatcttcccag

SEQ ID NO: 1197736 - DNA, 16 bp, Homo sapiens
ctgccatgatagctgg

SEQ ID NO: 1197737 - DNA, 23 bp, Homo sapiens
ctgccatgatagctggggcttca

SEQ ID NO: 1197738 - DNA, 17 bp, Homo sapiens
ctgccatgatgtatatc

SEQ ID NO: 1197739 - DNA, 17 bp, Homo sapiens
ctgccatgccactgcca

SEQ ID NO: 1197740 - DNA, 21 bp, Homo sapiens
ctgccatgccactgccaggca

SEQ ID NO: 1197741 - DNA, 24 bp, Homo sapiens
ctgccatgccactgccaggcacct

SEQ ID NO: 1197742 - DNA, 18 bp, Homo sapiens
ctgccatgccaggaacct

SEQ ID NO: 1197743 - DNA, 22 bp, Homo sapiens
ctgccatgccaggaacctgtcc

SEQ ID NO: 1197744 - DNA, 23 bp, Homo sapiens
ctgccatgccaggaacctgtcct

SEQ ID NO: 1197745 - DNA, 17 bp, Homo sapiens
ctgccatgtacctcccc

SEQ ID NO: 1197746 - DNA, 22 bp, Homo sapiens
ctgccatgtacctcccctgcct

SEQ ID NO: 1197747 - DNA, 22 bp, Homo sapiens
ctgccatgtttagtgaatgact

SEQ ID NO: 1197748 - DNA, 21 bp, Homo sapiens
ctgccattattttctgtcaga

SEQ ID NO: 1197749 - DNA, 14 bp, Homo sapiens
ctgccattggcctc

SEQ ID NO: 1197750 - DNA, 18 bp, Homo sapiens
ctgccattggcctcttgt

SEQ ID NO: 1197751 - DNA, 16 bp, Homo sapiens
ctgccatttctgagat

SEQ ID NO: 1197752 - DNA, 20 bp, Homo sapiens
ctgccatttgcaccctccgc

SEQ ID NO: 1197753 - DNA, 22 bp, Homo sapiens
ctgcccaaacagctgtatttat

SEQ ID NO: 1197754 - DNA, 23 bp, Homo sapiens
ctgcccaaacagctgtatttata

SEQ ID NO: 1197755 - DNA, 18 bp, Homo sapiens
ctgcccaaacccttaact

SEQ ID NO: 1197756 - DNA, 13 bp, Homo sapiens
ctgcccaaattat

SEQ ID NO: 1197757 - DNA, 18 bp, Homo sapiens
ctgcccaagcagcctgga

SEQ ID NO: 1197758 - DNA, 17 bp, Homo sapiens
ctgcccaagggcctccc

SEQ ID NO: 1197759 - DNA, 19 bp, Homo sapiens
ctgcccaagggcctcccac

SEQ ID NO: 1197760 - DNA, 21 bp, Homo sapiens
ctgcccaatgctttgggaggc

SEQ ID NO: 1197761 - DNA, 16 bp, Homo sapiens
ctgcccacatttgggc

SEQ ID NO: 1197762 - DNA, 12 bp, Homo sapiens
ctgcccaccccc

SEQ ID NO: 1197763 - DNA, 13 bp, Homo sapiens
ctgcccacccccg

SEQ ID NO: 1197764 - DNA, 13 bp, Homo sapiens
ctgcccaccccct

SEQ ID NO: 1197765 - DNA, 19 bp, Homo sapiens
ctgcccaccccctcaagcc

SEQ ID NO: 1197766 - DNA, 20 bp, Homo sapiens
ctgcccacctccttccagca

SEQ ID NO: 1197767 - DNA, 13 bp, Homo sapiens
ctgcccacctctc

SEQ ID NO: 1197768 - DNA, 16 bp, Homo sapiens
ctgcccacctctccct

SEQ ID NO: 1197769 - DNA, 23 bp, Homo sapiens
ctgcccacctctccctgcatcct

SEQ ID NO: 1197770 - DNA, 17 bp, Homo sapiens
ctgcccacgatcccctc

SEQ ID NO: 1197771 - DNA, 17 bp, Homo sapiens
ctgcccacgcagaggac

SEQ ID NO: 1197772 - DNA, 17 bp, Homo sapiens
ctgcccacgctcctgcc

SEQ ID NO: 1197773 - DNA, 19 bp, Homo sapiens
ctgcccacgctcctgccct

SEQ ID NO: 1197774 - DNA, 13 bp, Homo sapiens
ctgcccactgttt

SEQ ID NO: 1197775 - DNA, 21 bp, Homo sapiens
ctgcccagacccctctggcca

SEQ ID NO: 1197776 - DNA, 23 bp, Homo sapiens
ctgcccagacccctctggccagg

SEQ ID NO: 1197777 - DNA, 15 bp, Homo sapiens
ctgcccagactgatg

SEQ ID NO: 1197778 - DNA, 18 bp, Homo sapiens
ctgcccagatgccctttg

SEQ ID NO: 1197779 - DNA, 14 bp, Homo sapiens
ctgcccagctcctc

SEQ ID NO: 1197780 - DNA, 19 bp, Homo sapiens
ctgcccagctgctcccctg

SEQ ID NO: 1197781 - DNA, 15 bp, Homo sapiens
ctgcccagcttgggc

SEQ ID NO: 1197782 - DNA, 17 bp, Homo sapiens
ctgcccagcttgggccc

SEQ ID NO: 1197783 - DNA, 23 bp, Homo sapiens
ctgcccagcttgggcccagctgg

SEQ ID NO: 1197784 - DNA, 21 bp, Homo sapiens
ctgcccaggagacagaccact

SEQ ID NO: 1197785 - DNA, 22 bp, Homo sapiens
ctgcccaggagagccagccctc

SEQ ID NO: 1197786 - DNA, 17 bp, Homo sapiens
ctgcccagggagtcctt

SEQ ID NO: 1197787 - DNA, 18 bp, Homo sapiens
ctgcccaggggtgccccc

SEQ ID NO: 1197788 - DNA, 19 bp, Homo sapiens
ctgcccaggggtgccccct

SEQ ID NO: 1197789 - DNA, 21 bp, Homo sapiens
ctgcccaggggtgccccctcc

SEQ ID NO: 1197790 - DNA, 18 bp, Homo sapiens
ctgcccaggtggcctcct

SEQ ID NO: 1197791 - DNA, 22 bp, Homo sapiens
ctgcccagtgcaaaccacttct

SEQ ID NO: 1197792 - DNA, 16 bp, Homo sapiens
ctgcccatactgagcc

SEQ ID NO: 1197793 - DNA, 17 bp, Homo sapiens
ctgcccatactgagcct

SEQ ID NO: 1197794 - DNA, 15 bp, Homo sapiens
ctgcccatcacaggg

SEQ ID NO: 1197795 - DNA, 18 bp, Homo sapiens
ctgcccatcatgtggccc

SEQ ID NO: 1197796 - DNA, 15 bp, Homo sapiens
ctgcccatccgtctg

SEQ ID NO: 1197797 - DNA, 18 bp, Homo sapiens
ctgcccatccgtctgtct

SEQ ID NO: 1197798 - DNA, 20 bp, Homo sapiens
ctgcccatggacaggctggc

SEQ ID NO: 1197799 - DNA, 15 bp, Homo sapiens
ctgccccaaacaaat

SEQ ID NO: 1197800 - DNA, 21 bp, Homo sapiens
ctgccccaaacaaatatgcaa

SEQ ID NO: 1197801 - DNA, 22 bp, Homo sapiens
ctgccccaaataacttcagtcc

SEQ ID NO: 1197802 - DNA, 23 bp, Homo sapiens
ctgccccaaataacttcagtcct

SEQ ID NO: 1197803 - DNA, 16 bp, Homo sapiens
ctgccccaactcctgg

SEQ ID NO: 1197804 - DNA, 13 bp, Homo sapiens
ctgccccaactct

SEQ ID NO: 1197805 - DNA, 17 bp, Homo sapiens
ctgccccaagcagccag

SEQ ID NO: 1197806 - DNA, 18 bp, Homo sapiens
ctgccccaagcagccagc

SEQ ID NO: 1197807 - DNA, 14 bp, Homo sapiens
ctgccccaagcccc

SEQ ID NO: 1197808 - DNA, 23 bp, Homo sapiens
ctgccccaagcccccaaccccgc

SEQ ID NO: 1197809 - DNA, 15 bp, Homo sapiens
ctgccccaatcgggt

SEQ ID NO: 1197810 - DNA, 19 bp, Homo sapiens
ctgccccaatcgggtccag

SEQ ID NO: 1197811 - DNA, 20 bp, Homo sapiens
ctgccccaatcgggtccaga

SEQ ID NO: 1197812 - DNA, 23 bp, Homo sapiens
ctgccccaatcgggtccagagac

SEQ ID NO: 1197813 - DNA, 18 bp, Homo sapiens
ctgccccacacctcctct

SEQ ID NO: 1197814 - DNA, 22 bp, Homo sapiens
ctgccccaccacgcatgctcag

SEQ ID NO: 1197815 - DNA, 13 bp, Homo sapiens
ctgccccacccca

SEQ ID NO: 1197816 - DNA, 14 bp, Homo sapiens
ctgccccaccccat

SEQ ID NO: 1197817 - DNA, 12 bp, Homo sapiens
ctgccccaccct

SEQ ID NO: 1197818 - DNA, 14 bp, Homo sapiens
ctgccccacggaga

SEQ ID NO: 1197819 - DNA, 22 bp, Homo sapiens
ctgccccacttctggcatggga

SEQ ID NO: 1197820 - DNA, 13 bp, Homo sapiens
ctgccccagccaa

SEQ ID NO: 1197821 - DNA, 15 bp, Homo sapiens
ctgccccagccccta

SEQ ID NO: 1197822 - DNA, 15 bp, Homo sapiens
ctgccccagctctgg

SEQ ID NO: 1197823 - DNA, 19 bp, Homo sapiens
ctgccccagctctggcttc

SEQ ID NO: 1197824 - DNA, 21 bp, Homo sapiens
gggcagtgtgaggacctccct

SEQ ID NO: 1197825 - DNA, 17 bp, Homo sapiens
gggcagttagagcagcc

SEQ ID NO: 1197826 - DNA, 16 bp, Homo sapiens
gggcagttctcactcc

SEQ ID NO: 1197827 - DNA, 22 bp, Homo sapiens
gggcagttctcactcctaggag

SEQ ID NO: 1197828 - DNA, 24 bp, Homo sapiens
gggcagttctcactcctaggagag

SEQ ID NO: 1197829 - DNA, 18 bp, Homo sapiens
gggcagttctcccaggga

SEQ ID NO: 1197830 - DNA, 21 bp, Homo sapiens
gggcagttctcccagggagtg

SEQ ID NO: 1197831 - DNA, 17 bp, Homo sapiens
gggcatatccaccacct

SEQ ID NO: 1197832 - DNA, 12 bp, Homo sapiens
gggcatcaggca

SEQ ID NO: 1197833 - DNA, 13 bp, Homo sapiens
gggcatcaggcac

SEQ ID NO: 1197834 - DNA, 14 bp, Homo sapiens
gggcatcaggcact

SEQ ID NO: 1197835 - DNA, 17 bp, Homo sapiens
gggcatcaggcactggt

SEQ ID NO: 1197836 - DNA, 17 bp, Homo sapiens
gggcatccacccagtgc

SEQ ID NO: 1197837 - DNA, 22 bp, Homo sapiens
gggcatccacccagtgctgcca

SEQ ID NO: 1197838 - DNA, 23 bp, Homo sapiens
gggcatccacccagtgctgccat

SEQ ID NO: 1197839 - DNA, 14 bp, Homo sapiens
gggcatcccagctt

SEQ ID NO: 1197840 - DNA, 23 bp, Homo sapiens
gggcatcctggatgatttcatct

SEQ ID NO: 1197841 - DNA, 18 bp, Homo sapiens
gggcatctcttccccaga

SEQ ID NO: 1197842 - DNA, 20 bp, Homo sapiens
gggcatctcttccccagaga

SEQ ID NO: 1197843 - DNA, 21 bp, Homo sapiens
gggcatctgagtccagctccc

SEQ ID NO: 1197844 - DNA, 14 bp, Homo sapiens
gggcatctgcccct

SEQ ID NO: 1197845 - DNA, 20 bp, Homo sapiens
gggcatctgcccctccccca

SEQ ID NO: 1197846 - DNA, 17 bp, Homo sapiens
gggcatcttctggcttg

SEQ ID NO: 1197847 - DNA, 22 bp, Homo sapiens
gggcatgacctcagtcaggcac

SEQ ID NO: 1197848 - DNA, 18 bp, Homo sapiens
gggcccagcggtccctgc

SEQ ID NO: 1197849 - DNA, 21 bp, Homo sapiens
gggcccagctgggctctgcca

SEQ ID NO: 1197850 - DNA, 22 bp, Homo sapiens
gggcccagctgtagccatggct

SEQ ID NO: 1197851 - DNA, 16 bp, Homo sapiens
gggcccaggaccagct

SEQ ID NO: 1197852 - DNA, 12 bp, Homo sapiens
gggcccaggact

SEQ ID NO: 1197853 - DNA, 22 bp, Homo sapiens
gggcccaggagagcccccacca

SEQ ID NO: 1197854 - DNA, 23 bp, Homo sapiens
gggcccaggagagcccccaccag

SEQ ID NO: 1197855 - DNA, 13 bp, Homo sapiens
gggcccaggcagg

SEQ ID NO: 1197856 - DNA, 16 bp, Homo sapiens
gggcccaggccatgtg

SEQ ID NO: 1197857 - DNA, 17 bp, Homo sapiens
gggcccaggccatgtgg

SEQ ID NO: 1197858 - DNA, 22 bp, Homo sapiens
gggcccaggccatgtggcctgc

SEQ ID NO: 1197859 - DNA, 14 bp, Homo sapiens
gggcccaggcctgg

SEQ ID NO: 1197860 - DNA, 22 bp, Homo sapiens
gggcccataatagttagccctc

SEQ ID NO: 1197861 - DNA, 13 bp, Homo sapiens
gggcccatcaggc

SEQ ID NO: 1197862 - DNA, 19 bp, Homo sapiens
gggccccagatctgcctgg

SEQ ID NO: 1197863 - DNA, 24 bp, Homo sapiens
gggccccagatctgcctgggcctg

SEQ ID NO: 1197864 - DNA, 15 bp, Homo sapiens
gggccccagcgtctg

SEQ ID NO: 1197865 - DNA, 22 bp, Homo sapiens
gggccccagcgtctgcagggtg

SEQ ID NO: 1197866 - DNA, 24 bp, Homo sapiens
gggccccagcgtctgcagggtgac

SEQ ID NO: 1197867 - DNA, 17 bp, Homo sapiens
gggccccatcttgatct

SEQ ID NO: 1197868 - DNA, 16 bp, Homo sapiens
gggccccatgctctgc

SEQ ID NO: 1197869 - DNA, 19 bp, Homo sapiens
gggccccatgctctgcccc

SEQ ID NO: 1197870 - DNA, 20 bp, Homo sapiens
gggcccccaatgacacccat

SEQ ID NO: 1197871 - DNA, 10 bp, Homo sapiens
gggcccccct

SEQ ID NO: 1197872 - DNA, 20 bp, Homo sapiens
gggcccccctccccccactt

SEQ ID NO: 1197873 - DNA, 23 bp, Homo sapiens
gggccccgaatgtcactggtgga

SEQ ID NO: 1197874 - DNA, 15 bp, Homo sapiens
gggccccgccagggc

SEQ ID NO: 1197875 - DNA, 18 bp, Homo sapiens
gggccccgccagggctgg

SEQ ID NO: 1197876 - DNA, 15 bp, Homo sapiens
gggccccggggctgg

SEQ ID NO: 1197877 - DNA, 19 bp, Homo sapiens
gggccccggggctggcaag

SEQ ID NO: 1197878 - DNA, 12 bp, Homo sapiens
gggcccctccac

SEQ ID NO: 1197879 - DNA, 16 bp, Homo sapiens
gggcccctcccctcag

SEQ ID NO: 1197880 - DNA, 22 bp, Homo sapiens
gggcccctcccctcagagccca

SEQ ID NO: 1197881 - DNA, 15 bp, Homo sapiens
gggcccctccctctg

SEQ ID NO: 1197882 - DNA, 15 bp, Homo sapiens
gggcccctgaccctc

SEQ ID NO: 1197883 - DNA, 15 bp, Homo sapiens
gggcccctggcccag

SEQ ID NO: 1197884 - DNA, 14 bp, Homo sapiens
gggcccctggggac

SEQ ID NO: 1197885 - DNA, 18 bp, Homo sapiens
gggcccctggggacagag

SEQ ID NO: 1197886 - DNA, 21 bp, Homo sapiens
gggcccctgtccccagtcccc

SEQ ID NO: 1197887 - DNA, 23 bp, Homo sapiens
gggccccttgctgatgctcctcc

SEQ ID NO: 1197888 - DNA, 15 bp, Homo sapiens
gggcccgacaggtgg

SEQ ID NO: 1197889 - DNA, 16 bp, Homo sapiens
gggcccgacaggtggg

SEQ ID NO: 1197890 - DNA, 22 bp, Homo sapiens
gggcccgacaggtgggcctggg

SEQ ID NO: 1197891 - DNA, 15 bp, Homo sapiens
gggcccgctgcctct

SEQ ID NO: 1197892 - DNA, 19 bp, Homo sapiens
gggcccgctgcgtgccatc

SEQ ID NO: 1197893 - DNA, 13 bp, Homo sapiens
gggcccggccagc

SEQ ID NO: 1197894 - DNA, 17 bp, Homo sapiens
gggcccgggcaggccag

SEQ ID NO: 1197895 - DNA, 16 bp, Homo sapiens
gggcccgggcccccgc

SEQ ID NO: 1197896 - DNA, 17 bp, Homo sapiens
gggcccgttgaggatga

SEQ ID NO: 1197897 - DNA, 21 bp, Homo sapiens
gggccctcccagcccattgct

SEQ ID NO: 1197898 - DNA, 19 bp, Homo sapiens
gggccctctatgctggctt

SEQ ID NO: 1197899 - DNA, 14 bp, Homo sapiens
gggccctctcttct

SEQ ID NO: 1197900 - DNA, 14 bp, Homo sapiens
gggccctcttgcca

SEQ ID NO: 1197901 - DNA, 16 bp, Homo sapiens
gggccctcttgccagc

SEQ ID NO: 1197902 - DNA, 20 bp, Homo sapiens
gggccctcttgccagcctcc

SEQ ID NO: 1197903 - DNA, 18 bp, Homo sapiens
gggccctctttccctgcg

SEQ ID NO: 1197904 - DNA, 12 bp, Homo sapiens
gggccctgagcc

SEQ ID NO: 1197905 - DNA, 22 bp, Homo sapiens
gggccctgagctcggtggaccc

SEQ ID NO: 1197906 - DNA, 15 bp, Homo sapiens
gggccctgcagaggg

SEQ ID NO: 1197907 - DNA, 18 bp, Homo sapiens
gggccctgcaggctgcag

SEQ ID NO: 1197908 - DNA, 19 bp, Homo sapiens
gggccctgccccagcccct

SEQ ID NO: 1197909 - DNA, 18 bp, Homo sapiens
gggccctgccccaggcct

SEQ ID NO: 1197910 - DNA, 22 bp, Homo sapiens
gggccctgcccctaggatgctg

SEQ ID NO: 1197911 - DNA, 19 bp, Homo sapiens
gggccctgccctggcaggg

SEQ ID NO: 1197912 - DNA, 13 bp, Homo sapiens
gggccctggaaga

SEQ ID NO: 1197913 - DNA, 14 bp, Homo sapiens
gggccctggccagg

SEQ ID NO: 1197914 - DNA, 12 bp, Homo sapiens
gggccctgggca

SEQ ID NO: 1197915 - DNA, 18 bp, Homo sapiens
gggccctgggcctcagtt

SEQ ID NO: 1197916 - DNA, 13 bp, Homo sapiens
gggccctgggctg

SEQ ID NO: 1197917 - DNA, 13 bp, Homo sapiens
gggccctgtacag

SEQ ID NO: 1197918 - DNA, 12 bp, Homo sapiens
gggcccttcccc

SEQ ID NO: 1197919 - DNA, 20 bp, Homo sapiens
gggcccttgggccacgctct

SEQ ID NO: 1197920 - DNA, 15 bp, Homo sapiens
gggcccttggggcct

SEQ ID NO: 1197921 - DNA, 16 bp, Homo sapiens
gggcccttggggcctg

SEQ ID NO: 1197922 - DNA, 20 bp, Homo sapiens
gggcccttggggcctggctt

SEQ ID NO: 1197923 - DNA, 22 bp, Homo sapiens
gggcccttgtgctcctctcgca

SEQ ID NO: 1197924 - DNA, 13 bp, Homo sapiens
gggccgaaagaga

SEQ ID NO: 1197925 - DNA, 18 bp, Homo sapiens
gggccgaatcccctccct

SEQ ID NO: 1197926 - DNA, 17 bp, Homo sapiens
gggccgaccctgcggcc

SEQ ID NO: 1197927 - DNA, 17 bp, Homo sapiens
gggccgcaggagggagg

SEQ ID NO: 1197928 - DNA, 13 bp, Homo sapiens
gggccgcctgccc

SEQ ID NO: 1197929 - DNA, 15 bp, Homo sapiens
gggccgcctgccctg

SEQ ID NO: 1197930 - DNA, 16 bp, Homo sapiens
gggccgcctgccctgc

SEQ ID NO: 1197931 - DNA, 19 bp, Homo sapiens
gggccgcctgccctgcctt

SEQ ID NO: 1197932 - DNA, 21 bp, Homo sapiens
gggccgcctgccctgccttgc

SEQ ID NO: 1197933 - DNA, 13 bp, Homo sapiens
gggccgcctgcct

SEQ ID NO: 1197934 - DNA, 17 bp, Homo sapiens
gggccgcctgccttagc

SEQ ID NO: 1197935 - DNA, 12 bp, Homo sapiens
gggccgctgcca

SEQ ID NO: 1197936 - DNA, 15 bp, Homo sapiens
gggccggcgaggggg

SEQ ID NO: 1197937 - DNA, 17 bp, Homo sapiens
gggccggcggctctgag

SEQ ID NO: 1197938 - DNA, 23 bp, Homo sapiens
gggccgggcaggtcctgcccatg

SEQ ID NO: 1197939 - DNA, 20 bp, Homo sapiens
gggccgggcgcggtggctca

SEQ ID NO: 1197940 - DNA, 13 bp, Homo sapiens
gggccgggctgta

SEQ ID NO: 1197941 - DNA, 16 bp, Homo sapiens
gggccggtgaggggag

SEQ ID NO: 1197942 - DNA, 17 bp, Homo sapiens
gggccggtgaggggagg

SEQ ID NO: 1197943 - DNA, 22 bp, Homo sapiens
gggccggtgaggggaggggcct

SEQ ID NO: 1197944 - DNA, 12 bp, Homo sapiens
gggccggtgctg

SEQ ID NO: 1197945 - DNA, 13 bp, Homo sapiens
gggccggtgctgg

SEQ ID NO: 1197946 - DNA, 23 bp, Homo sapiens
gggccggtgctgggggcacagct

SEQ ID NO: 1197947 - DNA, 18 bp, Homo sapiens
gggccgtaccccaccctc

SEQ ID NO: 1197948 - DNA, 18 bp, Homo sapiens
gggccgtgagggcaagag

SEQ ID NO: 1197949 - DNA, 14 bp, Homo sapiens
gggccgtgcccagg

SEQ ID NO: 1197950 - DNA, 15 bp, Homo sapiens
gggccgtgcccttgc

SEQ ID NO: 1197951 - DNA, 20 bp, Homo sapiens
gggccgtggcttgggctggt

SEQ ID NO: 1197952 - DNA, 20 bp, Homo sapiens
gggcctagatccacacacag

SEQ ID NO: 1197953 - DNA, 21 bp, Homo sapiens
gggcctagcgatctctcctgg

SEQ ID NO: 1197954 - DNA, 18 bp, Homo sapiens
gggcctcaatctaaggcc

SEQ ID NO: 1197955 - DNA, 22 bp, Homo sapiens
ctgccccaggccggagcccaga

SEQ ID NO: 1197956 - DNA, 23 bp, Homo sapiens
ctgccccaggccggagcccagat

SEQ ID NO: 1197957 - DNA, 15 bp, Homo sapiens
ctgccccaggcctgg

SEQ ID NO: 1197958 - DNA, 16 bp, Homo sapiens
ctgccccaggcctgga

SEQ ID NO: 1197959 - DNA, 17 bp, Homo sapiens
ctgccccaggcctggac

SEQ ID NO: 1197960 - DNA, 11 bp, Homo sapiens
ctgccccaggg

SEQ ID NO: 1197961 - DNA, 19 bp, Homo sapiens
ctgccccagggctcccggc

SEQ ID NO: 1197962 - DNA, 13 bp, Homo sapiens
ctgccccatcctc

SEQ ID NO: 1197963 - DNA, 21 bp, Homo sapiens
ctgccccatcctccagcaggg

SEQ ID NO: 1197964 - DNA, 13 bp, Homo sapiens
ctgcccccaagtc

SEQ ID NO: 1197965 - DNA, 15 bp, Homo sapiens
ctgcccccaccccgg

SEQ ID NO: 1197966 - DNA, 12 bp, Homo sapiens
ctgcccccacga

SEQ ID NO: 1197967 - DNA, 13 bp, Homo sapiens
ctgcccccactgt

SEQ ID NO: 1197968 - DNA, 23 bp, Homo sapiens
ctgcccccactgtccccctaccc

SEQ ID NO: 1197969 - DNA, 16 bp, Homo sapiens
ctgcccccacttcctg

SEQ ID NO: 1197970 - DNA, 20 bp, Homo sapiens
ctgcccccagaaagcctcct

SEQ ID NO: 1197971 - DNA, 22 bp, Homo sapiens
ctgcccccagaaagcctcctgc

SEQ ID NO: 1197972 - DNA, 14 bp, Homo sapiens
ctgcccccagccca

SEQ ID NO: 1197973 - DNA, 14 bp, Homo sapiens
ctgcccccatcacc

SEQ ID NO: 1197974 - DNA, 17 bp, Homo sapiens
ctgcccccatcacctct

SEQ ID NO: 1197975 - DNA, 22 bp, Homo sapiens
ctgcccccatctccccaggcct

SEQ ID NO: 1197976 - DNA, 12 bp, Homo sapiens
ctgccccccagc

SEQ ID NO: 1197977 - DNA, 13 bp, Homo sapiens
ctgccccccagcc

SEQ ID NO: 1197978 - DNA, 14 bp, Homo sapiens
ctgccccccagggc

SEQ ID NO: 1197979 - DNA, 15 bp, Homo sapiens
ctgccccccagggct

SEQ ID NO: 1197980 - DNA, 16 bp, Homo sapiens
ctgccccccagggcta

SEQ ID NO: 1197981 - DNA, 18 bp, Homo sapiens
ctgccccccgaggctgct

SEQ ID NO: 1197982 - DNA, 15 bp, Homo sapiens
ctgccccctccccca

SEQ ID NO: 1197983 - DNA, 14 bp, Homo sapiens
ctgccccctgggct

SEQ ID NO: 1197984 - DNA, 12 bp, Homo sapiens
ctgccccctggt

SEQ ID NO: 1197985 - DNA, 14 bp, Homo sapiens
ctgccccctggtgg

SEQ ID NO: 1197986 - DNA, 19 bp, Homo sapiens
ctgcccccttctcccacac

SEQ ID NO: 1197987 - DNA, 23 bp, Homo sapiens
ctgccccgcagacggtctgtgtg

SEQ ID NO: 1197988 - DNA, 11 bp, Homo sapiens
ctgccccgccc

SEQ ID NO: 1197989 - DNA, 15 bp, Homo sapiens
ctgccccgcccagct

SEQ ID NO: 1197990 - DNA, 16 bp, Homo sapiens
ctgccccgcccagctg

SEQ ID NO: 1197991 - DNA, 18 bp, Homo sapiens
ctgccccgcccccagtcc

SEQ ID NO: 1197992 - DNA, 23 bp, Homo sapiens
ctgccccgcccccagtccccacc

SEQ ID NO: 1197993 - DNA, 16 bp, Homo sapiens
ctgccccgccccccag

SEQ ID NO: 1197994 - DNA, 18 bp, Homo sapiens
ctgccccgccccccagag

SEQ ID NO: 1197995 - DNA, 22 bp, Homo sapiens
ctgccccgccccccagagccag

SEQ ID NO: 1197996 - DNA, 23 bp, Homo sapiens
ctgccccgccttcgtgtgctgct

SEQ ID NO: 1197997 - DNA, 13 bp, Homo sapiens
ctgccccggacct

SEQ ID NO: 1197998 - DNA, 17 bp, Homo sapiens
ctgccccggacctacct

SEQ ID NO: 1197999 - DNA, 22 bp, Homo sapiens
ctgccccggcccctccccctga

SEQ ID NO: 1198000 - DNA, 17 bp, Homo sapiens
ctgccccgtagagaatg

SEQ ID NO: 1198001 - DNA, 18 bp, Homo sapiens
ctgccccgtcaccatctc

SEQ ID NO: 1198002 - DNA, 21 bp, Homo sapiens
ctgccccgtcaccatctcagg

SEQ ID NO: 1198003 - DNA, 23 bp, Homo sapiens
ctgccccgtcaccatctcaggcc

SEQ ID NO: 1198004 - DNA, 20 bp, Homo sapiens
ctgccccgttccctgtcaga

SEQ ID NO: 1198005 - DNA, 20 bp, Homo sapiens
ctgcccctaatctctgtagg

SEQ ID NO: 1198006 - DNA, 20 bp, Homo sapiens
ctgcccctaggatgctgcag

SEQ ID NO: 1198007 - DNA, 13 bp, Homo sapiens
ctgcccctcaggg

SEQ ID NO: 1198008 - DNA, 20 bp, Homo sapiens
ctgcccctcagggggccagc

SEQ ID NO: 1198009 - DNA, 23 bp, Homo sapiens
ctgcccctcagggggccagctgg

SEQ ID NO: 1198010 - DNA, 15 bp, Homo sapiens
ctgcccctccctcag

SEQ ID NO: 1198011 - DNA, 18 bp, Homo sapiens
ctgcccctccctcaggga

SEQ ID NO: 1198012 - DNA, 13 bp, Homo sapiens
ctgcccctccctt

SEQ ID NO: 1198013 - DNA, 13 bp, Homo sapiens
ctgcccctcctgg

SEQ ID NO: 1198014 - DNA, 14 bp, Homo sapiens
ctgcccctcctgga

SEQ ID NO: 1198015 - DNA, 18 bp, Homo sapiens
ctgcccctcgcacacagg

SEQ ID NO: 1198016 - DNA, 21 bp, Homo sapiens
ctgcccctcgcacacagggct

SEQ ID NO: 1198017 - DNA, 11 bp, Homo sapiens
ctgcccctgcc

SEQ ID NO: 1198018 - DNA, 13 bp, Homo sapiens
ctgcccctgcccc

SEQ ID NO: 1198019 - DNA, 14 bp, Homo sapiens
ctgcccctgcctga

SEQ ID NO: 1198020 - DNA, 18 bp, Homo sapiens
ctgcccctgcctgacagc

SEQ ID NO: 1198021 - DNA, 21 bp, Homo sapiens
ctgcccctggtgccctgagac

SEQ ID NO: 1198022 - DNA, 15 bp, Homo sapiens
ctgcccctgtaaggt

SEQ ID NO: 1198023 - DNA, 15 bp, Homo sapiens
ctgcccctgtccgga

SEQ ID NO: 1198024 - DNA, 13 bp, Homo sapiens
ctgcccctgttga

SEQ ID NO: 1198025 - DNA, 22 bp, Homo sapiens
ctgccccttcctttaaaaaact

SEQ ID NO: 1198026 - DNA, 17 bp, Homo sapiens
ctgccccttgcaagcca

SEQ ID NO: 1198027 - DNA, 18 bp, Homo sapiens
ctgccccttgcaagccat

SEQ ID NO: 1198028 - DNA, 13 bp, Homo sapiens
ctgcccgagctgg

SEQ ID NO: 1198029 - DNA, 21 bp, Homo sapiens
ctgcccgagctggtgcattac

SEQ ID NO: 1198030 - DNA, 13 bp, Homo sapiens
ctgcccgcagagc

SEQ ID NO: 1198031 - DNA, 15 bp, Homo sapiens
ctgcccgccacatgg

SEQ ID NO: 1198032 - DNA, 23 bp, Homo sapiens
ctgcccgcctcggtctcccaaag

SEQ ID NO: 1198033 - DNA, 14 bp, Homo sapiens
ctgcccgctcccaa

SEQ ID NO: 1198034 - DNA, 21 bp, Homo sapiens
ctgcccgctcccaacccccct

SEQ ID NO: 1198035 - DNA, 15 bp, Homo sapiens
ctgcccgctgcaatg

SEQ ID NO: 1198036 - DNA, 21 bp, Homo sapiens
ctgcccgctgcaatgcctaga

SEQ ID NO: 1198037 - DNA, 13 bp, Homo sapiens
ctgcccggggagc

SEQ ID NO: 1198038 - DNA, 14 bp, Homo sapiens
ctgcccggggagct

SEQ ID NO: 1198039 - DNA, 19 bp, Homo sapiens
ctgcccggggagctgcaga

SEQ ID NO: 1198040 - DNA, 13 bp, Homo sapiens
ctgcccggggtgg

SEQ ID NO: 1198041 - DNA, 22 bp, Homo sapiens
ctgcccggtggtttgccatgtc

SEQ ID NO: 1198042 - DNA, 23 bp, Homo sapiens
ctgcccggtggtttgccatgtcg

SEQ ID NO: 1198043 - DNA, 19 bp, Homo sapiens
ctgcccggttgccatggag

SEQ ID NO: 1198044 - DNA, 16 bp, Homo sapiens
ctgcccgtcttcagcc

SEQ ID NO: 1198045 - DNA, 18 bp, Homo sapiens
ctgcccgtcttcagccta

SEQ ID NO: 1198046 - DNA, 22 bp, Homo sapiens
ctgccctaactctgcccaccct

SEQ ID NO: 1198047 - DNA, 19 bp, Homo sapiens
ctgccctaagcccccaggg

SEQ ID NO: 1198048 - DNA, 18 bp, Homo sapiens
ctgccctacagaggtctc

SEQ ID NO: 1198049 - DNA, 21 bp, Homo sapiens
ctgccctagcgctctcttcca

SEQ ID NO: 1198050 - DNA, 16 bp, Homo sapiens
ctgccctagctgaccc

SEQ ID NO: 1198051 - DNA, 17 bp, Homo sapiens
ctgccctagctgacccc

SEQ ID NO: 1198052 - DNA, 21 bp, Homo sapiens
ctgccctatgggcctgccggg

SEQ ID NO: 1198053 - DNA, 22 bp, Homo sapiens
ctgccctcactccctctgcaga

SEQ ID NO: 1198054 - DNA, 20 bp, Homo sapiens
ctgccctcagggactgcacc

SEQ ID NO: 1198055 - DNA, 20 bp, Homo sapiens
ctgccctcattactgggcct

SEQ ID NO: 1198056 - DNA, 23 bp, Homo sapiens
ctgccctcccatgttgcatgcct

SEQ ID NO: 1198057 - DNA, 14 bp, Homo sapiens
ctgccctcccctct

SEQ ID NO: 1198058 - DNA, 15 bp, Homo sapiens
ctgccctcccgcacc

SEQ ID NO: 1198059 - DNA, 22 bp, Homo sapiens
ctgccctcgtctccctggccac

SEQ ID NO: 1198060 - DNA, 23 bp, Homo sapiens
ctgccctcgtggccagcccggct

SEQ ID NO: 1198061 - DNA, 14 bp, Homo sapiens
ctgccctctagagc

SEQ ID NO: 1198062 - DNA, 12 bp, Homo sapiens
ctgccctctgct

SEQ ID NO: 1198063 - DNA, 15 bp, Homo sapiens
ctgccctctgctctg

SEQ ID NO: 1198064 - DNA, 15 bp, Homo sapiens
ctgccctctgctgct

SEQ ID NO: 1198065 - DNA, 17 bp, Homo sapiens
ctgccctctgctgctgc

SEQ ID NO: 1198066 - DNA, 15 bp, Homo sapiens
ctgccctctgggtcc

SEQ ID NO: 1198067 - DNA, 16 bp, Homo sapiens
ctgccctgccactttg

SEQ ID NO: 1198068 - DNA, 14 bp, Homo sapiens
ctgccctgcccaag

SEQ ID NO: 1198069 - DNA, 22 bp, Homo sapiens
ctgccctgcccatactgagcct

SEQ ID NO: 1198070 - DNA, 23 bp, Homo sapiens
ctgccctgcccatactgagcctg

SEQ ID NO: 1198071 - DNA, 14 bp, Homo sapiens
ctgccctgcctccc

SEQ ID NO: 1198072 - DNA, 16 bp, Homo sapiens
ctgccctgcctgaggg

SEQ ID NO: 1198073 - DNA, 15 bp, Homo sapiens
ctgccctgcctgccc

SEQ ID NO: 1198074 - DNA, 16 bp, Homo sapiens
ctgccctgcctgccca

SEQ ID NO: 1198075 - DNA, 16 bp, Homo sapiens
ctgccctgcctgggcc

SEQ ID NO: 1198076 - DNA, 18 bp, Homo sapiens
ctgccctgcctgggcctt

SEQ ID NO: 1198077 - DNA, 20 bp, Homo sapiens
ctgccctgccttgccgctcc

SEQ ID NO: 1198078 - DNA, 22 bp, Homo sapiens
ctgccctgcgaagtggctctca

SEQ ID NO: 1198079 - DNA, 22 bp, Homo sapiens
ctgccctgctgagtcccaggct

SEQ ID NO: 1198080 - DNA, 18 bp, Homo sapiens
gggcctcacctgcccctc

SEQ ID NO: 1198081 - DNA, 15 bp, Homo sapiens
gggcctcagagcctg

SEQ ID NO: 1198082 - DNA, 14 bp, Homo sapiens
gggcctcagcctgg

SEQ ID NO: 1198083 - DNA, 15 bp, Homo sapiens
gggcctcagcctggg

SEQ ID NO: 1198084 - DNA, 16 bp, Homo sapiens
gggcctcagcctgggg

SEQ ID NO: 1198085 - DNA, 17 bp, Homo sapiens
gggcctcatctcacctc

SEQ ID NO: 1198086 - DNA, 12 bp, Homo sapiens
gggcctccaggg

SEQ ID NO: 1198087 - DNA, 13 bp, Homo sapiens
gggcctccagggc

SEQ ID NO: 1198088 - DNA, 15 bp, Homo sapiens
gggcctcctcagcct

SEQ ID NO: 1198089 - DNA, 15 bp, Homo sapiens
gggcctcctggggga

SEQ ID NO: 1198090 - DNA, 17 bp, Homo sapiens
gggcctcggagcctcat

SEQ ID NO: 1198091 - DNA, 22 bp, Homo sapiens
gggcctcggtgtggagaagcgg

SEQ ID NO: 1198092 - DNA, 23 bp, Homo sapiens
gggctcattttctacgtcatgta

SEQ ID NO: 1198093 - DNA, 17 bp, Homo sapiens
gggctccatgcctctgg

SEQ ID NO: 1198094 - DNA, 14 bp, Homo sapiens
gggctcccagctcc

SEQ ID NO: 1198095 - DNA, 13 bp, Homo sapiens
gggctcccagggg

SEQ ID NO: 1198096 - DNA, 13 bp, Homo sapiens
gggctcccctctt

SEQ ID NO: 1198097 - DNA, 16 bp, Homo sapiens
gggctcccctcttcct

SEQ ID NO: 1198098 - DNA, 20 bp, Homo sapiens
gggctcccgggtccttggcc

SEQ ID NO: 1198099 - DNA, 17 bp, Homo sapiens
gggctccctcctctggc

SEQ ID NO: 1198100 - DNA, 21 bp, Homo sapiens
gggctccctgtaacctcttca

SEQ ID NO: 1198101 - DNA, 13 bp, Homo sapiens
gggctcccttcat

SEQ ID NO: 1198102 - DNA, 18 bp, Homo sapiens
gggctccgggtcactgct

SEQ ID NO: 1198103 - DNA, 14 bp, Homo sapiens
gggctcctcccagc

SEQ ID NO: 1198104 - DNA, 16 bp, Homo sapiens
gggctcctcctgccct

SEQ ID NO: 1198105 - DNA, 18 bp, Homo sapiens
gggctcctgcacttactt

SEQ ID NO: 1198106 - DNA, 14 bp, Homo sapiens
gggctcctgcaggc

SEQ ID NO: 1198107 - DNA, 23 bp, Homo sapiens
gggctcctggaaaggctcagtct

SEQ ID NO: 1198108 - DNA, 13 bp, Homo sapiens
gggctcctggctg

SEQ ID NO: 1198109 - DNA, 14 bp, Homo sapiens
gggctcctggctgc

SEQ ID NO: 1198110 - DNA, 17 bp, Homo sapiens
gggctcctggctgccag

SEQ ID NO: 1198111 - DNA, 20 bp, Homo sapiens
gggctcctggctgccaggcg

SEQ ID NO: 1198112 - DNA, 12 bp, Homo sapiens
gggctcctgggt

SEQ ID NO: 1198113 - DNA, 22 bp, Homo sapiens
gggctcctgggttggagggaac

SEQ ID NO: 1198114 - DNA, 15 bp, Homo sapiens
gggctccttcccctg

SEQ ID NO: 1198115 - DNA, 14 bp, Homo sapiens
gggctcgcactgcc

SEQ ID NO: 1198116 - DNA, 15 bp, Homo sapiens
gggctcgcactgccc

SEQ ID NO: 1198117 - DNA, 18 bp, Homo sapiens
gggctcgccccacccagg

SEQ ID NO: 1198118 - DNA, 23 bp, Homo sapiens
gggctcgccgtgtctcagcctct

SEQ ID NO: 1198119 - DNA, 14 bp, Homo sapiens
gggctcggggaggc

SEQ ID NO: 1198120 - DNA, 17 bp, Homo sapiens
gggctcgtggccttccc

SEQ ID NO: 1198121 - DNA, 16 bp, Homo sapiens
gggctctatgcctgca

SEQ ID NO: 1198122 - DNA, 19 bp, Homo sapiens
gggctctccaaaggggctg

SEQ ID NO: 1198123 - DNA, 21 bp, Homo sapiens
gggctctccaaaggggctgct

SEQ ID NO: 1198124 - DNA, 23 bp, Homo sapiens
gggctctccaaaggggctgctgg

SEQ ID NO: 1198125 - DNA, 20 bp, Homo sapiens
gggctctctcacccagcctg

SEQ ID NO: 1198126 - DNA, 21 bp, Homo sapiens
gggctctctcacccagcctgg

SEQ ID NO: 1198127 - DNA, 21 bp, Homo sapiens
gggctctctctagctccccaa

SEQ ID NO: 1198128 - DNA, 13 bp, Homo sapiens
gggctctctgacc

SEQ ID NO: 1198129 - DNA, 15 bp, Homo sapiens
gggctctgaacacac

SEQ ID NO: 1198130 - DNA, 20 bp, Homo sapiens
gggctctgaacacacacgcc

SEQ ID NO: 1198131 - DNA, 20 bp, Homo sapiens
gggctctgcaattcccctct

SEQ ID NO: 1198132 - DNA, 23 bp, Homo sapiens
gggctctgcaattcccctctgct

SEQ ID NO: 1198133 - DNA, 16 bp, Homo sapiens
gggctctgcaggccac

SEQ ID NO: 1198134 - DNA, 21 bp, Homo sapiens
gggctctgccaatgtgggctg

SEQ ID NO: 1198135 - DNA, 16 bp, Homo sapiens
gggctctgcccacctg

SEQ ID NO: 1198136 - DNA, 13 bp, Homo sapiens
gggctctgcccca

SEQ ID NO: 1198137 - DNA, 18 bp, Homo sapiens
gggctctgccccaggccc

SEQ ID NO: 1198138 - DNA, 17 bp, Homo sapiens
gggctctggccaccctg

SEQ ID NO: 1198139 - DNA, 16 bp, Homo sapiens
gggctctgtgttagga

SEQ ID NO: 1198140 - DNA, 22 bp, Homo sapiens
gggctcttctcaggggctctag

SEQ ID NO: 1198141 - DNA, 19 bp, Homo sapiens
gggctctttctctctgctg

SEQ ID NO: 1198142 - DNA, 22 bp, Homo sapiens
gggctctttctctctgctgagc

SEQ ID NO: 1198143 - DNA, 19 bp, Homo sapiens
gggctgaacatgcctgcca

SEQ ID NO: 1198144 - DNA, 18 bp, Homo sapiens
gggctgaacggggagaaa

SEQ ID NO: 1198145 - DNA, 17 bp, Homo sapiens
gggctgaatcttctgga

SEQ ID NO: 1198146 - DNA, 20 bp, Homo sapiens
gggctgacacctaccatgct

SEQ ID NO: 1198147 - DNA, 13 bp, Homo sapiens
gggctgactgggc

SEQ ID NO: 1198148 - DNA, 19 bp, Homo sapiens
gggctgagaggaagcaaga

SEQ ID NO: 1198149 - DNA, 12 bp, Homo sapiens
gggctgagcccc

SEQ ID NO: 1198150 - DNA, 15 bp, Homo sapiens
gggctgagcccctac

SEQ ID NO: 1198151 - DNA, 13 bp, Homo sapiens
gggctgagccctg

SEQ ID NO: 1198152 - DNA, 20 bp, Homo sapiens
gggctgagcgtggaaggggg

SEQ ID NO: 1198153 - DNA, 20 bp, Homo sapiens
gggctgaggagcagccagga

SEQ ID NO: 1198154 - DNA, 18 bp, Homo sapiens
gggctgaggccagagtca

SEQ ID NO: 1198155 - DNA, 13 bp, Homo sapiens
gggctgagggagc

SEQ ID NO: 1198156 - DNA, 13 bp, Homo sapiens
gggctgagggcct

SEQ ID NO: 1198157 - DNA, 16 bp, Homo sapiens
gggctgagggcctgct

SEQ ID NO: 1198158 - DNA, 18 bp, Homo sapiens
gggctgagggcctgctgg

SEQ ID NO: 1198159 - DNA, 21 bp, Homo sapiens
gggctgatggcctggctgcct

SEQ ID NO: 1198160 - DNA, 17 bp, Homo sapiens
gggctgcaaaactggaa

SEQ ID NO: 1198161 - DNA, 14 bp, Homo sapiens
gggctgcagcagcc

SEQ ID NO: 1198162 - DNA, 14 bp, Homo sapiens
gggctgcaggtgct

SEQ ID NO: 1198163 - DNA, 20 bp, Homo sapiens
gggctgcatgatgtttgccc

SEQ ID NO: 1198164 - DNA, 19 bp, Homo sapiens
gggctgccaccagcccccg

SEQ ID NO: 1198165 - DNA, 19 bp, Homo sapiens
gggctgcccctcgcacaca

SEQ ID NO: 1198166 - DNA, 20 bp, Homo sapiens
gggctgcccctcgcacacag

SEQ ID NO: 1198167 - DNA, 23 bp, Homo sapiens
gggctgcccctcgcacacagggc

SEQ ID NO: 1198168 - DNA, 14 bp, Homo sapiens
gggctgccctgaga

SEQ ID NO: 1198169 - DNA, 13 bp, Homo sapiens
gggctgccctgcc

SEQ ID NO: 1198170 - DNA, 14 bp, Homo sapiens
gggctgccctggtg

SEQ ID NO: 1198171 - DNA, 13 bp, Homo sapiens
gggctgcctgccc

SEQ ID NO: 1198172 - DNA, 13 bp, Homo sapiens
gggctgcctgggc

SEQ ID NO: 1198173 - DNA, 19 bp, Homo sapiens
gggctgcctgggctgttgg

SEQ ID NO: 1198174 - DNA, 17 bp, Homo sapiens
gggctgccttctggcct

SEQ ID NO: 1198175 - DNA, 14 bp, Homo sapiens
gggctgcctttgtg

SEQ ID NO: 1198176 - DNA, 24 bp, Homo sapiens
gggctgcctttgtggtgggcgctg

SEQ ID NO: 1198177 - DNA, 14 bp, Homo sapiens
gggctgcgctagca

SEQ ID NO: 1198178 - DNA, 12 bp, Homo sapiens
gggctgctcacc

SEQ ID NO: 1198179 - DNA, 15 bp, Homo sapiens
gggctgctcccctaa

SEQ ID NO: 1198180 - DNA, 18 bp, Homo sapiens
gggctgctcctccagggc

SEQ ID NO: 1198181 - DNA, 13 bp, Homo sapiens
gggctgctgcctt

SEQ ID NO: 1198182 - DNA, 21 bp, Homo sapiens
gggctgctgcttctgctccag

SEQ ID NO: 1198183 - DNA, 13 bp, Homo sapiens
gggctgctgggcg

SEQ ID NO: 1198184 - DNA, 17 bp, Homo sapiens
gggctgcttcctcctgg

SEQ ID NO: 1198185 - DNA, 18 bp, Homo sapiens
gggctgcttcctcctgga

SEQ ID NO: 1198186 - DNA, 20 bp, Homo sapiens
gggctgcttcctcctggaaa

SEQ ID NO: 1198187 - DNA, 16 bp, Homo sapiens
gggctggaggcccagg

SEQ ID NO: 1198188 - DNA, 15 bp, Homo sapiens
gggctggaggtgctg

SEQ ID NO: 1198189 - DNA, 17 bp, Homo sapiens
gggctggagtgcgctct

SEQ ID NO: 1198190 - DNA, 14 bp, Homo sapiens
gggctggatggaca

SEQ ID NO: 1198191 - DNA, 17 bp, Homo sapiens
gggctggatggacagac

SEQ ID NO: 1198192 - DNA, 16 bp, Homo sapiens
gggctggccctgtgca

SEQ ID NO: 1198193 - DNA, 21 bp, Homo sapiens
gggctggccctgtgcagacct

SEQ ID NO: 1198194 - DNA, 19 bp, Homo sapiens
gggctggcgcttggatctg

SEQ ID NO: 1198195 - DNA, 22 bp, Homo sapiens
gggctggcgcttggatctgggg

SEQ ID NO: 1198196 - DNA, 23 bp, Homo sapiens
gggctggcgcttggatctggggt

SEQ ID NO: 1198197 - DNA, 23 bp, Homo sapiens
gggctggctgcttgcagccagga

SEQ ID NO: 1198198 - DNA, 20 bp, Homo sapiens
gggctgggagaagaaataga

SEQ ID NO: 1198199 - DNA, 16 bp, Homo sapiens
gggctgggagctctgc

SEQ ID NO: 1198200 - DNA, 13 bp, Homo sapiens
gggctgggcaccg

SEQ ID NO: 1198201 - DNA, 13 bp, Homo sapiens
gggctgggcacct

SEQ ID NO: 1198202 - DNA, 12 bp, Homo sapiens
gggctgggcagc

SEQ ID NO: 1198203 - DNA, 13 bp, Homo sapiens
gggctgggcagcc

SEQ ID NO: 1198204 - DNA, 23 bp, Homo sapiens
gggctgggcatcccagcttgccc

SEQ ID NO: 1198205 - DNA, 14 bp, Homo sapiens
gggctgggcccaca

SEQ ID NO: 1198206 - DNA, 15 bp, Homo sapiens
gggctgggcccacag

SEQ ID NO: 1198207 - DNA, 13 bp, Homo sapiens
gggctgggctaga

SEQ ID NO: 1198208 - DNA, 13 bp, Homo sapiens
gggctggggaaga

SEQ ID NO: 1198209 - DNA, 17 bp, Homo sapiens
gggctggggactgggga

SEQ ID NO: 1198210 - DNA, 15 bp, Homo sapiens
gggctggggaggagg

SEQ ID NO: 1198211 - DNA, 11 bp, Homo sapiens
gggctggggca

SEQ ID NO: 1198212 - DNA, 16 bp, Homo sapiens
ctgccctgctgccaca

SEQ ID NO: 1198213 - DNA, 21 bp, Homo sapiens
ctgccctgctgccacagcaag

SEQ ID NO: 1198214 - DNA, 21 bp, Homo sapiens
ctgccctgctgccgcctccca

SEQ ID NO: 1198215 - DNA, 17 bp, Homo sapiens
ctgccctggcagcagca

SEQ ID NO: 1198216 - DNA, 12 bp, Homo sapiens
ctgccctggccc

SEQ ID NO: 1198217 - DNA, 14 bp, Homo sapiens
ctgccctggccctg

SEQ ID NO: 1198218 - DNA, 17 bp, Homo sapiens
ctgccctggccctgagg

SEQ ID NO: 1198219 - DNA, 18 bp, Homo sapiens
ctgccctggccctgaggt

SEQ ID NO: 1198220 - DNA, 23 bp, Homo sapiens
ctgccctggccctgaggtgtggg

SEQ ID NO: 1198221 - DNA, 16 bp, Homo sapiens
ctgccctggctgctgc

SEQ ID NO: 1198222 - DNA, 17 bp, Homo sapiens
ctgccctggctgctgcc

SEQ ID NO: 1198223 - DNA, 23 bp, Homo sapiens
ctgccctggtccagggaagctgg

SEQ ID NO: 1198224 - DNA, 13 bp, Homo sapiens
ctgccctggtgct

SEQ ID NO: 1198225 - DNA, 15 bp, Homo sapiens
ctgccctggtgctgc

SEQ ID NO: 1198226 - DNA, 20 bp, Homo sapiens
ctgccctggtgctgccacac

SEQ ID NO: 1198227 - DNA, 21 bp, Homo sapiens
ctgccctgtaccccagcactt

SEQ ID NO: 1198228 - DNA, 13 bp, Homo sapiens
ctgccctgtccaa

SEQ ID NO: 1198229 - DNA, 15 bp, Homo sapiens
ctgccctgtccctgt

SEQ ID NO: 1198230 - DNA, 18 bp, Homo sapiens
ctgccctgtccctgtccc

SEQ ID NO: 1198231 - DNA, 17 bp, Homo sapiens
ctgccctgtgccgcact

SEQ ID NO: 1198232 - DNA, 18 bp, Homo sapiens
ctgccctgtgccgcactc

SEQ ID NO: 1198233 - DNA, 20 bp, Homo sapiens
ctgccctgtgccgcactctg

SEQ ID NO: 1198234 - DNA, 21 bp, Homo sapiens
ctgccctgtgccgcactctgg

SEQ ID NO: 1198235 - DNA, 12 bp, Homo sapiens
ctgccctgtgta

SEQ ID NO: 1198236 - DNA, 19 bp, Homo sapiens
ctgccctgttgtgtataga

SEQ ID NO: 1198237 - DNA, 20 bp, Homo sapiens
ctgcccttccaggtgggtgt

SEQ ID NO: 1198238 - DNA, 15 bp, Homo sapiens
ctgcccttccccctg

SEQ ID NO: 1198239 - DNA, 13 bp, Homo sapiens
ctgcccttcccct

SEQ ID NO: 1198240 - DNA, 14 bp, Homo sapiens
ctgcccttcccctc

SEQ ID NO: 1198241 - DNA, 19 bp, Homo sapiens
ctgcccttcccctcccgac

SEQ ID NO: 1198242 - DNA, 11 bp, Homo sapiens
ctgcccttcct

SEQ ID NO: 1198243 - DNA, 14 bp, Homo sapiens
ctgcccttcctcag

SEQ ID NO: 1198244 - DNA, 15 bp, Homo sapiens
ctgcccttcctcagg

SEQ ID NO: 1198245 - DNA, 21 bp, Homo sapiens
ctgcccttcctcagggcccct

SEQ ID NO: 1198246 - DNA, 14 bp, Homo sapiens
ctgcccttctcaag

SEQ ID NO: 1198247 - DNA, 18 bp, Homo sapiens
ctgcccttctctgcctcc

SEQ ID NO: 1198248 - DNA, 22 bp, Homo sapiens
ctgcccttgaaccccctccctg

SEQ ID NO: 1198249 - DNA, 16 bp, Homo sapiens
ctgcccttgatcagcc

SEQ ID NO: 1198250 - DNA, 14 bp, Homo sapiens
ctgcccttgctgcc

SEQ ID NO: 1198251 - DNA, 16 bp, Homo sapiens
ctgcccttggcaccac

SEQ ID NO: 1198252 - DNA, 23 bp, Homo sapiens
ctgcccttggcaccaccagggtg

SEQ ID NO: 1198253 - DNA, 23 bp, Homo sapiens
ctgccctttcccaggtaatttaa

SEQ ID NO: 1198254 - DNA, 17 bp, Homo sapiens
ctgccctttcctaggcc

SEQ ID NO: 1198255 - DNA, 20 bp, Homo sapiens
ctgccctttggccaacaggg

SEQ ID NO: 1198256 - DNA, 17 bp, Homo sapiens
ctgcccttttcaggaag

SEQ ID NO: 1198257 - DNA, 16 bp, Homo sapiens
ctgccgacatcagcat

SEQ ID NO: 1198258 - DNA, 17 bp, Homo sapiens
ctgccgacatccctccc

SEQ ID NO: 1198259 - DNA, 22 bp, Homo sapiens
ctgccgacatccctcccccagc

SEQ ID NO: 1198260 - DNA, 16 bp, Homo sapiens
ctgccgaccagagccc

SEQ ID NO: 1198261 - DNA, 14 bp, Homo sapiens
ctgccgactcctgg

SEQ ID NO: 1198262 - DNA, 15 bp, Homo sapiens
ctgccgactcctggg

SEQ ID NO: 1198263 - DNA, 19 bp, Homo sapiens
ctgccgactcctgggttga

SEQ ID NO: 1198264 - DNA, 15 bp, Homo sapiens
ctgccgacttggaga

SEQ ID NO: 1198265 - DNA, 17 bp, Homo sapiens
ctgccgcaacagttttt

SEQ ID NO: 1198266 - DNA, 18 bp, Homo sapiens
ctgccgcaatacaggaac

SEQ ID NO: 1198267 - DNA, 19 bp, Homo sapiens
ctgccgcaatacaggaacc

SEQ ID NO: 1198268 - DNA, 15 bp, Homo sapiens
ctgccgcaccccaga

SEQ ID NO: 1198269 - DNA, 14 bp, Homo sapiens
ctgccgcccacctc

SEQ ID NO: 1198270 - DNA, 22 bp, Homo sapiens
ctgccgcccacctcgctcccct

SEQ ID NO: 1198271 - DNA, 15 bp, Homo sapiens
ctgccgcctcccagc

SEQ ID NO: 1198272 - DNA, 18 bp, Homo sapiens
ctgccgctacctccctcc

SEQ ID NO: 1198273 - DNA, 15 bp, Homo sapiens
ctgccgctgcaccac

SEQ ID NO: 1198274 - DNA, 17 bp, Homo sapiens
ctgccgctgcaggaaac

SEQ ID NO: 1198275 - DNA, 19 bp, Homo sapiens
ctgccgctgcaggaaacat

SEQ ID NO: 1198276 - DNA, 14 bp, Homo sapiens
ctgccgctgtcaag

SEQ ID NO: 1198277 - DNA, 14 bp, Homo sapiens
ctgccggatctggg

SEQ ID NO: 1198278 - DNA, 17 bp, Homo sapiens
ctgccggatctgggctg

SEQ ID NO: 1198279 - DNA, 20 bp, Homo sapiens
ctgccggctctttccttgct

SEQ ID NO: 1198280 - DNA, 20 bp, Homo sapiens
ctgccgggttctagtctcct

SEQ ID NO: 1198281 - DNA, 15 bp, Homo sapiens
ctgccggtgggaccc

SEQ ID NO: 1198282 - DNA, 18 bp, Homo sapiens
ctgccggtgggaccctgt

SEQ ID NO: 1198283 - DNA, 23 bp, Homo sapiens
ctgccggttcttaaatccatcct

SEQ ID NO: 1198284 - DNA, 16 bp, Homo sapiens
ctgccgtcaccaccac

SEQ ID NO: 1198285 - DNA, 15 bp, Homo sapiens
ctgccgtctctcctg

SEQ ID NO: 1198286 - DNA, 17 bp, Homo sapiens
ctgccgtctctggagcg

SEQ ID NO: 1198287 - DNA, 16 bp, Homo sapiens
ctgccgtgcatggctc

SEQ ID NO: 1198288 - DNA, 18 bp, Homo sapiens
ctgccgtgcatggctcct

SEQ ID NO: 1198289 - DNA, 20 bp, Homo sapiens
ctgccgtgcatggctcctgt

SEQ ID NO: 1198290 - DNA, 20 bp, Homo sapiens
ctgccgtggggccgccgcct

SEQ ID NO: 1198291 - DNA, 19 bp, Homo sapiens
ctgcctaaggccctttgtg

SEQ ID NO: 1198292 - DNA, 16 bp, Homo sapiens
ctgcctaagtggctgc

SEQ ID NO: 1198293 - DNA, 18 bp, Homo sapiens
ctgcctaagtggctgctg

SEQ ID NO: 1198294 - DNA, 19 bp, Homo sapiens
ctgcctaagtggctgctga

SEQ ID NO: 1198295 - DNA, 23 bp, Homo sapiens
ctgcctaattttgccaaaatcct

SEQ ID NO: 1198296 - DNA, 23 bp, Homo sapiens
ctgcctacagaacttcagaaaga

SEQ ID NO: 1198297 - DNA, 13 bp, Homo sapiens
ctgcctacagcca

SEQ ID NO: 1198298 - DNA, 14 bp, Homo sapiens
ctgcctacagccag

SEQ ID NO: 1198299 - DNA, 15 bp, Homo sapiens
ctgcctacagccagg

SEQ ID NO: 1198300 - DNA, 20 bp, Homo sapiens
ctgcctacgttctctttaaa

SEQ ID NO: 1198301 - DNA, 21 bp, Homo sapiens
ctgcctagagtgtagcctaaa

SEQ ID NO: 1198302 - DNA, 22 bp, Homo sapiens
ctgcctagagtgtagcctaaag

SEQ ID NO: 1198303 - DNA, 23 bp, Homo sapiens
ctgcctagatccacgtgtggcct

SEQ ID NO: 1198304 - DNA, 19 bp, Homo sapiens
ctgcctagcatggggtcag

SEQ ID NO: 1198305 - DNA, 20 bp, Homo sapiens
ctgcctagccctccccccag

SEQ ID NO: 1198306 - DNA, 21 bp, Homo sapiens
ctgcctaggaggctggccaag

SEQ ID NO: 1198307 - DNA, 20 bp, Homo sapiens
ctgcctagtcgggacttgta

SEQ ID NO: 1198308 - DNA, 23 bp, Homo sapiens
ctgcctatcccacttcacaggtg

SEQ ID NO: 1198309 - DNA, 11 bp, Homo sapiens
ctgcctcaccc

SEQ ID NO: 1198310 - DNA, 21 bp, Homo sapiens
ctgcctcagacgttgcctgag

SEQ ID NO: 1198311 - DNA, 22 bp, Homo sapiens
ctgcctcagacgttgcctgaga

SEQ ID NO: 1198312 - DNA, 15 bp, Homo sapiens
ctgcctcagccaggc

SEQ ID NO: 1198313 - DNA, 20 bp, Homo sapiens
ctgcctcagccagtggcaca

SEQ ID NO: 1198314 - DNA, 12 bp, Homo sapiens
ctgcctcagcct

SEQ ID NO: 1198315 - DNA, 18 bp, Homo sapiens
ctgcctcagcctcccaag

SEQ ID NO: 1198316 - DNA, 16 bp, Homo sapiens
ctgcctcagccttcca

SEQ ID NO: 1198317 - DNA, 17 bp, Homo sapiens
ctgcctcagccttccaa

SEQ ID NO: 1198318 - DNA, 12 bp, Homo sapiens
ctgcctcaggca

SEQ ID NO: 1198319 - DNA, 17 bp, Homo sapiens
ctgcctcaggcactctc

SEQ ID NO: 1198320 - DNA, 22 bp, Homo sapiens
ctgcctccagaatggtctttct

SEQ ID NO: 1198321 - DNA, 14 bp, Homo sapiens
ctgcctcccaggtt

SEQ ID NO: 1198322 - DNA, 16 bp, Homo sapiens
ctgcctcccattctga

SEQ ID NO: 1198323 - DNA, 15 bp, Homo sapiens
ctgcctccccaaccc

SEQ ID NO: 1198324 - DNA, 16 bp, Homo sapiens
ctgcctccccaaccct

SEQ ID NO: 1198325 - DNA, 19 bp, Homo sapiens
ctgcctccccaaccctgcc

SEQ ID NO: 1198326 - DNA, 20 bp, Homo sapiens
ctgcctcccctctccttcct

SEQ ID NO: 1198327 - DNA, 17 bp, Homo sapiens
ctgcctccctaagttgc

SEQ ID NO: 1198328 - DNA, 11 bp, Homo sapiens
ctgcctccctc

SEQ ID NO: 1198329 - DNA, 14 bp, Homo sapiens
ctgcctccctcacc

SEQ ID NO: 1198330 - DNA, 20 bp, Homo sapiens
ctgcctccctcaccctgagc

SEQ ID NO: 1198331 - DNA, 18 bp, Homo sapiens
ctgcctccctctccatat

SEQ ID NO: 1198332 - DNA, 16 bp, Homo sapiens
ctgcctcccttgtggc

SEQ ID NO: 1198333 - DNA, 20 bp, Homo sapiens
ctgcctccctttctgggagg

SEQ ID NO: 1198334 - DNA, 12 bp, Homo sapiens
ctgcctcctcat

SEQ ID NO: 1198335 - DNA, 20 bp, Homo sapiens
ctgcctcctcatcagtgtgt

SEQ ID NO: 1198336 - DNA, 23 bp, Homo sapiens
gggctggggcaggggcctgggcc

SEQ ID NO: 1198337 - DNA, 11 bp, Homo sapiens
gggctggggcc

SEQ ID NO: 1198338 - DNA, 13 bp, Homo sapiens
gggctggggccac

SEQ ID NO: 1198339 - DNA, 15 bp, Homo sapiens
gggctggggccacct

SEQ ID NO: 1198340 - DNA, 13 bp, Homo sapiens
gggctggggcctc

SEQ ID NO: 1198341 - DNA, 13 bp, Homo sapiens
gggctggggctgc

SEQ ID NO: 1198342 - DNA, 13 bp, Homo sapiens
gggctgggggagg

SEQ ID NO: 1198343 - DNA, 20 bp, Homo sapiens
gggctgggggccagggctgg

SEQ ID NO: 1198344 - DNA, 18 bp, Homo sapiens
gggctggtattctctcta

SEQ ID NO: 1198345 - DNA, 16 bp, Homo sapiens
gggctggtgccagcct

SEQ ID NO: 1198346 - DNA, 17 bp, Homo sapiens
gggctggtgccagcctt

SEQ ID NO: 1198347 - DNA, 17 bp, Homo sapiens
gggctggtgccccacag

SEQ ID NO: 1198348 - DNA, 14 bp, Homo sapiens
gggctggttctgta

SEQ ID NO: 1198349 - DNA, 23 bp, Homo sapiens
gggctggttctgtaattgtgtgt

SEQ ID NO: 1198350 - DNA, 19 bp, Homo sapiens
gggctgtaacgtggcactg

SEQ ID NO: 1198351 - DNA, 17 bp, Homo sapiens
gggctgtcatctgtgca

SEQ ID NO: 1198352 - DNA, 14 bp, Homo sapiens
gggctgtccagcct

SEQ ID NO: 1198353 - DNA, 16 bp, Homo sapiens
gggctgtccagcctta

SEQ ID NO: 1198354 - DNA, 13 bp, Homo sapiens
gggctgtcccagc

SEQ ID NO: 1198355 - DNA, 18 bp, Homo sapiens
gggctgtcctccttcctg

SEQ ID NO: 1198356 - DNA, 21 bp, Homo sapiens
gggctgtcctccttcctggga

SEQ ID NO: 1198357 - DNA, 19 bp, Homo sapiens
gggctgtctgggtgtccgc

SEQ ID NO: 1198358 - DNA, 12 bp, Homo sapiens
gggctgtgatcg

SEQ ID NO: 1198359 - DNA, 14 bp, Homo sapiens
gggctgtggccctg

SEQ ID NO: 1198360 - DNA, 21 bp, Homo sapiens
gggctgtgtcctaaggcccat

SEQ ID NO: 1198361 - DNA, 21 bp, Homo sapiens
gggctgtgttgactgctgctc

SEQ ID NO: 1198362 - DNA, 23 bp, Homo sapiens
gggctgtgttgactgctgctccc

SEQ ID NO: 1198363 - DNA, 20 bp, Homo sapiens
gggctgttcttccaggaggc

SEQ ID NO: 1198364 - DNA, 19 bp, Homo sapiens
gggctgttgagatgcctgt

SEQ ID NO: 1198365 - DNA, 15 bp, Homo sapiens
gggcttaaagcagaa

SEQ ID NO: 1198366 - DNA, 20 bp, Homo sapiens
gggcttataataaaggactg

SEQ ID NO: 1198367 - DNA, 14 bp, Homo sapiens
gggcttatatctgg

SEQ ID NO: 1198368 - DNA, 22 bp, Homo sapiens
gggcttcaccagtctgtctact

SEQ ID NO: 1198369 - DNA, 23 bp, Homo sapiens
gggcttccatttgtgtgtgtgca

SEQ ID NO: 1198370 - DNA, 15 bp, Homo sapiens
gggcttcccactttg

SEQ ID NO: 1198371 - DNA, 18 bp, Homo sapiens
gggcttccccatcagctc

SEQ ID NO: 1198372 - DNA, 21 bp, Homo sapiens
gggcttccccatcagctccca

SEQ ID NO: 1198373 - DNA, 17 bp, Homo sapiens
gggcttcctgggtcctg

SEQ ID NO: 1198374 - DNA, 23 bp, Homo sapiens
gggcttctgcaccctccaccctg

SEQ ID NO: 1198375 - DNA, 22 bp, Homo sapiens
gggcttctgttctctgctgagg

SEQ ID NO: 1198376 - DNA, 22 bp, Homo sapiens
gggcttcttcctcacactgctg

SEQ ID NO: 1198377 - DNA, 17 bp, Homo sapiens
gggcttgagctgcagaa

SEQ ID NO: 1198378 - DNA, 21 bp, Homo sapiens
gggcttggacttcctggggcc

SEQ ID NO: 1198379 - DNA, 13 bp, Homo sapiens
gggcttggcctgg

SEQ ID NO: 1198380 - DNA, 19 bp, Homo sapiens
gggcttggcctggagagga

SEQ ID NO: 1198381 - DNA, 24 bp, Homo sapiens
gggcttgttgtttttaagtcctgt

SEQ ID NO: 1198382 - DNA, 18 bp, Homo sapiens
gggctttcacgggcccca

SEQ ID NO: 1198383 - DNA, 19 bp, Homo sapiens
gggctttctcttccccttc

SEQ ID NO: 1198384 - DNA, 16 bp, Homo sapiens
gggctttgcaggctct

SEQ ID NO: 1198385 - DNA, 17 bp, Homo sapiens
gggctttgcaggctctg

SEQ ID NO: 1198386 - DNA, 15 bp, Homo sapiens
gggctttgggcccaa

SEQ ID NO: 1198387 - DNA, 18 bp, Homo sapiens
gggctttggttccttctc

SEQ ID NO: 1198388 - DNA, 22 bp, Homo sapiens
gggctttggttccttctctggg

SEQ ID NO: 1198389 - DNA, 15 bp, Homo sapiens
gggcttttgttctga

SEQ ID NO: 1198390 - DNA, 17 bp, Homo sapiens
ggggaaaaaaaagaaaa

SEQ ID NO: 1198391 - DNA, 15 bp, Homo sapiens
ggggaaaaaattaac

SEQ ID NO: 1198392 - DNA, 19 bp, Homo sapiens
ggggaaaatcagcctgctc

SEQ ID NO: 1198393 - DNA, 15 bp, Homo sapiens
ggggaaaatgcattt

SEQ ID NO: 1198394 - DNA, 17 bp, Homo sapiens
ggggaaaggcaaggtcc

SEQ ID NO: 1198395 - DNA, 14 bp, Homo sapiens
ggggaaatgtaata

SEQ ID NO: 1198396 - DNA, 20 bp, Homo sapiens
ggggaactgacgctggagat

SEQ ID NO: 1198397 - DNA, 15 bp, Homo sapiens
ggggaagaggactgt

SEQ ID NO: 1198398 - DNA, 21 bp, Homo sapiens
ggggaagcaaaggggggaggt

SEQ ID NO: 1198399 - DNA, 14 bp, Homo sapiens
ggggaagccctgga

SEQ ID NO: 1198400 - DNA, 19 bp, Homo sapiens
ggggaaggaaggagggcac

SEQ ID NO: 1198401 - DNA, 21 bp, Homo sapiens
ggggaaggagccagtttgccg

SEQ ID NO: 1198402 - DNA, 13 bp, Homo sapiens
ggggaaggaggga

SEQ ID NO: 1198403 - DNA, 23 bp, Homo sapiens
ggggaagggccagtctgggctgc

SEQ ID NO: 1198404 - DNA, 14 bp, Homo sapiens
ggggaaggggcggt

SEQ ID NO: 1198405 - DNA, 15 bp, Homo sapiens
ggggaaggggtgcag

SEQ ID NO: 1198406 - DNA, 15 bp, Homo sapiens
ggggaagggtgggga

SEQ ID NO: 1198407 - DNA, 14 bp, Homo sapiens
ggggaagggtggtc

SEQ ID NO: 1198408 - DNA, 18 bp, Homo sapiens
ggggaagttcagaaggtg

SEQ ID NO: 1198409 - DNA, 12 bp, Homo sapiens
ggggaatctaag

SEQ ID NO: 1198410 - DNA, 19 bp, Homo sapiens
ggggaatgagcccagagaa

SEQ ID NO: 1198411 - DNA, 23 bp, Homo sapiens
ggggaatgagcccagagaacagc

SEQ ID NO: 1198412 - DNA, 15 bp, Homo sapiens
ggggaattccctccc

SEQ ID NO: 1198413 - DNA, 18 bp, Homo sapiens
ggggaattccctccccct

SEQ ID NO: 1198414 - DNA, 23 bp, Homo sapiens
ggggacaaccccccaagaccatc

SEQ ID NO: 1198415 - DNA, 18 bp, Homo sapiens
ggggacactgacaaagtc

SEQ ID NO: 1198416 - DNA, 22 bp, Homo sapiens
ggggacagagactcagatgagg

SEQ ID NO: 1198417 - DNA, 14 bp, Homo sapiens
ggggacagagccac

SEQ ID NO: 1198418 - DNA, 13 bp, Homo sapiens
ggggacagaggcc

SEQ ID NO: 1198419 - DNA, 13 bp, Homo sapiens
ggggacagctgtg

SEQ ID NO: 1198420 - DNA, 14 bp, Homo sapiens
ggggacagctgtgt

SEQ ID NO: 1198421 - DNA, 13 bp, Homo sapiens
ggggacaggcctc

SEQ ID NO: 1198422 - DNA, 19 bp, Homo sapiens
ggggacaggcctcacctct

SEQ ID NO: 1198423 - DNA, 13 bp, Homo sapiens
ggggacagggagg

SEQ ID NO: 1198424 - DNA, 12 bp, Homo sapiens
ggggacccaccc

SEQ ID NO: 1198425 - DNA, 14 bp, Homo sapiens
ggggacccaggctc

SEQ ID NO: 1198426 - DNA, 19 bp, Homo sapiens
ggggacccaggctccgccc

SEQ ID NO: 1198427 - DNA, 16 bp, Homo sapiens
ggggacccatgggggc

SEQ ID NO: 1198428 - DNA, 19 bp, Homo sapiens
ggggacccatgggggctgt

SEQ ID NO: 1198429 - DNA, 12 bp, Homo sapiens
ggggaccccact

SEQ ID NO: 1198430 - DNA, 18 bp, Homo sapiens
ggggacccccgccccctg

SEQ ID NO: 1198431 - DNA, 21 bp, Homo sapiens
ggggacccctcgcaaccctgc

SEQ ID NO: 1198432 - DNA, 21 bp, Homo sapiens
ggggaccctccaaaggaaggg

SEQ ID NO: 1198433 - DNA, 22 bp, Homo sapiens
ggggacctggtttgaatggaga

SEQ ID NO: 1198434 - DNA, 17 bp, Homo sapiens
ggggacctgtcccccac

SEQ ID NO: 1198435 - DNA, 21 bp, Homo sapiens
ggggacgcctgccctgcccag

SEQ ID NO: 1198436 - DNA, 17 bp, Homo sapiens
ggggacgtgggccctgc

SEQ ID NO: 1198437 - DNA, 15 bp, Homo sapiens
ggggactcagccctg

SEQ ID NO: 1198438 - DNA, 20 bp, Homo sapiens
ggggactctgagcgggaggc

SEQ ID NO: 1198439 - DNA, 23 bp, Homo sapiens
ggggactctgagcgggaggcaga

SEQ ID NO: 1198440 - DNA, 13 bp, Homo sapiens
ggggactctgccg

SEQ ID NO: 1198441 - DNA, 24 bp, Homo sapiens
ggggactgggagtcagagccctgg

SEQ ID NO: 1198442 - DNA, 18 bp, Homo sapiens
ggggactgggggactggg

SEQ ID NO: 1198443 - DNA, 14 bp, Homo sapiens
ggggactttattta

SEQ ID NO: 1198444 - DNA, 10 bp, Homo sapiens
ggggagaaat

SEQ ID NO: 1198445 - DNA, 15 bp, Homo sapiens
ggggagaagctgaag

SEQ ID NO: 1198446 - DNA, 18 bp, Homo sapiens
ggggagaatgcagcccac

SEQ ID NO: 1198447 - DNA, 18 bp, Homo sapiens
ggggagactgggctgagg

SEQ ID NO: 1198448 - DNA, 18 bp, Homo sapiens
ggggagagcaggctggca

SEQ ID NO: 1198449 - DNA, 18 bp, Homo sapiens
ggggagagcctgctggca

SEQ ID NO: 1198450 - DNA, 13 bp, Homo sapiens
ggggagaggcact

SEQ ID NO: 1198451 - DNA, 14 bp, Homo sapiens
ggggagatggggag

SEQ ID NO: 1198452 - DNA, 21 bp, Homo sapiens
ggggagcaggaggccaataaa

SEQ ID NO: 1198453 - DNA, 12 bp, Homo sapiens
ggggagccagct

SEQ ID NO: 1198454 - DNA, 14 bp, Homo sapiens
ggggagccagctgc

SEQ ID NO: 1198455 - DNA, 12 bp, Homo sapiens
ggggagcccagt

SEQ ID NO: 1198456 - DNA, 22 bp, Homo sapiens
ggggagccccttctgctcagct

SEQ ID NO: 1198457 - DNA, 22 bp, Homo sapiens
ggggagccctcaggctccccag

SEQ ID NO: 1198458 - DNA, 17 bp, Homo sapiens
ggggagctcctgggacc

SEQ ID NO: 1198459 - DNA, 15 bp, Homo sapiens
ggggagctgcagagc

SEQ ID NO: 1198460 - DNA, 21 bp, Homo sapiens
ggggagcttgggactcaggtc

SEQ ID NO: 1198461 - DNA, 11 bp, Homo sapiens
ctgcctcctcg

SEQ ID NO: 1198462 - DNA, 15 bp, Homo sapiens
ctgcctcctcgttcc

SEQ ID NO: 1198463 - DNA, 15 bp, Homo sapiens
ctgcctcctcttcaa

SEQ ID NO: 1198464 - DNA, 12 bp, Homo sapiens
ctgcctcctgcc

SEQ ID NO: 1198465 - DNA, 16 bp, Homo sapiens
ctgcctcctgccaccc

SEQ ID NO: 1198466 - DNA, 15 bp, Homo sapiens
ctgcctcctgcctgc

SEQ ID NO: 1198467 - DNA, 17 bp, Homo sapiens
ctgcctcctgcctgccc

SEQ ID NO: 1198468 - DNA, 19 bp, Homo sapiens
ctgcctcctgcctgcccct

SEQ ID NO: 1198469 - DNA, 17 bp, Homo sapiens
ctgcctcctgcctgggg

SEQ ID NO: 1198470 - DNA, 16 bp, Homo sapiens
ctgcctcctgctctct

SEQ ID NO: 1198471 - DNA, 14 bp, Homo sapiens
ctgcctcctggagg

SEQ ID NO: 1198472 - DNA, 14 bp, Homo sapiens
ctgcctcctggtct

SEQ ID NO: 1198473 - DNA, 19 bp, Homo sapiens
ctgcctcgagggccgcctg

SEQ ID NO: 1198474 - DNA, 14 bp, Homo sapiens
ctgcctcgctcacc

SEQ ID NO: 1198475 - DNA, 19 bp, Homo sapiens
ctgcctcggactccatggc

SEQ ID NO: 1198476 - DNA, 12 bp, Homo sapiens
ctgcctctatgc

SEQ ID NO: 1198477 - DNA, 22 bp, Homo sapiens
ctgcctctatgccctgcagagc

SEQ ID NO: 1198478 - DNA, 19 bp, Homo sapiens
ctgcctctcattggcacca

SEQ ID NO: 1198479 - DNA, 15 bp, Homo sapiens
ctgcctctccaggca

SEQ ID NO: 1198480 - DNA, 12 bp, Homo sapiens
ctgcctctccct

SEQ ID NO: 1198481 - DNA, 13 bp, Homo sapiens
ctgcctctccctc

SEQ ID NO: 1198482 - DNA, 12 bp, Homo sapiens
ctgcctctctgg

SEQ ID NO: 1198483 - DNA, 12 bp, Homo sapiens
ctgcctctgacc

SEQ ID NO: 1198484 - DNA, 21 bp, Homo sapiens
ctgcctctgagttttgatgct

SEQ ID NO: 1198485 - DNA, 15 bp, Homo sapiens
ctgcctctgctccct

SEQ ID NO: 1198486 - DNA, 16 bp, Homo sapiens
ctgcctctgctccctc

SEQ ID NO: 1198487 - DNA, 12 bp, Homo sapiens
ctgcctctgggc

SEQ ID NO: 1198488 - DNA, 13 bp, Homo sapiens
ctgcctctgggca

SEQ ID NO: 1198489 - DNA, 14 bp, Homo sapiens
ctgcctctgggcag

SEQ ID NO: 1198490 - DNA, 16 bp, Homo sapiens
ctgcctctgggcagcc

SEQ ID NO: 1198491 - DNA, 20 bp, Homo sapiens
ctgcctctgggcagcctgct

SEQ ID NO: 1198492 - DNA, 13 bp, Homo sapiens
ctgcctctgtgga

SEQ ID NO: 1198493 - DNA, 14 bp, Homo sapiens
ctgcctctgtgtag

SEQ ID NO: 1198494 - DNA, 12 bp, Homo sapiens
ctgcctcttcct

SEQ ID NO: 1198495 - DNA, 14 bp, Homo sapiens
ctgcctcttctcta

SEQ ID NO: 1198496 - DNA, 22 bp, Homo sapiens
ctgcctcttggcttctcagccc

SEQ ID NO: 1198497 - DNA, 23 bp, Homo sapiens
ctgcctcttggcttctcagcccc

SEQ ID NO: 1198498 - DNA, 20 bp, Homo sapiens
ctgcctcttgtttctgtgcc

SEQ ID NO: 1198499 - DNA, 14 bp, Homo sapiens
ctgcctctttccct

SEQ ID NO: 1198500 - DNA, 19 bp, Homo sapiens
ctgcctgaaacagccatgt

SEQ ID NO: 1198501 - DNA, 16 bp, Homo sapiens
ctgcctgacactgagc

SEQ ID NO: 1198502 - DNA, 21 bp, Homo sapiens
ctgcctgacactgagccccac

SEQ ID NO: 1198503 - DNA, 16 bp, Homo sapiens
ctgcctgacagccttc

SEQ ID NO: 1198504 - DNA, 23 bp, Homo sapiens
ctgcctgacatttggagtgttcc

SEQ ID NO: 1198505 - DNA, 18 bp, Homo sapiens
ctgcctgacccatccctt

SEQ ID NO: 1198506 - DNA, 23 bp, Homo sapiens
ctgcctgacccatcccttttcct

SEQ ID NO: 1198507 - DNA, 12 bp, Homo sapiens
ctgcctgagccc

SEQ ID NO: 1198508 - DNA, 13 bp, Homo sapiens
ctgcctgagccca

SEQ ID NO: 1198509 - DNA, 16 bp, Homo sapiens
ctgcctgagcccagga

SEQ ID NO: 1198510 - DNA, 11 bp, Homo sapiens
ctgcctgagga

SEQ ID NO: 1198511 - DNA, 15 bp, Homo sapiens
ctgcctgaggaggag

SEQ ID NO: 1198512 - DNA, 17 bp, Homo sapiens
ctgcctgagggcccctc

SEQ ID NO: 1198513 - DNA, 19 bp, Homo sapiens
ctgcctgatccctgaaccc

SEQ ID NO: 1198514 - DNA, 17 bp, Homo sapiens
ctgcctgcaatatttga

SEQ ID NO: 1198515 - DNA, 15 bp, Homo sapiens
ctgcctgcacccctg

SEQ ID NO: 1198516 - DNA, 13 bp, Homo sapiens
ctgcctgcacctc

SEQ ID NO: 1198517 - DNA, 14 bp, Homo sapiens
ctgcctgcacctcc

SEQ ID NO: 1198518 - DNA, 16 bp, Homo sapiens
ctgcctgcactccctg

SEQ ID NO: 1198519 - DNA, 17 bp, Homo sapiens
ctgcctgcactccctgg

SEQ ID NO: 1198520 - DNA, 18 bp, Homo sapiens
ctgcctgcactccctggc

SEQ ID NO: 1198521 - DNA, 20 bp, Homo sapiens
ctgcctgcactccctggcct

SEQ ID NO: 1198522 - DNA, 23 bp, Homo sapiens
ctgcctgcagaggtctgtgctga

SEQ ID NO: 1198523 - DNA, 13 bp, Homo sapiens
ctgcctgcagcac

SEQ ID NO: 1198524 - DNA, 15 bp, Homo sapiens
ctgcctgcagcacat

SEQ ID NO: 1198525 - DNA, 17 bp, Homo sapiens
ctgcctgcataggagtt

SEQ ID NO: 1198526 - DNA, 21 bp, Homo sapiens
ctgcctgccaaagtagtcctg

SEQ ID NO: 1198527 - DNA, 12 bp, Homo sapiens
ctgcctgccatg

SEQ ID NO: 1198528 - DNA, 22 bp, Homo sapiens
ctgcctgccatgtacctcccct

SEQ ID NO: 1198529 - DNA, 15 bp, Homo sapiens
ctgcctgcccacccg

SEQ ID NO: 1198530 - DNA, 21 bp, Homo sapiens
ctgcctgccccacacggactc

SEQ ID NO: 1198531 - DNA, 12 bp, Homo sapiens
ctgcctgccccc

SEQ ID NO: 1198532 - DNA, 18 bp, Homo sapiens
ctgcctgccctctgtctg

SEQ ID NO: 1198533 - DNA, 18 bp, Homo sapiens
ctgcctgccctgcctcag

SEQ ID NO: 1198534 - DNA, 17 bp, Homo sapiens
ctgcctgccgcccaaag

SEQ ID NO: 1198535 - DNA, 16 bp, Homo sapiens
ctgcctgccgctgcag

SEQ ID NO: 1198536 - DNA, 14 bp, Homo sapiens
ctgcctgcctccac

SEQ ID NO: 1198537 - DNA, 17 bp, Homo sapiens
ctgcctgcgtcttccgc

SEQ ID NO: 1198538 - DNA, 15 bp, Homo sapiens
ctgcctgctccatcg

SEQ ID NO: 1198539 - DNA, 12 bp, Homo sapiens
ctgcctgctcct

SEQ ID NO: 1198540 - DNA, 18 bp, Homo sapiens
ctgcctggactagaggga

SEQ ID NO: 1198541 - DNA, 20 bp, Homo sapiens
ctgcctggagacaaggtgct

SEQ ID NO: 1198542 - DNA, 23 bp, Homo sapiens
ctgcctggagacaaggtgctaac

SEQ ID NO: 1198543 - DNA, 22 bp, Homo sapiens
ctgcctggagacttagggcacc

SEQ ID NO: 1198544 - DNA, 22 bp, Homo sapiens
ctgcctggatgaggcacttctg

SEQ ID NO: 1198545 - DNA, 12 bp, Homo sapiens
ctgcctggccag

SEQ ID NO: 1198546 - DNA, 13 bp, Homo sapiens
ctgcctggccagg

SEQ ID NO: 1198547 - DNA, 19 bp, Homo sapiens
ctgcctggcccccaacctc

SEQ ID NO: 1198548 - DNA, 22 bp, Homo sapiens
ctgcctggcccccaacctcagg

SEQ ID NO: 1198549 - DNA, 23 bp, Homo sapiens
ctgcctggcccccaacctcaggg

SEQ ID NO: 1198550 - DNA, 19 bp, Homo sapiens
ctgcctggccctccccaca

SEQ ID NO: 1198551 - DNA, 11 bp, Homo sapiens
ctgcctggcct

SEQ ID NO: 1198552 - DNA, 12 bp, Homo sapiens
ctgcctggcctg

SEQ ID NO: 1198553 - DNA, 15 bp, Homo sapiens
ctgcctggcctggct

SEQ ID NO: 1198554 - DNA, 18 bp, Homo sapiens
ctgcctggcctggctccc

SEQ ID NO: 1198555 - DNA, 19 bp, Homo sapiens
ctgcctggcctggctcccc

SEQ ID NO: 1198556 - DNA, 12 bp, Homo sapiens
ctgcctggcctt

SEQ ID NO: 1198557 - DNA, 21 bp, Homo sapiens
ctgcctgggatgggctcccac

SEQ ID NO: 1198558 - DNA, 22 bp, Homo sapiens
ctgcctgggatgggctcccacc

SEQ ID NO: 1198559 - DNA, 23 bp, Homo sapiens
ctgcctgggccatgcgaggggcc

SEQ ID NO: 1198560 - DNA, 12 bp, Homo sapiens
ctgcctgggcct

SEQ ID NO: 1198561 - DNA, 13 bp, Homo sapiens
ctgcctgggcctg

SEQ ID NO: 1198562 - DNA, 14 bp, Homo sapiens
ctgcctgggcctgt

SEQ ID NO: 1198563 - DNA, 18 bp, Homo sapiens
ctgcctgggcctgtgcag

SEQ ID NO: 1198564 - DNA, 21 bp, Homo sapiens
ctgcctgggcctgtgcagcag

SEQ ID NO: 1198565 - DNA, 19 bp, Homo sapiens
ctgcctgggccttggctgg

SEQ ID NO: 1198566 - DNA, 16 bp, Homo sapiens
ctgcctgggctgttgg

SEQ ID NO: 1198567 - DNA, 18 bp, Homo sapiens
ctgcctgggctgttggca

SEQ ID NO: 1198568 - DNA, 17 bp, Homo sapiens
ctgcctggggcccaagt

SEQ ID NO: 1198569 - DNA, 19 bp, Homo sapiens
ctgcctggggcctccagaa

SEQ ID NO: 1198570 - DNA, 20 bp, Homo sapiens
ctgcctggtatatccaaaag

SEQ ID NO: 1198571 - DNA, 17 bp, Homo sapiens
ctgcctggtctctagag

SEQ ID NO: 1198572 - DNA, 21 bp, Homo sapiens
ctgcctggtctgtctggatcc

SEQ ID NO: 1198573 - DNA, 20 bp, Homo sapiens
ctgcctggtgcccagcacat

SEQ ID NO: 1198574 - DNA, 19 bp, Homo sapiens
ctgcctgtaacttgagagt

SEQ ID NO: 1198575 - DNA, 15 bp, Homo sapiens
ctgcctgtaattaaa

SEQ ID NO: 1198576 - DNA, 17 bp, Homo sapiens
ctgcctgtagcaatggc

SEQ ID NO: 1198577 - DNA, 13 bp, Homo sapiens
ctgcctgtagtta

SEQ ID NO: 1198578 - DNA, 16 bp, Homo sapiens
ctgcctgtagttagga

SEQ ID NO: 1198579 - DNA, 21 bp, Homo sapiens
ctgcctgtagttaggaaataa

SEQ ID NO: 1198580 - DNA, 22 bp, Homo sapiens
ctgcctgtagttaggaaataaa

SEQ ID NO: 1198581 - DNA, 13 bp, Homo sapiens
ctgcctgtatttt

SEQ ID NO: 1198582 - DNA, 14 bp, Homo sapiens
ctgcctgtattttc

SEQ ID NO: 1198583 - DNA, 12 bp, Homo sapiens
ctgcctgtctcc

SEQ ID NO: 1198584 - DNA, 11 bp, Homo sapiens
ctgcctgtctg

SEQ ID NO: 1198585 - DNA, 14 bp, Homo sapiens
ctgcctgtctgccc

SEQ ID NO: 1198586 - DNA, 23 bp, Homo sapiens
ctgcctgtctgccccagcccaga

SEQ ID NO: 1198587 - DNA, 11 bp, Homo sapiens
ggggaggaagg

SEQ ID NO: 1198588 - DNA, 12 bp, Homo sapiens
ggggaggaaggg

SEQ ID NO: 1198589 - DNA, 21 bp, Homo sapiens
ggggaggaagttggctgagcc

SEQ ID NO: 1198590 - DNA, 11 bp, Homo sapiens
ggggaggagac

SEQ ID NO: 1198591 - DNA, 16 bp, Homo sapiens
ggggaggaggacttgg

SEQ ID NO: 1198592 - DNA, 21 bp, Homo sapiens
ggggaggaggacttggagggt

SEQ ID NO: 1198593 - DNA, 15 bp, Homo sapiens
ggggaggagtcaggg

SEQ ID NO: 1198594 - DNA, 14 bp, Homo sapiens
ggggaggcagccgg

SEQ ID NO: 1198595 - DNA, 16 bp, Homo sapiens
ggggaggcagggctgg

SEQ ID NO: 1198596 - DNA, 17 bp, Homo sapiens
ggggaggcagggctgga

SEQ ID NO: 1198597 - DNA, 14 bp, Homo sapiens
ggggaggccagtgt

SEQ ID NO: 1198598 - DNA, 17 bp, Homo sapiens
ggggaggcccaaatgat

SEQ ID NO: 1198599 - DNA, 11 bp, Homo sapiens
ggggaggcttt

SEQ ID NO: 1198600 - DNA, 14 bp, Homo sapiens
ggggagggatgaag

SEQ ID NO: 1198601 - DNA, 21 bp, Homo sapiens
ggggagggccgtaccccaccc

SEQ ID NO: 1198602 - DNA, 14 bp, Homo sapiens
ggggagggctcctg

SEQ ID NO: 1198603 - DNA, 20 bp, Homo sapiens
ggggaggggcctagggagcc

SEQ ID NO: 1198604 - DNA, 20 bp, Homo sapiens
ggggaggggcgctggcccag

SEQ ID NO: 1198605 - DNA, 15 bp, Homo sapiens
ggggagggggatccg

SEQ ID NO: 1198606 - DNA, 14 bp, Homo sapiens
ggggaggggggagg

SEQ ID NO: 1198607 - DNA, 19 bp, Homo sapiens
ggggaggtgggaggccagg

SEQ ID NO: 1198608 - DNA, 14 bp, Homo sapiens
ggggagtagagaag

SEQ ID NO: 1198609 - DNA, 14 bp, Homo sapiens
ggggagtatgcaaa

SEQ ID NO: 1198610 - DNA, 15 bp, Homo sapiens
ggggagtcaccttcc

SEQ ID NO: 1198611 - DNA, 17 bp, Homo sapiens
ggggataccataaaaag

SEQ ID NO: 1198612 - DNA, 14 bp, Homo sapiens
ggggatatttccta

SEQ ID NO: 1198613 - DNA, 17 bp, Homo sapiens
ggggatcacagcctctg

SEQ ID NO: 1198614 - DNA, 23 bp, Homo sapiens
ggggatcatgttaaaaatagcag

SEQ ID NO: 1198615 - DNA, 13 bp, Homo sapiens
ggggatgccttca

SEQ ID NO: 1198616 - DNA, 13 bp, Homo sapiens
ggggatgcttcat

SEQ ID NO: 1198617 - DNA, 24 bp, Homo sapiens
ggggatggaggccagagtctccca

SEQ ID NO: 1198618 - DNA, 13 bp, Homo sapiens
ggggatgggccag

SEQ ID NO: 1198619 - DNA, 14 bp, Homo sapiens
ggggatgggccagg

SEQ ID NO: 1198620 - DNA, 21 bp, Homo sapiens
ggggatggtggcacaggcact

SEQ ID NO: 1198621 - DNA, 15 bp, Homo sapiens
ggggatgtttgcccc

SEQ ID NO: 1198622 - DNA, 19 bp, Homo sapiens
ggggattcaaaaacaggtt

SEQ ID NO: 1198623 - DNA, 20 bp, Homo sapiens
ggggattcaggggctttggg

SEQ ID NO: 1198624 - DNA, 15 bp, Homo sapiens
ggggatttctcccag

SEQ ID NO: 1198625 - DNA, 14 bp, Homo sapiens
ggggatttctggga

SEQ ID NO: 1198626 - DNA, 19 bp, Homo sapiens
ggggcaagccagggcccag

SEQ ID NO: 1198627 - DNA, 14 bp, Homo sapiens
ggggcaaggtctcc

SEQ ID NO: 1198628 - DNA, 15 bp, Homo sapiens
ggggcacaccactgc

SEQ ID NO: 1198629 - DNA, 20 bp, Homo sapiens
ggggcacaccactgccctgc

SEQ ID NO: 1198630 - DNA, 20 bp, Homo sapiens
ggggcacagctgtctgccag

SEQ ID NO: 1198631 - DNA, 23 bp, Homo sapiens
ggggcacagctgtctgccaggca

SEQ ID NO: 1198632 - DNA, 13 bp, Homo sapiens
ggggcacggcagg

SEQ ID NO: 1198633 - DNA, 15 bp, Homo sapiens
ggggcacggcaggcg

SEQ ID NO: 1198634 - DNA, 14 bp, Homo sapiens
ggggcagagccagg

SEQ ID NO: 1198635 - DNA, 16 bp, Homo sapiens
ggggcagagccaggaa

SEQ ID NO: 1198636 - DNA, 16 bp, Homo sapiens
ggggcagagggcagag

SEQ ID NO: 1198637 - DNA, 16 bp, Homo sapiens
ggggcagaggggcagc

SEQ ID NO: 1198638 - DNA, 24 bp, Homo sapiens
ggggcagcaaggccttggtggagc

SEQ ID NO: 1198639 - DNA, 16 bp, Homo sapiens
ggggcagcagcagccc

SEQ ID NO: 1198640 - DNA, 15 bp, Homo sapiens
ggggcagcaggagga

SEQ ID NO: 1198641 - DNA, 21 bp, Homo sapiens
ggggcagccaaacccatgagg

SEQ ID NO: 1198642 - DNA, 12 bp, Homo sapiens
ggggcagccctg

SEQ ID NO: 1198643 - DNA, 14 bp, Homo sapiens
ggggcagccctgag

SEQ ID NO: 1198644 - DNA, 20 bp, Homo sapiens
ggggcaggaaagccacatct

SEQ ID NO: 1198645 - DNA, 13 bp, Homo sapiens
ggggcaggagtgc

SEQ ID NO: 1198646 - DNA, 17 bp, Homo sapiens
ggggcaggagtgccagg

SEQ ID NO: 1198647 - DNA, 18 bp, Homo sapiens
ggggcaggagtgccagga

SEQ ID NO: 1198648 - DNA, 20 bp, Homo sapiens
ggggcaggagtgccaggacc

SEQ ID NO: 1198649 - DNA, 22 bp, Homo sapiens
ggggcaggagtgccaggaccag

SEQ ID NO: 1198650 - DNA, 23 bp, Homo sapiens
ggggcaggagtgccaggaccagc

SEQ ID NO: 1198651 - DNA, 14 bp, Homo sapiens
ggggcaggcagggc

SEQ ID NO: 1198652 - DNA, 13 bp, Homo sapiens
ggggcaggccagc

SEQ ID NO: 1198653 - DNA, 13 bp, Homo sapiens
ggggcaggcctgg

SEQ ID NO: 1198654 - DNA, 16 bp, Homo sapiens
ggggcaggcgcagagg

SEQ ID NO: 1198655 - DNA, 16 bp, Homo sapiens
ggggcaggctgggcca

SEQ ID NO: 1198656 - DNA, 16 bp, Homo sapiens
ggggcaggggcctggg

SEQ ID NO: 1198657 - DNA, 13 bp, Homo sapiens
ggggcaggggtgc

SEQ ID NO: 1198658 - DNA, 14 bp, Homo sapiens
ggggcatcctggat

SEQ ID NO: 1198659 - DNA, 22 bp, Homo sapiens
ggggcatctgagtccagctccc

SEQ ID NO: 1198660 - DNA, 20 bp, Homo sapiens
ggggcatctgcccctccccc

SEQ ID NO: 1198661 - DNA, 17 bp, Homo sapiens
ggggcatggacagggcc

SEQ ID NO: 1198662 - DNA, 18 bp, Homo sapiens
ggggcatggacagggcca

SEQ ID NO: 1198663 - DNA, 22 bp, Homo sapiens
ggggcatggacagggccagggt

SEQ ID NO: 1198664 - DNA, 16 bp, Homo sapiens
ggggccacacagaaac

SEQ ID NO: 1198665 - DNA, 14 bp, Homo sapiens
ggggccaccaaagc

SEQ ID NO: 1198666 - DNA, 16 bp, Homo sapiens
ggggccacctcctccc

SEQ ID NO: 1198667 - DNA, 18 bp, Homo sapiens
ggggccacctcctccccc

SEQ ID NO: 1198668 - DNA, 15 bp, Homo sapiens
ggggccactgaccca

SEQ ID NO: 1198669 - DNA, 13 bp, Homo sapiens
ggggccagagaca

SEQ ID NO: 1198670 - DNA, 14 bp, Homo sapiens
ggggccagagacat

SEQ ID NO: 1198671 - DNA, 18 bp, Homo sapiens
ggggccagagagcagggg

SEQ ID NO: 1198672 - DNA, 20 bp, Homo sapiens
ggggccagagagcaggggag

SEQ ID NO: 1198673 - DNA, 12 bp, Homo sapiens
ggggccagaggc

SEQ ID NO: 1198674 - DNA, 15 bp, Homo sapiens
ggggccagaggctgg

SEQ ID NO: 1198675 - DNA, 22 bp, Homo sapiens
ggggccagcagagggcgccacc

SEQ ID NO: 1198676 - DNA, 14 bp, Homo sapiens
ggggccagctgggg

SEQ ID NO: 1198677 - DNA, 12 bp, Homo sapiens
ggggccaggcct

SEQ ID NO: 1198678 - DNA, 20 bp, Homo sapiens
ggggccagggctggatggac

SEQ ID NO: 1198679 - DNA, 22 bp, Homo sapiens
ggggccagggctggatggacag

SEQ ID NO: 1198680 - DNA, 14 bp, Homo sapiens
ggggccatgaggcc

SEQ ID NO: 1198681 - DNA, 15 bp, Homo sapiens
ggggccatggtggag

SEQ ID NO: 1198682 - DNA, 19 bp, Homo sapiens
ggggccccagcgtctgcag

SEQ ID NO: 1198683 - DNA, 14 bp, Homo sapiens
ggggccccagggct

SEQ ID NO: 1198684 - DNA, 17 bp, Homo sapiens
ggggccccgccagggct

SEQ ID NO: 1198685 - DNA, 20 bp, Homo sapiens
ggggccccgccagggctggg

SEQ ID NO: 1198686 - DNA, 21 bp, Homo sapiens
ggggccccgccagggctgggg

SEQ ID NO: 1198687 - DNA, 16 bp, Homo sapiens
ggggcccgcctggcag

SEQ ID NO: 1198688 - DNA, 15 bp, Homo sapiens
ggggcccggccagcc

SEQ ID NO: 1198689 - DNA, 13 bp, Homo sapiens
ggggccctcaggc

SEQ ID NO: 1198690 - DNA, 12 bp, Homo sapiens
ggggccctgccc

SEQ ID NO: 1198691 - DNA, 13 bp, Homo sapiens
ggggccctgggcc

SEQ ID NO: 1198692 - DNA, 14 bp, Homo sapiens
ggggccctgggcct

SEQ ID NO: 1198693 - DNA, 12 bp, Homo sapiens
ggggccctggtc

SEQ ID NO: 1198694 - DNA, 17 bp, Homo sapiens
ggggccgcctgccctgc

SEQ ID NO: 1198695 - DNA, 14 bp, Homo sapiens
ggggccgctgccac

SEQ ID NO: 1198696 - DNA, 22 bp, Homo sapiens
ggggccgctgccacccacctcc

SEQ ID NO: 1198697 - DNA, 14 bp, Homo sapiens
ggggccggctggcc

SEQ ID NO: 1198698 - DNA, 21 bp, Homo sapiens
ggggccggctggcctggaggc

SEQ ID NO: 1198699 - DNA, 22 bp, Homo sapiens
ggggccggctggcctggaggct

SEQ ID NO: 1198700 - DNA, 17 bp, Homo sapiens
ggggccgggcaggtcct

SEQ ID NO: 1198701 - DNA, 21 bp, Homo sapiens
ggggccgggcaggtcctgccc

SEQ ID NO: 1198702 - DNA, 21 bp, Homo sapiens
ggggccgggcgcggtggctca

SEQ ID NO: 1198703 - DNA, 16 bp, Homo sapiens
ggggccggggggaggg

SEQ ID NO: 1198704 - DNA, 13 bp, Homo sapiens
ggggcctagggag

SEQ ID NO: 1198705 - DNA, 19 bp, Homo sapiens
ggggcctcagcctggggct

SEQ ID NO: 1198706 - DNA, 19 bp, Homo sapiens
ggggcctccagaagctgct

SEQ ID NO: 1198707 - DNA, 20 bp, Homo sapiens
ggggcctccagaagctgctc

SEQ ID NO: 1198708 - DNA, 13 bp, Homo sapiens
ggggcctccctcc

SEQ ID NO: 1198709 - DNA, 12 bp, Homo sapiens
ggggcctccctg

SEQ ID NO: 1198710 - DNA, 12 bp, Homo sapiens
ggggcctgagag

SEQ ID NO: 1198711 - DNA, 15 bp, Homo sapiens
ggggcctgagagaat

SEQ ID NO: 1198712 - DNA, 19 bp, Homo sapiens
ggggcctggagatcctcct

SEQ ID NO: 1198713 - DNA, 11 bp, Homo sapiens
ggggcctggca

SEQ ID NO: 1198714 - DNA, 16 bp, Homo sapiens
ctgcctgtgccatgcc

SEQ ID NO: 1198715 - DNA, 18 bp, Homo sapiens
ctgcctgtgccatgccca

SEQ ID NO: 1198716 - DNA, 21 bp, Homo sapiens
ctgcctgtgccatgcccaagg

SEQ ID NO: 1198717 - DNA, 12 bp, Homo sapiens
ctgcctgtgctg

SEQ ID NO: 1198718 - DNA, 21 bp, Homo sapiens
ctgcctgtggccttgcccgcc

SEQ ID NO: 1198719 - DNA, 18 bp, Homo sapiens
ctgcctgttataactctg

SEQ ID NO: 1198720 - DNA, 22 bp, Homo sapiens
ctgcctgttataactctgcact

SEQ ID NO: 1198721 - DNA, 18 bp, Homo sapiens
ctgcctgttggcaggccc

SEQ ID NO: 1198722 - DNA, 19 bp, Homo sapiens
ctgcctgttggcaggccca

SEQ ID NO: 1198723 - DNA, 21 bp, Homo sapiens
ctgcctgttggcaggcccact

SEQ ID NO: 1198724 - DNA, 16 bp, Homo sapiens
ctgccttaaaaccaaa

SEQ ID NO: 1198725 - DNA, 22 bp, Homo sapiens
ctgccttaaaaccaaagagggc

SEQ ID NO: 1198726 - DNA, 15 bp, Homo sapiens
ctgccttacaaaata

SEQ ID NO: 1198727 - DNA, 18 bp, Homo sapiens
ctgccttagcctaccatg

SEQ ID NO: 1198728 - DNA, 13 bp, Homo sapiens
ctgccttagcctc

SEQ ID NO: 1198729 - DNA, 15 bp, Homo sapiens
ctgccttagcctctt

SEQ ID NO: 1198730 - DNA, 17 bp, Homo sapiens
ctgccttagcctcttgg

SEQ ID NO: 1198731 - DNA, 19 bp, Homo sapiens
ctgccttaggcctacctga

SEQ ID NO: 1198732 - DNA, 16 bp, Homo sapiens
ctgccttcacaaatgt

SEQ ID NO: 1198733 - DNA, 18 bp, Homo sapiens
ctgccttcacaaatgtca

SEQ ID NO: 1198734 - DNA, 16 bp, Homo sapiens
ctgccttccagcccag

SEQ ID NO: 1198735 - DNA, 19 bp, Homo sapiens
ctgccttccagcccagacc

SEQ ID NO: 1198736 - DNA, 17 bp, Homo sapiens
ctgccttccctagcttt

SEQ ID NO: 1198737 - DNA, 16 bp, Homo sapiens
ctgccttcctctgagg

SEQ ID NO: 1198738 - DNA, 17 bp, Homo sapiens
ctgccttcctctgagga

SEQ ID NO: 1198739 - DNA, 21 bp, Homo sapiens
ctgccttcgcaccttgctgtg

SEQ ID NO: 1198740 - DNA, 14 bp, Homo sapiens
ctgccttcgcttct

SEQ ID NO: 1198741 - DNA, 15 bp, Homo sapiens
ctgccttcgcttctt

SEQ ID NO: 1198742 - DNA, 17 bp, Homo sapiens
ctgccttcgcttcttgc

SEQ ID NO: 1198743 - DNA, 23 bp, Homo sapiens
ctgccttcgcttcttgcctctgt

SEQ ID NO: 1198744 - DNA, 24 bp, Homo sapiens
ctgccttcttcggggaactcctgg

SEQ ID NO: 1198745 - DNA, 18 bp, Homo sapiens
ctgccttgctcctagcag

SEQ ID NO: 1198746 - DNA, 13 bp, Homo sapiens
ctgccttggacac

SEQ ID NO: 1198747 - DNA, 22 bp, Homo sapiens
ctgccttggccccccaaagtgc

SEQ ID NO: 1198748 - DNA, 19 bp, Homo sapiens
ctgccttggcccctccctc

SEQ ID NO: 1198749 - DNA, 13 bp, Homo sapiens
ctgccttggcctc

SEQ ID NO: 1198750 - DNA, 14 bp, Homo sapiens
ctgccttggctcag

SEQ ID NO: 1198751 - DNA, 22 bp, Homo sapiens
ctgccttggctcagacatgttt

SEQ ID NO: 1198752 - DNA, 15 bp, Homo sapiens
ctgcctttaagccaa

SEQ ID NO: 1198753 - DNA, 16 bp, Homo sapiens
ctgcctttaagccaaa

SEQ ID NO: 1198754 - DNA, 23 bp, Homo sapiens
ctgcctttaagccaaagaaacaa

SEQ ID NO: 1198755 - DNA, 15 bp, Homo sapiens
ctgcctttagaaaat

SEQ ID NO: 1198756 - DNA, 16 bp, Homo sapiens
ctgcctttagaaaata

SEQ ID NO: 1198757 - DNA, 17 bp, Homo sapiens
ctgcctttagaaaatat

SEQ ID NO: 1198758 - DNA, 20 bp, Homo sapiens
ctgcctttatgatgctaagc

SEQ ID NO: 1198759 - DNA, 13 bp, Homo sapiens
ctgcctttgtatg

SEQ ID NO: 1198760 - DNA, 14 bp, Homo sapiens
ctgcctttgtatgt

SEQ ID NO: 1198761 - DNA, 17 bp, Homo sapiens
ctgcctttgtatgtgga

SEQ ID NO: 1198762 - DNA, 21 bp, Homo sapiens
ctgcctttgtatgtggaagta

SEQ ID NO: 1198763 - DNA, 19 bp, Homo sapiens
ctgcctttgtccccacaca

SEQ ID NO: 1198764 - DNA, 21 bp, Homo sapiens
ctgccttttaagtttgaaact

SEQ ID NO: 1198765 - DNA, 14 bp, Homo sapiens
ctgccttttctgga

SEQ ID NO: 1198766 - DNA, 23 bp, Homo sapiens
ctgccttttttttttttttaaga

SEQ ID NO: 1198767 - DNA, 18 bp, Homo sapiens
ctgcgaaggggccctggt

SEQ ID NO: 1198768 - DNA, 19 bp, Homo sapiens
ctgcgaaggggccctggtc

SEQ ID NO: 1198769 - DNA, 18 bp, Homo sapiens
ctgcgactttctgcctgg

SEQ ID NO: 1198770 - DNA, 22 bp, Homo sapiens
ctgcgagacgcacacagctgag

SEQ ID NO: 1198771 - DNA, 19 bp, Homo sapiens
ctgcgatcttcagagcagg

SEQ ID NO: 1198772 - DNA, 17 bp, Homo sapiens
ctgcgattttgcctgtg

SEQ ID NO: 1198773 - DNA, 23 bp, Homo sapiens
ctgcgcagggtggtggtattctg

SEQ ID NO: 1198774 - DNA, 15 bp, Homo sapiens
ctgcgccacccacca

SEQ ID NO: 1198775 - DNA, 14 bp, Homo sapiens
ctgcgccaggcaga

SEQ ID NO: 1198776 - DNA, 19 bp, Homo sapiens
ctgcgcccagtccttccac

SEQ ID NO: 1198777 - DNA, 19 bp, Homo sapiens
ctgcgccccgcctgacctg

SEQ ID NO: 1198778 - DNA, 15 bp, Homo sapiens
ctgcgcccttgaggg

SEQ ID NO: 1198779 - DNA, 18 bp, Homo sapiens
ctgcgcccttgaggggcc

SEQ ID NO: 1198780 - DNA, 13 bp, Homo sapiens
ctgcgcctcaggc

SEQ ID NO: 1198781 - DNA, 20 bp, Homo sapiens
ctgcgcctccagaggtcctc

SEQ ID NO: 1198782 - DNA, 20 bp, Homo sapiens
ctgcgcctccatccatctgt

SEQ ID NO: 1198783 - DNA, 16 bp, Homo sapiens
ctgcgcctgcaggcag

SEQ ID NO: 1198784 - DNA, 18 bp, Homo sapiens
ctgcgcctgcaggcagag

SEQ ID NO: 1198785 - DNA, 21 bp, Homo sapiens
ctgcgcctgcaggcagagctg

SEQ ID NO: 1198786 - DNA, 15 bp, Homo sapiens
ctgcgcctgctgcct

SEQ ID NO: 1198787 - DNA, 15 bp, Homo sapiens
ctgcgctagcagccc

SEQ ID NO: 1198788 - DNA, 18 bp, Homo sapiens
ctgcgctctctttgcaac

SEQ ID NO: 1198789 - DNA, 20 bp, Homo sapiens
ctgcgctggacgatagcttg

SEQ ID NO: 1198790 - DNA, 19 bp, Homo sapiens
ctgcggacaccgtggcctg

SEQ ID NO: 1198791 - DNA, 15 bp, Homo sapiens
ctgcggaggcggtgg

SEQ ID NO: 1198792 - DNA, 19 bp, Homo sapiens
ctgcggagtgaagaggggc

SEQ ID NO: 1198793 - DNA, 20 bp, Homo sapiens
ctgcggatagcatttggtag

SEQ ID NO: 1198794 - DNA, 14 bp, Homo sapiens
ctgcggcccgggcc

SEQ ID NO: 1198795 - DNA, 21 bp, Homo sapiens
ctgcggccgccccccgcccct

SEQ ID NO: 1198796 - DNA, 15 bp, Homo sapiens
ctgcggcctgctgga

SEQ ID NO: 1198797 - DNA, 18 bp, Homo sapiens
ctgcggctcagccttgca

SEQ ID NO: 1198798 - DNA, 19 bp, Homo sapiens
ctgcgggaggctggggccc

SEQ ID NO: 1198799 - DNA, 13 bp, Homo sapiens
ctgcgggccacag

SEQ ID NO: 1198800 - DNA, 21 bp, Homo sapiens
ctgcgggctccctcctctggc

SEQ ID NO: 1198801 - DNA, 15 bp, Homo sapiens
ctgcgggtcctcagc

SEQ ID NO: 1198802 - DNA, 17 bp, Homo sapiens
ctgcgggtcctcagctg

SEQ ID NO: 1198803 - DNA, 18 bp, Homo sapiens
ctgcgggtcctcagctgc

SEQ ID NO: 1198804 - DNA, 20 bp, Homo sapiens
ctgcgggtcctcagctgctc

SEQ ID NO: 1198805 - DNA, 14 bp, Homo sapiens
ctgcgggttttaat

SEQ ID NO: 1198806 - DNA, 16 bp, Homo sapiens
ctgcgtactccactgg

SEQ ID NO: 1198807 - DNA, 13 bp, Homo sapiens
ctgcgtccaccag

SEQ ID NO: 1198808 - DNA, 16 bp, Homo sapiens
ctgcgtccaccaggcc

SEQ ID NO: 1198809 - DNA, 23 bp, Homo sapiens
ctgcgtccaccaggcctcactgg

SEQ ID NO: 1198810 - DNA, 19 bp, Homo sapiens
ctgcgtcctcctcacctca

SEQ ID NO: 1198811 - DNA, 24 bp, Homo sapiens
ctgcgtcctcctcacctcatgccc

SEQ ID NO: 1198812 - DNA, 19 bp, Homo sapiens
ctgcgtcctgacgccctgc

SEQ ID NO: 1198813 - DNA, 13 bp, Homo sapiens
ctgcgtctgtgtt

SEQ ID NO: 1198814 - DNA, 23 bp, Homo sapiens
ctgcgtgatggctatgccttgca

SEQ ID NO: 1198815 - DNA, 22 bp, Homo sapiens
ctgcgtgccagtcaagaagaaa

SEQ ID NO: 1198816 - DNA, 22 bp, Homo sapiens
ctgcgtgggtgtgtgcgtgttt

SEQ ID NO: 1198817 - DNA, 15 bp, Homo sapiens
ctgcgttcagcccct

SEQ ID NO: 1198818 - DNA, 19 bp, Homo sapiens
ctgcgttggagccactcct

SEQ ID NO: 1198819 - DNA, 21 bp, Homo sapiens
ctgcgttggagccactcctgt

SEQ ID NO: 1198820 - DNA, 22 bp, Homo sapiens
ctgcgttggagccactcctgtc

SEQ ID NO: 1198821 - DNA, 16 bp, Homo sapiens
ctgcgttggtccagag

SEQ ID NO: 1198822 - DNA, 18 bp, Homo sapiens
ctgcgttggtccagagcg

SEQ ID NO: 1198823 - DNA, 12 bp, Homo sapiens
ctgctaaataaa

SEQ ID NO: 1198824 - DNA, 15 bp, Homo sapiens
ctgctaaataaaatt

SEQ ID NO: 1198825 - DNA, 14 bp, Homo sapiens
ctgctaaatgcact

SEQ ID NO: 1198826 - DNA, 19 bp, Homo sapiens
ctgctaaatgcactgaccc

SEQ ID NO: 1198827 - DNA, 22 bp, Homo sapiens
ctgctaaattctatgttaaata

SEQ ID NO: 1198828 - DNA, 16 bp, Homo sapiens
ctgctaaggctcctcc

SEQ ID NO: 1198829 - DNA, 17 bp, Homo sapiens
ctgctaaggctcctcct

SEQ ID NO: 1198830 - DNA, 14 bp, Homo sapiens
ctgctaaggctgct

SEQ ID NO: 1198831 - DNA, 15 bp, Homo sapiens
ctgctaaggctgctg

SEQ ID NO: 1198832 - DNA, 21 bp, Homo sapiens
ctgctaaggctgctggcttca

SEQ ID NO: 1198833 - DNA, 17 bp, Homo sapiens
ctgctaagtatttccca

SEQ ID NO: 1198834 - DNA, 19 bp, Homo sapiens
ctgctaagtatttcccagc

SEQ ID NO: 1198835 - DNA, 21 bp, Homo sapiens
ctgctaagtatttcccagcac

SEQ ID NO: 1198836 - DNA, 23 bp, Homo sapiens
ctgctaagtatttcccagcacat

SEQ ID NO: 1198837 - DNA, 15 bp, Homo sapiens
ctgctaatgtaaact

SEQ ID NO: 1198838 - DNA, 16 bp, Homo sapiens
ggggcctgggacttcc

SEQ ID NO: 1198839 - DNA, 23 bp, Homo sapiens
ggggcctgggacttccatgcctt

SEQ ID NO: 1198840 - DNA, 22 bp, Homo sapiens
ggggcctgggagggttcccctg

SEQ ID NO: 1198841 - DNA, 13 bp, Homo sapiens
ggggcctgggcag

SEQ ID NO: 1198842 - DNA, 17 bp, Homo sapiens
ggggccttatcgggctc

SEQ ID NO: 1198843 - DNA, 18 bp, Homo sapiens
ggggccttgcggaagcca

SEQ ID NO: 1198844 - DNA, 17 bp, Homo sapiens
ggggccttgctctgagc

SEQ ID NO: 1198845 - DNA, 19 bp, Homo sapiens
ggggccttgctctgagcac

SEQ ID NO: 1198846 - DNA, 21 bp, Homo sapiens
ggggccttgctctgagcacag

SEQ ID NO: 1198847 - DNA, 18 bp, Homo sapiens
ggggcgcctggagggatg

SEQ ID NO: 1198848 - DNA, 14 bp, Homo sapiens
ggggcgctggccca

SEQ ID NO: 1198849 - DNA, 16 bp, Homo sapiens
ggggcgggccagggtg

SEQ ID NO: 1198850 - DNA, 15 bp, Homo sapiens
ggggcgggggcggag

SEQ ID NO: 1198851 - DNA, 19 bp, Homo sapiens
ggggcgggtgacgcccacc

SEQ ID NO: 1198852 - DNA, 21 bp, Homo sapiens
ggggcgggtgacgcccacctt

SEQ ID NO: 1198853 - DNA, 14 bp, Homo sapiens
ggggcggtgtcagg

SEQ ID NO: 1198854 - DNA, 17 bp, Homo sapiens
ggggcggtgtcaggtcc

SEQ ID NO: 1198855 - DNA, 15 bp, Homo sapiens
ggggcgtggctggcc

SEQ ID NO: 1198856 - DNA, 19 bp, Homo sapiens
ggggcgtggctggcctttc

SEQ ID NO: 1198857 - DNA, 21 bp, Homo sapiens
ggggctaaaggggagaaactg

SEQ ID NO: 1198858 - DNA, 14 bp, Homo sapiens
ggggctaatttaac

SEQ ID NO: 1198859 - DNA, 14 bp, Homo sapiens
ggggctaccaggaa

SEQ ID NO: 1198860 - DNA, 11 bp, Homo sapiens
ggggctcctgg

SEQ ID NO: 1198861 - DNA, 17 bp, Homo sapiens
ggggctcgccccaccca

SEQ ID NO: 1198862 - DNA, 17 bp, Homo sapiens
ggggctcggggaggcag

SEQ ID NO: 1198863 - DNA, 18 bp, Homo sapiens
ggggctcggggaggcaga

SEQ ID NO: 1198864 - DNA, 18 bp, Homo sapiens
ggggctcgtggccttccc

SEQ ID NO: 1198865 - DNA, 24 bp, Homo sapiens
ggggctctcatgttttcaactgcc

SEQ ID NO: 1198866 - DNA, 12 bp, Homo sapiens
ggggctctctga

SEQ ID NO: 1198867 - DNA, 18 bp, Homo sapiens
ggggctctgcccacctgg

SEQ ID NO: 1198868 - DNA, 22 bp, Homo sapiens
ggggctctgcccacctggggtc

SEQ ID NO: 1198869 - DNA, 16 bp, Homo sapiens
ggggctctgccccagg

SEQ ID NO: 1198870 - DNA, 12 bp, Homo sapiens
ggggctctggga

SEQ ID NO: 1198871 - DNA, 23 bp, Homo sapiens
ggggctgaattgccaggggcgag

SEQ ID NO: 1198872 - DNA, 17 bp, Homo sapiens
ggggctgaggtgggagg

SEQ ID NO: 1198873 - DNA, 23 bp, Homo sapiens
ggggctgcacctcctaccctccc

SEQ ID NO: 1198874 - DNA, 20 bp, Homo sapiens
ggggctgccatagggtctgc

SEQ ID NO: 1198875 - DNA, 23 bp, Homo sapiens
ggggctgcccagctgctcccctg

SEQ ID NO: 1198876 - DNA, 21 bp, Homo sapiens
ggggctgcgctagcagccctt

SEQ ID NO: 1198877 - DNA, 22 bp, Homo sapiens
ggggctgcgctagcagcccttg

SEQ ID NO: 1198878 - DNA, 13 bp, Homo sapiens
ggggctgctgcct

SEQ ID NO: 1198879 - DNA, 13 bp, Homo sapiens
ggggctgcttagg

SEQ ID NO: 1198880 - DNA, 18 bp, Homo sapiens
ggggctgcttcctcctgg

SEQ ID NO: 1198881 - DNA, 18 bp, Homo sapiens
ggggctggcaagcaggga

SEQ ID NO: 1198882 - DNA, 16 bp, Homo sapiens
ggggctggccttcctg

SEQ ID NO: 1198883 - DNA, 19 bp, Homo sapiens
ggggctggcggctactcag

SEQ ID NO: 1198884 - DNA, 19 bp, Homo sapiens
ggggctggctcccagggtg

SEQ ID NO: 1198885 - DNA, 12 bp, Homo sapiens
ggggctgggcac

SEQ ID NO: 1198886 - DNA, 12 bp, Homo sapiens
ggggctgggcat

SEQ ID NO: 1198887 - DNA, 20 bp, Homo sapiens
ggggctgggcatcccagctt

SEQ ID NO: 1198888 - DNA, 16 bp, Homo sapiens
ggggctggggcaggct

SEQ ID NO: 1198889 - DNA, 12 bp, Homo sapiens
ggggctgtgcca

SEQ ID NO: 1198890 - DNA, 20 bp, Homo sapiens
ggggcttataataaaggact

SEQ ID NO: 1198891 - DNA, 18 bp, Homo sapiens
ggggctttcggggagggc

SEQ ID NO: 1198892 - DNA, 19 bp, Homo sapiens
ggggctttcggggagggcg

SEQ ID NO: 1198893 - DNA, 20 bp, Homo sapiens
ggggctttcggggagggcgc

SEQ ID NO: 1198894 - DNA, 21 bp, Homo sapiens
ggggctttctcttccccttcc

SEQ ID NO: 1198895 - DNA, 21 bp, Homo sapiens
ggggctttgggcccaagaact

SEQ ID NO: 1198896 - DNA, 17 bp, Homo sapiens
gggggaacgatgtgtct

SEQ ID NO: 1198897 - DNA, 18 bp, Homo sapiens
gggggaacgatgtgtctg

SEQ ID NO: 1198898 - DNA, 18 bp, Homo sapiens
gggggaaggccaagggga

SEQ ID NO: 1198899 - DNA, 20 bp, Homo sapiens
gggggacccaggtgggactt

SEQ ID NO: 1198900 - DNA, 22 bp, Homo sapiens
gggggacctgtcccccactctc

SEQ ID NO: 1198901 - DNA, 20 bp, Homo sapiens
gggggactctgagcgggagg

SEQ ID NO: 1198902 - DNA, 22 bp, Homo sapiens
gggggagccccttctgctcagc

SEQ ID NO: 1198903 - DNA, 15 bp, Homo sapiens
gggggaggagtcagg

SEQ ID NO: 1198904 - DNA, 12 bp, Homo sapiens
gggggaggcagg

SEQ ID NO: 1198905 - DNA, 15 bp, Homo sapiens
gggggaggccacccc

SEQ ID NO: 1198906 - DNA, 19 bp, Homo sapiens
gggggaggggccctcaggc

SEQ ID NO: 1198907 - DNA, 16 bp, Homo sapiens
gggggagtagccaagc

SEQ ID NO: 1198908 - DNA, 18 bp, Homo sapiens
gggggatggtcagagccc

SEQ ID NO: 1198909 - DNA, 14 bp, Homo sapiens
gggggcacagctgt

SEQ ID NO: 1198910 - DNA, 23 bp, Homo sapiens
gggggcacagctgtctgccaggc

SEQ ID NO: 1198911 - DNA, 11 bp, Homo sapiens
gggggcagagg

SEQ ID NO: 1198912 - DNA, 13 bp, Homo sapiens
gggggcagcccag

SEQ ID NO: 1198913 - DNA, 13 bp, Homo sapiens
gggggcagggctg

SEQ ID NO: 1198914 - DNA, 15 bp, Homo sapiens
gggggccaacaccag

SEQ ID NO: 1198915 - DNA, 17 bp, Homo sapiens
gggggccaaggtcctgc

SEQ ID NO: 1198916 - DNA, 12 bp, Homo sapiens
gggggccagctg

SEQ ID NO: 1198917 - DNA, 15 bp, Homo sapiens
gggggccagctgggg

SEQ ID NO: 1198918 - DNA, 11 bp, Homo sapiens
gggggccaggc

SEQ ID NO: 1198919 - DNA, 19 bp, Homo sapiens
gggggccagggctggatgg

SEQ ID NO: 1198920 - DNA, 15 bp, Homo sapiens
gggggccatgagctc

SEQ ID NO: 1198921 - DNA, 12 bp, Homo sapiens
gggggccccacc

SEQ ID NO: 1198922 - DNA, 19 bp, Homo sapiens
gggggccccacctcggcac

SEQ ID NO: 1198923 - DNA, 22 bp, Homo sapiens
gggggccccgccagggctgggg

SEQ ID NO: 1198924 - DNA, 13 bp, Homo sapiens
gggggccggaccc

SEQ ID NO: 1198925 - DNA, 18 bp, Homo sapiens
gggggccgggcaggtcct

SEQ ID NO: 1198926 - DNA, 22 bp, Homo sapiens
gggggcctccgcttatcctgct

SEQ ID NO: 1198927 - DNA, 23 bp, Homo sapiens
gggggcgctcaggacccaggccc

SEQ ID NO: 1198928 - DNA, 15 bp, Homo sapiens
gggggcggaggagga

SEQ ID NO: 1198929 - DNA, 15 bp, Homo sapiens
gggggcgtggctggc

SEQ ID NO: 1198930 - DNA, 20 bp, Homo sapiens
gggggcgtggctggcctttc

SEQ ID NO: 1198931 - DNA, 22 bp, Homo sapiens
gggggctatagctacaggaagc

SEQ ID NO: 1198932 - DNA, 19 bp, Homo sapiens
gggggctcttcccctagac

SEQ ID NO: 1198933 - DNA, 14 bp, Homo sapiens
gggggctgctgggc

SEQ ID NO: 1198934 - DNA, 24 bp, Homo sapiens
gggggctgctgggcgtctgttctt

SEQ ID NO: 1198935 - DNA, 12 bp, Homo sapiens
gggggctggcct

SEQ ID NO: 1198936 - DNA, 12 bp, Homo sapiens
gggggctggctc

SEQ ID NO: 1198937 - DNA, 13 bp, Homo sapiens
gggggctggtgcc

SEQ ID NO: 1198938 - DNA, 14 bp, Homo sapiens
gggggctggtgcca

SEQ ID NO: 1198939 - DNA, 21 bp, Homo sapiens
gggggctggtgccagccttcc

SEQ ID NO: 1198940 - DNA, 13 bp, Homo sapiens
gggggctttggcc

SEQ ID NO: 1198941 - DNA, 13 bp, Homo sapiens
ggggggacagtgc

SEQ ID NO: 1198942 - DNA, 10 bp, Homo sapiens
ggggggagag

SEQ ID NO: 1198943 - DNA, 23 bp, Homo sapiens
ggggggcccgcctggcagaactg

SEQ ID NO: 1198944 - DNA, 11 bp, Homo sapiens
ggggggctggg

SEQ ID NO: 1198945 - DNA, 12 bp, Homo sapiens
ggggggctggga

SEQ ID NO: 1198946 - DNA, 14 bp, Homo sapiens
gggggtaggagagc

SEQ ID NO: 1198947 - DNA, 21 bp, Homo sapiens
gggggtaggagagcactgcct

SEQ ID NO: 1198948 - DNA, 21 bp, Homo sapiens
gggggtcagaagaagtgggag

SEQ ID NO: 1198949 - DNA, 22 bp, Homo sapiens
gggggtcagaagaagtgggagc

SEQ ID NO: 1198950 - DNA, 14 bp, Homo sapiens
gggggtgctggggc

SEQ ID NO: 1198951 - DNA, 10 bp, Homo sapiens
gggggtggca

SEQ ID NO: 1198952 - DNA, 12 bp, Homo sapiens
gggggtgggagg

SEQ ID NO: 1198953 - DNA, 22 bp, Homo sapiens
gggggtttcacctgggccctgg

SEQ ID NO: 1198954 - DNA, 24 bp, Homo sapiens
gggggtttttactccagtggtgaa

SEQ ID NO: 1198955 - DNA, 15 bp, Homo sapiens
ggggtagccccgccc

SEQ ID NO: 1198956 - DNA, 12 bp, Homo sapiens
ggggtagcctgg

SEQ ID NO: 1198957 - DNA, 16 bp, Homo sapiens
ggggtaggagagcact

SEQ ID NO: 1198958 - DNA, 17 bp, Homo sapiens
ggggtaggcagagcctt

SEQ ID NO: 1198959 - DNA, 22 bp, Homo sapiens
ggggtcagaagaagtgggagca

SEQ ID NO: 1198960 - DNA, 22 bp, Homo sapiens
ggggtcagggaccaaggacccc

SEQ ID NO: 1198961 - DNA, 12 bp, Homo sapiens
ggggtccagggc

SEQ ID NO: 1198962 - DNA, 13 bp, Homo sapiens
ggggtccagtgca

SEQ ID NO: 1198963 - DNA, 15 bp, Homo sapiens
ctgctacaagtgttt

SEQ ID NO: 1198964 - DNA, 16 bp, Homo sapiens
ctgctacaagtgtttt

SEQ ID NO: 1198965 - DNA, 17 bp, Homo sapiens
ctgctacccagaaatca

SEQ ID NO: 1198966 - DNA, 21 bp, Homo sapiens
ctgctaccgttgacttccagg

SEQ ID NO: 1198967 - DNA, 23 bp, Homo sapiens
ctgctactacccgagcccagcta

SEQ ID NO: 1198968 - DNA, 15 bp, Homo sapiens
ctgctactcctgtgc

SEQ ID NO: 1198969 - DNA, 17 bp, Homo sapiens
ctgctactcctgtgctc

SEQ ID NO: 1198970 - DNA, 19 bp, Homo sapiens
ctgctactcctgtgctctg

SEQ ID NO: 1198971 - DNA, 18 bp, Homo sapiens
ctgctactctgttccttc

SEQ ID NO: 1198972 - DNA, 22 bp, Homo sapiens
ctgctactctgttccttcacat

SEQ ID NO: 1198973 - DNA, 18 bp, Homo sapiens
ctgctactgcccctctcc

SEQ ID NO: 1198974 - DNA, 12 bp, Homo sapiens
ctgctagaacct

SEQ ID NO: 1198975 - DNA, 18 bp, Homo sapiens
ctgctagaacctctcgta

SEQ ID NO: 1198976 - DNA, 15 bp, Homo sapiens
ctgctagagcaaccc

SEQ ID NO: 1198977 - DNA, 21 bp, Homo sapiens
ctgctagattttaatttattt

SEQ ID NO: 1198978 - DNA, 22 bp, Homo sapiens
ctgctagattttaatttatttg

SEQ ID NO: 1198979 - DNA, 22 bp, Homo sapiens
ctgctagcacttggagccaagg

SEQ ID NO: 1198980 - DNA, 18 bp, Homo sapiens
ctgctagcaggcccccta

SEQ ID NO: 1198981 - DNA, 19 bp, Homo sapiens
ctgctaggcgagtgccagg

SEQ ID NO: 1198982 - DNA, 15 bp, Homo sapiens
ctgctaggtgggcca

SEQ ID NO: 1198983 - DNA, 16 bp, Homo sapiens
ctgctaggtgggccag

SEQ ID NO: 1198984 - DNA, 17 bp, Homo sapiens
ctgctagtgctgtaata

SEQ ID NO: 1198985 - DNA, 21 bp, Homo sapiens
ctgctagtgctgtaatattgt

SEQ ID NO: 1198986 - DNA, 13 bp, Homo sapiens
ctgctatatattt

SEQ ID NO: 1198987 - DNA, 20 bp, Homo sapiens
ctgctatatgccttaagcca

SEQ ID NO: 1198988 - DNA, 19 bp, Homo sapiens
ctgctatattaacatcatc

SEQ ID NO: 1198989 - DNA, 21 bp, Homo sapiens
ctgctatccccatctccctgc

SEQ ID NO: 1198990 - DNA, 13 bp, Homo sapiens
ctgctatgaaaat

SEQ ID NO: 1198991 - DNA, 21 bp, Homo sapiens
ctgctatgaaaatgagcatca

SEQ ID NO: 1198992 - DNA, 19 bp, Homo sapiens
ctgctatgacagctggcta

SEQ ID NO: 1198993 - DNA, 14 bp, Homo sapiens
ctgctatgcatttt

SEQ ID NO: 1198994 - DNA, 20 bp, Homo sapiens
ctgctatgcattttcttcac

SEQ ID NO: 1198995 - DNA, 21 bp, Homo sapiens
ctgctatgcattttcttcaca

SEQ ID NO: 1198996 - DNA, 21 bp, Homo sapiens
ctgctatggttttctccaaga

SEQ ID NO: 1198997 - DNA, 14 bp, Homo sapiens
ctgctattgctgtc

SEQ ID NO: 1198998 - DNA, 16 bp, Homo sapiens
ctgctattgctgtctg

SEQ ID NO: 1198999 - DNA, 21 bp, Homo sapiens
ctgctattgctgtctggtgag

SEQ ID NO: 1199000 - DNA, 20 bp, Homo sapiens
ctgctatttattttcctaaa

SEQ ID NO: 1199001 - DNA, 21 bp, Homo sapiens
ctgctatttattttcctaaag

SEQ ID NO: 1199002 - DNA, 16 bp, Homo sapiens
ctgctcaaggccacag

SEQ ID NO: 1199003 - DNA, 13 bp, Homo sapiens
ctgctcacaggga

SEQ ID NO: 1199004 - DNA, 16 bp, Homo sapiens
ctgctcacagggatgc

SEQ ID NO: 1199005 - DNA, 19 bp, Homo sapiens
ctgctcacagggatgctgg

SEQ ID NO: 1199006 - DNA, 14 bp, Homo sapiens
ctgctcacccacct

SEQ ID NO: 1199007 - DNA, 15 bp, Homo sapiens
ctgctcaccgcccat

SEQ ID NO: 1199008 - DNA, 17 bp, Homo sapiens
ctgctcagaacttgctg

SEQ ID NO: 1199009 - DNA, 18 bp, Homo sapiens
ctgctcagagctttaaaa

SEQ ID NO: 1199010 - DNA, 14 bp, Homo sapiens
ctgctcagcagcca

SEQ ID NO: 1199011 - DNA, 13 bp, Homo sapiens
ctgctcagctctg

SEQ ID NO: 1199012 - DNA, 17 bp, Homo sapiens
ctgctcagctctggtcc

SEQ ID NO: 1199013 - DNA, 18 bp, Homo sapiens
ctgctcagctctggtcca

SEQ ID NO: 1199014 - DNA, 23 bp, Homo sapiens
ctgctcagctctggtccaggccc

SEQ ID NO: 1199015 - DNA, 15 bp, Homo sapiens
ctgctcagcttctcc

SEQ ID NO: 1199016 - DNA, 21 bp, Homo sapiens
ctgctcaggaaaccacaacct

SEQ ID NO: 1199017 - DNA, 11 bp, Homo sapiens
ctgctcaggcc

SEQ ID NO: 1199018 - DNA, 13 bp, Homo sapiens
ctgctcaggctgc

SEQ ID NO: 1199019 - DNA, 16 bp, Homo sapiens
ctgctcaggctgcagc

SEQ ID NO: 1199020 - DNA, 19 bp, Homo sapiens
ctgctcaggctgcagctgg

SEQ ID NO: 1199021 - DNA, 23 bp, Homo sapiens
ctgctcaggctgcagctggacag

SEQ ID NO: 1199022 - DNA, 22 bp, Homo sapiens
ctgctcagggaaaagcagctct

SEQ ID NO: 1199023 - DNA, 23 bp, Homo sapiens
ctgctcagggaaaagcagctctc

SEQ ID NO: 1199024 - DNA, 19 bp, Homo sapiens
ctgctcatgggtggctgtg

SEQ ID NO: 1199025 - DNA, 22 bp, Homo sapiens
ctgctcattacagttctttcct

SEQ ID NO: 1199026 - DNA, 17 bp, Homo sapiens
ctgctccaagggacagg

SEQ ID NO: 1199027 - DNA, 16 bp, Homo sapiens
ctgctccaccacatcc

SEQ ID NO: 1199028 - DNA, 13 bp, Homo sapiens
ctgctccaccagc

SEQ ID NO: 1199029 - DNA, 14 bp, Homo sapiens
ctgctccacccttg

SEQ ID NO: 1199030 - DNA, 17 bp, Homo sapiens
ctgctccacccttggcc

SEQ ID NO: 1199031 - DNA, 20 bp, Homo sapiens
ctgctccacccttggcctgt

SEQ ID NO: 1199032 - DNA, 21 bp, Homo sapiens
ctgctccacccttggcctgtc

SEQ ID NO: 1199033 - DNA, 16 bp, Homo sapiens
ctgctccacgaagcct

SEQ ID NO: 1199034 - DNA, 13 bp, Homo sapiens
ctgctccagcccc

SEQ ID NO: 1199035 - DNA, 14 bp, Homo sapiens
ctgctccagctgtt

SEQ ID NO: 1199036 - DNA, 15 bp, Homo sapiens
ctgctccagctgttc

SEQ ID NO: 1199037 - DNA, 14 bp, Homo sapiens
ctgctccaggcctg

SEQ ID NO: 1199038 - DNA, 17 bp, Homo sapiens
ctgctccagtgggcagg

SEQ ID NO: 1199039 - DNA, 13 bp, Homo sapiens
ctgctccatgact

SEQ ID NO: 1199040 - DNA, 15 bp, Homo sapiens
ctgctccatgactgg

SEQ ID NO: 1199041 - DNA, 21 bp, Homo sapiens
ctgctccatttataaccccag

SEQ ID NO: 1199042 - DNA, 22 bp, Homo sapiens
ctgctccatttataaccccagc

SEQ ID NO: 1199043 - DNA, 17 bp, Homo sapiens
ctgctcccacacttgtg

SEQ ID NO: 1199044 - DNA, 22 bp, Homo sapiens
ctgctcccacacttgtgccagc

SEQ ID NO: 1199045 - DNA, 13 bp, Homo sapiens
ctgctcccacccc

SEQ ID NO: 1199046 - DNA, 17 bp, Homo sapiens
ctgctcccaccccagaa

SEQ ID NO: 1199047 - DNA, 22 bp, Homo sapiens
ctgctcccaccccagaaatcac

SEQ ID NO: 1199048 - DNA, 23 bp, Homo sapiens
ctgctcccaccccagaaatcact

SEQ ID NO: 1199049 - DNA, 21 bp, Homo sapiens
ctgctcccagcagccctaagg

SEQ ID NO: 1199050 - DNA, 13 bp, Homo sapiens
ctgctcccagcct

SEQ ID NO: 1199051 - DNA, 18 bp, Homo sapiens
ctgctcccagcctgctga

SEQ ID NO: 1199052 - DNA, 22 bp, Homo sapiens
ctgctcccagcctgctgagagc

SEQ ID NO: 1199053 - DNA, 16 bp, Homo sapiens
ctgctcccatcctcac

SEQ ID NO: 1199054 - DNA, 18 bp, Homo sapiens
ctgctcccatcctcaccc

SEQ ID NO: 1199055 - DNA, 20 bp, Homo sapiens
ctgctcccatcctcacccag

SEQ ID NO: 1199056 - DNA, 21 bp, Homo sapiens
ctgctcccatcctcacccaga

SEQ ID NO: 1199057 - DNA, 20 bp, Homo sapiens
ctgctccccaacacctgcct

SEQ ID NO: 1199058 - DNA, 19 bp, Homo sapiens
ctgctccccagccctggct

SEQ ID NO: 1199059 - DNA, 12 bp, Homo sapiens
ctgctcccccac

SEQ ID NO: 1199060 - DNA, 19 bp, Homo sapiens
ctgctcccctaaagcctca

SEQ ID NO: 1199061 - DNA, 22 bp, Homo sapiens
ctgctcccctgagaccaccccc

SEQ ID NO: 1199062 - DNA, 17 bp, Homo sapiens
ctgctccctaagccagc

SEQ ID NO: 1199063 - DNA, 20 bp, Homo sapiens
ctgctccctaagccagcctg

SEQ ID NO: 1199064 - DNA, 21 bp, Homo sapiens
ctgctccctaagccagcctgg

SEQ ID NO: 1199065 - DNA, 15 bp, Homo sapiens
ctgctccgctgctcc

SEQ ID NO: 1199066 - DNA, 17 bp, Homo sapiens
ctgctccgctgctcctt

SEQ ID NO: 1199067 - DNA, 18 bp, Homo sapiens
ctgctccgctgctccttg

SEQ ID NO: 1199068 - DNA, 18 bp, Homo sapiens
ctgctccggtttgggctg

SEQ ID NO: 1199069 - DNA, 15 bp, Homo sapiens
ctgctccgtggactg

SEQ ID NO: 1199070 - DNA, 22 bp, Homo sapiens
gggtccttgatgccagagggcc

SEQ ID NO: 1199071 - DNA, 19 bp, Homo sapiens
gggtccttttgacactgct

SEQ ID NO: 1199072 - DNA, 15 bp, Homo sapiens
gggtcggaagcctgt

SEQ ID NO: 1199073 - DNA, 16 bp, Homo sapiens
gggtcggccctgccca

SEQ ID NO: 1199074 - DNA, 23 bp, Homo sapiens
gggtctaaggagcgctagtgcct

SEQ ID NO: 1199075 - DNA, 14 bp, Homo sapiens
gggtctagggagag

SEQ ID NO: 1199076 - DNA, 17 bp, Homo sapiens
gggtctcactctgttgc

SEQ ID NO: 1199077 - DNA, 12 bp, Homo sapiens
gggtctcccctc

SEQ ID NO: 1199078 - DNA, 18 bp, Homo sapiens
gggtctcccctcctgcac

SEQ ID NO: 1199079 - DNA, 15 bp, Homo sapiens
gggtctccctctcct

SEQ ID NO: 1199080 - DNA, 11 bp, Homo sapiens
gggtctccctg

SEQ ID NO: 1199081 - DNA, 15 bp, Homo sapiens
gggtctccctggagt

SEQ ID NO: 1199082 - DNA, 14 bp, Homo sapiens
gggtctccctggct

SEQ ID NO: 1199083 - DNA, 21 bp, Homo sapiens
gggtctccctggctccctcct

SEQ ID NO: 1199084 - DNA, 22 bp, Homo sapiens
gggtctccctggctccctcctc

SEQ ID NO: 1199085 - DNA, 16 bp, Homo sapiens
gggtctcgcagcctga

SEQ ID NO: 1199086 - DNA, 17 bp, Homo sapiens
gggtctctccctcaggt

SEQ ID NO: 1199087 - DNA, 14 bp, Homo sapiens
gggtctctgaaggg

SEQ ID NO: 1199088 - DNA, 22 bp, Homo sapiens
gggtctctgaagggaccccccc

SEQ ID NO: 1199089 - DNA, 12 bp, Homo sapiens
gggtctctggaa

SEQ ID NO: 1199090 - DNA, 11 bp, Homo sapiens
ctgctcctgct

SEQ ID NO: 1199091 - DNA, 12 bp, Homo sapiens
ctgctcctgctt

SEQ ID NO: 1199092 - DNA, 22 bp, Homo sapiens
ctgctcctgcttttctgtcctg

SEQ ID NO: 1199093 - DNA, 23 bp, Homo sapiens
ctgctcctgcttttctgtcctgg

SEQ ID NO: 1199094 - DNA, 13 bp, Homo sapiens
ctgctcctggagc

SEQ ID NO: 1199095 - DNA, 14 bp, Homo sapiens
ctgctcctgtactt

SEQ ID NO: 1199096 - DNA, 15 bp, Homo sapiens
ctgctcctgtggcag

SEQ ID NO: 1199097 - DNA, 18 bp, Homo sapiens
ctgctcctgtggcaggag

SEQ ID NO: 1199098 - DNA, 11 bp, Homo sapiens
ctgctcctgtt

SEQ ID NO: 1199099 - DNA, 12 bp, Homo sapiens
ctgctccttcac

SEQ ID NO: 1199100 - DNA, 15 bp, Homo sapiens
ctgctccttcactgt

SEQ ID NO: 1199101 - DNA, 18 bp, Homo sapiens
ctgctccttcactgttcc

SEQ ID NO: 1199102 - DNA, 18 bp, Homo sapiens
ctgctccttggcaccccc

SEQ ID NO: 1199103 - DNA, 14 bp, Homo sapiens
ctgctcgccctcct

SEQ ID NO: 1199104 - DNA, 17 bp, Homo sapiens
ctgctcgccctcctttc

SEQ ID NO: 1199105 - DNA, 22 bp, Homo sapiens
ctgctcggcttcttggaccttg

SEQ ID NO: 1199106 - DNA, 16 bp, Homo sapiens
ctgctcgtggactgtg

SEQ ID NO: 1199107 - DNA, 18 bp, Homo sapiens
ctgctcgtggactgtgct

SEQ ID NO: 1199108 - DNA, 12 bp, Homo sapiens
ctgctctaacag

SEQ ID NO: 1199109 - DNA, 17 bp, Homo sapiens
ctgctctaacagccctc

SEQ ID NO: 1199110 - DNA, 23 bp, Homo sapiens
ctgctctacccatgagcctgccc

SEQ ID NO: 1199111 - DNA, 19 bp, Homo sapiens
ctgctctagaaagtataga

SEQ ID NO: 1199112 - DNA, 15 bp, Homo sapiens
ctgctctagctggca

SEQ ID NO: 1199113 - DNA, 22 bp, Homo sapiens
ctgctctagctggcaggacaca

SEQ ID NO: 1199114 - DNA, 16 bp, Homo sapiens
ctgctctagggaatct

SEQ ID NO: 1199115 - DNA, 16 bp, Homo sapiens
ctgctctagtgggaca

SEQ ID NO: 1199116 - DNA, 21 bp, Homo sapiens
ctgctctattccaaaaaggtt

SEQ ID NO: 1199117 - DNA, 15 bp, Homo sapiens
ctgctctattgtagc

SEQ ID NO: 1199118 - DNA, 19 bp, Homo sapiens
ctgctctccgcgcctaccc

SEQ ID NO: 1199119 - DNA, 13 bp, Homo sapiens
ctgctctctgctc

SEQ ID NO: 1199120 - DNA, 14 bp, Homo sapiens
ctgctctctgctca

SEQ ID NO: 1199121 - DNA, 19 bp, Homo sapiens
ctgctctctgctcatgggt

SEQ ID NO: 1199122 - DNA, 18 bp, Homo sapiens
ctgctctcttcaggaggc

SEQ ID NO: 1199123 - DNA, 16 bp, Homo sapiens
ctgctctgaccttcca

SEQ ID NO: 1199124 - DNA, 13 bp, Homo sapiens
ctgctctgagaat

SEQ ID NO: 1199125 - DNA, 13 bp, Homo sapiens
ctgctctgagcca

SEQ ID NO: 1199126 - DNA, 19 bp, Homo sapiens
ctgctctgaggcttccaga

SEQ ID NO: 1199127 - DNA, 21 bp, Homo sapiens
ctgctctgaggcttccagaga

SEQ ID NO: 1199128 - DNA, 11 bp, Homo sapiens
ctgctctgcca

SEQ ID NO: 1199129 - DNA, 11 bp, Homo sapiens
ctgctctgccc

SEQ ID NO: 1199130 - DNA, 22 bp, Homo sapiens
ctgctctgcccttgttccctag

SEQ ID NO: 1199131 - DNA, 11 bp, Homo sapiens
ctgctctgcta

SEQ ID NO: 1199132 - DNA, 14 bp, Homo sapiens
ctgctctgctgtga

SEQ ID NO: 1199133 - DNA, 23 bp, Homo sapiens
ctgctctggaataaagttgcaga

SEQ ID NO: 1199134 - DNA, 13 bp, Homo sapiens
ctgctctggtggc

SEQ ID NO: 1199135 - DNA, 17 bp, Homo sapiens
ctgctctgtccccaaag

SEQ ID NO: 1199136 - DNA, 15 bp, Homo sapiens
ctgctcttagtgccc

SEQ ID NO: 1199137 - DNA, 18 bp, Homo sapiens
ctgctcttagtgcccgcc

SEQ ID NO: 1199138 - DNA, 17 bp, Homo sapiens
ctgctcttccaaagctc

SEQ ID NO: 1199139 - DNA, 14 bp, Homo sapiens
ctgctcttcccagt

SEQ ID NO: 1199140 - DNA, 17 bp, Homo sapiens
ctgctcttctgtgccca

SEQ ID NO: 1199141 - DNA, 17 bp, Homo sapiens
ctgctcttgaacattgt

SEQ ID NO: 1199142 - DNA, 21 bp, Homo sapiens
ctgctcttgtttcactccacc

SEQ ID NO: 1199143 - DNA, 22 bp, Homo sapiens
ctgctctttctacatgactggg

SEQ ID NO: 1199144 - DNA, 16 bp, Homo sapiens
ctgctctttctctgcc

SEQ ID NO: 1199145 - DNA, 17 bp, Homo sapiens
ctgctctttctctgcca

SEQ ID NO: 1199146 - DNA, 15 bp, Homo sapiens
ctgctcttttgtgat

SEQ ID NO: 1199147 - DNA, 21 bp, Homo sapiens
ctgctcttttgtgatgaacat

SEQ ID NO: 1199148 - DNA, 22 bp, Homo sapiens
ctgctcttttgtgatgaacata

SEQ ID NO: 1199149 - DNA, 19 bp, Homo sapiens
ctgctgaagatgcccctgc

SEQ ID NO: 1199150 - DNA, 23 bp, Homo sapiens
ctgctgaagatgcccctgctccc

SEQ ID NO: 1199151 - DNA, 19 bp, Homo sapiens
ctgctgaaggacagaacat

SEQ ID NO: 1199152 - DNA, 17 bp, Homo sapiens
ctgctgaagttctgagc

SEQ ID NO: 1199153 - DNA, 19 bp, Homo sapiens
ctgctgaatgcagggaatg

SEQ ID NO: 1199154 - DNA, 20 bp, Homo sapiens
ctgctgaattgtttataatg

SEQ ID NO: 1199155 - DNA, 22 bp, Homo sapiens
ctgctgacacgcagcctgctct

SEQ ID NO: 1199156 - DNA, 15 bp, Homo sapiens
ctgctgaccaaatgg

SEQ ID NO: 1199157 - DNA, 14 bp, Homo sapiens
ctgctgacctgctg

SEQ ID NO: 1199158 - DNA, 21 bp, Homo sapiens
ctgctgacctgctgacctgtg

SEQ ID NO: 1199159 - DNA, 16 bp, Homo sapiens
ctgctgactgtttcat

SEQ ID NO: 1199160 - DNA, 20 bp, Homo sapiens
ctgctgactgtttcattcac

SEQ ID NO: 1199161 - DNA, 21 bp, Homo sapiens
ctgctgactgttttctcttga

SEQ ID NO: 1199162 - DNA, 16 bp, Homo sapiens
ctgctgagagacccaa

SEQ ID NO: 1199163 - DNA, 21 bp, Homo sapiens
ctgctgagagacccaaggagg

SEQ ID NO: 1199164 - DNA, 20 bp, Homo sapiens
ctgctgagagcccccacctt

SEQ ID NO: 1199165 - DNA, 11 bp, Homo sapiens
ctgctgagcca

SEQ ID NO: 1199166 - DNA, 12 bp, Homo sapiens
ctgctgagctgg

SEQ ID NO: 1199167 - DNA, 22 bp, Homo sapiens
ctgctgagctggcccttgggga

SEQ ID NO: 1199168 - DNA, 13 bp, Homo sapiens
ctgctgagctggg

SEQ ID NO: 1199169 - DNA, 21 bp, Homo sapiens
ctgctgaggaggggcctgggc

SEQ ID NO: 1199170 - DNA, 12 bp, Homo sapiens
ctgctgaggccc

SEQ ID NO: 1199171 - DNA, 16 bp, Homo sapiens
ctgctgaggccttctc

SEQ ID NO: 1199172 - DNA, 13 bp, Homo sapiens
ctgctgagtgctg

SEQ ID NO: 1199173 - DNA, 16 bp, Homo sapiens
ctgctgagtgctgggc

SEQ ID NO: 1199174 - DNA, 17 bp, Homo sapiens
ctgctgagtgctgggca

SEQ ID NO: 1199175 - DNA, 19 bp, Homo sapiens
ctgctgatattttctctag

SEQ ID NO: 1199176 - DNA, 15 bp, Homo sapiens
ctgctgattcttgta

SEQ ID NO: 1199177 - DNA, 19 bp, Homo sapiens
ctgctgattcttgtaaatc

SEQ ID NO: 1199178 - DNA, 21 bp, Homo sapiens
ctgctgattcttgtaaatctt

SEQ ID NO: 1199179 - DNA, 22 bp, Homo sapiens
ctgctgcaaggtggcctctgcc

SEQ ID NO: 1199180 - DNA, 16 bp, Homo sapiens
ctgctgcaccaacctc

SEQ ID NO: 1199181 - DNA, 14 bp, Homo sapiens
ctgctgcaccagag

SEQ ID NO: 1199182 - DNA, 17 bp, Homo sapiens
ctgctgcaccagagtga

SEQ ID NO: 1199183 - DNA, 22 bp, Homo sapiens
ctgctgcaggccgtgtgtctgt

SEQ ID NO: 1199184 - DNA, 15 bp, Homo sapiens
ctgctgcagtagggg

SEQ ID NO: 1199185 - DNA, 20 bp, Homo sapiens
ctgctgcagttaccacagca

SEQ ID NO: 1199186 - DNA, 16 bp, Homo sapiens
ctgctgcatggggtgg

SEQ ID NO: 1199187 - DNA, 13 bp, Homo sapiens
ctgctgccacagc

SEQ ID NO: 1199188 - DNA, 14 bp, Homo sapiens
ctgctgccagtgca

SEQ ID NO: 1199189 - DNA, 22 bp, Homo sapiens
ctgctgccatggcgtgtccctc

SEQ ID NO: 1199190 - DNA, 13 bp, Homo sapiens
ctgctgcccaggc

SEQ ID NO: 1199191 - DNA, 19 bp, Homo sapiens
ctgctgcccaggctgtgca

SEQ ID NO: 1199192 - DNA, 13 bp, Homo sapiens
ctgctgccccagc

SEQ ID NO: 1199193 - DNA, 15 bp, Homo sapiens
ctgcttacttggtga

SEQ ID NO: 1199194 - DNA, 12 bp, Homo sapiens
ctgcttactttt

SEQ ID NO: 1199195 - DNA, 17 bp, Homo sapiens
ctgcttactttttatat

SEQ ID NO: 1199196 - DNA, 15 bp, Homo sapiens
ctgcttagaatctga

SEQ ID NO: 1199197 - DNA, 21 bp, Homo sapiens
ctgcttagctgccttgagcta

SEQ ID NO: 1199198 - DNA, 12 bp, Homo sapiens
ctgcttcagtgg

SEQ ID NO: 1199199 - DNA, 16 bp, Homo sapiens
ctgcttcatgtgaaca

SEQ ID NO: 1199200 - DNA, 24 bp, Homo sapiens
ctgcttccaattttctggaataca

SEQ ID NO: 1199201 - DNA, 11 bp, Homo sapiens
ctgcttccagg

SEQ ID NO: 1199202 - DNA, 14 bp, Homo sapiens
ctgcttcccatcct

SEQ ID NO: 1199203 - DNA, 19 bp, Homo sapiens
ctgcttcccatcctaccct

SEQ ID NO: 1199204 - DNA, 12 bp, Homo sapiens
ctgcttcccctc

SEQ ID NO: 1199205 - DNA, 14 bp, Homo sapiens
ctgcttcccctccc

SEQ ID NO: 1199206 - DNA, 21 bp, Homo sapiens
ctgcttccctctgcctgtccc

SEQ ID NO: 1199207 - DNA, 13 bp, Homo sapiens
ctgcttcctcctg

SEQ ID NO: 1199208 - DNA, 16 bp, Homo sapiens
ctgcttcctcctggaa

SEQ ID NO: 1199209 - DNA, 14 bp, Homo sapiens
ctgcttcctgcttg

SEQ ID NO: 1199210 - DNA, 15 bp, Homo sapiens
ctgcttcctgcttgc

SEQ ID NO: 1199211 - DNA, 13 bp, Homo sapiens
ctgcttcctgtga

SEQ ID NO: 1199212 - DNA, 17 bp, Homo sapiens
ctgcttcctgtgacagt

SEQ ID NO: 1199213 - DNA, 21 bp, Homo sapiens
ctgcttctccccccatcccag

SEQ ID NO: 1199214 - DNA, 23 bp, Homo sapiens
ctgcttctccccccatcccaggg

SEQ ID NO: 1199215 - DNA, 12 bp, Homo sapiens
ctgcttctcccg

SEQ ID NO: 1199216 - DNA, 23 bp, Homo sapiens
ctgcttctcggggtccagtgcat

SEQ ID NO: 1199217 - DNA, 15 bp, Homo sapiens
ctgcttctctgactt

SEQ ID NO: 1199218 - DNA, 19 bp, Homo sapiens
ctgcttctctgacttctgc

SEQ ID NO: 1199219 - DNA, 21 bp, Homo sapiens
ctgcttctctgacttctgcct

SEQ ID NO: 1199220 - DNA, 23 bp, Homo sapiens
ctgcttctctgacttctgcctgg

SEQ ID NO: 1199221 - DNA, 24 bp, Homo sapiens
gggtgtcaaacattcgtgagctgg

SEQ ID NO: 1199222 - DNA, 20 bp, Homo sapiens
gggtgtccgccatccagggt

SEQ ID NO: 1199223 - DNA, 19 bp, Homo sapiens
gggtgtcctgcctgtctgc

SEQ ID NO: 1199224 - DNA, 13 bp, Homo sapiens
gggtgtctccctc

SEQ ID NO: 1199225 - DNA, 15 bp, Homo sapiens
gggtgtgagtggcat

SEQ ID NO: 1199226 - DNA, 14 bp, Homo sapiens
gggtgtggcacgca

SEQ ID NO: 1199227 - DNA, 13 bp, Homo sapiens
gggtgtggccagc

SEQ ID NO: 1199228 - DNA, 13 bp, Homo sapiens
gggtgtggcctca

SEQ ID NO: 1199229 - DNA, 19 bp, Homo sapiens
gggtgtgggacacctggga

SEQ ID NO: 1199230 - DNA, 16 bp, Homo sapiens
gggtgtggggtggggt

SEQ ID NO: 1199231 - DNA, 18 bp, Homo sapiens
gggtgttgtatggggagg

SEQ ID NO: 1199232 - DNA, 22 bp, Homo sapiens
gggttaacccttcatcttcctg

SEQ ID NO: 1199233 - DNA, 16 bp, Homo sapiens
gggttaattcatttgg

SEQ ID NO: 1199234 - DNA, 15 bp, Homo sapiens
gggttacctccctcg

SEQ ID NO: 1199235 - DNA, 17 bp, Homo sapiens
gggttagaggagtctgt

SEQ ID NO: 1199236 - DNA, 19 bp, Homo sapiens
gggttatttttattaaatg

SEQ ID NO: 1199237 - DNA, 21 bp, Homo sapiens
gggttcacttgccatgcagga

SEQ ID NO: 1199238 - DNA, 22 bp, Homo sapiens
gggttcacttgccatgcaggaa

SEQ ID NO: 1199239 - DNA, 19 bp, Homo sapiens
gggttcagaaatgctgcct

SEQ ID NO: 1199240 - DNA, 13 bp, Homo sapiens
gggttcagcccct

SEQ ID NO: 1199241 - DNA, 21 bp, Homo sapiens
gggttcagcccctcctctgcc

SEQ ID NO: 1199242 - DNA, 21 bp, Homo sapiens
gggttcataggtcactggctc

SEQ ID NO: 1199243 - DNA, 13 bp, Homo sapiens
gggttcattattg

SEQ ID NO: 1199244 - DNA, 14 bp, Homo sapiens
gggttcatttgtgt

SEQ ID NO: 1199245 - DNA, 20 bp, Homo sapiens
gggttccccacacagggcac

SEQ ID NO: 1199246 - DNA, 15 bp, Homo sapiens
gggttcccccagccc

SEQ ID NO: 1199247 - DNA, 13 bp, Homo sapiens
gggttcccctggc

SEQ ID NO: 1199248 - DNA, 18 bp, Homo sapiens
gggttccctttccttcca

SEQ ID NO: 1199249 - DNA, 19 bp, Homo sapiens
gggttccgggaggcagaga

SEQ ID NO: 1199250 - DNA, 14 bp, Homo sapiens
gggttcctcttccc

SEQ ID NO: 1199251 - DNA, 14 bp, Homo sapiens
gggttcctgctgtg

SEQ ID NO: 1199252 - DNA, 19 bp, Homo sapiens
gggttcggttgcagggctg

SEQ ID NO: 1199253 - DNA, 16 bp, Homo sapiens
gggttcgttggggaca

SEQ ID NO: 1199254 - DNA, 19 bp, Homo sapiens
gggttctagacgcccctcc

SEQ ID NO: 1199255 - DNA, 22 bp, Homo sapiens
gggttctaggcatctctgtact

SEQ ID NO: 1199256 - DNA, 19 bp, Homo sapiens
gggttctcagtgccggagg

SEQ ID NO: 1199257 - DNA, 20 bp, Homo sapiens
gggttctgccctgcctgagg

SEQ ID NO: 1199258 - DNA, 13 bp, Homo sapiens
gggttctgcctct

SEQ ID NO: 1199259 - DNA, 13 bp, Homo sapiens
gggttctggcagg

SEQ ID NO: 1199260 - DNA, 16 bp, Homo sapiens
gggttctttcttcctc

SEQ ID NO: 1199261 - DNA, 16 bp, Homo sapiens
gggttctttggaagga

SEQ ID NO: 1199262 - DNA, 19 bp, Homo sapiens
gggttctttggaaggagtg

SEQ ID NO: 1199263 - DNA, 13 bp, Homo sapiens
gggttggccagga

SEQ ID NO: 1199264 - DNA, 12 bp, Homo sapiens
gggttggccctt

SEQ ID NO: 1199265 - DNA, 20 bp, Homo sapiens
gggttggctgggcccagaag

SEQ ID NO: 1199266 - DNA, 17 bp, Homo sapiens
gggttggctgttccaga

SEQ ID NO: 1199267 - DNA, 18 bp, Homo sapiens
gggttggggtgggagggc

SEQ ID NO: 1199268 - DNA, 21 bp, Homo sapiens
gggttgggttcatctgagcaa

SEQ ID NO: 1199269 - DNA, 17 bp, Homo sapiens
gggttgtccccgctggc

SEQ ID NO: 1199270 - DNA, 21 bp, Homo sapiens
gggttgtgaggcctggccagg

SEQ ID NO: 1199271 - DNA, 20 bp, Homo sapiens
gggtttcaccgtgttagcca

SEQ ID NO: 1199272 - DNA, 20 bp, Homo sapiens
gggtttcacctgggccctgg

SEQ ID NO: 1199273 - DNA, 14 bp, Homo sapiens
gggtttgaattgtt

SEQ ID NO: 1199274 - DNA, 21 bp, Homo sapiens
gggtttgagtcaaaagcctgg

SEQ ID NO: 1199275 - DNA, 15 bp, Homo sapiens
gggtttgctcatgta

SEQ ID NO: 1199276 - DNA, 20 bp, Homo sapiens
gggtttggaccccagctggg

SEQ ID NO: 1199277 - DNA, 21 bp, Homo sapiens
gggtttggaccccagctggga

SEQ ID NO: 1199278 - DNA, 13 bp, Homo sapiens
gggtttggccagg

SEQ ID NO: 1199279 - DNA, 15 bp, Homo sapiens
gggtttggccaggga

SEQ ID NO: 1199280 - DNA, 13 bp, Homo sapiens
gggtttggcccaa

SEQ ID NO: 1199281 - DNA, 16 bp, Homo sapiens
gggttttccaccctgg

SEQ ID NO: 1199282 - DNA, 17 bp, Homo sapiens
gggttttccaccctgga

SEQ ID NO: 1199283 - DNA, 12 bp, Homo sapiens
gggttttcttaa

SEQ ID NO: 1199284 - DNA, 13 bp, Homo sapiens
gggttttgtaatg

SEQ ID NO: 1199285 - DNA, 18 bp, Homo sapiens
gggttttgtattctctga

SEQ ID NO: 1199286 - DNA, 13 bp, Homo sapiens
gggtttttgctgt

SEQ ID NO: 1199287 - DNA, 16 bp, Homo sapiens
gggttttttgggaaga

SEQ ID NO: 1199288 - DNA, 18 bp, Homo sapiens
gggttttttttttctgaa

SEQ ID NO: 1199289 - DNA, 19 bp, Homo sapiens
gggttttttttttttcctt

SEQ ID NO: 1199290 - DNA, 19 bp, Homo sapiens
ggtaaaaacagcagctcat

SEQ ID NO: 1199291 - DNA, 18 bp, Homo sapiens
ggtaaaacagggccacat

SEQ ID NO: 1199292 - DNA, 19 bp, Homo sapiens
ggtaaaactcactgtgatc

SEQ ID NO: 1199293 - DNA, 12 bp, Homo sapiens
ggtaaaatcact

SEQ ID NO: 1199294 - DNA, 20 bp, Homo sapiens
ggtaaaatcacttcagatct

SEQ ID NO: 1199295 - DNA, 15 bp, Homo sapiens
ggtaaagactggctt

SEQ ID NO: 1199296 - DNA, 16 bp, Homo sapiens
ggtaaagactggcttt

SEQ ID NO: 1199297 - DNA, 23 bp, Homo sapiens
ggtaaagccatgttaaatgactt

SEQ ID NO: 1199298 - DNA, 19 bp, Homo sapiens
ggtaaataaaaagaaaggc

SEQ ID NO: 1199299 - DNA, 14 bp, Homo sapiens
ggtaaatactgtga

SEQ ID NO: 1199300 - DNA, 10 bp, Homo sapiens
ggtaaatgtt

SEQ ID NO: 1199301 - DNA, 22 bp, Homo sapiens
ggtaaattgtcgggggagagag

SEQ ID NO: 1199302 - DNA, 21 bp, Homo sapiens
ggtaaatttttgaaaaatatt

SEQ ID NO: 1199303 - DNA, 22 bp, Homo sapiens
ggtaacgagggcaacagggagc

SEQ ID NO: 1199304 - DNA, 18 bp, Homo sapiens
ggtaacgtggctccacct

SEQ ID NO: 1199305 - DNA, 14 bp, Homo sapiens
ggtaactaactgct

SEQ ID NO: 1199306 - DNA, 19 bp, Homo sapiens
ggtaactgcacctgggcag

SEQ ID NO: 1199307 - DNA, 18 bp, Homo sapiens
ggtaactgctttctgttc

SEQ ID NO: 1199308 - DNA, 20 bp, Homo sapiens
ggtaattgttttttaaagca

SEQ ID NO: 1199309 - DNA, 21 bp, Homo sapiens
ggtaatttataaagaaaaata

SEQ ID NO: 1199310 - DNA, 11 bp, Homo sapiens
ggtaatttttt

SEQ ID NO: 1199311 - DNA, 21 bp, Homo sapiens
ggtaattttttttgttttttg

SEQ ID NO: 1199312 - DNA, 13 bp, Homo sapiens
ggtacaaatgtga

SEQ ID NO: 1199313 - DNA, 18 bp, Homo sapiens
ggtacaagttctggcaag

SEQ ID NO: 1199314 - DNA, 20 bp, Homo sapiens
ggtacagaaaacatgtttaa

SEQ ID NO: 1199315 - DNA, 20 bp, Homo sapiens
ctggaaaggggggagctggg

SEQ ID NO: 1199316 - DNA, 16 bp, Homo sapiens
ctggaaatattaagaa

SEQ ID NO: 1199317 - DNA, 21 bp, Homo sapiens
ctggaaatgtaaaattgaaaa

SEQ ID NO: 1199318 - DNA, 21 bp, Homo sapiens
ctggaaattccaggaaccaaa

SEQ ID NO: 1199319 - DNA, 16 bp, Homo sapiens
ctggaaattttgtcca

SEQ ID NO: 1199320 - DNA, 17 bp, Homo sapiens
ctggaacaaattatttt

SEQ ID NO: 1199321 - DNA, 16 bp, Homo sapiens
ctggaacatggctagc

SEQ ID NO: 1199322 - DNA, 20 bp, Homo sapiens
ctggaacatggctagccttt

SEQ ID NO: 1199323 - DNA, 20 bp, Homo sapiens
ctggaacatttgatattttt

SEQ ID NO: 1199324 - DNA, 14 bp, Homo sapiens
ctggaaccagagcc

SEQ ID NO: 1199325 - DNA, 20 bp, Homo sapiens
ctggaaccagggaggagagg

SEQ ID NO: 1199326 - DNA, 18 bp, Homo sapiens
ctggaacccaggaggtgg

SEQ ID NO: 1199327 - DNA, 14 bp, Homo sapiens
ctggaaccccccag

SEQ ID NO: 1199328 - DNA, 21 bp, Homo sapiens
ctggaaccccccaggccctac

SEQ ID NO: 1199329 - DNA, 15 bp, Homo sapiens
ctggaacctgcaaaa

SEQ ID NO: 1199330 - DNA, 15 bp, Homo sapiens
ctggaaccttgctgt

SEQ ID NO: 1199331 - DNA, 18 bp, Homo sapiens
ctggaagaaaaaaaccac

SEQ ID NO: 1199332 - DNA, 13 bp, Homo sapiens
ctggaagaacatc

SEQ ID NO: 1199333 - DNA, 21 bp, Homo sapiens
ctggaagaacatcaagatacc

SEQ ID NO: 1199334 - DNA, 18 bp, Homo sapiens
ctggaagacacttcagat

SEQ ID NO: 1199335 - DNA, 19 bp, Homo sapiens
ctggaagactgctcccggc

SEQ ID NO: 1199336 - DNA, 14 bp, Homo sapiens
ctggaagagcccag

SEQ ID NO: 1199337 - DNA, 12 bp, Homo sapiens
ctggaagcacat

SEQ ID NO: 1199338 - DNA, 18 bp, Homo sapiens
ctggaagcaggtgctaca

SEQ ID NO: 1199339 - DNA, 16 bp, Homo sapiens
ctggaagccagctttc

SEQ ID NO: 1199340 - DNA, 12 bp, Homo sapiens
ctggaagcccag

SEQ ID NO: 1199341 - DNA, 12 bp, Homo sapiens
ctggaagcctgc

SEQ ID NO: 1199342 - DNA, 17 bp, Homo sapiens
ctggaagctaatttgca

SEQ ID NO: 1199343 - DNA, 14 bp, Homo sapiens
ctggaaggacacag

SEQ ID NO: 1199344 - DNA, 17 bp, Homo sapiens
ctggaaggacacagtga

SEQ ID NO: 1199345 - DNA, 17 bp, Homo sapiens
ctggaaggagtgagagg

SEQ ID NO: 1199346 - DNA, 21 bp, Homo sapiens
ctggaaggcagggcagaggga

SEQ ID NO: 1199347 - DNA, 19 bp, Homo sapiens
ctggaaggctggctgagtg

SEQ ID NO: 1199348 - DNA, 20 bp, Homo sapiens
ctggaagggaggaaggcctt

SEQ ID NO: 1199349 - DNA, 15 bp, Homo sapiens
ggtagaatgtaaagc

SEQ ID NO: 1199350 - DNA, 18 bp, Homo sapiens
ggtagaccttgagggtgg

SEQ ID NO: 1199351 - DNA, 23 bp, Homo sapiens
ggtagacttggacatctctctgg

SEQ ID NO: 1199352 - DNA, 15 bp, Homo sapiens
ggtagagacccccag

SEQ ID NO: 1199353 - DNA, 16 bp, Homo sapiens
ggtagagacccccagg

SEQ ID NO: 1199354 - DNA, 18 bp, Homo sapiens
ggtagagacccccaggcc

SEQ ID NO: 1199355 - DNA, 17 bp, Homo sapiens
ggtagagaggggactgg

SEQ ID NO: 1199356 - DNA, 21 bp, Homo sapiens
ggtagagaggggactggggga

SEQ ID NO: 1199357 - DNA, 23 bp, Homo sapiens
ggtagagcaaaggagacaaagca

SEQ ID NO: 1199358 - DNA, 18 bp, Homo sapiens
ggtagatcacgagatcaa

SEQ ID NO: 1199359 - DNA, 23 bp, Homo sapiens
ggtagatccagatccagactgta

SEQ ID NO: 1199360 - DNA, 19 bp, Homo sapiens
ggtagatcgcttgagccca

SEQ ID NO: 1199361 - DNA, 22 bp, Homo sapiens
ggtagatcgcttgagcccagga

SEQ ID NO: 1199362 - DNA, 14 bp, Homo sapiens
ggtagcagctggac

SEQ ID NO: 1199363 - DNA, 12 bp, Homo sapiens
ggtagccatccc

SEQ ID NO: 1199364 - DNA, 21 bp, Homo sapiens
ggtagccccgccccagccctc

SEQ ID NO: 1199365 - DNA, 16 bp, Homo sapiens
ggtagcgagctgctct

SEQ ID NO: 1199366 - DNA, 20 bp, Homo sapiens
ggtagcgagctgctctgcta

SEQ ID NO: 1199367 - DNA, 20 bp, Homo sapiens
ggtagctagcgtgtgccagg

SEQ ID NO: 1199368 - DNA, 12 bp, Homo sapiens
ggtagctgaggg

SEQ ID NO: 1199369 - DNA, 17 bp, Homo sapiens
ggtagctggtggttgtg

SEQ ID NO: 1199370 - DNA, 16 bp, Homo sapiens
ggtaggagagcactgc

SEQ ID NO: 1199371 - DNA, 18 bp, Homo sapiens
ggtaggagagcactgcct

SEQ ID NO: 1199372 - DNA, 14 bp, Homo sapiens
ggtaggagaggaga

SEQ ID NO: 1199373 - DNA, 12 bp, Homo sapiens
ggtaggcccttg

SEQ ID NO: 1199374 - DNA, 14 bp, Homo sapiens
ggtaggcccttgtc

SEQ ID NO: 1199375 - DNA, 19 bp, Homo sapiens
ggtaggcccttgtcctgcc

SEQ ID NO: 1199376 - DNA, 21 bp, Homo sapiens
ggtagggatatggcaggactc

SEQ ID NO: 1199377 - DNA, 12 bp, Homo sapiens
ggtagggcagac

SEQ ID NO: 1199378 - DNA, 15 bp, Homo sapiens
ggtagggcagacatg

SEQ ID NO: 1199379 - DNA, 14 bp, Homo sapiens
ggtaggggagggca

SEQ ID NO: 1199380 - DNA, 15 bp, Homo sapiens
ggtaggttcagccaa

SEQ ID NO: 1199381 - DNA, 18 bp, Homo sapiens
ggtaggttcagccaaggt

SEQ ID NO: 1199382 - DNA, 19 bp, Homo sapiens
ggtaggttcagccaaggtt

SEQ ID NO: 1199383 - DNA, 17 bp, Homo sapiens
ggtaggttgggacacca

SEQ ID NO: 1199384 - DNA, 16 bp, Homo sapiens
ggtagtgtagctgtgt

SEQ ID NO: 1199385 - DNA, 21 bp, Homo sapiens
ggtagttcaaagagtctgtct

SEQ ID NO: 1199386 - DNA, 18 bp, Homo sapiens
ggtagttctgtgcctccc

SEQ ID NO: 1199387 - DNA, 21 bp, Homo sapiens
ggtagttctgtgcctcccccc

SEQ ID NO: 1199388 - DNA, 13 bp, Homo sapiens
ggtataaagacaa

SEQ ID NO: 1199389 - DNA, 20 bp, Homo sapiens
ggtataatggttgactgggt

SEQ ID NO: 1199390 - DNA, 13 bp, Homo sapiens
ggtatagaaatgc

SEQ ID NO: 1199391 - DNA, 22 bp, Homo sapiens
ggtatatcattataactgaagg

SEQ ID NO: 1199392 - DNA, 12 bp, Homo sapiens
ggtatattttcc

SEQ ID NO: 1199393 - DNA, 21 bp, Homo sapiens
ggtatatttttgataccttca

SEQ ID NO: 1199394 - DNA, 16 bp, Homo sapiens
ggtatcagttatatga

SEQ ID NO: 1199395 - DNA, 18 bp, Homo sapiens
ggtatccccccatcttgc

SEQ ID NO: 1199396 - DNA, 12 bp, Homo sapiens
ggtatcctccct

SEQ ID NO: 1199397 - DNA, 16 bp, Homo sapiens
ggtatcctccctgccc

SEQ ID NO: 1199398 - DNA, 18 bp, Homo sapiens
ggtatcctccctgcccat

SEQ ID NO: 1199399 - DNA, 19 bp, Homo sapiens
ggtatcctccctgcccatc

SEQ ID NO: 1199400 - DNA, 17 bp, Homo sapiens
ggtatcctgcccagtgt

SEQ ID NO: 1199401 - DNA, 16 bp, Homo sapiens
ggtatgagctgagggg

SEQ ID NO: 1199402 - DNA, 16 bp, Homo sapiens
ggtatgatcaataaag

SEQ ID NO: 1199403 - DNA, 15 bp, Homo sapiens
ggtatgctggccagc

SEQ ID NO: 1199404 - DNA, 21 bp, Homo sapiens
ggtatgctggccagcaccctc

SEQ ID NO: 1199405 - DNA, 15 bp, Homo sapiens
ggtatggaactctct

SEQ ID NO: 1199406 - DNA, 13 bp, Homo sapiens
ggtatgggaagcc

SEQ ID NO: 1199407 - DNA, 18 bp, Homo sapiens
ggtatggtggggatattt

SEQ ID NO: 1199408 - DNA, 14 bp, Homo sapiens
ggtatgtctgccat

SEQ ID NO: 1199409 - DNA, 17 bp, Homo sapiens
ggtatgtgtgtgtgggt

SEQ ID NO: 1199410 - DNA, 14 bp, Homo sapiens
ggtatgttcctaag

SEQ ID NO: 1199411 - DNA, 18 bp, Homo sapiens
ggtatgtttaatctgtta

SEQ ID NO: 1199412 - DNA, 16 bp, Homo sapiens
ggtattaatcttgtgt

SEQ ID NO: 1199413 - DNA, 18 bp, Homo sapiens
ggtattccttttgtgtac

SEQ ID NO: 1199414 - DNA, 14 bp, Homo sapiens
ggtattggcctgtt

SEQ ID NO: 1199415 - DNA, 18 bp, Homo sapiens
ggtattgtctactctgaa

SEQ ID NO: 1199416 - DNA, 21 bp, Homo sapiens
ggtattttattttggcttcat

SEQ ID NO: 1199417 - DNA, 18 bp, Homo sapiens
ggtatttttgccctgagt

SEQ ID NO: 1199418 - DNA, 22 bp, Homo sapiens
ggtcaaaccgcactcacccatg

SEQ ID NO: 1199419 - DNA, 21 bp, Homo sapiens
ggtcaacacaggtagcacaga

SEQ ID NO: 1199420 - DNA, 14 bp, Homo sapiens
ggtcaacagagaag

SEQ ID NO: 1199421 - DNA, 22 bp, Homo sapiens
ggtcaacctttgtgtggctcct

SEQ ID NO: 1199422 - DNA, 19 bp, Homo sapiens
ggtcaagaaacagccagca

SEQ ID NO: 1199423 - DNA, 20 bp, Homo sapiens
ggtcaagaaaggaggggaga

SEQ ID NO: 1199424 - DNA, 11 bp, Homo sapiens
ggtcaagaaca

SEQ ID NO: 1199425 - DNA, 11 bp, Homo sapiens
ggtcaagcctc

SEQ ID NO: 1199426 - DNA, 18 bp, Homo sapiens
ggtcaagttcccaactga

SEQ ID NO: 1199427 - DNA, 11 bp, Homo sapiens
ggtcaataaac

SEQ ID NO: 1199428 - DNA, 14 bp, Homo sapiens
ggtcaataaactta

SEQ ID NO: 1199429 - DNA, 23 bp, Homo sapiens
ggtcaataaacttagaggaaaat

SEQ ID NO: 1199430 - DNA, 15 bp, Homo sapiens
ggtcaataaagcaga

SEQ ID NO: 1199431 - DNA, 19 bp, Homo sapiens
ggtcaataaagcagagcca

SEQ ID NO: 1199432 - DNA, 22 bp, Homo sapiens
ggtcacaaatcctaaaagaagc

SEQ ID NO: 1199433 - DNA, 16 bp, Homo sapiens
ggtcacagaggggctc

SEQ ID NO: 1199434 - DNA, 21 bp, Homo sapiens
ggtcacagcggaggtgtggag

SEQ ID NO: 1199435 - DNA, 16 bp, Homo sapiens
ggtcacaggactctgc

SEQ ID NO: 1199436 - DNA, 21 bp, Homo sapiens
ggtcacagtcctatgtacaga

SEQ ID NO: 1199437 - DNA, 22 bp, Homo sapiens
ggtcacagtcctatgtacagag

SEQ ID NO: 1199438 - DNA, 22 bp, Homo sapiens
ggtcaccaaggcagtgcatgca

SEQ ID NO: 1199439 - DNA, 11 bp, Homo sapiens
ggtcaccagct

SEQ ID NO: 1199440 - DNA, 16 bp, Homo sapiens
ggtcaccagctcctcc

SEQ ID NO: 1199441 - DNA, 14 bp, Homo sapiens
ggtcaccatgaaac

SEQ ID NO: 1199442 - DNA, 15 bp, Homo sapiens
ggtcaccatgaaact

SEQ ID NO: 1199443 - DNA, 15 bp, Homo sapiens
ggtcaccctggggct

SEQ ID NO: 1199444 - DNA, 20 bp, Homo sapiens
ggtcacgtttggtgcttctc

SEQ ID NO: 1199445 - DNA, 17 bp, Homo sapiens
ggtcactaaccaacaag

SEQ ID NO: 1199446 - DNA, 13 bp, Homo sapiens
ggtcactcctggg

SEQ ID NO: 1199447 - DNA, 21 bp, Homo sapiens
ggtcactctgccctctgctgc

SEQ ID NO: 1199448 - DNA, 15 bp, Homo sapiens
ggtcactggaaaggg

SEQ ID NO: 1199449 - DNA, 16 bp, Homo sapiens
ggtcactggtcagggc

SEQ ID NO: 1199450 - DNA, 19 bp, Homo sapiens
ggtcactggtcagggcagt

SEQ ID NO: 1199451 - DNA, 18 bp, Homo sapiens
ggtcagaagaagtgggag

SEQ ID NO: 1199452 - DNA, 21 bp, Homo sapiens
ggtcagaagaagtgggagcag

SEQ ID NO: 1199453 - DNA, 23 bp, Homo sapiens
ggtcagaagaagtgggagcagct

SEQ ID NO: 1199454 - DNA, 23 bp, Homo sapiens
ggtcagagtggcgtgagctgccc

SEQ ID NO: 1199455 - DNA, 21 bp, Homo sapiens
ggtcagcagatgccagtgaag

SEQ ID NO: 1199456 - DNA, 11 bp, Homo sapiens
ggtcagccatt

SEQ ID NO: 1199457 - DNA, 12 bp, Homo sapiens
ggtcagccccaa

SEQ ID NO: 1199458 - DNA, 23 bp, Homo sapiens
ggtcagccccaagggctggggcg

SEQ ID NO: 1199459 - DNA, 14 bp, Homo sapiens
ggtcagccctgtgt

SEQ ID NO: 1199460 - DNA, 15 bp, Homo sapiens
ggtcagccctgtgtc

SEQ ID NO: 1199461 - DNA, 23 bp, Homo sapiens
ggtcagccctgtgtctgtcacag

SEQ ID NO: 1199462 - DNA, 15 bp, Homo sapiens
ggtcagcgactggat

SEQ ID NO: 1199463 - DNA, 13 bp, Homo sapiens
ggtcagctgggag

SEQ ID NO: 1199464 - DNA, 15 bp, Homo sapiens
ggtcagctgggagcc

SEQ ID NO: 1199465 - DNA, 20 bp, Homo sapiens
ggtcagctgggagccagtgt

SEQ ID NO: 1199466 - DNA, 19 bp, Homo sapiens
ggtcaggaacagtggctgg

SEQ ID NO: 1199467 - DNA, 20 bp, Homo sapiens
ggtcaggaacagtggctggg

SEQ ID NO: 1199468 - DNA, 22 bp, Homo sapiens
ggtcaggagaggggcagaacag

SEQ ID NO: 1199469 - DNA, 19 bp, Homo sapiens
ggtcaggcagccagtgaga

SEQ ID NO: 1199470 - DNA, 12 bp, Homo sapiens
ggtcagggcagt

SEQ ID NO: 1199471 - DNA, 16 bp, Homo sapiens
ggtcagggcagtggcc

SEQ ID NO: 1199472 - DNA, 17 bp, Homo sapiens
ggtcagggcagtggcca

SEQ ID NO: 1199473 - DNA, 21 bp, Homo sapiens
ggtcagggcagtggccaagcc

SEQ ID NO: 1199474 - DNA, 23 bp, Homo sapiens
ctggaagggaggaaggcctttct

SEQ ID NO: 1199475 - DNA, 16 bp, Homo sapiens
ctggaagggcagagta

SEQ ID NO: 1199476 - DNA, 19 bp, Homo sapiens
ctggaaggggaagggacac

SEQ ID NO: 1199477 - DNA, 14 bp, Homo sapiens
ctggaaggggcagc

SEQ ID NO: 1199478 - DNA, 15 bp, Homo sapiens
ctggaaggggcagca

SEQ ID NO: 1199479 - DNA, 16 bp, Homo sapiens
ctggaaggggcagcag

SEQ ID NO: 1199480 - DNA, 18 bp, Homo sapiens
ctggaaggggcagccctg

SEQ ID NO: 1199481 - DNA, 19 bp, Homo sapiens
ctggaaggggcagccctga

SEQ ID NO: 1199482 - DNA, 21 bp, Homo sapiens
ctggaaggggcagccctgagt

SEQ ID NO: 1199483 - DNA, 22 bp, Homo sapiens
ctggaaggggcagccctgagtg

SEQ ID NO: 1199484 - DNA, 19 bp, Homo sapiens
ctggaagttgtggatatca

SEQ ID NO: 1199485 - DNA, 21 bp, Homo sapiens
ctggaataaaatataaaactg

SEQ ID NO: 1199486 - DNA, 16 bp, Homo sapiens
ctggaataaagttgca

SEQ ID NO: 1199487 - DNA, 14 bp, Homo sapiens
ctggaataagttca

SEQ ID NO: 1199488 - DNA, 20 bp, Homo sapiens
ctggaataatttgtaaatga

SEQ ID NO: 1199489 - DNA, 16 bp, Homo sapiens
ctggaatattgtttct

SEQ ID NO: 1199490 - DNA, 23 bp, Homo sapiens
ctggaatcaagatgtcagactgg

SEQ ID NO: 1199491 - DNA, 22 bp, Homo sapiens
ctggaatcctgaaagggcactt

SEQ ID NO: 1199492 - DNA, 17 bp, Homo sapiens
ctggaatctggagacca

SEQ ID NO: 1199493 - DNA, 18 bp, Homo sapiens
ctggaatctggagaccag

SEQ ID NO: 1199494 - DNA, 13 bp, Homo sapiens
ctggaatcttccc

SEQ ID NO: 1199495 - DNA, 22 bp, Homo sapiens
ctggaatcttccccaagggcca

SEQ ID NO: 1199496 - DNA, 17 bp, Homo sapiens
ctggaatgagggaggcg

SEQ ID NO: 1199497 - DNA, 23 bp, Homo sapiens
ctggaatgtttttccctccccag

SEQ ID NO: 1199498 - DNA, 16 bp, Homo sapiens
ctggaattcagcaccc

SEQ ID NO: 1199499 - DNA, 17 bp, Homo sapiens
ctggaattcagcaccct

SEQ ID NO: 1199500 - DNA, 19 bp, Homo sapiens
ctggaattcagcaccctgg

SEQ ID NO: 1199501 - DNA, 22 bp, Homo sapiens
ctggaattcagcaccctgggtg

SEQ ID NO: 1199502 - DNA, 23 bp, Homo sapiens
ctggaattgtggctatcctgatt

SEQ ID NO: 1199503 - DNA, 19 bp, Homo sapiens
ctggaatttacctcccctt

SEQ ID NO: 1199504 - DNA, 15 bp, Homo sapiens
ctggacaaagaattc

SEQ ID NO: 1199505 - DNA, 21 bp, Homo sapiens
ctggacaacactgattcctgg

SEQ ID NO: 1199506 - DNA, 11 bp, Homo sapiens
ctggacaagcc

SEQ ID NO: 1199507 - DNA, 23 bp, Homo sapiens
ctggacaagccaacttgtaaata

SEQ ID NO: 1199508 - DNA, 19 bp, Homo sapiens
ctggacaatctcacacctt

SEQ ID NO: 1199509 - DNA, 10 bp, Homo sapiens
ctggacacac

SEQ ID NO: 1199510 - DNA, 12 bp, Homo sapiens
ctggacacacac

SEQ ID NO: 1199511 - DNA, 13 bp, Homo sapiens
ctggacacacact

SEQ ID NO: 1199512 - DNA, 23 bp, Homo sapiens
ctggacacacactcaccagtggc

SEQ ID NO: 1199513 - DNA, 12 bp, Homo sapiens
ctggacacactc

SEQ ID NO: 1199514 - DNA, 16 bp, Homo sapiens
ctggacactcagacct

SEQ ID NO: 1199515 - DNA, 17 bp, Homo sapiens
ctggacactcagacctg

SEQ ID NO: 1199516 - DNA, 18 bp, Homo sapiens
ctggacactctatatgta

SEQ ID NO: 1199517 - DNA, 13 bp, Homo sapiens
ctggacagagggg

SEQ ID NO: 1199518 - DNA, 21 bp, Homo sapiens
ctggacagatggacgcaggcc

SEQ ID NO: 1199519 - DNA, 22 bp, Homo sapiens
ctggacagatggacgcaggccc

SEQ ID NO: 1199520 - DNA, 20 bp, Homo sapiens
ctggacagatggcccaaggg

SEQ ID NO: 1199521 - DNA, 12 bp, Homo sapiens
ctggacagccag

SEQ ID NO: 1199522 - DNA, 19 bp, Homo sapiens
ctggacaggctctgcttct

SEQ ID NO: 1199523 - DNA, 18 bp, Homo sapiens
ctggacagtacctgattg

SEQ ID NO: 1199524 - DNA, 20 bp, Homo sapiens
ctggacagtacctgattgta

SEQ ID NO: 1199525 - DNA, 16 bp, Homo sapiens
ctggacagtatcccac

SEQ ID NO: 1199526 - DNA, 18 bp, Homo sapiens
ctggacagtatcccacat

SEQ ID NO: 1199527 - DNA, 16 bp, Homo sapiens
ctggacatactgctgg

SEQ ID NO: 1199528 - DNA, 16 bp, Homo sapiens
ctggacatcaccagtc

SEQ ID NO: 1199529 - DNA, 18 bp, Homo sapiens
ctggacatcaccagtcct

SEQ ID NO: 1199530 - DNA, 23 bp, Homo sapiens
ctggacatgaagattctttccca

SEQ ID NO: 1199531 - DNA, 18 bp, Homo sapiens
ctggacatttgccttgct

SEQ ID NO: 1199532 - DNA, 18 bp, Homo sapiens
ctggaccaccagccccag

SEQ ID NO: 1199533 - DNA, 21 bp, Homo sapiens
ctggaccaccagccccagcaa

SEQ ID NO: 1199534 - DNA, 22 bp, Homo sapiens
ctggaccattcctgtccctttg

SEQ ID NO: 1199535 - DNA, 14 bp, Homo sapiens
ctggaccccactgg

SEQ ID NO: 1199536 - DNA, 21 bp, Homo sapiens
ctggaccccactggctgagaa

SEQ ID NO: 1199537 - DNA, 23 bp, Homo sapiens
ctggacccccagcccccagggcc

SEQ ID NO: 1199538 - DNA, 18 bp, Homo sapiens
ctggacccctggggtggc

SEQ ID NO: 1199539 - DNA, 18 bp, Homo sapiens
ctggaccgagatgtgagt

SEQ ID NO: 1199540 - DNA, 20 bp, Homo sapiens
ctggacctagggtggcctga

SEQ ID NO: 1199541 - DNA, 18 bp, Homo sapiens
ctggacctcaggagggca

SEQ ID NO: 1199542 - DNA, 17 bp, Homo sapiens
ctggacctgcctcctgc

SEQ ID NO: 1199543 - DNA, 12 bp, Homo sapiens
ctggacctggga

SEQ ID NO: 1199544 - DNA, 13 bp, Homo sapiens
ctggacctggggg

SEQ ID NO: 1199545 - DNA, 14 bp, Homo sapiens
ctggacctgggggt

SEQ ID NO: 1199546 - DNA, 19 bp, Homo sapiens
ctggaccttgacagagcag

SEQ ID NO: 1199547 - DNA, 19 bp, Homo sapiens
ctggacctttgggttcttt

SEQ ID NO: 1199548 - DNA, 22 bp, Homo sapiens
ctggacctttgggttctttctg

SEQ ID NO: 1199549 - DNA, 18 bp, Homo sapiens
ctggacgctgccctgcat

SEQ ID NO: 1199550 - DNA, 19 bp, Homo sapiens
ctggacggcattcctgctt

SEQ ID NO: 1199551 - DNA, 13 bp, Homo sapiens
ctggacgggccct

SEQ ID NO: 1199552 - DNA, 18 bp, Homo sapiens
ctggactaaccctgtggt

SEQ ID NO: 1199553 - DNA, 20 bp, Homo sapiens
ctggactacacccaagcctg

SEQ ID NO: 1199554 - DNA, 21 bp, Homo sapiens
ctggactacacccaagcctga

SEQ ID NO: 1199555 - DNA, 20 bp, Homo sapiens
ctggactagagggacctctc

SEQ ID NO: 1199556 - DNA, 12 bp, Homo sapiens
ctggactagtgt

SEQ ID NO: 1199557 - DNA, 12 bp, Homo sapiens
ctggactcagga

SEQ ID NO: 1199558 - DNA, 18 bp, Homo sapiens
ggtccgcaccagctgctc

SEQ ID NO: 1199559 - DNA, 23 bp, Homo sapiens
ggtccgcaccagctgctctgccc

SEQ ID NO: 1199560 - DNA, 15 bp, Homo sapiens
ggtccgcggcctgca

SEQ ID NO: 1199561 - DNA, 16 bp, Homo sapiens
ggtccgcggcctgcac

SEQ ID NO: 1199562 - DNA, 16 bp, Homo sapiens
ggtccgtgcccaggcc

SEQ ID NO: 1199563 - DNA, 18 bp, Homo sapiens
ggtccgtgcccaggccct

SEQ ID NO: 1199564 - DNA, 13 bp, Homo sapiens
ggtccgtgggacg

SEQ ID NO: 1199565 - DNA, 17 bp, Homo sapiens
ggtcctacccatccccg

SEQ ID NO: 1199566 - DNA, 20 bp, Homo sapiens
ggtcctacccatccccgcag

SEQ ID NO: 1199567 - DNA, 14 bp, Homo sapiens
ggtcctagcccttc

SEQ ID NO: 1199568 - DNA, 18 bp, Homo sapiens
ggtcctagcccttccctg

SEQ ID NO: 1199569 - DNA, 19 bp, Homo sapiens
ggtcctagcccttccctga

SEQ ID NO: 1199570 - DNA, 19 bp, Homo sapiens
ggtcctagtcgggcagggc

SEQ ID NO: 1199571 - DNA, 22 bp, Homo sapiens
ggtcctcagatgggaattgcac

SEQ ID NO: 1199572 - DNA, 13 bp, Homo sapiens
ggtcctcagctgc

SEQ ID NO: 1199573 - DNA, 20 bp, Homo sapiens
ggtcctcctaagtcccttcc

SEQ ID NO: 1199574 - DNA, 22 bp, Homo sapiens
ggtcctcctaagtcccttccta

SEQ ID NO: 1199575 - DNA, 20 bp, Homo sapiens
ggtcctcctcgctcctcctt

SEQ ID NO: 1199576 - DNA, 23 bp, Homo sapiens
ggtcctctagcccactccctgcc

SEQ ID NO: 1199577 - DNA, 12 bp, Homo sapiens
ggtcctctctct

SEQ ID NO: 1199578 - DNA, 13 bp, Homo sapiens
ggtcctctggagc

SEQ ID NO: 1199579 - DNA, 21 bp, Homo sapiens
ggtcctctgtcagtcacagcc

SEQ ID NO: 1199580 - DNA, 19 bp, Homo sapiens
ggtcctcttttcctggcag

SEQ ID NO: 1199581 - DNA, 20 bp, Homo sapiens
ggtcctcttttcctggcagc

SEQ ID NO: 1199582 - DNA, 15 bp, Homo sapiens
ggtcctgcagcctgc

SEQ ID NO: 1199583 - DNA, 19 bp, Homo sapiens
ggtcctgccctccggagga

SEQ ID NO: 1199584 - DNA, 22 bp, Homo sapiens
ggtcctgccctccggaggagca

SEQ ID NO: 1199585 - DNA, 21 bp, Homo sapiens
ggtcctggacacctcccaggg

SEQ ID NO: 1199586 - DNA, 14 bp, Homo sapiens
ggtcctggccatcc

SEQ ID NO: 1199587 - DNA, 21 bp, Homo sapiens
ggtcctggccatcccacaagt

SEQ ID NO: 1199588 - DNA, 23 bp, Homo sapiens
ggtcctgggcaggtgggagctga

SEQ ID NO: 1199589 - DNA, 12 bp, Homo sapiens
ggtcctggggct

SEQ ID NO: 1199590 - DNA, 23 bp, Homo sapiens
ggtcctggggctctgtgcaggga

SEQ ID NO: 1199591 - DNA, 12 bp, Homo sapiens
ggtcctggtgcc

SEQ ID NO: 1199592 - DNA, 24 bp, Homo sapiens
ggtcctggtgccctggatgcccag

SEQ ID NO: 1199593 - DNA, 13 bp, Homo sapiens
ggtcctgtctctg

SEQ ID NO: 1199594 - DNA, 15 bp, Homo sapiens
ggtcctgtctgtcct

SEQ ID NO: 1199595 - DNA, 15 bp, Homo sapiens
ggtcctgtgcctgga

SEQ ID NO: 1199596 - DNA, 12 bp, Homo sapiens
ggtcctgtggat

SEQ ID NO: 1199597 - DNA, 15 bp, Homo sapiens
ggtccttatttattt

SEQ ID NO: 1199598 - DNA, 10 bp, Homo sapiens
ggtccttcaa

SEQ ID NO: 1199599 - DNA, 15 bp, Homo sapiens
ggtccttctgacccc

SEQ ID NO: 1199600 - DNA, 14 bp, Homo sapiens
ggtccttgatgcca

SEQ ID NO: 1199601 - DNA, 20 bp, Homo sapiens
ctggagacgtggaacctctg

SEQ ID NO: 1199602 - DNA, 12 bp, Homo sapiens
ctggagactgtc

SEQ ID NO: 1199603 - DNA, 21 bp, Homo sapiens
ctggagacttagggcaccagg

SEQ ID NO: 1199604 - DNA, 18 bp, Homo sapiens
ctggagacttcctctggt

SEQ ID NO: 1199605 - DNA, 17 bp, Homo sapiens
ctggagagaagtttctg

SEQ ID NO: 1199606 - DNA, 21 bp, Homo sapiens
ctggagaggcctggggtggga

SEQ ID NO: 1199607 - DNA, 19 bp, Homo sapiens
ctggagaggtggctgcgcc

SEQ ID NO: 1199608 - DNA, 12 bp, Homo sapiens
ctggagaggtta

SEQ ID NO: 1199609 - DNA, 21 bp, Homo sapiens
ctggagaggttataggtcact

SEQ ID NO: 1199610 - DNA, 21 bp, Homo sapiens
ctggagataacagcctcttgc

SEQ ID NO: 1199611 - DNA, 13 bp, Homo sapiens
ctggagatatgaa

SEQ ID NO: 1199612 - DNA, 17 bp, Homo sapiens
ctggagatcctcctgca

SEQ ID NO: 1199613 - DNA, 21 bp, Homo sapiens
ctggagatgcagctactggaa

SEQ ID NO: 1199614 - DNA, 23 bp, Homo sapiens
ctggagatgcagctactggaatg

SEQ ID NO: 1199615 - DNA, 15 bp, Homo sapiens
ctggagatggatcct

SEQ ID NO: 1199616 - DNA, 13 bp, Homo sapiens
ctggagcaccagg

SEQ ID NO: 1199617 - DNA, 15 bp, Homo sapiens
ctggagcaccaggca

SEQ ID NO: 1199618 - DNA, 22 bp, Homo sapiens
ctggagcacttgttttaaaatg

SEQ ID NO: 1199619 - DNA, 20 bp, Homo sapiens
ctggagcagccaaggccgcc

SEQ ID NO: 1199620 - DNA, 13 bp, Homo sapiens
ctggagcaggagc

SEQ ID NO: 1199621 - DNA, 14 bp, Homo sapiens
ctggagcaggagcc

SEQ ID NO: 1199622 - DNA, 16 bp, Homo sapiens
ctggagcaggagcccc

SEQ ID NO: 1199623 - DNA, 17 bp, Homo sapiens
ctggagcaggagccccg

SEQ ID NO: 1199624 - DNA, 23 bp, Homo sapiens
ctggagcatctgactcacaagaa

SEQ ID NO: 1199625 - DNA, 14 bp, Homo sapiens
ctggagcatttctc

SEQ ID NO: 1199626 - DNA, 15 bp, Homo sapiens
ctggagccacaggca

SEQ ID NO: 1199627 - DNA, 18 bp, Homo sapiens
ctggagccacaggcaggg

SEQ ID NO: 1199628 - DNA, 22 bp, Homo sapiens
ctggagccagactctggtcttc

SEQ ID NO: 1199629 - DNA, 17 bp, Homo sapiens
ctggagccagagagaac

SEQ ID NO: 1199630 - DNA, 12 bp, Homo sapiens
ctggagccaggg

SEQ ID NO: 1199631 - DNA, 14 bp, Homo sapiens
ctggagccagggca

SEQ ID NO: 1199632 - DNA, 22 bp, Homo sapiens
ctggagccagggcagaggaatg

SEQ ID NO: 1199633 - DNA, 23 bp, Homo sapiens
ctggagccatcccttcggagcca

SEQ ID NO: 1199634 - DNA, 19 bp, Homo sapiens
ctggagcccacagcgagcc

SEQ ID NO: 1199635 - DNA, 20 bp, Homo sapiens
ctggagcccacagcgagcct

SEQ ID NO: 1199636 - DNA, 21 bp, Homo sapiens
ctggagcccacagcgagcctg

SEQ ID NO: 1199637 - DNA, 23 bp, Homo sapiens
ctggagcccacagcgagcctgtg

SEQ ID NO: 1199638 - DNA, 12 bp, Homo sapiens
ctggagcccagg

SEQ ID NO: 1199639 - DNA, 13 bp, Homo sapiens
ctggagccccatc

SEQ ID NO: 1199640 - DNA, 20 bp, Homo sapiens
ctggagcccccagcagaggc

SEQ ID NO: 1199641 - DNA, 23 bp, Homo sapiens
ctggagcccccagcagaggcagg

SEQ ID NO: 1199642 - DNA, 18 bp, Homo sapiens
ctggagcccctcctcccc

SEQ ID NO: 1199643 - DNA, 22 bp, Homo sapiens
ctggagcccctcctcccccggc

SEQ ID NO: 1199644 - DNA, 16 bp, Homo sapiens
ctggagcccctgggtg

SEQ ID NO: 1199645 - DNA, 17 bp, Homo sapiens
ctggagcccctgggtgg

SEQ ID NO: 1199646 - DNA, 22 bp, Homo sapiens
ctggagccctaaccccttccag

SEQ ID NO: 1199647 - DNA, 15 bp, Homo sapiens
ctggagcccttgggt

SEQ ID NO: 1199648 - DNA, 15 bp, Homo sapiens
ctggagcctggggtg

SEQ ID NO: 1199649 - DNA, 20 bp, Homo sapiens
ctggagcgtttgctgtgcca

SEQ ID NO: 1199650 - DNA, 21 bp, Homo sapiens
ctggagcgtttgctgtgccag

SEQ ID NO: 1199651 - DNA, 14 bp, Homo sapiens
ctggagctcatctg

SEQ ID NO: 1199652 - DNA, 20 bp, Homo sapiens
ctggagctcatctgcaaaag

SEQ ID NO: 1199653 - DNA, 14 bp, Homo sapiens
ctggagctcttgga

SEQ ID NO: 1199654 - DNA, 21 bp, Homo sapiens
ctggagctcttggaagagctc

SEQ ID NO: 1199655 - DNA, 22 bp, Homo sapiens
ctggagctcttggaagagctct

SEQ ID NO: 1199656 - DNA, 18 bp, Homo sapiens
ctggagcttcattttggt

SEQ ID NO: 1199657 - DNA, 16 bp, Homo sapiens
ctggaggaagtggggt

SEQ ID NO: 1199658 - DNA, 22 bp, Homo sapiens
ctggaggaattcagctcagctt

SEQ ID NO: 1199659 - DNA, 16 bp, Homo sapiens
ctggaggaggggaagc

SEQ ID NO: 1199660 - DNA, 21 bp, Homo sapiens
ctggaggaggggaagctgggc

SEQ ID NO: 1199661 - DNA, 23 bp, Homo sapiens
ctggaggaggggaagctgggccc

SEQ ID NO: 1199662 - DNA, 14 bp, Homo sapiens
ctggaggcaagagg

SEQ ID NO: 1199663 - DNA, 15 bp, Homo sapiens
ctggaggcagggcct

SEQ ID NO: 1199664 - DNA, 19 bp, Homo sapiens
ctggaggcagggccttgcc

SEQ ID NO: 1199665 - DNA, 23 bp, Homo sapiens
ctggaggcaggggctgctgcctt

SEQ ID NO: 1199666 - DNA, 13 bp, Homo sapiens
ctggaggcccagg

SEQ ID NO: 1199667 - DNA, 14 bp, Homo sapiens
ctggaggccccaac

SEQ ID NO: 1199668 - DNA, 17 bp, Homo sapiens
ctggaggcccctggagc

SEQ ID NO: 1199669 - DNA, 20 bp, Homo sapiens
ctggaggcccctggagccag

SEQ ID NO: 1199670 - DNA, 13 bp, Homo sapiens
ctggaggcctcag

SEQ ID NO: 1199671 - DNA, 18 bp, Homo sapiens
ctggaggcctcaggtgct

SEQ ID NO: 1199672 - DNA, 21 bp, Homo sapiens
ctggaggcctcaggtgctgtc

SEQ ID NO: 1199673 - DNA, 13 bp, Homo sapiens
ctggaggcctctg

SEQ ID NO: 1199674 - DNA, 14 bp, Homo sapiens
ctggaggcctctgg

SEQ ID NO: 1199675 - DNA, 15 bp, Homo sapiens
ctggaggcctctggc

SEQ ID NO: 1199676 - DNA, 18 bp, Homo sapiens
ctggaggcctctggccct

SEQ ID NO: 1199677 - DNA, 19 bp, Homo sapiens
ctggaggcctctggccctc

SEQ ID NO: 1199678 - DNA, 19 bp, Homo sapiens
ctggaggccttccagctgc

SEQ ID NO: 1199679 - DNA, 22 bp, Homo sapiens
ggtctgctctttctctgccagt

SEQ ID NO: 1199680 - DNA, 16 bp, Homo sapiens
ggtctggagtcccacc

SEQ ID NO: 1199681 - DNA, 16 bp, Homo sapiens
ggtctggatgggagga

SEQ ID NO: 1199682 - DNA, 11 bp, Homo sapiens
ggtctggcaga

SEQ ID NO: 1199683 - DNA, 19 bp, Homo sapiens
ggtctggcagagcctctga

SEQ ID NO: 1199684 - DNA, 22 bp, Homo sapiens
ggtctggcagcctcccatccag

SEQ ID NO: 1199685 - DNA, 11 bp, Homo sapiens
ggtctgggagg

SEQ ID NO: 1199686 - DNA, 19 bp, Homo sapiens
ggtctgggagtcacacagt

SEQ ID NO: 1199687 - DNA, 20 bp, Homo sapiens
ggtctgggagtcacacagtg

SEQ ID NO: 1199688 - DNA, 16 bp, Homo sapiens
ggtctgggatatggct

SEQ ID NO: 1199689 - DNA, 17 bp, Homo sapiens
ggtctgggatggacagg

SEQ ID NO: 1199690 - DNA, 19 bp, Homo sapiens
ggtctgggcagtgccacag

SEQ ID NO: 1199691 - DNA, 22 bp, Homo sapiens
ggtctgggcggcgggcggctgg

SEQ ID NO: 1199692 - DNA, 16 bp, Homo sapiens
ggtctggggacaggcc

SEQ ID NO: 1199693 - DNA, 17 bp, Homo sapiens
ggtctggggacaggccc

SEQ ID NO: 1199694 - DNA, 15 bp, Homo sapiens
ggtctgggggcagct

SEQ ID NO: 1199695 - DNA, 15 bp, Homo sapiens
ggtctggtaaatatg

SEQ ID NO: 1199696 - DNA, 24 bp, Homo sapiens
ggtctggttgttgcaccatctgct

SEQ ID NO: 1199697 - DNA, 12 bp, Homo sapiens
ggtctgtaactg

SEQ ID NO: 1199698 - DNA, 18 bp, Homo sapiens
ggtctgtacgttacctct

SEQ ID NO: 1199699 - DNA, 18 bp, Homo sapiens
ggtctgtatatacatttc

SEQ ID NO: 1199700 - DNA, 15 bp, Homo sapiens
ggtctgtctgctttg

SEQ ID NO: 1199701 - DNA, 20 bp, Homo sapiens
ggtctgtgctgtgcctgcta

SEQ ID NO: 1199702 - DNA, 21 bp, Homo sapiens
ggtctgtgctgtgcctgctag

SEQ ID NO: 1199703 - DNA, 19 bp, Homo sapiens
ggtctgtgtctcttttctc

SEQ ID NO: 1199704 - DNA, 16 bp, Homo sapiens
ggtctgtgtgaatgtg

SEQ ID NO: 1199705 - DNA, 24 bp, Homo sapiens
ggtctgtgtgaatgtgggcactgg

SEQ ID NO: 1199706 - DNA, 16 bp, Homo sapiens
ggtctgtgtgctgttt

SEQ ID NO: 1199707 - DNA, 18 bp, Homo sapiens
ggtctgttcttgaagcag

SEQ ID NO: 1199708 - DNA, 12 bp, Homo sapiens
ggtctgttcttt

SEQ ID NO: 1199709 - DNA, 16 bp, Homo sapiens
ggtctgttggcaggct

SEQ ID NO: 1199710 - DNA, 21 bp, Homo sapiens
ggtctgtttgtctgaacaaag

SEQ ID NO: 1199711 - DNA, 22 bp, Homo sapiens
ggtctgttttggtcccctccct

SEQ ID NO: 1199712 - DNA, 23 bp, Homo sapiens
ggtctgttttggtcccctccctc

SEQ ID NO: 1199713 - DNA, 16 bp, Homo sapiens
ggtcttagctctttct

SEQ ID NO: 1199714 - DNA, 18 bp, Homo sapiens
ggtcttagctctttctct

SEQ ID NO: 1199715 - DNA, 14 bp, Homo sapiens
ggtcttcagccatc

SEQ ID NO: 1199716 - DNA, 18 bp, Homo sapiens
ggtcttcagcctccctca

SEQ ID NO: 1199717 - DNA, 20 bp, Homo sapiens
ggtcttccctacctcaggca

SEQ ID NO: 1199718 - DNA, 22 bp, Homo sapiens
ggtcttccctacctcaggcagg

SEQ ID NO: 1199719 - DNA, 22 bp, Homo sapiens
ggtcttccggggccatgggcat

SEQ ID NO: 1199720 - DNA, 13 bp, Homo sapiens
ggtcttcctgctt

SEQ ID NO: 1199721 - DNA, 17 bp, Homo sapiens
ggtcttcctgctttcca

SEQ ID NO: 1199722 - DNA, 16 bp, Homo sapiens
ggtcttcttggcagct

SEQ ID NO: 1199723 - DNA, 13 bp, Homo sapiens
ggtcttgatctcc

SEQ ID NO: 1199724 - DNA, 20 bp, Homo sapiens
ggtcttgctatgttgcccaa

SEQ ID NO: 1199725 - DNA, 23 bp, Homo sapiens
ggtcttgctctgtcccccaggct

SEQ ID NO: 1199726 - DNA, 20 bp, Homo sapiens
ggtcttgggctactggcagc

SEQ ID NO: 1199727 - DNA, 23 bp, Homo sapiens
ggcaggcgcatgagtatctgtgg

SEQ ID NO: 1199728 - DNA, 16 bp, Homo sapiens
ggcaggcggctcctcc

SEQ ID NO: 1199729 - DNA, 18 bp, Homo sapiens
ggcaggcgtgtggcagcc

SEQ ID NO: 1199730 - DNA, 21 bp, Homo sapiens
ggcaggcgtgtggcagccaca

SEQ ID NO: 1199731 - DNA, 13 bp, Homo sapiens
ggcaggctcactg

SEQ ID NO: 1199732 - DNA, 16 bp, Homo sapiens
ggcaggctcactgcca

SEQ ID NO: 1199733 - DNA, 16 bp, Homo sapiens
ggcaggctgaggtggg

SEQ ID NO: 1199734 - DNA, 18 bp, Homo sapiens
ggcaggctgaggtgggga

SEQ ID NO: 1199735 - DNA, 13 bp, Homo sapiens
ggcaggctggcca

SEQ ID NO: 1199736 - DNA, 20 bp, Homo sapiens
ggcaggctggccagtccagg

SEQ ID NO: 1199737 - DNA, 16 bp, Homo sapiens
ggcaggctggctggcc

SEQ ID NO: 1199738 - DNA, 12 bp, Homo sapiens
ggcaggctgggc

SEQ ID NO: 1199739 - DNA, 12 bp, Homo sapiens
ggcaggcttggg

SEQ ID NO: 1199740 - DNA, 16 bp, Homo sapiens
ggcaggcttggggaaa

SEQ ID NO: 1199741 - DNA, 17 bp, Homo sapiens
ggcaggcttggggaaaa

SEQ ID NO: 1199742 - DNA, 19 bp, Homo sapiens
ggcagggaatgcctggagg

SEQ ID NO: 1199743 - DNA, 19 bp, Homo sapiens
ggcagggacttgcctccac

SEQ ID NO: 1199744 - DNA, 16 bp, Homo sapiens
ggcagggagagcgcct

SEQ ID NO: 1199745 - DNA, 11 bp, Homo sapiens
ggcagggaggg

SEQ ID NO: 1199746 - DNA, 18 bp, Homo sapiens
ggcagggagggcttgggg

SEQ ID NO: 1199747 - DNA, 22 bp, Homo sapiens
ggcagggatgatggcagagcca

SEQ ID NO: 1199748 - DNA, 14 bp, Homo sapiens
ggcagggcagaggg

SEQ ID NO: 1199749 - DNA, 15 bp, Homo sapiens
ggcagggcagaggga

SEQ ID NO: 1199750 - DNA, 15 bp, Homo sapiens
ggcagggcatctcct

SEQ ID NO: 1199751 - DNA, 17 bp, Homo sapiens
ggcagggccagggcaat

SEQ ID NO: 1199752 - DNA, 20 bp, Homo sapiens
ggcagggcccacgtgtatag

SEQ ID NO: 1199753 - DNA, 21 bp, Homo sapiens
ggcagggccgctcgatgcctt

SEQ ID NO: 1199754 - DNA, 18 bp, Homo sapiens
ggcagggccttgcccaga

SEQ ID NO: 1199755 - DNA, 19 bp, Homo sapiens
ggcagggcgggcagagggc

SEQ ID NO: 1199756 - DNA, 21 bp, Homo sapiens
ggcagggcgggcagagggctg

SEQ ID NO: 1199757 - DNA, 15 bp, Homo sapiens
ggcagggcggggggg

SEQ ID NO: 1199758 - DNA, 17 bp, Homo sapiens
ggcagggctcacactcc

SEQ ID NO: 1199759 - DNA, 19 bp, Homo sapiens
ggcagggctcacactcctg

SEQ ID NO: 1199760 - DNA, 21 bp, Homo sapiens
ggcagggctcacactcctggg

SEQ ID NO: 1199761 - DNA, 15 bp, Homo sapiens
ggcagggctgggcct

SEQ ID NO: 1199762 - DNA, 22 bp, Homo sapiens
ggcaggggacaagggaggcagt

SEQ ID NO: 1199763 - DNA, 18 bp, Homo sapiens
ggcaggggagacaggagc

SEQ ID NO: 1199764 - DNA, 14 bp, Homo sapiens
ggcaggggcatctg

SEQ ID NO: 1199765 - DNA, 14 bp, Homo sapiens
ggcaggggcctgga

SEQ ID NO: 1199766 - DNA, 15 bp, Homo sapiens
ggcaggggcctgggc

SEQ ID NO: 1199767 - DNA, 16 bp, Homo sapiens
ggcaggggcctgggcc

SEQ ID NO: 1199768 - DNA, 20 bp, Homo sapiens
ggcaggggtgagagcaccca

SEQ ID NO: 1199769 - DNA, 20 bp, Homo sapiens
ggcaggggtgcttcctcctc

SEQ ID NO: 1199770 - DNA, 17 bp, Homo sapiens
ggcaggggtgggagagc

SEQ ID NO: 1199771 - DNA, 12 bp, Homo sapiens
ggcagggtccta

SEQ ID NO: 1199772 - DNA, 16 bp, Homo sapiens
ggcagggtctgggctg

SEQ ID NO: 1199773 - DNA, 14 bp, Homo sapiens
ggcagggtgaccct

SEQ ID NO: 1199774 - DNA, 16 bp, Homo sapiens
ggcaggtcctgcccat

SEQ ID NO: 1199775 - DNA, 20 bp, Homo sapiens
ggcaggtctgcaagggccca

SEQ ID NO: 1199776 - DNA, 13 bp, Homo sapiens
ggcaggtgcctcc

SEQ ID NO: 1199777 - DNA, 14 bp, Homo sapiens
ggcaggtgcctcca

SEQ ID NO: 1199778 - DNA, 15 bp, Homo sapiens
ggcaggtgcctccag

SEQ ID NO: 1199779 - DNA, 20 bp, Homo sapiens
ggcaggtggatcacgaggtc

SEQ ID NO: 1199780 - DNA, 18 bp, Homo sapiens
ggcaggtggccgcccctg

SEQ ID NO: 1199781 - DNA, 16 bp, Homo sapiens
ggcaggtgggctgcct

SEQ ID NO: 1199782 - DNA, 23 bp, Homo sapiens
ggcaggtgggctgcctgctgtgt

SEQ ID NO: 1199783 - DNA, 18 bp, Homo sapiens
ggcaggtggtggaggggc

SEQ ID NO: 1199784 - DNA, 17 bp, Homo sapiens
ggcaggtggtggcactg

SEQ ID NO: 1199785 - DNA, 21 bp, Homo sapiens
ggcaggtggtggcactgagcc

SEQ ID NO: 1199786 - DNA, 15 bp, Homo sapiens
ggcaggttagaagaa

SEQ ID NO: 1199787 - DNA, 20 bp, Homo sapiens
ggcaggttcctggggccgcc

SEQ ID NO: 1199788 - DNA, 19 bp, Homo sapiens
ggcaggttggatgggagtg

SEQ ID NO: 1199789 - DNA, 17 bp, Homo sapiens
ggcaggttggtgggggc

SEQ ID NO: 1199790 - DNA, 16 bp, Homo sapiens
ggcaggtttgccagtg

SEQ ID NO: 1199791 - DNA, 14 bp, Homo sapiens
ggcagtaataaaaa

SEQ ID NO: 1199792 - DNA, 14 bp, Homo sapiens
ggcagtacctggga

SEQ ID NO: 1199793 - DNA, 23 bp, Homo sapiens
ggcagtacctgggaaaggaccca

SEQ ID NO: 1199794 - DNA, 19 bp, Homo sapiens
ggcagtattttgtgtcctc

SEQ ID NO: 1199795 - DNA, 18 bp, Homo sapiens
ggcagtcaccacccagcc

SEQ ID NO: 1199796 - DNA, 13 bp, Homo sapiens
ggcagtccagagc

SEQ ID NO: 1199797 - DNA, 14 bp, Homo sapiens
ggcagtccagagct

SEQ ID NO: 1199798 - DNA, 16 bp, Homo sapiens
ggcagtcccgggagaa

SEQ ID NO: 1199799 - DNA, 15 bp, Homo sapiens
ggcagtccgtgggac

SEQ ID NO: 1199800 - DNA, 15 bp, Homo sapiens
ggcagtcctgtgtga

SEQ ID NO: 1199801 - DNA, 18 bp, Homo sapiens
ggcagtccttactccccc

SEQ ID NO: 1199802 - DNA, 18 bp, Homo sapiens
ggcagtcgggggctggcc

SEQ ID NO: 1199803 - DNA, 21 bp, Homo sapiens
ggcagtcgggggctggcctag

SEQ ID NO: 1199804 - DNA, 13 bp, Homo sapiens
ggcagtctgctct

SEQ ID NO: 1199805 - DNA, 14 bp, Homo sapiens
ggcagtctgctctg

SEQ ID NO: 1199806 - DNA, 16 bp, Homo sapiens
ggcagtctgctctgct

SEQ ID NO: 1199807 - DNA, 11 bp, Homo sapiens
ggcagtgactt

SEQ ID NO: 1199808 - DNA, 23 bp, Homo sapiens
ggcagtgatgacttgctgtccag

SEQ ID NO: 1199809 - DNA, 14 bp, Homo sapiens
ggcagtgattctgt

SEQ ID NO: 1199810 - DNA, 14 bp, Homo sapiens
ggcagtgcatgcat

SEQ ID NO: 1199811 - DNA, 18 bp, Homo sapiens
ggcagtgccacagcctgc

SEQ ID NO: 1199812 - DNA, 19 bp, Homo sapiens
ggcagtgccacagcctgct

SEQ ID NO: 1199813 - DNA, 23 bp, Homo sapiens
ggcagtgccacagcctgctggca

SEQ ID NO: 1199814 - DNA, 14 bp, Homo sapiens
ggcagtgccagcca

SEQ ID NO: 1199815 - DNA, 15 bp, Homo sapiens
ggcagtgccccaggg

SEQ ID NO: 1199816 - DNA, 13 bp, Homo sapiens
ggcagtggccaag

SEQ ID NO: 1199817 - DNA, 21 bp, Homo sapiens
ggcagtgggacagggcatggc

SEQ ID NO: 1199818 - DNA, 20 bp, Homo sapiens
ggcagtggtaagctctggct

SEQ ID NO: 1199819 - DNA, 21 bp, Homo sapiens
ggcagtggtggttttctgttc

SEQ ID NO: 1199820 - DNA, 23 bp, Homo sapiens
ggcagtgtcccagggccctggat

SEQ ID NO: 1199821 - DNA, 18 bp, Homo sapiens
ggcagttagagcagcctc

SEQ ID NO: 1199822 - DNA, 23 bp, Homo sapiens
ggcagttagagcagcctcgtgga

SEQ ID NO: 1199823 - DNA, 18 bp, Homo sapiens
ggcagttctcactcctag

SEQ ID NO: 1199824 - DNA, 21 bp, Homo sapiens
ggcagttctcactcctaggag

SEQ ID NO: 1199825 - DNA, 14 bp, Homo sapiens
ggcagttctcccag

SEQ ID NO: 1199826 - DNA, 21 bp, Homo sapiens
ggcagttctcccagggagtga

SEQ ID NO: 1199827 - DNA, 17 bp, Homo sapiens
ggcagttgaacagaggg

SEQ ID NO: 1199828 - DNA, 13 bp, Homo sapiens
ggcagttggccag

SEQ ID NO: 1199829 - DNA, 19 bp, Homo sapiens
ggcagttttagcagcactt

SEQ ID NO: 1199830 - DNA, 12 bp, Homo sapiens
ggcataaagtaa

SEQ ID NO: 1199831 - DNA, 16 bp, Homo sapiens
ggcataaattaaaatg

SEQ ID NO: 1199832 - DNA, 13 bp, Homo sapiens
ggcataaattaca

SEQ ID NO: 1199833 - DNA, 16 bp, Homo sapiens
ggcataaattacagtc

SEQ ID NO: 1199834 - DNA, 21 bp, Homo sapiens
ggcataaattacagtcatctg

SEQ ID NO: 1199835 - DNA, 17 bp, Homo sapiens
ggcatacaatgaaaagt

SEQ ID NO: 1199836 - DNA, 15 bp, Homo sapiens
ggcataccttgtgca

SEQ ID NO: 1199837 - DNA, 22 bp, Homo sapiens
ggcatacgagagcagaggtctc

SEQ ID NO: 1199838 - DNA, 21 bp, Homo sapiens
ggcatacgcctgtagtcctag

SEQ ID NO: 1199839 - DNA, 14 bp, Homo sapiens
ggcatactttctct

SEQ ID NO: 1199840 - DNA, 19 bp, Homo sapiens
ggcatactttttaaaaaac

SEQ ID NO: 1199841 - DNA, 20 bp, Homo sapiens
ggcatactttttaaaaaact

SEQ ID NO: 1199842 - DNA, 16 bp, Homo sapiens
ggcatagaggcttctc

SEQ ID NO: 1199843 - DNA, 21 bp, Homo sapiens
ggcatagctccccgcttctgc

SEQ ID NO: 1199844 - DNA, 13 bp, Homo sapiens
ggcatagctctgg

SEQ ID NO: 1199845 - DNA, 15 bp, Homo sapiens
ggcatagctctgggg

SEQ ID NO: 1199846 - DNA, 16 bp, Homo sapiens
ggcataggcctgggtg

SEQ ID NO: 1199847 - DNA, 17 bp, Homo sapiens
ggcataggcctgggtgc

SEQ ID NO: 1199848 - DNA, 22 bp, Homo sapiens
ggcatataattttcacttctgt

SEQ ID NO: 1199849 - DNA, 23 bp, Homo sapiens
ggcatatgtttccccatctctgt

SEQ ID NO: 1199850 - DNA, 21 bp, Homo sapiens
ggcatcacacttatattttat

SEQ ID NO: 1199851 - DNA, 16 bp, Homo sapiens
ggcatcaggcactggt

SEQ ID NO: 1199852 - DNA, 14 bp, Homo sapiens
ggcaccgagaatgt

SEQ ID NO: 1199853 - DNA, 20 bp, Homo sapiens
ggcaccgccacgtcccagca

SEQ ID NO: 1199854 - DNA, 13 bp, Homo sapiens
ggcaccggcgctg

SEQ ID NO: 1199855 - DNA, 22 bp, Homo sapiens
ggcacctatagtcccagctact

SEQ ID NO: 1199856 - DNA, 16 bp, Homo sapiens
ggcacctcacaggccc

SEQ ID NO: 1199857 - DNA, 14 bp, Homo sapiens
ggcacctccaggca

SEQ ID NO: 1199858 - DNA, 13 bp, Homo sapiens
ggcacctcctgag

SEQ ID NO: 1199859 - DNA, 20 bp, Homo sapiens
ggcacctcggggacaccaga

SEQ ID NO: 1199860 - DNA, 22 bp, Homo sapiens
ggcacctcggggacaccagagc

SEQ ID NO: 1199861 - DNA, 19 bp, Homo sapiens
ggcacctctgcccttcccc

SEQ ID NO: 1199862 - DNA, 22 bp, Homo sapiens
ggcacctctgcccttcccctcc

SEQ ID NO: 1199863 - DNA, 22 bp, Homo sapiens
ggcacctgaaattaatttgtga

SEQ ID NO: 1199864 - DNA, 16 bp, Homo sapiens
ggcacctgacttggct

SEQ ID NO: 1199865 - DNA, 22 bp, Homo sapiens
ggcacctgacttggctggggag

SEQ ID NO: 1199866 - DNA, 17 bp, Homo sapiens
ggcacctggggagtggg

SEQ ID NO: 1199867 - DNA, 13 bp, Homo sapiens
ggcacctgtttcc

SEQ ID NO: 1199868 - DNA, 20 bp, Homo sapiens
ggcacgaacccacctgctga

SEQ ID NO: 1199869 - DNA, 14 bp, Homo sapiens
ggcacgcacctgta

SEQ ID NO: 1199870 - DNA, 17 bp, Homo sapiens
ggcacgcactgggttgc

SEQ ID NO: 1199871 - DNA, 18 bp, Homo sapiens
ggcacgccaacagccccc

SEQ ID NO: 1199872 - DNA, 16 bp, Homo sapiens
ggcacgccctcctcag

SEQ ID NO: 1199873 - DNA, 21 bp, Homo sapiens
ggcacgcttgcgtatgtctgt

SEQ ID NO: 1199874 - DNA, 15 bp, Homo sapiens
ggcacggggacctgg

SEQ ID NO: 1199875 - DNA, 16 bp, Homo sapiens
ggcacggggacctgga

SEQ ID NO: 1199876 - DNA, 17 bp, Homo sapiens
ggcacgggtggtccccg

SEQ ID NO: 1199877 - DNA, 21 bp, Homo sapiens
ggcacgtcgcccgctgagctg

SEQ ID NO: 1199878 - DNA, 13 bp, Homo sapiens
ggcacgtgtgggc

SEQ ID NO: 1199879 - DNA, 23 bp, Homo sapiens
ggcactaaaccacttctctgctg

SEQ ID NO: 1199880 - DNA, 22 bp, Homo sapiens
ggcactcacagacctggagccc

SEQ ID NO: 1199881 - DNA, 19 bp, Homo sapiens
ggcactcagtgagcctcct

SEQ ID NO: 1199882 - DNA, 22 bp, Homo sapiens
ggcactcagtgagcctcctgtg

SEQ ID NO: 1199883 - DNA, 10 bp, Homo sapiens
ggcactccca

SEQ ID NO: 1199884 - DNA, 21 bp, Homo sapiens
ggcactccgcgccgatgccac

SEQ ID NO: 1199885 - DNA, 18 bp, Homo sapiens
ggcactgaacaggctggg

SEQ ID NO: 1199886 - DNA, 17 bp, Homo sapiens
ggcactgcagtctgcag

SEQ ID NO: 1199887 - DNA, 16 bp, Homo sapiens
ggcactgcccttttca

SEQ ID NO: 1199888 - DNA, 20 bp, Homo sapiens
ggcactgccttctcctctct

SEQ ID NO: 1199889 - DNA, 16 bp, Homo sapiens
ggcactggagctggga

SEQ ID NO: 1199890 - DNA, 16 bp, Homo sapiens
ggcactggatggactt

SEQ ID NO: 1199891 - DNA, 22 bp, Homo sapiens
ggcactggccacccctccccag

SEQ ID NO: 1199892 - DNA, 19 bp, Homo sapiens
ggcactggctgaacttgga

SEQ ID NO: 1199893 - DNA, 20 bp, Homo sapiens
ggcactgggatgagccgctg

SEQ ID NO: 1199894 - DNA, 21 bp, Homo sapiens
ggcactgggatgagccgctgt

SEQ ID NO: 1199895 - DNA, 19 bp, Homo sapiens
ggcactgggcgtctgactc

SEQ ID NO: 1199896 - DNA, 21 bp, Homo sapiens
ggcactgggtacccaagtgaa

SEQ ID NO: 1199897 - DNA, 13 bp, Homo sapiens
ggcactggtggca

SEQ ID NO: 1199898 - DNA, 18 bp, Homo sapiens
ggcactgtggcccttctg

SEQ ID NO: 1199899 - DNA, 21 bp, Homo sapiens
ggcacttaagtgcactttttt

SEQ ID NO: 1199900 - DNA, 16 bp, Homo sapiens
ggcacttaatttgtaa

SEQ ID NO: 1199901 - DNA, 13 bp, Homo sapiens
ggcacttcctcca

SEQ ID NO: 1199902 - DNA, 22 bp, Homo sapiens
ggcacttctgccttgagtcccc

SEQ ID NO: 1199903 - DNA, 17 bp, Homo sapiens
ggcacttgtatttaatt

SEQ ID NO: 1199904 - DNA, 15 bp, Homo sapiens
ggcagaaaagaggag

SEQ ID NO: 1199905 - DNA, 16 bp, Homo sapiens
ggcagaaaagaggaga

SEQ ID NO: 1199906 - DNA, 21 bp, Homo sapiens
ggcagaaaagaggagaccctg

SEQ ID NO: 1199907 - DNA, 14 bp, Homo sapiens
ggcagaaagtggcc

SEQ ID NO: 1199908 - DNA, 16 bp, Homo sapiens
ggcagaaagtggccat

SEQ ID NO: 1199909 - DNA, 18 bp, Homo sapiens
ggcagaacagccgctcct

SEQ ID NO: 1199910 - DNA, 15 bp, Homo sapiens
ggcagaactctctgt

SEQ ID NO: 1199911 - DNA, 15 bp, Homo sapiens
ggcagaactgagctc

SEQ ID NO: 1199912 - DNA, 21 bp, Homo sapiens
ggcagaagactagaggccagg

SEQ ID NO: 1199913 - DNA, 22 bp, Homo sapiens
ggcagaagtgtcaccctgtggg

SEQ ID NO: 1199914 - DNA, 23 bp, Homo sapiens
ggcagaagtgtcaccctgtgggt

SEQ ID NO: 1199915 - DNA, 15 bp, Homo sapiens
ggcagaatggctgca

SEQ ID NO: 1199916 - DNA, 20 bp, Homo sapiens
ggcagacaagagctgctgtc

SEQ ID NO: 1199917 - DNA, 12 bp, Homo sapiens
ggcagacacaac

SEQ ID NO: 1199918 - DNA, 17 bp, Homo sapiens
ggcagacacagggactt

SEQ ID NO: 1199919 - DNA, 20 bp, Homo sapiens
ggcagacacagggacttgaa

SEQ ID NO: 1199920 - DNA, 20 bp, Homo sapiens
ggcagacagcagctcaggca

SEQ ID NO: 1199921 - DNA, 18 bp, Homo sapiens
ggcagaccgggcccccct

SEQ ID NO: 1199922 - DNA, 11 bp, Homo sapiens
ggcagactctt

SEQ ID NO: 1199923 - DNA, 23 bp, Homo sapiens
ggcagactctttaataaattgct

SEQ ID NO: 1199924 - DNA, 15 bp, Homo sapiens
ggcagagaaggcctc

SEQ ID NO: 1199925 - DNA, 13 bp, Homo sapiens
ggcagagaataaa

SEQ ID NO: 1199926 - DNA, 14 bp, Homo sapiens
ggcagagaataaaa

SEQ ID NO: 1199927 - DNA, 17 bp, Homo sapiens
ggcagagaatctcttgg

SEQ ID NO: 1199928 - DNA, 20 bp, Homo sapiens
ggcagagaatggctgggtca

SEQ ID NO: 1199929 - DNA, 23 bp, Homo sapiens
ggcagagagtacagactgcagac

SEQ ID NO: 1199930 - DNA, 13 bp, Homo sapiens
ggcagagcacagc

SEQ ID NO: 1199931 - DNA, 17 bp, Homo sapiens
ggcagagcacagcccac

SEQ ID NO: 1199932 - DNA, 14 bp, Homo sapiens
ggcagagccaggaa

SEQ ID NO: 1199933 - DNA, 18 bp, Homo sapiens
ggcagagccatgggcctg

SEQ ID NO: 1199934 - DNA, 22 bp, Homo sapiens
ggcagagccatgggcctgggcc

SEQ ID NO: 1199935 - DNA, 12 bp, Homo sapiens
ggcagagcccaa

SEQ ID NO: 1199936 - DNA, 16 bp, Homo sapiens
ggcagagcccaaggga

SEQ ID NO: 1199937 - DNA, 13 bp, Homo sapiens
ggcagagcctctg

SEQ ID NO: 1199938 - DNA, 16 bp, Homo sapiens
ggcagagcctctgaga

SEQ ID NO: 1199939 - DNA, 13 bp, Homo sapiens
ggcagagcctgtc

SEQ ID NO: 1199940 - DNA, 12 bp, Homo sapiens
ggcagagctgag

SEQ ID NO: 1199941 - DNA, 18 bp, Homo sapiens
ggcagagctgagggccct

SEQ ID NO: 1199942 - DNA, 16 bp, Homo sapiens
ggcagagctggctctg

SEQ ID NO: 1199943 - DNA, 19 bp, Homo sapiens
ggcagagcttttgcatttc

SEQ ID NO: 1199944 - DNA, 21 bp, Homo sapiens
ggcagaggaatgtagggcctg

SEQ ID NO: 1199945 - DNA, 23 bp, Homo sapiens
ggcagaggaatgtagggcctgca

SEQ ID NO: 1199946 - DNA, 14 bp, Homo sapiens
ggcagaggcctggg

SEQ ID NO: 1199947 - DNA, 17 bp, Homo sapiens
ggcagaggcctgggctg

SEQ ID NO: 1199948 - DNA, 18 bp, Homo sapiens
ggcagaggcctgggctgg

SEQ ID NO: 1199949 - DNA, 21 bp, Homo sapiens
ggcagaggctggaggcagggc

SEQ ID NO: 1199950 - DNA, 14 bp, Homo sapiens
ggcagaggctggca

SEQ ID NO: 1199951 - DNA, 22 bp, Homo sapiens
ggcagaggcttccgtgtcctct

SEQ ID NO: 1199952 - DNA, 21 bp, Homo sapiens
ggcagagggctggaggcccag

SEQ ID NO: 1199953 - DNA, 16 bp, Homo sapiens
ggcagaggggcagccg

SEQ ID NO: 1199954 - DNA, 14 bp, Homo sapiens
ggcagaggttgcag

SEQ ID NO: 1199955 - DNA, 22 bp, Homo sapiens
ggcagaggttttaatgtctgtt

SEQ ID NO: 1199956 - DNA, 19 bp, Homo sapiens
ggcagagtggcgtggcctc

SEQ ID NO: 1199957 - DNA, 13 bp, Homo sapiens
ggcagagttacag

SEQ ID NO: 1199958 - DNA, 23 bp, Homo sapiens
ggcagagttgtaaatatataaat

SEQ ID NO: 1199959 - DNA, 19 bp, Homo sapiens
ggcagataatcagcctctt

SEQ ID NO: 1199960 - DNA, 17 bp, Homo sapiens
ggcagatctgtgcccca

SEQ ID NO: 1199961 - DNA, 20 bp, Homo sapiens
ggcagatctgtgccccatgc

SEQ ID NO: 1199962 - DNA, 13 bp, Homo sapiens
ggcagatggagac

SEQ ID NO: 1199963 - DNA, 22 bp, Homo sapiens
ggcagatgtggggctgagctgg

SEQ ID NO: 1199964 - DNA, 15 bp, Homo sapiens
ggcagattcccactg

SEQ ID NO: 1199965 - DNA, 21 bp, Homo sapiens
ggcagattttacaaaagatgt

SEQ ID NO: 1199966 - DNA, 20 bp, Homo sapiens
ggcagattttacagagcgca

SEQ ID NO: 1199967 - DNA, 22 bp, Homo sapiens
ggcagcaaaacaagtgacatga

SEQ ID NO: 1199968 - DNA, 22 bp, Homo sapiens
ggcagcaaagaggggcgctgtc

SEQ ID NO: 1199969 - DNA, 12 bp, Homo sapiens
ggcagcaaggcc

SEQ ID NO: 1199970 - DNA, 22 bp, Homo sapiens
ggcagcaaggctgctgccggaa

SEQ ID NO: 1199971 - DNA, 20 bp, Homo sapiens
ggcagcaagggacctgctca

SEQ ID NO: 1199972 - DNA, 18 bp, Homo sapiens
ggcagcacacctctgggg

SEQ ID NO: 1199973 - DNA, 20 bp, Homo sapiens
ggcagcacagcccagggcct

SEQ ID NO: 1199974 - DNA, 17 bp, Homo sapiens
ggcagcaccctataaat

SEQ ID NO: 1199975 - DNA, 19 bp, Homo sapiens
ggcagcacgcaggcggggc

SEQ ID NO: 1199976 - DNA, 20 bp, Homo sapiens
ctctgggctatggacacagg

SEQ ID NO: 1199977 - DNA, 19 bp, Homo sapiens
ctctgggctcagggctgga

SEQ ID NO: 1199978 - DNA, 18 bp, Homo sapiens
ctctggggacagcttcct

SEQ ID NO: 1199979 - DNA, 20 bp, Homo sapiens
ctctggggaccctccagagg

SEQ ID NO: 1199980 - DNA, 11 bp, Homo sapiens
ctctggggatg

SEQ ID NO: 1199981 - DNA, 16 bp, Homo sapiens
ctctggggccctgggc

SEQ ID NO: 1199982 - DNA, 17 bp, Homo sapiens
ctctggggccctgggcc

SEQ ID NO: 1199983 - DNA, 16 bp, Homo sapiens
ctctggggcgcggcca

SEQ ID NO: 1199984 - DNA, 18 bp, Homo sapiens
ctctggggctcaagcagt

SEQ ID NO: 1199985 - DNA, 23 bp, Homo sapiens
ctctggggcttgtcctgtgcttg

SEQ ID NO: 1199986 - DNA, 15 bp, Homo sapiens
ctctgggggaggcag

SEQ ID NO: 1199987 - DNA, 19 bp, Homo sapiens
ctctgggggaggcagggct

SEQ ID NO: 1199988 - DNA, 20 bp, Homo sapiens
ctctgggggaggcagggctg

SEQ ID NO: 1199989 - DNA, 18 bp, Homo sapiens
ctctggggtatgtgtgtg

SEQ ID NO: 1199990 - DNA, 19 bp, Homo sapiens
ctctggggtatgtgtgtgt

SEQ ID NO: 1199991 - DNA, 22 bp, Homo sapiens
ctctggggtatgtgtgtgtggg

SEQ ID NO: 1199992 - DNA, 15 bp, Homo sapiens
ctctggggtgggcag

SEQ ID NO: 1199993 - DNA, 20 bp, Homo sapiens
ctctgggtcagaaccagagg

SEQ ID NO: 1199994 - DNA, 19 bp, Homo sapiens
ctctgggtccttggctccc

SEQ ID NO: 1199995 - DNA, 22 bp, Homo sapiens
ctctgggtctgattttctcact

SEQ ID NO: 1199996 - DNA, 21 bp, Homo sapiens
ctctggtaaacattcctccag

SEQ ID NO: 1199997 - DNA, 17 bp, Homo sapiens
ctctggtcctcggagct

SEQ ID NO: 1199998 - DNA, 18 bp, Homo sapiens
ctctggtcctcggagctg

SEQ ID NO: 1199999 - DNA, 14 bp, Homo sapiens
ctctggtccttctg

SEQ ID NO: 1200000 - DNA, 18 bp, Homo sapiens
ctctggtcgctcctgccc

SEQ ID NO: 1200001 - DNA, 20 bp, Homo sapiens
ctctggtcgctcctgcccac

SEQ ID NO: 1200002 - DNA, 20 bp, Homo sapiens
ctctggtcttctttgggtaa

SEQ ID NO: 1200003 - DNA, 21 bp, Homo sapiens
ctctggtgcacgcctgagcgt

SEQ ID NO: 1200004 - DNA, 22 bp, Homo sapiens
ctctggtggccacttcattcca

SEQ ID NO: 1200005 - DNA, 14 bp, Homo sapiens
ctctggtggctcct

SEQ ID NO: 1200006 - DNA, 23 bp, Homo sapiens
ctctggtggcttaagtgagcaga

SEQ ID NO: 1200007 - DNA, 23 bp, Homo sapiens
ctctggttatttttctcttgtac

SEQ ID NO: 1200008 - DNA, 15 bp, Homo sapiens
ctctggttcctttca

SEQ ID NO: 1200009 - DNA, 22 bp, Homo sapiens
ctctggttcctttcatctctct

SEQ ID NO: 1200010 - DNA, 18 bp, Homo sapiens
ctctggttgtttctgttc

SEQ ID NO: 1200011 - DNA, 20 bp, Homo sapiens
ctctggttgtttctgttcca

SEQ ID NO: 1200012 - DNA, 22 bp, Homo sapiens
ctctggttgtttctgttccaaa

SEQ ID NO: 1200013 - DNA, 15 bp, Homo sapiens
ctctgtaaagctaaa

SEQ ID NO: 1200014 - DNA, 19 bp, Homo sapiens
ctctgtaagtaattgccac

SEQ ID NO: 1200015 - DNA, 19 bp, Homo sapiens
ctctgtaagtgtagctcaa

SEQ ID NO: 1200016 - DNA, 14 bp, Homo sapiens
ctctgtacgggcca

SEQ ID NO: 1200017 - DNA, 11 bp, Homo sapiens
ctctgtacttt

SEQ ID NO: 1200018 - DNA, 22 bp, Homo sapiens
ctctgtaggatcgtaaaaaaat

SEQ ID NO: 1200019 - DNA, 21 bp, Homo sapiens
ctctgtaggcacagagctgca

SEQ ID NO: 1200020 - DNA, 20 bp, Homo sapiens
ctctgtaggcagcagagaga

SEQ ID NO: 1200021 - DNA, 18 bp, Homo sapiens
ctctgtagtttatggcag

SEQ ID NO: 1200022 - DNA, 14 bp, Homo sapiens
ctctgtatctatgc

SEQ ID NO: 1200023 - DNA, 15 bp, Homo sapiens
ctctgtcacatccaa

SEQ ID NO: 1200024 - DNA, 18 bp, Homo sapiens
ctctgtcacatccaactg

SEQ ID NO: 1200025 - DNA, 19 bp, Homo sapiens
ctctgtcacccttgtcctt

SEQ ID NO: 1200026 - DNA, 12 bp, Homo sapiens
ctctgtcactga

SEQ ID NO: 1200027 - DNA, 14 bp, Homo sapiens
ctctgtcactgagc

SEQ ID NO: 1200028 - DNA, 23 bp, Homo sapiens
ctctgtcagatgggaagacatga

SEQ ID NO: 1200029 - DNA, 20 bp, Homo sapiens
ctctgtcagtcacagccacc

SEQ ID NO: 1200030 - DNA, 16 bp, Homo sapiens
ctctgtcatcactccc

SEQ ID NO: 1200031 - DNA, 19 bp, Homo sapiens
ctctgtccaaacatttcat

SEQ ID NO: 1200032 - DNA, 14 bp, Homo sapiens
ctctgtccaggcac

SEQ ID NO: 1200033 - DNA, 16 bp, Homo sapiens
ctctgtccaggccact

SEQ ID NO: 1200034 - DNA, 17 bp, Homo sapiens
ctctgtccaggccactg

SEQ ID NO: 1200035 - DNA, 20 bp, Homo sapiens
ctctgtcccattccctggga

SEQ ID NO: 1200036 - DNA, 21 bp, Homo sapiens
ctctgtcccattccctgggat

SEQ ID NO: 1200037 - DNA, 14 bp, Homo sapiens
ctctgtccccacga

SEQ ID NO: 1200038 - DNA, 17 bp, Homo sapiens
ctctgtccccacgaggg

SEQ ID NO: 1200039 - DNA, 15 bp, Homo sapiens
ctctgtccccaggcc

SEQ ID NO: 1200040 - DNA, 16 bp, Homo sapiens
ctctgtccccaggcct

SEQ ID NO: 1200041 - DNA, 21 bp, Homo sapiens
ctctgtcccggttcaccttgc

SEQ ID NO: 1200042 - DNA, 22 bp, Homo sapiens
ctctgtcccggttcaccttgcc

SEQ ID NO: 1200043 - DNA, 16 bp, Homo sapiens
ctctgtcccttgctgt

SEQ ID NO: 1200044 - DNA, 19 bp, Homo sapiens
ctctgtcctcccatcccct

SEQ ID NO: 1200045 - DNA, 17 bp, Homo sapiens
ctctgtcgctcaggctg

SEQ ID NO: 1200046 - DNA, 19 bp, Homo sapiens
ctctgtcgctcaggctgga

SEQ ID NO: 1200047 - DNA, 21 bp, Homo sapiens
ctctgtcgctcaggctggagt

SEQ ID NO: 1200048 - DNA, 15 bp, Homo sapiens
ctctgtcgtggacac

SEQ ID NO: 1200049 - DNA, 16 bp, Homo sapiens
ctctgtctacccagtg

SEQ ID NO: 1200050 - DNA, 20 bp, Homo sapiens
ctctgtctacctggtctggt

SEQ ID NO: 1200051 - DNA, 13 bp, Homo sapiens
ctctgtctaggac

SEQ ID NO: 1200052 - DNA, 18 bp, Homo sapiens
ctctgtctcccaggctgg

SEQ ID NO: 1200053 - DNA, 14 bp, Homo sapiens
ctctgtctctccta

SEQ ID NO: 1200054 - DNA, 15 bp, Homo sapiens
ctctgtctctcctag

SEQ ID NO: 1200055 - DNA, 13 bp, Homo sapiens
ctctgtctggggc

SEQ ID NO: 1200056 - DNA, 14 bp, Homo sapiens
ctctgtctgtctct

SEQ ID NO: 1200057 - DNA, 15 bp, Homo sapiens
ctctgtctgtctctc

SEQ ID NO: 1200058 - DNA, 19 bp, Homo sapiens
ctctgtctgtctctccccc

SEQ ID NO: 1200059 - DNA, 16 bp, Homo sapiens
ctctgtctgtcttctc

SEQ ID NO: 1200060 - DNA, 19 bp, Homo sapiens
ctctgtcttggtaggtttg

SEQ ID NO: 1200061 - DNA, 21 bp, Homo sapiens
ctctgtgaacgatttagaaag

SEQ ID NO: 1200062 - DNA, 18 bp, Homo sapiens
ctctgtgaatacaattaa

SEQ ID NO: 1200063 - DNA, 15 bp, Homo sapiens
ctctgtgaccaactg

SEQ ID NO: 1200064 - DNA, 17 bp, Homo sapiens
ctctgtgaccaatgtct

SEQ ID NO: 1200065 - DNA, 18 bp, Homo sapiens
ctctgtgaccaatgtctt

SEQ ID NO: 1200066 - DNA, 22 bp, Homo sapiens
ctctgtgcccacggtctgagct

SEQ ID NO: 1200067 - DNA, 13 bp, Homo sapiens
ctctgtgccttcg

SEQ ID NO: 1200068 - DNA, 15 bp, Homo sapiens
ctctgtgctctgaat

SEQ ID NO: 1200069 - DNA, 12 bp, Homo sapiens
ctctgtgcttcg

SEQ ID NO: 1200070 - DNA, 13 bp, Homo sapiens
ctctgtgcttcga

SEQ ID NO: 1200071 - DNA, 19 bp, Homo sapiens
ctctgtgcttcgactactg

SEQ ID NO: 1200072 - DNA, 20 bp, Homo sapiens
ctctgtgcttcgactactgc

SEQ ID NO: 1200073 - DNA, 23 bp, Homo sapiens
ctctgtgctttgactcacctgtt

SEQ ID NO: 1200074 - DNA, 16 bp, Homo sapiens
ctctgtggcctgtgtc

SEQ ID NO: 1200075 - DNA, 18 bp, Homo sapiens
ctctgtggcctgtgtcca

SEQ ID NO: 1200076 - DNA, 23 bp, Homo sapiens
ctctgtggcctgtgtccagcagc

SEQ ID NO: 1200077 - DNA, 20 bp, Homo sapiens
ctctgtggttttttttgaat

SEQ ID NO: 1200078 - DNA, 22 bp, Homo sapiens
ctctgtgtatttatataaaaat

SEQ ID NO: 1200079 - DNA, 16 bp, Homo sapiens
ctctgtgtccttccct

SEQ ID NO: 1200080 - DNA, 17 bp, Homo sapiens
ctctgtgtccttccctg

SEQ ID NO: 1200081 - DNA, 17 bp, Homo sapiens
ctctgtgtgcacaaata

SEQ ID NO: 1200082 - DNA, 18 bp, Homo sapiens
ctctgtgttcccagaggc

SEQ ID NO: 1200083 - DNA, 13 bp, Homo sapiens
ctctgtgtttaaa

SEQ ID NO: 1200084 - DNA, 14 bp, Homo sapiens
ctctgtgtttaaaa

SEQ ID NO: 1200085 - DNA, 16 bp, Homo sapiens
ctctgttaggtccatt

SEQ ID NO: 1200086 - DNA, 19 bp, Homo sapiens
ctctgttaggtccattttc

SEQ ID NO: 1200087 - DNA, 15 bp, Homo sapiens
ctctgttcatttcac

SEQ ID NO: 1200088 - DNA, 13 bp, Homo sapiens
ctctgttccccca

SEQ ID NO: 1200089 - DNA, 17 bp, Homo sapiens
ctctgttcccttcctca

SEQ ID NO: 1200090 - DNA, 19 bp, Homo sapiens
ctctgttcctgagccccca

SEQ ID NO: 1200091 - DNA, 18 bp, Homo sapiens
ctctgttcggcctttggg

SEQ ID NO: 1200092 - DNA, 15 bp, Homo sapiens
ctctgttctctcccc

SEQ ID NO: 1200093 - DNA, 17 bp, Homo sapiens
ctctgttctctcccctc

SEQ ID NO: 1200094 - DNA, 20 bp, Homo sapiens
ctctgttctctcccctcaca

SEQ ID NO: 1200095 - DNA, 23 bp, Homo sapiens
ctctgttgatctacccgtgcctg

SEQ ID NO: 1200096 - DNA, 16 bp, Homo sapiens
ctctgttggtccactg

SEQ ID NO: 1200097 - DNA, 17 bp, Homo sapiens
ctctgttgtcctcccct

SEQ ID NO: 1200098 - DNA, 20 bp, Homo sapiens
ctctgttgtcctccccttgg

SEQ ID NO: 1200099 - DNA, 22 bp, Homo sapiens
ctctgttgtcctccccttgggc

SEQ ID NO: 1200100 - DNA, 20 bp, Homo sapiens
ggcagcacgcaggcggggca

SEQ ID NO: 1200101 - DNA, 13 bp, Homo sapiens
ggcagcacggccc

SEQ ID NO: 1200102 - DNA, 20 bp, Homo sapiens
ggcagcactccccagagctg

SEQ ID NO: 1200103 - DNA, 14 bp, Homo sapiens
ggcagcagacacat

SEQ ID NO: 1200104 - DNA, 22 bp, Homo sapiens
ggcagcagagagagaggacaga

SEQ ID NO: 1200105 - DNA, 12 bp, Homo sapiens
ggcagcagagcg

SEQ ID NO: 1200106 - DNA, 15 bp, Homo sapiens
ggcagcagcagccct

SEQ ID NO: 1200107 - DNA, 16 bp, Homo sapiens
ggcagcagcagccctg

SEQ ID NO: 1200108 - DNA, 17 bp, Homo sapiens
ggcagcagcagccctgc

SEQ ID NO: 1200109 - DNA, 13 bp, Homo sapiens
ggcagcagccatc

SEQ ID NO: 1200110 - DNA, 13 bp, Homo sapiens
ggcagcaggagga

SEQ ID NO: 1200111 - DNA, 13 bp, Homo sapiens
ggcagcagggcta

SEQ ID NO: 1200112 - DNA, 16 bp, Homo sapiens
ggcagcatgcccagat

SEQ ID NO: 1200113 - DNA, 17 bp, Homo sapiens
ggcagcatggagagcct

SEQ ID NO: 1200114 - DNA, 16 bp, Homo sapiens
ggcagccaaacccatg

SEQ ID NO: 1200115 - DNA, 18 bp, Homo sapiens
ggcagccaaacccatgag

SEQ ID NO: 1200116 - DNA, 13 bp, Homo sapiens
ggcagccaaggaa

SEQ ID NO: 1200117 - DNA, 15 bp, Homo sapiens
ggcagccaaggaatg

SEQ ID NO: 1200118 - DNA, 17 bp, Homo sapiens
ggcagccacacgcaggc

SEQ ID NO: 1200119 - DNA, 21 bp, Homo sapiens
ggcagccacacgcaggcggcc

SEQ ID NO: 1200120 - DNA, 12 bp, Homo sapiens
ggcagccacagg

SEQ ID NO: 1200121 - DNA, 16 bp, Homo sapiens
ggcagccacccaagcc

SEQ ID NO: 1200122 - DNA, 17 bp, Homo sapiens
ggcagccacccaagcct

SEQ ID NO: 1200123 - DNA, 13 bp, Homo sapiens
ggcagccagcaga

SEQ ID NO: 1200124 - DNA, 12 bp, Homo sapiens
ggcagccaggct

SEQ ID NO: 1200125 - DNA, 11 bp, Homo sapiens
ggcagccatgc

SEQ ID NO: 1200126 - DNA, 21 bp, Homo sapiens
ggcagcccagagactttgtag

SEQ ID NO: 1200127 - DNA, 14 bp, Homo sapiens
ggcagcccagcagt

SEQ ID NO: 1200128 - DNA, 11 bp, Homo sapiens
ggcagcccagg

SEQ ID NO: 1200129 - DNA, 16 bp, Homo sapiens
ggcagccccacagtcc

SEQ ID NO: 1200130 - DNA, 22 bp, Homo sapiens
ggcagccccacagtcccattcc

SEQ ID NO: 1200131 - DNA, 20 bp, Homo sapiens
ggcagcccccccctcaaggg

SEQ ID NO: 1200132 - DNA, 16 bp, Homo sapiens
ggcagccccctccaca

SEQ ID NO: 1200133 - DNA, 17 bp, Homo sapiens
ggcagcccgctaggctc

SEQ ID NO: 1200134 - DNA, 22 bp, Homo sapiens
ggcagcccggctgctgcttgga

SEQ ID NO: 1200135 - DNA, 16 bp, Homo sapiens
ggcagccctccatggt

SEQ ID NO: 1200136 - DNA, 11 bp, Homo sapiens
ggcagccctga

SEQ ID NO: 1200137 - DNA, 16 bp, Homo sapiens
ggcagcctcaaggccc

SEQ ID NO: 1200138 - DNA, 21 bp, Homo sapiens
ggcagcctcccatccagggcc

SEQ ID NO: 1200139 - DNA, 12 bp, Homo sapiens
ggcagcctgccg

SEQ ID NO: 1200140 - DNA, 22 bp, Homo sapiens
ggcagcctggatccctgccctt

SEQ ID NO: 1200141 - DNA, 18 bp, Homo sapiens
ggcagcctttccagcctc

SEQ ID NO: 1200142 - DNA, 18 bp, Homo sapiens
ggcagcgcagggctggca

SEQ ID NO: 1200143 - DNA, 20 bp, Homo sapiens
ggcagcgcagggctggcacg

SEQ ID NO: 1200144 - DNA, 18 bp, Homo sapiens
ggcagcgccaagtgcgtg

SEQ ID NO: 1200145 - DNA, 21 bp, Homo sapiens
ggcagcgccaggctgaccaca

SEQ ID NO: 1200146 - DNA, 22 bp, Homo sapiens
ggcagcgccaggctgaccacag

SEQ ID NO: 1200147 - DNA, 14 bp, Homo sapiens
ggcagcgtgggctc

SEQ ID NO: 1200148 - DNA, 17 bp, Homo sapiens
ggcagcgtgggctctgc

SEQ ID NO: 1200149 - DNA, 14 bp, Homo sapiens
ggcagctagactgg

SEQ ID NO: 1200150 - DNA, 15 bp, Homo sapiens
ggcagctagactgga

SEQ ID NO: 1200151 - DNA, 14 bp, Homo sapiens
ggcagctagtgcct

SEQ ID NO: 1200152 - DNA, 15 bp, Homo sapiens
ggcagctagtgcctt

SEQ ID NO: 1200153 - DNA, 20 bp, Homo sapiens
ggcagctatttcagcctcct

SEQ ID NO: 1200154 - DNA, 21 bp, Homo sapiens
ggcagctatttcagcctcctg

SEQ ID NO: 1200155 - DNA, 19 bp, Homo sapiens
ggcagctcacccctgggca

SEQ ID NO: 1200156 - DNA, 23 bp, Homo sapiens
ggcagctcctccctgtgccccca

SEQ ID NO: 1200157 - DNA, 14 bp, Homo sapiens
ggcagctcctctcc
